United States Patent 11,492,591 (UNIVERSAL DONOR STEM CELLS AND RELATED METHODS) - sequence listing, part 21

SEQ ID NO: 673048 - DNA, 20 bp, Artificial
  CRISPR gRNA sequence
cctctccttaatctactccc

SEQ ID NO: 673049 - DNA, 20 bp, Artificial
  CRISPR gRNA sequence
tccttaatctactcccatct

SEQ ID NO: 673050 - DNA, 20 bp, Artificial
  CRISPR gRNA sequence
cttaatctactcccatcttg

SEQ ID NO: 673051 - DNA, 20 bp, Artificial
  CRISPR gRNA sequence
aatctactcccatcttgtaa

SEQ ID NO: 673052 - DNA, 20 bp, Artificial
  CRISPR gRNA sequence
atctactcccatcttgtaac

SEQ ID NO: 673053 - DNA, 20 bp, Artificial
  CRISPR gRNA sequence
ctcccatcttgtaactcagt

SEQ ID NO: 673054 - DNA, 20 bp, Artificial
  CRISPR gRNA sequence
ccatcttgtaactcagtttt

SEQ ID NO: 673055 - DNA, 20 bp, Artificial
  CRISPR gRNA sequence
gtaactcagttttcagcacc

SEQ ID NO: 673056 - DNA, 20 bp, Artificial
  CRISPR gRNA sequence
taactcagttttcagcaccg

SEQ ID NO: 673057 - DNA, 20 bp, Artificial
  CRISPR gRNA sequence
agttttcagcaccgtatttt

SEQ ID NO: 673058 - DNA, 20 bp, Artificial
  CRISPR gRNA sequence
tcagcaccgtattttgtaca

SEQ ID NO: 673059 - DNA, 20 bp, Artificial
  CRISPR gRNA sequence
cagcaccgtattttgtacat

SEQ ID NO: 673060 - DNA, 20 bp, Artificial
  CRISPR gRNA sequence
agcaccgtattttgtacatt

SEQ ID NO: 673061 - DNA, 20 bp, Artificial
  CRISPR gRNA sequence
tgtacattgcagctttgtgc

SEQ ID NO: 673062 - DNA, 20 bp, Artificial
  CRISPR gRNA sequence
gtacattgcagctttgtgca

SEQ ID NO: 673063 - DNA, 20 bp, Artificial
  CRISPR gRNA sequence
tacattgcagctttgtgcag

SEQ ID NO: 673064 - DNA, 20 bp, Artificial
  CRISPR gRNA sequence
cagctttgtgcagccatcct

SEQ ID NO: 673065 - DNA, 20 bp, Artificial
  CRISPR gRNA sequence
tgtgcagccatcctcttgct

SEQ ID NO: 673066 - DNA, 20 bp, Artificial
  CRISPR gRNA sequence
gtgcagccatcctcttgctc

SEQ ID NO: 673067 - DNA, 20 bp, Artificial
  CRISPR gRNA sequence
tgcagccatcctcttgctca

SEQ ID NO: 673068 - DNA, 20 bp, Artificial
  CRISPR gRNA sequence
ttgctcaaaggcactcagca

SEQ ID NO: 673069 - DNA, 20 bp, Artificial
  CRISPR gRNA sequence
gctcaaaggcactcagcaga

SEQ ID NO: 673070 - DNA, 20 bp, Artificial
  CRISPR gRNA sequence
ctcaaaggcactcagcagat

SEQ ID NO: 673071 - DNA, 20 bp, Artificial
  CRISPR gRNA sequence
aaaggcactcagcagatgct

SEQ ID NO: 673072 - DNA, 20 bp, Artificial
  CRISPR gRNA sequence
agcagatgcttgagattctg

SEQ ID NO: 673073 - DNA, 20 bp, Artificial
  CRISPR gRNA sequence
gagattctgcatatttgtag

SEQ ID NO: 673074 - DNA, 20 bp, Artificial
  CRISPR gRNA sequence
agattctgcatatttgtagg

SEQ ID NO: 673075 - DNA, 20 bp, Artificial
  CRISPR gRNA sequence
tgcatatttgtaggttgttc

SEQ ID NO: 673076 - DNA, 20 bp, Artificial
  CRISPR gRNA sequence
catatttgtaggttgttcca

SEQ ID NO: 673077 - DNA, 20 bp, Artificial
  CRISPR gRNA sequence
gtaggttgttccacccaaca

SEQ ID NO: 673078 - DNA, 20 bp, Artificial
  CRISPR gRNA sequence
taggttgttccacccaacat

SEQ ID NO: 673079 - DNA, 20 bp, Artificial
  CRISPR gRNA sequence
ttccacccaacataggagca

SEQ ID NO: 673080 - DNA, 20 bp, Artificial
  CRISPR gRNA sequence
cacccaacataggagcaccc

SEQ ID NO: 673081 - DNA, 20 bp, Artificial
  CRISPR gRNA sequence
tgtctttgattcaccaaagc

SEQ ID NO: 673082 - DNA, 20 bp, Artificial
  CRISPR gRNA sequence
tctttgattcaccaaagcaa

SEQ ID NO: 673083 - DNA, 20 bp, Artificial
  CRISPR gRNA sequence
tgattcaccaaagcaagttg

SEQ ID NO: 673084 - DNA, 20 bp, Artificial
  CRISPR gRNA sequence
gattcaccaaagcaagttga

SEQ ID NO: 673085 - DNA, 20 bp, Artificial
  CRISPR gRNA sequence
attcaccaaagcaagttgat

SEQ ID NO: 673086 - DNA, 20 bp, Artificial
  CRISPR gRNA sequence
accaaagcaagttgatgcat

SEQ ID NO: 673087 - DNA, 20 bp, Artificial
  CRISPR gRNA sequence
atgcatatatatttgcattt

SEQ ID NO: 673088 - DNA, 20 bp, Artificial
  CRISPR gRNA sequence
gcattttaattgaatattta

SEQ ID NO: 673089 - DNA, 20 bp, Artificial
  CRISPR gRNA sequence
cattttaattgaatatttaa

SEQ ID NO: 673090 - DNA, 20 bp, Artificial
  CRISPR gRNA sequence
taattgaatatttaaatgca

SEQ ID NO: 673091 - DNA, 20 bp, Artificial
  CRISPR gRNA sequence
aattgaatatttaaatgcag

SEQ ID NO: 673092 - DNA, 20 bp, Artificial
  CRISPR gRNA sequence
attgaatatttaaatgcagg

SEQ ID NO: 673093 - DNA, 20 bp, Artificial
  CRISPR gRNA sequence
aatatttaaatgcaggtcta

SEQ ID NO: 673094 - DNA, 20 bp, Artificial
  CRISPR gRNA sequence
aaatgcaggtctagaaatag

SEQ ID NO: 673095 - DNA, 20 bp, Artificial
  CRISPR gRNA sequence
aatgcaggtctagaaatagg

SEQ ID NO: 673096 - DNA, 20 bp, Artificial
  CRISPR gRNA sequence
gaaataggtgtttatgaagg

SEQ ID NO: 673097 - DNA, 20 bp, Artificial
  CRISPR gRNA sequence
atgaaggtacataaaatatt

SEQ ID NO: 673098 - DNA, 20 bp, Artificial
  CRISPR gRNA sequence
tgaaggtacataaaatattg

SEQ ID NO: 673099 - DNA, 20 bp, Artificial
  CRISPR gRNA sequence
aaatataagatattccataa

SEQ ID NO: 673100 - DNA, 20 bp, Artificial
  CRISPR gRNA sequence
cataataaaaataatatata

SEQ ID NO: 673101 - DNA, 20 bp, Artificial
  CRISPR gRNA sequence
acccagtcaataaataaaaa

SEQ ID NO: 673102 - DNA, 20 bp, Artificial
  CRISPR gRNA sequence
ttctattgtatttaaaaata

SEQ ID NO: 673103 - DNA, 20 bp, Artificial
  CRISPR gRNA sequence
tattgtatttaaaaataaaa

SEQ ID NO: 673104 - DNA, 20 bp, Artificial
  CRISPR gRNA sequence
ttgtatttaaaaataaaaac

SEQ ID NO: 673105 - DNA, 20 bp, Artificial
  CRISPR gRNA sequence
tatttaaaaataaaaacaaa

SEQ ID NO: 673106 - DNA, 20 bp, Artificial
  CRISPR gRNA sequence
aaaaataaaaacaaaacaac

SEQ ID NO: 673107 - DNA, 20 bp, Artificial
  CRISPR gRNA sequence
aaaataaaaacaaaacaaca

SEQ ID NO: 673108 - DNA, 20 bp, Artificial
  CRISPR gRNA sequence
agatatggacatgaaggaca

SEQ ID NO: 673109 - DNA, 20 bp, Artificial
  CRISPR gRNA sequence
aattattttcctcgatccag

SEQ ID NO: 673110 - DNA, 20 bp, Artificial
  CRISPR gRNA sequence
attattttcctcgatccagt

SEQ ID NO: 673111 - DNA, 20 bp, Artificial
  CRISPR gRNA sequence
ttttcctcgatccagttttg

SEQ ID NO: 673112 - DNA, 20 bp, Artificial
  CRISPR gRNA sequence
tcctcgatccagttttgtta

SEQ ID NO: 673113 - DNA, 20 bp, Artificial
  CRISPR gRNA sequence
cctcgatccagttttgttag

SEQ ID NO: 673114 - DNA, 20 bp, Artificial
  CRISPR gRNA sequence
ctcgatccagttttgttagt

SEQ ID NO: 673115 - DNA, 20 bp, Artificial
  CRISPR gRNA sequence
gatccagttttgttagtcta

SEQ ID NO: 673116 - DNA, 20 bp, Artificial
  CRISPR gRNA sequence
tgttagtctagatttttgtg

SEQ ID NO: 673117 - DNA, 20 bp, Artificial
  CRISPR gRNA sequence
gttagtctagatttttgtgc

SEQ ID NO: 673118 - DNA, 20 bp, Artificial
  CRISPR gRNA sequence
ttagtctagatttttgtgcc

SEQ ID NO: 673119 - DNA, 20 bp, Artificial
  CRISPR gRNA sequence
gtctagatttttgtgcctac

SEQ ID NO: 673120 - DNA, 20 bp, Artificial
  CRISPR gRNA sequence
gatttttgtgcctaccaggg

SEQ ID NO: 673121 - DNA, 20 bp, Artificial
  CRISPR gRNA sequence
ttgtgcctaccaggggaaag

SEQ ID NO: 673122 - DNA, 20 bp, Artificial
  CRISPR gRNA sequence
tgtgcctaccaggggaaaga

SEQ ID NO: 673123 - DNA, 20 bp, Artificial
  CRISPR gRNA sequence
gtgcctaccaggggaaagat

SEQ ID NO: 673124 - DNA, 20 bp, Artificial
  CRISPR gRNA sequence
tgcctaccaggggaaagatt

SEQ ID NO: 673125 - DNA, 20 bp, Artificial
  CRISPR gRNA sequence
ccaggggaaagattagtcat

SEQ ID NO: 673126 - DNA, 20 bp, Artificial
  CRISPR gRNA sequence
gtcattatggttataacaaa

SEQ ID NO: 673127 - DNA, 20 bp, Artificial
  CRISPR gRNA sequence
tggttataacaaactactta

SEQ ID NO: 673128 - DNA, 20 bp, Artificial
  CRISPR gRNA sequence
taacaaactacttaatgttt

SEQ ID NO: 673129 - DNA, 20 bp, Artificial
  CRISPR gRNA sequence
cttaatgttttcagcttgga

SEQ ID NO: 673130 - DNA, 20 bp, Artificial
  CRISPR gRNA sequence
aatgttttcagcttggattg

SEQ ID NO: 673131 - DNA, 20 bp, Artificial
  CRISPR gRNA sequence
atgttttcagcttggattgc

SEQ ID NO: 673132 - DNA, 20 bp, Artificial
  CRISPR gRNA sequence
tcagcttggattgctccatt

SEQ ID NO: 673133 - DNA, 20 bp, Artificial
  CRISPR gRNA sequence
cagcttggattgctccatta

SEQ ID NO: 673134 - DNA, 20 bp, Artificial
  CRISPR gRNA sequence
agcttggattgctccattaa

SEQ ID NO: 673135 - DNA, 20 bp, Artificial
  CRISPR gRNA sequence
ggattgctccattaatgtag

SEQ ID NO: 673136 - DNA, 20 bp, Artificial
  CRISPR gRNA sequence
gattgctccattaatgtagt

SEQ ID NO: 673137 - DNA, 20 bp, Artificial
  CRISPR gRNA sequence
ctccattaatgtagttagta

SEQ ID NO: 673138 - DNA, 20 bp, Artificial
  CRISPR gRNA sequence
cattaatgtagttagtaaat

SEQ ID NO: 673139 - DNA, 20 bp, Artificial
  CRISPR gRNA sequence
atgtagttagtaaatttgtg

SEQ ID NO: 673140 - DNA, 20 bp, Artificial
  CRISPR gRNA sequence
gtaaatttgtgagattttct

SEQ ID NO: 673141 - DNA, 20 bp, Artificial
  CRISPR gRNA sequence
gtgagattttcttaaaattt

SEQ ID NO: 673142 - DNA, 20 bp, Artificial
  CRISPR gRNA sequence
tgagattttcttaaaatttg

SEQ ID NO: 673143 - DNA, 20 bp, Artificial
  CRISPR gRNA sequence
tcttaaaatttgctttgata

SEQ ID NO: 673144 - DNA, 20 bp, Artificial
  CRISPR gRNA sequence
cttaaaatttgctttgatat

SEQ ID NO: 673145 - DNA, 20 bp, Artificial
  CRISPR gRNA sequence
ttaaaatttgctttgatata

SEQ ID NO: 673146 - DNA, 20 bp, Artificial
  CRISPR gRNA sequence
aaaatttgctttgatataca

SEQ ID NO: 673147 - DNA, 20 bp, Artificial
  CRISPR gRNA sequence
aaatttgctttgatatacat

SEQ ID NO: 673148 - DNA, 20 bp, Artificial
  CRISPR gRNA sequence
gctttgatatacatatgaag

SEQ ID NO: 673149 - DNA, 20 bp, Artificial
  CRISPR gRNA sequence
ctttgatatacatatgaaga

SEQ ID NO: 673150 - DNA, 20 bp, Artificial
  CRISPR gRNA sequence
tgatatacatatgaagaaca

SEQ ID NO: 673151 - DNA, 20 bp, Artificial
  CRISPR gRNA sequence
gatatacatatgaagaacat

SEQ ID NO: 673152 - DNA, 20 bp, Artificial
  CRISPR gRNA sequence
atatacatatgaagaacatg

SEQ ID NO: 673153 - DNA, 20 bp, Artificial
  CRISPR gRNA sequence
atatttttttcagacaaagt

SEQ ID NO: 673154 - DNA, 20 bp, Artificial
  CRISPR gRNA sequence
ttttcagacaaagtctaaac

SEQ ID NO: 673155 - DNA, 20 bp, Artificial
  CRISPR gRNA sequence
tttcagacaaagtctaaact

SEQ ID NO: 673156 - DNA, 20 bp, Artificial
  CRISPR gRNA sequence
ttcagacaaagtctaaactg

SEQ ID NO: 673157 - DNA, 20 bp, Artificial
  CRISPR gRNA sequence
tcagacaaagtctaaactga

SEQ ID NO: 673158 - DNA, 20 bp, Artificial
  CRISPR gRNA sequence
cagacaaagtctaaactgac

SEQ ID NO: 673159 - DNA, 20 bp, Artificial
  CRISPR gRNA sequence
agacaaagtctaaactgact

SEQ ID NO: 673160 - DNA, 20 bp, Artificial
  CRISPR gRNA sequence
aactgactcaaaaagggcac

SEQ ID NO: 673161 - DNA, 20 bp, Artificial
  CRISPR gRNA sequence
actcaaaaagggcacattga

SEQ ID NO: 673162 - DNA, 20 bp, Artificial
  CRISPR gRNA sequence
aaaaagggcacattgatgca

SEQ ID NO: 673163 - DNA, 20 bp, Artificial
  CRISPR gRNA sequence
atgcagtccatttaaagaac

SEQ ID NO: 673164 - DNA, 20 bp, Artificial
  CRISPR gRNA sequence
aaagaacaaattatttacaa

SEQ ID NO: 673165 - DNA, 20 bp, Artificial
  CRISPR gRNA sequence
aagaacaaattatttacaag

SEQ ID NO: 673166 - DNA, 20 bp, Artificial
  CRISPR gRNA sequence
tttacaagaaataattgaga

SEQ ID NO: 673167 - DNA, 20 bp, Artificial
  CRISPR gRNA sequence
acaagaaataattgagatat

SEQ ID NO: 673168 - DNA, 20 bp, Artificial
  CRISPR gRNA sequence
caagaaataattgagatatg

SEQ ID NO: 673169 - DNA, 20 bp, Artificial
  CRISPR gRNA sequence
agatatgttgttttaaagtt

SEQ ID NO: 673170 - DNA, 20 bp, Artificial
  CRISPR gRNA sequence
ttttaaagtttcatagacag

SEQ ID NO: 673171 - DNA, 20 bp, Artificial
  CRISPR gRNA sequence
taaagtttcatagacagtat

SEQ ID NO: 673172 - DNA, 20 bp, Artificial
  CRISPR gRNA sequence
aaagtttcatagacagtatg

SEQ ID NO: 673173 - DNA, 20 bp, Artificial
  CRISPR gRNA sequence
aagtttcatagacagtatgg

SEQ ID NO: 673174 - DNA, 20 bp, Artificial
  CRISPR gRNA sequence
catagacagtatggagtttt

SEQ ID NO: 673175 - DNA, 20 bp, Artificial
  CRISPR gRNA sequence
atagacagtatggagttttt

SEQ ID NO: 673176 - DNA, 20 bp, Artificial
  CRISPR gRNA sequence
ttgcatatgtaccatttgca

SEQ ID NO: 673177 - DNA, 20 bp, Artificial
  CRISPR gRNA sequence
tgcatatgtaccatttgcat

SEQ ID NO: 673178 - DNA, 20 bp, Artificial
  CRISPR gRNA sequence
gcatatgtaccatttgcata

SEQ ID NO: 673179 - DNA, 20 bp, Artificial
  CRISPR gRNA sequence
catatgtaccatttgcatag

SEQ ID NO: 673180 - DNA, 20 bp, Artificial
  CRISPR gRNA sequence
gcatagagaaaagatagtta

SEQ ID NO: 673181 - DNA, 20 bp, Artificial
  CRISPR gRNA sequence
catagagaaaagatagttaa

SEQ ID NO: 673182 - DNA, 20 bp, Artificial
  CRISPR gRNA sequence
actgaatcttttacttaatt

SEQ ID NO: 673183 - DNA, 20 bp, Artificial
  CRISPR gRNA sequence
aatcttttacttaattatca

SEQ ID NO: 673184 - DNA, 20 bp, Artificial
  CRISPR gRNA sequence
ttacttaattatcagataat

SEQ ID NO: 673185 - DNA, 20 bp, Artificial
  CRISPR gRNA sequence
tacttaattatcagataatt

SEQ ID NO: 673186 - DNA, 20 bp, Artificial
  CRISPR gRNA sequence
acttaattatcagataattt

SEQ ID NO: 673187 - DNA, 20 bp, Artificial
  CRISPR gRNA sequence
cttaattatcagataatttt

SEQ ID NO: 673188 - DNA, 20 bp, Artificial
  CRISPR gRNA sequence
aattatcagataattttaca

SEQ ID NO: 673189 - DNA, 20 bp, Artificial
  CRISPR gRNA sequence
attatcagataattttacac

SEQ ID NO: 673190 - DNA, 20 bp, Artificial
  CRISPR gRNA sequence
tcagataattttacacttat

SEQ ID NO: 673191 - DNA, 20 bp, Artificial
  CRISPR gRNA sequence
tacacttattctgtaatgcc

SEQ ID NO: 673192 - DNA, 20 bp, Artificial
  CRISPR gRNA sequence
acacttattctgtaatgcct

SEQ ID NO: 673193 - DNA, 20 bp, Artificial
  CRISPR gRNA sequence
cacttattctgtaatgccta

SEQ ID NO: 673194 - DNA, 20 bp, Artificial
  CRISPR gRNA sequence
attctgtaatgcctaggcca

SEQ ID NO: 673195 - DNA, 20 bp, Artificial
  CRISPR gRNA sequence
ttctgtaatgcctaggccag

SEQ ID NO: 673196 - DNA, 20 bp, Artificial
  CRISPR gRNA sequence
tgtaatgcctaggccaggaa

SEQ ID NO: 673197 - DNA, 20 bp, Artificial
  CRISPR gRNA sequence
taatgcctaggccaggaaat

SEQ ID NO: 673198 - DNA, 20 bp, Artificial
  CRISPR gRNA sequence
ggccaggaaataccccacga

SEQ ID NO: 673199 - DNA, 20 bp, Artificial
  CRISPR gRNA sequence
aataaaagggttgctaatgt

SEQ ID NO: 673200 - DNA, 20 bp, Artificial
  CRISPR gRNA sequence
ctaatgttttatagaaataa

SEQ ID NO: 673201 - DNA, 20 bp, Artificial
  CRISPR gRNA sequence
atgttttatagaaataactt

SEQ ID NO: 673202 - DNA, 20 bp, Artificial
  CRISPR gRNA sequence
tatagaaataactttatcaa

SEQ ID NO: 673203 - DNA, 20 bp, Artificial
  CRISPR gRNA sequence
atagaaataactttatcaaa

SEQ ID NO: 673204 - DNA, 20 bp, Artificial
  CRISPR gRNA sequence
tagaaataactttatcaaaa

SEQ ID NO: 673205 - DNA, 20 bp, Artificial
  CRISPR gRNA sequence
tatcaaaaattgagtcaatt

SEQ ID NO: 673206 - DNA, 20 bp, Artificial
  CRISPR gRNA sequence
atcaaaaattgagtcaattc

SEQ ID NO: 673207 - DNA, 20 bp, Artificial
  CRISPR gRNA sequence
tcaaaaattgagtcaattca

SEQ ID NO: 673208 - DNA, 20 bp, Artificial
  CRISPR gRNA sequence
agtcaattcactttttattt

SEQ ID NO: 673209 - DNA, 20 bp, Artificial
  CRISPR gRNA sequence
actttttatttgttattaga

SEQ ID NO: 673210 - DNA, 20 bp, Artificial
  CRISPR gRNA sequence
tttatttgttattagacaga

SEQ ID NO: 673211 - DNA, 20 bp, Artificial
  CRISPR gRNA sequence
ttatttgttattagacagat

SEQ ID NO: 673212 - DNA, 20 bp, Artificial
  CRISPR gRNA sequence
tatttgttattagacagata

SEQ ID NO: 673213 - DNA, 20 bp, Artificial
  CRISPR gRNA sequence
atttgttattagacagatat

SEQ ID NO: 673214 - DNA, 20 bp, Artificial
  CRISPR gRNA sequence
tttgttattagacagatatg

SEQ ID NO: 673215 - DNA, 20 bp, Artificial
  CRISPR gRNA sequence
gttattagacagatatggat

SEQ ID NO: 673216 - DNA, 20 bp, Artificial
  CRISPR gRNA sequence
ttattagacagatatggata

SEQ ID NO: 673217 - DNA, 20 bp, Artificial
  CRISPR gRNA sequence
ttagacagatatggatatta

SEQ ID NO: 673218 - DNA, 20 bp, Artificial
  CRISPR gRNA sequence
gacagatatggatattactt

SEQ ID NO: 673219 - DNA, 20 bp, Artificial
  CRISPR gRNA sequence
cttctatatttggattattc

SEQ ID NO: 673220 - DNA, 20 bp, Artificial
  CRISPR gRNA sequence
ctatatttggattattcctg

SEQ ID NO: 673221 - DNA, 20 bp, Artificial
  CRISPR gRNA sequence
tatatttggattattcctgg

SEQ ID NO: 673222 - DNA, 20 bp, Artificial
  CRISPR gRNA sequence
tatttggattattcctggaa

SEQ ID NO: 673223 - DNA, 20 bp, Artificial
  CRISPR gRNA sequence
ggattattcctggaatataa

SEQ ID NO: 673224 - DNA, 20 bp, Artificial
  CRISPR gRNA sequence
gattattcctggaatataac

SEQ ID NO: 673225 - DNA, 20 bp, Artificial
  CRISPR gRNA sequence
ttcctggaatataactatgt

SEQ ID NO: 673226 - DNA, 20 bp, Artificial
  CRISPR gRNA sequence
ctggaatataactatgtata

SEQ ID NO: 673227 - DNA, 20 bp, Artificial
  CRISPR gRNA sequence
gaatataactatgtatactt

SEQ ID NO: 673228 - DNA, 20 bp, Artificial
  CRISPR gRNA sequence
tgtatacttttagaaatctc

SEQ ID NO: 673229 - DNA, 20 bp, Artificial
  CRISPR gRNA sequence
ttagaaatctcataaattac

SEQ ID NO: 673230 - DNA, 20 bp, Artificial
  CRISPR gRNA sequence
tagaaatctcataaattacc

SEQ ID NO: 673231 - DNA, 20 bp, Artificial
  CRISPR gRNA sequence
agaaatctcataaattaccc

SEQ ID NO: 673232 - DNA, 20 bp, Artificial
  CRISPR gRNA sequence
gaaatctcataaattaccct

SEQ ID NO: 673233 - DNA, 20 bp, Artificial
  CRISPR gRNA sequence
ataaattaccctctgtttta

SEQ ID NO: 673234 - DNA, 20 bp, Artificial
  CRISPR gRNA sequence
ccctctgttttaatccttgt

SEQ ID NO: 673235 - DNA, 20 bp, Artificial
  CRISPR gRNA sequence
tgttttaatccttgtttcta

SEQ ID NO: 673236 - DNA, 20 bp, Artificial
  CRISPR gRNA sequence
ttttaatccttgtttctaac

SEQ ID NO: 673237 - DNA, 20 bp, Artificial
  CRISPR gRNA sequence
taatccttgtttctaacagt

SEQ ID NO: 673238 - DNA, 20 bp, Artificial
  CRISPR gRNA sequence
aatccttgtttctaacagta

SEQ ID NO: 673239 - DNA, 20 bp, Artificial
  CRISPR gRNA sequence
atccttgtttctaacagtat

SEQ ID NO: 673240 - DNA, 20 bp, Artificial
  CRISPR gRNA sequence
gtttctaacagtattgtctt

SEQ ID NO: 673241 - DNA, 20 bp, Artificial
  CRISPR gRNA sequence
tttctaacagtattgtcttt

SEQ ID NO: 673242 - DNA, 20 bp, Artificial
  CRISPR gRNA sequence
ctaacagtattgtctttgag

SEQ ID NO: 673243 - DNA, 20 bp, Artificial
  CRISPR gRNA sequence
taacagtattgtctttgagg

SEQ ID NO: 673244 - DNA, 20 bp, Artificial
  CRISPR gRNA sequence
acagtattgtctttgagggt

SEQ ID NO: 673245 - DNA, 20 bp, Artificial
  CRISPR gRNA sequence
tctttgagggtttcattatg

SEQ ID NO: 673246 - DNA, 20 bp, Artificial
  CRISPR gRNA sequence
tgagggtttcattatgattc

SEQ ID NO: 673247 - DNA, 20 bp, Artificial
  CRISPR gRNA sequence
gagggtttcattatgattcc

SEQ ID NO: 673248 - DNA, 20 bp, Artificial
  CRISPR gRNA sequence
agggtttcattatgattcca

SEQ ID NO: 673249 - DNA, 20 bp, Artificial
  CRISPR gRNA sequence
cattatgattccaactaact

SEQ ID NO: 673250 - DNA, 20 bp, Artificial
  CRISPR gRNA sequence
attatgattccaactaactt

SEQ ID NO: 673251 - DNA, 20 bp, Artificial
  CRISPR gRNA sequence
tgattccaactaactttagt

SEQ ID NO: 673252 - DNA, 20 bp, Artificial
  CRISPR gRNA sequence
caactaactttagtttggaa

SEQ ID NO: 673253 - DNA, 20 bp, Artificial
  CRISPR gRNA sequence
actttagtttggaacacaat

SEQ ID NO: 673254 - DNA, 20 bp, Artificial
  CRISPR gRNA sequence
tagtttggaacacaataaaa

SEQ ID NO: 673255 - DNA, 20 bp, Artificial
  CRISPR gRNA sequence
agtttggaacacaataaaac

SEQ ID NO: 673256 - DNA, 20 bp, Artificial
  CRISPR gRNA sequence
gtttggaacacaataaaaca

SEQ ID NO: 673257 - DNA, 20 bp, Artificial
  CRISPR gRNA sequence
ggaacacaataaaacaagtg

SEQ ID NO: 673258 - DNA, 20 bp, Artificial
  CRISPR gRNA sequence
gaacacaataaaacaagtgg

SEQ ID NO: 673259 - DNA, 20 bp, Artificial
  CRISPR gRNA sequence
ttgaaatgataattatcttt

SEQ ID NO: 673260 - DNA, 20 bp, Artificial
  CRISPR gRNA sequence
gaaatgataattatcttttc

SEQ ID NO: 673261 - DNA, 20 bp, Artificial
  CRISPR gRNA sequence
aaatgataattatcttttca

SEQ ID NO: 673262 - DNA, 20 bp, Artificial
  CRISPR gRNA sequence
tcttttcatataatcaagac

SEQ ID NO: 673263 - DNA, 20 bp, Artificial
  CRISPR gRNA sequence
ttcatataatcaagacatca

SEQ ID NO: 673264 - DNA, 20 bp, Artificial
  CRISPR gRNA sequence
tcatataatcaagacatcaa

SEQ ID NO: 673265 - DNA, 20 bp, Artificial
  CRISPR gRNA sequence
catataatcaagacatcaac

SEQ ID NO: 673266 - DNA, 20 bp, Artificial
  CRISPR gRNA sequence
atataatcaagacatcaaca

SEQ ID NO: 673267 - DNA, 20 bp, Artificial
  CRISPR gRNA sequence
ggcaaataaaatgaggaaag

SEQ ID NO: 673268 - DNA, 20 bp, Artificial
  CRISPR gRNA sequence
gtatccaaatgtaaaaagca

SEQ ID NO: 673269 - DNA, 20 bp, Artificial
  CRISPR gRNA sequence
tcaagacttattcataattc

SEQ ID NO: 673270 - DNA, 20 bp, Artificial
  CRISPR gRNA sequence
attcataattcaaatcaata

SEQ ID NO: 673271 - DNA, 20 bp, Artificial
  CRISPR gRNA sequence
ttcataattcaaatcaatat

SEQ ID NO: 673272 - DNA, 20 bp, Artificial
  CRISPR gRNA sequence
ataattcaaatcaatatctc

SEQ ID NO: 673273 - DNA, 20 bp, Artificial
  CRISPR gRNA sequence
aaatcaatatctcccaaagc

SEQ ID NO: 673274 - DNA, 20 bp, Artificial
  CRISPR gRNA sequence
ccaaagccttatcttattga

SEQ ID NO: 673275 - DNA, 20 bp, Artificial
  CRISPR gRNA sequence
atcttattgaaattaaaatg

SEQ ID NO: 673276 - DNA, 20 bp, Artificial
  CRISPR gRNA sequence
tcttattgaaattaaaatgt

SEQ ID NO: 673277 - DNA, 20 bp, Artificial
  CRISPR gRNA sequence
attgaaattaaaatgtatta

SEQ ID NO: 673278 - DNA, 20 bp, Artificial
  CRISPR gRNA sequence
ttgaaattaaaatgtattat

SEQ ID NO: 673279 - DNA, 20 bp, Artificial
  CRISPR gRNA sequence
aaattaaaatgtattatttt

SEQ ID NO: 673280 - DNA, 20 bp, Artificial
  CRISPR gRNA sequence
aaatgtattattttcaatgc

SEQ ID NO: 673281 - DNA, 20 bp, Artificial
  CRISPR gRNA sequence
ttttcaatgccccttttctc

SEQ ID NO: 673282 - DNA, 20 bp, Artificial
  CRISPR gRNA sequence
tcaatgccccttttctctta

SEQ ID NO: 673283 - DNA, 20 bp, Artificial
  CRISPR gRNA sequence
caatgccccttttctcttac

SEQ ID NO: 673284 - DNA, 20 bp, Artificial
  CRISPR gRNA sequence
aatgccccttttctcttacc

SEQ ID NO: 673285 - DNA, 20 bp, Artificial
  CRISPR gRNA sequence
ttctcttaccaaaaaaagga

SEQ ID NO: 673286 - DNA, 20 bp, Artificial
  CRISPR gRNA sequence
tctcttaccaaaaaaaggaa

SEQ ID NO: 673287 - DNA, 20 bp, Artificial
  CRISPR gRNA sequence
ctcttaccaaaaaaaggaag

SEQ ID NO: 673288 - DNA, 20 bp, Artificial
  CRISPR gRNA sequence
tcttaccaaaaaaaggaaga

SEQ ID NO: 673289 - DNA, 20 bp, Artificial
  CRISPR gRNA sequence
ttaccaaaaaaaggaagaaa

SEQ ID NO: 673290 - DNA, 20 bp, Artificial
  CRISPR gRNA sequence
accaaaaaaaggaagaaaac

SEQ ID NO: 673291 - DNA, 20 bp, Artificial
  CRISPR gRNA sequence
ccaaaaaaaggaagaaaact

SEQ ID NO: 673292 - DNA, 20 bp, Artificial
  CRISPR gRNA sequence
tttaccttcatcatgccttg

SEQ ID NO: 673293 - DNA, 20 bp, Artificial
  CRISPR gRNA sequence
accttcatcatgccttgttc

SEQ ID NO: 673294 - DNA, 20 bp, Artificial
  CRISPR gRNA sequence
ccttcatcatgccttgttct

SEQ ID NO: 673295 - DNA, 20 bp, Artificial
  CRISPR gRNA sequence
catcatgccttgttcttctt

SEQ ID NO: 673296 - DNA, 20 bp, Artificial
  CRISPR gRNA sequence
atcatgccttgttcttcttt

SEQ ID NO: 673297 - DNA, 20 bp, Artificial
  CRISPR gRNA sequence
gttcttctttacttcccatg

SEQ ID NO: 673298 - DNA, 20 bp, Artificial
  CRISPR gRNA sequence
ttcttctttacttcccatgt

SEQ ID NO: 673299 - DNA, 20 bp, Artificial
  CRISPR gRNA sequence
ttctttacttcccatgtcct

SEQ ID NO: 673300 - DNA, 20 bp, Artificial
  CRISPR gRNA sequence
ctttacttcccatgtccttg

SEQ ID NO: 673301 - DNA, 20 bp, Artificial
  CRISPR gRNA sequence
tttacttcccatgtccttgg

SEQ ID NO: 673302 - DNA, 20 bp, Artificial
  CRISPR gRNA sequence
tacttcccatgtccttggga

SEQ ID NO: 673303 - DNA, 20 bp, Artificial
  CRISPR gRNA sequence
acttcccatgtccttgggaa

SEQ ID NO: 673304 - DNA, 20 bp, Artificial
  CRISPR gRNA sequence
cttcccatgtccttgggaac

SEQ ID NO: 673305 - DNA, 20 bp, Artificial
  CRISPR gRNA sequence
cccatgtccttgggaactta

SEQ ID NO: 673306 - DNA, 20 bp, Artificial
  CRISPR gRNA sequence
ccatgtccttgggaacttac

SEQ ID NO: 673307 - DNA, 20 bp, Artificial
  CRISPR gRNA sequence
gggaacttaccaaagacttc

SEQ ID NO: 673308 - DNA, 20 bp, Artificial
  CRISPR gRNA sequence
ggaacttaccaaagacttcc

SEQ ID NO: 673309 - DNA, 20 bp, Artificial
  CRISPR gRNA sequence
accaaagacttccatagtat

SEQ ID NO: 673310 - DNA, 20 bp, Artificial
  CRISPR gRNA sequence
ccaaagacttccatagtatg

SEQ ID NO: 673311 - DNA, 20 bp, Artificial
  CRISPR gRNA sequence
ccatagtatgacttccacac

SEQ ID NO: 673312 - DNA, 20 bp, Artificial
  CRISPR gRNA sequence
catagtatgacttccacact

SEQ ID NO: 673313 - DNA, 20 bp, Artificial
  CRISPR gRNA sequence
ccacactcagcaacaggaca

SEQ ID NO: 673314 - DNA, 20 bp, Artificial
  CRISPR gRNA sequence
cacactcagcaacaggacaa

SEQ ID NO: 673315 - DNA, 20 bp, Artificial
  CRISPR gRNA sequence
agcaacaggacaatatttcc

SEQ ID NO: 673316 - DNA, 20 bp, Artificial
  CRISPR gRNA sequence
ccagatatacctagactacc

SEQ ID NO: 673317 - DNA, 20 bp, Artificial
  CRISPR gRNA sequence
cagatatacctagactacct

SEQ ID NO: 673318 - DNA, 20 bp, Artificial
  CRISPR gRNA sequence
gactaccttttgtttattct

SEQ ID NO: 673319 - DNA, 20 bp, Artificial
  CRISPR gRNA sequence
ccttttgtttattctacgcc

SEQ ID NO: 673320 - DNA, 20 bp, Artificial
  CRISPR gRNA sequence
ttgtttattctacgccattt

SEQ ID NO: 673321 - DNA, 20 bp, Artificial
  CRISPR gRNA sequence
tgtttattctacgccatttg

SEQ ID NO: 673322 - DNA, 20 bp, Artificial
  CRISPR gRNA sequence
gtttattctacgccatttgg

SEQ ID NO: 673323 - DNA, 20 bp, Artificial
  CRISPR gRNA sequence
tttattctacgccatttggg

SEQ ID NO: 673324 - DNA, 20 bp, Artificial
  CRISPR gRNA sequence
attctacgccatttggggat

SEQ ID NO: 673325 - DNA, 20 bp, Artificial
  CRISPR gRNA sequence
ttctacgccatttggggatg

SEQ ID NO: 673326 - DNA, 20 bp, Artificial
  CRISPR gRNA sequence
tacgccatttggggatgatc

SEQ ID NO: 673327 - DNA, 20 bp, Artificial
  CRISPR gRNA sequence
cgccatttggggatgatcat

SEQ ID NO: 673328 - DNA, 20 bp, Artificial
  CRISPR gRNA sequence
ggggatgatcatataaattc

SEQ ID NO: 673329 - DNA, 20 bp, Artificial
  CRISPR gRNA sequence
gggatgatcatataaattca

SEQ ID NO: 673330 - DNA, 20 bp, Artificial
  CRISPR gRNA sequence
agaagtaatttcttattaaa

SEQ ID NO: 673331 - DNA, 20 bp, Artificial
  CRISPR gRNA sequence
cttattaaaaagatttgaag

SEQ ID NO: 673332 - DNA, 20 bp, Artificial
  CRISPR gRNA sequence
ttattaaaaagatttgaaga

SEQ ID NO: 673333 - DNA, 20 bp, Artificial
  CRISPR gRNA sequence
attaaaaagatttgaagata

SEQ ID NO: 673334 - DNA, 20 bp, Artificial
  CRISPR gRNA sequence
ttaaaaagatttgaagatat

SEQ ID NO: 673335 - DNA, 20 bp, Artificial
  CRISPR gRNA sequence
aaaagatttgaagatatcta

SEQ ID NO: 673336 - DNA, 20 bp, Artificial
  CRISPR gRNA sequence
gaagatatctagagtatttt

SEQ ID NO: 673337 - DNA, 20 bp, Artificial
  CRISPR gRNA sequence
aagatatctagagtattttg

SEQ ID NO: 673338 - DNA, 20 bp, Artificial
  CRISPR gRNA sequence
gagtattttgtaaatgtaaa

SEQ ID NO: 673339 - DNA, 20 bp, Artificial
  CRISPR gRNA sequence
tgtaaatgtaaaaactaaat

SEQ ID NO: 673340 - DNA, 20 bp, Artificial
  CRISPR gRNA sequence
gtaaatgtaaaaactaaatt

SEQ ID NO: 673341 - DNA, 20 bp, Artificial
  CRISPR gRNA sequence
taaatgtaaaaactaaatta

SEQ ID NO: 673342 - DNA, 20 bp, Artificial
  CRISPR gRNA sequence
aattaccctttcattaatcg

SEQ ID NO: 673343 - DNA, 20 bp, Artificial
  CRISPR gRNA sequence
ccctttcattaatcgcataa

SEQ ID NO: 673344 - DNA, 20 bp, Artificial
  CRISPR gRNA sequence
tcattaatcgcataaaactc

SEQ ID NO: 673345 - DNA, 20 bp, Artificial
  CRISPR gRNA sequence
cattaatcgcataaaactca

SEQ ID NO: 673346 - DNA, 20 bp, Artificial
  CRISPR gRNA sequence
attaatcgcataaaactcaa

SEQ ID NO: 673347 - DNA, 20 bp, Artificial
  CRISPR gRNA sequence
atcgcataaaactcaattag

SEQ ID NO: 673348 - DNA, 20 bp, Artificial
  CRISPR gRNA sequence
aattaggtgaattttaaaat

SEQ ID NO: 673349 - DNA, 20 bp, Artificial
  CRISPR gRNA sequence
ggtgaattttaaaattcttt

SEQ ID NO: 673350 - DNA, 20 bp, Artificial
  CRISPR gRNA sequence
taaaattctttttaaaaaag

SEQ ID NO: 673351 - DNA, 20 bp, Artificial
  CRISPR gRNA sequence
aaaattctttttaaaaaaga

SEQ ID NO: 673352 - DNA, 20 bp, Artificial
  CRISPR gRNA sequence
aaattctttttaaaaaagat

SEQ ID NO: 673353 - DNA, 20 bp, Artificial
  CRISPR gRNA sequence
tttttaaaaaagatattgtt

SEQ ID NO: 673354 - DNA, 20 bp, Artificial
  CRISPR gRNA sequence
tttaaaaaagatattgtttc

SEQ ID NO: 673355 - DNA, 20 bp, Artificial
  CRISPR gRNA sequence
ttaaaaaagatattgtttca

SEQ ID NO: 673356 - DNA, 20 bp, Artificial
  CRISPR gRNA sequence
taaaaaagatattgtttcat

SEQ ID NO: 673357 - DNA, 20 bp, Artificial
  CRISPR gRNA sequence
aaaaaagatattgtttcatt

SEQ ID NO: 673358 - DNA, 20 bp, Artificial
  CRISPR gRNA sequence
aaaaagatattgtttcattt

SEQ ID NO: 673359 - DNA, 20 bp, Artificial
  CRISPR gRNA sequence
tttcatttttagactagcat

SEQ ID NO: 673360 - DNA, 20 bp, Artificial
  CRISPR gRNA sequence
catttttagactagcattat

SEQ ID NO: 673361 - DNA, 20 bp, Artificial
  CRISPR gRNA sequence
atttttagactagcattatt

SEQ ID NO: 673362 - DNA, 20 bp, Artificial
  CRISPR gRNA sequence
ttagactagcattatttttg

SEQ ID NO: 673363 - DNA, 20 bp, Artificial
  CRISPR gRNA sequence
tagactagcattatttttga

SEQ ID NO: 673364 - DNA, 20 bp, Artificial
  CRISPR gRNA sequence
agactagcattatttttgaa

SEQ ID NO: 673365 - DNA, 20 bp, Artificial
  CRISPR gRNA sequence
gactagcattatttttgaag

SEQ ID NO: 673366 - DNA, 20 bp, Artificial
  CRISPR gRNA sequence
gcattatttttgaagaatga

SEQ ID NO: 673367 - DNA, 20 bp, Artificial
  CRISPR gRNA sequence
tttttgaagaatgaactact

SEQ ID NO: 673368 - DNA, 20 bp, Artificial
  CRISPR gRNA sequence
ttgaagaatgaactactcta

SEQ ID NO: 673369 - DNA, 20 bp, Artificial
  CRISPR gRNA sequence
tgaagaatgaactactctaa

SEQ ID NO: 673370 - DNA, 20 bp, Artificial
  CRISPR gRNA sequence
gaagaatgaactactctaaa

SEQ ID NO: 673371 - DNA, 20 bp, Artificial
  CRISPR gRNA sequence
aagaatgaactactctaaat

SEQ ID NO: 673372 - DNA, 20 bp, Artificial
  CRISPR gRNA sequence
ctctaaattaaggattttga

SEQ ID NO: 673373 - DNA, 20 bp, Artificial
  CRISPR gRNA sequence
taaattaaggattttgaaat

SEQ ID NO: 673374 - DNA, 20 bp, Artificial
  CRISPR gRNA sequence
aattaaggattttgaaatat

SEQ ID NO: 673375 - DNA, 20 bp, Artificial
  CRISPR gRNA sequence
aggattttgaaatatttcaa

SEQ ID NO: 673376 - DNA, 20 bp, Artificial
  CRISPR gRNA sequence
tgaaatatttcaactcaaac

SEQ ID NO: 673377 - DNA, 20 bp, Artificial
  CRISPR gRNA sequence
gaaatatttcaactcaaaca

SEQ ID NO: 673378 - DNA, 20 bp, Artificial
  CRISPR gRNA sequence
aaatatttcaactcaaacat

SEQ ID NO: 673379 - DNA, 20 bp, Artificial
  CRISPR gRNA sequence
caactcaaacattgtaggag

SEQ ID NO: 673380 - DNA, 20 bp, Artificial
  CRISPR gRNA sequence
aactcaaacattgtaggagg

SEQ ID NO: 673381 - DNA, 20 bp, Artificial
  CRISPR gRNA sequence
aaacattgtaggaggtttaa

SEQ ID NO: 673382 - DNA, 20 bp, Artificial
  CRISPR gRNA sequence
taggaggtttaaaggaaatt

SEQ ID NO: 673383 - DNA, 20 bp, Artificial
  CRISPR gRNA sequence
aaaggaaattggagtcagca

SEQ ID NO: 673384 - DNA, 20 bp, Artificial
  CRISPR gRNA sequence
aaggaaattggagtcagcat

SEQ ID NO: 673385 - DNA, 20 bp, Artificial
  CRISPR gRNA sequence
gagtcagcatgctataggag

SEQ ID NO: 673386 - DNA, 20 bp, Artificial
  CRISPR gRNA sequence
taggagtattatctaaaggc

SEQ ID NO: 673387 - DNA, 20 bp, Artificial
  CRISPR gRNA sequence
tctaaaggcagacatgactt

SEQ ID NO: 673388 - DNA, 20 bp, Artificial
  CRISPR gRNA sequence
aaggcagacatgacttcaaa

SEQ ID NO: 673389 - DNA, 20 bp, Artificial
  CRISPR gRNA sequence
caaattgttcaccacactta

SEQ ID NO: 673390 - DNA, 20 bp, Artificial
  CRISPR gRNA sequence
aaattgttcaccacacttag

SEQ ID NO: 673391 - DNA, 20 bp, Artificial
  CRISPR gRNA sequence
ttcaccacacttagtaattt

SEQ ID NO: 673392 - DNA, 20 bp, Artificial
  CRISPR gRNA sequence
accacacttagtaatttaac

SEQ ID NO: 673393 - DNA, 20 bp, Artificial
  CRISPR gRNA sequence
agtaatttaactcttgtaaa

SEQ ID NO: 673394 - DNA, 20 bp, Artificial
  CRISPR gRNA sequence
gtaatttaactcttgtaaag

SEQ ID NO: 673395 - DNA, 20 bp, Artificial
  CRISPR gRNA sequence
aactcttgtaaagttattgt

SEQ ID NO: 673396 - DNA, 20 bp, Artificial
  CRISPR gRNA sequence
actcttgtaaagttattgtt

SEQ ID NO: 673397 - DNA, 20 bp, Artificial
  CRISPR gRNA sequence
ttgtaaagttattgttaacg

SEQ ID NO: 673398 - DNA, 20 bp, Artificial
  CRISPR gRNA sequence
gtaaagttattgttaacgaa

SEQ ID NO: 673399 - DNA, 20 bp, Artificial
  CRISPR gRNA sequence
taaagttattgttaacgaat

SEQ ID NO: 673400 - DNA, 20 bp, Artificial
  CRISPR gRNA sequence
ttgttaacgaatttgttact

SEQ ID NO: 673401 - DNA, 20 bp, Artificial
  CRISPR gRNA sequence
ttaacgaatttgttacttgc

SEQ ID NO: 673402 - DNA, 20 bp, Artificial
  CRISPR gRNA sequence
acgaatttgttacttgcttg

SEQ ID NO: 673403 - DNA, 20 bp, Artificial
  CRISPR gRNA sequence
gttacttgcttgggaaacct

SEQ ID NO: 673404 - DNA, 20 bp, Artificial
  CRISPR gRNA sequence
ttacttgcttgggaaacctt

SEQ ID NO: 673405 - DNA, 20 bp, Artificial
  CRISPR gRNA sequence
cttgcttgggaaaccttacg

SEQ ID NO: 673406 - DNA, 20 bp, Artificial
  CRISPR gRNA sequence
gcttgggaaaccttacgtag

SEQ ID NO: 673407 - DNA, 20 bp, Artificial
  CRISPR gRNA sequence
cttgggaaaccttacgtaga

SEQ ID NO: 673408 - DNA, 20 bp, Artificial
  CRISPR gRNA sequence
gggaaaccttacgtagacat

SEQ ID NO: 673409 - DNA, 20 bp, Artificial
  CRISPR gRNA sequence
ggaaaccttacgtagacata

SEQ ID NO: 673410 - DNA, 20 bp, Artificial
  CRISPR gRNA sequence
acgtagacatattttaaaag

SEQ ID NO: 673411 - DNA, 20 bp, Artificial
  CRISPR gRNA sequence
cgtagacatattttaaaagt

SEQ ID NO: 673412 - DNA, 20 bp, Artificial
  CRISPR gRNA sequence
taaaagtaaaatcaaatttt

SEQ ID NO: 673413 - DNA, 20 bp, Artificial
  CRISPR gRNA sequence
aaaagtaaaatcaaattttt

SEQ ID NO: 673414 - DNA, 20 bp, Artificial
  CRISPR gRNA sequence
aaagtaaaatcaaatttttg

SEQ ID NO: 673415 - DNA, 20 bp, Artificial
  CRISPR gRNA sequence
ttggagtgaaaagtataata

SEQ ID NO: 673416 - DNA, 20 bp, Artificial
  CRISPR gRNA sequence
tggagtgaaaagtataatat

SEQ ID NO: 673417 - DNA, 20 bp, Artificial
  CRISPR gRNA sequence
ggagtgaaaagtataatata

SEQ ID NO: 673418 - DNA, 20 bp, Artificial
  CRISPR gRNA sequence
gagtgaaaagtataatatat

SEQ ID NO: 673419 - DNA, 20 bp, Artificial
  CRISPR gRNA sequence
gctattttcctttttcttta

SEQ ID NO: 673420 - DNA, 20 bp, Artificial
  CRISPR gRNA sequence
ctattttcctttttctttaa

SEQ ID NO: 673421 - DNA, 20 bp, Artificial
  CRISPR gRNA sequence
ttttcctttttctttaaaaa

SEQ ID NO: 673422 - DNA, 20 bp, Artificial
  CRISPR gRNA sequence
tcctttttctttaaaaattt

SEQ ID NO: 673423 - DNA, 20 bp, Artificial
  CRISPR gRNA sequence
cctttttctttaaaaattta

SEQ ID NO: 673424 - DNA, 20 bp, Artificial
  CRISPR gRNA sequence
ctttttctttaaaaatttaa

SEQ ID NO: 673425 - DNA, 20 bp, Artificial
  CRISPR gRNA sequence
tttctttaaaaatttaattt

SEQ ID NO: 673426 - DNA, 20 bp, Artificial
  CRISPR gRNA sequence
ttctttaaaaatttaatttg

SEQ ID NO: 673427 - DNA, 20 bp, Artificial
  CRISPR gRNA sequence
tctttaaaaatttaatttgt

SEQ ID NO: 673428 - DNA, 20 bp, Artificial
  CRISPR gRNA sequence
ctttaaaaatttaatttgtg

SEQ ID NO: 673429 - DNA, 20 bp, Artificial
  CRISPR gRNA sequence
tttaaaaatttaatttgtga

SEQ ID NO: 673430 - DNA, 20 bp, Artificial
  CRISPR gRNA sequence
taaaaatttaatttgtgaaa

SEQ ID NO: 673431 - DNA, 20 bp, Artificial
  CRISPR gRNA sequence
aaaaatttaatttgtgaaag

SEQ ID NO: 673432 - DNA, 20 bp, Artificial
  CRISPR gRNA sequence
aaaatttaatttgtgaaaga

SEQ ID NO: 673433 - DNA, 20 bp, Artificial
  CRISPR gRNA sequence
aatttgtgaaagaagtgcct

SEQ ID NO: 673434 - DNA, 20 bp, Artificial
  CRISPR gRNA sequence
atttgtgaaagaagtgcctc

SEQ ID NO: 673435 - DNA, 20 bp, Artificial
  CRISPR gRNA sequence
gtgaaagaagtgcctccatc

SEQ ID NO: 673436 - DNA, 20 bp, Artificial
  CRISPR gRNA sequence
tgaaagaagtgcctccatct

SEQ ID NO: 673437 - DNA, 20 bp, Artificial
  CRISPR gRNA sequence
catctttccttttattacta

SEQ ID NO: 673438 - DNA, 20 bp, Artificial
  CRISPR gRNA sequence
tccttttattactatggcag

SEQ ID NO: 673439 - DNA, 20 bp, Artificial
  CRISPR gRNA sequence
ccttttattactatggcagg

SEQ ID NO: 673440 - DNA, 20 bp, Artificial
  CRISPR gRNA sequence
cttttattactatggcaggg

SEQ ID NO: 673441 - DNA, 20 bp, Artificial
  CRISPR gRNA sequence
ttattactatggcaggggtt

SEQ ID NO: 673442 - DNA, 20 bp, Artificial
  CRISPR gRNA sequence
tattactatggcaggggttg

SEQ ID NO: 673443 - DNA, 20 bp, Artificial
  CRISPR gRNA sequence
attactatggcaggggttgg

SEQ ID NO: 673444 - DNA, 20 bp, Artificial
  CRISPR gRNA sequence
ttactatggcaggggttggg

SEQ ID NO: 673445 - DNA, 20 bp, Artificial
  CRISPR gRNA sequence
ctatggcaggggttgggagt

SEQ ID NO: 673446 - DNA, 20 bp, Artificial
  CRISPR gRNA sequence
tggcaggggttgggagtgga

SEQ ID NO: 673447 - DNA, 20 bp, Artificial
  CRISPR gRNA sequence
ggagtggaaaattcttgatt

SEQ ID NO: 673448 - DNA, 20 bp, Artificial
  CRISPR gRNA sequence
ttgatttaaaaagttgcagc

SEQ ID NO: 673449 - DNA, 20 bp, Artificial
  CRISPR gRNA sequence
gatttaaaaagttgcagcct

SEQ ID NO: 673450 - DNA, 20 bp, Artificial
  CRISPR gRNA sequence
atttaaaaagttgcagcctg

SEQ ID NO: 673451 - DNA, 20 bp, Artificial
  CRISPR gRNA sequence
aaaaagttgcagcctgtgat

SEQ ID NO: 673452 - DNA, 20 bp, Artificial
  CRISPR gRNA sequence
aaaagttgcagcctgtgatt

SEQ ID NO: 673453 - DNA, 20 bp, Artificial
  CRISPR gRNA sequence
cagcctgtgattccattagg

SEQ ID NO: 673454 - DNA, 20 bp, Artificial
  CRISPR gRNA sequence
tgattccattaggaaagaga

SEQ ID NO: 673455 - DNA, 20 bp, Artificial
  CRISPR gRNA sequence
cattaggaaagagaatcaaa

SEQ ID NO: 673456 - DNA, 20 bp, Artificial
  CRISPR gRNA sequence
ggaaagagaatcaaataatc

SEQ ID NO: 673457 - DNA, 20 bp, Artificial
  CRISPR gRNA sequence
tatattgtgtgtaaaagtaa

SEQ ID NO: 673458 - DNA, 20 bp, Artificial
  CRISPR gRNA sequence
tgtgtaaaagtaaaaaagat

SEQ ID NO: 673459 - DNA, 20 bp, Artificial
  CRISPR gRNA sequence
ccaaaattcaatttatttta

SEQ ID NO: 673460 - DNA, 20 bp, Artificial
  CRISPR gRNA sequence
aatttattttaaaaccttat

SEQ ID NO: 673461 - DNA, 20 bp, Artificial
  CRISPR gRNA sequence
attttaaaaccttatgttgg

SEQ ID NO: 673462 - DNA, 20 bp, Artificial
  CRISPR gRNA sequence
ttttaaaaccttatgttgga

SEQ ID NO: 673463 - DNA, 20 bp, Artificial
  CRISPR gRNA sequence
taaaaccttatgttggaaga

SEQ ID NO: 673464 - DNA, 20 bp, Artificial
  CRISPR gRNA sequence
aaaaccttatgttggaagac

SEQ ID NO: 673465 - DNA, 20 bp, Artificial
  CRISPR gRNA sequence
aaaccttatgttggaagact

SEQ ID NO: 673466 - DNA, 20 bp, Artificial
  CRISPR gRNA sequence
atgttggaagactttatatg

SEQ ID NO: 673467 - DNA, 20 bp, Artificial
  CRISPR gRNA sequence
tgttggaagactttatatga

SEQ ID NO: 673468 - DNA, 20 bp, Artificial
  CRISPR gRNA sequence
gaagactttatatgaggaga

SEQ ID NO: 673469 - DNA, 20 bp, Artificial
  CRISPR gRNA sequence
tatatgaggagatatagatc

SEQ ID NO: 673470 - DNA, 20 bp, Artificial
  CRISPR gRNA sequence
atatgaggagatatagatct

SEQ ID NO: 673471 - DNA, 20 bp, Artificial
  CRISPR gRNA sequence
tatgaggagatatagatctt

SEQ ID NO: 673472 - DNA, 20 bp, Artificial
  CRISPR gRNA sequence
accaggttaatcaaactaag

SEQ ID NO: 673473 - DNA, 20 bp, Artificial
  CRISPR gRNA sequence
ccaggttaatcaaactaaga

SEQ ID NO: 673474 - DNA, 20 bp, Artificial
  CRISPR gRNA sequence
atcaaactaagaagatacca

SEQ ID NO: 673475 - DNA, 20 bp, Artificial
  CRISPR gRNA sequence
agaagataccacttaaggga

SEQ ID NO: 673476 - DNA, 20 bp, Artificial
  CRISPR gRNA sequence
aagggaactttaacattaca

SEQ ID NO: 673477 - DNA, 20 bp, Artificial
  CRISPR gRNA sequence
agggaactttaacattacag

SEQ ID NO: 673478 - DNA, 20 bp, Artificial
  CRISPR gRNA sequence
taacattacagatttttttc

SEQ ID NO: 673479 - DNA, 20 bp, Artificial
  CRISPR gRNA sequence
aacattacagatttttttca

SEQ ID NO: 673480 - DNA, 20 bp, Artificial
  CRISPR gRNA sequence
acattacagatttttttcaa

SEQ ID NO: 673481 - DNA, 20 bp, Artificial
  CRISPR gRNA sequence
cagatttttttcaatccaat

SEQ ID NO: 673482 - DNA, 20 bp, Artificial
  CRISPR gRNA sequence
ttttcaatccaatattatca

SEQ ID NO: 673483 - DNA, 20 bp, Artificial
  CRISPR gRNA sequence
tttcaatccaatattatcaa

SEQ ID NO: 673484 - DNA, 20 bp, Artificial
  CRISPR gRNA sequence
ttcaatccaatattatcaat

SEQ ID NO: 673485 - DNA, 20 bp, Artificial
  CRISPR gRNA sequence
tcaatccaatattatcaata

SEQ ID NO: 673486 - DNA, 20 bp, Artificial
  CRISPR gRNA sequence
caatccaatattatcaatat

SEQ ID NO: 673487 - DNA, 20 bp, Artificial
  CRISPR gRNA sequence
aatccaatattatcaatata

SEQ ID NO: 673488 - DNA, 20 bp, Artificial
  CRISPR gRNA sequence
tcaatataggacctcttgta

SEQ ID NO: 673489 - DNA, 20 bp, Artificial
  CRISPR gRNA sequence
ttgtacatgtagctcataag

SEQ ID NO: 673490 - DNA, 20 bp, Artificial
  CRISPR gRNA sequence
gtacatgtagctcataagag

SEQ ID NO: 673491 - DNA, 20 bp, Artificial
  CRISPR gRNA sequence
tacatgtagctcataagagc

SEQ ID NO: 673492 - DNA, 20 bp, Artificial
  CRISPR gRNA sequence
ataagagctccagatttctt

SEQ ID NO: 673493 - DNA, 20 bp, Artificial
  CRISPR gRNA sequence
cagatttcttaagaaaaaac

SEQ ID NO: 673494 - DNA, 20 bp, Artificial
  CRISPR gRNA sequence
cttaagaaaaaaccttaacc

SEQ ID NO: 673495 - DNA, 20 bp, Artificial
  CRISPR gRNA sequence
ttaagaaaaaaccttaaccc

SEQ ID NO: 673496 - DNA, 20 bp, Artificial
  CRISPR gRNA sequence
aagaaaaaaccttaaccccc

SEQ ID NO: 673497 - DNA, 20 bp, Artificial
  CRISPR gRNA sequence
agaaaaaaccttaaccccca

SEQ ID NO: 673498 - DNA, 20 bp, Artificial
  CRISPR gRNA sequence
aacccccaccacacccacag

SEQ ID NO: 673499 - DNA, 20 bp, Artificial
  CRISPR gRNA sequence
acccccaccacacccacaga

SEQ ID NO: 673500 - DNA, 20 bp, Artificial
  CRISPR gRNA sequence
cacctttttggtatgtacct

SEQ ID NO: 673501 - DNA, 20 bp, Artificial
  CRISPR gRNA sequence
tttggtatgtacctcattaa

SEQ ID NO: 673502 - DNA, 20 bp, Artificial
  CRISPR gRNA sequence
ttggtatgtacctcattaac

SEQ ID NO: 673503 - DNA, 20 bp, Artificial
  CRISPR gRNA sequence
tggtatgtacctcattaact

SEQ ID NO: 673504 - DNA, 20 bp, Artificial
  CRISPR gRNA sequence
ggtatgtacctcattaactc

SEQ ID NO: 673505 - DNA, 20 bp, Artificial
  CRISPR gRNA sequence
gtatgtacctcattaactcc

SEQ ID NO: 673506 - DNA, 20 bp, Artificial
  CRISPR gRNA sequence
attaactcccaaaacactaa

SEQ ID NO: 673507 - DNA, 20 bp, Artificial
  CRISPR gRNA sequence
actcccaaaacactaaatac

SEQ ID NO: 673508 - DNA, 20 bp, Artificial
  CRISPR gRNA sequence
ccaaaacactaaatactaca

SEQ ID NO: 673509 - DNA, 20 bp, Artificial
  CRISPR gRNA sequence
aatactacagaatttgagat

SEQ ID NO: 673510 - DNA, 20 bp, Artificial
  CRISPR gRNA sequence
cagaatttgagatatacttg

SEQ ID NO: 673511 - DNA, 20 bp, Artificial
  CRISPR gRNA sequence
gagatatacttgatctacca

SEQ ID NO: 673512 - DNA, 20 bp, Artificial
  CRISPR gRNA sequence
agatatacttgatctaccaa

SEQ ID NO: 673513 - DNA, 20 bp, Artificial
  CRISPR gRNA sequence
gatctaccaatttttaaatt

SEQ ID NO: 673514 - DNA, 20 bp, Artificial
  CRISPR gRNA sequence
atctaccaatttttaaattt

SEQ ID NO: 673515 - DNA, 20 bp, Artificial
  CRISPR gRNA sequence
ccaatttttaaatttatcta

SEQ ID NO: 673516 - DNA, 20 bp, Artificial
  CRISPR gRNA sequence
ttaaatttatctaggtttta

SEQ ID NO: 673517 - DNA, 20 bp, Artificial
  CRISPR gRNA sequence
taaatttatctaggttttat

SEQ ID NO: 673518 - DNA, 20 bp, Artificial
  CRISPR gRNA sequence
aaatttatctaggttttata

SEQ ID NO: 673519 - DNA, 20 bp, Artificial
  CRISPR gRNA sequence
aatttatctaggttttataa

SEQ ID NO: 673520 - DNA, 20 bp, Artificial
  CRISPR gRNA sequence
atctaggttttataacaaat

SEQ ID NO: 673521 - DNA, 20 bp, Artificial
  CRISPR gRNA sequence
tctaggttttataacaaatc

SEQ ID NO: 673522 - DNA, 20 bp, Artificial
  CRISPR gRNA sequence
ggttttataacaaatctata

SEQ ID NO: 673523 - DNA, 20 bp, Artificial
  CRISPR gRNA sequence
tataacaaatctatatgata

SEQ ID NO: 673524 - DNA, 20 bp, Artificial
  CRISPR gRNA sequence
ataacaaatctatatgatag

SEQ ID NO: 673525 - DNA, 20 bp, Artificial
  CRISPR gRNA sequence
taacaaatctatatgataga

SEQ ID NO: 673526 - DNA, 20 bp, Artificial
  CRISPR gRNA sequence
tatgatagaattttcaatag

SEQ ID NO: 673527 - DNA, 20 bp, Artificial
  CRISPR gRNA sequence
tcaatagctgctgccagaaa

SEQ ID NO: 673528 - DNA, 20 bp, Artificial
  CRISPR gRNA sequence
caatagctgctgccagaaag

SEQ ID NO: 673529 - DNA, 20 bp, Artificial
  CRISPR gRNA sequence
aatagctgctgccagaaagt

SEQ ID NO: 673530 - DNA, 20 bp, Artificial
  CRISPR gRNA sequence
ctgccagaaagtgaccatag

SEQ ID NO: 673531 - DNA, 20 bp, Artificial
  CRISPR gRNA sequence
ccagaaagtgaccatagttt

SEQ ID NO: 673532 - DNA, 20 bp, Artificial
  CRISPR gRNA sequence
atcttatttatacctcttag

SEQ ID NO: 673533 - DNA, 20 bp, Artificial
  CRISPR gRNA sequence
tcttatttatacctcttagc

SEQ ID NO: 673534 - DNA, 20 bp, Artificial
  CRISPR gRNA sequence
atttatacctcttagctttc

SEQ ID NO: 673535 - DNA, 20 bp, Artificial
  CRISPR gRNA sequence
tttatacctcttagctttct

SEQ ID NO: 673536 - DNA, 20 bp, Artificial
  CRISPR gRNA sequence
atacctcttagctttcttta

SEQ ID NO: 673537 - DNA, 20 bp, Artificial
  CRISPR gRNA sequence
tacctcttagctttctttaa

SEQ ID NO: 673538 - DNA, 20 bp, Artificial
  CRISPR gRNA sequence
ttagctttctttaataaaag

SEQ ID NO: 673539 - DNA, 20 bp, Artificial
  CRISPR gRNA sequence
agctttctttaataaaagaa

SEQ ID NO: 673540 - DNA, 20 bp, Artificial
  CRISPR gRNA sequence
gctttctttaataaaagaat

SEQ ID NO: 673541 - DNA, 20 bp, Artificial
  CRISPR gRNA sequence
tctttaataaaagaatcatt

SEQ ID NO: 673542 - DNA, 20 bp, Artificial
  CRISPR gRNA sequence
ctttaataaaagaatcattg

SEQ ID NO: 673543 - DNA, 20 bp, Artificial
  CRISPR gRNA sequence
tttaataaaagaatcattga

SEQ ID NO: 673544 - DNA, 20 bp, Artificial
  CRISPR gRNA sequence
taataaaagaatcattgagt

SEQ ID NO: 673545 - DNA, 20 bp, Artificial
  CRISPR gRNA sequence
aataaaagaatcattgagtt

SEQ ID NO: 673546 - DNA, 20 bp, Artificial
  CRISPR gRNA sequence
ataaaagaatcattgagttt

SEQ ID NO: 673547 - DNA, 20 bp, Artificial
  CRISPR gRNA sequence
agtttgcattatgtcaaagg

SEQ ID NO: 673548 - DNA, 20 bp, Artificial
  CRISPR gRNA sequence
gcattatgtcaaagggccaa

SEQ ID NO: 673549 - DNA, 20 bp, Artificial
  CRISPR gRNA sequence
cattatgtcaaagggccaaa

SEQ ID NO: 673550 - DNA, 20 bp, Artificial
  CRISPR gRNA sequence
tgtcaaagggccaaaaaacc

SEQ ID NO: 673551 - DNA, 20 bp, Artificial
  CRISPR gRNA sequence
gagtttttattattcattat

SEQ ID NO: 673552 - DNA, 20 bp, Artificial
  CRISPR gRNA sequence
agtttttattattcattatt

SEQ ID NO: 673553 - DNA, 20 bp, Artificial
  CRISPR gRNA sequence
ttattattcattattatgtg

SEQ ID NO: 673554 - DNA, 20 bp, Artificial
  CRISPR gRNA sequence
tattattcattattatgtgt

SEQ ID NO: 673555 - DNA, 20 bp, Artificial
  CRISPR gRNA sequence
attattcattattatgtgtg

SEQ ID NO: 673556 - DNA, 20 bp, Artificial
  CRISPR gRNA sequence
ttattcattattatgtgtgt

SEQ ID NO: 673557 - DNA, 20 bp, Artificial
  CRISPR gRNA sequence
ttcattattatgtgtgtttc

SEQ ID NO: 673558 - DNA, 20 bp, Artificial
  CRISPR gRNA sequence
attattatgtgtgtttcagt

SEQ ID NO: 673559 - DNA, 20 bp, Artificial
  CRISPR gRNA sequence
ttatgtgtgtttcagttaaa

SEQ ID NO: 673560 - DNA, 20 bp, Artificial
  CRISPR gRNA sequence
tgtgtgtttcagttaaagat

SEQ ID NO: 673561 - DNA, 20 bp, Artificial
  CRISPR gRNA sequence
cagttaaagatatatgaaac

SEQ ID NO: 673562 - DNA, 20 bp, Artificial
  CRISPR gRNA sequence
agttaaagatatatgaaaca

SEQ ID NO: 673563 - DNA, 20 bp, Artificial
  CRISPR gRNA sequence
aagatatatgaaacatgaca

SEQ ID NO: 673564 - DNA, 20 bp, Artificial
  CRISPR gRNA sequence
caatgtaagctttttgaaaa

SEQ ID NO: 673565 - DNA, 20 bp, Artificial
  CRISPR gRNA sequence
aatgtaagctttttgaaaaa

SEQ ID NO: 673566 - DNA, 20 bp, Artificial
  CRISPR gRNA sequence
tttgaaaaactattaaaatt

SEQ ID NO: 673567 - DNA, 20 bp, Artificial
  CRISPR gRNA sequence
ttgaaaaactattaaaatta

SEQ ID NO: 673568 - DNA, 20 bp, Artificial
  CRISPR gRNA sequence
tgaaaaactattaaaattag

SEQ ID NO: 673569 - DNA, 20 bp, Artificial
  CRISPR gRNA sequence
gaaaaactattaaaattaga

SEQ ID NO: 673570 - DNA, 20 bp, Artificial
  CRISPR gRNA sequence
aaaaactattaaaattagaa

SEQ ID NO: 673571 - DNA, 20 bp, Artificial
  CRISPR gRNA sequence
ttaaaattagaatcatcatc

SEQ ID NO: 673572 - DNA, 20 bp, Artificial
  CRISPR gRNA sequence
aaattagaatcatcatctaa

SEQ ID NO: 673573 - DNA, 20 bp, Artificial
  CRISPR gRNA sequence
gaatcatcatctaactgcag

SEQ ID NO: 673574 - DNA, 20 bp, Artificial
  CRISPR gRNA sequence
actgcaggtaaagaaatggt

SEQ ID NO: 673575 - DNA, 20 bp, Artificial
  CRISPR gRNA sequence
caggtaaagaaatggtccag

SEQ ID NO: 673576 - DNA, 20 bp, Artificial
  CRISPR gRNA sequence
aaccaaaagggaattgtttt

SEQ ID NO: 673577 - DNA, 20 bp, Artificial
  CRISPR gRNA sequence
ttttgtaatgttctttttat

SEQ ID NO: 673578 - DNA, 20 bp, Artificial
  CRISPR gRNA sequence
tgtaatgttctttttattct

SEQ ID NO: 673579 - DNA, 20 bp, Artificial
  CRISPR gRNA sequence
gtaatgttctttttattcta

SEQ ID NO: 673580 - DNA, 20 bp, Artificial
  CRISPR gRNA sequence
taatgttctttttattctaa

SEQ ID NO: 673581 - DNA, 20 bp, Artificial
  CRISPR gRNA sequence
tttttattctaaacttagag

SEQ ID NO: 673582 - DNA, 20 bp, Artificial
  CRISPR gRNA sequence
tttattctaaacttagagct

SEQ ID NO: 673583 - DNA, 20 bp, Artificial
  CRISPR gRNA sequence
ttattctaaacttagagctt

SEQ ID NO: 673584 - DNA, 20 bp, Artificial
  CRISPR gRNA sequence
tattctaaacttagagcttt

SEQ ID NO: 673585 - DNA, 20 bp, Artificial
  CRISPR gRNA sequence
attctaaacttagagcttta

SEQ ID NO: 673586 - DNA, 20 bp, Artificial
  CRISPR gRNA sequence
ttctaaacttagagctttag

SEQ ID NO: 673587 - DNA, 20 bp, Artificial
  CRISPR gRNA sequence
taaacttagagctttagtat

SEQ ID NO: 673588 - DNA, 20 bp, Artificial
  CRISPR gRNA sequence
aacttagagctttagtatga

SEQ ID NO: 673589 - DNA, 20 bp, Artificial
  CRISPR gRNA sequence
agagctttagtatgatacat

SEQ ID NO: 673590 - DNA, 20 bp, Artificial
  CRISPR gRNA sequence
gagctttagtatgatacatt

SEQ ID NO: 673591 - DNA, 20 bp, Artificial
  CRISPR gRNA sequence
tagtatgatacatttttact

SEQ ID NO: 673592 - DNA, 20 bp, Artificial
  CRISPR gRNA sequence
agtatgatacatttttactg

SEQ ID NO: 673593 - DNA, 20 bp, Artificial
  CRISPR gRNA sequence
gtatgatacatttttactgt

SEQ ID NO: 673594 - DNA, 20 bp, Artificial
  CRISPR gRNA sequence
ttactgtttacttatatttg

SEQ ID NO: 673595 - DNA, 20 bp, Artificial
  CRISPR gRNA sequence
tactgtttacttatatttga

SEQ ID NO: 673596 - DNA, 20 bp, Artificial
  CRISPR gRNA sequence
actgtttacttatatttgaa

SEQ ID NO: 673597 - DNA, 20 bp, Artificial
  CRISPR gRNA sequence
ctgtttacttatatttgaat

SEQ ID NO: 673598 - DNA, 20 bp, Artificial
  CRISPR gRNA sequence
tttacttatatttgaatttt

SEQ ID NO: 673599 - DNA, 20 bp, Artificial
  CRISPR gRNA sequence
acttatatttgaatttttat

SEQ ID NO: 673600 - DNA, 20 bp, Artificial
  CRISPR gRNA sequence
cttatatttgaatttttatt

SEQ ID NO: 673601 - DNA, 20 bp, Artificial
  CRISPR gRNA sequence
atatttgaatttttatttta

SEQ ID NO: 673602 - DNA, 20 bp, Artificial
  CRISPR gRNA sequence
tatttgaatttttattttat

SEQ ID NO: 673603 - DNA, 20 bp, Artificial
  CRISPR gRNA sequence
gaatttttattttatttcat

SEQ ID NO: 673604 - DNA, 20 bp, Artificial
  CRISPR gRNA sequence
aatttttattttatttcatg

SEQ ID NO: 673605 - DNA, 20 bp, Artificial
  CRISPR gRNA sequence
ttattttatttcatgtatat

SEQ ID NO: 673606 - DNA, 20 bp, Artificial
  CRISPR gRNA sequence
tattttatttcatgtatatc

SEQ ID NO: 673607 - DNA, 20 bp, Artificial
  CRISPR gRNA sequence
attttatttcatgtatatct

SEQ ID NO: 673608 - DNA, 20 bp, Artificial
  CRISPR gRNA sequence
ttttatttcatgtatatctt

SEQ ID NO: 673609 - DNA, 20 bp, Artificial
  CRISPR gRNA sequence
tatttcatgtatatctttag

SEQ ID NO: 673610 - DNA, 20 bp, Artificial
  CRISPR gRNA sequence
atttcatgtatatctttagt

SEQ ID NO: 673611 - DNA, 20 bp, Artificial
  CRISPR gRNA sequence
tttcatgtatatctttagtg

SEQ ID NO: 673612 - DNA, 20 bp, Artificial
  CRISPR gRNA sequence
catgtatatctttagtgata

SEQ ID NO: 673613 - DNA, 20 bp, Artificial
  CRISPR gRNA sequence
atgtatatctttagtgatag

SEQ ID NO: 673614 - DNA, 20 bp, Artificial
  CRISPR gRNA sequence
tagtgataggtgaatttaaa

SEQ ID NO: 673615 - DNA, 20 bp, Artificial
  CRISPR gRNA sequence
agtgataggtgaatttaaaa

SEQ ID NO: 673616 - DNA, 20 bp, Artificial
  CRISPR gRNA sequence
gtgataggtgaatttaaaat

SEQ ID NO: 673617 - DNA, 20 bp, Artificial
  CRISPR gRNA sequence
aaaataatagcattttcttt

SEQ ID NO: 673618 - DNA, 20 bp, Artificial
  CRISPR gRNA sequence
aaataatagcattttcttta

SEQ ID NO: 673619 - DNA, 20 bp, Artificial
  CRISPR gRNA sequence
tctttatggtttgataaggc

SEQ ID NO: 673620 - DNA, 20 bp, Artificial
  CRISPR gRNA sequence
ctttatggtttgataaggct

SEQ ID NO: 673621 - DNA, 20 bp, Artificial
  CRISPR gRNA sequence
tttatggtttgataaggcta

SEQ ID NO: 673622 - DNA, 20 bp, Artificial
  CRISPR gRNA sequence
tatggtttgataaggctatc

SEQ ID NO: 673623 - DNA, 20 bp, Artificial
  CRISPR gRNA sequence
atggtttgataaggctatca

SEQ ID NO: 673624 - DNA, 20 bp, Artificial
  CRISPR gRNA sequence
tggtttgataaggctatcaa

SEQ ID NO: 673625 - DNA, 20 bp, Artificial
  CRISPR gRNA sequence
gataaggctatcaatttgat

SEQ ID NO: 673626 - DNA, 20 bp, Artificial
  CRISPR gRNA sequence
ataaggctatcaatttgatc

SEQ ID NO: 673627 - DNA, 20 bp, Artificial
  CRISPR gRNA sequence
tcaatttgatcctacttgcc

SEQ ID NO: 673628 - DNA, 20 bp, Artificial
  CRISPR gRNA sequence
gatcctacttgccagttgta

SEQ ID NO: 673629 - DNA, 20 bp, Artificial
  CRISPR gRNA sequence
atcctacttgccagttgtac

SEQ ID NO: 673630 - DNA, 20 bp, Artificial
  CRISPR gRNA sequence
cttgccagttgtactgcttc

SEQ ID NO: 673631 - DNA, 20 bp, Artificial
  CRISPR gRNA sequence
gccagttgtactgcttcatt

SEQ ID NO: 673632 - DNA, 20 bp, Artificial
  CRISPR gRNA sequence
ccagttgtactgcttcattg

SEQ ID NO: 673633 - DNA, 20 bp, Artificial
  CRISPR gRNA sequence
tactgcttcattgcgtacat

SEQ ID NO: 673634 - DNA, 20 bp, Artificial
  CRISPR gRNA sequence
cttcattgcgtacatgtttt

SEQ ID NO: 673635 - DNA, 20 bp, Artificial
  CRISPR gRNA sequence
cattgcgtacatgtttttat

SEQ ID NO: 673636 - DNA, 20 bp, Artificial
  CRISPR gRNA sequence
attgcgtacatgtttttata

SEQ ID NO: 673637 - DNA, 20 bp, Artificial
  CRISPR gRNA sequence
cgtacatgtttttatatttg

SEQ ID NO: 673638 - DNA, 20 bp, Artificial
  CRISPR gRNA sequence
ttatatttgatgacattggt

SEQ ID NO: 673639 - DNA, 20 bp, Artificial
  CRISPR gRNA sequence
tatatttgatgacattggtg

SEQ ID NO: 673640 - DNA, 20 bp, Artificial
  CRISPR gRNA sequence
atatttgatgacattggtga

SEQ ID NO: 673641 - DNA, 20 bp, Artificial
  CRISPR gRNA sequence
tatttgatgacattggtgag

SEQ ID NO: 673642 - DNA, 20 bp, Artificial
  CRISPR gRNA sequence
gatgacattggtgagtcagt

SEQ ID NO: 673643 - DNA, 20 bp, Artificial
  CRISPR gRNA sequence
atgacattggtgagtcagtt

SEQ ID NO: 673644 - DNA, 20 bp, Artificial
  CRISPR gRNA sequence
gtgagtcagttgatggcaac

SEQ ID NO: 673645 - DNA, 20 bp, Artificial
  CRISPR gRNA sequence
atggcaacagaccaaactta

SEQ ID NO: 673646 - DNA, 20 bp, Artificial
  CRISPR gRNA sequence
ataattgaggcttaaaaact

SEQ ID NO: 673647 - DNA, 20 bp, Artificial
  CRISPR gRNA sequence
taattgaggcttaaaaactt

SEQ ID NO: 673648 - DNA, 20 bp, Artificial
  CRISPR gRNA sequence
aggcttaaaaacttcatagc

SEQ ID NO: 673649 - DNA, 20 bp, Artificial
  CRISPR gRNA sequence
aaaaacttcatagcaatatc

SEQ ID NO: 673650 - DNA, 20 bp, Artificial
  CRISPR gRNA sequence
aaaacttcatagcaatatca

SEQ ID NO: 673651 - DNA, 20 bp, Artificial
  CRISPR gRNA sequence
catagcaatatcagtaatag

SEQ ID NO: 673652 - DNA, 20 bp, Artificial
  CRISPR gRNA sequence
atagcaatatcagtaataga

SEQ ID NO: 673653 - DNA, 20 bp, Artificial
  CRISPR gRNA sequence
ctttcaaataataagtttca

SEQ ID NO: 673654 - DNA, 20 bp, Artificial
  CRISPR gRNA sequence
tcaaataataagtttcacaa

SEQ ID NO: 673655 - DNA, 20 bp, Artificial
  CRISPR gRNA sequence
caaataataagtttcacaaa

SEQ ID NO: 673656 - DNA, 20 bp, Artificial
  CRISPR gRNA sequence
aaataataagtttcacaaaa

SEQ ID NO: 673657 - DNA, 20 bp, Artificial
  CRISPR gRNA sequence
cacaaaaaacatgtacagga

SEQ ID NO: 673658 - DNA, 20 bp, Artificial
  CRISPR gRNA sequence
acaaaaaacatgtacaggac

SEQ ID NO: 673659 - DNA, 20 bp, Artificial
  CRISPR gRNA sequence
gatgaataattttatttgga

SEQ ID NO: 673660 - DNA, 20 bp, Artificial
  CRISPR gRNA sequence
tatttggaaattttgctaaa

SEQ ID NO: 673661 - DNA, 20 bp, Artificial
  CRISPR gRNA sequence
atttggaaattttgctaaag

SEQ ID NO: 673662 - DNA, 20 bp, Artificial
  CRISPR gRNA sequence
tttggaaattttgctaaagg

SEQ ID NO: 673663 - DNA, 20 bp, Artificial
  CRISPR gRNA sequence
ggaaattttgctaaaggttt

SEQ ID NO: 673664 - DNA, 20 bp, Artificial
  CRISPR gRNA sequence
gaaattttgctaaaggtttt

SEQ ID NO: 673665 - DNA, 20 bp, Artificial
  CRISPR gRNA sequence
tgctaaaggttttactatta

SEQ ID NO: 673666 - DNA, 20 bp, Artificial
  CRISPR gRNA sequence
gctaaaggttttactattag

SEQ ID NO: 673667 - DNA, 20 bp, Artificial
  CRISPR gRNA sequence
ctaaaggttttactattagt

SEQ ID NO: 673668 - DNA, 20 bp, Artificial
  CRISPR gRNA sequence
aaggttttactattagtgac

SEQ ID NO: 673669 - DNA, 20 bp, Artificial
  CRISPR gRNA sequence
tactattagtgaccaggaga

SEQ ID NO: 673670 - DNA, 20 bp, Artificial
  CRISPR gRNA sequence
actattagtgaccaggagaa

SEQ ID NO: 673671 - DNA, 20 bp, Artificial
  CRISPR gRNA sequence
ctattagtgaccaggagaat

SEQ ID NO: 673672 - DNA, 20 bp, Artificial
  CRISPR gRNA sequence
ttagtgaccaggagaatcaa

SEQ ID NO: 673673 - DNA, 20 bp, Artificial
  CRISPR gRNA sequence
gtgaccaggagaatcaagaa

SEQ ID NO: 673674 - DNA, 20 bp, Artificial
  CRISPR gRNA sequence
gcccgtatttgaaaatcttg

SEQ ID NO: 673675 - DNA, 20 bp, Artificial
  CRISPR gRNA sequence
gaaaatcttgtactaatgag

SEQ ID NO: 673676 - DNA, 20 bp, Artificial
  CRISPR gRNA sequence
aaaatcttgtactaatgagc

SEQ ID NO: 673677 - DNA, 20 bp, Artificial
  CRISPR gRNA sequence
gtactaatgagctttgtaag

SEQ ID NO: 673678 - DNA, 20 bp, Artificial
  CRISPR gRNA sequence
tactaatgagctttgtaagc

SEQ ID NO: 673679 - DNA, 20 bp, Artificial
  CRISPR gRNA sequence
atgagctttgtaagctggtt

SEQ ID NO: 673680 - DNA, 20 bp, Artificial
  CRISPR gRNA sequence
tgtaagctggttcatttgct

SEQ ID NO: 673681 - DNA, 20 bp, Artificial
  CRISPR gRNA sequence
gtaagctggttcatttgctg

SEQ ID NO: 673682 - DNA, 20 bp, Artificial
  CRISPR gRNA sequence
taagctggttcatttgctgt

SEQ ID NO: 673683 - DNA, 20 bp, Artificial
  CRISPR gRNA sequence
gttcatttgctgtacctttt

SEQ ID NO: 673684 - DNA, 20 bp, Artificial
  CRISPR gRNA sequence
atttgctgtaccttttagtt

SEQ ID NO: 673685 - DNA, 20 bp, Artificial
  CRISPR gRNA sequence
gctgtaccttttagttgccc

SEQ ID NO: 673686 - DNA, 20 bp, Artificial
  CRISPR gRNA sequence
ctgtaccttttagttgcccc

SEQ ID NO: 673687 - DNA, 20 bp, Artificial
  CRISPR gRNA sequence
taccttttagttgccccttt

SEQ ID NO: 673688 - DNA, 20 bp, Artificial
  CRISPR gRNA sequence
ttagttgcccctttccatat

SEQ ID NO: 673689 - DNA, 20 bp, Artificial
  CRISPR gRNA sequence
tagttgcccctttccatatc

SEQ ID NO: 673690 - DNA, 20 bp, Artificial
  CRISPR gRNA sequence
agttgcccctttccatatca

SEQ ID NO: 673691 - DNA, 20 bp, Artificial
  CRISPR gRNA sequence
gttgcccctttccatatcag

SEQ ID NO: 673692 - DNA, 20 bp, Artificial
  CRISPR gRNA sequence
cccctttccatatcagctaa

SEQ ID NO: 673693 - DNA, 20 bp, Artificial
  CRISPR gRNA sequence
tccatatcagctaaatgagg

SEQ ID NO: 673694 - DNA, 20 bp, Artificial
  CRISPR gRNA sequence
ccatatcagctaaatgaggg

SEQ ID NO: 673695 - DNA, 20 bp, Artificial
  CRISPR gRNA sequence
catatcagctaaatgaggga

SEQ ID NO: 673696 - DNA, 20 bp, Artificial
  CRISPR gRNA sequence
aatgagggaattagactgaa

SEQ ID NO: 673697 - DNA, 20 bp, Artificial
  CRISPR gRNA sequence
gactgaaggtctctttcagc

SEQ ID NO: 673698 - DNA, 20 bp, Artificial
  CRISPR gRNA sequence
aaggtctctttcagctcaaa

SEQ ID NO: 673699 - DNA, 20 bp, Artificial
  CRISPR gRNA sequence
tttcagctcaaattttctgc

SEQ ID NO: 673700 - DNA, 20 bp, Artificial
  CRISPR gRNA sequence
tcagctcaaattttctgcca

SEQ ID NO: 673701 - DNA, 20 bp, Artificial
  CRISPR gRNA sequence
cagctcaaattttctgccaa

SEQ ID NO: 673702 - DNA, 20 bp, Artificial
  CRISPR gRNA sequence
agctcaaattttctgccaat

SEQ ID NO: 673703 - DNA, 20 bp, Artificial
  CRISPR gRNA sequence
aaattttctgccaattttaa

SEQ ID NO: 673704 - DNA, 20 bp, Artificial
  CRISPR gRNA sequence
tctgccaattttaaagagat

SEQ ID NO: 673705 - DNA, 20 bp, Artificial
  CRISPR gRNA sequence
ctgccaattttaaagagata

SEQ ID NO: 673706 - DNA, 20 bp, Artificial
  CRISPR gRNA sequence
tgccaattttaaagagatag

SEQ ID NO: 673707 - DNA, 20 bp, Artificial
  CRISPR gRNA sequence
ccaattttaaagagatagca

SEQ ID NO: 673708 - DNA, 20 bp, Artificial
  CRISPR gRNA sequence
taaagagatagcatggtaaa

SEQ ID NO: 673709 - DNA, 20 bp, Artificial
  CRISPR gRNA sequence
aaagagatagcatggtaaaa

SEQ ID NO: 673710 - DNA, 20 bp, Artificial
  CRISPR gRNA sequence
aagagatagcatggtaaaag

SEQ ID NO: 673711 - DNA, 20 bp, Artificial
  CRISPR gRNA sequence
tgtagccaaactgaccaggt

SEQ ID NO: 673712 - DNA, 20 bp, Artificial
  CRISPR gRNA sequence
gtagccaaactgaccaggtt

SEQ ID NO: 673713 - DNA, 20 bp, Artificial
  CRISPR gRNA sequence
tagccaaactgaccaggttc

SEQ ID NO: 673714 - DNA, 20 bp, Artificial
  CRISPR gRNA sequence
accaggttcatttctcacct

SEQ ID NO: 673715 - DNA, 20 bp, Artificial
  CRISPR gRNA sequence
atttctcaccttgactactt

SEQ ID NO: 673716 - DNA, 20 bp, Artificial
  CRISPR gRNA sequence
ctcaccttgactactttcta

SEQ ID NO: 673717 - DNA, 20 bp, Artificial
  CRISPR gRNA sequence
tcaccttgactactttctag

SEQ ID NO: 673718 - DNA, 20 bp, Artificial
  CRISPR gRNA sequence
accttgactactttctagct

SEQ ID NO: 673719 - DNA, 20 bp, Artificial
  CRISPR gRNA sequence
gactactttctagctctgtg

SEQ ID NO: 673720 - DNA, 20 bp, Artificial
  CRISPR gRNA sequence
actactttctagctctgtgt

SEQ ID NO: 673721 - DNA, 20 bp, Artificial
  CRISPR gRNA sequence
ctttctagctctgtgtaaca

SEQ ID NO: 673722 - DNA, 20 bp, Artificial
  CRISPR gRNA sequence
tctagctctgtgtaacaaaa

SEQ ID NO: 673723 - DNA, 20 bp, Artificial
  CRISPR gRNA sequence
ctagctctgtgtaacaaaat

SEQ ID NO: 673724 - DNA, 20 bp, Artificial
  CRISPR gRNA sequence
tagctctgtgtaacaaaata

SEQ ID NO: 673725 - DNA, 20 bp, Artificial
  CRISPR gRNA sequence
gctctgtgtaacaaaatagt

SEQ ID NO: 673726 - DNA, 20 bp, Artificial
  CRISPR gRNA sequence
tgtgtaacaaaatagtttga

SEQ ID NO: 673727 - DNA, 20 bp, Artificial
  CRISPR gRNA sequence
tgtaacaaaatagtttgatc

SEQ ID NO: 673728 - DNA, 20 bp, Artificial
  CRISPR gRNA sequence
gatctatggactttaatttc

SEQ ID NO: 673729 - DNA, 20 bp, Artificial
  CRISPR gRNA sequence
atctatggactttaatttct

SEQ ID NO: 673730 - DNA, 20 bp, Artificial
  CRISPR gRNA sequence
tggactttaatttcttcatt

SEQ ID NO: 673731 - DNA, 20 bp, Artificial
  CRISPR gRNA sequence
taatttcttcatttgttaat

SEQ ID NO: 673732 - DNA, 20 bp, Artificial
  CRISPR gRNA sequence
aatttcttcatttgttaatt

SEQ ID NO: 673733 - DNA, 20 bp, Artificial
  CRISPR gRNA sequence
atttcttcatttgttaatta

SEQ ID NO: 673734 - DNA, 20 bp, Artificial
  CRISPR gRNA sequence
cttcatttgttaattaaaat

SEQ ID NO: 673735 - DNA, 20 bp, Artificial
  CRISPR gRNA sequence
ttcatttgttaattaaaatt

SEQ ID NO: 673736 - DNA, 20 bp, Artificial
  CRISPR gRNA sequence
catttgttaattaaaattaa

SEQ ID NO: 673737 - DNA, 20 bp, Artificial
  CRISPR gRNA sequence
atttgttaattaaaattaaa

SEQ ID NO: 673738 - DNA, 20 bp, Artificial
  CRISPR gRNA sequence
gttaattaaaattaaaacaa

SEQ ID NO: 673739 - DNA, 20 bp, Artificial
  CRISPR gRNA sequence
ttaattaaaattaaaacaac

SEQ ID NO: 673740 - DNA, 20 bp, Artificial
  CRISPR gRNA sequence
attaaaattaaaacaaccta

SEQ ID NO: 673741 - DNA, 20 bp, Artificial
  CRISPR gRNA sequence
aaattaaaacaacctaatta

SEQ ID NO: 673742 - DNA, 20 bp, Artificial
  CRISPR gRNA sequence
aaacaacctaattattgtca

SEQ ID NO: 673743 - DNA, 20 bp, Artificial
  CRISPR gRNA sequence
attattgtcattgtaagaaa

SEQ ID NO: 673744 - DNA, 20 bp, Artificial
  CRISPR gRNA sequence
ttgtcattgtaagaaaggat

SEQ ID NO: 673745 - DNA, 20 bp, Artificial
  CRISPR gRNA sequence
tcattgtaagaaaggattga

SEQ ID NO: 673746 - DNA, 20 bp, Artificial
  CRISPR gRNA sequence
taagaaaggattgaaatatt

SEQ ID NO: 673747 - DNA, 20 bp, Artificial
  CRISPR gRNA sequence
aaatattctatggaaagcat

SEQ ID NO: 673748 - DNA, 20 bp, Artificial
  CRISPR gRNA sequence
tatggaaagcatccaattgt

SEQ ID NO: 673749 - DNA, 20 bp, Artificial
  CRISPR gRNA sequence
tggaaagcatccaattgtgt

SEQ ID NO: 673750 - DNA, 20 bp, Artificial
  CRISPR gRNA sequence
tgtgtaaggccctaaagtga

SEQ ID NO: 673751 - DNA, 20 bp, Artificial
  CRISPR gRNA sequence
aagtgacagcacctcattgt

SEQ ID NO: 673752 - DNA, 20 bp, Artificial
  CRISPR gRNA sequence
attgttcaaccaatgataaa

SEQ ID NO: 673753 - DNA, 20 bp, Artificial
  CRISPR gRNA sequence
ttcaaccaatgataaatgct

SEQ ID NO: 673754 - DNA, 20 bp, Artificial
  CRISPR gRNA sequence
aaccaatgataaatgctatt

SEQ ID NO: 673755 - DNA, 20 bp, Artificial
  CRISPR gRNA sequence
ttattgttattcttctgagt

SEQ ID NO: 673756 - DNA, 20 bp, Artificial
  CRISPR gRNA sequence
ttgttattcttctgagtcaa

SEQ ID NO: 673757 - DNA, 20 bp, Artificial
  CRISPR gRNA sequence
ttattcttctgagtcaatga

SEQ ID NO: 673758 - DNA, 20 bp, Artificial
  CRISPR gRNA sequence
ttcttctgagtcaatgatag

SEQ ID NO: 673759 - DNA, 20 bp, Artificial
  CRISPR gRNA sequence
ttctgagtcaatgataggac

SEQ ID NO: 673760 - DNA, 20 bp, Artificial
  CRISPR gRNA sequence
ctgagtcaatgataggactt

SEQ ID NO: 673761 - DNA, 20 bp, Artificial
  CRISPR gRNA sequence
tgagtcaatgataggacttt

SEQ ID NO: 673762 - DNA, 20 bp, Artificial
  CRISPR gRNA sequence
agtcaatgataggacttttg

SEQ ID NO: 673763 - DNA, 20 bp, Artificial
  CRISPR gRNA sequence
ttgtcacatttatacataaa

SEQ ID NO: 673764 - DNA, 20 bp, Artificial
  CRISPR gRNA sequence
tgtcacatttatacataaaa

SEQ ID NO: 673765 - DNA, 20 bp, Artificial
  CRISPR gRNA sequence
gtcacatttatacataaaag

SEQ ID NO: 673766 - DNA, 20 bp, Artificial
  CRISPR gRNA sequence
tcacatttatacataaaagg

SEQ ID NO: 673767 - DNA, 20 bp, Artificial
  CRISPR gRNA sequence
atacataaaaggggaaagat

SEQ ID NO: 673768 - DNA, 20 bp, Artificial
  CRISPR gRNA sequence
tacataaaaggggaaagatc

SEQ ID NO: 673769 - DNA, 20 bp, Artificial
  CRISPR gRNA sequence
gatgtaaaacttaagacttt

SEQ ID NO: 673770 - DNA, 20 bp, Artificial
  CRISPR gRNA sequence
atgtaaaacttaagactttg

SEQ ID NO: 673771 - DNA, 20 bp, Artificial
  CRISPR gRNA sequence
aagactttggtaactgtatt

SEQ ID NO: 673772 - DNA, 20 bp, Artificial
  CRISPR gRNA sequence
agactttggtaactgtattg

SEQ ID NO: 673773 - DNA, 20 bp, Artificial
  CRISPR gRNA sequence
tggtaactgtattgacaaag

SEQ ID NO: 673774 - DNA, 20 bp, Artificial
  CRISPR gRNA sequence
ggtaactgtattgacaaagc

SEQ ID NO: 673775 - DNA, 20 bp, Artificial
  CRISPR gRNA sequence
gtaactgtattgacaaagca

SEQ ID NO: 673776 - DNA, 20 bp, Artificial
  CRISPR gRNA sequence
tattgacaaagcaaattctg

SEQ ID NO: 673777 - DNA, 20 bp, Artificial
  CRISPR gRNA sequence
acaaagcaaattctgggcag

SEQ ID NO: 673778 - DNA, 20 bp, Artificial
  CRISPR gRNA sequence
tgggcagataaatgtttaaa

SEQ ID NO: 673779 - DNA, 20 bp, Artificial
  CRISPR gRNA sequence
ggcagataaatgtttaaaag

SEQ ID NO: 673780 - DNA, 20 bp, Artificial
  CRISPR gRNA sequence
aaaagacttatgagggagat

SEQ ID NO: 673781 - DNA, 20 bp, Artificial
  CRISPR gRNA sequence
aaagacttatgagggagatg

SEQ ID NO: 673782 - DNA, 20 bp, Artificial
  CRISPR gRNA sequence
atgagggagatgaacatttt

SEQ ID NO: 673783 - DNA, 20 bp, Artificial
  CRISPR gRNA sequence
tgagggagatgaacattttt

SEQ ID NO: 673784 - DNA, 20 bp, Artificial
  CRISPR gRNA sequence
ttagcatagagaactggctt

SEQ ID NO: 673785 - DNA, 20 bp, Artificial
  CRISPR gRNA sequence
tagcatagagaactggcttt

SEQ ID NO: 673786 - DNA, 20 bp, Artificial
  CRISPR gRNA sequence
agcatagagaactggctttg

SEQ ID NO: 673787 - DNA, 20 bp, Artificial
  CRISPR gRNA sequence
gcatagagaactggctttgg

SEQ ID NO: 673788 - DNA, 20 bp, Artificial
  CRISPR gRNA sequence
gctttggttaacagtggatg

SEQ ID NO: 673789 - DNA, 20 bp, Artificial
  CRISPR gRNA sequence
tggttaacagtggatggcaa

SEQ ID NO: 673790 - DNA, 20 bp, Artificial
  CRISPR gRNA sequence
ggttaacagtggatggcaaa

SEQ ID NO: 673791 - DNA, 20 bp, Artificial
  CRISPR gRNA sequence
gttaacagtggatggcaaat

SEQ ID NO: 673792 - DNA, 20 bp, Artificial
  CRISPR gRNA sequence
acagtggatggcaaattagt

SEQ ID NO: 673793 - DNA, 20 bp, Artificial
  CRISPR gRNA sequence
gtcacttgcacataccctag

SEQ ID NO: 673794 - DNA, 20 bp, Artificial
  CRISPR gRNA sequence
gcacataccctagttgatac

SEQ ID NO: 673795 - DNA, 20 bp, Artificial
  CRISPR gRNA sequence
cacataccctagttgatact

SEQ ID NO: 673796 - DNA, 20 bp, Artificial
  CRISPR gRNA sequence
gttgatacttcccatttctt

SEQ ID NO: 673797 - DNA, 20 bp, Artificial
  CRISPR gRNA sequence
atacttcccatttcttctcc

SEQ ID NO: 673798 - DNA, 20 bp, Artificial
  CRISPR gRNA sequence
cccatttcttctccttactg

SEQ ID NO: 673799 - DNA, 20 bp, Artificial
  CRISPR gRNA sequence
ccatttcttctccttactgc

SEQ ID NO: 673800 - DNA, 20 bp, Artificial
  CRISPR gRNA sequence
cttctccttactgcaggtga

SEQ ID NO: 673801 - DNA, 20 bp, Artificial
  CRISPR gRNA sequence
ttctccttactgcaggtgaa

SEQ ID NO: 673802 - DNA, 20 bp, Artificial
  CRISPR gRNA sequence
ctccttactgcaggtgaacg

SEQ ID NO: 673803 - DNA, 20 bp, Artificial
  CRISPR gRNA sequence
tccttactgcaggtgaacgc

SEQ ID NO: 673804 - DNA, 20 bp, Artificial
  CRISPR gRNA sequence
cttactgcaggtgaacgccc

SEQ ID NO: 673805 - DNA, 20 bp, Artificial
  CRISPR gRNA sequence
actgcaggtgaacgcccctt

SEQ ID NO: 673806 - DNA, 20 bp, Artificial
  CRISPR gRNA sequence
ctgcaggtgaacgccccttc

SEQ ID NO: 673807 - DNA, 20 bp, Artificial
  CRISPR gRNA sequence
caggtgaacgccccttccac

SEQ ID NO: 673808 - DNA, 20 bp, Artificial
  CRISPR gRNA sequence
ccactgtaaccagtgtggag

SEQ ID NO: 673809 - DNA, 20 bp, Artificial
  CRISPR gRNA sequence
cactgtaaccagtgtggagc

SEQ ID NO: 673810 - DNA, 20 bp, Artificial
  CRISPR gRNA sequence
taaccagtgtggagcttctt

SEQ ID NO: 673811 - DNA, 20 bp, Artificial
  CRISPR gRNA sequence
cttttactcagaagggcaac

SEQ ID NO: 673812 - DNA, 20 bp, Artificial
  CRISPR gRNA sequence
ttttactcagaagggcaacc

SEQ ID NO: 673813 - DNA, 20 bp, Artificial
  CRISPR gRNA sequence
ttactcagaagggcaacctt

SEQ ID NO: 673814 - DNA, 20 bp, Artificial
  CRISPR gRNA sequence
tactcagaagggcaaccttc

SEQ ID NO: 673815 - DNA, 20 bp, Artificial
  CRISPR gRNA sequence
actcagaagggcaaccttct

SEQ ID NO: 673816 - DNA, 20 bp, Artificial
  CRISPR gRNA sequence
ctcagaagggcaaccttctg

SEQ ID NO: 673817 - DNA, 20 bp, Artificial
  CRISPR gRNA sequence
agaagggcaaccttctgaga

SEQ ID NO: 673818 - DNA, 20 bp, Artificial
  CRISPR gRNA sequence
ctgagacacataaagttaca

SEQ ID NO: 673819 - DNA, 20 bp, Artificial
  CRISPR gRNA sequence
tgagacacataaagttacac

SEQ ID NO: 673820 - DNA, 20 bp, Artificial
  CRISPR gRNA sequence
agacacataaagttacactc

SEQ ID NO: 673821 - DNA, 20 bp, Artificial
  CRISPR gRNA sequence
cactctggagagaagccgtt

SEQ ID NO: 673822 - DNA, 20 bp, Artificial
  CRISPR gRNA sequence
tggagagaagccgttcaaat

SEQ ID NO: 673823 - DNA, 20 bp, Artificial
  CRISPR gRNA sequence
gagagaagccgttcaaatgt

SEQ ID NO: 673824 - DNA, 20 bp, Artificial
  CRISPR gRNA sequence
aaatgtcctttctgtagcta

SEQ ID NO: 673825 - DNA, 20 bp, Artificial
  CRISPR gRNA sequence
tctgtagctacgcctgtaga

SEQ ID NO: 673826 - DNA, 20 bp, Artificial
  CRISPR gRNA sequence
ctgtagctacgcctgtagaa

SEQ ID NO: 673827 - DNA, 20 bp, Artificial
  CRISPR gRNA sequence
tgtagctacgcctgtagaag

SEQ ID NO: 673828 - DNA, 20 bp, Artificial
  CRISPR gRNA sequence
tagctacgcctgtagaagaa

SEQ ID NO: 673829 - DNA, 20 bp, Artificial
  CRISPR gRNA sequence
cgcctgtagaagaagggacg

SEQ ID NO: 673830 - DNA, 20 bp, Artificial
  CRISPR gRNA sequence
tagaagaagggacgccctca

SEQ ID NO: 673831 - DNA, 20 bp, Artificial
  CRISPR gRNA sequence
acaggacacctcaggaccca

SEQ ID NO: 673832 - DNA, 20 bp, Artificial
  CRISPR gRNA sequence
aggacccattctggtaagtg

SEQ ID NO: 673833 - DNA, 20 bp, Artificial
  CRISPR gRNA sequence
tggtaagtgtcaccaactcc

SEQ ID NO: 673834 - DNA, 20 bp, Artificial
  CRISPR gRNA sequence
gtaagtgtcaccaactcctt

SEQ ID NO: 673835 - DNA, 20 bp, Artificial
  CRISPR gRNA sequence
cttgagaagaaaagtaaaac

SEQ ID NO: 673836 - DNA, 20 bp, Artificial
  CRISPR gRNA sequence
gagaagaaaagtaaaacagg

SEQ ID NO: 673837 - DNA, 20 bp, Artificial
  CRISPR gRNA sequence
agaagaaaagtaaaacagga

SEQ ID NO: 673838 - DNA, 20 bp, Artificial
  CRISPR gRNA sequence
agaagagtactattgaatga

SEQ ID NO: 673839 - DNA, 20 bp, Artificial
  CRISPR gRNA sequence
gaagagtactattgaatgat

SEQ ID NO: 673840 - DNA, 20 bp, Artificial
  CRISPR gRNA sequence
ttgaatgatagtaacatggc

SEQ ID NO: 673841 - DNA, 20 bp, Artificial
  CRISPR gRNA sequence
aatgatagtaacatggcttt

SEQ ID NO: 673842 - DNA, 20 bp, Artificial
  CRISPR gRNA sequence
tgttatgtagtcggtaatga

SEQ ID NO: 673843 - DNA, 20 bp, Artificial
  CRISPR gRNA sequence
gttatgtagtcggtaatgac

SEQ ID NO: 673844 - DNA, 20 bp, Artificial
  CRISPR gRNA sequence
ttatgtagtcggtaatgacc

SEQ ID NO: 673845 - DNA, 20 bp, Artificial
  CRISPR gRNA sequence
tgtagtcggtaatgaccaag

SEQ ID NO: 673846 - DNA, 20 bp, Artificial
  CRISPR gRNA sequence
gttattggtgtacattaaat

SEQ ID NO: 673847 - DNA, 20 bp, Artificial
  CRISPR gRNA sequence
ttattggtgtacattaaata

SEQ ID NO: 673848 - DNA, 20 bp, Artificial
  CRISPR gRNA sequence
ttggtgtacattaaataatt

SEQ ID NO: 673849 - DNA, 20 bp, Artificial
  CRISPR gRNA sequence
gtgtacattaaataattgat

SEQ ID NO: 673850 - DNA, 20 bp, Artificial
  CRISPR gRNA sequence
aataattgataaatcttgca

SEQ ID NO: 673851 - DNA, 20 bp, Artificial
  CRISPR gRNA sequence
ataaatcttgcaggatgcat

SEQ ID NO: 673852 - DNA, 20 bp, Artificial
  CRISPR gRNA sequence
gcaggatgcatgtatctttc

SEQ ID NO: 673853 - DNA, 20 bp, Artificial
  CRISPR gRNA sequence
caggatgcatgtatctttca

SEQ ID NO: 673854 - DNA, 20 bp, Artificial
  CRISPR gRNA sequence
tcatttttagactttacggc

SEQ ID NO: 673855 - DNA, 20 bp, Artificial
  CRISPR gRNA sequence
catttttagactttacggct

SEQ ID NO: 673856 - DNA, 20 bp, Artificial
  CRISPR gRNA sequence
atttttagactttacggctt

SEQ ID NO: 673857 - DNA, 20 bp, Artificial
  CRISPR gRNA sequence
ttagactttacggcttggca

SEQ ID NO: 673858 - DNA, 20 bp, Artificial
  CRISPR gRNA sequence
tagactttacggcttggcag

SEQ ID NO: 673859 - DNA, 20 bp, Artificial
  CRISPR gRNA sequence
agactttacggcttggcaga

SEQ ID NO: 673860 - DNA, 20 bp, Artificial
  CRISPR gRNA sequence
gactttacggcttggcagaa

SEQ ID NO: 673861 - DNA, 20 bp, Artificial
  CRISPR gRNA sequence
tacggcttggcagaaaggag

SEQ ID NO: 673862 - DNA, 20 bp, Artificial
  CRISPR gRNA sequence
acggcttggcagaaaggagc

SEQ ID NO: 673863 - DNA, 20 bp, Artificial
  CRISPR gRNA sequence
cggcttggcagaaaggagca

SEQ ID NO: 673864 - DNA, 20 bp, Artificial
  CRISPR gRNA sequence
ggcagaaaggagcactgtca

SEQ ID NO: 673865 - DNA, 20 bp, Artificial
  CRISPR gRNA sequence
gcagaaaggagcactgtcaa

SEQ ID NO: 673866 - DNA, 20 bp, Artificial
  CRISPR gRNA sequence
tcaactgaagagtatcttac

SEQ ID NO: 673867 - DNA, 20 bp, Artificial
  CRISPR gRNA sequence
aagagtatcttacttcaata

SEQ ID NO: 673868 - DNA, 20 bp, Artificial
  CRISPR gRNA sequence
acttcaatatattagaataa

SEQ ID NO: 673869 - DNA, 20 bp, Artificial
  CRISPR gRNA sequence
cttcaatatattagaataag

SEQ ID NO: 673870 - DNA, 20 bp, Artificial
  CRISPR gRNA sequence
caatatattagaataagaaa

SEQ ID NO: 673871 - DNA, 20 bp, Artificial
  CRISPR gRNA sequence
aatatattagaataagaaaa

SEQ ID NO: 673872 - DNA, 20 bp, Artificial
  CRISPR gRNA sequence
gaataagaaaacagctgtta

SEQ ID NO: 673873 - DNA, 20 bp, Artificial
  CRISPR gRNA sequence
ttatatattttctataattt

SEQ ID NO: 673874 - DNA, 20 bp, Artificial
  CRISPR gRNA sequence
tatattttctataattttaa

SEQ ID NO: 673875 - DNA, 20 bp, Artificial
  CRISPR gRNA sequence
tctataattttaaaatttta

SEQ ID NO: 673876 - DNA, 20 bp, Artificial
  CRISPR gRNA sequence
ctataattttaaaattttac

SEQ ID NO: 673877 - DNA, 20 bp, Artificial
  CRISPR gRNA sequence
tataattttaaaattttaca

SEQ ID NO: 673878 - DNA, 20 bp, Artificial
  CRISPR gRNA sequence
taattttaaaattttacaat

SEQ ID NO: 673879 - DNA, 20 bp, Artificial
  CRISPR gRNA sequence
taaaattttacaattaagaa

SEQ ID NO: 673880 - DNA, 20 bp, Artificial
  CRISPR gRNA sequence
aaaattttacaattaagaat

SEQ ID NO: 673881 - DNA, 20 bp, Artificial
  CRISPR gRNA sequence
aaattttacaattaagaatg

SEQ ID NO: 673882 - DNA, 20 bp, Artificial
  CRISPR gRNA sequence
tacaattaagaatgcagtca

SEQ ID NO: 673883 - DNA, 20 bp, Artificial
  CRISPR gRNA sequence
acaattaagaatgcagtcat

SEQ ID NO: 673884 - DNA, 20 bp, Artificial
  CRISPR gRNA sequence
caattaagaatgcagtcatt

SEQ ID NO: 673885 - DNA, 20 bp, Artificial
  CRISPR gRNA sequence
agaatgcagtcattatggtt

SEQ ID NO: 673886 - DNA, 20 bp, Artificial
  CRISPR gRNA sequence
tggttaatccaagataagtg

SEQ ID NO: 673887 - DNA, 20 bp, Artificial
  CRISPR gRNA sequence
atccaagataagtgaagatc

SEQ ID NO: 673888 - DNA, 20 bp, Artificial
  CRISPR gRNA sequence
tgtttcgagttactgtagag

SEQ ID NO: 673889 - DNA, 20 bp, Artificial
  CRISPR gRNA sequence
cgagttactgtagaggaaat

SEQ ID NO: 673890 - DNA, 20 bp, Artificial
  CRISPR gRNA sequence
gagttactgtagaggaaatg

SEQ ID NO: 673891 - DNA, 20 bp, Artificial
  CRISPR gRNA sequence
ctgtagaggaaatgaaaact

SEQ ID NO: 673892 - DNA, 20 bp, Artificial
  CRISPR gRNA sequence
tagaggaaatgaaaactgat

SEQ ID NO: 673893 - DNA, 20 bp, Artificial
  CRISPR gRNA sequence
attttttttgactgatacag

SEQ ID NO: 673894 - DNA, 20 bp, Artificial
  CRISPR gRNA sequence
tttttgactgatacagtgct

SEQ ID NO: 673895 - DNA, 20 bp, Artificial
  CRISPR gRNA sequence
ttttgactgatacagtgctc

SEQ ID NO: 673896 - DNA, 20 bp, Artificial
  CRISPR gRNA sequence
tttgactgatacagtgctca

SEQ ID NO: 673897 - DNA, 20 bp, Artificial
  CRISPR gRNA sequence
ttgactgatacagtgctcag

SEQ ID NO: 673898 - DNA, 20 bp, Artificial
  CRISPR gRNA sequence
tgactgatacagtgctcagg

SEQ ID NO: 673899 - DNA, 20 bp, Artificial
  CRISPR gRNA sequence
gactgatacagtgctcaggc

SEQ ID NO: 673900 - DNA, 20 bp, Artificial
  CRISPR gRNA sequence
actgatacagtgctcaggct

SEQ ID NO: 673901 - DNA, 20 bp, Artificial
  CRISPR gRNA sequence
atacagtgctcaggctggga

SEQ ID NO: 673902 - DNA, 20 bp, Artificial
  CRISPR gRNA sequence
aggctgggatctctgtggaa

SEQ ID NO: 673903 - DNA, 20 bp, Artificial
  CRISPR gRNA sequence
ggatctctgtggaaaataaa

SEQ ID NO: 673904 - DNA, 20 bp, Artificial
  CRISPR gRNA sequence
tgtggaaaataaaattgttt

SEQ ID NO: 673905 - DNA, 20 bp, Artificial
  CRISPR gRNA sequence
tggaaaataaaattgtttct

SEQ ID NO: 673906 - DNA, 20 bp, Artificial
  CRISPR gRNA sequence
tttcttttaaacttgaaaat

SEQ ID NO: 673907 - DNA, 20 bp, Artificial
  CRISPR gRNA sequence
cttttaaacttgaaaatata

SEQ ID NO: 673908 - DNA, 20 bp, Artificial
  CRISPR gRNA sequence
ttttaaacttgaaaatatac

SEQ ID NO: 673909 - DNA, 20 bp, Artificial
  CRISPR gRNA sequence
ttaaacttgaaaatatactc

SEQ ID NO: 673910 - DNA, 20 bp, Artificial
  CRISPR gRNA sequence
taaacttgaaaatatactca

SEQ ID NO: 673911 - DNA, 20 bp, Artificial
  CRISPR gRNA sequence
aaacttgaaaatatactcag

SEQ ID NO: 673912 - DNA, 20 bp, Artificial
  CRISPR gRNA sequence
aacttgaaaatatactcaga

SEQ ID NO: 673913 - DNA, 20 bp, Artificial
  CRISPR gRNA sequence
gaaaatatactcagaaaatt

SEQ ID NO: 673914 - DNA, 20 bp, Artificial
  CRISPR gRNA sequence
aaaatatactcagaaaattg

SEQ ID NO: 673915 - DNA, 20 bp, Artificial
  CRISPR gRNA sequence
agaaaattggcttttcgagt

SEQ ID NO: 673916 - DNA, 20 bp, Artificial
  CRISPR gRNA sequence
gcttttcgagtattttatat

SEQ ID NO: 673917 - DNA, 20 bp, Artificial
  CRISPR gRNA sequence
ttcgagtattttatattcta

SEQ ID NO: 673918 - DNA, 20 bp, Artificial
  CRISPR gRNA sequence
tcgagtattttatattctaa

SEQ ID NO: 673919 - DNA, 20 bp, Artificial
  CRISPR gRNA sequence
cgagtattttatattctaat

SEQ ID NO: 673920 - DNA, 20 bp, Artificial
  CRISPR gRNA sequence
gagtattttatattctaatt

SEQ ID NO: 673921 - DNA, 20 bp, Artificial
  CRISPR gRNA sequence
tatattctaattttaactct

SEQ ID NO: 673922 - DNA, 20 bp, Artificial
  CRISPR gRNA sequence
atattctaattttaactctc

SEQ ID NO: 673923 - DNA, 20 bp, Artificial
  CRISPR gRNA sequence
tattctaattttaactctcc

SEQ ID NO: 673924 - DNA, 20 bp, Artificial
  CRISPR gRNA sequence
taattttaactctccttgta

SEQ ID NO: 673925 - DNA, 20 bp, Artificial
  CRISPR gRNA sequence
attttaactctccttgtatc

SEQ ID NO: 673926 - DNA, 20 bp, Artificial
  CRISPR gRNA sequence
taactctccttgtatcttta

SEQ ID NO: 673927 - DNA, 20 bp, Artificial
  CRISPR gRNA sequence
aactctccttgtatctttag

SEQ ID NO: 673928 - DNA, 20 bp, Artificial
  CRISPR gRNA sequence
actctccttgtatctttagc

SEQ ID NO: 673929 - DNA, 20 bp, Artificial
  CRISPR gRNA sequence
tccttgtatctttagctctc

SEQ ID NO: 673930 - DNA, 20 bp, Artificial
  CRISPR gRNA sequence
cttgtatctttagctctcaa

SEQ ID NO: 673931 - DNA, 20 bp, Artificial
  CRISPR gRNA sequence
gtatctttagctctcaaaca

SEQ ID NO: 673932 - DNA, 20 bp, Artificial
  CRISPR gRNA sequence
tatctttagctctcaaacaa

SEQ ID NO: 673933 - DNA, 20 bp, Artificial
  CRISPR gRNA sequence
tagctctcaaacaatagtca

SEQ ID NO: 673934 - DNA, 20 bp, Artificial
  CRISPR gRNA sequence
agctctcaaacaatagtcat

SEQ ID NO: 673935 - DNA, 20 bp, Artificial
  CRISPR gRNA sequence
gctctcaaacaatagtcatt

SEQ ID NO: 673936 - DNA, 20 bp, Artificial
  CRISPR gRNA sequence
tcaaacaatagtcattgggt

SEQ ID NO: 673937 - DNA, 20 bp, Artificial
  CRISPR gRNA sequence
aaacaatagtcattgggtac

SEQ ID NO: 673938 - DNA, 20 bp, Artificial
  CRISPR gRNA sequence
ggtactctgaaactttgctg

SEQ ID NO: 673939 - DNA, 20 bp, Artificial
  CRISPR gRNA sequence
tgaaactttgctgtgtttca

SEQ ID NO: 673940 - DNA, 20 bp, Artificial
  CRISPR gRNA sequence
aaactttgctgtgtttcata

SEQ ID NO: 673941 - DNA, 20 bp, Artificial
  CRISPR gRNA sequence
tgctgtgtttcataaatcat

SEQ ID NO: 673942 - DNA, 20 bp, Artificial
  CRISPR gRNA sequence
gctgtgtttcataaatcatt

SEQ ID NO: 673943 - DNA, 20 bp, Artificial
  CRISPR gRNA sequence
ctgtgtttcataaatcattt

SEQ ID NO: 673944 - DNA, 20 bp, Artificial
  CRISPR gRNA sequence
tgtttcataaatcatttaaa

SEQ ID NO: 673945 - DNA, 20 bp, Artificial
  CRISPR gRNA sequence
cataaatcatttaaaaaatg

SEQ ID NO: 673946 - DNA, 20 bp, Artificial
  CRISPR gRNA sequence
ataaatcatttaaaaaatgt

SEQ ID NO: 673947 - DNA, 20 bp, Artificial
  CRISPR gRNA sequence
aaaaaatgtagaatatgaca

SEQ ID NO: 673948 - DNA, 20 bp, Artificial
  CRISPR gRNA sequence
aaaaatgtagaatatgacaa

SEQ ID NO: 673949 - DNA, 20 bp, Artificial
  CRISPR gRNA sequence
ttgggaataaaagaaaaaaa

SEQ ID NO: 673950 - DNA, 20 bp, Artificial
  CRISPR gRNA sequence
gggaataaaagaaaaaaata

SEQ ID NO: 673951 - DNA, 20 bp, Artificial
  CRISPR gRNA sequence
ggaataaaagaaaaaaataa

SEQ ID NO: 673952 - DNA, 20 bp, Artificial
  CRISPR gRNA sequence
aatgtttttaagaaatgcca

SEQ ID NO: 673953 - DNA, 20 bp, Artificial
  CRISPR gRNA sequence
atgtttttaagaaatgccag

SEQ ID NO: 673954 - DNA, 20 bp, Artificial
  CRISPR gRNA sequence
ttaagaaatgccagaatata

SEQ ID NO: 673955 - DNA, 20 bp, Artificial
  CRISPR gRNA sequence
taagaaatgccagaatataa

SEQ ID NO: 673956 - DNA, 20 bp, Artificial
  CRISPR gRNA sequence
aagaaatgccagaatataac

SEQ ID NO: 673957 - DNA, 20 bp, Artificial
  CRISPR gRNA sequence
agaaatgccagaatataaca

SEQ ID NO: 673958 - DNA, 20 bp, Artificial
  CRISPR gRNA sequence
atttgacttttagcataaat

SEQ ID NO: 673959 - DNA, 20 bp, Artificial
  CRISPR gRNA sequence
gacttttagcataaattttc

SEQ ID NO: 673960 - DNA, 20 bp, Artificial
  CRISPR gRNA sequence
acttttagcataaattttca

SEQ ID NO: 673961 - DNA, 20 bp, Artificial
  CRISPR gRNA sequence
ttagcataaattttcataac

SEQ ID NO: 673962 - DNA, 20 bp, Artificial
  CRISPR gRNA sequence
tagcataaattttcataacc

SEQ ID NO: 673963 - DNA, 20 bp, Artificial
  CRISPR gRNA sequence
agcataaattttcataacca

SEQ ID NO: 673964 - DNA, 20 bp, Artificial
  CRISPR gRNA sequence
gcataaattttcataaccaa

SEQ ID NO: 673965 - DNA, 20 bp, Artificial
  CRISPR gRNA sequence
tcataaccaagaagttaaag

SEQ ID NO: 673966 - DNA, 20 bp, Artificial
  CRISPR gRNA sequence
cataaccaagaagttaaagg

SEQ ID NO: 673967 - DNA, 20 bp, Artificial
  CRISPR gRNA sequence
ataaccaagaagttaaaggt

SEQ ID NO: 673968 - DNA, 20 bp, Artificial
  CRISPR gRNA sequence
aaggtggaaaattaatatag

SEQ ID NO: 673969 - DNA, 20 bp, Artificial
  CRISPR gRNA sequence
atatagaatactctcaagct

SEQ ID NO: 673970 - DNA, 20 bp, Artificial
  CRISPR gRNA sequence
tcaagctagttttatttgtt

SEQ ID NO: 673971 - DNA, 20 bp, Artificial
  CRISPR gRNA sequence
aagctagttttatttgtttc

SEQ ID NO: 673972 - DNA, 20 bp, Artificial
  CRISPR gRNA sequence
gttttatttgtttcttctgt

SEQ ID NO: 673973 - DNA, 20 bp, Artificial
  CRISPR gRNA sequence
tatttgtttcttctgttcat

SEQ ID NO: 673974 - DNA, 20 bp, Artificial
  CRISPR gRNA sequence
atttgtttcttctgttcata

SEQ ID NO: 673975 - DNA, 20 bp, Artificial
  CRISPR gRNA sequence
tttgtttcttctgttcataa

SEQ ID NO: 673976 - DNA, 20 bp, Artificial
  CRISPR gRNA sequence
gtttcttctgttcataatga

SEQ ID NO: 673977 - DNA, 20 bp, Artificial
  CRISPR gRNA sequence
tttcttctgttcataatgac

SEQ ID NO: 673978 - DNA, 20 bp, Artificial
  CRISPR gRNA sequence
cttctgttcataatgacata

SEQ ID NO: 673979 - DNA, 20 bp, Artificial
  CRISPR gRNA sequence
ttctgttcataatgacatac

SEQ ID NO: 673980 - DNA, 20 bp, Artificial
  CRISPR gRNA sequence
ctgttcataatgacatacta

SEQ ID NO: 673981 - DNA, 20 bp, Artificial
  CRISPR gRNA sequence
tgttcataatgacatactaa

SEQ ID NO: 673982 - DNA, 20 bp, Artificial
  CRISPR gRNA sequence
ttcataatgacatactaaat

SEQ ID NO: 673983 - DNA, 20 bp, Artificial
  CRISPR gRNA sequence
ataatgacatactaaatttt

SEQ ID NO: 673984 - DNA, 20 bp, Artificial
  CRISPR gRNA sequence
aattttaattttaatatgaa

SEQ ID NO: 673985 - DNA, 20 bp, Artificial
  CRISPR gRNA sequence
taattttaatatgaagatat

SEQ ID NO: 673986 - DNA, 20 bp, Artificial
  CRISPR gRNA sequence
aattttaatatgaagatatg

SEQ ID NO: 673987 - DNA, 20 bp, Artificial
  CRISPR gRNA sequence
attttaatatgaagatatga

SEQ ID NO: 673988 - DNA, 20 bp, Artificial
  CRISPR gRNA sequence
taatatgaagatatgatgga

SEQ ID NO: 673989 - DNA, 20 bp, Artificial
  CRISPR gRNA sequence
aatatgaagatatgatggaa

SEQ ID NO: 673990 - DNA, 20 bp, Artificial
  CRISPR gRNA sequence
atatgaagatatgatggaag

SEQ ID NO: 673991 - DNA, 20 bp, Artificial
  CRISPR gRNA sequence
taatctacattgacaaatcg

SEQ ID NO: 673992 - DNA, 20 bp, Artificial
  CRISPR gRNA sequence
aatctacattgacaaatcgt

SEQ ID NO: 673993 - DNA, 20 bp, Artificial
  CRISPR gRNA sequence
atctacattgacaaatcgta

SEQ ID NO: 673994 - DNA, 20 bp, Artificial
  CRISPR gRNA sequence
cattgacaaatcgtattaga

SEQ ID NO: 673995 - DNA, 20 bp, Artificial
  CRISPR gRNA sequence
acaaatcgtattagagagtg

SEQ ID NO: 673996 - DNA, 20 bp, Artificial
  CRISPR gRNA sequence
gagagtgctgaggttgtgag

SEQ ID NO: 673997 - DNA, 20 bp, Artificial
  CRISPR gRNA sequence
aggttgtgagataatgctta

SEQ ID NO: 673998 - DNA, 20 bp, Artificial
  CRISPR gRNA sequence
tgagataatgcttattgtat

SEQ ID NO: 673999 - DNA, 20 bp, Artificial
  CRISPR gRNA sequence
attgtattatctctctttac

SEQ ID NO: 674000 - DNA, 20 bp, Artificial
  CRISPR gRNA sequence
ttgtattatctctctttaca

SEQ ID NO: 674001 - DNA, 20 bp, Artificial
  CRISPR gRNA sequence
tattatctctctttacattt

SEQ ID NO: 674002 - DNA, 20 bp, Artificial
  CRISPR gRNA sequence
tctctctttacatttttcct

SEQ ID NO: 674003 - DNA, 20 bp, Artificial
  CRISPR gRNA sequence
tctttacatttttccttttt

SEQ ID NO: 674004 - DNA, 20 bp, Artificial
  CRISPR gRNA sequence
tttacatttttcctttttat

SEQ ID NO: 674005 - DNA, 20 bp, Artificial
  CRISPR gRNA sequence
tacatttttcctttttatcc

SEQ ID NO: 674006 - DNA, 20 bp, Artificial
  CRISPR gRNA sequence
acatttttcctttttatcct

SEQ ID NO: 674007 - DNA, 20 bp, Artificial
  CRISPR gRNA sequence
catttttcctttttatcctt

SEQ ID NO: 674008 - DNA, 20 bp, Artificial
  CRISPR gRNA sequence
ttcctttttatccttaaggc

SEQ ID NO: 674009 - DNA, 20 bp, Artificial
  CRISPR gRNA sequence
tcctttttatccttaaggct

SEQ ID NO: 674010 - DNA, 20 bp, Artificial
  CRISPR gRNA sequence
cctttttatccttaaggctg

SEQ ID NO: 674011 - DNA, 20 bp, Artificial
  CRISPR gRNA sequence
ctttttatccttaaggctgt

SEQ ID NO: 674012 - DNA, 20 bp, Artificial
  CRISPR gRNA sequence
tttatccttaaggctgtact

SEQ ID NO: 674013 - DNA, 20 bp, Artificial
  CRISPR gRNA sequence
ttatccttaaggctgtacta

SEQ ID NO: 674014 - DNA, 20 bp, Artificial
  CRISPR gRNA sequence
tatccttaaggctgtactaa

SEQ ID NO: 674015 - DNA, 20 bp, Artificial
  CRISPR gRNA sequence
atccttaaggctgtactaag

SEQ ID NO: 674016 - DNA, 20 bp, Artificial
  CRISPR gRNA sequence
tccttaaggctgtactaagt

SEQ ID NO: 674017 - DNA, 20 bp, Artificial
  CRISPR gRNA sequence
aaggctgtactaagttttta

SEQ ID NO: 674018 - DNA, 20 bp, Artificial
  CRISPR gRNA sequence
aggctgtactaagtttttaa

SEQ ID NO: 674019 - DNA, 20 bp, Artificial
  CRISPR gRNA sequence
tactaagtttttaaacatga

SEQ ID NO: 674020 - DNA, 20 bp, Artificial
  CRISPR gRNA sequence
agtttttaaacatgaatgtg

SEQ ID NO: 674021 - DNA, 20 bp, Artificial
  CRISPR gRNA sequence
ttaaacatgaatgtgaatcg

SEQ ID NO: 674022 - DNA, 20 bp, Artificial
  CRISPR gRNA sequence
taaacatgaatgtgaatcgt

SEQ ID NO: 674023 - DNA, 20 bp, Artificial
  CRISPR gRNA sequence
aaacatgaatgtgaatcgtg

SEQ ID NO: 674024 - DNA, 20 bp, Artificial
  CRISPR gRNA sequence
aacatgaatgtgaatcgtgt

SEQ ID NO: 674025 - DNA, 20 bp, Artificial
  CRISPR gRNA sequence
ttttaaacattaactcttaa

SEQ ID NO: 674026 - DNA, 20 bp, Artificial
  CRISPR gRNA sequence
taaacattaactcttaaatt

SEQ ID NO: 674027 - DNA, 20 bp, Artificial
  CRISPR gRNA sequence
aaacattaactcttaaattt

SEQ ID NO: 674028 - DNA, 20 bp, Artificial
  CRISPR gRNA sequence
aacattaactcttaaatttg

SEQ ID NO: 674029 - DNA, 20 bp, Artificial
  CRISPR gRNA sequence
actcttaaatttggggcagt

SEQ ID NO: 674030 - DNA, 20 bp, Artificial
  CRISPR gRNA sequence
ttaaatttggggcagttaca

SEQ ID NO: 674031 - DNA, 20 bp, Artificial
  CRISPR gRNA sequence
aaatttggggcagttacaaa

SEQ ID NO: 674032 - DNA, 20 bp, Artificial
  CRISPR gRNA sequence
aatttggggcagttacaaaa

SEQ ID NO: 674033 - DNA, 20 bp, Artificial
  CRISPR gRNA sequence
ggggcagttacaaaaaaatt

SEQ ID NO: 674034 - DNA, 20 bp, Artificial
  CRISPR gRNA sequence
gggcagttacaaaaaaatta

SEQ ID NO: 674035 - DNA, 20 bp, Artificial
  CRISPR gRNA sequence
caaaaaaattaaattaatgc

SEQ ID NO: 674036 - DNA, 20 bp, Artificial
  CRISPR gRNA sequence
aattaatgcaaacacgaaaa

SEQ ID NO: 674037 - DNA, 20 bp, Artificial
  CRISPR gRNA sequence
atgcaaacacgaaaacaaaa

SEQ ID NO: 674038 - DNA, 20 bp, Artificial
  CRISPR gRNA sequence
taagtatatatttttctttc

SEQ ID NO: 674039 - DNA, 20 bp, Artificial
  CRISPR gRNA sequence
aagtatatatttttctttcc

SEQ ID NO: 674040 - DNA, 20 bp, Artificial
  CRISPR gRNA sequence
agtatatatttttctttcct

SEQ ID NO: 674041 - DNA, 20 bp, Artificial
  CRISPR gRNA sequence
ttctttcctccctgagttaa

SEQ ID NO: 674042 - DNA, 20 bp, Artificial
  CRISPR gRNA sequence
tctttcctccctgagttaaa

SEQ ID NO: 674043 - DNA, 20 bp, Artificial
  CRISPR gRNA sequence
ctttcctccctgagttaaag

SEQ ID NO: 674044 - DNA, 20 bp, Artificial
  CRISPR gRNA sequence
tttcctccctgagttaaagg

SEQ ID NO: 674045 - DNA, 20 bp, Artificial
  CRISPR gRNA sequence
tcctccctgagttaaaggaa

SEQ ID NO: 674046 - DNA, 20 bp, Artificial
  CRISPR gRNA sequence
cctccctgagttaaaggaat

SEQ ID NO: 674047 - DNA, 20 bp, Artificial
  CRISPR gRNA sequence
ctccctgagttaaaggaatt

SEQ ID NO: 674048 - DNA, 20 bp, Artificial
  CRISPR gRNA sequence
cctgagttaaaggaattcac

SEQ ID NO: 674049 - DNA, 20 bp, Artificial
  CRISPR gRNA sequence
agttaaaggaattcacttac

SEQ ID NO: 674050 - DNA, 20 bp, Artificial
  CRISPR gRNA sequence
aaggaattcacttacttcca

SEQ ID NO: 674051 - DNA, 20 bp, Artificial
  CRISPR gRNA sequence
acttacttccaactacaaca

SEQ ID NO: 674052 - DNA, 20 bp, Artificial
  CRISPR gRNA sequence
acttccaactacaacatttt

SEQ ID NO: 674053 - DNA, 20 bp, Artificial
  CRISPR gRNA sequence
cttccaactacaacatttta

SEQ ID NO: 674054 - DNA, 20 bp, Artificial
  CRISPR gRNA sequence
ccaactacaacattttatgt

SEQ ID NO: 674055 - DNA, 20 bp, Artificial
  CRISPR gRNA sequence
caactacaacattttatgtt

SEQ ID NO: 674056 - DNA, 20 bp, Artificial
  CRISPR gRNA sequence
caacattttatgttttattt

SEQ ID NO: 674057 - DNA, 20 bp, Artificial
  CRISPR gRNA sequence
tatgttttattttaaaattg

SEQ ID NO: 674058 - DNA, 20 bp, Artificial
  CRISPR gRNA sequence
atgttttattttaaaattgt

SEQ ID NO: 674059 - DNA, 20 bp, Artificial
  CRISPR gRNA sequence
tgttttattttaaaattgtg

SEQ ID NO: 674060 - DNA, 20 bp, Artificial
  CRISPR gRNA sequence
tattttaaaattgtgctatc

SEQ ID NO: 674061 - DNA, 20 bp, Artificial
  CRISPR gRNA sequence
attttaaaattgtgctatca

SEQ ID NO: 674062 - DNA, 20 bp, Artificial
  CRISPR gRNA sequence
ttttaaaattgtgctatcaa

SEQ ID NO: 674063 - DNA, 20 bp, Artificial
  CRISPR gRNA sequence
taaaattgtgctatcaaaat

SEQ ID NO: 674064 - DNA, 20 bp, Artificial
  CRISPR gRNA sequence
aaaattgtgctatcaaaatt

SEQ ID NO: 674065 - DNA, 20 bp, Artificial
  CRISPR gRNA sequence
aaattgtgctatcaaaatta

SEQ ID NO: 674066 - DNA, 20 bp, Artificial
  CRISPR gRNA sequence
tgctatcaaaattatatctt

SEQ ID NO: 674067 - DNA, 20 bp, Artificial
  CRISPR gRNA sequence
tcaaaattatatcttaaagc

SEQ ID NO: 674068 - DNA, 20 bp, Artificial
  CRISPR gRNA sequence
tatcttaaagcagtgttttc

SEQ ID NO: 674069 - DNA, 20 bp, Artificial
  CRISPR gRNA sequence
aaagcagtgttttcttatga

SEQ ID NO: 674070 - DNA, 20 bp, Artificial
  CRISPR gRNA sequence
aagcagtgttttcttatgaa

SEQ ID NO: 674071 - DNA, 20 bp, Artificial
  CRISPR gRNA sequence
tcttatgaaaagttctttat

SEQ ID NO: 674072 - DNA, 20 bp, Artificial
  CRISPR gRNA sequence
cttatgaaaagttctttatt

SEQ ID NO: 674073 - DNA, 20 bp, Artificial
  CRISPR gRNA sequence
ttatgaaaagttctttattg

SEQ ID NO: 674074 - DNA, 20 bp, Artificial
  CRISPR gRNA sequence
atgaaaagttctttattgaa

SEQ ID NO: 674075 - DNA, 20 bp, Artificial
  CRISPR gRNA sequence
tgaaaagttctttattgaaa

SEQ ID NO: 674076 - DNA, 20 bp, Artificial
  CRISPR gRNA sequence
tttattgaaatatacttcta

SEQ ID NO: 674077 - DNA, 20 bp, Artificial
  CRISPR gRNA sequence
tattgaaatatacttctagg

SEQ ID NO: 674078 - DNA, 20 bp, Artificial
  CRISPR gRNA sequence
attgaaatatacttctagga

SEQ ID NO: 674079 - DNA, 20 bp, Artificial
  CRISPR gRNA sequence
ttgaaatatacttctaggac

SEQ ID NO: 674080 - DNA, 20 bp, Artificial
  CRISPR gRNA sequence
aaatatacttctaggacatg

SEQ ID NO: 674081 - DNA, 20 bp, Artificial
  CRISPR gRNA sequence
ctaggacatgataggcattt

SEQ ID NO: 674082 - DNA, 20 bp, Artificial
  CRISPR gRNA sequence
taggacatgataggcatttc

SEQ ID NO: 674083 - DNA, 20 bp, Artificial
  CRISPR gRNA sequence
ggacatgataggcatttcca

SEQ ID NO: 674084 - DNA, 20 bp, Artificial
  CRISPR gRNA sequence
ccattagcttgtcatgtact

SEQ ID NO: 674085 - DNA, 20 bp, Artificial
  CRISPR gRNA sequence
cattagcttgtcatgtactc

SEQ ID NO: 674086 - DNA, 20 bp, Artificial
  CRISPR gRNA sequence
gcttgtcatgtactctagcc

SEQ ID NO: 674087 - DNA, 20 bp, Artificial
  CRISPR gRNA sequence
gtcatgtactctagccagag

SEQ ID NO: 674088 - DNA, 20 bp, Artificial
  CRISPR gRNA sequence
tcatgtactctagccagagt

SEQ ID NO: 674089 - DNA, 20 bp, Artificial
  CRISPR gRNA sequence
tagccagagttaaattatta

SEQ ID NO: 674090 - DNA, 20 bp, Artificial
  CRISPR gRNA sequence
gccagagttaaattattatt

SEQ ID NO: 674091 - DNA, 20 bp, Artificial
  CRISPR gRNA sequence
aattattattgagttgtcca

SEQ ID NO: 674092 - DNA, 20 bp, Artificial
  CRISPR gRNA sequence
ttattgagttgtccaaacat

SEQ ID NO: 674093 - DNA, 20 bp, Artificial
  CRISPR gRNA sequence
ttgagttgtccaaacattat

SEQ ID NO: 674094 - DNA, 20 bp, Artificial
  CRISPR gRNA sequence
agttgtccaaacattatata

SEQ ID NO: 674095 - DNA, 20 bp, Artificial
  CRISPR gRNA sequence
tccaaacattatataacaaa

SEQ ID NO: 674096 - DNA, 20 bp, Artificial
  CRISPR gRNA sequence
tataacaaatagatcttcgt

SEQ ID NO: 674097 - DNA, 20 bp, Artificial
  CRISPR gRNA sequence
cgtgaacatatagttttgcc

SEQ ID NO: 674098 - DNA, 20 bp, Artificial
  CRISPR gRNA sequence
gtgaacatatagttttgcct

SEQ ID NO: 674099 - DNA, 20 bp, Artificial
  CRISPR gRNA sequence
tgcctcaacttcatgtaata

SEQ ID NO: 674100 - DNA, 20 bp, Artificial
  CRISPR gRNA sequence
gcctcaacttcatgtaataa

SEQ ID NO: 674101 - DNA, 20 bp, Artificial
  CRISPR gRNA sequence
cctcaacttcatgtaataaa

SEQ ID NO: 674102 - DNA, 20 bp, Artificial
  CRISPR gRNA sequence
aacttcatgtaataaataac

SEQ ID NO: 674103 - DNA, 20 bp, Artificial
  CRISPR gRNA sequence
catgtaataaataactttaa

SEQ ID NO: 674104 - DNA, 20 bp, Artificial
  CRISPR gRNA sequence
atgtaataaataactttaaa

SEQ ID NO: 674105 - DNA, 20 bp, Artificial
  CRISPR gRNA sequence
taaacatccatcttattttt

SEQ ID NO: 674106 - DNA, 20 bp, Artificial
  CRISPR gRNA sequence
aaacatccatcttatttttg

SEQ ID NO: 674107 - DNA, 20 bp, Artificial
  CRISPR gRNA sequence
aacatccatcttatttttgt

SEQ ID NO: 674108 - DNA, 20 bp, Artificial
  CRISPR gRNA sequence
atttttgttgaaatcatgtt

SEQ ID NO: 674109 - DNA, 20 bp, Artificial
  CRISPR gRNA sequence
tttttgttgaaatcatgttg

SEQ ID NO: 674110 - DNA, 20 bp, Artificial
  CRISPR gRNA sequence
ttgttgaaatcatgttgttt

SEQ ID NO: 674111 - DNA, 20 bp, Artificial
  CRISPR gRNA sequence
tgttgaaatcatgttgtttt

SEQ ID NO: 674112 - DNA, 20 bp, Artificial
  CRISPR gRNA sequence
gttgaaatcatgttgttttt

SEQ ID NO: 674113 - DNA, 20 bp, Artificial
  CRISPR gRNA sequence
ttgaaatcatgttgttttta

SEQ ID NO: 674114 - DNA, 20 bp, Artificial
  CRISPR gRNA sequence
aaatcatgttgtttttaata

SEQ ID NO: 674115 - DNA, 20 bp, Artificial
  CRISPR gRNA sequence
tttttaatatcatggttttg

SEQ ID NO: 674116 - DNA, 20 bp, Artificial
  CRISPR gRNA sequence
ttaatatcatggttttgtgt

SEQ ID NO: 674117 - DNA, 20 bp, Artificial
  CRISPR gRNA sequence
taatatcatggttttgtgtg

SEQ ID NO: 674118 - DNA, 20 bp, Artificial
  CRISPR gRNA sequence
aatatcatggttttgtgtgt

SEQ ID NO: 674119 - DNA, 20 bp, Artificial
  CRISPR gRNA sequence
atatcatggttttgtgtgta

SEQ ID NO: 674120 - DNA, 20 bp, Artificial
  CRISPR gRNA sequence
tgtgtgtacatattatgtta

SEQ ID NO: 674121 - DNA, 20 bp, Artificial
  CRISPR gRNA sequence
gtgtgtacatattatgttat

SEQ ID NO: 674122 - DNA, 20 bp, Artificial
  CRISPR gRNA sequence
tgtgtacatattatgttatc

SEQ ID NO: 674123 - DNA, 20 bp, Artificial
  CRISPR gRNA sequence
tgttatctgtcttcataaac

SEQ ID NO: 674124 - DNA, 20 bp, Artificial
  CRISPR gRNA sequence
tctgtcttcataaacaaaga

SEQ ID NO: 674125 - DNA, 20 bp, Artificial
  CRISPR gRNA sequence
tcttcataaacaaagacatg

SEQ ID NO: 674126 - DNA, 20 bp, Artificial
  CRISPR gRNA sequence
cataaacaaagacatggtcc

SEQ ID NO: 674127 - DNA, 20 bp, Artificial
  CRISPR gRNA sequence
ataaacaaagacatggtcct

SEQ ID NO: 674128 - DNA, 20 bp, Artificial
  CRISPR gRNA sequence
ataactgccatcgtgctcat

SEQ ID NO: 674129 - DNA, 20 bp, Artificial
  CRISPR gRNA sequence
taactgccatcgtgctcatt

SEQ ID NO: 674130 - DNA, 20 bp, Artificial
  CRISPR gRNA sequence
ccatcgtgctcattttgcaa

SEQ ID NO: 674131 - DNA, 20 bp, Artificial
  CRISPR gRNA sequence
attttgcaatttagtatatc

SEQ ID NO: 674132 - DNA, 20 bp, Artificial
  CRISPR gRNA sequence
tgcaatttagtatatcaagt

SEQ ID NO: 674133 - DNA, 20 bp, Artificial
  CRISPR gRNA sequence
gcaatttagtatatcaagtt

SEQ ID NO: 674134 - DNA, 20 bp, Artificial
  CRISPR gRNA sequence
caatttagtatatcaagtta

SEQ ID NO: 674135 - DNA, 20 bp, Artificial
  CRISPR gRNA sequence
agtatatcaagttatgattt

SEQ ID NO: 674136 - DNA, 20 bp, Artificial
  CRISPR gRNA sequence
gtatatcaagttatgatttt

SEQ ID NO: 674137 - DNA, 20 bp, Artificial
  CRISPR gRNA sequence
tgatttttgcagatatataa

SEQ ID NO: 674138 - DNA, 20 bp, Artificial
  CRISPR gRNA sequence
ttgcagatatataaatagat

SEQ ID NO: 674139 - DNA, 20 bp, Artificial
  CRISPR gRNA sequence
tgcagatatataaatagata

SEQ ID NO: 674140 - DNA, 20 bp, Artificial
  CRISPR gRNA sequence
gcagatatataaatagatat

SEQ ID NO: 674141 - DNA, 20 bp, Artificial
  CRISPR gRNA sequence
cagatatataaatagatata

SEQ ID NO: 674142 - DNA, 20 bp, Artificial
  CRISPR gRNA sequence
aaattgggtaattcaagaga

SEQ ID NO: 674143 - DNA, 20 bp, Artificial
  CRISPR gRNA sequence
ggtaattcaagagagtttaa

SEQ ID NO: 674144 - DNA, 20 bp, Artificial
  CRISPR gRNA sequence
aagagagtttaatggagtcc

SEQ ID NO: 674145 - DNA, 20 bp, Artificial
  CRISPR gRNA sequence
aatggagtccctattggaga

SEQ ID NO: 674146 - DNA, 20 bp, Artificial
  CRISPR gRNA sequence
atggagtccctattggagag

SEQ ID NO: 674147 - DNA, 20 bp, Artificial
  CRISPR gRNA sequence
ttggagagggggcatccagc

SEQ ID NO: 674148 - DNA, 20 bp, Artificial
  CRISPR gRNA sequence
gagagggggcatccagctac

SEQ ID NO: 674149 - DNA, 20 bp, Artificial
  CRISPR gRNA sequence
ctgcatcaccaagagctgat

SEQ ID NO: 674150 - DNA, 20 bp, Artificial
  CRISPR gRNA sequence
catcaccaagagctgatacc

SEQ ID NO: 674151 - DNA, 20 bp, Artificial
  CRISPR gRNA sequence
ataccaattcaatcatgctt

SEQ ID NO: 674152 - DNA, 20 bp, Artificial
  CRISPR gRNA sequence
aatcatgcttccaattggaa

SEQ ID NO: 674153 - DNA, 20 bp, Artificial
  CRISPR gRNA sequence
ccaattggaatctaaaatac

SEQ ID NO: 674154 - DNA, 20 bp, Artificial
  CRISPR gRNA sequence
caattggaatctaaaatact

SEQ ID NO: 674155 - DNA, 20 bp, Artificial
  CRISPR gRNA sequence
gaatctaaaatactagccat

SEQ ID NO: 674156 - DNA, 20 bp, Artificial
  CRISPR gRNA sequence
aaatactagccatccctaat

SEQ ID NO: 674157 - DNA, 20 bp, Artificial
  CRISPR gRNA sequence
gccatccctaattttcttca

SEQ ID NO: 674158 - DNA, 20 bp, Artificial
  CRISPR gRNA sequence
attttcttcataatagatag

SEQ ID NO: 674159 - DNA, 20 bp, Artificial
  CRISPR gRNA sequence
tcttcataatagatagaaca

SEQ ID NO: 674160 - DNA, 20 bp, Artificial
  CRISPR gRNA sequence
cttcataatagatagaacat

SEQ ID NO: 674161 - DNA, 20 bp, Artificial
  CRISPR gRNA sequence
ttcataatagatagaacata

SEQ ID NO: 674162 - DNA, 20 bp, Artificial
  CRISPR gRNA sequence
cataatagatagaacataaa

SEQ ID NO: 674163 - DNA, 20 bp, Artificial
  CRISPR gRNA sequence
ataatagatagaacataaaa

SEQ ID NO: 674164 - DNA, 20 bp, Artificial
  CRISPR gRNA sequence
ctacagtttttgctcctcta

SEQ ID NO: 674165 - DNA, 20 bp, Artificial
  CRISPR gRNA sequence
cagtttttgctcctctaagt

SEQ ID NO: 674166 - DNA, 20 bp, Artificial
  CRISPR gRNA sequence
ttgctcctctaagttgccag

SEQ ID NO: 674167 - DNA, 20 bp, Artificial
  CRISPR gRNA sequence
tgctcctctaagttgccaga

SEQ ID NO: 674168 - DNA, 20 bp, Artificial
  CRISPR gRNA sequence
gctcctctaagttgccagaa

SEQ ID NO: 674169 - DNA, 20 bp, Artificial
  CRISPR gRNA sequence
ctcctctaagttgccagaaa

SEQ ID NO: 674170 - DNA, 20 bp, Artificial
  CRISPR gRNA sequence
ctctaagttgccagaaagct

SEQ ID NO: 674171 - DNA, 20 bp, Artificial
  CRISPR gRNA sequence
taagttgccagaaagctcaa

SEQ ID NO: 674172 - DNA, 20 bp, Artificial
  CRISPR gRNA sequence
agttgccagaaagctcaaaa

SEQ ID NO: 674173 - DNA, 20 bp, Artificial
  CRISPR gRNA sequence
ccagaaagctcaaaattgat

SEQ ID NO: 674174 - DNA, 20 bp, Artificial
  CRISPR gRNA sequence
aaaattgatcattatagtgt

SEQ ID NO: 674175 - DNA, 20 bp, Artificial
  CRISPR gRNA sequence
atcattatagtgttcttctt

SEQ ID NO: 674176 - DNA, 20 bp, Artificial
  CRISPR gRNA sequence
tagtgttcttcttccaatca

SEQ ID NO: 674177 - DNA, 20 bp, Artificial
  CRISPR gRNA sequence
ttcttccaatcaaatacatc

SEQ ID NO: 674178 - DNA, 20 bp, Artificial
  CRISPR gRNA sequence
cttccaatcaaatacatctt

SEQ ID NO: 674179 - DNA, 20 bp, Artificial
  CRISPR gRNA sequence
ttccaatcaaatacatcttc

SEQ ID NO: 674180 - DNA, 20 bp, Artificial
  CRISPR gRNA sequence
ccaatcaaatacatcttccc

SEQ ID NO: 674181 - DNA, 20 bp, Artificial
  CRISPR gRNA sequence
caatcaaatacatcttcccc

SEQ ID NO: 674182 - DNA, 20 bp, Artificial
  CRISPR gRNA sequence
ccccttactcttactctgtt

SEQ ID NO: 674183 - DNA, 20 bp, Artificial
  CRISPR gRNA sequence
cccttactcttactctgttt

SEQ ID NO: 674184 - DNA, 20 bp, Artificial
  CRISPR gRNA sequence
actcttactctgtttagcac

SEQ ID NO: 674185 - DNA, 20 bp, Artificial
  CRISPR gRNA sequence
ctcttactctgtttagcaca

SEQ ID NO: 674186 - DNA, 20 bp, Artificial
  CRISPR gRNA sequence
ttactctgtttagcacatcg

SEQ ID NO: 674187 - DNA, 20 bp, Artificial
  CRISPR gRNA sequence
actctgtttagcacatcggc

SEQ ID NO: 674188 - DNA, 20 bp, Artificial
  CRISPR gRNA sequence
ctctgtttagcacatcggct

SEQ ID NO: 674189 - DNA, 20 bp, Artificial
  CRISPR gRNA sequence
tgtttagcacatcggctaaa

SEQ ID NO: 674190 - DNA, 20 bp, Artificial
  CRISPR gRNA sequence
tttagcacatcggctaaata

SEQ ID NO: 674191 - DNA, 20 bp, Artificial
  CRISPR gRNA sequence
agcacatcggctaaataagg

SEQ ID NO: 674192 - DNA, 20 bp, Artificial
  CRISPR gRNA sequence
gcacatcggctaaataaggt

SEQ ID NO: 674193 - DNA, 20 bp, Artificial
  CRISPR gRNA sequence
aataaggttctttatctgat

SEQ ID NO: 674194 - DNA, 20 bp, Artificial
  CRISPR gRNA sequence
tttatctgataggtgactaa

SEQ ID NO: 674195 - DNA, 20 bp, Artificial
  CRISPR gRNA sequence
tatctgataggtgactaaaa

SEQ ID NO: 674196 - DNA, 20 bp, Artificial
  CRISPR gRNA sequence
atctgataggtgactaaaat

SEQ ID NO: 674197 - DNA, 20 bp, Artificial
  CRISPR gRNA sequence
tctgataggtgactaaaatt

SEQ ID NO: 674198 - DNA, 20 bp, Artificial
  CRISPR gRNA sequence
ataggtgactaaaattttat

SEQ ID NO: 674199 - DNA, 20 bp, Artificial
  CRISPR gRNA sequence
aaattttataggttctgagt

SEQ ID NO: 674200 - DNA, 20 bp, Artificial
  CRISPR gRNA sequence
tataggttctgagtcttcgg

SEQ ID NO: 674201 - DNA, 20 bp, Artificial
  CRISPR gRNA sequence
ataggttctgagtcttcggt

SEQ ID NO: 674202 - DNA, 20 bp, Artificial
  CRISPR gRNA sequence
taggttctgagtcttcggtg

SEQ ID NO: 674203 - DNA, 20 bp, Artificial
  CRISPR gRNA sequence
tgagtcttcggtggtcctgt

SEQ ID NO: 674204 - DNA, 20 bp, Artificial
  CRISPR gRNA sequence
agtcttcggtggtcctgtct

SEQ ID NO: 674205 - DNA, 20 bp, Artificial
  CRISPR gRNA sequence
cggtggtcctgtctttctta

SEQ ID NO: 674206 - DNA, 20 bp, Artificial
  CRISPR gRNA sequence
ggtggtcctgtctttcttat

SEQ ID NO: 674207 - DNA, 20 bp, Artificial
  CRISPR gRNA sequence
tctttcttatattactataa

SEQ ID NO: 674208 - DNA, 20 bp, Artificial
  CRISPR gRNA sequence
tcttatattactataatttt

SEQ ID NO: 674209 - DNA, 20 bp, Artificial
  CRISPR gRNA sequence
cttatattactataattttt

SEQ ID NO: 674210 - DNA, 20 bp, Artificial
  CRISPR gRNA sequence
ttatattactataatttttc

SEQ ID NO: 674211 - DNA, 20 bp, Artificial
  CRISPR gRNA sequence
atattactataatttttcaa

SEQ ID NO: 674212 - DNA, 20 bp, Artificial
  CRISPR gRNA sequence
tattactataatttttcaat

SEQ ID NO: 674213 - DNA, 20 bp, Artificial
  CRISPR gRNA sequence
ctataatttttcaataacca

SEQ ID NO: 674214 - DNA, 20 bp, Artificial
  CRISPR gRNA sequence
taatttttcaataaccaaaa

SEQ ID NO: 674215 - DNA, 20 bp, Artificial
  CRISPR gRNA sequence
ttcaataaccaaaattatga

SEQ ID NO: 674216 - DNA, 20 bp, Artificial
  CRISPR gRNA sequence
tcaataaccaaaattatgag

SEQ ID NO: 674217 - DNA, 20 bp, Artificial
  CRISPR gRNA sequence
caataaccaaaattatgagg

SEQ ID NO: 674218 - DNA, 20 bp, Artificial
  CRISPR gRNA sequence
aataaccaaaattatgaggt

SEQ ID NO: 674219 - DNA, 20 bp, Artificial
  CRISPR gRNA sequence
tgaggtaagtatttctaaag

SEQ ID NO: 674220 - DNA, 20 bp, Artificial
  CRISPR gRNA sequence
ctaaagagatgccccagtaa

SEQ ID NO: 674221 - DNA, 20 bp, Artificial
  CRISPR gRNA sequence
taaagagatgccccagtaaa

SEQ ID NO: 674222 - DNA, 20 bp, Artificial
  CRISPR gRNA sequence
aagagatgccccagtaaatc

SEQ ID NO: 674223 - DNA, 20 bp, Artificial
  CRISPR gRNA sequence
agttccaagcatagttcttc

SEQ ID NO: 674224 - DNA, 20 bp, Artificial
  CRISPR gRNA sequence
caagcatagttcttcttgtc

SEQ ID NO: 674225 - DNA, 20 bp, Artificial
  CRISPR gRNA sequence
ttcttgtcctcattgtatag

SEQ ID NO: 674226 - DNA, 20 bp, Artificial
  CRISPR gRNA sequence
cttgtcctcattgtatagca

SEQ ID NO: 674227 - DNA, 20 bp, Artificial
  CRISPR gRNA sequence
ttgtcctcattgtatagcaa

SEQ ID NO: 674228 - DNA, 20 bp, Artificial
  CRISPR gRNA sequence
gtcctcattgtatagcaaca

SEQ ID NO: 674229 - DNA, 20 bp, Artificial
  CRISPR gRNA sequence
tcctcattgtatagcaacag

SEQ ID NO: 674230 - DNA, 20 bp, Artificial
  CRISPR gRNA sequence
attgtatagcaacagctcca

SEQ ID NO: 674231 - DNA, 20 bp, Artificial
  CRISPR gRNA sequence
tatagcaacagctccaaatc

SEQ ID NO: 674232 - DNA, 20 bp, Artificial
  CRISPR gRNA sequence
caaatcattctggtagtctg

SEQ ID NO: 674233 - DNA, 20 bp, Artificial
  CRISPR gRNA sequence
tggtagtctggaaaaattat

SEQ ID NO: 674234 - DNA, 20 bp, Artificial
  CRISPR gRNA sequence
gtagtctggaaaaattataa

SEQ ID NO: 674235 - DNA, 20 bp, Artificial
  CRISPR gRNA sequence
gaaaaattataagccagtcc

SEQ ID NO: 674236 - DNA, 20 bp, Artificial
  CRISPR gRNA sequence
taagccagtccctgtttatt

SEQ ID NO: 674237 - DNA, 20 bp, Artificial
  CRISPR gRNA sequence
tttatttagcagcttgacat

SEQ ID NO: 674238 - DNA, 20 bp, Artificial
  CRISPR gRNA sequence
atttagcagcttgacatgcc

SEQ ID NO: 674239 - DNA, 20 bp, Artificial
  CRISPR gRNA sequence
tttagcagcttgacatgccc

SEQ ID NO: 674240 - DNA, 20 bp, Artificial
  CRISPR gRNA sequence
agcagcttgacatgcccaaa

SEQ ID NO: 674241 - DNA, 20 bp, Artificial
  CRISPR gRNA sequence
gcagcttgacatgcccaaaa

SEQ ID NO: 674242 - DNA, 20 bp, Artificial
  CRISPR gRNA sequence
gacatgcccaaaatagctag

SEQ ID NO: 674243 - DNA, 20 bp, Artificial
  CRISPR gRNA sequence
acatgcccaaaatagctagt

SEQ ID NO: 674244 - DNA, 20 bp, Artificial
  CRISPR gRNA sequence
gtgagtattctcagcttcca

SEQ ID NO: 674245 - DNA, 20 bp, Artificial
  CRISPR gRNA sequence
tcagcttccaatacaacagg

SEQ ID NO: 674246 - DNA, 20 bp, Artificial
  CRISPR gRNA sequence
agcttccaatacaacaggac

SEQ ID NO: 674247 - DNA, 20 bp, Artificial
  CRISPR gRNA sequence
ccaatacaacaggaccagat

SEQ ID NO: 674248 - DNA, 20 bp, Artificial
  CRISPR gRNA sequence
caatacaacaggaccagatc

SEQ ID NO: 674249 - DNA, 20 bp, Artificial
  CRISPR gRNA sequence
tgaaacctggagaaaacatt

SEQ ID NO: 674250 - DNA, 20 bp, Artificial
  CRISPR gRNA sequence
aaacctggagaaaacattct

SEQ ID NO: 674251 - DNA, 20 bp, Artificial
  CRISPR gRNA sequence
gagaaaacattcttcttttg

SEQ ID NO: 674252 - DNA, 20 bp, Artificial
  CRISPR gRNA sequence
ttcttttgggaactgagatc

SEQ ID NO: 674253 - DNA, 20 bp, Artificial
  CRISPR gRNA sequence
cttttgggaactgagatctc

SEQ ID NO: 674254 - DNA, 20 bp, Artificial
  CRISPR gRNA sequence
ttttgggaactgagatctcc

SEQ ID NO: 674255 - DNA, 20 bp, Artificial
  CRISPR gRNA sequence
ttgggaactgagatctccaa

SEQ ID NO: 674256 - DNA, 20 bp, Artificial
  CRISPR gRNA sequence
tgggaactgagatctccaaa

SEQ ID NO: 674257 - DNA, 20 bp, Artificial
  CRISPR gRNA sequence
gggaactgagatctccaaaa

SEQ ID NO: 674258 - DNA, 20 bp, Artificial
  CRISPR gRNA sequence
ggaactgagatctccaaaac

SEQ ID NO: 674259 - DNA, 20 bp, Artificial
  CRISPR gRNA sequence
agatctccaaaaccaccaat

SEQ ID NO: 674260 - DNA, 20 bp, Artificial
  CRISPR gRNA sequence
caaaaccaccaatctgaagg

SEQ ID NO: 674261 - DNA, 20 bp, Artificial
  CRISPR gRNA sequence
aaggtttcaggacacagagt

SEQ ID NO: 674262 - DNA, 20 bp, Artificial
  CRISPR gRNA sequence
caggacacagagtaaaaagc

SEQ ID NO: 674263 - DNA, 20 bp, Artificial
  CRISPR gRNA sequence
aggacacagagtaaaaagcc

SEQ ID NO: 674264 - DNA, 20 bp, Artificial
  CRISPR gRNA sequence
taaatgggttatttgatgtt

SEQ ID NO: 674265 - DNA, 20 bp, Artificial
  CRISPR gRNA sequence
aaatgggttatttgatgtta

SEQ ID NO: 674266 - DNA, 20 bp, Artificial
  CRISPR gRNA sequence
aatgggttatttgatgttat

SEQ ID NO: 674267 - DNA, 20 bp, Artificial
  CRISPR gRNA sequence
tttgatgttattagagtggc

SEQ ID NO: 674268 - DNA, 20 bp, Artificial
  CRISPR gRNA sequence
gatgttattagagtggccac

SEQ ID NO: 674269 - DNA, 20 bp, Artificial
  CRISPR gRNA sequence
atgttattagagtggccacc

SEQ ID NO: 674270 - DNA, 20 bp, Artificial
  CRISPR gRNA sequence
ttagagtggccacctctacc

SEQ ID NO: 674271 - DNA, 20 bp, Artificial
  CRISPR gRNA sequence
gagtggccacctctacctta

SEQ ID NO: 674272 - DNA, 20 bp, Artificial
  CRISPR gRNA sequence
taccttaacctctttgttct

SEQ ID NO: 674273 - DNA, 20 bp, Artificial
  CRISPR gRNA sequence
ccttaacctctttgttctca

SEQ ID NO: 674274 - DNA, 20 bp, Artificial
  CRISPR gRNA sequence
aacctctttgttctcagact

SEQ ID NO: 674275 - DNA, 20 bp, Artificial
  CRISPR gRNA sequence
acctctttgttctcagactc

SEQ ID NO: 674276 - DNA, 20 bp, Artificial
  CRISPR gRNA sequence
tttgttctcagactcatgcc

SEQ ID NO: 674277 - DNA, 20 bp, Artificial
  CRISPR gRNA sequence
tgttctcagactcatgcctt

SEQ ID NO: 674278 - DNA, 20 bp, Artificial
  CRISPR gRNA sequence
gttctcagactcatgccttc

SEQ ID NO: 674279 - DNA, 20 bp, Artificial
  CRISPR gRNA sequence
ttctcagactcatgccttct

SEQ ID NO: 674280 - DNA, 20 bp, Artificial
  CRISPR gRNA sequence
tcagactcatgccttctggc

SEQ ID NO: 674281 - DNA, 20 bp, Artificial
  CRISPR gRNA sequence
agactcatgccttctggcta

SEQ ID NO: 674282 - DNA, 20 bp, Artificial
  CRISPR gRNA sequence
atgccttctggctatggagg

SEQ ID NO: 674283 - DNA, 20 bp, Artificial
  CRISPR gRNA sequence
ctggctatggaggagatgat

SEQ ID NO: 674284 - DNA, 20 bp, Artificial
  CRISPR gRNA sequence
tggctatggaggagatgatg

SEQ ID NO: 674285 - DNA, 20 bp, Artificial
  CRISPR gRNA sequence
gctatggaggagatgatgtt

SEQ ID NO: 674286 - DNA, 20 bp, Artificial
  CRISPR gRNA sequence
tggaggagatgatgttggcc

SEQ ID NO: 674287 - DNA, 20 bp, Artificial
  CRISPR gRNA sequence
gccatatataatatcctgta

SEQ ID NO: 674288 - DNA, 20 bp, Artificial
  CRISPR gRNA sequence
tagaacacacccaaactcct

SEQ ID NO: 674289 - DNA, 20 bp, Artificial
  CRISPR gRNA sequence
ctcccagctggcaaccatac

SEQ ID NO: 674290 - DNA, 20 bp, Artificial
  CRISPR gRNA sequence
ccagctggcaaccatacatg

SEQ ID NO: 674291 - DNA, 20 bp, Artificial
  CRISPR gRNA sequence
gcaaccatacatgaaccact

SEQ ID NO: 674292 - DNA, 20 bp, Artificial
  CRISPR gRNA sequence
ctttggtaggccatttcacc

SEQ ID NO: 674293 - DNA, 20 bp, Artificial
  CRISPR gRNA sequence
tggtaggccatttcaccact

SEQ ID NO: 674294 - DNA, 20 bp, Artificial
  CRISPR gRNA sequence
ggtaggccatttcaccactc

SEQ ID NO: 674295 - DNA, 20 bp, Artificial
  CRISPR gRNA sequence
gtaggccatttcaccactcc

SEQ ID NO: 674296 - DNA, 20 bp, Artificial
  CRISPR gRNA sequence
caccactccatgtagccagc

SEQ ID NO: 674297 - DNA, 20 bp, Artificial
  CRISPR gRNA sequence
accactccatgtagccagct

SEQ ID NO: 674298 - DNA, 20 bp, Artificial
  CRISPR gRNA sequence
catgtagccagctgattctg

SEQ ID NO: 674299 - DNA, 20 bp, Artificial
  CRISPR gRNA sequence
attctgtgtggtgatacatg

SEQ ID NO: 674300 - DNA, 20 bp, Artificial
  CRISPR gRNA sequence
tgtgtggtgatacatggggt

SEQ ID NO: 674301 - DNA, 20 bp, Artificial
  CRISPR gRNA sequence
tgtggtgatacatggggtat

SEQ ID NO: 674302 - DNA, 20 bp, Artificial
  CRISPR gRNA sequence
tatagatttgcgctaattgt

SEQ ID NO: 674303 - DNA, 20 bp, Artificial
  CRISPR gRNA sequence
tagatttgcgctaattgtat

SEQ ID NO: 674304 - DNA, 20 bp, Artificial
  CRISPR gRNA sequence
gcgctaattgtatttgtctt

SEQ ID NO: 674305 - DNA, 20 bp, Artificial
  CRISPR gRNA sequence
cgctaattgtatttgtcttg

SEQ ID NO: 674306 - DNA, 20 bp, Artificial
  CRISPR gRNA sequence
attgtatttgtcttgccata

SEQ ID NO: 674307 - DNA, 20 bp, Artificial
  CRISPR gRNA sequence
tatttgtcttgccataaaaa

SEQ ID NO: 674308 - DNA, 20 bp, Artificial
  CRISPR gRNA sequence
gtcttgccataaaaaggagt

SEQ ID NO: 674309 - DNA, 20 bp, Artificial
  CRISPR gRNA sequence
tcttgccataaaaaggagtt

SEQ ID NO: 674310 - DNA, 20 bp, Artificial
  CRISPR gRNA sequence
gccataaaaaggagtttcct

SEQ ID NO: 674311 - DNA, 20 bp, Artificial
  CRISPR gRNA sequence
ccataaaaaggagtttcctg

SEQ ID NO: 674312 - DNA, 20 bp, Artificial
  CRISPR gRNA sequence
cctggttgaaggcagtatag

SEQ ID NO: 674313 - DNA, 20 bp, Artificial
  CRISPR gRNA sequence
ctggttgaaggcagtatagc

SEQ ID NO: 674314 - DNA, 20 bp, Artificial
  CRISPR gRNA sequence
gttgaaggcagtatagcaag

SEQ ID NO: 674315 - DNA, 20 bp, Artificial
  CRISPR gRNA sequence
aaggcagtatagcaaggaat

SEQ ID NO: 674316 - DNA, 20 bp, Artificial
  CRISPR gRNA sequence
gtaaggcattctgttaaatc

SEQ ID NO: 674317 - DNA, 20 bp, Artificial
  CRISPR gRNA sequence
tgttaaatccatatttgagg

SEQ ID NO: 674318 - DNA, 20 bp, Artificial
  CRISPR gRNA sequence
ttaaatccatatttgaggga

SEQ ID NO: 674319 - DNA, 20 bp, Artificial
  CRISPR gRNA sequence
aatccatatttgagggagct

SEQ ID NO: 674320 - DNA, 20 bp, Artificial
  CRISPR gRNA sequence
gagggagcttgcaaaaatat

SEQ ID NO: 674321 - DNA, 20 bp, Artificial
  CRISPR gRNA sequence
agggagcttgcaaaaatatt

SEQ ID NO: 674322 - DNA, 20 bp, Artificial
  CRISPR gRNA sequence
gcaaaaatattgaagagaaa

SEQ ID NO: 674323 - DNA, 20 bp, Artificial
  CRISPR gRNA sequence
caaaaatattgaagagaaag

SEQ ID NO: 674324 - DNA, 20 bp, Artificial
  CRISPR gRNA sequence
aagagaaagggaaggcatat

SEQ ID NO: 674325 - DNA, 20 bp, Artificial
  CRISPR gRNA sequence
ttaggatatatttctgcctc

SEQ ID NO: 674326 - DNA, 20 bp, Artificial
  CRISPR gRNA sequence
ggatatatttctgcctcttc

SEQ ID NO: 674327 - DNA, 20 bp, Artificial
  CRISPR gRNA sequence
ctgcctcttccatgttggaa

SEQ ID NO: 674328 - DNA, 20 bp, Artificial
  CRISPR gRNA sequence
tgcctcttccatgttggaaa

SEQ ID NO: 674329 - DNA, 20 bp, Artificial
  CRISPR gRNA sequence
cctcttccatgttggaaaga

SEQ ID NO: 674330 - DNA, 20 bp, Artificial
  CRISPR gRNA sequence
ttccatgttggaaagagtca

SEQ ID NO: 674331 - DNA, 20 bp, Artificial
  CRISPR gRNA sequence
ccatgttggaaagagtcaaa

SEQ ID NO: 674332 - DNA, 20 bp, Artificial
  CRISPR gRNA sequence
catgttggaaagagtcaaat

SEQ ID NO: 674333 - DNA, 20 bp, Artificial
  CRISPR gRNA sequence
gaaagagtcaaatgtaacct

SEQ ID NO: 674334 - DNA, 20 bp, Artificial
  CRISPR gRNA sequence
cctgccactacttgcttggt

SEQ ID NO: 674335 - DNA, 20 bp, Artificial
  CRISPR gRNA sequence
ccactacttgcttggttgat

SEQ ID NO: 674336 - DNA, 20 bp, Artificial
  CRISPR gRNA sequence
cttgcttggttgatctctct

SEQ ID NO: 674337 - DNA, 20 bp, Artificial
  CRISPR gRNA sequence
gcttggttgatctctctcag

SEQ ID NO: 674338 - DNA, 20 bp, Artificial
  CRISPR gRNA sequence
cttggttgatctctctcagg

SEQ ID NO: 674339 - DNA, 20 bp, Artificial
  CRISPR gRNA sequence
ggttgatctctctcaggaat

SEQ ID NO: 674340 - DNA, 20 bp, Artificial
  CRISPR gRNA sequence
gttgatctctctcaggaatg

SEQ ID NO: 674341 - DNA, 20 bp, Artificial
  CRISPR gRNA sequence
atctctctcaggaatggtgc

SEQ ID NO: 674342 - DNA, 20 bp, Artificial
  CRISPR gRNA sequence
tctcaggaatggtgccatat

SEQ ID NO: 674343 - DNA, 20 bp, Artificial
  CRISPR gRNA sequence
tcaggaatggtgccatatca

SEQ ID NO: 674344 - DNA, 20 bp, Artificial
  CRISPR gRNA sequence
aggaatggtgccatatcagg

SEQ ID NO: 674345 - DNA, 20 bp, Artificial
  CRISPR gRNA sequence
agcactggaaaattgtgagc

SEQ ID NO: 674346 - DNA, 20 bp, Artificial
  CRISPR gRNA sequence
gaaaattgtgagctcagcag

SEQ ID NO: 674347 - DNA, 20 bp, Artificial
  CRISPR gRNA sequence
tgagctcagcagtggtggta

SEQ ID NO: 674348 - DNA, 20 bp, Artificial
  CRISPR gRNA sequence
agcagtggtggtagttaaat

SEQ ID NO: 674349 - DNA, 20 bp, Artificial
  CRISPR gRNA sequence
aatcagtcatagagaagagg

SEQ ID NO: 674350 - DNA, 20 bp, Artificial
  CRISPR gRNA sequence
aatctgttcatagtttctgt

SEQ ID NO: 674351 - DNA, 20 bp, Artificial
  CRISPR gRNA sequence
ttcatagtttctgtgtccct

SEQ ID NO: 674352 - DNA, 20 bp, Artificial
  CRISPR gRNA sequence
atagtttctgtgtccctact

SEQ ID NO: 674353 - DNA, 20 bp, Artificial
  CRISPR gRNA sequence
ctgtgtccctactcccattg

SEQ ID NO: 674354 - DNA, 20 bp, Artificial
  CRISPR gRNA sequence
tgtgtccctactcccattgt

SEQ ID NO: 674355 - DNA, 20 bp, Artificial
  CRISPR gRNA sequence
tgtccctactcccattgtca

SEQ ID NO: 674356 - DNA, 20 bp, Artificial
  CRISPR gRNA sequence
ctcccattgtcactttgtac

SEQ ID NO: 674357 - DNA, 20 bp, Artificial
  CRISPR gRNA sequence
ccattgtcactttgtacatt

SEQ ID NO: 674358 - DNA, 20 bp, Artificial
  CRISPR gRNA sequence
tcactttgtacattggccca

SEQ ID NO: 674359 - DNA, 20 bp, Artificial
  CRISPR gRNA sequence
tgtacattggcccactgaga

SEQ ID NO: 674360 - DNA, 20 bp, Artificial
  CRISPR gRNA sequence
gtacattggcccactgagaa

SEQ ID NO: 674361 - DNA, 20 bp, Artificial
  CRISPR gRNA sequence
tacattggcccactgagaaa

SEQ ID NO: 674362 - DNA, 20 bp, Artificial
  CRISPR gRNA sequence
gcccactgagaaagtaccag

SEQ ID NO: 674363 - DNA, 20 bp, Artificial
  CRISPR gRNA sequence
agaaagtaccaggtaagcct

SEQ ID NO: 674364 - DNA, 20 bp, Artificial
  CRISPR gRNA sequence
gtaaagagtctgagattcat

SEQ ID NO: 674365 - DNA, 20 bp, Artificial
  CRISPR gRNA sequence
agattcatgagattaccccc

SEQ ID NO: 674366 - DNA, 20 bp, Artificial
  CRISPR gRNA sequence
atgagattacccccttcaga

SEQ ID NO: 674367 - DNA, 20 bp, Artificial
  CRISPR gRNA sequence
cccccttcagattactaaca

SEQ ID NO: 674368 - DNA, 20 bp, Artificial
  CRISPR gRNA sequence
cagattactaacagccttca

SEQ ID NO: 674369 - DNA, 20 bp, Artificial
  CRISPR gRNA sequence
agattactaacagccttcac

SEQ ID NO: 674370 - DNA, 20 bp, Artificial
  CRISPR gRNA sequence
ctaacagccttcactacagt

SEQ ID NO: 674371 - DNA, 20 bp, Artificial
  CRISPR gRNA sequence
acagccttcactacagtgaa

SEQ ID NO: 674372 - DNA, 20 bp, Artificial
  CRISPR gRNA sequence
cactacagtgaatgccctct

SEQ ID NO: 674373 - DNA, 20 bp, Artificial
  CRISPR gRNA sequence
actacagtgaatgccctctg

SEQ ID NO: 674374 - DNA, 20 bp, Artificial
  CRISPR gRNA sequence
cagtgaatgccctctggaga

SEQ ID NO: 674375 - DNA, 20 bp, Artificial
  CRISPR gRNA sequence
tggagagaatttacatagaa

SEQ ID NO: 674376 - DNA, 20 bp, Artificial
  CRISPR gRNA sequence
gagagaatttacatagaata

SEQ ID NO: 674377 - DNA, 20 bp, Artificial
  CRISPR gRNA sequence
acatagaataccatatcatt

SEQ ID NO: 674378 - DNA, 20 bp, Artificial
  CRISPR gRNA sequence
catagaataccatatcatta

SEQ ID NO: 674379 - DNA, 20 bp, Artificial
  CRISPR gRNA sequence
cattttgtaccaattctgaa

SEQ ID NO: 674380 - DNA, 20 bp, Artificial
  CRISPR gRNA sequence
tgtaccaattctgaaggata

SEQ ID NO: 674381 - DNA, 20 bp, Artificial
  CRISPR gRNA sequence
gtaccaattctgaaggatat

SEQ ID NO: 674382 - DNA, 20 bp, Artificial
  CRISPR gRNA sequence
taccaattctgaaggatata

SEQ ID NO: 674383 - DNA, 20 bp, Artificial
  CRISPR gRNA sequence
tgaaggatatatcctcataa

SEQ ID NO: 674384 - DNA, 20 bp, Artificial
  CRISPR gRNA sequence
aaggatatatcctcataact

SEQ ID NO: 674385 - DNA, 20 bp, Artificial
  CRISPR gRNA sequence
ataactcttccctagacttt

SEQ ID NO: 674386 - DNA, 20 bp, Artificial
  CRISPR gRNA sequence
ttccctagactttctgtcac

SEQ ID NO: 674387 - DNA, 20 bp, Artificial
  CRISPR gRNA sequence
ccctagactttctgtcacca

SEQ ID NO: 674388 - DNA, 20 bp, Artificial
  CRISPR gRNA sequence
cctagactttctgtcaccag

SEQ ID NO: 674389 - DNA, 20 bp, Artificial
  CRISPR gRNA sequence
gactttctgtcaccagtcgt

SEQ ID NO: 674390 - DNA, 20 bp, Artificial
  CRISPR gRNA sequence
tctgtcaccagtcgtccaat

SEQ ID NO: 674391 - DNA, 20 bp, Artificial
  CRISPR gRNA sequence
ctgtcaccagtcgtccaatt

SEQ ID NO: 674392 - DNA, 20 bp, Artificial
  CRISPR gRNA sequence
tgtcaccagtcgtccaattt

SEQ ID NO: 674393 - DNA, 20 bp, Artificial
  CRISPR gRNA sequence
tcaccagtcgtccaattttg

SEQ ID NO: 674394 - DNA, 20 bp, Artificial
  CRISPR gRNA sequence
tgttctttgaagtccttgac

SEQ ID NO: 674395 - DNA, 20 bp, Artificial
  CRISPR gRNA sequence
gttctttgaagtccttgacc

SEQ ID NO: 674396 - DNA, 20 bp, Artificial
  CRISPR gRNA sequence
ttctttgaagtccttgacca

SEQ ID NO: 674397 - DNA, 20 bp, Artificial
  CRISPR gRNA sequence
tttgaagtccttgaccatat

SEQ ID NO: 674398 - DNA, 20 bp, Artificial
  CRISPR gRNA sequence
tgaagtccttgaccatatgg

SEQ ID NO: 674399 - DNA, 20 bp, Artificial
  CRISPR gRNA sequence
gaagtccttgaccatatggc

SEQ ID NO: 674400 - DNA, 20 bp, Artificial
  CRISPR gRNA sequence
aagtccttgaccatatggcc

SEQ ID NO: 674401 - DNA, 20 bp, Artificial
  CRISPR gRNA sequence
gaccatatggccatgccata

SEQ ID NO: 674402 - DNA, 20 bp, Artificial
  CRISPR gRNA sequence
accatatggccatgccatat

SEQ ID NO: 674403 - DNA, 20 bp, Artificial
  CRISPR gRNA sequence
cctcaactatctcttcttcc

SEQ ID NO: 674404 - DNA, 20 bp, Artificial
  CRISPR gRNA sequence
aactatctcttcttccatgc

SEQ ID NO: 674405 - DNA, 20 bp, Artificial
  CRISPR gRNA sequence
tctcttcttccatgcaaagt

SEQ ID NO: 674406 - DNA, 20 bp, Artificial
  CRISPR gRNA sequence
ttcttccatgcaaagtgtgc

SEQ ID NO: 674407 - DNA, 20 bp, Artificial
  CRISPR gRNA sequence
cttccatgcaaagtgtgcag

SEQ ID NO: 674408 - DNA, 20 bp, Artificial
  CRISPR gRNA sequence
ttccatgcaaagtgtgcagt

SEQ ID NO: 674409 - DNA, 20 bp, Artificial
  CRISPR gRNA sequence
ccatgcaaagtgtgcagtta

SEQ ID NO: 674410 - DNA, 20 bp, Artificial
  CRISPR gRNA sequence
catgcaaagtgtgcagttaa

SEQ ID NO: 674411 - DNA, 20 bp, Artificial
  CRISPR gRNA sequence
aatgtactagctgaatgaaa

SEQ ID NO: 674412 - DNA, 20 bp, Artificial
  CRISPR gRNA sequence
gctgaatgaaattctggctg

SEQ ID NO: 674413 - DNA, 20 bp, Artificial
  CRISPR gRNA sequence
aatgaaattctggctgctgg

SEQ ID NO: 674414 - DNA, 20 bp, Artificial
  CRISPR gRNA sequence
tggctgctggtgggatagcc

SEQ ID NO: 674415 - DNA, 20 bp, Artificial
  CRISPR gRNA sequence
gctgctggtgggatagccac

SEQ ID NO: 674416 - DNA, 20 bp, Artificial
  CRISPR gRNA sequence
ctggtgggatagccactgta

SEQ ID NO: 674417 - DNA, 20 bp, Artificial
  CRISPR gRNA sequence
gtgggatagccactgtattt

SEQ ID NO: 674418 - DNA, 20 bp, Artificial
  CRISPR gRNA sequence
tatttcagggccctctccct

SEQ ID NO: 674419 - DNA, 20 bp, Artificial
  CRISPR gRNA sequence
cagggccctctcccttaagt

SEQ ID NO: 674420 - DNA, 20 bp, Artificial
  CRISPR gRNA sequence
agggccctctcccttaagtg

SEQ ID NO: 674421 - DNA, 20 bp, Artificial
  CRISPR gRNA sequence
tcccttaagtggacctgtaa

SEQ ID NO: 674422 - DNA, 20 bp, Artificial
  CRISPR gRNA sequence
ccttaagtggacctgtaaac

SEQ ID NO: 674423 - DNA, 20 bp, Artificial
  CRISPR gRNA sequence
aagtggacctgtaaacacca

SEQ ID NO: 674424 - DNA, 20 bp, Artificial
  CRISPR gRNA sequence
agtggacctgtaaacaccat

SEQ ID NO: 674425 - DNA, 20 bp, Artificial
  CRISPR gRNA sequence
taaacaccatagtcatagct

SEQ ID NO: 674426 - DNA, 20 bp, Artificial
  CRISPR gRNA sequence
gtattgaattccagacattc

SEQ ID NO: 674427 - DNA, 20 bp, Artificial
  CRISPR gRNA sequence
aattccagacattctattta

SEQ ID NO: 674428 - DNA, 20 bp, Artificial
  CRISPR gRNA sequence
cagacattctatttacaaac

SEQ ID NO: 674429 - DNA, 20 bp, Artificial
  CRISPR gRNA sequence
tatttacaaaccagatccac

SEQ ID NO: 674430 - DNA, 20 bp, Artificial
  CRISPR gRNA sequence
tttacaaaccagatccacac

SEQ ID NO: 674431 - DNA, 20 bp, Artificial
  CRISPR gRNA sequence
acaaaccagatccacactgt

SEQ ID NO: 674432 - DNA, 20 bp, Artificial
  CRISPR gRNA sequence
caaaccagatccacactgtt

SEQ ID NO: 674433 - DNA, 20 bp, Artificial
  CRISPR gRNA sequence
tttcatcctcatcaactagt

SEQ ID NO: 674434 - DNA, 20 bp, Artificial
  CRISPR gRNA sequence
catcctcatcaactagtcac

SEQ ID NO: 674435 - DNA, 20 bp, Artificial
  CRISPR gRNA sequence
atcctcatcaactagtcact

SEQ ID NO: 674436 - DNA, 20 bp, Artificial
  CRISPR gRNA sequence
atcaactagtcactgagaat

SEQ ID NO: 674437 - DNA, 20 bp, Artificial
  CRISPR gRNA sequence
gtcactgagaataccccatg

SEQ ID NO: 674438 - DNA, 20 bp, Artificial
  CRISPR gRNA sequence
agaataccccatgaggccat

SEQ ID NO: 674439 - DNA, 20 bp, Artificial
  CRISPR gRNA sequence
aagcaaaaagattgagaagc

SEQ ID NO: 674440 - DNA, 20 bp, Artificial
  CRISPR gRNA sequence
agaagcagtagtagcaggta

SEQ ID NO: 674441 - DNA, 20 bp, Artificial
  CRISPR gRNA sequence
gggacctctgagctacttgc

SEQ ID NO: 674442 - DNA, 20 bp, Artificial
  CRISPR gRNA sequence
tgagctacttgctcatacag

SEQ ID NO: 674443 - DNA, 20 bp, Artificial
  CRISPR gRNA sequence
agctacttgctcatacagta

SEQ ID NO: 674444 - DNA, 20 bp, Artificial
  CRISPR gRNA sequence
cttgctcatacagtatactt

SEQ ID NO: 674445 - DNA, 20 bp, Artificial
  CRISPR gRNA sequence
gctcatacagtatacttggg

SEQ ID NO: 674446 - DNA, 20 bp, Artificial
  CRISPR gRNA sequence
ctcatacagtatacttgggc

SEQ ID NO: 674447 - DNA, 20 bp, Artificial
  CRISPR gRNA sequence
atacagtatacttgggcttc

SEQ ID NO: 674448 - DNA, 20 bp, Artificial
  CRISPR gRNA sequence
gggcttcctcaactagcata

SEQ ID NO: 674449 - DNA, 20 bp, Artificial
  CRISPR gRNA sequence
ggcttcctcaactagcataa

SEQ ID NO: 674450 - DNA, 20 bp, Artificial
  CRISPR gRNA sequence
cctcaactagcataagaagg

SEQ ID NO: 674451 - DNA, 20 bp, Artificial
  CRISPR gRNA sequence
ctcaactagcataagaaggc

SEQ ID NO: 674452 - DNA, 20 bp, Artificial
  CRISPR gRNA sequence
aactagcataagaaggctgc

SEQ ID NO: 674453 - DNA, 20 bp, Artificial
  CRISPR gRNA sequence
gcataagaaggctgcaggga

SEQ ID NO: 674454 - DNA, 20 bp, Artificial
  CRISPR gRNA sequence
cagggaaggaaaatatacca

SEQ ID NO: 674455 - DNA, 20 bp, Artificial
  CRISPR gRNA sequence
ttgtgtacatttttgatatg

SEQ ID NO: 674456 - DNA, 20 bp, Artificial
  CRISPR gRNA sequence
tgtacatttttgatatgttg

SEQ ID NO: 674457 - DNA, 20 bp, Artificial
  CRISPR gRNA sequence
ttgatatgttgaattagata

SEQ ID NO: 674458 - DNA, 20 bp, Artificial
  CRISPR gRNA sequence
tgatatgttgaattagataa

SEQ ID NO: 674459 - DNA, 20 bp, Artificial
  CRISPR gRNA sequence
gatatgttgaattagataac

SEQ ID NO: 674460 - DNA, 20 bp, Artificial
  CRISPR gRNA sequence
atatgttgaattagataaca

SEQ ID NO: 674461 - DNA, 20 bp, Artificial
  CRISPR gRNA sequence
aattagataacacctagttc

SEQ ID NO: 674462 - DNA, 20 bp, Artificial
  CRISPR gRNA sequence
gataacacctagttcatgat

SEQ ID NO: 674463 - DNA, 20 bp, Artificial
  CRISPR gRNA sequence
gttcatgatgcacggtttgg

SEQ ID NO: 674464 - DNA, 20 bp, Artificial
  CRISPR gRNA sequence
atgatgcacggtttgggcta

SEQ ID NO: 674465 - DNA, 20 bp, Artificial
  CRISPR gRNA sequence
gggctacattgtcattccga

SEQ ID NO: 674466 - DNA, 20 bp, Artificial
  CRISPR gRNA sequence
ggctacattgtcattccgag

SEQ ID NO: 674467 - DNA, 20 bp, Artificial
  CRISPR gRNA sequence
cattgtcattccgagtccta

SEQ ID NO: 674468 - DNA, 20 bp, Artificial
  CRISPR gRNA sequence
tcattccgagtcctatggcc

SEQ ID NO: 674469 - DNA, 20 bp, Artificial
  CRISPR gRNA sequence
cgagtcctatggcccagtac

SEQ ID NO: 674470 - DNA, 20 bp, Artificial
  CRISPR gRNA sequence
tggcccagtacacagtctta

SEQ ID NO: 674471 - DNA, 20 bp, Artificial
  CRISPR gRNA sequence
aaccaaagttcattagcaag

SEQ ID NO: 674472 - DNA, 20 bp, Artificial
  CRISPR gRNA sequence
accaaagttcattagcaagt

SEQ ID NO: 674473 - DNA, 20 bp, Artificial
  CRISPR gRNA sequence
attagcaagtaaggagtggc

SEQ ID NO: 674474 - DNA, 20 bp, Artificial
  CRISPR gRNA sequence
gcaagtaaggagtggctttt

SEQ ID NO: 674475 - DNA, 20 bp, Artificial
  CRISPR gRNA sequence
ttcaaatggagattagttat

SEQ ID NO: 674476 - DNA, 20 bp, Artificial
  CRISPR gRNA sequence
tcaaatggagattagttatt

SEQ ID NO: 674477 - DNA, 20 bp, Artificial
  CRISPR gRNA sequence
caaatggagattagttattg

SEQ ID NO: 674478 - DNA, 20 bp, Artificial
  CRISPR gRNA sequence
aaatggagattagttattgt

SEQ ID NO: 674479 - DNA, 20 bp, Artificial
  CRISPR gRNA sequence
gttattgttagaaaactgca

SEQ ID NO: 674480 - DNA, 20 bp, Artificial
  CRISPR gRNA sequence
ttgttagaaaactgcatgtc

SEQ ID NO: 674481 - DNA, 20 bp, Artificial
  CRISPR gRNA sequence
ttagaaaactgcatgtcttt

SEQ ID NO: 674482 - DNA, 20 bp, Artificial
  CRISPR gRNA sequence
gaaaactgcatgtctttact

SEQ ID NO: 674483 - DNA, 20 bp, Artificial
  CRISPR gRNA sequence
catgtctttactataaaacc

SEQ ID NO: 674484 - DNA, 20 bp, Artificial
  CRISPR gRNA sequence
tactataaaaccacgaggga

SEQ ID NO: 674485 - DNA, 20 bp, Artificial
  CRISPR gRNA sequence
actataaaaccacgagggat

SEQ ID NO: 674486 - DNA, 20 bp, Artificial
  CRISPR gRNA sequence
ctataaaaccacgagggatc

SEQ ID NO: 674487 - DNA, 20 bp, Artificial
  CRISPR gRNA sequence
taaaaccacgagggatctac

SEQ ID NO: 674488 - DNA, 20 bp, Artificial
  CRISPR gRNA sequence
cacactgaggcttccattga

SEQ ID NO: 674489 - DNA, 20 bp, Artificial
  CRISPR gRNA sequence
aggcttccattgacagagat

SEQ ID NO: 674490 - DNA, 20 bp, Artificial
  CRISPR gRNA sequence
ccattgacagagatgtcata

SEQ ID NO: 674491 - DNA, 20 bp, Artificial
  CRISPR gRNA sequence
cattgacagagatgtcatac

SEQ ID NO: 674492 - DNA, 20 bp, Artificial
  CRISPR gRNA sequence
acagagatgtcatacagcat

SEQ ID NO: 674493 - DNA, 20 bp, Artificial
  CRISPR gRNA sequence
catttgccacagacatttcc

SEQ ID NO: 674494 - DNA, 20 bp, Artificial
  CRISPR gRNA sequence
gccacagacatttccaaaaa

SEQ ID NO: 674495 - DNA, 20 bp, Artificial
  CRISPR gRNA sequence
ccacagacatttccaaaaat

SEQ ID NO: 674496 - DNA, 20 bp, Artificial
  CRISPR gRNA sequence
ccaaaaatcattgcatctgc

SEQ ID NO: 674497 - DNA, 20 bp, Artificial
  CRISPR gRNA sequence
caaaaatcattgcatctgct

SEQ ID NO: 674498 - DNA, 20 bp, Artificial
  CRISPR gRNA sequence
catctgctgaatcttagagt

SEQ ID NO: 674499 - DNA, 20 bp, Artificial
  CRISPR gRNA sequence
ctgaatcttagagtcaaaag

SEQ ID NO: 674500 - DNA, 20 bp, Artificial
  CRISPR gRNA sequence
aatcttagagtcaaaagtag

SEQ ID NO: 674501 - DNA, 20 bp, Artificial
  CRISPR gRNA sequence
agagtcaaaagtagagggag

SEQ ID NO: 674502 - DNA, 20 bp, Artificial
  CRISPR gRNA sequence
gagtcaaaagtagagggagc

SEQ ID NO: 674503 - DNA, 20 bp, Artificial
  CRISPR gRNA sequence
tcatcatggcagggtatgat

SEQ ID NO: 674504 - DNA, 20 bp, Artificial
  CRISPR gRNA sequence
catcatggcagggtatgatg

SEQ ID NO: 674505 - DNA, 20 bp, Artificial
  CRISPR gRNA sequence
atcatggcagggtatgatgt

SEQ ID NO: 674506 - DNA, 20 bp, Artificial
  CRISPR gRNA sequence
ttcttgccccaggctgctct

SEQ ID NO: 674507 - DNA, 20 bp, Artificial
  CRISPR gRNA sequence
tcttgccccaggctgctctc

SEQ ID NO: 674508 - DNA, 20 bp, Artificial
  CRISPR gRNA sequence
cttgccccaggctgctctca

SEQ ID NO: 674509 - DNA, 20 bp, Artificial
  CRISPR gRNA sequence
ttgccccaggctgctctcaa

SEQ ID NO: 674510 - DNA, 20 bp, Artificial
  CRISPR gRNA sequence
gccccaggctgctctcaaaa

SEQ ID NO: 674511 - DNA, 20 bp, Artificial
  CRISPR gRNA sequence
ccccaggctgctctcaaaat

SEQ ID NO: 674512 - DNA, 20 bp, Artificial
  CRISPR gRNA sequence
ctctcaaaatggacagcctg

SEQ ID NO: 674513 - DNA, 20 bp, Artificial
  CRISPR gRNA sequence
tcaaaatggacagcctgtgg

SEQ ID NO: 674514 - DNA, 20 bp, Artificial
  CRISPR gRNA sequence
aaaatggacagcctgtggat

SEQ ID NO: 674515 - DNA, 20 bp, Artificial
  CRISPR gRNA sequence
tggattacctagtatatgca

SEQ ID NO: 674516 - DNA, 20 bp, Artificial
  CRISPR gRNA sequence
cctagtatatgcaccacaga

SEQ ID NO: 674517 - DNA, 20 bp, Artificial
  CRISPR gRNA sequence
gtatatgcaccacagaagta

SEQ ID NO: 674518 - DNA, 20 bp, Artificial
  CRISPR gRNA sequence
tgttgcttctaaaatctaga

SEQ ID NO: 674519 - DNA, 20 bp, Artificial
  CRISPR gRNA sequence
cttctaaaatctagagaggc

SEQ ID NO: 674520 - DNA, 20 bp, Artificial
  CRISPR gRNA sequence
ctaaaatctagagaggccac

SEQ ID NO: 674521 - DNA, 20 bp, Artificial
  CRISPR gRNA sequence
taaaatctagagaggccacc

SEQ ID NO: 674522 - DNA, 20 bp, Artificial
  CRISPR gRNA sequence
aaatctagagaggccaccac

SEQ ID NO: 674523 - DNA, 20 bp, Artificial
  CRISPR gRNA sequence
gagaggccaccacattttgt

SEQ ID NO: 674524 - DNA, 20 bp, Artificial
  CRISPR gRNA sequence
tgtgcttcattttcacgaag

SEQ ID NO: 674525 - DNA, 20 bp, Artificial
  CRISPR gRNA sequence
gtgcttcattttcacgaagg

SEQ ID NO: 674526 - DNA, 20 bp, Artificial
  CRISPR gRNA sequence
tgcttcattttcacgaagga

SEQ ID NO: 674527 - DNA, 20 bp, Artificial
  CRISPR gRNA sequence
cattttcacgaaggaaggtg

SEQ ID NO: 674528 - DNA, 20 bp, Artificial
  CRISPR gRNA sequence
attttcacgaaggaaggtgc

SEQ ID NO: 674529 - DNA, 20 bp, Artificial
  CRISPR gRNA sequence
tcacgaaggaaggtgcaggg

SEQ ID NO: 674530 - DNA, 20 bp, Artificial
  CRISPR gRNA sequence
cacgaaggaaggtgcagggt

SEQ ID NO: 674531 - DNA, 20 bp, Artificial
  CRISPR gRNA sequence
acgaaggaaggtgcagggtg

SEQ ID NO: 674532 - DNA, 20 bp, Artificial
  CRISPR gRNA sequence
ctcacttacaatggaggatc

SEQ ID NO: 674533 - DNA, 20 bp, Artificial
  CRISPR gRNA sequence
tcacttacaatggaggatct

SEQ ID NO: 674534 - DNA, 20 bp, Artificial
  CRISPR gRNA sequence
acttacaatggaggatctat

SEQ ID NO: 674535 - DNA, 20 bp, Artificial
  CRISPR gRNA sequence
acaatggaggatctatttca

SEQ ID NO: 674536 - DNA, 20 bp, Artificial
  CRISPR gRNA sequence
caatggaggatctatttcag

SEQ ID NO: 674537 - DNA, 20 bp, Artificial
  CRISPR gRNA sequence
tttcagcatgcacagatcag

SEQ ID NO: 674538 - DNA, 20 bp, Artificial
  CRISPR gRNA sequence
cagcatgcacagatcagtgg

SEQ ID NO: 674539 - DNA, 20 bp, Artificial
  CRISPR gRNA sequence
agcatgcacagatcagtggc

SEQ ID NO: 674540 - DNA, 20 bp, Artificial
  CRISPR gRNA sequence
taaaattttaccaatgctga

SEQ ID NO: 674541 - DNA, 20 bp, Artificial
  CRISPR gRNA sequence
taccaatgctgaaagtccct

SEQ ID NO: 674542 - DNA, 20 bp, Artificial
  CRISPR gRNA sequence
accaatgctgaaagtccctg

SEQ ID NO: 674543 - DNA, 20 bp, Artificial
  CRISPR gRNA sequence
ccaatgctgaaagtccctga

SEQ ID NO: 674544 - DNA, 20 bp, Artificial
  CRISPR gRNA sequence
aaagtccctgaactttcttg

SEQ ID NO: 674545 - DNA, 20 bp, Artificial
  CRISPR gRNA sequence
aactttcttggagtttatct

SEQ ID NO: 674546 - DNA, 20 bp, Artificial
  CRISPR gRNA sequence
tcttggagtttatctcctat

SEQ ID NO: 674547 - DNA, 20 bp, Artificial
  CRISPR gRNA sequence
cttggagtttatctcctatt

SEQ ID NO: 674548 - DNA, 20 bp, Artificial
  CRISPR gRNA sequence
ttggagtttatctcctattc

SEQ ID NO: 674549 - DNA, 20 bp, Artificial
  CRISPR gRNA sequence
ggagtttatctcctattcta

SEQ ID NO: 674550 - DNA, 20 bp, Artificial
  CRISPR gRNA sequence
gagtttatctcctattctat

SEQ ID NO: 674551 - DNA, 20 bp, Artificial
  CRISPR gRNA sequence
atctcctattctatagcata

SEQ ID NO: 674552 - DNA, 20 bp, Artificial
  CRISPR gRNA sequence
tctcctattctatagcatat

SEQ ID NO: 674553 - DNA, 20 bp, Artificial
  CRISPR gRNA sequence
ctattctatagcatatatct

SEQ ID NO: 674554 - DNA, 20 bp, Artificial
  CRISPR gRNA sequence
ttctatagcatatatctctt

SEQ ID NO: 674555 - DNA, 20 bp, Artificial
  CRISPR gRNA sequence
tatagcatatatctcttact

SEQ ID NO: 674556 - DNA, 20 bp, Artificial
  CRISPR gRNA sequence
tagcatatatctcttactga

SEQ ID NO: 674557 - DNA, 20 bp, Artificial
  CRISPR gRNA sequence
ttactgaggcatctcaggta

SEQ ID NO: 674558 - DNA, 20 bp, Artificial
  CRISPR gRNA sequence
actgaggcatctcaggtatt

SEQ ID NO: 674559 - DNA, 20 bp, Artificial
  CRISPR gRNA sequence
ctgaggcatctcaggtattt

SEQ ID NO: 674560 - DNA, 20 bp, Artificial
  CRISPR gRNA sequence
aggcatctcaggtatttact

SEQ ID NO: 674561 - DNA, 20 bp, Artificial
  CRISPR gRNA sequence
aggtatttactatatcctgc

SEQ ID NO: 674562 - DNA, 20 bp, Artificial
  CRISPR gRNA sequence
actatatcctgctcccaagt

SEQ ID NO: 674563 - DNA, 20 bp, Artificial
  CRISPR gRNA sequence
ctatatcctgctcccaagtt

SEQ ID NO: 674564 - DNA, 20 bp, Artificial
  CRISPR gRNA sequence
tatcctgctcccaagttcac

SEQ ID NO: 674565 - DNA, 20 bp, Artificial
  CRISPR gRNA sequence
ctcccaagttcactcagtgt

SEQ ID NO: 674566 - DNA, 20 bp, Artificial
  CRISPR gRNA sequence
ccaagttcactcagtgtaat

SEQ ID NO: 674567 - DNA, 20 bp, Artificial
  CRISPR gRNA sequence
actcagtgtaatgtcatgaa

SEQ ID NO: 674568 - DNA, 20 bp, Artificial
  CRISPR gRNA sequence
agtgtaatgtcatgaatata

SEQ ID NO: 674569 - DNA, 20 bp, Artificial
  CRISPR gRNA sequence
cagcttgatgttttttggaa

SEQ ID NO: 674570 - DNA, 20 bp, Artificial
  CRISPR gRNA sequence
gatgttttttggaatgtcaa

SEQ ID NO: 674571 - DNA, 20 bp, Artificial
  CRISPR gRNA sequence
atgttttttggaatgtcaag

SEQ ID NO: 674572 - DNA, 20 bp, Artificial
  CRISPR gRNA sequence
tttggaatgtcaagatgaac

SEQ ID NO: 674573 - DNA, 20 bp, Artificial
  CRISPR gRNA sequence
ttggaatgtcaagatgaaca

SEQ ID NO: 674574 - DNA, 20 bp, Artificial
  CRISPR gRNA sequence
tggaatgtcaagatgaacaa

SEQ ID NO: 674575 - DNA, 20 bp, Artificial
  CRISPR gRNA sequence
ggaatgtcaagatgaacaag

SEQ ID NO: 674576 - DNA, 20 bp, Artificial
  CRISPR gRNA sequence
gaatgtcaagatgaacaaga

SEQ ID NO: 674577 - DNA, 20 bp, Artificial
  CRISPR gRNA sequence
ctccagactatgttatgaca

SEQ ID NO: 674578 - DNA, 20 bp, Artificial
  CRISPR gRNA sequence
tccagactatgttatgacaa

SEQ ID NO: 674579 - DNA, 20 bp, Artificial
  CRISPR gRNA sequence
cagactatgttatgacaaag

SEQ ID NO: 674580 - DNA, 20 bp, Artificial
  CRISPR gRNA sequence
tgttatgacaaagagagcag

SEQ ID NO: 674581 - DNA, 20 bp, Artificial
  CRISPR gRNA sequence
tgacaaagagagcagagttg

SEQ ID NO: 674582 - DNA, 20 bp, Artificial
  CRISPR gRNA sequence
acctagccttaaggtaagag

SEQ ID NO: 674583 - DNA, 20 bp, Artificial
  CRISPR gRNA sequence
gccttaaggtaagagagtaa

SEQ ID NO: 674584 - DNA, 20 bp, Artificial
  CRISPR gRNA sequence
aaggtaagagagtaaaagta

SEQ ID NO: 674585 - DNA, 20 bp, Artificial
  CRISPR gRNA sequence
aggtaagagagtaaaagtat

SEQ ID NO: 674586 - DNA, 20 bp, Artificial
  CRISPR gRNA sequence
ctcctctagtgtgaagggaa

SEQ ID NO: 674587 - DNA, 20 bp, Artificial
  CRISPR gRNA sequence
ctctagtgtgaagggaaaaa

SEQ ID NO: 674588 - DNA, 20 bp, Artificial
  CRISPR gRNA sequence
tagtgtgaagggaaaaaact

SEQ ID NO: 674589 - DNA, 20 bp, Artificial
  CRISPR gRNA sequence
gtgtgaagggaaaaaactgc

SEQ ID NO: 674590 - DNA, 20 bp, Artificial
  CRISPR gRNA sequence
cttctgattatctttgttat

SEQ ID NO: 674591 - DNA, 20 bp, Artificial
  CRISPR gRNA sequence
ctgattatctttgttataca

SEQ ID NO: 674592 - DNA, 20 bp, Artificial
  CRISPR gRNA sequence
tgattatctttgttatacaa

SEQ ID NO: 674593 - DNA, 20 bp, Artificial
  CRISPR gRNA sequence
attatctttgttatacaaat

SEQ ID NO: 674594 - DNA, 20 bp, Artificial
  CRISPR gRNA sequence
tctttgttatacaaattacc

SEQ ID NO: 674595 - DNA, 20 bp, Artificial
  CRISPR gRNA sequence
tgttatacaaattaccttaa

SEQ ID NO: 674596 - DNA, 20 bp, Artificial
  CRISPR gRNA sequence
gttatacaaattaccttaaa

SEQ ID NO: 674597 - DNA, 20 bp, Artificial
  CRISPR gRNA sequence
ttatacaaattaccttaaac

SEQ ID NO: 674598 - DNA, 20 bp, Artificial
  CRISPR gRNA sequence
tacaaattaccttaaacaga

SEQ ID NO: 674599 - DNA, 20 bp, Artificial
  CRISPR gRNA sequence
ccttaaacagaaatcaagtt

SEQ ID NO: 674600 - DNA, 20 bp, Artificial
  CRISPR gRNA sequence
aaacagaaatcaagttcatt

SEQ ID NO: 674601 - DNA, 20 bp, Artificial
  CRISPR gRNA sequence
aacagaaatcaagttcattg

SEQ ID NO: 674602 - DNA, 20 bp, Artificial
  CRISPR gRNA sequence
attgcttcatacctagtgtc

SEQ ID NO: 674603 - DNA, 20 bp, Artificial
  CRISPR gRNA sequence
cttcatacctagtgtcagtg

SEQ ID NO: 674604 - DNA, 20 bp, Artificial
  CRISPR gRNA sequence
catacctagtgtcagtggct

SEQ ID NO: 674605 - DNA, 20 bp, Artificial
  CRISPR gRNA sequence
atacctagtgtcagtggcta

SEQ ID NO: 674606 - DNA, 20 bp, Artificial
  CRISPR gRNA sequence
gtgtcagtggctatgttaat

SEQ ID NO: 674607 - DNA, 20 bp, Artificial
  CRISPR gRNA sequence
tgttaatatgctccagtaaa

SEQ ID NO: 674608 - DNA, 20 bp, Artificial
  CRISPR gRNA sequence
atatgctccagtaaagattg

SEQ ID NO: 674609 - DNA, 20 bp, Artificial
  CRISPR gRNA sequence
cagtaaagattgtacagcta

SEQ ID NO: 674610 - DNA, 20 bp, Artificial
  CRISPR gRNA sequence
tacagctaaaactgcatcta

SEQ ID NO: 674611 - DNA, 20 bp, Artificial
  CRISPR gRNA sequence
aaactgcatctacagttagc

SEQ ID NO: 674612 - DNA, 20 bp, Artificial
  CRISPR gRNA sequence
catctacagttagcattatg

SEQ ID NO: 674613 - DNA, 20 bp, Artificial
  CRISPR gRNA sequence
cagttagcattatgaaatga

SEQ ID NO: 674614 - DNA, 20 bp, Artificial
  CRISPR gRNA sequence
gcattatgaaatgattaagt

SEQ ID NO: 674615 - DNA, 20 bp, Artificial
  CRISPR gRNA sequence
tgaaatgattaagtctgcat

SEQ ID NO: 674616 - DNA, 20 bp, Artificial
  CRISPR gRNA sequence
agtctgcatcaatgccatgc

SEQ ID NO: 674617 - DNA, 20 bp, Artificial
  CRISPR gRNA sequence
catcaatgccatgccttagc

SEQ ID NO: 674618 - DNA, 20 bp, Artificial
  CRISPR gRNA sequence
agcctaataaacagtttaaa

SEQ ID NO: 674619 - DNA, 20 bp, Artificial
  CRISPR gRNA sequence
gcctaataaacagtttaaat

SEQ ID NO: 674620 - DNA, 20 bp, Artificial
  CRISPR gRNA sequence
ataaacagtttaaatgggtg

SEQ ID NO: 674621 - DNA, 20 bp, Artificial
  CRISPR gRNA sequence
aaatgggtgtatagtgtgaa

SEQ ID NO: 674622 - DNA, 20 bp, Artificial
  CRISPR gRNA sequence
aatgggtgtatagtgtgaat

SEQ ID NO: 674623 - DNA, 20 bp, Artificial
  CRISPR gRNA sequence
tcacccctaacatctttcag

SEQ ID NO: 674624 - DNA, 20 bp, Artificial
  CRISPR gRNA sequence
acatctttcagttttctgat

SEQ ID NO: 674625 - DNA, 20 bp, Artificial
  CRISPR gRNA sequence
tcagttttctgatggtttca

SEQ ID NO: 674626 - DNA, 20 bp, Artificial
  CRISPR gRNA sequence
cagttttctgatggtttcac

SEQ ID NO: 674627 - DNA, 20 bp, Artificial
  CRISPR gRNA sequence
agttttctgatggtttcact

SEQ ID NO: 674628 - DNA, 20 bp, Artificial
  CRISPR gRNA sequence
tctgatggtttcactactgt

SEQ ID NO: 674629 - DNA, 20 bp, Artificial
  CRISPR gRNA sequence
ctgatggtttcactactgtc

SEQ ID NO: 674630 - DNA, 20 bp, Artificial
  CRISPR gRNA sequence
tgatggtttcactactgtct

SEQ ID NO: 674631 - DNA, 20 bp, Artificial
  CRISPR gRNA sequence
atggtttcactactgtctgt

SEQ ID NO: 674632 - DNA, 20 bp, Artificial
  CRISPR gRNA sequence
cactactgtctgttattcat

SEQ ID NO: 674633 - DNA, 20 bp, Artificial
  CRISPR gRNA sequence
actactgtctgttattcatc

SEQ ID NO: 674634 - DNA, 20 bp, Artificial
  CRISPR gRNA sequence
ctgtctgttattcatccata

SEQ ID NO: 674635 - DNA, 20 bp, Artificial
  CRISPR gRNA sequence
tctgttattcatccatagaa

SEQ ID NO: 674636 - DNA, 20 bp, Artificial
  CRISPR gRNA sequence
ttattcatccatagaattat

SEQ ID NO: 674637 - DNA, 20 bp, Artificial
  CRISPR gRNA sequence
ttcatccatagaattattat

SEQ ID NO: 674638 - DNA, 20 bp, Artificial
  CRISPR gRNA sequence
atccatagaattattatttc

SEQ ID NO: 674639 - DNA, 20 bp, Artificial
  CRISPR gRNA sequence
ttatttcttttagtttgctg

SEQ ID NO: 674640 - DNA, 20 bp, Artificial
  CRISPR gRNA sequence
tttcttttagtttgctgtct

SEQ ID NO: 674641 - DNA, 20 bp, Artificial
  CRISPR gRNA sequence
cttttagtttgctgtcttgg

SEQ ID NO: 674642 - DNA, 20 bp, Artificial
  CRISPR gRNA sequence
ttttagtttgctgtcttggg

SEQ ID NO: 674643 - DNA, 20 bp, Artificial
  CRISPR gRNA sequence
ttagtttgctgtcttgggag

SEQ ID NO: 674644 - DNA, 20 bp, Artificial
  CRISPR gRNA sequence
tagtttgctgtcttgggaga

SEQ ID NO: 674645 - DNA, 20 bp, Artificial
  CRISPR gRNA sequence
agtttgctgtcttgggagag

SEQ ID NO: 674646 - DNA, 20 bp, Artificial
  CRISPR gRNA sequence
gtttgctgtcttgggagagg

SEQ ID NO: 674647 - DNA, 20 bp, Artificial
  CRISPR gRNA sequence
gctgtcttgggagaggtgat

SEQ ID NO: 674648 - DNA, 20 bp, Artificial
  CRISPR gRNA sequence
ctgtcttgggagaggtgata

SEQ ID NO: 674649 - DNA, 20 bp, Artificial
  CRISPR gRNA sequence
tcttgggagaggtgatagtt

SEQ ID NO: 674650 - DNA, 20 bp, Artificial
  CRISPR gRNA sequence
gggagaggtgatagttgtag

SEQ ID NO: 674651 - DNA, 20 bp, Artificial
  CRISPR gRNA sequence
ggagaggtgatagttgtagg

SEQ ID NO: 674652 - DNA, 20 bp, Artificial
  CRISPR gRNA sequence
tagggctacgctgtccaata

SEQ ID NO: 674653 - DNA, 20 bp, Artificial
  CRISPR gRNA sequence
cgctgtccaatatggtagcc

SEQ ID NO: 674654 - DNA, 20 bp, Artificial
  CRISPR gRNA sequence
tccaatatggtagccactag

SEQ ID NO: 674655 - DNA, 20 bp, Artificial
  CRISPR gRNA sequence
gcctcatgtggttactaaac

SEQ ID NO: 674656 - DNA, 20 bp, Artificial
  CRISPR gRNA sequence
atgtggttactaaacaccta

SEQ ID NO: 674657 - DNA, 20 bp, Artificial
  CRISPR gRNA sequence
ctaaacacctaaatatggct

SEQ ID NO: 674658 - DNA, 20 bp, Artificial
  CRISPR gRNA sequence
aacacctaaatatggctagt

SEQ ID NO: 674659 - DNA, 20 bp, Artificial
  CRISPR gRNA sequence
aatatggctagtgctacatg

SEQ ID NO: 674660 - DNA, 20 bp, Artificial
  CRISPR gRNA sequence
gtgctacatgttgaaataat

SEQ ID NO: 674661 - DNA, 20 bp, Artificial
  CRISPR gRNA sequence
catgttgaaataatattttt

SEQ ID NO: 674662 - DNA, 20 bp, Artificial
  CRISPR gRNA sequence
aaataatattttttattttt

SEQ ID NO: 674663 - DNA, 20 bp, Artificial
  CRISPR gRNA sequence
tttatttttcttgttttttt

SEQ ID NO: 674664 - DNA, 20 bp, Artificial
  CRISPR gRNA sequence
ttatttttcttgttttttta

SEQ ID NO: 674665 - DNA, 20 bp, Artificial
  CRISPR gRNA sequence
tatttttcttgtttttttac

SEQ ID NO: 674666 - DNA, 20 bp, Artificial
  CRISPR gRNA sequence
atttttcttgtttttttact

SEQ ID NO: 674667 - DNA, 20 bp, Artificial
  CRISPR gRNA sequence
tttttcttgtttttttacta

SEQ ID NO: 674668 - DNA, 20 bp, Artificial
  CRISPR gRNA sequence
ttcttgtttttttactacag

SEQ ID NO: 674669 - DNA, 20 bp, Artificial
  CRISPR gRNA sequence
tcttgtttttttactacagt

SEQ ID NO: 674670 - DNA, 20 bp, Artificial
  CRISPR gRNA sequence
cttgtttttttactacagtt

SEQ ID NO: 674671 - DNA, 20 bp, Artificial
  CRISPR gRNA sequence
ttgtttttttactacagttt

SEQ ID NO: 674672 - DNA, 20 bp, Artificial
  CRISPR gRNA sequence
gtttttttactacagtttta

SEQ ID NO: 674673 - DNA, 20 bp, Artificial
  CRISPR gRNA sequence
tttttttactacagttttat

SEQ ID NO: 674674 - DNA, 20 bp, Artificial
  CRISPR gRNA sequence
ttttactacagttttatgta

SEQ ID NO: 674675 - DNA, 20 bp, Artificial
  CRISPR gRNA sequence
tttactacagttttatgtat

SEQ ID NO: 674676 - DNA, 20 bp, Artificial
  CRISPR gRNA sequence
ttactacagttttatgtata

SEQ ID NO: 674677 - DNA, 20 bp, Artificial
  CRISPR gRNA sequence
tactacagttttatgtatat

SEQ ID NO: 674678 - DNA, 20 bp, Artificial
  CRISPR gRNA sequence
actacagttttatgtatatt

SEQ ID NO: 674679 - DNA, 20 bp, Artificial
  CRISPR gRNA sequence
ctacagttttatgtatatta

SEQ ID NO: 674680 - DNA, 20 bp, Artificial
  CRISPR gRNA sequence
cagttttatgtatattaact

SEQ ID NO: 674681 - DNA, 20 bp, Artificial
  CRISPR gRNA sequence
tatgtatattaactatacct

SEQ ID NO: 674682 - DNA, 20 bp, Artificial
  CRISPR gRNA sequence
atgtatattaactatacctc

SEQ ID NO: 674683 - DNA, 20 bp, Artificial
  CRISPR gRNA sequence
tgtatattaactatacctca

SEQ ID NO: 674684 - DNA, 20 bp, Artificial
  CRISPR gRNA sequence
actatacctcaatgaagttg

SEQ ID NO: 674685 - DNA, 20 bp, Artificial
  CRISPR gRNA sequence
tacctcaatgaagttgttga

SEQ ID NO: 674686 - DNA, 20 bp, Artificial
  CRISPR gRNA sequence
aatgaagttgttgaggggga

SEQ ID NO: 674687 - DNA, 20 bp, Artificial
  CRISPR gRNA sequence
ttgagggggagggagaagat

SEQ ID NO: 674688 - DNA, 20 bp, Artificial
  CRISPR gRNA sequence
agggggagggagaagatact

SEQ ID NO: 674689 - DNA, 20 bp, Artificial
  CRISPR gRNA sequence
ccatcccatgtttctctgct

SEQ ID NO: 674690 - DNA, 20 bp, Artificial
  CRISPR gRNA sequence
ctctgctttctcatcattgc

SEQ ID NO: 674691 - DNA, 20 bp, Artificial
  CRISPR gRNA sequence
tctgctttctcatcattgcc

SEQ ID NO: 674692 - DNA, 20 bp, Artificial
  CRISPR gRNA sequence
tgctttctcatcattgcccc

SEQ ID NO: 674693 - DNA, 20 bp, Artificial
  CRISPR gRNA sequence
ctttctcatcattgccccac

SEQ ID NO: 674694 - DNA, 20 bp, Artificial
  CRISPR gRNA sequence
tctcatcattgccccactac

SEQ ID NO: 674695 - DNA, 20 bp, Artificial
  CRISPR gRNA sequence
ctcatcattgccccactacc

SEQ ID NO: 674696 - DNA, 20 bp, Artificial
  CRISPR gRNA sequence
tcatcattgccccactacca

SEQ ID NO: 674697 - DNA, 20 bp, Artificial
  CRISPR gRNA sequence
atcattgccccactaccaaa

SEQ ID NO: 674698 - DNA, 20 bp, Artificial
  CRISPR gRNA sequence
ccccactaccaaaaactaat

SEQ ID NO: 674699 - DNA, 20 bp, Artificial
  CRISPR gRNA sequence
ccaaaaactaatggtcttag

SEQ ID NO: 674700 - DNA, 20 bp, Artificial
  CRISPR gRNA sequence
atggtcttagtattgtccat

SEQ ID NO: 674701 - DNA, 20 bp, Artificial
  CRISPR gRNA sequence
agtattgtccattgtattta

SEQ ID NO: 674702 - DNA, 20 bp, Artificial
  CRISPR gRNA sequence
gtattgtccattgtatttag

SEQ ID NO: 674703 - DNA, 20 bp, Artificial
  CRISPR gRNA sequence
tccattgtatttagcattgc

SEQ ID NO: 674704 - DNA, 20 bp, Artificial
  CRISPR gRNA sequence
tatttagcattgcaattcta

SEQ ID NO: 674705 - DNA, 20 bp, Artificial
  CRISPR gRNA sequence
agcattgcaattctataacc

SEQ ID NO: 674706 - DNA, 20 bp, Artificial
  CRISPR gRNA sequence
gcattgcaattctataaccc

SEQ ID NO: 674707 - DNA, 20 bp, Artificial
  CRISPR gRNA sequence
caattctataacccttcaaa

SEQ ID NO: 674708 - DNA, 20 bp, Artificial
  CRISPR gRNA sequence
tataacccttcaaatcagat

SEQ ID NO: 674709 - DNA, 20 bp, Artificial
  CRISPR gRNA sequence
taacccttcaaatcagattc

SEQ ID NO: 674710 - DNA, 20 bp, Artificial
  CRISPR gRNA sequence
caaatcagattctggagttg

SEQ ID NO: 674711 - DNA, 20 bp, Artificial
  CRISPR gRNA sequence
aaatcagattctggagttgg

SEQ ID NO: 674712 - DNA, 20 bp, Artificial
  CRISPR gRNA sequence
tggagttggtcttcagcctt

SEQ ID NO: 674713 - DNA, 20 bp, Artificial
  CRISPR gRNA sequence
gagttggtcttcagccttat

SEQ ID NO: 674714 - DNA, 20 bp, Artificial
  CRISPR gRNA sequence
gtcttcagccttatttgcct

SEQ ID NO: 674715 - DNA, 20 bp, Artificial
  CRISPR gRNA sequence
cagccttatttgccttgagg

SEQ ID NO: 674716 - DNA, 20 bp, Artificial
  CRISPR gRNA sequence
agccttatttgccttgaggc

SEQ ID NO: 674717 - DNA, 20 bp, Artificial
  CRISPR gRNA sequence
atttgccttgaggcttaagt

SEQ ID NO: 674718 - DNA, 20 bp, Artificial
  CRISPR gRNA sequence
tttgccttgaggcttaagtg

SEQ ID NO: 674719 - DNA, 20 bp, Artificial
  CRISPR gRNA sequence
gccttgaggcttaagtggat

SEQ ID NO: 674720 - DNA, 20 bp, Artificial
  CRISPR gRNA sequence
ccttgaggcttaagtggata

SEQ ID NO: 674721 - DNA, 20 bp, Artificial
  CRISPR gRNA sequence
gaggcttaagtggataaggg

SEQ ID NO: 674722 - DNA, 20 bp, Artificial
  CRISPR gRNA sequence
aggcttaagtggataaggga

SEQ ID NO: 674723 - DNA, 20 bp, Artificial
  CRISPR gRNA sequence
aagtggataagggacccttt

SEQ ID NO: 674724 - DNA, 20 bp, Artificial
  CRISPR gRNA sequence
agtggataagggaccctttt

SEQ ID NO: 674725 - DNA, 20 bp, Artificial
  CRISPR gRNA sequence
ttaaagctgacataaacttt

SEQ ID NO: 674726 - DNA, 20 bp, Artificial
  CRISPR gRNA sequence
taaagctgacataaactttc

SEQ ID NO: 674727 - DNA, 20 bp, Artificial
  CRISPR gRNA sequence
aaagctgacataaactttct

SEQ ID NO: 674728 - DNA, 20 bp, Artificial
  CRISPR gRNA sequence
aagctgacataaactttctt

SEQ ID NO: 674729 - DNA, 20 bp, Artificial
  CRISPR gRNA sequence
acataaactttcttgtattt

SEQ ID NO: 674730 - DNA, 20 bp, Artificial
  CRISPR gRNA sequence
tcttgtattttgcctgtatt

SEQ ID NO: 674731 - DNA, 20 bp, Artificial
  CRISPR gRNA sequence
cttgtattttgcctgtattc

SEQ ID NO: 674732 - DNA, 20 bp, Artificial
  CRISPR gRNA sequence
ttgtattttgcctgtattct

SEQ ID NO: 674733 - DNA, 20 bp, Artificial
  CRISPR gRNA sequence
gtattttgcctgtattctga

SEQ ID NO: 674734 - DNA, 20 bp, Artificial
  CRISPR gRNA sequence
tattttgcctgtattctgac

SEQ ID NO: 674735 - DNA, 20 bp, Artificial
  CRISPR gRNA sequence
tgcctgtattctgacttgag

SEQ ID NO: 674736 - DNA, 20 bp, Artificial
  CRISPR gRNA sequence
gcctgtattctgacttgagt

SEQ ID NO: 674737 - DNA, 20 bp, Artificial
  CRISPR gRNA sequence
cctgtattctgacttgagta

SEQ ID NO: 674738 - DNA, 20 bp, Artificial
  CRISPR gRNA sequence
tattctgacttgagtattcc

SEQ ID NO: 674739 - DNA, 20 bp, Artificial
  CRISPR gRNA sequence
tgacttgagtattccaggca

SEQ ID NO: 674740 - DNA, 20 bp, Artificial
  CRISPR gRNA sequence
acttgagtattccaggcact

SEQ ID NO: 674741 - DNA, 20 bp, Artificial
  CRISPR gRNA sequence
gagtattccaggcactcagt

SEQ ID NO: 674742 - DNA, 20 bp, Artificial
  CRISPR gRNA sequence
agtattccaggcactcagtt

SEQ ID NO: 674743 - DNA, 20 bp, Artificial
  CRISPR gRNA sequence
caggcactcagtttgtcttc

SEQ ID NO: 674744 - DNA, 20 bp, Artificial
  CRISPR gRNA sequence
agtttgtcttccacctttgt

SEQ ID NO: 674745 - DNA, 20 bp, Artificial
  CRISPR gRNA sequence
gtcttccacctttgtgtgct

SEQ ID NO: 674746 - DNA, 20 bp, Artificial
  CRISPR gRNA sequence
tcttccacctttgtgtgctc

SEQ ID NO: 674747 - DNA, 20 bp, Artificial
  CRISPR gRNA sequence
ccacctttgtgtgctcctta

SEQ ID NO: 674748 - DNA, 20 bp, Artificial
  CRISPR gRNA sequence
cacctttgtgtgctccttag

SEQ ID NO: 674749 - DNA, 20 bp, Artificial
  CRISPR gRNA sequence
tgtgtgctccttagggccat

SEQ ID NO: 674750 - DNA, 20 bp, Artificial
  CRISPR gRNA sequence
gtgtgctccttagggccatc

SEQ ID NO: 674751 - DNA, 20 bp, Artificial
  CRISPR gRNA sequence
tgtgctccttagggccatca

SEQ ID NO: 674752 - DNA, 20 bp, Artificial
  CRISPR gRNA sequence
cttagggccatcagccatat

SEQ ID NO: 674753 - DNA, 20 bp, Artificial
  CRISPR gRNA sequence
agggccatcagccatatcat

SEQ ID NO: 674754 - DNA, 20 bp, Artificial
  CRISPR gRNA sequence
gggccatcagccatatcatg

SEQ ID NO: 674755 - DNA, 20 bp, Artificial
  CRISPR gRNA sequence
taatctttatacactaccat

SEQ ID NO: 674756 - DNA, 20 bp, Artificial
  CRISPR gRNA sequence
tatacactaccattgctgct

SEQ ID NO: 674757 - DNA, 20 bp, Artificial
  CRISPR gRNA sequence
atacactaccattgctgctt

SEQ ID NO: 674758 - DNA, 20 bp, Artificial
  CRISPR gRNA sequence
tacactaccattgctgcttt

SEQ ID NO: 674759 - DNA, 20 bp, Artificial
  CRISPR gRNA sequence
ccattgctgctttagcaagt

SEQ ID NO: 674760 - DNA, 20 bp, Artificial
  CRISPR gRNA sequence
ctgctttagcaagtaatgcc

SEQ ID NO: 674761 - DNA, 20 bp, Artificial
  CRISPR gRNA sequence
ctttagcaagtaatgccatg

SEQ ID NO: 674762 - DNA, 20 bp, Artificial
  CRISPR gRNA sequence
tagcaagtaatgccatggct

SEQ ID NO: 674763 - DNA, 20 bp, Artificial
  CRISPR gRNA sequence
agcaagtaatgccatggctc

SEQ ID NO: 674764 - DNA, 20 bp, Artificial
  CRISPR gRNA sequence
gcaagtaatgccatggctcc

SEQ ID NO: 674765 - DNA, 20 bp, Artificial
  CRISPR gRNA sequence
ccaaagccttaccctgcgtc

SEQ ID NO: 674766 - DNA, 20 bp, Artificial
  CRISPR gRNA sequence
accctgcgtcgtacatcctt

SEQ ID NO: 674767 - DNA, 20 bp, Artificial
  CRISPR gRNA sequence
ccctgcgtcgtacatccttc

SEQ ID NO: 674768 - DNA, 20 bp, Artificial
  CRISPR gRNA sequence
cgtcgtacatccttccatgc

SEQ ID NO: 674769 - DNA, 20 bp, Artificial
  CRISPR gRNA sequence
ccatgctaccaccagtgaca

SEQ ID NO: 674770 - DNA, 20 bp, Artificial
  CRISPR gRNA sequence
catgctaccaccagtgacaa

SEQ ID NO: 674771 - DNA, 20 bp, Artificial
  CRISPR gRNA sequence
ccaccagtgacaatttgaat

SEQ ID NO: 674772 - DNA, 20 bp, Artificial
  CRISPR gRNA sequence
gaataatcatcttgccagca

SEQ ID NO: 674773 - DNA, 20 bp, Artificial
  CRISPR gRNA sequence
aataatcatcttgccagcac

SEQ ID NO: 674774 - DNA, 20 bp, Artificial
  CRISPR gRNA sequence
gccagcacatgccttggatc

SEQ ID NO: 674775 - DNA, 20 bp, Artificial
  CRISPR gRNA sequence
ccagcacatgccttggatca

SEQ ID NO: 674776 - DNA, 20 bp, Artificial
  CRISPR gRNA sequence
ggatcactactgtcccatta

SEQ ID NO: 674777 - DNA, 20 bp, Artificial
  CRISPR gRNA sequence
gatcactactgtcccattaa

SEQ ID NO: 674778 - DNA, 20 bp, Artificial
  CRISPR gRNA sequence
ctgtcccattaactctgtga

SEQ ID NO: 674779 - DNA, 20 bp, Artificial
  CRISPR gRNA sequence
tcccattaactctgtgataa

SEQ ID NO: 674780 - DNA, 20 bp, Artificial
  CRISPR gRNA sequence
actctgtgataaggaggcta

SEQ ID NO: 674781 - DNA, 20 bp, Artificial
  CRISPR gRNA sequence
tgtgataaggaggctatcct

SEQ ID NO: 674782 - DNA, 20 bp, Artificial
  CRISPR gRNA sequence
tgataaggaggctatcctgc

SEQ ID NO: 674783 - DNA, 20 bp, Artificial
  CRISPR gRNA sequence
tcctgctatccttgaattcc

SEQ ID NO: 674784 - DNA, 20 bp, Artificial
  CRISPR gRNA sequence
ctatccttgaattccatttt

SEQ ID NO: 674785 - DNA, 20 bp, Artificial
  CRISPR gRNA sequence
tccttgaattccattttgac

SEQ ID NO: 674786 - DNA, 20 bp, Artificial
  CRISPR gRNA sequence
gaattccattttgactggag

SEQ ID NO: 674787 - DNA, 20 bp, Artificial
  CRISPR gRNA sequence
aattccattttgactggagc

SEQ ID NO: 674788 - DNA, 20 bp, Artificial
  CRISPR gRNA sequence
cattttgactggagctttgg

SEQ ID NO: 674789 - DNA, 20 bp, Artificial
  CRISPR gRNA sequence
tgactggagctttgggccat

SEQ ID NO: 674790 - DNA, 20 bp, Artificial
  CRISPR gRNA sequence
gactggagctttgggccatt

SEQ ID NO: 674791 - DNA, 20 bp, Artificial
  CRISPR gRNA sequence
actggagctttgggccattt

SEQ ID NO: 674792 - DNA, 20 bp, Artificial
  CRISPR gRNA sequence
gagctttgggccatttctga

SEQ ID NO: 674793 - DNA, 20 bp, Artificial
  CRISPR gRNA sequence
tgggccatttctgatatcag

SEQ ID NO: 674794 - DNA, 20 bp, Artificial
  CRISPR gRNA sequence
gggccatttctgatatcagt

SEQ ID NO: 674795 - DNA, 20 bp, Artificial
  CRISPR gRNA sequence
ggccatttctgatatcagta

SEQ ID NO: 674796 - DNA, 20 bp, Artificial
  CRISPR gRNA sequence
ctgatatcagtaactcttta

SEQ ID NO: 674797 - DNA, 20 bp, Artificial
  CRISPR gRNA sequence
tgatatcagtaactctttat

SEQ ID NO: 674798 - DNA, 20 bp, Artificial
  CRISPR gRNA sequence
atatcagtaactctttatca

SEQ ID NO: 674799 - DNA, 20 bp, Artificial
  CRISPR gRNA sequence
tttatcagtcaggatcctga

SEQ ID NO: 674800 - DNA, 20 bp, Artificial
  CRISPR gRNA sequence
tatcagtcaggatcctgaca

SEQ ID NO: 674801 - DNA, 20 bp, Artificial
  CRISPR gRNA sequence
atcagtcaggatcctgacaa

SEQ ID NO: 674802 - DNA, 20 bp, Artificial
  CRISPR gRNA sequence
tcagtcaggatcctgacaag

SEQ ID NO: 674803 - DNA, 20 bp, Artificial
  CRISPR gRNA sequence
acaagaaaacagtaagacac

SEQ ID NO: 674804 - DNA, 20 bp, Artificial
  CRISPR gRNA sequence
aagtggggaaaatttgggga

SEQ ID NO: 674805 - DNA, 20 bp, Artificial
  CRISPR gRNA sequence
ggggacatgcatgaaagaca

SEQ ID NO: 674806 - DNA, 20 bp, Artificial
  CRISPR gRNA sequence
gggacatgcatgaaagacaa

SEQ ID NO: 674807 - DNA, 20 bp, Artificial
  CRISPR gRNA sequence
acaaaagaatggttaggaat

SEQ ID NO: 674808 - DNA, 20 bp, Artificial
  CRISPR gRNA sequence
ggaataagggtagtctacaa

SEQ ID NO: 674809 - DNA, 20 bp, Artificial
  CRISPR gRNA sequence
caaaaagatggctgggttta

SEQ ID NO: 674810 - DNA, 20 bp, Artificial
  CRISPR gRNA sequence
ggtttacagtagtaggaagc

SEQ ID NO: 674811 - DNA, 20 bp, Artificial
  CRISPR gRNA sequence
acagtagtaggaagccattt

SEQ ID NO: 674812 - DNA, 20 bp, Artificial
  CRISPR gRNA sequence
cagtagtaggaagccattta

SEQ ID NO: 674813 - DNA, 20 bp, Artificial
  CRISPR gRNA sequence
actagctctagcctgaaaga

SEQ ID NO: 674814 - DNA, 20 bp, Artificial
  CRISPR gRNA sequence
ctagctctagcctgaaagag

SEQ ID NO: 674815 - DNA, 20 bp, Artificial
  CRISPR gRNA sequence
gctctagcctgaaagagaaa

SEQ ID NO: 674816 - DNA, 20 bp, Artificial
  CRISPR gRNA sequence
tagcctgaaagagaaagggg

SEQ ID NO: 674817 - DNA, 20 bp, Artificial
  CRISPR gRNA sequence
gcctgaaagagaaaggggat

SEQ ID NO: 674818 - DNA, 20 bp, Artificial
  CRISPR gRNA sequence
aaagagaaaggggatctaga

SEQ ID NO: 674819 - DNA, 20 bp, Artificial
  CRISPR gRNA sequence
gaggtcactggaattaagag

SEQ ID NO: 674820 - DNA, 20 bp, Artificial
  CRISPR gRNA sequence
gaattaagagaaataggaaa

SEQ ID NO: 674821 - DNA, 20 bp, Artificial
  CRISPR gRNA sequence
agagaaataggaaagggtct

SEQ ID NO: 674822 - DNA, 20 bp, Artificial
  CRISPR gRNA sequence
gagcactgaccttcggtaga

SEQ ID NO: 674823 - DNA, 20 bp, Artificial
  CRISPR gRNA sequence
agcactgaccttcggtagaa

SEQ ID NO: 674824 - DNA, 20 bp, Artificial
  CRISPR gRNA sequence
accttcggtagaagaatgta

SEQ ID NO: 674825 - DNA, 20 bp, Artificial
  CRISPR gRNA sequence
cggtagaagaatgtagcctt

SEQ ID NO: 674826 - DNA, 20 bp, Artificial
  CRISPR gRNA sequence
ggtagaagaatgtagccttt

SEQ ID NO: 674827 - DNA, 20 bp, Artificial
  CRISPR gRNA sequence
tgctaacctgtgacttgggg

SEQ ID NO: 674828 - DNA, 20 bp, Artificial
  CRISPR gRNA sequence
gctaacctgtgacttgggga

SEQ ID NO: 674829 - DNA, 20 bp, Artificial
  CRISPR gRNA sequence
ctaacctgtgacttggggaa

SEQ ID NO: 674830 - DNA, 20 bp, Artificial
  CRISPR gRNA sequence
acctgtgacttggggaataa

SEQ ID NO: 674831 - DNA, 20 bp, Artificial
  CRISPR gRNA sequence
tgacttggggaataaacacc

SEQ ID NO: 674832 - DNA, 20 bp, Artificial
  CRISPR gRNA sequence
ggggaataaacaccctgacc

SEQ ID NO: 674833 - DNA, 20 bp, Artificial
  CRISPR gRNA sequence
gggaataaacaccctgacct

SEQ ID NO: 674834 - DNA, 20 bp, Artificial
  CRISPR gRNA sequence
acctcactctttccaccctt

SEQ ID NO: 674835 - DNA, 20 bp, Artificial
  CRISPR gRNA sequence
actctttccacccttcagtc

SEQ ID NO: 674836 - DNA, 20 bp, Artificial
  CRISPR gRNA sequence
tttccacccttcagtctctt

SEQ ID NO: 674837 - DNA, 20 bp, Artificial
  CRISPR gRNA sequence
tccacccttcagtctcttac

SEQ ID NO: 674838 - DNA, 20 bp, Artificial
  CRISPR gRNA sequence
ccacccttcagtctcttact

SEQ ID NO: 674839 - DNA, 20 bp, Artificial
  CRISPR gRNA sequence
cacccttcagtctcttactg

SEQ ID NO: 674840 - DNA, 20 bp, Artificial
  CRISPR gRNA sequence
cagtctcttactggtgcctc

SEQ ID NO: 674841 - DNA, 20 bp, Artificial
  CRISPR gRNA sequence
agtctcttactggtgcctca

SEQ ID NO: 674842 - DNA, 20 bp, Artificial
  CRISPR gRNA sequence
ttactggtgcctcacattga

SEQ ID NO: 674843 - DNA, 20 bp, Artificial
  CRISPR gRNA sequence
actggtgcctcacattgact

SEQ ID NO: 674844 - DNA, 20 bp, Artificial
  CRISPR gRNA sequence
ctggtgcctcacattgacta

SEQ ID NO: 674845 - DNA, 20 bp, Artificial
  CRISPR gRNA sequence
gtgcctcacattgactaaac

SEQ ID NO: 674846 - DNA, 20 bp, Artificial
  CRISPR gRNA sequence
acattgactaaacttaacca

SEQ ID NO: 674847 - DNA, 20 bp, Artificial
  CRISPR gRNA sequence
actaaacttaaccagaagcc

SEQ ID NO: 674848 - DNA, 20 bp, Artificial
  CRISPR gRNA sequence
aacttaaccagaagccagag

SEQ ID NO: 674849 - DNA, 20 bp, Artificial
  CRISPR gRNA sequence
aaccagaagccagaggacaa

SEQ ID NO: 674850 - DNA, 20 bp, Artificial
  CRISPR gRNA sequence
accagaagccagaggacaac

SEQ ID NO: 674851 - DNA, 20 bp, Artificial
  CRISPR gRNA sequence
attaaagccaataaaaatta

SEQ ID NO: 674852 - DNA, 20 bp, Artificial
  CRISPR gRNA sequence
aagccaataaaaattagctt

SEQ ID NO: 674853 - DNA, 20 bp, Artificial
  CRISPR gRNA sequence
gcttttgcgggagcagagca

SEQ ID NO: 674854 - DNA, 20 bp, Artificial
  CRISPR gRNA sequence
ttgcgggagcagagcaaaga

SEQ ID NO: 674855 - DNA, 20 bp, Artificial
  CRISPR gRNA sequence
tgcgggagcagagcaaagaa

SEQ ID NO: 674856 - DNA, 20 bp, Artificial
  CRISPR gRNA sequence
gcgggagcagagcaaagaag

SEQ ID NO: 674857 - DNA, 20 bp, Artificial
  CRISPR gRNA sequence
cgggagcagagcaaagaagt

SEQ ID NO: 674858 - DNA, 20 bp, Artificial
  CRISPR gRNA sequence
tggcagccaaacagagaatg

SEQ ID NO: 674859 - DNA, 20 bp, Artificial
  CRISPR gRNA sequence
actaaaatttaagaactagt

SEQ ID NO: 674860 - DNA, 20 bp, Artificial
  CRISPR gRNA sequence
aaatttaagaactagtgctt

SEQ ID NO: 674861 - DNA, 20 bp, Artificial
  CRISPR gRNA sequence
aagaactagtgcttaaaatt

SEQ ID NO: 674862 - DNA, 20 bp, Artificial
  CRISPR gRNA sequence
agaactagtgcttaaaatta

SEQ ID NO: 674863 - DNA, 20 bp, Artificial
  CRISPR gRNA sequence
gtgcttaaaattactagtat

SEQ ID NO: 674864 - DNA, 20 bp, Artificial
  CRISPR gRNA sequence
aaaattactagtatagagca

SEQ ID NO: 674865 - DNA, 20 bp, Artificial
  CRISPR gRNA sequence
aaattactagtatagagcag

SEQ ID NO: 674866 - DNA, 20 bp, Artificial
  CRISPR gRNA sequence
ctagtatagagcaggggtcc

SEQ ID NO: 674867 - DNA, 20 bp, Artificial
  CRISPR gRNA sequence
gtatagagcaggggtcctca

SEQ ID NO: 674868 - DNA, 20 bp, Artificial
  CRISPR gRNA sequence
aacctcctggctgcagacca

SEQ ID NO: 674869 - DNA, 20 bp, Artificial
  CRISPR gRNA sequence
ctggctgcagaccagtacca

SEQ ID NO: 674870 - DNA, 20 bp, Artificial
  CRISPR gRNA sequence
gctgcagaccagtaccagtc

SEQ ID NO: 674871 - DNA, 20 bp, Artificial
  CRISPR gRNA sequence
cagaccagtaccagtcactg

SEQ ID NO: 674872 - DNA, 20 bp, Artificial
  CRISPR gRNA sequence
ggtggcctcttacaaattga

SEQ ID NO: 674873 - DNA, 20 bp, Artificial
  CRISPR gRNA sequence
ttacaaattgagccgcatag

SEQ ID NO: 674874 - DNA, 20 bp, Artificial
  CRISPR gRNA sequence
acaaattgagccgcatagca

SEQ ID NO: 674875 - DNA, 20 bp, Artificial
  CRISPR gRNA sequence
caaattgagccgcatagcag

SEQ ID NO: 674876 - DNA, 20 bp, Artificial
  CRISPR gRNA sequence
agccgcatagcaggaggtga

SEQ ID NO: 674877 - DNA, 20 bp, Artificial
  CRISPR gRNA sequence
ctgcctgagctcctcttcct

SEQ ID NO: 674878 - DNA, 20 bp, Artificial
  CRISPR gRNA sequence
cctgagctcctcttcctgtc

SEQ ID NO: 674879 - DNA, 20 bp, Artificial
  CRISPR gRNA sequence
agctcctcttcctgtcagat

SEQ ID NO: 674880 - DNA, 20 bp, Artificial
  CRISPR gRNA sequence
ctcttcctgtcagatcagtg

SEQ ID NO: 674881 - DNA, 20 bp, Artificial
  CRISPR gRNA sequence
ttcctgtcagatcagtgaca

SEQ ID NO: 674882 - DNA, 20 bp, Artificial
  CRISPR gRNA sequence
cctgtcagatcagtgacagc

SEQ ID NO: 674883 - DNA, 20 bp, Artificial
  CRISPR gRNA sequence
ctgtcagatcagtgacagca

SEQ ID NO: 674884 - DNA, 20 bp, Artificial
  CRISPR gRNA sequence
tcagatcagtgacagcatta

SEQ ID NO: 674885 - DNA, 20 bp, Artificial
  CRISPR gRNA sequence
gattctcataggcacgcacc

SEQ ID NO: 674886 - DNA, 20 bp, Artificial
  CRISPR gRNA sequence
tcataggcacgcaccctatt

SEQ ID NO: 674887 - DNA, 20 bp, Artificial
  CRISPR gRNA sequence
ataggcacgcaccctattgt

SEQ ID NO: 674888 - DNA, 20 bp, Artificial
  CRISPR gRNA sequence
ttgtgaactgcgcatgcaag

SEQ ID NO: 674889 - DNA, 20 bp, Artificial
  CRISPR gRNA sequence
tgaactgcgcatgcaaggga

SEQ ID NO: 674890 - DNA, 20 bp, Artificial
  CRISPR gRNA sequence
cgcatgcaagggacctactt

SEQ ID NO: 674891 - DNA, 20 bp, Artificial
  CRISPR gRNA sequence
cttggtgtgctccttatgag

SEQ ID NO: 674892 - DNA, 20 bp, Artificial
  CRISPR gRNA sequence
ggtgtgctccttatgagaat

SEQ ID NO: 674893 - DNA, 20 bp, Artificial
  CRISPR gRNA sequence
gtgtgctccttatgagaatc

SEQ ID NO: 674894 - DNA, 20 bp, Artificial
  CRISPR gRNA sequence
cttatgagaatctaatgcct

SEQ ID NO: 674895 - DNA, 20 bp, Artificial
  CRISPR gRNA sequence
atgagaatctaatgcctgat

SEQ ID NO: 674896 - DNA, 20 bp, Artificial
  CRISPR gRNA sequence
tgagaatctaatgcctgatg

SEQ ID NO: 674897 - DNA, 20 bp, Artificial
  CRISPR gRNA sequence
atgcctgatgatctgaggtg

SEQ ID NO: 674898 - DNA, 20 bp, Artificial
  CRISPR gRNA sequence
atgatctgaggtggaatagt

SEQ ID NO: 674899 - DNA, 20 bp, Artificial
  CRISPR gRNA sequence
aggtggaatagtttcattct

SEQ ID NO: 674900 - DNA, 20 bp, Artificial
  CRISPR gRNA sequence
cattctgaaatcattccccc

SEQ ID NO: 674901 - DNA, 20 bp, Artificial
  CRISPR gRNA sequence
attctgaaatcattccccca

SEQ ID NO: 674902 - DNA, 20 bp, Artificial
  CRISPR gRNA sequence
tgaaatcattcccccaccac

SEQ ID NO: 674903 - DNA, 20 bp, Artificial
  CRISPR gRNA sequence
aaatcattcccccaccacct

SEQ ID NO: 674904 - DNA, 20 bp, Artificial
  CRISPR gRNA sequence
ccccaccacctgtcatttgt

SEQ ID NO: 674905 - DNA, 20 bp, Artificial
  CRISPR gRNA sequence
tcatttgtggaaaaactgtc

SEQ ID NO: 674906 - DNA, 20 bp, Artificial
  CRISPR gRNA sequence
gtggaaaaactgtcttccat

SEQ ID NO: 674907 - DNA, 20 bp, Artificial
  CRISPR gRNA sequence
tggaaaaactgtcttccatg

SEQ ID NO: 674908 - DNA, 20 bp, Artificial
  CRISPR gRNA sequence
tcttccatgaaactggtccc

SEQ ID NO: 674909 - DNA, 20 bp, Artificial
  CRISPR gRNA sequence
ccatgaaactggtccctggt

SEQ ID NO: 674910 - DNA, 20 bp, Artificial
  CRISPR gRNA sequence
catgaaactggtccctggtg

SEQ ID NO: 674911 - DNA, 20 bp, Artificial
  CRISPR gRNA sequence
gtccctggtggtgaaaaggt

SEQ ID NO: 674912 - DNA, 20 bp, Artificial
  CRISPR gRNA sequence
gtggtgaaaaggttgggaac

SEQ ID NO: 674913 - DNA, 20 bp, Artificial
  CRISPR gRNA sequence
ggaactgctgatatagagta

SEQ ID NO: 674914 - DNA, 20 bp, Artificial
  CRISPR gRNA sequence
ctgatatagagtattaaggg

SEQ ID NO: 674915 - DNA, 20 bp, Artificial
  CRISPR gRNA sequence
atatagagtattaaggggaa

SEQ ID NO: 674916 - DNA, 20 bp, Artificial
  CRISPR gRNA sequence
aggggaatataatgatttta

SEQ ID NO: 674917 - DNA, 20 bp, Artificial
  CRISPR gRNA sequence
taaatttaatctctgttttt

SEQ ID NO: 674918 - DNA, 20 bp, Artificial
  CRISPR gRNA sequence
aaatttaatctctgttttta

SEQ ID NO: 674919 - DNA, 20 bp, Artificial
  CRISPR gRNA sequence
aatttaatctctgtttttat

SEQ ID NO: 674920 - DNA, 20 bp, Artificial
  CRISPR gRNA sequence
aatctctgtttttatgaata

SEQ ID NO: 674921 - DNA, 20 bp, Artificial
  CRISPR gRNA sequence
atctctgtttttatgaatat

SEQ ID NO: 674922 - DNA, 20 bp, Artificial
  CRISPR gRNA sequence
tgtttttatgaatattatta

SEQ ID NO: 674923 - DNA, 20 bp, Artificial
  CRISPR gRNA sequence
tttttatgaatattattatt

SEQ ID NO: 674924 - DNA, 20 bp, Artificial
  CRISPR gRNA sequence
ttatgaatattattattggt

SEQ ID NO: 674925 - DNA, 20 bp, Artificial
  CRISPR gRNA sequence
tatgaatattattattggta

SEQ ID NO: 674926 - DNA, 20 bp, Artificial
  CRISPR gRNA sequence
atgaatattattattggtag

SEQ ID NO: 674927 - DNA, 20 bp, Artificial
  CRISPR gRNA sequence
tgaatattattattggtaga

SEQ ID NO: 674928 - DNA, 20 bp, Artificial
  CRISPR gRNA sequence
ttattggtagaaagtattag

SEQ ID NO: 674929 - DNA, 20 bp, Artificial
  CRISPR gRNA sequence
ttggtagaaagtattagcct

SEQ ID NO: 674930 - DNA, 20 bp, Artificial
  CRISPR gRNA sequence
gtagaaagtattagcctccc

SEQ ID NO: 674931 - DNA, 20 bp, Artificial
  CRISPR gRNA sequence
gcctccctttttcctccagg

SEQ ID NO: 674932 - DNA, 20 bp, Artificial
  CRISPR gRNA sequence
cctttttcctccaggtaata

SEQ ID NO: 674933 - DNA, 20 bp, Artificial
  CRISPR gRNA sequence
tttcctccaggtaataactg

SEQ ID NO: 674934 - DNA, 20 bp, Artificial
  CRISPR gRNA sequence
ttcctccaggtaataactgt

SEQ ID NO: 674935 - DNA, 20 bp, Artificial
  CRISPR gRNA sequence
tcctccaggtaataactgtc

SEQ ID NO: 674936 - DNA, 20 bp, Artificial
  CRISPR gRNA sequence
cctccaggtaataactgtcc

SEQ ID NO: 674937 - DNA, 20 bp, Artificial
  CRISPR gRNA sequence
ctccaggtaataactgtcca

SEQ ID NO: 674938 - DNA, 20 bp, Artificial
  CRISPR gRNA sequence
caggtaataactgtccattg

SEQ ID NO: 674939 - DNA, 20 bp, Artificial
  CRISPR gRNA sequence
tccattgttttattgtattg

SEQ ID NO: 674940 - DNA, 20 bp, Artificial
  CRISPR gRNA sequence
ttttattgtattgttattta

SEQ ID NO: 674941 - DNA, 20 bp, Artificial
  CRISPR gRNA sequence
tattgtattgttatttatca

SEQ ID NO: 674942 - DNA, 20 bp, Artificial
  CRISPR gRNA sequence
attgtattgttatttatcat

SEQ ID NO: 674943 - DNA, 20 bp, Artificial
  CRISPR gRNA sequence
ttgtattgttatttatcatg

SEQ ID NO: 674944 - DNA, 20 bp, Artificial
  CRISPR gRNA sequence
tattgttatttatcatgttg

SEQ ID NO: 674945 - DNA, 20 bp, Artificial
  CRISPR gRNA sequence
ttatttatcatgttggatat

SEQ ID NO: 674946 - DNA, 20 bp, Artificial
  CRISPR gRNA sequence
tttatcatgttggatattaa

SEQ ID NO: 674947 - DNA, 20 bp, Artificial
  CRISPR gRNA sequence
atcatgttggatattaatac

SEQ ID NO: 674948 - DNA, 20 bp, Artificial
  CRISPR gRNA sequence
tcatgttggatattaatacc

SEQ ID NO: 674949 - DNA, 20 bp, Artificial
  CRISPR gRNA sequence
gatattaataccacatttct

SEQ ID NO: 674950 - DNA, 20 bp, Artificial
  CRISPR gRNA sequence
ataccacatttctgcttcct

SEQ ID NO: 674951 - DNA, 20 bp, Artificial
  CRISPR gRNA sequence
ctgcttcctatattgtagac

SEQ ID NO: 674952 - DNA, 20 bp, Artificial
  CRISPR gRNA sequence
tgcttcctatattgtagact

SEQ ID NO: 674953 - DNA, 20 bp, Artificial
  CRISPR gRNA sequence
cttcctatattgtagactta

SEQ ID NO: 674954 - DNA, 20 bp, Artificial
  CRISPR gRNA sequence
cctatattgtagacttaaaa

SEQ ID NO: 674955 - DNA, 20 bp, Artificial
  CRISPR gRNA sequence
ctatattgtagacttaaaaa

SEQ ID NO: 674956 - DNA, 20 bp, Artificial
  CRISPR gRNA sequence
tattgtagacttaaaaattt

SEQ ID NO: 674957 - DNA, 20 bp, Artificial
  CRISPR gRNA sequence
tagacttaaaaatttctcat

SEQ ID NO: 674958 - DNA, 20 bp, Artificial
  CRISPR gRNA sequence
aaaaatttctcatcttgatt

SEQ ID NO: 674959 - DNA, 20 bp, Artificial
  CRISPR gRNA sequence
aaaatttctcatcttgattt

SEQ ID NO: 674960 - DNA, 20 bp, Artificial
  CRISPR gRNA sequence
ctcatcttgattttcattta

SEQ ID NO: 674961 - DNA, 20 bp, Artificial
  CRISPR gRNA sequence
tcatcttgattttcatttag

SEQ ID NO: 674962 - DNA, 20 bp, Artificial
  CRISPR gRNA sequence
atcttgattttcatttagta

SEQ ID NO: 674963 - DNA, 20 bp, Artificial
  CRISPR gRNA sequence
gattttcatttagtaggttg

SEQ ID NO: 674964 - DNA, 20 bp, Artificial
  CRISPR gRNA sequence
attttcatttagtaggttgg

SEQ ID NO: 674965 - DNA, 20 bp, Artificial
  CRISPR gRNA sequence
tcatttagtaggttggtaac

SEQ ID NO: 674966 - DNA, 20 bp, Artificial
  CRISPR gRNA sequence
catttagtaggttggtaaca

SEQ ID NO: 674967 - DNA, 20 bp, Artificial
  CRISPR gRNA sequence
atttagtaggttggtaacaa

SEQ ID NO: 674968 - DNA, 20 bp, Artificial
  CRISPR gRNA sequence
agtaggttggtaacaacaag

SEQ ID NO: 674969 - DNA, 20 bp, Artificial
  CRISPR gRNA sequence
gtaggttggtaacaacaagc

SEQ ID NO: 674970 - DNA, 20 bp, Artificial
  CRISPR gRNA sequence
gtaacaacaagcccagcaca

SEQ ID NO: 674971 - DNA, 20 bp, Artificial
  CRISPR gRNA sequence
ctgtgatagatgttacagtt

SEQ ID NO: 674972 - DNA, 20 bp, Artificial
  CRISPR gRNA sequence
tgatagatgttacagtttaa

SEQ ID NO: 674973 - DNA, 20 bp, Artificial
  CRISPR gRNA sequence
cagtttaagaaatgaaaaat

SEQ ID NO: 674974 - DNA, 20 bp, Artificial
  CRISPR gRNA sequence
aagaaatgaaaaatactttg

SEQ ID NO: 674975 - DNA, 20 bp, Artificial
  CRISPR gRNA sequence
agaaatgaaaaatactttga

SEQ ID NO: 674976 - DNA, 20 bp, Artificial
  CRISPR gRNA sequence
tgaaaaatatctggaataca

SEQ ID NO: 674977 - DNA, 20 bp, Artificial
  CRISPR gRNA sequence
gaaaaatatctggaatacaa

SEQ ID NO: 674978 - DNA, 20 bp, Artificial
  CRISPR gRNA sequence
aaaaatatctggaatacaat

SEQ ID NO: 674979 - DNA, 20 bp, Artificial
  CRISPR gRNA sequence
gaatacaatatgtattaagt

SEQ ID NO: 674980 - DNA, 20 bp, Artificial
  CRISPR gRNA sequence
agtaaatactaggggtgtgt

SEQ ID NO: 674981 - DNA, 20 bp, Artificial
  CRISPR gRNA sequence
ggggtgtgtgtgtgtgtgtg

SEQ ID NO: 674982 - DNA, 20 bp, Artificial
  CRISPR gRNA sequence
catttaccttgcatgatccc

SEQ ID NO: 674983 - DNA, 20 bp, Artificial
  CRISPR gRNA sequence
atttaccttgcatgatccct

SEQ ID NO: 674984 - DNA, 20 bp, Artificial
  CRISPR gRNA sequence
accttgcatgatccctgtac

SEQ ID NO: 674985 - DNA, 20 bp, Artificial
  CRISPR gRNA sequence
ccttgcatgatccctgtaca

SEQ ID NO: 674986 - DNA, 20 bp, Artificial
  CRISPR gRNA sequence
gcatgatccctgtacaaggt

SEQ ID NO: 674987 - DNA, 20 bp, Artificial
  CRISPR gRNA sequence
catgatccctgtacaaggtg

SEQ ID NO: 674988 - DNA, 20 bp, Artificial
  CRISPR gRNA sequence
tacaaggtggtatttttctg

SEQ ID NO: 674989 - DNA, 20 bp, Artificial
  CRISPR gRNA sequence
ttctgcttaggaactcttct

SEQ ID NO: 674990 - DNA, 20 bp, Artificial
  CRISPR gRNA sequence
tctgcttaggaactcttctt

SEQ ID NO: 674991 - DNA, 20 bp, Artificial
  CRISPR gRNA sequence
ctgcttaggaactcttcttg

SEQ ID NO: 674992 - DNA, 20 bp, Artificial
  CRISPR gRNA sequence
tgcttaggaactcttcttgt

SEQ ID NO: 674993 - DNA, 20 bp, Artificial
  CRISPR gRNA sequence
cttaggaactcttcttgtcc

SEQ ID NO: 674994 - DNA, 20 bp, Artificial
  CRISPR gRNA sequence
aggaactcttcttgtcctct

SEQ ID NO: 674995 - DNA, 20 bp, Artificial
  CRISPR gRNA sequence
ggaactcttcttgtcctcta

SEQ ID NO: 674996 - DNA, 20 bp, Artificial
  CRISPR gRNA sequence
ttcttgtcctctagaggaca

SEQ ID NO: 674997 - DNA, 20 bp, Artificial
  CRISPR gRNA sequence
cttgtcctctagaggacacc

SEQ ID NO: 674998 - DNA, 20 bp, Artificial
  CRISPR gRNA sequence
ttgtcctctagaggacacca

SEQ ID NO: 674999 - DNA, 20 bp, Artificial
  CRISPR gRNA sequence
gtcctctagaggacaccaag

SEQ ID NO: 675000 - DNA, 20 bp, Artificial
  CRISPR gRNA sequence
tcctctagaggacaccaagt

SEQ ID NO: 675001 - DNA, 20 bp, Artificial
  CRISPR gRNA sequence
tagaggacaccaagtagtgt

SEQ ID NO: 675002 - DNA, 20 bp, Artificial
  CRISPR gRNA sequence
gaggacaccaagtagtgtct

SEQ ID NO: 675003 - DNA, 20 bp, Artificial
  CRISPR gRNA sequence
ggtttttattgcataggcct

SEQ ID NO: 675004 - DNA, 20 bp, Artificial
  CRISPR gRNA sequence
gtttttattgcataggcctg

SEQ ID NO: 675005 - DNA, 20 bp, Artificial
  CRISPR gRNA sequence
ttattgcataggcctggtag

SEQ ID NO: 675006 - DNA, 20 bp, Artificial
  CRISPR gRNA sequence
tattgcataggcctggtagt

SEQ ID NO: 675007 - DNA, 20 bp, Artificial
  CRISPR gRNA sequence
attgcataggcctggtagtt

SEQ ID NO: 675008 - DNA, 20 bp, Artificial
  CRISPR gRNA sequence
ttgcataggcctggtagtta

SEQ ID NO: 675009 - DNA, 20 bp, Artificial
  CRISPR gRNA sequence
cataggcctggtagttaggt

SEQ ID NO: 675010 - DNA, 20 bp, Artificial
  CRISPR gRNA sequence
gtagttaggttatttatctg

SEQ ID NO: 675011 - DNA, 20 bp, Artificial
  CRISPR gRNA sequence
ggttatttatctggaatttc

SEQ ID NO: 675012 - DNA, 20 bp, Artificial
  CRISPR gRNA sequence
tttatctggaatttcttgag

SEQ ID NO: 675013 - DNA, 20 bp, Artificial
  CRISPR gRNA sequence
atctggaatttcttgagctt

SEQ ID NO: 675014 - DNA, 20 bp, Artificial
  CRISPR gRNA sequence
tctggaatttcttgagcttt

SEQ ID NO: 675015 - DNA, 20 bp, Artificial
  CRISPR gRNA sequence
gaatttcttgagctttccct

SEQ ID NO: 675016 - DNA, 20 bp, Artificial
  CRISPR gRNA sequence
cttgagctttccctagacag

SEQ ID NO: 675017 - DNA, 20 bp, Artificial
  CRISPR gRNA sequence
ttgagctttccctagacagt

SEQ ID NO: 675018 - DNA, 20 bp, Artificial
  CRISPR gRNA sequence
gagctttccctagacagtag

SEQ ID NO: 675019 - DNA, 20 bp, Artificial
  CRISPR gRNA sequence
agctttccctagacagtaga

SEQ ID NO: 675020 - DNA, 20 bp, Artificial
  CRISPR gRNA sequence
tccctagacagtagacactg

SEQ ID NO: 675021 - DNA, 20 bp, Artificial
  CRISPR gRNA sequence
ccctagacagtagacactgt

SEQ ID NO: 675022 - DNA, 20 bp, Artificial
  CRISPR gRNA sequence
cctagacagtagacactgta

SEQ ID NO: 675023 - DNA, 20 bp, Artificial
  CRISPR gRNA sequence
gacagtagacactgtactaa

SEQ ID NO: 675024 - DNA, 20 bp, Artificial
  CRISPR gRNA sequence
tactaagcattttccatggt

SEQ ID NO: 675025 - DNA, 20 bp, Artificial
  CRISPR gRNA sequence
agcattttccatggtttctt

SEQ ID NO: 675026 - DNA, 20 bp, Artificial
  CRISPR gRNA sequence
tccatggtttctttaataaa

SEQ ID NO: 675027 - DNA, 20 bp, Artificial
  CRISPR gRNA sequence
ccatggtttctttaataaaa

SEQ ID NO: 675028 - DNA, 20 bp, Artificial
  CRISPR gRNA sequence
catggtttctttaataaaaa

SEQ ID NO: 675029 - DNA, 20 bp, Artificial
  CRISPR gRNA sequence
ctttaataaaaaaccttttt

SEQ ID NO: 675030 - DNA, 20 bp, Artificial
  CRISPR gRNA sequence
tttaataaaaaaccttttta

SEQ ID NO: 675031 - DNA, 20 bp, Artificial
  CRISPR gRNA sequence
taataaaaaacctttttatc

SEQ ID NO: 675032 - DNA, 20 bp, Artificial
  CRISPR gRNA sequence
aataaaaaacctttttatct

SEQ ID NO: 675033 - DNA, 20 bp, Artificial
  CRISPR gRNA sequence
ataaaaaacctttttatcta

SEQ ID NO: 675034 - DNA, 20 bp, Artificial
  CRISPR gRNA sequence
tttatctaacataagcaaaa

SEQ ID NO: 675035 - DNA, 20 bp, Artificial
  CRISPR gRNA sequence
ttatctaacataagcaaaaa

SEQ ID NO: 675036 - DNA, 20 bp, Artificial
  CRISPR gRNA sequence
tatctaacataagcaaaaag

SEQ ID NO: 675037 - DNA, 20 bp, Artificial
  CRISPR gRNA sequence
atctaacataagcaaaaaga

SEQ ID NO: 675038 - DNA, 20 bp, Artificial
  CRISPR gRNA sequence
tctaacataagcaaaaagag

SEQ ID NO: 675039 - DNA, 20 bp, Artificial
  CRISPR gRNA sequence
acataagcaaaaagagattg

SEQ ID NO: 675040 - DNA, 20 bp, Artificial
  CRISPR gRNA sequence
tagattaatagcaataagtc

SEQ ID NO: 675041 - DNA, 20 bp, Artificial
  CRISPR gRNA sequence
atagcaataagtctagtaac

SEQ ID NO: 675042 - DNA, 20 bp, Artificial
  CRISPR gRNA sequence
gtaacatggaaaatgcagtt

SEQ ID NO: 675043 - DNA, 20 bp, Artificial
  CRISPR gRNA sequence
tgaaaagtttttactttaaa

SEQ ID NO: 675044 - DNA, 20 bp, Artificial
  CRISPR gRNA sequence
gaaaagtttttactttaaaa

SEQ ID NO: 675045 - DNA, 20 bp, Artificial
  CRISPR gRNA sequence
aaaagtttttactttaaaaa

SEQ ID NO: 675046 - DNA, 20 bp, Artificial
  CRISPR gRNA sequence
ttactttaaaaaatataaat

SEQ ID NO: 675047 - DNA, 20 bp, Artificial
  CRISPR gRNA sequence
tactttaaaaaatataaatg

SEQ ID NO: 675048 - DNA, 20 bp, Artificial
  CRISPR gRNA sequence
actttaaaaaatataaatgt

SEQ ID NO: 675049 - DNA, 20 bp, Artificial
  CRISPR gRNA sequence
ctttaaaaaatataaatgta

SEQ ID NO: 675050 - DNA, 20 bp, Artificial
  CRISPR gRNA sequence
taaaaaatataaatgtaata

SEQ ID NO: 675051 - DNA, 20 bp, Artificial
  CRISPR gRNA sequence
aaaaaatataaatgtaatat

SEQ ID NO: 675052 - DNA, 20 bp, Artificial
  CRISPR gRNA sequence
aaaaatataaatgtaatata

SEQ ID NO: 675053 - DNA, 20 bp, Artificial
  CRISPR gRNA sequence
tgttatttatttttttattt

SEQ ID NO: 675054 - DNA, 20 bp, Artificial
  CRISPR gRNA sequence
gttatttatttttttattta

SEQ ID NO: 675055 - DNA, 20 bp, Artificial
  CRISPR gRNA sequence
ttatttatttttttatttaa

SEQ ID NO: 675056 - DNA, 20 bp, Artificial
  CRISPR gRNA sequence
tttatttttttatttaaggc

SEQ ID NO: 675057 - DNA, 20 bp, Artificial
  CRISPR gRNA sequence
atttttttatttaaggccaa

SEQ ID NO: 675058 - DNA, 20 bp, Artificial
  CRISPR gRNA sequence
tttttttatttaaggccaag

SEQ ID NO: 675059 - DNA, 20 bp, Artificial
  CRISPR gRNA sequence
ttttatttaaggccaagctc

SEQ ID NO: 675060 - DNA, 20 bp, Artificial
  CRISPR gRNA sequence
tttatttaaggccaagctct

SEQ ID NO: 675061 - DNA, 20 bp, Artificial
  CRISPR gRNA sequence
ttatttaaggccaagctctt

SEQ ID NO: 675062 - DNA, 20 bp, Artificial
  CRISPR gRNA sequence
tatttaaggccaagctcttt

SEQ ID NO: 675063 - DNA, 20 bp, Artificial
  CRISPR gRNA sequence
atttaaggccaagctctttt

SEQ ID NO: 675064 - DNA, 20 bp, Artificial
  CRISPR gRNA sequence
tttaaggccaagctcttttc

SEQ ID NO: 675065 - DNA, 20 bp, Artificial
  CRISPR gRNA sequence
aaggccaagctcttttcttt

SEQ ID NO: 675066 - DNA, 20 bp, Artificial
  CRISPR gRNA sequence
aggccaagctcttttctttc

SEQ ID NO: 675067 - DNA, 20 bp, Artificial
  CRISPR gRNA sequence
ttttctttcagtgagaaatt

SEQ ID NO: 675068 - DNA, 20 bp, Artificial
  CRISPR gRNA sequence
ttctttcagtgagaaatttg

SEQ ID NO: 675069 - DNA, 20 bp, Artificial
  CRISPR gRNA sequence
tctttcagtgagaaatttgg

SEQ ID NO: 675070 - DNA, 20 bp, Artificial
  CRISPR gRNA sequence
ctttcagtgagaaatttggt

SEQ ID NO: 675071 - DNA, 20 bp, Artificial
  CRISPR gRNA sequence
tttcagtgagaaatttggtt

SEQ ID NO: 675072 - DNA, 20 bp, Artificial
  CRISPR gRNA sequence
tcagtgagaaatttggttgt

SEQ ID NO: 675073 - DNA, 20 bp, Artificial
  CRISPR gRNA sequence
cagtgagaaatttggttgtt

SEQ ID NO: 675074 - DNA, 20 bp, Artificial
  CRISPR gRNA sequence
agtgagaaatttggttgttg

SEQ ID NO: 675075 - DNA, 20 bp, Artificial
  CRISPR gRNA sequence
ggttgttgaatagcatgtaa

SEQ ID NO: 675076 - DNA, 20 bp, Artificial
  CRISPR gRNA sequence
gttgttgaatagcatgtaat

SEQ ID NO: 675077 - DNA, 20 bp, Artificial
  CRISPR gRNA sequence
ttgaatagcatgtaattttt

SEQ ID NO: 675078 - DNA, 20 bp, Artificial
  CRISPR gRNA sequence
aatagcatgtaatttttctg

SEQ ID NO: 675079 - DNA, 20 bp, Artificial
  CRISPR gRNA sequence
ttctggtctaaaccataccc

SEQ ID NO: 675080 - DNA, 20 bp, Artificial
  CRISPR gRNA sequence
tctggtctaaaccataccca

SEQ ID NO: 675081 - DNA, 20 bp, Artificial
  CRISPR gRNA sequence
ctggtctaaaccatacccat

SEQ ID NO: 675082 - DNA, 20 bp, Artificial
  CRISPR gRNA sequence
tggtctaaaccatacccata

SEQ ID NO: 675083 - DNA, 20 bp, Artificial
  CRISPR gRNA sequence
gtctaaaccatacccataac

SEQ ID NO: 675084 - DNA, 20 bp, Artificial
  CRISPR gRNA sequence
aaccatacccataacacatt

SEQ ID NO: 675085 - DNA, 20 bp, Artificial
  CRISPR gRNA sequence
tctttagttacattttcagt

SEQ ID NO: 675086 - DNA, 20 bp, Artificial
  CRISPR gRNA sequence
tagttacattttcagtgtct

SEQ ID NO: 675087 - DNA, 20 bp, Artificial
  CRISPR gRNA sequence
agttacattttcagtgtctt

SEQ ID NO: 675088 - DNA, 20 bp, Artificial
  CRISPR gRNA sequence
gttacattttcagtgtcttt

SEQ ID NO: 675089 - DNA, 20 bp, Artificial
  CRISPR gRNA sequence
cattttcagtgtctttaaga

SEQ ID NO: 675090 - DNA, 20 bp, Artificial
  CRISPR gRNA sequence
tcagtgtctttaagaactta

SEQ ID NO: 675091 - DNA, 20 bp, Artificial
  CRISPR gRNA sequence
cagtgtctttaagaacttaa

SEQ ID NO: 675092 - DNA, 20 bp, Artificial
  CRISPR gRNA sequence
agtgtctttaagaacttaaa

SEQ ID NO: 675093 - DNA, 20 bp, Artificial
  CRISPR gRNA sequence
taagaacttaaagatcctgt

SEQ ID NO: 675094 - DNA, 20 bp, Artificial
  CRISPR gRNA sequence
aagaacttaaagatcctgtg

SEQ ID NO: 675095 - DNA, 20 bp, Artificial
  CRISPR gRNA sequence
agaacttaaagatcctgtga

SEQ ID NO: 675096 - DNA, 20 bp, Artificial
  CRISPR gRNA sequence
aaagatcctgtgaagcagtc

SEQ ID NO: 675097 - DNA, 20 bp, Artificial
  CRISPR gRNA sequence
aagatcctgtgaagcagtca

SEQ ID NO: 675098 - DNA, 20 bp, Artificial
  CRISPR gRNA sequence
tgaagcagtcagacttctat

SEQ ID NO: 675099 - DNA, 20 bp, Artificial
  CRISPR gRNA sequence
ctattcatttttaaagattt

SEQ ID NO: 675100 - DNA, 20 bp, Artificial
  CRISPR gRNA sequence
tattcatttttaaagatttt

SEQ ID NO: 675101 - DNA, 20 bp, Artificial
  CRISPR gRNA sequence
ttcatttttaaagatttttt

SEQ ID NO: 675102 - DNA, 20 bp, Artificial
  CRISPR gRNA sequence
atttttaaagattttttcac

SEQ ID NO: 675103 - DNA, 20 bp, Artificial
  CRISPR gRNA sequence
ttaaagattttttcactaat

SEQ ID NO: 675104 - DNA, 20 bp, Artificial
  CRISPR gRNA sequence
taaagattttttcactaatt

SEQ ID NO: 675105 - DNA, 20 bp, Artificial
  CRISPR gRNA sequence
aaagattttttcactaattt

SEQ ID NO: 675106 - DNA, 20 bp, Artificial
  CRISPR gRNA sequence
aagattttttcactaatttt

SEQ ID NO: 675107 - DNA, 20 bp, Artificial
  CRISPR gRNA sequence
tttcactaatttttatgatt

SEQ ID NO: 675108 - DNA, 20 bp, Artificial
  CRISPR gRNA sequence
ttcactaatttttatgatta

SEQ ID NO: 675109 - DNA, 20 bp, Artificial
  CRISPR gRNA sequence
tcactaatttttatgattat

SEQ ID NO: 675110 - DNA, 20 bp, Artificial
  CRISPR gRNA sequence
cactaatttttatgattatt

SEQ ID NO: 675111 - DNA, 20 bp, Artificial
  CRISPR gRNA sequence
actaatttttatgattattt

SEQ ID NO: 675112 - DNA, 20 bp, Artificial
  CRISPR gRNA sequence
atttttatgattatttttgc

SEQ ID NO: 675113 - DNA, 20 bp, Artificial
  CRISPR gRNA sequence
ttatgattatttttgcccac

SEQ ID NO: 675114 - DNA, 20 bp, Artificial
  CRISPR gRNA sequence
tatgattatttttgcccaca

SEQ ID NO: 675115 - DNA, 20 bp, Artificial
  CRISPR gRNA sequence
atgattatttttgcccacat

SEQ ID NO: 675116 - DNA, 20 bp, Artificial
  CRISPR gRNA sequence
tgattatttttgcccacatt

SEQ ID NO: 675117 - DNA, 20 bp, Artificial
  CRISPR gRNA sequence
tttttgcccacattcacttc

SEQ ID NO: 675118 - DNA, 20 bp, Artificial
  CRISPR gRNA sequence
ttgcccacattcacttcttt

SEQ ID NO: 675119 - DNA, 20 bp, Artificial
  CRISPR gRNA sequence
tgcccacattcacttcttta

SEQ ID NO: 675120 - DNA, 20 bp, Artificial
  CRISPR gRNA sequence
gcccacattcacttctttag

SEQ ID NO: 675121 - DNA, 20 bp, Artificial
  CRISPR gRNA sequence
cccacattcacttctttaga

SEQ ID NO: 675122 - DNA, 20 bp, Artificial
  CRISPR gRNA sequence
acttctttagaaatattttt

SEQ ID NO: 675123 - DNA, 20 bp, Artificial
  CRISPR gRNA sequence
ctttagaaatatttttatca

SEQ ID NO: 675124 - DNA, 20 bp, Artificial
  CRISPR gRNA sequence
tttagaaatatttttatcag

SEQ ID NO: 675125 - DNA, 20 bp, Artificial
  CRISPR gRNA sequence
tagaaatatttttatcagct

SEQ ID NO: 675126 - DNA, 20 bp, Artificial
  CRISPR gRNA sequence
agaaatatttttatcagctt

SEQ ID NO: 675127 - DNA, 20 bp, Artificial
  CRISPR gRNA sequence
gaaatatttttatcagctta

SEQ ID NO: 675128 - DNA, 20 bp, Artificial
  CRISPR gRNA sequence
ttatcagcttatctttattg

SEQ ID NO: 675129 - DNA, 20 bp, Artificial
  CRISPR gRNA sequence
tatcagcttatctttattga

SEQ ID NO: 675130 - DNA, 20 bp, Artificial
  CRISPR gRNA sequence
atcagcttatctttattgaa

SEQ ID NO: 675131 - DNA, 20 bp, Artificial
  CRISPR gRNA sequence
tcagcttatctttattgaat

SEQ ID NO: 675132 - DNA, 20 bp, Artificial
  CRISPR gRNA sequence
atctttattgaatcttttca

SEQ ID NO: 675133 - DNA, 20 bp, Artificial
  CRISPR gRNA sequence
tctttattgaatcttttcaa

SEQ ID NO: 675134 - DNA, 20 bp, Artificial
  CRISPR gRNA sequence
tattgaatcttttcaaagtg

SEQ ID NO: 675135 - DNA, 20 bp, Artificial
  CRISPR gRNA sequence
attgaatcttttcaaagtgg

SEQ ID NO: 675136 - DNA, 20 bp, Artificial
  CRISPR gRNA sequence
ttgaatcttttcaaagtggt

SEQ ID NO: 675137 - DNA, 20 bp, Artificial
  CRISPR gRNA sequence
aatcttttcaaagtggtaaa

SEQ ID NO: 675138 - DNA, 20 bp, Artificial
  CRISPR gRNA sequence
ttcaaagtggtaaaatttgg

SEQ ID NO: 675139 - DNA, 20 bp, Artificial
  CRISPR gRNA sequence
tcaaagtggtaaaatttggt

SEQ ID NO: 675140 - DNA, 20 bp, Artificial
  CRISPR gRNA sequence
caaagtggtaaaatttggtt

SEQ ID NO: 675141 - DNA, 20 bp, Artificial
  CRISPR gRNA sequence
aaagtggtaaaatttggttt

SEQ ID NO: 675142 - DNA, 20 bp, Artificial
  CRISPR gRNA sequence
ggtttcatagaaacagtatt

SEQ ID NO: 675143 - DNA, 20 bp, Artificial
  CRISPR gRNA sequence
gtttcatagaaacagtattc

SEQ ID NO: 675144 - DNA, 20 bp, Artificial
  CRISPR gRNA sequence
catagaaacagtattctttt

SEQ ID NO: 675145 - DNA, 20 bp, Artificial
  CRISPR gRNA sequence
atagaaacagtattcttttt

SEQ ID NO: 675146 - DNA, 20 bp, Artificial
  CRISPR gRNA sequence
tttttgtaattatttcgttg

SEQ ID NO: 675147 - DNA, 20 bp, Artificial
  CRISPR gRNA sequence
tttgtaattatttcgttgga

SEQ ID NO: 675148 - DNA, 20 bp, Artificial
  CRISPR gRNA sequence
ttgtaattatttcgttggaa

SEQ ID NO: 675149 - DNA, 20 bp, Artificial
  CRISPR gRNA sequence
tgtaattatttcgttggaaa

SEQ ID NO: 675150 - DNA, 20 bp, Artificial
  CRISPR gRNA sequence
gtaattatttcgttggaaat

SEQ ID NO: 675151 - DNA, 20 bp, Artificial
  CRISPR gRNA sequence
taattatttcgttggaaata

SEQ ID NO: 675152 - DNA, 20 bp, Artificial
  CRISPR gRNA sequence
tttcgttggaaataattata

SEQ ID NO: 675153 - DNA, 20 bp, Artificial
  CRISPR gRNA sequence
cgttggaaataattatagca

SEQ ID NO: 675154 - DNA, 20 bp, Artificial
  CRISPR gRNA sequence
gttggaaataattatagcag

SEQ ID NO: 675155 - DNA, 20 bp, Artificial
  CRISPR gRNA sequence
gaaataattatagcaggtaa

SEQ ID NO: 675156 - DNA, 20 bp, Artificial
  CRISPR gRNA sequence
tagcaggtaaactggcataa

SEQ ID NO: 675157 - DNA, 20 bp, Artificial
  CRISPR gRNA sequence
gcataaataggttttgctac

SEQ ID NO: 675158 - DNA, 20 bp, Artificial
  CRISPR gRNA sequence
tgctacagtcatacctgact

SEQ ID NO: 675159 - DNA, 20 bp, Artificial
  CRISPR gRNA sequence
gctacagtcatacctgactc

SEQ ID NO: 675160 - DNA, 20 bp, Artificial
  CRISPR gRNA sequence
ctacagtcatacctgactct

SEQ ID NO: 675161 - DNA, 20 bp, Artificial
  CRISPR gRNA sequence
cagtcatacctgactcttag

SEQ ID NO: 675162 - DNA, 20 bp, Artificial
  CRISPR gRNA sequence
actcttagtgactacacata

SEQ ID NO: 675163 - DNA, 20 bp, Artificial
  CRISPR gRNA sequence
ttagtgactacacatacagc

SEQ ID NO: 675164 - DNA, 20 bp, Artificial
  CRISPR gRNA sequence
agtgactacacatacagctc

SEQ ID NO: 675165 - DNA, 20 bp, Artificial
  CRISPR gRNA sequence
gtgactacacatacagctca

SEQ ID NO: 675166 - DNA, 20 bp, Artificial
  CRISPR gRNA sequence
cacatacagctcaactgcta

SEQ ID NO: 675167 - DNA, 20 bp, Artificial
  CRISPR gRNA sequence
aactgctagaagtatactcg

SEQ ID NO: 675168 - DNA, 20 bp, Artificial
  CRISPR gRNA sequence
ctagaagtatactcggacgt

SEQ ID NO: 675169 - DNA, 20 bp, Artificial
  CRISPR gRNA sequence
gaagtatactcggacgtacc

SEQ ID NO: 675170 - DNA, 20 bp, Artificial
  CRISPR gRNA sequence
ggacgtaccaaagaagaacg

SEQ ID NO: 675171 - DNA, 20 bp, Artificial
  CRISPR gRNA sequence
caagaattcagtgtttttgg

SEQ ID NO: 675172 - DNA, 20 bp, Artificial
  CRISPR gRNA sequence
agtgtttttggttatccatt

SEQ ID NO: 675173 - DNA, 20 bp, Artificial
  CRISPR gRNA sequence
ttggttatccattagtatgt

SEQ ID NO: 675174 - DNA, 20 bp, Artificial
  CRISPR gRNA sequence
tggttatccattagtatgtt

SEQ ID NO: 675175 - DNA, 20 bp, Artificial
  CRISPR gRNA sequence
ggttatccattagtatgttt

SEQ ID NO: 675176 - DNA, 20 bp, Artificial
  CRISPR gRNA sequence
gttatccattagtatgtttt

SEQ ID NO: 675177 - DNA, 20 bp, Artificial
  CRISPR gRNA sequence
tccattagtatgttttacaa

SEQ ID NO: 675178 - DNA, 20 bp, Artificial
  CRISPR gRNA sequence
gtatgttttacaaagagaat

SEQ ID NO: 675179 - DNA, 20 bp, Artificial
  CRISPR gRNA sequence
tacaaagagaatggagaggc

SEQ ID NO: 675180 - DNA, 20 bp, Artificial
  CRISPR gRNA sequence
acaaagagaatggagaggca

SEQ ID NO: 675181 - DNA, 20 bp, Artificial
  CRISPR gRNA sequence
caaagagaatggagaggcag

SEQ ID NO: 675182 - DNA, 20 bp, Artificial
  CRISPR gRNA sequence
attatgagaacctctcactt

SEQ ID NO: 675183 - DNA, 20 bp, Artificial
  CRISPR gRNA sequence
tgagaacctctcactttggt

SEQ ID NO: 675184 - DNA, 20 bp, Artificial
  CRISPR gRNA sequence
tcactttggttattcctatt

SEQ ID NO: 675185 - DNA, 20 bp, Artificial
  CRISPR gRNA sequence
actttggttattcctattgt

SEQ ID NO: 675186 - DNA, 20 bp, Artificial
  CRISPR gRNA sequence
tggttattcctattgtacac

SEQ ID NO: 675187 - DNA, 20 bp, Artificial
  CRISPR gRNA sequence
ggttattcctattgtacact

SEQ ID NO: 675188 - DNA, 20 bp, Artificial
  CRISPR gRNA sequence
gttattcctattgtacactg

SEQ ID NO: 675189 - DNA, 20 bp, Artificial
  CRISPR gRNA sequence
ttcctattgtacactgaggc

SEQ ID NO: 675190 - DNA, 20 bp, Artificial
  CRISPR gRNA sequence
ctattgtacactgaggcaga

SEQ ID NO: 675191 - DNA, 20 bp, Artificial
  CRISPR gRNA sequence
ttgtacactgaggcagaaaa

SEQ ID NO: 675192 - DNA, 20 bp, Artificial
  CRISPR gRNA sequence
tacactgaggcagaaaagaa

SEQ ID NO: 675193 - DNA, 20 bp, Artificial
  CRISPR gRNA sequence
aggcagaaaagaagtcacac

SEQ ID NO: 675194 - DNA, 20 bp, Artificial
  CRISPR gRNA sequence
gatttaaactaaggcagcaa

SEQ ID NO: 675195 - DNA, 20 bp, Artificial
  CRISPR gRNA sequence
aaactaaggcagcaaactcc

SEQ ID NO: 675196 - DNA, 20 bp, Artificial
  CRISPR gRNA sequence
aactaaggcagcaaactcca

SEQ ID NO: 675197 - DNA, 20 bp, Artificial
  CRISPR gRNA sequence
aggcagcaaactccacaatt

SEQ ID NO: 675198 - DNA, 20 bp, Artificial
  CRISPR gRNA sequence
cacaatttgtgctcatcaca

SEQ ID NO: 675199 - DNA, 20 bp, Artificial
  CRISPR gRNA sequence
gtgctcatcacaccctgcta

SEQ ID NO: 675200 - DNA, 20 bp, Artificial
  CRISPR gRNA sequence
tgctcatcacaccctgctaa

SEQ ID NO: 675201 - DNA, 20 bp, Artificial
  CRISPR gRNA sequence
atcacaccctgctaagtgat

SEQ ID NO: 675202 - DNA, 20 bp, Artificial
  CRISPR gRNA sequence
ctaagtgataaatgacacag

SEQ ID NO: 675203 - DNA, 20 bp, Artificial
  CRISPR gRNA sequence
agtgataaatgacacagctc

SEQ ID NO: 675204 - DNA, 20 bp, Artificial
  CRISPR gRNA sequence
gtatgtttattctataaagc

SEQ ID NO: 675205 - DNA, 20 bp, Artificial
  CRISPR gRNA sequence
attctataaagctttaactc

SEQ ID NO: 675206 - DNA, 20 bp, Artificial
  CRISPR gRNA sequence
ttctataaagctttaactct

SEQ ID NO: 675207 - DNA, 20 bp, Artificial
  CRISPR gRNA sequence
tataaagctttaactctact

SEQ ID NO: 675208 - DNA, 20 bp, Artificial
  CRISPR gRNA sequence
taaagctttaactctactga

SEQ ID NO: 675209 - DNA, 20 bp, Artificial
  CRISPR gRNA sequence
taactctactgaagtaactc

SEQ ID NO: 675210 - DNA, 20 bp, Artificial
  CRISPR gRNA sequence
aactctactgaagtaactcc

SEQ ID NO: 675211 - DNA, 20 bp, Artificial
  CRISPR gRNA sequence
actctactgaagtaactcct

SEQ ID NO: 675212 - DNA, 20 bp, Artificial
  CRISPR gRNA sequence
tactgaagtaactcctaatg

SEQ ID NO: 675213 - DNA, 20 bp, Artificial
  CRISPR gRNA sequence
ctgaagtaactcctaatgat

SEQ ID NO: 675214 - DNA, 20 bp, Artificial
  CRISPR gRNA sequence
aagtaactcctaatgattga

SEQ ID NO: 675215 - DNA, 20 bp, Artificial
  CRISPR gRNA sequence
ctaatgattgaaaaaaaaaa

SEQ ID NO: 675216 - DNA, 20 bp, Artificial
  CRISPR gRNA sequence
atgattgaaaaaaaaaatgt

SEQ ID NO: 675217 - DNA, 20 bp, Artificial
  CRISPR gRNA sequence
aaaaaaaaaatgtgctgtct

SEQ ID NO: 675218 - DNA, 20 bp, Artificial
  CRISPR gRNA sequence
tctagaagtcaggagatcaa

SEQ ID NO: 675219 - DNA, 20 bp, Artificial
  CRISPR gRNA sequence
gaagtcaggagatcaaggca

SEQ ID NO: 675220 - DNA, 20 bp, Artificial
  CRISPR gRNA sequence
tagggtggccttgctgcaaa

SEQ ID NO: 675221 - DNA, 20 bp, Artificial
  CRISPR gRNA sequence
agggtggccttgctgcaaat

SEQ ID NO: 675222 - DNA, 20 bp, Artificial
  CRISPR gRNA sequence
gggtggccttgctgcaaatt

SEQ ID NO: 675223 - DNA, 20 bp, Artificial
  CRISPR gRNA sequence
gctgcaaattagctatggga

SEQ ID NO: 675224 - DNA, 20 bp, Artificial
  CRISPR gRNA sequence
ctgcaaattagctatgggac

SEQ ID NO: 675225 - DNA, 20 bp, Artificial
  CRISPR gRNA sequence
caaattagctatgggacgtt

SEQ ID NO: 675226 - DNA, 20 bp, Artificial
  CRISPR gRNA sequence
gctatgggacgttgtcaagt

SEQ ID NO: 675227 - DNA, 20 bp, Artificial
  CRISPR gRNA sequence
tgggacgttgtcaagtcact

SEQ ID NO: 675228 - DNA, 20 bp, Artificial
  CRISPR gRNA sequence
tcaagtcacttaatttactc

SEQ ID NO: 675229 - DNA, 20 bp, Artificial
  CRISPR gRNA sequence
aatttactctttaaatctcc

SEQ ID NO: 675230 - DNA, 20 bp, Artificial
  CRISPR gRNA sequence
atttactctttaaatctcct

SEQ ID NO: 675231 - DNA, 20 bp, Artificial
  CRISPR gRNA sequence
actctttaaatctcctggtg

SEQ ID NO: 675232 - DNA, 20 bp, Artificial
  CRISPR gRNA sequence
ctctttaaatctcctggtgc

SEQ ID NO: 675233 - DNA, 20 bp, Artificial
  CRISPR gRNA sequence
tttaaatctcctggtgctgc

SEQ ID NO: 675234 - DNA, 20 bp, Artificial
  CRISPR gRNA sequence
taaatctcctggtgctgcta

SEQ ID NO: 675235 - DNA, 20 bp, Artificial
  CRISPR gRNA sequence
aaatctcctggtgctgctat

SEQ ID NO: 675236 - DNA, 20 bp, Artificial
  CRISPR gRNA sequence
aatctcctggtgctgctatt

SEQ ID NO: 675237 - DNA, 20 bp, Artificial
  CRISPR gRNA sequence
ctggtgctgctattatatga

SEQ ID NO: 675238 - DNA, 20 bp, Artificial
  CRISPR gRNA sequence
gtgctgctattatatgatgc

SEQ ID NO: 675239 - DNA, 20 bp, Artificial
  CRISPR gRNA sequence
ctattatatgatgcgaacta

SEQ ID NO: 675240 - DNA, 20 bp, Artificial
  CRISPR gRNA sequence
ttatatgatgcgaactacaa

SEQ ID NO: 675241 - DNA, 20 bp, Artificial
  CRISPR gRNA sequence
tatgatgcgaactacaatgt

SEQ ID NO: 675242 - DNA, 20 bp, Artificial
  CRISPR gRNA sequence
caatgtgttatcttttctcc

SEQ ID NO: 675243 - DNA, 20 bp, Artificial
  CRISPR gRNA sequence
tcttttctccctggattttg

SEQ ID NO: 675244 - DNA, 20 bp, Artificial
  CRISPR gRNA sequence
ttctccctggattttgctaa

SEQ ID NO: 675245 - DNA, 20 bp, Artificial
  CRISPR gRNA sequence
tctccctggattttgctaat

SEQ ID NO: 675246 - DNA, 20 bp, Artificial
  CRISPR gRNA sequence
ctccctggattttgctaatc

SEQ ID NO: 675247 - DNA, 20 bp, Artificial
  CRISPR gRNA sequence
tccctggattttgctaatca

SEQ ID NO: 675248 - DNA, 20 bp, Artificial
  CRISPR gRNA sequence
cctggattttgctaatcagt

SEQ ID NO: 675249 - DNA, 20 bp, Artificial
  CRISPR gRNA sequence
gattttgctaatcagtcact

SEQ ID NO: 675250 - DNA, 20 bp, Artificial
  CRISPR gRNA sequence
tgctaatcagtcactactac

SEQ ID NO: 675251 - DNA, 20 bp, Artificial
  CRISPR gRNA sequence
gctaatcagtcactactacc

SEQ ID NO: 675252 - DNA, 20 bp, Artificial
  CRISPR gRNA sequence
ctaatcagtcactactacca

SEQ ID NO: 675253 - DNA, 20 bp, Artificial
  CRISPR gRNA sequence
atcagtcactactaccacac

SEQ ID NO: 675254 - DNA, 20 bp, Artificial
  CRISPR gRNA sequence
ctaccacaccttaaagagta

SEQ ID NO: 675255 - DNA, 20 bp, Artificial
  CRISPR gRNA sequence
ccacaccttaaagagtagtc

SEQ ID NO: 675256 - DNA, 20 bp, Artificial
  CRISPR gRNA sequence
aaagagtagtctccactccc

SEQ ID NO: 675257 - DNA, 20 bp, Artificial
  CRISPR gRNA sequence
aagagtagtctccactccct

SEQ ID NO: 675258 - DNA, 20 bp, Artificial
  CRISPR gRNA sequence
cactccctccaaattacttc

SEQ ID NO: 675259 - DNA, 20 bp, Artificial
  CRISPR gRNA sequence
cctccaaattacttcttttt

SEQ ID NO: 675260 - DNA, 20 bp, Artificial
  CRISPR gRNA sequence
caaattacttctttttgttt

SEQ ID NO: 675261 - DNA, 20 bp, Artificial
  CRISPR gRNA sequence
cttctttttgtttgtttgtt

SEQ ID NO: 675262 - DNA, 20 bp, Artificial
  CRISPR gRNA sequence
ctttttgtttgtttgtttgt

SEQ ID NO: 675263 - DNA, 20 bp, Artificial
  CRISPR gRNA sequence
tttttgtttgtttgtttgtt

SEQ ID NO: 675264 - DNA, 20 bp, Artificial
  CRISPR gRNA sequence
tttgtttgtttgtttgtttg

SEQ ID NO: 675265 - DNA, 20 bp, Artificial
  CRISPR gRNA sequence
ttgtttgtttgtttgtttgt

SEQ ID NO: 675266 - DNA, 20 bp, Artificial
  CRISPR gRNA sequence
tgtttgtttgtttgtttgtt

SEQ ID NO: 675267 - DNA, 20 bp, Artificial
  CRISPR gRNA sequence
gtttgtttgtttgtttgttt

SEQ ID NO: 675268 - DNA, 20 bp, Artificial
  CRISPR gRNA sequence
tttgtttgtttgtttgtttt

SEQ ID NO: 675269 - DNA, 20 bp, Artificial
  CRISPR gRNA sequence
gtttgtttgtttgttttagt

SEQ ID NO: 675270 - DNA, 20 bp, Artificial
  CRISPR gRNA sequence
tttgtttgtttgttttagta

SEQ ID NO: 675271 - DNA, 20 bp, Artificial
  CRISPR gRNA sequence
gtttgtttgttttagtattt

SEQ ID NO: 675272 - DNA, 20 bp, Artificial
  CRISPR gRNA sequence
tttgtttgttttagtatttt

SEQ ID NO: 675273 - DNA, 20 bp, Artificial
  CRISPR gRNA sequence
gtttgttttagtattttgcc

SEQ ID NO: 675274 - DNA, 20 bp, Artificial
  CRISPR gRNA sequence
tttgttttagtattttgccc

SEQ ID NO: 675275 - DNA, 20 bp, Artificial
  CRISPR gRNA sequence
gttttagtattttgccctag

SEQ ID NO: 675276 - DNA, 20 bp, Artificial
  CRISPR gRNA sequence
ttttagtattttgccctagt

SEQ ID NO: 675277 - DNA, 20 bp, Artificial
  CRISPR gRNA sequence
tagtattttgccctagttta

SEQ ID NO: 675278 - DNA, 20 bp, Artificial
  CRISPR gRNA sequence
agtattttgccctagtttat

SEQ ID NO: 675279 - DNA, 20 bp, Artificial
  CRISPR gRNA sequence
gtattttgccctagtttatt

SEQ ID NO: 675280 - DNA, 20 bp, Artificial
  CRISPR gRNA sequence
tgccctagtttattttaaaa

SEQ ID NO: 675281 - DNA, 20 bp, Artificial
  CRISPR gRNA sequence
gccctagtttattttaaaat

SEQ ID NO: 675282 - DNA, 20 bp, Artificial
  CRISPR gRNA sequence
ccctagtttattttaaaata

SEQ ID NO: 675283 - DNA, 20 bp, Artificial
  CRISPR gRNA sequence
gtttattttaaaataagttt

SEQ ID NO: 675284 - DNA, 20 bp, Artificial
  CRISPR gRNA sequence
attttaaaataagttttcat

SEQ ID NO: 675285 - DNA, 20 bp, Artificial
  CRISPR gRNA sequence
ttttaaaataagttttcatg

SEQ ID NO: 675286 - DNA, 20 bp, Artificial
  CRISPR gRNA sequence
taaaataagttttcatgaaa

SEQ ID NO: 675287 - DNA, 20 bp, Artificial
  CRISPR gRNA sequence
aaaataagttttcatgaaac

SEQ ID NO: 675288 - DNA, 20 bp, Artificial
  CRISPR gRNA sequence
aaataagttttcatgaaacc

SEQ ID NO: 675289 - DNA, 20 bp, Artificial
  CRISPR gRNA sequence
tcatgaaaccgaattaacat

SEQ ID NO: 675290 - DNA, 20 bp, Artificial
  CRISPR gRNA sequence
catgaaaccgaattaacatc

SEQ ID NO: 675291 - DNA, 20 bp, Artificial
  CRISPR gRNA sequence
atgaaaccgaattaacatct

SEQ ID NO: 675292 - DNA, 20 bp, Artificial
  CRISPR gRNA sequence
acatcttaaggtttatattg

SEQ ID NO: 675293 - DNA, 20 bp, Artificial
  CRISPR gRNA sequence
aaggtttatattgagtcttc

SEQ ID NO: 675294 - DNA, 20 bp, Artificial
  CRISPR gRNA sequence
aggtttatattgagtcttca

SEQ ID NO: 675295 - DNA, 20 bp, Artificial
  CRISPR gRNA sequence
atattgagtcttcacagtgc

SEQ ID NO: 675296 - DNA, 20 bp, Artificial
  CRISPR gRNA sequence
tattgagtcttcacagtgcc

SEQ ID NO: 675297 - DNA, 20 bp, Artificial
  CRISPR gRNA sequence
agtcttcacagtgccaatat

SEQ ID NO: 675298 - DNA, 20 bp, Artificial
  CRISPR gRNA sequence
cacagtgccaatatttcttg

SEQ ID NO: 675299 - DNA, 20 bp, Artificial
  CRISPR gRNA sequence
acagtgccaatatttcttgt

SEQ ID NO: 675300 - DNA, 20 bp, Artificial
  CRISPR gRNA sequence
cttgtctactaatgtctgat

SEQ ID NO: 675301 - DNA, 20 bp, Artificial
  CRISPR gRNA sequence
ttgtctactaatgtctgata

SEQ ID NO: 675302 - DNA, 20 bp, Artificial
  CRISPR gRNA sequence
gtctactaatgtctgatatc

SEQ ID NO: 675303 - DNA, 20 bp, Artificial
  CRISPR gRNA sequence
tctactaatgtctgatatcc

SEQ ID NO: 675304 - DNA, 20 bp, Artificial
  CRISPR gRNA sequence
ctaatgtctgatatcctaca

SEQ ID NO: 675305 - DNA, 20 bp, Artificial
  CRISPR gRNA sequence
atgtctgatatcctacatct

SEQ ID NO: 675306 - DNA, 20 bp, Artificial
  CRISPR gRNA sequence
atatcctacatctgatagcc

SEQ ID NO: 675307 - DNA, 20 bp, Artificial
  CRISPR gRNA sequence
catctgatagccttgaagtg

SEQ ID NO: 675308 - DNA, 20 bp, Artificial
  CRISPR gRNA sequence
atagccttgaagtgtctaag

SEQ ID NO: 675309 - DNA, 20 bp, Artificial
  CRISPR gRNA sequence
gaagtgtctaagaaagaaaa

SEQ ID NO: 675310 - DNA, 20 bp, Artificial
  CRISPR gRNA sequence
aagtgtctaagaaagaaaaa

SEQ ID NO: 675311 - DNA, 20 bp, Artificial
  CRISPR gRNA sequence
agaaagaaaaaaataataac

SEQ ID NO: 675312 - DNA, 20 bp, Artificial
  CRISPR gRNA sequence
tttttatgtgaaatgtaaat

SEQ ID NO: 675313 - DNA, 20 bp, Artificial
  CRISPR gRNA sequence
ttttatgtgaaatgtaaatg

SEQ ID NO: 675314 - DNA, 20 bp, Artificial
  CRISPR gRNA sequence
tttatgtgaaatgtaaatga

SEQ ID NO: 675315 - DNA, 20 bp, Artificial
  CRISPR gRNA sequence
ttatgtgaaatgtaaatgac

SEQ ID NO: 675316 - DNA, 20 bp, Artificial
  CRISPR gRNA sequence
tatgtgaaatgtaaatgaca

SEQ ID NO: 675317 - DNA, 20 bp, Artificial
  CRISPR gRNA sequence
atgtgaaatgtaaatgacat

SEQ ID NO: 675318 - DNA, 20 bp, Artificial
  CRISPR gRNA sequence
tgtgaaatgtaaatgacatt

SEQ ID NO: 675319 - DNA, 20 bp, Artificial
  CRISPR gRNA sequence
taagaaggggaaggagaaga

SEQ ID NO: 675320 - DNA, 20 bp, Artificial
  CRISPR gRNA sequence
aagaaggggaaggagaagag

SEQ ID NO: 675321 - DNA, 20 bp, Artificial
  CRISPR gRNA sequence
agaaggggaaggagaagagg

SEQ ID NO: 675322 - DNA, 20 bp, Artificial
  CRISPR gRNA sequence
aaatgttttatgaacaaaga

SEQ ID NO: 675323 - DNA, 20 bp, Artificial
  CRISPR gRNA sequence
tatgaacaaagatcagctaa

SEQ ID NO: 675324 - DNA, 20 bp, Artificial
  CRISPR gRNA sequence
atgaacaaagatcagctaaa

SEQ ID NO: 675325 - DNA, 20 bp, Artificial
  CRISPR gRNA sequence
tgaacaaagatcagctaaag

SEQ ID NO: 675326 - DNA, 20 bp, Artificial
  CRISPR gRNA sequence
aagattacagtcaagttgtg

SEQ ID NO: 675327 - DNA, 20 bp, Artificial
  CRISPR gRNA sequence
cagtcaagttgtggccgggc

SEQ ID NO: 675328 - DNA, 20 bp, Artificial
  CRISPR gRNA sequence
tggccgggcacggtggctca

SEQ ID NO: 675329 - DNA, 20 bp, Artificial
  CRISPR gRNA sequence
acacctgtaatcctaacact

SEQ ID NO: 675330 - DNA, 20 bp, Artificial
  CRISPR gRNA sequence
taatcctaacactttgggag

SEQ ID NO: 675331 - DNA, 20 bp, Artificial
  CRISPR gRNA sequence
acactttgggaggccgaggt

SEQ ID NO: 675332 - DNA, 20 bp, Artificial
  CRISPR gRNA sequence
tgggaggccgaggtgggcgg

SEQ ID NO: 675333 - DNA, 20 bp, Artificial
  CRISPR gRNA sequence
gggaggccgaggtgggcgga

SEQ ID NO: 675334 - DNA, 20 bp, Artificial
  CRISPR gRNA sequence
ggaggccgaggtgggcggat

SEQ ID NO: 675335 - DNA, 20 bp, Artificial
  CRISPR gRNA sequence
tggttaacatggtgaaaccg

SEQ ID NO: 675336 - DNA, 20 bp, Artificial
  CRISPR gRNA sequence
gttaacatggtgaaaccgtg

SEQ ID NO: 675337 - DNA, 20 bp, Artificial
  CRISPR gRNA sequence
acatggtgaaaccgtgtttc

SEQ ID NO: 675338 - DNA, 20 bp, Artificial
  CRISPR gRNA sequence
ctactaaaaatacaaaaaat

SEQ ID NO: 675339 - DNA, 20 bp, Artificial
  CRISPR gRNA sequence
tactaaaaatacaaaaaatt

SEQ ID NO: 675340 - DNA, 20 bp, Artificial
  CRISPR gRNA sequence
ctaaaaatacaaaaaattat

SEQ ID NO: 675341 - DNA, 20 bp, Artificial
  CRISPR gRNA sequence
aaaatacaaaaaattatctg

SEQ ID NO: 675342 - DNA, 20 bp, Artificial
  CRISPR gRNA sequence
tctgggcgtgatagcacacg

SEQ ID NO: 675343 - DNA, 20 bp, Artificial
  CRISPR gRNA sequence
ggcgtgatagcacacgcctg

SEQ ID NO: 675344 - DNA, 20 bp, Artificial
  CRISPR gRNA sequence
tagtcccagctactcgggag

SEQ ID NO: 675345 - DNA, 20 bp, Artificial
  CRISPR gRNA sequence
ctcgggaggctgaggcagga

SEQ ID NO: 675346 - DNA, 20 bp, Artificial
  CRISPR gRNA sequence
gggaggctgaggcaggagga

SEQ ID NO: 675347 - DNA, 20 bp, Artificial
  CRISPR gRNA sequence
aggcaggaggattgcttgat

SEQ ID NO: 675348 - DNA, 20 bp, Artificial
  CRISPR gRNA sequence
cttgatcccgggaggcggac

SEQ ID NO: 675349 - DNA, 20 bp, Artificial
  CRISPR gRNA sequence
gatcccgggaggcggacacc

SEQ ID NO: 675350 - DNA, 20 bp, Artificial
  CRISPR gRNA sequence
atcccgggaggcggacacca

SEQ ID NO: 675351 - DNA, 20 bp, Artificial
  CRISPR gRNA sequence
ggtgacagagcgaaactcca

SEQ ID NO: 675352 - DNA, 20 bp, Artificial
  CRISPR gRNA sequence
catcctcccaccccccccaa

SEQ ID NO: 675353 - DNA, 20 bp, Artificial
  CRISPR gRNA sequence
ccaccccccccaaaaaaaga

SEQ ID NO: 675354 - DNA, 20 bp, Artificial
  CRISPR gRNA sequence
cagtcaagttattagcccac

SEQ ID NO: 675355 - DNA, 20 bp, Artificial
  CRISPR gRNA sequence
ttagcccactgagaaagtga

SEQ ID NO: 675356 - DNA, 20 bp, Artificial
  CRISPR gRNA sequence
gcccactgagaaagtgaact

SEQ ID NO: 675357 - DNA, 20 bp, Artificial
  CRISPR gRNA sequence
agaaagtgaactgcactttt

SEQ ID NO: 675358 - DNA, 20 bp, Artificial
  CRISPR gRNA sequence
cacttttaaaaacatgtccc

SEQ ID NO: 675359 - DNA, 20 bp, Artificial
  CRISPR gRNA sequence
ttaaaaacatgtcccagaga

SEQ ID NO: 675360 - DNA, 20 bp, Artificial
  CRISPR gRNA sequence
taaaaacatgtcccagagat

SEQ ID NO: 675361 - DNA, 20 bp, Artificial
  CRISPR gRNA sequence
aaaaacatgtcccagagata

SEQ ID NO: 675362 - DNA, 20 bp, Artificial
  CRISPR gRNA sequence
aaaacatgtcccagagatac

SEQ ID NO: 675363 - DNA, 20 bp, Artificial
  CRISPR gRNA sequence
cataaagttataggaaaata

SEQ ID NO: 675364 - DNA, 20 bp, Artificial
  CRISPR gRNA sequence
taggaaaataaaaggtatta

SEQ ID NO: 675365 - DNA, 20 bp, Artificial
  CRISPR gRNA sequence
gtctatacttgaaactcttg

SEQ ID NO: 675366 - DNA, 20 bp, Artificial
  CRISPR gRNA sequence
tacttgaaactcttgctatt

SEQ ID NO: 675367 - DNA, 20 bp, Artificial
  CRISPR gRNA sequence
gaaactcttgctattcagta

SEQ ID NO: 675368 - DNA, 20 bp, Artificial
  CRISPR gRNA sequence
aaactcttgctattcagtaa

SEQ ID NO: 675369 - DNA, 20 bp, Artificial
  CRISPR gRNA sequence
ttgctattcagtaatcttga

SEQ ID NO: 675370 - DNA, 20 bp, Artificial
  CRISPR gRNA sequence
gctattcagtaatcttgaga

SEQ ID NO: 675371 - DNA, 20 bp, Artificial
  CRISPR gRNA sequence
ctattcagtaatcttgagat

SEQ ID NO: 675372 - DNA, 20 bp, Artificial
  CRISPR gRNA sequence
ttcagtaatcttgagattta

SEQ ID NO: 675373 - DNA, 20 bp, Artificial
  CRISPR gRNA sequence
agtaatcttgagatttacta

SEQ ID NO: 675374 - DNA, 20 bp, Artificial
  CRISPR gRNA sequence
gagatttactatacaaatca

SEQ ID NO: 675375 - DNA, 20 bp, Artificial
  CRISPR gRNA sequence
agatttactatacaaatcat

SEQ ID NO: 675376 - DNA, 20 bp, Artificial
  CRISPR gRNA sequence
actatacaaatcatctactt

SEQ ID NO: 675377 - DNA, 20 bp, Artificial
  CRISPR gRNA sequence
ctatacaaatcatctacttt

SEQ ID NO: 675378 - DNA, 20 bp, Artificial
  CRISPR gRNA sequence
tacaaatcatctactttgct

SEQ ID NO: 675379 - DNA, 20 bp, Artificial
  CRISPR gRNA sequence
ctttgcttcatgtgaacttt

SEQ ID NO: 675380 - DNA, 20 bp, Artificial
  CRISPR gRNA sequence
tgcttcatgtgaacttttaa

SEQ ID NO: 675381 - DNA, 20 bp, Artificial
  CRISPR gRNA sequence
gcttcatgtgaacttttaac

SEQ ID NO: 675382 - DNA, 20 bp, Artificial
  CRISPR gRNA sequence
cttcatgtgaacttttaaca

SEQ ID NO: 675383 - DNA, 20 bp, Artificial
  CRISPR gRNA sequence
catgtgaacttttaacatag

SEQ ID NO: 675384 - DNA, 20 bp, Artificial
  CRISPR gRNA sequence
atgtgaacttttaacatagt

SEQ ID NO: 675385 - DNA, 20 bp, Artificial
  CRISPR gRNA sequence
ttaacatagtatttaagtga

SEQ ID NO: 675386 - DNA, 20 bp, Artificial
  CRISPR gRNA sequence
taacatagtatttaagtgac

SEQ ID NO: 675387 - DNA, 20 bp, Artificial
  CRISPR gRNA sequence
aacatagtatttaagtgact

SEQ ID NO: 675388 - DNA, 20 bp, Artificial
  CRISPR gRNA sequence
acatagtatttaagtgactt

SEQ ID NO: 675389 - DNA, 20 bp, Artificial
  CRISPR gRNA sequence
aagtgacttttttttttttc

SEQ ID NO: 675390 - DNA, 20 bp, Artificial
  CRISPR gRNA sequence
agtgacttttttttttttct

SEQ ID NO: 675391 - DNA, 20 bp, Artificial
  CRISPR gRNA sequence
ttttttttttctgagacagg

SEQ ID NO: 675392 - DNA, 20 bp, Artificial
  CRISPR gRNA sequence
tttttttttctgagacaggg

SEQ ID NO: 675393 - DNA, 20 bp, Artificial
  CRISPR gRNA sequence
ttttttttctgagacagggt

SEQ ID NO: 675394 - DNA, 20 bp, Artificial
  CRISPR gRNA sequence
tttttttctgagacagggtc

SEQ ID NO: 675395 - DNA, 20 bp, Artificial
  CRISPR gRNA sequence
ttttttctgagacagggtct

SEQ ID NO: 675396 - DNA, 20 bp, Artificial
  CRISPR gRNA sequence
tttttctgagacagggtctc

SEQ ID NO: 675397 - DNA, 20 bp, Artificial
  CRISPR gRNA sequence
ttttctgagacagggtctca

SEQ ID NO: 675398 - DNA, 20 bp, Artificial
  CRISPR gRNA sequence
tttctgagacagggtctcac

SEQ ID NO: 675399 - DNA, 20 bp, Artificial
  CRISPR gRNA sequence
ttctgagacagggtctcact

SEQ ID NO: 675400 - DNA, 20 bp, Artificial
  CRISPR gRNA sequence
tctgagacagggtctcactc

SEQ ID NO: 675401 - DNA, 20 bp, Artificial
  CRISPR gRNA sequence
ctgagacagggtctcactct

SEQ ID NO: 675402 - DNA, 20 bp, Artificial
  CRISPR gRNA sequence
tgagacagggtctcactctg

SEQ ID NO: 675403 - DNA, 20 bp, Artificial
  CRISPR gRNA sequence
agacagggtctcactctgtg

SEQ ID NO: 675404 - DNA, 20 bp, Artificial
  CRISPR gRNA sequence
actctgtggcccaggctgga

SEQ ID NO: 675405 - DNA, 20 bp, Artificial
  CRISPR gRNA sequence
tgtggcccaggctggagtgc

SEQ ID NO: 675406 - DNA, 20 bp, Artificial
  CRISPR gRNA sequence
tggcccaggctggagtgcag

SEQ ID NO: 675407 - DNA, 20 bp, Artificial
  CRISPR gRNA sequence
gagtgcagtggcgtgatctc

SEQ ID NO: 675408 - DNA, 20 bp, Artificial
  CRISPR gRNA sequence
ggctcactgcaacctccgcc

SEQ ID NO: 675409 - DNA, 20 bp, Artificial
  CRISPR gRNA sequence
actgcaacctccgcctcctg

SEQ ID NO: 675410 - DNA, 20 bp, Artificial
  CRISPR gRNA sequence
caacctccgcctcctgggtt

SEQ ID NO: 675411 - DNA, 20 bp, Artificial
  CRISPR gRNA sequence
cgcctcctgggtttaagtgg

SEQ ID NO: 675412 - DNA, 20 bp, Artificial
  CRISPR gRNA sequence
ctgggtttaagtggttcccc

SEQ ID NO: 675413 - DNA, 20 bp, Artificial
  CRISPR gRNA sequence
ggtttaagtggttcccccgc

SEQ ID NO: 675414 - DNA, 20 bp, Artificial
  CRISPR gRNA sequence
aagtggttcccccgcctcag

SEQ ID NO: 675415 - DNA, 20 bp, Artificial
  CRISPR gRNA sequence
agtggttcccccgcctcagc

SEQ ID NO: 675416 - DNA, 20 bp, Artificial
  CRISPR gRNA sequence
ccccgcctcagcctcccaag

SEQ ID NO: 675417 - DNA, 20 bp, Artificial
  CRISPR gRNA sequence
agcctcccaagtagctggaa

SEQ ID NO: 675418 - DNA, 20 bp, Artificial
  CRISPR gRNA sequence
ccaagtagctggaattacag

SEQ ID NO: 675419 - DNA, 20 bp, Artificial
  CRISPR gRNA sequence
gaattacaggcgtgcaccac

SEQ ID NO: 675420 - DNA, 20 bp, Artificial
  CRISPR gRNA sequence
caggcgtgcaccaccacgcc

SEQ ID NO: 675421 - DNA, 20 bp, Artificial
  CRISPR gRNA sequence
atttttgtatttttagtaga

SEQ ID NO: 675422 - DNA, 20 bp, Artificial
  CRISPR gRNA sequence
ttgtatttttagtagagacg

SEQ ID NO: 675423 - DNA, 20 bp, Artificial
  CRISPR gRNA sequence
tgtatttttagtagagacgg

SEQ ID NO: 675424 - DNA, 20 bp, Artificial
  CRISPR gRNA sequence
gtatttttagtagagacggg

SEQ ID NO: 675425 - DNA, 20 bp, Artificial
  CRISPR gRNA sequence
tatttttagtagagacgggg

SEQ ID NO: 675426 - DNA, 20 bp, Artificial
  CRISPR gRNA sequence
ttagtagagacggggtttca

SEQ ID NO: 675427 - DNA, 20 bp, Artificial
  CRISPR gRNA sequence
tagtagagacggggtttcac

SEQ ID NO: 675428 - DNA, 20 bp, Artificial
  CRISPR gRNA sequence
agtagagacggggtttcacc

SEQ ID NO: 675429 - DNA, 20 bp, Artificial
  CRISPR gRNA sequence
gtagagacggggtttcaccg

SEQ ID NO: 675430 - DNA, 20 bp, Artificial
  CRISPR gRNA sequence
caccgtgttggccaggctgg

SEQ ID NO: 675431 - DNA, 20 bp, Artificial
  CRISPR gRNA sequence
accgtgttggccaggctggt

SEQ ID NO: 675432 - DNA, 20 bp, Artificial
  CRISPR gRNA sequence
gccaggctggtcttgaactc

SEQ ID NO: 675433 - DNA, 20 bp, Artificial
  CRISPR gRNA sequence
gtcttgaactcctgacctca

SEQ ID NO: 675434 - DNA, 20 bp, Artificial
  CRISPR gRNA sequence
gaactcctgacctcaggtga

SEQ ID NO: 675435 - DNA, 20 bp, Artificial
  CRISPR gRNA sequence
aactcctgacctcaggtgat

SEQ ID NO: 675436 - DNA, 20 bp, Artificial
  CRISPR gRNA sequence
ctgacctcaggtgattcgcc

SEQ ID NO: 675437 - DNA, 20 bp, Artificial
  CRISPR gRNA sequence
acctcaggtgattcgcctgc

SEQ ID NO: 675438 - DNA, 20 bp, Artificial
  CRISPR gRNA sequence
aggtgattcgcctgcctcag

SEQ ID NO: 675439 - DNA, 20 bp, Artificial
  CRISPR gRNA sequence
gcctgcctcagcctcccaaa

SEQ ID NO: 675440 - DNA, 20 bp, Artificial
  CRISPR gRNA sequence
cctcagcctcccaaagtgct

SEQ ID NO: 675441 - DNA, 20 bp, Artificial
  CRISPR gRNA sequence
agcctcccaaagtgctggga

SEQ ID NO: 675442 - DNA, 20 bp, Artificial
  CRISPR gRNA sequence
ccaaagtgctgggattacag

SEQ ID NO: 675443 - DNA, 20 bp, Artificial
  CRISPR gRNA sequence
ggattacaggcgtgagccac

SEQ ID NO: 675444 - DNA, 20 bp, Artificial
  CRISPR gRNA sequence
caggcgtgagccactgcgcc

SEQ ID NO: 675445 - DNA, 20 bp, Artificial
  CRISPR gRNA sequence
cgcccacccttaagtgacta

SEQ ID NO: 675446 - DNA, 20 bp, Artificial
  CRISPR gRNA sequence
aagtgactatttaatgatga

SEQ ID NO: 675447 - DNA, 20 bp, Artificial
  CRISPR gRNA sequence
agtgactatttaatgatgaa

SEQ ID NO: 675448 - DNA, 20 bp, Artificial
  CRISPR gRNA sequence
tttaatgatgaatcaatgct

SEQ ID NO: 675449 - DNA, 20 bp, Artificial
  CRISPR gRNA sequence
aatgatgaatcaatgcttct

SEQ ID NO: 675450 - DNA, 20 bp, Artificial
  CRISPR gRNA sequence
atgatgaatcaatgcttctg

SEQ ID NO: 675451 - DNA, 20 bp, Artificial
  CRISPR gRNA sequence
ctgctacaaaaatgattttt

SEQ ID NO: 675452 - DNA, 20 bp, Artificial
  CRISPR gRNA sequence
tgctacaaaaatgattttta

SEQ ID NO: 675453 - DNA, 20 bp, Artificial
  CRISPR gRNA sequence
ctacaaaaatgatttttatt

SEQ ID NO: 675454 - DNA, 20 bp, Artificial
  CRISPR gRNA sequence
caaaaatgatttttattagt

SEQ ID NO: 675455 - DNA, 20 bp, Artificial
  CRISPR gRNA sequence
ttattagttttgtctcagat

SEQ ID NO: 675456 - DNA, 20 bp, Artificial
  CRISPR gRNA sequence
tattagttttgtctcagatt

SEQ ID NO: 675457 - DNA, 20 bp, Artificial
  CRISPR gRNA sequence
attagttttgtctcagattt

SEQ ID NO: 675458 - DNA, 20 bp, Artificial
  CRISPR gRNA sequence
ttagttttgtctcagatttt

SEQ ID NO: 675459 - DNA, 20 bp, Artificial
  CRISPR gRNA sequence
gttttgtctcagatttttca

SEQ ID NO: 675460 - DNA, 20 bp, Artificial
  CRISPR gRNA sequence
tgtctcagatttttcagttt

SEQ ID NO: 675461 - DNA, 20 bp, Artificial
  CRISPR gRNA sequence
gtctcagatttttcagtttt

SEQ ID NO: 675462 - DNA, 20 bp, Artificial
  CRISPR gRNA sequence
tctcagatttttcagtttta

SEQ ID NO: 675463 - DNA, 20 bp, Artificial
  CRISPR gRNA sequence
agatttttcagttttatagg

SEQ ID NO: 675464 - DNA, 20 bp, Artificial
  CRISPR gRNA sequence
ttcagttttataggtgatta

SEQ ID NO: 675465 - DNA, 20 bp, Artificial
  CRISPR gRNA sequence
tcagttttataggtgattat

SEQ ID NO: 675466 - DNA, 20 bp, Artificial
  CRISPR gRNA sequence
cagttttataggtgattata

SEQ ID NO: 675467 - DNA, 20 bp, Artificial
  CRISPR gRNA sequence
agttttataggtgattatag

SEQ ID NO: 675468 - DNA, 20 bp, Artificial
  CRISPR gRNA sequence
tataggtgattatagttctt

SEQ ID NO: 675469 - DNA, 20 bp, Artificial
  CRISPR gRNA sequence
ataggtgattatagttcttt

SEQ ID NO: 675470 - DNA, 20 bp, Artificial
  CRISPR gRNA sequence
taggtgattatagttctttc

SEQ ID NO: 675471 - DNA, 20 bp, Artificial
  CRISPR gRNA sequence
tagttctttcattcttataa

SEQ ID NO: 675472 - DNA, 20 bp, Artificial
  CRISPR gRNA sequence
tttcattcttataaatttga

SEQ ID NO: 675473 - DNA, 20 bp, Artificial
  CRISPR gRNA sequence
tcattcttataaatttgatt

SEQ ID NO: 675474 - DNA, 20 bp, Artificial
  CRISPR gRNA sequence
cattcttataaatttgatta

SEQ ID NO: 675475 - DNA, 20 bp, Artificial
  CRISPR gRNA sequence
attcttataaatttgattac

SEQ ID NO: 675476 - DNA, 20 bp, Artificial
  CRISPR gRNA sequence
ttataaatttgattactata

SEQ ID NO: 675477 - DNA, 20 bp, Artificial
  CRISPR gRNA sequence
ataaatttgattactatatt

SEQ ID NO: 675478 - DNA, 20 bp, Artificial
  CRISPR gRNA sequence
taaatttgattactatattt

SEQ ID NO: 675479 - DNA, 20 bp, Artificial
  CRISPR gRNA sequence
gattactatattttgtacat

SEQ ID NO: 675480 - DNA, 20 bp, Artificial
  CRISPR gRNA sequence
attactatattttgtacatt

SEQ ID NO: 675481 - DNA, 20 bp, Artificial
  CRISPR gRNA sequence
ctatattttgtacattatat

SEQ ID NO: 675482 - DNA, 20 bp, Artificial
  CRISPR gRNA sequence
tattttgtacattatatata

SEQ ID NO: 675483 - DNA, 20 bp, Artificial
  CRISPR gRNA sequence
tgtacattatatatattaca

SEQ ID NO: 675484 - DNA, 20 bp, Artificial
  CRISPR gRNA sequence
gtacattatatatattacac

SEQ ID NO: 675485 - DNA, 20 bp, Artificial
  CRISPR gRNA sequence
tacattatatatattacacc

SEQ ID NO: 675486 - DNA, 20 bp, Artificial
  CRISPR gRNA sequence
tatatattacaccttttact

SEQ ID NO: 675487 - DNA, 20 bp, Artificial
  CRISPR gRNA sequence
caccttttactttctttatt

SEQ ID NO: 675488 - DNA, 20 bp, Artificial
  CRISPR gRNA sequence
ttactttctttattatacct

SEQ ID NO: 675489 - DNA, 20 bp, Artificial
  CRISPR gRNA sequence
tactttctttattataccta

SEQ ID NO: 675490 - DNA, 20 bp, Artificial
  CRISPR gRNA sequence
actttctttattatacctaa

SEQ ID NO: 675491 - DNA, 20 bp, Artificial
  CRISPR gRNA sequence
ctttctttattatacctaat

SEQ ID NO: 675492 - DNA, 20 bp, Artificial
  CRISPR gRNA sequence
tctttattatacctaatact

SEQ ID NO: 675493 - DNA, 20 bp, Artificial
  CRISPR gRNA sequence
ctttattatacctaatactc

SEQ ID NO: 675494 - DNA, 20 bp, Artificial
  CRISPR gRNA sequence
tttattatacctaatactct

SEQ ID NO: 675495 - DNA, 20 bp, Artificial
  CRISPR gRNA sequence
tattatacctaatactctga

SEQ ID NO: 675496 - DNA, 20 bp, Artificial
  CRISPR gRNA sequence
attatacctaatactctgag

SEQ ID NO: 675497 - DNA, 20 bp, Artificial
  CRISPR gRNA sequence
ttatacctaatactctgagg

SEQ ID NO: 675498 - DNA, 20 bp, Artificial
  CRISPR gRNA sequence
tacctaatactctgagggga

SEQ ID NO: 675499 - DNA, 20 bp, Artificial
  CRISPR gRNA sequence
atactctgaggggatagtgt

SEQ ID NO: 675500 - DNA, 20 bp, Artificial
  CRISPR gRNA sequence
tgaggggatagtgtttaaat

SEQ ID NO: 675501 - DNA, 20 bp, Artificial
  CRISPR gRNA sequence
aggggatagtgtttaaatta

SEQ ID NO: 675502 - DNA, 20 bp, Artificial
  CRISPR gRNA sequence
aaattaagccctggacccct

SEQ ID NO: 675503 - DNA, 20 bp, Artificial
  CRISPR gRNA sequence
aattaagccctggaccccta

SEQ ID NO: 675504 - DNA, 20 bp, Artificial
  CRISPR gRNA sequence
agccctggacccctattagt

SEQ ID NO: 675505 - DNA, 20 bp, Artificial
  CRISPR gRNA sequence
gacccctattagtcaaaata

SEQ ID NO: 675506 - DNA, 20 bp, Artificial
  CRISPR gRNA sequence
ttagtcaaaataatatttag

SEQ ID NO: 675507 - DNA, 20 bp, Artificial
  CRISPR gRNA sequence
gtcaaaataatatttagcat

SEQ ID NO: 675508 - DNA, 20 bp, Artificial
  CRISPR gRNA sequence
agcatacttgttattttaaa

SEQ ID NO: 675509 - DNA, 20 bp, Artificial
  CRISPR gRNA sequence
gcatacttgttattttaaaa

SEQ ID NO: 675510 - DNA, 20 bp, Artificial
  CRISPR gRNA sequence
gttattttaaaaattctagg

SEQ ID NO: 675511 - DNA, 20 bp, Artificial
  CRISPR gRNA sequence
ttattttaaaaattctagga

SEQ ID NO: 675512 - DNA, 20 bp, Artificial
  CRISPR gRNA sequence
ttttaaaaattctaggagga

SEQ ID NO: 675513 - DNA, 20 bp, Artificial
  CRISPR gRNA sequence
taaaaattctaggaggaaat

SEQ ID NO: 675514 - DNA, 20 bp, Artificial
  CRISPR gRNA sequence
aaaaattctaggaggaaata

SEQ ID NO: 675515 - DNA, 20 bp, Artificial
  CRISPR gRNA sequence
aaaattctaggaggaaatag

SEQ ID NO: 675516 - DNA, 20 bp, Artificial
  CRISPR gRNA sequence
taggaggaaatagaattaca

SEQ ID NO: 675517 - DNA, 20 bp, Artificial
  CRISPR gRNA sequence
ggaggaaatagaattacatg

SEQ ID NO: 675518 - DNA, 20 bp, Artificial
  CRISPR gRNA sequence
catgttttttctaattagca

SEQ ID NO: 675519 - DNA, 20 bp, Artificial
  CRISPR gRNA sequence
tttctaattagcatttcagg

SEQ ID NO: 675520 - DNA, 20 bp, Artificial
  CRISPR gRNA sequence
ttctaattagcatttcaggt

SEQ ID NO: 675521 - DNA, 20 bp, Artificial
  CRISPR gRNA sequence
tctaattagcatttcaggta

SEQ ID NO: 675522 - DNA, 20 bp, Artificial
  CRISPR gRNA sequence
ctaattagcatttcaggtat

SEQ ID NO: 675523 - DNA, 20 bp, Artificial
  CRISPR gRNA sequence
taattagcatttcaggtata

SEQ ID NO: 675524 - DNA, 20 bp, Artificial
  CRISPR gRNA sequence
attagcatttcaggtatatt

SEQ ID NO: 675525 - DNA, 20 bp, Artificial
  CRISPR gRNA sequence
gcatttcaggtatattttgt

SEQ ID NO: 675526 - DNA, 20 bp, Artificial
  CRISPR gRNA sequence
caggtatattttgtatatac

SEQ ID NO: 675527 - DNA, 20 bp, Artificial
  CRISPR gRNA sequence
aggtatattttgtatatact

SEQ ID NO: 675528 - DNA, 20 bp, Artificial
  CRISPR gRNA sequence
tgtatatactcttatgctgt

SEQ ID NO: 675529 - DNA, 20 bp, Artificial
  CRISPR gRNA sequence
gtatatactcttatgctgta

SEQ ID NO: 675530 - DNA, 20 bp, Artificial
  CRISPR gRNA sequence
tatatactcttatgctgtac

SEQ ID NO: 675531 - DNA, 20 bp, Artificial
  CRISPR gRNA sequence
ttatgctgtacccaaattaa

SEQ ID NO: 675532 - DNA, 20 bp, Artificial
  CRISPR gRNA sequence
atgctgtacccaaattaaag

SEQ ID NO: 675533 - DNA, 20 bp, Artificial
  CRISPR gRNA sequence
tgctgtacccaaattaaagg

SEQ ID NO: 675534 - DNA, 20 bp, Artificial
  CRISPR gRNA sequence
tacccaaattaaaggtttaa

SEQ ID NO: 675535 - DNA, 20 bp, Artificial
  CRISPR gRNA sequence
aaggtttaaaacagaagagt

SEQ ID NO: 675536 - DNA, 20 bp, Artificial
  CRISPR gRNA sequence
aaaacagaagagtgtataat

SEQ ID NO: 675537 - DNA, 20 bp, Artificial
  CRISPR gRNA sequence
aaacagaagagtgtataatt

SEQ ID NO: 675538 - DNA, 20 bp, Artificial
  CRISPR gRNA sequence
taatatatgagaaacatata

SEQ ID NO: 675539 - DNA, 20 bp, Artificial
  CRISPR gRNA sequence
aatatatgagaaacatatat

SEQ ID NO: 675540 - DNA, 20 bp, Artificial
  CRISPR gRNA sequence
atatatgagaaacatatatg

SEQ ID NO: 675541 - DNA, 20 bp, Artificial
  CRISPR gRNA sequence
aacatttctttttataaatt

SEQ ID NO: 675542 - DNA, 20 bp, Artificial
  CRISPR gRNA sequence
ctttttataaattataaaga

SEQ ID NO: 675543 - DNA, 20 bp, Artificial
  CRISPR gRNA sequence
tttttataaattataaagag

SEQ ID NO: 675544 - DNA, 20 bp, Artificial
  CRISPR gRNA sequence
tttataaattataaagagaa

SEQ ID NO: 675545 - DNA, 20 bp, Artificial
  CRISPR gRNA sequence
ttataaattataaagagaaa

SEQ ID NO: 675546 - DNA, 20 bp, Artificial
  CRISPR gRNA sequence
tataaattataaagagaaaa

SEQ ID NO: 675547 - DNA, 20 bp, Artificial
  CRISPR gRNA sequence
ataaattataaagagaaaaa

SEQ ID NO: 675548 - DNA, 20 bp, Artificial
  CRISPR gRNA sequence
taaattataaagagaaaaat

SEQ ID NO: 675549 - DNA, 20 bp, Artificial
  CRISPR gRNA sequence
taaagagaaaaatgatgagt

SEQ ID NO: 675550 - DNA, 20 bp, Artificial
  CRISPR gRNA sequence
catagaggggaacaacacat

SEQ ID NO: 675551 - DNA, 20 bp, Artificial
  CRISPR gRNA sequence
gggcctattggagagtagag

SEQ ID NO: 675552 - DNA, 20 bp, Artificial
  CRISPR gRNA sequence
ttggagagtagagggtggga

SEQ ID NO: 675553 - DNA, 20 bp, Artificial
  CRISPR gRNA sequence
gagagtagagggtgggacga

SEQ ID NO: 675554 - DNA, 20 bp, Artificial
  CRISPR gRNA sequence
atggtgctagccttaatacc

SEQ ID NO: 675555 - DNA, 20 bp, Artificial
  CRISPR gRNA sequence
gccttaatacctggatgaca

SEQ ID NO: 675556 - DNA, 20 bp, Artificial
  CRISPR gRNA sequence
aatacctggatgacaaaata

SEQ ID NO: 675557 - DNA, 20 bp, Artificial
  CRISPR gRNA sequence
atacctggatgacaaaataa

SEQ ID NO: 675558 - DNA, 20 bp, Artificial
  CRISPR gRNA sequence
gatgacaaaataatttatac

SEQ ID NO: 675559 - DNA, 20 bp, Artificial
  CRISPR gRNA sequence
ataccaaaaaaaaaaaaaaa

SEQ ID NO: 675560 - DNA, 20 bp, Artificial
  CRISPR gRNA sequence
taccaaaaaaaaaaaaaaac

SEQ ID NO: 675561 - DNA, 20 bp, Artificial
  CRISPR gRNA sequence
acctatataacaaacctgca

SEQ ID NO: 675562 - DNA, 20 bp, Artificial
  CRISPR gRNA sequence
cctatataacaaacctgcac

SEQ ID NO: 675563 - DNA, 20 bp, Artificial
  CRISPR gRNA sequence
tataacaaacctgcacatgt

SEQ ID NO: 675564 - DNA, 20 bp, Artificial
  CRISPR gRNA sequence
cacatgtacctctgaactta

SEQ ID NO: 675565 - DNA, 20 bp, Artificial
  CRISPR gRNA sequence
tgaacttaaaataaaagtta

SEQ ID NO: 675566 - DNA, 20 bp, Artificial
  CRISPR gRNA sequence
aacttaaaataaaagttaaa

SEQ ID NO: 675567 - DNA, 20 bp, Artificial
  CRISPR gRNA sequence
aaaataaaagttaaaaaaac

SEQ ID NO: 675568 - DNA, 20 bp, Artificial
  CRISPR gRNA sequence
aaataaaagttaaaaaaaca

SEQ ID NO: 675569 - DNA, 20 bp, Artificial
  CRISPR gRNA sequence
aaaaaacagaatgcatctca

SEQ ID NO: 675570 - DNA, 20 bp, Artificial
  CRISPR gRNA sequence
atagagtctcaaaatatttt

SEQ ID NO: 675571 - DNA, 20 bp, Artificial
  CRISPR gRNA sequence
aaaatatttttctaccagat

SEQ ID NO: 675572 - DNA, 20 bp, Artificial
  CRISPR gRNA sequence
ttctaccagatgaaaaattc

SEQ ID NO: 675573 - DNA, 20 bp, Artificial
  CRISPR gRNA sequence
tctaccagatgaaaaattca

SEQ ID NO: 675574 - DNA, 20 bp, Artificial
  CRISPR gRNA sequence
ctaccagatgaaaaattcaa

SEQ ID NO: 675575 - DNA, 20 bp, Artificial
  CRISPR gRNA sequence
taccagatgaaaaattcaat

SEQ ID NO: 675576 - DNA, 20 bp, Artificial
  CRISPR gRNA sequence
ccagatgaaaaattcaattt

SEQ ID NO: 675577 - DNA, 20 bp, Artificial
  CRISPR gRNA sequence
aattttggctaagaattata

SEQ ID NO: 675578 - DNA, 20 bp, Artificial
  CRISPR gRNA sequence
tggctaagaattatactggt

SEQ ID NO: 675579 - DNA, 20 bp, Artificial
  CRISPR gRNA sequence
ggctaagaattatactggtt

SEQ ID NO: 675580 - DNA, 20 bp, Artificial
  CRISPR gRNA sequence
gctaagaattatactggttc

SEQ ID NO: 675581 - DNA, 20 bp, Artificial
  CRISPR gRNA sequence
agaattatactggttcagat

SEQ ID NO: 675582 - DNA, 20 bp, Artificial
  CRISPR gRNA sequence
tactggttcagattactatg

SEQ ID NO: 675583 - DNA, 20 bp, Artificial
  CRISPR gRNA sequence
gttcagattactatgaaaat

SEQ ID NO: 675584 - DNA, 20 bp, Artificial
  CRISPR gRNA sequence
agattactatgaaaattatg

SEQ ID NO: 675585 - DNA, 20 bp, Artificial
  CRISPR gRNA sequence
ctatgaaaattatgtattgc

SEQ ID NO: 675586 - DNA, 20 bp, Artificial
  CRISPR gRNA sequence
tgaaaattatgtattgctca

SEQ ID NO: 675587 - DNA, 20 bp, Artificial
  CRISPR gRNA sequence
tgtattgctcaaaaacggaa

SEQ ID NO: 675588 - DNA, 20 bp, Artificial
  CRISPR gRNA sequence
ctcaaaaacggaatcatcca

SEQ ID NO: 675589 - DNA, 20 bp, Artificial
  CRISPR gRNA sequence
aaaaacggaatcatccaaat

SEQ ID NO: 675590 - DNA, 20 bp, Artificial
  CRISPR gRNA sequence
gaaaattaaaaatcttaatt

SEQ ID NO: 675591 - DNA, 20 bp, Artificial
  CRISPR gRNA sequence
aaaattaaaaatcttaattt

SEQ ID NO: 675592 - DNA, 20 bp, Artificial
  CRISPR gRNA sequence
aaaatcttaatttcccaaag

SEQ ID NO: 675593 - DNA, 20 bp, Artificial
  CRISPR gRNA sequence
aatttcccaaagacatttat

SEQ ID NO: 675594 - DNA, 20 bp, Artificial
  CRISPR gRNA sequence
atttcccaaagacatttatt

SEQ ID NO: 675595 - DNA, 20 bp, Artificial
  CRISPR gRNA sequence
cccaaagacatttattcatt

SEQ ID NO: 675596 - DNA, 20 bp, Artificial
  CRISPR gRNA sequence
ccaaagacatttattcattg

SEQ ID NO: 675597 - DNA, 20 bp, Artificial
  CRISPR gRNA sequence
attcattgtctcttataaat

SEQ ID NO: 675598 - DNA, 20 bp, Artificial
  CRISPR gRNA sequence
ttcattgtctcttataaatc

SEQ ID NO: 675599 - DNA, 20 bp, Artificial
  CRISPR gRNA sequence
attgtctcttataaatctaa

SEQ ID NO: 675600 - DNA, 20 bp, Artificial
  CRISPR gRNA sequence
tctcttataaatctaaaaaa

SEQ ID NO: 675601 - DNA, 20 bp, Artificial
  CRISPR gRNA sequence
ttataaatctaaaaaagcca

SEQ ID NO: 675602 - DNA, 20 bp, Artificial
  CRISPR gRNA sequence
ataaatctaaaaaagccaaa

SEQ ID NO: 675603 - DNA, 20 bp, Artificial
  CRISPR gRNA sequence
taaatctaaaaaagccaaat

SEQ ID NO: 675604 - DNA, 20 bp, Artificial
  CRISPR gRNA sequence
aaaaagccaaatacttatta

SEQ ID NO: 675605 - DNA, 20 bp, Artificial
  CRISPR gRNA sequence
attaagagaaccatatattt

SEQ ID NO: 675606 - DNA, 20 bp, Artificial
  CRISPR gRNA sequence
ttaagagaaccatatattta

SEQ ID NO: 675607 - DNA, 20 bp, Artificial
  CRISPR gRNA sequence
agagaaccatatatttaaga

SEQ ID NO: 675608 - DNA, 20 bp, Artificial
  CRISPR gRNA sequence
aagatacttgttctaaaact

SEQ ID NO: 675609 - DNA, 20 bp, Artificial
  CRISPR gRNA sequence
agatacttgttctaaaacta

SEQ ID NO: 675610 - DNA, 20 bp, Artificial
  CRISPR gRNA sequence
gttctaaaactaagttattt

SEQ ID NO: 675611 - DNA, 20 bp, Artificial
  CRISPR gRNA sequence
ttctaaaactaagttatttt

SEQ ID NO: 675612 - DNA, 20 bp, Artificial
  CRISPR gRNA sequence
taaaactaagttatttttca

SEQ ID NO: 675613 - DNA, 20 bp, Artificial
  CRISPR gRNA sequence
aaactaagttatttttcaaa

SEQ ID NO: 675614 - DNA, 20 bp, Artificial
  CRISPR gRNA sequence
agttatttttcaaagattta

SEQ ID NO: 675615 - DNA, 20 bp, Artificial
  CRISPR gRNA sequence
tttttcaaagatttataagt

SEQ ID NO: 675616 - DNA, 20 bp, Artificial
  CRISPR gRNA sequence
ttcaaagatttataagtaaa

SEQ ID NO: 675617 - DNA, 20 bp, Artificial
  CRISPR gRNA sequence
tcaaagatttataagtaaaa

SEQ ID NO: 675618 - DNA, 20 bp, Artificial
  CRISPR gRNA sequence
caaagatttataagtaaaat

SEQ ID NO: 675619 - DNA, 20 bp, Artificial
  CRISPR gRNA sequence
aaagatttataagtaaaatg

SEQ ID NO: 675620 - DNA, 20 bp, Artificial
  CRISPR gRNA sequence
ataagtaaaatgtccttaag

SEQ ID NO: 675621 - DNA, 20 bp, Artificial
  CRISPR gRNA sequence
taagtaaaatgtccttaagt

SEQ ID NO: 675622 - DNA, 20 bp, Artificial
  CRISPR gRNA sequence
aagtaagaaaataagtaaag

SEQ ID NO: 675623 - DNA, 20 bp, Artificial
  CRISPR gRNA sequence
agtaagaaaataagtaaagg

SEQ ID NO: 675624 - DNA, 20 bp, Artificial
  CRISPR gRNA sequence
ttttctaatatttttgttca

SEQ ID NO: 675625 - DNA, 20 bp, Artificial
  CRISPR gRNA sequence
tctaatatttttgttcatcc

SEQ ID NO: 675626 - DNA, 20 bp, Artificial
  CRISPR gRNA sequence
ctaatatttttgttcatcct

SEQ ID NO: 675627 - DNA, 20 bp, Artificial
  CRISPR gRNA sequence
taatatttttgttcatcctc

SEQ ID NO: 675628 - DNA, 20 bp, Artificial
  CRISPR gRNA sequence
atatttttgttcatcctcat

SEQ ID NO: 675629 - DNA, 20 bp, Artificial
  CRISPR gRNA sequence
ttgttcatcctcattttaag

SEQ ID NO: 675630 - DNA, 20 bp, Artificial
  CRISPR gRNA sequence
tgttcatcctcattttaaga

SEQ ID NO: 675631 - DNA, 20 bp, Artificial
  CRISPR gRNA sequence
gttcatcctcattttaagaa

SEQ ID NO: 675632 - DNA, 20 bp, Artificial
  CRISPR gRNA sequence
ttcatcctcattttaagaaa

SEQ ID NO: 675633 - DNA, 20 bp, Artificial
  CRISPR gRNA sequence
atcctcattttaagaaaata

SEQ ID NO: 675634 - DNA, 20 bp, Artificial
  CRISPR gRNA sequence
attttaagaaaataattatt

SEQ ID NO: 675635 - DNA, 20 bp, Artificial
  CRISPR gRNA sequence
taagaaaataattatttcat

SEQ ID NO: 675636 - DNA, 20 bp, Artificial
  CRISPR gRNA sequence
aagaaaataattatttcata

SEQ ID NO: 675637 - DNA, 20 bp, Artificial
  CRISPR gRNA sequence
agaaaataattatttcatat

SEQ ID NO: 675638 - DNA, 20 bp, Artificial
  CRISPR gRNA sequence
tttcatattttcaataatgc

SEQ ID NO: 675639 - DNA, 20 bp, Artificial
  CRISPR gRNA sequence
catattttcaataatgctat

SEQ ID NO: 675640 - DNA, 20 bp, Artificial
  CRISPR gRNA sequence
atattttcaataatgctatt

SEQ ID NO: 675641 - DNA, 20 bp, Artificial
  CRISPR gRNA sequence
tcaataatgctattaaattc

SEQ ID NO: 675642 - DNA, 20 bp, Artificial
  CRISPR gRNA sequence
caataatgctattaaattct

SEQ ID NO: 675643 - DNA, 20 bp, Artificial
  CRISPR gRNA sequence
aataatgctattaaattcta

SEQ ID NO: 675644 - DNA, 20 bp, Artificial
  CRISPR gRNA sequence
ttaaattctaagtaaaacct

SEQ ID NO: 675645 - DNA, 20 bp, Artificial
  CRISPR gRNA sequence
aattctaagtaaaacctcag

SEQ ID NO: 675646 - DNA, 20 bp, Artificial
  CRISPR gRNA sequence
taagtaaaacctcagctttc

SEQ ID NO: 675647 - DNA, 20 bp, Artificial
  CRISPR gRNA sequence
agtaaaacctcagctttcaa

SEQ ID NO: 675648 - DNA, 20 bp, Artificial
  CRISPR gRNA sequence
agctttcaattgaaccagca

SEQ ID NO: 675649 - DNA, 20 bp, Artificial
  CRISPR gRNA sequence
tcaattgaaccagcattgag

SEQ ID NO: 675650 - DNA, 20 bp, Artificial
  CRISPR gRNA sequence
caattgaaccagcattgagc

SEQ ID NO: 675651 - DNA, 20 bp, Artificial
  CRISPR gRNA sequence
aattgaaccagcattgagca

SEQ ID NO: 675652 - DNA, 20 bp, Artificial
  CRISPR gRNA sequence
aaccagcattgagcatatga

SEQ ID NO: 675653 - DNA, 20 bp, Artificial
  CRISPR gRNA sequence
agcatatgatataattattt

SEQ ID NO: 675654 - DNA, 20 bp, Artificial
  CRISPR gRNA sequence
tttatttgtgtatatcactt

SEQ ID NO: 675655 - DNA, 20 bp, Artificial
  CRISPR gRNA sequence
atttgtgtatatcacttaaa

SEQ ID NO: 675656 - DNA, 20 bp, Artificial
  CRISPR gRNA sequence
tttgtgtatatcacttaaaa

SEQ ID NO: 675657 - DNA, 20 bp, Artificial
  CRISPR gRNA sequence
gtgtatatcacttaaaaata

SEQ ID NO: 675658 - DNA, 20 bp, Artificial
  CRISPR gRNA sequence
tgtatatcacttaaaaataa

SEQ ID NO: 675659 - DNA, 20 bp, Artificial
  CRISPR gRNA sequence
aaaaataactactttgtaaa

SEQ ID NO: 675660 - DNA, 20 bp, Artificial
  CRISPR gRNA sequence
aaaataactactttgtaaaa

SEQ ID NO: 675661 - DNA, 20 bp, Artificial
  CRISPR gRNA sequence
ctttgtaaaattagttatct

SEQ ID NO: 675662 - DNA, 20 bp, Artificial
  CRISPR gRNA sequence
tgtaaaattagttatctgta

SEQ ID NO: 675663 - DNA, 20 bp, Artificial
  CRISPR gRNA sequence
gtaaaattagttatctgtat

SEQ ID NO: 675664 - DNA, 20 bp, Artificial
  CRISPR gRNA sequence
taaaattagttatctgtatc

SEQ ID NO: 675665 - DNA, 20 bp, Artificial
  CRISPR gRNA sequence
gttatctgtatcacataact

SEQ ID NO: 675666 - DNA, 20 bp, Artificial
  CRISPR gRNA sequence
tctgtatcacataactttgg

SEQ ID NO: 675667 - DNA, 20 bp, Artificial
  CRISPR gRNA sequence
tatcacataactttggagta

SEQ ID NO: 675668 - DNA, 20 bp, Artificial
  CRISPR gRNA sequence
tggagtaagagagatttgag

SEQ ID NO: 675669 - DNA, 20 bp, Artificial
  CRISPR gRNA sequence
ggagtaagagagatttgagg

SEQ ID NO: 675670 - DNA, 20 bp, Artificial
  CRISPR gRNA sequence
gagtaagagagatttgagga

SEQ ID NO: 675671 - DNA, 20 bp, Artificial
  CRISPR gRNA sequence
gaggaaccttacaatgtcaa

SEQ ID NO: 675672 - DNA, 20 bp, Artificial
  CRISPR gRNA sequence
aggaaccttacaatgtcaaa

SEQ ID NO: 675673 - DNA, 20 bp, Artificial
  CRISPR gRNA sequence
acaatgtcaaagttcttttg

SEQ ID NO: 675674 - DNA, 20 bp, Artificial
  CRISPR gRNA sequence
caatgtcaaagttcttttga

SEQ ID NO: 675675 - DNA, 20 bp, Artificial
  CRISPR gRNA sequence
ttttgacttagggttgatat

SEQ ID NO: 675676 - DNA, 20 bp, Artificial
  CRISPR gRNA sequence
ttgacttagggttgatatgc

SEQ ID NO: 675677 - DNA, 20 bp, Artificial
  CRISPR gRNA sequence
tgacttagggttgatatgcc

SEQ ID NO: 675678 - DNA, 20 bp, Artificial
  CRISPR gRNA sequence
gacttagggttgatatgcct

SEQ ID NO: 675679 - DNA, 20 bp, Artificial
  CRISPR gRNA sequence
acttagggttgatatgccta

SEQ ID NO: 675680 - DNA, 20 bp, Artificial
  CRISPR gRNA sequence
agggttgatatgcctaaact

SEQ ID NO: 675681 - DNA, 20 bp, Artificial
  CRISPR gRNA sequence
gggttgatatgcctaaacta

SEQ ID NO: 675682 - DNA, 20 bp, Artificial
  CRISPR gRNA sequence
atatgcctaaactattctga

SEQ ID NO: 675683 - DNA, 20 bp, Artificial
  CRISPR gRNA sequence
aactattctgaacatgtatc

SEQ ID NO: 675684 - DNA, 20 bp, Artificial
  CRISPR gRNA sequence
ttctgaacatgtatctatct

SEQ ID NO: 675685 - DNA, 20 bp, Artificial
  CRISPR gRNA sequence
tgaacatgtatctatcttac

SEQ ID NO: 675686 - DNA, 20 bp, Artificial
  CRISPR gRNA sequence
aacatgtatctatcttactt

SEQ ID NO: 675687 - DNA, 20 bp, Artificial
  CRISPR gRNA sequence
tcttacttccaaacacttta

SEQ ID NO: 675688 - DNA, 20 bp, Artificial
  CRISPR gRNA sequence
acttccaaacactttaggaa

SEQ ID NO: 675689 - DNA, 20 bp, Artificial
  CRISPR gRNA sequence
cttccaaacactttaggaat

SEQ ID NO: 675690 - DNA, 20 bp, Artificial
  CRISPR gRNA sequence
ccaaacactttaggaatgtt

SEQ ID NO: 675691 - DNA, 20 bp, Artificial
  CRISPR gRNA sequence
caaacactttaggaatgttg

SEQ ID NO: 675692 - DNA, 20 bp, Artificial
  CRISPR gRNA sequence
taggaatgttgatttttaca

SEQ ID NO: 675693 - DNA, 20 bp, Artificial
  CRISPR gRNA sequence
aggaatgttgatttttacaa

SEQ ID NO: 675694 - DNA, 20 bp, Artificial
  CRISPR gRNA sequence
ggaatgttgatttttacaac

SEQ ID NO: 675695 - DNA, 20 bp, Artificial
  CRISPR gRNA sequence
atttttacaacactactttg

SEQ ID NO: 675696 - DNA, 20 bp, Artificial
  CRISPR gRNA sequence
ttacaacactactttgtgac

SEQ ID NO: 675697 - DNA, 20 bp, Artificial
  CRISPR gRNA sequence
tacaacactactttgtgacc

SEQ ID NO: 675698 - DNA, 20 bp, Artificial
  CRISPR gRNA sequence
acaacactactttgtgacct

SEQ ID NO: 675699 - DNA, 20 bp, Artificial
  CRISPR gRNA sequence
caacactactttgtgaccta

SEQ ID NO: 675700 - DNA, 20 bp, Artificial
  CRISPR gRNA sequence
ctttgtgacctactcagtgt

SEQ ID NO: 675701 - DNA, 20 bp, Artificial
  CRISPR gRNA sequence
tgtgacctactcagtgtttg

SEQ ID NO: 675702 - DNA, 20 bp, Artificial
  CRISPR gRNA sequence
gtgacctactcagtgtttga

SEQ ID NO: 675703 - DNA, 20 bp, Artificial
  CRISPR gRNA sequence
tgacctactcagtgtttgac

SEQ ID NO: 675704 - DNA, 20 bp, Artificial
  CRISPR gRNA sequence
ctcagtgtttgacaattttc

SEQ ID NO: 675705 - DNA, 20 bp, Artificial
  CRISPR gRNA sequence
agtgtttgacaattttcagc

SEQ ID NO: 675706 - DNA, 20 bp, Artificial
  CRISPR gRNA sequence
gacaattttcagcttatgaa

SEQ ID NO: 675707 - DNA, 20 bp, Artificial
  CRISPR gRNA sequence
acaattttcagcttatgaag

SEQ ID NO: 675708 - DNA, 20 bp, Artificial
  CRISPR gRNA sequence
tcagcttatgaagtttgttg

SEQ ID NO: 675709 - DNA, 20 bp, Artificial
  CRISPR gRNA sequence
cagcttatgaagtttgttgt

SEQ ID NO: 675710 - DNA, 20 bp, Artificial
  CRISPR gRNA sequence
agcttatgaagtttgttgtt

SEQ ID NO: 675711 - DNA, 20 bp, Artificial
  CRISPR gRNA sequence
atgaagtttgttgtttatgt

SEQ ID NO: 675712 - DNA, 20 bp, Artificial
  CRISPR gRNA sequence
tgaagtttgttgtttatgtc

SEQ ID NO: 675713 - DNA, 20 bp, Artificial
  CRISPR gRNA sequence
gttgtttatgtctaattgtc

SEQ ID NO: 675714 - DNA, 20 bp, Artificial
  CRISPR gRNA sequence
ttgtttatgtctaattgtca

SEQ ID NO: 675715 - DNA, 20 bp, Artificial
  CRISPR gRNA sequence
tttatgtctaattgtcagtt

SEQ ID NO: 675716 - DNA, 20 bp, Artificial
  CRISPR gRNA sequence
atgtctaattgtcagtttaa

SEQ ID NO: 675717 - DNA, 20 bp, Artificial
  CRISPR gRNA sequence
tgtctaattgtcagtttaaa

SEQ ID NO: 675718 - DNA, 20 bp, Artificial
  CRISPR gRNA sequence
attgtcagtttaaagctatt

SEQ ID NO: 675719 - DNA, 20 bp, Artificial
  CRISPR gRNA sequence
tcagtttaaagctattctgt

SEQ ID NO: 675720 - DNA, 20 bp, Artificial
  CRISPR gRNA sequence
aaagctattctgttccataa

SEQ ID NO: 675721 - DNA, 20 bp, Artificial
  CRISPR gRNA sequence
aagctattctgttccataaa

SEQ ID NO: 675722 - DNA, 20 bp, Artificial
  CRISPR gRNA sequence
ttctgttccataaaaaggaa

SEQ ID NO: 675723 - DNA, 20 bp, Artificial
  CRISPR gRNA sequence
tgttccataaaaaggaactg

SEQ ID NO: 675724 - DNA, 20 bp, Artificial
  CRISPR gRNA sequence
ttccataaaaaggaactgga

SEQ ID NO: 675725 - DNA, 20 bp, Artificial
  CRISPR gRNA sequence
cataaaaaggaactggacca

SEQ ID NO: 675726 - DNA, 20 bp, Artificial
  CRISPR gRNA sequence
gaccagatgtaccatataaa

SEQ ID NO: 675727 - DNA, 20 bp, Artificial
  CRISPR gRNA sequence
ttaaaacaacaacttcctcc

SEQ ID NO: 675728 - DNA, 20 bp, Artificial
  CRISPR gRNA sequence
aaacaacaacttcctcccaa

SEQ ID NO: 675729 - DNA, 20 bp, Artificial
  CRISPR gRNA sequence
cctcccaactaaaaaacatt

SEQ ID NO: 675730 - DNA, 20 bp, Artificial
  CRISPR gRNA sequence
ctcccaactaaaaaacattt

SEQ ID NO: 675731 - DNA, 20 bp, Artificial
  CRISPR gRNA sequence
ccaactaaaaaacattttta

SEQ ID NO: 675732 - DNA, 20 bp, Artificial
  CRISPR gRNA sequence
aaaaacatttttagtatata

SEQ ID NO: 675733 - DNA, 20 bp, Artificial
  CRISPR gRNA sequence
ttagtatatatatatatatg

SEQ ID NO: 675734 - DNA, 20 bp, Artificial
  CRISPR gRNA sequence
tagtatatatatatatatgg

SEQ ID NO: 675735 - DNA, 20 bp, Artificial
  CRISPR gRNA sequence
agtatatatatatatatgga

SEQ ID NO: 675736 - DNA, 20 bp, Artificial
  CRISPR gRNA sequence
gtatatatatatatatggac

SEQ ID NO: 675737 - DNA, 20 bp, Artificial
  CRISPR gRNA sequence
tctttatttttcaagtccct

SEQ ID NO: 675738 - DNA, 20 bp, Artificial
  CRISPR gRNA sequence
tatttttcaagtccctatag

SEQ ID NO: 675739 - DNA, 20 bp, Artificial
  CRISPR gRNA sequence
atttttcaagtccctatagt

SEQ ID NO: 675740 - DNA, 20 bp, Artificial
  CRISPR gRNA sequence
tttttcaagtccctatagtt

SEQ ID NO: 675741 - DNA, 20 bp, Artificial
  CRISPR gRNA sequence
ttcaagtccctatagttcca

SEQ ID NO: 675742 - DNA, 20 bp, Artificial
  CRISPR gRNA sequence
tcaagtccctatagttccaa

SEQ ID NO: 675743 - DNA, 20 bp, Artificial
  CRISPR gRNA sequence
caagtccctatagttccaag

SEQ ID NO: 675744 - DNA, 20 bp, Artificial
  CRISPR gRNA sequence
aagtccctatagttccaagg

SEQ ID NO: 675745 - DNA, 20 bp, Artificial
  CRISPR gRNA sequence
tagttccaaggactatattt

SEQ ID NO: 675746 - DNA, 20 bp, Artificial
  CRISPR gRNA sequence
caaggactatattttatcca

SEQ ID NO: 675747 - DNA, 20 bp, Artificial
  CRISPR gRNA sequence
tattttatccacaaaaatag

SEQ ID NO: 675748 - DNA, 20 bp, Artificial
  CRISPR gRNA sequence
tatccacaaaaatagctcag

SEQ ID NO: 675749 - DNA, 20 bp, Artificial
  CRISPR gRNA sequence
atccacaaaaatagctcaga

SEQ ID NO: 675750 - DNA, 20 bp, Artificial
  CRISPR gRNA sequence
tccacaaaaatagctcagaa

SEQ ID NO: 675751 - DNA, 20 bp, Artificial
  CRISPR gRNA sequence
agaaatattgaatgcttata

SEQ ID NO: 675752 - DNA, 20 bp, Artificial
  CRISPR gRNA sequence
aatgcttatactagttccta

SEQ ID NO: 675753 - DNA, 20 bp, Artificial
  CRISPR gRNA sequence
atactagttcctaatattga

SEQ ID NO: 675754 - DNA, 20 bp, Artificial
  CRISPR gRNA sequence
tactagttcctaatattgac

SEQ ID NO: 675755 - DNA, 20 bp, Artificial
  CRISPR gRNA sequence
gttcctaatattgactttta

SEQ ID NO: 675756 - DNA, 20 bp, Artificial
  CRISPR gRNA sequence
ctaatattgacttttaaaaa

SEQ ID NO: 675757 - DNA, 20 bp, Artificial
  CRISPR gRNA sequence
atattgacttttaaaaatcc

SEQ ID NO: 675758 - DNA, 20 bp, Artificial
  CRISPR gRNA sequence
acttttaaaaatcccaatta

SEQ ID NO: 675759 - DNA, 20 bp, Artificial
  CRISPR gRNA sequence
ttaaaaatcccaattaaata

SEQ ID NO: 675760 - DNA, 20 bp, Artificial
  CRISPR gRNA sequence
taaaaatcccaattaaatag

SEQ ID NO: 675761 - DNA, 20 bp, Artificial
  CRISPR gRNA sequence
aaaaatcccaattaaatagc

SEQ ID NO: 675762 - DNA, 20 bp, Artificial
  CRISPR gRNA sequence
aaaatcccaattaaatagcc

SEQ ID NO: 675763 - DNA, 20 bp, Artificial
  CRISPR gRNA sequence
aatagcctagtttatatttt

SEQ ID NO: 675764 - DNA, 20 bp, Artificial
  CRISPR gRNA sequence
gtttatattttgttcagtta

SEQ ID NO: 675765 - DNA, 20 bp, Artificial
  CRISPR gRNA sequence
atattttgttcagttatgcc

SEQ ID NO: 675766 - DNA, 20 bp, Artificial
  CRISPR gRNA sequence
tattttgttcagttatgcct

SEQ ID NO: 675767 - DNA, 20 bp, Artificial
  CRISPR gRNA sequence
tgttcagttatgccttcacc

SEQ ID NO: 675768 - DNA, 20 bp, Artificial
  CRISPR gRNA sequence
gttcagttatgccttcacct

SEQ ID NO: 675769 - DNA, 20 bp, Artificial
  CRISPR gRNA sequence
ttcagttatgccttcaccta

SEQ ID NO: 675770 - DNA, 20 bp, Artificial
  CRISPR gRNA sequence
agttatgccttcacctatta

SEQ ID NO: 675771 - DNA, 20 bp, Artificial
  CRISPR gRNA sequence
tgccttcacctattatgaga

SEQ ID NO: 675772 - DNA, 20 bp, Artificial
  CRISPR gRNA sequence
cacctattatgagaaaattc

SEQ ID NO: 675773 - DNA, 20 bp, Artificial
  CRISPR gRNA sequence
acctattatgagaaaattcc

SEQ ID NO: 675774 - DNA, 20 bp, Artificial
  CRISPR gRNA sequence
ttatgagaaaattcctgtaa

SEQ ID NO: 675775 - DNA, 20 bp, Artificial
  CRISPR gRNA sequence
tgagaaaattcctgtaaagt

SEQ ID NO: 675776 - DNA, 20 bp, Artificial
  CRISPR gRNA sequence
ctgtaaagtattatgactca

SEQ ID NO: 675777 - DNA, 20 bp, Artificial
  CRISPR gRNA sequence
taaagtattatgactcatcc

SEQ ID NO: 675778 - DNA, 20 bp, Artificial
  CRISPR gRNA sequence
tgactcatcctatgtttaaa

SEQ ID NO: 675779 - DNA, 20 bp, Artificial
  CRISPR gRNA sequence
atcctatgtttaaatatatt

SEQ ID NO: 675780 - DNA, 20 bp, Artificial
  CRISPR gRNA sequence
tgtttaaatatatttccaca

SEQ ID NO: 675781 - DNA, 20 bp, Artificial
  CRISPR gRNA sequence
aaatatatttccacatttat

SEQ ID NO: 675782 - DNA, 20 bp, Artificial
  CRISPR gRNA sequence
aatatatttccacatttatc

SEQ ID NO: 675783 - DNA, 20 bp, Artificial
  CRISPR gRNA sequence
ccacatttatctttaataga

SEQ ID NO: 675784 - DNA, 20 bp, Artificial
  CRISPR gRNA sequence
cacatttatctttaatagaa

SEQ ID NO: 675785 - DNA, 20 bp, Artificial
  CRISPR gRNA sequence
atctttaatagaatttcaaa

SEQ ID NO: 675786 - DNA, 20 bp, Artificial
  CRISPR gRNA sequence
tctttaatagaatttcaaac

SEQ ID NO: 675787 - DNA, 20 bp, Artificial
  CRISPR gRNA sequence
taatagaatttcaaactaac

SEQ ID NO: 675788 - DNA, 20 bp, Artificial
  CRISPR gRNA sequence
aatagaatttcaaactaaca

SEQ ID NO: 675789 - DNA, 20 bp, Artificial
  CRISPR gRNA sequence
atagaatttcaaactaacat

SEQ ID NO: 675790 - DNA, 20 bp, Artificial
  CRISPR gRNA sequence
caaactaacatgcattttta

SEQ ID NO: 675791 - DNA, 20 bp, Artificial
  CRISPR gRNA sequence
aaactaacatgcatttttaa

SEQ ID NO: 675792 - DNA, 20 bp, Artificial
  CRISPR gRNA sequence
acatgcatttttaaggtata

SEQ ID NO: 675793 - DNA, 20 bp, Artificial
  CRISPR gRNA sequence
ttaaggtatatgctacatgc

SEQ ID NO: 675794 - DNA, 20 bp, Artificial
  CRISPR gRNA sequence
taaggtatatgctacatgcc

SEQ ID NO: 675795 - DNA, 20 bp, Artificial
  CRISPR gRNA sequence
aaggtatatgctacatgccc

SEQ ID NO: 675796 - DNA, 20 bp, Artificial
  CRISPR gRNA sequence
aggtatatgctacatgccct

SEQ ID NO: 675797 - DNA, 20 bp, Artificial
  CRISPR gRNA sequence
catgccctcagagaaactgg

SEQ ID NO: 675798 - DNA, 20 bp, Artificial
  CRISPR gRNA sequence
agagaaactggtaagacaag

SEQ ID NO: 675799 - DNA, 20 bp, Artificial
  CRISPR gRNA sequence
gtaagacaagatggtcttct

SEQ ID NO: 675800 - DNA, 20 bp, Artificial
  CRISPR gRNA sequence
cttcatatcttcaaatttct

SEQ ID NO: 675801 - DNA, 20 bp, Artificial
  CRISPR gRNA sequence
ttcatatcttcaaatttctt

SEQ ID NO: 675802 - DNA, 20 bp, Artificial
  CRISPR gRNA sequence
catatcttcaaatttcttaa

SEQ ID NO: 675803 - DNA, 20 bp, Artificial
  CRISPR gRNA sequence
atatcttcaaatttcttaaa

SEQ ID NO: 675804 - DNA, 20 bp, Artificial
  CRISPR gRNA sequence
caaatttcttaaaaataaaa

SEQ ID NO: 675805 - DNA, 20 bp, Artificial
  CRISPR gRNA sequence
aaatttcttaaaaataaaaa

SEQ ID NO: 675806 - DNA, 20 bp, Artificial
  CRISPR gRNA sequence
cttaaaaataaaaaaaaaaa

SEQ ID NO: 675807 - DNA, 20 bp, Artificial
  CRISPR gRNA sequence
ttaaaaataaaaaaaaaaaa

SEQ ID NO: 675808 - DNA, 20 bp, Artificial
  CRISPR gRNA sequence
aaaaataaaaaaaaaaaatt

SEQ ID NO: 675809 - DNA, 20 bp, Artificial
  CRISPR gRNA sequence
aaaataaaaaaaaaaaatta

SEQ ID NO: 675810 - DNA, 20 bp, Artificial
  CRISPR gRNA sequence
ccatgtggcttggatcaaga

SEQ ID NO: 675811 - DNA, 20 bp, Artificial
  CRISPR gRNA sequence
ggatcaagatggagctcatc

SEQ ID NO: 675812 - DNA, 20 bp, Artificial
  CRISPR gRNA sequence
gatcaagatggagctcatct

SEQ ID NO: 675813 - DNA, 20 bp, Artificial
  CRISPR gRNA sequence
atctttgaccatattgttta

SEQ ID NO: 675814 - DNA, 20 bp, Artificial
  CRISPR gRNA sequence
tgaccatattgtttaaagaa

SEQ ID NO: 675815 - DNA, 20 bp, Artificial
  CRISPR gRNA sequence
gaccatattgtttaaagaaa

SEQ ID NO: 675816 - DNA, 20 bp, Artificial
  CRISPR gRNA sequence
accatattgtttaaagaaac

SEQ ID NO: 675817 - DNA, 20 bp, Artificial
  CRISPR gRNA sequence
tttaaagaaacaacataatg

SEQ ID NO: 675818 - DNA, 20 bp, Artificial
  CRISPR gRNA sequence
aaagaaacaacataatgtta

SEQ ID NO: 675819 - DNA, 20 bp, Artificial
  CRISPR gRNA sequence
aagaaacaacataatgttag

SEQ ID NO: 675820 - DNA, 20 bp, Artificial
  CRISPR gRNA sequence
gttgctctagttttaaatct

SEQ ID NO: 675821 - DNA, 20 bp, Artificial
  CRISPR gRNA sequence
ctctagttttaaatctcata

SEQ ID NO: 675822 - DNA, 20 bp, Artificial
  CRISPR gRNA sequence
tagttttaaatctcatagaa

SEQ ID NO: 675823 - DNA, 20 bp, Artificial
  CRISPR gRNA sequence
gttttaaatctcatagaaat

SEQ ID NO: 675824 - DNA, 20 bp, Artificial
  CRISPR gRNA sequence
taaatctcatagaaatagtc

SEQ ID NO: 675825 - DNA, 20 bp, Artificial
  CRISPR gRNA sequence
aaatctcatagaaatagtct

SEQ ID NO: 675826 - DNA, 20 bp, Artificial
  CRISPR gRNA sequence
aatctcatagaaatagtctc

SEQ ID NO: 675827 - DNA, 20 bp, Artificial
  CRISPR gRNA sequence
atagaaatagtctcttaatt

SEQ ID NO: 675828 - DNA, 20 bp, Artificial
  CRISPR gRNA sequence
ttaatttgtcatgagagtag

SEQ ID NO: 675829 - DNA, 20 bp, Artificial
  CRISPR gRNA sequence
aatttgtcatgagagtagtg

SEQ ID NO: 675830 - DNA, 20 bp, Artificial
  CRISPR gRNA sequence
atttgtcatgagagtagtgt

SEQ ID NO: 675831 - DNA, 20 bp, Artificial
  CRISPR gRNA sequence
gtcatgagagtagtgtaccc

SEQ ID NO: 675832 - DNA, 20 bp, Artificial
  CRISPR gRNA sequence
tcatgagagtagtgtaccct

SEQ ID NO: 675833 - DNA, 20 bp, Artificial
  CRISPR gRNA sequence
aaacgcattgttgtctctta

SEQ ID NO: 675834 - DNA, 20 bp, Artificial
  CRISPR gRNA sequence
ttgtctcttactaaggaatt

SEQ ID NO: 675835 - DNA, 20 bp, Artificial
  CRISPR gRNA sequence
tctcttactaaggaatttat

SEQ ID NO: 675836 - DNA, 20 bp, Artificial
  CRISPR gRNA sequence
ttactaaggaatttattatc

SEQ ID NO: 675837 - DNA, 20 bp, Artificial
  CRISPR gRNA sequence
actaaggaatttattatcac

SEQ ID NO: 675838 - DNA, 20 bp, Artificial
  CRISPR gRNA sequence
ctaaggaatttattatcaca

SEQ ID NO: 675839 - DNA, 20 bp, Artificial
  CRISPR gRNA sequence
aggaatttattatcacaatc

SEQ ID NO: 675840 - DNA, 20 bp, Artificial
  CRISPR gRNA sequence
attatcacaatcacatcgtt

SEQ ID NO: 675841 - DNA, 20 bp, Artificial
  CRISPR gRNA sequence
ttatcacaatcacatcgttt

SEQ ID NO: 675842 - DNA, 20 bp, Artificial
  CRISPR gRNA sequence
tcacaatcacatcgtttctt

SEQ ID NO: 675843 - DNA, 20 bp, Artificial
  CRISPR gRNA sequence
ctttaaattgacaactgatc

SEQ ID NO: 675844 - DNA, 20 bp, Artificial
  CRISPR gRNA sequence
tttaaattgacaactgatca

SEQ ID NO: 675845 - DNA, 20 bp, Artificial
  CRISPR gRNA sequence
taaattgacaactgatcagt

SEQ ID NO: 675846 - DNA, 20 bp, Artificial
  CRISPR gRNA sequence
aaattgacaactgatcagtg

SEQ ID NO: 675847 - DNA, 20 bp, Artificial
  CRISPR gRNA sequence
aattgacaactgatcagtga

SEQ ID NO: 675848 - DNA, 20 bp, Artificial
  CRISPR gRNA sequence
acaactgatcagtgatttca

SEQ ID NO: 675849 - DNA, 20 bp, Artificial
  CRISPR gRNA sequence
atcagtgatttcataagcta

SEQ ID NO: 675850 - DNA, 20 bp, Artificial
  CRISPR gRNA sequence
cataagctaaagtattttct

SEQ ID NO: 675851 - DNA, 20 bp, Artificial
  CRISPR gRNA sequence
ataagctaaagtattttcta

SEQ ID NO: 675852 - DNA, 20 bp, Artificial
  CRISPR gRNA sequence
aagtattttctaatgtactg

SEQ ID NO: 675853 - DNA, 20 bp, Artificial
  CRISPR gRNA sequence
tctaatgtactgtagcattt

SEQ ID NO: 675854 - DNA, 20 bp, Artificial
  CRISPR gRNA sequence
ctaatgtactgtagcatttg

SEQ ID NO: 675855 - DNA, 20 bp, Artificial
  CRISPR gRNA sequence
taatgtactgtagcatttgt

SEQ ID NO: 675856 - DNA, 20 bp, Artificial
  CRISPR gRNA sequence
atgtactgtagcatttgtca

SEQ ID NO: 675857 - DNA, 20 bp, Artificial
  CRISPR gRNA sequence
tagcatttgtcatcacttac

SEQ ID NO: 675858 - DNA, 20 bp, Artificial
  CRISPR gRNA sequence
gtcatcacttactctctttt

SEQ ID NO: 675859 - DNA, 20 bp, Artificial
  CRISPR gRNA sequence
tcatcacttactctctttta

SEQ ID NO: 675860 - DNA, 20 bp, Artificial
  CRISPR gRNA sequence
actctcttttataatacacc

SEQ ID NO: 675861 - DNA, 20 bp, Artificial
  CRISPR gRNA sequence
ctctcttttataatacacca

SEQ ID NO: 675862 - DNA, 20 bp, Artificial
  CRISPR gRNA sequence
tcttttataatacaccagtt

SEQ ID NO: 675863 - DNA, 20 bp, Artificial
  CRISPR gRNA sequence
ttttataatacaccagtttc

SEQ ID NO: 675864 - DNA, 20 bp, Artificial
  CRISPR gRNA sequence
ttataatacaccagtttcta

SEQ ID NO: 675865 - DNA, 20 bp, Artificial
  CRISPR gRNA sequence
tataatacaccagtttctat

SEQ ID NO: 675866 - DNA, 20 bp, Artificial
  CRISPR gRNA sequence
ataatacaccagtttctatt

SEQ ID NO: 675867 - DNA, 20 bp, Artificial
  CRISPR gRNA sequence
taatacaccagtttctattt

SEQ ID NO: 675868 - DNA, 20 bp, Artificial
  CRISPR gRNA sequence
ctattttgttttatttaaat

SEQ ID NO: 675869 - DNA, 20 bp, Artificial
  CRISPR gRNA sequence
tattttgttttatttaaatt

SEQ ID NO: 675870 - DNA, 20 bp, Artificial
  CRISPR gRNA sequence
ttttgttttatttaaattat

SEQ ID NO: 675871 - DNA, 20 bp, Artificial
  CRISPR gRNA sequence
tgttttatttaaattatctt

SEQ ID NO: 675872 - DNA, 20 bp, Artificial
  CRISPR gRNA sequence
gttttatttaaattatcttc

SEQ ID NO: 675873 - DNA, 20 bp, Artificial
  CRISPR gRNA sequence
ttttatttaaattatcttcc

SEQ ID NO: 675874 - DNA, 20 bp, Artificial
  CRISPR gRNA sequence
tatttaaattatcttccctt

SEQ ID NO: 675875 - DNA, 20 bp, Artificial
  CRISPR gRNA sequence
atttaaattatcttcccttc

SEQ ID NO: 675876 - DNA, 20 bp, Artificial
  CRISPR gRNA sequence
tttaaattatcttcccttct

SEQ ID NO: 675877 - DNA, 20 bp, Artificial
  CRISPR gRNA sequence
aaattatcttcccttcttct

SEQ ID NO: 675878 - DNA, 20 bp, Artificial
  CRISPR gRNA sequence
aattatcttcccttcttctt

SEQ ID NO: 675879 - DNA, 20 bp, Artificial
  CRISPR gRNA sequence
tcttcccttcttcttttgag

SEQ ID NO: 675880 - DNA, 20 bp, Artificial
  CRISPR gRNA sequence
cccttcttcttttgagtgtt

SEQ ID NO: 675881 - DNA, 20 bp, Artificial
  CRISPR gRNA sequence
ccttcttcttttgagtgttg

SEQ ID NO: 675882 - DNA, 20 bp, Artificial
  CRISPR gRNA sequence
cttcttttgagtgttgtggt

SEQ ID NO: 675883 - DNA, 20 bp, Artificial
  CRISPR gRNA sequence
ttcttttgagtgttgtggtc

SEQ ID NO: 675884 - DNA, 20 bp, Artificial
  CRISPR gRNA sequence
cttttgagtgttgtggtctg

SEQ ID NO: 675885 - DNA, 20 bp, Artificial
  CRISPR gRNA sequence
ttttgagtgttgtggtctgc

SEQ ID NO: 675886 - DNA, 20 bp, Artificial
  CRISPR gRNA sequence
ttgagtgttgtggtctgctc

SEQ ID NO: 675887 - DNA, 20 bp, Artificial
  CRISPR gRNA sequence
tgagtgttgtggtctgctct

SEQ ID NO: 675888 - DNA, 20 bp, Artificial
  CRISPR gRNA sequence
gagtgttgtggtctgctctt

SEQ ID NO: 675889 - DNA, 20 bp, Artificial
  CRISPR gRNA sequence
agtgttgtggtctgctcttt

SEQ ID NO: 675890 - DNA, 20 bp, Artificial
  CRISPR gRNA sequence
tggtctgctctttcttgtct

SEQ ID NO: 675891 - DNA, 20 bp, Artificial
  CRISPR gRNA sequence
ctctttcttgtctttcttat

SEQ ID NO: 675892 - DNA, 20 bp, Artificial
  CRISPR gRNA sequence
tttcttgtctttcttataat

SEQ ID NO: 675893 - DNA, 20 bp, Artificial
  CRISPR gRNA sequence
tcttgtctttcttataattc

SEQ ID NO: 675894 - DNA, 20 bp, Artificial
  CRISPR gRNA sequence
cttgtctttcttataattct

SEQ ID NO: 675895 - DNA, 20 bp, Artificial
  CRISPR gRNA sequence
ttgtctttcttataattctt

SEQ ID NO: 675896 - DNA, 20 bp, Artificial
  CRISPR gRNA sequence
gtctttcttataattctttt

SEQ ID NO: 675897 - DNA, 20 bp, Artificial
  CRISPR gRNA sequence
tctttcttataattcttttt

SEQ ID NO: 675898 - DNA, 20 bp, Artificial
  CRISPR gRNA sequence
tcttataattctttttccct

SEQ ID NO: 675899 - DNA, 20 bp, Artificial
  CRISPR gRNA sequence
cttataattctttttccctc

SEQ ID NO: 675900 - DNA, 20 bp, Artificial
  CRISPR gRNA sequence
ttataattctttttccctca

SEQ ID NO: 675901 - DNA, 20 bp, Artificial
  CRISPR gRNA sequence
ataattctttttccctcaat

SEQ ID NO: 675902 - DNA, 20 bp, Artificial
  CRISPR gRNA sequence
taattctttttccctcaatc

SEQ ID NO: 675903 - DNA, 20 bp, Artificial
  CRISPR gRNA sequence
tttttccctcaatccttcat

SEQ ID NO: 675904 - DNA, 20 bp, Artificial
  CRISPR gRNA sequence
tttccctcaatccttcatcc

SEQ ID NO: 675905 - DNA, 20 bp, Artificial
  CRISPR gRNA sequence
ttccctcaatccttcatcca

SEQ ID NO: 675906 - DNA, 20 bp, Artificial
  CRISPR gRNA sequence
tccctcaatccttcatccat

SEQ ID NO: 675907 - DNA, 20 bp, Artificial
  CRISPR gRNA sequence
ccctcaatccttcatccatt

SEQ ID NO: 675908 - DNA, 20 bp, Artificial
  CRISPR gRNA sequence
cctcaatccttcatccattt

SEQ ID NO: 675909 - DNA, 20 bp, Artificial
  CRISPR gRNA sequence
aatccttcatccatttgctt

SEQ ID NO: 675910 - DNA, 20 bp, Artificial
  CRISPR gRNA sequence
catccatttgcttccatatt

SEQ ID NO: 675911 - DNA, 20 bp, Artificial
  CRISPR gRNA sequence
atccatttgcttccatatta

SEQ ID NO: 675912 - DNA, 20 bp, Artificial
  CRISPR gRNA sequence
gcttccatattacttcactt

SEQ ID NO: 675913 - DNA, 20 bp, Artificial
  CRISPR gRNA sequence
cttccatattacttcacttt

SEQ ID NO: 675914 - DNA, 20 bp, Artificial
  CRISPR gRNA sequence
ccatattacttcactttttt

SEQ ID NO: 675915 - DNA, 20 bp, Artificial
  CRISPR gRNA sequence
catattacttcacttttttt

SEQ ID NO: 675916 - DNA, 20 bp, Artificial
  CRISPR gRNA sequence
cttcactttttttttttgta

SEQ ID NO: 675917 - DNA, 20 bp, Artificial
  CRISPR gRNA sequence
cactttttttttttgtaatg

SEQ ID NO: 675918 - DNA, 20 bp, Artificial
  CRISPR gRNA sequence
actttttttttttgtaatga

SEQ ID NO: 675919 - DNA, 20 bp, Artificial
  CRISPR gRNA sequence
tttttttttgtaatgacttc

SEQ ID NO: 675920 - DNA, 20 bp, Artificial
  CRISPR gRNA sequence
ttttttttgtaatgacttcc

SEQ ID NO: 675921 - DNA, 20 bp, Artificial
  CRISPR gRNA sequence
tttttttgtaatgacttcca

SEQ ID NO: 675922 - DNA, 20 bp, Artificial
  CRISPR gRNA sequence
ttttttgtaatgacttccag

SEQ ID NO: 675923 - DNA, 20 bp, Artificial
  CRISPR gRNA sequence
tttttgtaatgacttccaga

SEQ ID NO: 675924 - DNA, 20 bp, Artificial
  CRISPR gRNA sequence
ttttgtaatgacttccagaa

SEQ ID NO: 675925 - DNA, 20 bp, Artificial
  CRISPR gRNA sequence
tttgtaatgacttccagaaa

SEQ ID NO: 675926 - DNA, 20 bp, Artificial
  CRISPR gRNA sequence
ttgtaatgacttccagaaaa

SEQ ID NO: 675927 - DNA, 20 bp, Artificial
  CRISPR gRNA sequence
tgtaatgacttccagaaaaa

SEQ ID NO: 675928 - DNA, 20 bp, Artificial
  CRISPR gRNA sequence
gtaatgacttccagaaaaaa

SEQ ID NO: 675929 - DNA, 20 bp, Artificial
  CRISPR gRNA sequence
taatgacttccagaaaaaaa

SEQ ID NO: 675930 - DNA, 20 bp, Artificial
  CRISPR gRNA sequence
ccagaaaaaaagtacataaa

SEQ ID NO: 675931 - DNA, 20 bp, Artificial
  CRISPR gRNA sequence
cagaaaaaaagtacataaat

SEQ ID NO: 675932 - DNA, 20 bp, Artificial
  CRISPR gRNA sequence
cttcagtgtatgtatcatgc

SEQ ID NO: 675933 - DNA, 20 bp, Artificial
  CRISPR gRNA sequence
ttcagtgtatgtatcatgca

SEQ ID NO: 675934 - DNA, 20 bp, Artificial
  CRISPR gRNA sequence
cagtgtatgtatcatgcaaa

SEQ ID NO: 675935 - DNA, 20 bp, Artificial
  CRISPR gRNA sequence
agtgtatgtatcatgcaaaa

SEQ ID NO: 675936 - DNA, 20 bp, Artificial
  CRISPR gRNA sequence
tgtataagatgggatagctg

SEQ ID NO: 675937 - DNA, 20 bp, Artificial
  CRISPR gRNA sequence
gtataagatgggatagctgc

SEQ ID NO: 675938 - DNA, 20 bp, Artificial
  CRISPR gRNA sequence
tataagatgggatagctgca

SEQ ID NO: 675939 - DNA, 20 bp, Artificial
  CRISPR gRNA sequence
caagttatacacctttggat

SEQ ID NO: 675940 - DNA, 20 bp, Artificial
  CRISPR gRNA sequence
tacacctttggatattaata

SEQ ID NO: 675941 - DNA, 20 bp, Artificial
  CRISPR gRNA sequence
tggatattaatagtagtgat

SEQ ID NO: 675942 - DNA, 20 bp, Artificial
  CRISPR gRNA sequence
ggatattaatagtagtgata

SEQ ID NO: 675943 - DNA, 20 bp, Artificial
  CRISPR gRNA sequence
gatattaatagtagtgatag

SEQ ID NO: 675944 - DNA, 20 bp, Artificial
  CRISPR gRNA sequence
atagtagtgatagttttgtg

SEQ ID NO: 675945 - DNA, 20 bp, Artificial
  CRISPR gRNA sequence
tgtggaatgattgaggacaa

SEQ ID NO: 675946 - DNA, 20 bp, Artificial
  CRISPR gRNA sequence
gtggaatgattgaggacaaa

SEQ ID NO: 675947 - DNA, 20 bp, Artificial
  CRISPR gRNA sequence
tggaatgattgaggacaaaa

SEQ ID NO: 675948 - DNA, 20 bp, Artificial
  CRISPR gRNA sequence
aggacaaaaatttctgaaaa

SEQ ID NO: 675949 - DNA, 20 bp, Artificial
  CRISPR gRNA sequence
ctgaaaattaggtacttggc

SEQ ID NO: 675950 - DNA, 20 bp, Artificial
  CRISPR gRNA sequence
tgaaaattaggtacttggcc

SEQ ID NO: 675951 - DNA, 20 bp, Artificial
  CRISPR gRNA sequence
aaaattaggtacttggccag

SEQ ID NO: 675952 - DNA, 20 bp, Artificial
  CRISPR gRNA sequence
ggtacttggccagaagatta

SEQ ID NO: 675953 - DNA, 20 bp, Artificial
  CRISPR gRNA sequence
ggccagaagattatgataat

SEQ ID NO: 675954 - DNA, 20 bp, Artificial
  CRISPR gRNA sequence
gccagaagattatgataatc

SEQ ID NO: 675955 - DNA, 20 bp, Artificial
  CRISPR gRNA sequence
tgataatcggttgttttcct

SEQ ID NO: 675956 - DNA, 20 bp, Artificial
  CRISPR gRNA sequence
ttttcctatttacattattt

SEQ ID NO: 675957 - DNA, 20 bp, Artificial
  CRISPR gRNA sequence
tcctatttacattattttaa

SEQ ID NO: 675958 - DNA, 20 bp, Artificial
  CRISPR gRNA sequence
cctatttacattattttaaa

SEQ ID NO: 675959 - DNA, 20 bp, Artificial
  CRISPR gRNA sequence
ctatttacattattttaaaa

SEQ ID NO: 675960 - DNA, 20 bp, Artificial
  CRISPR gRNA sequence
tttacattattttaaaacca

SEQ ID NO: 675961 - DNA, 20 bp, Artificial
  CRISPR gRNA sequence
acattattttaaaaccagac

SEQ ID NO: 675962 - DNA, 20 bp, Artificial
  CRISPR gRNA sequence
cattattttaaaaccagacc

SEQ ID NO: 675963 - DNA, 20 bp, Artificial
  CRISPR gRNA sequence
ttttaaaaccagaccagctg

SEQ ID NO: 675964 - DNA, 20 bp, Artificial
  CRISPR gRNA sequence
taaaaccagaccagctggac

SEQ ID NO: 675965 - DNA, 20 bp, Artificial
  CRISPR gRNA sequence
aaaaccagaccagctggaca

SEQ ID NO: 675966 - DNA, 20 bp, Artificial
  CRISPR gRNA sequence
aaaccagaccagctggacac

SEQ ID NO: 675967 - DNA, 20 bp, Artificial
  CRISPR gRNA sequence
gacacggtggctcacgcctg

SEQ ID NO: 675968 - DNA, 20 bp, Artificial
  CRISPR gRNA sequence
acgcctgtagtctcagcact

SEQ ID NO: 675969 - DNA, 20 bp, Artificial
  CRISPR gRNA sequence
tagtctcagcactttgggag

SEQ ID NO: 675970 - DNA, 20 bp, Artificial
  CRISPR gRNA sequence
agcactttgggaggccgaga

SEQ ID NO: 675971 - DNA, 20 bp, Artificial
  CRISPR gRNA sequence
tgggaggccgagacgggcag

SEQ ID NO: 675972 - DNA, 20 bp, Artificial
  CRISPR gRNA sequence
gggaggccgagacgggcaga

SEQ ID NO: 675973 - DNA, 20 bp, Artificial
  CRISPR gRNA sequence
ggaggccgagacgggcagat

SEQ ID NO: 675974 - DNA, 20 bp, Artificial
  CRISPR gRNA sequence
gctaacacggtgaaaccccg

SEQ ID NO: 675975 - DNA, 20 bp, Artificial
  CRISPR gRNA sequence
acacggtgaaaccccgtctc

SEQ ID NO: 675976 - DNA, 20 bp, Artificial
  CRISPR gRNA sequence
tactcaaaatacaaaaaaat

SEQ ID NO: 675977 - DNA, 20 bp, Artificial
  CRISPR gRNA sequence
ctcaaaatacaaaaaaatta

SEQ ID NO: 675978 - DNA, 20 bp, Artificial
  CRISPR gRNA sequence
aaaatacaaaaaaattagct

SEQ ID NO: 675979 - DNA, 20 bp, Artificial
  CRISPR gRNA sequence
gctgggcgtggtggcaggcc

SEQ ID NO: 675980 - DNA, 20 bp, Artificial
  CRISPR gRNA sequence
ggcgtggtggcaggcccctg

SEQ ID NO: 675981 - DNA, 20 bp, Artificial
  CRISPR gRNA sequence
tagttccagctacgggaggc

SEQ ID NO: 675982 - DNA, 20 bp, Artificial
  CRISPR gRNA sequence
cagctacgggaggctgaggc

SEQ ID NO: 675983 - DNA, 20 bp, Artificial
  CRISPR gRNA sequence
cgggaggctgaggcaggaga

SEQ ID NO: 675984 - DNA, 20 bp, Artificial
  CRISPR gRNA sequence
aggcaggagaacggcgtgca

SEQ ID NO: 675985 - DNA, 20 bp, Artificial
  CRISPR gRNA sequence
ggaggcggagcttgtagtga

SEQ ID NO: 675986 - DNA, 20 bp, Artificial
  CRISPR gRNA sequence
gtagtgaacagagatcctgc

SEQ ID NO: 675987 - DNA, 20 bp, Artificial
  CRISPR gRNA sequence
tagtgaacagagatcctgcc

SEQ ID NO: 675988 - DNA, 20 bp, Artificial
  CRISPR gRNA sequence
ccactgcactccagcctggg

SEQ ID NO: 675989 - DNA, 20 bp, Artificial
  CRISPR gRNA sequence
cactccagcctgggtgacag

SEQ ID NO: 675990 - DNA, 20 bp, Artificial
  CRISPR gRNA sequence
cagcctgggtgacagagtga

SEQ ID NO: 675991 - DNA, 20 bp, Artificial
  CRISPR gRNA sequence
ggtgacagagtgagactctg

SEQ ID NO: 675992 - DNA, 20 bp, Artificial
  CRISPR gRNA sequence
tgtctcaaaaaagaaaagaa

SEQ ID NO: 675993 - DNA, 20 bp, Artificial
  CRISPR gRNA sequence
tctcaaaaaagaaaagaaaa

SEQ ID NO: 675994 - DNA, 20 bp, Artificial
  CRISPR gRNA sequence
aaaaaagaaaagaaaagaaa

SEQ ID NO: 675995 - DNA, 20 bp, Artificial
  CRISPR gRNA sequence
tttttttttttttaaggata

SEQ ID NO: 675996 - DNA, 20 bp, Artificial
  CRISPR gRNA sequence
ttttttttttttaaggatag

SEQ ID NO: 675997 - DNA, 20 bp, Artificial
  CRISPR gRNA sequence
tttttttttttaaggataga

SEQ ID NO: 675998 - DNA, 20 bp, Artificial
  CRISPR gRNA sequence
ttttttttttaaggatagaa

SEQ ID NO: 675999 - DNA, 20 bp, Artificial
  CRISPR gRNA sequence
tttttttttaaggatagaaa

SEQ ID NO: 676000 - DNA, 20 bp, Artificial
  CRISPR gRNA sequence
ttttttttaaggatagaaac

SEQ ID NO: 676001 - DNA, 20 bp, Artificial
  CRISPR gRNA sequence
tttttttaaggatagaaaca

SEQ ID NO: 676002 - DNA, 20 bp, Artificial
  CRISPR gRNA sequence
ttttttaaggatagaaacat

SEQ ID NO: 676003 - DNA, 20 bp, Artificial
  CRISPR gRNA sequence
tttttaaggatagaaacatt

SEQ ID NO: 676004 - DNA, 20 bp, Artificial
  CRISPR gRNA sequence
ttttaaggatagaaacattg

SEQ ID NO: 676005 - DNA, 20 bp, Artificial
  CRISPR gRNA sequence
tttaaggatagaaacattga

SEQ ID NO: 676006 - DNA, 20 bp, Artificial
  CRISPR gRNA sequence
ttaaggatagaaacattgaa

SEQ ID NO: 676007 - DNA, 20 bp, Artificial
  CRISPR gRNA sequence
taaggatagaaacattgaat

SEQ ID NO: 676008 - DNA, 20 bp, Artificial
  CRISPR gRNA sequence
aaggatagaaacattgaatt

SEQ ID NO: 676009 - DNA, 20 bp, Artificial
  CRISPR gRNA sequence
aggatagaaacattgaatta

SEQ ID NO: 676010 - DNA, 20 bp, Artificial
  CRISPR gRNA sequence
aattaaattatgctggttta

SEQ ID NO: 676011 - DNA, 20 bp, Artificial
  CRISPR gRNA sequence
aattatgctggtttagaaat

SEQ ID NO: 676012 - DNA, 20 bp, Artificial
  CRISPR gRNA sequence
tgctggtttagaaattgaat

SEQ ID NO: 676013 - DNA, 20 bp, Artificial
  CRISPR gRNA sequence
gtttagaaattgaatccagt

SEQ ID NO: 676014 - DNA, 20 bp, Artificial
  CRISPR gRNA sequence
agaaattgaatccagtgcag

SEQ ID NO: 676015 - DNA, 20 bp, Artificial
  CRISPR gRNA sequence
gaaattgaatccagtgcagc

SEQ ID NO: 676016 - DNA, 20 bp, Artificial
  CRISPR gRNA sequence
aatccagtgcagctcattca

SEQ ID NO: 676017 - DNA, 20 bp, Artificial
  CRISPR gRNA sequence
attcataatagtgatggtgc

SEQ ID NO: 676018 - DNA, 20 bp, Artificial
  CRISPR gRNA sequence
ataatagtgatggtgcatta

SEQ ID NO: 676019 - DNA, 20 bp, Artificial
  CRISPR gRNA sequence
aatgtagtataatttgtctt

SEQ ID NO: 676020 - DNA, 20 bp, Artificial
  CRISPR gRNA sequence
gtcttgcaggcttctcatga

SEQ ID NO: 676021 - DNA, 20 bp, Artificial
  CRISPR gRNA sequence
tcttgcaggcttctcatgag

SEQ ID NO: 676022 - DNA, 20 bp, Artificial
  CRISPR gRNA sequence
gcaggcttctcatgagaagg

SEQ ID NO: 676023 - DNA, 20 bp, Artificial
  CRISPR gRNA sequence
caggcttctcatgagaagga

SEQ ID NO: 676024 - DNA, 20 bp, Artificial
  CRISPR gRNA sequence
ctcatgagaaggaactattt

SEQ ID NO: 676025 - DNA, 20 bp, Artificial
  CRISPR gRNA sequence
tcatgagaaggaactatttt

SEQ ID NO: 676026 - DNA, 20 bp, Artificial
  CRISPR gRNA sequence
atgagaaggaactattttaa

SEQ ID NO: 676027 - DNA, 20 bp, Artificial
  CRISPR gRNA sequence
ttttaaactgattgtagacc

SEQ ID NO: 676028 - DNA, 20 bp, Artificial
  CRISPR gRNA sequence
taaactgattgtagacctgg

SEQ ID NO: 676029 - DNA, 20 bp, Artificial
  CRISPR gRNA sequence
aaactgattgtagacctggc

SEQ ID NO: 676030 - DNA, 20 bp, Artificial
  CRISPR gRNA sequence
aactgattgtagacctggca

SEQ ID NO: 676031 - DNA, 20 bp, Artificial
  CRISPR gRNA sequence
attgtagacctggcacctgg

SEQ ID NO: 676032 - DNA, 20 bp, Artificial
  CRISPR gRNA sequence
tagacctggcacctggccca

SEQ ID NO: 676033 - DNA, 20 bp, Artificial
  CRISPR gRNA sequence
gcacctggcccactttctgg

SEQ ID NO: 676034 - DNA, 20 bp, Artificial
  CRISPR gRNA sequence
gcccactttctgggtgatct

SEQ ID NO: 676035 - DNA, 20 bp, Artificial
  CRISPR gRNA sequence
tctgggtgatctcccaagtg

SEQ ID NO: 676036 - DNA, 20 bp, Artificial
  CRISPR gRNA sequence
ctgggtgatctcccaagtgt

SEQ ID NO: 676037 - DNA, 20 bp, Artificial
  CRISPR gRNA sequence
tgggtgatctcccaagtgtg

SEQ ID NO: 676038 - DNA, 20 bp, Artificial
  CRISPR gRNA sequence
ggtgatctcccaagtgtgaa

SEQ ID NO: 676039 - DNA, 20 bp, Artificial
  CRISPR gRNA sequence
ccaagtgtgaactttcccta

SEQ ID NO: 676040 - DNA, 20 bp, Artificial
  CRISPR gRNA sequence
tccctacccttagcccctcc

SEQ ID NO: 676041 - DNA, 20 bp, Artificial
  CRISPR gRNA sequence
ccctacccttagcccctcct

SEQ ID NO: 676042 - DNA, 20 bp, Artificial
  CRISPR gRNA sequence
cctacccttagcccctcctt

SEQ ID NO: 676043 - DNA, 20 bp, Artificial
  CRISPR gRNA sequence
cccttagcccctcctttcct

SEQ ID NO: 676044 - DNA, 20 bp, Artificial
  CRISPR gRNA sequence
agcccctcctttccttcctg

SEQ ID NO: 676045 - DNA, 20 bp, Artificial
  CRISPR gRNA sequence
gcccctcctttccttcctgg

SEQ ID NO: 676046 - DNA, 20 bp, Artificial
  CRISPR gRNA sequence
ctttccttcctggaggtggc

SEQ ID NO: 676047 - DNA, 20 bp, Artificial
  CRISPR gRNA sequence
tccttcctggaggtggctga

SEQ ID NO: 676048 - DNA, 20 bp, Artificial
  CRISPR gRNA sequence
ccttcctggaggtggctgat

SEQ ID NO: 676049 - DNA, 20 bp, Artificial
  CRISPR gRNA sequence
cttcctggaggtggctgata

SEQ ID NO: 676050 - DNA, 20 bp, Artificial
  CRISPR gRNA sequence
cctggaggtggctgatagag

SEQ ID NO: 676051 - DNA, 20 bp, Artificial
  CRISPR gRNA sequence
ctggaggtggctgatagagg

SEQ ID NO: 676052 - DNA, 20 bp, Artificial
  CRISPR gRNA sequence
gaggtggctgatagaggtgg

SEQ ID NO: 676053 - DNA, 20 bp, Artificial
  CRISPR gRNA sequence
atagaggtggattatactga

SEQ ID NO: 676054 - DNA, 20 bp, Artificial
  CRISPR gRNA sequence
tactgataattacacaagca

SEQ ID NO: 676055 - DNA, 20 bp, Artificial
  CRISPR gRNA sequence
ataattacacaagcagtgtc

SEQ ID NO: 676056 - DNA, 20 bp, Artificial
  CRISPR gRNA sequence
cacaagcagtgtcagttgca

SEQ ID NO: 676057 - DNA, 20 bp, Artificial
  CRISPR gRNA sequence
cacacatgatttgcataact

SEQ ID NO: 676058 - DNA, 20 bp, Artificial
  CRISPR gRNA sequence
gcataactgtgctgtgctga

SEQ ID NO: 676059 - DNA, 20 bp, Artificial
  CRISPR gRNA sequence
cataactgtgctgtgctgat

SEQ ID NO: 676060 - DNA, 20 bp, Artificial
  CRISPR gRNA sequence
tgctgtgctgatttcatcca

SEQ ID NO: 676061 - DNA, 20 bp, Artificial
  CRISPR gRNA sequence
tgctgatttcatccatcaaa

SEQ ID NO: 676062 - DNA, 20 bp, Artificial
  CRISPR gRNA sequence
atttcatccatcaaattctg

SEQ ID NO: 676063 - DNA, 20 bp, Artificial
  CRISPR gRNA sequence
catccatcaaattctgatac

SEQ ID NO: 676064 - DNA, 20 bp, Artificial
  CRISPR gRNA sequence
atccatcaaattctgatact

SEQ ID NO: 676065 - DNA, 20 bp, Artificial
  CRISPR gRNA sequence
tgatactgatgcctttggtg

SEQ ID NO: 676066 - DNA, 20 bp, Artificial
  CRISPR gRNA sequence
atactgatgcctttggtgcc

SEQ ID NO: 676067 - DNA, 20 bp, Artificial
  CRISPR gRNA sequence
atgcctttggtgcctcactg

SEQ ID NO: 676068 - DNA, 20 bp, Artificial
  CRISPR gRNA sequence
tggtgcctcactgtatgctt

SEQ ID NO: 676069 - DNA, 20 bp, Artificial
  CRISPR gRNA sequence
ggtgcctcactgtatgcttt

SEQ ID NO: 676070 - DNA, 20 bp, Artificial
  CRISPR gRNA sequence
gtgcctcactgtatgctttg

SEQ ID NO: 676071 - DNA, 20 bp, Artificial
  CRISPR gRNA sequence
actgtatgctttgcaataaa

SEQ ID NO: 676072 - DNA, 20 bp, Artificial
  CRISPR gRNA sequence
tatgctttgcaataaacact

SEQ ID NO: 676073 - DNA, 20 bp, Artificial
  CRISPR gRNA sequence
tgcaataaacactgaagaaa

SEQ ID NO: 676074 - DNA, 20 bp, Artificial
  CRISPR gRNA sequence
gcaataaacactgaagaaag

SEQ ID NO: 676075 - DNA, 20 bp, Artificial
  CRISPR gRNA sequence
caataaacactgaagaaagg

SEQ ID NO: 676076 - DNA, 20 bp, Artificial
  CRISPR gRNA sequence
aagaaaggagatgggattaa

SEQ ID NO: 676077 - DNA, 20 bp, Artificial
  CRISPR gRNA sequence
atattttcattcttgactct

SEQ ID NO: 676078 - DNA, 20 bp, Artificial
  CRISPR gRNA sequence
tcattcttgactcttaaaac

SEQ ID NO: 676079 - DNA, 20 bp, Artificial
  CRISPR gRNA sequence
cattcttgactcttaaaaca

SEQ ID NO: 676080 - DNA, 20 bp, Artificial
  CRISPR gRNA sequence
attcttgactcttaaaacac

SEQ ID NO: 676081 - DNA, 20 bp, Artificial
  CRISPR gRNA sequence
ttgactcttaaaacacacac

SEQ ID NO: 676082 - DNA, 20 bp, Artificial
  CRISPR gRNA sequence
gactcttaaaacacacactt

SEQ ID NO: 676083 - DNA, 20 bp, Artificial
  CRISPR gRNA sequence
actcttaaaacacacacttg

SEQ ID NO: 676084 - DNA, 20 bp, Artificial
  CRISPR gRNA sequence
ttaaaacacacacttgaggt

SEQ ID NO: 676085 - DNA, 20 bp, Artificial
  CRISPR gRNA sequence
aaaacacacacttgaggtcc

SEQ ID NO: 676086 - DNA, 20 bp, Artificial
  CRISPR gRNA sequence
aaacacacacttgaggtcct

SEQ ID NO: 676087 - DNA, 20 bp, Artificial
  CRISPR gRNA sequence
gaggtcctactcattgaaat

SEQ ID NO: 676088 - DNA, 20 bp, Artificial
  CRISPR gRNA sequence
aggtcctactcattgaaatt

SEQ ID NO: 676089 - DNA, 20 bp, Artificial
  CRISPR gRNA sequence
ctcattgaaatttacctaga

SEQ ID NO: 676090 - DNA, 20 bp, Artificial
  CRISPR gRNA sequence
attgaaatttacctagaagg

SEQ ID NO: 676091 - DNA, 20 bp, Artificial
  CRISPR gRNA sequence
aaatttacctagaaggtaaa

SEQ ID NO: 676092 - DNA, 20 bp, Artificial
  CRISPR gRNA sequence
acctagaaggtaaaagccac

SEQ ID NO: 676093 - DNA, 20 bp, Artificial
  CRISPR gRNA sequence
cctagaaggtaaaagccact

SEQ ID NO: 676094 - DNA, 20 bp, Artificial
  CRISPR gRNA sequence
gaaggtaaaagccactttca

SEQ ID NO: 676095 - DNA, 20 bp, Artificial
  CRISPR gRNA sequence
tcagtcaggccggctgtaag

SEQ ID NO: 676096 - DNA, 20 bp, Artificial
  CRISPR gRNA sequence
cagtcaggccggctgtaaga

SEQ ID NO: 676097 - DNA, 20 bp, Artificial
  CRISPR gRNA sequence
agtcaggccggctgtaagac

SEQ ID NO: 676098 - DNA, 20 bp, Artificial
  CRISPR gRNA sequence
taagacagcccatttgattt

SEQ ID NO: 676099 - DNA, 20 bp, Artificial
  CRISPR gRNA sequence
gatttccaccaggtagaacg

SEQ ID NO: 676100 - DNA, 20 bp, Artificial
  CRISPR gRNA sequence
atttccaccaggtagaacgc

SEQ ID NO: 676101 - DNA, 20 bp, Artificial
  CRISPR gRNA sequence
ccaccaggtagaacgcctct

SEQ ID NO: 676102 - DNA, 20 bp, Artificial
  CRISPR gRNA sequence
caccaggtagaacgcctctt

SEQ ID NO: 676103 - DNA, 20 bp, Artificial
  CRISPR gRNA sequence
tttccccctaccccagacca

SEQ ID NO: 676104 - DNA, 20 bp, Artificial
  CRISPR gRNA sequence
tccccctaccccagaccaat

SEQ ID NO: 676105 - DNA, 20 bp, Artificial
  CRISPR gRNA sequence
ccccctaccccagaccaata

SEQ ID NO: 676106 - DNA, 20 bp, Artificial
  CRISPR gRNA sequence
cccctaccccagaccaataa

SEQ ID NO: 676107 - DNA, 20 bp, Artificial
  CRISPR gRNA sequence
ccccagaccaataaccatta

SEQ ID NO: 676108 - DNA, 20 bp, Artificial
  CRISPR gRNA sequence
tgtatctactcttcgttatt

SEQ ID NO: 676109 - DNA, 20 bp, Artificial
  CRISPR gRNA sequence
ctcttcgttattgtttctaa

SEQ ID NO: 676110 - DNA, 20 bp, Artificial
  CRISPR gRNA sequence
ttcgttattgtttctaataa

SEQ ID NO: 676111 - DNA, 20 bp, Artificial
  CRISPR gRNA sequence
cgttattgtttctaataaaa

SEQ ID NO: 676112 - DNA, 20 bp, Artificial
  CRISPR gRNA sequence
gttattgtttctaataaaag

SEQ ID NO: 676113 - DNA, 20 bp, Artificial
  CRISPR gRNA sequence
ttgtttctaataaaagaaag

SEQ ID NO: 676114 - DNA, 20 bp, Artificial
  CRISPR gRNA sequence
tttctaataaaagaaagtaa

SEQ ID NO: 676115 - DNA, 20 bp, Artificial
  CRISPR gRNA sequence
ctaataaaagaaagtaaaac

SEQ ID NO: 676116 - DNA, 20 bp, Artificial
  CRISPR gRNA sequence
taataaaagaaagtaaaact

SEQ ID NO: 676117 - DNA, 20 bp, Artificial
  CRISPR gRNA sequence
ataaaagaaagtaaaacttt

SEQ ID NO: 676118 - DNA, 20 bp, Artificial
  CRISPR gRNA sequence
ttaatagcatatacaatcac

SEQ ID NO: 676119 - DNA, 20 bp, Artificial
  CRISPR gRNA sequence
taatagcatatacaatcaca

SEQ ID NO: 676120 - DNA, 20 bp, Artificial
  CRISPR gRNA sequence
aatagcatatacaatcacat

SEQ ID NO: 676121 - DNA, 20 bp, Artificial
  CRISPR gRNA sequence
atagcatatacaatcacatc

SEQ ID NO: 676122 - DNA, 20 bp, Artificial
  CRISPR gRNA sequence
ttatgaattgtagtagtcat

SEQ ID NO: 676123 - DNA, 20 bp, Artificial
  CRISPR gRNA sequence
tatgaattgtagtagtcatg

SEQ ID NO: 676124 - DNA, 20 bp, Artificial
  CRISPR gRNA sequence
atgaattgtagtagtcatgc

SEQ ID NO: 676125 - DNA, 20 bp, Artificial
  CRISPR gRNA sequence
tgaattgtagtagtcatgct

SEQ ID NO: 676126 - DNA, 20 bp, Artificial
  CRISPR gRNA sequence
tagtagtcatgcttctttca

SEQ ID NO: 676127 - DNA, 20 bp, Artificial
  CRISPR gRNA sequence
ctttcagaccctatttctag

SEQ ID NO: 676128 - DNA, 20 bp, Artificial
  CRISPR gRNA sequence
tttcagaccctatttctaga

SEQ ID NO: 676129 - DNA, 20 bp, Artificial
  CRISPR gRNA sequence
tcagaccctatttctagaag

SEQ ID NO: 676130 - DNA, 20 bp, Artificial
  CRISPR gRNA sequence
cagaccctatttctagaagg

SEQ ID NO: 676131 - DNA, 20 bp, Artificial
  CRISPR gRNA sequence
agaccctatttctagaagga

SEQ ID NO: 676132 - DNA, 20 bp, Artificial
  CRISPR gRNA sequence
tttctagaaggaattaataa

SEQ ID NO: 676133 - DNA, 20 bp, Artificial
  CRISPR gRNA sequence
ctagaaggaattaataagcc

SEQ ID NO: 676134 - DNA, 20 bp, Artificial
  CRISPR gRNA sequence
tagaaggaattaataagcct

SEQ ID NO: 676135 - DNA, 20 bp, Artificial
  CRISPR gRNA sequence
gaaggaattaataagccttt

SEQ ID NO: 676136 - DNA, 20 bp, Artificial
  CRISPR gRNA sequence
ataagcctttcttttataat

SEQ ID NO: 676137 - DNA, 20 bp, Artificial
  CRISPR gRNA sequence
tcttttataattctatgcag

SEQ ID NO: 676138 - DNA, 20 bp, Artificial
  CRISPR gRNA sequence
cttttataattctatgcagc

SEQ ID NO: 676139 - DNA, 20 bp, Artificial
  CRISPR gRNA sequence
ttttataattctatgcagct

SEQ ID NO: 676140 - DNA, 20 bp, Artificial
  CRISPR gRNA sequence
ttataattctatgcagctct

SEQ ID NO: 676141 - DNA, 20 bp, Artificial
  CRISPR gRNA sequence
tataattctatgcagctctt

SEQ ID NO: 676142 - DNA, 20 bp, Artificial
  CRISPR gRNA sequence
ataattctatgcagctcttt

SEQ ID NO: 676143 - DNA, 20 bp, Artificial
  CRISPR gRNA sequence
taattctatgcagctctttt

SEQ ID NO: 676144 - DNA, 20 bp, Artificial
  CRISPR gRNA sequence
tatgcagctcttttcacttt

SEQ ID NO: 676145 - DNA, 20 bp, Artificial
  CRISPR gRNA sequence
tgcagctcttttcactttgg

SEQ ID NO: 676146 - DNA, 20 bp, Artificial
  CRISPR gRNA sequence
ttttcactttggtgcaagtc

SEQ ID NO: 676147 - DNA, 20 bp, Artificial
  CRISPR gRNA sequence
ttcactttggtgcaagtcat

SEQ ID NO: 676148 - DNA, 20 bp, Artificial
  CRISPR gRNA sequence
tcactttggtgcaagtcatt

SEQ ID NO: 676149 - DNA, 20 bp, Artificial
  CRISPR gRNA sequence
cactttggtgcaagtcattt

SEQ ID NO: 676150 - DNA, 20 bp, Artificial
  CRISPR gRNA sequence
actttggtgcaagtcattta

SEQ ID NO: 676151 - DNA, 20 bp, Artificial
  CRISPR gRNA sequence
tggtgcaagtcatttagaag

SEQ ID NO: 676152 - DNA, 20 bp, Artificial
  CRISPR gRNA sequence
ggtgcaagtcatttagaaga

SEQ ID NO: 676153 - DNA, 20 bp, Artificial
  CRISPR gRNA sequence
gtgcaagtcatttagaagat

SEQ ID NO: 676154 - DNA, 20 bp, Artificial
  CRISPR gRNA sequence
agaagatcaatttattgtag

SEQ ID NO: 676155 - DNA, 20 bp, Artificial
  CRISPR gRNA sequence
gaagatcaatttattgtagg

SEQ ID NO: 676156 - DNA, 20 bp, Artificial
  CRISPR gRNA sequence
attgtaggaagctttccttc

SEQ ID NO: 676157 - DNA, 20 bp, Artificial
  CRISPR gRNA sequence
ttgtaggaagctttccttcc

SEQ ID NO: 676158 - DNA, 20 bp, Artificial
  CRISPR gRNA sequence
taggaagctttccttcctcc

SEQ ID NO: 676159 - DNA, 20 bp, Artificial
  CRISPR gRNA sequence
tccttcctcctttattatca

SEQ ID NO: 676160 - DNA, 20 bp, Artificial
  CRISPR gRNA sequence
ccttcctcctttattatcag

SEQ ID NO: 676161 - DNA, 20 bp, Artificial
  CRISPR gRNA sequence
cttcctcctttattatcagg

SEQ ID NO: 676162 - DNA, 20 bp, Artificial
  CRISPR gRNA sequence
cctcctttattatcaggagt

SEQ ID NO: 676163 - DNA, 20 bp, Artificial
  CRISPR gRNA sequence
ctcctttattatcaggagtt

SEQ ID NO: 676164 - DNA, 20 bp, Artificial
  CRISPR gRNA sequence
ctttattatcaggagttcta

SEQ ID NO: 676165 - DNA, 20 bp, Artificial
  CRISPR gRNA sequence
tattatcaggagttctaaag

SEQ ID NO: 676166 - DNA, 20 bp, Artificial
  CRISPR gRNA sequence
attatcaggagttctaaaga

SEQ ID NO: 676167 - DNA, 20 bp, Artificial
  CRISPR gRNA sequence
ttatcaggagttctaaagaa

SEQ ID NO: 676168 - DNA, 20 bp, Artificial
  CRISPR gRNA sequence
tcaggagttctaaagaaatg

SEQ ID NO: 676169 - DNA, 20 bp, Artificial
  CRISPR gRNA sequence
taaagaaatggacaagattc

SEQ ID NO: 676170 - DNA, 20 bp, Artificial
  CRISPR gRNA sequence
aagaaatggacaagattctt

SEQ ID NO: 676171 - DNA, 20 bp, Artificial
  CRISPR gRNA sequence
ttagctgctttctcattgtt

SEQ ID NO: 676172 - DNA, 20 bp, Artificial
  CRISPR gRNA sequence
agctgctttctcattgttct

SEQ ID NO: 676173 - DNA, 20 bp, Artificial
  CRISPR gRNA sequence
gctgctttctcattgttctg

SEQ ID NO: 676174 - DNA, 20 bp, Artificial
  CRISPR gRNA sequence
ctttctcattgttctgaata

SEQ ID NO: 676175 - DNA, 20 bp, Artificial
  CRISPR gRNA sequence
tctcattgttctgaataatc

SEQ ID NO: 676176 - DNA, 20 bp, Artificial
  CRISPR gRNA sequence
ctcattgttctgaataatct

SEQ ID NO: 676177 - DNA, 20 bp, Artificial
  CRISPR gRNA sequence
tcattgttctgaataatcta

SEQ ID NO: 676178 - DNA, 20 bp, Artificial
  CRISPR gRNA sequence
attgttctgaataatctaca

SEQ ID NO: 676179 - DNA, 20 bp, Artificial
  CRISPR gRNA sequence
ttctgaataatctacactgt

SEQ ID NO: 676180 - DNA, 20 bp, Artificial
  CRISPR gRNA sequence
tgaataatctacactgtcct

SEQ ID NO: 676181 - DNA, 20 bp, Artificial
  CRISPR gRNA sequence
aataatctacactgtcctca

SEQ ID NO: 676182 - DNA, 20 bp, Artificial
  CRISPR gRNA sequence
cactgtcctcattccaaagc

SEQ ID NO: 676183 - DNA, 20 bp, Artificial
  CRISPR gRNA sequence
tcctcattccaaagcttgct

SEQ ID NO: 676184 - DNA, 20 bp, Artificial
  CRISPR gRNA sequence
attccaaagcttgctaccac

SEQ ID NO: 676185 - DNA, 20 bp, Artificial
  CRISPR gRNA sequence
caaagcttgctaccacagtt

SEQ ID NO: 676186 - DNA, 20 bp, Artificial
  CRISPR gRNA sequence
gctaccacagttttgtaccc

SEQ ID NO: 676187 - DNA, 20 bp, Artificial
  CRISPR gRNA sequence
ctaccacagttttgtaccct

SEQ ID NO: 676188 - DNA, 20 bp, Artificial
  CRISPR gRNA sequence
ccacagttttgtaccctgca

SEQ ID NO: 676189 - DNA, 20 bp, Artificial
  CRISPR gRNA sequence
tgtaccctgcatggatttag

SEQ ID NO: 676190 - DNA, 20 bp, Artificial
  CRISPR gRNA sequence
gtaccctgcatggatttagt

SEQ ID NO: 676191 - DNA, 20 bp, Artificial
  CRISPR gRNA sequence
taccctgcatggatttagtg

SEQ ID NO: 676192 - DNA, 20 bp, Artificial
  CRISPR gRNA sequence
catggatttagtgtggacag

SEQ ID NO: 676193 - DNA, 20 bp, Artificial
  CRISPR gRNA sequence
agtgtggacagtcttaactt

SEQ ID NO: 676194 - DNA, 20 bp, Artificial
  CRISPR gRNA sequence
gtgtggacagtcttaacttt

SEQ ID NO: 676195 - DNA, 20 bp, Artificial
  CRISPR gRNA sequence
aactttggccatttcacatt

SEQ ID NO: 676196 - DNA, 20 bp, Artificial
  CRISPR gRNA sequence
actttggccatttcacattt

SEQ ID NO: 676197 - DNA, 20 bp, Artificial
  CRISPR gRNA sequence
tggccatttcacattttccc

SEQ ID NO: 676198 - DNA, 20 bp, Artificial
  CRISPR gRNA sequence
ggccatttcacattttccct

SEQ ID NO: 676199 - DNA, 20 bp, Artificial
  CRISPR gRNA sequence
gccatttcacattttccctt

SEQ ID NO: 676200 - DNA, 20 bp, Artificial
  CRISPR gRNA sequence
cacattttcccttccacacc

SEQ ID NO: 676201 - DNA, 20 bp, Artificial
  CRISPR gRNA sequence
acattttcccttccacacca

SEQ ID NO: 676202 - DNA, 20 bp, Artificial
  CRISPR gRNA sequence
tcccttccacaccatgagtc

SEQ ID NO: 676203 - DNA, 20 bp, Artificial
  CRISPR gRNA sequence
cccttccacaccatgagtct

SEQ ID NO: 676204 - DNA, 20 bp, Artificial
  CRISPR gRNA sequence
ccttccacaccatgagtctg

SEQ ID NO: 676205 - DNA, 20 bp, Artificial
  CRISPR gRNA sequence
ccacaccatgagtctgcagg

SEQ ID NO: 676206 - DNA, 20 bp, Artificial
  CRISPR gRNA sequence
cacaccatgagtctgcaggc

SEQ ID NO: 676207 - DNA, 20 bp, Artificial
  CRISPR gRNA sequence
caggcctggcatgtttggaa

SEQ ID NO: 676208 - DNA, 20 bp, Artificial
  CRISPR gRNA sequence
gcatgtttggaactccacaa

SEQ ID NO: 676209 - DNA, 20 bp, Artificial
  CRISPR gRNA sequence
ggaactccacaacagaagtg

SEQ ID NO: 676210 - DNA, 20 bp, Artificial
  CRISPR gRNA sequence
gaactccacaacagaagtgg

SEQ ID NO: 676211 - DNA, 20 bp, Artificial
  CRISPR gRNA sequence
cacaacagaagtggagaggc

SEQ ID NO: 676212 - DNA, 20 bp, Artificial
  CRISPR gRNA sequence
cacgcaaactttattactca

SEQ ID NO: 676213 - DNA, 20 bp, Artificial
  CRISPR gRNA sequence
tattactcacctagtatcca

SEQ ID NO: 676214 - DNA, 20 bp, Artificial
  CRISPR gRNA sequence
attactcacctagtatccag

SEQ ID NO: 676215 - DNA, 20 bp, Artificial
  CRISPR gRNA sequence
ttactcacctagtatccaga

SEQ ID NO: 676216 - DNA, 20 bp, Artificial
  CRISPR gRNA sequence
ctcacctagtatccagaagg

SEQ ID NO: 676217 - DNA, 20 bp, Artificial
  CRISPR gRNA sequence
acctagtatccagaagggca

SEQ ID NO: 676218 - DNA, 20 bp, Artificial
  CRISPR gRNA sequence
gtatccagaagggcatgaca

SEQ ID NO: 676219 - DNA, 20 bp, Artificial
  CRISPR gRNA sequence
ggacttgtgtgtgtgtgtgt

SEQ ID NO: 676220 - DNA, 20 bp, Artificial
  CRISPR gRNA sequence
gtgtgtgtgtgtgtgtggtg

SEQ ID NO: 676221 - DNA, 20 bp, Artificial
  CRISPR gRNA sequence
tgtgtgtgtgtgtgtggtgt

SEQ ID NO: 676222 - DNA, 20 bp, Artificial
  CRISPR gRNA sequence
tgtttggatgtttttttcta

SEQ ID NO: 676223 - DNA, 20 bp, Artificial
  CRISPR gRNA sequence
gtttggatgtttttttctaa

SEQ ID NO: 676224 - DNA, 20 bp, Artificial
  CRISPR gRNA sequence
tttggatgtttttttctaac

SEQ ID NO: 676225 - DNA, 20 bp, Artificial
  CRISPR gRNA sequence
ggatgtttttttctaaccta

SEQ ID NO: 676226 - DNA, 20 bp, Artificial
  CRISPR gRNA sequence
gatgtttttttctaacctaa

SEQ ID NO: 676227 - DNA, 20 bp, Artificial
  CRISPR gRNA sequence
ttttctaacctaacctttac

SEQ ID NO: 676228 - DNA, 20 bp, Artificial
  CRISPR gRNA sequence
tttctaacctaacctttacc

SEQ ID NO: 676229 - DNA, 20 bp, Artificial
  CRISPR gRNA sequence
ttctaacctaacctttacca

SEQ ID NO: 676230 - DNA, 20 bp, Artificial
  CRISPR gRNA sequence
tctaacctaacctttaccat

SEQ ID NO: 676231 - DNA, 20 bp, Artificial
  CRISPR gRNA sequence
ctaacctaacctttaccatt

SEQ ID NO: 676232 - DNA, 20 bp, Artificial
  CRISPR gRNA sequence
taacctaacctttaccattt

SEQ ID NO: 676233 - DNA, 20 bp, Artificial
  CRISPR gRNA sequence
acctaacctttaccatttct

SEQ ID NO: 676234 - DNA, 20 bp, Artificial
  CRISPR gRNA sequence
acctttaccatttctttcaa

SEQ ID NO: 676235 - DNA, 20 bp, Artificial
  CRISPR gRNA sequence
taccatttctttcaattttt

SEQ ID NO: 676236 - DNA, 20 bp, Artificial
  CRISPR gRNA sequence
accatttctttcaatttttc

SEQ ID NO: 676237 - DNA, 20 bp, Artificial
  CRISPR gRNA sequence
ccatttctttcaatttttcc

SEQ ID NO: 676238 - DNA, 20 bp, Artificial
  CRISPR gRNA sequence
ctttcaatttttcctacttg

SEQ ID NO: 676239 - DNA, 20 bp, Artificial
  CRISPR gRNA sequence
tttcaatttttcctacttga

SEQ ID NO: 676240 - DNA, 20 bp, Artificial
  CRISPR gRNA sequence
tcaatttttcctacttgatc

SEQ ID NO: 676241 - DNA, 20 bp, Artificial
  CRISPR gRNA sequence
caatttttcctacttgatct

SEQ ID NO: 676242 - DNA, 20 bp, Artificial
  CRISPR gRNA sequence
aatttttcctacttgatctg

SEQ ID NO: 676243 - DNA, 20 bp, Artificial
  CRISPR gRNA sequence
ttcctacttgatctgtgtat

SEQ ID NO: 676244 - DNA, 20 bp, Artificial
  CRISPR gRNA sequence
tcctacttgatctgtgtatg

SEQ ID NO: 676245 - DNA, 20 bp, Artificial
  CRISPR gRNA sequence
cctacttgatctgtgtatgt

SEQ ID NO: 676246 - DNA, 20 bp, Artificial
  CRISPR gRNA sequence
ctacttgatctgtgtatgtg

SEQ ID NO: 676247 - DNA, 20 bp, Artificial
  CRISPR gRNA sequence
cttgatctgtgtatgtgagt

SEQ ID NO: 676248 - DNA, 20 bp, Artificial
  CRISPR gRNA sequence
gatctgtgtatgtgagtcaa

SEQ ID NO: 676249 - DNA, 20 bp, Artificial
  CRISPR gRNA sequence
atctgtgtatgtgagtcaaa

SEQ ID NO: 676250 - DNA, 20 bp, Artificial
  CRISPR gRNA sequence
tgtatgtgagtcaaagaaac

SEQ ID NO: 676251 - DNA, 20 bp, Artificial
  CRISPR gRNA sequence
ttcatccacagcctatacta

SEQ ID NO: 676252 - DNA, 20 bp, Artificial
  CRISPR gRNA sequence
atccacagcctatactatct

SEQ ID NO: 676253 - DNA, 20 bp, Artificial
  CRISPR gRNA sequence
tactatcttgccaaatactg

SEQ ID NO: 676254 - DNA, 20 bp, Artificial
  CRISPR gRNA sequence
tcttgccaaatactgtaaga

SEQ ID NO: 676255 - DNA, 20 bp, Artificial
  CRISPR gRNA sequence
gccaaatactgtaagaaaac

SEQ ID NO: 676256 - DNA, 20 bp, Artificial
  CRISPR gRNA sequence
ccaaatactgtaagaaaact

SEQ ID NO: 676257 - DNA, 20 bp, Artificial
  CRISPR gRNA sequence
taagaaaactctcaaatggt

SEQ ID NO: 676258 - DNA, 20 bp, Artificial
  CRISPR gRNA sequence
tcaaatggtagaaaatcaga

SEQ ID NO: 676259 - DNA, 20 bp, Artificial
  CRISPR gRNA sequence
aaatggtagaaaatcagaca

SEQ ID NO: 676260 - DNA, 20 bp, Artificial
  CRISPR gRNA sequence
atcataagcatgtaaaatat

SEQ ID NO: 676261 - DNA, 20 bp, Artificial
  CRISPR gRNA sequence
agaatataattaaagtttta

SEQ ID NO: 676262 - DNA, 20 bp, Artificial
  CRISPR gRNA sequence
gaatataattaaagttttat

SEQ ID NO: 676263 - DNA, 20 bp, Artificial
  CRISPR gRNA sequence
aagttttatgtaaggtatca

SEQ ID NO: 676264 - DNA, 20 bp, Artificial
  CRISPR gRNA sequence
tatgtaaggtatcagaaatc

SEQ ID NO: 676265 - DNA, 20 bp, Artificial
  CRISPR gRNA sequence
atgtaaggtatcagaaatct

SEQ ID NO: 676266 - DNA, 20 bp, Artificial
  CRISPR gRNA sequence
tgtaaggtatcagaaatcta

SEQ ID NO: 676267 - DNA, 20 bp, Artificial
  CRISPR gRNA sequence
tcagagtggagtccttttaa

SEQ ID NO: 676268 - DNA, 20 bp, Artificial
  CRISPR gRNA sequence
ttaaattgtatagaaatatg

SEQ ID NO: 676269 - DNA, 20 bp, Artificial
  CRISPR gRNA sequence
taaattgtatagaaatatga

SEQ ID NO: 676270 - DNA, 20 bp, Artificial
  CRISPR gRNA sequence
aaattgtatagaaatatgat

SEQ ID NO: 676271 - DNA, 20 bp, Artificial
  CRISPR gRNA sequence
aattgtatagaaatatgatg

SEQ ID NO: 676272 - DNA, 20 bp, Artificial
  CRISPR gRNA sequence
tatagaaatatgatgataat

SEQ ID NO: 676273 - DNA, 20 bp, Artificial
  CRISPR gRNA sequence
taagcaactggataagaata

SEQ ID NO: 676274 - DNA, 20 bp, Artificial
  CRISPR gRNA sequence
gataagaataaaaggtccta

SEQ ID NO: 676275 - DNA, 20 bp, Artificial
  CRISPR gRNA sequence
gatccagcatctcaaagaag

SEQ ID NO: 676276 - DNA, 20 bp, Artificial
  CRISPR gRNA sequence
aaagaagagattttgcatct

SEQ ID NO: 676277 - DNA, 20 bp, Artificial
  CRISPR gRNA sequence
tgcatcttcatcccttatat

SEQ ID NO: 676278 - DNA, 20 bp, Artificial
  CRISPR gRNA sequence
gcatcttcatcccttatata

SEQ ID NO: 676279 - DNA, 20 bp, Artificial
  CRISPR gRNA sequence
catcttcatcccttatatac

SEQ ID NO: 676280 - DNA, 20 bp, Artificial
  CRISPR gRNA sequence
catcccttatataccatatt

SEQ ID NO: 676281 - DNA, 20 bp, Artificial
  CRISPR gRNA sequence
atcccttatataccatattg

SEQ ID NO: 676282 - DNA, 20 bp, Artificial
  CRISPR gRNA sequence
atataccatattgattgaat

SEQ ID NO: 676283 - DNA, 20 bp, Artificial
  CRISPR gRNA sequence
tataccatattgattgaatg

SEQ ID NO: 676284 - DNA, 20 bp, Artificial
  CRISPR gRNA sequence
attgaatgaattaatggaca

SEQ ID NO: 676285 - DNA, 20 bp, Artificial
  CRISPR gRNA sequence
aatgaattaatggacagatt

SEQ ID NO: 676286 - DNA, 20 bp, Artificial
  CRISPR gRNA sequence
atggacagattattttattt

SEQ ID NO: 676287 - DNA, 20 bp, Artificial
  CRISPR gRNA sequence
ttttatttgaatattcttat

SEQ ID NO: 676288 - DNA, 20 bp, Artificial
  CRISPR gRNA sequence
tatttgaatattcttatatt

SEQ ID NO: 676289 - DNA, 20 bp, Artificial
  CRISPR gRNA sequence
atttgaatattcttatatta

SEQ ID NO: 676290 - DNA, 20 bp, Artificial
  CRISPR gRNA sequence
tttgaatattcttatattaa

SEQ ID NO: 676291 - DNA, 20 bp, Artificial
  CRISPR gRNA sequence
gaatattcttatattaacta

SEQ ID NO: 676292 - DNA, 20 bp, Artificial
  CRISPR gRNA sequence
aatattcttatattaactag

SEQ ID NO: 676293 - DNA, 20 bp, Artificial
  CRISPR gRNA sequence
ttatattaactagaaaggtt

SEQ ID NO: 676294 - DNA, 20 bp, Artificial
  CRISPR gRNA sequence
atattaactagaaaggtttt

SEQ ID NO: 676295 - DNA, 20 bp, Artificial
  CRISPR gRNA sequence
tattaactagaaaggtttta

SEQ ID NO: 676296 - DNA, 20 bp, Artificial
  CRISPR gRNA sequence
actagaaaggttttaaagat

SEQ ID NO: 676297 - DNA, 20 bp, Artificial
  CRISPR gRNA sequence
gaaaggttttaaagattcat

SEQ ID NO: 676298 - DNA, 20 bp, Artificial
  CRISPR gRNA sequence
taaagattcatggaggtcaa

SEQ ID NO: 676299 - DNA, 20 bp, Artificial
  CRISPR gRNA sequence
aaagattcatggaggtcaat

SEQ ID NO: 676300 - DNA, 20 bp, Artificial
  CRISPR gRNA sequence
aagattcatggaggtcaatg

SEQ ID NO: 676301 - DNA, 20 bp, Artificial
  CRISPR gRNA sequence
atggaggtcaatggtggttg

SEQ ID NO: 676302 - DNA, 20 bp, Artificial
  CRISPR gRNA sequence
agtatgtttcctagtacatg

SEQ ID NO: 676303 - DNA, 20 bp, Artificial
  CRISPR gRNA sequence
cctagtacatgataagtatt

SEQ ID NO: 676304 - DNA, 20 bp, Artificial
  CRISPR gRNA sequence
ctagtacatgataagtatta

SEQ ID NO: 676305 - DNA, 20 bp, Artificial
  CRISPR gRNA sequence
gtacatgataagtattagtc

SEQ ID NO: 676306 - DNA, 20 bp, Artificial
  CRISPR gRNA sequence
gtctattacaaaaattaaaa

SEQ ID NO: 676307 - DNA, 20 bp, Artificial
  CRISPR gRNA sequence
ttacaaaaattaaaaattat

SEQ ID NO: 676308 - DNA, 20 bp, Artificial
  CRISPR gRNA sequence
caaaaattaaaaattatggg

SEQ ID NO: 676309 - DNA, 20 bp, Artificial
  CRISPR gRNA sequence
aaaattatgggtatatttaa

SEQ ID NO: 676310 - DNA, 20 bp, Artificial
  CRISPR gRNA sequence
tgggtatatttaataagttc

SEQ ID NO: 676311 - DNA, 20 bp, Artificial
  CRISPR gRNA sequence
aataagttcttattttgtga

SEQ ID NO: 676312 - DNA, 20 bp, Artificial
  CRISPR gRNA sequence
ataagttcttattttgtgac

SEQ ID NO: 676313 - DNA, 20 bp, Artificial
  CRISPR gRNA sequence
ttattttgtgacaagcatta

SEQ ID NO: 676314 - DNA, 20 bp, Artificial
  CRISPR gRNA sequence
attttgtgacaagcattatg

SEQ ID NO: 676315 - DNA, 20 bp, Artificial
  CRISPR gRNA sequence
ttttgtgacaagcattatgt

SEQ ID NO: 676316 - DNA, 20 bp, Artificial
  CRISPR gRNA sequence
tgtgacaagcattatgttaa

SEQ ID NO: 676317 - DNA, 20 bp, Artificial
  CRISPR gRNA sequence
gtgacaagcattatgttaag

SEQ ID NO: 676318 - DNA, 20 bp, Artificial
  CRISPR gRNA sequence
tgacaagcattatgttaagg

SEQ ID NO: 676319 - DNA, 20 bp, Artificial
  CRISPR gRNA sequence
tgttaagggccttattttgc

SEQ ID NO: 676320 - DNA, 20 bp, Artificial
  CRISPR gRNA sequence
agggccttattttgcagata

SEQ ID NO: 676321 - DNA, 20 bp, Artificial
  CRISPR gRNA sequence
attttgcagataagtagagt

SEQ ID NO: 676322 - DNA, 20 bp, Artificial
  CRISPR gRNA sequence
ttttgcagataagtagagtc

SEQ ID NO: 676323 - DNA, 20 bp, Artificial
  CRISPR gRNA sequence
tgcagataagtagagtcaag

SEQ ID NO: 676324 - DNA, 20 bp, Artificial
  CRISPR gRNA sequence
gcagataagtagagtcaagt

SEQ ID NO: 676325 - DNA, 20 bp, Artificial
  CRISPR gRNA sequence
cagataagtagagtcaagtt

SEQ ID NO: 676326 - DNA, 20 bp, Artificial
  CRISPR gRNA sequence
aaagaaagagatgttaccta

SEQ ID NO: 676327 - DNA, 20 bp, Artificial
  CRISPR gRNA sequence
aagaaagagatgttacctaa

SEQ ID NO: 676328 - DNA, 20 bp, Artificial
  CRISPR gRNA sequence
cctaatgtcctcacgcagtc

SEQ ID NO: 676329 - DNA, 20 bp, Artificial
  CRISPR gRNA sequence
atgtcctcacgcagtcattt

SEQ ID NO: 676330 - DNA, 20 bp, Artificial
  CRISPR gRNA sequence
acgcagtcattttacatatt

SEQ ID NO: 676331 - DNA, 20 bp, Artificial
  CRISPR gRNA sequence
tacatattacatgtatgcct

SEQ ID NO: 676332 - DNA, 20 bp, Artificial
  CRISPR gRNA sequence
acatattacatgtatgcctc

SEQ ID NO: 676333 - DNA, 20 bp, Artificial
  CRISPR gRNA sequence
catattacatgtatgcctcc

SEQ ID NO: 676334 - DNA, 20 bp, Artificial
  CRISPR gRNA sequence
catgtatgcctcctcagctt

SEQ ID NO: 676335 - DNA, 20 bp, Artificial
  CRISPR gRNA sequence
ctcagcttatacagattata

SEQ ID NO: 676336 - DNA, 20 bp, Artificial
  CRISPR gRNA sequence
agcttatacagattatactt

SEQ ID NO: 676337 - DNA, 20 bp, Artificial
  CRISPR gRNA sequence
atacagattatactttcacc

SEQ ID NO: 676338 - DNA, 20 bp, Artificial
  CRISPR gRNA sequence
tacagattatactttcacct

SEQ ID NO: 676339 - DNA, 20 bp, Artificial
  CRISPR gRNA sequence
tactttcaccttatttttct

SEQ ID NO: 676340 - DNA, 20 bp, Artificial
  CRISPR gRNA sequence
tcaccttatttttcttttat

SEQ ID NO: 676341 - DNA, 20 bp, Artificial
  CRISPR gRNA sequence
caccttatttttcttttatt

SEQ ID NO: 676342 - DNA, 20 bp, Artificial
  CRISPR gRNA sequence
accttatttttcttttattt

SEQ ID NO: 676343 - DNA, 20 bp, Artificial
  CRISPR gRNA sequence
atttttcttttattttccat

SEQ ID NO: 676344 - DNA, 20 bp, Artificial
  CRISPR gRNA sequence
tttttcttttattttccatg

SEQ ID NO: 676345 - DNA, 20 bp, Artificial
  CRISPR gRNA sequence
ttcttttattttccatggtt

SEQ ID NO: 676346 - DNA, 20 bp, Artificial
  CRISPR gRNA sequence
tcttttattttccatggttt

SEQ ID NO: 676347 - DNA, 20 bp, Artificial
  CRISPR gRNA sequence
cttttattttccatggtttg

SEQ ID NO: 676348 - DNA, 20 bp, Artificial
  CRISPR gRNA sequence
ttttattttccatggtttgg

SEQ ID NO: 676349 - DNA, 20 bp, Artificial
  CRISPR gRNA sequence
ttattttccatggtttggca

SEQ ID NO: 676350 - DNA, 20 bp, Artificial
  CRISPR gRNA sequence
tattttccatggtttggcaa

SEQ ID NO: 676351 - DNA, 20 bp, Artificial
  CRISPR gRNA sequence
attttccatggtttggcaac

SEQ ID NO: 676352 - DNA, 20 bp, Artificial
  CRISPR gRNA sequence
ttttccatggtttggcaaca

SEQ ID NO: 676353 - DNA, 20 bp, Artificial
  CRISPR gRNA sequence
tccatggtttggcaacaatg

SEQ ID NO: 676354 - DNA, 20 bp, Artificial
  CRISPR gRNA sequence
ccatggtttggcaacaatgt

SEQ ID NO: 676355 - DNA, 20 bp, Artificial
  CRISPR gRNA sequence
catggtttggcaacaatgta

SEQ ID NO: 676356 - DNA, 20 bp, Artificial
  CRISPR gRNA sequence
ggcaacaatgtattattgga

SEQ ID NO: 676357 - DNA, 20 bp, Artificial
  CRISPR gRNA sequence
gcaacaatgtattattggat

SEQ ID NO: 676358 - DNA, 20 bp, Artificial
  CRISPR gRNA sequence
ttggattagatttcaaacac

SEQ ID NO: 676359 - DNA, 20 bp, Artificial
  CRISPR gRNA sequence
gattagatttcaaacacaca

SEQ ID NO: 676360 - DNA, 20 bp, Artificial
  CRISPR gRNA sequence
gatttcaaacacacacatac

SEQ ID NO: 676361 - DNA, 20 bp, Artificial
  CRISPR gRNA sequence
caaacacacacatacacacc

SEQ ID NO: 676362 - DNA, 20 bp, Artificial
  CRISPR gRNA sequence
aaacacacacatacacaccc

SEQ ID NO: 676363 - DNA, 20 bp, Artificial
  CRISPR gRNA sequence
tatcatgctcttataaacaa

SEQ ID NO: 676364 - DNA, 20 bp, Artificial
  CRISPR gRNA sequence
ttataaacaaaaatctatca

SEQ ID NO: 676365 - DNA, 20 bp, Artificial
  CRISPR gRNA sequence
ataaacaaaaatctatcatg

SEQ ID NO: 676366 - DNA, 20 bp, Artificial
  CRISPR gRNA sequence
taaacaaaaatctatcatga

SEQ ID NO: 676367 - DNA, 20 bp, Artificial
  CRISPR gRNA sequence
tcatgaggcttgaagacata

SEQ ID NO: 676368 - DNA, 20 bp, Artificial
  CRISPR gRNA sequence
gaagacatatagcagcttag

SEQ ID NO: 676369 - DNA, 20 bp, Artificial
  CRISPR gRNA sequence
aagacatatagcagcttaga

SEQ ID NO: 676370 - DNA, 20 bp, Artificial
  CRISPR gRNA sequence
agaacaaaataaatctaaca

SEQ ID NO: 676371 - DNA, 20 bp, Artificial
  CRISPR gRNA sequence
gaacaaaataaatctaacaa

SEQ ID NO: 676372 - DNA, 20 bp, Artificial
  CRISPR gRNA sequence
acaatagtataaattatatt

SEQ ID NO: 676373 - DNA, 20 bp, Artificial
  CRISPR gRNA sequence
tatttgtgagagtactttaa

SEQ ID NO: 676374 - DNA, 20 bp, Artificial
  CRISPR gRNA sequence
gtgagagtactttaaaaatt

SEQ ID NO: 676375 - DNA, 20 bp, Artificial
  CRISPR gRNA sequence
tgagagtactttaaaaatta

SEQ ID NO: 676376 - DNA, 20 bp, Artificial
  CRISPR gRNA sequence
taaaaattatgatctgatat

SEQ ID NO: 676377 - DNA, 20 bp, Artificial
  CRISPR gRNA sequence
aaaaattatgatctgatata

SEQ ID NO: 676378 - DNA, 20 bp, Artificial
  CRISPR gRNA sequence
aaaattatgatctgatatag

SEQ ID NO: 676379 - DNA, 20 bp, Artificial
  CRISPR gRNA sequence
tgatctgatatagcaaaaaa

SEQ ID NO: 676380 - DNA, 20 bp, Artificial
  CRISPR gRNA sequence
atatagcaaaaaaaatcata

SEQ ID NO: 676381 - DNA, 20 bp, Artificial
  CRISPR gRNA sequence
gataactatatgtttacatt

SEQ ID NO: 676382 - DNA, 20 bp, Artificial
  CRISPR gRNA sequence
ataactatatgtttacattt

SEQ ID NO: 676383 - DNA, 20 bp, Artificial
  CRISPR gRNA sequence
tatgtttacattttatccaa

SEQ ID NO: 676384 - DNA, 20 bp, Artificial
  CRISPR gRNA sequence
acattttatccaacttccaa

SEQ ID NO: 676385 - DNA, 20 bp, Artificial
  CRISPR gRNA sequence
cattttatccaacttccaat

SEQ ID NO: 676386 - DNA, 20 bp, Artificial
  CRISPR gRNA sequence
tatccaacttccaatatact

SEQ ID NO: 676387 - DNA, 20 bp, Artificial
  CRISPR gRNA sequence
atccaacttccaatatactc

SEQ ID NO: 676388 - DNA, 20 bp, Artificial
  CRISPR gRNA sequence
tccaacttccaatatactca

SEQ ID NO: 676389 - DNA, 20 bp, Artificial
  CRISPR gRNA sequence
ccaatatactcatgaaagct

SEQ ID NO: 676390 - DNA, 20 bp, Artificial
  CRISPR gRNA sequence
caatatactcatgaaagctg

SEQ ID NO: 676391 - DNA, 20 bp, Artificial
  CRISPR gRNA sequence
atgaaagctgagatataagc

SEQ ID NO: 676392 - DNA, 20 bp, Artificial
  CRISPR gRNA sequence
agatataagctctggtctgt

SEQ ID NO: 676393 - DNA, 20 bp, Artificial
  CRISPR gRNA sequence
tggtctgtctgaatctaggg

SEQ ID NO: 676394 - DNA, 20 bp, Artificial
  CRISPR gRNA sequence
gtctgtctgaatctagggtc

SEQ ID NO: 676395 - DNA, 20 bp, Artificial
  CRISPR gRNA sequence
tctgaatctagggtctctgc

SEQ ID NO: 676396 - DNA, 20 bp, Artificial
  CRISPR gRNA sequence
aatctagggtctctgctctc

SEQ ID NO: 676397 - DNA, 20 bp, Artificial
  CRISPR gRNA sequence
gggtctctgctctcagccac

SEQ ID NO: 676398 - DNA, 20 bp, Artificial
  CRISPR gRNA sequence
tgctctcagccactatactc

SEQ ID NO: 676399 - DNA, 20 bp, Artificial
  CRISPR gRNA sequence
ctctcagccactatactcct

SEQ ID NO: 676400 - DNA, 20 bp, Artificial
  CRISPR gRNA sequence
tcagccactatactcctgct

SEQ ID NO: 676401 - DNA, 20 bp, Artificial
  CRISPR gRNA sequence
agccactatactcctgcttc

SEQ ID NO: 676402 - DNA, 20 bp, Artificial
  CRISPR gRNA sequence
tactcctgcttcccaatcta

SEQ ID NO: 676403 - DNA, 20 bp, Artificial
  CRISPR gRNA sequence
ctgcttcccaatctattctc

SEQ ID NO: 676404 - DNA, 20 bp, Artificial
  CRISPR gRNA sequence
cttcccaatctattctccag

SEQ ID NO: 676405 - DNA, 20 bp, Artificial
  CRISPR gRNA sequence
cccaatctattctccagata

SEQ ID NO: 676406 - DNA, 20 bp, Artificial
  CRISPR gRNA sequence
ccaatctattctccagatag

SEQ ID NO: 676407 - DNA, 20 bp, Artificial
  CRISPR gRNA sequence
ttctccagatagcaaccaga

SEQ ID NO: 676408 - DNA, 20 bp, Artificial
  CRISPR gRNA sequence
tccagatagcaaccagaatg

SEQ ID NO: 676409 - DNA, 20 bp, Artificial
  CRISPR gRNA sequence
cagatagcaaccagaatgtt

SEQ ID NO: 676410 - DNA, 20 bp, Artificial
  CRISPR gRNA sequence
ctttaaaatctgatttaaac

SEQ ID NO: 676411 - DNA, 20 bp, Artificial
  CRISPR gRNA sequence
taaaatctgatttaaaccat

SEQ ID NO: 676412 - DNA, 20 bp, Artificial
  CRISPR gRNA sequence
aaaatctgatttaaaccatg

SEQ ID NO: 676413 - DNA, 20 bp, Artificial
  CRISPR gRNA sequence
aaatctgatttaaaccatgt

SEQ ID NO: 676414 - DNA, 20 bp, Artificial
  CRISPR gRNA sequence
atttaaaccatgtcactcct

SEQ ID NO: 676415 - DNA, 20 bp, Artificial
  CRISPR gRNA sequence
aaaccatgtcactcctcttc

SEQ ID NO: 676416 - DNA, 20 bp, Artificial
  CRISPR gRNA sequence
aaccatgtcactcctcttct

SEQ ID NO: 676417 - DNA, 20 bp, Artificial
  CRISPR gRNA sequence
ctcttcttaaaatattttaa

SEQ ID NO: 676418 - DNA, 20 bp, Artificial
  CRISPR gRNA sequence
ttcttaaaatattttaatgg

SEQ ID NO: 676419 - DNA, 20 bp, Artificial
  CRISPR gRNA sequence
cttaaaatattttaatggtt

SEQ ID NO: 676420 - DNA, 20 bp, Artificial
  CRISPR gRNA sequence
ttaaaatattttaatggttt

SEQ ID NO: 676421 - DNA, 20 bp, Artificial
  CRISPR gRNA sequence
aaaatattttaatggttttc

SEQ ID NO: 676422 - DNA, 20 bp, Artificial
  CRISPR gRNA sequence
aaatattttaatggttttcc

SEQ ID NO: 676423 - DNA, 20 bp, Artificial
  CRISPR gRNA sequence
taatggttttccattgcttt

SEQ ID NO: 676424 - DNA, 20 bp, Artificial
  CRISPR gRNA sequence
aatggttttccattgctttt

SEQ ID NO: 676425 - DNA, 20 bp, Artificial
  CRISPR gRNA sequence
atggttttccattgctttta

SEQ ID NO: 676426 - DNA, 20 bp, Artificial
  CRISPR gRNA sequence
tccattgcttttataataaa

SEQ ID NO: 676427 - DNA, 20 bp, Artificial
  CRISPR gRNA sequence
ccattgcttttataataaaa

SEQ ID NO: 676428 - DNA, 20 bp, Artificial
  CRISPR gRNA sequence
cattgcttttataataaaat

SEQ ID NO: 676429 - DNA, 20 bp, Artificial
  CRISPR gRNA sequence
cttttataataaaatcaaac

SEQ ID NO: 676430 - DNA, 20 bp, Artificial
  CRISPR gRNA sequence
ttataataaaatcaaactac

SEQ ID NO: 676431 - DNA, 20 bp, Artificial
  CRISPR gRNA sequence
tataataaaatcaaactact

SEQ ID NO: 676432 - DNA, 20 bp, Artificial
  CRISPR gRNA sequence
ataataaaatcaaactacta

SEQ ID NO: 676433 - DNA, 20 bp, Artificial
  CRISPR gRNA sequence
taataaaatcaaactactaa

SEQ ID NO: 676434 - DNA, 20 bp, Artificial
  CRISPR gRNA sequence
ctaatcatggccattggtgg

SEQ ID NO: 676435 - DNA, 20 bp, Artificial
  CRISPR gRNA sequence
atcatggccattggtggttc

SEQ ID NO: 676436 - DNA, 20 bp, Artificial
  CRISPR gRNA sequence
gtggttctgcccacttctac

SEQ ID NO: 676437 - DNA, 20 bp, Artificial
  CRISPR gRNA sequence
tgcccacttctactgtctga

SEQ ID NO: 676438 - DNA, 20 bp, Artificial
  CRISPR gRNA sequence
cccacttctactgtctgatc

SEQ ID NO: 676439 - DNA, 20 bp, Artificial
  CRISPR gRNA sequence
ctactgtctgatcttctact

SEQ ID NO: 676440 - DNA, 20 bp, Artificial
  CRISPR gRNA sequence
tactgtctgatcttctacta

SEQ ID NO: 676441 - DNA, 20 bp, Artificial
  CRISPR gRNA sequence
ctgtctgatcttctactact

SEQ ID NO: 676442 - DNA, 20 bp, Artificial
  CRISPR gRNA sequence
tctgatcttctactacttta

SEQ ID NO: 676443 - DNA, 20 bp, Artificial
  CRISPR gRNA sequence
atcttctactactttacgcc

SEQ ID NO: 676444 - DNA, 20 bp, Artificial
  CRISPR gRNA sequence
ctactactttacgcctcact

SEQ ID NO: 676445 - DNA, 20 bp, Artificial
  CRISPR gRNA sequence
tactactttacgcctcactc

SEQ ID NO: 676446 - DNA, 20 bp, Artificial
  CRISPR gRNA sequence
ctactttacgcctcactctg

SEQ ID NO: 676447 - DNA, 20 bp, Artificial
  CRISPR gRNA sequence
ctttacgcctcactctgggt

SEQ ID NO: 676448 - DNA, 20 bp, Artificial
  CRISPR gRNA sequence
tacgcctcactctgggttct

SEQ ID NO: 676449 - DNA, 20 bp, Artificial
  CRISPR gRNA sequence
acgcctcactctgggttctt

SEQ ID NO: 676450 - DNA, 20 bp, Artificial
  CRISPR gRNA sequence
cgcctcactctgggttcttt

SEQ ID NO: 676451 - DNA, 20 bp, Artificial
  CRISPR gRNA sequence
actctgggttctttgcaacc

SEQ ID NO: 676452 - DNA, 20 bp, Artificial
  CRISPR gRNA sequence
tgggttctttgcaacccgag

SEQ ID NO: 676453 - DNA, 20 bp, Artificial
  CRISPR gRNA sequence
ggttctttgcaacccgaggt

SEQ ID NO: 676454 - DNA, 20 bp, Artificial
  CRISPR gRNA sequence
tttgcaacccgaggtttctt

SEQ ID NO: 676455 - DNA, 20 bp, Artificial
  CRISPR gRNA sequence
tgcaacccgaggtttcttta

SEQ ID NO: 676456 - DNA, 20 bp, Artificial
  CRISPR gRNA sequence
gcaacccgaggtttctttat

SEQ ID NO: 676457 - DNA, 20 bp, Artificial
  CRISPR gRNA sequence
caacccgaggtttctttatt

SEQ ID NO: 676458 - DNA, 20 bp, Artificial
  CRISPR gRNA sequence
ctttattctttcctactgtt

SEQ ID NO: 676459 - DNA, 20 bp, Artificial
  CRISPR gRNA sequence
tttattctttcctactgttt

SEQ ID NO: 676460 - DNA, 20 bp, Artificial
  CRISPR gRNA sequence
tattctttcctactgttttt

SEQ ID NO: 676461 - DNA, 20 bp, Artificial
  CRISPR gRNA sequence
attctttcctactgtttttg

SEQ ID NO: 676462 - DNA, 20 bp, Artificial
  CRISPR gRNA sequence
ttctttcctactgtttttga

SEQ ID NO: 676463 - DNA, 20 bp, Artificial
  CRISPR gRNA sequence
tttcctactgtttttgaact

SEQ ID NO: 676464 - DNA, 20 bp, Artificial
  CRISPR gRNA sequence
tcctactgtttttgaactaa

SEQ ID NO: 676465 - DNA, 20 bp, Artificial
  CRISPR gRNA sequence
cctactgtttttgaactaat

SEQ ID NO: 676466 - DNA, 20 bp, Artificial
  CRISPR gRNA sequence
ctactgtttttgaactaatg

SEQ ID NO: 676467 - DNA, 20 bp, Artificial
  CRISPR gRNA sequence
ctgtttttgaactaatggat

SEQ ID NO: 676468 - DNA, 20 bp, Artificial
  CRISPR gRNA sequence
tttttgaactaatggatgat

SEQ ID NO: 676469 - DNA, 20 bp, Artificial
  CRISPR gRNA sequence
ttgaactaatggatgatcct

SEQ ID NO: 676470 - DNA, 20 bp, Artificial
  CRISPR gRNA sequence
tgaactaatggatgatccta

SEQ ID NO: 676471 - DNA, 20 bp, Artificial
  CRISPR gRNA sequence
gaactaatggatgatcctag

SEQ ID NO: 676472 - DNA, 20 bp, Artificial
  CRISPR gRNA sequence
aactaatggatgatcctaga

SEQ ID NO: 676473 - DNA, 20 bp, Artificial
  CRISPR gRNA sequence
atggatgatcctagaagtca

SEQ ID NO: 676474 - DNA, 20 bp, Artificial
  CRISPR gRNA sequence
gaagtcaacaccttcagcgt

SEQ ID NO: 676475 - DNA, 20 bp, Artificial
  CRISPR gRNA sequence
cagcgttttcccaagatctt

SEQ ID NO: 676476 - DNA, 20 bp, Artificial
  CRISPR gRNA sequence
agcgttttcccaagatcttg

SEQ ID NO: 676477 - DNA, 20 bp, Artificial
  CRISPR gRNA sequence
tcccaagatcttggcatagt

SEQ ID NO: 676478 - DNA, 20 bp, Artificial
  CRISPR gRNA sequence
cccaagatcttggcatagtt

SEQ ID NO: 676479 - DNA, 20 bp, Artificial
  CRISPR gRNA sequence
ccaagatcttggcatagttg

SEQ ID NO: 676480 - DNA, 20 bp, Artificial
  CRISPR gRNA sequence
ggcatagttgccttattatc

SEQ ID NO: 676481 - DNA, 20 bp, Artificial
  CRISPR gRNA sequence
gcatagttgccttattatct

SEQ ID NO: 676482 - DNA, 20 bp, Artificial
  CRISPR gRNA sequence
ccttattatctttcagatgt

SEQ ID NO: 676483 - DNA, 20 bp, Artificial
  CRISPR gRNA sequence
attatctttcagatgttagt

SEQ ID NO: 676484 - DNA, 20 bp, Artificial
  CRISPR gRNA sequence
ttatctttcagatgttagtt

SEQ ID NO: 676485 - DNA, 20 bp, Artificial
  CRISPR gRNA sequence
tctttcagatgttagtttaa

SEQ ID NO: 676486 - DNA, 20 bp, Artificial
  CRISPR gRNA sequence
tcagatgttagtttaaatgt

SEQ ID NO: 676487 - DNA, 20 bp, Artificial
  CRISPR gRNA sequence
cagatgttagtttaaatgtc

SEQ ID NO: 676488 - DNA, 20 bp, Artificial
  CRISPR gRNA sequence
agatgttagtttaaatgtca

SEQ ID NO: 676489 - DNA, 20 bp, Artificial
  CRISPR gRNA sequence
gtttaaatgtcatctctttg

SEQ ID NO: 676490 - DNA, 20 bp, Artificial
  CRISPR gRNA sequence
aaatgtcatctctttgaaaa

SEQ ID NO: 676491 - DNA, 20 bp, Artificial
  CRISPR gRNA sequence
aatgtcatctctttgaaaat

SEQ ID NO: 676492 - DNA, 20 bp, Artificial
  CRISPR gRNA sequence
tttgaaaatagtggcatcca

SEQ ID NO: 676493 - DNA, 20 bp, Artificial
  CRISPR gRNA sequence
tgaaaatagtggcatccata

SEQ ID NO: 676494 - DNA, 20 bp, Artificial
  CRISPR gRNA sequence
gaaaatagtggcatccataa

SEQ ID NO: 676495 - DNA, 20 bp, Artificial
  CRISPR gRNA sequence
aaaatagtggcatccataag

SEQ ID NO: 676496 - DNA, 20 bp, Artificial
  CRISPR gRNA sequence
ccagaagcatccccttagtt

SEQ ID NO: 676497 - DNA, 20 bp, Artificial
  CRISPR gRNA sequence
agttctattttgctatctct

SEQ ID NO: 676498 - DNA, 20 bp, Artificial
  CRISPR gRNA sequence
gttctattttgctatctcta

SEQ ID NO: 676499 - DNA, 20 bp, Artificial
  CRISPR gRNA sequence
tattttgctatctctatctt

SEQ ID NO: 676500 - DNA, 20 bp, Artificial
  CRISPR gRNA sequence
ttttgctatctctatcttaa

SEQ ID NO: 676501 - DNA, 20 bp, Artificial
  CRISPR gRNA sequence
tgctatctctatcttaataa

SEQ ID NO: 676502 - DNA, 20 bp, Artificial
  CRISPR gRNA sequence
gctatctctatcttaataaa

SEQ ID NO: 676503 - DNA, 20 bp, Artificial
  CRISPR gRNA sequence
ctatctctatcttaataaaa

SEQ ID NO: 676504 - DNA, 20 bp, Artificial
  CRISPR gRNA sequence
tctctatcttaataaaaagc

SEQ ID NO: 676505 - DNA, 20 bp, Artificial
  CRISPR gRNA sequence
tatcttaataaaaagcttga

SEQ ID NO: 676506 - DNA, 20 bp, Artificial
  CRISPR gRNA sequence
tcttaataaaaagcttgaat

SEQ ID NO: 676507 - DNA, 20 bp, Artificial
  CRISPR gRNA sequence
aataaaaagcttgaatcaga

SEQ ID NO: 676508 - DNA, 20 bp, Artificial
  CRISPR gRNA sequence
ataaaaagcttgaatcagaa

SEQ ID NO: 676509 - DNA, 20 bp, Artificial
  CRISPR gRNA sequence
gaatcagaatctgtggttat

SEQ ID NO: 676510 - DNA, 20 bp, Artificial
  CRISPR gRNA sequence
aatcagaatctgtggttatg

SEQ ID NO: 676511 - DNA, 20 bp, Artificial
  CRISPR gRNA sequence
tggttatgttggtgtttagt

SEQ ID NO: 676512 - DNA, 20 bp, Artificial
  CRISPR gRNA sequence
tgttggtgtttagtttatac

SEQ ID NO: 676513 - DNA, 20 bp, Artificial
  CRISPR gRNA sequence
gtgtttagtttatacacatg

SEQ ID NO: 676514 - DNA, 20 bp, Artificial
  CRISPR gRNA sequence
agtttatacacatgttgtct

SEQ ID NO: 676515 - DNA, 20 bp, Artificial
  CRISPR gRNA sequence
gtttatacacatgttgtctg

SEQ ID NO: 676516 - DNA, 20 bp, Artificial
  CRISPR gRNA sequence
atacacatgttgtctgtgcc

SEQ ID NO: 676517 - DNA, 20 bp, Artificial
  CRISPR gRNA sequence
tacacatgttgtctgtgcca

SEQ ID NO: 676518 - DNA, 20 bp, Artificial
  CRISPR gRNA sequence
tctgtgccatcccacctcac

SEQ ID NO: 676519 - DNA, 20 bp, Artificial
  CRISPR gRNA sequence
tgccatcccacctcactcga

SEQ ID NO: 676520 - DNA, 20 bp, Artificial
  CRISPR gRNA sequence
actcgaatgtaagctctgtg

SEQ ID NO: 676521 - DNA, 20 bp, Artificial
  CRISPR gRNA sequence
gaatgtaagctctgtgagat

SEQ ID NO: 676522 - DNA, 20 bp, Artificial
  CRISPR gRNA sequence
tgtgagattgtggactgcaa

SEQ ID NO: 676523 - DNA, 20 bp, Artificial
  CRISPR gRNA sequence
tgagattgtggactgcaaga

SEQ ID NO: 676524 - DNA, 20 bp, Artificial
  CRISPR gRNA sequence
tggactgcaagactgtcttt

SEQ ID NO: 676525 - DNA, 20 bp, Artificial
  CRISPR gRNA sequence
caagactgtctttgtggagc

SEQ ID NO: 676526 - DNA, 20 bp, Artificial
  CRISPR gRNA sequence
tctttgtggagcttacattt

SEQ ID NO: 676527 - DNA, 20 bp, Artificial
  CRISPR gRNA sequence
tgtggagcttacattttaat

SEQ ID NO: 676528 - DNA, 20 bp, Artificial
  CRISPR gRNA sequence
gtggagcttacattttaata

SEQ ID NO: 676529 - DNA, 20 bp, Artificial
  CRISPR gRNA sequence
tggagcttacattttaataa

SEQ ID NO: 676530 - DNA, 20 bp, Artificial
  CRISPR gRNA sequence
acattttaataaggggagac

SEQ ID NO: 676531 - DNA, 20 bp, Artificial
  CRISPR gRNA sequence
cattttaataaggggagacg

SEQ ID NO: 676532 - DNA, 20 bp, Artificial
  CRISPR gRNA sequence
taataaggggagacgggcaa

SEQ ID NO: 676533 - DNA, 20 bp, Artificial
  CRISPR gRNA sequence
aataaggggagacgggcaag

SEQ ID NO: 676534 - DNA, 20 bp, Artificial
  CRISPR gRNA sequence
ataaggggagacgggcaaga

SEQ ID NO: 676535 - DNA, 20 bp, Artificial
  CRISPR gRNA sequence
aaaaatcatataatatgtta

SEQ ID NO: 676536 - DNA, 20 bp, Artificial
  CRISPR gRNA sequence
gaagatgttgactgctacag

SEQ ID NO: 676537 - DNA, 20 bp, Artificial
  CRISPR gRNA sequence
actgctacagggaaaaaaaa

SEQ ID NO: 676538 - DNA, 20 bp, Artificial
  CRISPR gRNA sequence
ctacagggaaaaaaaaagat

SEQ ID NO: 676539 - DNA, 20 bp, Artificial
  CRISPR gRNA sequence
cagggaaaaaaaaagatttt

SEQ ID NO: 676540 - DNA, 20 bp, Artificial
  CRISPR gRNA sequence
tccacttattgatcatttat

SEQ ID NO: 676541 - DNA, 20 bp, Artificial
  CRISPR gRNA sequence
ccacttattgatcatttatt

SEQ ID NO: 676542 - DNA, 20 bp, Artificial
  CRISPR gRNA sequence
cacttattgatcatttattg

SEQ ID NO: 676543 - DNA, 20 bp, Artificial
  CRISPR gRNA sequence
attgatcatttattgtgtgt

SEQ ID NO: 676544 - DNA, 20 bp, Artificial
  CRISPR gRNA sequence
ttgatcatttattgtgtgtt

SEQ ID NO: 676545 - DNA, 20 bp, Artificial
  CRISPR gRNA sequence
atcatttattgtgtgttaag

SEQ ID NO: 676546 - DNA, 20 bp, Artificial
  CRISPR gRNA sequence
attgtgtgttaagtaccttg

SEQ ID NO: 676547 - DNA, 20 bp, Artificial
  CRISPR gRNA sequence
ttgtgtgttaagtaccttga

SEQ ID NO: 676548 - DNA, 20 bp, Artificial
  CRISPR gRNA sequence
tgtgttaagtaccttgagtt

SEQ ID NO: 676549 - DNA, 20 bp, Artificial
  CRISPR gRNA sequence
agtaccttgagttttccata

SEQ ID NO: 676550 - DNA, 20 bp, Artificial
  CRISPR gRNA sequence
gagttttccatatggattaa

SEQ ID NO: 676551 - DNA, 20 bp, Artificial
  CRISPR gRNA sequence
agttttccatatggattaaa

SEQ ID NO: 676552 - DNA, 20 bp, Artificial
  CRISPR gRNA sequence
tccatatggattaaaaaaaa

SEQ ID NO: 676553 - DNA, 20 bp, Artificial
  CRISPR gRNA sequence
ccatatggattaaaaaaaat

SEQ ID NO: 676554 - DNA, 20 bp, Artificial
  CRISPR gRNA sequence
catatggattaaaaaaaata

SEQ ID NO: 676555 - DNA, 20 bp, Artificial
  CRISPR gRNA sequence
aaaaaaatatatactcacag

SEQ ID NO: 676556 - DNA, 20 bp, Artificial
  CRISPR gRNA sequence
acagaaatgctgtgagttag

SEQ ID NO: 676557 - DNA, 20 bp, Artificial
  CRISPR gRNA sequence
tgagttaggtacaactattt

SEQ ID NO: 676558 - DNA, 20 bp, Artificial
  CRISPR gRNA sequence
ggtacaactatttcctaatt

SEQ ID NO: 676559 - DNA, 20 bp, Artificial
  CRISPR gRNA sequence
tttcctaatttaacgtaacc

SEQ ID NO: 676560 - DNA, 20 bp, Artificial
  CRISPR gRNA sequence
cctaatttaacgtaacctag

SEQ ID NO: 676561 - DNA, 20 bp, Artificial
  CRISPR gRNA sequence
ctaatttaacgtaacctagg

SEQ ID NO: 676562 - DNA, 20 bp, Artificial
  CRISPR gRNA sequence
atttaacgtaacctaggctt

SEQ ID NO: 676563 - DNA, 20 bp, Artificial
  CRISPR gRNA sequence
aacgtaacctaggcttcaca

SEQ ID NO: 676564 - DNA, 20 bp, Artificial
  CRISPR gRNA sequence
acgtaacctaggcttcacac

SEQ ID NO: 676565 - DNA, 20 bp, Artificial
  CRISPR gRNA sequence
ggcttcacacacaactggca

SEQ ID NO: 676566 - DNA, 20 bp, Artificial
  CRISPR gRNA sequence
cacacacaactggcattagg

SEQ ID NO: 676567 - DNA, 20 bp, Artificial
  CRISPR gRNA sequence
acacacaactggcattaggg

SEQ ID NO: 676568 - DNA, 20 bp, Artificial
  CRISPR gRNA sequence
gcattagggttagaatttga

SEQ ID NO: 676569 - DNA, 20 bp, Artificial
  CRISPR gRNA sequence
gggttagaatttgagatcca

SEQ ID NO: 676570 - DNA, 20 bp, Artificial
  CRISPR gRNA sequence
gaatttgagatccaagtaag

SEQ ID NO: 676571 - DNA, 20 bp, Artificial
  CRISPR gRNA sequence
gagatccaagtaagaaacca

SEQ ID NO: 676572 - DNA, 20 bp, Artificial
  CRISPR gRNA sequence
agatccaagtaagaaaccac

SEQ ID NO: 676573 - DNA, 20 bp, Artificial
  CRISPR gRNA sequence
tggatatacaaatacatatt

SEQ ID NO: 676574 - DNA, 20 bp, Artificial
  CRISPR gRNA sequence
gatatacaaatacatattct

SEQ ID NO: 676575 - DNA, 20 bp, Artificial
  CRISPR gRNA sequence
tttatatgaatattccataa

SEQ ID NO: 676576 - DNA, 20 bp, Artificial
  CRISPR gRNA sequence
tatatgaatattccataagt

SEQ ID NO: 676577 - DNA, 20 bp, Artificial
  CRISPR gRNA sequence
atatgaatattccataagtt

SEQ ID NO: 676578 - DNA, 20 bp, Artificial
  CRISPR gRNA sequence
tatgaatattccataagtta

SEQ ID NO: 676579 - DNA, 20 bp, Artificial
  CRISPR gRNA sequence
cataagttagagcaagctat

SEQ ID NO: 676580 - DNA, 20 bp, Artificial
  CRISPR gRNA sequence
gagcaagctatttgcttctg

SEQ ID NO: 676581 - DNA, 20 bp, Artificial
  CRISPR gRNA sequence
tttgcttctgaattgattat

SEQ ID NO: 676582 - DNA, 20 bp, Artificial
  CRISPR gRNA sequence
gcttctgaattgattatttt

SEQ ID NO: 676583 - DNA, 20 bp, Artificial
  CRISPR gRNA sequence
cttctgaattgattattttg

SEQ ID NO: 676584 - DNA, 20 bp, Artificial
  CRISPR gRNA sequence
ctgaattgattattttggga

SEQ ID NO: 676585 - DNA, 20 bp, Artificial
  CRISPR gRNA sequence
tgaattgattattttgggag

SEQ ID NO: 676586 - DNA, 20 bp, Artificial
  CRISPR gRNA sequence
aattgattattttgggagct

SEQ ID NO: 676587 - DNA, 20 bp, Artificial
  CRISPR gRNA sequence
attattttgggagctgtttg

SEQ ID NO: 676588 - DNA, 20 bp, Artificial
  CRISPR gRNA sequence
ttttgggagctgtttgctat

SEQ ID NO: 676589 - DNA, 20 bp, Artificial
  CRISPR gRNA sequence
tgggagctgtttgctatcca

SEQ ID NO: 676590 - DNA, 20 bp, Artificial
  CRISPR gRNA sequence
gggagctgtttgctatccaa

SEQ ID NO: 676591 - DNA, 20 bp, Artificial
  CRISPR gRNA sequence
ggagctgtttgctatccaaa

SEQ ID NO: 676592 - DNA, 20 bp, Artificial
  CRISPR gRNA sequence
tttgctatccaaattatttg

SEQ ID NO: 676593 - DNA, 20 bp, Artificial
  CRISPR gRNA sequence
gctatccaaattatttgctt

SEQ ID NO: 676594 - DNA, 20 bp, Artificial
  CRISPR gRNA sequence
ctatccaaattatttgctta

SEQ ID NO: 676595 - DNA, 20 bp, Artificial
  CRISPR gRNA sequence
tccaaattatttgcttactc

SEQ ID NO: 676596 - DNA, 20 bp, Artificial
  CRISPR gRNA sequence
tttgcttactcataagcctg

SEQ ID NO: 676597 - DNA, 20 bp, Artificial
  CRISPR gRNA sequence
gcttactcataagcctgagt

SEQ ID NO: 676598 - DNA, 20 bp, Artificial
  CRISPR gRNA sequence
cttactcataagcctgagtt

SEQ ID NO: 676599 - DNA, 20 bp, Artificial
  CRISPR gRNA sequence
actcataagcctgagttctt

SEQ ID NO: 676600 - DNA, 20 bp, Artificial
  CRISPR gRNA sequence
ctcataagcctgagttcttg

SEQ ID NO: 676601 - DNA, 20 bp, Artificial
  CRISPR gRNA sequence
ataagcctgagttcttgtaa

SEQ ID NO: 676602 - DNA, 20 bp, Artificial
  CRISPR gRNA sequence
agttcttgtaatatagaaag

SEQ ID NO: 676603 - DNA, 20 bp, Artificial
  CRISPR gRNA sequence
ttgtaatatagaaagtcaga

SEQ ID NO: 676604 - DNA, 20 bp, Artificial
  CRISPR gRNA sequence
gtaatatagaaagtcagatg

SEQ ID NO: 676605 - DNA, 20 bp, Artificial
  CRISPR gRNA sequence
taatatagaaagtcagatga

SEQ ID NO: 676606 - DNA, 20 bp, Artificial
  CRISPR gRNA sequence
cctttattgtgccttacttt

SEQ ID NO: 676607 - DNA, 20 bp, Artificial
  CRISPR gRNA sequence
ctttattgtgccttacttta

SEQ ID NO: 676608 - DNA, 20 bp, Artificial
  CRISPR gRNA sequence
tattgtgccttactttattg

SEQ ID NO: 676609 - DNA, 20 bp, Artificial
  CRISPR gRNA sequence
attgtgccttactttattgc

SEQ ID NO: 676610 - DNA, 20 bp, Artificial
  CRISPR gRNA sequence
ttgtgccttactttattgca

SEQ ID NO: 676611 - DNA, 20 bp, Artificial
  CRISPR gRNA sequence
tgccttactttattgcactt

SEQ ID NO: 676612 - DNA, 20 bp, Artificial
  CRISPR gRNA sequence
actttattgcacttcacaga

SEQ ID NO: 676613 - DNA, 20 bp, Artificial
  CRISPR gRNA sequence
ctttattgcacttcacagat

SEQ ID NO: 676614 - DNA, 20 bp, Artificial
  CRISPR gRNA sequence
tattgcacttcacagataac

SEQ ID NO: 676615 - DNA, 20 bp, Artificial
  CRISPR gRNA sequence
attgcacttcacagataact

SEQ ID NO: 676616 - DNA, 20 bp, Artificial
  CRISPR gRNA sequence
ttgcacttcacagataactg

SEQ ID NO: 676617 - DNA, 20 bp, Artificial
  CRISPR gRNA sequence
cacttcacagataactgcgt

SEQ ID NO: 676618 - DNA, 20 bp, Artificial
  CRISPR gRNA sequence
cacagataactgcgtttttt

SEQ ID NO: 676619 - DNA, 20 bp, Artificial
  CRISPR gRNA sequence
acagataactgcgtttttta

SEQ ID NO: 676620 - DNA, 20 bp, Artificial
  CRISPR gRNA sequence
cgttttttacaaattgaaag

SEQ ID NO: 676621 - DNA, 20 bp, Artificial
  CRISPR gRNA sequence
tttacaaattgaaagtttgt

SEQ ID NO: 676622 - DNA, 20 bp, Artificial
  CRISPR gRNA sequence
ttacaaattgaaagtttgtg

SEQ ID NO: 676623 - DNA, 20 bp, Artificial
  CRISPR gRNA sequence
tacaaattgaaagtttgtgg

SEQ ID NO: 676624 - DNA, 20 bp, Artificial
  CRISPR gRNA sequence
acaaattgaaagtttgtggt

SEQ ID NO: 676625 - DNA, 20 bp, Artificial
  CRISPR gRNA sequence
caaattgaaagtttgtggta

SEQ ID NO: 676626 - DNA, 20 bp, Artificial
  CRISPR gRNA sequence
aaagtttgtggtaaccctaa

SEQ ID NO: 676627 - DNA, 20 bp, Artificial
  CRISPR gRNA sequence
gtggtaaccctaattccaag

SEQ ID NO: 676628 - DNA, 20 bp, Artificial
  CRISPR gRNA sequence
tggtaaccctaattccaagc

SEQ ID NO: 676629 - DNA, 20 bp, Artificial
  CRISPR gRNA sequence
attccaagcaagtcggttga

SEQ ID NO: 676630 - DNA, 20 bp, Artificial
  CRISPR gRNA sequence
caagcaagtcggttgatacc

SEQ ID NO: 676631 - DNA, 20 bp, Artificial
  CRISPR gRNA sequence
ataccatttttccaatgaca

SEQ ID NO: 676632 - DNA, 20 bp, Artificial
  CRISPR gRNA sequence
ttccaatgacacatgctcac

SEQ ID NO: 676633 - DNA, 20 bp, Artificial
  CRISPR gRNA sequence
tccaatgacacatgctcacc

SEQ ID NO: 676634 - DNA, 20 bp, Artificial
  CRISPR gRNA sequence
ccaatgacacatgctcacct

SEQ ID NO: 676635 - DNA, 20 bp, Artificial
  CRISPR gRNA sequence
caatgacacatgctcacctc

SEQ ID NO: 676636 - DNA, 20 bp, Artificial
  CRISPR gRNA sequence
acctcatgtctctctgtcac

SEQ ID NO: 676637 - DNA, 20 bp, Artificial
  CRISPR gRNA sequence
atgtctctctgtcacattta

SEQ ID NO: 676638 - DNA, 20 bp, Artificial
  CRISPR gRNA sequence
tctgtcacatttaaataatt

SEQ ID NO: 676639 - DNA, 20 bp, Artificial
  CRISPR gRNA sequence
tgtcacatttaaataattct

SEQ ID NO: 676640 - DNA, 20 bp, Artificial
  CRISPR gRNA sequence
tcacatttaaataattcttg

SEQ ID NO: 676641 - DNA, 20 bp, Artificial
  CRISPR gRNA sequence
aaataattcttgcaatattt

SEQ ID NO: 676642 - DNA, 20 bp, Artificial
  CRISPR gRNA sequence
aataattcttgcaatatttc

SEQ ID NO: 676643 - DNA, 20 bp, Artificial
  CRISPR gRNA sequence
ttgcaatatttcacatttgc

SEQ ID NO: 676644 - DNA, 20 bp, Artificial
  CRISPR gRNA sequence
gcaatatttcacatttgctc

SEQ ID NO: 676645 - DNA, 20 bp, Artificial
  CRISPR gRNA sequence
caatatttcacatttgctca

SEQ ID NO: 676646 - DNA, 20 bp, Artificial
  CRISPR gRNA sequence
cacatttgctcattattatg

SEQ ID NO: 676647 - DNA, 20 bp, Artificial
  CRISPR gRNA sequence
acatttgctcattattatgt

SEQ ID NO: 676648 - DNA, 20 bp, Artificial
  CRISPR gRNA sequence
gctcattattatgtctgttt

SEQ ID NO: 676649 - DNA, 20 bp, Artificial
  CRISPR gRNA sequence
ctcattattatgtctgtttt

SEQ ID NO: 676650 - DNA, 20 bp, Artificial
  CRISPR gRNA sequence
attattatgtctgttttgtg

SEQ ID NO: 676651 - DNA, 20 bp, Artificial
  CRISPR gRNA sequence
ttatgtctgttttgtgatct

SEQ ID NO: 676652 - DNA, 20 bp, Artificial
  CRISPR gRNA sequence
tgtctgttttgtgatctgtg

SEQ ID NO: 676653 - DNA, 20 bp, Artificial
  CRISPR gRNA sequence
ttttgtgatctgtgatcttt

SEQ ID NO: 676654 - DNA, 20 bp, Artificial
  CRISPR gRNA sequence
tgtgatctgtgatctttctt

SEQ ID NO: 676655 - DNA, 20 bp, Artificial
  CRISPR gRNA sequence
gtgatctgtgatctttcttg

SEQ ID NO: 676656 - DNA, 20 bp, Artificial
  CRISPR gRNA sequence
tgatctgtgatctttcttgt

SEQ ID NO: 676657 - DNA, 20 bp, Artificial
  CRISPR gRNA sequence
tgatctttcttgttattatt

SEQ ID NO: 676658 - DNA, 20 bp, Artificial
  CRISPR gRNA sequence
tcttgttattattataactg

SEQ ID NO: 676659 - DNA, 20 bp, Artificial
  CRISPR gRNA sequence
cttgttattattataactgt

SEQ ID NO: 676660 - DNA, 20 bp, Artificial
  CRISPR gRNA sequence
ttgttattattataactgtt

SEQ ID NO: 676661 - DNA, 20 bp, Artificial
  CRISPR gRNA sequence
gttattattataactgtttt

SEQ ID NO: 676662 - DNA, 20 bp, Artificial
  CRISPR gRNA sequence
ttattattataactgtttta

SEQ ID NO: 676663 - DNA, 20 bp, Artificial
  CRISPR gRNA sequence
ttattataactgttttagga

SEQ ID NO: 676664 - DNA, 20 bp, Artificial
  CRISPR gRNA sequence
ttataactgttttaggatac

SEQ ID NO: 676665 - DNA, 20 bp, Artificial
  CRISPR gRNA sequence
taactgttttaggataccac

SEQ ID NO: 676666 - DNA, 20 bp, Artificial
  CRISPR gRNA sequence
ttttaggataccacgaacca

SEQ ID NO: 676667 - DNA, 20 bp, Artificial
  CRISPR gRNA sequence
taggataccacgaaccacac

SEQ ID NO: 676668 - DNA, 20 bp, Artificial
  CRISPR gRNA sequence
aggataccacgaaccacacc

SEQ ID NO: 676669 - DNA, 20 bp, Artificial
  CRISPR gRNA sequence
ggataccacgaaccacacct

SEQ ID NO: 676670 - DNA, 20 bp, Artificial
  CRISPR gRNA sequence
tacaggctggcaaacttgaa

SEQ ID NO: 676671 - DNA, 20 bp, Artificial
  CRISPR gRNA sequence
gcaaacttgaatttttgtgt

SEQ ID NO: 676672 - DNA, 20 bp, Artificial
  CRISPR gRNA sequence
gaatttttgtgttgataaat

SEQ ID NO: 676673 - DNA, 20 bp, Artificial
  CRISPR gRNA sequence
aatttttgtgttgataaatg

SEQ ID NO: 676674 - DNA, 20 bp, Artificial
  CRISPR gRNA sequence
ttgtgttgataaatgttgtg

SEQ ID NO: 676675 - DNA, 20 bp, Artificial
  CRISPR gRNA sequence
tgtgttgataaatgttgtgt

SEQ ID NO: 676676 - DNA, 20 bp, Artificial
  CRISPR gRNA sequence
gtgttgataaatgttgtgta

SEQ ID NO: 676677 - DNA, 20 bp, Artificial
  CRISPR gRNA sequence
tgttgataaatgttgtgtaa

SEQ ID NO: 676678 - DNA, 20 bp, Artificial
  CRISPR gRNA sequence
ataaatgttgtgtaagctct

SEQ ID NO: 676679 - DNA, 20 bp, Artificial
  CRISPR gRNA sequence
tgtaagctctgactgcttca

SEQ ID NO: 676680 - DNA, 20 bp, Artificial
  CRISPR gRNA sequence
tgactgcttcaccaactggc

SEQ ID NO: 676681 - DNA, 20 bp, Artificial
  CRISPR gRNA sequence
actgcttcaccaactggcca

SEQ ID NO: 676682 - DNA, 20 bp, Artificial
  CRISPR gRNA sequence
cttcaccaactggccagttt

SEQ ID NO: 676683 - DNA, 20 bp, Artificial
  CRISPR gRNA sequence
caccaactggccagtttctc

SEQ ID NO: 676684 - DNA, 20 bp, Artificial
  CRISPR gRNA sequence
accaactggccagtttctct

SEQ ID NO: 676685 - DNA, 20 bp, Artificial
  CRISPR gRNA sequence
gccagtttctctgtccctct

SEQ ID NO: 676686 - DNA, 20 bp, Artificial
  CRISPR gRNA sequence
ctctgtccctctgtccctca

SEQ ID NO: 676687 - DNA, 20 bp, Artificial
  CRISPR gRNA sequence
tctgtccctctgtccctcac

SEQ ID NO: 676688 - DNA, 20 bp, Artificial
  CRISPR gRNA sequence
tgtccctctgtccctcacct

SEQ ID NO: 676689 - DNA, 20 bp, Artificial
  CRISPR gRNA sequence
tccctctgtccctcacctgg

SEQ ID NO: 676690 - DNA, 20 bp, Artificial
  CRISPR gRNA sequence
tgtccctcacctggcctcta

SEQ ID NO: 676691 - DNA, 20 bp, Artificial
  CRISPR gRNA sequence
tccctcacctggcctctata

SEQ ID NO: 676692 - DNA, 20 bp, Artificial
  CRISPR gRNA sequence
acctggcctctatattcctg

SEQ ID NO: 676693 - DNA, 20 bp, Artificial
  CRISPR gRNA sequence
gcctctatattcctgaaatg

SEQ ID NO: 676694 - DNA, 20 bp, Artificial
  CRISPR gRNA sequence
tatattcctgaaatgcaaaa

SEQ ID NO: 676695 - DNA, 20 bp, Artificial
  CRISPR gRNA sequence
tattcctgaaatgcaaaaat

SEQ ID NO: 676696 - DNA, 20 bp, Artificial
  CRISPR gRNA sequence
ctgaaatgcaaaaatactga

SEQ ID NO: 676697 - DNA, 20 bp, Artificial
  CRISPR gRNA sequence
aaatgcaaaaatactgaaat

SEQ ID NO: 676698 - DNA, 20 bp, Artificial
  CRISPR gRNA sequence
aaattaggccacttaataac

SEQ ID NO: 676699 - DNA, 20 bp, Artificial
  CRISPR gRNA sequence
ggccacttaataactgtaca

SEQ ID NO: 676700 - DNA, 20 bp, Artificial
  CRISPR gRNA sequence
aataactgtacaatggcctc

SEQ ID NO: 676701 - DNA, 20 bp, Artificial
  CRISPR gRNA sequence
ataactgtacaatggcctct

SEQ ID NO: 676702 - DNA, 20 bp, Artificial
  CRISPR gRNA sequence
tacaatggcctctaagtgtt

SEQ ID NO: 676703 - DNA, 20 bp, Artificial
  CRISPR gRNA sequence
taagtgttcaagttaaagga

SEQ ID NO: 676704 - DNA, 20 bp, Artificial
  CRISPR gRNA sequence
agtgttcaagttaaaggaag

SEQ ID NO: 676705 - DNA, 20 bp, Artificial
  CRISPR gRNA sequence
aagttaaaggaagactcaca

SEQ ID NO: 676706 - DNA, 20 bp, Artificial
  CRISPR gRNA sequence
aaggaagactcacatttctc

SEQ ID NO: 676707 - DNA, 20 bp, Artificial
  CRISPR gRNA sequence
acatttctcactttaaatca

SEQ ID NO: 676708 - DNA, 20 bp, Artificial
  CRISPR gRNA sequence
ctcactttaaatcaaaagct

SEQ ID NO: 676709 - DNA, 20 bp, Artificial
  CRISPR gRNA sequence
tcactttaaatcaaaagcta

SEQ ID NO: 676710 - DNA, 20 bp, Artificial
  CRISPR gRNA sequence
actttaaatcaaaagctaga

SEQ ID NO: 676711 - DNA, 20 bp, Artificial
  CRISPR gRNA sequence
taaatcaaaagctagaaatg

SEQ ID NO: 676712 - DNA, 20 bp, Artificial
  CRISPR gRNA sequence
aaatcaaaagctagaaatga

SEQ ID NO: 676713 - DNA, 20 bp, Artificial
  CRISPR gRNA sequence
aatcaaaagctagaaatgat

SEQ ID NO: 676714 - DNA, 20 bp, Artificial
  CRISPR gRNA sequence
gaaatgatgaggcttagtga

SEQ ID NO: 676715 - DNA, 20 bp, Artificial
  CRISPR gRNA sequence
agtgaggaaggtatgtcaac

SEQ ID NO: 676716 - DNA, 20 bp, Artificial
  CRISPR gRNA sequence
gtgaggaaggtatgtcaaca

SEQ ID NO: 676717 - DNA, 20 bp, Artificial
  CRISPR gRNA sequence
ctgtgccaaacagccacatt

SEQ ID NO: 676718 - DNA, 20 bp, Artificial
  CRISPR gRNA sequence
tgccaaacagccacattgtg

SEQ ID NO: 676719 - DNA, 20 bp, Artificial
  CRISPR gRNA sequence
tgaatgcaaaggaaatgtta

SEQ ID NO: 676720 - DNA, 20 bp, Artificial
  CRISPR gRNA sequence
ttgaagaaaatttaaaatgc

SEQ ID NO: 676721 - DNA, 20 bp, Artificial
  CRISPR gRNA sequence
aagaaaatttaaaatgctac

SEQ ID NO: 676722 - DNA, 20 bp, Artificial
  CRISPR gRNA sequence
aaaatgctactccagtgaac

SEQ ID NO: 676723 - DNA, 20 bp, Artificial
  CRISPR gRNA sequence
aaatgctactccagtgaaca

SEQ ID NO: 676724 - DNA, 20 bp, Artificial
  CRISPR gRNA sequence
ctccagtgaacacacaagtg

SEQ ID NO: 676725 - DNA, 20 bp, Artificial
  CRISPR gRNA sequence
cagtgaacacacaagtgata

SEQ ID NO: 676726 - DNA, 20 bp, Artificial
  CRISPR gRNA sequence
ccttacttctgattatggag

SEQ ID NO: 676727 - DNA, 20 bp, Artificial
  CRISPR gRNA sequence
acttctgattatggagaaag

SEQ ID NO: 676728 - DNA, 20 bp, Artificial
  CRISPR gRNA sequence
cttctgattatggagaaagt

SEQ ID NO: 676729 - DNA, 20 bp, Artificial
  CRISPR gRNA sequence
ctgattatggagaaagtttc

SEQ ID NO: 676730 - DNA, 20 bp, Artificial
  CRISPR gRNA sequence
tgattatggagaaagtttca

SEQ ID NO: 676731 - DNA, 20 bp, Artificial
  CRISPR gRNA sequence
attatggagaaagtttcagt

SEQ ID NO: 676732 - DNA, 20 bp, Artificial
  CRISPR gRNA sequence
tggagaaagtttcagtggtc

SEQ ID NO: 676733 - DNA, 20 bp, Artificial
  CRISPR gRNA sequence
cagtggtctggatagaagat

SEQ ID NO: 676734 - DNA, 20 bp, Artificial
  CRISPR gRNA sequence
agtggtctggatagaagatc

SEQ ID NO: 676735 - DNA, 20 bp, Artificial
  CRISPR gRNA sequence
gatagaagatcaaaccagcc

SEQ ID NO: 676736 - DNA, 20 bp, Artificial
  CRISPR gRNA sequence
tcttaaatcaaagcctaatc

SEQ ID NO: 676737 - DNA, 20 bp, Artificial
  CRISPR gRNA sequence
ttaaatcaaagcctaatcct

SEQ ID NO: 676738 - DNA, 20 bp, Artificial
  CRISPR gRNA sequence
aaatcaaagcctaatcctga

SEQ ID NO: 676739 - DNA, 20 bp, Artificial
  CRISPR gRNA sequence
aatcaaagcctaatcctgag

SEQ ID NO: 676740 - DNA, 20 bp, Artificial
  CRISPR gRNA sequence
atcctgaggaagaccctaac

SEQ ID NO: 676741 - DNA, 20 bp, Artificial
  CRISPR gRNA sequence
aggaagaccctaacaatatt

SEQ ID NO: 676742 - DNA, 20 bp, Artificial
  CRISPR gRNA sequence
acaatattcaattttctgaa

SEQ ID NO: 676743 - DNA, 20 bp, Artificial
  CRISPR gRNA sequence
aattttctgaaggccacgag

SEQ ID NO: 676744 - DNA, 20 bp, Artificial
  CRISPR gRNA sequence
tctgaaggccacgagatgtg

SEQ ID NO: 676745 - DNA, 20 bp, Artificial
  CRISPR gRNA sequence
ctgaaggccacgagatgtga

SEQ ID NO: 676746 - DNA, 20 bp, Artificial
  CRISPR gRNA sequence
tgaaggccacgagatgtgag

SEQ ID NO: 676747 - DNA, 20 bp, Artificial
  CRISPR gRNA sequence
aaggccacgagatgtgagga

SEQ ID NO: 676748 - DNA, 20 bp, Artificial
  CRISPR gRNA sequence
cagaagaaaagttggaagct

SEQ ID NO: 676749 - DNA, 20 bp, Artificial
  CRISPR gRNA sequence
gaagctagcagaggttggtt

SEQ ID NO: 676750 - DNA, 20 bp, Artificial
  CRISPR gRNA sequence
gcagaggttggttcatgagg

SEQ ID NO: 676751 - DNA, 20 bp, Artificial
  CRISPR gRNA sequence
gttcatgaggtttaaggaaa

SEQ ID NO: 676752 - DNA, 20 bp, Artificial
  CRISPR gRNA sequence
atgaggtttaaggaaagaag

SEQ ID NO: 676753 - DNA, 20 bp, Artificial
  CRISPR gRNA sequence
aaggaaagaagccatctcta

SEQ ID NO: 676754 - DNA, 20 bp, Artificial
  CRISPR gRNA sequence
aggaaagaagccatctctat

SEQ ID NO: 676755 - DNA, 20 bp, Artificial
  CRISPR gRNA sequence
tataacataaaagtgcaagg

SEQ ID NO: 676756 - DNA, 20 bp, Artificial
  CRISPR gRNA sequence
taacataaaagtgcaaggtg

SEQ ID NO: 676757 - DNA, 20 bp, Artificial
  CRISPR gRNA sequence
atgtagaggctacagtaatt

SEQ ID NO: 676758 - DNA, 20 bp, Artificial
  CRISPR gRNA sequence
cagtaattcatccagaagaa

SEQ ID NO: 676759 - DNA, 20 bp, Artificial
  CRISPR gRNA sequence
atccagaagaactagctaag

SEQ ID NO: 676760 - DNA, 20 bp, Artificial
  CRISPR gRNA sequence
gctaagctaattaatgaagg

SEQ ID NO: 676761 - DNA, 20 bp, Artificial
  CRISPR gRNA sequence
agctaattaatgaaggtggt

SEQ ID NO: 676762 - DNA, 20 bp, Artificial
  CRISPR gRNA sequence
attaatgaaggtggttgtga

SEQ ID NO: 676763 - DNA, 20 bp, Artificial
  CRISPR gRNA sequence
atgaaggtggttgtgataaa

SEQ ID NO: 676764 - DNA, 20 bp, Artificial
  CRISPR gRNA sequence
tgataaatggcagagtttca

SEQ ID NO: 676765 - DNA, 20 bp, Artificial
  CRISPR gRNA sequence
cagtgtagacaaaacagcct

SEQ ID NO: 676766 - DNA, 20 bp, Artificial
  CRISPR gRNA sequence
agtgtagacaaaacagcctt

SEQ ID NO: 676767 - DNA, 20 bp, Artificial
  CRISPR gRNA sequence
ctattagaagaagaggccat

SEQ ID NO: 676768 - DNA, 20 bp, Artificial
  CRISPR gRNA sequence
tattagaagaagaggccatc

SEQ ID NO: 676769 - DNA, 20 bp, Artificial
  CRISPR gRNA sequence
ttagaagaagaggccatcta

SEQ ID NO: 676770 - DNA, 20 bp, Artificial
  CRISPR gRNA sequence
gaagaagaggccatctagag

SEQ ID NO: 676771 - DNA, 20 bp, Artificial
  CRISPR gRNA sequence
gagaggagaagtcagtgcct

SEQ ID NO: 676772 - DNA, 20 bp, Artificial
  CRISPR gRNA sequence
ggttaaaagcttcaaaggac

SEQ ID NO: 676773 - DNA, 20 bp, Artificial
  CRISPR gRNA sequence
aaagcttcaaaggacaggct

SEQ ID NO: 676774 - DNA, 20 bp, Artificial
  CRISPR gRNA sequence
caaaggacaggctgactctc

SEQ ID NO: 676775 - DNA, 20 bp, Artificial
  CRISPR gRNA sequence
aaaggacaggctgactctct

SEQ ID NO: 676776 - DNA, 20 bp, Artificial
  CRISPR gRNA sequence
actctcttggtaggacaatg

SEQ ID NO: 676777 - DNA, 20 bp, Artificial
  CRISPR gRNA sequence
tcttggtaggacaatgcagc

SEQ ID NO: 676778 - DNA, 20 bp, Artificial
  CRISPR gRNA sequence
ttggtaggacaatgcagctg

SEQ ID NO: 676779 - DNA, 20 bp, Artificial
  CRISPR gRNA sequence
ggtaggacaatgcagctggt

SEQ ID NO: 676780 - DNA, 20 bp, Artificial
  CRISPR gRNA sequence
gtaggacaatgcagctggtg

SEQ ID NO: 676781 - DNA, 20 bp, Artificial
  CRISPR gRNA sequence
gtgacttaaagttgtagcca

SEQ ID NO: 676782 - DNA, 20 bp, Artificial
  CRISPR gRNA sequence
aaagttgtagccaatgctca

SEQ ID NO: 676783 - DNA, 20 bp, Artificial
  CRISPR gRNA sequence
aagttgtagccaatgctcat

SEQ ID NO: 676784 - DNA, 20 bp, Artificial
  CRISPR gRNA sequence
tagccaatgctcattgacca

SEQ ID NO: 676785 - DNA, 20 bp, Artificial
  CRISPR gRNA sequence
attgaccattccaaaaattc

SEQ ID NO: 676786 - DNA, 20 bp, Artificial
  CRISPR gRNA sequence
accattccaaaaattctaag

SEQ ID NO: 676787 - DNA, 20 bp, Artificial
  CRISPR gRNA sequence
caaaaattctaaggtcctta

SEQ ID NO: 676788 - DNA, 20 bp, Artificial
  CRISPR gRNA sequence
taaggtccttaagaattatg

SEQ ID NO: 676789 - DNA, 20 bp, Artificial
  CRISPR gRNA sequence
aggtccttaagaattatgct

SEQ ID NO: 676790 - DNA, 20 bp, Artificial
  CRISPR gRNA sequence
aagaattatgctatatctac

SEQ ID NO: 676791 - DNA, 20 bp, Artificial
  CRISPR gRNA sequence
agaattatgctatatctact

SEQ ID NO: 676792 - DNA, 20 bp, Artificial
  CRISPR gRNA sequence
tgctatatctactctgcctg

SEQ ID NO: 676793 - DNA, 20 bp, Artificial
  CRISPR gRNA sequence
tatctactctgcctgtgctc

SEQ ID NO: 676794 - DNA, 20 bp, Artificial
  CRISPR gRNA sequence
ctctgcctgtgctctataaa

SEQ ID NO: 676795 - DNA, 20 bp, Artificial
  CRISPR gRNA sequence
tgcctgtgctctataaatgg

SEQ ID NO: 676796 - DNA, 20 bp, Artificial
  CRISPR gRNA sequence
cctgtgctctataaatggaa

SEQ ID NO: 676797 - DNA, 20 bp, Artificial
  CRISPR gRNA sequence
tgctctataaatggaacagc

SEQ ID NO: 676798 - DNA, 20 bp, Artificial
  CRISPR gRNA sequence
tataaatggaacagcaaagt

SEQ ID NO: 676799 - DNA, 20 bp, Artificial
  CRISPR gRNA sequence
taaatggaacagcaaagtct

SEQ ID NO: 676800 - DNA, 20 bp, Artificial
  CRISPR gRNA sequence
ggtgacagcacatttgttta

SEQ ID NO: 676801 - DNA, 20 bp, Artificial
  CRISPR gRNA sequence
gtttacaatatggtttagtg

SEQ ID NO: 676802 - DNA, 20 bp, Artificial
  CRISPR gRNA sequence
tttacaatatggtttagtga

SEQ ID NO: 676803 - DNA, 20 bp, Artificial
  CRISPR gRNA sequence
acaatatggtttagtgaata

SEQ ID NO: 676804 - DNA, 20 bp, Artificial
  CRISPR gRNA sequence
caatatggtttagtgaataa

SEQ ID NO: 676805 - DNA, 20 bp, Artificial
  CRISPR gRNA sequence
agtgaataagcctattgttt

SEQ ID NO: 676806 - DNA, 20 bp, Artificial
  CRISPR gRNA sequence
gtgaataagcctattgttta

SEQ ID NO: 676807 - DNA, 20 bp, Artificial
  CRISPR gRNA sequence
ttgtttagacactgctcaga

SEQ ID NO: 676808 - DNA, 20 bp, Artificial
  CRISPR gRNA sequence
tttagacactgctcagaaac

SEQ ID NO: 676809 - DNA, 20 bp, Artificial
  CRISPR gRNA sequence
agacactgctcagaaacaaa

SEQ ID NO: 676810 - DNA, 20 bp, Artificial
  CRISPR gRNA sequence
gacactgctcagaaacaaaa

SEQ ID NO: 676811 - DNA, 20 bp, Artificial
  CRISPR gRNA sequence
ctcagaaacaaaaattcctt

SEQ ID NO: 676812 - DNA, 20 bp, Artificial
  CRISPR gRNA sequence
agaaacaaaaattcctttca

SEQ ID NO: 676813 - DNA, 20 bp, Artificial
  CRISPR gRNA sequence
ctttcaaaatattacagttc

SEQ ID NO: 676814 - DNA, 20 bp, Artificial
  CRISPR gRNA sequence
tcaaaatattacagttcatt

SEQ ID NO: 676815 - DNA, 20 bp, Artificial
  CRISPR gRNA sequence
caaaatattacagttcattg

SEQ ID NO: 676816 - DNA, 20 bp, Artificial
  CRISPR gRNA sequence
aaaatattacagttcattga

SEQ ID NO: 676817 - DNA, 20 bp, Artificial
  CRISPR gRNA sequence
cagttcattgacaatgtacc

SEQ ID NO: 676818 - DNA, 20 bp, Artificial
  CRISPR gRNA sequence
attgacaatgtaccttgtca

SEQ ID NO: 676819 - DNA, 20 bp, Artificial
  CRISPR gRNA sequence
acaatgtaccttgtcaccca

SEQ ID NO: 676820 - DNA, 20 bp, Artificial
  CRISPR gRNA sequence
gtcacccaaaacttctgatg

SEQ ID NO: 676821 - DNA, 20 bp, Artificial
  CRISPR gRNA sequence
tcacccaaaacttctgatgg

SEQ ID NO: 676822 - DNA, 20 bp, Artificial
  CRISPR gRNA sequence
ctgatggagatgtacaagca

SEQ ID NO: 676823 - DNA, 20 bp, Artificial
  CRISPR gRNA sequence
tgatggagatgtacaagcag

SEQ ID NO: 676824 - DNA, 20 bp, Artificial
  CRISPR gRNA sequence
atggagatgtacaagcagat

SEQ ID NO: 676825 - DNA, 20 bp, Artificial
  CRISPR gRNA sequence
atgttgttttcatggctgtt

SEQ ID NO: 676826 - DNA, 20 bp, Artificial
  CRISPR gRNA sequence
ttttcatggctgttaataca

SEQ ID NO: 676827 - DNA, 20 bp, Artificial
  CRISPR gRNA sequence
tcatggctgttaatacagca

SEQ ID NO: 676828 - DNA, 20 bp, Artificial
  CRISPR gRNA sequence
catggctgttaatacagcat

SEQ ID NO: 676829 - DNA, 20 bp, Artificial
  CRISPR gRNA sequence
atggctgttaatacagcata

SEQ ID NO: 676830 - DNA, 20 bp, Artificial
  CRISPR gRNA sequence
ttaatacagcatatattctt

SEQ ID NO: 676831 - DNA, 20 bp, Artificial
  CRISPR gRNA sequence
atacagcatatattcttcag

SEQ ID NO: 676832 - DNA, 20 bp, Artificial
  CRISPR gRNA sequence
ttcagcccacgctcaagggt

SEQ ID NO: 676833 - DNA, 20 bp, Artificial
  CRISPR gRNA sequence
cagcccacgctcaagggtta

SEQ ID NO: 676834 - DNA, 20 bp, Artificial
  CRISPR gRNA sequence
agcccacgctcaagggttaa

SEQ ID NO: 676835 - DNA, 20 bp, Artificial
  CRISPR gRNA sequence
aagggttaatttaaactttc

SEQ ID NO: 676836 - DNA, 20 bp, Artificial
  CRISPR gRNA sequence
atttaaactttcaagtctta

SEQ ID NO: 676837 - DNA, 20 bp, Artificial
  CRISPR gRNA sequence
aaactttcaagtcttattac

SEQ ID NO: 676838 - DNA, 20 bp, Artificial
  CRISPR gRNA sequence
aactttcaagtcttattact

SEQ ID NO: 676839 - DNA, 20 bp, Artificial
  CRISPR gRNA sequence
tcaagtcttattacttaaga

SEQ ID NO: 676840 - DNA, 20 bp, Artificial
  CRISPR gRNA sequence
caagtcttattacttaagac

SEQ ID NO: 676841 - DNA, 20 bp, Artificial
  CRISPR gRNA sequence
aagtcttattacttaagaca

SEQ ID NO: 676842 - DNA, 20 bp, Artificial
  CRISPR gRNA sequence
attacttaagacatacattt

SEQ ID NO: 676843 - DNA, 20 bp, Artificial
  CRISPR gRNA sequence
ttacttaagacatacatttt

SEQ ID NO: 676844 - DNA, 20 bp, Artificial
  CRISPR gRNA sequence
cttaagacatacattttata

SEQ ID NO: 676845 - DNA, 20 bp, Artificial
  CRISPR gRNA sequence
aagacatacattttataagg

SEQ ID NO: 676846 - DNA, 20 bp, Artificial
  CRISPR gRNA sequence
agacatacattttataaggc

SEQ ID NO: 676847 - DNA, 20 bp, Artificial
  CRISPR gRNA sequence
tataaggctagaggtgccat

SEQ ID NO: 676848 - DNA, 20 bp, Artificial
  CRISPR gRNA sequence
ataaggctagaggtgccata

SEQ ID NO: 676849 - DNA, 20 bp, Artificial
  CRISPR gRNA sequence
taaggctagaggtgccatag

SEQ ID NO: 676850 - DNA, 20 bp, Artificial
  CRISPR gRNA sequence
gaggtgccatagacagtgat

SEQ ID NO: 676851 - DNA, 20 bp, Artificial
  CRISPR gRNA sequence
ctatgatggatgtgggcaaa

SEQ ID NO: 676852 - DNA, 20 bp, Artificial
  CRISPR gRNA sequence
tatgatggatgtgggcaaag

SEQ ID NO: 676853 - DNA, 20 bp, Artificial
  CRISPR gRNA sequence
tgatggatgtgggcaaagta

SEQ ID NO: 676854 - DNA, 20 bp, Artificial
  CRISPR gRNA sequence
aaaaccttctggaaaggatt

SEQ ID NO: 676855 - DNA, 20 bp, Artificial
  CRISPR gRNA sequence
ctggaaaggattcagaattc

SEQ ID NO: 676856 - DNA, 20 bp, Artificial
  CRISPR gRNA sequence
tggaaaggattcagaattct

SEQ ID NO: 676857 - DNA, 20 bp, Artificial
  CRISPR gRNA sequence
gaaaggattcagaattctag

SEQ ID NO: 676858 - DNA, 20 bp, Artificial
  CRISPR gRNA sequence
agaattctagatgtcattga

SEQ ID NO: 676859 - DNA, 20 bp, Artificial
  CRISPR gRNA sequence
tagatgtcattgagaacatt

SEQ ID NO: 676860 - DNA, 20 bp, Artificial
  CRISPR gRNA sequence
gatgtcattgagaacatttg

SEQ ID NO: 676861 - DNA, 20 bp, Artificial
  CRISPR gRNA sequence
agaacatttgtgattcatct

SEQ ID NO: 676862 - DNA, 20 bp, Artificial
  CRISPR gRNA sequence
gtgattcatctgagaaggtc

SEQ ID NO: 676863 - DNA, 20 bp, Artificial
  CRISPR gRNA sequence
tgattcatctgagaaggtca

SEQ ID NO: 676864 - DNA, 20 bp, Artificial
  CRISPR gRNA sequence
atctgagaaggtcaagatat

SEQ ID NO: 676865 - DNA, 20 bp, Artificial
  CRISPR gRNA sequence
agaaggtcaagatattaaca

SEQ ID NO: 676866 - DNA, 20 bp, Artificial
  CRISPR gRNA sequence
acaggagttgggaaaaagtt

SEQ ID NO: 676867 - DNA, 20 bp, Artificial
  CRISPR gRNA sequence
ggaaaaagttgatttcaacc

SEQ ID NO: 676868 - DNA, 20 bp, Artificial
  CRISPR gRNA sequence
atttcaacctcatggatgac

SEQ ID NO: 676869 - DNA, 20 bp, Artificial
  CRISPR gRNA sequence
caacctcatggatgactttc

SEQ ID NO: 676870 - DNA, 20 bp, Artificial
  CRISPR gRNA sequence
aacctcatggatgactttca

SEQ ID NO: 676871 - DNA, 20 bp, Artificial
  CRISPR gRNA sequence
atggatgactttcaggaggt

SEQ ID NO: 676872 - DNA, 20 bp, Artificial
  CRISPR gRNA sequence
tcaggaggttcaggacttca

SEQ ID NO: 676873 - DNA, 20 bp, Artificial
  CRISPR gRNA sequence
caggaggttcaggacttcag

SEQ ID NO: 676874 - DNA, 20 bp, Artificial
  CRISPR gRNA sequence
aggaggttcaggacttcagt

SEQ ID NO: 676875 - DNA, 20 bp, Artificial
  CRISPR gRNA sequence
aggacttcagtggataaagg

SEQ ID NO: 676876 - DNA, 20 bp, Artificial
  CRISPR gRNA sequence
cagtggataaaggaactgca

SEQ ID NO: 676877 - DNA, 20 bp, Artificial
  CRISPR gRNA sequence
agtggataaaggaactgcag

SEQ ID NO: 676878 - DNA, 20 bp, Artificial
  CRISPR gRNA sequence
cagatgtgatagaaacagca

SEQ ID NO: 676879 - DNA, 20 bp, Artificial
  CRISPR gRNA sequence
gagttagaagtggagcctga

SEQ ID NO: 676880 - DNA, 20 bp, Artificial
  CRISPR gRNA sequence
gaagtggagcctgaagatgt

SEQ ID NO: 676881 - DNA, 20 bp, Artificial
  CRISPR gRNA sequence
aagatgtgactgaattactg

SEQ ID NO: 676882 - DNA, 20 bp, Artificial
  CRISPR gRNA sequence
aattactgcagtctcgttat

SEQ ID NO: 676883 - DNA, 20 bp, Artificial
  CRISPR gRNA sequence
ctgcagtctcgttataaaat

SEQ ID NO: 676884 - DNA, 20 bp, Artificial
  CRISPR gRNA sequence
cagtctcgttataaaatgtg

SEQ ID NO: 676885 - DNA, 20 bp, Artificial
  CRISPR gRNA sequence
gttataaaatgtgaatggat

SEQ ID NO: 676886 - DNA, 20 bp, Artificial
  CRISPR gRNA sequence
taaaatgtgaatggatgaag

SEQ ID NO: 676887 - DNA, 20 bp, Artificial
  CRISPR gRNA sequence
cttcttacaatgggcaaaga

SEQ ID NO: 676888 - DNA, 20 bp, Artificial
  CRISPR gRNA sequence
cttacaatgggcaaagaaag

SEQ ID NO: 676889 - DNA, 20 bp, Artificial
  CRISPR gRNA sequence
ttacaatgggcaaagaaagt

SEQ ID NO: 676890 - DNA, 20 bp, Artificial
  CRISPR gRNA sequence
acaatgggcaaagaaagtgg

SEQ ID NO: 676891 - DNA, 20 bp, Artificial
  CRISPR gRNA sequence
caatgggcaaagaaagtggt

SEQ ID NO: 676892 - DNA, 20 bp, Artificial
  CRISPR gRNA sequence
cttgagatcgaatcttctag

SEQ ID NO: 676893 - DNA, 20 bp, Artificial
  CRISPR gRNA sequence
ttgagatcgaatcttctagt

SEQ ID NO: 676894 - DNA, 20 bp, Artificial
  CRISPR gRNA sequence
gagatcgaatcttctagtgt

SEQ ID NO: 676895 - DNA, 20 bp, Artificial
  CRISPR gRNA sequence
agatcgaatcttctagtgta

SEQ ID NO: 676896 - DNA, 20 bp, Artificial
  CRISPR gRNA sequence
ctagtgtagatcctgtgaat

SEQ ID NO: 676897 - DNA, 20 bp, Artificial
  CRISPR gRNA sequence
tagtgtagatcctgtgaata

SEQ ID NO: 676898 - DNA, 20 bp, Artificial
  CRISPR gRNA sequence
gtgtagatcctgtgaatatt

SEQ ID NO: 676899 - DNA, 20 bp, Artificial
  CRISPR gRNA sequence
tgaatattgttgaaatgaca

SEQ ID NO: 676900 - DNA, 20 bp, Artificial
  CRISPR gRNA sequence
ttgaaatgacaacagaggat

SEQ ID NO: 676901 - DNA, 20 bp, Artificial
  CRISPR gRNA sequence
aaatgacaacagaggatttg

SEQ ID NO: 676902 - DNA, 20 bp, Artificial
  CRISPR gRNA sequence
ggaatattacataaacttag

SEQ ID NO: 676903 - DNA, 20 bp, Artificial
  CRISPR gRNA sequence
gaatattacataaacttagt

SEQ ID NO: 676904 - DNA, 20 bp, Artificial
  CRISPR gRNA sequence
cataaacttagttgacaaag

SEQ ID NO: 676905 - DNA, 20 bp, Artificial
  CRISPR gRNA sequence
agttgacaaagcagtagcag

SEQ ID NO: 676906 - DNA, 20 bp, Artificial
  CRISPR gRNA sequence
gttgacaaagcagtagcaga

SEQ ID NO: 676907 - DNA, 20 bp, Artificial
  CRISPR gRNA sequence
acaaagcagtagcagagttt

SEQ ID NO: 676908 - DNA, 20 bp, Artificial
  CRISPR gRNA sequence
gagagagttgaatccaattt

SEQ ID NO: 676909 - DNA, 20 bp, Artificial
  CRISPR gRNA sequence
agagagttgaatccaatttt

SEQ ID NO: 676910 - DNA, 20 bp, Artificial
  CRISPR gRNA sequence
aatccaattttgaaagaaat

SEQ ID NO: 676911 - DNA, 20 bp, Artificial
  CRISPR gRNA sequence
tgaaagaaattctactctgg

SEQ ID NO: 676912 - DNA, 20 bp, Artificial
  CRISPR gRNA sequence
gaaagaaattctactctggg

SEQ ID NO: 676913 - DNA, 20 bp, Artificial
  CRISPR gRNA sequence
aaagaaattctactctgggt

SEQ ID NO: 676914 - DNA, 20 bp, Artificial
  CRISPR gRNA sequence
tactctgggtaaaatcgtat

SEQ ID NO: 676915 - DNA, 20 bp, Artificial
  CRISPR gRNA sequence
ctctgggtaaaatcgtatca

SEQ ID NO: 676916 - DNA, 20 bp, Artificial
  CRISPR gRNA sequence
tgggtaaaatcgtatcaaat

SEQ ID NO: 676917 - DNA, 20 bp, Artificial
  CRISPR gRNA sequence
ggtaaaatcgtatcaaatag

SEQ ID NO: 676918 - DNA, 20 bp, Artificial
  CRISPR gRNA sequence
cagagaagtcctttgtgaaa

SEQ ID NO: 676919 - DNA, 20 bp, Artificial
  CRISPR gRNA sequence
tgtgaaaggaagtgttgact

SEQ ID NO: 676920 - DNA, 20 bp, Artificial
  CRISPR gRNA sequence
gtgaaaggaagtgttgactg

SEQ ID NO: 676921 - DNA, 20 bp, Artificial
  CRISPR gRNA sequence
tgaaaggaagtgttgactga

SEQ ID NO: 676922 - DNA, 20 bp, Artificial
  CRISPR gRNA sequence
actgatgtggcaaacttcat

SEQ ID NO: 676923 - DNA, 20 bp, Artificial
  CRISPR gRNA sequence
atgtggcaaacttcattgtt

SEQ ID NO: 676924 - DNA, 20 bp, Artificial
  CRISPR gRNA sequence
cattgttgccttatgttaag

SEQ ID NO: 676925 - DNA, 20 bp, Artificial
  CRISPR gRNA sequence
attgttgccttatgttaagg

SEQ ID NO: 676926 - DNA, 20 bp, Artificial
  CRISPR gRNA sequence
ttgccttatgttaaggaatt

SEQ ID NO: 676927 - DNA, 20 bp, Artificial
  CRISPR gRNA sequence
ccttatgttaaggaattgcc

SEQ ID NO: 676928 - DNA, 20 bp, Artificial
  CRISPR gRNA sequence
atgttaaggaattgccacat

SEQ ID NO: 676929 - DNA, 20 bp, Artificial
  CRISPR gRNA sequence
tgttaaggaattgccacatc

SEQ ID NO: 676930 - DNA, 20 bp, Artificial
  CRISPR gRNA sequence
aggaattgccacatccatcc

SEQ ID NO: 676931 - DNA, 20 bp, Artificial
  CRISPR gRNA sequence
ccacatccatcccagccttc

SEQ ID NO: 676932 - DNA, 20 bp, Artificial
  CRISPR gRNA sequence
caacaaccaccagccttatc

SEQ ID NO: 676933 - DNA, 20 bp, Artificial
  CRISPR gRNA sequence
aacaaccaccagccttatca

SEQ ID NO: 676934 - DNA, 20 bp, Artificial
  CRISPR gRNA sequence
atcaatcagtagccatcgac

SEQ ID NO: 676935 - DNA, 20 bp, Artificial
  CRISPR gRNA sequence
tcaatcagtagccatcgaca

SEQ ID NO: 676936 - DNA, 20 bp, Artificial
  CRISPR gRNA sequence
ctccaccagtggaaagatga

SEQ ID NO: 676937 - DNA, 20 bp, Artificial
  CRISPR gRNA sequence
caccagtggaaagatgatga

SEQ ID NO: 676938 - DNA, 20 bp, Artificial
  CRISPR gRNA sequence
aaggctcagattatctttac

SEQ ID NO: 676939 - DNA, 20 bp, Artificial
  CRISPR gRNA sequence
agattatctttacagtgtat

SEQ ID NO: 676940 - DNA, 20 bp, Artificial
  CRISPR gRNA sequence
tctttacagtgtatgtgtat

SEQ ID NO: 676941 - DNA, 20 bp, Artificial
  CRISPR gRNA sequence
tacagtgtatgtgtatgtat

SEQ ID NO: 676942 - DNA, 20 bp, Artificial
  CRISPR gRNA sequence
acagtgtatgtgtatgtatg

SEQ ID NO: 676943 - DNA, 20 bp, Artificial
  CRISPR gRNA sequence
cagtgtatgtgtatgtatgt

SEQ ID NO: 676944 - DNA, 20 bp, Artificial
  CRISPR gRNA sequence
actgtagccttgactgtctg

SEQ ID NO: 676945 - DNA, 20 bp, Artificial
  CRISPR gRNA sequence
tagccttgactgtctgggct

SEQ ID NO: 676946 - DNA, 20 bp, Artificial
  CRISPR gRNA sequence
gactgtctgggctcaagtga

SEQ ID NO: 676947 - DNA, 20 bp, Artificial
  CRISPR gRNA sequence
actgtctgggctcaagtgat

SEQ ID NO: 676948 - DNA, 20 bp, Artificial
  CRISPR gRNA sequence
tctgggctcaagtgatcctc

SEQ ID NO: 676949 - DNA, 20 bp, Artificial
  CRISPR gRNA sequence
ggctcaagtgatcctcccac

SEQ ID NO: 676950 - DNA, 20 bp, Artificial
  CRISPR gRNA sequence
aagtgatcctcccacctcag

SEQ ID NO: 676951 - DNA, 20 bp, Artificial
  CRISPR gRNA sequence
ccacctcagcctctcagcct

SEQ ID NO: 676952 - DNA, 20 bp, Artificial
  CRISPR gRNA sequence
agcctctcagcctcccgagt

SEQ ID NO: 676953 - DNA, 20 bp, Artificial
  CRISPR gRNA sequence
tcagcctcccgagtaactgg

SEQ ID NO: 676954 - DNA, 20 bp, Artificial
  CRISPR gRNA sequence
agcctcccgagtaactggga

SEQ ID NO: 676955 - DNA, 20 bp, Artificial
  CRISPR gRNA sequence
ccgagtaactgggaccactg

SEQ ID NO: 676956 - DNA, 20 bp, Artificial
  CRISPR gRNA sequence
ggaccactggtgcatgctac

SEQ ID NO: 676957 - DNA, 20 bp, Artificial
  CRISPR gRNA sequence
gtgcatgctaccacaccctg

SEQ ID NO: 676958 - DNA, 20 bp, Artificial
  CRISPR gRNA sequence
ccacaccctggctaattttg

SEQ ID NO: 676959 - DNA, 20 bp, Artificial
  CRISPR gRNA sequence
gctaattttgctagttttgt

SEQ ID NO: 676960 - DNA, 20 bp, Artificial
  CRISPR gRNA sequence
attttgctagttttgtattg

SEQ ID NO: 676961 - DNA, 20 bp, Artificial
  CRISPR gRNA sequence
tgctagttttgtattgttta

SEQ ID NO: 676962 - DNA, 20 bp, Artificial
  CRISPR gRNA sequence
gctagttttgtattgtttat

SEQ ID NO: 676963 - DNA, 20 bp, Artificial
  CRISPR gRNA sequence
ctagttttgtattgtttata

SEQ ID NO: 676964 - DNA, 20 bp, Artificial
  CRISPR gRNA sequence
gttttgtattgtttatagag

SEQ ID NO: 676965 - DNA, 20 bp, Artificial
  CRISPR gRNA sequence
tgtattgtttatagagatga

SEQ ID NO: 676966 - DNA, 20 bp, Artificial
  CRISPR gRNA sequence
gtattgtttatagagatgag

SEQ ID NO: 676967 - DNA, 20 bp, Artificial
  CRISPR gRNA sequence
tattgtttatagagatgaga

SEQ ID NO: 676968 - DNA, 20 bp, Artificial
  CRISPR gRNA sequence
tttatagagatgagatttca

SEQ ID NO: 676969 - DNA, 20 bp, Artificial
  CRISPR gRNA sequence
atagagatgagatttcatca

SEQ ID NO: 676970 - DNA, 20 bp, Artificial
  CRISPR gRNA sequence
tagagatgagatttcatcat

SEQ ID NO: 676971 - DNA, 20 bp, Artificial
  CRISPR gRNA sequence
catcatgttgcccaggctgg

SEQ ID NO: 676972 - DNA, 20 bp, Artificial
  CRISPR gRNA sequence
atcatgttgcccaggctggt

SEQ ID NO: 676973 - DNA, 20 bp, Artificial
  CRISPR gRNA sequence
cccaggctggtctagaactc

SEQ ID NO: 676974 - DNA, 20 bp, Artificial
  CRISPR gRNA sequence
gtctagaactcctgggcttt

SEQ ID NO: 676975 - DNA, 20 bp, Artificial
  CRISPR gRNA sequence
gaactcctgggctttagtga

SEQ ID NO: 676976 - DNA, 20 bp, Artificial
  CRISPR gRNA sequence
ctgggctttagtgatcctcc

SEQ ID NO: 676977 - DNA, 20 bp, Artificial
  CRISPR gRNA sequence
ggctttagtgatcctcctgc

SEQ ID NO: 676978 - DNA, 20 bp, Artificial
  CRISPR gRNA sequence
tagtgatcctcctgcctcca

SEQ ID NO: 676979 - DNA, 20 bp, Artificial
  CRISPR gRNA sequence
agtgatcctcctgcctccac

SEQ ID NO: 676980 - DNA, 20 bp, Artificial
  CRISPR gRNA sequence
gtgatcctcctgcctccact

SEQ ID NO: 676981 - DNA, 20 bp, Artificial
  CRISPR gRNA sequence
ctgcctccacttcccaaagt

SEQ ID NO: 676982 - DNA, 20 bp, Artificial
  CRISPR gRNA sequence
cctccacttcccaaagtgct

SEQ ID NO: 676983 - DNA, 20 bp, Artificial
  CRISPR gRNA sequence
cacttcccaaagtgcttgta

SEQ ID NO: 676984 - DNA, 20 bp, Artificial
  CRISPR gRNA sequence
cccaaagtgcttgtattaca

SEQ ID NO: 676985 - DNA, 20 bp, Artificial
  CRISPR gRNA sequence
ccaaagtgcttgtattacag

SEQ ID NO: 676986 - DNA, 20 bp, Artificial
  CRISPR gRNA sequence
gtattacaggtgtgagccac

SEQ ID NO: 676987 - DNA, 20 bp, Artificial
  CRISPR gRNA sequence
tattacaggtgtgagccact

SEQ ID NO: 676988 - DNA, 20 bp, Artificial
  CRISPR gRNA sequence
caggtgtgagccactgcacc

SEQ ID NO: 676989 - DNA, 20 bp, Artificial
  CRISPR gRNA sequence
cacctggcctctttagcatt

SEQ ID NO: 676990 - DNA, 20 bp, Artificial
  CRISPR gRNA sequence
gcctctttagcattttttag

SEQ ID NO: 676991 - DNA, 20 bp, Artificial
  CRISPR gRNA sequence
tttagcattttttagcagca

SEQ ID NO: 676992 - DNA, 20 bp, Artificial
  CRISPR gRNA sequence
tagcattttttagcagcaaa

SEQ ID NO: 676993 - DNA, 20 bp, Artificial
  CRISPR gRNA sequence
agcattttttagcagcaaag

SEQ ID NO: 676994 - DNA, 20 bp, Artificial
  CRISPR gRNA sequence
gcattttttagcagcaaagt

SEQ ID NO: 676995 - DNA, 20 bp, Artificial
  CRISPR gRNA sequence
tttagcagcaaagtattttt

SEQ ID NO: 676996 - DNA, 20 bp, Artificial
  CRISPR gRNA sequence
ttagcagcaaagtattttta

SEQ ID NO: 676997 - DNA, 20 bp, Artificial
  CRISPR gRNA sequence
tagcagcaaagtatttttaa

SEQ ID NO: 676998 - DNA, 20 bp, Artificial
  CRISPR gRNA sequence
agcagcaaagtatttttaaa

SEQ ID NO: 676999 - DNA, 20 bp, Artificial
  CRISPR gRNA sequence
gcagcaaagtatttttaaaa

SEQ ID NO: 677000 - DNA, 20 bp, Artificial
  CRISPR gRNA sequence
ttaaaattaaggtatataca

SEQ ID NO: 677001 - DNA, 20 bp, Artificial
  CRISPR gRNA sequence
taaaattaaggtatatacat

SEQ ID NO: 677002 - DNA, 20 bp, Artificial
  CRISPR gRNA sequence
aaaattaaggtatatacatt

SEQ ID NO: 677003 - DNA, 20 bp, Artificial
  CRISPR gRNA sequence
aaattaaggtatatacattg

SEQ ID NO: 677004 - DNA, 20 bp, Artificial
  CRISPR gRNA sequence
aggtatatacattgttttta

SEQ ID NO: 677005 - DNA, 20 bp, Artificial
  CRISPR gRNA sequence
tttttatacacaattctgtt

SEQ ID NO: 677006 - DNA, 20 bp, Artificial
  CRISPR gRNA sequence
ttatacacaattctgttgca

SEQ ID NO: 677007 - DNA, 20 bp, Artificial
  CRISPR gRNA sequence
tatacacaattctgttgcac

SEQ ID NO: 677008 - DNA, 20 bp, Artificial
  CRISPR gRNA sequence
atacacaattctgttgcaca

SEQ ID NO: 677009 - DNA, 20 bp, Artificial
  CRISPR gRNA sequence
tacacaattctgttgcacac

SEQ ID NO: 677010 - DNA, 20 bp, Artificial
  CRISPR gRNA sequence
tgttgcacacttaatagatt

SEQ ID NO: 677011 - DNA, 20 bp, Artificial
  CRISPR gRNA sequence
ttgcacacttaatagattat

SEQ ID NO: 677012 - DNA, 20 bp, Artificial
  CRISPR gRNA sequence
cacacttaatagattatggt

SEQ ID NO: 677013 - DNA, 20 bp, Artificial
  CRISPR gRNA sequence
aatagattatggtatgatat

SEQ ID NO: 677014 - DNA, 20 bp, Artificial
  CRISPR gRNA sequence
atagattatggtatgatata

SEQ ID NO: 677015 - DNA, 20 bp, Artificial
  CRISPR gRNA sequence
tggtatgatataaacataac

SEQ ID NO: 677016 - DNA, 20 bp, Artificial
  CRISPR gRNA sequence
ctatctgagtgacccacttt

SEQ ID NO: 677017 - DNA, 20 bp, Artificial
  CRISPR gRNA sequence
tatctgagtgacccacttta

SEQ ID NO: 677018 - DNA, 20 bp, Artificial
  CRISPR gRNA sequence
tctgagtgacccactttatc

SEQ ID NO: 677019 - DNA, 20 bp, Artificial
  CRISPR gRNA sequence
agtgacccactttatcagga

SEQ ID NO: 677020 - DNA, 20 bp, Artificial
  CRISPR gRNA sequence
tatcaggatatattctttat

SEQ ID NO: 677021 - DNA, 20 bp, Artificial
  CRISPR gRNA sequence
atcaggatatattctttatt

SEQ ID NO: 677022 - DNA, 20 bp, Artificial
  CRISPR gRNA sequence
tcaggatatattctttattg

SEQ ID NO: 677023 - DNA, 20 bp, Artificial
  CRISPR gRNA sequence
tttattgtgatggggtggaa

SEQ ID NO: 677024 - DNA, 20 bp, Artificial
  CRISPR gRNA sequence
tattgtgatggggtggaact

SEQ ID NO: 677025 - DNA, 20 bp, Artificial
  CRISPR gRNA sequence
attgtgatggggtggaactc

SEQ ID NO: 677026 - DNA, 20 bp, Artificial
  CRISPR gRNA sequence
ttgtgatggggtggaactca

SEQ ID NO: 677027 - DNA, 20 bp, Artificial
  CRISPR gRNA sequence
tgatggggtggaactcaacc

SEQ ID NO: 677028 - DNA, 20 bp, Artificial
  CRISPR gRNA sequence
aacctgcaatatctccaaga

SEQ ID NO: 677029 - DNA, 20 bp, Artificial
  CRISPR gRNA sequence
caatatctccaagatatgcc

SEQ ID NO: 677030 - DNA, 20 bp, Artificial
  CRISPR gRNA sequence
caagatatgccagtggtttg

SEQ ID NO: 677031 - DNA, 20 bp, Artificial
  CRISPR gRNA sequence
gattaattgaaatctcatta

SEQ ID NO: 677032 - DNA, 20 bp, Artificial
  CRISPR gRNA sequence
attaattgaaatctcattaa

SEQ ID NO: 677033 - DNA, 20 bp, Artificial
  CRISPR gRNA sequence
attgaaatctcattaaaagg

SEQ ID NO: 677034 - DNA, 20 bp, Artificial
  CRISPR gRNA sequence
aaatctcattaaaaggaaga

SEQ ID NO: 677035 - DNA, 20 bp, Artificial
  CRISPR gRNA sequence
attaaaaggaagagtctata

SEQ ID NO: 677036 - DNA, 20 bp, Artificial
  CRISPR gRNA sequence
aaaggaagagtctatataat

SEQ ID NO: 677037 - DNA, 20 bp, Artificial
  CRISPR gRNA sequence
tataatttggattattcatt

SEQ ID NO: 677038 - DNA, 20 bp, Artificial
  CRISPR gRNA sequence
ggattattcatttaatctgt

SEQ ID NO: 677039 - DNA, 20 bp, Artificial
  CRISPR gRNA sequence
gattattcatttaatctgta

SEQ ID NO: 677040 - DNA, 20 bp, Artificial
  CRISPR gRNA sequence
ttcatttaatctgtatgcct

SEQ ID NO: 677041 - DNA, 20 bp, Artificial
  CRISPR gRNA sequence
atttaatctgtatgcctagt

SEQ ID NO: 677042 - DNA, 20 bp, Artificial
  CRISPR gRNA sequence
aatctgtatgcctagtaaat

SEQ ID NO: 677043 - DNA, 20 bp, Artificial
  CRISPR gRNA sequence
atctgtatgcctagtaaatt

SEQ ID NO: 677044 - DNA, 20 bp, Artificial
  CRISPR gRNA sequence
tatgcctagtaaattcttac

SEQ ID NO: 677045 - DNA, 20 bp, Artificial
  CRISPR gRNA sequence
gtaaattcttactagccttt

SEQ ID NO: 677046 - DNA, 20 bp, Artificial
  CRISPR gRNA sequence
ttactagcctttctgtttac

SEQ ID NO: 677047 - DNA, 20 bp, Artificial
  CRISPR gRNA sequence
actagcctttctgtttactt

SEQ ID NO: 677048 - DNA, 20 bp, Artificial
  CRISPR gRNA sequence
ctagcctttctgtttacttt

SEQ ID NO: 677049 - DNA, 20 bp, Artificial
  CRISPR gRNA sequence
gcctttctgtttacttttta

SEQ ID NO: 677050 - DNA, 20 bp, Artificial
  CRISPR gRNA sequence
tctgtttactttttattccc

SEQ ID NO: 677051 - DNA, 20 bp, Artificial
  CRISPR gRNA sequence
ctgtttactttttattcccc

SEQ ID NO: 677052 - DNA, 20 bp, Artificial
  CRISPR gRNA sequence
tgtttactttttattcccca

SEQ ID NO: 677053 - DNA, 20 bp, Artificial
  CRISPR gRNA sequence
tttactttttattccccata

SEQ ID NO: 677054 - DNA, 20 bp, Artificial
  CRISPR gRNA sequence
actttttattccccataatg

SEQ ID NO: 677055 - DNA, 20 bp, Artificial
  CRISPR gRNA sequence
ctttttattccccataatga

SEQ ID NO: 677056 - DNA, 20 bp, Artificial
  CRISPR gRNA sequence
tttattccccataatgaata

SEQ ID NO: 677057 - DNA, 20 bp, Artificial
  CRISPR gRNA sequence
ttattccccataatgaatat

SEQ ID NO: 677058 - DNA, 20 bp, Artificial
  CRISPR gRNA sequence
tattccccataatgaatatt

SEQ ID NO: 677059 - DNA, 20 bp, Artificial
  CRISPR gRNA sequence
attccccataatgaatattt

SEQ ID NO: 677060 - DNA, 20 bp, Artificial
  CRISPR gRNA sequence
ttccccataatgaatatttt

SEQ ID NO: 677061 - DNA, 20 bp, Artificial
  CRISPR gRNA sequence
cccataatgaatattttgca

SEQ ID NO: 677062 - DNA, 20 bp, Artificial
  CRISPR gRNA sequence
tgcacatttgtaataatgaa

SEQ ID NO: 677063 - DNA, 20 bp, Artificial
  CRISPR gRNA sequence
gcacatttgtaataatgaaa

SEQ ID NO: 677064 - DNA, 20 bp, Artificial
  CRISPR gRNA sequence
cacatttgtaataatgaaac

SEQ ID NO: 677065 - DNA, 20 bp, Artificial
  CRISPR gRNA sequence
gtaataatgaaacagtatca

SEQ ID NO: 677066 - DNA, 20 bp, Artificial
  CRISPR gRNA sequence
taataatgaaacagtatcaa

SEQ ID NO: 677067 - DNA, 20 bp, Artificial
  CRISPR gRNA sequence
ctgtttcccttgtgtcttag

SEQ ID NO: 677068 - DNA, 20 bp, Artificial
  CRISPR gRNA sequence
tttcccttgtgtcttagatt

SEQ ID NO: 677069 - DNA, 20 bp, Artificial
  CRISPR gRNA sequence
cccttgtgtcttagatttta

SEQ ID NO: 677070 - DNA, 20 bp, Artificial
  CRISPR gRNA sequence
ccttgtgtcttagattttac

SEQ ID NO: 677071 - DNA, 20 bp, Artificial
  CRISPR gRNA sequence
gtgtcttagattttactgta

SEQ ID NO: 677072 - DNA, 20 bp, Artificial
  CRISPR gRNA sequence
tgtcttagattttactgtac

SEQ ID NO: 677073 - DNA, 20 bp, Artificial
  CRISPR gRNA sequence
agattttactgtaccatctc

SEQ ID NO: 677074 - DNA, 20 bp, Artificial
  CRISPR gRNA sequence
gattttactgtaccatctcc

SEQ ID NO: 677075 - DNA, 20 bp, Artificial
  CRISPR gRNA sequence
tactgtaccatctcctggcc

SEQ ID NO: 677076 - DNA, 20 bp, Artificial
  CRISPR gRNA sequence
actgtaccatctcctggcca

SEQ ID NO: 677077 - DNA, 20 bp, Artificial
  CRISPR gRNA sequence
ctgtaccatctcctggccac

SEQ ID NO: 677078 - DNA, 20 bp, Artificial
  CRISPR gRNA sequence
taccatctcctggccacatt

SEQ ID NO: 677079 - DNA, 20 bp, Artificial
  CRISPR gRNA sequence
ctggccacattaaaactttt

SEQ ID NO: 677080 - DNA, 20 bp, Artificial
  CRISPR gRNA sequence
gccacattaaaactttttgc

SEQ ID NO: 677081 - DNA, 20 bp, Artificial
  CRISPR gRNA sequence
aaactttttgcacctttata

SEQ ID NO: 677082 - DNA, 20 bp, Artificial
  CRISPR gRNA sequence
tttgcacctttatactttct

SEQ ID NO: 677083 - DNA, 20 bp, Artificial
  CRISPR gRNA sequence
ttgcacctttatactttctc

SEQ ID NO: 677084 - DNA, 20 bp, Artificial
  CRISPR gRNA sequence
tgcacctttatactttctct

SEQ ID NO: 677085 - DNA, 20 bp, Artificial
  CRISPR gRNA sequence
gcacctttatactttctcta

SEQ ID NO: 677086 - DNA, 20 bp, Artificial
  CRISPR gRNA sequence
cacctttatactttctctag

SEQ ID NO: 677087 - DNA, 20 bp, Artificial
  CRISPR gRNA sequence
tatactttctctagctcttt

SEQ ID NO: 677088 - DNA, 20 bp, Artificial
  CRISPR gRNA sequence
atactttctctagctctttt

SEQ ID NO: 677089 - DNA, 20 bp, Artificial
  CRISPR gRNA sequence
tactttctctagctcttttt

SEQ ID NO: 677090 - DNA, 20 bp, Artificial
  CRISPR gRNA sequence
tctctagctctttttcctaa

SEQ ID NO: 677091 - DNA, 20 bp, Artificial
  CRISPR gRNA sequence
ctctagctctttttcctaaa

SEQ ID NO: 677092 - DNA, 20 bp, Artificial
  CRISPR gRNA sequence
tctagctctttttcctaaat

SEQ ID NO: 677093 - DNA, 20 bp, Artificial
  CRISPR gRNA sequence
tagctctttttcctaaattc

SEQ ID NO: 677094 - DNA, 20 bp, Artificial
  CRISPR gRNA sequence
gctctttttcctaaattcat

SEQ ID NO: 677095 - DNA, 20 bp, Artificial
  CRISPR gRNA sequence
tttttcctaaattcatcaac

SEQ ID NO: 677096 - DNA, 20 bp, Artificial
  CRISPR gRNA sequence
tttcctaaattcatcaacca

SEQ ID NO: 677097 - DNA, 20 bp, Artificial
  CRISPR gRNA sequence
ttcctaaattcatcaaccaa

SEQ ID NO: 677098 - DNA, 20 bp, Artificial
  CRISPR gRNA sequence
tcctaaattcatcaaccaat

SEQ ID NO: 677099 - DNA, 20 bp, Artificial
  CRISPR gRNA sequence
cctaaattcatcaaccaatc

SEQ ID NO: 677100 - DNA, 20 bp, Artificial
  CRISPR gRNA sequence
ctaaattcatcaaccaatct

SEQ ID NO: 677101 - DNA, 20 bp, Artificial
  CRISPR gRNA sequence
aattcatcaaccaatctgtt

SEQ ID NO: 677102 - DNA, 20 bp, Artificial
  CRISPR gRNA sequence
atcaaccaatctgttaaatg

SEQ ID NO: 677103 - DNA, 20 bp, Artificial
  CRISPR gRNA sequence
ttaaatgacttatgttacac

SEQ ID NO: 677104 - DNA, 20 bp, Artificial
  CRISPR gRNA sequence
aatgacttatgttacactta

SEQ ID NO: 677105 - DNA, 20 bp, Artificial
  CRISPR gRNA sequence
atgttacacttacagtgaaa

SEQ ID NO: 677106 - DNA, 20 bp, Artificial
  CRISPR gRNA sequence
tgttacacttacagtgaaag

SEQ ID NO: 677107 - DNA, 20 bp, Artificial
  CRISPR gRNA sequence
cacttacagtgaaagaagtg

SEQ ID NO: 677108 - DNA, 20 bp, Artificial
  CRISPR gRNA sequence
acagtgaaagaagtgagcat

SEQ ID NO: 677109 - DNA, 20 bp, Artificial
  CRISPR gRNA sequence
cagtgaaagaagtgagcatc

SEQ ID NO: 677110 - DNA, 20 bp, Artificial
  CRISPR gRNA sequence
ggggttaaatggtttttgaa

SEQ ID NO: 677111 - DNA, 20 bp, Artificial
  CRISPR gRNA sequence
aatggtttttgaatataatg

SEQ ID NO: 677112 - DNA, 20 bp, Artificial
  CRISPR gRNA sequence
ttgaatataatgtttattat

SEQ ID NO: 677113 - DNA, 20 bp, Artificial
  CRISPR gRNA sequence
tgaatataatgtttattatt

SEQ ID NO: 677114 - DNA, 20 bp, Artificial
  CRISPR gRNA sequence
gaatataatgtttattatta

SEQ ID NO: 677115 - DNA, 20 bp, Artificial
  CRISPR gRNA sequence
aatataatgtttattattat

SEQ ID NO: 677116 - DNA, 20 bp, Artificial
  CRISPR gRNA sequence
attattatgattatatatgc

SEQ ID NO: 677117 - DNA, 20 bp, Artificial
  CRISPR gRNA sequence
ttattatgattatatatgcc

SEQ ID NO: 677118 - DNA, 20 bp, Artificial
  CRISPR gRNA sequence
ttatgattatatatgccaca

SEQ ID NO: 677119 - DNA, 20 bp, Artificial
  CRISPR gRNA sequence
tgattatatatgccacattt

SEQ ID NO: 677120 - DNA, 20 bp, Artificial
  CRISPR gRNA sequence
tatatgccacattttaggca

SEQ ID NO: 677121 - DNA, 20 bp, Artificial
  CRISPR gRNA sequence
taggcagctggtaaatacat

SEQ ID NO: 677122 - DNA, 20 bp, Artificial
  CRISPR gRNA sequence
aggcagctggtaaatacatg

SEQ ID NO: 677123 - DNA, 20 bp, Artificial
  CRISPR gRNA sequence
ggcagctggtaaatacatgt

SEQ ID NO: 677124 - DNA, 20 bp, Artificial
  CRISPR gRNA sequence
gtaaatacatgttgtatgaa

SEQ ID NO: 677125 - DNA, 20 bp, Artificial
  CRISPR gRNA sequence
tatgaataaacaattgatat

SEQ ID NO: 677126 - DNA, 20 bp, Artificial
  CRISPR gRNA sequence
atatgtatatatttttaaca

SEQ ID NO: 677127 - DNA, 20 bp, Artificial
  CRISPR gRNA sequence
ttaacagaagtgtaaaaatt

SEQ ID NO: 677128 - DNA, 20 bp, Artificial
  CRISPR gRNA sequence
taacagaagtgtaaaaattt

SEQ ID NO: 677129 - DNA, 20 bp, Artificial
  CRISPR gRNA sequence
aacagaagtgtaaaaattta

SEQ ID NO: 677130 - DNA, 20 bp, Artificial
  CRISPR gRNA sequence
acagaagtgtaaaaatttag

SEQ ID NO: 677131 - DNA, 20 bp, Artificial
  CRISPR gRNA sequence
agagagattaagcatctact

SEQ ID NO: 677132 - DNA, 20 bp, Artificial
  CRISPR gRNA sequence
gagagattaagcatctactt

SEQ ID NO: 677133 - DNA, 20 bp, Artificial
  CRISPR gRNA sequence
agcatctacttccatttatt

SEQ ID NO: 677134 - DNA, 20 bp, Artificial
  CRISPR gRNA sequence
cttccatttattgtttaatt

SEQ ID NO: 677135 - DNA, 20 bp, Artificial
  CRISPR gRNA sequence
ccatttattgtttaattatt

SEQ ID NO: 677136 - DNA, 20 bp, Artificial
  CRISPR gRNA sequence
catttattgtttaattattt

SEQ ID NO: 677137 - DNA, 20 bp, Artificial
  CRISPR gRNA sequence
attgtttaattattttatta

SEQ ID NO: 677138 - DNA, 20 bp, Artificial
  CRISPR gRNA sequence
ttgtttaattattttattag

SEQ ID NO: 677139 - DNA, 20 bp, Artificial
  CRISPR gRNA sequence
tttaattattttattagcaa

SEQ ID NO: 677140 - DNA, 20 bp, Artificial
  CRISPR gRNA sequence
aattattttattagcaatgt

SEQ ID NO: 677141 - DNA, 20 bp, Artificial
  CRISPR gRNA sequence
attattttattagcaatgtt

SEQ ID NO: 677142 - DNA, 20 bp, Artificial
  CRISPR gRNA sequence
ttttattagcaatgttcaaa

SEQ ID NO: 677143 - DNA, 20 bp, Artificial
  CRISPR gRNA sequence
tattagcaatgttcaaaata

SEQ ID NO: 677144 - DNA, 20 bp, Artificial
  CRISPR gRNA sequence
attagcaatgttcaaaataa

SEQ ID NO: 677145 - DNA, 20 bp, Artificial
  CRISPR gRNA sequence
ttagcaatgttcaaaataag

SEQ ID NO: 677146 - DNA, 20 bp, Artificial
  CRISPR gRNA sequence
gcaatgttcaaaataagcaa

SEQ ID NO: 677147 - DNA, 20 bp, Artificial
  CRISPR gRNA sequence
aaaataagcaataaaatatt

SEQ ID NO: 677148 - DNA, 20 bp, Artificial
  CRISPR gRNA sequence
tatgtggtaaggaaatgctg

SEQ ID NO: 677149 - DNA, 20 bp, Artificial
  CRISPR gRNA sequence
atgtggtaaggaaatgctgg

SEQ ID NO: 677150 - DNA, 20 bp, Artificial
  CRISPR gRNA sequence
tgtggtaaggaaatgctggg

SEQ ID NO: 677151 - DNA, 20 bp, Artificial
  CRISPR gRNA sequence
gggaagcataactgttacac

SEQ ID NO: 677152 - DNA, 20 bp, Artificial
  CRISPR gRNA sequence
ttacactgccaaaatatgtt

SEQ ID NO: 677153 - DNA, 20 bp, Artificial
  CRISPR gRNA sequence
cactgccaaaatatgttaca

SEQ ID NO: 677154 - DNA, 20 bp, Artificial
  CRISPR gRNA sequence
ccaaaatatgttacaatgta

SEQ ID NO: 677155 - DNA, 20 bp, Artificial
  CRISPR gRNA sequence
caatgtatattttgcttcgt

SEQ ID NO: 677156 - DNA, 20 bp, Artificial
  CRISPR gRNA sequence
tgcttcgtcccattttgctt

SEQ ID NO: 677157 - DNA, 20 bp, Artificial
  CRISPR gRNA sequence
gcttcgtcccattttgcttc

SEQ ID NO: 677158 - DNA, 20 bp, Artificial
  CRISPR gRNA sequence
cttcgtcccattttgcttcc

SEQ ID NO: 677159 - DNA, 20 bp, Artificial
  CRISPR gRNA sequence
cgtcccattttgcttcctta

SEQ ID NO: 677160 - DNA, 20 bp, Artificial
  CRISPR gRNA sequence
gtcccattttgcttccttat

SEQ ID NO: 677161 - DNA, 20 bp, Artificial
  CRISPR gRNA sequence
tgcttccttattttaggtgt

SEQ ID NO: 677162 - DNA, 20 bp, Artificial
  CRISPR gRNA sequence
gcttccttattttaggtgtt

SEQ ID NO: 677163 - DNA, 20 bp, Artificial
  CRISPR gRNA sequence
cttccttattttaggtgtta

SEQ ID NO: 677164 - DNA, 20 bp, Artificial
  CRISPR gRNA sequence
ccttattttaggtgttaagt

SEQ ID NO: 677165 - DNA, 20 bp, Artificial
  CRISPR gRNA sequence
cttattttaggtgttaagtt

SEQ ID NO: 677166 - DNA, 20 bp, Artificial
  CRISPR gRNA sequence
attttaggtgttaagttcaa

SEQ ID NO: 677167 - DNA, 20 bp, Artificial
  CRISPR gRNA sequence
ttttaggtgttaagttcaag

SEQ ID NO: 677168 - DNA, 20 bp, Artificial
  CRISPR gRNA sequence
taggtgttaagttcaagaaa

SEQ ID NO: 677169 - DNA, 20 bp, Artificial
  CRISPR gRNA sequence
aggtgttaagttcaagaaat

SEQ ID NO: 677170 - DNA, 20 bp, Artificial
  CRISPR gRNA sequence
ggtgttaagttcaagaaatc

SEQ ID NO: 677171 - DNA, 20 bp, Artificial
  CRISPR gRNA sequence
agttcaagaaatctgaggaa

SEQ ID NO: 677172 - DNA, 20 bp, Artificial
  CRISPR gRNA sequence
aagaaatctgaggaaatgtg

SEQ ID NO: 677173 - DNA, 20 bp, Artificial
  CRISPR gRNA sequence
aggaaatgtgttaacttaaa

SEQ ID NO: 677174 - DNA, 20 bp, Artificial
  CRISPR gRNA sequence
acttaaagtgatagaaaagt

SEQ ID NO: 677175 - DNA, 20 bp, Artificial
  CRISPR gRNA sequence
aaagtgatagaaaagtagat

SEQ ID NO: 677176 - DNA, 20 bp, Artificial
  CRISPR gRNA sequence
aagtgatagaaaagtagatg

SEQ ID NO: 677177 - DNA, 20 bp, Artificial
  CRISPR gRNA sequence
agactcttataaaaataatc

SEQ ID NO: 677178 - DNA, 20 bp, Artificial
  CRISPR gRNA sequence
gactcttataaaaataatct

SEQ ID NO: 677179 - DNA, 20 bp, Artificial
  CRISPR gRNA sequence
ttataaaaataatcttacat

SEQ ID NO: 677180 - DNA, 20 bp, Artificial
  CRISPR gRNA sequence
ataaaaataatcttacataa

SEQ ID NO: 677181 - DNA, 20 bp, Artificial
  CRISPR gRNA sequence
taaaaataatcttacataag

SEQ ID NO: 677182 - DNA, 20 bp, Artificial
  CRISPR gRNA sequence
acataagacattttcttgtt

SEQ ID NO: 677183 - DNA, 20 bp, Artificial
  CRISPR gRNA sequence
cataagacattttcttgttt

SEQ ID NO: 677184 - DNA, 20 bp, Artificial
  CRISPR gRNA sequence
tcttgtttgaattgtgacta

SEQ ID NO: 677185 - DNA, 20 bp, Artificial
  CRISPR gRNA sequence
cttgtttgaattgtgactat

SEQ ID NO: 677186 - DNA, 20 bp, Artificial
  CRISPR gRNA sequence
ttgtttgaattgtgactatt

SEQ ID NO: 677187 - DNA, 20 bp, Artificial
  CRISPR gRNA sequence
gtttgaattgtgactatttt

SEQ ID NO: 677188 - DNA, 20 bp, Artificial
  CRISPR gRNA sequence
tttgaattgtgactattttt

SEQ ID NO: 677189 - DNA, 20 bp, Artificial
  CRISPR gRNA sequence
gaattgtgactatttttctt

SEQ ID NO: 677190 - DNA, 20 bp, Artificial
  CRISPR gRNA sequence
aattgtgactatttttcttc

SEQ ID NO: 677191 - DNA, 20 bp, Artificial
  CRISPR gRNA sequence
tgactatttttcttccagag

SEQ ID NO: 677192 - DNA, 20 bp, Artificial
  CRISPR gRNA sequence
tttttcttccagagtgccca

SEQ ID NO: 677193 - DNA, 20 bp, Artificial
  CRISPR gRNA sequence
ttcttccagagtgcccaaaa

SEQ ID NO: 677194 - DNA, 20 bp, Artificial
  CRISPR gRNA sequence
tcttccagagtgcccaaaac

SEQ ID NO: 677195 - DNA, 20 bp, Artificial
  CRISPR gRNA sequence
cttccagagtgcccaaaaca

SEQ ID NO: 677196 - DNA, 20 bp, Artificial
  CRISPR gRNA sequence
ttccagagtgcccaaaacaa

SEQ ID NO: 677197 - DNA, 20 bp, Artificial
  CRISPR gRNA sequence
ccagagtgcccaaaacaata

SEQ ID NO: 677198 - DNA, 20 bp, Artificial
  CRISPR gRNA sequence
cagagtgcccaaaacaataa

SEQ ID NO: 677199 - DNA, 20 bp, Artificial
  CRISPR gRNA sequence
tcttttgctttcaaatgtct

SEQ ID NO: 677200 - DNA, 20 bp, Artificial
  CRISPR gRNA sequence
cttttgctttcaaatgtctg

SEQ ID NO: 677201 - DNA, 20 bp, Artificial
  CRISPR gRNA sequence
ttttgctttcaaatgtctgt

SEQ ID NO: 677202 - DNA, 20 bp, Artificial
  CRISPR gRNA sequence
ttgctttcaaatgtctgtga

SEQ ID NO: 677203 - DNA, 20 bp, Artificial
  CRISPR gRNA sequence
tgctttcaaatgtctgtgat

SEQ ID NO: 677204 - DNA, 20 bp, Artificial
  CRISPR gRNA sequence
gctttcaaatgtctgtgatt

SEQ ID NO: 677205 - DNA, 20 bp, Artificial
  CRISPR gRNA sequence
ctttcaaatgtctgtgattt

SEQ ID NO: 677206 - DNA, 20 bp, Artificial
  CRISPR gRNA sequence
tcaaatgtctgtgattttac

SEQ ID NO: 677207 - DNA, 20 bp, Artificial
  CRISPR gRNA sequence
caaatgtctgtgattttact

SEQ ID NO: 677208 - DNA, 20 bp, Artificial
  CRISPR gRNA sequence
aaatgtctgtgattttactt

SEQ ID NO: 677209 - DNA, 20 bp, Artificial
  CRISPR gRNA sequence
tgattttactttaaaggtcc

SEQ ID NO: 677210 - DNA, 20 bp, Artificial
  CRISPR gRNA sequence
tactttaaaggtcccataca

SEQ ID NO: 677211 - DNA, 20 bp, Artificial
  CRISPR gRNA sequence
actttaaaggtcccatacat

SEQ ID NO: 677212 - DNA, 20 bp, Artificial
  CRISPR gRNA sequence
ctttaaaggtcccatacata

SEQ ID NO: 677213 - DNA, 20 bp, Artificial
  CRISPR gRNA sequence
taaaggtcccatacatactt

SEQ ID NO: 677214 - DNA, 20 bp, Artificial
  CRISPR gRNA sequence
aaaggtcccatacatacttt

SEQ ID NO: 677215 - DNA, 20 bp, Artificial
  CRISPR gRNA sequence
aaggtcccatacatactttt

SEQ ID NO: 677216 - DNA, 20 bp, Artificial
  CRISPR gRNA sequence
ttttatatacaatttttcct

SEQ ID NO: 677217 - DNA, 20 bp, Artificial
  CRISPR gRNA sequence
tttatatacaatttttcctg

SEQ ID NO: 677218 - DNA, 20 bp, Artificial
  CRISPR gRNA sequence
ttatatacaatttttcctgg

SEQ ID NO: 677219 - DNA, 20 bp, Artificial
  CRISPR gRNA sequence
tatatacaatttttcctggt

SEQ ID NO: 677220 - DNA, 20 bp, Artificial
  CRISPR gRNA sequence
atatacaatttttcctggtg

SEQ ID NO: 677221 - DNA, 20 bp, Artificial
  CRISPR gRNA sequence
tatacaatttttcctggtgt

SEQ ID NO: 677222 - DNA, 20 bp, Artificial
  CRISPR gRNA sequence
ttcctggtgtttgtgtcctg

SEQ ID NO: 677223 - DNA, 20 bp, Artificial
  CRISPR gRNA sequence
tcctggtgtttgtgtcctgt

SEQ ID NO: 677224 - DNA, 20 bp, Artificial
  CRISPR gRNA sequence
cctggtgtttgtgtcctgta

SEQ ID NO: 677225 - DNA, 20 bp, Artificial
  CRISPR gRNA sequence
ctggtgtttgtgtcctgtat

SEQ ID NO: 677226 - DNA, 20 bp, Artificial
  CRISPR gRNA sequence
gtgtttgtgtcctgtataag

SEQ ID NO: 677227 - DNA, 20 bp, Artificial
  CRISPR gRNA sequence
gtgtcctgtataagattttc

SEQ ID NO: 677228 - DNA, 20 bp, Artificial
  CRISPR gRNA sequence
tgtcctgtataagattttca

SEQ ID NO: 677229 - DNA, 20 bp, Artificial
  CRISPR gRNA sequence
tataagattttcagtttact

SEQ ID NO: 677230 - DNA, 20 bp, Artificial
  CRISPR gRNA sequence
tcagtttactttgaacattg

SEQ ID NO: 677231 - DNA, 20 bp, Artificial
  CRISPR gRNA sequence
cagtttactttgaacattgt

SEQ ID NO: 677232 - DNA, 20 bp, Artificial
  CRISPR gRNA sequence
agtttactttgaacattgtt

SEQ ID NO: 677233 - DNA, 20 bp, Artificial
  CRISPR gRNA sequence
actttgaacattgttattac

SEQ ID NO: 677234 - DNA, 20 bp, Artificial
  CRISPR gRNA sequence
ctttgaacattgttattaca

SEQ ID NO: 677235 - DNA, 20 bp, Artificial
  CRISPR gRNA sequence
tgaacattgttattacatta

SEQ ID NO: 677236 - DNA, 20 bp, Artificial
  CRISPR gRNA sequence
gaacattgttattacattat

SEQ ID NO: 677237 - DNA, 20 bp, Artificial
  CRISPR gRNA sequence
aacattgttattacattata

SEQ ID NO: 677238 - DNA, 20 bp, Artificial
  CRISPR gRNA sequence
ttattacattataaaacaaa

SEQ ID NO: 677239 - DNA, 20 bp, Artificial
  CRISPR gRNA sequence
ttacattataaaacaaatgg

SEQ ID NO: 677240 - DNA, 20 bp, Artificial
  CRISPR gRNA sequence
cattataaaacaaatggcaa

SEQ ID NO: 677241 - DNA, 20 bp, Artificial
  CRISPR gRNA sequence
taaaacaaatggcaatattt

SEQ ID NO: 677242 - DNA, 20 bp, Artificial
  CRISPR gRNA sequence
ggatggttaataatgttagc

SEQ ID NO: 677243 - DNA, 20 bp, Artificial
  CRISPR gRNA sequence
gatggttaataatgttagct

SEQ ID NO: 677244 - DNA, 20 bp, Artificial
  CRISPR gRNA sequence
ataatgttagctctgtggat

SEQ ID NO: 677245 - DNA, 20 bp, Artificial
  CRISPR gRNA sequence
gctctgtggatgcaggaatg

SEQ ID NO: 677246 - DNA, 20 bp, Artificial
  CRISPR gRNA sequence
tgtggatgcaggaatgacat

SEQ ID NO: 677247 - DNA, 20 bp, Artificial
  CRISPR gRNA sequence
tggatgcaggaatgacattt

SEQ ID NO: 677248 - DNA, 20 bp, Artificial
  CRISPR gRNA sequence
gtctcgttcagtgctgtatc

SEQ ID NO: 677249 - DNA, 20 bp, Artificial
  CRISPR gRNA sequence
tctcgttcagtgctgtatct

SEQ ID NO: 677250 - DNA, 20 bp, Artificial
  CRISPR gRNA sequence
gttcagtgctgtatctacag

SEQ ID NO: 677251 - DNA, 20 bp, Artificial
  CRISPR gRNA sequence
agtgctgtatctacagcacc

SEQ ID NO: 677252 - DNA, 20 bp, Artificial
  CRISPR gRNA sequence
tatctacagcacctagaacg

SEQ ID NO: 677253 - DNA, 20 bp, Artificial
  CRISPR gRNA sequence
cagcacctagaacgtggaca

SEQ ID NO: 677254 - DNA, 20 bp, Artificial
  CRISPR gRNA sequence
gaacgtggacatggaatact

SEQ ID NO: 677255 - DNA, 20 bp, Artificial
  CRISPR gRNA sequence
gaggtgctcaagaaatttat

SEQ ID NO: 677256 - DNA, 20 bp, Artificial
  CRISPR gRNA sequence
aagaaatttatgttaaagga

SEQ ID NO: 677257 - DNA, 20 bp, Artificial
  CRISPR gRNA sequence
atgttaaaggaactagatgt

SEQ ID NO: 677258 - DNA, 20 bp, Artificial
  CRISPR gRNA sequence
tgttaaaggaactagatgtc

SEQ ID NO: 677259 - DNA, 20 bp, Artificial
  CRISPR gRNA sequence
aaggaactagatgtctttgc

SEQ ID NO: 677260 - DNA, 20 bp, Artificial
  CRISPR gRNA sequence
gatgtctttgctcaacacct

SEQ ID NO: 677261 - DNA, 20 bp, Artificial
  CRISPR gRNA sequence
tgctcaacacctggcacatc

SEQ ID NO: 677262 - DNA, 20 bp, Artificial
  CRISPR gRNA sequence
gctcaacacctggcacatcc

SEQ ID NO: 677263 - DNA, 20 bp, Artificial
  CRISPR gRNA sequence
ctcaacacctggcacatcct

SEQ ID NO: 677264 - DNA, 20 bp, Artificial
  CRISPR gRNA sequence
aacacctggcacatcctgtt

SEQ ID NO: 677265 - DNA, 20 bp, Artificial
  CRISPR gRNA sequence
gcacatcctgttaaagaaga

SEQ ID NO: 677266 - DNA, 20 bp, Artificial
  CRISPR gRNA sequence
ttaaagaagagtaaacagta

SEQ ID NO: 677267 - DNA, 20 bp, Artificial
  CRISPR gRNA sequence
aagaagagtaaacagtatta

SEQ ID NO: 677268 - DNA, 20 bp, Artificial
  CRISPR gRNA sequence
acacagcctggcgcagtggc

SEQ ID NO: 677269 - DNA, 20 bp, Artificial
  CRISPR gRNA sequence
gcgcagtggcacacgcctgt

SEQ ID NO: 677270 - DNA, 20 bp, Artificial
  CRISPR gRNA sequence
taatcccagcactttgggag

SEQ ID NO: 677271 - DNA, 20 bp, Artificial
  CRISPR gRNA sequence
tgggaggctgaggcgggcgg

SEQ ID NO: 677272 - DNA, 20 bp, Artificial
  CRISPR gRNA sequence
gggaggctgaggcgggcgga

SEQ ID NO: 677273 - DNA, 20 bp, Artificial
  CRISPR gRNA sequence
ggaggctgaggcgggcggat

SEQ ID NO: 677274 - DNA, 20 bp, Artificial
  CRISPR gRNA sequence
aggcgggcggatcacttgag

SEQ ID NO: 677275 - DNA, 20 bp, Artificial
  CRISPR gRNA sequence
gaggtcaggagttcaagacc

SEQ ID NO: 677276 - DNA, 20 bp, Artificial
  CRISPR gRNA sequence
aggtcaggagttcaagacca

SEQ ID NO: 677277 - DNA, 20 bp, Artificial
  CRISPR gRNA sequence
aagaccagcctggccaacgt

SEQ ID NO: 677278 - DNA, 20 bp, Artificial
  CRISPR gRNA sequence
gccaacgtggtgaaaccccg

SEQ ID NO: 677279 - DNA, 20 bp, Artificial
  CRISPR gRNA sequence
tactaaaaatacaaaaatta

SEQ ID NO: 677280 - DNA, 20 bp, Artificial
  CRISPR gRNA sequence
ctaaaaatacaaaaattagc

SEQ ID NO: 677281 - DNA, 20 bp, Artificial
  CRISPR gRNA sequence
aaaatacaaaaattagccag

SEQ ID NO: 677282 - DNA, 20 bp, Artificial
  CRISPR gRNA sequence
gccagacgtggtggcacgtg

SEQ ID NO: 677283 - DNA, 20 bp, Artificial
  CRISPR gRNA sequence
tagtcccagctactcaggag

SEQ ID NO: 677284 - DNA, 20 bp, Artificial
  CRISPR gRNA sequence
ctcaggaggctgaggctgga

SEQ ID NO: 677285 - DNA, 20 bp, Artificial
  CRISPR gRNA sequence
aggaggctgaggctggagaa

SEQ ID NO: 677286 - DNA, 20 bp, Artificial
  CRISPR gRNA sequence
aggctggagaatcatttgaa

SEQ ID NO: 677287 - DNA, 20 bp, Artificial
  CRISPR gRNA sequence
gagaatcatttgaacccagg

SEQ ID NO: 677288 - DNA, 20 bp, Artificial
  CRISPR gRNA sequence
gaacccaggaggtggaggtt

SEQ ID NO: 677289 - DNA, 20 bp, Artificial
  CRISPR gRNA sequence
aacccaggaggtggaggttg

SEQ ID NO: 677290 - DNA, 20 bp, Artificial
  CRISPR gRNA sequence
cagtgatccgaggtggcacc

SEQ ID NO: 677291 - DNA, 20 bp, Artificial
  CRISPR gRNA sequence
ctgccctccagtctgggcga

SEQ ID NO: 677292 - DNA, 20 bp, Artificial
  CRISPR gRNA sequence
ccctccagtctgggcgacag

SEQ ID NO: 677293 - DNA, 20 bp, Artificial
  CRISPR gRNA sequence
cagtctgggcgacagagcga

SEQ ID NO: 677294 - DNA, 20 bp, Artificial
  CRISPR gRNA sequence
ggcgacagagcgagactcca

SEQ ID NO: 677295 - DNA, 20 bp, Artificial
  CRISPR gRNA sequence
catctcaccaaacaaaaaaa

SEQ ID NO: 677296 - DNA, 20 bp, Artificial
  CRISPR gRNA sequence
accaaacaaaaaaaaaaaaa

SEQ ID NO: 677297 - DNA, 20 bp, Artificial
  CRISPR gRNA sequence
atgctggctttttttttgcc

SEQ ID NO: 677298 - DNA, 20 bp, Artificial
  CRISPR gRNA sequence
gctttttttttgcctctttt

SEQ ID NO: 677299 - DNA, 20 bp, Artificial
  CRISPR gRNA sequence
tttttttgcctcttttattg

SEQ ID NO: 677300 - DNA, 20 bp, Artificial
  CRISPR gRNA sequence
ttttttgcctcttttattgt

SEQ ID NO: 677301 - DNA, 20 bp, Artificial
  CRISPR gRNA sequence
tttttgcctcttttattgtc

SEQ ID NO: 677302 - DNA, 20 bp, Artificial
  CRISPR gRNA sequence
ttttgcctcttttattgtca

SEQ ID NO: 677303 - DNA, 20 bp, Artificial
  CRISPR gRNA sequence
tttgcctcttttattgtcat

SEQ ID NO: 677304 - DNA, 20 bp, Artificial
  CRISPR gRNA sequence
ttgcctcttttattgtcata

SEQ ID NO: 677305 - DNA, 20 bp, Artificial
  CRISPR gRNA sequence
tgcctcttttattgtcataa

SEQ ID NO: 677306 - DNA, 20 bp, Artificial
  CRISPR gRNA sequence
gcctcttttattgtcataat

SEQ ID NO: 677307 - DNA, 20 bp, Artificial
  CRISPR gRNA sequence
cctcttttattgtcataatg

SEQ ID NO: 677308 - DNA, 20 bp, Artificial
  CRISPR gRNA sequence
ttttattgtcataatgcagt

SEQ ID NO: 677309 - DNA, 20 bp, Artificial
  CRISPR gRNA sequence
ttattgtcataatgcagtgt

SEQ ID NO: 677310 - DNA, 20 bp, Artificial
  CRISPR gRNA sequence
tattgtcataatgcagtgtt

SEQ ID NO: 677311 - DNA, 20 bp, Artificial
  CRISPR gRNA sequence
attgtcataatgcagtgttc

SEQ ID NO: 677312 - DNA, 20 bp, Artificial
  CRISPR gRNA sequence
ttgtcataatgcagtgttct

SEQ ID NO: 677313 - DNA, 20 bp, Artificial
  CRISPR gRNA sequence
tcataatgcagtgttcttca

SEQ ID NO: 677314 - DNA, 20 bp, Artificial
  CRISPR gRNA sequence
ttcacagtatgttcacaaaa

SEQ ID NO: 677315 - DNA, 20 bp, Artificial
  CRISPR gRNA sequence
cacagtatgttcacaaaaaa

SEQ ID NO: 677316 - DNA, 20 bp, Artificial
  CRISPR gRNA sequence
acagtatgttcacaaaaaaa

SEQ ID NO: 677317 - DNA, 20 bp, Artificial
  CRISPR gRNA sequence
acaaaaaaatatttacttgc

SEQ ID NO: 677318 - DNA, 20 bp, Artificial
  CRISPR gRNA sequence
acttgcgaaattaatagttg

SEQ ID NO: 677319 - DNA, 20 bp, Artificial
  CRISPR gRNA sequence
cttgcgaaattaatagttgc

SEQ ID NO: 677320 - DNA, 20 bp, Artificial
  CRISPR gRNA sequence
gcgaaattaatagttgctaa

SEQ ID NO: 677321 - DNA, 20 bp, Artificial
  CRISPR gRNA sequence
cgaaattaatagttgctaaa

SEQ ID NO: 677322 - DNA, 20 bp, Artificial
  CRISPR gRNA sequence
atagttgctaaaataaaaaa

SEQ ID NO: 677323 - DNA, 20 bp, Artificial
  CRISPR gRNA sequence
ctaaaataaaaaattgtact

SEQ ID NO: 677324 - DNA, 20 bp, Artificial
  CRISPR gRNA sequence
aaataaaaaattgtactata

SEQ ID NO: 677325 - DNA, 20 bp, Artificial
  CRISPR gRNA sequence
tactatatttagtttttttg

SEQ ID NO: 677326 - DNA, 20 bp, Artificial
  CRISPR gRNA sequence
tatttagtttttttggaaaa

SEQ ID NO: 677327 - DNA, 20 bp, Artificial
  CRISPR gRNA sequence
agtttttttggaaaacgttg

SEQ ID NO: 677328 - DNA, 20 bp, Artificial
  CRISPR gRNA sequence
gtttttttggaaaacgttgg

SEQ ID NO: 677329 - DNA, 20 bp, Artificial
  CRISPR gRNA sequence
ttttggaaaacgttgggtta

SEQ ID NO: 677330 - DNA, 20 bp, Artificial
  CRISPR gRNA sequence
tttggaaaacgttgggttaa

SEQ ID NO: 677331 - DNA, 20 bp, Artificial
  CRISPR gRNA sequence
ttggaaaacgttgggttaaa

SEQ ID NO: 677332 - DNA, 20 bp, Artificial
  CRISPR gRNA sequence
tggaaaacgttgggttaaat

SEQ ID NO: 677333 - DNA, 20 bp, Artificial
  CRISPR gRNA sequence
ggaaaacgttgggttaaata

SEQ ID NO: 677334 - DNA, 20 bp, Artificial
  CRISPR gRNA sequence
gaaaacgttgggttaaataa

SEQ ID NO: 677335 - DNA, 20 bp, Artificial
  CRISPR gRNA sequence
ggttaaataagttttgtctg

SEQ ID NO: 677336 - DNA, 20 bp, Artificial
  CRISPR gRNA sequence
aataagttttgtctgtttgc

SEQ ID NO: 677337 - DNA, 20 bp, Artificial
  CRISPR gRNA sequence
tgtctgtttgcttttttgtt

SEQ ID NO: 677338 - DNA, 20 bp, Artificial
  CRISPR gRNA sequence
gtctgtttgcttttttgtta

SEQ ID NO: 677339 - DNA, 20 bp, Artificial
  CRISPR gRNA sequence
tctgtttgcttttttgttat

SEQ ID NO: 677340 - DNA, 20 bp, Artificial
  CRISPR gRNA sequence
tttgcttttttgttattgaa

SEQ ID NO: 677341 - DNA, 20 bp, Artificial
  CRISPR gRNA sequence
gcttttttgttattgaagct

SEQ ID NO: 677342 - DNA, 20 bp, Artificial
  CRISPR gRNA sequence
cttttttgttattgaagcta

SEQ ID NO: 677343 - DNA, 20 bp, Artificial
  CRISPR gRNA sequence
ttttgttattgaagctaaac

SEQ ID NO: 677344 - DNA, 20 bp, Artificial
  CRISPR gRNA sequence
tttgttattgaagctaaaca

SEQ ID NO: 677345 - DNA, 20 bp, Artificial
  CRISPR gRNA sequence
ttgttattgaagctaaacat

SEQ ID NO: 677346 - DNA, 20 bp, Artificial
  CRISPR gRNA sequence
tgttattgaagctaaacatc

SEQ ID NO: 677347 - DNA, 20 bp, Artificial
  CRISPR gRNA sequence
gttattgaagctaaacatcc

SEQ ID NO: 677348 - DNA, 20 bp, Artificial
  CRISPR gRNA sequence
ttattgaagctaaacatcca

SEQ ID NO: 677349 - DNA, 20 bp, Artificial
  CRISPR gRNA sequence
ttgaagctaaacatccaaaa

SEQ ID NO: 677350 - DNA, 20 bp, Artificial
  CRISPR gRNA sequence
aagctaaacatccaaaagaa

SEQ ID NO: 677351 - DNA, 20 bp, Artificial
  CRISPR gRNA sequence
aacatccaaaagaacctctg

SEQ ID NO: 677352 - DNA, 20 bp, Artificial
  CRISPR gRNA sequence
tgataatgctcatatacatt

SEQ ID NO: 677353 - DNA, 20 bp, Artificial
  CRISPR gRNA sequence
ataatgctcatatacattgt

SEQ ID NO: 677354 - DNA, 20 bp, Artificial
  CRISPR gRNA sequence
atatacattgtaaatctcta

SEQ ID NO: 677355 - DNA, 20 bp, Artificial
  CRISPR gRNA sequence
taaatctctaagaaatctgc

SEQ ID NO: 677356 - DNA, 20 bp, Artificial
  CRISPR gRNA sequence
taagaaatctgcattaaata

SEQ ID NO: 677357 - DNA, 20 bp, Artificial
  CRISPR gRNA sequence
agaaatctgcattaaatata

SEQ ID NO: 677358 - DNA, 20 bp, Artificial
  CRISPR gRNA sequence
cattaaatatactgtctcac

SEQ ID NO: 677359 - DNA, 20 bp, Artificial
  CRISPR gRNA sequence
aatatactgtctcacagact

SEQ ID NO: 677360 - DNA, 20 bp, Artificial
  CRISPR gRNA sequence
tctcacagacttgtttaaac

SEQ ID NO: 677361 - DNA, 20 bp, Artificial
  CRISPR gRNA sequence
acagacttgtttaaacattt

SEQ ID NO: 677362 - DNA, 20 bp, Artificial
  CRISPR gRNA sequence
gtttaaacatttaacattca

SEQ ID NO: 677363 - DNA, 20 bp, Artificial
  CRISPR gRNA sequence
tttaaacatttaacattcat

SEQ ID NO: 677364 - DNA, 20 bp, Artificial
  CRISPR gRNA sequence
aaacatttaacattcatccc

SEQ ID NO: 677365 - DNA, 20 bp, Artificial
  CRISPR gRNA sequence
aacatttaacattcatcccc

SEQ ID NO: 677366 - DNA, 20 bp, Artificial
  CRISPR gRNA sequence
aacattcatccccccaccct

SEQ ID NO: 677367 - DNA, 20 bp, Artificial
  CRISPR gRNA sequence
acattcatccccccaccctc

SEQ ID NO: 677368 - DNA, 20 bp, Artificial
  CRISPR gRNA sequence
atccccccaccctcaactac

SEQ ID NO: 677369 - DNA, 20 bp, Artificial
  CRISPR gRNA sequence
aactactttagtaaactgtc

SEQ ID NO: 677370 - DNA, 20 bp, Artificial
  CRISPR gRNA sequence
ctttagtaaactgtccttag

SEQ ID NO: 677371 - DNA, 20 bp, Artificial
  CRISPR gRNA sequence
tagtaaactgtccttagaga

SEQ ID NO: 677372 - DNA, 20 bp, Artificial
  CRISPR gRNA sequence
agtaaactgtccttagagag

SEQ ID NO: 677373 - DNA, 20 bp, Artificial
  CRISPR gRNA sequence
gtaaactgtccttagagaga

SEQ ID NO: 677374 - DNA, 20 bp, Artificial
  CRISPR gRNA sequence
tccttagagagataaaagtt

SEQ ID NO: 677375 - DNA, 20 bp, Artificial
  CRISPR gRNA sequence
agagagataaaagttatttt

SEQ ID NO: 677376 - DNA, 20 bp, Artificial
  CRISPR gRNA sequence
gagagataaaagttatttta

SEQ ID NO: 677377 - DNA, 20 bp, Artificial
  CRISPR gRNA sequence
ttttactgtaatgatttttg

SEQ ID NO: 677378 - DNA, 20 bp, Artificial
  CRISPR gRNA sequence
tactgtaatgatttttgaca

SEQ ID NO: 677379 - DNA, 20 bp, Artificial
  CRISPR gRNA sequence
actgtaatgatttttgacag

SEQ ID NO: 677380 - DNA, 20 bp, Artificial
  CRISPR gRNA sequence
ctgtaatgatttttgacaga

SEQ ID NO: 677381 - DNA, 20 bp, Artificial
  CRISPR gRNA sequence
taatgatttttgacagacac

SEQ ID NO: 677382 - DNA, 20 bp, Artificial
  CRISPR gRNA sequence
ttgacagacacctaattatc

SEQ ID NO: 677383 - DNA, 20 bp, Artificial
  CRISPR gRNA sequence
tgacagacacctaattatcc

SEQ ID NO: 677384 - DNA, 20 bp, Artificial
  CRISPR gRNA sequence
gacagacacctaattatcct

SEQ ID NO: 677385 - DNA, 20 bp, Artificial
  CRISPR gRNA sequence
acagacacctaattatcctg

SEQ ID NO: 677386 - DNA, 20 bp, Artificial
  CRISPR gRNA sequence
attatcctgaaatgatttca

SEQ ID NO: 677387 - DNA, 20 bp, Artificial
  CRISPR gRNA sequence
tcctgaaatgatttcatata

SEQ ID NO: 677388 - DNA, 20 bp, Artificial
  CRISPR gRNA sequence
aaatgatttcatataaagag

SEQ ID NO: 677389 - DNA, 20 bp, Artificial
  CRISPR gRNA sequence
catataaagagattctcttt

SEQ ID NO: 677390 - DNA, 20 bp, Artificial
  CRISPR gRNA sequence
atataaagagattctctttg

SEQ ID NO: 677391 - DNA, 20 bp, Artificial
  CRISPR gRNA sequence
tctttgaaagatatctcact

SEQ ID NO: 677392 - DNA, 20 bp, Artificial
  CRISPR gRNA sequence
tttgaaagatatctcacttt

SEQ ID NO: 677393 - DNA, 20 bp, Artificial
  CRISPR gRNA sequence
tgaaagatatctcacttttc

SEQ ID NO: 677394 - DNA, 20 bp, Artificial
  CRISPR gRNA sequence
gaaagatatctcacttttca

SEQ ID NO: 677395 - DNA, 20 bp, Artificial
  CRISPR gRNA sequence
aaagatatctcacttttcag

SEQ ID NO: 677396 - DNA, 20 bp, Artificial
  CRISPR gRNA sequence
acttttcaggtagagatctg

SEQ ID NO: 677397 - DNA, 20 bp, Artificial
  CRISPR gRNA sequence
ttcaggtagagatctgtttc

SEQ ID NO: 677398 - DNA, 20 bp, Artificial
  CRISPR gRNA sequence
tcaggtagagatctgtttcc

SEQ ID NO: 677399 - DNA, 20 bp, Artificial
  CRISPR gRNA sequence
caggtagagatctgtttcct

SEQ ID NO: 677400 - DNA, 20 bp, Artificial
  CRISPR gRNA sequence
aggtagagatctgtttcctt

SEQ ID NO: 677401 - DNA, 20 bp, Artificial
  CRISPR gRNA sequence
tttcctttctaaaatattct

SEQ ID NO: 677402 - DNA, 20 bp, Artificial
  CRISPR gRNA sequence
cctttctaaaatattctttt

SEQ ID NO: 677403 - DNA, 20 bp, Artificial
  CRISPR gRNA sequence
ctttctaaaatattcttttc

SEQ ID NO: 677404 - DNA, 20 bp, Artificial
  CRISPR gRNA sequence
tctaaaatattcttttccca

SEQ ID NO: 677405 - DNA, 20 bp, Artificial
  CRISPR gRNA sequence
ctaaaatattcttttcccac

SEQ ID NO: 677406 - DNA, 20 bp, Artificial
  CRISPR gRNA sequence
taaaatattcttttcccact

SEQ ID NO: 677407 - DNA, 20 bp, Artificial
  CRISPR gRNA sequence
aaatattcttttcccactta

SEQ ID NO: 677408 - DNA, 20 bp, Artificial
  CRISPR gRNA sequence
ttttcccacttaatcatttc

SEQ ID NO: 677409 - DNA, 20 bp, Artificial
  CRISPR gRNA sequence
ttcccacttaatcatttcat

SEQ ID NO: 677410 - DNA, 20 bp, Artificial
  CRISPR gRNA sequence
tcccacttaatcatttcatt

SEQ ID NO: 677411 - DNA, 20 bp, Artificial
  CRISPR gRNA sequence
cccacttaatcatttcatta

SEQ ID NO: 677412 - DNA, 20 bp, Artificial
  CRISPR gRNA sequence
ccacttaatcatttcattaa

SEQ ID NO: 677413 - DNA, 20 bp, Artificial
  CRISPR gRNA sequence
aatcatttcattaaaaaaat

SEQ ID NO: 677414 - DNA, 20 bp, Artificial
  CRISPR gRNA sequence
atcatttcattaaaaaaata

SEQ ID NO: 677415 - DNA, 20 bp, Artificial
  CRISPR gRNA sequence
cattaaaaaaataaacctag

SEQ ID NO: 677416 - DNA, 20 bp, Artificial
  CRISPR gRNA sequence
attaaaaaaataaacctaga

SEQ ID NO: 677417 - DNA, 20 bp, Artificial
  CRISPR gRNA sequence
aaaaaataaacctagagtca

SEQ ID NO: 677418 - DNA, 20 bp, Artificial
  CRISPR gRNA sequence
gagtcattaagacttctaaa

SEQ ID NO: 677419 - DNA, 20 bp, Artificial
  CRISPR gRNA sequence
agacttctaaagatttagaa

SEQ ID NO: 677420 - DNA, 20 bp, Artificial
  CRISPR gRNA sequence
ctaaagatttagaaaaaaaa

SEQ ID NO: 677421 - DNA, 20 bp, Artificial
  CRISPR gRNA sequence
taaagatttagaaaaaaaaa

SEQ ID NO: 677422 - DNA, 20 bp, Artificial
  CRISPR gRNA sequence
aagatttagaaaaaaaaagt

SEQ ID NO: 677423 - DNA, 20 bp, Artificial
  CRISPR gRNA sequence
agaaaaaaaaagtaggtgtg

SEQ ID NO: 677424 - DNA, 20 bp, Artificial
  CRISPR gRNA sequence
gaaaaaaaaagtaggtgtgg

SEQ ID NO: 677425 - DNA, 20 bp, Artificial
  CRISPR gRNA sequence
ctaaaaaattccatatcagg

SEQ ID NO: 677426 - DNA, 20 bp, Artificial
  CRISPR gRNA sequence
taaaaaattccatatcaggc

SEQ ID NO: 677427 - DNA, 20 bp, Artificial
  CRISPR gRNA sequence
aaaaattccatatcaggcag

SEQ ID NO: 677428 - DNA, 20 bp, Artificial
  CRISPR gRNA sequence
catatcaggcagaattttaa

SEQ ID NO: 677429 - DNA, 20 bp, Artificial
  CRISPR gRNA sequence
taaaacttaaaacagtaaag

SEQ ID NO: 677430 - DNA, 20 bp, Artificial
  CRISPR gRNA sequence
aaaacttaaaacagtaaaga

SEQ ID NO: 677431 - DNA, 20 bp, Artificial
  CRISPR gRNA sequence
aaacttaaaacagtaaagaa

SEQ ID NO: 677432 - DNA, 20 bp, Artificial
  CRISPR gRNA sequence
aaaacagtaaagaaatcaca

SEQ ID NO: 677433 - DNA, 20 bp, Artificial
  CRISPR gRNA sequence
aaacagtaaagaaatcacaa

SEQ ID NO: 677434 - DNA, 20 bp, Artificial
  CRISPR gRNA sequence
ccaacaattttgaccacaag

SEQ ID NO: 677435 - DNA, 20 bp, Artificial
  CRISPR gRNA sequence
tgaccacaagaaaatgtaaa

SEQ ID NO: 677436 - DNA, 20 bp, Artificial
  CRISPR gRNA sequence
gaccacaagaaaatgtaaaa

SEQ ID NO: 677437 - DNA, 20 bp, Artificial
  CRISPR gRNA sequence
accacaagaaaatgtaaaac

SEQ ID NO: 677438 - DNA, 20 bp, Artificial
  CRISPR gRNA sequence
taaacctcaaaaaaagcata

SEQ ID NO: 677439 - DNA, 20 bp, Artificial
  CRISPR gRNA sequence
aacctcaaaaaaagcataag

SEQ ID NO: 677440 - DNA, 20 bp, Artificial
  CRISPR gRNA sequence
aaaaaaagcataagtcaaat

SEQ ID NO: 677441 - DNA, 20 bp, Artificial
  CRISPR gRNA sequence
atatatacagagatcaattt

SEQ ID NO: 677442 - DNA, 20 bp, Artificial
  CRISPR gRNA sequence
ctgatcaatttattcagaaa

SEQ ID NO: 677443 - DNA, 20 bp, Artificial
  CRISPR gRNA sequence
tgatcaatttattcagaaag

SEQ ID NO: 677444 - DNA, 20 bp, Artificial
  CRISPR gRNA sequence
atcaatttattcagaaagac

SEQ ID NO: 677445 - DNA, 20 bp, Artificial
  CRISPR gRNA sequence
attcagaaagacaaaagcag

SEQ ID NO: 677446 - DNA, 20 bp, Artificial
  CRISPR gRNA sequence
ttcagaaagacaaaagcagt

SEQ ID NO: 677447 - DNA, 20 bp, Artificial
  CRISPR gRNA sequence
agaaagacaaaagcagtaag

SEQ ID NO: 677448 - DNA, 20 bp, Artificial
  CRISPR gRNA sequence
aaaaataggtgaaggcatga

SEQ ID NO: 677449 - DNA, 20 bp, Artificial
  CRISPR gRNA sequence
aaaataggtgaaggcatgaa

SEQ ID NO: 677450 - DNA, 20 bp, Artificial
  CRISPR gRNA sequence
gaaaggacagcaaacaaatg

SEQ ID NO: 677451 - DNA, 20 bp, Artificial
  CRISPR gRNA sequence
aaaggacagcaaacaaatgt

SEQ ID NO: 677452 - DNA, 20 bp, Artificial
  CRISPR gRNA sequence
atgatttttttgtttaatat

SEQ ID NO: 677453 - DNA, 20 bp, Artificial
  CRISPR gRNA sequence
ttttgtttaatatttcgttt

SEQ ID NO: 677454 - DNA, 20 bp, Artificial
  CRISPR gRNA sequence
tttgtttaatatttcgtttc

SEQ ID NO: 677455 - DNA, 20 bp, Artificial
  CRISPR gRNA sequence
ttgtttaatatttcgtttca

SEQ ID NO: 677456 - DNA, 20 bp, Artificial
  CRISPR gRNA sequence
tgtttaatatttcgtttcac

SEQ ID NO: 677457 - DNA, 20 bp, Artificial
  CRISPR gRNA sequence
gtttaatatttcgtttcact

SEQ ID NO: 677458 - DNA, 20 bp, Artificial
  CRISPR gRNA sequence
tttaatatttcgtttcacta

SEQ ID NO: 677459 - DNA, 20 bp, Artificial
  CRISPR gRNA sequence
aatatttcgtttcactaatg

SEQ ID NO: 677460 - DNA, 20 bp, Artificial
  CRISPR gRNA sequence
atatttcgtttcactaatgc

SEQ ID NO: 677461 - DNA, 20 bp, Artificial
  CRISPR gRNA sequence
cgtttcactaatgcaagtgt

SEQ ID NO: 677462 - DNA, 20 bp, Artificial
  CRISPR gRNA sequence
gtttcactaatgcaagtgta

SEQ ID NO: 677463 - DNA, 20 bp, Artificial
  CRISPR gRNA sequence
cactaatgcaagtgtaaaag

SEQ ID NO: 677464 - DNA, 20 bp, Artificial
  CRISPR gRNA sequence
actaatgcaagtgtaaaaga

SEQ ID NO: 677465 - DNA, 20 bp, Artificial
  CRISPR gRNA sequence
atgcaagtgtaaaagaaata

SEQ ID NO: 677466 - DNA, 20 bp, Artificial
  CRISPR gRNA sequence
cattttattacctagctcag

SEQ ID NO: 677467 - DNA, 20 bp, Artificial
  CRISPR gRNA sequence
tattacctagctcagtgttt

SEQ ID NO: 677468 - DNA, 20 bp, Artificial
  CRISPR gRNA sequence
attacctagctcagtgtttc

SEQ ID NO: 677469 - DNA, 20 bp, Artificial
  CRISPR gRNA sequence
ttacctagctcagtgtttcc

SEQ ID NO: 677470 - DNA, 20 bp, Artificial
  CRISPR gRNA sequence
cctagctcagtgtttcccaa

SEQ ID NO: 677471 - DNA, 20 bp, Artificial
  CRISPR gRNA sequence
gctcagtgtttcccaaactt

SEQ ID NO: 677472 - DNA, 20 bp, Artificial
  CRISPR gRNA sequence
agtgtttcccaaactttctt

SEQ ID NO: 677473 - DNA, 20 bp, Artificial
  CRISPR gRNA sequence
cccaaactttcttggttcat

SEQ ID NO: 677474 - DNA, 20 bp, Artificial
  CRISPR gRNA sequence
ccaaactttcttggttcatt

SEQ ID NO: 677475 - DNA, 20 bp, Artificial
  CRISPR gRNA sequence
tcttggttcattgtgactgt

SEQ ID NO: 677476 - DNA, 20 bp, Artificial
  CRISPR gRNA sequence
cttggttcattgtgactgta

SEQ ID NO: 677477 - DNA, 20 bp, Artificial
  CRISPR gRNA sequence
ttggttcattgtgactgtag

SEQ ID NO: 677478 - DNA, 20 bp, Artificial
  CRISPR gRNA sequence
ggttcattgtgactgtagtg

SEQ ID NO: 677479 - DNA, 20 bp, Artificial
  CRISPR gRNA sequence
gttcattgtgactgtagtgt

SEQ ID NO: 677480 - DNA, 20 bp, Artificial
  CRISPR gRNA sequence
attgtgactgtagtgtctta

SEQ ID NO: 677481 - DNA, 20 bp, Artificial
  CRISPR gRNA sequence
tgactgtagtgtcttaataa

SEQ ID NO: 677482 - DNA, 20 bp, Artificial
  CRISPR gRNA sequence
tagtgtcttaataattttgt

SEQ ID NO: 677483 - DNA, 20 bp, Artificial
  CRISPR gRNA sequence
aataattttgtcaaagttca

SEQ ID NO: 677484 - DNA, 20 bp, Artificial
  CRISPR gRNA sequence
ataattttgtcaaagttcat

SEQ ID NO: 677485 - DNA, 20 bp, Artificial
  CRISPR gRNA sequence
tgtcaaagttcatttagggc

SEQ ID NO: 677486 - DNA, 20 bp, Artificial
  CRISPR gRNA sequence
gtcaaagttcatttagggct

SEQ ID NO: 677487 - DNA, 20 bp, Artificial
  CRISPR gRNA sequence
tcaaagttcatttagggcta

SEQ ID NO: 677488 - DNA, 20 bp, Artificial
  CRISPR gRNA sequence
atttagggctaaaagtaata

SEQ ID NO: 677489 - DNA, 20 bp, Artificial
  CRISPR gRNA sequence
agggctaaaagtaatactga

SEQ ID NO: 677490 - DNA, 20 bp, Artificial
  CRISPR gRNA sequence
gggctaaaagtaatactgaa

SEQ ID NO: 677491 - DNA, 20 bp, Artificial
  CRISPR gRNA sequence
aaagtaatactgaaaagttt

SEQ ID NO: 677492 - DNA, 20 bp, Artificial
  CRISPR gRNA sequence
aaaagtttcattttattaag

SEQ ID NO: 677493 - DNA, 20 bp, Artificial
  CRISPR gRNA sequence
cattttattaagtagtaagg

SEQ ID NO: 677494 - DNA, 20 bp, Artificial
  CRISPR gRNA sequence
attttattaagtagtaaggt

SEQ ID NO: 677495 - DNA, 20 bp, Artificial
  CRISPR gRNA sequence
tattaagtagtaaggtccaa

SEQ ID NO: 677496 - DNA, 20 bp, Artificial
  CRISPR gRNA sequence
attaagtagtaaggtccaaa

SEQ ID NO: 677497 - DNA, 20 bp, Artificial
  CRISPR gRNA sequence
ttaagtagtaaggtccaaac

SEQ ID NO: 677498 - DNA, 20 bp, Artificial
  CRISPR gRNA sequence
agtagtaaggtccaaacaac

SEQ ID NO: 677499 - DNA, 20 bp, Artificial
  CRISPR gRNA sequence
aataatgatttgtgccctaa

SEQ ID NO: 677500 - DNA, 20 bp, Artificial
  CRISPR gRNA sequence
ataatgatttgtgccctaac

SEQ ID NO: 677501 - DNA, 20 bp, Artificial
  CRISPR gRNA sequence
gtgccctaacaactttttat

SEQ ID NO: 677502 - DNA, 20 bp, Artificial
  CRISPR gRNA sequence
tgccctaacaactttttatc

SEQ ID NO: 677503 - DNA, 20 bp, Artificial
  CRISPR gRNA sequence
acaactttttatccatttgg

SEQ ID NO: 677504 - DNA, 20 bp, Artificial
  CRISPR gRNA sequence
tttatccatttgggaaaatt

SEQ ID NO: 677505 - DNA, 20 bp, Artificial
  CRISPR gRNA sequence
ttatccatttgggaaaatta

SEQ ID NO: 677506 - DNA, 20 bp, Artificial
  CRISPR gRNA sequence
tatccatttgggaaaattat

SEQ ID NO: 677507 - DNA, 20 bp, Artificial
  CRISPR gRNA sequence
atccatttgggaaaattata

SEQ ID NO: 677508 - DNA, 20 bp, Artificial
  CRISPR gRNA sequence
tccatttgggaaaattataa

SEQ ID NO: 677509 - DNA, 20 bp, Artificial
  CRISPR gRNA sequence
gggaaaattataatatataa

SEQ ID NO: 677510 - DNA, 20 bp, Artificial
  CRISPR gRNA sequence
ggaaaattataatatataaa

SEQ ID NO: 677511 - DNA, 20 bp, Artificial
  CRISPR gRNA sequence
taatatataaattgaaaccc

SEQ ID NO: 677512 - DNA, 20 bp, Artificial
  CRISPR gRNA sequence
aaacccaaaacagggttttg

SEQ ID NO: 677513 - DNA, 20 bp, Artificial
  CRISPR gRNA sequence
tgttttgttttttcatctta

SEQ ID NO: 677514 - DNA, 20 bp, Artificial
  CRISPR gRNA sequence
gttttgttttttcatcttag

SEQ ID NO: 677515 - DNA, 20 bp, Artificial
  CRISPR gRNA sequence
ttttgttttttcatcttaga

SEQ ID NO: 677516 - DNA, 20 bp, Artificial
  CRISPR gRNA sequence
tgttttttcatcttagatgg

SEQ ID NO: 677517 - DNA, 20 bp, Artificial
  CRISPR gRNA sequence
gttttttcatcttagatggc

SEQ ID NO: 677518 - DNA, 20 bp, Artificial
  CRISPR gRNA sequence
ttttttcatcttagatggcc

SEQ ID NO: 677519 - DNA, 20 bp, Artificial
  CRISPR gRNA sequence
tttcatcttagatggccaca

SEQ ID NO: 677520 - DNA, 20 bp, Artificial
  CRISPR gRNA sequence
ttcatcttagatggccacag

SEQ ID NO: 677521 - DNA, 20 bp, Artificial
  CRISPR gRNA sequence
tcatcttagatggccacagt

SEQ ID NO: 677522 - DNA, 20 bp, Artificial
  CRISPR gRNA sequence
catcttagatggccacagtt

SEQ ID NO: 677523 - DNA, 20 bp, Artificial
  CRISPR gRNA sequence
atcttagatggccacagtta

SEQ ID NO: 677524 - DNA, 20 bp, Artificial
  CRISPR gRNA sequence
agatggccacagttacttac

SEQ ID NO: 677525 - DNA, 20 bp, Artificial
  CRISPR gRNA sequence
gatggccacagttacttact

SEQ ID NO: 677526 - DNA, 20 bp, Artificial
  CRISPR gRNA sequence
cttactaatgggatggtatg

SEQ ID NO: 677527 - DNA, 20 bp, Artificial
  CRISPR gRNA sequence
actaatgggatggtatgcct

SEQ ID NO: 677528 - DNA, 20 bp, Artificial
  CRISPR gRNA sequence
ctaatgggatggtatgcctt

SEQ ID NO: 677529 - DNA, 20 bp, Artificial
  CRISPR gRNA sequence
atgggatggtatgccttgtt

SEQ ID NO: 677530 - DNA, 20 bp, Artificial
  CRISPR gRNA sequence
gttgggcataccattagtaa

SEQ ID NO: 677531 - DNA, 20 bp, Artificial
  CRISPR gRNA sequence
ttgggcataccattagtaag

SEQ ID NO: 677532 - DNA, 20 bp, Artificial
  CRISPR gRNA sequence
ggcataccattagtaagtga

SEQ ID NO: 677533 - DNA, 20 bp, Artificial
  CRISPR gRNA sequence
gtaagtgaaatcgaagactg

SEQ ID NO: 677534 - DNA, 20 bp, Artificial
  CRISPR gRNA sequence
attatatgagaagatcaata

SEQ ID NO: 677535 - DNA, 20 bp, Artificial
  CRISPR gRNA sequence
tatgagaagatcaataaaat

SEQ ID NO: 677536 - DNA, 20 bp, Artificial
  CRISPR gRNA sequence
tagcaagatcaatcaatatt

SEQ ID NO: 677537 - DNA, 20 bp, Artificial
  CRISPR gRNA sequence
gcaagatcaatcaatattaa

SEQ ID NO: 677538 - DNA, 20 bp, Artificial
  CRISPR gRNA sequence
aaagaacacataatttggca

SEQ ID NO: 677539 - DNA, 20 bp, Artificial
  CRISPR gRNA sequence
ggcatcatctagaataaaaa

SEQ ID NO: 677540 - DNA, 20 bp, Artificial
  CRISPR gRNA sequence
gcatcatctagaataaaaac

SEQ ID NO: 677541 - DNA, 20 bp, Artificial
  CRISPR gRNA sequence
gaataaaaaccggaaatcac

SEQ ID NO: 677542 - DNA, 20 bp, Artificial
  CRISPR gRNA sequence
aaaatcctgtagccattgga

SEQ ID NO: 677543 - DNA, 20 bp, Artificial
  CRISPR gRNA sequence
tagccattggaggcataata

SEQ ID NO: 677544 - DNA, 20 bp, Artificial
  CRISPR gRNA sequence
gaggcataatatggggatat

SEQ ID NO: 677545 - DNA, 20 bp, Artificial
  CRISPR gRNA sequence
tgaacaactttatgtcaaat

SEQ ID NO: 677546 - DNA, 20 bp, Artificial
  CRISPR gRNA sequence
gaacaactttatgtcaaatt

SEQ ID NO: 677547 - DNA, 20 bp, Artificial
  CRISPR gRNA sequence
aacaactttatgtcaaattc

SEQ ID NO: 677548 - DNA, 20 bp, Artificial
  CRISPR gRNA sequence
tatgtcaaattcagctagat

SEQ ID NO: 677549 - DNA, 20 bp, Artificial
  CRISPR gRNA sequence
atgtcaaattcagctagatg

SEQ ID NO: 677550 - DNA, 20 bp, Artificial
  CRISPR gRNA sequence
tgtcaaattcagctagatga

SEQ ID NO: 677551 - DNA, 20 bp, Artificial
  CRISPR gRNA sequence
agctagatgaaataaaaaat

SEQ ID NO: 677552 - DNA, 20 bp, Artificial
  CRISPR gRNA sequence
gatgaaataaaaaatagaaa

SEQ ID NO: 677553 - DNA, 20 bp, Artificial
  CRISPR gRNA sequence
ttgactctcattcaggaaga

SEQ ID NO: 677554 - DNA, 20 bp, Artificial
  CRISPR gRNA sequence
actctcattcaggaagaaat

SEQ ID NO: 677555 - DNA, 20 bp, Artificial
  CRISPR gRNA sequence
tcattcaggaagaaatatac

SEQ ID NO: 677556 - DNA, 20 bp, Artificial
  CRISPR gRNA sequence
attcaggaagaaatatacac

SEQ ID NO: 677557 - DNA, 20 bp, Artificial
  CRISPR gRNA sequence
aggaagaaatatacactctg

SEQ ID NO: 677558 - DNA, 20 bp, Artificial
  CRISPR gRNA sequence
tgaatagcccacatttattc

SEQ ID NO: 677559 - DNA, 20 bp, Artificial
  CRISPR gRNA sequence
aatagcccacatttattcca

SEQ ID NO: 677560 - DNA, 20 bp, Artificial
  CRISPR gRNA sequence
attccaggaattgaaattga

SEQ ID NO: 677561 - DNA, 20 bp, Artificial
  CRISPR gRNA sequence
ttccaggaattgaaattgaa

SEQ ID NO: 677562 - DNA, 20 bp, Artificial
  CRISPR gRNA sequence
caggaattgaaattgaagtt

SEQ ID NO: 677563 - DNA, 20 bp, Artificial
  CRISPR gRNA sequence
aaattgaagttaaaaacctt

SEQ ID NO: 677564 - DNA, 20 bp, Artificial
  CRISPR gRNA sequence
aagttaaaaaccttcccaca

SEQ ID NO: 677565 - DNA, 20 bp, Artificial
  CRISPR gRNA sequence
aaaaccttcccacaaagaaa

SEQ ID NO: 677566 - DNA, 20 bp, Artificial
  CRISPR gRNA sequence
cccacaaagaaaactccaga

SEQ ID NO: 677567 - DNA, 20 bp, Artificial
  CRISPR gRNA sequence
ccacaaagaaaactccagat

SEQ ID NO: 677568 - DNA, 20 bp, Artificial
  CRISPR gRNA sequence
cagatgacttcactggtaaa

SEQ ID NO: 677569 - DNA, 20 bp, Artificial
  CRISPR gRNA sequence
cactggtaaattctgtcaaa

SEQ ID NO: 677570 - DNA, 20 bp, Artificial
  CRISPR gRNA sequence
actggtaaattctgtcaaat

SEQ ID NO: 677571 - DNA, 20 bp, Artificial
  CRISPR gRNA sequence
gtaaattctgtcaaatattt

SEQ ID NO: 677572 - DNA, 20 bp, Artificial
  CRISPR gRNA sequence
tgtcaaatatttaaggaaaa

SEQ ID NO: 677573 - DNA, 20 bp, Artificial
  CRISPR gRNA sequence
tcaaatatttaaggaaaatg

SEQ ID NO: 677574 - DNA, 20 bp, Artificial
  CRISPR gRNA sequence
aaggaaaatgtaatttaaga

SEQ ID NO: 677575 - DNA, 20 bp, Artificial
  CRISPR gRNA sequence
aggaaaatgtaatttaagaa

SEQ ID NO: 677576 - DNA, 20 bp, Artificial
  CRISPR gRNA sequence
aagaaaaacactaaaggaac

SEQ ID NO: 677577 - DNA, 20 bp, Artificial
  CRISPR gRNA sequence
agaaaaacactaaaggaaca

SEQ ID NO: 677578 - DNA, 20 bp, Artificial
  CRISPR gRNA sequence
aaggaacaaattcctccaga

SEQ ID NO: 677579 - DNA, 20 bp, Artificial
  CRISPR gRNA sequence
ctccagacaatagaaaaggg

SEQ ID NO: 677580 - DNA, 20 bp, Artificial
  CRISPR gRNA sequence
cagacaatagaaaagggagg

SEQ ID NO: 677581 - DNA, 20 bp, Artificial
  CRISPR gRNA sequence
caaacaaattattatattca

SEQ ID NO: 677582 - DNA, 20 bp, Artificial
  CRISPR gRNA sequence
ttatattcagcattactctg

SEQ ID NO: 677583 - DNA, 20 bp, Artificial
  CRISPR gRNA sequence
tattcagcattactctgaca

SEQ ID NO: 677584 - DNA, 20 bp, Artificial
  CRISPR gRNA sequence
agcattactctgacaccaaa

SEQ ID NO: 677585 - DNA, 20 bp, Artificial
  CRISPR gRNA sequence
ctctgacaccaaaatcaaag

SEQ ID NO: 677586 - DNA, 20 bp, Artificial
  CRISPR gRNA sequence
tgacaccaaaatcaaagaca

SEQ ID NO: 677587 - DNA, 20 bp, Artificial
  CRISPR gRNA sequence
acaccaaaatcaaagacatt

SEQ ID NO: 677588 - DNA, 20 bp, Artificial
  CRISPR gRNA sequence
caagaaaaaaatactgcata

SEQ ID NO: 677589 - DNA, 20 bp, Artificial
  CRISPR gRNA sequence
cataacggtattcttcatga

SEQ ID NO: 677590 - DNA, 20 bp, Artificial
  CRISPR gRNA sequence
ttcatgatgcagatgcaaaa

SEQ ID NO: 677591 - DNA, 20 bp, Artificial
  CRISPR gRNA sequence
catgatgcagatgcaaaagt

SEQ ID NO: 677592 - DNA, 20 bp, Artificial
  CRISPR gRNA sequence
atgatgcagatgcaaaagtc

SEQ ID NO: 677593 - DNA, 20 bp, Artificial
  CRISPR gRNA sequence
aaaattttaacacattgaat

SEQ ID NO: 677594 - DNA, 20 bp, Artificial
  CRISPR gRNA sequence
aaattttaacacattgaatc

SEQ ID NO: 677595 - DNA, 20 bp, Artificial
  CRISPR gRNA sequence
taacacattgaatctggaat

SEQ ID NO: 677596 - DNA, 20 bp, Artificial
  CRISPR gRNA sequence
aacacattgaatctggaata

SEQ ID NO: 677597 - DNA, 20 bp, Artificial
  CRISPR gRNA sequence
acacattgaatctggaatat

SEQ ID NO: 677598 - DNA, 20 bp, Artificial
  CRISPR gRNA sequence
aatctggaatatataaaaag

SEQ ID NO: 677599 - DNA, 20 bp, Artificial
  CRISPR gRNA sequence
gaatatataaaaaggataat

SEQ ID NO: 677600 - DNA, 20 bp, Artificial
  CRISPR gRNA sequence
atcttaggaatttaaagttg

SEQ ID NO: 677601 - DNA, 20 bp, Artificial
  CRISPR gRNA sequence
tcttaggaatttaaagttgg

SEQ ID NO: 677602 - DNA, 20 bp, Artificial
  CRISPR gRNA sequence
aggaatttaaagttggttta

SEQ ID NO: 677603 - DNA, 20 bp, Artificial
  CRISPR gRNA sequence
ggaatttaaagttggtttaa

SEQ ID NO: 677604 - DNA, 20 bp, Artificial
  CRISPR gRNA sequence
aaagttggtttaacattggg

SEQ ID NO: 677605 - DNA, 20 bp, Artificial
  CRISPR gRNA sequence
aagttggtttaacattgggt

SEQ ID NO: 677606 - DNA, 20 bp, Artificial
  CRISPR gRNA sequence
gtttaacattgggtgaaaaa

SEQ ID NO: 677607 - DNA, 20 bp, Artificial
  CRISPR gRNA sequence
aacattgggtgaaaaaacat

SEQ ID NO: 677608 - DNA, 20 bp, Artificial
  CRISPR gRNA sequence
acattgggtgaaaaaacatc

SEQ ID NO: 677609 - DNA, 20 bp, Artificial
  CRISPR gRNA sequence
ggtgaaaaaacatcacaatg

SEQ ID NO: 677610 - DNA, 20 bp, Artificial
  CRISPR gRNA sequence
tccatattaacagactaaaa

SEQ ID NO: 677611 - DNA, 20 bp, Artificial
  CRISPR gRNA sequence
ccatattaacagactaaaaa

SEQ ID NO: 677612 - DNA, 20 bp, Artificial
  CRISPR gRNA sequence
catattaacagactaaaaaa

SEQ ID NO: 677613 - DNA, 20 bp, Artificial
  CRISPR gRNA sequence
acagactaaaaaagaaaaga

SEQ ID NO: 677614 - DNA, 20 bp, Artificial
  CRISPR gRNA sequence
aaaaagaaaagattttagtc

SEQ ID NO: 677615 - DNA, 20 bp, Artificial
  CRISPR gRNA sequence
tagtctgtctttaaagtttc

SEQ ID NO: 677616 - DNA, 20 bp, Artificial
  CRISPR gRNA sequence
agtctgtctttaaagtttca

SEQ ID NO: 677617 - DNA, 20 bp, Artificial
  CRISPR gRNA sequence
gtctgtctttaaagtttcag

SEQ ID NO: 677618 - DNA, 20 bp, Artificial
  CRISPR gRNA sequence
tctttaaagtttcagaaaaa

SEQ ID NO: 677619 - DNA, 20 bp, Artificial
  CRISPR gRNA sequence
taaagtttcagaaaaagtat

SEQ ID NO: 677620 - DNA, 20 bp, Artificial
  CRISPR gRNA sequence
aaagtttcagaaaaagtatt

SEQ ID NO: 677621 - DNA, 20 bp, Artificial
  CRISPR gRNA sequence
aagtttcagaaaaagtattt

SEQ ID NO: 677622 - DNA, 20 bp, Artificial
  CRISPR gRNA sequence
cagaaaaagtatttgacata

SEQ ID NO: 677623 - DNA, 20 bp, Artificial
  CRISPR gRNA sequence
agaaaaagtatttgacataa

SEQ ID NO: 677624 - DNA, 20 bp, Artificial
  CRISPR gRNA sequence
gacataattcagctttcaca

SEQ ID NO: 677625 - DNA, 20 bp, Artificial
  CRISPR gRNA sequence
acataattcagctttcacat

SEQ ID NO: 677626 - DNA, 20 bp, Artificial
  CRISPR gRNA sequence
agctttcacatattataaaa

SEQ ID NO: 677627 - DNA, 20 bp, Artificial
  CRISPR gRNA sequence
tcacatattataaaaattct

SEQ ID NO: 677628 - DNA, 20 bp, Artificial
  CRISPR gRNA sequence
cacatattataaaaattctc

SEQ ID NO: 677629 - DNA, 20 bp, Artificial
  CRISPR gRNA sequence
acatattataaaaattctct

SEQ ID NO: 677630 - DNA, 20 bp, Artificial
  CRISPR gRNA sequence
taaaaattctctgcaactga

SEQ ID NO: 677631 - DNA, 20 bp, Artificial
  CRISPR gRNA sequence
tctgcaactgagtagaaaag

SEQ ID NO: 677632 - DNA, 20 bp, Artificial
  CRISPR gRNA sequence
tgcaactgagtagaaaagaa

SEQ ID NO: 677633 - DNA, 20 bp, Artificial
  CRISPR gRNA sequence
caactgagtagaaaagaact

SEQ ID NO: 677634 - DNA, 20 bp, Artificial
  CRISPR gRNA sequence
agtagaaaagaacttcctca

SEQ ID NO: 677635 - DNA, 20 bp, Artificial
  CRISPR gRNA sequence
cctcatcatgatggttatca

SEQ ID NO: 677636 - DNA, 20 bp, Artificial
  CRISPR gRNA sequence
ctcatcatgatggttatcat

SEQ ID NO: 677637 - DNA, 20 bp, Artificial
  CRISPR gRNA sequence
atcatgatggttatcatttg

SEQ ID NO: 677638 - DNA, 20 bp, Artificial
  CRISPR gRNA sequence
tcatttgatgagtgtaataa

SEQ ID NO: 677639 - DNA, 20 bp, Artificial
  CRISPR gRNA sequence
gatgagtgtaataagaaaat

SEQ ID NO: 677640 - DNA, 20 bp, Artificial
  CRISPR gRNA sequence
atgagtgtaataagaaaata

SEQ ID NO: 677641 - DNA, 20 bp, Artificial
  CRISPR gRNA sequence
aggttgatgccatatcttgg

SEQ ID NO: 677642 - DNA, 20 bp, Artificial
  CRISPR gRNA sequence
ggttgatgccatatcttggc

SEQ ID NO: 677643 - DNA, 20 bp, Artificial
  CRISPR gRNA sequence
atgccatatcttggctattg

SEQ ID NO: 677644 - DNA, 20 bp, Artificial
  CRISPR gRNA sequence
ggctattgtgaaatgatgta

SEQ ID NO: 677645 - DNA, 20 bp, Artificial
  CRISPR gRNA sequence
gctattgtgaaatgatgtaa

SEQ ID NO: 677646 - DNA, 20 bp, Artificial
  CRISPR gRNA sequence
ttgtgaaatgatgtaataaa

SEQ ID NO: 677647 - DNA, 20 bp, Artificial
  CRISPR gRNA sequence
tgaaatgatgtaataaacat

SEQ ID NO: 677648 - DNA, 20 bp, Artificial
  CRISPR gRNA sequence
ctttgacatactgagattaa

SEQ ID NO: 677649 - DNA, 20 bp, Artificial
  CRISPR gRNA sequence
tttgacatactgagattaaa

SEQ ID NO: 677650 - DNA, 20 bp, Artificial
  CRISPR gRNA sequence
tgacatactgagattaaatc

SEQ ID NO: 677651 - DNA, 20 bp, Artificial
  CRISPR gRNA sequence
gacatactgagattaaatca

SEQ ID NO: 677652 - DNA, 20 bp, Artificial
  CRISPR gRNA sequence
acatactgagattaaatcaa

SEQ ID NO: 677653 - DNA, 20 bp, Artificial
  CRISPR gRNA sequence
agattaaatcaaatgtattt

SEQ ID NO: 677654 - DNA, 20 bp, Artificial
  CRISPR gRNA sequence
aatcaaatgtatttctatat

SEQ ID NO: 677655 - DNA, 20 bp, Artificial
  CRISPR gRNA sequence
ctatatgctaggaatgaaca

SEQ ID NO: 677656 - DNA, 20 bp, Artificial
  CRISPR gRNA sequence
tatatgctaggaatgaacag

SEQ ID NO: 677657 - DNA, 20 bp, Artificial
  CRISPR gRNA sequence
tatgctaggaatgaacagtt

SEQ ID NO: 677658 - DNA, 20 bp, Artificial
  CRISPR gRNA sequence
ggaatgaacagttggacatt

SEQ ID NO: 677659 - DNA, 20 bp, Artificial
  CRISPR gRNA sequence
gacattggaatttagaaagc

SEQ ID NO: 677660 - DNA, 20 bp, Artificial
  CRISPR gRNA sequence
gaatttagaaagcaatgcca

SEQ ID NO: 677661 - DNA, 20 bp, Artificial
  CRISPR gRNA sequence
agaaagcaatgccattgatt

SEQ ID NO: 677662 - DNA, 20 bp, Artificial
  CRISPR gRNA sequence
gaaagcaatgccattgatta

SEQ ID NO: 677663 - DNA, 20 bp, Artificial
  CRISPR gRNA sequence
attataacatcccaaaatgt

SEQ ID NO: 677664 - DNA, 20 bp, Artificial
  CRISPR gRNA sequence
taacatcccaaaatgtatga

SEQ ID NO: 677665 - DNA, 20 bp, Artificial
  CRISPR gRNA sequence
agagttaaattaagtaatat

SEQ ID NO: 677666 - DNA, 20 bp, Artificial
  CRISPR gRNA sequence
gagttaaattaagtaatatg

SEQ ID NO: 677667 - DNA, 20 bp, Artificial
  CRISPR gRNA sequence
aattaagtaatatgtgtaag

SEQ ID NO: 677668 - DNA, 20 bp, Artificial
  CRISPR gRNA sequence
agtaatatgtgtaagaactg

SEQ ID NO: 677669 - DNA, 20 bp, Artificial
  CRISPR gRNA sequence
tgtacgtaaaatcataacac

SEQ ID NO: 677670 - DNA, 20 bp, Artificial
  CRISPR gRNA sequence
ctgagataaattaaagactt

SEQ ID NO: 677671 - DNA, 20 bp, Artificial
  CRISPR gRNA sequence
agataaattaaagacttcaa

SEQ ID NO: 677672 - DNA, 20 bp, Artificial
  CRISPR gRNA sequence
aagacttcaataaatgcaga

SEQ ID NO: 677673 - DNA, 20 bp, Artificial
  CRISPR gRNA sequence
caataaatgcagagatgaga

SEQ ID NO: 677674 - DNA, 20 bp, Artificial
  CRISPR gRNA sequence
aataaatgcagagatgagac

SEQ ID NO: 677675 - DNA, 20 bp, Artificial
  CRISPR gRNA sequence
tcatgatttaaaagattcag

SEQ ID NO: 677676 - DNA, 20 bp, Artificial
  CRISPR gRNA sequence
aaaagattcagtattgttaa

SEQ ID NO: 677677 - DNA, 20 bp, Artificial
  CRISPR gRNA sequence
aaagattcagtattgttaag

SEQ ID NO: 677678 - DNA, 20 bp, Artificial
  CRISPR gRNA sequence
agtattgttaagatgttggt

SEQ ID NO: 677679 - DNA, 20 bp, Artificial
  CRISPR gRNA sequence
ttaagatgttggtttctcct

SEQ ID NO: 677680 - DNA, 20 bp, Artificial
  CRISPR gRNA sequence
agatgttggtttctcctgaa

SEQ ID NO: 677681 - DNA, 20 bp, Artificial
  CRISPR gRNA sequence
gtttctcctgaaatcgagtc

SEQ ID NO: 677682 - DNA, 20 bp, Artificial
  CRISPR gRNA sequence
ctcctgaaatcgagtctgtc

SEQ ID NO: 677683 - DNA, 20 bp, Artificial
  CRISPR gRNA sequence
tcctgaaatcgagtctgtca

SEQ ID NO: 677684 - DNA, 20 bp, Artificial
  CRISPR gRNA sequence
ctgaaatcgagtctgtcagt

SEQ ID NO: 677685 - DNA, 20 bp, Artificial
  CRISPR gRNA sequence
aaatcgagtctgtcagttca

SEQ ID NO: 677686 - DNA, 20 bp, Artificial
  CRISPR gRNA sequence
tcagttcagggcaatttcag

SEQ ID NO: 677687 - DNA, 20 bp, Artificial
  CRISPR gRNA sequence
agggcaatttcagtcaaaat

SEQ ID NO: 677688 - DNA, 20 bp, Artificial
  CRISPR gRNA sequence
cagtcaaaatcccaacaagc

SEQ ID NO: 677689 - DNA, 20 bp, Artificial
  CRISPR gRNA sequence
agtcaaaatcccaacaagct

SEQ ID NO: 677690 - DNA, 20 bp, Artificial
  CRISPR gRNA sequence
tttaacagaaattggcaaac

SEQ ID NO: 677691 - DNA, 20 bp, Artificial
  CRISPR gRNA sequence
ttaacagaaattggcaaact

SEQ ID NO: 677692 - DNA, 20 bp, Artificial
  CRISPR gRNA sequence
taacagaaattggcaaactg

SEQ ID NO: 677693 - DNA, 20 bp, Artificial
  CRISPR gRNA sequence
aacagaaattggcaaactga

SEQ ID NO: 677694 - DNA, 20 bp, Artificial
  CRISPR gRNA sequence
acagaaattggcaaactgat

SEQ ID NO: 677695 - DNA, 20 bp, Artificial
  CRISPR gRNA sequence
gcaaactgattacaaacttt

SEQ ID NO: 677696 - DNA, 20 bp, Artificial
  CRISPR gRNA sequence
attacaaactttgtttggaa

SEQ ID NO: 677697 - DNA, 20 bp, Artificial
  CRISPR gRNA sequence
caaactttgtttggaaatgt

SEQ ID NO: 677698 - DNA, 20 bp, Artificial
  CRISPR gRNA sequence
tgtttggaaatgtagaccta

SEQ ID NO: 677699 - DNA, 20 bp, Artificial
  CRISPR gRNA sequence
gtttggaaatgtagacctaa

SEQ ID NO: 677700 - DNA, 20 bp, Artificial
  CRISPR gRNA sequence
tttggaaatgtagacctaaa

SEQ ID NO: 677701 - DNA, 20 bp, Artificial
  CRISPR gRNA sequence
ggaaatgtagacctaaaata

SEQ ID NO: 677702 - DNA, 20 bp, Artificial
  CRISPR gRNA sequence
gaaatgtagacctaaaatag

SEQ ID NO: 677703 - DNA, 20 bp, Artificial
  CRISPR gRNA sequence
aaatagccaaaataattttg

SEQ ID NO: 677704 - DNA, 20 bp, Artificial
  CRISPR gRNA sequence
tgaaaagccaaatttggatg

SEQ ID NO: 677705 - DNA, 20 bp, Artificial
  CRISPR gRNA sequence
gaaaagccaaatttggatga

SEQ ID NO: 677706 - DNA, 20 bp, Artificial
  CRISPR gRNA sequence
aaaagccaaatttggatgac

SEQ ID NO: 677707 - DNA, 20 bp, Artificial
  CRISPR gRNA sequence
ggatgacttgcactgcctga

SEQ ID NO: 677708 - DNA, 20 bp, Artificial
  CRISPR gRNA sequence
gatgacttgcactgcctgat

SEQ ID NO: 677709 - DNA, 20 bp, Artificial
  CRISPR gRNA sequence
gcactgcctgattccaaatc

SEQ ID NO: 677710 - DNA, 20 bp, Artificial
  CRISPR gRNA sequence
cactgcctgattccaaatct

SEQ ID NO: 677711 - DNA, 20 bp, Artificial
  CRISPR gRNA sequence
cctgattccaaatctattcc

SEQ ID NO: 677712 - DNA, 20 bp, Artificial
  CRISPR gRNA sequence
attccaaatctattcctaag

SEQ ID NO: 677713 - DNA, 20 bp, Artificial
  CRISPR gRNA sequence
caaatctattcctaagactt

SEQ ID NO: 677714 - DNA, 20 bp, Artificial
  CRISPR gRNA sequence
ttcctaagacttgctctgtt

SEQ ID NO: 677715 - DNA, 20 bp, Artificial
  CRISPR gRNA sequence
ctaagacttgctctgttggt

SEQ ID NO: 677716 - DNA, 20 bp, Artificial
  CRISPR gRNA sequence
agacttgctctgttggttta

SEQ ID NO: 677717 - DNA, 20 bp, Artificial
  CRISPR gRNA sequence
gctctgttggtttaagtata

SEQ ID NO: 677718 - DNA, 20 bp, Artificial
  CRISPR gRNA sequence
ctctgttggtttaagtatag

SEQ ID NO: 677719 - DNA, 20 bp, Artificial
  CRISPR gRNA sequence
tgttggtttaagtatagaca

SEQ ID NO: 677720 - DNA, 20 bp, Artificial
  CRISPR gRNA sequence
ttggtttaagtatagacata

SEQ ID NO: 677721 - DNA, 20 bp, Artificial
  CRISPR gRNA sequence
gtttaagtatagacatagag

SEQ ID NO: 677722 - DNA, 20 bp, Artificial
  CRISPR gRNA sequence
aagtatagacatagaggtta

SEQ ID NO: 677723 - DNA, 20 bp, Artificial
  CRISPR gRNA sequence
agtatagacatagaggttaa

SEQ ID NO: 677724 - DNA, 20 bp, Artificial
  CRISPR gRNA sequence
atggaatggaatagagtcca

SEQ ID NO: 677725 - DNA, 20 bp, Artificial
  CRISPR gRNA sequence
gtcagttgattttcaacaaa

SEQ ID NO: 677726 - DNA, 20 bp, Artificial
  CRISPR gRNA sequence
attttcaacaaaggtactga

SEQ ID NO: 677727 - DNA, 20 bp, Artificial
  CRISPR gRNA sequence
tcaacaaaggtactgagata

SEQ ID NO: 677728 - DNA, 20 bp, Artificial
  CRISPR gRNA sequence
caacaaaggtactgagataa

SEQ ID NO: 677729 - DNA, 20 bp, Artificial
  CRISPR gRNA sequence
aacaaaggtactgagataat

SEQ ID NO: 677730 - DNA, 20 bp, Artificial
  CRISPR gRNA sequence
agataatttaaggggggaaa

SEQ ID NO: 677731 - DNA, 20 bp, Artificial
  CRISPR gRNA sequence
aaggggggaaaggataatat

SEQ ID NO: 677732 - DNA, 20 bp, Artificial
  CRISPR gRNA sequence
aggggggaaaggataatatt

SEQ ID NO: 677733 - DNA, 20 bp, Artificial
  CRISPR gRNA sequence
tctataaatgggtctagaac

SEQ ID NO: 677734 - DNA, 20 bp, Artificial
  CRISPR gRNA sequence
ctataaatgggtctagaaca

SEQ ID NO: 677735 - DNA, 20 bp, Artificial
  CRISPR gRNA sequence
tataaatgggtctagaacaa

SEQ ID NO: 677736 - DNA, 20 bp, Artificial
  CRISPR gRNA sequence
taaatgggtctagaacaact

SEQ ID NO: 677737 - DNA, 20 bp, Artificial
  CRISPR gRNA sequence
gaacaactgaatacccatat

SEQ ID NO: 677738 - DNA, 20 bp, Artificial
  CRISPR gRNA sequence
aatacccatatttttgaaaa

SEQ ID NO: 677739 - DNA, 20 bp, Artificial
  CRISPR gRNA sequence
ttgaaaaaaatggtctaaga

SEQ ID NO: 677740 - DNA, 20 bp, Artificial
  CRISPR gRNA sequence
tgaaaaaaatggtctaagac

SEQ ID NO: 677741 - DNA, 20 bp, Artificial
  CRISPR gRNA sequence
gaaaaaaatggtctaagact

SEQ ID NO: 677742 - DNA, 20 bp, Artificial
  CRISPR gRNA sequence
aaaaaaatggtctaagactc

SEQ ID NO: 677743 - DNA, 20 bp, Artificial
  CRISPR gRNA sequence
agactcttatgccatatata

SEQ ID NO: 677744 - DNA, 20 bp, Artificial
  CRISPR gRNA sequence
ttatgccatatataaaaatt

SEQ ID NO: 677745 - DNA, 20 bp, Artificial
  CRISPR gRNA sequence
atgccatatataaaaattaa

SEQ ID NO: 677746 - DNA, 20 bp, Artificial
  CRISPR gRNA sequence
tgccatatataaaaattaag

SEQ ID NO: 677747 - DNA, 20 bp, Artificial
  CRISPR gRNA sequence
agttgaaatagccatagact

SEQ ID NO: 677748 - DNA, 20 bp, Artificial
  CRISPR gRNA sequence
aaatagccatagacttttga

SEQ ID NO: 677749 - DNA, 20 bp, Artificial
  CRISPR gRNA sequence
ttgacaactatagtaattat

SEQ ID NO: 677750 - DNA, 20 bp, Artificial
  CRISPR gRNA sequence
tgacaactatagtaattatg

SEQ ID NO: 677751 - DNA, 20 bp, Artificial
  CRISPR gRNA sequence
gacaactatagtaattatgt

SEQ ID NO: 677752 - DNA, 20 bp, Artificial
  CRISPR gRNA sequence
acaactatagtaattatgtg

SEQ ID NO: 677753 - DNA, 20 bp, Artificial
  CRISPR gRNA sequence
tagtaattatgtgaatcgat

SEQ ID NO: 677754 - DNA, 20 bp, Artificial
  CRISPR gRNA sequence
tgtgaatcgatgttaaacac

SEQ ID NO: 677755 - DNA, 20 bp, Artificial
  CRISPR gRNA sequence
aacacatatttatttgtttt

SEQ ID NO: 677756 - DNA, 20 bp, Artificial
  CRISPR gRNA sequence
atttgttttatctgtatata

SEQ ID NO: 677757 - DNA, 20 bp, Artificial
  CRISPR gRNA sequence
tttgttttatctgtatatat

SEQ ID NO: 677758 - DNA, 20 bp, Artificial
  CRISPR gRNA sequence
gttttatctgtatatatgta

SEQ ID NO: 677759 - DNA, 20 bp, Artificial
  CRISPR gRNA sequence
ttttatctgtatatatgtaa

SEQ ID NO: 677760 - DNA, 20 bp, Artificial
  CRISPR gRNA sequence
tatctgtatatatgtaaata

SEQ ID NO: 677761 - DNA, 20 bp, Artificial
  CRISPR gRNA sequence
atctgtatatatgtaaatat

SEQ ID NO: 677762 - DNA, 20 bp, Artificial
  CRISPR gRNA sequence
tctgtatatatgtaaatatt

SEQ ID NO: 677763 - DNA, 20 bp, Artificial
  CRISPR gRNA sequence
tatatatgtaaatattctgc

SEQ ID NO: 677764 - DNA, 20 bp, Artificial
  CRISPR gRNA sequence
tgcaatatgtgaactagtat

SEQ ID NO: 677765 - DNA, 20 bp, Artificial
  CRISPR gRNA sequence
caatatgtgaactagtatat

SEQ ID NO: 677766 - DNA, 20 bp, Artificial
  CRISPR gRNA sequence
gtatatacttattatatata

SEQ ID NO: 677767 - DNA, 20 bp, Artificial
  CRISPR gRNA sequence
attatatatagtacagacac

SEQ ID NO: 677768 - DNA, 20 bp, Artificial
  CRISPR gRNA sequence
ttatatatagtacagacaca

SEQ ID NO: 677769 - DNA, 20 bp, Artificial
  CRISPR gRNA sequence
tatatagtacagacacatat

SEQ ID NO: 677770 - DNA, 20 bp, Artificial
  CRISPR gRNA sequence
cttgagaggtaagggacaaa

SEQ ID NO: 677771 - DNA, 20 bp, Artificial
  CRISPR gRNA sequence
ttgagaggtaagggacaaac

SEQ ID NO: 677772 - DNA, 20 bp, Artificial
  CRISPR gRNA sequence
gagaggtaagggacaaacat

SEQ ID NO: 677773 - DNA, 20 bp, Artificial
  CRISPR gRNA sequence
agaggtaagggacaaacatc

SEQ ID NO: 677774 - DNA, 20 bp, Artificial
  CRISPR gRNA sequence
gagactttagaccagagaca

SEQ ID NO: 677775 - DNA, 20 bp, Artificial
  CRISPR gRNA sequence
tagaccagagacatacgctc

SEQ ID NO: 677776 - DNA, 20 bp, Artificial
  CRISPR gRNA sequence
agaccagagacatacgctca

SEQ ID NO: 677777 - DNA, 20 bp, Artificial
  CRISPR gRNA sequence
gaccagagacatacgctcat

SEQ ID NO: 677778 - DNA, 20 bp, Artificial
  CRISPR gRNA sequence
atatttcagaatttcagaac

SEQ ID NO: 677779 - DNA, 20 bp, Artificial
  CRISPR gRNA sequence
cagaatttcagaacatcaag

SEQ ID NO: 677780 - DNA, 20 bp, Artificial
  CRISPR gRNA sequence
agaatttcagaacatcaagg

SEQ ID NO: 677781 - DNA, 20 bp, Artificial
  CRISPR gRNA sequence
cagaacatcaaggacaaact

SEQ ID NO: 677782 - DNA, 20 bp, Artificial
  CRISPR gRNA sequence
agaacatcaaggacaaactg

SEQ ID NO: 677783 - DNA, 20 bp, Artificial
  CRISPR gRNA sequence
aagttactaagagctttcag

SEQ ID NO: 677784 - DNA, 20 bp, Artificial
  CRISPR gRNA sequence
ctaagagctttcagacaaac

SEQ ID NO: 677785 - DNA, 20 bp, Artificial
  CRISPR gRNA sequence
agagctttcagacaaacagg

SEQ ID NO: 677786 - DNA, 20 bp, Artificial
  CRISPR gRNA sequence
tcagacaaacaggccacata

SEQ ID NO: 677787 - DNA, 20 bp, Artificial
  CRISPR gRNA sequence
cagacaaacaggccacatat

SEQ ID NO: 677788 - DNA, 20 bp, Artificial
  CRISPR gRNA sequence
agacaaacaggccacatata

SEQ ID NO: 677789 - DNA, 20 bp, Artificial
  CRISPR gRNA sequence
tatttatataatacttttaa

SEQ ID NO: 677790 - DNA, 20 bp, Artificial
  CRISPR gRNA sequence
atataatacttttaaaaaga

SEQ ID NO: 677791 - DNA, 20 bp, Artificial
  CRISPR gRNA sequence
tataatacttttaaaaagaa

SEQ ID NO: 677792 - DNA, 20 bp, Artificial
  CRISPR gRNA sequence
ttaaaaagaaactttggagg

SEQ ID NO: 677793 - DNA, 20 bp, Artificial
  CRISPR gRNA sequence
taaaaagaaactttggaggt

SEQ ID NO: 677794 - DNA, 20 bp, Artificial
  CRISPR gRNA sequence
aaaaagaaactttggaggtt

SEQ ID NO: 677795 - DNA, 20 bp, Artificial
  CRISPR gRNA sequence
aaaagaaactttggaggtta

SEQ ID NO: 677796 - DNA, 20 bp, Artificial
  CRISPR gRNA sequence
tggaggttagtagcccagtg

SEQ ID NO: 677797 - DNA, 20 bp, Artificial
  CRISPR gRNA sequence
ggaggttagtagcccagtga

SEQ ID NO: 677798 - DNA, 20 bp, Artificial
  CRISPR gRNA sequence
gaggttagtagcccagtgaa

SEQ ID NO: 677799 - DNA, 20 bp, Artificial
  CRISPR gRNA sequence
gtagcccagtgaaaaaaagg

SEQ ID NO: 677800 - DNA, 20 bp, Artificial
  CRISPR gRNA sequence
caaaatgttaagagaaaatg

SEQ ID NO: 677801 - DNA, 20 bp, Artificial
  CRISPR gRNA sequence
aaaatgttaagagaaaatga

SEQ ID NO: 677802 - DNA, 20 bp, Artificial
  CRISPR gRNA sequence
agagaaaatgagtttcaacc

SEQ ID NO: 677803 - DNA, 20 bp, Artificial
  CRISPR gRNA sequence
caacctggaaattctaaacc

SEQ ID NO: 677804 - DNA, 20 bp, Artificial
  CRISPR gRNA sequence
aacctggaaattctaaaccc

SEQ ID NO: 677805 - DNA, 20 bp, Artificial
  CRISPR gRNA sequence
gaaattctaaacccaacgaa

SEQ ID NO: 677806 - DNA, 20 bp, Artificial
  CRISPR gRNA sequence
taaacccaacgaagaggaaa

SEQ ID NO: 677807 - DNA, 20 bp, Artificial
  CRISPR gRNA sequence
aacccaacgaagaggaaaac

SEQ ID NO: 677808 - DNA, 20 bp, Artificial
  CRISPR gRNA sequence
aggcagcagaagactaatca

SEQ ID NO: 677809 - DNA, 20 bp, Artificial
  CRISPR gRNA sequence
atcatgagggggacaaagga

SEQ ID NO: 677810 - DNA, 20 bp, Artificial
  CRISPR gRNA sequence
tggataacaactctgtaata

SEQ ID NO: 677811 - DNA, 20 bp, Artificial
  CRISPR gRNA sequence
gataacaactctgtaataaa

SEQ ID NO: 677812 - DNA, 20 bp, Artificial
  CRISPR gRNA sequence
tgtaataaacccagggtacc

SEQ ID NO: 677813 - DNA, 20 bp, Artificial
  CRISPR gRNA sequence
taataaacccagggtaccat

SEQ ID NO: 677814 - DNA, 20 bp, Artificial
  CRISPR gRNA sequence
caactggagaaaggggtgcc

SEQ ID NO: 677815 - DNA, 20 bp, Artificial
  CRISPR gRNA sequence
gagaaaggggtgccaatggt

SEQ ID NO: 677816 - DNA, 20 bp, Artificial
  CRISPR gRNA sequence
tgagaaggcaagaggaaagt

SEQ ID NO: 677817 - DNA, 20 bp, Artificial
  CRISPR gRNA sequence
gcaaggacctatgacattgt

SEQ ID NO: 677818 - DNA, 20 bp, Artificial
  CRISPR gRNA sequence
tgacattgttctggactctg

SEQ ID NO: 677819 - DNA, 20 bp, Artificial
  CRISPR gRNA sequence
ttctggactctgagttatca

SEQ ID NO: 677820 - DNA, 20 bp, Artificial
  CRISPR gRNA sequence
tggactctgagttatcagta

SEQ ID NO: 677821 - DNA, 20 bp, Artificial
  CRISPR gRNA sequence
gactctgagttatcagtaag

SEQ ID NO: 677822 - DNA, 20 bp, Artificial
  CRISPR gRNA sequence
tgagttatcagtaaggtgtg

SEQ ID NO: 677823 - DNA, 20 bp, Artificial
  CRISPR gRNA sequence
agttatcagtaaggtgtgag

SEQ ID NO: 677824 - DNA, 20 bp, Artificial
  CRISPR gRNA sequence
tcagtaaggtgtgagaacct

SEQ ID NO: 677825 - DNA, 20 bp, Artificial
  CRISPR gRNA sequence
agaggaaggggtaagtggca

SEQ ID NO: 677826 - DNA, 20 bp, Artificial
  CRISPR gRNA sequence
gatacagaaacacaagcaaa

SEQ ID NO: 677827 - DNA, 20 bp, Artificial
  CRISPR gRNA sequence
ttaactctaggaaaaattaa

SEQ ID NO: 677828 - DNA, 20 bp, Artificial
  CRISPR gRNA sequence
actctaggaaaaattaaaag

SEQ ID NO: 677829 - DNA, 20 bp, Artificial
  CRISPR gRNA sequence
taggaaaaattaaaagctgc

SEQ ID NO: 677830 - DNA, 20 bp, Artificial
  CRISPR gRNA sequence
ggaaaaattaaaagctgcac

SEQ ID NO: 677831 - DNA, 20 bp, Artificial
  CRISPR gRNA sequence
aaagctgcacaaaaaaggaa

SEQ ID NO: 677832 - DNA, 20 bp, Artificial
  CRISPR gRNA sequence
cacaaaaaaggaaatgtaat

SEQ ID NO: 677833 - DNA, 20 bp, Artificial
  CRISPR gRNA sequence
ttgagccaaatagtatgtta

SEQ ID NO: 677834 - DNA, 20 bp, Artificial
  CRISPR gRNA sequence
agccaaatagtatgttatga

SEQ ID NO: 677835 - DNA, 20 bp, Artificial
  CRISPR gRNA sequence
tgattaatatttctatgact

SEQ ID NO: 677836 - DNA, 20 bp, Artificial
  CRISPR gRNA sequence
atatttctatgactactgga

SEQ ID NO: 677837 - DNA, 20 bp, Artificial
  CRISPR gRNA sequence
ctatgactactggaaatttc

SEQ ID NO: 677838 - DNA, 20 bp, Artificial
  CRISPR gRNA sequence
tatgactactggaaatttcc

SEQ ID NO: 677839 - DNA, 20 bp, Artificial
  CRISPR gRNA sequence
tgactactggaaatttccat

SEQ ID NO: 677840 - DNA, 20 bp, Artificial
  CRISPR gRNA sequence
ctggaaatttccatttctat

SEQ ID NO: 677841 - DNA, 20 bp, Artificial
  CRISPR gRNA sequence
gaaatttccatttctatact

SEQ ID NO: 677842 - DNA, 20 bp, Artificial
  CRISPR gRNA sequence
ccatttctatactattaatc

SEQ ID NO: 677843 - DNA, 20 bp, Artificial
  CRISPR gRNA sequence
catttctatactattaatca

SEQ ID NO: 677844 - DNA, 20 bp, Artificial
  CRISPR gRNA sequence
ctatactattaatcagaaat

SEQ ID NO: 677845 - DNA, 20 bp, Artificial
  CRISPR gRNA sequence
tatactattaatcagaaatg

SEQ ID NO: 677846 - DNA, 20 bp, Artificial
  CRISPR gRNA sequence
tactattaatcagaaatgat

SEQ ID NO: 677847 - DNA, 20 bp, Artificial
  CRISPR gRNA sequence
ttaatcagaaatgattatgt

SEQ ID NO: 677848 - DNA, 20 bp, Artificial
  CRISPR gRNA sequence
atcagaaatgattatgtaac

SEQ ID NO: 677849 - DNA, 20 bp, Artificial
  CRISPR gRNA sequence
tgtaactattgaaagaccac

SEQ ID NO: 677850 - DNA, 20 bp, Artificial
  CRISPR gRNA sequence
ttgaaagaccacagaagtga

SEQ ID NO: 677851 - DNA, 20 bp, Artificial
  CRISPR gRNA sequence
aaagaccacagaagtgagaa

SEQ ID NO: 677852 - DNA, 20 bp, Artificial
  CRISPR gRNA sequence
agagggtgtttgtaagagag

SEQ ID NO: 677853 - DNA, 20 bp, Artificial
  CRISPR gRNA sequence
gtaagagagctgaatcctta

SEQ ID NO: 677854 - DNA, 20 bp, Artificial
  CRISPR gRNA sequence
taagagagctgaatccttaa

SEQ ID NO: 677855 - DNA, 20 bp, Artificial
  CRISPR gRNA sequence
aatccttaactaccaggaca

SEQ ID NO: 677856 - DNA, 20 bp, Artificial
  CRISPR gRNA sequence
aactaccaggacagagaagc

SEQ ID NO: 677857 - DNA, 20 bp, Artificial
  CRISPR gRNA sequence
actaccaggacagagaagca

SEQ ID NO: 677858 - DNA, 20 bp, Artificial
  CRISPR gRNA sequence
ccaggacagagaagcaatag

SEQ ID NO: 677859 - DNA, 20 bp, Artificial
  CRISPR gRNA sequence
tctctaaacctgatgaataa

SEQ ID NO: 677860 - DNA, 20 bp, Artificial
  CRISPR gRNA sequence
taaacctgatgaataaaaat

SEQ ID NO: 677861 - DNA, 20 bp, Artificial
  CRISPR gRNA sequence
aacctgatgaataaaaataa

SEQ ID NO: 677862 - DNA, 20 bp, Artificial
  CRISPR gRNA sequence
atgaataaaaataacccaca

SEQ ID NO: 677863 - DNA, 20 bp, Artificial
  CRISPR gRNA sequence
tttagaaatatgaatataat

SEQ ID NO: 677864 - DNA, 20 bp, Artificial
  CRISPR gRNA sequence
agaaatatgaatataatcac

SEQ ID NO: 677865 - DNA, 20 bp, Artificial
  CRISPR gRNA sequence
gaaatatgaatataatcacc

SEQ ID NO: 677866 - DNA, 20 bp, Artificial
  CRISPR gRNA sequence
aaaatggttgctttttggga

SEQ ID NO: 677867 - DNA, 20 bp, Artificial
  CRISPR gRNA sequence
ctttttgggattttgattag

SEQ ID NO: 677868 - DNA, 20 bp, Artificial
  CRISPR gRNA sequence
tttgggattttgattagatt

SEQ ID NO: 677869 - DNA, 20 bp, Artificial
  CRISPR gRNA sequence
ttgggattttgattagattg

SEQ ID NO: 677870 - DNA, 20 bp, Artificial
  CRISPR gRNA sequence
tgggattttgattagattgc

SEQ ID NO: 677871 - DNA, 20 bp, Artificial
  CRISPR gRNA sequence
gggattttgattagattgct

SEQ ID NO: 677872 - DNA, 20 bp, Artificial
  CRISPR gRNA sequence
ggattttgattagattgctt

SEQ ID NO: 677873 - DNA, 20 bp, Artificial
  CRISPR gRNA sequence
tgattagattgcttgggggc

SEQ ID NO: 677874 - DNA, 20 bp, Artificial
  CRISPR gRNA sequence
gattagattgcttgggggca

SEQ ID NO: 677875 - DNA, 20 bp, Artificial
  CRISPR gRNA sequence
attagattgcttgggggcag

SEQ ID NO: 677876 - DNA, 20 bp, Artificial
  CRISPR gRNA sequence
gattgcttgggggcaggtag

SEQ ID NO: 677877 - DNA, 20 bp, Artificial
  CRISPR gRNA sequence
cttgggggcaggtagggcag

SEQ ID NO: 677878 - DNA, 20 bp, Artificial
  CRISPR gRNA sequence
gggggcaggtagggcagcat

SEQ ID NO: 677879 - DNA, 20 bp, Artificial
  CRISPR gRNA sequence
ggggcaggtagggcagcatg

SEQ ID NO: 677880 - DNA, 20 bp, Artificial
  CRISPR gRNA sequence
tgtatttcattaaatgccac

SEQ ID NO: 677881 - DNA, 20 bp, Artificial
  CRISPR gRNA sequence
cattaaatgccacttgggac

SEQ ID NO: 677882 - DNA, 20 bp, Artificial
  CRISPR gRNA sequence
attaaatgccacttgggact

SEQ ID NO: 677883 - DNA, 20 bp, Artificial
  CRISPR gRNA sequence
aatgccacttgggactattt

SEQ ID NO: 677884 - DNA, 20 bp, Artificial
  CRISPR gRNA sequence
gggactatttgatttttttt

SEQ ID NO: 677885 - DNA, 20 bp, Artificial
  CRISPR gRNA sequence
ggactatttgatttttttta

SEQ ID NO: 677886 - DNA, 20 bp, Artificial
  CRISPR gRNA sequence
tttgattttttttatgggca

SEQ ID NO: 677887 - DNA, 20 bp, Artificial
  CRISPR gRNA sequence
gattttttttatgggcatat

SEQ ID NO: 677888 - DNA, 20 bp, Artificial
  CRISPR gRNA sequence
attttttttatgggcatatc

SEQ ID NO: 677889 - DNA, 20 bp, Artificial
  CRISPR gRNA sequence
tttttatgggcatatctaac

SEQ ID NO: 677890 - DNA, 20 bp, Artificial
  CRISPR gRNA sequence
ttttatgggcatatctaact

SEQ ID NO: 677891 - DNA, 20 bp, Artificial
  CRISPR gRNA sequence
tttatgggcatatctaacta

SEQ ID NO: 677892 - DNA, 20 bp, Artificial
  CRISPR gRNA sequence
ttatgggcatatctaactat

SEQ ID NO: 677893 - DNA, 20 bp, Artificial
  CRISPR gRNA sequence
tatgggcatatctaactatg

SEQ ID NO: 677894 - DNA, 20 bp, Artificial
  CRISPR gRNA sequence
atgggcatatctaactatgg

SEQ ID NO: 677895 - DNA, 20 bp, Artificial
  CRISPR gRNA sequence
tgggcatatctaactatggt

SEQ ID NO: 677896 - DNA, 20 bp, Artificial
  CRISPR gRNA sequence
actatggtaaaaagaaaaat

SEQ ID NO: 677897 - DNA, 20 bp, Artificial
  CRISPR gRNA sequence
tggtaaaaagaaaaataatc

SEQ ID NO: 677898 - DNA, 20 bp, Artificial
  CRISPR gRNA sequence
acgtaataaaagaaaaggac

SEQ ID NO: 677899 - DNA, 20 bp, Artificial
  CRISPR gRNA sequence
agaatgctgagcaaactgaa

SEQ ID NO: 677900 - DNA, 20 bp, Artificial
  CRISPR gRNA sequence
agcaaactgaataattcagc

SEQ ID NO: 677901 - DNA, 20 bp, Artificial
  CRISPR gRNA sequence
aataattcagcattaccata

SEQ ID NO: 677902 - DNA, 20 bp, Artificial
  CRISPR gRNA sequence
agcattaccataaatctaga

SEQ ID NO: 677903 - DNA, 20 bp, Artificial
  CRISPR gRNA sequence
ccataaatctagaatctggg

SEQ ID NO: 677904 - DNA, 20 bp, Artificial
  CRISPR gRNA sequence
gaatctgggagaaagtgtta

SEQ ID NO: 677905 - DNA, 20 bp, Artificial
  CRISPR gRNA sequence
ggagaaagtgttacctaaca

SEQ ID NO: 677906 - DNA, 20 bp, Artificial
  CRISPR gRNA sequence
cctaacagcagcaacaaaaa

SEQ ID NO: 677907 - DNA, 20 bp, Artificial
  CRISPR gRNA sequence
acagcagcaacaaaaatatc

SEQ ID NO: 677908 - DNA, 20 bp, Artificial
  CRISPR gRNA sequence
cataataatggggaaatgtt

SEQ ID NO: 677909 - DNA, 20 bp, Artificial
  CRISPR gRNA sequence
ataataatggggaaatgttc

SEQ ID NO: 677910 - DNA, 20 bp, Artificial
  CRISPR gRNA sequence
aaaatatattgttcagtaaa

SEQ ID NO: 677911 - DNA, 20 bp, Artificial
  CRISPR gRNA sequence
ttcagtaaaataagcaggtt

SEQ ID NO: 677912 - DNA, 20 bp, Artificial
  CRISPR gRNA sequence
agtaaaataagcaggttata

SEQ ID NO: 677913 - DNA, 20 bp, Artificial
  CRISPR gRNA sequence
taaaataacagtgtataaaa

SEQ ID NO: 677914 - DNA, 20 bp, Artificial
  CRISPR gRNA sequence
attttcataccaaaatttat

SEQ ID NO: 677915 - DNA, 20 bp, Artificial
  CRISPR gRNA sequence
tcataccaaaatttatcttt

SEQ ID NO: 677916 - DNA, 20 bp, Artificial
  CRISPR gRNA sequence
cataccaaaatttatctttg

SEQ ID NO: 677917 - DNA, 20 bp, Artificial
  CRISPR gRNA sequence
ataccaaaatttatctttgc

SEQ ID NO: 677918 - DNA, 20 bp, Artificial
  CRISPR gRNA sequence
atctttgcatgcattaaaaa

SEQ ID NO: 677919 - DNA, 20 bp, Artificial
  CRISPR gRNA sequence
tctttgcatgcattaaaaaa

SEQ ID NO: 677920 - DNA, 20 bp, Artificial
  CRISPR gRNA sequence
tgcatgcattaaaaaaatgc

SEQ ID NO: 677921 - DNA, 20 bp, Artificial
  CRISPR gRNA sequence
gcatgcattaaaaaaatgca

SEQ ID NO: 677922 - DNA, 20 bp, Artificial
  CRISPR gRNA sequence
catgcattaaaaaaatgcaa

SEQ ID NO: 677923 - DNA, 20 bp, Artificial
  CRISPR gRNA sequence
aaaaaatgcaagaggataat

SEQ ID NO: 677924 - DNA, 20 bp, Artificial
  CRISPR gRNA sequence
tttctaaatgatataattat

SEQ ID NO: 677925 - DNA, 20 bp, Artificial
  CRISPR gRNA sequence
ctaaatgatataattatgga

SEQ ID NO: 677926 - DNA, 20 bp, Artificial
  CRISPR gRNA sequence
taaatgatataattatggat

SEQ ID NO: 677927 - DNA, 20 bp, Artificial
  CRISPR gRNA sequence
aatgatataattatggattt

SEQ ID NO: 677928 - DNA, 20 bp, Artificial
  CRISPR gRNA sequence
tggattttactggtgattaa

SEQ ID NO: 677929 - DNA, 20 bp, Artificial
  CRISPR gRNA sequence
tactggtgattaaaaaaatt

SEQ ID NO: 677930 - DNA, 20 bp, Artificial
  CRISPR gRNA sequence
actggtgattaaaaaaattt

SEQ ID NO: 677931 - DNA, 20 bp, Artificial
  CRISPR gRNA sequence
ctggtgattaaaaaaatttt

SEQ ID NO: 677932 - DNA, 20 bp, Artificial
  CRISPR gRNA sequence
gtgattaaaaaaattttata

SEQ ID NO: 677933 - DNA, 20 bp, Artificial
  CRISPR gRNA sequence
aaaaaattttatatgaatat

SEQ ID NO: 677934 - DNA, 20 bp, Artificial
  CRISPR gRNA sequence
tatatgaatattttacattt

SEQ ID NO: 677935 - DNA, 20 bp, Artificial
  CRISPR gRNA sequence
atatgaatattttacatttg

SEQ ID NO: 677936 - DNA, 20 bp, Artificial
  CRISPR gRNA sequence
tatgaatattttacatttga

SEQ ID NO: 677937 - DNA, 20 bp, Artificial
  CRISPR gRNA sequence
tacatttgaaattagaaaga

SEQ ID NO: 677938 - DNA, 20 bp, Artificial
  CRISPR gRNA sequence
acatttgaaattagaaagag

SEQ ID NO: 677939 - DNA, 20 bp, Artificial
  CRISPR gRNA sequence
catttgaaattagaaagaga

SEQ ID NO: 677940 - DNA, 20 bp, Artificial
  CRISPR gRNA sequence
gaaattagaaagagatttaa

SEQ ID NO: 677941 - DNA, 20 bp, Artificial
  CRISPR gRNA sequence
aaattagaaagagatttaag

SEQ ID NO: 677942 - DNA, 20 bp, Artificial
  CRISPR gRNA sequence
gaaagagatttaagaaaaac

SEQ ID NO: 677943 - DNA, 20 bp, Artificial
  CRISPR gRNA sequence
aagaaaaactaatgagaaaa

SEQ ID NO: 677944 - DNA, 20 bp, Artificial
  CRISPR gRNA sequence
agaaaaactaatgagaaaaa

SEQ ID NO: 677945 - DNA, 20 bp, Artificial
  CRISPR gRNA sequence
atgagaaaaagctatttaaa

SEQ ID NO: 677946 - DNA, 20 bp, Artificial
  CRISPR gRNA sequence
tttaaagagtttggaaatta

SEQ ID NO: 677947 - DNA, 20 bp, Artificial
  CRISPR gRNA sequence
aaagagtttggaaattatat

SEQ ID NO: 677948 - DNA, 20 bp, Artificial
  CRISPR gRNA sequence
aagagtttggaaattatatc

SEQ ID NO: 677949 - DNA, 20 bp, Artificial
  CRISPR gRNA sequence
ggaaattatatcattcataa

SEQ ID NO: 677950 - DNA, 20 bp, Artificial
  CRISPR gRNA sequence
gaaattatatcattcataaa

SEQ ID NO: 677951 - DNA, 20 bp, Artificial
  CRISPR gRNA sequence
tatcattcataaaaactcca

SEQ ID NO: 677952 - DNA, 20 bp, Artificial
  CRISPR gRNA sequence
ataaaaactccacttattag

SEQ ID NO: 677953 - DNA, 20 bp, Artificial
  CRISPR gRNA sequence
cacttattagttctttctat

SEQ ID NO: 677954 - DNA, 20 bp, Artificial
  CRISPR gRNA sequence
attagttctttctatgagca

SEQ ID NO: 677955 - DNA, 20 bp, Artificial
  CRISPR gRNA sequence
ttagttctttctatgagcaa

SEQ ID NO: 677956 - DNA, 20 bp, Artificial
  CRISPR gRNA sequence
gttctttctatgagcaaagc

SEQ ID NO: 677957 - DNA, 20 bp, Artificial
  CRISPR gRNA sequence
tttctatgagcaaagcaccc

SEQ ID NO: 677958 - DNA, 20 bp, Artificial
  CRISPR gRNA sequence
tctatgagcaaagcaccctg

SEQ ID NO: 677959 - DNA, 20 bp, Artificial
  CRISPR gRNA sequence
ctatgagcaaagcaccctgc

SEQ ID NO: 677960 - DNA, 20 bp, Artificial
  CRISPR gRNA sequence
tatgagcaaagcaccctgct

SEQ ID NO: 677961 - DNA, 20 bp, Artificial
  CRISPR gRNA sequence
tgagcaaagcaccctgctaa

SEQ ID NO: 677962 - DNA, 20 bp, Artificial
  CRISPR gRNA sequence
ctaaactcttcggaagttac

SEQ ID NO: 677963 - DNA, 20 bp, Artificial
  CRISPR gRNA sequence
aactcttcggaagttacaaa

SEQ ID NO: 677964 - DNA, 20 bp, Artificial
  CRISPR gRNA sequence
ttcggaagttacaaagacac

SEQ ID NO: 677965 - DNA, 20 bp, Artificial
  CRISPR gRNA sequence
cggaagttacaaagacacat

SEQ ID NO: 677966 - DNA, 20 bp, Artificial
  CRISPR gRNA sequence
ggaagttacaaagacacata

SEQ ID NO: 677967 - DNA, 20 bp, Artificial
  CRISPR gRNA sequence
caaagacacataagatattg

SEQ ID NO: 677968 - DNA, 20 bp, Artificial
  CRISPR gRNA sequence
ttataatttctcaaaaaggt

SEQ ID NO: 677969 - DNA, 20 bp, Artificial
  CRISPR gRNA sequence
taatttctcaaaaaggtcaa

SEQ ID NO: 677970 - DNA, 20 bp, Artificial
  CRISPR gRNA sequence
ctcaaaaaggtcaagatcta

SEQ ID NO: 677971 - DNA, 20 bp, Artificial
  CRISPR gRNA sequence
tcaaaaaggtcaagatctaa

SEQ ID NO: 677972 - DNA, 20 bp, Artificial
  CRISPR gRNA sequence
aaaaaggtcaagatctaaca

SEQ ID NO: 677973 - DNA, 20 bp, Artificial
  CRISPR gRNA sequence
acatggagatgaaaattagt

SEQ ID NO: 677974 - DNA, 20 bp, Artificial
  CRISPR gRNA sequence
gtgtgtaaataccagtataa

SEQ ID NO: 677975 - DNA, 20 bp, Artificial
  CRISPR gRNA sequence
gaagtgttctaagcatgagg

SEQ ID NO: 677976 - DNA, 20 bp, Artificial
  CRISPR gRNA sequence
taagcatgagggtcaataca

SEQ ID NO: 677977 - DNA, 20 bp, Artificial
  CRISPR gRNA sequence
agcatgagggtcaatacagg

SEQ ID NO: 677978 - DNA, 20 bp, Artificial
  CRISPR gRNA sequence
tttagtgagaaagatcacgt

SEQ ID NO: 677979 - DNA, 20 bp, Artificial
  CRISPR gRNA sequence
tagtgagaaagatcacgtta

SEQ ID NO: 677980 - DNA, 20 bp, Artificial
  CRISPR gRNA sequence
agtgagaaagatcacgttaa

SEQ ID NO: 677981 - DNA, 20 bp, Artificial
  CRISPR gRNA sequence
gtgagaaagatcacgttaaa

SEQ ID NO: 677982 - DNA, 20 bp, Artificial
  CRISPR gRNA sequence
aaatggaacagagttaagga

SEQ ID NO: 677983 - DNA, 20 bp, Artificial
  CRISPR gRNA sequence
aggaggttggaagtggaggg

SEQ ID NO: 677984 - DNA, 20 bp, Artificial
  CRISPR gRNA sequence
gaagtggagggatgtggagg

SEQ ID NO: 677985 - DNA, 20 bp, Artificial
  CRISPR gRNA sequence
caagaggtagaaatcatgtg

SEQ ID NO: 677986 - DNA, 20 bp, Artificial
  CRISPR gRNA sequence
aagaggtagaaatcatgtga

SEQ ID NO: 677987 - DNA, 20 bp, Artificial
  CRISPR gRNA sequence
cagcaacaaacaaaactcag

SEQ ID NO: 677988 - DNA, 20 bp, Artificial
  CRISPR gRNA sequence
agaagtgtaggtgtaaagta

SEQ ID NO: 677989 - DNA, 20 bp, Artificial
  CRISPR gRNA sequence
tgactggggcctggggtagg

SEQ ID NO: 677990 - DNA, 20 bp, Artificial
  CRISPR gRNA sequence
gactggggcctggggtagga

SEQ ID NO: 677991 - DNA, 20 bp, Artificial
  CRISPR gRNA sequence
actggggcctggggtaggag

SEQ ID NO: 677992 - DNA, 20 bp, Artificial
  CRISPR gRNA sequence
gggcctggggtaggagtggg

SEQ ID NO: 677993 - DNA, 20 bp, Artificial
  CRISPR gRNA sequence
gggtaggagtgggatgtgtg

SEQ ID NO: 677994 - DNA, 20 bp, Artificial
  CRISPR gRNA sequence
tgggaccagatggtataggg

SEQ ID NO: 677995 - DNA, 20 bp, Artificial
  CRISPR gRNA sequence
gggaccagatggtatagggt

SEQ ID NO: 677996 - DNA, 20 bp, Artificial
  CRISPR gRNA sequence
ggaccagatggtatagggtg

SEQ ID NO: 677997 - DNA, 20 bp, Artificial
  CRISPR gRNA sequence
aatgccaggtaaagggattt

SEQ ID NO: 677998 - DNA, 20 bp, Artificial
  CRISPR gRNA sequence
caacttagttcaataaaact

SEQ ID NO: 677999 - DNA, 20 bp, Artificial
  CRISPR gRNA sequence
aacttagttcaataaaactt

SEQ ID NO: 678000 - DNA, 20 bp, Artificial
  CRISPR gRNA sequence
agttcaataaaacttaacag

SEQ ID NO: 678001 - DNA, 20 bp, Artificial
  CRISPR gRNA sequence
gttcaataaaacttaacagt

SEQ ID NO: 678002 - DNA, 20 bp, Artificial
  CRISPR gRNA sequence
aataaaacttaacagttatt

SEQ ID NO: 678003 - DNA, 20 bp, Artificial
  CRISPR gRNA sequence
aacagttattgaaagttgtt

SEQ ID NO: 678004 - DNA, 20 bp, Artificial
  CRISPR gRNA sequence
acagttattgaaagttgttg

SEQ ID NO: 678005 - DNA, 20 bp, Artificial
  CRISPR gRNA sequence
ttgaaagttgttggagagag

SEQ ID NO: 678006 - DNA, 20 bp, Artificial
  CRISPR gRNA sequence
aaagttgttggagagaggaa

SEQ ID NO: 678007 - DNA, 20 bp, Artificial
  CRISPR gRNA sequence
ttggagagaggaataaaata

SEQ ID NO: 678008 - DNA, 20 bp, Artificial
  CRISPR gRNA sequence
gagagaggaataaaataatt

SEQ ID NO: 678009 - DNA, 20 bp, Artificial
  CRISPR gRNA sequence
cacacgggaagagaaagcct

SEQ ID NO: 678010 - DNA, 20 bp, Artificial
  CRISPR gRNA sequence
tttgaagtctattatgccag

SEQ ID NO: 678011 - DNA, 20 bp, Artificial
  CRISPR gRNA sequence
gaagtctattatgccaggcc

SEQ ID NO: 678012 - DNA, 20 bp, Artificial
  CRISPR gRNA sequence
aagtctattatgccaggccc

SEQ ID NO: 678013 - DNA, 20 bp, Artificial
  CRISPR gRNA sequence
ttatgccaggcccaggtgag

SEQ ID NO: 678014 - DNA, 20 bp, Artificial
  CRISPR gRNA sequence
tgccaggcccaggtgagcaa

SEQ ID NO: 678015 - DNA, 20 bp, Artificial
  CRISPR gRNA sequence
aactaggacgttgattgtga

SEQ ID NO: 678016 - DNA, 20 bp, Artificial
  CRISPR gRNA sequence
ggacgttgattgtgagaatg

SEQ ID NO: 678017 - DNA, 20 bp, Artificial
  CRISPR gRNA sequence
attgtgagaatgaaaagaag

SEQ ID NO: 678018 - DNA, 20 bp, Artificial
  CRISPR gRNA sequence
tgagaatgaaaagaagggat

SEQ ID NO: 678019 - DNA, 20 bp, Artificial
  CRISPR gRNA sequence
gagaatcattttacgagtcc

SEQ ID NO: 678020 - DNA, 20 bp, Artificial
  CRISPR gRNA sequence
agaatcattttacgagtcca

SEQ ID NO: 678021 - DNA, 20 bp, Artificial
  CRISPR gRNA sequence
tacgagtccagtatatagaa

SEQ ID NO: 678022 - DNA, 20 bp, Artificial
  CRISPR gRNA sequence
acgagtccagtatatagaat

SEQ ID NO: 678023 - DNA, 20 bp, Artificial
  CRISPR gRNA sequence
cgagtccagtatatagaatt

SEQ ID NO: 678024 - DNA, 20 bp, Artificial
  CRISPR gRNA sequence
agcagctatttggaagtagg

SEQ ID NO: 678025 - DNA, 20 bp, Artificial
  CRISPR gRNA sequence
gcagctatttggaagtagga

SEQ ID NO: 678026 - DNA, 20 bp, Artificial
  CRISPR gRNA sequence
tttggaagtaggaaaagagg

SEQ ID NO: 678027 - DNA, 20 bp, Artificial
  CRISPR gRNA sequence
ggaagtaggaaaagaggtag

SEQ ID NO: 678028 - DNA, 20 bp, Artificial
  CRISPR gRNA sequence
gaagtaggaaaagaggtaga

SEQ ID NO: 678029 - DNA, 20 bp, Artificial
  CRISPR gRNA sequence
ttgtgaatcttgagtattag

SEQ ID NO: 678030 - DNA, 20 bp, Artificial
  CRISPR gRNA sequence
tgaatcttgagtattagaac

SEQ ID NO: 678031 - DNA, 20 bp, Artificial
  CRISPR gRNA sequence
gagtattagaacagtggtaa

SEQ ID NO: 678032 - DNA, 20 bp, Artificial
  CRISPR gRNA sequence
agtattagaacagtggtaac

SEQ ID NO: 678033 - DNA, 20 bp, Artificial
  CRISPR gRNA sequence
gaacagtggtaacactagca

SEQ ID NO: 678034 - DNA, 20 bp, Artificial
  CRISPR gRNA sequence
gcaaagaagggcagtcagaa

SEQ ID NO: 678035 - DNA, 20 bp, Artificial
  CRISPR gRNA sequence
tgtggaggaagatagttttg

SEQ ID NO: 678036 - DNA, 20 bp, Artificial
  CRISPR gRNA sequence
gtggaggaagatagttttgg

SEQ ID NO: 678037 - DNA, 20 bp, Artificial
  CRISPR gRNA sequence
tggaggaagatagttttggg

SEQ ID NO: 678038 - DNA, 20 bp, Artificial
  CRISPR gRNA sequence
tgggtatcttgaatgtttga

SEQ ID NO: 678039 - DNA, 20 bp, Artificial
  CRISPR gRNA sequence
gggtatcttgaatgtttgat

SEQ ID NO: 678040 - DNA, 20 bp, Artificial
  CRISPR gRNA sequence
ggtatcttgaatgtttgatt

SEQ ID NO: 678041 - DNA, 20 bp, Artificial
  CRISPR gRNA sequence
gaatgtttgatttggttttg

SEQ ID NO: 678042 - DNA, 20 bp, Artificial
  CRISPR gRNA sequence
aatgtttgatttggttttgg

SEQ ID NO: 678043 - DNA, 20 bp, Artificial
  CRISPR gRNA sequence
gatttggttttgggggaata

SEQ ID NO: 678044 - DNA, 20 bp, Artificial
  CRISPR gRNA sequence
atttggttttgggggaatat

SEQ ID NO: 678045 - DNA, 20 bp, Artificial
  CRISPR gRNA sequence
ggttttgggggaatatccat

SEQ ID NO: 678046 - DNA, 20 bp, Artificial
  CRISPR gRNA sequence
gttttgggggaatatccatg

SEQ ID NO: 678047 - DNA, 20 bp, Artificial
  CRISPR gRNA sequence
tgggggaatatccatgaggc

SEQ ID NO: 678048 - DNA, 20 bp, Artificial
  CRISPR gRNA sequence
gggggaatatccatgaggca

SEQ ID NO: 678049 - DNA, 20 bp, Artificial
  CRISPR gRNA sequence
ggggaatatccatgaggcaa

SEQ ID NO: 678050 - DNA, 20 bp, Artificial
  CRISPR gRNA sequence
aaaaggcagttgcaagtatg

SEQ ID NO: 678051 - DNA, 20 bp, Artificial
  CRISPR gRNA sequence
caagtatggatttgaagtag

SEQ ID NO: 678052 - DNA, 20 bp, Artificial
  CRISPR gRNA sequence
gaagtagtcattcagcaaat

SEQ ID NO: 678053 - DNA, 20 bp, Artificial
  CRISPR gRNA sequence
aagtagtcattcagcaaata

SEQ ID NO: 678054 - DNA, 20 bp, Artificial
  CRISPR gRNA sequence
agcaaatatatattgtctcc

SEQ ID NO: 678055 - DNA, 20 bp, Artificial
  CRISPR gRNA sequence
tctcctgtgtttaataactc

SEQ ID NO: 678056 - DNA, 20 bp, Artificial
  CRISPR gRNA sequence
ctgtgtttaataactcgata

SEQ ID NO: 678057 - DNA, 20 bp, Artificial
  CRISPR gRNA sequence
tgtttaataactcgatatgt

SEQ ID NO: 678058 - DNA, 20 bp, Artificial
  CRISPR gRNA sequence
aataactcgatatgtattat

SEQ ID NO: 678059 - DNA, 20 bp, Artificial
  CRISPR gRNA sequence
ataactcgatatgtattatc

SEQ ID NO: 678060 - DNA, 20 bp, Artificial
  CRISPR gRNA sequence
gatatgtattatcaatttaa

SEQ ID NO: 678061 - DNA, 20 bp, Artificial
  CRISPR gRNA sequence
tcaatttaaaattgagtaaa

SEQ ID NO: 678062 - DNA, 20 bp, Artificial
  CRISPR gRNA sequence
aaaattgagtaaaacaagat

SEQ ID NO: 678063 - DNA, 20 bp, Artificial
  CRISPR gRNA sequence
aaattgagtaaaacaagatc

SEQ ID NO: 678064 - DNA, 20 bp, Artificial
  CRISPR gRNA sequence
agtaaaacaagatctctctc

SEQ ID NO: 678065 - DNA, 20 bp, Artificial
  CRISPR gRNA sequence
tctcctcatgaagctcatcg

SEQ ID NO: 678066 - DNA, 20 bp, Artificial
  CRISPR gRNA sequence
tcctcatgaagctcatcgtt

SEQ ID NO: 678067 - DNA, 20 bp, Artificial
  CRISPR gRNA sequence
ctcatgaagctcatcgtttg

SEQ ID NO: 678068 - DNA, 20 bp, Artificial
  CRISPR gRNA sequence
atgaagctcatcgtttggac

SEQ ID NO: 678069 - DNA, 20 bp, Artificial
  CRISPR gRNA sequence
atcgtttggactagggaaat

SEQ ID NO: 678070 - DNA, 20 bp, Artificial
  CRISPR gRNA sequence
ggactagggaaataaatagg

SEQ ID NO: 678071 - DNA, 20 bp, Artificial
  CRISPR gRNA sequence
gactagggaaataaataggt

SEQ ID NO: 678072 - DNA, 20 bp, Artificial
  CRISPR gRNA sequence
gggaaataaataggtatccg

SEQ ID NO: 678073 - DNA, 20 bp, Artificial
  CRISPR gRNA sequence
attacaacacagttgttata

SEQ ID NO: 678074 - DNA, 20 bp, Artificial
  CRISPR gRNA sequence
caacacagttgttataagta

SEQ ID NO: 678075 - DNA, 20 bp, Artificial
  CRISPR gRNA sequence
ttataagtaatgcatcaaca

SEQ ID NO: 678076 - DNA, 20 bp, Artificial
  CRISPR gRNA sequence
taagtaatgcatcaacagag

SEQ ID NO: 678077 - DNA, 20 bp, Artificial
  CRISPR gRNA sequence
tgtgagagcagaggagacag

SEQ ID NO: 678078 - DNA, 20 bp, Artificial
  CRISPR gRNA sequence
tgagagcagaggagacagct

SEQ ID NO: 678079 - DNA, 20 bp, Artificial
  CRISPR gRNA sequence
tgtcctgatgctcttcgttt

SEQ ID NO: 678080 - DNA, 20 bp, Artificial
  CRISPR gRNA sequence
atgctcttcgttttggttgt

SEQ ID NO: 678081 - DNA, 20 bp, Artificial
  CRISPR gRNA sequence
ttcgttttggttgtagggaa

SEQ ID NO: 678082 - DNA, 20 bp, Artificial
  CRISPR gRNA sequence
cgttttggttgtagggaagg

SEQ ID NO: 678083 - DNA, 20 bp, Artificial
  CRISPR gRNA sequence
gttttggttgtagggaaggg

SEQ ID NO: 678084 - DNA, 20 bp, Artificial
  CRISPR gRNA sequence
tggttgtagggaagggattc

SEQ ID NO: 678085 - DNA, 20 bp, Artificial
  CRISPR gRNA sequence
ggttgtagggaagggattca

SEQ ID NO: 678086 - DNA, 20 bp, Artificial
  CRISPR gRNA sequence
gttgtagggaagggattcac

SEQ ID NO: 678087 - DNA, 20 bp, Artificial
  CRISPR gRNA sequence
tagggaagggattcactcag

SEQ ID NO: 678088 - DNA, 20 bp, Artificial
  CRISPR gRNA sequence
actcagacattgaaagatgt

SEQ ID NO: 678089 - DNA, 20 bp, Artificial
  CRISPR gRNA sequence
agacattgaaagatgtacat

SEQ ID NO: 678090 - DNA, 20 bp, Artificial
  CRISPR gRNA sequence
aaagatgtacatggccagtt

SEQ ID NO: 678091 - DNA, 20 bp, Artificial
  CRISPR gRNA sequence
gagcttacaaacatgggaaa

SEQ ID NO: 678092 - DNA, 20 bp, Artificial
  CRISPR gRNA sequence
acaaacatgggaaattattc

SEQ ID NO: 678093 - DNA, 20 bp, Artificial
  CRISPR gRNA sequence
caaacatgggaaattattct

SEQ ID NO: 678094 - DNA, 20 bp, Artificial
  CRISPR gRNA sequence
ttcttgacctgatgtggatg

SEQ ID NO: 678095 - DNA, 20 bp, Artificial
  CRISPR gRNA sequence
ttgacctgatgtggatgttt

SEQ ID NO: 678096 - DNA, 20 bp, Artificial
  CRISPR gRNA sequence
gacctgatgtggatgtttca

SEQ ID NO: 678097 - DNA, 20 bp, Artificial
  CRISPR gRNA sequence
acctgatgtggatgtttcat

SEQ ID NO: 678098 - DNA, 20 bp, Artificial
  CRISPR gRNA sequence
atgtggatgtttcataaaaa

SEQ ID NO: 678099 - DNA, 20 bp, Artificial
  CRISPR gRNA sequence
cataaaaatgagcacttcat

SEQ ID NO: 678100 - DNA, 20 bp, Artificial
  CRISPR gRNA sequence
ataaaaatgagcacttcatt

SEQ ID NO: 678101 - DNA, 20 bp, Artificial
  CRISPR gRNA sequence
catttagagagcaaagaggg

SEQ ID NO: 678102 - DNA, 20 bp, Artificial
  CRISPR gRNA sequence
atttagagagcaaagaggga

SEQ ID NO: 678103 - DNA, 20 bp, Artificial
  CRISPR gRNA sequence
agagagcaaagagggagaac

SEQ ID NO: 678104 - DNA, 20 bp, Artificial
  CRISPR gRNA sequence
gagagcaaagagggagaaca

SEQ ID NO: 678105 - DNA, 20 bp, Artificial
  CRISPR gRNA sequence
tactgagaacaatatctgaa

SEQ ID NO: 678106 - DNA, 20 bp, Artificial
  CRISPR gRNA sequence
agaacaatatctgaagggat

SEQ ID NO: 678107 - DNA, 20 bp, Artificial
  CRISPR gRNA sequence
aagggatgcatataacatat

SEQ ID NO: 678108 - DNA, 20 bp, Artificial
  CRISPR gRNA sequence
gcaagttaggaaaaaactga

SEQ ID NO: 678109 - DNA, 20 bp, Artificial
  CRISPR gRNA sequence
caagttaggaaaaaactgag

SEQ ID NO: 678110 - DNA, 20 bp, Artificial
  CRISPR gRNA sequence
ggaaaaaactgagaagcagt

SEQ ID NO: 678111 - DNA, 20 bp, Artificial
  CRISPR gRNA sequence
agaagcagtgagggcgaatg

SEQ ID NO: 678112 - DNA, 20 bp, Artificial
  CRISPR gRNA sequence
atctcagacgctaaaacagg

SEQ ID NO: 678113 - DNA, 20 bp, Artificial
  CRISPR gRNA sequence
agacgctaaaacaggagacc

SEQ ID NO: 678114 - DNA, 20 bp, Artificial
  CRISPR gRNA sequence
aaacaggagacccaagacac

SEQ ID NO: 678115 - DNA, 20 bp, Artificial
  CRISPR gRNA sequence
gatagtggccaagagattag

SEQ ID NO: 678116 - DNA, 20 bp, Artificial
  CRISPR gRNA sequence
atagtggccaagagattagg

SEQ ID NO: 678117 - DNA, 20 bp, Artificial
  CRISPR gRNA sequence
ggaagacagaggattaataa

SEQ ID NO: 678118 - DNA, 20 bp, Artificial
  CRISPR gRNA sequence
ataaaagcctatggatttag

SEQ ID NO: 678119 - DNA, 20 bp, Artificial
  CRISPR gRNA sequence
tggatttagtgattcagaga

SEQ ID NO: 678120 - DNA, 20 bp, Artificial
  CRISPR gRNA sequence
agtgattcagagaccactga

SEQ ID NO: 678121 - DNA, 20 bp, Artificial
  CRISPR gRNA sequence
gtgattcagagaccactgac

SEQ ID NO: 678122 - DNA, 20 bp, Artificial
  CRISPR gRNA sequence
agagaccactgacttttcaa

SEQ ID NO: 678123 - DNA, 20 bp, Artificial
  CRISPR gRNA sequence
acttttcaaaaatgtttcaa

SEQ ID NO: 678124 - DNA, 20 bp, Artificial
  CRISPR gRNA sequence
ttcaaaaatgtttcaataat

SEQ ID NO: 678125 - DNA, 20 bp, Artificial
  CRISPR gRNA sequence
tcaaaaatgtttcaataata

SEQ ID NO: 678126 - DNA, 20 bp, Artificial
  CRISPR gRNA sequence
caaaaatgtttcaataatag

SEQ ID NO: 678127 - DNA, 20 bp, Artificial
  CRISPR gRNA sequence
aaaaatgtttcaataatagc

SEQ ID NO: 678128 - DNA, 20 bp, Artificial
  CRISPR gRNA sequence
caataatagcagaaaaagtc

SEQ ID NO: 678129 - DNA, 20 bp, Artificial
  CRISPR gRNA sequence
aataatagcagaaaaagtcc

SEQ ID NO: 678130 - DNA, 20 bp, Artificial
  CRISPR gRNA sequence
cagttggtaacaatatgaag

SEQ ID NO: 678131 - DNA, 20 bp, Artificial
  CRISPR gRNA sequence
agttggtaacaatatgaagt

SEQ ID NO: 678132 - DNA, 20 bp, Artificial
  CRISPR gRNA sequence
gtaacaatatgaagtaataa

SEQ ID NO: 678133 - DNA, 20 bp, Artificial
  CRISPR gRNA sequence
ttataaaaataaaggtagtg

SEQ ID NO: 678134 - DNA, 20 bp, Artificial
  CRISPR gRNA sequence
taaaaataaaggtagtgaaa

SEQ ID NO: 678135 - DNA, 20 bp, Artificial
  CRISPR gRNA sequence
gtccttttatatgaatatat

SEQ ID NO: 678136 - DNA, 20 bp, Artificial
  CRISPR gRNA sequence
ttatatgaatatatatgtta

SEQ ID NO: 678137 - DNA, 20 bp, Artificial
  CRISPR gRNA sequence
tatatgaatatatatgttat

SEQ ID NO: 678138 - DNA, 20 bp, Artificial
  CRISPR gRNA sequence
atatgaatatatatgttata

SEQ ID NO: 678139 - DNA, 20 bp, Artificial
  CRISPR gRNA sequence
tatgaatatatatgttatat

SEQ ID NO: 678140 - DNA, 20 bp, Artificial
  CRISPR gRNA sequence
tatgtattaattatgtatta

SEQ ID NO: 678141 - DNA, 20 bp, Artificial
  CRISPR gRNA sequence
attatgtattactttaaaga

SEQ ID NO: 678142 - DNA, 20 bp, Artificial
  CRISPR gRNA sequence
tgtattactttaaagataaa

SEQ ID NO: 678143 - DNA, 20 bp, Artificial
  CRISPR gRNA sequence
ctttaaagataaactcatgt

SEQ ID NO: 678144 - DNA, 20 bp, Artificial
  CRISPR gRNA sequence
taaagataaactcatgtaca

SEQ ID NO: 678145 - DNA, 20 bp, Artificial
  CRISPR gRNA sequence
aaagataaactcatgtacag

SEQ ID NO: 678146 - DNA, 20 bp, Artificial
  CRISPR gRNA sequence
aagataaactcatgtacaga

SEQ ID NO: 678147 - DNA, 20 bp, Artificial
  CRISPR gRNA sequence
atgtacagataaacacatgt

SEQ ID NO: 678148 - DNA, 20 bp, Artificial
  CRISPR gRNA sequence
ttatgaactttatttttaag

SEQ ID NO: 678149 - DNA, 20 bp, Artificial
  CRISPR gRNA sequence
tatgaactttatttttaaga

SEQ ID NO: 678150 - DNA, 20 bp, Artificial
  CRISPR gRNA sequence
atgaactttatttttaagaa

SEQ ID NO: 678151 - DNA, 20 bp, Artificial
  CRISPR gRNA sequence
tgaactttatttttaagaaa

SEQ ID NO: 678152 - DNA, 20 bp, Artificial
  CRISPR gRNA sequence
tatttttaagaaatagtatg

SEQ ID NO: 678153 - DNA, 20 bp, Artificial
  CRISPR gRNA sequence
atttttaagaaatagtatga

SEQ ID NO: 678154 - DNA, 20 bp, Artificial
  CRISPR gRNA sequence
tttttaagaaatagtatgaa

SEQ ID NO: 678155 - DNA, 20 bp, Artificial
  CRISPR gRNA sequence
ttaagaaatagtatgaaatg

SEQ ID NO: 678156 - DNA, 20 bp, Artificial
  CRISPR gRNA sequence
taagaaatagtatgaaatgg

SEQ ID NO: 678157 - DNA, 20 bp, Artificial
  CRISPR gRNA sequence
aagaaatagtatgaaatgga

SEQ ID NO: 678158 - DNA, 20 bp, Artificial
  CRISPR gRNA sequence
agaaatagtatgaaatggat

SEQ ID NO: 678159 - DNA, 20 bp, Artificial
  CRISPR gRNA sequence
gtggagatagcagagccatt

SEQ ID NO: 678160 - DNA, 20 bp, Artificial
  CRISPR gRNA sequence
tggagatagcagagccattg

SEQ ID NO: 678161 - DNA, 20 bp, Artificial
  CRISPR gRNA sequence
aatttgcagggattgttggc

SEQ ID NO: 678162 - DNA, 20 bp, Artificial
  CRISPR gRNA sequence
gcagggattgttggcaatgt

SEQ ID NO: 678163 - DNA, 20 bp, Artificial
  CRISPR gRNA sequence
cagggattgttggcaatgtc

SEQ ID NO: 678164 - DNA, 20 bp, Artificial
  CRISPR gRNA sequence
ttggcaatgtctgaaaacaa

SEQ ID NO: 678165 - DNA, 20 bp, Artificial
  CRISPR gRNA sequence
gcaatgtctgaaaacaattt

SEQ ID NO: 678166 - DNA, 20 bp, Artificial
  CRISPR gRNA sequence
aaaacaattttcaaaggagt

SEQ ID NO: 678167 - DNA, 20 bp, Artificial
  CRISPR gRNA sequence
tcaaaggagtagtaagggca

SEQ ID NO: 678168 - DNA, 20 bp, Artificial
  CRISPR gRNA sequence
caaaggagtagtaagggcag

SEQ ID NO: 678169 - DNA, 20 bp, Artificial
  CRISPR gRNA sequence
aaaggagtagtaagggcaga

SEQ ID NO: 678170 - DNA, 20 bp, Artificial
  CRISPR gRNA sequence
tgaaggagctaagtatatag

SEQ ID NO: 678171 - DNA, 20 bp, Artificial
  CRISPR gRNA sequence
gaaggagctaagtatataga

SEQ ID NO: 678172 - DNA, 20 bp, Artificial
  CRISPR gRNA sequence
aaggagctaagtatatagag

SEQ ID NO: 678173 - DNA, 20 bp, Artificial
  CRISPR gRNA sequence
agtatatagaggaaaataaa

SEQ ID NO: 678174 - DNA, 20 bp, Artificial
  CRISPR gRNA sequence
caggtctcagaaatcctgaa

SEQ ID NO: 678175 - DNA, 20 bp, Artificial
  CRISPR gRNA sequence
agaaatcctgaaatcctgcc

SEQ ID NO: 678176 - DNA, 20 bp, Artificial
  CRISPR gRNA sequence
aaatcctgcctttccaccct

SEQ ID NO: 678177 - DNA, 20 bp, Artificial
  CRISPR gRNA sequence
cctttccaccctcactcccc

SEQ ID NO: 678178 - DNA, 20 bp, Artificial
  CRISPR gRNA sequence
tccaccctcactccccaatt

SEQ ID NO: 678179 - DNA, 20 bp, Artificial
  CRISPR gRNA sequence
ccaccctcactccccaatta

SEQ ID NO: 678180 - DNA, 20 bp, Artificial
  CRISPR gRNA sequence
caccctcactccccaattat

SEQ ID NO: 678181 - DNA, 20 bp, Artificial
  CRISPR gRNA sequence
actccccaattatataatga

SEQ ID NO: 678182 - DNA, 20 bp, Artificial
  CRISPR gRNA sequence
cccaattatataatgactac

SEQ ID NO: 678183 - DNA, 20 bp, Artificial
  CRISPR gRNA sequence
tataatgactactttttctt

SEQ ID NO: 678184 - DNA, 20 bp, Artificial
  CRISPR gRNA sequence
ctttttcttcagttgtcacc

SEQ ID NO: 678185 - DNA, 20 bp, Artificial
  CRISPR gRNA sequence
tttcttcagttgtcacctga

SEQ ID NO: 678186 - DNA, 20 bp, Artificial
  CRISPR gRNA sequence
ttcttcagttgtcacctgaa

SEQ ID NO: 678187 - DNA, 20 bp, Artificial
  CRISPR gRNA sequence
tcttcagttgtcacctgaaa

SEQ ID NO: 678188 - DNA, 20 bp, Artificial
  CRISPR gRNA sequence
cttcagttgtcacctgaaat

SEQ ID NO: 678189 - DNA, 20 bp, Artificial
  CRISPR gRNA sequence
ttcagttgtcacctgaaatg

SEQ ID NO: 678190 - DNA, 20 bp, Artificial
  CRISPR gRNA sequence
cagttgtcacctgaaatgtt

SEQ ID NO: 678191 - DNA, 20 bp, Artificial
  CRISPR gRNA sequence
agttgtcacctgaaatgttc

SEQ ID NO: 678192 - DNA, 20 bp, Artificial
  CRISPR gRNA sequence
tcacctgaaatgttcctact

SEQ ID NO: 678193 - DNA, 20 bp, Artificial
  CRISPR gRNA sequence
aaatgttcctacttcaaaca

SEQ ID NO: 678194 - DNA, 20 bp, Artificial
  CRISPR gRNA sequence
ctacttcaaacagaccttct

SEQ ID NO: 678195 - DNA, 20 bp, Artificial
  CRISPR gRNA sequence
cttcaaacagaccttcttgt

SEQ ID NO: 678196 - DNA, 20 bp, Artificial
  CRISPR gRNA sequence
caaacagaccttcttgttca

SEQ ID NO: 678197 - DNA, 20 bp, Artificial
  CRISPR gRNA sequence
aaacagaccttcttgttcaa

SEQ ID NO: 678198 - DNA, 20 bp, Artificial
  CRISPR gRNA sequence
cttgttcaaccttttcaaac

SEQ ID NO: 678199 - DNA, 20 bp, Artificial
  CRISPR gRNA sequence
ttgttcaaccttttcaaact

SEQ ID NO: 678200 - DNA, 20 bp, Artificial
  CRISPR gRNA sequence
gttcaaccttttcaaactag

SEQ ID NO: 678201 - DNA, 20 bp, Artificial
  CRISPR gRNA sequence
ttcaaccttttcaaactagt

SEQ ID NO: 678202 - DNA, 20 bp, Artificial
  CRISPR gRNA sequence
aaccttttcaaactagtttc

SEQ ID NO: 678203 - DNA, 20 bp, Artificial
  CRISPR gRNA sequence
ttcaaactagtttccccatg

SEQ ID NO: 678204 - DNA, 20 bp, Artificial
  CRISPR gRNA sequence
tcaaactagtttccccatgt

SEQ ID NO: 678205 - DNA, 20 bp, Artificial
  CRISPR gRNA sequence
caaactagtttccccatgtt

SEQ ID NO: 678206 - DNA, 20 bp, Artificial
  CRISPR gRNA sequence
aaactagtttccccatgtta

SEQ ID NO: 678207 - DNA, 20 bp, Artificial
  CRISPR gRNA sequence
gtttccccatgttatactac

SEQ ID NO: 678208 - DNA, 20 bp, Artificial
  CRISPR gRNA sequence
ccccatgttatactacacca

SEQ ID NO: 678209 - DNA, 20 bp, Artificial
  CRISPR gRNA sequence
cccatgttatactacaccac

SEQ ID NO: 678210 - DNA, 20 bp, Artificial
  CRISPR gRNA sequence
tactacaccaccattctttt

SEQ ID NO: 678211 - DNA, 20 bp, Artificial
  CRISPR gRNA sequence
caccaccattcttttgctcc

SEQ ID NO: 678212 - DNA, 20 bp, Artificial
  CRISPR gRNA sequence
ttttgctccatgcaactgcc

SEQ ID NO: 678213 - DNA, 20 bp, Artificial
  CRISPR gRNA sequence
ttgctccatgcaactgccca

SEQ ID NO: 678214 - DNA, 20 bp, Artificial
  CRISPR gRNA sequence
tgctccatgcaactgcccac

SEQ ID NO: 678215 - DNA, 20 bp, Artificial
  CRISPR gRNA sequence
gctccatgcaactgcccaca

SEQ ID NO: 678216 - DNA, 20 bp, Artificial
  CRISPR gRNA sequence
ctccatgcaactgcccacaa

SEQ ID NO: 678217 - DNA, 20 bp, Artificial
  CRISPR gRNA sequence
catgcaactgcccacaattt

SEQ ID NO: 678218 - DNA, 20 bp, Artificial
  CRISPR gRNA sequence
cccacaatttgtaatacatt

SEQ ID NO: 678219 - DNA, 20 bp, Artificial
  CRISPR gRNA sequence
gtaatacattgcttgtgtat

SEQ ID NO: 678220 - DNA, 20 bp, Artificial
  CRISPR gRNA sequence
taatacattgcttgtgtatt

SEQ ID NO: 678221 - DNA, 20 bp, Artificial
  CRISPR gRNA sequence
cttgtgtattttttaaatgt

SEQ ID NO: 678222 - DNA, 20 bp, Artificial
  CRISPR gRNA sequence
gtgtattttttaaatgtctg

SEQ ID NO: 678223 - DNA, 20 bp, Artificial
  CRISPR gRNA sequence
tgtattttttaaatgtctgt

SEQ ID NO: 678224 - DNA, 20 bp, Artificial
  CRISPR gRNA sequence
tttaaatgtctgtctgcctc

SEQ ID NO: 678225 - DNA, 20 bp, Artificial
  CRISPR gRNA sequence
ttaaatgtctgtctgcctca

SEQ ID NO: 678226 - DNA, 20 bp, Artificial
  CRISPR gRNA sequence
taaatgtctgtctgcctcac

SEQ ID NO: 678227 - DNA, 20 bp, Artificial
  CRISPR gRNA sequence
aaatgtctgtctgcctcacc

SEQ ID NO: 678228 - DNA, 20 bp, Artificial
  CRISPR gRNA sequence
aatgtctgtctgcctcacca

SEQ ID NO: 678229 - DNA, 20 bp, Artificial
  CRISPR gRNA sequence
tctgcctcaccagactgtca

SEQ ID NO: 678230 - DNA, 20 bp, Artificial
  CRISPR gRNA sequence
cctcaccagactgtcagttg

SEQ ID NO: 678231 - DNA, 20 bp, Artificial
  CRISPR gRNA sequence
accagactgtcagttgcata

SEQ ID NO: 678232 - DNA, 20 bp, Artificial
  CRISPR gRNA sequence
tcagttgcatacggataggc

SEQ ID NO: 678233 - DNA, 20 bp, Artificial
  CRISPR gRNA sequence
catacggataggcaccatgg

SEQ ID NO: 678234 - DNA, 20 bp, Artificial
  CRISPR gRNA sequence
gttttccactttacatttta

SEQ ID NO: 678235 - DNA, 20 bp, Artificial
  CRISPR gRNA sequence
ttttccactttacattttag

SEQ ID NO: 678236 - DNA, 20 bp, Artificial
  CRISPR gRNA sequence
tccactttacattttagcct

SEQ ID NO: 678237 - DNA, 20 bp, Artificial
  CRISPR gRNA sequence
ccactttacattttagcctc

SEQ ID NO: 678238 - DNA, 20 bp, Artificial
  CRISPR gRNA sequence
cactttacattttagcctca

SEQ ID NO: 678239 - DNA, 20 bp, Artificial
  CRISPR gRNA sequence
tacattttagcctcatgagc

SEQ ID NO: 678240 - DNA, 20 bp, Artificial
  CRISPR gRNA sequence
acattttagcctcatgagca

SEQ ID NO: 678241 - DNA, 20 bp, Artificial
  CRISPR gRNA sequence
cattttagcctcatgagcat

SEQ ID NO: 678242 - DNA, 20 bp, Artificial
  CRISPR gRNA sequence
tagcctcatgagcattggta

SEQ ID NO: 678243 - DNA, 20 bp, Artificial
  CRISPR gRNA sequence
agcctcatgagcattggtac

SEQ ID NO: 678244 - DNA, 20 bp, Artificial
  CRISPR gRNA sequence
gcctcatgagcattggtaca

SEQ ID NO: 678245 - DNA, 20 bp, Artificial
  CRISPR gRNA sequence
atgagcattggtacatagta

SEQ ID NO: 678246 - DNA, 20 bp, Artificial
  CRISPR gRNA sequence
gtacatagtagtctgttatt

SEQ ID NO: 678247 - DNA, 20 bp, Artificial
  CRISPR gRNA sequence
ttattgaatgaatgagagag

SEQ ID NO: 678248 - DNA, 20 bp, Artificial
  CRISPR gRNA sequence
ttgaatgaatgagagaggta

SEQ ID NO: 678249 - DNA, 20 bp, Artificial
  CRISPR gRNA sequence
aatgaatgagagaggtaaaa

SEQ ID NO: 678250 - DNA, 20 bp, Artificial
  CRISPR gRNA sequence
tctccagagcaaatttattg

SEQ ID NO: 678251 - DNA, 20 bp, Artificial
  CRISPR gRNA sequence
cagagcaaatttattggaaa

SEQ ID NO: 678252 - DNA, 20 bp, Artificial
  CRISPR gRNA sequence
attggaaatagaatagtttt

SEQ ID NO: 678253 - DNA, 20 bp, Artificial
  CRISPR gRNA sequence
ttggaaatagaatagtttta

SEQ ID NO: 678254 - DNA, 20 bp, Artificial
  CRISPR gRNA sequence
gaaatagaatagttttaaga

SEQ ID NO: 678255 - DNA, 20 bp, Artificial
  CRISPR gRNA sequence
taagaaatgtccaaatccaa

SEQ ID NO: 678256 - DNA, 20 bp, Artificial
  CRISPR gRNA sequence
aagaaatgtccaaatccaac

SEQ ID NO: 678257 - DNA, 20 bp, Artificial
  CRISPR gRNA sequence
agaaatgtccaaatccaaca

SEQ ID NO: 678258 - DNA, 20 bp, Artificial
  CRISPR gRNA sequence
ataattgggttgctggaata

SEQ ID NO: 678259 - DNA, 20 bp, Artificial
  CRISPR gRNA sequence
ggttgctggaatagaatgga

SEQ ID NO: 678260 - DNA, 20 bp, Artificial
  CRISPR gRNA sequence
ctggaatagaatggagatga

SEQ ID NO: 678261 - DNA, 20 bp, Artificial
  CRISPR gRNA sequence
gaatagaatggagatgaaga

SEQ ID NO: 678262 - DNA, 20 bp, Artificial
  CRISPR gRNA sequence
ggaaaattagggttatacat

SEQ ID NO: 678263 - DNA, 20 bp, Artificial
  CRISPR gRNA sequence
gggttatacatttagaacaa

SEQ ID NO: 678264 - DNA, 20 bp, Artificial
  CRISPR gRNA sequence
tacatttagaacaaagccca

SEQ ID NO: 678265 - DNA, 20 bp, Artificial
  CRISPR gRNA sequence
agaacaaagcccaactcaga

SEQ ID NO: 678266 - DNA, 20 bp, Artificial
  CRISPR gRNA sequence
gaacaaagcccaactcagat

SEQ ID NO: 678267 - DNA, 20 bp, Artificial
  CRISPR gRNA sequence
agatccctgttggactcaat

SEQ ID NO: 678268 - DNA, 20 bp, Artificial
  CRISPR gRNA sequence
ttggactcaatgatgggatg

SEQ ID NO: 678269 - DNA, 20 bp, Artificial
  CRISPR gRNA sequence
gactcaatgatgggatgaag

SEQ ID NO: 678270 - DNA, 20 bp, Artificial
  CRISPR gRNA sequence
aatgatgggatgaagaggaa

SEQ ID NO: 678271 - DNA, 20 bp, Artificial
  CRISPR gRNA sequence
taaaatagaggacaaaatgg

SEQ ID NO: 678272 - DNA, 20 bp, Artificial
  CRISPR gRNA sequence
aaaatagaggacaaaatggg

SEQ ID NO: 678273 - DNA, 20 bp, Artificial
  CRISPR gRNA sequence
aaatagaggacaaaatggga

SEQ ID NO: 678274 - DNA, 20 bp, Artificial
  CRISPR gRNA sequence
aaataaagcagatgggatag

SEQ ID NO: 678275 - DNA, 20 bp, Artificial
  CRISPR gRNA sequence
catgtctcttccttcttatc

SEQ ID NO: 678276 - DNA, 20 bp, Artificial
  CRISPR gRNA sequence
ttccttcttatcaggtgagt

SEQ ID NO: 678277 - DNA, 20 bp, Artificial
  CRISPR gRNA sequence
ccttcttatcaggtgagttg

SEQ ID NO: 678278 - DNA, 20 bp, Artificial
  CRISPR gRNA sequence
cttcttatcaggtgagttgg

SEQ ID NO: 678279 - DNA, 20 bp, Artificial
  CRISPR gRNA sequence
cttatcaggtgagttgggac

SEQ ID NO: 678280 - DNA, 20 bp, Artificial
  CRISPR gRNA sequence
ttatcaggtgagttgggact

SEQ ID NO: 678281 - DNA, 20 bp, Artificial
  CRISPR gRNA sequence
atcaggtgagttgggacttt

SEQ ID NO: 678282 - DNA, 20 bp, Artificial
  CRISPR gRNA sequence
tcaggtgagttgggactttt

SEQ ID NO: 678283 - DNA, 20 bp, Artificial
  CRISPR gRNA sequence
ggacttttagagggttgtga

SEQ ID NO: 678284 - DNA, 20 bp, Artificial
  CRISPR gRNA sequence
ttagagggttgtgagccaag

SEQ ID NO: 678285 - DNA, 20 bp, Artificial
  CRISPR gRNA sequence
tagagggttgtgagccaagg

SEQ ID NO: 678286 - DNA, 20 bp, Artificial
  CRISPR gRNA sequence
agagggttgtgagccaaggg

SEQ ID NO: 678287 - DNA, 20 bp, Artificial
  CRISPR gRNA sequence
gagggttgtgagccaagggg

SEQ ID NO: 678288 - DNA, 20 bp, Artificial
  CRISPR gRNA sequence
tgagccaaggggaatagaat

SEQ ID NO: 678289 - DNA, 20 bp, Artificial
  CRISPR gRNA sequence
caattaaattgagaaggtat

SEQ ID NO: 678290 - DNA, 20 bp, Artificial
  CRISPR gRNA sequence
aattaaattgagaaggtata

SEQ ID NO: 678291 - DNA, 20 bp, Artificial
  CRISPR gRNA sequence
aattgagaaggtataatgat

SEQ ID NO: 678292 - DNA, 20 bp, Artificial
  CRISPR gRNA sequence
agaaggtataatgattgctt

SEQ ID NO: 678293 - DNA, 20 bp, Artificial
  CRISPR gRNA sequence
cttacagaaataaggggaag

SEQ ID NO: 678294 - DNA, 20 bp, Artificial
  CRISPR gRNA sequence
acagaaataaggggaagaaa

SEQ ID NO: 678295 - DNA, 20 bp, Artificial
  CRISPR gRNA sequence
cagaaataaggggaagaaag

SEQ ID NO: 678296 - DNA, 20 bp, Artificial
  CRISPR gRNA sequence
atagtacaacagaggcatca

SEQ ID NO: 678297 - DNA, 20 bp, Artificial
  CRISPR gRNA sequence
ataccagggaagacccggaa

SEQ ID NO: 678298 - DNA, 20 bp, Artificial
  CRISPR gRNA sequence
aagtagtttacagcgggcta

SEQ ID NO: 678299 - DNA, 20 bp, Artificial
  CRISPR gRNA sequence
acagcgggctattagcttca

SEQ ID NO: 678300 - DNA, 20 bp, Artificial
  CRISPR gRNA sequence
cagcgggctattagcttcaa

SEQ ID NO: 678301 - DNA, 20 bp, Artificial
  CRISPR gRNA sequence
ttagcttcaatgtaagtgct

SEQ ID NO: 678302 - DNA, 20 bp, Artificial
  CRISPR gRNA sequence
gcttcaatgtaagtgcttaa

SEQ ID NO: 678303 - DNA, 20 bp, Artificial
  CRISPR gRNA sequence
caatgtaagtgcttaataag

SEQ ID NO: 678304 - DNA, 20 bp, Artificial
  CRISPR gRNA sequence
aatgtaagtgcttaataagt

SEQ ID NO: 678305 - DNA, 20 bp, Artificial
  CRISPR gRNA sequence
aataagtattaattggttaa

SEQ ID NO: 678306 - DNA, 20 bp, Artificial
  CRISPR gRNA sequence
ataagtattaattggttaat

SEQ ID NO: 678307 - DNA, 20 bp, Artificial
  CRISPR gRNA sequence
attggttaataaacttgttc

SEQ ID NO: 678308 - DNA, 20 bp, Artificial
  CRISPR gRNA sequence
gttaataaacttgttcagta

SEQ ID NO: 678309 - DNA, 20 bp, Artificial
  CRISPR gRNA sequence
ataaacttgttcagtataaa

SEQ ID NO: 678310 - DNA, 20 bp, Artificial
  CRISPR gRNA sequence
gttcagtataaattcattac

SEQ ID NO: 678311 - DNA, 20 bp, Artificial
  CRISPR gRNA sequence
ttcagtataaattcattact

SEQ ID NO: 678312 - DNA, 20 bp, Artificial
  CRISPR gRNA sequence
agtataaattcattactatt

SEQ ID NO: 678313 - DNA, 20 bp, Artificial
  CRISPR gRNA sequence
attactatttctagagaaat

SEQ ID NO: 678314 - DNA, 20 bp, Artificial
  CRISPR gRNA sequence
ctatttctagagaaatatta

SEQ ID NO: 678315 - DNA, 20 bp, Artificial
  CRISPR gRNA sequence
tttctagagaaatattacag

SEQ ID NO: 678316 - DNA, 20 bp, Artificial
  CRISPR gRNA sequence
ctagagaaatattacagaag

SEQ ID NO: 678317 - DNA, 20 bp, Artificial
  CRISPR gRNA sequence
tagagaaatattacagaaga

SEQ ID NO: 678318 - DNA, 20 bp, Artificial
  CRISPR gRNA sequence
gagaaatattacagaagaac

SEQ ID NO: 678319 - DNA, 20 bp, Artificial
  CRISPR gRNA sequence
cagaagaacccaaaactgag

SEQ ID NO: 678320 - DNA, 20 bp, Artificial
  CRISPR gRNA sequence
agtaatgctaatagtaaaca

SEQ ID NO: 678321 - DNA, 20 bp, Artificial
  CRISPR gRNA sequence
atagtaaacagatacttttt

SEQ ID NO: 678322 - DNA, 20 bp, Artificial
  CRISPR gRNA sequence
tttgttatgtagtcccatat

SEQ ID NO: 678323 - DNA, 20 bp, Artificial
  CRISPR gRNA sequence
ttgttatgtagtcccatatc

SEQ ID NO: 678324 - DNA, 20 bp, Artificial
  CRISPR gRNA sequence
tgttatgtagtcccatatct

SEQ ID NO: 678325 - DNA, 20 bp, Artificial
  CRISPR gRNA sequence
gttatgtagtcccatatctt

SEQ ID NO: 678326 - DNA, 20 bp, Artificial
  CRISPR gRNA sequence
ttatgtagtcccatatcttg

SEQ ID NO: 678327 - DNA, 20 bp, Artificial
  CRISPR gRNA sequence
tgtagtcccatatcttggaa

SEQ ID NO: 678328 - DNA, 20 bp, Artificial
  CRISPR gRNA sequence
ggaacataattacatgtaaa

SEQ ID NO: 678329 - DNA, 20 bp, Artificial
  CRISPR gRNA sequence
gaacataattacatgtaaat

SEQ ID NO: 678330 - DNA, 20 bp, Artificial
  CRISPR gRNA sequence
catgtaaatttatttatagt

SEQ ID NO: 678331 - DNA, 20 bp, Artificial
  CRISPR gRNA sequence
atttatagtatttacactag

SEQ ID NO: 678332 - DNA, 20 bp, Artificial
  CRISPR gRNA sequence
tttatagtatttacactaga

SEQ ID NO: 678333 - DNA, 20 bp, Artificial
  CRISPR gRNA sequence
atagtatttacactagatga

SEQ ID NO: 678334 - DNA, 20 bp, Artificial
  CRISPR gRNA sequence
tagtatttacactagatgat

SEQ ID NO: 678335 - DNA, 20 bp, Artificial
  CRISPR gRNA sequence
acactagatgatttcagcaa

SEQ ID NO: 678336 - DNA, 20 bp, Artificial
  CRISPR gRNA sequence
cactagatgatttcagcaaa

SEQ ID NO: 678337 - DNA, 20 bp, Artificial
  CRISPR gRNA sequence
gatgatttcagcaaaactta

SEQ ID NO: 678338 - DNA, 20 bp, Artificial
  CRISPR gRNA sequence
cagcaaaacttattttttgt

SEQ ID NO: 678339 - DNA, 20 bp, Artificial
  CRISPR gRNA sequence
agcaaaacttattttttgta

SEQ ID NO: 678340 - DNA, 20 bp, Artificial
  CRISPR gRNA sequence
attttttgtatttttaatgc

SEQ ID NO: 678341 - DNA, 20 bp, Artificial
  CRISPR gRNA sequence
ttttttgtatttttaatgct

SEQ ID NO: 678342 - DNA, 20 bp, Artificial
  CRISPR gRNA sequence
tttgtatttttaatgctgtc

SEQ ID NO: 678343 - DNA, 20 bp, Artificial
  CRISPR gRNA sequence
ttgtatttttaatgctgtca

SEQ ID NO: 678344 - DNA, 20 bp, Artificial
  CRISPR gRNA sequence
tgtatttttaatgctgtcac

SEQ ID NO: 678345 - DNA, 20 bp, Artificial
  CRISPR gRNA sequence
gtatttttaatgctgtcaca

SEQ ID NO: 678346 - DNA, 20 bp, Artificial
  CRISPR gRNA sequence
tatttttaatgctgtcacat

SEQ ID NO: 678347 - DNA, 20 bp, Artificial
  CRISPR gRNA sequence
ttaatgctgtcacatggtga

SEQ ID NO: 678348 - DNA, 20 bp, Artificial
  CRISPR gRNA sequence
taatgctgtcacatggtgat

SEQ ID NO: 678349 - DNA, 20 bp, Artificial
  CRISPR gRNA sequence
aatgctgtcacatggtgata

SEQ ID NO: 678350 - DNA, 20 bp, Artificial
  CRISPR gRNA sequence
atgctgtcacatggtgatac

SEQ ID NO: 678351 - DNA, 20 bp, Artificial
  CRISPR gRNA sequence
tcacatggtgatacaagttc

SEQ ID NO: 678352 - DNA, 20 bp, Artificial
  CRISPR gRNA sequence
tgcacagtattctcagctac

SEQ ID NO: 678353 - DNA, 20 bp, Artificial
  CRISPR gRNA sequence
cacagtattctcagctactt

SEQ ID NO: 678354 - DNA, 20 bp, Artificial
  CRISPR gRNA sequence
tcagctacttcccagaaatc

SEQ ID NO: 678355 - DNA, 20 bp, Artificial
  CRISPR gRNA sequence
agctacttcccagaaatcca

SEQ ID NO: 678356 - DNA, 20 bp, Artificial
  CRISPR gRNA sequence
cttcccagaaatccatggtt

SEQ ID NO: 678357 - DNA, 20 bp, Artificial
  CRISPR gRNA sequence
cccagaaatccatggttcca

SEQ ID NO: 678358 - DNA, 20 bp, Artificial
  CRISPR gRNA sequence
ccagaaatccatggttccaa

SEQ ID NO: 678359 - DNA, 20 bp, Artificial
  CRISPR gRNA sequence
caaaaaatagaagctggttt

SEQ ID NO: 678360 - DNA, 20 bp, Artificial
  CRISPR gRNA sequence
gtttgccaagcatttttaaa

SEQ ID NO: 678361 - DNA, 20 bp, Artificial
  CRISPR gRNA sequence
gccaagcatttttaaaaaaa

SEQ ID NO: 678362 - DNA, 20 bp, Artificial
  CRISPR gRNA sequence
ccaagcatttttaaaaaaat

SEQ ID NO: 678363 - DNA, 20 bp, Artificial
  CRISPR gRNA sequence
ttaaaaaaatgaataatcac

SEQ ID NO: 678364 - DNA, 20 bp, Artificial
  CRISPR gRNA sequence
taaaaaaatgaataatcact

SEQ ID NO: 678365 - DNA, 20 bp, Artificial
  CRISPR gRNA sequence
aaaaaaatgaataatcactc

SEQ ID NO: 678366 - DNA, 20 bp, Artificial
  CRISPR gRNA sequence
aaaaaatgaataatcactcc

SEQ ID NO: 678367 - DNA, 20 bp, Artificial
  CRISPR gRNA sequence
cataaataacttttatgata

SEQ ID NO: 678368 - DNA, 20 bp, Artificial
  CRISPR gRNA sequence
ttatgatagtttacaaacaa

SEQ ID NO: 678369 - DNA, 20 bp, Artificial
  CRISPR gRNA sequence
tatgatagtttacaaacaat

SEQ ID NO: 678370 - DNA, 20 bp, Artificial
  CRISPR gRNA sequence
atgatagtttacaaacaatt

SEQ ID NO: 678371 - DNA, 20 bp, Artificial
  CRISPR gRNA sequence
tgatagtttacaaacaatta

SEQ ID NO: 678372 - DNA, 20 bp, Artificial
  CRISPR gRNA sequence
acaaacaattatgattatga

SEQ ID NO: 678373 - DNA, 20 bp, Artificial
  CRISPR gRNA sequence
caaacaattatgattatgaa

SEQ ID NO: 678374 - DNA, 20 bp, Artificial
  CRISPR gRNA sequence
tgattatgaaataactgatc

SEQ ID NO: 678375 - DNA, 20 bp, Artificial
  CRISPR gRNA sequence
tgaaataactgatcttaatt

SEQ ID NO: 678376 - DNA, 20 bp, Artificial
  CRISPR gRNA sequence
atcttaatttatgtgtacct

SEQ ID NO: 678377 - DNA, 20 bp, Artificial
  CRISPR gRNA sequence
aatttatgtgtacctcaatt

SEQ ID NO: 678378 - DNA, 20 bp, Artificial
  CRISPR gRNA sequence
atttatgtgtacctcaatta

SEQ ID NO: 678379 - DNA, 20 bp, Artificial
  CRISPR gRNA sequence
atgtgtacctcaattacaat

SEQ ID NO: 678380 - DNA, 20 bp, Artificial
  CRISPR gRNA sequence
tgtgtacctcaattacaatc

SEQ ID NO: 678381 - DNA, 20 bp, Artificial
  CRISPR gRNA sequence
aattacaatctaaaggtttg

SEQ ID NO: 678382 - DNA, 20 bp, Artificial
  CRISPR gRNA sequence
caatctaaaggtttggtgta

SEQ ID NO: 678383 - DNA, 20 bp, Artificial
  CRISPR gRNA sequence
aaggtttggtgtagctttct

SEQ ID NO: 678384 - DNA, 20 bp, Artificial
  CRISPR gRNA sequence
ggtgtagctttctttttcat

SEQ ID NO: 678385 - DNA, 20 bp, Artificial
  CRISPR gRNA sequence
gtgtagctttctttttcatc

SEQ ID NO: 678386 - DNA, 20 bp, Artificial
  CRISPR gRNA sequence
tctttttcatcagtacagtg

SEQ ID NO: 678387 - DNA, 20 bp, Artificial
  CRISPR gRNA sequence
ctttttcatcagtacagtga

SEQ ID NO: 678388 - DNA, 20 bp, Artificial
  CRISPR gRNA sequence
tttttcatcagtacagtgaa

SEQ ID NO: 678389 - DNA, 20 bp, Artificial
  CRISPR gRNA sequence
tttcatcagtacagtgaaac

SEQ ID NO: 678390 - DNA, 20 bp, Artificial
  CRISPR gRNA sequence
ttcatcagtacagtgaaact

SEQ ID NO: 678391 - DNA, 20 bp, Artificial
  CRISPR gRNA sequence
tcatcagtacagtgaaactt

SEQ ID NO: 678392 - DNA, 20 bp, Artificial
  CRISPR gRNA sequence
catcagtacagtgaaacttt

SEQ ID NO: 678393 - DNA, 20 bp, Artificial
  CRISPR gRNA sequence
atcagtacagtgaaactttc

SEQ ID NO: 678394 - DNA, 20 bp, Artificial
  CRISPR gRNA sequence
tcaggcagccatgaatacct

SEQ ID NO: 678395 - DNA, 20 bp, Artificial
  CRISPR gRNA sequence
caggcagccatgaatacctt

SEQ ID NO: 678396 - DNA, 20 bp, Artificial
  CRISPR gRNA sequence
aggcagccatgaataccttg

SEQ ID NO: 678397 - DNA, 20 bp, Artificial
  CRISPR gRNA sequence
gccttgttatagtatttcag

SEQ ID NO: 678398 - DNA, 20 bp, Artificial
  CRISPR gRNA sequence
ccttgttatagtatttcagt

SEQ ID NO: 678399 - DNA, 20 bp, Artificial
  CRISPR gRNA sequence
gttatagtatttcagttcct

SEQ ID NO: 678400 - DNA, 20 bp, Artificial
  CRISPR gRNA sequence
ttatagtatttcagttcctc

SEQ ID NO: 678401 - DNA, 20 bp, Artificial
  CRISPR gRNA sequence
tagtatttcagttcctcttg

SEQ ID NO: 678402 - DNA, 20 bp, Artificial
  CRISPR gRNA sequence
cagttcctcttgtgaccagt

SEQ ID NO: 678403 - DNA, 20 bp, Artificial
  CRISPR gRNA sequence
agttcctcttgtgaccagtg

SEQ ID NO: 678404 - DNA, 20 bp, Artificial
  CRISPR gRNA sequence
ctcttgtgaccagtgtcata

SEQ ID NO: 678405 - DNA, 20 bp, Artificial
  CRISPR gRNA sequence
ttgtgaccagtgtcatagca

SEQ ID NO: 678406 - DNA, 20 bp, Artificial
  CRISPR gRNA sequence
gtgaccagtgtcatagcatg

SEQ ID NO: 678407 - DNA, 20 bp, Artificial
  CRISPR gRNA sequence
tgaccagtgtcatagcatgg

SEQ ID NO: 678408 - DNA, 20 bp, Artificial
  CRISPR gRNA sequence
ataagttaactggagttagg

SEQ ID NO: 678409 - DNA, 20 bp, Artificial
  CRISPR gRNA sequence
taagttaactggagttaggg

SEQ ID NO: 678410 - DNA, 20 bp, Artificial
  CRISPR gRNA sequence
actggagttagggatgctat

SEQ ID NO: 678411 - DNA, 20 bp, Artificial
  CRISPR gRNA sequence
gagttagggatgctatcttt

SEQ ID NO: 678412 - DNA, 20 bp, Artificial
  CRISPR gRNA sequence
gggatgctatctttggtcat

SEQ ID NO: 678413 - DNA, 20 bp, Artificial
  CRISPR gRNA sequence
tctttggtcatgaaaaagag

SEQ ID NO: 678414 - DNA, 20 bp, Artificial
  CRISPR gRNA sequence
tggtcatgaaaaagagttgt

SEQ ID NO: 678415 - DNA, 20 bp, Artificial
  CRISPR gRNA sequence
ggtcatgaaaaagagttgtc

SEQ ID NO: 678416 - DNA, 20 bp, Artificial
  CRISPR gRNA sequence
gtcatgaaaaagagttgtct

SEQ ID NO: 678417 - DNA, 20 bp, Artificial
  CRISPR gRNA sequence
tctgttattctctgagcaaa

SEQ ID NO: 678418 - DNA, 20 bp, Artificial
  CRISPR gRNA sequence
ttattctctgagcaaaacta

SEQ ID NO: 678419 - DNA, 20 bp, Artificial
  CRISPR gRNA sequence
ttctctgagcaaaactaaat

SEQ ID NO: 678420 - DNA, 20 bp, Artificial
  CRISPR gRNA sequence
tctgagcaaaactaaataat

SEQ ID NO: 678421 - DNA, 20 bp, Artificial
  CRISPR gRNA sequence
tgagcaaaactaaataattc

SEQ ID NO: 678422 - DNA, 20 bp, Artificial
  CRISPR gRNA sequence
agcaaaactaaataattcct

SEQ ID NO: 678423 - DNA, 20 bp, Artificial
  CRISPR gRNA sequence
aataattcctctgggagtca

SEQ ID NO: 678424 - DNA, 20 bp, Artificial
  CRISPR gRNA sequence
ctctgggagtcaaatagaga

SEQ ID NO: 678425 - DNA, 20 bp, Artificial
  CRISPR gRNA sequence
tgggagtcaaatagagacac

SEQ ID NO: 678426 - DNA, 20 bp, Artificial
  CRISPR gRNA sequence
ggagtcaaatagagacacgg

SEQ ID NO: 678427 - DNA, 20 bp, Artificial
  CRISPR gRNA sequence
gatcacacggtgctttacta

SEQ ID NO: 678428 - DNA, 20 bp, Artificial
  CRISPR gRNA sequence
tactattgagggctttggca

SEQ ID NO: 678429 - DNA, 20 bp, Artificial
  CRISPR gRNA sequence
actattgagggctttggcac

SEQ ID NO: 678430 - DNA, 20 bp, Artificial
  CRISPR gRNA sequence
ctattgagggctttggcaca

SEQ ID NO: 678431 - DNA, 20 bp, Artificial
  CRISPR gRNA sequence
ttgagggctttggcacagac

SEQ ID NO: 678432 - DNA, 20 bp, Artificial
  CRISPR gRNA sequence
agggctttggcacagaccac

SEQ ID NO: 678433 - DNA, 20 bp, Artificial
  CRISPR gRNA sequence
tggcacagaccacctggggt

SEQ ID NO: 678434 - DNA, 20 bp, Artificial
  CRISPR gRNA sequence
ggcacagaccacctggggtt

SEQ ID NO: 678435 - DNA, 20 bp, Artificial
  CRISPR gRNA sequence
gcacagaccacctggggttt

SEQ ID NO: 678436 - DNA, 20 bp, Artificial
  CRISPR gRNA sequence
gggttttatgttgttctgta

SEQ ID NO: 678437 - DNA, 20 bp, Artificial
  CRISPR gRNA sequence
tatgttgttctgtattcatt

SEQ ID NO: 678438 - DNA, 20 bp, Artificial
  CRISPR gRNA sequence
atgttgttctgtattcattc

SEQ ID NO: 678439 - DNA, 20 bp, Artificial
  CRISPR gRNA sequence
tgttgttctgtattcattca

SEQ ID NO: 678440 - DNA, 20 bp, Artificial
  CRISPR gRNA sequence
ttctgtattcattcaaaacc

SEQ ID NO: 678441 - DNA, 20 bp, Artificial
  CRISPR gRNA sequence
tgtattcattcaaaaccaag

SEQ ID NO: 678442 - DNA, 20 bp, Artificial
  CRISPR gRNA sequence
tattcattcaaaaccaagag

SEQ ID NO: 678443 - DNA, 20 bp, Artificial
  CRISPR gRNA sequence
attcaaaaccaagagtcaaa

SEQ ID NO: 678444 - DNA, 20 bp, Artificial
  CRISPR gRNA sequence
aaaaccaagagtcaaagtgc

SEQ ID NO: 678445 - DNA, 20 bp, Artificial
  CRISPR gRNA sequence
tgtgatgtccttatgaagag

SEQ ID NO: 678446 - DNA, 20 bp, Artificial
  CRISPR gRNA sequence
tgatgtccttatgaagagtc

SEQ ID NO: 678447 - DNA, 20 bp, Artificial
  CRISPR gRNA sequence
atgaagagtcatgcattaaa

SEQ ID NO: 678448 - DNA, 20 bp, Artificial
  CRISPR gRNA sequence
tgaagagtcatgcattaaaa

SEQ ID NO: 678449 - DNA, 20 bp, Artificial
  CRISPR gRNA sequence
aaacatgcttctttccatag

SEQ ID NO: 678450 - DNA, 20 bp, Artificial
  CRISPR gRNA sequence
ctttccatagagattatatt

SEQ ID NO: 678451 - DNA, 20 bp, Artificial
  CRISPR gRNA sequence
tttccatagagattatattt

SEQ ID NO: 678452 - DNA, 20 bp, Artificial
  CRISPR gRNA sequence
tccatagagattatattttt

SEQ ID NO: 678453 - DNA, 20 bp, Artificial
  CRISPR gRNA sequence
ccatagagattatatttttc

SEQ ID NO: 678454 - DNA, 20 bp, Artificial
  CRISPR gRNA sequence
catagagattatatttttct

SEQ ID NO: 678455 - DNA, 20 bp, Artificial
  CRISPR gRNA sequence
tatttttcttctttgttttt

SEQ ID NO: 678456 - DNA, 20 bp, Artificial
  CRISPR gRNA sequence
ttcttctttgttttttaagg

SEQ ID NO: 678457 - DNA, 20 bp, Artificial
  CRISPR gRNA sequence
tcttctttgttttttaaggt

SEQ ID NO: 678458 - DNA, 20 bp, Artificial
  CRISPR gRNA sequence
cttctttgttttttaaggtt

SEQ ID NO: 678459 - DNA, 20 bp, Artificial
  CRISPR gRNA sequence
ttctttgttttttaaggttt

SEQ ID NO: 678460 - DNA, 20 bp, Artificial
  CRISPR gRNA sequence
ctttgttttttaaggttttt

SEQ ID NO: 678461 - DNA, 20 bp, Artificial
  CRISPR gRNA sequence
tttgttttttaaggtttttt

SEQ ID NO: 678462 - DNA, 20 bp, Artificial
  CRISPR gRNA sequence
tgttttttaaggtttttttt

SEQ ID NO: 678463 - DNA, 20 bp, Artificial
  CRISPR gRNA sequence
gttttttaaggtttttttta

SEQ ID NO: 678464 - DNA, 20 bp, Artificial
  CRISPR gRNA sequence
ttttttaaggttttttttaa

SEQ ID NO: 678465 - DNA, 20 bp, Artificial
  CRISPR gRNA sequence
tttaaggttttttttaactg

SEQ ID NO: 678466 - DNA, 20 bp, Artificial
  CRISPR gRNA sequence
ttaaggttttttttaactga

SEQ ID NO: 678467 - DNA, 20 bp, Artificial
  CRISPR gRNA sequence
taaggttttttttaactgaa

SEQ ID NO: 678468 - DNA, 20 bp, Artificial
  CRISPR gRNA sequence
aaggttttttttaactgaac

SEQ ID NO: 678469 - DNA, 20 bp, Artificial
  CRISPR gRNA sequence
aggttttttttaactgaaca

SEQ ID NO: 678470 - DNA, 20 bp, Artificial
  CRISPR gRNA sequence
tttttaactgaacatcttag

SEQ ID NO: 678471 - DNA, 20 bp, Artificial
  CRISPR gRNA sequence
ttttaactgaacatcttagt

SEQ ID NO: 678472 - DNA, 20 bp, Artificial
  CRISPR gRNA sequence
tttaactgaacatcttagta

SEQ ID NO: 678473 - DNA, 20 bp, Artificial
  CRISPR gRNA sequence
ttaactgaacatcttagtat

SEQ ID NO: 678474 - DNA, 20 bp, Artificial
  CRISPR gRNA sequence
taactgaacatcttagtatt

SEQ ID NO: 678475 - DNA, 20 bp, Artificial
  CRISPR gRNA sequence
aactgaacatcttagtattt

SEQ ID NO: 678476 - DNA, 20 bp, Artificial
  CRISPR gRNA sequence
actgaacatcttagtatttt

SEQ ID NO: 678477 - DNA, 20 bp, Artificial
  CRISPR gRNA sequence
aacatcttagtattttaaca

SEQ ID NO: 678478 - DNA, 20 bp, Artificial
  CRISPR gRNA sequence
agtattttaacagatgtatt

SEQ ID NO: 678479 - DNA, 20 bp, Artificial
  CRISPR gRNA sequence
gtattttaacagatgtattg

SEQ ID NO: 678480 - DNA, 20 bp, Artificial
  CRISPR gRNA sequence
taacagatgtattgagataa

SEQ ID NO: 678481 - DNA, 20 bp, Artificial
  CRISPR gRNA sequence
aacagatgtattgagataat

SEQ ID NO: 678482 - DNA, 20 bp, Artificial
  CRISPR gRNA sequence
acagatgtattgagataatg

SEQ ID NO: 678483 - DNA, 20 bp, Artificial
  CRISPR gRNA sequence
agataatgacactgagataa

SEQ ID NO: 678484 - DNA, 20 bp, Artificial
  CRISPR gRNA sequence
agataatggctccctagcta

SEQ ID NO: 678485 - DNA, 20 bp, Artificial
  CRISPR gRNA sequence
cctagctattagggaataat

SEQ ID NO: 678486 - DNA, 20 bp, Artificial
  CRISPR gRNA sequence
gctattagggaataattcat

SEQ ID NO: 678487 - DNA, 20 bp, Artificial
  CRISPR gRNA sequence
ttagggaataattcatttcc

SEQ ID NO: 678488 - DNA, 20 bp, Artificial
  CRISPR gRNA sequence
gggaataattcatttcctta

SEQ ID NO: 678489 - DNA, 20 bp, Artificial
  CRISPR gRNA sequence
atttccttaatgtgagatgt

SEQ ID NO: 678490 - DNA, 20 bp, Artificial
  CRISPR gRNA sequence
ccttaatgtgagatgttttg

SEQ ID NO: 678491 - DNA, 20 bp, Artificial
  CRISPR gRNA sequence
cttaatgtgagatgttttgg

SEQ ID NO: 678492 - DNA, 20 bp, Artificial
  CRISPR gRNA sequence
aatgtgagatgttttggaaa

SEQ ID NO: 678493 - DNA, 20 bp, Artificial
  CRISPR gRNA sequence
atgtgagatgttttggaaaa

SEQ ID NO: 678494 - DNA, 20 bp, Artificial
  CRISPR gRNA sequence
tggaaaatattactgtcatt

SEQ ID NO: 678495 - DNA, 20 bp, Artificial
  CRISPR gRNA sequence
ggaaaatattactgtcattt

SEQ ID NO: 678496 - DNA, 20 bp, Artificial
  CRISPR gRNA sequence
gaaaatattactgtcatttt

SEQ ID NO: 678497 - DNA, 20 bp, Artificial
  CRISPR gRNA sequence
ctgtcattttgtaactacat

SEQ ID NO: 678498 - DNA, 20 bp, Artificial
  CRISPR gRNA sequence
tcattttgtaactacatatt

SEQ ID NO: 678499 - DNA, 20 bp, Artificial
  CRISPR gRNA sequence
tgtaactacatattgtgtaa

SEQ ID NO: 678500 - DNA, 20 bp, Artificial
  CRISPR gRNA sequence
gtaactacatattgtgtaat

SEQ ID NO: 678501 - DNA, 20 bp, Artificial
  CRISPR gRNA sequence
taactacatattgtgtaata

SEQ ID NO: 678502 - DNA, 20 bp, Artificial
  CRISPR gRNA sequence
catattgtgtaataatcctg

SEQ ID NO: 678503 - DNA, 20 bp, Artificial
  CRISPR gRNA sequence
tgtaataatcctgactcaaa

SEQ ID NO: 678504 - DNA, 20 bp, Artificial
  CRISPR gRNA sequence
actcaaagcacctagtaggt

SEQ ID NO: 678505 - DNA, 20 bp, Artificial
  CRISPR gRNA sequence
aaagcacctagtaggttaat

SEQ ID NO: 678506 - DNA, 20 bp, Artificial
  CRISPR gRNA sequence
gtaggttaattcttggtatt

SEQ ID NO: 678507 - DNA, 20 bp, Artificial
  CRISPR gRNA sequence
attcttggtattataaaagc

SEQ ID NO: 678508 - DNA, 20 bp, Artificial
  CRISPR gRNA sequence
ttggtattataaaagctgat

SEQ ID NO: 678509 - DNA, 20 bp, Artificial
  CRISPR gRNA sequence
ggtattataaaagctgatga

SEQ ID NO: 678510 - DNA, 20 bp, Artificial
  CRISPR gRNA sequence
gtattataaaagctgatgag

SEQ ID NO: 678511 - DNA, 20 bp, Artificial
  CRISPR gRNA sequence
taaaagctgatgagggagaa

SEQ ID NO: 678512 - DNA, 20 bp, Artificial
  CRISPR gRNA sequence
atgagggagaatatacttac

SEQ ID NO: 678513 - DNA, 20 bp, Artificial
  CRISPR gRNA sequence
acctgccacaaaattttgca

SEQ ID NO: 678514 - DNA, 20 bp, Artificial
  CRISPR gRNA sequence
cctgccacaaaattttgcat

SEQ ID NO: 678515 - DNA, 20 bp, Artificial
  CRISPR gRNA sequence
ccacaaaattttgcatgtgt

SEQ ID NO: 678516 - DNA, 20 bp, Artificial
  CRISPR gRNA sequence
tgcatgtgtgaatagttgtt

SEQ ID NO: 678517 - DNA, 20 bp, Artificial
  CRISPR gRNA sequence
gcatgtgtgaatagttgtta

SEQ ID NO: 678518 - DNA, 20 bp, Artificial
  CRISPR gRNA sequence
catgtgtgaatagttgttac

SEQ ID NO: 678519 - DNA, 20 bp, Artificial
  CRISPR gRNA sequence
ttaccaaggtgaaaggaaag

SEQ ID NO: 678520 - DNA, 20 bp, Artificial
  CRISPR gRNA sequence
ccaaggtgaaaggaaaggaa

SEQ ID NO: 678521 - DNA, 20 bp, Artificial
  CRISPR gRNA sequence
tactttcatctgtacttttt

SEQ ID NO: 678522 - DNA, 20 bp, Artificial
  CRISPR gRNA sequence
ctttcatctgtactttttct

SEQ ID NO: 678523 - DNA, 20 bp, Artificial
  CRISPR gRNA sequence
tcatctgtactttttctcac

SEQ ID NO: 678524 - DNA, 20 bp, Artificial
  CRISPR gRNA sequence
catctgtactttttctcacc

SEQ ID NO: 678525 - DNA, 20 bp, Artificial
  CRISPR gRNA sequence
atctgtactttttctcacca

SEQ ID NO: 678526 - DNA, 20 bp, Artificial
  CRISPR gRNA sequence
tactttttctcaccacttga

SEQ ID NO: 678527 - DNA, 20 bp, Artificial
  CRISPR gRNA sequence
tttctcaccacttgagttct

SEQ ID NO: 678528 - DNA, 20 bp, Artificial
  CRISPR gRNA sequence
ttctcaccacttgagttctt

SEQ ID NO: 678529 - DNA, 20 bp, Artificial
  CRISPR gRNA sequence
tctcaccacttgagttcttt

SEQ ID NO: 678530 - DNA, 20 bp, Artificial
  CRISPR gRNA sequence
ctcaccacttgagttctttt

SEQ ID NO: 678531 - DNA, 20 bp, Artificial
  CRISPR gRNA sequence
tcaccacttgagttcttttt

SEQ ID NO: 678532 - DNA, 20 bp, Artificial
  CRISPR gRNA sequence
accacttgagttctttttaa

SEQ ID NO: 678533 - DNA, 20 bp, Artificial
  CRISPR gRNA sequence
gagttctttttaatcttctt

SEQ ID NO: 678534 - DNA, 20 bp, Artificial
  CRISPR gRNA sequence
agttctttttaatcttcttg

SEQ ID NO: 678535 - DNA, 20 bp, Artificial
  CRISPR gRNA sequence
tttttaatcttcttggtacc

SEQ ID NO: 678536 - DNA, 20 bp, Artificial
  CRISPR gRNA sequence
tttaatcttcttggtaccca

SEQ ID NO: 678537 - DNA, 20 bp, Artificial
  CRISPR gRNA sequence
ttaatcttcttggtacccaa

SEQ ID NO: 678538 - DNA, 20 bp, Artificial
  CRISPR gRNA sequence
taatcttcttggtacccaag

SEQ ID NO: 678539 - DNA, 20 bp, Artificial
  CRISPR gRNA sequence
aatcttcttggtacccaaga

SEQ ID NO: 678540 - DNA, 20 bp, Artificial
  CRISPR gRNA sequence
atcttcttggtacccaagaa

SEQ ID NO: 678541 - DNA, 20 bp, Artificial
  CRISPR gRNA sequence
cttggtacccaagaataatc

SEQ ID NO: 678542 - DNA, 20 bp, Artificial
  CRISPR gRNA sequence
ttggtacccaagaataatct

SEQ ID NO: 678543 - DNA, 20 bp, Artificial
  CRISPR gRNA sequence
ggtacccaagaataatctct

SEQ ID NO: 678544 - DNA, 20 bp, Artificial
  CRISPR gRNA sequence
gtacccaagaataatctctt

SEQ ID NO: 678545 - DNA, 20 bp, Artificial
  CRISPR gRNA sequence
tttattaaactgtgacattt

SEQ ID NO: 678546 - DNA, 20 bp, Artificial
  CRISPR gRNA sequence
tattaaactgtgacatttca

SEQ ID NO: 678547 - DNA, 20 bp, Artificial
  CRISPR gRNA sequence
attaaactgtgacatttcaa

SEQ ID NO: 678548 - DNA, 20 bp, Artificial
  CRISPR gRNA sequence
ttaaactgtgacatttcaag

SEQ ID NO: 678549 - DNA, 20 bp, Artificial
  CRISPR gRNA sequence
aactgtgacatttcaagttg

SEQ ID NO: 678550 - DNA, 20 bp, Artificial
  CRISPR gRNA sequence
tgacatttcaagttgttgca

SEQ ID NO: 678551 - DNA, 20 bp, Artificial
  CRISPR gRNA sequence
caagttgttgcattttaagt

SEQ ID NO: 678552 - DNA, 20 bp, Artificial
  CRISPR gRNA sequence
aagttgttgcattttaagtt

SEQ ID NO: 678553 - DNA, 20 bp, Artificial
  CRISPR gRNA sequence
ttgcattttaagttttcttc

SEQ ID NO: 678554 - DNA, 20 bp, Artificial
  CRISPR gRNA sequence
cattttaagttttcttctgt

SEQ ID NO: 678555 - DNA, 20 bp, Artificial
  CRISPR gRNA sequence
taagttttcttctgtaaaat

SEQ ID NO: 678556 - DNA, 20 bp, Artificial
  CRISPR gRNA sequence
aagttttcttctgtaaaatt

SEQ ID NO: 678557 - DNA, 20 bp, Artificial
  CRISPR gRNA sequence
agttttcttctgtaaaattc

SEQ ID NO: 678558 - DNA, 20 bp, Artificial
  CRISPR gRNA sequence
tcttctgtaaaattctctgc

SEQ ID NO: 678559 - DNA, 20 bp, Artificial
  CRISPR gRNA sequence
cttctgtaaaattctctgcc

SEQ ID NO: 678560 - DNA, 20 bp, Artificial
  CRISPR gRNA sequence
ttctgtaaaattctctgccc

SEQ ID NO: 678561 - DNA, 20 bp, Artificial
  CRISPR gRNA sequence
ctgtaaaattctctgccctt

SEQ ID NO: 678562 - DNA, 20 bp, Artificial
  CRISPR gRNA sequence
tgtaaaattctctgccctta

SEQ ID NO: 678563 - DNA, 20 bp, Artificial
  CRISPR gRNA sequence
taaaattctctgcccttacc

SEQ ID NO: 678564 - DNA, 20 bp, Artificial
  CRISPR gRNA sequence
tctgcccttacccgaaaaga

SEQ ID NO: 678565 - DNA, 20 bp, Artificial
  CRISPR gRNA sequence
tgcccttacccgaaaagaaa

SEQ ID NO: 678566 - DNA, 20 bp, Artificial
  CRISPR gRNA sequence
cccttacccgaaaagaaaac

SEQ ID NO: 678567 - DNA, 20 bp, Artificial
  CRISPR gRNA sequence
acccgaaaagaaaacaaaca

SEQ ID NO: 678568 - DNA, 20 bp, Artificial
  CRISPR gRNA sequence
cccgaaaagaaaacaaacaa

SEQ ID NO: 678569 - DNA, 20 bp, Artificial
  CRISPR gRNA sequence
ttgatgtatctaggatactc

SEQ ID NO: 678570 - DNA, 20 bp, Artificial
  CRISPR gRNA sequence
gatgtatctaggatactcct

SEQ ID NO: 678571 - DNA, 20 bp, Artificial
  CRISPR gRNA sequence
atgtatctaggatactcctg

SEQ ID NO: 678572 - DNA, 20 bp, Artificial
  CRISPR gRNA sequence
ggatactcctgatttgtctt

SEQ ID NO: 678573 - DNA, 20 bp, Artificial
  CRISPR gRNA sequence
ctgatttgtcttgaatgagt

SEQ ID NO: 678574 - DNA, 20 bp, Artificial
  CRISPR gRNA sequence
atttgtcttgaatgagtcaa

SEQ ID NO: 678575 - DNA, 20 bp, Artificial
  CRISPR gRNA sequence
gtcttgaatgagtcaaagct

SEQ ID NO: 678576 - DNA, 20 bp, Artificial
  CRISPR gRNA sequence
tcttgaatgagtcaaagctg

SEQ ID NO: 678577 - DNA, 20 bp, Artificial
  CRISPR gRNA sequence
gaatgagtcaaagctgagag

SEQ ID NO: 678578 - DNA, 20 bp, Artificial
  CRISPR gRNA sequence
aatgagtcaaagctgagagt

SEQ ID NO: 678579 - DNA, 20 bp, Artificial
  CRISPR gRNA sequence
agagtcagtgtattaagagt

SEQ ID NO: 678580 - DNA, 20 bp, Artificial
  CRISPR gRNA sequence
agagtgagataatttgaaga

SEQ ID NO: 678581 - DNA, 20 bp, Artificial
  CRISPR gRNA sequence
gaagactgatcaccaggccc

SEQ ID NO: 678582 - DNA, 20 bp, Artificial
  CRISPR gRNA sequence
aagactgatcaccaggccct

SEQ ID NO: 678583 - DNA, 20 bp, Artificial
  CRISPR gRNA sequence
atcaccaggccctcaaggtc

SEQ ID NO: 678584 - DNA, 20 bp, Artificial
  CRISPR gRNA sequence
aaggtctagaatacagtcag

SEQ ID NO: 678585 - DNA, 20 bp, Artificial
  CRISPR gRNA sequence
gaatacagtcagagcaagaa

SEQ ID NO: 678586 - DNA, 20 bp, Artificial
  CRISPR gRNA sequence
gattcagtatttcccctgtt

SEQ ID NO: 678587 - DNA, 20 bp, Artificial
  CRISPR gRNA sequence
attcagtatttcccctgttg

SEQ ID NO: 678588 - DNA, 20 bp, Artificial
  CRISPR gRNA sequence
agtatttcccctgttgccag

SEQ ID NO: 678589 - DNA, 20 bp, Artificial
  CRISPR gRNA sequence
cccctgttgccagaggtacg

SEQ ID NO: 678590 - DNA, 20 bp, Artificial
  CRISPR gRNA sequence
ccctgttgccagaggtacga

SEQ ID NO: 678591 - DNA, 20 bp, Artificial
  CRISPR gRNA sequence
ttgccagaggtacgatccac

SEQ ID NO: 678592 - DNA, 20 bp, Artificial
  CRISPR gRNA sequence
ccagaggtacgatccacctg

SEQ ID NO: 678593 - DNA, 20 bp, Artificial
  CRISPR gRNA sequence
tcttcttgtctttgtcttgg

SEQ ID NO: 678594 - DNA, 20 bp, Artificial
  CRISPR gRNA sequence
cttgtctttgtcttggtaga

SEQ ID NO: 678595 - DNA, 20 bp, Artificial
  CRISPR gRNA sequence
ttgtctttgtcttggtagaa

SEQ ID NO: 678596 - DNA, 20 bp, Artificial
  CRISPR gRNA sequence
gtctttgtcttggtagaaat

SEQ ID NO: 678597 - DNA, 20 bp, Artificial
  CRISPR gRNA sequence
tctttgtcttggtagaaatg

SEQ ID NO: 678598 - DNA, 20 bp, Artificial
  CRISPR gRNA sequence
tgtcttggtagaaatgtatt

SEQ ID NO: 678599 - DNA, 20 bp, Artificial
  CRISPR gRNA sequence
gtcttggtagaaatgtatta

SEQ ID NO: 678600 - DNA, 20 bp, Artificial
  CRISPR gRNA sequence
tcttggtagaaatgtattat

SEQ ID NO: 678601 - DNA, 20 bp, Artificial
  CRISPR gRNA sequence
ggtagaaatgtattatcttt

SEQ ID NO: 678602 - DNA, 20 bp, Artificial
  CRISPR gRNA sequence
gtagaaatgtattatctttt

SEQ ID NO: 678603 - DNA, 20 bp, Artificial
  CRISPR gRNA sequence
tcttttcttaccaaaattgg

SEQ ID NO: 678604 - DNA, 20 bp, Artificial
  CRISPR gRNA sequence
ttcttaccaaaattggaatg

SEQ ID NO: 678605 - DNA, 20 bp, Artificial
  CRISPR gRNA sequence
tcttaccaaaattggaatgt

SEQ ID NO: 678606 - DNA, 20 bp, Artificial
  CRISPR gRNA sequence
cttaccaaaattggaatgta

SEQ ID NO: 678607 - DNA, 20 bp, Artificial
  CRISPR gRNA sequence
ttaccaaaattggaatgtaa

SEQ ID NO: 678608 - DNA, 20 bp, Artificial
  CRISPR gRNA sequence
accaaaattggaatgtaaag

SEQ ID NO: 678609 - DNA, 20 bp, Artificial
  CRISPR gRNA sequence
ccaaaattggaatgtaaagg

SEQ ID NO: 678610 - DNA, 20 bp, Artificial
  CRISPR gRNA sequence
gaatgtaaaggaggaagaga

SEQ ID NO: 678611 - DNA, 20 bp, Artificial
  CRISPR gRNA sequence
aagtctgaaaattatatgag

SEQ ID NO: 678612 - DNA, 20 bp, Artificial
  CRISPR gRNA sequence
agtctgaaaattatatgagt

SEQ ID NO: 678613 - DNA, 20 bp, Artificial
  CRISPR gRNA sequence
aaaattatatgagtgcttcc

SEQ ID NO: 678614 - DNA, 20 bp, Artificial
  CRISPR gRNA sequence
tatgagtgcttcctccagac

SEQ ID NO: 678615 - DNA, 20 bp, Artificial
  CRISPR gRNA sequence
cctccagactatcaaaagtt

SEQ ID NO: 678616 - DNA, 20 bp, Artificial
  CRISPR gRNA sequence
ctccagactatcaaaagtta

SEQ ID NO: 678617 - DNA, 20 bp, Artificial
  CRISPR gRNA sequence
cagactatcaaaagttagct

SEQ ID NO: 678618 - DNA, 20 bp, Artificial
  CRISPR gRNA sequence
tcaaaagttagctattgatt

SEQ ID NO: 678619 - DNA, 20 bp, Artificial
  CRISPR gRNA sequence
gctattgattttgctttgaa

SEQ ID NO: 678620 - DNA, 20 bp, Artificial
  CRISPR gRNA sequence
ttgattttgctttgaatgtt

SEQ ID NO: 678621 - DNA, 20 bp, Artificial
  CRISPR gRNA sequence
attttgctttgaatgttgat

SEQ ID NO: 678622 - DNA, 20 bp, Artificial
  CRISPR gRNA sequence
tgctttgaatgttgatgaga

SEQ ID NO: 678623 - DNA, 20 bp, Artificial
  CRISPR gRNA sequence
gctttgaatgttgatgagac

SEQ ID NO: 678624 - DNA, 20 bp, Artificial
  CRISPR gRNA sequence
ctttgaatgttgatgagact

SEQ ID NO: 678625 - DNA, 20 bp, Artificial
  CRISPR gRNA sequence
tgaatgttgatgagactaac

SEQ ID NO: 678626 - DNA, 20 bp, Artificial
  CRISPR gRNA sequence
gaatgttgatgagactaaca

SEQ ID NO: 678627 - DNA, 20 bp, Artificial
  CRISPR gRNA sequence
aatgttgatgagactaacag

SEQ ID NO: 678628 - DNA, 20 bp, Artificial
  CRISPR gRNA sequence
atgagactaacagcacactg

SEQ ID NO: 678629 - DNA, 20 bp, Artificial
  CRISPR gRNA sequence
acagcacactgaccttgagt

SEQ ID NO: 678630 - DNA, 20 bp, Artificial
  CRISPR gRNA sequence
accttgagttctcttcacag

SEQ ID NO: 678631 - DNA, 20 bp, Artificial
  CRISPR gRNA sequence
gagttctcttcacagtgggt

SEQ ID NO: 678632 - DNA, 20 bp, Artificial
  CRISPR gRNA sequence
agttctcttcacagtgggta

SEQ ID NO: 678633 - DNA, 20 bp, Artificial
  CRISPR gRNA sequence
tcttcacagtgggtaaacct

SEQ ID NO: 678634 - DNA, 20 bp, Artificial
  CRISPR gRNA sequence
ttcacagtgggtaaacctca

SEQ ID NO: 678635 - DNA, 20 bp, Artificial
  CRISPR gRNA sequence
cacagtgggtaaacctcaca

SEQ ID NO: 678636 - DNA, 20 bp, Artificial
  CRISPR gRNA sequence
acagtgggtaaacctcacaa

SEQ ID NO: 678637 - DNA, 20 bp, Artificial
  CRISPR gRNA sequence
acaagtgcaactactgtgga

SEQ ID NO: 678638 - DNA, 20 bp, Artificial
  CRISPR gRNA sequence
ctgtggacgaagctacaagc

SEQ ID NO: 678639 - DNA, 20 bp, Artificial
  CRISPR gRNA sequence
tggacgaagctacaagcagc

SEQ ID NO: 678640 - DNA, 20 bp, Artificial
  CRISPR gRNA sequence
caagcagcgcagttcactgg

SEQ ID NO: 678641 - DNA, 20 bp, Artificial
  CRISPR gRNA sequence
actggaggagcacaaggaac

SEQ ID NO: 678642 - DNA, 20 bp, Artificial
  CRISPR gRNA sequence
gaggagcacaaggaacgctg

SEQ ID NO: 678643 - DNA, 20 bp, Artificial
  CRISPR gRNA sequence
ccacaactatctccagaatg

SEQ ID NO: 678644 - DNA, 20 bp, Artificial
  CRISPR gRNA sequence
tctccagaatgtcagcatgg

SEQ ID NO: 678645 - DNA, 20 bp, Artificial
  CRISPR gRNA sequence
cagaatgtcagcatggaggc

SEQ ID NO: 678646 - DNA, 20 bp, Artificial
  CRISPR gRNA sequence
ctgggcaggtcatgagtcac

SEQ ID NO: 678647 - DNA, 20 bp, Artificial
  CRISPR gRNA sequence
ggcaggtcatgagtcaccat

SEQ ID NO: 678648 - DNA, 20 bp, Artificial
  CRISPR gRNA sequence
gattcatcatttttatttcc

SEQ ID NO: 678649 - DNA, 20 bp, Artificial
  CRISPR gRNA sequence
atcatttttatttcccccta

SEQ ID NO: 678650 - DNA, 20 bp, Artificial
  CRISPR gRNA sequence
ttatttccccctactgcttt

SEQ ID NO: 678651 - DNA, 20 bp, Artificial
  CRISPR gRNA sequence
tatttccccctactgctttt

SEQ ID NO: 678652 - DNA, 20 bp, Artificial
  CRISPR gRNA sequence
atttccccctactgcttttg

SEQ ID NO: 678653 - DNA, 20 bp, Artificial
  CRISPR gRNA sequence
tttccccctactgcttttgt

SEQ ID NO: 678654 - DNA, 20 bp, Artificial
  CRISPR gRNA sequence
ccccctactgcttttgtagt

SEQ ID NO: 678655 - DNA, 20 bp, Artificial
  CRISPR gRNA sequence
cccctactgcttttgtagtt

SEQ ID NO: 678656 - DNA, 20 bp, Artificial
  CRISPR gRNA sequence
ctgcttttgtagttcaacat

SEQ ID NO: 678657 - DNA, 20 bp, Artificial
  CRISPR gRNA sequence
cttttgtagttcaacatgaa

SEQ ID NO: 678658 - DNA, 20 bp, Artificial
  CRISPR gRNA sequence
ttgtagttcaacatgaagat

SEQ ID NO: 678659 - DNA, 20 bp, Artificial
  CRISPR gRNA sequence
tgtagttcaacatgaagata

SEQ ID NO: 678660 - DNA, 20 bp, Artificial
  CRISPR gRNA sequence
gtagttcaacatgaagataa

SEQ ID NO: 678661 - DNA, 20 bp, Artificial
  CRISPR gRNA sequence
tagttcaacatgaagataaa

SEQ ID NO: 678662 - DNA, 20 bp, Artificial
  CRISPR gRNA sequence
aacatgaagataaaatctta

SEQ ID NO: 678663 - DNA, 20 bp, Artificial
  CRISPR gRNA sequence
atgctgtttaaaactatttt

SEQ ID NO: 678664 - DNA, 20 bp, Artificial
  CRISPR gRNA sequence
tgctgtttaaaactatttta

SEQ ID NO: 678665 - DNA, 20 bp, Artificial
  CRISPR gRNA sequence
tttaaaactattttagatca

SEQ ID NO: 678666 - DNA, 20 bp, Artificial
  CRISPR gRNA sequence
aaaactattttagatcactt

SEQ ID NO: 678667 - DNA, 20 bp, Artificial
  CRISPR gRNA sequence
aaactattttagatcacttt

SEQ ID NO: 678668 - DNA, 20 bp, Artificial
  CRISPR gRNA sequence
ttttagatcactttaactta

SEQ ID NO: 678669 - DNA, 20 bp, Artificial
  CRISPR gRNA sequence
tagatcactttaacttaaat

SEQ ID NO: 678670 - DNA, 20 bp, Artificial
  CRISPR gRNA sequence
agatcactttaacttaaatg

SEQ ID NO: 678671 - DNA, 20 bp, Artificial
  CRISPR gRNA sequence
gatcactttaacttaaatga

SEQ ID NO: 678672 - DNA, 20 bp, Artificial
  CRISPR gRNA sequence
taacttaaatgagttgagct

SEQ ID NO: 678673 - DNA, 20 bp, Artificial
  CRISPR gRNA sequence
aacttaaatgagttgagctt

SEQ ID NO: 678674 - DNA, 20 bp, Artificial
  CRISPR gRNA sequence
acttaaatgagttgagcttt

SEQ ID NO: 678675 - DNA, 20 bp, Artificial
  CRISPR gRNA sequence
aaatgagttgagctttggga

SEQ ID NO: 678676 - DNA, 20 bp, Artificial
  CRISPR gRNA sequence
aatgagttgagctttgggat

SEQ ID NO: 678677 - DNA, 20 bp, Artificial
  CRISPR gRNA sequence
agctttgggatacattgcaa

SEQ ID NO: 678678 - DNA, 20 bp, Artificial
  CRISPR gRNA sequence
tgggatacattgcaaataat

SEQ ID NO: 678679 - DNA, 20 bp, Artificial
  CRISPR gRNA sequence
gggatacattgcaaataatc

SEQ ID NO: 678680 - DNA, 20 bp, Artificial
  CRISPR gRNA sequence
ggatacattgcaaataatct

SEQ ID NO: 678681 - DNA, 20 bp, Artificial
  CRISPR gRNA sequence
caaataatctgtattgaaat

SEQ ID NO: 678682 - DNA, 20 bp, Artificial
  CRISPR gRNA sequence
tattgaaattttgcaatact

SEQ ID NO: 678683 - DNA, 20 bp, Artificial
  CRISPR gRNA sequence
aaattttgcaatactcccaa

SEQ ID NO: 678684 - DNA, 20 bp, Artificial
  CRISPR gRNA sequence
tgcaatactcccaaattatt

SEQ ID NO: 678685 - DNA, 20 bp, Artificial
  CRISPR gRNA sequence
gcaatactcccaaattattt

SEQ ID NO: 678686 - DNA, 20 bp, Artificial
  CRISPR gRNA sequence
caatactcccaaattatttc

SEQ ID NO: 678687 - DNA, 20 bp, Artificial
  CRISPR gRNA sequence
ccaaattatttctgataatg

SEQ ID NO: 678688 - DNA, 20 bp, Artificial
  CRISPR gRNA sequence
tttctgataatgtttgaatt

SEQ ID NO: 678689 - DNA, 20 bp, Artificial
  CRISPR gRNA sequence
ctgataatgtttgaattagc

SEQ ID NO: 678690 - DNA, 20 bp, Artificial
  CRISPR gRNA sequence
tgataatgtttgaattagca

SEQ ID NO: 678691 - DNA, 20 bp, Artificial
  CRISPR gRNA sequence
ataatgtttgaattagcata

SEQ ID NO: 678692 - DNA, 20 bp, Artificial
  CRISPR gRNA sequence
gaattagcataataatgaca

SEQ ID NO: 678693 - DNA, 20 bp, Artificial
  CRISPR gRNA sequence
aattagcataataatgacaa

SEQ ID NO: 678694 - DNA, 20 bp, Artificial
  CRISPR gRNA sequence
gcataataatgacaaccaac

SEQ ID NO: 678695 - DNA, 20 bp, Artificial
  CRISPR gRNA sequence
tcatataccaaaggaaggta

SEQ ID NO: 678696 - DNA, 20 bp, Artificial
  CRISPR gRNA sequence
catataccaaaggaaggtac

SEQ ID NO: 678697 - DNA, 20 bp, Artificial
  CRISPR gRNA sequence
atataccaaaggaaggtact

SEQ ID NO: 678698 - DNA, 20 bp, Artificial
  CRISPR gRNA sequence
tttactcttctttttcattt

SEQ ID NO: 678699 - DNA, 20 bp, Artificial
  CRISPR gRNA sequence
actcttctttttcatttttc

SEQ ID NO: 678700 - DNA, 20 bp, Artificial
  CRISPR gRNA sequence
ctcttctttttcatttttct

SEQ ID NO: 678701 - DNA, 20 bp, Artificial
  CRISPR gRNA sequence
ttctttttcatttttctaac

SEQ ID NO: 678702 - DNA, 20 bp, Artificial
  CRISPR gRNA sequence
ctttttcatttttctaacca

SEQ ID NO: 678703 - DNA, 20 bp, Artificial
  CRISPR gRNA sequence
tttttcatttttctaaccag

SEQ ID NO: 678704 - DNA, 20 bp, Artificial
  CRISPR gRNA sequence
tttcatttttctaaccagat

SEQ ID NO: 678705 - DNA, 20 bp, Artificial
  CRISPR gRNA sequence
ttcatttttctaaccagata

SEQ ID NO: 678706 - DNA, 20 bp, Artificial
  CRISPR gRNA sequence
tcatttttctaaccagatag

SEQ ID NO: 678707 - DNA, 20 bp, Artificial
  CRISPR gRNA sequence
catttttctaaccagatagt

SEQ ID NO: 678708 - DNA, 20 bp, Artificial
  CRISPR gRNA sequence
atttttctaaccagatagtt

SEQ ID NO: 678709 - DNA, 20 bp, Artificial
  CRISPR gRNA sequence
ttctaaccagatagttagag

SEQ ID NO: 678710 - DNA, 20 bp, Artificial
  CRISPR gRNA sequence
tctaaccagatagttagagc

SEQ ID NO: 678711 - DNA, 20 bp, Artificial
  CRISPR gRNA sequence
ctaaccagatagttagagct

SEQ ID NO: 678712 - DNA, 20 bp, Artificial
  CRISPR gRNA sequence
taaccagatagttagagctg

SEQ ID NO: 678713 - DNA, 20 bp, Artificial
  CRISPR gRNA sequence
accagatagttagagctgat

SEQ ID NO: 678714 - DNA, 20 bp, Artificial
  CRISPR gRNA sequence
gagctgattccacattagtc

SEQ ID NO: 678715 - DNA, 20 bp, Artificial
  CRISPR gRNA sequence
attccacattagtctgtagg

SEQ ID NO: 678716 - DNA, 20 bp, Artificial
  CRISPR gRNA sequence
cacattagtctgtaggctgc

SEQ ID NO: 678717 - DNA, 20 bp, Artificial
  CRISPR gRNA sequence
gtctgtaggctgcctaaaag

SEQ ID NO: 678718 - DNA, 20 bp, Artificial
  CRISPR gRNA sequence
taggctgcctaaaagaatga

SEQ ID NO: 678719 - DNA, 20 bp, Artificial
  CRISPR gRNA sequence
cctaaaagaatgaattggtt

SEQ ID NO: 678720 - DNA, 20 bp, Artificial
  CRISPR gRNA sequence
aaagaatgaattggttattt

SEQ ID NO: 678721 - DNA, 20 bp, Artificial
  CRISPR gRNA sequence
gttatttgaatattttcatc

SEQ ID NO: 678722 - DNA, 20 bp, Artificial
  CRISPR gRNA sequence
tttgaatattttcatctcag

SEQ ID NO: 678723 - DNA, 20 bp, Artificial
  CRISPR gRNA sequence
gaatattttcatctcaggta

SEQ ID NO: 678724 - DNA, 20 bp, Artificial
  CRISPR gRNA sequence
aatattttcatctcaggtaa

SEQ ID NO: 678725 - DNA, 20 bp, Artificial
  CRISPR gRNA sequence
tcatctcaggtaagtgatca

SEQ ID NO: 678726 - DNA, 20 bp, Artificial
  CRISPR gRNA sequence
catctcaggtaagtgatcag

SEQ ID NO: 678727 - DNA, 20 bp, Artificial
  CRISPR gRNA sequence
atctcaggtaagtgatcagt

SEQ ID NO: 678728 - DNA, 20 bp, Artificial
  CRISPR gRNA sequence
aggtaagtgatcagtcatat

SEQ ID NO: 678729 - DNA, 20 bp, Artificial
  CRISPR gRNA sequence
gaaatttctccaatcggccc

SEQ ID NO: 678730 - DNA, 20 bp, Artificial
  CRISPR gRNA sequence
aaatttctccaatcggccct

SEQ ID NO: 678731 - DNA, 20 bp, Artificial
  CRISPR gRNA sequence
ctccaatcggccctttaatt

SEQ ID NO: 678732 - DNA, 20 bp, Artificial
  CRISPR gRNA sequence
tccaatcggccctttaattt

SEQ ID NO: 678733 - DNA, 20 bp, Artificial
  CRISPR gRNA sequence
caatcggccctttaattttt

SEQ ID NO: 678734 - DNA, 20 bp, Artificial
  CRISPR gRNA sequence
taatttttatgagaaattac

SEQ ID NO: 678735 - DNA, 20 bp, Artificial
  CRISPR gRNA sequence
aatttttatgagaaattact

SEQ ID NO: 678736 - DNA, 20 bp, Artificial
  CRISPR gRNA sequence
atttttatgagaaattactg

SEQ ID NO: 678737 - DNA, 20 bp, Artificial
  CRISPR gRNA sequence
ttatgagaaattactgattt

SEQ ID NO: 678738 - DNA, 20 bp, Artificial
  CRISPR gRNA sequence
tatgagaaattactgatttt

SEQ ID NO: 678739 - DNA, 20 bp, Artificial
  CRISPR gRNA sequence
atgagaaattactgattttg

SEQ ID NO: 678740 - DNA, 20 bp, Artificial
  CRISPR gRNA sequence
tgagaaattactgattttgc

SEQ ID NO: 678741 - DNA, 20 bp, Artificial
  CRISPR gRNA sequence
ctgattttgctttctacaat

SEQ ID NO: 678742 - DNA, 20 bp, Artificial
  CRISPR gRNA sequence
attttgctttctacaatgtg

SEQ ID NO: 678743 - DNA, 20 bp, Artificial
  CRISPR gRNA sequence
tgctttctacaatgtgcaaa

SEQ ID NO: 678744 - DNA, 20 bp, Artificial
  CRISPR gRNA sequence
gctttctacaatgtgcaaaa

SEQ ID NO: 678745 - DNA, 20 bp, Artificial
  CRISPR gRNA sequence
ctttctacaatgtgcaaaac

SEQ ID NO: 678746 - DNA, 20 bp, Artificial
  CRISPR gRNA sequence
tctacaatgtgcaaaacaat

SEQ ID NO: 678747 - DNA, 20 bp, Artificial
  CRISPR gRNA sequence
ctacaatgtgcaaaacaatc

SEQ ID NO: 678748 - DNA, 20 bp, Artificial
  CRISPR gRNA sequence
tacaatgtgcaaaacaatct

SEQ ID NO: 678749 - DNA, 20 bp, Artificial
  CRISPR gRNA sequence
caatgtgcaaaacaatctag

SEQ ID NO: 678750 - DNA, 20 bp, Artificial
  CRISPR gRNA sequence
gaccaacattagacaccatc

SEQ ID NO: 678751 - DNA, 20 bp, Artificial
  CRISPR gRNA sequence
gacaccatctctctccacaa

SEQ ID NO: 678752 - DNA, 20 bp, Artificial
  CRISPR gRNA sequence
tctccacaaaaaacattctc

SEQ ID NO: 678753 - DNA, 20 bp, Artificial
  CRISPR gRNA sequence
tccacaaaaaacattctcca

SEQ ID NO: 678754 - DNA, 20 bp, Artificial
  CRISPR gRNA sequence
cacaaaaaacattctccaag

SEQ ID NO: 678755 - DNA, 20 bp, Artificial
  CRISPR gRNA sequence
tccaagcaaaacatcctgat

SEQ ID NO: 678756 - DNA, 20 bp, Artificial
  CRISPR gRNA sequence
caagcaaaacatcctgatct

SEQ ID NO: 678757 - DNA, 20 bp, Artificial
  CRISPR gRNA sequence
atctctaaatacactacggc

SEQ ID NO: 678758 - DNA, 20 bp, Artificial
  CRISPR gRNA sequence
taaatacactacggcaggta

SEQ ID NO: 678759 - DNA, 20 bp, Artificial
  CRISPR gRNA sequence
aatacactacggcaggtagg

SEQ ID NO: 678760 - DNA, 20 bp, Artificial
  CRISPR gRNA sequence
cggcaggtaggaaggcaatc

SEQ ID NO: 678761 - DNA, 20 bp, Artificial
  CRISPR gRNA sequence
aggtttatcaatgaataatt

SEQ ID NO: 678762 - DNA, 20 bp, Artificial
  CRISPR gRNA sequence
atcaatgaataattctctgt

SEQ ID NO: 678763 - DNA, 20 bp, Artificial
  CRISPR gRNA sequence
tcaatgaataattctctgtt

SEQ ID NO: 678764 - DNA, 20 bp, Artificial
  CRISPR gRNA sequence
tctgttcctgaaaagttaat

SEQ ID NO: 678765 - DNA, 20 bp, Artificial
  CRISPR gRNA sequence
tgttcctgaaaagttaattt

SEQ ID NO: 678766 - DNA, 20 bp, Artificial
  CRISPR gRNA sequence
ttcctgaaaagttaatttta

SEQ ID NO: 678767 - DNA, 20 bp, Artificial
  CRISPR gRNA sequence
ctgaaaagttaattttaata

SEQ ID NO: 678768 - DNA, 20 bp, Artificial
  CRISPR gRNA sequence
aaaagttaattttaataatc

SEQ ID NO: 678769 - DNA, 20 bp, Artificial
  CRISPR gRNA sequence
attttaataatcagccttat

SEQ ID NO: 678770 - DNA, 20 bp, Artificial
  CRISPR gRNA sequence
taataatcagccttatatag

SEQ ID NO: 678771 - DNA, 20 bp, Artificial
  CRISPR gRNA sequence
aataatcagccttatatagg

SEQ ID NO: 678772 - DNA, 20 bp, Artificial
  CRISPR gRNA sequence
ataatcagccttatatagga

SEQ ID NO: 678773 - DNA, 20 bp, Artificial
  CRISPR gRNA sequence
atataggaaaataatgaatt

SEQ ID NO: 678774 - DNA, 20 bp, Artificial
  CRISPR gRNA sequence
tataggaaaataatgaattt

SEQ ID NO: 678775 - DNA, 20 bp, Artificial
  CRISPR gRNA sequence
cagttcttaagatttgtaat

SEQ ID NO: 678776 - DNA, 20 bp, Artificial
  CRISPR gRNA sequence
agttcttaagatttgtaatg

SEQ ID NO: 678777 - DNA, 20 bp, Artificial
  CRISPR gRNA sequence
ttaagatttgtaatgtctat

SEQ ID NO: 678778 - DNA, 20 bp, Artificial
  CRISPR gRNA sequence
aagatttgtaatgtctatct

SEQ ID NO: 678779 - DNA, 20 bp, Artificial
  CRISPR gRNA sequence
agatttgtaatgtctatctt

SEQ ID NO: 678780 - DNA, 20 bp, Artificial
  CRISPR gRNA sequence
gtaatgtctatcttgtctta

SEQ ID NO: 678781 - DNA, 20 bp, Artificial
  CRISPR gRNA sequence
taatgtctatcttgtcttac

SEQ ID NO: 678782 - DNA, 20 bp, Artificial
  CRISPR gRNA sequence
tcttgtcttactaattagat

SEQ ID NO: 678783 - DNA, 20 bp, Artificial
  CRISPR gRNA sequence
gtcttactaattagatttgt

SEQ ID NO: 678784 - DNA, 20 bp, Artificial
  CRISPR gRNA sequence
tcttactaattagatttgtc

SEQ ID NO: 678785 - DNA, 20 bp, Artificial
  CRISPR gRNA sequence
actaattagatttgtctact

SEQ ID NO: 678786 - DNA, 20 bp, Artificial
  CRISPR gRNA sequence
ctaattagatttgtctactg

SEQ ID NO: 678787 - DNA, 20 bp, Artificial
  CRISPR gRNA sequence
attagatttgtctactgata

SEQ ID NO: 678788 - DNA, 20 bp, Artificial
  CRISPR gRNA sequence
gatttgtctactgataagtt

SEQ ID NO: 678789 - DNA, 20 bp, Artificial
  CRISPR gRNA sequence
gtctactgataagttttatt

SEQ ID NO: 678790 - DNA, 20 bp, Artificial
  CRISPR gRNA sequence
tctactgataagttttattt

SEQ ID NO: 678791 - DNA, 20 bp, Artificial
  CRISPR gRNA sequence
ctgataagttttatttatac

SEQ ID NO: 678792 - DNA, 20 bp, Artificial
  CRISPR gRNA sequence
ataagttttatttatacaaa

SEQ ID NO: 678793 - DNA, 20 bp, Artificial
  CRISPR gRNA sequence
tatttatacaaagacaaaaa

SEQ ID NO: 678794 - DNA, 20 bp, Artificial
  CRISPR gRNA sequence
atttatacaaagacaaaaat

SEQ ID NO: 678795 - DNA, 20 bp, Artificial
  CRISPR gRNA sequence
tttatacaaagacaaaaatc

SEQ ID NO: 678796 - DNA, 20 bp, Artificial
  CRISPR gRNA sequence
atacaaagacaaaaatctca

SEQ ID NO: 678797 - DNA, 20 bp, Artificial
  CRISPR gRNA sequence
tacaaagacaaaaatctcaa

SEQ ID NO: 678798 - DNA, 20 bp, Artificial
  CRISPR gRNA sequence
aacttattagtacatgtata

SEQ ID NO: 678799 - DNA, 20 bp, Artificial
  CRISPR gRNA sequence
attagtacatgtatatcttt

SEQ ID NO: 678800 - DNA, 20 bp, Artificial
  CRISPR gRNA sequence
ttagtacatgtatatctttt

SEQ ID NO: 678801 - DNA, 20 bp, Artificial
  CRISPR gRNA sequence
gtacatgtatatcttttatt

SEQ ID NO: 678802 - DNA, 20 bp, Artificial
  CRISPR gRNA sequence
ttatttatttttttaaatta

SEQ ID NO: 678803 - DNA, 20 bp, Artificial
  CRISPR gRNA sequence
tatttatttttttaaattat

SEQ ID NO: 678804 - DNA, 20 bp, Artificial
  CRISPR gRNA sequence
atttatttttttaaattatt

SEQ ID NO: 678805 - DNA, 20 bp, Artificial
  CRISPR gRNA sequence
tttatttttttaaattattt

SEQ ID NO: 678806 - DNA, 20 bp, Artificial
  CRISPR gRNA sequence
atttttttaaattatttttt

SEQ ID NO: 678807 - DNA, 20 bp, Artificial
  CRISPR gRNA sequence
tttttttaaattatttttta

SEQ ID NO: 678808 - DNA, 20 bp, Artificial
  CRISPR gRNA sequence
ttttaaattattttttattt

SEQ ID NO: 678809 - DNA, 20 bp, Artificial
  CRISPR gRNA sequence
tttaaattattttttatttt

SEQ ID NO: 678810 - DNA, 20 bp, Artificial
  CRISPR gRNA sequence
ttaaattattttttatttta

SEQ ID NO: 678811 - DNA, 20 bp, Artificial
  CRISPR gRNA sequence
taaattattttttattttat

SEQ ID NO: 678812 - DNA, 20 bp, Artificial
  CRISPR gRNA sequence
aaattattttttattttatt

SEQ ID NO: 678813 - DNA, 20 bp, Artificial
  CRISPR gRNA sequence
aattattttttattttattt

SEQ ID NO: 678814 - DNA, 20 bp, Artificial
  CRISPR gRNA sequence
ttttttattttattttattt

SEQ ID NO: 678815 - DNA, 20 bp, Artificial
  CRISPR gRNA sequence
tttattttattttatttttt

SEQ ID NO: 678816 - DNA, 20 bp, Artificial
  CRISPR gRNA sequence
ttattttattttattttttt

SEQ ID NO: 678817 - DNA, 20 bp, Artificial
  CRISPR gRNA sequence
tattttattttatttttttt

SEQ ID NO: 678818 - DNA, 20 bp, Artificial
  CRISPR gRNA sequence
attttattttattttttttg

SEQ ID NO: 678819 - DNA, 20 bp, Artificial
  CRISPR gRNA sequence
ttttattttattttttttga

SEQ ID NO: 678820 - DNA, 20 bp, Artificial
  CRISPR gRNA sequence
tattttattttttttgagat

SEQ ID NO: 678821 - DNA, 20 bp, Artificial
  CRISPR gRNA sequence
attttattttttttgagatg

SEQ ID NO: 678822 - DNA, 20 bp, Artificial
  CRISPR gRNA sequence
ttttattttttttgagatgg

SEQ ID NO: 678823 - DNA, 20 bp, Artificial
  CRISPR gRNA sequence
tattttttttgagatggact

SEQ ID NO: 678824 - DNA, 20 bp, Artificial
  CRISPR gRNA sequence
attttttttgagatggactc

SEQ ID NO: 678825 - DNA, 20 bp, Artificial
  CRISPR gRNA sequence
ttttttttgagatggactct

SEQ ID NO: 678826 - DNA, 20 bp, Artificial
  CRISPR gRNA sequence
tttttgagatggactctcac

SEQ ID NO: 678827 - DNA, 20 bp, Artificial
  CRISPR gRNA sequence
ttttgagatggactctcact

SEQ ID NO: 678828 - DNA, 20 bp, Artificial
  CRISPR gRNA sequence
tttgagatggactctcactt

SEQ ID NO: 678829 - DNA, 20 bp, Artificial
  CRISPR gRNA sequence
ttgagatggactctcacttt

SEQ ID NO: 678830 - DNA, 20 bp, Artificial
  CRISPR gRNA sequence
tgagatggactctcactttg

SEQ ID NO: 678831 - DNA, 20 bp, Artificial
  CRISPR gRNA sequence
gagatggactctcactttgc

SEQ ID NO: 678832 - DNA, 20 bp, Artificial
  CRISPR gRNA sequence
agatggactctcactttgcc

SEQ ID NO: 678833 - DNA, 20 bp, Artificial
  CRISPR gRNA sequence
tcactttgccacccaggctg

SEQ ID NO: 678834 - DNA, 20 bp, Artificial
  CRISPR gRNA sequence
actttgccacccaggctgga

SEQ ID NO: 678835 - DNA, 20 bp, Artificial
  CRISPR gRNA sequence
tgccacccaggctggagtgc

SEQ ID NO: 678836 - DNA, 20 bp, Artificial
  CRISPR gRNA sequence
gccacccaggctggagtgca

SEQ ID NO: 678837 - DNA, 20 bp, Artificial
  CRISPR gRNA sequence
ccacccaggctggagtgcag

SEQ ID NO: 678838 - DNA, 20 bp, Artificial
  CRISPR gRNA sequence
gagtgcagtggcacgatctc

SEQ ID NO: 678839 - DNA, 20 bp, Artificial
  CRISPR gRNA sequence
agctcaccacaacctctgcc

SEQ ID NO: 678840 - DNA, 20 bp, Artificial
  CRISPR gRNA sequence
accacaacctctgcctcccc

SEQ ID NO: 678841 - DNA, 20 bp, Artificial
  CRISPR gRNA sequence
tgcctccccggttcaagcga

SEQ ID NO: 678842 - DNA, 20 bp, Artificial
  CRISPR gRNA sequence
cctccccggttcaagcgatt

SEQ ID NO: 678843 - DNA, 20 bp, Artificial
  CRISPR gRNA sequence
cccggttcaagcgattctcc

SEQ ID NO: 678844 - DNA, 20 bp, Artificial
  CRISPR gRNA sequence
aagcgattctcctgcttcag

SEQ ID NO: 678845 - DNA, 20 bp, Artificial
  CRISPR gRNA sequence
tcctgcttcagcctgccaag

SEQ ID NO: 678846 - DNA, 20 bp, Artificial
  CRISPR gRNA sequence
ctgcttcagcctgccaagta

SEQ ID NO: 678847 - DNA, 20 bp, Artificial
  CRISPR gRNA sequence
cttcagcctgccaagtaact

SEQ ID NO: 678848 - DNA, 20 bp, Artificial
  CRISPR gRNA sequence
cagcctgccaagtaactggg

SEQ ID NO: 678849 - DNA, 20 bp, Artificial
  CRISPR gRNA sequence
agcctgccaagtaactggga

SEQ ID NO: 678850 - DNA, 20 bp, Artificial
  CRISPR gRNA sequence
ccaagtaactgggattacag

SEQ ID NO: 678851 - DNA, 20 bp, Artificial
  CRISPR gRNA sequence
ggattacaggcatgtaccac

SEQ ID NO: 678852 - DNA, 20 bp, Artificial
  CRISPR gRNA sequence
caggcatgtaccaccaggcc

SEQ ID NO: 678853 - DNA, 20 bp, Artificial
  CRISPR gRNA sequence
gctagtttttgtatttttag

SEQ ID NO: 678854 - DNA, 20 bp, Artificial
  CRISPR gRNA sequence
gtttttgtatttttagtaga

SEQ ID NO: 678855 - DNA, 20 bp, Artificial
  CRISPR gRNA sequence
ttgtatttttagtagagacg

SEQ ID NO: 678856 - DNA, 20 bp, Artificial
  CRISPR gRNA sequence
tgtatttttagtagagacgg

SEQ ID NO: 678857 - DNA, 20 bp, Artificial
  CRISPR gRNA sequence
gtatttttagtagagacggg

SEQ ID NO: 678858 - DNA, 20 bp, Artificial
  CRISPR gRNA sequence
tatttttagtagagacgggg

SEQ ID NO: 678859 - DNA, 20 bp, Artificial
  CRISPR gRNA sequence
ttagtagagacggggtttcg

SEQ ID NO: 678860 - DNA, 20 bp, Artificial
  CRISPR gRNA sequence
tagtagagacggggtttcgc

SEQ ID NO: 678861 - DNA, 20 bp, Artificial
  CRISPR gRNA sequence
agtagagacggggtttcgcc

SEQ ID NO: 678862 - DNA, 20 bp, Artificial
  CRISPR gRNA sequence
gtagagacggggtttcgcca

SEQ ID NO: 678863 - DNA, 20 bp, Artificial
  CRISPR gRNA sequence
cgccatgttggccaggctgg

SEQ ID NO: 678864 - DNA, 20 bp, Artificial
  CRISPR gRNA sequence
gccatgttggccaggctggt

SEQ ID NO: 678865 - DNA, 20 bp, Artificial
  CRISPR gRNA sequence
gccaggctggtctcaaactc

SEQ ID NO: 678866 - DNA, 20 bp, Artificial
  CRISPR gRNA sequence
gtctcaaactcctgacctca

SEQ ID NO: 678867 - DNA, 20 bp, Artificial
  CRISPR gRNA sequence
aaactcctgacctcaggtga

SEQ ID NO: 678868 - DNA, 20 bp, Artificial
  CRISPR gRNA sequence
ctgacctcaggtgagctgcc

SEQ ID NO: 678869 - DNA, 20 bp, Artificial
  CRISPR gRNA sequence
acctcaggtgagctgcccgc

SEQ ID NO: 678870 - DNA, 20 bp, Artificial
  CRISPR gRNA sequence
aggtgagctgcccgccttgc

SEQ ID NO: 678871 - DNA, 20 bp, Artificial
  CRISPR gRNA sequence
cccgccttgccttcccaaag

SEQ ID NO: 678872 - DNA, 20 bp, Artificial
  CRISPR gRNA sequence
gccttcccaaagttctggga

SEQ ID NO: 678873 - DNA, 20 bp, Artificial
  CRISPR gRNA sequence
ccttcccaaagttctgggat

SEQ ID NO: 678874 - DNA, 20 bp, Artificial
  CRISPR gRNA sequence
cccaaagttctgggattaca

SEQ ID NO: 678875 - DNA, 20 bp, Artificial
  CRISPR gRNA sequence
ccaaagttctgggattacag

SEQ ID NO: 678876 - DNA, 20 bp, Artificial
  CRISPR gRNA sequence
tgggattacaggtgtgaacc

SEQ ID NO: 678877 - DNA, 20 bp, Artificial
  CRISPR gRNA sequence
ggattacaggtgtgaaccat

SEQ ID NO: 678878 - DNA, 20 bp, Artificial
  CRISPR gRNA sequence
caggtgtgaaccattgcacc

SEQ ID NO: 678879 - DNA, 20 bp, Artificial
  CRISPR gRNA sequence
cacctggccacttgtatatc

SEQ ID NO: 678880 - DNA, 20 bp, Artificial
  CRISPR gRNA sequence
gccacttgtatatcttttat

SEQ ID NO: 678881 - DNA, 20 bp, Artificial
  CRISPR gRNA sequence
gtatatcttttatttaaaaa

SEQ ID NO: 678882 - DNA, 20 bp, Artificial
  CRISPR gRNA sequence
tatatcttttatttaaaaaa

SEQ ID NO: 678883 - DNA, 20 bp, Artificial
  CRISPR gRNA sequence
ttatttaaaaaaggtttgcc

SEQ ID NO: 678884 - DNA, 20 bp, Artificial
  CRISPR gRNA sequence
tatttaaaaaaggtttgccc

SEQ ID NO: 678885 - DNA, 20 bp, Artificial
  CRISPR gRNA sequence
atttaaaaaaggtttgccca

SEQ ID NO: 678886 - DNA, 20 bp, Artificial
  CRISPR gRNA sequence
tttaaaaaaggtttgcccag

SEQ ID NO: 678887 - DNA, 20 bp, Artificial
  CRISPR gRNA sequence
aaaaaaggtttgcccagtat

SEQ ID NO: 678888 - DNA, 20 bp, Artificial
  CRISPR gRNA sequence
aaaaaggtttgcccagtatt

SEQ ID NO: 678889 - DNA, 20 bp, Artificial
  CRISPR gRNA sequence
gcccagtattaaatggtata

SEQ ID NO: 678890 - DNA, 20 bp, Artificial
  CRISPR gRNA sequence
cccagtattaaatggtatag

SEQ ID NO: 678891 - DNA, 20 bp, Artificial
  CRISPR gRNA sequence
aatggtatagttggggattg

SEQ ID NO: 678892 - DNA, 20 bp, Artificial
  CRISPR gRNA sequence
gggattgcgacagtcacttt

SEQ ID NO: 678893 - DNA, 20 bp, Artificial
  CRISPR gRNA sequence
cgacagtcacttttaaaata

SEQ ID NO: 678894 - DNA, 20 bp, Artificial
  CRISPR gRNA sequence
ttaaaatataaatatctatg

SEQ ID NO: 678895 - DNA, 20 bp, Artificial
  CRISPR gRNA sequence
taaaatataaatatctatgt

SEQ ID NO: 678896 - DNA, 20 bp, Artificial
  CRISPR gRNA sequence
aaaatataaatatctatgta

SEQ ID NO: 678897 - DNA, 20 bp, Artificial
  CRISPR gRNA sequence
aaatataaatatctatgtat

SEQ ID NO: 678898 - DNA, 20 bp, Artificial
  CRISPR gRNA sequence
tgtattggcttatacatagc

SEQ ID NO: 678899 - DNA, 20 bp, Artificial
  CRISPR gRNA sequence
gcttatacatagccaggtca

SEQ ID NO: 678900 - DNA, 20 bp, Artificial
  CRISPR gRNA sequence
atacatagccaggtcaagga

SEQ ID NO: 678901 - DNA, 20 bp, Artificial
  CRISPR gRNA sequence
tacatagccaggtcaaggat

SEQ ID NO: 678902 - DNA, 20 bp, Artificial
  CRISPR gRNA sequence
tttctggggttttctgtttg

SEQ ID NO: 678903 - DNA, 20 bp, Artificial
  CRISPR gRNA sequence
ctggggttttctgtttgttt

SEQ ID NO: 678904 - DNA, 20 bp, Artificial
  CRISPR gRNA sequence
tggggttttctgtttgtttt

SEQ ID NO: 678905 - DNA, 20 bp, Artificial
  CRISPR gRNA sequence
gggttttctgtttgttttat

SEQ ID NO: 678906 - DNA, 20 bp, Artificial
  CRISPR gRNA sequence
tctgtttgttttatagagta

SEQ ID NO: 678907 - DNA, 20 bp, Artificial
  CRISPR gRNA sequence
ctgtttgttttatagagtat

SEQ ID NO: 678908 - DNA, 20 bp, Artificial
  CRISPR gRNA sequence
tgtttgttttatagagtata

SEQ ID NO: 678909 - DNA, 20 bp, Artificial
  CRISPR gRNA sequence
tttgttttatagagtatata

SEQ ID NO: 678910 - DNA, 20 bp, Artificial
  CRISPR gRNA sequence
gttttatagagtatatacta

SEQ ID NO: 678911 - DNA, 20 bp, Artificial
  CRISPR gRNA sequence
ttttatagagtatatactat

SEQ ID NO: 678912 - DNA, 20 bp, Artificial
  CRISPR gRNA sequence
tatagagtatatactatgga

SEQ ID NO: 678913 - DNA, 20 bp, Artificial
  CRISPR gRNA sequence
atagagtatatactatggaa

SEQ ID NO: 678914 - DNA, 20 bp, Artificial
  CRISPR gRNA sequence
tagagtatatactatggaac

SEQ ID NO: 678915 - DNA, 20 bp, Artificial
  CRISPR gRNA sequence
tggaactgtgtttgttggac

SEQ ID NO: 678916 - DNA, 20 bp, Artificial
  CRISPR gRNA sequence
tgtttgttggacagctagtg

SEQ ID NO: 678917 - DNA, 20 bp, Artificial
  CRISPR gRNA sequence
gttggacagctagtgattat

SEQ ID NO: 678918 - DNA, 20 bp, Artificial
  CRISPR gRNA sequence
ttggacagctagtgattatg

SEQ ID NO: 678919 - DNA, 20 bp, Artificial
  CRISPR gRNA sequence
gacagctagtgattatgtgt

SEQ ID NO: 678920 - DNA, 20 bp, Artificial
  CRISPR gRNA sequence
gtgattatgtgttgttgagt

SEQ ID NO: 678921 - DNA, 20 bp, Artificial
  CRISPR gRNA sequence
tgtgttgttgagttgggaat

SEQ ID NO: 678922 - DNA, 20 bp, Artificial
  CRISPR gRNA sequence
ttgagttgggaattttttta

SEQ ID NO: 678923 - DNA, 20 bp, Artificial
  CRISPR gRNA sequence
agttgggaatttttttaatt

SEQ ID NO: 678924 - DNA, 20 bp, Artificial
  CRISPR gRNA sequence
ggaatttttttaatttaaaa

SEQ ID NO: 678925 - DNA, 20 bp, Artificial
  CRISPR gRNA sequence
ttttaatttaaaattttctt

SEQ ID NO: 678926 - DNA, 20 bp, Artificial
  CRISPR gRNA sequence
tttaatttaaaattttcttg

SEQ ID NO: 678927 - DNA, 20 bp, Artificial
  CRISPR gRNA sequence
ttaatttaaaattttcttgt

SEQ ID NO: 678928 - DNA, 20 bp, Artificial
  CRISPR gRNA sequence
taatttaaaattttcttgtt

SEQ ID NO: 678929 - DNA, 20 bp, Artificial
  CRISPR gRNA sequence
aatttaaaattttcttgtta

SEQ ID NO: 678930 - DNA, 20 bp, Artificial
  CRISPR gRNA sequence
atttaaaattttcttgttat

SEQ ID NO: 678931 - DNA, 20 bp, Artificial
  CRISPR gRNA sequence
aaaattttcttgttatcctg

SEQ ID NO: 678932 - DNA, 20 bp, Artificial
  CRISPR gRNA sequence
aaattttcttgttatcctga

SEQ ID NO: 678933 - DNA, 20 bp, Artificial
  CRISPR gRNA sequence
tcttgttatcctgaacaact

SEQ ID NO: 678934 - DNA, 20 bp, Artificial
  CRISPR gRNA sequence
cttgttatcctgaacaactg

SEQ ID NO: 678935 - DNA, 20 bp, Artificial
  CRISPR gRNA sequence
ttgttatcctgaacaactga

SEQ ID NO: 678936 - DNA, 20 bp, Artificial
  CRISPR gRNA sequence
gttatcctgaacaactgaag

SEQ ID NO: 678937 - DNA, 20 bp, Artificial
  CRISPR gRNA sequence
ttatcctgaacaactgaagc

SEQ ID NO: 678938 - DNA, 20 bp, Artificial
  CRISPR gRNA sequence
tcctgaacaactgaagcatt

SEQ ID NO: 678939 - DNA, 20 bp, Artificial
  CRISPR gRNA sequence
aacaactgaagcatttcctt

SEQ ID NO: 678940 - DNA, 20 bp, Artificial
  CRISPR gRNA sequence
aagcatttccttctagtttc

SEQ ID NO: 678941 - DNA, 20 bp, Artificial
  CRISPR gRNA sequence
ccttctagtttctataatct

SEQ ID NO: 678942 - DNA, 20 bp, Artificial
  CRISPR gRNA sequence
cttctagtttctataatcta

SEQ ID NO: 678943 - DNA, 20 bp, Artificial
  CRISPR gRNA sequence
ctagtttctataatctaaag

SEQ ID NO: 678944 - DNA, 20 bp, Artificial
  CRISPR gRNA sequence
tagtttctataatctaaaga

SEQ ID NO: 678945 - DNA, 20 bp, Artificial
  CRISPR gRNA sequence
gtttctataatctaaagaat

SEQ ID NO: 678946 - DNA, 20 bp, Artificial
  CRISPR gRNA sequence
ctataatctaaagaatctaa

SEQ ID NO: 678947 - DNA, 20 bp, Artificial
  CRISPR gRNA sequence
tataatctaaagaatctaat

SEQ ID NO: 678948 - DNA, 20 bp, Artificial
  CRISPR gRNA sequence
taatctaaagaatctaattc

SEQ ID NO: 678949 - DNA, 20 bp, Artificial
  CRISPR gRNA sequence
aagaatctaattctattgat

SEQ ID NO: 678950 - DNA, 20 bp, Artificial
  CRISPR gRNA sequence
attctattgatttgtgatca

SEQ ID NO: 678951 - DNA, 20 bp, Artificial
  CRISPR gRNA sequence
tattgatttgtgatcaagtc

SEQ ID NO: 678952 - DNA, 20 bp, Artificial
  CRISPR gRNA sequence
ttgatttgtgatcaagtcca

SEQ ID NO: 678953 - DNA, 20 bp, Artificial
  CRISPR gRNA sequence
atttgtgatcaagtccattt

SEQ ID NO: 678954 - DNA, 20 bp, Artificial
  CRISPR gRNA sequence
gtgatcaagtccatttattt

SEQ ID NO: 678955 - DNA, 20 bp, Artificial
  CRISPR gRNA sequence
tgatcaagtccatttatttt

SEQ ID NO: 678956 - DNA, 20 bp, Artificial
  CRISPR gRNA sequence
atttttatattatcatcatt

SEQ ID NO: 678957 - DNA, 20 bp, Artificial
  CRISPR gRNA sequence
tttttatattatcatcatta

SEQ ID NO: 678958 - DNA, 20 bp, Artificial
  CRISPR gRNA sequence
ttatattatcatcattaaca

SEQ ID NO: 678959 - DNA, 20 bp, Artificial
  CRISPR gRNA sequence
tatattatcatcattaacat

SEQ ID NO: 678960 - DNA, 20 bp, Artificial
  CRISPR gRNA sequence
atattatcatcattaacatt

SEQ ID NO: 678961 - DNA, 20 bp, Artificial
  CRISPR gRNA sequence
tattatcatcattaacattt

SEQ ID NO: 678962 - DNA, 20 bp, Artificial
  CRISPR gRNA sequence
tcatcattaacattttttac

SEQ ID NO: 678963 - DNA, 20 bp, Artificial
  CRISPR gRNA sequence
acattttttacaaacctatc

SEQ ID NO: 678964 - DNA, 20 bp, Artificial
  CRISPR gRNA sequence
tttacaaacctatctgtgta

SEQ ID NO: 678965 - DNA, 20 bp, Artificial
  CRISPR gRNA sequence
ttacaaacctatctgtgtat

SEQ ID NO: 678966 - DNA, 20 bp, Artificial
  CRISPR gRNA sequence
tacaaacctatctgtgtatc

SEQ ID NO: 678967 - DNA, 20 bp, Artificial
  CRISPR gRNA sequence
acaaacctatctgtgtatca

SEQ ID NO: 678968 - DNA, 20 bp, Artificial
  CRISPR gRNA sequence
caaacctatctgtgtatcaa

SEQ ID NO: 678969 - DNA, 20 bp, Artificial
  CRISPR gRNA sequence
tctgtgtatcaagtcttggt

SEQ ID NO: 678970 - DNA, 20 bp, Artificial
  CRISPR gRNA sequence
tgtatcaagtcttggtaaat

SEQ ID NO: 678971 - DNA, 20 bp, Artificial
  CRISPR gRNA sequence
ggtaaatttgatatttcaag

SEQ ID NO: 678972 - DNA, 20 bp, Artificial
  CRISPR gRNA sequence
gtaaatttgatatttcaagc

SEQ ID NO: 678973 - DNA, 20 bp, Artificial
  CRISPR gRNA sequence
gatatttcaagcttgcatta

SEQ ID NO: 678974 - DNA, 20 bp, Artificial
  CRISPR gRNA sequence
atatttcaagcttgcattac

SEQ ID NO: 678975 - DNA, 20 bp, Artificial
  CRISPR gRNA sequence
caagcttgcattacctgggc

SEQ ID NO: 678976 - DNA, 20 bp, Artificial
  CRISPR gRNA sequence
aagcttgcattacctgggct

SEQ ID NO: 678977 - DNA, 20 bp, Artificial
  CRISPR gRNA sequence
gcattacctgggctgatgat

SEQ ID NO: 678978 - DNA, 20 bp, Artificial
  CRISPR gRNA sequence
cattacctgggctgatgatg

SEQ ID NO: 678979 - DNA, 20 bp, Artificial
  CRISPR gRNA sequence
cctgggctgatgatgatagc

SEQ ID NO: 678980 - DNA, 20 bp, Artificial
  CRISPR gRNA sequence
ggctgatgatgatagcatag

SEQ ID NO: 678981 - DNA, 20 bp, Artificial
  CRISPR gRNA sequence
atgatgatagcataggatct

SEQ ID NO: 678982 - DNA, 20 bp, Artificial
  CRISPR gRNA sequence
gaacatagagattacaaaat

SEQ ID NO: 678983 - DNA, 20 bp, Artificial
  CRISPR gRNA sequence
caaaatggtgcgtctcggag

SEQ ID NO: 678984 - DNA, 20 bp, Artificial
  CRISPR gRNA sequence
ggagtctgccaaacctgctc

SEQ ID NO: 678985 - DNA, 20 bp, Artificial
  CRISPR gRNA sequence
ccaaacctgctctggctact

SEQ ID NO: 678986 - DNA, 20 bp, Artificial
  CRISPR gRNA sequence
ctctggctacttcgtgtctg

SEQ ID NO: 678987 - DNA, 20 bp, Artificial
  CRISPR gRNA sequence
tggctacttcgtgtctgggt

SEQ ID NO: 678988 - DNA, 20 bp, Artificial
  CRISPR gRNA sequence
gctacttcgtgtctgggtgt

SEQ ID NO: 678989 - DNA, 20 bp, Artificial
  CRISPR gRNA sequence
cttcgtgtctgggtgtgtca

SEQ ID NO: 678990 - DNA, 20 bp, Artificial
  CRISPR gRNA sequence
cgtgtctgggtgtgtcactc

SEQ ID NO: 678991 - DNA, 20 bp, Artificial
  CRISPR gRNA sequence
gtgtctgggtgtgtcactca

SEQ ID NO: 678992 - DNA, 20 bp, Artificial
  CRISPR gRNA sequence
ggtgtgtcactcataggctg

SEQ ID NO: 678993 - DNA, 20 bp, Artificial
  CRISPR gRNA sequence
ataggctgggtttgaggatt

SEQ ID NO: 678994 - DNA, 20 bp, Artificial
  CRISPR gRNA sequence
ggtttgaggattaaatgtga

SEQ ID NO: 678995 - DNA, 20 bp, Artificial
  CRISPR gRNA sequence
gaggattaaatgtgactgga

SEQ ID NO: 678996 - DNA, 20 bp, Artificial
  CRISPR gRNA sequence
aggattaaatgtgactggat

SEQ ID NO: 678997 - DNA, 20 bp, Artificial
  CRISPR gRNA sequence
aatgtgactggatatgtaat

SEQ ID NO: 678998 - DNA, 20 bp, Artificial
  CRISPR gRNA sequence
gatatgtaataaatgcccaa

SEQ ID NO: 678999 - DNA, 20 bp, Artificial
  CRISPR gRNA sequence
gctttactgttaacatttga

SEQ ID NO: 679000 - DNA, 20 bp, Artificial
  CRISPR gRNA sequence
ctttactgttaacatttgag

SEQ ID NO: 679001 - DNA, 20 bp, Artificial
  CRISPR gRNA sequence
tactgttaacatttgagaac

SEQ ID NO: 679002 - DNA, 20 bp, Artificial
  CRISPR gRNA sequence
actgttaacatttgagaaca

SEQ ID NO: 679003 - DNA, 20 bp, Artificial
  CRISPR gRNA sequence
ctgttaacatttgagaacat

SEQ ID NO: 679004 - DNA, 20 bp, Artificial
  CRISPR gRNA sequence
ttaacatttgagaacattaa

SEQ ID NO: 679005 - DNA, 20 bp, Artificial
  CRISPR gRNA sequence
acatttgagaacattaaata

SEQ ID NO: 679006 - DNA, 20 bp, Artificial
  CRISPR gRNA sequence
gagaacattaaataactgaa

SEQ ID NO: 679007 - DNA, 20 bp, Artificial
  CRISPR gRNA sequence
agaacattaaataactgaat

SEQ ID NO: 679008 - DNA, 20 bp, Artificial
  CRISPR gRNA sequence
aataactgaataacagtaaa

SEQ ID NO: 679009 - DNA, 20 bp, Artificial
  CRISPR gRNA sequence
aataacagtaaatgtgctat

SEQ ID NO: 679010 - DNA, 20 bp, Artificial
  CRISPR gRNA sequence
ttccctataaatttgttatt

SEQ ID NO: 679011 - DNA, 20 bp, Artificial
  CRISPR gRNA sequence
cctataaatttgttatttac

SEQ ID NO: 679012 - DNA, 20 bp, Artificial
  CRISPR gRNA sequence
taaatttgttatttaccagc

SEQ ID NO: 679013 - DNA, 20 bp, Artificial
  CRISPR gRNA sequence
gttatttaccagcagtaact

SEQ ID NO: 679014 - DNA, 20 bp, Artificial
  CRISPR gRNA sequence
ttatttaccagcagtaactt

SEQ ID NO: 679015 - DNA, 20 bp, Artificial
  CRISPR gRNA sequence
tttaccagcagtaacttaag

SEQ ID NO: 679016 - DNA, 20 bp, Artificial
  CRISPR gRNA sequence
accagcagtaacttaagcat

SEQ ID NO: 679017 - DNA, 20 bp, Artificial
  CRISPR gRNA sequence
ccagcagtaacttaagcatt

SEQ ID NO: 679018 - DNA, 20 bp, Artificial
  CRISPR gRNA sequence
aagcattagaagtttcattt

SEQ ID NO: 679019 - DNA, 20 bp, Artificial
  CRISPR gRNA sequence
agcattagaagtttcatttg

SEQ ID NO: 679020 - DNA, 20 bp, Artificial
  CRISPR gRNA sequence
gaagtttcatttgctgacca

SEQ ID NO: 679021 - DNA, 20 bp, Artificial
  CRISPR gRNA sequence
catttgctgaccaaatacac

SEQ ID NO: 679022 - DNA, 20 bp, Artificial
  CRISPR gRNA sequence
atttgctgaccaaatacact

SEQ ID NO: 679023 - DNA, 20 bp, Artificial
  CRISPR gRNA sequence
gctgaccaaatacactgtta

SEQ ID NO: 679024 - DNA, 20 bp, Artificial
  CRISPR gRNA sequence
ctgaccaaatacactgttac

SEQ ID NO: 679025 - DNA, 20 bp, Artificial
  CRISPR gRNA sequence
accaaatacactgttactat

SEQ ID NO: 679026 - DNA, 20 bp, Artificial
  CRISPR gRNA sequence
ttactatttaaattgatgga

SEQ ID NO: 679027 - DNA, 20 bp, Artificial
  CRISPR gRNA sequence
ctatttaaattgatggattt

SEQ ID NO: 679028 - DNA, 20 bp, Artificial
  CRISPR gRNA sequence
tttaaattgatggatttaag

SEQ ID NO: 679029 - DNA, 20 bp, Artificial
  CRISPR gRNA sequence
aaattgatggatttaagggt

SEQ ID NO: 679030 - DNA, 20 bp, Artificial
  CRISPR gRNA sequence
aattgatggatttaagggta

SEQ ID NO: 679031 - DNA, 20 bp, Artificial
  CRISPR gRNA sequence
atggatttaagggtaaattg

SEQ ID NO: 679032 - DNA, 20 bp, Artificial
  CRISPR gRNA sequence
aagggtaaattgaggctgga

SEQ ID NO: 679033 - DNA, 20 bp, Artificial
  CRISPR gRNA sequence
agggtaaattgaggctggaa

SEQ ID NO: 679034 - DNA, 20 bp, Artificial
  CRISPR gRNA sequence
aggctggaagctgatggaag

SEQ ID NO: 679035 - DNA, 20 bp, Artificial
  CRISPR gRNA sequence
gaagctgatggaagcttggg

SEQ ID NO: 679036 - DNA, 20 bp, Artificial
  CRISPR gRNA sequence
atggaagcttgggggaatac

SEQ ID NO: 679037 - DNA, 20 bp, Artificial
  CRISPR gRNA sequence
gggggaataccaaatcttcc

SEQ ID NO: 679038 - DNA, 20 bp, Artificial
  CRISPR gRNA sequence
ggggaataccaaatcttccc

SEQ ID NO: 679039 - DNA, 20 bp, Artificial
  CRISPR gRNA sequence
ccccaaaacaccttatggca

SEQ ID NO: 679040 - DNA, 20 bp, Artificial
  CRISPR gRNA sequence
cccaaaacaccttatggcat

SEQ ID NO: 679041 - DNA, 20 bp, Artificial
  CRISPR gRNA sequence
atggcattgctactagtttt

SEQ ID NO: 679042 - DNA, 20 bp, Artificial
  CRISPR gRNA sequence
tggcattgctactagttttt

SEQ ID NO: 679043 - DNA, 20 bp, Artificial
  CRISPR gRNA sequence
ctactagtttttctatatta

SEQ ID NO: 679044 - DNA, 20 bp, Artificial
  CRISPR gRNA sequence
ctagtttttctatattatat

SEQ ID NO: 679045 - DNA, 20 bp, Artificial
  CRISPR gRNA sequence
gtttttctatattatattct

SEQ ID NO: 679046 - DNA, 20 bp, Artificial
  CRISPR gRNA sequence
ttctatattatattctccca

SEQ ID NO: 679047 - DNA, 20 bp, Artificial
  CRISPR gRNA sequence
tctatattatattctcccat

SEQ ID NO: 679048 - DNA, 20 bp, Artificial
  CRISPR gRNA sequence
ctatattatattctcccatt

SEQ ID NO: 679049 - DNA, 20 bp, Artificial
  CRISPR gRNA sequence
tatattatattctcccattg

SEQ ID NO: 679050 - DNA, 20 bp, Artificial
  CRISPR gRNA sequence
tattatattctcccattgca

SEQ ID NO: 679051 - DNA, 20 bp, Artificial
  CRISPR gRNA sequence
tattctcccattgcagttct

SEQ ID NO: 679052 - DNA, 20 bp, Artificial
  CRISPR gRNA sequence
tcccattgcagttctgacat

SEQ ID NO: 679053 - DNA, 20 bp, Artificial
  CRISPR gRNA sequence
ccattgcagttctgacattt

SEQ ID NO: 679054 - DNA, 20 bp, Artificial
  CRISPR gRNA sequence
cagttctgacatttgatggc

SEQ ID NO: 679055 - DNA, 20 bp, Artificial
  CRISPR gRNA sequence
tgacatttgatggcgttatg

SEQ ID NO: 679056 - DNA, 20 bp, Artificial
  CRISPR gRNA sequence
acatttgatggcgttatgca

SEQ ID NO: 679057 - DNA, 20 bp, Artificial
  CRISPR gRNA sequence
gatggcgttatgcatttcca

SEQ ID NO: 679058 - DNA, 20 bp, Artificial
  CRISPR gRNA sequence
atggcgttatgcatttccaa

SEQ ID NO: 679059 - DNA, 20 bp, Artificial
  CRISPR gRNA sequence
tgcatttccaactttattta

SEQ ID NO: 679060 - DNA, 20 bp, Artificial
  CRISPR gRNA sequence
ccaactttatttattatttt

SEQ ID NO: 679061 - DNA, 20 bp, Artificial
  CRISPR gRNA sequence
caactttatttattattttt

SEQ ID NO: 679062 - DNA, 20 bp, Artificial
  CRISPR gRNA sequence
tatttattatttttgcattc

SEQ ID NO: 679063 - DNA, 20 bp, Artificial
  CRISPR gRNA sequence
atttattatttttgcattcc

SEQ ID NO: 679064 - DNA, 20 bp, Artificial
  CRISPR gRNA sequence
tttattatttttgcattcct

SEQ ID NO: 679065 - DNA, 20 bp, Artificial
  CRISPR gRNA sequence
attatttttgcattcctagt

SEQ ID NO: 679066 - DNA, 20 bp, Artificial
  CRISPR gRNA sequence
ttatttttgcattcctagtt

SEQ ID NO: 679067 - DNA, 20 bp, Artificial
  CRISPR gRNA sequence
tttttgcattcctagttatt

SEQ ID NO: 679068 - DNA, 20 bp, Artificial
  CRISPR gRNA sequence
ttgcattcctagttatttat

SEQ ID NO: 679069 - DNA, 20 bp, Artificial
  CRISPR gRNA sequence
tgcattcctagttatttatg

SEQ ID NO: 679070 - DNA, 20 bp, Artificial
  CRISPR gRNA sequence
gcattcctagttatttatgg

SEQ ID NO: 679071 - DNA, 20 bp, Artificial
  CRISPR gRNA sequence
cattcctagttatttatgga

SEQ ID NO: 679072 - DNA, 20 bp, Artificial
  CRISPR gRNA sequence
ctagttatttatggaattct

SEQ ID NO: 679073 - DNA, 20 bp, Artificial
  CRISPR gRNA sequence
gttatttatggaattctgta

SEQ ID NO: 679074 - DNA, 20 bp, Artificial
  CRISPR gRNA sequence
tttatggaattctgtattgc

SEQ ID NO: 679075 - DNA, 20 bp, Artificial
  CRISPR gRNA sequence
atggaattctgtattgcata

SEQ ID NO: 679076 - DNA, 20 bp, Artificial
  CRISPR gRNA sequence
tggaattctgtattgcatac

SEQ ID NO: 679077 - DNA, 20 bp, Artificial
  CRISPR gRNA sequence
tgtattgcatacatactcct

SEQ ID NO: 679078 - DNA, 20 bp, Artificial
  CRISPR gRNA sequence
tattgcatacatactcctaa

SEQ ID NO: 679079 - DNA, 20 bp, Artificial
  CRISPR gRNA sequence
catacatactcctaaaagac

SEQ ID NO: 679080 - DNA, 20 bp, Artificial
  CRISPR gRNA sequence
ctaaaagactatatggtaat

SEQ ID NO: 679081 - DNA, 20 bp, Artificial
  CRISPR gRNA sequence
aaagactatatggtaatagg

SEQ ID NO: 679082 - DNA, 20 bp, Artificial
  CRISPR gRNA sequence
tatggtaatagggaggtaaa

SEQ ID NO: 679083 - DNA, 20 bp, Artificial
  CRISPR gRNA sequence
ttataatcaacattgaatta

SEQ ID NO: 679084 - DNA, 20 bp, Artificial
  CRISPR gRNA sequence
taatcaacattgaattatct

SEQ ID NO: 679085 - DNA, 20 bp, Artificial
  CRISPR gRNA sequence
aattatctgttggcagattg

SEQ ID NO: 679086 - DNA, 20 bp, Artificial
  CRISPR gRNA sequence
tctgttggcagattgaactt

SEQ ID NO: 679087 - DNA, 20 bp, Artificial
  CRISPR gRNA sequence
ttggcagattgaacttttag

SEQ ID NO: 679088 - DNA, 20 bp, Artificial
  CRISPR gRNA sequence
gcagattgaacttttagaga

SEQ ID NO: 679089 - DNA, 20 bp, Artificial
  CRISPR gRNA sequence
aacttttagagaatcaaatg

SEQ ID NO: 679090 - DNA, 20 bp, Artificial
  CRISPR gRNA sequence
ttagagaatcaaatgctaac

SEQ ID NO: 679091 - DNA, 20 bp, Artificial
  CRISPR gRNA sequence
tagagaatcaaatgctaacg

SEQ ID NO: 679092 - DNA, 20 bp, Artificial
  CRISPR gRNA sequence
agagaatcaaatgctaacga

SEQ ID NO: 679093 - DNA, 20 bp, Artificial
  CRISPR gRNA sequence
gagaatcaaatgctaacgaa

SEQ ID NO: 679094 - DNA, 20 bp, Artificial
  CRISPR gRNA sequence
acgaaaaatttaaacaagta

SEQ ID NO: 679095 - DNA, 20 bp, Artificial
  CRISPR gRNA sequence
aaacaagtatattttgagag

SEQ ID NO: 679096 - DNA, 20 bp, Artificial
  CRISPR gRNA sequence
aacaagtatattttgagaga

SEQ ID NO: 679097 - DNA, 20 bp, Artificial
  CRISPR gRNA sequence
tgagagaagcaaagatatgt

SEQ ID NO: 679098 - DNA, 20 bp, Artificial
  CRISPR gRNA sequence
gagagaagcaaagatatgtc

SEQ ID NO: 679099 - DNA, 20 bp, Artificial
  CRISPR gRNA sequence
agagaagcaaagatatgtcc

SEQ ID NO: 679100 - DNA, 20 bp, Artificial
  CRISPR gRNA sequence
aacaactggggcctcagtct

SEQ ID NO: 679101 - DNA, 20 bp, Artificial
  CRISPR gRNA sequence
gggcctcagtcttaccccct

SEQ ID NO: 679102 - DNA, 20 bp, Artificial
  CRISPR gRNA sequence
agtcttaccccctattcccc

SEQ ID NO: 679103 - DNA, 20 bp, Artificial
  CRISPR gRNA sequence
accccctattccccagattg

SEQ ID NO: 679104 - DNA, 20 bp, Artificial
  CRISPR gRNA sequence
ccccctattccccagattgc

SEQ ID NO: 679105 - DNA, 20 bp, Artificial
  CRISPR gRNA sequence
ttccccagattgcttagccc

SEQ ID NO: 679106 - DNA, 20 bp, Artificial
  CRISPR gRNA sequence
cccagattgcttagccctcc

SEQ ID NO: 679107 - DNA, 20 bp, Artificial
  CRISPR gRNA sequence
cttagccctccgtaggcaca

SEQ ID NO: 679108 - DNA, 20 bp, Artificial
  CRISPR gRNA sequence
agccctccgtaggcacaggc

SEQ ID NO: 679109 - DNA, 20 bp, Artificial
  CRISPR gRNA sequence
gccctccgtaggcacaggcc

SEQ ID NO: 679110 - DNA, 20 bp, Artificial
  CRISPR gRNA sequence
cgtaggcacaggccctttac

SEQ ID NO: 679111 - DNA, 20 bp, Artificial
  CRISPR gRNA sequence
tacaggtggtgctgaagctg

SEQ ID NO: 679112 - DNA, 20 bp, Artificial
  CRISPR gRNA sequence
acaggtggtgctgaagctgg

SEQ ID NO: 679113 - DNA, 20 bp, Artificial
  CRISPR gRNA sequence
caggtggtgctgaagctgga

SEQ ID NO: 679114 - DNA, 20 bp, Artificial
  CRISPR gRNA sequence
aagctggaaccaagtggggg

SEQ ID NO: 679115 - DNA, 20 bp, Artificial
  CRISPR gRNA sequence
gaaccaagtgggggaaagtg

SEQ ID NO: 679116 - DNA, 20 bp, Artificial
  CRISPR gRNA sequence
ggtaggtagagcagagggta

SEQ ID NO: 679117 - DNA, 20 bp, Artificial
  CRISPR gRNA sequence
agggtagcttctgataccat

SEQ ID NO: 679118 - DNA, 20 bp, Artificial
  CRISPR gRNA sequence
ctgataccatttatagaaac

SEQ ID NO: 679119 - DNA, 20 bp, Artificial
  CRISPR gRNA sequence
tgataccatttatagaaaca

SEQ ID NO: 679120 - DNA, 20 bp, Artificial
  CRISPR gRNA sequence
ataccatttatagaaacaaa

SEQ ID NO: 679121 - DNA, 20 bp, Artificial
  CRISPR gRNA sequence
atagaaacaaatattcttaa

SEQ ID NO: 679122 - DNA, 20 bp, Artificial
  CRISPR gRNA sequence
tagaaacaaatattcttaaa

SEQ ID NO: 679123 - DNA, 20 bp, Artificial
  CRISPR gRNA sequence
ttaaatactggatatcattt

SEQ ID NO: 679124 - DNA, 20 bp, Artificial
  CRISPR gRNA sequence
aaatactggatatcatttta

SEQ ID NO: 679125 - DNA, 20 bp, Artificial
  CRISPR gRNA sequence
aatactggatatcattttaa

SEQ ID NO: 679126 - DNA, 20 bp, Artificial
  CRISPR gRNA sequence
gatatcattttaaccacata

SEQ ID NO: 679127 - DNA, 20 bp, Artificial
  CRISPR gRNA sequence
taaccacataagtttacatt

SEQ ID NO: 679128 - DNA, 20 bp, Artificial
  CRISPR gRNA sequence
aaccacataagtttacattc

SEQ ID NO: 679129 - DNA, 20 bp, Artificial
  CRISPR gRNA sequence
accacataagtttacattca

SEQ ID NO: 679130 - DNA, 20 bp, Artificial
  CRISPR gRNA sequence
acattcatgccatttcatac

SEQ ID NO: 679131 - DNA, 20 bp, Artificial
  CRISPR gRNA sequence
cattcatgccatttcatacc

SEQ ID NO: 679132 - DNA, 20 bp, Artificial
  CRISPR gRNA sequence
atgccatttcataccatact

SEQ ID NO: 679133 - DNA, 20 bp, Artificial
  CRISPR gRNA sequence
cataccatactttttctggg

SEQ ID NO: 679134 - DNA, 20 bp, Artificial
  CRISPR gRNA sequence
ataccatactttttctgggt

SEQ ID NO: 679135 - DNA, 20 bp, Artificial
  CRISPR gRNA sequence
tttctgggtttgttataaca

SEQ ID NO: 679136 - DNA, 20 bp, Artificial
  CRISPR gRNA sequence
ttctgggtttgttataacaa

SEQ ID NO: 679137 - DNA, 20 bp, Artificial
  CRISPR gRNA sequence
tctgggtttgttataacaat

SEQ ID NO: 679138 - DNA, 20 bp, Artificial
  CRISPR gRNA sequence
ctgggtttgttataacaata

SEQ ID NO: 679139 - DNA, 20 bp, Artificial
  CRISPR gRNA sequence
tgggtttgttataacaataa

SEQ ID NO: 679140 - DNA, 20 bp, Artificial
  CRISPR gRNA sequence
ggtttgttataacaataatt

SEQ ID NO: 679141 - DNA, 20 bp, Artificial
  CRISPR gRNA sequence
gttataacaataatttgaga

SEQ ID NO: 679142 - DNA, 20 bp, Artificial
  CRISPR gRNA sequence
ttataacaataatttgagat

SEQ ID NO: 679143 - DNA, 20 bp, Artificial
  CRISPR gRNA sequence
taacaataatttgagattat

SEQ ID NO: 679144 - DNA, 20 bp, Artificial
  CRISPR gRNA sequence
gagattatccttaatctcct

SEQ ID NO: 679145 - DNA, 20 bp, Artificial
  CRISPR gRNA sequence
agattatccttaatctcctc

SEQ ID NO: 679146 - DNA, 20 bp, Artificial
  CRISPR gRNA sequence
tccttaatctcctctatctg

SEQ ID NO: 679147 - DNA, 20 bp, Artificial
  CRISPR gRNA sequence
aatctcctctatctgttgtt

SEQ ID NO: 679148 - DNA, 20 bp, Artificial
  CRISPR gRNA sequence
atctcctctatctgttgtta

SEQ ID NO: 679149 - DNA, 20 bp, Artificial
  CRISPR gRNA sequence
ctctatctgttgttaacatg

SEQ ID NO: 679150 - DNA, 20 bp, Artificial
  CRISPR gRNA sequence
tatctgttgttaacatgcct

SEQ ID NO: 679151 - DNA, 20 bp, Artificial
  CRISPR gRNA sequence
tctgttgttaacatgcctaa

SEQ ID NO: 679152 - DNA, 20 bp, Artificial
  CRISPR gRNA sequence
ttgttaacatgcctaatggg

SEQ ID NO: 679153 - DNA, 20 bp, Artificial
  CRISPR gRNA sequence
ttaacatgcctaatgggaaa

SEQ ID NO: 679154 - DNA, 20 bp, Artificial
  CRISPR gRNA sequence
acatgcctaatgggaaattg

SEQ ID NO: 679155 - DNA, 20 bp, Artificial
  CRISPR gRNA sequence
atgggaaattggccatacga

SEQ ID NO: 679156 - DNA, 20 bp, Artificial
  CRISPR gRNA sequence
gccatacgaggtaggagttg

SEQ ID NO: 679157 - DNA, 20 bp, Artificial
  CRISPR gRNA sequence
ataaatactgtaagagaaaa

SEQ ID NO: 679158 - DNA, 20 bp, Artificial
  CRISPR gRNA sequence
taagagaaaaacatggttct

SEQ ID NO: 679159 - DNA, 20 bp, Artificial
  CRISPR gRNA sequence
tgtaaaatgctgctagagtt

SEQ ID NO: 679160 - DNA, 20 bp, Artificial
  CRISPR gRNA sequence
taaaatgctgctagagttca

SEQ ID NO: 679161 - DNA, 20 bp, Artificial
  CRISPR gRNA sequence
ctagagttcatcattaacat

SEQ ID NO: 679162 - DNA, 20 bp, Artificial
  CRISPR gRNA sequence
gagttcatcattaacatacg

SEQ ID NO: 679163 - DNA, 20 bp, Artificial
  CRISPR gRNA sequence
atcattaacatacgtctcat

SEQ ID NO: 679164 - DNA, 20 bp, Artificial
  CRISPR gRNA sequence
acatacgtctcatataaata

SEQ ID NO: 679165 - DNA, 20 bp, Artificial
  CRISPR gRNA sequence
atataaatagcttggcatat

SEQ ID NO: 679166 - DNA, 20 bp, Artificial
  CRISPR gRNA sequence
ggcatatgtctctttttaaa

SEQ ID NO: 679167 - DNA, 20 bp, Artificial
  CRISPR gRNA sequence
gcatatgtctctttttaaac

SEQ ID NO: 679168 - DNA, 20 bp, Artificial
  CRISPR gRNA sequence
tttttaaacagaaccatgat

SEQ ID NO: 679169 - DNA, 20 bp, Artificial
  CRISPR gRNA sequence
tttaaacagaaccatgatga

SEQ ID NO: 679170 - DNA, 20 bp, Artificial
  CRISPR gRNA sequence
ttaaacagaaccatgatgaa

SEQ ID NO: 679171 - DNA, 20 bp, Artificial
  CRISPR gRNA sequence
taaacagaaccatgatgaaa

SEQ ID NO: 679172 - DNA, 20 bp, Artificial
  CRISPR gRNA sequence
aaacagaaccatgatgaaac

SEQ ID NO: 679173 - DNA, 20 bp, Artificial
  CRISPR gRNA sequence
aacagaaccatgatgaaact

SEQ ID NO: 679174 - DNA, 20 bp, Artificial
  CRISPR gRNA sequence
atatctattcccttctcttg

SEQ ID NO: 679175 - DNA, 20 bp, Artificial
  CRISPR gRNA sequence
tatctattcccttctcttgc

SEQ ID NO: 679176 - DNA, 20 bp, Artificial
  CRISPR gRNA sequence
ttcccttctcttgctgtatg

SEQ ID NO: 679177 - DNA, 20 bp, Artificial
  CRISPR gRNA sequence
ccttctcttgctgtatgtta

SEQ ID NO: 679178 - DNA, 20 bp, Artificial
  CRISPR gRNA sequence
ctcttgctgtatgttattta

SEQ ID NO: 679179 - DNA, 20 bp, Artificial
  CRISPR gRNA sequence
tcttgctgtatgttatttat

SEQ ID NO: 679180 - DNA, 20 bp, Artificial
  CRISPR gRNA sequence
ttgctgtatgttatttattt

SEQ ID NO: 679181 - DNA, 20 bp, Artificial
  CRISPR gRNA sequence
gctgtatgttatttatttgt

SEQ ID NO: 679182 - DNA, 20 bp, Artificial
  CRISPR gRNA sequence
ctgtatgttatttatttgtt

SEQ ID NO: 679183 - DNA, 20 bp, Artificial
  CRISPR gRNA sequence
tatgttatttatttgttttc

SEQ ID NO: 679184 - DNA, 20 bp, Artificial
  CRISPR gRNA sequence
tttatttgttttcctttttt

SEQ ID NO: 679185 - DNA, 20 bp, Artificial
  CRISPR gRNA sequence
atttgttttccttttttgtg

SEQ ID NO: 679186 - DNA, 20 bp, Artificial
  CRISPR gRNA sequence
tttgttttccttttttgtgg

SEQ ID NO: 679187 - DNA, 20 bp, Artificial
  CRISPR gRNA sequence
gttttccttttttgtggtag

SEQ ID NO: 679188 - DNA, 20 bp, Artificial
  CRISPR gRNA sequence
ttttccttttttgtggtaga

SEQ ID NO: 679189 - DNA, 20 bp, Artificial
  CRISPR gRNA sequence
tccttttttgtggtagatat

SEQ ID NO: 679190 - DNA, 20 bp, Artificial
  CRISPR gRNA sequence
ccttttttgtggtagatatg

SEQ ID NO: 679191 - DNA, 20 bp, Artificial
  CRISPR gRNA sequence
cttttttgtggtagatatga

SEQ ID NO: 679192 - DNA, 20 bp, Artificial
  CRISPR gRNA sequence
ttttgtggtagatatgagag

SEQ ID NO: 679193 - DNA, 20 bp, Artificial
  CRISPR gRNA sequence
tttgtggtagatatgagagt

SEQ ID NO: 679194 - DNA, 20 bp, Artificial
  CRISPR gRNA sequence
ttgtggtagatatgagagtt

SEQ ID NO: 679195 - DNA, 20 bp, Artificial
  CRISPR gRNA sequence
tgtggtagatatgagagttg

SEQ ID NO: 679196 - DNA, 20 bp, Artificial
  CRISPR gRNA sequence
gtggtagatatgagagttgc

SEQ ID NO: 679197 - DNA, 20 bp, Artificial
  CRISPR gRNA sequence
tggtagatatgagagttgct

SEQ ID NO: 679198 - DNA, 20 bp, Artificial
  CRISPR gRNA sequence
ctgtcattttggttgccatt

SEQ ID NO: 679199 - DNA, 20 bp, Artificial
  CRISPR gRNA sequence
tcattttggttgccattagc

SEQ ID NO: 679200 - DNA, 20 bp, Artificial
  CRISPR gRNA sequence
tggttgccattagctccatg

SEQ ID NO: 679201 - DNA, 20 bp, Artificial
  CRISPR gRNA sequence
ggttgccattagctccatga

SEQ ID NO: 679202 - DNA, 20 bp, Artificial
  CRISPR gRNA sequence
gttgccattagctccatgaa

SEQ ID NO: 679203 - DNA, 20 bp, Artificial
  CRISPR gRNA sequence
ccattagctccatgaaatga

SEQ ID NO: 679204 - DNA, 20 bp, Artificial
  CRISPR gRNA sequence
gctccatgaaatgatttaac

SEQ ID NO: 679205 - DNA, 20 bp, Artificial
  CRISPR gRNA sequence
catgaaatgatttaactatt

SEQ ID NO: 679206 - DNA, 20 bp, Artificial
  CRISPR gRNA sequence
aactattacttgtttttaaa

SEQ ID NO: 679207 - DNA, 20 bp, Artificial
  CRISPR gRNA sequence
actattacttgtttttaaaa

SEQ ID NO: 679208 - DNA, 20 bp, Artificial
  CRISPR gRNA sequence
ttacttgtttttaaaaaata

SEQ ID NO: 679209 - DNA, 20 bp, Artificial
  CRISPR gRNA sequence
cttgtttttaaaaaatatct

SEQ ID NO: 679210 - DNA, 20 bp, Artificial
  CRISPR gRNA sequence
gtttttaaaaaatatctgac

SEQ ID NO: 679211 - DNA, 20 bp, Artificial
  CRISPR gRNA sequence
tttttaaaaaatatctgaca

SEQ ID NO: 679212 - DNA, 20 bp, Artificial
  CRISPR gRNA sequence
ttaaaaaatatctgacatag

SEQ ID NO: 679213 - DNA, 20 bp, Artificial
  CRISPR gRNA sequence
taaaaaatatctgacatagt

SEQ ID NO: 679214 - DNA, 20 bp, Artificial
  CRISPR gRNA sequence
aaaaaatatctgacatagtt

SEQ ID NO: 679215 - DNA, 20 bp, Artificial
  CRISPR gRNA sequence
aaaaatatctgacatagtta

SEQ ID NO: 679216 - DNA, 20 bp, Artificial
  CRISPR gRNA sequence
acatagttatatttcctagt

SEQ ID NO: 679217 - DNA, 20 bp, Artificial
  CRISPR gRNA sequence
tatttcctagtctttctttt

SEQ ID NO: 679218 - DNA, 20 bp, Artificial
  CRISPR gRNA sequence
cctagtctttcttttctaaa

SEQ ID NO: 679219 - DNA, 20 bp, Artificial
  CRISPR gRNA sequence
ctagtctttcttttctaaaa

SEQ ID NO: 679220 - DNA, 20 bp, Artificial
  CRISPR gRNA sequence
gtctttcttttctaaaacat

SEQ ID NO: 679221 - DNA, 20 bp, Artificial
  CRISPR gRNA sequence
tcttttctaaaacatgtttt

SEQ ID NO: 679222 - DNA, 20 bp, Artificial
  CRISPR gRNA sequence
cttttctaaaacatgttttt

SEQ ID NO: 679223 - DNA, 20 bp, Artificial
  CRISPR gRNA sequence
ttttctaaaacatgtttttc

SEQ ID NO: 679224 - DNA, 20 bp, Artificial
  CRISPR gRNA sequence
ttctaaaacatgtttttccc

SEQ ID NO: 679225 - DNA, 20 bp, Artificial
  CRISPR gRNA sequence
tctaaaacatgtttttccct

SEQ ID NO: 679226 - DNA, 20 bp, Artificial
  CRISPR gRNA sequence
ctaaaacatgtttttccctg

SEQ ID NO: 679227 - DNA, 20 bp, Artificial
  CRISPR gRNA sequence
taaaacatgtttttccctgt

SEQ ID NO: 679228 - DNA, 20 bp, Artificial
  CRISPR gRNA sequence
aaacatgtttttccctgtgt

SEQ ID NO: 679229 - DNA, 20 bp, Artificial
  CRISPR gRNA sequence
ttccctgtgttgttcttcta

SEQ ID NO: 679230 - DNA, 20 bp, Artificial
  CRISPR gRNA sequence
tccctgtgttgttcttctag

SEQ ID NO: 679231 - DNA, 20 bp, Artificial
  CRISPR gRNA sequence
ccctgtgttgttcttctagt

SEQ ID NO: 679232 - DNA, 20 bp, Artificial
  CRISPR gRNA sequence
cctgtgttgttcttctagta

SEQ ID NO: 679233 - DNA, 20 bp, Artificial
  CRISPR gRNA sequence
tgttgttcttctagtatgga

SEQ ID NO: 679234 - DNA, 20 bp, Artificial
  CRISPR gRNA sequence
ttcttctagtatggaatttt

SEQ ID NO: 679235 - DNA, 20 bp, Artificial
  CRISPR gRNA sequence
ttctagtatggaatttttta

SEQ ID NO: 679236 - DNA, 20 bp, Artificial
  CRISPR gRNA sequence
ctagtatggaattttttaaa

SEQ ID NO: 679237 - DNA, 20 bp, Artificial
  CRISPR gRNA sequence
tagtatggaattttttaaag

SEQ ID NO: 679238 - DNA, 20 bp, Artificial
  CRISPR gRNA sequence
gtatggaattttttaaagga

SEQ ID NO: 679239 - DNA, 20 bp, Artificial
  CRISPR gRNA sequence
tttaaaggaaaagaggcatt

SEQ ID NO: 679240 - DNA, 20 bp, Artificial
  CRISPR gRNA sequence
ttaaaggaaaagaggcattt

SEQ ID NO: 679241 - DNA, 20 bp, Artificial
  CRISPR gRNA sequence
taaaggaaaagaggcatttt

SEQ ID NO: 679242 - DNA, 20 bp, Artificial
  CRISPR gRNA sequence
aaaggaaaagaggcattttc

SEQ ID NO: 679243 - DNA, 20 bp, Artificial
  CRISPR gRNA sequence
aaggaaaagaggcattttca

SEQ ID NO: 679244 - DNA, 20 bp, Artificial
  CRISPR gRNA sequence
tcactttactcagaaaacat

SEQ ID NO: 679245 - DNA, 20 bp, Artificial
  CRISPR gRNA sequence
cactttactcagaaaacatt

SEQ ID NO: 679246 - DNA, 20 bp, Artificial
  CRISPR gRNA sequence
actttactcagaaaacattt

SEQ ID NO: 679247 - DNA, 20 bp, Artificial
  CRISPR gRNA sequence
tactcagaaaacatttatca

SEQ ID NO: 679248 - DNA, 20 bp, Artificial
  CRISPR gRNA sequence
actcagaaaacatttatcaa

SEQ ID NO: 679249 - DNA, 20 bp, Artificial
  CRISPR gRNA sequence
ctcagaaaacatttatcaag

SEQ ID NO: 679250 - DNA, 20 bp, Artificial
  CRISPR gRNA sequence
agaaaacatttatcaagagc

SEQ ID NO: 679251 - DNA, 20 bp, Artificial
  CRISPR gRNA sequence
atcaagagcttactatgtgc

SEQ ID NO: 679252 - DNA, 20 bp, Artificial
  CRISPR gRNA sequence
tcaagagcttactatgtgcc

SEQ ID NO: 679253 - DNA, 20 bp, Artificial
  CRISPR gRNA sequence
actatgtgccaagttatata

SEQ ID NO: 679254 - DNA, 20 bp, Artificial
  CRISPR gRNA sequence
ctatgtgccaagttatatag

SEQ ID NO: 679255 - DNA, 20 bp, Artificial
  CRISPR gRNA sequence
tgtgccaagttatatagaac

SEQ ID NO: 679256 - DNA, 20 bp, Artificial
  CRISPR gRNA sequence
tatagaacattctggggtat

SEQ ID NO: 679257 - DNA, 20 bp, Artificial
  CRISPR gRNA sequence
tggggtataaaaataaatgg

SEQ ID NO: 679258 - DNA, 20 bp, Artificial
  CRISPR gRNA sequence
gggtataaaaataaatggac

SEQ ID NO: 679259 - DNA, 20 bp, Artificial
  CRISPR gRNA sequence
ttaatacacttactttatag

SEQ ID NO: 679260 - DNA, 20 bp, Artificial
  CRISPR gRNA sequence
taatacacttactttatagt

SEQ ID NO: 679261 - DNA, 20 bp, Artificial
  CRISPR gRNA sequence
aatacacttactttatagtc

SEQ ID NO: 679262 - DNA, 20 bp, Artificial
  CRISPR gRNA sequence
atacacttactttatagtct

SEQ ID NO: 679263 - DNA, 20 bp, Artificial
  CRISPR gRNA sequence
actttatagtctggtaggaa

SEQ ID NO: 679264 - DNA, 20 bp, Artificial
  CRISPR gRNA sequence
ctttatagtctggtaggaaa

SEQ ID NO: 679265 - DNA, 20 bp, Artificial
  CRISPR gRNA sequence
tatagtctggtaggaaatac

SEQ ID NO: 679266 - DNA, 20 bp, Artificial
  CRISPR gRNA sequence
atagtctggtaggaaataca

SEQ ID NO: 679267 - DNA, 20 bp, Artificial
  CRISPR gRNA sequence
tagtctggtaggaaatacat

SEQ ID NO: 679268 - DNA, 20 bp, Artificial
  CRISPR gRNA sequence
gtaggaaatacatactttaa

SEQ ID NO: 679269 - DNA, 20 bp, Artificial
  CRISPR gRNA sequence
taaaaaaataaaataaaatg

SEQ ID NO: 679270 - DNA, 20 bp, Artificial
  CRISPR gRNA sequence
aaaaaaataaaataaaatga

SEQ ID NO: 679271 - DNA, 20 bp, Artificial
  CRISPR gRNA sequence
aaaaaataaaataaaatgaa

SEQ ID NO: 679272 - DNA, 20 bp, Artificial
  CRISPR gRNA sequence
taataaggatgcatacacag

SEQ ID NO: 679273 - DNA, 20 bp, Artificial
  CRISPR gRNA sequence
ataaggatgcatacacagtt

SEQ ID NO: 679274 - DNA, 20 bp, Artificial
  CRISPR gRNA sequence
tctgggaacatagatgtaga

SEQ ID NO: 679275 - DNA, 20 bp, Artificial
  CRISPR gRNA sequence
tgggaacatagatgtagaat

SEQ ID NO: 679276 - DNA, 20 bp, Artificial
  CRISPR gRNA sequence
ggaacatagatgtagaatta

SEQ ID NO: 679277 - DNA, 20 bp, Artificial
  CRISPR gRNA sequence
acctaactctggaaaagtca

SEQ ID NO: 679278 - DNA, 20 bp, Artificial
  CRISPR gRNA sequence
actctggaaaagtcaagaga

SEQ ID NO: 679279 - DNA, 20 bp, Artificial
  CRISPR gRNA sequence
tggaaaagtcaagagaggct

SEQ ID NO: 679280 - DNA, 20 bp, Artificial
  CRISPR gRNA sequence
gaaaagtcaagagaggcttc

SEQ ID NO: 679281 - DNA, 20 bp, Artificial
  CRISPR gRNA sequence
cttacatgcaggagtgttca

SEQ ID NO: 679282 - DNA, 20 bp, Artificial
  CRISPR gRNA sequence
ttacatgcaggagtgttcaa

SEQ ID NO: 679283 - DNA, 20 bp, Artificial
  CRISPR gRNA sequence
acatgcaggagtgttcaatc

SEQ ID NO: 679284 - DNA, 20 bp, Artificial
  CRISPR gRNA sequence
catgcaggagtgttcaatcc

SEQ ID NO: 679285 - DNA, 20 bp, Artificial
  CRISPR gRNA sequence
aatccaaacatgagggatga

SEQ ID NO: 679286 - DNA, 20 bp, Artificial
  CRISPR gRNA sequence
catatatcaggcaggataca

SEQ ID NO: 679287 - DNA, 20 bp, Artificial
  CRISPR gRNA sequence
aaggagaaaaagaggcttgg

SEQ ID NO: 679288 - DNA, 20 bp, Artificial
  CRISPR gRNA sequence
ggagatataaaagataatta

SEQ ID NO: 679289 - DNA, 20 bp, Artificial
  CRISPR gRNA sequence
gagatataaaagataattaa

SEQ ID NO: 679290 - DNA, 20 bp, Artificial
  CRISPR gRNA sequence
acagcttccctgatgttgag

SEQ ID NO: 679291 - DNA, 20 bp, Artificial
  CRISPR gRNA sequence
ccctgatgttgagtgtaact

SEQ ID NO: 679292 - DNA, 20 bp, Artificial
  CRISPR gRNA sequence
cctgatgttgagtgtaactg

SEQ ID NO: 679293 - DNA, 20 bp, Artificial
  CRISPR gRNA sequence
atgttgagtgtaactgcagt

SEQ ID NO: 679294 - DNA, 20 bp, Artificial
  CRISPR gRNA sequence
agtgtaactgcagtttaagg

SEQ ID NO: 679295 - DNA, 20 bp, Artificial
  CRISPR gRNA sequence
cagtttaaggagtggtagga

SEQ ID NO: 679296 - DNA, 20 bp, Artificial
  CRISPR gRNA sequence
aaggagtggtaggaaatgaa

SEQ ID NO: 679297 - DNA, 20 bp, Artificial
  CRISPR gRNA sequence
aggagtggtaggaaatgaag

SEQ ID NO: 679298 - DNA, 20 bp, Artificial
  CRISPR gRNA sequence
ctgaattagtaggttgtgat

SEQ ID NO: 679299 - DNA, 20 bp, Artificial
  CRISPR gRNA sequence
tgaattagtaggttgtgatg

SEQ ID NO: 679300 - DNA, 20 bp, Artificial
  CRISPR gRNA sequence
aattagtaggttgtgatgca

SEQ ID NO: 679301 - DNA, 20 bp, Artificial
  CRISPR gRNA sequence
gtaggttgtgatgcaaagac

SEQ ID NO: 679302 - DNA, 20 bp, Artificial
  CRISPR gRNA sequence
tgatgcaaagacagagtctt

SEQ ID NO: 679303 - DNA, 20 bp, Artificial
  CRISPR gRNA sequence
ctctgctaagctagtgtttg

SEQ ID NO: 679304 - DNA, 20 bp, Artificial
  CRISPR gRNA sequence
tctgctaagctagtgtttga

SEQ ID NO: 679305 - DNA, 20 bp, Artificial
  CRISPR gRNA sequence
tgctaagctagtgtttgaat

SEQ ID NO: 679306 - DNA, 20 bp, Artificial
  CRISPR gRNA sequence
ctaagctagtgtttgaattt

SEQ ID NO: 679307 - DNA, 20 bp, Artificial
  CRISPR gRNA sequence
agctagtgtttgaatttcat

SEQ ID NO: 679308 - DNA, 20 bp, Artificial
  CRISPR gRNA sequence
gtgtttgaatttcattgtgt

SEQ ID NO: 679309 - DNA, 20 bp, Artificial
  CRISPR gRNA sequence
gaatttcattgtgtaactga

SEQ ID NO: 679310 - DNA, 20 bp, Artificial
  CRISPR gRNA sequence
aatttcattgtgtaactgat

SEQ ID NO: 679311 - DNA, 20 bp, Artificial
  CRISPR gRNA sequence
cattgtgtaactgatggggg

SEQ ID NO: 679312 - DNA, 20 bp, Artificial
  CRISPR gRNA sequence
attgtgtaactgatgggggg

SEQ ID NO: 679313 - DNA, 20 bp, Artificial
  CRISPR gRNA sequence
tgtaactgatggggggccac

SEQ ID NO: 679314 - DNA, 20 bp, Artificial
  CRISPR gRNA sequence
atggggggccactagggtaa

SEQ ID NO: 679315 - DNA, 20 bp, Artificial
  CRISPR gRNA sequence
gggtaaccaaatttgttatt

SEQ ID NO: 679316 - DNA, 20 bp, Artificial
  CRISPR gRNA sequence
gttattaatgaggtaatcaa

SEQ ID NO: 679317 - DNA, 20 bp, Artificial
  CRISPR gRNA sequence
ttattaatgaggtaatcaaa

SEQ ID NO: 679318 - DNA, 20 bp, Artificial
  CRISPR gRNA sequence
ttaatgaggtaatcaaatca

SEQ ID NO: 679319 - DNA, 20 bp, Artificial
  CRISPR gRNA sequence
atgaggtaatcaaatcaaga

SEQ ID NO: 679320 - DNA, 20 bp, Artificial
  CRISPR gRNA sequence
caatgaggatacatgataaa

SEQ ID NO: 679321 - DNA, 20 bp, Artificial
  CRISPR gRNA sequence
cctggggcagggggtatggt

SEQ ID NO: 679322 - DNA, 20 bp, Artificial
  CRISPR gRNA sequence
gggcagggggtatggtgtga

SEQ ID NO: 679323 - DNA, 20 bp, Artificial
  CRISPR gRNA sequence
gaaatgacaatgccaaaaag

SEQ ID NO: 679324 - DNA, 20 bp, Artificial
  CRISPR gRNA sequence
cagaagagaacaaggtgaaa

SEQ ID NO: 679325 - DNA, 20 bp, Artificial
  CRISPR gRNA sequence
aagacatatttaggaggtag

SEQ ID NO: 679326 - DNA, 20 bp, Artificial
  CRISPR gRNA sequence
aggaggtagaataaaatggt

SEQ ID NO: 679327 - DNA, 20 bp, Artificial
  CRISPR gRNA sequence
ggaggtagaataaaatggtc

SEQ ID NO: 679328 - DNA, 20 bp, Artificial
  CRISPR gRNA sequence
agaaaagttgattgagtttg

SEQ ID NO: 679329 - DNA, 20 bp, Artificial
  CRISPR gRNA sequence
gaaaagttgattgagtttga

SEQ ID NO: 679330 - DNA, 20 bp, Artificial
  CRISPR gRNA sequence
attgagtttgaggaaaaagg

SEQ ID NO: 679331 - DNA, 20 bp, Artificial
  CRISPR gRNA sequence
agtttgaggaaaaaggagga

SEQ ID NO: 679332 - DNA, 20 bp, Artificial
  CRISPR gRNA sequence
gaggaaaaaggaggaatatc

SEQ ID NO: 679333 - DNA, 20 bp, Artificial
  CRISPR gRNA sequence
aggaaaaaggaggaatatca

SEQ ID NO: 679334 - DNA, 20 bp, Artificial
  CRISPR gRNA sequence
atagttttggaaataataat

SEQ ID NO: 679335 - DNA, 20 bp, Artificial
  CRISPR gRNA sequence
tggaaataataattgagttt

SEQ ID NO: 679336 - DNA, 20 bp, Artificial
  CRISPR gRNA sequence
ggaaataataattgagtttt

SEQ ID NO: 679337 - DNA, 20 bp, Artificial
  CRISPR gRNA sequence
gaaataataattgagtttta

SEQ ID NO: 679338 - DNA, 20 bp, Artificial
  CRISPR gRNA sequence
agttttatgacagattattt

SEQ ID NO: 679339 - DNA, 20 bp, Artificial
  CRISPR gRNA sequence
tatgacagattatttatata

SEQ ID NO: 679340 - DNA, 20 bp, Artificial
  CRISPR gRNA sequence
atgacagattatttatataa

SEQ ID NO: 679341 - DNA, 20 bp, Artificial
  CRISPR gRNA sequence
tgacagattatttatataat

SEQ ID NO: 679342 - DNA, 20 bp, Artificial
  CRISPR gRNA sequence
tttatataattaaattattt

SEQ ID NO: 679343 - DNA, 20 bp, Artificial
  CRISPR gRNA sequence
atataattaaattatttaat

SEQ ID NO: 679344 - DNA, 20 bp, Artificial
  CRISPR gRNA sequence
tataattaaattatttaatt

SEQ ID NO: 679345 - DNA, 20 bp, Artificial
  CRISPR gRNA sequence
aattatttaattgggtttga

SEQ ID NO: 679346 - DNA, 20 bp, Artificial
  CRISPR gRNA sequence
tttaattgggtttgatgagc

SEQ ID NO: 679347 - DNA, 20 bp, Artificial
  CRISPR gRNA sequence
aattgggtttgatgagctta

SEQ ID NO: 679348 - DNA, 20 bp, Artificial
  CRISPR gRNA sequence
attgggtttgatgagcttat

SEQ ID NO: 679349 - DNA, 20 bp, Artificial
  CRISPR gRNA sequence
ggtttgatgagcttatttat

SEQ ID NO: 679350 - DNA, 20 bp, Artificial
  CRISPR gRNA sequence
gatgagcttatttattttat

SEQ ID NO: 679351 - DNA, 20 bp, Artificial
  CRISPR gRNA sequence
atgagcttatttattttatt

SEQ ID NO: 679352 - DNA, 20 bp, Artificial
  CRISPR gRNA sequence
atttattttattgggtttta

SEQ ID NO: 679353 - DNA, 20 bp, Artificial
  CRISPR gRNA sequence
tttattttattgggttttag

SEQ ID NO: 679354 - DNA, 20 bp, Artificial
  CRISPR gRNA sequence
attttattgggttttagggc

SEQ ID NO: 679355 - DNA, 20 bp, Artificial
  CRISPR gRNA sequence
ttttattgggttttagggca

SEQ ID NO: 679356 - DNA, 20 bp, Artificial
  CRISPR gRNA sequence
tattgggttttagggcagat

SEQ ID NO: 679357 - DNA, 20 bp, Artificial
  CRISPR gRNA sequence
attgggttttagggcagatt

SEQ ID NO: 679358 - DNA, 20 bp, Artificial
  CRISPR gRNA sequence
ttgggttttagggcagatta

SEQ ID NO: 679359 - DNA, 20 bp, Artificial
  CRISPR gRNA sequence
ggttttagggcagattattt

SEQ ID NO: 679360 - DNA, 20 bp, Artificial
  CRISPR gRNA sequence
tagggcagattatttatctt

SEQ ID NO: 679361 - DNA, 20 bp, Artificial
  CRISPR gRNA sequence
agggcagattatttatctta

SEQ ID NO: 679362 - DNA, 20 bp, Artificial
  CRISPR gRNA sequence
gggcagattatttatcttat

SEQ ID NO: 679363 - DNA, 20 bp, Artificial
  CRISPR gRNA sequence
tttatcttatttaattaggt

SEQ ID NO: 679364 - DNA, 20 bp, Artificial
  CRISPR gRNA sequence
atcttatttaattaggtttt

SEQ ID NO: 679365 - DNA, 20 bp, Artificial
  CRISPR gRNA sequence
tcttatttaattaggtttta

SEQ ID NO: 679366 - DNA, 20 bp, Artificial
  CRISPR gRNA sequence
atttaattaggttttatggc

SEQ ID NO: 679367 - DNA, 20 bp, Artificial
  CRISPR gRNA sequence
tttaattaggttttatggca

SEQ ID NO: 679368 - DNA, 20 bp, Artificial
  CRISPR gRNA sequence
aattaggttttatggcagat

SEQ ID NO: 679369 - DNA, 20 bp, Artificial
  CRISPR gRNA sequence
attaggttttatggcagatt

SEQ ID NO: 679370 - DNA, 20 bp, Artificial
  CRISPR gRNA sequence
ggttttatggcagattatct

SEQ ID NO: 679371 - DNA, 20 bp, Artificial
  CRISPR gRNA sequence
tatggcagattatcttgttc

SEQ ID NO: 679372 - DNA, 20 bp, Artificial
  CRISPR gRNA sequence
atggcagattatcttgttca

SEQ ID NO: 679373 - DNA, 20 bp, Artificial
  CRISPR gRNA sequence
tggcagattatcttgttcaa

SEQ ID NO: 679374 - DNA, 20 bp, Artificial
  CRISPR gRNA sequence
tcttgttcaatattatcttt

SEQ ID NO: 679375 - DNA, 20 bp, Artificial
  CRISPR gRNA sequence
gttcaatattatctttatgt

SEQ ID NO: 679376 - DNA, 20 bp, Artificial
  CRISPR gRNA sequence
ttcaatattatctttatgtt

SEQ ID NO: 679377 - DNA, 20 bp, Artificial
  CRISPR gRNA sequence
aatattatctttatgttgct

SEQ ID NO: 679378 - DNA, 20 bp, Artificial
  CRISPR gRNA sequence
tctttatgttgctttttcaa

SEQ ID NO: 679379 - DNA, 20 bp, Artificial
  CRISPR gRNA sequence
tatgttgctttttcaagtct

SEQ ID NO: 679380 - DNA, 20 bp, Artificial
  CRISPR gRNA sequence
atgttgctttttcaagtctg

SEQ ID NO: 679381 - DNA, 20 bp, Artificial
  CRISPR gRNA sequence
tgttgctttttcaagtctgc

SEQ ID NO: 679382 - DNA, 20 bp, Artificial
  CRISPR gRNA sequence
ctttttcaagtctgcttagc

SEQ ID NO: 679383 - DNA, 20 bp, Artificial
  CRISPR gRNA sequence
tttcaagtctgcttagcttg

SEQ ID NO: 679384 - DNA, 20 bp, Artificial
  CRISPR gRNA sequence
ttcaagtctgcttagcttga

SEQ ID NO: 679385 - DNA, 20 bp, Artificial
  CRISPR gRNA sequence
tcaagtctgcttagcttgaa

SEQ ID NO: 679386 - DNA, 20 bp, Artificial
  CRISPR gRNA sequence
caagtctgcttagcttgaag

SEQ ID NO: 679387 - DNA, 20 bp, Artificial
  CRISPR gRNA sequence
aagtctgcttagcttgaagg

SEQ ID NO: 679388 - DNA, 20 bp, Artificial
  CRISPR gRNA sequence
cttagcttgaaggaaaagct

SEQ ID NO: 679389 - DNA, 20 bp, Artificial
  CRISPR gRNA sequence
agcttgaaggaaaagcttta

SEQ ID NO: 679390 - DNA, 20 bp, Artificial
  CRISPR gRNA sequence
gcttgaaggaaaagctttaa

SEQ ID NO: 679391 - DNA, 20 bp, Artificial
  CRISPR gRNA sequence
gaaggaaaagctttaaaatc

SEQ ID NO: 679392 - DNA, 20 bp, Artificial
  CRISPR gRNA sequence
aaggaaaagctttaaaatca

SEQ ID NO: 679393 - DNA, 20 bp, Artificial
  CRISPR gRNA sequence
taaaatcaaactatgttatt

SEQ ID NO: 679394 - DNA, 20 bp, Artificial
  CRISPR gRNA sequence
aaaatcaaactatgttatta

SEQ ID NO: 679395 - DNA, 20 bp, Artificial
  CRISPR gRNA sequence
aaatcaaactatgttattac

SEQ ID NO: 679396 - DNA, 20 bp, Artificial
  CRISPR gRNA sequence
tgttattacctgttttacct

SEQ ID NO: 679397 - DNA, 20 bp, Artificial
  CRISPR gRNA sequence
ttacctgttttacctaaacc

SEQ ID NO: 679398 - DNA, 20 bp, Artificial
  CRISPR gRNA sequence
cctgttttacctaaacctaa

SEQ ID NO: 679399 - DNA, 20 bp, Artificial
  CRISPR gRNA sequence
ttttacctaaacctaaagac

SEQ ID NO: 679400 - DNA, 20 bp, Artificial
  CRISPR gRNA sequence
tacctaaacctaaagacaaa

SEQ ID NO: 679401 - DNA, 20 bp, Artificial
  CRISPR gRNA sequence
acctaaacctaaagacaaaa

SEQ ID NO: 679402 - DNA, 20 bp, Artificial
  CRISPR gRNA sequence
cctaaacctaaagacaaaaa

SEQ ID NO: 679403 - DNA, 20 bp, Artificial
  CRISPR gRNA sequence
aacctaaagacaaaaatgaa

SEQ ID NO: 679404 - DNA, 20 bp, Artificial
  CRISPR gRNA sequence
aagacaaaaatgaaagtgca

SEQ ID NO: 679405 - DNA, 20 bp, Artificial
  CRISPR gRNA sequence
aaaatctatatatattgtta

SEQ ID NO: 679406 - DNA, 20 bp, Artificial
  CRISPR gRNA sequence
aaatctatatatattgttag

SEQ ID NO: 679407 - DNA, 20 bp, Artificial
  CRISPR gRNA sequence
tatatattgttaggtttatg

SEQ ID NO: 679408 - DNA, 20 bp, Artificial
  CRISPR gRNA sequence
ttaggtttatgctttgaatt

SEQ ID NO: 679409 - DNA, 20 bp, Artificial
  CRISPR gRNA sequence
ggtttatgctttgaattgtt

SEQ ID NO: 679410 - DNA, 20 bp, Artificial
  CRISPR gRNA sequence
atgctttgaattgtttagga

SEQ ID NO: 679411 - DNA, 20 bp, Artificial
  CRISPR gRNA sequence
tgctttgaattgtttaggaa

SEQ ID NO: 679412 - DNA, 20 bp, Artificial
  CRISPR gRNA sequence
tgaattgtttaggaaaggga

SEQ ID NO: 679413 - DNA, 20 bp, Artificial
  CRISPR gRNA sequence
gaattgtttaggaaagggag

SEQ ID NO: 679414 - DNA, 20 bp, Artificial
  CRISPR gRNA sequence
aattgtttaggaaagggagg

SEQ ID NO: 679415 - DNA, 20 bp, Artificial
  CRISPR gRNA sequence
tttaggaaagggaggttctt

SEQ ID NO: 679416 - DNA, 20 bp, Artificial
  CRISPR gRNA sequence
aggaaagggaggttcttttt

SEQ ID NO: 679417 - DNA, 20 bp, Artificial
  CRISPR gRNA sequence
ggaaagggaggttctttttc

SEQ ID NO: 679418 - DNA, 20 bp, Artificial
  CRISPR gRNA sequence
tttttcacagtatagaggca

SEQ ID NO: 679419 - DNA, 20 bp, Artificial
  CRISPR gRNA sequence
tttcacagtatagaggcatt

SEQ ID NO: 679420 - DNA, 20 bp, Artificial
  CRISPR gRNA sequence
ttcacagtatagaggcatta

SEQ ID NO: 679421 - DNA, 20 bp, Artificial
  CRISPR gRNA sequence
tcacagtatagaggcattat

SEQ ID NO: 679422 - DNA, 20 bp, Artificial
  CRISPR gRNA sequence
cacagtatagaggcattatt

SEQ ID NO: 679423 - DNA, 20 bp, Artificial
  CRISPR gRNA sequence
acagtatagaggcattattg

SEQ ID NO: 679424 - DNA, 20 bp, Artificial
  CRISPR gRNA sequence
ttgggcacccccaaactttg

SEQ ID NO: 679425 - DNA, 20 bp, Artificial
  CRISPR gRNA sequence
ggcacccccaaactttggaa

SEQ ID NO: 679426 - DNA, 20 bp, Artificial
  CRISPR gRNA sequence
tggaataagcttttttgact

SEQ ID NO: 679427 - DNA, 20 bp, Artificial
  CRISPR gRNA sequence
ggaataagcttttttgactt

SEQ ID NO: 679428 - DNA, 20 bp, Artificial
  CRISPR gRNA sequence
gaataagcttttttgactta

SEQ ID NO: 679429 - DNA, 20 bp, Artificial
  CRISPR gRNA sequence
ttttgacttatttctattgg

SEQ ID NO: 679430 - DNA, 20 bp, Artificial
  CRISPR gRNA sequence
tttgacttatttctattggg

SEQ ID NO: 679431 - DNA, 20 bp, Artificial
  CRISPR gRNA sequence
ttgacttatttctattgggt

SEQ ID NO: 679432 - DNA, 20 bp, Artificial
  CRISPR gRNA sequence
tgacttatttctattgggtg

SEQ ID NO: 679433 - DNA, 20 bp, Artificial
  CRISPR gRNA sequence
gacttatttctattgggtga

SEQ ID NO: 679434 - DNA, 20 bp, Artificial
  CRISPR gRNA sequence
acttatttctattgggtgac

SEQ ID NO: 679435 - DNA, 20 bp, Artificial
  CRISPR gRNA sequence
atttctattgggtgacatca

SEQ ID NO: 679436 - DNA, 20 bp, Artificial
  CRISPR gRNA sequence
tttctattgggtgacatcat

SEQ ID NO: 679437 - DNA, 20 bp, Artificial
  CRISPR gRNA sequence
ctattgggtgacatcattca

SEQ ID NO: 679438 - DNA, 20 bp, Artificial
  CRISPR gRNA sequence
tattgggtgacatcattcag

SEQ ID NO: 679439 - DNA, 20 bp, Artificial
  CRISPR gRNA sequence
ttgggtgacatcattcagtg

SEQ ID NO: 679440 - DNA, 20 bp, Artificial
  CRISPR gRNA sequence
ggtgacatcattcagtgaac

SEQ ID NO: 679441 - DNA, 20 bp, Artificial
  CRISPR gRNA sequence
agtgaacatccattgaatat

SEQ ID NO: 679442 - DNA, 20 bp, Artificial
  CRISPR gRNA sequence
aatattatatctctcttgta

SEQ ID NO: 679443 - DNA, 20 bp, Artificial
  CRISPR gRNA sequence
tatctctcttgtatcataaa

SEQ ID NO: 679444 - DNA, 20 bp, Artificial
  CRISPR gRNA sequence
tcttgtatcataaaaggtat

SEQ ID NO: 679445 - DNA, 20 bp, Artificial
  CRISPR gRNA sequence
ttgtatcataaaaggtatta

SEQ ID NO: 679446 - DNA, 20 bp, Artificial
  CRISPR gRNA sequence
gtatcataaaaggtattaga

SEQ ID NO: 679447 - DNA, 20 bp, Artificial
  CRISPR gRNA sequence
tatcataaaaggtattagag

SEQ ID NO: 679448 - DNA, 20 bp, Artificial
  CRISPR gRNA sequence
gagacacaaatacaacagaa

SEQ ID NO: 679449 - DNA, 20 bp, Artificial
  CRISPR gRNA sequence
aggttatttaccagctattg

SEQ ID NO: 679450 - DNA, 20 bp, Artificial
  CRISPR gRNA sequence
tttaccagctattggaagat

SEQ ID NO: 679451 - DNA, 20 bp, Artificial
  CRISPR gRNA sequence
accagctattggaagataga

SEQ ID NO: 679452 - DNA, 20 bp, Artificial
  CRISPR gRNA sequence
ccagctattggaagatagac

SEQ ID NO: 679453 - DNA, 20 bp, Artificial
  CRISPR gRNA sequence
ttggaagatagaccagtaaa

SEQ ID NO: 679454 - DNA, 20 bp, Artificial
  CRISPR gRNA sequence
gaagatagaccagtaaaaca

SEQ ID NO: 679455 - DNA, 20 bp, Artificial
  CRISPR gRNA sequence
tagtactatgtgataagcat

SEQ ID NO: 679456 - DNA, 20 bp, Artificial
  CRISPR gRNA sequence
tgtgataagcattatggaga

SEQ ID NO: 679457 - DNA, 20 bp, Artificial
  CRISPR gRNA sequence
tggagacagagaggacatac

SEQ ID NO: 679458 - DNA, 20 bp, Artificial
  CRISPR gRNA sequence
aatcagcagaacatccaaga

SEQ ID NO: 679459 - DNA, 20 bp, Artificial
  CRISPR gRNA sequence
cccgggattgagcttagttt

SEQ ID NO: 679460 - DNA, 20 bp, Artificial
  CRISPR gRNA sequence
ccgggattgagcttagtttt

SEQ ID NO: 679461 - DNA, 20 bp, Artificial
  CRISPR gRNA sequence
agcttagttttaaaaagcaa

SEQ ID NO: 679462 - DNA, 20 bp, Artificial
  CRISPR gRNA sequence
agttttaaaaagcaaaaatg

SEQ ID NO: 679463 - DNA, 20 bp, Artificial
  CRISPR gRNA sequence
gttttaaaaagcaaaaatgt

SEQ ID NO: 679464 - DNA, 20 bp, Artificial
  CRISPR gRNA sequence
taaaaagcaaaaatgtgaac

SEQ ID NO: 679465 - DNA, 20 bp, Artificial
  CRISPR gRNA sequence
aaaaagcaaaaatgtgaact

SEQ ID NO: 679466 - DNA, 20 bp, Artificial
  CRISPR gRNA sequence
aaaagcaaaaatgtgaacta

SEQ ID NO: 679467 - DNA, 20 bp, Artificial
  CRISPR gRNA sequence
ataaatggagaagggtgttt

SEQ ID NO: 679468 - DNA, 20 bp, Artificial
  CRISPR gRNA sequence
cctgcagaaagaacaacata

SEQ ID NO: 679469 - DNA, 20 bp, Artificial
  CRISPR gRNA sequence
ctgcagaaagaacaacatat

SEQ ID NO: 679470 - DNA, 20 bp, Artificial
  CRISPR gRNA sequence
cagaaagaacaacatatgtg

SEQ ID NO: 679471 - DNA, 20 bp, Artificial
  CRISPR gRNA sequence
ccaatgtagcatctaaaaca

SEQ ID NO: 679472 - DNA, 20 bp, Artificial
  CRISPR gRNA sequence
aaacacttggggtacctcca

SEQ ID NO: 679473 - DNA, 20 bp, Artificial
  CRISPR gRNA sequence
ggggtacctccatgtgtgtt

SEQ ID NO: 679474 - DNA, 20 bp, Artificial
  CRISPR gRNA sequence
gggtacctccatgtgtgttt

SEQ ID NO: 679475 - DNA, 20 bp, Artificial
  CRISPR gRNA sequence
catgtgtgtttgtaaagaga

SEQ ID NO: 679476 - DNA, 20 bp, Artificial
  CRISPR gRNA sequence
gtaaagagatgtggtaggga

SEQ ID NO: 679477 - DNA, 20 bp, Artificial
  CRISPR gRNA sequence
taaagagatgtggtagggag

SEQ ID NO: 679478 - DNA, 20 bp, Artificial
  CRISPR gRNA sequence
gatgaaaggaagaaatctag

SEQ ID NO: 679479 - DNA, 20 bp, Artificial
  CRISPR gRNA sequence
ggattttccacaggtgacca

SEQ ID NO: 679480 - DNA, 20 bp, Artificial
  CRISPR gRNA sequence
tccacaggtgaccagcatgg

SEQ ID NO: 679481 - DNA, 20 bp, Artificial
  CRISPR gRNA sequence
ccacaggtgaccagcatggc

SEQ ID NO: 679482 - DNA, 20 bp, Artificial
  CRISPR gRNA sequence
cacaggtgaccagcatggct

SEQ ID NO: 679483 - DNA, 20 bp, Artificial
  CRISPR gRNA sequence
atggagtaaatagtagtgtc

SEQ ID NO: 679484 - DNA, 20 bp, Artificial
  CRISPR gRNA sequence
agtgatatggtaattagtag

SEQ ID NO: 679485 - DNA, 20 bp, Artificial
  CRISPR gRNA sequence
gtagtgtcattcagtgatat

SEQ ID NO: 679486 - DNA, 20 bp, Artificial
  CRISPR gRNA sequence
agtgatatggtaattaggaa

SEQ ID NO: 679487 - DNA, 20 bp, Artificial
  CRISPR gRNA sequence
ggaaaatagaagaaagaaag

SEQ ID NO: 679488 - DNA, 20 bp, Artificial
  CRISPR gRNA sequence
tacttcttttactatattct

SEQ ID NO: 679489 - DNA, 20 bp, Artificial
  CRISPR gRNA sequence
acttcttttactatattctt

SEQ ID NO: 679490 - DNA, 20 bp, Artificial
  CRISPR gRNA sequence
cttcttttactatattcttt

SEQ ID NO: 679491 - DNA, 20 bp, Artificial
  CRISPR gRNA sequence
cttttactatattcttttat

SEQ ID NO: 679492 - DNA, 20 bp, Artificial
  CRISPR gRNA sequence
ttttactatattcttttatg

SEQ ID NO: 679493 - DNA, 20 bp, Artificial
  CRISPR gRNA sequence
ttactatattcttttatgtc

SEQ ID NO: 679494 - DNA, 20 bp, Artificial
  CRISPR gRNA sequence
tactatattcttttatgtct

SEQ ID NO: 679495 - DNA, 20 bp, Artificial
  CRISPR gRNA sequence
actatattcttttatgtctc

SEQ ID NO: 679496 - DNA, 20 bp, Artificial
  CRISPR gRNA sequence
ctatattcttttatgtctcc

SEQ ID NO: 679497 - DNA, 20 bp, Artificial
  CRISPR gRNA sequence
tattcttttatgtctccatg

SEQ ID NO: 679498 - DNA, 20 bp, Artificial
  CRISPR gRNA sequence
ttttatgtctccatgaaata

SEQ ID NO: 679499 - DNA, 20 bp, Artificial
  CRISPR gRNA sequence
ttatgtctccatgaaatagg

SEQ ID NO: 679500 - DNA, 20 bp, Artificial
  CRISPR gRNA sequence
tatgtctccatgaaataggc

SEQ ID NO: 679501 - DNA, 20 bp, Artificial
  CRISPR gRNA sequence
atgtctccatgaaataggca

SEQ ID NO: 679502 - DNA, 20 bp, Artificial
  CRISPR gRNA sequence
tgtctccatgaaataggcaa

SEQ ID NO: 679503 - DNA, 20 bp, Artificial
  CRISPR gRNA sequence
catgaaataggcaaataaaa

SEQ ID NO: 679504 - DNA, 20 bp, Artificial
  CRISPR gRNA sequence
tctaggaagatgttaaatat

SEQ ID NO: 679505 - DNA, 20 bp, Artificial
  CRISPR gRNA sequence
ggaagatgttaaatatatag

SEQ ID NO: 679506 - DNA, 20 bp, Artificial
  CRISPR gRNA sequence
aatatatagatctcaagctc

SEQ ID NO: 679507 - DNA, 20 bp, Artificial
  CRISPR gRNA sequence
aagctcttgagaggggtctg

SEQ ID NO: 679508 - DNA, 20 bp, Artificial
  CRISPR gRNA sequence
ttgagaggggtctgagtagg

SEQ ID NO: 679509 - DNA, 20 bp, Artificial
  CRISPR gRNA sequence
gagaggggtctgagtaggaa

SEQ ID NO: 679510 - DNA, 20 bp, Artificial
  CRISPR gRNA sequence
agaggggtctgagtaggaaa

SEQ ID NO: 679511 - DNA, 20 bp, Artificial
  CRISPR gRNA sequence
agtaggaaacaaagatgcag

SEQ ID NO: 679512 - DNA, 20 bp, Artificial
  CRISPR gRNA sequence
atgtagtggcccaacgtagt

SEQ ID NO: 679513 - DNA, 20 bp, Artificial
  CRISPR gRNA sequence
tgtagtggcccaacgtagta

SEQ ID NO: 679514 - DNA, 20 bp, Artificial
  CRISPR gRNA sequence
ttaataaggcaatacggata

SEQ ID NO: 679515 - DNA, 20 bp, Artificial
  CRISPR gRNA sequence
taataaggcaatacggataa

SEQ ID NO: 679516 - DNA, 20 bp, Artificial
  CRISPR gRNA sequence
aataaggcaatacggataag

SEQ ID NO: 679517 - DNA, 20 bp, Artificial
  CRISPR gRNA sequence
ataaggcaatacggataagt

SEQ ID NO: 679518 - DNA, 20 bp, Artificial
  CRISPR gRNA sequence
gcaggaaaaaaatttcatga

SEQ ID NO: 679519 - DNA, 20 bp, Artificial
  CRISPR gRNA sequence
catgaagatgagtaagagca

SEQ ID NO: 679520 - DNA, 20 bp, Artificial
  CRISPR gRNA sequence
atgaagatgagtaagagcag

SEQ ID NO: 679521 - DNA, 20 bp, Artificial
  CRISPR gRNA sequence
cacagaagccaaagcaagtg

SEQ ID NO: 679522 - DNA, 20 bp, Artificial
  CRISPR gRNA sequence
acagaagccaaagcaagtgt

SEQ ID NO: 679523 - DNA, 20 bp, Artificial
  CRISPR gRNA sequence
ccaaatgctgtcaagaaaat

SEQ ID NO: 679524 - DNA, 20 bp, Artificial
  CRISPR gRNA sequence
tcaagaaaataactaagata

SEQ ID NO: 679525 - DNA, 20 bp, Artificial
  CRISPR gRNA sequence
agataactgtaaagtttttt

SEQ ID NO: 679526 - DNA, 20 bp, Artificial
  CRISPR gRNA sequence
taaagttttttttttagatc

SEQ ID NO: 679527 - DNA, 20 bp, Artificial
  CRISPR gRNA sequence
tttttttagatcgggtaaca

SEQ ID NO: 679528 - DNA, 20 bp, Artificial
  CRISPR gRNA sequence
ttttttagatcgggtaacac

SEQ ID NO: 679529 - DNA, 20 bp, Artificial
  CRISPR gRNA sequence
tttttagatcgggtaacacg

SEQ ID NO: 679530 - DNA, 20 bp, Artificial
  CRISPR gRNA sequence
ttttagatcgggtaacacgg

SEQ ID NO: 679531 - DNA, 20 bp, Artificial
  CRISPR gRNA sequence
tttagatcgggtaacacgga

SEQ ID NO: 679532 - DNA, 20 bp, Artificial
  CRISPR gRNA sequence
ttagatcgggtaacacggag

SEQ ID NO: 679533 - DNA, 20 bp, Artificial
  CRISPR gRNA sequence
tagatcgggtaacacggaga

SEQ ID NO: 679534 - DNA, 20 bp, Artificial
  CRISPR gRNA sequence
agatcgggtaacacggagaa

SEQ ID NO: 679535 - DNA, 20 bp, Artificial
  CRISPR gRNA sequence
gatcgggtaacacggagaaa

SEQ ID NO: 679536 - DNA, 20 bp, Artificial
  CRISPR gRNA sequence
gcaacaatatagaagacatc

SEQ ID NO: 679537 - DNA, 20 bp, Artificial
  CRISPR gRNA sequence
caacaatatagaagacatct

SEQ ID NO: 679538 - DNA, 20 bp, Artificial
  CRISPR gRNA sequence
ttgtttttgcctgcctgaca

SEQ ID NO: 679539 - DNA, 20 bp, Artificial
  CRISPR gRNA sequence
tttttgcctgcctgacatcc

SEQ ID NO: 679540 - DNA, 20 bp, Artificial
  CRISPR gRNA sequence
ttgcctgcctgacatccctt

SEQ ID NO: 679541 - DNA, 20 bp, Artificial
  CRISPR gRNA sequence
tgcctgcctgacatcccttc

SEQ ID NO: 679542 - DNA, 20 bp, Artificial
  CRISPR gRNA sequence
gcctgcctgacatcccttcc

SEQ ID NO: 679543 - DNA, 20 bp, Artificial
  CRISPR gRNA sequence
cctgcctgacatcccttcct

SEQ ID NO: 679544 - DNA, 20 bp, Artificial
  CRISPR gRNA sequence
cctgacatcccttcctcctt

SEQ ID NO: 679545 - DNA, 20 bp, Artificial
  CRISPR gRNA sequence
acatcccttcctccttctct

SEQ ID NO: 679546 - DNA, 20 bp, Artificial
  CRISPR gRNA sequence
cctccttctcttgataacaa

SEQ ID NO: 679547 - DNA, 20 bp, Artificial
  CRISPR gRNA sequence
ctccttctcttgataacaag

SEQ ID NO: 679548 - DNA, 20 bp, Artificial
  CRISPR gRNA sequence
cttctcttgataacaagagt

SEQ ID NO: 679549 - DNA, 20 bp, Artificial
  CRISPR gRNA sequence
ctcttgataacaagagtgcc

SEQ ID NO: 679550 - DNA, 20 bp, Artificial
  CRISPR gRNA sequence
tcttgataacaagagtgccc

SEQ ID NO: 679551 - DNA, 20 bp, Artificial
  CRISPR gRNA sequence
ttgataacaagagtgcccat

SEQ ID NO: 679552 - DNA, 20 bp, Artificial
  CRISPR gRNA sequence
gataacaagagtgcccattt

SEQ ID NO: 679553 - DNA, 20 bp, Artificial
  CRISPR gRNA sequence
ataacaagagtgcccattta

SEQ ID NO: 679554 - DNA, 20 bp, Artificial
  CRISPR gRNA sequence
acctttagagaactttcctg

SEQ ID NO: 679555 - DNA, 20 bp, Artificial
  CRISPR gRNA sequence
cctttagagaactttcctgt

SEQ ID NO: 679556 - DNA, 20 bp, Artificial
  CRISPR gRNA sequence
tagagaactttcctgttgca

SEQ ID NO: 679557 - DNA, 20 bp, Artificial
  CRISPR gRNA sequence
agagaactttcctgttgcat

SEQ ID NO: 679558 - DNA, 20 bp, Artificial
  CRISPR gRNA sequence
gagaactttcctgttgcatg

SEQ ID NO: 679559 - DNA, 20 bp, Artificial
  CRISPR gRNA sequence
tcctgttgcatgtagctgtg

SEQ ID NO: 679560 - DNA, 20 bp, Artificial
  CRISPR gRNA sequence
cctgttgcatgtagctgtgg

SEQ ID NO: 679561 - DNA, 20 bp, Artificial
  CRISPR gRNA sequence
ctgttgcatgtagctgtggt

SEQ ID NO: 679562 - DNA, 20 bp, Artificial
  CRISPR gRNA sequence
ttgcatgtagctgtggtggg

SEQ ID NO: 679563 - DNA, 20 bp, Artificial
  CRISPR gRNA sequence
catgtagctgtggtgggacc

SEQ ID NO: 679564 - DNA, 20 bp, Artificial
  CRISPR gRNA sequence
tggtgggaccctcagtccag

SEQ ID NO: 679565 - DNA, 20 bp, Artificial
  CRISPR gRNA sequence
agtccaggtactctgccctc

SEQ ID NO: 679566 - DNA, 20 bp, Artificial
  CRISPR gRNA sequence
tgccctctcctgctcaggag

SEQ ID NO: 679567 - DNA, 20 bp, Artificial
  CRISPR gRNA sequence
ccctctcctgctcaggagct

SEQ ID NO: 679568 - DNA, 20 bp, Artificial
  CRISPR gRNA sequence
tcctgctcaggagctagaca

SEQ ID NO: 679569 - DNA, 20 bp, Artificial
  CRISPR gRNA sequence
ctgctcaggagctagacatg

SEQ ID NO: 679570 - DNA, 20 bp, Artificial
  CRISPR gRNA sequence
ctcaggagctagacatgtga

SEQ ID NO: 679571 - DNA, 20 bp, Artificial
  CRISPR gRNA sequence
aggagctagacatgtgatct

SEQ ID NO: 679572 - DNA, 20 bp, Artificial
  CRISPR gRNA sequence
gacatgtgatctaacctagg

SEQ ID NO: 679573 - DNA, 20 bp, Artificial
  CRISPR gRNA sequence
acctaggtccctcagacttg

SEQ ID NO: 679574 - DNA, 20 bp, Artificial
  CRISPR gRNA sequence
ggtccctcagacttggaatt

SEQ ID NO: 679575 - DNA, 20 bp, Artificial
  CRISPR gRNA sequence
agacttggaatttgaatttg

SEQ ID NO: 679576 - DNA, 20 bp, Artificial
  CRISPR gRNA sequence
ggaatttgaatttgggtgaa

SEQ ID NO: 679577 - DNA, 20 bp, Artificial
  CRISPR gRNA sequence
gaatttgaatttgggtgaac

SEQ ID NO: 679578 - DNA, 20 bp, Artificial
  CRISPR gRNA sequence
gaatttgggtgaactgtttg

SEQ ID NO: 679579 - DNA, 20 bp, Artificial
  CRISPR gRNA sequence
aatttgggtgaactgtttgg

SEQ ID NO: 679580 - DNA, 20 bp, Artificial
  CRISPR gRNA sequence
gggtgaactgtttggttttt

SEQ ID NO: 679581 - DNA, 20 bp, Artificial
  CRISPR gRNA sequence
ggtgaactgtttggtttttc

SEQ ID NO: 679582 - DNA, 20 bp, Artificial
  CRISPR gRNA sequence
tttggtttttcaaaagaata

SEQ ID NO: 679583 - DNA, 20 bp, Artificial
  CRISPR gRNA sequence
ggtttttcaaaagaatacat

SEQ ID NO: 679584 - DNA, 20 bp, Artificial
  CRISPR gRNA sequence
gtttttcaaaagaatacatt

SEQ ID NO: 679585 - DNA, 20 bp, Artificial
  CRISPR gRNA sequence
ttcaaaagaatacattggga

SEQ ID NO: 679586 - DNA, 20 bp, Artificial
  CRISPR gRNA sequence
tcaaaagaatacattgggaa

SEQ ID NO: 679587 - DNA, 20 bp, Artificial
  CRISPR gRNA sequence
caaaagaatacattgggaat

SEQ ID NO: 679588 - DNA, 20 bp, Artificial
  CRISPR gRNA sequence
aaaagaatacattgggaata

SEQ ID NO: 679589 - DNA, 20 bp, Artificial
  CRISPR gRNA sequence
ggaatacacttatggttttg

SEQ ID NO: 679590 - DNA, 20 bp, Artificial
  CRISPR gRNA sequence
atggttttgccgttatggtt

SEQ ID NO: 679591 - DNA, 20 bp, Artificial
  CRISPR gRNA sequence
tggttttgccgttatggtta

SEQ ID NO: 679592 - DNA, 20 bp, Artificial
  CRISPR gRNA sequence
tgccgttatggttatcaacg

SEQ ID NO: 679593 - DNA, 20 bp, Artificial
  CRISPR gRNA sequence
gccgttatggttatcaacgt

SEQ ID NO: 679594 - DNA, 20 bp, Artificial
  CRISPR gRNA sequence
ccgttatggttatcaacgtg

SEQ ID NO: 679595 - DNA, 20 bp, Artificial
  CRISPR gRNA sequence
tggttatcaacgtgatgaaa

SEQ ID NO: 679596 - DNA, 20 bp, Artificial
  CRISPR gRNA sequence
tcaacgtgatgaaacagtga

SEQ ID NO: 679597 - DNA, 20 bp, Artificial
  CRISPR gRNA sequence
atggaattatgtttttatct

SEQ ID NO: 679598 - DNA, 20 bp, Artificial
  CRISPR gRNA sequence
tgtttttatcttggttataa

SEQ ID NO: 679599 - DNA, 20 bp, Artificial
  CRISPR gRNA sequence
ttatcttggttataacctca

SEQ ID NO: 679600 - DNA, 20 bp, Artificial
  CRISPR gRNA sequence
tatcttggttataacctcaa

SEQ ID NO: 679601 - DNA, 20 bp, Artificial
  CRISPR gRNA sequence
atcttggttataacctcaaa

SEQ ID NO: 679602 - DNA, 20 bp, Artificial
  CRISPR gRNA sequence
tcttggttataacctcaaat

SEQ ID NO: 679603 - DNA, 20 bp, Artificial
  CRISPR gRNA sequence
ggttataacctcaaatataa

SEQ ID NO: 679604 - DNA, 20 bp, Artificial
  CRISPR gRNA sequence
gttataacctcaaatataag

SEQ ID NO: 679605 - DNA, 20 bp, Artificial
  CRISPR gRNA sequence
taacctcaaatataaggtca

SEQ ID NO: 679606 - DNA, 20 bp, Artificial
  CRISPR gRNA sequence
aaatataaggtcaaagagga

SEQ ID NO: 679607 - DNA, 20 bp, Artificial
  CRISPR gRNA sequence
ggttataaagtttgttcaaa

SEQ ID NO: 679608 - DNA, 20 bp, Artificial
  CRISPR gRNA sequence
gttataaagtttgttcaaac

SEQ ID NO: 679609 - DNA, 20 bp, Artificial
  CRISPR gRNA sequence
taaagtttgttcaaacaggg

SEQ ID NO: 679610 - DNA, 20 bp, Artificial
  CRISPR gRNA sequence
gttcaaacaggggaagttac

SEQ ID NO: 679611 - DNA, 20 bp, Artificial
  CRISPR gRNA sequence
ttcaaacaggggaagttacc

SEQ ID NO: 679612 - DNA, 20 bp, Artificial
  CRISPR gRNA sequence
aaacaggggaagttacctta

SEQ ID NO: 679613 - DNA, 20 bp, Artificial
  CRISPR gRNA sequence
ccttattggtatatctttag

SEQ ID NO: 679614 - DNA, 20 bp, Artificial
  CRISPR gRNA sequence
attggtatatctttagccca

SEQ ID NO: 679615 - DNA, 20 bp, Artificial
  CRISPR gRNA sequence
ttggtatatctttagcccag

SEQ ID NO: 679616 - DNA, 20 bp, Artificial
  CRISPR gRNA sequence
gtatatctttagcccagatt

SEQ ID NO: 679617 - DNA, 20 bp, Artificial
  CRISPR gRNA sequence
tagcccagattaatgtctat

SEQ ID NO: 679618 - DNA, 20 bp, Artificial
  CRISPR gRNA sequence
agcccagattaatgtctatg

SEQ ID NO: 679619 - DNA, 20 bp, Artificial
  CRISPR gRNA sequence
gcccagattaatgtctatgt

SEQ ID NO: 679620 - DNA, 20 bp, Artificial
  CRISPR gRNA sequence
atgtctatgtgattaatgca

SEQ ID NO: 679621 - DNA, 20 bp, Artificial
  CRISPR gRNA sequence
tgtgattaatgcattattga

SEQ ID NO: 679622 - DNA, 20 bp, Artificial
  CRISPR gRNA sequence
atgcattattgagatatcta

SEQ ID NO: 679623 - DNA, 20 bp, Artificial
  CRISPR gRNA sequence
ttgagatatctagagaattt

SEQ ID NO: 679624 - DNA, 20 bp, Artificial
  CRISPR gRNA sequence
agatatctagagaatttgtt

SEQ ID NO: 679625 - DNA, 20 bp, Artificial
  CRISPR gRNA sequence
gagaatttgttttatgtttc

SEQ ID NO: 679626 - DNA, 20 bp, Artificial
  CRISPR gRNA sequence
gttttatgtttctagcaatg

SEQ ID NO: 679627 - DNA, 20 bp, Artificial
  CRISPR gRNA sequence
ttttatgtttctagcaatgt

SEQ ID NO: 679628 - DNA, 20 bp, Artificial
  CRISPR gRNA sequence
tatgtttctagcaatgtata

SEQ ID NO: 679629 - DNA, 20 bp, Artificial
  CRISPR gRNA sequence
atgtttctagcaatgtatac

SEQ ID NO: 679630 - DNA, 20 bp, Artificial
  CRISPR gRNA sequence
tgtttctagcaatgtataca

SEQ ID NO: 679631 - DNA, 20 bp, Artificial
  CRISPR gRNA sequence
ctagcaatgtatacacagaa

SEQ ID NO: 679632 - DNA, 20 bp, Artificial
  CRISPR gRNA sequence
tagcaatgtatacacagaaa

SEQ ID NO: 679633 - DNA, 20 bp, Artificial
  CRISPR gRNA sequence
gcaatgtatacacagaaata

SEQ ID NO: 679634 - DNA, 20 bp, Artificial
  CRISPR gRNA sequence
tgatgagttgcacccagatc

SEQ ID NO: 679635 - DNA, 20 bp, Artificial
  CRISPR gRNA sequence
gatgagttgcacccagatcc

SEQ ID NO: 679636 - DNA, 20 bp, Artificial
  CRISPR gRNA sequence
atgagttgcacccagatcca

SEQ ID NO: 679637 - DNA, 20 bp, Artificial
  CRISPR gRNA sequence
cacccagatccatgaagcaa

SEQ ID NO: 679638 - DNA, 20 bp, Artificial
  CRISPR gRNA sequence
gttacataattaaggaaaaa

SEQ ID NO: 679639 - DNA, 20 bp, Artificial
  CRISPR gRNA sequence
cataattaaggaaaaatgta

SEQ ID NO: 679640 - DNA, 20 bp, Artificial
  CRISPR gRNA sequence
aggaaaaatgtatcaggtct

SEQ ID NO: 679641 - DNA, 20 bp, Artificial
  CRISPR gRNA sequence
tacccaatggcagaccttac

SEQ ID NO: 679642 - DNA, 20 bp, Artificial
  CRISPR gRNA sequence
acccaatggcagaccttaca

SEQ ID NO: 679643 - DNA, 20 bp, Artificial
  CRISPR gRNA sequence
cccaatggcagaccttacaa

SEQ ID NO: 679644 - DNA, 20 bp, Artificial
  CRISPR gRNA sequence
acaaatatgtctgactggtt

SEQ ID NO: 679645 - DNA, 20 bp, Artificial
  CRISPR gRNA sequence
caaatatgtctgactggttt

SEQ ID NO: 679646 - DNA, 20 bp, Artificial
  CRISPR gRNA sequence
actggtttacaaaaagtcaa

SEQ ID NO: 679647 - DNA, 20 bp, Artificial
  CRISPR gRNA sequence
gtttacaaaaagtcaatgct

SEQ ID NO: 679648 - DNA, 20 bp, Artificial
  CRISPR gRNA sequence
acaaaaagtcaatgctcaaa

SEQ ID NO: 679649 - DNA, 20 bp, Artificial
  CRISPR gRNA sequence
caaaaagtcaatgctcaaaa

SEQ ID NO: 679650 - DNA, 20 bp, Artificial
  CRISPR gRNA sequence
aaaatacctctacaaagagt

SEQ ID NO: 679651 - DNA, 20 bp, Artificial
  CRISPR gRNA sequence
tacaaagagtagtatagcgt

SEQ ID NO: 679652 - DNA, 20 bp, Artificial
  CRISPR gRNA sequence
caaagagtagtatagcgtaa

SEQ ID NO: 679653 - DNA, 20 bp, Artificial
  CRISPR gRNA sequence
agccaggctctggagccaga

SEQ ID NO: 679654 - DNA, 20 bp, Artificial
  CRISPR gRNA sequence
tggagccagactcctagtag

SEQ ID NO: 679655 - DNA, 20 bp, Artificial
  CRISPR gRNA sequence
gagccagactcctagtagta

SEQ ID NO: 679656 - DNA, 20 bp, Artificial
  CRISPR gRNA sequence
ctagtagtaataacattctc

SEQ ID NO: 679657 - DNA, 20 bp, Artificial
  CRISPR gRNA sequence
gtagtaataacattctctac

SEQ ID NO: 679658 - DNA, 20 bp, Artificial
  CRISPR gRNA sequence
tctactaactagatgtaaac

SEQ ID NO: 679659 - DNA, 20 bp, Artificial
  CRISPR gRNA sequence
tactaactagatgtaaaccc

SEQ ID NO: 679660 - DNA, 20 bp, Artificial
  CRISPR gRNA sequence
ctaactagatgtaaaccctg

SEQ ID NO: 679661 - DNA, 20 bp, Artificial
  CRISPR gRNA sequence
actagatgtaaaccctgagg

SEQ ID NO: 679662 - DNA, 20 bp, Artificial
  CRISPR gRNA sequence
gatgtaaaccctgaggaaat

SEQ ID NO: 679663 - DNA, 20 bp, Artificial
  CRISPR gRNA sequence
aggaaattacttaacatctc

SEQ ID NO: 679664 - DNA, 20 bp, Artificial
  CRISPR gRNA sequence
cttaacatctctgggtcttt

SEQ ID NO: 679665 - DNA, 20 bp, Artificial
  CRISPR gRNA sequence
aacatctctgggtctttctg

SEQ ID NO: 679666 - DNA, 20 bp, Artificial
  CRISPR gRNA sequence
acatctctgggtctttctgt

SEQ ID NO: 679667 - DNA, 20 bp, Artificial
  CRISPR gRNA sequence
tgggtctttctgttctcatc

SEQ ID NO: 679668 - DNA, 20 bp, Artificial
  CRISPR gRNA sequence
ggtctttctgttctcatctg

SEQ ID NO: 679669 - DNA, 20 bp, Artificial
  CRISPR gRNA sequence
tctgttctcatctgtacagt

SEQ ID NO: 679670 - DNA, 20 bp, Artificial
  CRISPR gRNA sequence
ctgttctcatctgtacagtg

SEQ ID NO: 679671 - DNA, 20 bp, Artificial
  CRISPR gRNA sequence
tgttctcatctgtacagtga

SEQ ID NO: 679672 - DNA, 20 bp, Artificial
  CRISPR gRNA sequence
ttctcatctgtacagtgaag

SEQ ID NO: 679673 - DNA, 20 bp, Artificial
  CRISPR gRNA sequence
tcatctgtacagtgaagatg

SEQ ID NO: 679674 - DNA, 20 bp, Artificial
  CRISPR gRNA sequence
atctgtacagtgaagatggt

SEQ ID NO: 679675 - DNA, 20 bp, Artificial
  CRISPR gRNA sequence
tacagtgaagatggtattac

SEQ ID NO: 679676 - DNA, 20 bp, Artificial
  CRISPR gRNA sequence
cacctatttcatggagtttc

SEQ ID NO: 679677 - DNA, 20 bp, Artificial
  CRISPR gRNA sequence
tttcatggagtttctggatg

SEQ ID NO: 679678 - DNA, 20 bp, Artificial
  CRISPR gRNA sequence
catggagtttctggatgaat

SEQ ID NO: 679679 - DNA, 20 bp, Artificial
  CRISPR gRNA sequence
atggagtttctggatgaatt

SEQ ID NO: 679680 - DNA, 20 bp, Artificial
  CRISPR gRNA sequence
ctggatgaattaaattaatt

SEQ ID NO: 679681 - DNA, 20 bp, Artificial
  CRISPR gRNA sequence
tggatgaattaaattaatta

SEQ ID NO: 679682 - DNA, 20 bp, Artificial
  CRISPR gRNA sequence
gatgaattaaattaattatt

SEQ ID NO: 679683 - DNA, 20 bp, Artificial
  CRISPR gRNA sequence
aattaattattaaatgcaaa

SEQ ID NO: 679684 - DNA, 20 bp, Artificial
  CRISPR gRNA sequence
attattaaatgcaaagcctt

SEQ ID NO: 679685 - DNA, 20 bp, Artificial
  CRISPR gRNA sequence
ttaaatgcaaagccttaaaa

SEQ ID NO: 679686 - DNA, 20 bp, Artificial
  CRISPR gRNA sequence
aatgcaaagccttaaaacag

SEQ ID NO: 679687 - DNA, 20 bp, Artificial
  CRISPR gRNA sequence
aaaacagcacacagcacata

SEQ ID NO: 679688 - DNA, 20 bp, Artificial
  CRISPR gRNA sequence
aaacagcacacagcacatag

SEQ ID NO: 679689 - DNA, 20 bp, Artificial
  CRISPR gRNA sequence
ttattattgccgatgtggta

SEQ ID NO: 679690 - DNA, 20 bp, Artificial
  CRISPR gRNA sequence
ttattgccgatgtggtagaa

SEQ ID NO: 679691 - DNA, 20 bp, Artificial
  CRISPR gRNA sequence
ttgccgatgtggtagaaaca

SEQ ID NO: 679692 - DNA, 20 bp, Artificial
  CRISPR gRNA sequence
ccgatgtggtagaaacaaga

SEQ ID NO: 679693 - DNA, 20 bp, Artificial
  CRISPR gRNA sequence
ttgacatgaaaagggctatt

SEQ ID NO: 679694 - DNA, 20 bp, Artificial
  CRISPR gRNA sequence
tgacatgaaaagggctattg

SEQ ID NO: 679695 - DNA, 20 bp, Artificial
  CRISPR gRNA sequence
gacatgaaaagggctattgt

SEQ ID NO: 679696 - DNA, 20 bp, Artificial
  CRISPR gRNA sequence
acatgaaaagggctattgta

SEQ ID NO: 679697 - DNA, 20 bp, Artificial
  CRISPR gRNA sequence
ttgtaaagtagaaattagat

SEQ ID NO: 679698 - DNA, 20 bp, Artificial
  CRISPR gRNA sequence
taaagtagaaattagatcag

SEQ ID NO: 679699 - DNA, 20 bp, Artificial
  CRISPR gRNA sequence
gatcagaactctgccaaaat

SEQ ID NO: 679700 - DNA, 20 bp, Artificial
  CRISPR gRNA sequence
tgccaaaatcatcattttca

SEQ ID NO: 679701 - DNA, 20 bp, Artificial
  CRISPR gRNA sequence
ccaaaatcatcattttcagt

SEQ ID NO: 679702 - DNA, 20 bp, Artificial
  CRISPR gRNA sequence
tcagttcacatgagcttcat

SEQ ID NO: 679703 - DNA, 20 bp, Artificial
  CRISPR gRNA sequence
cagttcacatgagcttcatt

SEQ ID NO: 679704 - DNA, 20 bp, Artificial
  CRISPR gRNA sequence
agttcacatgagcttcattg

SEQ ID NO: 679705 - DNA, 20 bp, Artificial
  CRISPR gRNA sequence
acatgagcttcattgaactc

SEQ ID NO: 679706 - DNA, 20 bp, Artificial
  CRISPR gRNA sequence
cattgaactcgggacaaatc

SEQ ID NO: 679707 - DNA, 20 bp, Artificial
  CRISPR gRNA sequence
attgaactcgggacaaatca

SEQ ID NO: 679708 - DNA, 20 bp, Artificial
  CRISPR gRNA sequence
aactcgggacaaatcatctg

SEQ ID NO: 679709 - DNA, 20 bp, Artificial
  CRISPR gRNA sequence
gggacaaatcatctgaattg

SEQ ID NO: 679710 - DNA, 20 bp, Artificial
  CRISPR gRNA sequence
aattgaggtggatgtggtgt

SEQ ID NO: 679711 - DNA, 20 bp, Artificial
  CRISPR gRNA sequence
aggtggatgtggtgtgggac

SEQ ID NO: 679712 - DNA, 20 bp, Artificial
  CRISPR gRNA sequence
ccacacccaggtttcgtttt

SEQ ID NO: 679713 - DNA, 20 bp, Artificial
  CRISPR gRNA sequence
cgttttgagtgttaaatgcg

SEQ ID NO: 679714 - DNA, 20 bp, Artificial
  CRISPR gRNA sequence
gttttgagtgttaaatgcgt

SEQ ID NO: 679715 - DNA, 20 bp, Artificial
  CRISPR gRNA sequence
tgagtgttaaatgcgttcaa

SEQ ID NO: 679716 - DNA, 20 bp, Artificial
  CRISPR gRNA sequence
gagtgttaaatgcgttcaaa

SEQ ID NO: 679717 - DNA, 20 bp, Artificial
  CRISPR gRNA sequence
agtgttaaatgcgttcaaat

SEQ ID NO: 679718 - DNA, 20 bp, Artificial
  CRISPR gRNA sequence
aatgcgttcaaatatgaaaa

SEQ ID NO: 679719 - DNA, 20 bp, Artificial
  CRISPR gRNA sequence
aaatatgaaaattcagggtg

SEQ ID NO: 679720 - DNA, 20 bp, Artificial
  CRISPR gRNA sequence
agggtgaaacttagagcaaa

SEQ ID NO: 679721 - DNA, 20 bp, Artificial
  CRISPR gRNA sequence
agagcaaaactgccaggttt

SEQ ID NO: 679722 - DNA, 20 bp, Artificial
  CRISPR gRNA sequence
gagcaaaactgccaggtttt

SEQ ID NO: 679723 - DNA, 20 bp, Artificial
  CRISPR gRNA sequence
ccaggttttggactactcat

SEQ ID NO: 679724 - DNA, 20 bp, Artificial
  CRISPR gRNA sequence
tggactactcatttcagaac

SEQ ID NO: 679725 - DNA, 20 bp, Artificial
  CRISPR gRNA sequence
ggactactcatttcagaaca

SEQ ID NO: 679726 - DNA, 20 bp, Artificial
  CRISPR gRNA sequence
gactactcatttcagaacaa

SEQ ID NO: 679727 - DNA, 20 bp, Artificial
  CRISPR gRNA sequence
ctcatttcagaacaaattag

SEQ ID NO: 679728 - DNA, 20 bp, Artificial
  CRISPR gRNA sequence
atttcagaacaaattagcat

SEQ ID NO: 679729 - DNA, 20 bp, Artificial
  CRISPR gRNA sequence
cagaacaaattagcatattt

SEQ ID NO: 679730 - DNA, 20 bp, Artificial
  CRISPR gRNA sequence
agaacaaattagcatattta

SEQ ID NO: 679731 - DNA, 20 bp, Artificial
  CRISPR gRNA sequence
gcatatttaattttgggggc

SEQ ID NO: 679732 - DNA, 20 bp, Artificial
  CRISPR gRNA sequence
aattttgggggcaaacccgt

SEQ ID NO: 679733 - DNA, 20 bp, Artificial
  CRISPR gRNA sequence
attttgggggcaaacccgtt

SEQ ID NO: 679734 - DNA, 20 bp, Artificial
  CRISPR gRNA sequence
tgggggcaaacccgttaacc

SEQ ID NO: 679735 - DNA, 20 bp, Artificial
  CRISPR gRNA sequence
gggggcaaacccgttaacca

SEQ ID NO: 679736 - DNA, 20 bp, Artificial
  CRISPR gRNA sequence
ggggcaaacccgttaaccag

SEQ ID NO: 679737 - DNA, 20 bp, Artificial
  CRISPR gRNA sequence
accagttttgctagtttttt

SEQ ID NO: 679738 - DNA, 20 bp, Artificial
  CRISPR gRNA sequence
tgctagttttttagcaaaat

SEQ ID NO: 679739 - DNA, 20 bp, Artificial
  CRISPR gRNA sequence
gctagttttttagcaaaatt

SEQ ID NO: 679740 - DNA, 20 bp, Artificial
  CRISPR gRNA sequence
ctagttttttagcaaaattt

SEQ ID NO: 679741 - DNA, 20 bp, Artificial
  CRISPR gRNA sequence
gttttttagcaaaatttaca

SEQ ID NO: 679742 - DNA, 20 bp, Artificial
  CRISPR gRNA sequence
tttagcaaaatttacaacaa

SEQ ID NO: 679743 - DNA, 20 bp, Artificial
  CRISPR gRNA sequence
ttagcaaaatttacaacaac

SEQ ID NO: 679744 - DNA, 20 bp, Artificial
  CRISPR gRNA sequence
tagcaaaatttacaacaaca

SEQ ID NO: 679745 - DNA, 20 bp, Artificial
  CRISPR gRNA sequence
agcaaaatttacaacaacat

SEQ ID NO: 679746 - DNA, 20 bp, Artificial
  CRISPR gRNA sequence
gcaaaatttacaacaacatt

SEQ ID NO: 679747 - DNA, 20 bp, Artificial
  CRISPR gRNA sequence
acaacaacattttttttttc

SEQ ID NO: 679748 - DNA, 20 bp, Artificial
  CRISPR gRNA sequence
caacaacattttttttttct

SEQ ID NO: 679749 - DNA, 20 bp, Artificial
  CRISPR gRNA sequence
tttttttcttgccaaattct

SEQ ID NO: 679750 - DNA, 20 bp, Artificial
  CRISPR gRNA sequence
ttttttcttgccaaattctt

SEQ ID NO: 679751 - DNA, 20 bp, Artificial
  CRISPR gRNA sequence
tttttcttgccaaattcttt

SEQ ID NO: 679752 - DNA, 20 bp, Artificial
  CRISPR gRNA sequence
ttttcttgccaaattctttc

SEQ ID NO: 679753 - DNA, 20 bp, Artificial
  CRISPR gRNA sequence
tttcttgccaaattctttca

SEQ ID NO: 679754 - DNA, 20 bp, Artificial
  CRISPR gRNA sequence
ttcttgccaaattctttcat

SEQ ID NO: 679755 - DNA, 20 bp, Artificial
  CRISPR gRNA sequence
tcttgccaaattctttcatt

SEQ ID NO: 679756 - DNA, 20 bp, Artificial
  CRISPR gRNA sequence
cttgccaaattctttcattt

SEQ ID NO: 679757 - DNA, 20 bp, Artificial
  CRISPR gRNA sequence
ttgccaaattctttcatttt

SEQ ID NO: 679758 - DNA, 20 bp, Artificial
  CRISPR gRNA sequence
gccaaattctttcattttgg

SEQ ID NO: 679759 - DNA, 20 bp, Artificial
  CRISPR gRNA sequence
ccaaattctttcattttgga

SEQ ID NO: 679760 - DNA, 20 bp, Artificial
  CRISPR gRNA sequence
tttcattttggatcttggtc

SEQ ID NO: 679761 - DNA, 20 bp, Artificial
  CRISPR gRNA sequence
tcattttggatcttggtctg

SEQ ID NO: 679762 - DNA, 20 bp, Artificial
  CRISPR gRNA sequence
cattttggatcttggtctga

SEQ ID NO: 679763 - DNA, 20 bp, Artificial
  CRISPR gRNA sequence
attttggatcttggtctgac

SEQ ID NO: 679764 - DNA, 20 bp, Artificial
  CRISPR gRNA sequence
tggatcttggtctgacatat

SEQ ID NO: 679765 - DNA, 20 bp, Artificial
  CRISPR gRNA sequence
ggatcttggtctgacatatt

SEQ ID NO: 679766 - DNA, 20 bp, Artificial
  CRISPR gRNA sequence
gatcttggtctgacatattt

SEQ ID NO: 679767 - DNA, 20 bp, Artificial
  CRISPR gRNA sequence
ggtctgacatattttcatct

SEQ ID NO: 679768 - DNA, 20 bp, Artificial
  CRISPR gRNA sequence
gtctgacatattttcatctt

SEQ ID NO: 679769 - DNA, 20 bp, Artificial
  CRISPR gRNA sequence
acatattttcatctttggtc

SEQ ID NO: 679770 - DNA, 20 bp, Artificial
  CRISPR gRNA sequence
tcatctttggtccatacttg

SEQ ID NO: 679771 - DNA, 20 bp, Artificial
  CRISPR gRNA sequence
catctttggtccatacttgg

SEQ ID NO: 679772 - DNA, 20 bp, Artificial
  CRISPR gRNA sequence
atctttggtccatacttgga

SEQ ID NO: 679773 - DNA, 20 bp, Artificial
  CRISPR gRNA sequence
tggtccatacttggactgct

SEQ ID NO: 679774 - DNA, 20 bp, Artificial
  CRISPR gRNA sequence
ggtccatacttggactgctt

SEQ ID NO: 679775 - DNA, 20 bp, Artificial
  CRISPR gRNA sequence
gtccatacttggactgcttt

SEQ ID NO: 679776 - DNA, 20 bp, Artificial
  CRISPR gRNA sequence
ggactgctttttagttttat

SEQ ID NO: 679777 - DNA, 20 bp, Artificial
  CRISPR gRNA sequence
gactgctttttagttttatt

SEQ ID NO: 679778 - DNA, 20 bp, Artificial
  CRISPR gRNA sequence
ctttttagttttattgttat

SEQ ID NO: 679779 - DNA, 20 bp, Artificial
  CRISPR gRNA sequence
tttagttttattgttatttc

SEQ ID NO: 679780 - DNA, 20 bp, Artificial
  CRISPR gRNA sequence
ttagttttattgttatttct

SEQ ID NO: 679781 - DNA, 20 bp, Artificial
  CRISPR gRNA sequence
tagttttattgttatttcta

SEQ ID NO: 679782 - DNA, 20 bp, Artificial
  CRISPR gRNA sequence
agttttattgttatttctaa

SEQ ID NO: 679783 - DNA, 20 bp, Artificial
  CRISPR gRNA sequence
gttttattgttatttctaat

SEQ ID NO: 679784 - DNA, 20 bp, Artificial
  CRISPR gRNA sequence
tattgttatttctaataatg

SEQ ID NO: 679785 - DNA, 20 bp, Artificial
  CRISPR gRNA sequence
attgttatttctaataatgt

SEQ ID NO: 679786 - DNA, 20 bp, Artificial
  CRISPR gRNA sequence
ttgttatttctaataatgta

SEQ ID NO: 679787 - DNA, 20 bp, Artificial
  CRISPR gRNA sequence
ttatttctaataatgtagta

SEQ ID NO: 679788 - DNA, 20 bp, Artificial
  CRISPR gRNA sequence
tttctaataatgtagtaagt

SEQ ID NO: 679789 - DNA, 20 bp, Artificial
  CRISPR gRNA sequence
ctaataatgtagtaagtgct

SEQ ID NO: 679790 - DNA, 20 bp, Artificial
  CRISPR gRNA sequence
taataatgtagtaagtgctt

SEQ ID NO: 679791 - DNA, 20 bp, Artificial
  CRISPR gRNA sequence
ataatgtagtaagtgcttgt

SEQ ID NO: 679792 - DNA, 20 bp, Artificial
  CRISPR gRNA sequence
gtaaatccatcatccaaaca

SEQ ID NO: 679793 - DNA, 20 bp, Artificial
  CRISPR gRNA sequence
taaatccatcatccaaacaa

SEQ ID NO: 679794 - DNA, 20 bp, Artificial
  CRISPR gRNA sequence
agattttgaccacaatttgt

SEQ ID NO: 679795 - DNA, 20 bp, Artificial
  CRISPR gRNA sequence
tgaccacaatttgtatctca

SEQ ID NO: 679796 - DNA, 20 bp, Artificial
  CRISPR gRNA sequence
gaccacaatttgtatctcat

SEQ ID NO: 679797 - DNA, 20 bp, Artificial
  CRISPR gRNA sequence
accacaatttgtatctcatt

SEQ ID NO: 679798 - DNA, 20 bp, Artificial
  CRISPR gRNA sequence
gtatctcattacctggttct

SEQ ID NO: 679799 - DNA, 20 bp, Artificial
  CRISPR gRNA sequence
tatctcattacctggttctc

SEQ ID NO: 679800 - DNA, 20 bp, Artificial
  CRISPR gRNA sequence
attacctggttctccaccac

SEQ ID NO: 679801 - DNA, 20 bp, Artificial
  CRISPR gRNA sequence
cctggttctccaccacacca

SEQ ID NO: 679802 - DNA, 20 bp, Artificial
  CRISPR gRNA sequence
gttctccaccacaccaccac

SEQ ID NO: 679803 - DNA, 20 bp, Artificial
  CRISPR gRNA sequence
tccaccacaccaccaccact

SEQ ID NO: 679804 - DNA, 20 bp, Artificial
  CRISPR gRNA sequence
caccacaccaccaccactgt

SEQ ID NO: 679805 - DNA, 20 bp, Artificial
  CRISPR gRNA sequence
tgccattcttctgactcccc

SEQ ID NO: 679806 - DNA, 20 bp, Artificial
  CRISPR gRNA sequence
ttctgactccccttacgtga

SEQ ID NO: 679807 - DNA, 20 bp, Artificial
  CRISPR gRNA sequence
ctgactccccttacgtgaat

SEQ ID NO: 679808 - DNA, 20 bp, Artificial
  CRISPR gRNA sequence
tgactccccttacgtgaatt

SEQ ID NO: 679809 - DNA, 20 bp, Artificial
  CRISPR gRNA sequence
actccccttacgtgaattgg

SEQ ID NO: 679810 - DNA, 20 bp, Artificial
  CRISPR gRNA sequence
cccttacgtgaattggtcat

SEQ ID NO: 679811 - DNA, 20 bp, Artificial
  CRISPR gRNA sequence
acgtgaattggtcatccttg

SEQ ID NO: 679812 - DNA, 20 bp, Artificial
  CRISPR gRNA sequence
cgtgaattggtcatccttga

SEQ ID NO: 679813 - DNA, 20 bp, Artificial
  CRISPR gRNA sequence
gtcatccttgaatgtttttg

SEQ ID NO: 679814 - DNA, 20 bp, Artificial
  CRISPR gRNA sequence
gaatgtttttgaaattcttt

SEQ ID NO: 679815 - DNA, 20 bp, Artificial
  CRISPR gRNA sequence
aatgtttttgaaattctttg

SEQ ID NO: 679816 - DNA, 20 bp, Artificial
  CRISPR gRNA sequence
ttgaaattctttgctttttt

SEQ ID NO: 679817 - DNA, 20 bp, Artificial
  CRISPR gRNA sequence
tgaaattctttgcttttttg

SEQ ID NO: 679818 - DNA, 20 bp, Artificial
  CRISPR gRNA sequence
gaaattctttgcttttttgt

SEQ ID NO: 679819 - DNA, 20 bp, Artificial
  CRISPR gRNA sequence
aaattctttgcttttttgtt

SEQ ID NO: 679820 - DNA, 20 bp, Artificial
  CRISPR gRNA sequence
tttgcttttttgttgactct

SEQ ID NO: 679821 - DNA, 20 bp, Artificial
  CRISPR gRNA sequence
tgcttttttgttgactcttt

SEQ ID NO: 679822 - DNA, 20 bp, Artificial
  CRISPR gRNA sequence
gcttttttgttgactctttt

SEQ ID NO: 679823 - DNA, 20 bp, Artificial
  CRISPR gRNA sequence
cttttttgttgactctttta

SEQ ID NO: 679824 - DNA, 20 bp, Artificial
  CRISPR gRNA sequence
ttttgttgactcttttactt

SEQ ID NO: 679825 - DNA, 20 bp, Artificial
  CRISPR gRNA sequence
tttgttgactcttttacttt

SEQ ID NO: 679826 - DNA, 20 bp, Artificial
  CRISPR gRNA sequence
ttgttgactcttttactttt

SEQ ID NO: 679827 - DNA, 20 bp, Artificial
  CRISPR gRNA sequence
tgttgactcttttacttttg

SEQ ID NO: 679828 - DNA, 20 bp, Artificial
  CRISPR gRNA sequence
gttgactcttttacttttgt

SEQ ID NO: 679829 - DNA, 20 bp, Artificial
  CRISPR gRNA sequence
ttgactcttttacttttgtg

SEQ ID NO: 679830 - DNA, 20 bp, Artificial
  CRISPR gRNA sequence
actcttttacttttgtgtca

SEQ ID NO: 679831 - DNA, 20 bp, Artificial
  CRISPR gRNA sequence
ttttacttttgtgtcacttt

SEQ ID NO: 679832 - DNA, 20 bp, Artificial
  CRISPR gRNA sequence
ttacttttgtgtcacttttt

SEQ ID NO: 679833 - DNA, 20 bp, Artificial
  CRISPR gRNA sequence
tacttttgtgtcactttttt

SEQ ID NO: 679834 - DNA, 20 bp, Artificial
  CRISPR gRNA sequence
acttttgtgtcactttttta

SEQ ID NO: 679835 - DNA, 20 bp, Artificial
  CRISPR gRNA sequence
cttttgtgtcacttttttag

SEQ ID NO: 679836 - DNA, 20 bp, Artificial
  CRISPR gRNA sequence
ttgtgtcacttttttagttg

SEQ ID NO: 679837 - DNA, 20 bp, Artificial
  CRISPR gRNA sequence
tgtgtcacttttttagttgt

SEQ ID NO: 679838 - DNA, 20 bp, Artificial
  CRISPR gRNA sequence
gtgtcacttttttagttgtt

SEQ ID NO: 679839 - DNA, 20 bp, Artificial
  CRISPR gRNA sequence
tgtcacttttttagttgtta

SEQ ID NO: 679840 - DNA, 20 bp, Artificial
  CRISPR gRNA sequence
ttttagttgttactaaaaga

SEQ ID NO: 679841 - DNA, 20 bp, Artificial
  CRISPR gRNA sequence
tttagttgttactaaaagag

SEQ ID NO: 679842 - DNA, 20 bp, Artificial
  CRISPR gRNA sequence
ttagttgttactaaaagaga

SEQ ID NO: 679843 - DNA, 20 bp, Artificial
  CRISPR gRNA sequence
tagttgttactaaaagagaa

SEQ ID NO: 679844 - DNA, 20 bp, Artificial
  CRISPR gRNA sequence
agttgttactaaaagagaat

SEQ ID NO: 679845 - DNA, 20 bp, Artificial
  CRISPR gRNA sequence
gttgttactaaaagagaata

SEQ ID NO: 679846 - DNA, 20 bp, Artificial
  CRISPR gRNA sequence
ttactaaaagagaatataat

SEQ ID NO: 679847 - DNA, 20 bp, Artificial
  CRISPR gRNA sequence
ctaaaagagaatataatgtt

SEQ ID NO: 679848 - DNA, 20 bp, Artificial
  CRISPR gRNA sequence
aaagagaatataatgtttta

SEQ ID NO: 679849 - DNA, 20 bp, Artificial
  CRISPR gRNA sequence
tatacataatatcttgggac

SEQ ID NO: 679850 - DNA, 20 bp, Artificial
  CRISPR gRNA sequence
atacataatatcttgggaca

SEQ ID NO: 679851 - DNA, 20 bp, Artificial
  CRISPR gRNA sequence
tacataatatcttgggacat

SEQ ID NO: 679852 - DNA, 20 bp, Artificial
  CRISPR gRNA sequence
gggacatactttttcaatgt

SEQ ID NO: 679853 - DNA, 20 bp, Artificial
  CRISPR gRNA sequence
ggacatactttttcaatgtg

SEQ ID NO: 679854 - DNA, 20 bp, Artificial
  CRISPR gRNA sequence
tttcaatgtgataacatcat

SEQ ID NO: 679855 - DNA, 20 bp, Artificial
  CRISPR gRNA sequence
ttcaatgtgataacatcatt

SEQ ID NO: 679856 - DNA, 20 bp, Artificial
  CRISPR gRNA sequence
tcaatgtgataacatcatta

SEQ ID NO: 679857 - DNA, 20 bp, Artificial
  CRISPR gRNA sequence
caatgtgataacatcattaa

SEQ ID NO: 679858 - DNA, 20 bp, Artificial
  CRISPR gRNA sequence
aatgtgataacatcattaat

SEQ ID NO: 679859 - DNA, 20 bp, Artificial
  CRISPR gRNA sequence
atgatatagtgcagacaatg

SEQ ID NO: 679860 - DNA, 20 bp, Artificial
  CRISPR gRNA sequence
tttccttgttcctcagtctc

SEQ ID NO: 679861 - DNA, 20 bp, Artificial
  CRISPR gRNA sequence
ccttgttcctcagtctcacc

SEQ ID NO: 679862 - DNA, 20 bp, Artificial
  CRISPR gRNA sequence
cttgttcctcagtctcacct

SEQ ID NO: 679863 - DNA, 20 bp, Artificial
  CRISPR gRNA sequence
gttcctcagtctcaccttga

SEQ ID NO: 679864 - DNA, 20 bp, Artificial
  CRISPR gRNA sequence
ttcctcagtctcaccttgaa

SEQ ID NO: 679865 - DNA, 20 bp, Artificial
  CRISPR gRNA sequence
ctcagtctcaccttgaaact

SEQ ID NO: 679866 - DNA, 20 bp, Artificial
  CRISPR gRNA sequence
agtctcaccttgaaactttt

SEQ ID NO: 679867 - DNA, 20 bp, Artificial
  CRISPR gRNA sequence
accttgaaacttttttccaa

SEQ ID NO: 679868 - DNA, 20 bp, Artificial
  CRISPR gRNA sequence
gaaacttttttccaaattaa

SEQ ID NO: 679869 - DNA, 20 bp, Artificial
  CRISPR gRNA sequence
aaacttttttccaaattaac

SEQ ID NO: 679870 - DNA, 20 bp, Artificial
  CRISPR gRNA sequence
ttttccaaattaacatctaa

SEQ ID NO: 679871 - DNA, 20 bp, Artificial
  CRISPR gRNA sequence
tttccaaattaacatctaat

SEQ ID NO: 679872 - DNA, 20 bp, Artificial
  CRISPR gRNA sequence
ttccaaattaacatctaata

SEQ ID NO: 679873 - DNA, 20 bp, Artificial
  CRISPR gRNA sequence
tccaaattaacatctaataa

SEQ ID NO: 679874 - DNA, 20 bp, Artificial
  CRISPR gRNA sequence
ccaaattaacatctaataat

SEQ ID NO: 679875 - DNA, 20 bp, Artificial
  CRISPR gRNA sequence
caaattaacatctaataatt

SEQ ID NO: 679876 - DNA, 20 bp, Artificial
  CRISPR gRNA sequence
acatctaataattgcacaat

SEQ ID NO: 679877 - DNA, 20 bp, Artificial
  CRISPR gRNA sequence
ataattgcacaatcccttgc

SEQ ID NO: 679878 - DNA, 20 bp, Artificial
  CRISPR gRNA sequence
cacaatcccttgctattcat

SEQ ID NO: 679879 - DNA, 20 bp, Artificial
  CRISPR gRNA sequence
gctattcatagccagaggac

SEQ ID NO: 679880 - DNA, 20 bp, Artificial
  CRISPR gRNA sequence
ctattcatagccagaggact

SEQ ID NO: 679881 - DNA, 20 bp, Artificial
  CRISPR gRNA sequence
ttcatagccagaggacttct

SEQ ID NO: 679882 - DNA, 20 bp, Artificial
  CRISPR gRNA sequence
atagccagaggacttcttat

SEQ ID NO: 679883 - DNA, 20 bp, Artificial
  CRISPR gRNA sequence
cttattaaatgtagattaca

SEQ ID NO: 679884 - DNA, 20 bp, Artificial
  CRISPR gRNA sequence
ttattaaatgtagattacaa

SEQ ID NO: 679885 - DNA, 20 bp, Artificial
  CRISPR gRNA sequence
attaaatgtagattacaatt

SEQ ID NO: 679886 - DNA, 20 bp, Artificial
  CRISPR gRNA sequence
ttaaatgtagattacaattc

SEQ ID NO: 679887 - DNA, 20 bp, Artificial
  CRISPR gRNA sequence
aatgtagattacaattcaat

SEQ ID NO: 679888 - DNA, 20 bp, Artificial
  CRISPR gRNA sequence
caattcaatttttttgaccc

SEQ ID NO: 679889 - DNA, 20 bp, Artificial
  CRISPR gRNA sequence
aatttttttgacccatctat

SEQ ID NO: 679890 - DNA, 20 bp, Artificial
  CRISPR gRNA sequence
ttttgacccatctataggtt

SEQ ID NO: 679891 - DNA, 20 bp, Artificial
  CRISPR gRNA sequence
tttgacccatctataggtta

SEQ ID NO: 679892 - DNA, 20 bp, Artificial
  CRISPR gRNA sequence
ttgacccatctataggttaa

SEQ ID NO: 679893 - DNA, 20 bp, Artificial
  CRISPR gRNA sequence
tgacccatctataggttaat

SEQ ID NO: 679894 - DNA, 20 bp, Artificial
  CRISPR gRNA sequence
gacccatctataggttaatc

SEQ ID NO: 679895 - DNA, 20 bp, Artificial
  CRISPR gRNA sequence
acccatctataggttaatca

SEQ ID NO: 679896 - DNA, 20 bp, Artificial
  CRISPR gRNA sequence
taggttaatcaaaacttgga

SEQ ID NO: 679897 - DNA, 20 bp, Artificial
  CRISPR gRNA sequence
atcaaaacttggatggaatg

SEQ ID NO: 679898 - DNA, 20 bp, Artificial
  CRISPR gRNA sequence
ggatggaatgttgatttctt

SEQ ID NO: 679899 - DNA, 20 bp, Artificial
  CRISPR gRNA sequence
gatggaatgttgatttcttt

SEQ ID NO: 679900 - DNA, 20 bp, Artificial
  CRISPR gRNA sequence
atttctttaaacatgtccaa

SEQ ID NO: 679901 - DNA, 20 bp, Artificial
  CRISPR gRNA sequence
ctttaaacatgtccaaatca

SEQ ID NO: 679902 - DNA, 20 bp, Artificial
  CRISPR gRNA sequence
tttaaacatgtccaaatcat

SEQ ID NO: 679903 - DNA, 20 bp, Artificial
  CRISPR gRNA sequence
taaacatgtccaaatcatga

SEQ ID NO: 679904 - DNA, 20 bp, Artificial
  CRISPR gRNA sequence
aaacatgtccaaatcatgaa

SEQ ID NO: 679905 - DNA, 20 bp, Artificial
  CRISPR gRNA sequence
aacatgtccaaatcatgaaa

SEQ ID NO: 679906 - DNA, 20 bp, Artificial
  CRISPR gRNA sequence
tttcacactatgtttcattt

SEQ ID NO: 679907 - DNA, 20 bp, Artificial
  CRISPR gRNA sequence
ttcacactatgtttcatttt

SEQ ID NO: 679908 - DNA, 20 bp, Artificial
  CRISPR gRNA sequence
tcacactatgtttcattttc

SEQ ID NO: 679909 - DNA, 20 bp, Artificial
  CRISPR gRNA sequence
cacactatgtttcattttct

SEQ ID NO: 679910 - DNA, 20 bp, Artificial
  CRISPR gRNA sequence
acactatgtttcattttctt

SEQ ID NO: 679911 - DNA, 20 bp, Artificial
  CRISPR gRNA sequence
tgtttcattttcttcaaaat

SEQ ID NO: 679912 - DNA, 20 bp, Artificial
  CRISPR gRNA sequence
cattttcttcaaaattggta

SEQ ID NO: 679913 - DNA, 20 bp, Artificial
  CRISPR gRNA sequence
attttcttcaaaattggtaa

SEQ ID NO: 679914 - DNA, 20 bp, Artificial
  CRISPR gRNA sequence
tcttcaaaattggtaaccta

SEQ ID NO: 679915 - DNA, 20 bp, Artificial
  CRISPR gRNA sequence
cttcaaaattggtaacctat

SEQ ID NO: 679916 - DNA, 20 bp, Artificial
  CRISPR gRNA sequence
ttcaaaattggtaacctatt

SEQ ID NO: 679917 - DNA, 20 bp, Artificial
  CRISPR gRNA sequence
caaaattggtaacctattgg

SEQ ID NO: 679918 - DNA, 20 bp, Artificial
  CRISPR gRNA sequence
aaaattggtaacctattggt

SEQ ID NO: 679919 - DNA, 20 bp, Artificial
  CRISPR gRNA sequence
gtaacctattggttattaaa

SEQ ID NO: 679920 - DNA, 20 bp, Artificial
  CRISPR gRNA sequence
ttggttattaaatacatcaa

SEQ ID NO: 679921 - DNA, 20 bp, Artificial
  CRISPR gRNA sequence
gttattaaatacatcaactg

SEQ ID NO: 679922 - DNA, 20 bp, Artificial
  CRISPR gRNA sequence
ttaaatacatcaactgaatt

SEQ ID NO: 679923 - DNA, 20 bp, Artificial
  CRISPR gRNA sequence
aatacatcaactgaattgtg

SEQ ID NO: 679924 - DNA, 20 bp, Artificial
  CRISPR gRNA sequence
aattgtgcactgaattttcc

SEQ ID NO: 679925 - DNA, 20 bp, Artificial
  CRISPR gRNA sequence
tgcactgaattttcctacct

SEQ ID NO: 679926 - DNA, 20 bp, Artificial
  CRISPR gRNA sequence
aattttcctacctttcatct

SEQ ID NO: 679927 - DNA, 20 bp, Artificial
  CRISPR gRNA sequence
tcctacctttcatctcttgc

SEQ ID NO: 679928 - DNA, 20 bp, Artificial
  CRISPR gRNA sequence
cctacctttcatctcttgct

SEQ ID NO: 679929 - DNA, 20 bp, Artificial
  CRISPR gRNA sequence
ctacctttcatctcttgctt

SEQ ID NO: 679930 - DNA, 20 bp, Artificial
  CRISPR gRNA sequence
cctttcatctcttgctttct

SEQ ID NO: 679931 - DNA, 20 bp, Artificial
  CRISPR gRNA sequence
tcatctcttgctttctcact

SEQ ID NO: 679932 - DNA, 20 bp, Artificial
  CRISPR gRNA sequence
catctcttgctttctcactt

SEQ ID NO: 679933 - DNA, 20 bp, Artificial
  CRISPR gRNA sequence
atctcttgctttctcactta

SEQ ID NO: 679934 - DNA, 20 bp, Artificial
  CRISPR gRNA sequence
ttgctttctcacttattttt

SEQ ID NO: 679935 - DNA, 20 bp, Artificial
  CRISPR gRNA sequence
gctttctcacttatttttgt

SEQ ID NO: 679936 - DNA, 20 bp, Artificial
  CRISPR gRNA sequence
ctttctcacttatttttgtg

SEQ ID NO: 679937 - DNA, 20 bp, Artificial
  CRISPR gRNA sequence
tctcacttatttttgtgtct

SEQ ID NO: 679938 - DNA, 20 bp, Artificial
  CRISPR gRNA sequence
ctcacttatttttgtgtctg

SEQ ID NO: 679939 - DNA, 20 bp, Artificial
  CRISPR gRNA sequence
tcacttatttttgtgtctgc

SEQ ID NO: 679940 - DNA, 20 bp, Artificial
  CRISPR gRNA sequence
acttatttttgtgtctgcca

SEQ ID NO: 679941 - DNA, 20 bp, Artificial
  CRISPR gRNA sequence
atttttgtgtctgccaagag

SEQ ID NO: 679942 - DNA, 20 bp, Artificial
  CRISPR gRNA sequence
tttttgtgtctgccaagagg

SEQ ID NO: 679943 - DNA, 20 bp, Artificial
  CRISPR gRNA sequence
ttgtgtctgccaagaggatc

SEQ ID NO: 679944 - DNA, 20 bp, Artificial
  CRISPR gRNA sequence
tgtgtctgccaagaggatcc

SEQ ID NO: 679945 - DNA, 20 bp, Artificial
  CRISPR gRNA sequence
gtgtctgccaagaggatccc

SEQ ID NO: 679946 - DNA, 20 bp, Artificial
  CRISPR gRNA sequence
tgtctgccaagaggatcccc

SEQ ID NO: 679947 - DNA, 20 bp, Artificial
  CRISPR gRNA sequence
ccaagaggatccccttataa

SEQ ID NO: 679948 - DNA, 20 bp, Artificial
  CRISPR gRNA sequence
ataaatgagactacattttt

SEQ ID NO: 679949 - DNA, 20 bp, Artificial
  CRISPR gRNA sequence
taaatgagactacatttttt

SEQ ID NO: 679950 - DNA, 20 bp, Artificial
  CRISPR gRNA sequence
catttttttgtacacagtgg

SEQ ID NO: 679951 - DNA, 20 bp, Artificial
  CRISPR gRNA sequence
ttttgtacacagtgggacta

SEQ ID NO: 679952 - DNA, 20 bp, Artificial
  CRISPR gRNA sequence
tttgtacacagtgggactat

SEQ ID NO: 679953 - DNA, 20 bp, Artificial
  CRISPR gRNA sequence
ttgtacacagtgggactatc

SEQ ID NO: 679954 - DNA, 20 bp, Artificial
  CRISPR gRNA sequence
tgtacacagtgggactatct

SEQ ID NO: 679955 - DNA, 20 bp, Artificial
  CRISPR gRNA sequence
gtacacagtgggactatctt

SEQ ID NO: 679956 - DNA, 20 bp, Artificial
  CRISPR gRNA sequence
tacacagtgggactatctta

SEQ ID NO: 679957 - DNA, 20 bp, Artificial
  CRISPR gRNA sequence
tcttatacaaatgaaaggat

SEQ ID NO: 679958 - DNA, 20 bp, Artificial
  CRISPR gRNA sequence
atacaaatgaaaggatcaga

SEQ ID NO: 679959 - DNA, 20 bp, Artificial
  CRISPR gRNA sequence
tacaaatgaaaggatcagag

SEQ ID NO: 679960 - DNA, 20 bp, Artificial
  CRISPR gRNA sequence
ttacagggcatactgaacaa

SEQ ID NO: 679961 - DNA, 20 bp, Artificial
  CRISPR gRNA sequence
tacagggcatactgaacaag

SEQ ID NO: 679962 - DNA, 20 bp, Artificial
  CRISPR gRNA sequence
acagggcatactgaacaagt

SEQ ID NO: 679963 - DNA, 20 bp, Artificial
  CRISPR gRNA sequence
cagggcatactgaacaagta

SEQ ID NO: 679964 - DNA, 20 bp, Artificial
  CRISPR gRNA sequence
aacaagtaaagttattctaa

SEQ ID NO: 679965 - DNA, 20 bp, Artificial
  CRISPR gRNA sequence
ttctaagaaatgaaagcttt

SEQ ID NO: 679966 - DNA, 20 bp, Artificial
  CRISPR gRNA sequence
taagaaatgaaagctttagg

SEQ ID NO: 679967 - DNA, 20 bp, Artificial
  CRISPR gRNA sequence
agaaatgaaagctttaggtt

SEQ ID NO: 679968 - DNA, 20 bp, Artificial
  CRISPR gRNA sequence
taggtttccaaacagtactg

SEQ ID NO: 679969 - DNA, 20 bp, Artificial
  CRISPR gRNA sequence
aggtttccaaacagtactgg

SEQ ID NO: 679970 - DNA, 20 bp, Artificial
  CRISPR gRNA sequence
ggtttccaaacagtactggc

SEQ ID NO: 679971 - DNA, 20 bp, Artificial
  CRISPR gRNA sequence
ccaaacagtactggcacaag

SEQ ID NO: 679972 - DNA, 20 bp, Artificial
  CRISPR gRNA sequence
caaacagtactggcacaagt

SEQ ID NO: 679973 - DNA, 20 bp, Artificial
  CRISPR gRNA sequence
gcacaagtgcaactggagaa

SEQ ID NO: 679974 - DNA, 20 bp, Artificial
  CRISPR gRNA sequence
gagaaagcaacaataaacaa

SEQ ID NO: 679975 - DNA, 20 bp, Artificial
  CRISPR gRNA sequence
tgttctttcctgagaacact

SEQ ID NO: 679976 - DNA, 20 bp, Artificial
  CRISPR gRNA sequence
tttcctgagaacactgtttt

SEQ ID NO: 679977 - DNA, 20 bp, Artificial
  CRISPR gRNA sequence
tcctgagaacactgttttta

SEQ ID NO: 679978 - DNA, 20 bp, Artificial
  CRISPR gRNA sequence
cctgagaacactgtttttaa

SEQ ID NO: 679979 - DNA, 20 bp, Artificial
  CRISPR gRNA sequence
ctgagaacactgtttttaat

SEQ ID NO: 679980 - DNA, 20 bp, Artificial
  CRISPR gRNA sequence
agaacactgtttttaatcaa

SEQ ID NO: 679981 - DNA, 20 bp, Artificial
  CRISPR gRNA sequence
tttttaatcaactgattcgc

SEQ ID NO: 679982 - DNA, 20 bp, Artificial
  CRISPR gRNA sequence
ttaatcaactgattcgcctt

SEQ ID NO: 679983 - DNA, 20 bp, Artificial
  CRISPR gRNA sequence
taatcaactgattcgccttg

SEQ ID NO: 679984 - DNA, 20 bp, Artificial
  CRISPR gRNA sequence
aatcaactgattcgccttgt

SEQ ID NO: 679985 - DNA, 20 bp, Artificial
  CRISPR gRNA sequence
atcaactgattcgccttgtc

SEQ ID NO: 679986 - DNA, 20 bp, Artificial
  CRISPR gRNA sequence
attcgccttgtctgagttgt

SEQ ID NO: 679987 - DNA, 20 bp, Artificial
  CRISPR gRNA sequence
gccttgtctgagttgttacc

SEQ ID NO: 679988 - DNA, 20 bp, Artificial
  CRISPR gRNA sequence
gtctgagttgttaccctatc

SEQ ID NO: 679989 - DNA, 20 bp, Artificial
  CRISPR gRNA sequence
tctgagttgttaccctatcc

SEQ ID NO: 679990 - DNA, 20 bp, Artificial
  CRISPR gRNA sequence
agttgttaccctatccttaa

SEQ ID NO: 679991 - DNA, 20 bp, Artificial
  CRISPR gRNA sequence
ttaccctatccttaattaaa

SEQ ID NO: 679992 - DNA, 20 bp, Artificial
  CRISPR gRNA sequence
ccctatccttaattaaacat

SEQ ID NO: 679993 - DNA, 20 bp, Artificial
  CRISPR gRNA sequence
tccttaattaaacatccttg

SEQ ID NO: 679994 - DNA, 20 bp, Artificial
  CRISPR gRNA sequence
aattaaacatccttgggcag

SEQ ID NO: 679995 - DNA, 20 bp, Artificial
  CRISPR gRNA sequence
attaaacatccttgggcagt

SEQ ID NO: 679996 - DNA, 20 bp, Artificial
  CRISPR gRNA sequence
aacatccttgggcagtattt

SEQ ID NO: 679997 - DNA, 20 bp, Artificial
  CRISPR gRNA sequence
gggcagtatttctactcaaa

SEQ ID NO: 679998 - DNA, 20 bp, Artificial
  CRISPR gRNA sequence
ggcagtatttctactcaaaa

SEQ ID NO: 679999 - DNA, 20 bp, Artificial
  CRISPR gRNA sequence
ctactcaaaaaacaactgtt

SEQ ID NO: 680000 - DNA, 20 bp, Artificial
  CRISPR gRNA sequence
tactcaaaaaacaactgttt

SEQ ID NO: 680001 - DNA, 20 bp, Artificial
  CRISPR gRNA sequence
ctcaaaaaacaactgtttta

SEQ ID NO: 680002 - DNA, 20 bp, Artificial
  CRISPR gRNA sequence
aaaaaacaactgttttaagt

SEQ ID NO: 680003 - DNA, 20 bp, Artificial
  CRISPR gRNA sequence
ttttaagttctttgtctgca

SEQ ID NO: 680004 - DNA, 20 bp, Artificial
  CRISPR gRNA sequence
taagttctttgtctgcacta

SEQ ID NO: 680005 - DNA, 20 bp, Artificial
  CRISPR gRNA sequence
aagttctttgtctgcactat

SEQ ID NO: 680006 - DNA, 20 bp, Artificial
  CRISPR gRNA sequence
agttctttgtctgcactatg

SEQ ID NO: 680007 - DNA, 20 bp, Artificial
  CRISPR gRNA sequence
tttgtctgcactatgaatgt

SEQ ID NO: 680008 - DNA, 20 bp, Artificial
  CRISPR gRNA sequence
tgtctgcactatgaatgtca

SEQ ID NO: 680009 - DNA, 20 bp, Artificial
  CRISPR gRNA sequence
gtctgcactatgaatgtcag

SEQ ID NO: 680010 - DNA, 20 bp, Artificial
  CRISPR gRNA sequence
tctgcactatgaatgtcagt

SEQ ID NO: 680011 - DNA, 20 bp, Artificial
  CRISPR gRNA sequence
cactatgaatgtcagtgtct

SEQ ID NO: 680012 - DNA, 20 bp, Artificial
  CRISPR gRNA sequence
tgaatgtcagtgtctaaggg

SEQ ID NO: 680013 - DNA, 20 bp, Artificial
  CRISPR gRNA sequence
agggctaacagattagtcca

SEQ ID NO: 680014 - DNA, 20 bp, Artificial
  CRISPR gRNA sequence
acagattagtccatagcaac

SEQ ID NO: 680015 - DNA, 20 bp, Artificial
  CRISPR gRNA sequence
gtccatagcaacttagaaaa

SEQ ID NO: 680016 - DNA, 20 bp, Artificial
  CRISPR gRNA sequence
agaaaaaagggatgaatagg

SEQ ID NO: 680017 - DNA, 20 bp, Artificial
  CRISPR gRNA sequence
gaaaaaagggatgaataggg

SEQ ID NO: 680018 - DNA, 20 bp, Artificial
  CRISPR gRNA sequence
gagagtatatgtcaaatgaa

SEQ ID NO: 680019 - DNA, 20 bp, Artificial
  CRISPR gRNA sequence
gggcagtagtttagtgagcc

SEQ ID NO: 680020 - DNA, 20 bp, Artificial
  CRISPR gRNA sequence
agtgagccaatgtgccaatt

SEQ ID NO: 680021 - DNA, 20 bp, Artificial
  CRISPR gRNA sequence
gtgagccaatgtgccaattt

SEQ ID NO: 680022 - DNA, 20 bp, Artificial
  CRISPR gRNA sequence
agaaatggattcttcttcct

SEQ ID NO: 680023 - DNA, 20 bp, Artificial
  CRISPR gRNA sequence
gaaatggattcttcttcctg

SEQ ID NO: 680024 - DNA, 20 bp, Artificial
  CRISPR gRNA sequence
ttcttcctgctgaagagctc

SEQ ID NO: 680025 - DNA, 20 bp, Artificial
  CRISPR gRNA sequence
cttcctgctgaagagctctt

SEQ ID NO: 680026 - DNA, 20 bp, Artificial
  CRISPR gRNA sequence
ttcctgctgaagagctcttt

SEQ ID NO: 680027 - DNA, 20 bp, Artificial
  CRISPR gRNA sequence
cctgctgaagagctcttttt

SEQ ID NO: 680028 - DNA, 20 bp, Artificial
  CRISPR gRNA sequence
ctgctgaagagctcttttta

SEQ ID NO: 680029 - DNA, 20 bp, Artificial
  CRISPR gRNA sequence
ctgaagagctctttttaaaa

SEQ ID NO: 680030 - DNA, 20 bp, Artificial
  CRISPR gRNA sequence
aagagctctttttaaaataa

SEQ ID NO: 680031 - DNA, 20 bp, Artificial
  CRISPR gRNA sequence
tttttaaaataaattacaat

SEQ ID NO: 680032 - DNA, 20 bp, Artificial
  CRISPR gRNA sequence
tttaaaataaattacaatca

SEQ ID NO: 680033 - DNA, 20 bp, Artificial
  CRISPR gRNA sequence
ttaaaataaattacaatcat

SEQ ID NO: 680034 - DNA, 20 bp, Artificial
  CRISPR gRNA sequence
taaaataaattacaatcata

SEQ ID NO: 680035 - DNA, 20 bp, Artificial
  CRISPR gRNA sequence
aaaataaattacaatcataa

SEQ ID NO: 680036 - DNA, 20 bp, Artificial
  CRISPR gRNA sequence
aaataaattacaatcataaa

SEQ ID NO: 680037 - DNA, 20 bp, Artificial
  CRISPR gRNA sequence
caatcataaagctgccacag

SEQ ID NO: 680038 - DNA, 20 bp, Artificial
  CRISPR gRNA sequence
ccacagtttactgtgcatag

SEQ ID NO: 680039 - DNA, 20 bp, Artificial
  CRISPR gRNA sequence
actgtgcatagacatgttca

SEQ ID NO: 680040 - DNA, 20 bp, Artificial
  CRISPR gRNA sequence
ctgtgcatagacatgttcag

SEQ ID NO: 680041 - DNA, 20 bp, Artificial
  CRISPR gRNA sequence
tgcatagacatgttcagaat

SEQ ID NO: 680042 - DNA, 20 bp, Artificial
  CRISPR gRNA sequence
agaattggctcttcttcatg

SEQ ID NO: 680043 - DNA, 20 bp, Artificial
  CRISPR gRNA sequence
gctcttcttcatgagggctg

SEQ ID NO: 680044 - DNA, 20 bp, Artificial
  CRISPR gRNA sequence
ttcttcatgagggctgcttg

SEQ ID NO: 680045 - DNA, 20 bp, Artificial
  CRISPR gRNA sequence
cttcatgagggctgcttggt

SEQ ID NO: 680046 - DNA, 20 bp, Artificial
  CRISPR gRNA sequence
ttcatgagggctgcttggtg

SEQ ID NO: 680047 - DNA, 20 bp, Artificial
  CRISPR gRNA sequence
catgagggctgcttggtgca

SEQ ID NO: 680048 - DNA, 20 bp, Artificial
  CRISPR gRNA sequence
atgagggctgcttggtgcag

SEQ ID NO: 680049 - DNA, 20 bp, Artificial
  CRISPR gRNA sequence
cttggtgcaggtatttaagc

SEQ ID NO: 680050 - DNA, 20 bp, Artificial
  CRISPR gRNA sequence
ggtgcaggtatttaagctac

SEQ ID NO: 680051 - DNA, 20 bp, Artificial
  CRISPR gRNA sequence
gtgcaggtatttaagctact

SEQ ID NO: 680052 - DNA, 20 bp, Artificial
  CRISPR gRNA sequence
aagctactgccaataaggct

SEQ ID NO: 680053 - DNA, 20 bp, Artificial
  CRISPR gRNA sequence
agctactgccaataaggcta

SEQ ID NO: 680054 - DNA, 20 bp, Artificial
  CRISPR gRNA sequence
ctgccaataaggctaacagc

SEQ ID NO: 680055 - DNA, 20 bp, Artificial
  CRISPR gRNA sequence
ccaataaggctaacagctca

SEQ ID NO: 680056 - DNA, 20 bp, Artificial
  CRISPR gRNA sequence
acagctcatcaaatagaaaa

SEQ ID NO: 680057 - DNA, 20 bp, Artificial
  CRISPR gRNA sequence
atcaaatagaaaatacgctg

SEQ ID NO: 680058 - DNA, 20 bp, Artificial
  CRISPR gRNA sequence
caggaaaatacatgggttaa

SEQ ID NO: 680059 - DNA, 20 bp, Artificial
  CRISPR gRNA sequence
agaaaaacagttaaataccg

SEQ ID NO: 680060 - DNA, 20 bp, Artificial
  CRISPR gRNA sequence
aataccgtgctgttattttg

SEQ ID NO: 680061 - DNA, 20 bp, Artificial
  CRISPR gRNA sequence
ttattttgtatgtctgttta

SEQ ID NO: 680062 - DNA, 20 bp, Artificial
  CRISPR gRNA sequence
ttttgtatgtctgtttaagc

SEQ ID NO: 680063 - DNA, 20 bp, Artificial
  CRISPR gRNA sequence
tgtatgtctgtttaagcttt

SEQ ID NO: 680064 - DNA, 20 bp, Artificial
  CRISPR gRNA sequence
gtatgtctgtttaagctttt

SEQ ID NO: 680065 - DNA, 20 bp, Artificial
  CRISPR gRNA sequence
tatgtctgtttaagcttttc

SEQ ID NO: 680066 - DNA, 20 bp, Artificial
  CRISPR gRNA sequence
tttaagcttttctctcaaac

SEQ ID NO: 680067 - DNA, 20 bp, Artificial
  CRISPR gRNA sequence
aagcttttctctcaaacaag

SEQ ID NO: 680068 - DNA, 20 bp, Artificial
  CRISPR gRNA sequence
agcttttctctcaaacaagt

SEQ ID NO: 680069 - DNA, 20 bp, Artificial
  CRISPR gRNA sequence
ttctctcaaacaagttgact

SEQ ID NO: 680070 - DNA, 20 bp, Artificial
  CRISPR gRNA sequence
tctctcaaacaagttgactt

SEQ ID NO: 680071 - DNA, 20 bp, Artificial
  CRISPR gRNA sequence
ctctcaaacaagttgactta

SEQ ID NO: 680072 - DNA, 20 bp, Artificial
  CRISPR gRNA sequence
tctcaaacaagttgacttac

SEQ ID NO: 680073 - DNA, 20 bp, Artificial
  CRISPR gRNA sequence
tcaaacaagttgacttactt

SEQ ID NO: 680074 - DNA, 20 bp, Artificial
  CRISPR gRNA sequence
aaacaagttgacttacttaa

SEQ ID NO: 680075 - DNA, 20 bp, Artificial
  CRISPR gRNA sequence
acttacttaaattgtttttt

SEQ ID NO: 680076 - DNA, 20 bp, Artificial
  CRISPR gRNA sequence
acttaaattgttttttaaaa

SEQ ID NO: 680077 - DNA, 20 bp, Artificial
  CRISPR gRNA sequence
cttaaattgttttttaaaaa

SEQ ID NO: 680078 - DNA, 20 bp, Artificial
  CRISPR gRNA sequence
aaattgttttttaaaaataa

SEQ ID NO: 680079 - DNA, 20 bp, Artificial
  CRISPR gRNA sequence
aattgttttttaaaaataaa

SEQ ID NO: 680080 - DNA, 20 bp, Artificial
  CRISPR gRNA sequence
ttttttaaaaataaactcta

SEQ ID NO: 680081 - DNA, 20 bp, Artificial
  CRISPR gRNA sequence
tttaaaaataaactctaaaa

SEQ ID NO: 680082 - DNA, 20 bp, Artificial
  CRISPR gRNA sequence
ttaaaaataaactctaaaag

SEQ ID NO: 680083 - DNA, 20 bp, Artificial
  CRISPR gRNA sequence
taaaaataaactctaaaagc

SEQ ID NO: 680084 - DNA, 20 bp, Artificial
  CRISPR gRNA sequence
aaaaataaactctaaaagcc

SEQ ID NO: 680085 - DNA, 20 bp, Artificial
  CRISPR gRNA sequence
aaaataaactctaaaagcct

SEQ ID NO: 680086 - DNA, 20 bp, Artificial
  CRISPR gRNA sequence
taaaagccttgaaaatagtg

SEQ ID NO: 680087 - DNA, 20 bp, Artificial
  CRISPR gRNA sequence
aaagccttgaaaatagtgca

SEQ ID NO: 680088 - DNA, 20 bp, Artificial
  CRISPR gRNA sequence
gaaaatagtgcagtcttaaa

SEQ ID NO: 680089 - DNA, 20 bp, Artificial
  CRISPR gRNA sequence
aaaatagtgcagtcttaaaa

SEQ ID NO: 680090 - DNA, 20 bp, Artificial
  CRISPR gRNA sequence
aaaagtagtattgattttag

SEQ ID NO: 680091 - DNA, 20 bp, Artificial
  CRISPR gRNA sequence
aaagtagtattgattttagt

SEQ ID NO: 680092 - DNA, 20 bp, Artificial
  CRISPR gRNA sequence
attttagtcaatgctaaaaa

SEQ ID NO: 680093 - DNA, 20 bp, Artificial
  CRISPR gRNA sequence
tagtcaatgctaaaaacact

SEQ ID NO: 680094 - DNA, 20 bp, Artificial
  CRISPR gRNA sequence
agtcaatgctaaaaacactt

SEQ ID NO: 680095 - DNA, 20 bp, Artificial
  CRISPR gRNA sequence
gtcaatgctaaaaacacttt

SEQ ID NO: 680096 - DNA, 20 bp, Artificial
  CRISPR gRNA sequence
aaaacactttcaggggaata

SEQ ID NO: 680097 - DNA, 20 bp, Artificial
  CRISPR gRNA sequence
tcaggggaataagatgagaa

SEQ ID NO: 680098 - DNA, 20 bp, Artificial
  CRISPR gRNA sequence
caggggaataagatgagaaa

SEQ ID NO: 680099 - DNA, 20 bp, Artificial
  CRISPR gRNA sequence
aggggaataagatgagaaac

SEQ ID NO: 680100 - DNA, 20 bp, Artificial
  CRISPR gRNA sequence
gccaccaatagtggcaacag

SEQ ID NO: 680101 - DNA, 20 bp, Artificial
  CRISPR gRNA sequence
ccaccaatagtggcaacagt

SEQ ID NO: 680102 - DNA, 20 bp, Artificial
  CRISPR gRNA sequence
aagagagactcaaataaaaa

SEQ ID NO: 680103 - DNA, 20 bp, Artificial
  CRISPR gRNA sequence
agagagactcaaataaaaac

SEQ ID NO: 680104 - DNA, 20 bp, Artificial
  CRISPR gRNA sequence
aaataaaaacaaatcctctg

SEQ ID NO: 680105 - DNA, 20 bp, Artificial
  CRISPR gRNA sequence
tggtgtatatgtgtgtgtgc

SEQ ID NO: 680106 - DNA, 20 bp, Artificial
  CRISPR gRNA sequence
gtgtatatgtgtgtgtgcaa

SEQ ID NO: 680107 - DNA, 20 bp, Artificial
  CRISPR gRNA sequence
aaagagtatactttcacact

SEQ ID NO: 680108 - DNA, 20 bp, Artificial
  CRISPR gRNA sequence
aagagtatactttcacacta

SEQ ID NO: 680109 - DNA, 20 bp, Artificial
  CRISPR gRNA sequence
tcacactagagggtattctt

SEQ ID NO: 680110 - DNA, 20 bp, Artificial
  CRISPR gRNA sequence
cacactagagggtattcttt

SEQ ID NO: 680111 - DNA, 20 bp, Artificial
  CRISPR gRNA sequence
acactagagggtattctttc

SEQ ID NO: 680112 - DNA, 20 bp, Artificial
  CRISPR gRNA sequence
gagggtattctttctacttg

SEQ ID NO: 680113 - DNA, 20 bp, Artificial
  CRISPR gRNA sequence
tttctacttgcttctactga

SEQ ID NO: 680114 - DNA, 20 bp, Artificial
  CRISPR gRNA sequence
tctacttgcttctactgaag

SEQ ID NO: 680115 - DNA, 20 bp, Artificial
  CRISPR gRNA sequence
ctacttgcttctactgaagc

SEQ ID NO: 680116 - DNA, 20 bp, Artificial
  CRISPR gRNA sequence
tacttgcttctactgaagca

SEQ ID NO: 680117 - DNA, 20 bp, Artificial
  CRISPR gRNA sequence
cttgcttctactgaagcata

SEQ ID NO: 680118 - DNA, 20 bp, Artificial
  CRISPR gRNA sequence
gcttctactgaagcatacta

SEQ ID NO: 680119 - DNA, 20 bp, Artificial
  CRISPR gRNA sequence
cttctactgaagcatactag

SEQ ID NO: 680120 - DNA, 20 bp, Artificial
  CRISPR gRNA sequence
ctactgaagcatactagctt

SEQ ID NO: 680121 - DNA, 20 bp, Artificial
  CRISPR gRNA sequence
tactgaagcatactagcttt

SEQ ID NO: 680122 - DNA, 20 bp, Artificial
  CRISPR gRNA sequence
ctgaagcatactagctttta

SEQ ID NO: 680123 - DNA, 20 bp, Artificial
  CRISPR gRNA sequence
aagcatactagcttttataa

SEQ ID NO: 680124 - DNA, 20 bp, Artificial
  CRISPR gRNA sequence
gcttttataacacatatcga

SEQ ID NO: 680125 - DNA, 20 bp, Artificial
  CRISPR gRNA sequence
ttataacacatatcgagatg

SEQ ID NO: 680126 - DNA, 20 bp, Artificial
  CRISPR gRNA sequence
tataacacatatcgagatgg

SEQ ID NO: 680127 - DNA, 20 bp, Artificial
  CRISPR gRNA sequence
ataacacatatcgagatggc

SEQ ID NO: 680128 - DNA, 20 bp, Artificial
  CRISPR gRNA sequence
taacacatatcgagatggca

SEQ ID NO: 680129 - DNA, 20 bp, Artificial
  CRISPR gRNA sequence
tgtatcatccaaaatgttga

SEQ ID NO: 680130 - DNA, 20 bp, Artificial
  CRISPR gRNA sequence
gtatcatccaaaatgttgaa

SEQ ID NO: 680131 - DNA, 20 bp, Artificial
  CRISPR gRNA sequence
tatcatccaaaatgttgaag

SEQ ID NO: 680132 - DNA, 20 bp, Artificial
  CRISPR gRNA sequence
aagaaattatcagattgcat

SEQ ID NO: 680133 - DNA, 20 bp, Artificial
  CRISPR gRNA sequence
tcagattgcatttttctatg

SEQ ID NO: 680134 - DNA, 20 bp, Artificial
  CRISPR gRNA sequence
catttttctatggttttgta

SEQ ID NO: 680135 - DNA, 20 bp, Artificial
  CRISPR gRNA sequence
ttctatggttttgtatagta

SEQ ID NO: 680136 - DNA, 20 bp, Artificial
  CRISPR gRNA sequence
tctatggttttgtatagtac

SEQ ID NO: 680137 - DNA, 20 bp, Artificial
  CRISPR gRNA sequence
ctatggttttgtatagtacc

SEQ ID NO: 680138 - DNA, 20 bp, Artificial
  CRISPR gRNA sequence
tatggttttgtatagtacct

SEQ ID NO: 680139 - DNA, 20 bp, Artificial
  CRISPR gRNA sequence
tggttttgtatagtacctcc

SEQ ID NO: 680140 - DNA, 20 bp, Artificial
  CRISPR gRNA sequence
tgtatagtacctcctatgga

SEQ ID NO: 680141 - DNA, 20 bp, Artificial
  CRISPR gRNA sequence
gtatagtacctcctatggaa

SEQ ID NO: 680142 - DNA, 20 bp, Artificial
  CRISPR gRNA sequence
tatagtacctcctatggaag

SEQ ID NO: 680143 - DNA, 20 bp, Artificial
  CRISPR gRNA sequence
ctatggaagattgtaaggaa

SEQ ID NO: 680144 - DNA, 20 bp, Artificial
  CRISPR gRNA sequence
tggaagattgtaaggaacaa

SEQ ID NO: 680145 - DNA, 20 bp, Artificial
  CRISPR gRNA sequence
taaggaacaagagcctatta

SEQ ID NO: 680146 - DNA, 20 bp, Artificial
  CRISPR gRNA sequence
ttatggacaacaatatttct

SEQ ID NO: 680147 - DNA, 20 bp, Artificial
  CRISPR gRNA sequence
tggacaacaatatttctctg

SEQ ID NO: 680148 - DNA, 20 bp, Artificial
  CRISPR gRNA sequence
ctctggtgccttttgagaga

SEQ ID NO: 680149 - DNA, 20 bp, Artificial
  CRISPR gRNA sequence
tctggtgccttttgagagac

SEQ ID NO: 680150 - DNA, 20 bp, Artificial
  CRISPR gRNA sequence
tggtgccttttgagagacct

SEQ ID NO: 680151 - DNA, 20 bp, Artificial
  CRISPR gRNA sequence
gtgccttttgagagacctgc

SEQ ID NO: 680152 - DNA, 20 bp, Artificial
  CRISPR gRNA sequence
ttgagagacctgctgtcata

SEQ ID NO: 680153 - DNA, 20 bp, Artificial
  CRISPR gRNA sequence
tgagagacctgctgtcatag

SEQ ID NO: 680154 - DNA, 20 bp, Artificial
  CRISPR gRNA sequence
gagagacctgctgtcataga

SEQ ID NO: 680155 - DNA, 20 bp, Artificial
  CRISPR gRNA sequence
agagacctgctgtcatagag

SEQ ID NO: 680156 - DNA, 20 bp, Artificial
  CRISPR gRNA sequence
ctgtcatagagaagctcacg

SEQ ID NO: 680157 - DNA, 20 bp, Artificial
  CRISPR gRNA sequence
tcatagagaagctcacgggg

SEQ ID NO: 680158 - DNA, 20 bp, Artificial
  CRISPR gRNA sequence
acggggaatatgggaaaacg

SEQ ID NO: 680159 - DNA, 20 bp, Artificial
  CRISPR gRNA sequence
cactccacaaaagtttgtgg

SEQ ID NO: 680160 - DNA, 20 bp, Artificial
  CRISPR gRNA sequence
cacaaaagtttgtgggtaag

SEQ ID NO: 680161 - DNA, 20 bp, Artificial
  CRISPR gRNA sequence
gtgggtaagcattacaaatg

SEQ ID NO: 680162 - DNA, 20 bp, Artificial
  CRISPR gRNA sequence
tgggtaagcattacaaatgc

SEQ ID NO: 680163 - DNA, 20 bp, Artificial
  CRISPR gRNA sequence
caaatgcttttgtttctttg

SEQ ID NO: 680164 - DNA, 20 bp, Artificial
  CRISPR gRNA sequence
ttgtttctttgcaaggtgat

SEQ ID NO: 680165 - DNA, 20 bp, Artificial
  CRISPR gRNA sequence
tgtttctttgcaaggtgatg

SEQ ID NO: 680166 - DNA, 20 bp, Artificial
  CRISPR gRNA sequence
gtttctttgcaaggtgatgt

SEQ ID NO: 680167 - DNA, 20 bp, Artificial
  CRISPR gRNA sequence
tttctttgcaaggtgatgtt

SEQ ID NO: 680168 - DNA, 20 bp, Artificial
  CRISPR gRNA sequence
ctttgcaaggtgatgttaat

SEQ ID NO: 680169 - DNA, 20 bp, Artificial
  CRISPR gRNA sequence
tttgcaaggtgatgttaata

SEQ ID NO: 680170 - DNA, 20 bp, Artificial
  CRISPR gRNA sequence
tgcaaggtgatgttaatagg

SEQ ID NO: 680171 - DNA, 20 bp, Artificial
  CRISPR gRNA sequence
gcaaggtgatgttaatagga

SEQ ID NO: 680172 - DNA, 20 bp, Artificial
  CRISPR gRNA sequence
caaggtgatgttaataggaa

SEQ ID NO: 680173 - DNA, 20 bp, Artificial
  CRISPR gRNA sequence
ataggaaaaggcaagttccc

SEQ ID NO: 680174 - DNA, 20 bp, Artificial
  CRISPR gRNA sequence
ccatgtattagaaatatata

SEQ ID NO: 680175 - DNA, 20 bp, Artificial
  CRISPR gRNA sequence
gaaatatatatggtgtgttt

SEQ ID NO: 680176 - DNA, 20 bp, Artificial
  CRISPR gRNA sequence
cagttcatgaaataaatacc

SEQ ID NO: 680177 - DNA, 20 bp, Artificial
  CRISPR gRNA sequence
agttcatgaaataaataccc

SEQ ID NO: 680178 - DNA, 20 bp, Artificial
  CRISPR gRNA sequence
atgaaataaatacccatctc

SEQ ID NO: 680179 - DNA, 20 bp, Artificial
  CRISPR gRNA sequence
ttttcttcattattcttttt

SEQ ID NO: 680180 - DNA, 20 bp, Artificial
  CRISPR gRNA sequence
ttcttcattattctttttta

SEQ ID NO: 680181 - DNA, 20 bp, Artificial
  CRISPR gRNA sequence
tcttcattattcttttttac

SEQ ID NO: 680182 - DNA, 20 bp, Artificial
  CRISPR gRNA sequence
cttcattattcttttttact

SEQ ID NO: 680183 - DNA, 20 bp, Artificial
  CRISPR gRNA sequence
ttcattattcttttttactc

SEQ ID NO: 680184 - DNA, 20 bp, Artificial
  CRISPR gRNA sequence
cattattcttttttactctc

SEQ ID NO: 680185 - DNA, 20 bp, Artificial
  CRISPR gRNA sequence
attattcttttttactctct

SEQ ID NO: 680186 - DNA, 20 bp, Artificial
  CRISPR gRNA sequence
ttcttttttactctctgaca

SEQ ID NO: 680187 - DNA, 20 bp, Artificial
  CRISPR gRNA sequence
ttttttactctctgacattc

SEQ ID NO: 680188 - DNA, 20 bp, Artificial
  CRISPR gRNA sequence
ttttactctctgacattctg

SEQ ID NO: 680189 - DNA, 20 bp, Artificial
  CRISPR gRNA sequence
tttactctctgacattctgt

SEQ ID NO: 680190 - DNA, 20 bp, Artificial
  CRISPR gRNA sequence
ttactctctgacattctgtg

SEQ ID NO: 680191 - DNA, 20 bp, Artificial
  CRISPR gRNA sequence
tactctctgacattctgtgt

SEQ ID NO: 680192 - DNA, 20 bp, Artificial
  CRISPR gRNA sequence
actctctgacattctgtgta

SEQ ID NO: 680193 - DNA, 20 bp, Artificial
  CRISPR gRNA sequence
ctctctgacattctgtgtac

SEQ ID NO: 680194 - DNA, 20 bp, Artificial
  CRISPR gRNA sequence
tctgacattctgtgtacacc

SEQ ID NO: 680195 - DNA, 20 bp, Artificial
  CRISPR gRNA sequence
tgacattctgtgtacaccac

SEQ ID NO: 680196 - DNA, 20 bp, Artificial
  CRISPR gRNA sequence
acattctgtgtacaccacac

SEQ ID NO: 680197 - DNA, 20 bp, Artificial
  CRISPR gRNA sequence
tgtgtacaccacacttacac

SEQ ID NO: 680198 - DNA, 20 bp, Artificial
  CRISPR gRNA sequence
tgtacaccacacttacacca

SEQ ID NO: 680199 - DNA, 20 bp, Artificial
  CRISPR gRNA sequence
acaccaacacacacaaatac

SEQ ID NO: 680200 - DNA, 20 bp, Artificial
  CRISPR gRNA sequence
caccaacacacacaaataca

SEQ ID NO: 680201 - DNA, 20 bp, Artificial
  CRISPR gRNA sequence
atagtggtcaccatctcaaa

SEQ ID NO: 680202 - DNA, 20 bp, Artificial
  CRISPR gRNA sequence
aaaatatgatgatatataaa

SEQ ID NO: 680203 - DNA, 20 bp, Artificial
  CRISPR gRNA sequence
atttctttaaaaaatagtca

SEQ ID NO: 680204 - DNA, 20 bp, Artificial
  CRISPR gRNA sequence
ctttaaaaaatagtcataca

SEQ ID NO: 680205 - DNA, 20 bp, Artificial
  CRISPR gRNA sequence
tttaaaaaatagtcatacag

SEQ ID NO: 680206 - DNA, 20 bp, Artificial
  CRISPR gRNA sequence
taaaaaatagtcatacagaa

SEQ ID NO: 680207 - DNA, 20 bp, Artificial
  CRISPR gRNA sequence
aaaaaatagtcatacagaag

SEQ ID NO: 680208 - DNA, 20 bp, Artificial
  CRISPR gRNA sequence
aaaaatagtcatacagaaga

SEQ ID NO: 680209 - DNA, 20 bp, Artificial
  CRISPR gRNA sequence
ttggccagttttgtaatctg

SEQ ID NO: 680210 - DNA, 20 bp, Artificial
  CRISPR gRNA sequence
gccagttttgtaatctgttt

SEQ ID NO: 680211 - DNA, 20 bp, Artificial
  CRISPR gRNA sequence
tgtaatctgttttaaaattt

SEQ ID NO: 680212 - DNA, 20 bp, Artificial
  CRISPR gRNA sequence
gtaatctgttttaaaatttt

SEQ ID NO: 680213 - DNA, 20 bp, Artificial
  CRISPR gRNA sequence
taatctgttttaaaattttc

SEQ ID NO: 680214 - DNA, 20 bp, Artificial
  CRISPR gRNA sequence
ttttaaaattttcattagtg

SEQ ID NO: 680215 - DNA, 20 bp, Artificial
  CRISPR gRNA sequence
taaaattttcattagtgtca

SEQ ID NO: 680216 - DNA, 20 bp, Artificial
  CRISPR gRNA sequence
aaaattttcattagtgtcag

SEQ ID NO: 680217 - DNA, 20 bp, Artificial
  CRISPR gRNA sequence
aaattttcattagtgtcagg

SEQ ID NO: 680218 - DNA, 20 bp, Artificial
  CRISPR gRNA sequence
tcattagtgtcaggttttta

SEQ ID NO: 680219 - DNA, 20 bp, Artificial
  CRISPR gRNA sequence
cattagtgtcaggtttttag

SEQ ID NO: 680220 - DNA, 20 bp, Artificial
  CRISPR gRNA sequence
attagtgtcaggtttttagc

SEQ ID NO: 680221 - DNA, 20 bp, Artificial
  CRISPR gRNA sequence
gtgtcaggtttttagctgtt

SEQ ID NO: 680222 - DNA, 20 bp, Artificial
  CRISPR gRNA sequence
ttagctgttttttttttaac

SEQ ID NO: 680223 - DNA, 20 bp, Artificial
  CRISPR gRNA sequence
tagctgttttttttttaacc

SEQ ID NO: 680224 - DNA, 20 bp, Artificial
  CRISPR gRNA sequence
agctgttttttttttaacct

SEQ ID NO: 680225 - DNA, 20 bp, Artificial
  CRISPR gRNA sequence
gctgttttttttttaaccta

SEQ ID NO: 680226 - DNA, 20 bp, Artificial
  CRISPR gRNA sequence
ttttttttttaacctattaa

SEQ ID NO: 680227 - DNA, 20 bp, Artificial
  CRISPR gRNA sequence
tttttttaacctattaacat

SEQ ID NO: 680228 - DNA, 20 bp, Artificial
  CRISPR gRNA sequence
ttttttaacctattaacatt

SEQ ID NO: 680229 - DNA, 20 bp, Artificial
  CRISPR gRNA sequence
tttttaacctattaacattt

SEQ ID NO: 680230 - DNA, 20 bp, Artificial
  CRISPR gRNA sequence
ttttaacctattaacattta

SEQ ID NO: 680231 - DNA, 20 bp, Artificial
  CRISPR gRNA sequence
tttaacctattaacatttat

SEQ ID NO: 680232 - DNA, 20 bp, Artificial
  CRISPR gRNA sequence
ttaacctattaacatttatg

SEQ ID NO: 680233 - DNA, 20 bp, Artificial
  CRISPR gRNA sequence
taacctattaacatttatgc

SEQ ID NO: 680234 - DNA, 20 bp, Artificial
  CRISPR gRNA sequence
aacctattaacatttatgcc

SEQ ID NO: 680235 - DNA, 20 bp, Artificial
  CRISPR gRNA sequence
acctattaacatttatgcct

SEQ ID NO: 680236 - DNA, 20 bp, Artificial
  CRISPR gRNA sequence
ttaacatttatgcctagtgt

SEQ ID NO: 680237 - DNA, 20 bp, Artificial
  CRISPR gRNA sequence
acatttatgcctagtgtccc

SEQ ID NO: 680238 - DNA, 20 bp, Artificial
  CRISPR gRNA sequence
atgcctagtgtcccattatt

SEQ ID NO: 680239 - DNA, 20 bp, Artificial
  CRISPR gRNA sequence
tgcctagtgtcccattattg

SEQ ID NO: 680240 - DNA, 20 bp, Artificial
  CRISPR gRNA sequence
gtgtcccattattggaacgc

SEQ ID NO: 680241 - DNA, 20 bp, Artificial
  CRISPR gRNA sequence
ttggaacgctaagcatgtgg

SEQ ID NO: 680242 - DNA, 20 bp, Artificial
  CRISPR gRNA sequence
gaacgctaagcatgtgggag

SEQ ID NO: 680243 - DNA, 20 bp, Artificial
  CRISPR gRNA sequence
agcatgtgggagttatttat

SEQ ID NO: 680244 - DNA, 20 bp, Artificial
  CRISPR gRNA sequence
tttatatcctactgctcaag

SEQ ID NO: 680245 - DNA, 20 bp, Artificial
  CRISPR gRNA sequence
atatcctactgctcaaggtc

SEQ ID NO: 680246 - DNA, 20 bp, Artificial
  CRISPR gRNA sequence
tatcctactgctcaaggtca

SEQ ID NO: 680247 - DNA, 20 bp, Artificial
  CRISPR gRNA sequence
ctgctcaaggtcatcgccaa

SEQ ID NO: 680248 - DNA, 20 bp, Artificial
  CRISPR gRNA sequence
ctcaaggtcatcgccaaggt

SEQ ID NO: 680249 - DNA, 20 bp, Artificial
  CRISPR gRNA sequence
aaggtcatcgccaaggtctg

SEQ ID NO: 680250 - DNA, 20 bp, Artificial
  CRISPR gRNA sequence
attgcaaaaattaaaacaaa

SEQ ID NO: 680251 - DNA, 20 bp, Artificial
  CRISPR gRNA sequence
caaaaattaaaacaaaattt

SEQ ID NO: 680252 - DNA, 20 bp, Artificial
  CRISPR gRNA sequence
aaacaaaatttcaacctcag

SEQ ID NO: 680253 - DNA, 20 bp, Artificial
  CRISPR gRNA sequence
caacctcaggcataaatggg

SEQ ID NO: 680254 - DNA, 20 bp, Artificial
  CRISPR gRNA sequence
aacctcaggcataaatgggt

SEQ ID NO: 680255 - DNA, 20 bp, Artificial
  CRISPR gRNA sequence
aggcataaatgggttaatta

SEQ ID NO: 680256 - DNA, 20 bp, Artificial
  CRISPR gRNA sequence
attattttcgtattttatct

SEQ ID NO: 680257 - DNA, 20 bp, Artificial
  CRISPR gRNA sequence
ttttcgtattttatctggaa

SEQ ID NO: 680258 - DNA, 20 bp, Artificial
  CRISPR gRNA sequence
tcgtattttatctggaatga

SEQ ID NO: 680259 - DNA, 20 bp, Artificial
  CRISPR gRNA sequence
cgtattttatctggaatgaa

SEQ ID NO: 680260 - DNA, 20 bp, Artificial
  CRISPR gRNA sequence
gtattttatctggaatgaag

SEQ ID NO: 680261 - DNA, 20 bp, Artificial
  CRISPR gRNA sequence
tatctggaatgaagataatt

SEQ ID NO: 680262 - DNA, 20 bp, Artificial
  CRISPR gRNA sequence
atctggaatgaagataattt

SEQ ID NO: 680263 - DNA, 20 bp, Artificial
  CRISPR gRNA sequence
tctggaatgaagataatttt

SEQ ID NO: 680264 - DNA, 20 bp, Artificial
  CRISPR gRNA sequence
gaatgaagataatttttctt

SEQ ID NO: 680265 - DNA, 20 bp, Artificial
  CRISPR gRNA sequence
ttctttttttcaaaattctg

SEQ ID NO: 680266 - DNA, 20 bp, Artificial
  CRISPR gRNA sequence
tctttttttcaaaattctgc

SEQ ID NO: 680267 - DNA, 20 bp, Artificial
  CRISPR gRNA sequence
ctttttttcaaaattctgca

SEQ ID NO: 680268 - DNA, 20 bp, Artificial
  CRISPR gRNA sequence
tttttttcaaaattctgcat

SEQ ID NO: 680269 - DNA, 20 bp, Artificial
  CRISPR gRNA sequence
tttttcaaaattctgcattg

SEQ ID NO: 680270 - DNA, 20 bp, Artificial
  CRISPR gRNA sequence
ttttcaaaattctgcattgg

SEQ ID NO: 680271 - DNA, 20 bp, Artificial
  CRISPR gRNA sequence
tttcaaaattctgcattgga

SEQ ID NO: 680272 - DNA, 20 bp, Artificial
  CRISPR gRNA sequence
ttcaaaattctgcattggaa

SEQ ID NO: 680273 - DNA, 20 bp, Artificial
  CRISPR gRNA sequence
tcaaaattctgcattggaaa

SEQ ID NO: 680274 - DNA, 20 bp, Artificial
  CRISPR gRNA sequence
caaaattctgcattggaaaa

SEQ ID NO: 680275 - DNA, 20 bp, Artificial
  CRISPR gRNA sequence
aaaattctgcattggaaaaa

SEQ ID NO: 680276 - DNA, 20 bp, Artificial
  CRISPR gRNA sequence
tgcattggaaaaataatgca

SEQ ID NO: 680277 - DNA, 20 bp, Artificial
  CRISPR gRNA sequence
cattggaaaaataatgcagc

SEQ ID NO: 680278 - DNA, 20 bp, Artificial
  CRISPR gRNA sequence
gaaaaataatgcagcaacct

SEQ ID NO: 680279 - DNA, 20 bp, Artificial
  CRISPR gRNA sequence
cattcaagatgtttcatatt

SEQ ID NO: 680280 - DNA, 20 bp, Artificial
  CRISPR gRNA sequence
aagatgtttcatatttggat

SEQ ID NO: 680281 - DNA, 20 bp, Artificial
  CRISPR gRNA sequence
catatttggatctttatttc

SEQ ID NO: 680282 - DNA, 20 bp, Artificial
  CRISPR gRNA sequence
atatttggatctttatttca

SEQ ID NO: 680283 - DNA, 20 bp, Artificial
  CRISPR gRNA sequence
ggatctttatttcatatttt

SEQ ID NO: 680284 - DNA, 20 bp, Artificial
  CRISPR gRNA sequence
gatctttatttcatatttta

SEQ ID NO: 680285 - DNA, 20 bp, Artificial
  CRISPR gRNA sequence
tatttcatattttaatcttt

SEQ ID NO: 680286 - DNA, 20 bp, Artificial
  CRISPR gRNA sequence
atttcatattttaatctttg

SEQ ID NO: 680287 - DNA, 20 bp, Artificial
  CRISPR gRNA sequence
tttcatattttaatctttgt

SEQ ID NO: 680288 - DNA, 20 bp, Artificial
  CRISPR gRNA sequence
catattttaatctttgtttt

SEQ ID NO: 680289 - DNA, 20 bp, Artificial
  CRISPR gRNA sequence
atattttaatctttgttttt

SEQ ID NO: 680290 - DNA, 20 bp, Artificial
  CRISPR gRNA sequence
taatctttgttttttcatcc

SEQ ID NO: 680291 - DNA, 20 bp, Artificial
  CRISPR gRNA sequence
aatctttgttttttcatcca

SEQ ID NO: 680292 - DNA, 20 bp, Artificial
  CRISPR gRNA sequence
atctttgttttttcatccag

SEQ ID NO: 680293 - DNA, 20 bp, Artificial
  CRISPR gRNA sequence
tgttttttcatccagcctat

SEQ ID NO: 680294 - DNA, 20 bp, Artificial
  CRISPR gRNA sequence
gttttttcatccagcctatg

SEQ ID NO: 680295 - DNA, 20 bp, Artificial
  CRISPR gRNA sequence
ttttttcatccagcctatga

SEQ ID NO: 680296 - DNA, 20 bp, Artificial
  CRISPR gRNA sequence
tttcatccagcctatgattt

SEQ ID NO: 680297 - DNA, 20 bp, Artificial
  CRISPR gRNA sequence
ttcatccagcctatgatttt

SEQ ID NO: 680298 - DNA, 20 bp, Artificial
  CRISPR gRNA sequence
tcatccagcctatgattttg

SEQ ID NO: 680299 - DNA, 20 bp, Artificial
  CRISPR gRNA sequence
catccagcctatgattttga

SEQ ID NO: 680300 - DNA, 20 bp, Artificial
  CRISPR gRNA sequence
atccagcctatgattttgaa

SEQ ID NO: 680301 - DNA, 20 bp, Artificial
  CRISPR gRNA sequence
tgattttgaactgaaaagat

SEQ ID NO: 680302 - DNA, 20 bp, Artificial
  CRISPR gRNA sequence
tgaactgaaaagattaaata

SEQ ID NO: 680303 - DNA, 20 bp, Artificial
  CRISPR gRNA sequence
gaactgaaaagattaaatat

SEQ ID NO: 680304 - DNA, 20 bp, Artificial
  CRISPR gRNA sequence
aactgaaaagattaaatatc

SEQ ID NO: 680305 - DNA, 20 bp, Artificial
  CRISPR gRNA sequence
aaaagattaaatatcatata

SEQ ID NO: 680306 - DNA, 20 bp, Artificial
  CRISPR gRNA sequence
aatatcatatatttagactt

SEQ ID NO: 680307 - DNA, 20 bp, Artificial
  CRISPR gRNA sequence
agactttcccttttcatttc

SEQ ID NO: 680308 - DNA, 20 bp, Artificial
  CRISPR gRNA sequence
gactttcccttttcatttcc

SEQ ID NO: 680309 - DNA, 20 bp, Artificial
  CRISPR gRNA sequence
tcccttttcatttccgaacc

SEQ ID NO: 680310 - DNA, 20 bp, Artificial
  CRISPR gRNA sequence
cccttttcatttccgaaccc

SEQ ID NO: 680311 - DNA, 20 bp, Artificial
  CRISPR gRNA sequence
ccttttcatttccgaaccct

SEQ ID NO: 680312 - DNA, 20 bp, Artificial
  CRISPR gRNA sequence
ttcatttccgaacccttaga

SEQ ID NO: 680313 - DNA, 20 bp, Artificial
  CRISPR gRNA sequence
tcatttccgaacccttagat

SEQ ID NO: 680314 - DNA, 20 bp, Artificial
  CRISPR gRNA sequence
catttccgaacccttagata

SEQ ID NO: 680315 - DNA, 20 bp, Artificial
  CRISPR gRNA sequence
atttccgaacccttagatat

SEQ ID NO: 680316 - DNA, 20 bp, Artificial
  CRISPR gRNA sequence
ccgaacccttagatattctt

SEQ ID NO: 680317 - DNA, 20 bp, Artificial
  CRISPR gRNA sequence
cgaacccttagatattcttt

SEQ ID NO: 680318 - DNA, 20 bp, Artificial
  CRISPR gRNA sequence
agatattctttgatacgccc

SEQ ID NO: 680319 - DNA, 20 bp, Artificial
  CRISPR gRNA sequence
gatattctttgatacgccca

SEQ ID NO: 680320 - DNA, 20 bp, Artificial
  CRISPR gRNA sequence
tttgatacgcccaatgttgg

SEQ ID NO: 680321 - DNA, 20 bp, Artificial
  CRISPR gRNA sequence
tgatacgcccaatgttggca

SEQ ID NO: 680322 - DNA, 20 bp, Artificial
  CRISPR gRNA sequence
gatacgcccaatgttggcat

SEQ ID NO: 680323 - DNA, 20 bp, Artificial
  CRISPR gRNA sequence
atacgcccaatgttggcatc

SEQ ID NO: 680324 - DNA, 20 bp, Artificial
  CRISPR gRNA sequence
gcatcattctggatgcatgc

SEQ ID NO: 680325 - DNA, 20 bp, Artificial
  CRISPR gRNA sequence
tggatgcatgctgtaagtca

SEQ ID NO: 680326 - DNA, 20 bp, Artificial
  CRISPR gRNA sequence
gatgcatgctgtaagtcata

SEQ ID NO: 680327 - DNA, 20 bp, Artificial
  CRISPR gRNA sequence
taagtcatagattgtctctg

SEQ ID NO: 680328 - DNA, 20 bp, Artificial
  CRISPR gRNA sequence
tctctgaggatacaaaaagc

SEQ ID NO: 680329 - DNA, 20 bp, Artificial
  CRISPR gRNA sequence
tgaggatacaaaaagcatgg

SEQ ID NO: 680330 - DNA, 20 bp, Artificial
  CRISPR gRNA sequence
aggatacaaaaagcatggac

SEQ ID NO: 680331 - DNA, 20 bp, Artificial
  CRISPR gRNA sequence
tttaaaagaaatatgaataa

SEQ ID NO: 680332 - DNA, 20 bp, Artificial
  CRISPR gRNA sequence
ttaaaagaaatatgaataat

SEQ ID NO: 680333 - DNA, 20 bp, Artificial
  CRISPR gRNA sequence
taaaagaaatatgaataata

SEQ ID NO: 680334 - DNA, 20 bp, Artificial
  CRISPR gRNA sequence
aaaagaaatatgaataatag

SEQ ID NO: 680335 - DNA, 20 bp, Artificial
  CRISPR gRNA sequence
aaagaaatatgaataataga

SEQ ID NO: 680336 - DNA, 20 bp, Artificial
  CRISPR gRNA sequence
aataaaaagaattgttaaag

SEQ ID NO: 680337 - DNA, 20 bp, Artificial
  CRISPR gRNA sequence
ttaaagaattgttattcatt

SEQ ID NO: 680338 - DNA, 20 bp, Artificial
  CRISPR gRNA sequence
aagaattgttattcattgta

SEQ ID NO: 680339 - DNA, 20 bp, Artificial
  CRISPR gRNA sequence
ttattcattgtatatatatc

SEQ ID NO: 680340 - DNA, 20 bp, Artificial
  CRISPR gRNA sequence
ttcattgtatatatatctat

SEQ ID NO: 680341 - DNA, 20 bp, Artificial
  CRISPR gRNA sequence
attgtatatatatctattag

SEQ ID NO: 680342 - DNA, 20 bp, Artificial
  CRISPR gRNA sequence
tatatatatctattaggata

SEQ ID NO: 680343 - DNA, 20 bp, Artificial
  CRISPR gRNA sequence
ttaggataaaaatattcaaa

SEQ ID NO: 680344 - DNA, 20 bp, Artificial
  CRISPR gRNA sequence
ggataaaaatattcaaacag

SEQ ID NO: 680345 - DNA, 20 bp, Artificial
  CRISPR gRNA sequence
aaacagattctgacattcta

SEQ ID NO: 680346 - DNA, 20 bp, Artificial
  CRISPR gRNA sequence
tgacattctagtgtcagcat

SEQ ID NO: 680347 - DNA, 20 bp, Artificial
  CRISPR gRNA sequence
acattctagtgtcagcattg

SEQ ID NO: 680348 - DNA, 20 bp, Artificial
  CRISPR gRNA sequence
tagtgtcagcattgtgggac

SEQ ID NO: 680349 - DNA, 20 bp, Artificial
  CRISPR gRNA sequence
gtgtcagcattgtgggacat

SEQ ID NO: 680350 - DNA, 20 bp, Artificial
  CRISPR gRNA sequence
tgggacatcctgattaaatg

SEQ ID NO: 680351 - DNA, 20 bp, Artificial
  CRISPR gRNA sequence
attaaatggtgattgagaca

SEQ ID NO: 680352 - DNA, 20 bp, Artificial
  CRISPR gRNA sequence
aatggtgattgagacaaaaa

SEQ ID NO: 680353 - DNA, 20 bp, Artificial
  CRISPR gRNA sequence
agacaaaaatctttgctttg

SEQ ID NO: 680354 - DNA, 20 bp, Artificial
  CRISPR gRNA sequence
tgctttggttatttcaggga

SEQ ID NO: 680355 - DNA, 20 bp, Artificial
  CRISPR gRNA sequence
gctttggttatttcagggag

SEQ ID NO: 680356 - DNA, 20 bp, Artificial
  CRISPR gRNA sequence
ctttggttatttcagggagg

SEQ ID NO: 680357 - DNA, 20 bp, Artificial
  CRISPR gRNA sequence
tggttatttcagggaggaga

SEQ ID NO: 680358 - DNA, 20 bp, Artificial
  CRISPR gRNA sequence
ggttatttcagggaggagag

SEQ ID NO: 680359 - DNA, 20 bp, Artificial
  CRISPR gRNA sequence
gttatttcagggaggagagg

SEQ ID NO: 680360 - DNA, 20 bp, Artificial
  CRISPR gRNA sequence
tttcagggaggagaggataa

SEQ ID NO: 680361 - DNA, 20 bp, Artificial
  CRISPR gRNA sequence
cagggaggagaggataacac

SEQ ID NO: 680362 - DNA, 20 bp, Artificial
  CRISPR gRNA sequence
agggaggagaggataacaca

SEQ ID NO: 680363 - DNA, 20 bp, Artificial
  CRISPR gRNA sequence
cattacttcaataaacactt

SEQ ID NO: 680364 - DNA, 20 bp, Artificial
  CRISPR gRNA sequence
cttcaataaacacttaaaga

SEQ ID NO: 680365 - DNA, 20 bp, Artificial
  CRISPR gRNA sequence
caataaacacttaaagaagg

SEQ ID NO: 680366 - DNA, 20 bp, Artificial
  CRISPR gRNA sequence
aataaacacttaaagaaggt

SEQ ID NO: 680367 - DNA, 20 bp, Artificial
  CRISPR gRNA sequence
aaagaaggtttcctttcaat

SEQ ID NO: 680368 - DNA, 20 bp, Artificial
  CRISPR gRNA sequence
aagaaggtttcctttcaatc

SEQ ID NO: 680369 - DNA, 20 bp, Artificial
  CRISPR gRNA sequence
cctttcaatctgaaattgaa

SEQ ID NO: 680370 - DNA, 20 bp, Artificial
  CRISPR gRNA sequence
ctttcaatctgaaattgaag

SEQ ID NO: 680371 - DNA, 20 bp, Artificial
  CRISPR gRNA sequence
tcaatctgaaattgaagaac

SEQ ID NO: 680372 - DNA, 20 bp, Artificial
  CRISPR gRNA sequence
caatctgaaattgaagaact

SEQ ID NO: 680373 - DNA, 20 bp, Artificial
  CRISPR gRNA sequence
aatctgaaattgaagaacta

SEQ ID NO: 680374 - DNA, 20 bp, Artificial
  CRISPR gRNA sequence
aaattgaagaactaacacat

SEQ ID NO: 680375 - DNA, 20 bp, Artificial
  CRISPR gRNA sequence
aagaactaacacatcaccaa

SEQ ID NO: 680376 - DNA, 20 bp, Artificial
  CRISPR gRNA sequence
acacatcaccaaaatagcac

SEQ ID NO: 680377 - DNA, 20 bp, Artificial
  CRISPR gRNA sequence
taagactagctggagggatt

SEQ ID NO: 680378 - DNA, 20 bp, Artificial
  CRISPR gRNA sequence
agactagctggagggattta

SEQ ID NO: 680379 - DNA, 20 bp, Artificial
  CRISPR gRNA sequence
gctggagggatttattgaga

SEQ ID NO: 680380 - DNA, 20 bp, Artificial
  CRISPR gRNA sequence
gagggatttattgagaactc

SEQ ID NO: 680381 - DNA, 20 bp, Artificial
  CRISPR gRNA sequence
attgagaactcattgaaaga

SEQ ID NO: 680382 - DNA, 20 bp, Artificial
  CRISPR gRNA sequence
ttgagaactcattgaaagaa

SEQ ID NO: 680383 - DNA, 20 bp, Artificial
  CRISPR gRNA sequence
agaactcattgaaagaaggc

SEQ ID NO: 680384 - DNA, 20 bp, Artificial
  CRISPR gRNA sequence
attgaaagaaggcctaaggg

SEQ ID NO: 680385 - DNA, 20 bp, Artificial
  CRISPR gRNA sequence
aaagaaggcctaagggtgac

SEQ ID NO: 680386 - DNA, 20 bp, Artificial
  CRISPR gRNA sequence
agggtgactataagggccat

SEQ ID NO: 680387 - DNA, 20 bp, Artificial
  CRISPR gRNA sequence
taagggccatagtttatatt

SEQ ID NO: 680388 - DNA, 20 bp, Artificial
  CRISPR gRNA sequence
atattatgtcagttgaagcc

SEQ ID NO: 680389 - DNA, 20 bp, Artificial
  CRISPR gRNA sequence
tattatgtcagttgaagccc

SEQ ID NO: 680390 - DNA, 20 bp, Artificial
  CRISPR gRNA sequence
tgtcagttgaagcccctgag

SEQ ID NO: 680391 - DNA, 20 bp, Artificial
  CRISPR gRNA sequence
aagcccctgagttatacaca

SEQ ID NO: 680392 - DNA, 20 bp, Artificial
  CRISPR gRNA sequence
agttatacacaaaggactgc

SEQ ID NO: 680393 - DNA, 20 bp, Artificial
  CRISPR gRNA sequence
tacacaaaggactgcctcag

SEQ ID NO: 680394 - DNA, 20 bp, Artificial
  CRISPR gRNA sequence
cctcaggcctttggtaactt

SEQ ID NO: 680395 - DNA, 20 bp, Artificial
  CRISPR gRNA sequence
aggcctttggtaactttttt

SEQ ID NO: 680396 - DNA, 20 bp, Artificial
  CRISPR gRNA sequence
tggtaactttttttctgttc

SEQ ID NO: 680397 - DNA, 20 bp, Artificial
  CRISPR gRNA sequence
ggtaactttttttctgttct

SEQ ID NO: 680398 - DNA, 20 bp, Artificial
  CRISPR gRNA sequence
gtaactttttttctgttctt

SEQ ID NO: 680399 - DNA, 20 bp, Artificial
  CRISPR gRNA sequence
tttttctgttcttgtgggta

SEQ ID NO: 680400 - DNA, 20 bp, Artificial
  CRISPR gRNA sequence
ttttctgttcttgtgggtaa

SEQ ID NO: 680401 - DNA, 20 bp, Artificial
  CRISPR gRNA sequence
tttctgttcttgtgggtaac

SEQ ID NO: 680402 - DNA, 20 bp, Artificial
  CRISPR gRNA sequence
ttctgttcttgtgggtaact

SEQ ID NO: 680403 - DNA, 20 bp, Artificial
  CRISPR gRNA sequence
tctgttcttgtgggtaacta

SEQ ID NO: 680404 - DNA, 20 bp, Artificial
  CRISPR gRNA sequence
ctgttcttgtgggtaactat

SEQ ID NO: 680405 - DNA, 20 bp, Artificial
  CRISPR gRNA sequence
tgttcttgtgggtaactatg

SEQ ID NO: 680406 - DNA, 20 bp, Artificial
  CRISPR gRNA sequence
ttcttgtgggtaactatgaa

SEQ ID NO: 680407 - DNA, 20 bp, Artificial
  CRISPR gRNA sequence
ttgtgggtaactatgaaaaa

SEQ ID NO: 680408 - DNA, 20 bp, Artificial
  CRISPR gRNA sequence
gtgggtaactatgaaaaaaa

SEQ ID NO: 680409 - DNA, 20 bp, Artificial
  CRISPR gRNA sequence
tgggtaactatgaaaaaaaa

SEQ ID NO: 680410 - DNA, 20 bp, Artificial
  CRISPR gRNA sequence
tgaaaaaaaagaaataaaga

SEQ ID NO: 680411 - DNA, 20 bp, Artificial
  CRISPR gRNA sequence
acttatttttaatattgatt

SEQ ID NO: 680412 - DNA, 20 bp, Artificial
  CRISPR gRNA sequence
cttatttttaatattgattt

SEQ ID NO: 680413 - DNA, 20 bp, Artificial
  CRISPR gRNA sequence
atttttaatattgatttttt

SEQ ID NO: 680414 - DNA, 20 bp, Artificial
  CRISPR gRNA sequence
tttttaatattgattttttt

SEQ ID NO: 680415 - DNA, 20 bp, Artificial
  CRISPR gRNA sequence
ttaatattgatttttttgtt

SEQ ID NO: 680416 - DNA, 20 bp, Artificial
  CRISPR gRNA sequence
taatattgatttttttgttg

SEQ ID NO: 680417 - DNA, 20 bp, Artificial
  CRISPR gRNA sequence
aatattgatttttttgttgg

SEQ ID NO: 680418 - DNA, 20 bp, Artificial
  CRISPR gRNA sequence
atattgatttttttgttgga

SEQ ID NO: 680419 - DNA, 20 bp, Artificial
  CRISPR gRNA sequence
atttttttgttggatgtcat

SEQ ID NO: 680420 - DNA, 20 bp, Artificial
  CRISPR gRNA sequence
ttttgttggatgtcattaaa

SEQ ID NO: 680421 - DNA, 20 bp, Artificial
  CRISPR gRNA sequence
tttgttggatgtcattaaat

SEQ ID NO: 680422 - DNA, 20 bp, Artificial
  CRISPR gRNA sequence
ttgttggatgtcattaaatg

SEQ ID NO: 680423 - DNA, 20 bp, Artificial
  CRISPR gRNA sequence
tgttggatgtcattaaatgc

SEQ ID NO: 680424 - DNA, 20 bp, Artificial
  CRISPR gRNA sequence
gttggatgtcattaaatgct

SEQ ID NO: 680425 - DNA, 20 bp, Artificial
  CRISPR gRNA sequence
ttggatgtcattaaatgctt

SEQ ID NO: 680426 - DNA, 20 bp, Artificial
  CRISPR gRNA sequence
gatgtcattaaatgcttaaa

SEQ ID NO: 680427 - DNA, 20 bp, Artificial
  CRISPR gRNA sequence
aatgcttaaatctaactaga

SEQ ID NO: 680428 - DNA, 20 bp, Artificial
  CRISPR gRNA sequence
aaatctaactagactctaat

SEQ ID NO: 680429 - DNA, 20 bp, Artificial
  CRISPR gRNA sequence
aatctaactagactctaatg

SEQ ID NO: 680430 - DNA, 20 bp, Artificial
  CRISPR gRNA sequence
actagactctaatgtagttg

SEQ ID NO: 680431 - DNA, 20 bp, Artificial
  CRISPR gRNA sequence
gactctaatgtagttggaaa

SEQ ID NO: 680432 - DNA, 20 bp, Artificial
  CRISPR gRNA sequence
taatgtagttggaaaaaata

SEQ ID NO: 680433 - DNA, 20 bp, Artificial
  CRISPR gRNA sequence
atgtagttggaaaaaataaa

SEQ ID NO: 680434 - DNA, 20 bp, Artificial
  CRISPR gRNA sequence
gaaaaaataaaatatattat

SEQ ID NO: 680435 - DNA, 20 bp, Artificial
  CRISPR gRNA sequence
ttattctttctgtcttctga

SEQ ID NO: 680436 - DNA, 20 bp, Artificial
  CRISPR gRNA sequence
ttctttctgtcttctgaatt

SEQ ID NO: 680437 - DNA, 20 bp, Artificial
  CRISPR gRNA sequence
tttctgtcttctgaatttat

SEQ ID NO: 680438 - DNA, 20 bp, Artificial
  CRISPR gRNA sequence
tctgtcttctgaatttatat

SEQ ID NO: 680439 - DNA, 20 bp, Artificial
  CRISPR gRNA sequence
ctgtcttctgaatttatata

SEQ ID NO: 680440 - DNA, 20 bp, Artificial
  CRISPR gRNA sequence
tgtcttctgaatttatatag

SEQ ID NO: 680441 - DNA, 20 bp, Artificial
  CRISPR gRNA sequence
tcttctgaatttatatagtc

SEQ ID NO: 680442 - DNA, 20 bp, Artificial
  CRISPR gRNA sequence
ctgaatttatatagtctact

SEQ ID NO: 680443 - DNA, 20 bp, Artificial
  CRISPR gRNA sequence
tgaatttatatagtctactc

SEQ ID NO: 680444 - DNA, 20 bp, Artificial
  CRISPR gRNA sequence
aatttatatagtctactctt

SEQ ID NO: 680445 - DNA, 20 bp, Artificial
  CRISPR gRNA sequence
atatagtctactctttgtaa

SEQ ID NO: 680446 - DNA, 20 bp, Artificial
  CRISPR gRNA sequence
tatagtctactctttgtaac

SEQ ID NO: 680447 - DNA, 20 bp, Artificial
  CRISPR gRNA sequence
ctctttgtaacgttttttgt

SEQ ID NO: 680448 - DNA, 20 bp, Artificial
  CRISPR gRNA sequence
tttgtaacgttttttgtcat

SEQ ID NO: 680449 - DNA, 20 bp, Artificial
  CRISPR gRNA sequence
tgtaacgttttttgtcatgt

SEQ ID NO: 680450 - DNA, 20 bp, Artificial
  CRISPR gRNA sequence
gtaacgttttttgtcatgtt

SEQ ID NO: 680451 - DNA, 20 bp, Artificial
  CRISPR gRNA sequence
taacgttttttgtcatgttt

SEQ ID NO: 680452 - DNA, 20 bp, Artificial
  CRISPR gRNA sequence
tttgtcatgtttcctgactt

SEQ ID NO: 680453 - DNA, 20 bp, Artificial
  CRISPR gRNA sequence
ttgtcatgtttcctgactta

SEQ ID NO: 680454 - DNA, 20 bp, Artificial
  CRISPR gRNA sequence
tgtcatgtttcctgacttag

SEQ ID NO: 680455 - DNA, 20 bp, Artificial
  CRISPR gRNA sequence
gtcatgtttcctgacttaga

SEQ ID NO: 680456 - DNA, 20 bp, Artificial
  CRISPR gRNA sequence
tcatgtttcctgacttagag

SEQ ID NO: 680457 - DNA, 20 bp, Artificial
  CRISPR gRNA sequence
cctgacttagagatgttact

SEQ ID NO: 680458 - DNA, 20 bp, Artificial
  CRISPR gRNA sequence
ctgacttagagatgttactc

SEQ ID NO: 680459 - DNA, 20 bp, Artificial
  CRISPR gRNA sequence
acttagagatgttactctca

SEQ ID NO: 680460 - DNA, 20 bp, Artificial
  CRISPR gRNA sequence
agagatgttactctcaattt

SEQ ID NO: 680461 - DNA, 20 bp, Artificial
  CRISPR gRNA sequence
gagatgttactctcaatttt

SEQ ID NO: 680462 - DNA, 20 bp, Artificial
  CRISPR gRNA sequence
ctctcaattttatttcactg

SEQ ID NO: 680463 - DNA, 20 bp, Artificial
  CRISPR gRNA sequence
tcaattttatttcactgcat

SEQ ID NO: 680464 - DNA, 20 bp, Artificial
  CRISPR gRNA sequence
aattttatttcactgcattc

SEQ ID NO: 680465 - DNA, 20 bp, Artificial
  CRISPR gRNA sequence
tatttcactgcattccttag

SEQ ID NO: 680466 - DNA, 20 bp, Artificial
  CRISPR gRNA sequence
atttcactgcattccttaga

SEQ ID NO: 680467 - DNA, 20 bp, Artificial
  CRISPR gRNA sequence
tttcactgcattccttagaa

SEQ ID NO: 680468 - DNA, 20 bp, Artificial
  CRISPR gRNA sequence
cactgcattccttagaaaag

SEQ ID NO: 680469 - DNA, 20 bp, Artificial
  CRISPR gRNA sequence
actgcattccttagaaaaga

SEQ ID NO: 680470 - DNA, 20 bp, Artificial
  CRISPR gRNA sequence
cattccttagaaaagaggga

SEQ ID NO: 680471 - DNA, 20 bp, Artificial
  CRISPR gRNA sequence
cttagaaaagagggacagct

SEQ ID NO: 680472 - DNA, 20 bp, Artificial
  CRISPR gRNA sequence
agaaaagagggacagctttt

SEQ ID NO: 680473 - DNA, 20 bp, Artificial
  CRISPR gRNA sequence
gaaaagagggacagcttttt

SEQ ID NO: 680474 - DNA, 20 bp, Artificial
  CRISPR gRNA sequence
tttagaaaattacattatga

SEQ ID NO: 680475 - DNA, 20 bp, Artificial
  CRISPR gRNA sequence
ttagaaaattacattatgat

SEQ ID NO: 680476 - DNA, 20 bp, Artificial
  CRISPR gRNA sequence
tagaaaattacattatgatt

SEQ ID NO: 680477 - DNA, 20 bp, Artificial
  CRISPR gRNA sequence
agaaaattacattatgattc

SEQ ID NO: 680478 - DNA, 20 bp, Artificial
  CRISPR gRNA sequence
gaaaattacattatgattct

SEQ ID NO: 680479 - DNA, 20 bp, Artificial
  CRISPR gRNA sequence
cattatgattctaaaatatt

SEQ ID NO: 680480 - DNA, 20 bp, Artificial
  CRISPR gRNA sequence
tgattctaaaatatttatat

SEQ ID NO: 680481 - DNA, 20 bp, Artificial
  CRISPR gRNA sequence
taaaatatttatattatatt

SEQ ID NO: 680482 - DNA, 20 bp, Artificial
  CRISPR gRNA sequence
aaatatttatattatatttt

SEQ ID NO: 680483 - DNA, 20 bp, Artificial
  CRISPR gRNA sequence
atattatatttttaattaag

SEQ ID NO: 680484 - DNA, 20 bp, Artificial
  CRISPR gRNA sequence
tattatatttttaattaaga

SEQ ID NO: 680485 - DNA, 20 bp, Artificial
  CRISPR gRNA sequence
tatttttaattaagaatttg

SEQ ID NO: 680486 - DNA, 20 bp, Artificial
  CRISPR gRNA sequence
ttaattaagaatttgagaga

SEQ ID NO: 680487 - DNA, 20 bp, Artificial
  CRISPR gRNA sequence
taattaagaatttgagagaa

SEQ ID NO: 680488 - DNA, 20 bp, Artificial
  CRISPR gRNA sequence
aattaagaatttgagagaat

SEQ ID NO: 680489 - DNA, 20 bp, Artificial
  CRISPR gRNA sequence
attaagaatttgagagaata

SEQ ID NO: 680490 - DNA, 20 bp, Artificial
  CRISPR gRNA sequence
agaatttgagagaatatttt

SEQ ID NO: 680491 - DNA, 20 bp, Artificial
  CRISPR gRNA sequence
gagagaatatttttctttat

SEQ ID NO: 680492 - DNA, 20 bp, Artificial
  CRISPR gRNA sequence
agagaatatttttctttatt

SEQ ID NO: 680493 - DNA, 20 bp, Artificial
  CRISPR gRNA sequence
ttctttatttggattctatc

SEQ ID NO: 680494 - DNA, 20 bp, Artificial
  CRISPR gRNA sequence
tctttatttggattctatcc

SEQ ID NO: 680495 - DNA, 20 bp, Artificial
  CRISPR gRNA sequence
ctttatttggattctatcct

SEQ ID NO: 680496 - DNA, 20 bp, Artificial
  CRISPR gRNA sequence
tttatttggattctatccta

SEQ ID NO: 680497 - DNA, 20 bp, Artificial
  CRISPR gRNA sequence
tatttggattctatcctagt

SEQ ID NO: 680498 - DNA, 20 bp, Artificial
  CRISPR gRNA sequence
atttggattctatcctagta

SEQ ID NO: 680499 - DNA, 20 bp, Artificial
  CRISPR gRNA sequence
tttggattctatcctagtaa

SEQ ID NO: 680500 - DNA, 20 bp, Artificial
  CRISPR gRNA sequence
ggattctatcctagtaatat

SEQ ID NO: 680501 - DNA, 20 bp, Artificial
  CRISPR gRNA sequence
gattctatcctagtaatata

SEQ ID NO: 680502 - DNA, 20 bp, Artificial
  CRISPR gRNA sequence
tatcctagtaatatataaca

SEQ ID NO: 680503 - DNA, 20 bp, Artificial
  CRISPR gRNA sequence
tcctagtaatatataacaaa

SEQ ID NO: 680504 - DNA, 20 bp, Artificial
  CRISPR gRNA sequence
gtaatatataacaaacagta

SEQ ID NO: 680505 - DNA, 20 bp, Artificial
  CRISPR gRNA sequence
cttctgttattgttcttgaa

SEQ ID NO: 680506 - DNA, 20 bp, Artificial
  CRISPR gRNA sequence
ctgttattgttcttgaaaca

SEQ ID NO: 680507 - DNA, 20 bp, Artificial
  CRISPR gRNA sequence
tgttattgttcttgaaacaa

SEQ ID NO: 680508 - DNA, 20 bp, Artificial
  CRISPR gRNA sequence
ttattgttcttgaaacaaaa

SEQ ID NO: 680509 - DNA, 20 bp, Artificial
  CRISPR gRNA sequence
ttgttcttgaaacaaaaaat

SEQ ID NO: 680510 - DNA, 20 bp, Artificial
  CRISPR gRNA sequence
ttcttgaaacaaaaaatttc

SEQ ID NO: 680511 - DNA, 20 bp, Artificial
  CRISPR gRNA sequence
ttgaaacaaaaaatttcatc

SEQ ID NO: 680512 - DNA, 20 bp, Artificial
  CRISPR gRNA sequence
gaaacaaaaaatttcatcat

SEQ ID NO: 680513 - DNA, 20 bp, Artificial
  CRISPR gRNA sequence
aaacaaaaaatttcatcatt

SEQ ID NO: 680514 - DNA, 20 bp, Artificial
  CRISPR gRNA sequence
catcattccacacttattat

SEQ ID NO: 680515 - DNA, 20 bp, Artificial
  CRISPR gRNA sequence
atcattccacacttattata

SEQ ID NO: 680516 - DNA, 20 bp, Artificial
  CRISPR gRNA sequence
cacacttattataaattgcc

SEQ ID NO: 680517 - DNA, 20 bp, Artificial
  CRISPR gRNA sequence
attataaattgccttctcca

SEQ ID NO: 680518 - DNA, 20 bp, Artificial
  CRISPR gRNA sequence
ttataaattgccttctccat

SEQ ID NO: 680519 - DNA, 20 bp, Artificial
  CRISPR gRNA sequence
taaattgccttctccatgtg

SEQ ID NO: 680520 - DNA, 20 bp, Artificial
  CRISPR gRNA sequence
ccttctccatgtgcctcagt

SEQ ID NO: 680521 - DNA, 20 bp, Artificial
  CRISPR gRNA sequence
ctccatgtgcctcagttaaa

SEQ ID NO: 680522 - DNA, 20 bp, Artificial
  CRISPR gRNA sequence
tccatgtgcctcagttaaat

SEQ ID NO: 680523 - DNA, 20 bp, Artificial
  CRISPR gRNA sequence
catgtgcctcagttaaatac

SEQ ID NO: 680524 - DNA, 20 bp, Artificial
  CRISPR gRNA sequence
agttaaatactattctttga

SEQ ID NO: 680525 - DNA, 20 bp, Artificial
  CRISPR gRNA sequence
aatactattctttgacctta

SEQ ID NO: 680526 - DNA, 20 bp, Artificial
  CRISPR gRNA sequence
ttctttgaccttatcaaatt

SEQ ID NO: 680527 - DNA, 20 bp, Artificial
  CRISPR gRNA sequence
tttgaccttatcaaattctc

SEQ ID NO: 680528 - DNA, 20 bp, Artificial
  CRISPR gRNA sequence
tgaccttatcaaattctcca

SEQ ID NO: 680529 - DNA, 20 bp, Artificial
  CRISPR gRNA sequence
gaccttatcaaattctccag

SEQ ID NO: 680530 - DNA, 20 bp, Artificial
  CRISPR gRNA sequence
accttatcaaattctccaga

SEQ ID NO: 680531 - DNA, 20 bp, Artificial
  CRISPR gRNA sequence
atcaaattctccagaccaat

SEQ ID NO: 680532 - DNA, 20 bp, Artificial
  CRISPR gRNA sequence
tcaaattctccagaccaatg

SEQ ID NO: 680533 - DNA, 20 bp, Artificial
  CRISPR gRNA sequence
tccagaccaatgatccctga

SEQ ID NO: 680534 - DNA, 20 bp, Artificial
  CRISPR gRNA sequence
cagaccaatgatccctgaac

SEQ ID NO: 680535 - DNA, 20 bp, Artificial
  CRISPR gRNA sequence
aacttcctgcatatctactt

SEQ ID NO: 680536 - DNA, 20 bp, Artificial
  CRISPR gRNA sequence
cctgcatatctacttgtctc

SEQ ID NO: 680537 - DNA, 20 bp, Artificial
  CRISPR gRNA sequence
ctgcatatctacttgtctct

SEQ ID NO: 680538 - DNA, 20 bp, Artificial
  CRISPR gRNA sequence
catatctacttgtctctccc

SEQ ID NO: 680539 - DNA, 20 bp, Artificial
  CRISPR gRNA sequence
cttgtctctccctctctttt

SEQ ID NO: 680540 - DNA, 20 bp, Artificial
  CRISPR gRNA sequence
gtctctccctctcttttctt

SEQ ID NO: 680541 - DNA, 20 bp, Artificial
  CRISPR gRNA sequence
tctctccctctcttttctta

SEQ ID NO: 680542 - DNA, 20 bp, Artificial
  CRISPR gRNA sequence
tccctctcttttcttattca

SEQ ID NO: 680543 - DNA, 20 bp, Artificial
  CRISPR gRNA sequence
cctctcttttcttattcagc

SEQ ID NO: 680544 - DNA, 20 bp, Artificial
  CRISPR gRNA sequence
tcttttcttattcagcttag

SEQ ID NO: 680545 - DNA, 20 bp, Artificial
  CRISPR gRNA sequence
ttttcttattcagcttagat

SEQ ID NO: 680546 - DNA, 20 bp, Artificial
  CRISPR gRNA sequence
ttcttattcagcttagattc

SEQ ID NO: 680547 - DNA, 20 bp, Artificial
  CRISPR gRNA sequence
tcttattcagcttagattcc

SEQ ID NO: 680548 - DNA, 20 bp, Artificial
  CRISPR gRNA sequence
cttattcagcttagattcca

SEQ ID NO: 680549 - DNA, 20 bp, Artificial
  CRISPR gRNA sequence
ttattcagcttagattccat

SEQ ID NO: 680550 - DNA, 20 bp, Artificial
  CRISPR gRNA sequence
attcagcttagattccatgg

SEQ ID NO: 680551 - DNA, 20 bp, Artificial
  CRISPR gRNA sequence
ttcagcttagattccatggc

SEQ ID NO: 680552 - DNA, 20 bp, Artificial
  CRISPR gRNA sequence
agcttagattccatggctca

SEQ ID NO: 680553 - DNA, 20 bp, Artificial
  CRISPR gRNA sequence
agattccatggctcatcact

SEQ ID NO: 680554 - DNA, 20 bp, Artificial
  CRISPR gRNA sequence
gattccatggctcatcactt

SEQ ID NO: 680555 - DNA, 20 bp, Artificial
  CRISPR gRNA sequence
catggctcatcacttctaca

SEQ ID NO: 680556 - DNA, 20 bp, Artificial
  CRISPR gRNA sequence
atcacttctacatctctctt

SEQ ID NO: 680557 - DNA, 20 bp, Artificial
  CRISPR gRNA sequence
ctacatctctcttgccaata

SEQ ID NO: 680558 - DNA, 20 bp, Artificial
  CRISPR gRNA sequence
tacatctctcttgccaatat

SEQ ID NO: 680559 - DNA, 20 bp, Artificial
  CRISPR gRNA sequence
catctctcttgccaatattc

SEQ ID NO: 680560 - DNA, 20 bp, Artificial
  CRISPR gRNA sequence
tcttgccaatattcttgcct

SEQ ID NO: 680561 - DNA, 20 bp, Artificial
  CRISPR gRNA sequence
ttgccaatattcttgccttt

SEQ ID NO: 680562 - DNA, 20 bp, Artificial
  CRISPR gRNA sequence
gccaatattcttgcctttct

SEQ ID NO: 680563 - DNA, 20 bp, Artificial
  CRISPR gRNA sequence
ccaatattcttgcctttctt

SEQ ID NO: 680564 - DNA, 20 bp, Artificial
  CRISPR gRNA sequence
ttgcctttcttgccttgttg

SEQ ID NO: 680565 - DNA, 20 bp, Artificial
  CRISPR gRNA sequence
gcctttcttgccttgttggc

SEQ ID NO: 680566 - DNA, 20 bp, Artificial
  CRISPR gRNA sequence
cctttcttgccttgttggct

SEQ ID NO: 680567 - DNA, 20 bp, Artificial
  CRISPR gRNA sequence
tcttgccttgttggctgatc

SEQ ID NO: 680568 - DNA, 20 bp, Artificial
  CRISPR gRNA sequence
cttgccttgttggctgatct

SEQ ID NO: 680569 - DNA, 20 bp, Artificial
  CRISPR gRNA sequence
ttgccttgttggctgatcta

SEQ ID NO: 680570 - DNA, 20 bp, Artificial
  CRISPR gRNA sequence
gccttgttggctgatctatc

SEQ ID NO: 680571 - DNA, 20 bp, Artificial
  CRISPR gRNA sequence
ccttgttggctgatctatca

SEQ ID NO: 680572 - DNA, 20 bp, Artificial
  CRISPR gRNA sequence
gttggctgatctatcatccc

SEQ ID NO: 680573 - DNA, 20 bp, Artificial
  CRISPR gRNA sequence
ttggctgatctatcatcccc

SEQ ID NO: 680574 - DNA, 20 bp, Artificial
  CRISPR gRNA sequence
gctgatctatcatccccttc

SEQ ID NO: 680575 - DNA, 20 bp, Artificial
  CRISPR gRNA sequence
atctatcatccccttctcct

SEQ ID NO: 680576 - DNA, 20 bp, Artificial
  CRISPR gRNA sequence
tcatccccttctcctgatga

SEQ ID NO: 680577 - DNA, 20 bp, Artificial
  CRISPR gRNA sequence
ctcctgatgaaaccctactg

SEQ ID NO: 680578 - DNA, 20 bp, Artificial
  CRISPR gRNA sequence
tcctgatgaaaccctactgt

SEQ ID NO: 680579 - DNA, 20 bp, Artificial
  CRISPR gRNA sequence
ctgatgaaaccctactgtct

SEQ ID NO: 680580 - DNA, 20 bp, Artificial
  CRISPR gRNA sequence
atgaaaccctactgtcttgt

SEQ ID NO: 680581 - DNA, 20 bp, Artificial
  CRISPR gRNA sequence
ctgtcttgtaaagctgactg

SEQ ID NO: 680582 - DNA, 20 bp, Artificial
  CRISPR gRNA sequence
tcttgtaaagctgactgagc

SEQ ID NO: 680583 - DNA, 20 bp, Artificial
  CRISPR gRNA sequence
gtaaagctgactgagcatcc

SEQ ID NO: 680584 - DNA, 20 bp, Artificial
  CRISPR gRNA sequence
taaagctgactgagcatcct

SEQ ID NO: 680585 - DNA, 20 bp, Artificial
  CRISPR gRNA sequence
actgagcatcctttccatac

SEQ ID NO: 680586 - DNA, 20 bp, Artificial
  CRISPR gRNA sequence
agcatcctttccatacttat

SEQ ID NO: 680587 - DNA, 20 bp, Artificial
  CRISPR gRNA sequence
tccatacttatatctcacta

SEQ ID NO: 680588 - DNA, 20 bp, Artificial
  CRISPR gRNA sequence
ccatacttatatctcactag

SEQ ID NO: 680589 - DNA, 20 bp, Artificial
  CRISPR gRNA sequence
catacttatatctcactaga

SEQ ID NO: 680590 - DNA, 20 bp, Artificial
  CRISPR gRNA sequence
atatctcactagatgtgcac

SEQ ID NO: 680591 - DNA, 20 bp, Artificial
  CRISPR gRNA sequence
tatctcactagatgtgcacc

SEQ ID NO: 680592 - DNA, 20 bp, Artificial
  CRISPR gRNA sequence
actagatgtgcaccccagcc

SEQ ID NO: 680593 - DNA, 20 bp, Artificial
  CRISPR gRNA sequence
gatgtgcaccccagcctgca

SEQ ID NO: 680594 - DNA, 20 bp, Artificial
  CRISPR gRNA sequence
cacatctggtacttttggag

SEQ ID NO: 680595 - DNA, 20 bp, Artificial
  CRISPR gRNA sequence
gtacttttggagaaaattcc

SEQ ID NO: 680596 - DNA, 20 bp, Artificial
  CRISPR gRNA sequence
ttggagaaaattccacaggc

SEQ ID NO: 680597 - DNA, 20 bp, Artificial
  CRISPR gRNA sequence
tggagaaaattccacaggct

SEQ ID NO: 680598 - DNA, 20 bp, Artificial
  CRISPR gRNA sequence
ggagaaaattccacaggctg

SEQ ID NO: 680599 - DNA, 20 bp, Artificial
  CRISPR gRNA sequence
gagaaaattccacaggctga

SEQ ID NO: 680600 - DNA, 20 bp, Artificial
  CRISPR gRNA sequence
cacaggctgatgagttggca

SEQ ID NO: 680601 - DNA, 20 bp, Artificial
  CRISPR gRNA sequence
atgagttggcatcaatatat

SEQ ID NO: 680602 - DNA, 20 bp, Artificial
  CRISPR gRNA sequence
gcatcaatatatatgaatga

SEQ ID NO: 680603 - DNA, 20 bp, Artificial
  CRISPR gRNA sequence
atcccaaatatcagctggcc

SEQ ID NO: 680604 - DNA, 20 bp, Artificial
  CRISPR gRNA sequence
gcctatccatcctatggagc

SEQ ID NO: 680605 - DNA, 20 bp, Artificial
  CRISPR gRNA sequence
tccatcctatggagcagcat

SEQ ID NO: 680606 - DNA, 20 bp, Artificial
  CRISPR gRNA sequence
tggagcagcatccctgaaga

SEQ ID NO: 680607 - DNA, 20 bp, Artificial
  CRISPR gRNA sequence
aagaatcatctctcctgctc

SEQ ID NO: 680608 - DNA, 20 bp, Artificial
  CRISPR gRNA sequence
tcctgctctccaccatgaca

SEQ ID NO: 680609 - DNA, 20 bp, Artificial
  CRISPR gRNA sequence
ctgctctccaccatgacagt

SEQ ID NO: 680610 - DNA, 20 bp, Artificial
  CRISPR gRNA sequence
ctctccaccatgacagtgcc

SEQ ID NO: 680611 - DNA, 20 bp, Artificial
  CRISPR gRNA sequence
tccaccatgacagtgccaac

SEQ ID NO: 680612 - DNA, 20 bp, Artificial
  CRISPR gRNA sequence
caccatgacagtgccaacct

SEQ ID NO: 680613 - DNA, 20 bp, Artificial
  CRISPR gRNA sequence
ctgtactctctgcaaacatg

SEQ ID NO: 680614 - DNA, 20 bp, Artificial
  CRISPR gRNA sequence
tgtactctctgcaaacatgc

SEQ ID NO: 680615 - DNA, 20 bp, Artificial
  CRISPR gRNA sequence
tactctctgcaaacatgctg

SEQ ID NO: 680616 - DNA, 20 bp, Artificial
  CRISPR gRNA sequence
tctgcaaacatgctgtctca

SEQ ID NO: 680617 - DNA, 20 bp, Artificial
  CRISPR gRNA sequence
tgcaaacatgctgtctcact

SEQ ID NO: 680618 - DNA, 20 bp, Artificial
  CRISPR gRNA sequence
caaacatgctgtctcactcc

SEQ ID NO: 680619 - DNA, 20 bp, Artificial
  CRISPR gRNA sequence
tctcactccttggtgatctt

SEQ ID NO: 680620 - DNA, 20 bp, Artificial
  CRISPR gRNA sequence
actccttggtgatcttatat

SEQ ID NO: 680621 - DNA, 20 bp, Artificial
  CRISPR gRNA sequence
cttggtgatcttatatctat

SEQ ID NO: 680622 - DNA, 20 bp, Artificial
  CRISPR gRNA sequence
ggtgatcttatatctatatt

SEQ ID NO: 680623 - DNA, 20 bp, Artificial
  CRISPR gRNA sequence
gtgatcttatatctatattc

SEQ ID NO: 680624 - DNA, 20 bp, Artificial
  CRISPR gRNA sequence
atatctatattcacagggga

SEQ ID NO: 680625 - DNA, 20 bp, Artificial
  CRISPR gRNA sequence
tatctatattcacaggggat

SEQ ID NO: 680626 - DNA, 20 bp, Artificial
  CRISPR gRNA sequence
tattcacaggggataaaatc

SEQ ID NO: 680627 - DNA, 20 bp, Artificial
  CRISPR gRNA sequence
acaggggataaaatcgctgg

SEQ ID NO: 680628 - DNA, 20 bp, Artificial
  CRISPR gRNA sequence
gaactgatttcaacataata

SEQ ID NO: 680629 - DNA, 20 bp, Artificial
  CRISPR gRNA sequence
atttcaacataatattacca

SEQ ID NO: 680630 - DNA, 20 bp, Artificial
  CRISPR gRNA sequence
caacataatattaccaattc

SEQ ID NO: 680631 - DNA, 20 bp, Artificial
  CRISPR gRNA sequence
aacataatattaccaattct

SEQ ID NO: 680632 - DNA, 20 bp, Artificial
  CRISPR gRNA sequence
ccaattctataggattgtat

SEQ ID NO: 680633 - DNA, 20 bp, Artificial
  CRISPR gRNA sequence
tataggattgtatgcatcca

SEQ ID NO: 680634 - DNA, 20 bp, Artificial
  CRISPR gRNA sequence
taggattgtatgcatccatg

SEQ ID NO: 680635 - DNA, 20 bp, Artificial
  CRISPR gRNA sequence
tatgcatccatgtaaatgct

SEQ ID NO: 680636 - DNA, 20 bp, Artificial
  CRISPR gRNA sequence
ttatcttttttccttatttc

SEQ ID NO: 680637 - DNA, 20 bp, Artificial
  CRISPR gRNA sequence
tatcttttttccttatttca

SEQ ID NO: 680638 - DNA, 20 bp, Artificial
  CRISPR gRNA sequence
atcttttttccttatttcaa

SEQ ID NO: 680639 - DNA, 20 bp, Artificial
  CRISPR gRNA sequence
tcttttttccttatttcaat

SEQ ID NO: 680640 - DNA, 20 bp, Artificial
  CRISPR gRNA sequence
ttttccttatttcaatgaaa

SEQ ID NO: 680641 - DNA, 20 bp, Artificial
  CRISPR gRNA sequence
tttccttatttcaatgaaac

SEQ ID NO: 680642 - DNA, 20 bp, Artificial
  CRISPR gRNA sequence
ttccttatttcaatgaaaca

SEQ ID NO: 680643 - DNA, 20 bp, Artificial
  CRISPR gRNA sequence
tccttatttcaatgaaacaa

SEQ ID NO: 680644 - DNA, 20 bp, Artificial
  CRISPR gRNA sequence
ccttatttcaatgaaacaac

SEQ ID NO: 680645 - DNA, 20 bp, Artificial
  CRISPR gRNA sequence
cttatttcaatgaaacaact

SEQ ID NO: 680646 - DNA, 20 bp, Artificial
  CRISPR gRNA sequence
atttcaatgaaacaactatc

SEQ ID NO: 680647 - DNA, 20 bp, Artificial
  CRISPR gRNA sequence
tttcaatgaaacaactatcc

SEQ ID NO: 680648 - DNA, 20 bp, Artificial
  CRISPR gRNA sequence
caatgaaacaactatccctc

SEQ ID NO: 680649 - DNA, 20 bp, Artificial
  CRISPR gRNA sequence
aatgaaacaactatccctct

SEQ ID NO: 680650 - DNA, 20 bp, Artificial
  CRISPR gRNA sequence
tccctctttctaattaaagt

SEQ ID NO: 680651 - DNA, 20 bp, Artificial
  CRISPR gRNA sequence
tttctaattaaagttcattc

SEQ ID NO: 680652 - DNA, 20 bp, Artificial
  CRISPR gRNA sequence
tctaattaaagttcattccc

SEQ ID NO: 680653 - DNA, 20 bp, Artificial
  CRISPR gRNA sequence
ctaattaaagttcattcccc

SEQ ID NO: 680654 - DNA, 20 bp, Artificial
  CRISPR gRNA sequence
taattaaagttcattccccc

SEQ ID NO: 680655 - DNA, 20 bp, Artificial
  CRISPR gRNA sequence
attaaagttcattccccctc

SEQ ID NO: 680656 - DNA, 20 bp, Artificial
  CRISPR gRNA sequence
aagttcattccccctcttgt

SEQ ID NO: 680657 - DNA, 20 bp, Artificial
  CRISPR gRNA sequence
attccccctcttgtgcacag

SEQ ID NO: 680658 - DNA, 20 bp, Artificial
  CRISPR gRNA sequence
cccctcttgtgcacaggaat

SEQ ID NO: 680659 - DNA, 20 bp, Artificial
  CRISPR gRNA sequence
ttgtgcacaggaattctcct

SEQ ID NO: 680660 - DNA, 20 bp, Artificial
  CRISPR gRNA sequence
gtgcacaggaattctcctat

SEQ ID NO: 680661 - DNA, 20 bp, Artificial
  CRISPR gRNA sequence
tgcacaggaattctcctatc

SEQ ID NO: 680662 - DNA, 20 bp, Artificial
  CRISPR gRNA sequence
tcctatcctggccccccaga

SEQ ID NO: 680663 - DNA, 20 bp, Artificial
  CRISPR gRNA sequence
ctatcctggccccccagata

SEQ ID NO: 680664 - DNA, 20 bp, Artificial
  CRISPR gRNA sequence
tcctggccccccagatacct

SEQ ID NO: 680665 - DNA, 20 bp, Artificial
  CRISPR gRNA sequence
gccccccagatacctcacgc

SEQ ID NO: 680666 - DNA, 20 bp, Artificial
  CRISPR gRNA sequence
acgctattattttttcctct

SEQ ID NO: 680667 - DNA, 20 bp, Artificial
  CRISPR gRNA sequence
ttattttttcctctttctca

SEQ ID NO: 680668 - DNA, 20 bp, Artificial
  CRISPR gRNA sequence
ttttttcctctttctcactt

SEQ ID NO: 680669 - DNA, 20 bp, Artificial
  CRISPR gRNA sequence
tttcctctttctcacttaca

SEQ ID NO: 680670 - DNA, 20 bp, Artificial
  CRISPR gRNA sequence
ttcctctttctcacttacat

SEQ ID NO: 680671 - DNA, 20 bp, Artificial
  CRISPR gRNA sequence
tcctctttctcacttacatt

SEQ ID NO: 680672 - DNA, 20 bp, Artificial
  CRISPR gRNA sequence
cctctttctcacttacattt

SEQ ID NO: 680673 - DNA, 20 bp, Artificial
  CRISPR gRNA sequence
ctctttctcacttacatttt

SEQ ID NO: 680674 - DNA, 20 bp, Artificial
  CRISPR gRNA sequence
tttctcacttacatttttaa

SEQ ID NO: 680675 - DNA, 20 bp, Artificial
  CRISPR gRNA sequence
tctcacttacatttttaacc

SEQ ID NO: 680676 - DNA, 20 bp, Artificial
  CRISPR gRNA sequence
ctcacttacatttttaacct

SEQ ID NO: 680677 - DNA, 20 bp, Artificial
  CRISPR gRNA sequence
tcacttacatttttaacctc

SEQ ID NO: 680678 - DNA, 20 bp, Artificial
  CRISPR gRNA sequence
acttacatttttaacctctc

SEQ ID NO: 680679 - DNA, 20 bp, Artificial
  CRISPR gRNA sequence
acatttttaacctctcccct

SEQ ID NO: 680680 - DNA, 20 bp, Artificial
  CRISPR gRNA sequence
catttttaacctctcccctc

SEQ ID NO: 680681 - DNA, 20 bp, Artificial
  CRISPR gRNA sequence
ttaacctctcccctctattg

SEQ ID NO: 680682 - DNA, 20 bp, Artificial
  CRISPR gRNA sequence
taacctctcccctctattgg

SEQ ID NO: 680683 - DNA, 20 bp, Artificial
  CRISPR gRNA sequence
aacctctcccctctattggg

SEQ ID NO: 680684 - DNA, 20 bp, Artificial
  CRISPR gRNA sequence
acctctcccctctattgggc

SEQ ID NO: 680685 - DNA, 20 bp, Artificial
  CRISPR gRNA sequence
tcccctctattgggcatttc

SEQ ID NO: 680686 - DNA, 20 bp, Artificial
  CRISPR gRNA sequence
ccctctattgggcatttcct

SEQ ID NO: 680687 - DNA, 20 bp, Artificial
  CRISPR gRNA sequence
tattgggcatttcctatcag

SEQ ID NO: 680688 - DNA, 20 bp, Artificial
  CRISPR gRNA sequence
ttgggcatttcctatcagca

SEQ ID NO: 680689 - DNA, 20 bp, Artificial
  CRISPR gRNA sequence
ggcatttcctatcagcattt

SEQ ID NO: 680690 - DNA, 20 bp, Artificial
  CRISPR gRNA sequence
cctatcagcatttaatgcaa

SEQ ID NO: 680691 - DNA, 20 bp, Artificial
  CRISPR gRNA sequence
ctatcagcatttaatgcaat

SEQ ID NO: 680692 - DNA, 20 bp, Artificial
  CRISPR gRNA sequence
tcagcatttaatgcaataaa

SEQ ID NO: 680693 - DNA, 20 bp, Artificial
  CRISPR gRNA sequence
aatgcaataaattctcataa

SEQ ID NO: 680694 - DNA, 20 bp, Artificial
  CRISPR gRNA sequence
atgcaataaattctcataat

SEQ ID NO: 680695 - DNA, 20 bp, Artificial
  CRISPR gRNA sequence
tcataattaaaaaaaatctt

SEQ ID NO: 680696 - DNA, 20 bp, Artificial
  CRISPR gRNA sequence
ataattaaaaaaaatcttcc

SEQ ID NO: 680697 - DNA, 20 bp, Artificial
  CRISPR gRNA sequence
aaaaaaatcttcctttaagc

SEQ ID NO: 680698 - DNA, 20 bp, Artificial
  CRISPR gRNA sequence
cctttaagccccatctcctt

SEQ ID NO: 680699 - DNA, 20 bp, Artificial
  CRISPR gRNA sequence
ctttaagccccatctccttc

SEQ ID NO: 680700 - DNA, 20 bp, Artificial
  CRISPR gRNA sequence
taagccccatctccttccag

SEQ ID NO: 680701 - DNA, 20 bp, Artificial
  CRISPR gRNA sequence
aagccccatctccttccagg

SEQ ID NO: 680702 - DNA, 20 bp, Artificial
  CRISPR gRNA sequence
agccccatctccttccaggt

SEQ ID NO: 680703 - DNA, 20 bp, Artificial
  CRISPR gRNA sequence
cttccaggtacacctgtagt

SEQ ID NO: 680704 - DNA, 20 bp, Artificial
  CRISPR gRNA sequence
ccaggtacacctgtagtctc

SEQ ID NO: 680705 - DNA, 20 bp, Artificial
  CRISPR gRNA sequence
caggtacacctgtagtctcc

SEQ ID NO: 680706 - DNA, 20 bp, Artificial
  CRISPR gRNA sequence
tagtctccttttcttcaaag

SEQ ID NO: 680707 - DNA, 20 bp, Artificial
  CRISPR gRNA sequence
cttttcttcaaagatgaaat

SEQ ID NO: 680708 - DNA, 20 bp, Artificial
  CRISPR gRNA sequence
ttcttcaaagatgaaattgt

SEQ ID NO: 680709 - DNA, 20 bp, Artificial
  CRISPR gRNA sequence
tcttcaaagatgaaattgtt

SEQ ID NO: 680710 - DNA, 20 bp, Artificial
  CRISPR gRNA sequence
cttcaaagatgaaattgttg

SEQ ID NO: 680711 - DNA, 20 bp, Artificial
  CRISPR gRNA sequence
ttcaaagatgaaattgttga

SEQ ID NO: 680712 - DNA, 20 bp, Artificial
  CRISPR gRNA sequence
caaagatgaaattgttgaaa

SEQ ID NO: 680713 - DNA, 20 bp, Artificial
  CRISPR gRNA sequence
aaagatgaaattgttgaaag

SEQ ID NO: 680714 - DNA, 20 bp, Artificial
  CRISPR gRNA sequence
ttgaaagaatctctgtgctt

SEQ ID NO: 680715 - DNA, 20 bp, Artificial
  CRISPR gRNA sequence
aaagaatctctgtgcttgtt

SEQ ID NO: 680716 - DNA, 20 bp, Artificial
  CRISPR gRNA sequence
tgtgcttgttttcaatgatt

SEQ ID NO: 680717 - DNA, 20 bp, Artificial
  CRISPR gRNA sequence
tgcttgttttcaatgatttt

SEQ ID NO: 680718 - DNA, 20 bp, Artificial
  CRISPR gRNA sequence
gttttcaatgattttttttt

SEQ ID NO: 680719 - DNA, 20 bp, Artificial
  CRISPR gRNA sequence
ttttcaatgatttttttttt

SEQ ID NO: 680720 - DNA, 20 bp, Artificial
  CRISPR gRNA sequence
tcaatgattttttttttcta

SEQ ID NO: 680721 - DNA, 20 bp, Artificial
  CRISPR gRNA sequence
caatgattttttttttctat

SEQ ID NO: 680722 - DNA, 20 bp, Artificial
  CRISPR gRNA sequence
aatgattttttttttctatt

SEQ ID NO: 680723 - DNA, 20 bp, Artificial
  CRISPR gRNA sequence
tttttttctattcatttcca

SEQ ID NO: 680724 - DNA, 20 bp, Artificial
  CRISPR gRNA sequence
ttttttctattcatttccaa

SEQ ID NO: 680725 - DNA, 20 bp, Artificial
  CRISPR gRNA sequence
tttttctattcatttccaag

SEQ ID NO: 680726 - DNA, 20 bp, Artificial
  CRISPR gRNA sequence
ttttctattcatttccaagt

SEQ ID NO: 680727 - DNA, 20 bp, Artificial
  CRISPR gRNA sequence
tttctattcatttccaagtc

SEQ ID NO: 680728 - DNA, 20 bp, Artificial
  CRISPR gRNA sequence
ttctattcatttccaagtcc

SEQ ID NO: 680729 - DNA, 20 bp, Artificial
  CRISPR gRNA sequence
tctattcatttccaagtcca

SEQ ID NO: 680730 - DNA, 20 bp, Artificial
  CRISPR gRNA sequence
ctattcatttccaagtccat

SEQ ID NO: 680731 - DNA, 20 bp, Artificial
  CRISPR gRNA sequence
tattcatttccaagtccatg

SEQ ID NO: 680732 - DNA, 20 bp, Artificial
  CRISPR gRNA sequence
ttcatttccaagtccatgca

SEQ ID NO: 680733 - DNA, 20 bp, Artificial
  CRISPR gRNA sequence
atttccaagtccatgcaacc

SEQ ID NO: 680734 - DNA, 20 bp, Artificial
  CRISPR gRNA sequence
ccaagtccatgcaacctgtt

SEQ ID NO: 680735 - DNA, 20 bp, Artificial
  CRISPR gRNA sequence
caagtccatgcaacctgttt

SEQ ID NO: 680736 - DNA, 20 bp, Artificial
  CRISPR gRNA sequence
tttttctttcccacactcca

SEQ ID NO: 680737 - DNA, 20 bp, Artificial
  CRISPR gRNA sequence
ttctttcccacactccatta

SEQ ID NO: 680738 - DNA, 20 bp, Artificial
  CRISPR gRNA sequence
tctttcccacactccattaa

SEQ ID NO: 680739 - DNA, 20 bp, Artificial
  CRISPR gRNA sequence
ctttcccacactccattaaa

SEQ ID NO: 680740 - DNA, 20 bp, Artificial
  CRISPR gRNA sequence
tttcccacactccattaaaa

SEQ ID NO: 680741 - DNA, 20 bp, Artificial
  CRISPR gRNA sequence
tcccacactccattaaaatt

SEQ ID NO: 680742 - DNA, 20 bp, Artificial
  CRISPR gRNA sequence
cccacactccattaaaatta

SEQ ID NO: 680743 - DNA, 20 bp, Artificial
  CRISPR gRNA sequence
ccacactccattaaaattat

SEQ ID NO: 680744 - DNA, 20 bp, Artificial
  CRISPR gRNA sequence
cattaaaattattctcactg

SEQ ID NO: 680745 - DNA, 20 bp, Artificial
  CRISPR gRNA sequence
aaattattctcactgaggtc

SEQ ID NO: 680746 - DNA, 20 bp, Artificial
  CRISPR gRNA sequence
ttctcactgaggtcacaact

SEQ ID NO: 680747 - DNA, 20 bp, Artificial
  CRISPR gRNA sequence
tcactgaggtcacaactagc

SEQ ID NO: 680748 - DNA, 20 bp, Artificial
  CRISPR gRNA sequence
actgaggtcacaactagctt

SEQ ID NO: 680749 - DNA, 20 bp, Artificial
  CRISPR gRNA sequence
aggtcacaactagcttctgt

SEQ ID NO: 680750 - DNA, 20 bp, Artificial
  CRISPR gRNA sequence
gcttctgtagtgccaaatcg

SEQ ID NO: 680751 - DNA, 20 bp, Artificial
  CRISPR gRNA sequence
ctgtagtgccaaatcgagta

SEQ ID NO: 680752 - DNA, 20 bp, Artificial
  CRISPR gRNA sequence
tgtagtgccaaatcgagtag

SEQ ID NO: 680753 - DNA, 20 bp, Artificial
  CRISPR gRNA sequence
tagtgccaaatcgagtagac

SEQ ID NO: 680754 - DNA, 20 bp, Artificial
  CRISPR gRNA sequence
ttttaagacagtatcttaca

SEQ ID NO: 680755 - DNA, 20 bp, Artificial
  CRISPR gRNA sequence
ttaagacagtatcttacaca

SEQ ID NO: 680756 - DNA, 20 bp, Artificial
  CRISPR gRNA sequence
taagacagtatcttacacag

SEQ ID NO: 680757 - DNA, 20 bp, Artificial
  CRISPR gRNA sequence
aagacagtatcttacacagc

SEQ ID NO: 680758 - DNA, 20 bp, Artificial
  CRISPR gRNA sequence
agacagtatcttacacagct

SEQ ID NO: 680759 - DNA, 20 bp, Artificial
  CRISPR gRNA sequence
acacagctcctagagagtat

SEQ ID NO: 680760 - DNA, 20 bp, Artificial
  CRISPR gRNA sequence
cacagctcctagagagtatc

SEQ ID NO: 680761 - DNA, 20 bp, Artificial
  CRISPR gRNA sequence
ctagagagtatctgccacta

SEQ ID NO: 680762 - DNA, 20 bp, Artificial
  CRISPR gRNA sequence
gagagtatctgccactattg

SEQ ID NO: 680763 - DNA, 20 bp, Artificial
  CRISPR gRNA sequence
ccactattgaatagtcaatt

SEQ ID NO: 680764 - DNA, 20 bp, Artificial
  CRISPR gRNA sequence
ttgaatagtcaattcctttg

SEQ ID NO: 680765 - DNA, 20 bp, Artificial
  CRISPR gRNA sequence
aatagtcaattcctttggaa

SEQ ID NO: 680766 - DNA, 20 bp, Artificial
  CRISPR gRNA sequence
ctttggaaacacactctttt

SEQ ID NO: 680767 - DNA, 20 bp, Artificial
  CRISPR gRNA sequence
tggaaacacactcttttctt

SEQ ID NO: 680768 - DNA, 20 bp, Artificial
  CRISPR gRNA sequence
ggaaacacactcttttcttg

SEQ ID NO: 680769 - DNA, 20 bp, Artificial
  CRISPR gRNA sequence
gaaacacactcttttcttgg

SEQ ID NO: 680770 - DNA, 20 bp, Artificial
  CRISPR gRNA sequence
ttttcttggtttttatgaca

SEQ ID NO: 680771 - DNA, 20 bp, Artificial
  CRISPR gRNA sequence
ttcttggtttttatgacatt

SEQ ID NO: 680772 - DNA, 20 bp, Artificial
  CRISPR gRNA sequence
tcttggtttttatgacattg

SEQ ID NO: 680773 - DNA, 20 bp, Artificial
  CRISPR gRNA sequence
cttggtttttatgacattgt

SEQ ID NO: 680774 - DNA, 20 bp, Artificial
  CRISPR gRNA sequence
ttggtttttatgacattgtt

SEQ ID NO: 680775 - DNA, 20 bp, Artificial
  CRISPR gRNA sequence
ggtttttatgacattgttct

SEQ ID NO: 680776 - DNA, 20 bp, Artificial
  CRISPR gRNA sequence
gtttttatgacattgttctc

SEQ ID NO: 680777 - DNA, 20 bp, Artificial
  CRISPR gRNA sequence
ttatgacattgttctctctc

SEQ ID NO: 680778 - DNA, 20 bp, Artificial
  CRISPR gRNA sequence
tatgacattgttctctctct

SEQ ID NO: 680779 - DNA, 20 bp, Artificial
  CRISPR gRNA sequence
atgacattgttctctctctc

SEQ ID NO: 680780 - DNA, 20 bp, Artificial
  CRISPR gRNA sequence
tgacattgttctctctctct

SEQ ID NO: 680781 - DNA, 20 bp, Artificial
  CRISPR gRNA sequence
ttctctctctctgactgtgt

SEQ ID NO: 680782 - DNA, 20 bp, Artificial
  CRISPR gRNA sequence
tctctctctgactgtgttca

SEQ ID NO: 680783 - DNA, 20 bp, Artificial
  CRISPR gRNA sequence
tctctctgactgtgttcagt

SEQ ID NO: 680784 - DNA, 20 bp, Artificial
  CRISPR gRNA sequence
tctctgactgtgttcagtat

SEQ ID NO: 680785 - DNA, 20 bp, Artificial
  CRISPR gRNA sequence
tctgactgtgttcagtattc

SEQ ID NO: 680786 - DNA, 20 bp, Artificial
  CRISPR gRNA sequence
tgactgtgttcagtattctt

SEQ ID NO: 680787 - DNA, 20 bp, Artificial
  CRISPR gRNA sequence
actgtgttcagtattctttc

SEQ ID NO: 680788 - DNA, 20 bp, Artificial
  CRISPR gRNA sequence
tgttcagtattctttcagac

SEQ ID NO: 680789 - DNA, 20 bp, Artificial
  CRISPR gRNA sequence
agtattctttcagacttatc

SEQ ID NO: 680790 - DNA, 20 bp, Artificial
  CRISPR gRNA sequence
tttcagacttatccttaaca

SEQ ID NO: 680791 - DNA, 20 bp, Artificial
  CRISPR gRNA sequence
tcagacttatccttaacagc

SEQ ID NO: 680792 - DNA, 20 bp, Artificial
  CRISPR gRNA sequence
cagacttatccttaacagct

SEQ ID NO: 680793 - DNA, 20 bp, Artificial
  CRISPR gRNA sequence
agacttatccttaacagcta

SEQ ID NO: 680794 - DNA, 20 bp, Artificial
  CRISPR gRNA sequence
atccttaacagctatgcaag

SEQ ID NO: 680795 - DNA, 20 bp, Artificial
  CRISPR gRNA sequence
tccttaacagctatgcaagt

SEQ ID NO: 680796 - DNA, 20 bp, Artificial
  CRISPR gRNA sequence
aacagctatgcaagttggcc

SEQ ID NO: 680797 - DNA, 20 bp, Artificial
  CRISPR gRNA sequence
acagctatgcaagttggcca

SEQ ID NO: 680798 - DNA, 20 bp, Artificial
  CRISPR gRNA sequence
tgcaagttggccaaagtaca

SEQ ID NO: 680799 - DNA, 20 bp, Artificial
  CRISPR gRNA sequence
gccaaagtacaaatggaggc

SEQ ID NO: 680800 - DNA, 20 bp, Artificial
  CRISPR gRNA sequence
atatgcctaaatatttttat

SEQ ID NO: 680801 - DNA, 20 bp, Artificial
  CRISPR gRNA sequence
aatatttttatattataaat

SEQ ID NO: 680802 - DNA, 20 bp, Artificial
  CRISPR gRNA sequence
ttatattataaatctaactg

SEQ ID NO: 680803 - DNA, 20 bp, Artificial
  CRISPR gRNA sequence
tatattataaatctaactgt

SEQ ID NO: 680804 - DNA, 20 bp, Artificial
  CRISPR gRNA sequence
atattataaatctaactgta

SEQ ID NO: 680805 - DNA, 20 bp, Artificial
  CRISPR gRNA sequence
tattataaatctaactgtaa

SEQ ID NO: 680806 - DNA, 20 bp, Artificial
  CRISPR gRNA sequence
taaatctaactgtaaaactt

SEQ ID NO: 680807 - DNA, 20 bp, Artificial
  CRISPR gRNA sequence
actgtaaaacttattttcta

SEQ ID NO: 680808 - DNA, 20 bp, Artificial
  CRISPR gRNA sequence
taaaacttattttctaccct

SEQ ID NO: 680809 - DNA, 20 bp, Artificial
  CRISPR gRNA sequence
attttctacccttccaactt

SEQ ID NO: 680810 - DNA, 20 bp, Artificial
  CRISPR gRNA sequence
ttttctacccttccaacttg

SEQ ID NO: 680811 - DNA, 20 bp, Artificial
  CRISPR gRNA sequence
tctacccttccaacttgact

SEQ ID NO: 680812 - DNA, 20 bp, Artificial
  CRISPR gRNA sequence
ctacccttccaacttgacta

SEQ ID NO: 680813 - DNA, 20 bp, Artificial
  CRISPR gRNA sequence
tacccttccaacttgactaa

SEQ ID NO: 680814 - DNA, 20 bp, Artificial
  CRISPR gRNA sequence
cccttccaacttgactaagt

SEQ ID NO: 680815 - DNA, 20 bp, Artificial
  CRISPR gRNA sequence
ccaacttgactaagttcaaa

SEQ ID NO: 680816 - DNA, 20 bp, Artificial
  CRISPR gRNA sequence
caacttgactaagttcaaat

SEQ ID NO: 680817 - DNA, 20 bp, Artificial
  CRISPR gRNA sequence
gactaagttcaaataaatat

SEQ ID NO: 680818 - DNA, 20 bp, Artificial
  CRISPR gRNA sequence
actaagttcaaataaatatg

SEQ ID NO: 680819 - DNA, 20 bp, Artificial
  CRISPR gRNA sequence
agttcaaataaatatgcaat

SEQ ID NO: 680820 - DNA, 20 bp, Artificial
  CRISPR gRNA sequence
aaataaatatgcaattctca

SEQ ID NO: 680821 - DNA, 20 bp, Artificial
  CRISPR gRNA sequence
tcagatttcctgtagctcta

SEQ ID NO: 680822 - DNA, 20 bp, Artificial
  CRISPR gRNA sequence
agatttcctgtagctctaca

SEQ ID NO: 680823 - DNA, 20 bp, Artificial
  CRISPR gRNA sequence
cctgtagctctacactacac

SEQ ID NO: 680824 - DNA, 20 bp, Artificial
  CRISPR gRNA sequence
ctgtagctctacactacacc

SEQ ID NO: 680825 - DNA, 20 bp, Artificial
  CRISPR gRNA sequence
tagctctacactacaccttg

SEQ ID NO: 680826 - DNA, 20 bp, Artificial
  CRISPR gRNA sequence
tacactacaccttggcagca

SEQ ID NO: 680827 - DNA, 20 bp, Artificial
  CRISPR gRNA sequence
cactacaccttggcagcacg

SEQ ID NO: 680828 - DNA, 20 bp, Artificial
  CRISPR gRNA sequence
caccttggcagcacgagcag

SEQ ID NO: 680829 - DNA, 20 bp, Artificial
  CRISPR gRNA sequence
ggcagcacgagcagaaccac

SEQ ID NO: 680830 - DNA, 20 bp, Artificial
  CRISPR gRNA sequence
gcagcacgagcagaaccacc

SEQ ID NO: 680831 - DNA, 20 bp, Artificial
  CRISPR gRNA sequence
gcttacagctaggctcctct

SEQ ID NO: 680832 - DNA, 20 bp, Artificial
  CRISPR gRNA sequence
acagctaggctcctctctta

SEQ ID NO: 680833 - DNA, 20 bp, Artificial
  CRISPR gRNA sequence
cagctaggctcctctcttag

SEQ ID NO: 680834 - DNA, 20 bp, Artificial
  CRISPR gRNA sequence
ggctcctctcttagacccac

SEQ ID NO: 680835 - DNA, 20 bp, Artificial
  CRISPR gRNA sequence
ctctcttagacccactccta

SEQ ID NO: 680836 - DNA, 20 bp, Artificial
  CRISPR gRNA sequence
tcttagacccactcctagtt

SEQ ID NO: 680837 - DNA, 20 bp, Artificial
  CRISPR gRNA sequence
ttagacccactcctagttct

SEQ ID NO: 680838 - DNA, 20 bp, Artificial
  CRISPR gRNA sequence
agacccactcctagttctct

SEQ ID NO: 680839 - DNA, 20 bp, Artificial
  CRISPR gRNA sequence
gacccactcctagttctctc

SEQ ID NO: 680840 - DNA, 20 bp, Artificial
  CRISPR gRNA sequence
ctagttctctccattaccaa

SEQ ID NO: 680841 - DNA, 20 bp, Artificial
  CRISPR gRNA sequence
gttctctccattaccaaagg

SEQ ID NO: 680842 - DNA, 20 bp, Artificial
  CRISPR gRNA sequence
tctccattaccaaagggggt

SEQ ID NO: 680843 - DNA, 20 bp, Artificial
  CRISPR gRNA sequence
tccattaccaaagggggtct

SEQ ID NO: 680844 - DNA, 20 bp, Artificial
  CRISPR gRNA sequence
cattaccaaagggggtctca

SEQ ID NO: 680845 - DNA, 20 bp, Artificial
  CRISPR gRNA sequence
ccaaagggggtctcacacac

SEQ ID NO: 680846 - DNA, 20 bp, Artificial
  CRISPR gRNA sequence
acacacacatgtatggacac

SEQ ID NO: 680847 - DNA, 20 bp, Artificial
  CRISPR gRNA sequence
catatccaggttctttttac

SEQ ID NO: 680848 - DNA, 20 bp, Artificial
  CRISPR gRNA sequence
tttttacattgcacataaag

SEQ ID NO: 680849 - DNA, 20 bp, Artificial
  CRISPR gRNA sequence
tttacattgcacataaagac

SEQ ID NO: 680850 - DNA, 20 bp, Artificial
  CRISPR gRNA sequence
ttacattgcacataaagacc

SEQ ID NO: 680851 - DNA, 20 bp, Artificial
  CRISPR gRNA sequence
tacattgcacataaagacca

SEQ ID NO: 680852 - DNA, 20 bp, Artificial
  CRISPR gRNA sequence
acattgcacataaagaccag

SEQ ID NO: 680853 - DNA, 20 bp, Artificial
  CRISPR gRNA sequence
cattgcacataaagaccagt

SEQ ID NO: 680854 - DNA, 20 bp, Artificial
  CRISPR gRNA sequence
cacataaagaccagtgcctt

SEQ ID NO: 680855 - DNA, 20 bp, Artificial
  CRISPR gRNA sequence
ggccatcaggcctaggtgtg

SEQ ID NO: 680856 - DNA, 20 bp, Artificial
  CRISPR gRNA sequence
gccatcaggcctaggtgtgt

SEQ ID NO: 680857 - DNA, 20 bp, Artificial
  CRISPR gRNA sequence
ggtgtgtgcttaccagtagc

SEQ ID NO: 680858 - DNA, 20 bp, Artificial
  CRISPR gRNA sequence
accagtagcacagttggtat

SEQ ID NO: 680859 - DNA, 20 bp, Artificial
  CRISPR gRNA sequence
ccagtagcacagttggtatg

SEQ ID NO: 680860 - DNA, 20 bp, Artificial
  CRISPR gRNA sequence
gtatgaagtattatggaccc

SEQ ID NO: 680861 - DNA, 20 bp, Artificial
  CRISPR gRNA sequence
tggaccctatgaagaggact

SEQ ID NO: 680862 - DNA, 20 bp, Artificial
  CRISPR gRNA sequence
tgaagaggactgtgtagtcc

SEQ ID NO: 680863 - DNA, 20 bp, Artificial
  CRISPR gRNA sequence
tgtagtccctagaagcaggc

SEQ ID NO: 680864 - DNA, 20 bp, Artificial
  CRISPR gRNA sequence
gaagcaggctcagaaccatt

SEQ ID NO: 680865 - DNA, 20 bp, Artificial
  CRISPR gRNA sequence
agaaccatttgggcaaggaa

SEQ ID NO: 680866 - DNA, 20 bp, Artificial
  CRISPR gRNA sequence
gggcaaggaattctggggtc

SEQ ID NO: 680867 - DNA, 20 bp, Artificial
  CRISPR gRNA sequence
ggcaaggaattctggggtct

SEQ ID NO: 680868 - DNA, 20 bp, Artificial
  CRISPR gRNA sequence
tggggtctgagtgagcttca

SEQ ID NO: 680869 - DNA, 20 bp, Artificial
  CRISPR gRNA sequence
gggtctgagtgagcttcaga

SEQ ID NO: 680870 - DNA, 20 bp, Artificial
  CRISPR gRNA sequence
agtgagcttcagatcagcac

SEQ ID NO: 680871 - DNA, 20 bp, Artificial
  CRISPR gRNA sequence
cagatcagcacattcccttg

SEQ ID NO: 680872 - DNA, 20 bp, Artificial
  CRISPR gRNA sequence
agatcagcacattcccttgg

SEQ ID NO: 680873 - DNA, 20 bp, Artificial
  CRISPR gRNA sequence
ccttggccctagaagctcct

SEQ ID NO: 680874 - DNA, 20 bp, Artificial
  CRISPR gRNA sequence
ggccctagaagctcctcatt

SEQ ID NO: 680875 - DNA, 20 bp, Artificial
  CRISPR gRNA sequence
gccctagaagctcctcattt

SEQ ID NO: 680876 - DNA, 20 bp, Artificial
  CRISPR gRNA sequence
gaagctcctcatttcctgag

SEQ ID NO: 680877 - DNA, 20 bp, Artificial
  CRISPR gRNA sequence
ctcatttcctgagaagaaag

SEQ ID NO: 680878 - DNA, 20 bp, Artificial
  CRISPR gRNA sequence
atttcctgagaagaaaggcc

SEQ ID NO: 680879 - DNA, 20 bp, Artificial
  CRISPR gRNA sequence
cctgagaagaaaggcccagg

SEQ ID NO: 680880 - DNA, 20 bp, Artificial
  CRISPR gRNA sequence
ctgagaagaaaggcccaggg

SEQ ID NO: 680881 - DNA, 20 bp, Artificial
  CRISPR gRNA sequence
agaagaaaggcccagggctc

SEQ ID NO: 680882 - DNA, 20 bp, Artificial
  CRISPR gRNA sequence
cctaaacatggggcccagtg

SEQ ID NO: 680883 - DNA, 20 bp, Artificial
  CRISPR gRNA sequence
aacatggggcccagtgcaaa

SEQ ID NO: 680884 - DNA, 20 bp, Artificial
  CRISPR gRNA sequence
tccctgatctatgagtaggc

SEQ ID NO: 680885 - DNA, 20 bp, Artificial
  CRISPR gRNA sequence
ccctgatctatgagtaggca

SEQ ID NO: 680886 - DNA, 20 bp, Artificial
  CRISPR gRNA sequence
cctgatctatgagtaggcag

SEQ ID NO: 680887 - DNA, 20 bp, Artificial
  CRISPR gRNA sequence
atctatgagtaggcagacaa

SEQ ID NO: 680888 - DNA, 20 bp, Artificial
  CRISPR gRNA sequence
tgagtaggcagacaaatctt

SEQ ID NO: 680889 - DNA, 20 bp, Artificial
  CRISPR gRNA sequence
agtgttattccaggttctat

SEQ ID NO: 680890 - DNA, 20 bp, Artificial
  CRISPR gRNA sequence
gtgttattccaggttctatt

SEQ ID NO: 680891 - DNA, 20 bp, Artificial
  CRISPR gRNA sequence
ttccaggttctatttttgac

SEQ ID NO: 680892 - DNA, 20 bp, Artificial
  CRISPR gRNA sequence
caggttctatttttgaccca

SEQ ID NO: 680893 - DNA, 20 bp, Artificial
  CRISPR gRNA sequence
tatttttgacccatcccctt

SEQ ID NO: 680894 - DNA, 20 bp, Artificial
  CRISPR gRNA sequence
tttttgacccatccccttca

SEQ ID NO: 680895 - DNA, 20 bp, Artificial
  CRISPR gRNA sequence
ttgacccatccccttcacac

SEQ ID NO: 680896 - DNA, 20 bp, Artificial
  CRISPR gRNA sequence
tgacccatccccttcacact

SEQ ID NO: 680897 - DNA, 20 bp, Artificial
  CRISPR gRNA sequence
gacccatccccttcacactc

SEQ ID NO: 680898 - DNA, 20 bp, Artificial
  CRISPR gRNA sequence
acccatccccttcacactct

SEQ ID NO: 680899 - DNA, 20 bp, Artificial
  CRISPR gRNA sequence
cacactctacctgggtgata

SEQ ID NO: 680900 - DNA, 20 bp, Artificial
  CRISPR gRNA sequence
acactctacctgggtgatat

SEQ ID NO: 680901 - DNA, 20 bp, Artificial
  CRISPR gRNA sequence
tacctgggtgatatcagtta

SEQ ID NO: 680902 - DNA, 20 bp, Artificial
  CRISPR gRNA sequence
cctgggtgatatcagttatt

SEQ ID NO: 680903 - DNA, 20 bp, Artificial
  CRISPR gRNA sequence
ggtgatatcagttatttcct

SEQ ID NO: 680904 - DNA, 20 bp, Artificial
  CRISPR gRNA sequence
tttccttggcttcagaagtt

SEQ ID NO: 680905 - DNA, 20 bp, Artificial
  CRISPR gRNA sequence
ccttggcttcagaagttgct

SEQ ID NO: 680906 - DNA, 20 bp, Artificial
  CRISPR gRNA sequence
cttggcttcagaagttgctt

SEQ ID NO: 680907 - DNA, 20 bp, Artificial
  CRISPR gRNA sequence
ggcttcagaagttgctttct

SEQ ID NO: 680908 - DNA, 20 bp, Artificial
  CRISPR gRNA sequence
gcttcagaagttgctttcta

SEQ ID NO: 680909 - DNA, 20 bp, Artificial
  CRISPR gRNA sequence
cagaagttgctttctatcaa

SEQ ID NO: 680910 - DNA, 20 bp, Artificial
  CRISPR gRNA sequence
agaagttgctttctatcaac

SEQ ID NO: 680911 - DNA, 20 bp, Artificial
  CRISPR gRNA sequence
ctttctatcaactgatgact

SEQ ID NO: 680912 - DNA, 20 bp, Artificial
  CRISPR gRNA sequence
tctatcaactgatgactcat

SEQ ID NO: 680913 - DNA, 20 bp, Artificial
  CRISPR gRNA sequence
ctatcaactgatgactcatt

SEQ ID NO: 680914 - DNA, 20 bp, Artificial
  CRISPR gRNA sequence
tatcaactgatgactcattt

SEQ ID NO: 680915 - DNA, 20 bp, Artificial
  CRISPR gRNA sequence
tcaactgatgactcatttct

SEQ ID NO: 680916 - DNA, 20 bp, Artificial
  CRISPR gRNA sequence
atgactcatttctacatctc

SEQ ID NO: 680917 - DNA, 20 bp, Artificial
  CRISPR gRNA sequence
atttctacatctcaagccca

SEQ ID NO: 680918 - DNA, 20 bp, Artificial
  CRISPR gRNA sequence
ctacatctcaagcccaggtc

SEQ ID NO: 680919 - DNA, 20 bp, Artificial
  CRISPR gRNA sequence
tacatctcaagcccaggtct

SEQ ID NO: 680920 - DNA, 20 bp, Artificial
  CRISPR gRNA sequence
catctcaagcccaggtctct

SEQ ID NO: 680921 - DNA, 20 bp, Artificial
  CRISPR gRNA sequence
aagcccaggtctctcttctg

SEQ ID NO: 680922 - DNA, 20 bp, Artificial
  CRISPR gRNA sequence
tcttctgaatttgagactaa

SEQ ID NO: 680923 - DNA, 20 bp, Artificial
  CRISPR gRNA sequence
ttctgaatttgagactaaac

SEQ ID NO: 680924 - DNA, 20 bp, Artificial
  CRISPR gRNA sequence
ctgaatttgagactaaactt

SEQ ID NO: 680925 - DNA, 20 bp, Artificial
  CRISPR gRNA sequence
tgaatttgagactaaactta

SEQ ID NO: 680926 - DNA, 20 bp, Artificial
  CRISPR gRNA sequence
aatttgagactaaacttact

SEQ ID NO: 680927 - DNA, 20 bp, Artificial
  CRISPR gRNA sequence
gagactaaacttactggaca

SEQ ID NO: 680928 - DNA, 20 bp, Artificial
  CRISPR gRNA sequence
agactaaacttactggacat

SEQ ID NO: 680929 - DNA, 20 bp, Artificial
  CRISPR gRNA sequence
aacttactggacattattat

SEQ ID NO: 680930 - DNA, 20 bp, Artificial
  CRISPR gRNA sequence
actggacattattattactc

SEQ ID NO: 680931 - DNA, 20 bp, Artificial
  CRISPR gRNA sequence
ctggacattattattactca

SEQ ID NO: 680932 - DNA, 20 bp, Artificial
  CRISPR gRNA sequence
gacattattattactcatag

SEQ ID NO: 680933 - DNA, 20 bp, Artificial
  CRISPR gRNA sequence
ttattactcatagtcctccc

SEQ ID NO: 680934 - DNA, 20 bp, Artificial
  CRISPR gRNA sequence
ttactcatagtcctcccaaa

SEQ ID NO: 680935 - DNA, 20 bp, Artificial
  CRISPR gRNA sequence
ctcatagtcctcccaaactg

SEQ ID NO: 680936 - DNA, 20 bp, Artificial
  CRISPR gRNA sequence
atagtcctcccaaactgaat

SEQ ID NO: 680937 - DNA, 20 bp, Artificial
  CRISPR gRNA sequence
ccaaactgaattcatcatct

SEQ ID NO: 680938 - DNA, 20 bp, Artificial
  CRISPR gRNA sequence
aattcatcatcttttctatc

SEQ ID NO: 680939 - DNA, 20 bp, Artificial
  CRISPR gRNA sequence
atcatcttttctatctcatt

SEQ ID NO: 680940 - DNA, 20 bp, Artificial
  CRISPR gRNA sequence
ttctatctcattgtcatcta

SEQ ID NO: 680941 - DNA, 20 bp, Artificial
  CRISPR gRNA sequence
tctatctcattgtcatctac

SEQ ID NO: 680942 - DNA, 20 bp, Artificial
  CRISPR gRNA sequence
ctatctcattgtcatctact

SEQ ID NO: 680943 - DNA, 20 bp, Artificial
  CRISPR gRNA sequence
tatctcattgtcatctacta

SEQ ID NO: 680944 - DNA, 20 bp, Artificial
  CRISPR gRNA sequence
tctcattgtcatctactaaa

SEQ ID NO: 680945 - DNA, 20 bp, Artificial
  CRISPR gRNA sequence
attgtcatctactaaatttc

SEQ ID NO: 680946 - DNA, 20 bp, Artificial
  CRISPR gRNA sequence
tcatctactaaatttcctag

SEQ ID NO: 680947 - DNA, 20 bp, Artificial
  CRISPR gRNA sequence
ctaaatttcctaggccagaa

SEQ ID NO: 680948 - DNA, 20 bp, Artificial
  CRISPR gRNA sequence
aatttcctaggccagaaacc

SEQ ID NO: 680949 - DNA, 20 bp, Artificial
  CRISPR gRNA sequence
cctaggccagaaacctagag

SEQ ID NO: 680950 - DNA, 20 bp, Artificial
  CRISPR gRNA sequence
ctaggccagaaacctagagc

SEQ ID NO: 680951 - DNA, 20 bp, Artificial
  CRISPR gRNA sequence
ggccagaaacctagagcagc

SEQ ID NO: 680952 - DNA, 20 bp, Artificial
  CRISPR gRNA sequence
gagcagcaatttcctaaacc

SEQ ID NO: 680953 - DNA, 20 bp, Artificial
  CRISPR gRNA sequence
cctaaacccctttgctaaat

SEQ ID NO: 680954 - DNA, 20 bp, Artificial
  CRISPR gRNA sequence
ctaaacccctttgctaaatg

SEQ ID NO: 680955 - DNA, 20 bp, Artificial
  CRISPR gRNA sequence
aacccctttgctaaatgaat

SEQ ID NO: 680956 - DNA, 20 bp, Artificial
  CRISPR gRNA sequence
tgctaaatgaataccttcag

SEQ ID NO: 680957 - DNA, 20 bp, Artificial
  CRISPR gRNA sequence
gctaaatgaataccttcagg

SEQ ID NO: 680958 - DNA, 20 bp, Artificial
  CRISPR gRNA sequence
ctaaatgaataccttcaggg

SEQ ID NO: 680959 - DNA, 20 bp, Artificial
  CRISPR gRNA sequence
aatgaataccttcagggcac

SEQ ID NO: 680960 - DNA, 20 bp, Artificial
  CRISPR gRNA sequence
cagggcacttccttgtttat

SEQ ID NO: 680961 - DNA, 20 bp, Artificial
  CRISPR gRNA sequence
agggcacttccttgtttatc

SEQ ID NO: 680962 - DNA, 20 bp, Artificial
  CRISPR gRNA sequence
ccttgtttatccccttcaat

SEQ ID NO: 680963 - DNA, 20 bp, Artificial
  CRISPR gRNA sequence
cttgtttatccccttcaatc

SEQ ID NO: 680964 - DNA, 20 bp, Artificial
  CRISPR gRNA sequence
gtttatccccttcaatctgt

SEQ ID NO: 680965 - DNA, 20 bp, Artificial
  CRISPR gRNA sequence
tttatccccttcaatctgta

SEQ ID NO: 680966 - DNA, 20 bp, Artificial
  CRISPR gRNA sequence
atccccttcaatctgtattc

SEQ ID NO: 680967 - DNA, 20 bp, Artificial
  CRISPR gRNA sequence
tccccttcaatctgtattcc

SEQ ID NO: 680968 - DNA, 20 bp, Artificial
  CRISPR gRNA sequence
caatctgtattcctttaggg

SEQ ID NO: 680969 - DNA, 20 bp, Artificial
  CRISPR gRNA sequence
aatctgtattcctttaggga

SEQ ID NO: 680970 - DNA, 20 bp, Artificial
  CRISPR gRNA sequence
tattcctttagggaaatatt

SEQ ID NO: 680971 - DNA, 20 bp, Artificial
  CRISPR gRNA sequence
ctttagggaaatattcaaat

SEQ ID NO: 680972 - DNA, 20 bp, Artificial
  CRISPR gRNA sequence
tagggaaatattcaaatttt

SEQ ID NO: 680973 - DNA, 20 bp, Artificial
  CRISPR gRNA sequence
agggaaatattcaaattttt

SEQ ID NO: 680974 - DNA, 20 bp, Artificial
  CRISPR gRNA sequence
gggaaatattcaaattttta

SEQ ID NO: 680975 - DNA, 20 bp, Artificial
  CRISPR gRNA sequence
aaatttttagcatatttagc

SEQ ID NO: 680976 - DNA, 20 bp, Artificial
  CRISPR gRNA sequence
ttagcatatttagccttata

SEQ ID NO: 680977 - DNA, 20 bp, Artificial
  CRISPR gRNA sequence
tagcatatttagccttatat

SEQ ID NO: 680978 - DNA, 20 bp, Artificial
  CRISPR gRNA sequence
agcatatttagccttatatt

SEQ ID NO: 680979 - DNA, 20 bp, Artificial
  CRISPR gRNA sequence
gcatatttagccttatatta

SEQ ID NO: 680980 - DNA, 20 bp, Artificial
  CRISPR gRNA sequence
agccttatattatctaactt

SEQ ID NO: 680981 - DNA, 20 bp, Artificial
  CRISPR gRNA sequence
gccttatattatctaacttg

SEQ ID NO: 680982 - DNA, 20 bp, Artificial
  CRISPR gRNA sequence
atattatctaacttgtcttt

SEQ ID NO: 680983 - DNA, 20 bp, Artificial
  CRISPR gRNA sequence
tattatctaacttgtctttc

SEQ ID NO: 680984 - DNA, 20 bp, Artificial
  CRISPR gRNA sequence
tctaacttgtctttcgcact

SEQ ID NO: 680985 - DNA, 20 bp, Artificial
  CRISPR gRNA sequence
acttgtctttcgcacttgtt

SEQ ID NO: 680986 - DNA, 20 bp, Artificial
  CRISPR gRNA sequence
gtctttcgcacttgtttcta

SEQ ID NO: 680987 - DNA, 20 bp, Artificial
  CRISPR gRNA sequence
tctttcgcacttgtttctac

SEQ ID NO: 680988 - DNA, 20 bp, Artificial
  CRISPR gRNA sequence
tcgcacttgtttctactctc

SEQ ID NO: 680989 - DNA, 20 bp, Artificial
  CRISPR gRNA sequence
cgcacttgtttctactctca

SEQ ID NO: 680990 - DNA, 20 bp, Artificial
  CRISPR gRNA sequence
gcacttgtttctactctcag

SEQ ID NO: 680991 - DNA, 20 bp, Artificial
  CRISPR gRNA sequence
gtttctactctcagccttat

SEQ ID NO: 680992 - DNA, 20 bp, Artificial
  CRISPR gRNA sequence
tttctactctcagccttatt

SEQ ID NO: 680993 - DNA, 20 bp, Artificial
  CRISPR gRNA sequence
ctactctcagccttattgaa

SEQ ID NO: 680994 - DNA, 20 bp, Artificial
  CRISPR gRNA sequence
tactctcagccttattgaag

SEQ ID NO: 680995 - DNA, 20 bp, Artificial
  CRISPR gRNA sequence
ctctcagccttattgaagta

SEQ ID NO: 680996 - DNA, 20 bp, Artificial
  CRISPR gRNA sequence
tcagccttattgaagtataa

SEQ ID NO: 680997 - DNA, 20 bp, Artificial
  CRISPR gRNA sequence
agccttattgaagtataagt

SEQ ID NO: 680998 - DNA, 20 bp, Artificial
  CRISPR gRNA sequence
attgaagtataagtaattcc

SEQ ID NO: 680999 - DNA, 20 bp, Artificial
  CRISPR gRNA sequence
ttgaagtataagtaattcct

SEQ ID NO: 681000 - DNA, 20 bp, Artificial
  CRISPR gRNA sequence
aagtataagtaattcctcct

SEQ ID NO: 681001 - DNA, 20 bp, Artificial
  CRISPR gRNA sequence
ctcctttataagtgatgccc

SEQ ID NO: 681002 - DNA, 20 bp, Artificial
  CRISPR gRNA sequence
ctttataagtgatgccctct

SEQ ID NO: 681003 - DNA, 20 bp, Artificial
  CRISPR gRNA sequence
tataagtgatgccctcttgc

SEQ ID NO: 681004 - DNA, 20 bp, Artificial
  CRISPR gRNA sequence
ataagtgatgccctcttgcc

SEQ ID NO: 681005 - DNA, 20 bp, Artificial
  CRISPR gRNA sequence
taagtgatgccctcttgcct

SEQ ID NO: 681006 - DNA, 20 bp, Artificial
  CRISPR gRNA sequence
ttgcctctgatcctttctac

SEQ ID NO: 681007 - DNA, 20 bp, Artificial
  CRISPR gRNA sequence
gcctctgatcctttctacca

SEQ ID NO: 681008 - DNA, 20 bp, Artificial
  CRISPR gRNA sequence
cctctgatcctttctaccag

SEQ ID NO: 681009 - DNA, 20 bp, Artificial
  CRISPR gRNA sequence
tgatcctttctaccagctac

SEQ ID NO: 681010 - DNA, 20 bp, Artificial
  CRISPR gRNA sequence
atcctttctaccagctactc

SEQ ID NO: 681011 - DNA, 20 bp, Artificial
  CRISPR gRNA sequence
tctaccagctactccacctc

SEQ ID NO: 681012 - DNA, 20 bp, Artificial
  CRISPR gRNA sequence
ctaccagctactccacctca

SEQ ID NO: 681013 - DNA, 20 bp, Artificial
  CRISPR gRNA sequence
taccagctactccacctcat

SEQ ID NO: 681014 - DNA, 20 bp, Artificial
  CRISPR gRNA sequence
ccagctactccacctcatgt

SEQ ID NO: 681015 - DNA, 20 bp, Artificial
  CRISPR gRNA sequence
ctccacctcatgtttcttca

SEQ ID NO: 681016 - DNA, 20 bp, Artificial
  CRISPR gRNA sequence
cacctcatgtttcttcactt

SEQ ID NO: 681017 - DNA, 20 bp, Artificial
  CRISPR gRNA sequence
atgtttcttcacttggctat

SEQ ID NO: 681018 - DNA, 20 bp, Artificial
  CRISPR gRNA sequence
cttcacttggctatgtttac

SEQ ID NO: 681019 - DNA, 20 bp, Artificial
  CRISPR gRNA sequence
ttcacttggctatgtttaca

SEQ ID NO: 681020 - DNA, 20 bp, Artificial
  CRISPR gRNA sequence
cacttggctatgtttacaat

SEQ ID NO: 681021 - DNA, 20 bp, Artificial
  CRISPR gRNA sequence
acttggctatgtttacaatc

SEQ ID NO: 681022 - DNA, 20 bp, Artificial
  CRISPR gRNA sequence
ggctatgtttacaatcacat

SEQ ID NO: 681023 - DNA, 20 bp, Artificial
  CRISPR gRNA sequence
gctatgtttacaatcacatt

SEQ ID NO: 681024 - DNA, 20 bp, Artificial
  CRISPR gRNA sequence
tgtttacaatcacattattg

SEQ ID NO: 681025 - DNA, 20 bp, Artificial
  CRISPR gRNA sequence
acaatcacattattgtcctt

SEQ ID NO: 681026 - DNA, 20 bp, Artificial
  CRISPR gRNA sequence
caatcacattattgtccttg

SEQ ID NO: 681027 - DNA, 20 bp, Artificial
  CRISPR gRNA sequence
ttgtccttgattccatttcc

SEQ ID NO: 681028 - DNA, 20 bp, Artificial
  CRISPR gRNA sequence
tccttgattccatttccttc

SEQ ID NO: 681029 - DNA, 20 bp, Artificial
  CRISPR gRNA sequence
gattccatttccttcaagaa

SEQ ID NO: 681030 - DNA, 20 bp, Artificial
  CRISPR gRNA sequence
attccatttccttcaagaag

SEQ ID NO: 681031 - DNA, 20 bp, Artificial
  CRISPR gRNA sequence
catttccttcaagaagtgtt

SEQ ID NO: 681032 - DNA, 20 bp, Artificial
  CRISPR gRNA sequence
ccttcaagaagtgttccttt

SEQ ID NO: 681033 - DNA, 20 bp, Artificial
  CRISPR gRNA sequence
cttcaagaagtgttccttta

SEQ ID NO: 681034 - DNA, 20 bp, Artificial
  CRISPR gRNA sequence
caagaagtgttcctttagtc

SEQ ID NO: 681035 - DNA, 20 bp, Artificial
  CRISPR gRNA sequence
aagaagtgttcctttagtcc

SEQ ID NO: 681036 - DNA, 20 bp, Artificial
  CRISPR gRNA sequence
ctttagtcccctggtatgag

SEQ ID NO: 681037 - DNA, 20 bp, Artificial
  CRISPR gRNA sequence
tagtcccctggtatgagcta

SEQ ID NO: 681038 - DNA, 20 bp, Artificial
  CRISPR gRNA sequence
agtcccctggtatgagctaa

SEQ ID NO: 681039 - DNA, 20 bp, Artificial
  CRISPR gRNA sequence
gtcccctggtatgagctaaa

SEQ ID NO: 681040 - DNA, 20 bp, Artificial
  CRISPR gRNA sequence
gtatgagctaaatattcctc

SEQ ID NO: 681041 - DNA, 20 bp, Artificial
  CRISPR gRNA sequence
aatattcctcttatttgacc

SEQ ID NO: 681042 - DNA, 20 bp, Artificial
  CRISPR gRNA sequence
ctcttatttgaccccatcac

SEQ ID NO: 681043 - DNA, 20 bp, Artificial
  CRISPR gRNA sequence
ttatttgaccccatcacaca

SEQ ID NO: 681044 - DNA, 20 bp, Artificial
  CRISPR gRNA sequence
atttgaccccatcacacata

SEQ ID NO: 681045 - DNA, 20 bp, Artificial
  CRISPR gRNA sequence
tttgaccccatcacacatac

SEQ ID NO: 681046 - DNA, 20 bp, Artificial
  CRISPR gRNA sequence
gaccccatcacacataccac

SEQ ID NO: 681047 - DNA, 20 bp, Artificial
  CRISPR gRNA sequence
accccatcacacataccaca

SEQ ID NO: 681048 - DNA, 20 bp, Artificial
  CRISPR gRNA sequence
tgttgtaaatgatccttaaa

SEQ ID NO: 681049 - DNA, 20 bp, Artificial
  CRISPR gRNA sequence
taaatgatccttaaattgct

SEQ ID NO: 681050 - DNA, 20 bp, Artificial
  CRISPR gRNA sequence
aaattgctattgttccttcc

SEQ ID NO: 681051 - DNA, 20 bp, Artificial
  CRISPR gRNA sequence
aattgctattgttccttcca

SEQ ID NO: 681052 - DNA, 20 bp, Artificial
  CRISPR gRNA sequence
ctattgttccttccaaactg

SEQ ID NO: 681053 - DNA, 20 bp, Artificial
  CRISPR gRNA sequence
ttgttccttccaaactgtaa

SEQ ID NO: 681054 - DNA, 20 bp, Artificial
  CRISPR gRNA sequence
ttccttccaaactgtaagtt

SEQ ID NO: 681055 - DNA, 20 bp, Artificial
  CRISPR gRNA sequence
cttccaaactgtaagttctt

SEQ ID NO: 681056 - DNA, 20 bp, Artificial
  CRISPR gRNA sequence
ccaaactgtaagttctttaa

SEQ ID NO: 681057 - DNA, 20 bp, Artificial
  CRISPR gRNA sequence
caaactgtaagttctttaag

SEQ ID NO: 681058 - DNA, 20 bp, Artificial
  CRISPR gRNA sequence
taagttctttaagaatatag

SEQ ID NO: 681059 - DNA, 20 bp, Artificial
  CRISPR gRNA sequence
tttaagaatatagatcaggt

SEQ ID NO: 681060 - DNA, 20 bp, Artificial
  CRISPR gRNA sequence
taagaatatagatcaggttt

SEQ ID NO: 681061 - DNA, 20 bp, Artificial
  CRISPR gRNA sequence
aagaatatagatcaggtttg

SEQ ID NO: 681062 - DNA, 20 bp, Artificial
  CRISPR gRNA sequence
agaatatagatcaggtttgt

SEQ ID NO: 681063 - DNA, 20 bp, Artificial
  CRISPR gRNA sequence
gtctagcttaatttggaaat

SEQ ID NO: 681064 - DNA, 20 bp, Artificial
  CRISPR gRNA sequence
tctagcttaatttggaaatg

SEQ ID NO: 681065 - DNA, 20 bp, Artificial
  CRISPR gRNA sequence
gcttaatttggaaatgtttg

SEQ ID NO: 681066 - DNA, 20 bp, Artificial
  CRISPR gRNA sequence
aatttggaaatgtttgacat

SEQ ID NO: 681067 - DNA, 20 bp, Artificial
  CRISPR gRNA sequence
atttggaaatgtttgacatt

SEQ ID NO: 681068 - DNA, 20 bp, Artificial
  CRISPR gRNA sequence
ggaaatgtttgacattgcat

SEQ ID NO: 681069 - DNA, 20 bp, Artificial
  CRISPR gRNA sequence
gaaatgtttgacattgcata

SEQ ID NO: 681070 - DNA, 20 bp, Artificial
  CRISPR gRNA sequence
gacattgcatatatcttaag

SEQ ID NO: 681071 - DNA, 20 bp, Artificial
  CRISPR gRNA sequence
acattgcatatatcttaagt

SEQ ID NO: 681072 - DNA, 20 bp, Artificial
  CRISPR gRNA sequence
catatatcttaagttgagtg

SEQ ID NO: 681073 - DNA, 20 bp, Artificial
  CRISPR gRNA sequence
aagttgagtgccatgaaata

SEQ ID NO: 681074 - DNA, 20 bp, Artificial
  CRISPR gRNA sequence
agttgagtgccatgaaataa

SEQ ID NO: 681075 - DNA, 20 bp, Artificial
  CRISPR gRNA sequence
agtgccatgaaataatttct

SEQ ID NO: 681076 - DNA, 20 bp, Artificial
  CRISPR gRNA sequence
ctcctcgttttgtgtttcca

SEQ ID NO: 681077 - DNA, 20 bp, Artificial
  CRISPR gRNA sequence
tcctcgttttgtgtttccat

SEQ ID NO: 681078 - DNA, 20 bp, Artificial
  CRISPR gRNA sequence
ctcgttttgtgtttccattt

SEQ ID NO: 681079 - DNA, 20 bp, Artificial
  CRISPR gRNA sequence
gttttgtgtttccatttttg

SEQ ID NO: 681080 - DNA, 20 bp, Artificial
  CRISPR gRNA sequence
tgtgtttccatttttgttac

SEQ ID NO: 681081 - DNA, 20 bp, Artificial
  CRISPR gRNA sequence
gtgtttccatttttgttact

SEQ ID NO: 681082 - DNA, 20 bp, Artificial
  CRISPR gRNA sequence
tgtttccatttttgttactc

SEQ ID NO: 681083 - DNA, 20 bp, Artificial
  CRISPR gRNA sequence
ccatttttgttactctaatc

SEQ ID NO: 681084 - DNA, 20 bp, Artificial
  CRISPR gRNA sequence
catttttgttactctaatca

SEQ ID NO: 681085 - DNA, 20 bp, Artificial
  CRISPR gRNA sequence
ttgttactctaatcattaca

SEQ ID NO: 681086 - DNA, 20 bp, Artificial
  CRISPR gRNA sequence
tgttactctaatcattacac

SEQ ID NO: 681087 - DNA, 20 bp, Artificial
  CRISPR gRNA sequence
gttactctaatcattacact

SEQ ID NO: 681088 - DNA, 20 bp, Artificial
  CRISPR gRNA sequence
ttactctaatcattacactg

SEQ ID NO: 681089 - DNA, 20 bp, Artificial
  CRISPR gRNA sequence
ctctaatcattacactgatc

SEQ ID NO: 681090 - DNA, 20 bp, Artificial
  CRISPR gRNA sequence
taatcattacactgatctca

SEQ ID NO: 681091 - DNA, 20 bp, Artificial
  CRISPR gRNA sequence
atcattacactgatctcacg

SEQ ID NO: 681092 - DNA, 20 bp, Artificial
  CRISPR gRNA sequence
cactgatctcacgtaggggc

SEQ ID NO: 681093 - DNA, 20 bp, Artificial
  CRISPR gRNA sequence
atctcacgtaggggccattt

SEQ ID NO: 681094 - DNA, 20 bp, Artificial
  CRISPR gRNA sequence
acgtaggggccatttcttcc

SEQ ID NO: 681095 - DNA, 20 bp, Artificial
  CRISPR gRNA sequence
cttccaatctgagagtatct

SEQ ID NO: 681096 - DNA, 20 bp, Artificial
  CRISPR gRNA sequence
ttccaatctgagagtatctg

SEQ ID NO: 681097 - DNA, 20 bp, Artificial
  CRISPR gRNA sequence
ccaatctgagagtatctgcc

SEQ ID NO: 681098 - DNA, 20 bp, Artificial
  CRISPR gRNA sequence
caatctgagagtatctgcca

SEQ ID NO: 681099 - DNA, 20 bp, Artificial
  CRISPR gRNA sequence
agagtatctgccaaaattac

SEQ ID NO: 681100 - DNA, 20 bp, Artificial
  CRISPR gRNA sequence
ccaaaattacaagttaagca

SEQ ID NO: 681101 - DNA, 20 bp, Artificial
  CRISPR gRNA sequence
caagttaagcatccatccac

SEQ ID NO: 681102 - DNA, 20 bp, Artificial
  CRISPR gRNA sequence
agcatccatccacaacaaca

SEQ ID NO: 681103 - DNA, 20 bp, Artificial
  CRISPR gRNA sequence
accatttatgggaaacccac

SEQ ID NO: 681104 - DNA, 20 bp, Artificial
  CRISPR gRNA sequence
atgggaaacccacatatgtt

SEQ ID NO: 681105 - DNA, 20 bp, Artificial
  CRISPR gRNA sequence
tgggaaacccacatatgttt

SEQ ID NO: 681106 - DNA, 20 bp, Artificial
  CRISPR gRNA sequence
ttaagaagcatttatctgta

SEQ ID NO: 681107 - DNA, 20 bp, Artificial
  CRISPR gRNA sequence
taagaagcatttatctgtaa

SEQ ID NO: 681108 - DNA, 20 bp, Artificial
  CRISPR gRNA sequence
aagaagcatttatctgtaag

SEQ ID NO: 681109 - DNA, 20 bp, Artificial
  CRISPR gRNA sequence
agaagcatttatctgtaaga

SEQ ID NO: 681110 - DNA, 20 bp, Artificial
  CRISPR gRNA sequence
atctgtaagatttacctatg

SEQ ID NO: 681111 - DNA, 20 bp, Artificial
  CRISPR gRNA sequence
tctgtaagatttacctatga

SEQ ID NO: 681112 - DNA, 20 bp, Artificial
  CRISPR gRNA sequence
taagatttacctatgaaagt

SEQ ID NO: 681113 - DNA, 20 bp, Artificial
  CRISPR gRNA sequence
acctatgaaagtaactggta

SEQ ID NO: 681114 - DNA, 20 bp, Artificial
  CRISPR gRNA sequence
cctatgaaagtaactggtaa

SEQ ID NO: 681115 - DNA, 20 bp, Artificial
  CRISPR gRNA sequence
tgaaagtaactggtaaatag

SEQ ID NO: 681116 - DNA, 20 bp, Artificial
  CRISPR gRNA sequence
gtaaatagagaccacattgt

SEQ ID NO: 681117 - DNA, 20 bp, Artificial
  CRISPR gRNA sequence
tcttagggacagaatttgta

SEQ ID NO: 681118 - DNA, 20 bp, Artificial
  CRISPR gRNA sequence
agggacagaatttgtaaaag

SEQ ID NO: 681119 - DNA, 20 bp, Artificial
  CRISPR gRNA sequence
gggacagaatttgtaaaaga

SEQ ID NO: 681120 - DNA, 20 bp, Artificial
  CRISPR gRNA sequence
gtaaaagactaaatattctg

SEQ ID NO: 681121 - DNA, 20 bp, Artificial
  CRISPR gRNA sequence
taaaagactaaatattctgt

SEQ ID NO: 681122 - DNA, 20 bp, Artificial
  CRISPR gRNA sequence
aatattctgttcaaaaccag

SEQ ID NO: 681123 - DNA, 20 bp, Artificial
  CRISPR gRNA sequence
tgttcaaaaccagcaatatc

SEQ ID NO: 681124 - DNA, 20 bp, Artificial
  CRISPR gRNA sequence
ttcaaaaccagcaatatctg

SEQ ID NO: 681125 - DNA, 20 bp, Artificial
  CRISPR gRNA sequence
aaaaccagcaatatctggct

SEQ ID NO: 681126 - DNA, 20 bp, Artificial
  CRISPR gRNA sequence
gctaaaaatcaaaactactt

SEQ ID NO: 681127 - DNA, 20 bp, Artificial
  CRISPR gRNA sequence
aaaatcaaaactacttttcc

SEQ ID NO: 681128 - DNA, 20 bp, Artificial
  CRISPR gRNA sequence
cttttcccgttgcaagcacc

SEQ ID NO: 681129 - DNA, 20 bp, Artificial
  CRISPR gRNA sequence
ttcccgttgcaagcaccaaa

SEQ ID NO: 681130 - DNA, 20 bp, Artificial
  CRISPR gRNA sequence
tcccgttgcaagcaccaaaa

SEQ ID NO: 681131 - DNA, 20 bp, Artificial
  CRISPR gRNA sequence
cccgttgcaagcaccaaaac

SEQ ID NO: 681132 - DNA, 20 bp, Artificial
  CRISPR gRNA sequence
ccgttgcaagcaccaaaact

SEQ ID NO: 681133 - DNA, 20 bp, Artificial
  CRISPR gRNA sequence
caagcaccaaaactctttta

SEQ ID NO: 681134 - DNA, 20 bp, Artificial
  CRISPR gRNA sequence
ttttatagttaacagtcaga

SEQ ID NO: 681135 - DNA, 20 bp, Artificial
  CRISPR gRNA sequence
ttatagttaacagtcagaca

SEQ ID NO: 681136 - DNA, 20 bp, Artificial
  CRISPR gRNA sequence
tatagttaacagtcagacat

SEQ ID NO: 681137 - DNA, 20 bp, Artificial
  CRISPR gRNA sequence
atagttaacagtcagacatt

SEQ ID NO: 681138 - DNA, 20 bp, Artificial
  CRISPR gRNA sequence
tagttaacagtcagacatta

SEQ ID NO: 681139 - DNA, 20 bp, Artificial
  CRISPR gRNA sequence
acagtcagacattatgttga

SEQ ID NO: 681140 - DNA, 20 bp, Artificial
  CRISPR gRNA sequence
tgttgatgtaaaatattgga

SEQ ID NO: 681141 - DNA, 20 bp, Artificial
  CRISPR gRNA sequence
atgtaaaatattggagtaaa

SEQ ID NO: 681142 - DNA, 20 bp, Artificial
  CRISPR gRNA sequence
gagtaaaattatatttgttg

SEQ ID NO: 681143 - DNA, 20 bp, Artificial
  CRISPR gRNA sequence
tatttgttgaggtgtatatt

SEQ ID NO: 681144 - DNA, 20 bp, Artificial
  CRISPR gRNA sequence
gttgaggtgtatatttaagg

SEQ ID NO: 681145 - DNA, 20 bp, Artificial
  CRISPR gRNA sequence
ttgaggtgtatatttaagga

SEQ ID NO: 681146 - DNA, 20 bp, Artificial
  CRISPR gRNA sequence
aggtgtatatttaaggaaaa

SEQ ID NO: 681147 - DNA, 20 bp, Artificial
  CRISPR gRNA sequence
aaggaaaaactgcaaacatg

SEQ ID NO: 681148 - DNA, 20 bp, Artificial
  CRISPR gRNA sequence
aggaaaaactgcaaacatgc

SEQ ID NO: 681149 - DNA, 20 bp, Artificial
  CRISPR gRNA sequence
caaacatgcttcaatcaaga

SEQ ID NO: 681150 - DNA, 20 bp, Artificial
  CRISPR gRNA sequence
caatcaagaaaaagtatggg

SEQ ID NO: 681151 - DNA, 20 bp, Artificial
  CRISPR gRNA sequence
aatcaagaaaaagtatggga

SEQ ID NO: 681152 - DNA, 20 bp, Artificial
  CRISPR gRNA sequence
gcaatgggtgtacgtaccag

SEQ ID NO: 681153 - DNA, 20 bp, Artificial
  CRISPR gRNA sequence
tcacatacacatgtctaaat

SEQ ID NO: 681154 - DNA, 20 bp, Artificial
  CRISPR gRNA sequence
aataagaaaggatgatataa

SEQ ID NO: 681155 - DNA, 20 bp, Artificial
  CRISPR gRNA sequence
atttcaagaagcaaaacaat

SEQ ID NO: 681156 - DNA, 20 bp, Artificial
  CRISPR gRNA sequence
caagaagcaaaacaatgaga

SEQ ID NO: 681157 - DNA, 20 bp, Artificial
  CRISPR gRNA sequence
aagaagcaaaacaatgagac

SEQ ID NO: 681158 - DNA, 20 bp, Artificial
  CRISPR gRNA sequence
tccgagtttatgagcaaata

SEQ ID NO: 681159 - DNA, 20 bp, Artificial
  CRISPR gRNA sequence
ccgagtttatgagcaaatac

SEQ ID NO: 681160 - DNA, 20 bp, Artificial
  CRISPR gRNA sequence
cgagtttatgagcaaatact

SEQ ID NO: 681161 - DNA, 20 bp, Artificial
  CRISPR gRNA sequence
atgagcaaatactttttgaa

SEQ ID NO: 681162 - DNA, 20 bp, Artificial
  CRISPR gRNA sequence
tgagcaaatactttttgaaa

SEQ ID NO: 681163 - DNA, 20 bp, Artificial
  CRISPR gRNA sequence
tttgaaataactcttaattt

SEQ ID NO: 681164 - DNA, 20 bp, Artificial
  CRISPR gRNA sequence
ttgaaataactcttaatttt

SEQ ID NO: 681165 - DNA, 20 bp, Artificial
  CRISPR gRNA sequence
tgaaataactcttaatttta

SEQ ID NO: 681166 - DNA, 20 bp, Artificial
  CRISPR gRNA sequence
gaaataactcttaattttat

SEQ ID NO: 681167 - DNA, 20 bp, Artificial
  CRISPR gRNA sequence
aaataactcttaattttatt

SEQ ID NO: 681168 - DNA, 20 bp, Artificial
  CRISPR gRNA sequence
ttaattttatttttaaataa

SEQ ID NO: 681169 - DNA, 20 bp, Artificial
  CRISPR gRNA sequence
aattttatttttaaataacc

SEQ ID NO: 681170 - DNA, 20 bp, Artificial
  CRISPR gRNA sequence
attttatttttaaataaccc

SEQ ID NO: 681171 - DNA, 20 bp, Artificial
  CRISPR gRNA sequence
tatttttaaataaccctaca

SEQ ID NO: 681172 - DNA, 20 bp, Artificial
  CRISPR gRNA sequence
atttttaaataaccctacat

SEQ ID NO: 681173 - DNA, 20 bp, Artificial
  CRISPR gRNA sequence
tttttaaataaccctacatt

SEQ ID NO: 681174 - DNA, 20 bp, Artificial
  CRISPR gRNA sequence
ttaaataaccctacatttca

SEQ ID NO: 681175 - DNA, 20 bp, Artificial
  CRISPR gRNA sequence
taaataaccctacatttcat

SEQ ID NO: 681176 - DNA, 20 bp, Artificial
  CRISPR gRNA sequence
aaataaccctacatttcatt

SEQ ID NO: 681177 - DNA, 20 bp, Artificial
  CRISPR gRNA sequence
aataaccctacatttcattc

SEQ ID NO: 681178 - DNA, 20 bp, Artificial
  CRISPR gRNA sequence
catttcattcatttttatta

SEQ ID NO: 681179 - DNA, 20 bp, Artificial
  CRISPR gRNA sequence
cattcatttttattaggtgg

SEQ ID NO: 681180 - DNA, 20 bp, Artificial
  CRISPR gRNA sequence
attcatttttattaggtggt

SEQ ID NO: 681181 - DNA, 20 bp, Artificial
  CRISPR gRNA sequence
atttttattaggtggtacta

SEQ ID NO: 681182 - DNA, 20 bp, Artificial
  CRISPR gRNA sequence
ttattaggtggtactacttt

SEQ ID NO: 681183 - DNA, 20 bp, Artificial
  CRISPR gRNA sequence
tattaggtggtactactttt

SEQ ID NO: 681184 - DNA, 20 bp, Artificial
  CRISPR gRNA sequence
attaggtggtactactttta

SEQ ID NO: 681185 - DNA, 20 bp, Artificial
  CRISPR gRNA sequence
ttaggtggtactacttttaa

SEQ ID NO: 681186 - DNA, 20 bp, Artificial
  CRISPR gRNA sequence
ggtggtactacttttaaaag

SEQ ID NO: 681187 - DNA, 20 bp, Artificial
  CRISPR gRNA sequence
cttttaaaagtattttaata

SEQ ID NO: 681188 - DNA, 20 bp, Artificial
  CRISPR gRNA sequence
ttaaaagtattttaataatg

SEQ ID NO: 681189 - DNA, 20 bp, Artificial
  CRISPR gRNA sequence
taaaagtattttaataatga

SEQ ID NO: 681190 - DNA, 20 bp, Artificial
  CRISPR gRNA sequence
aaaagtattttaataatgac

SEQ ID NO: 681191 - DNA, 20 bp, Artificial
  CRISPR gRNA sequence
aaagtattttaataatgact

SEQ ID NO: 681192 - DNA, 20 bp, Artificial
  CRISPR gRNA sequence
taataatgacttttaaaaaa

SEQ ID NO: 681193 - DNA, 20 bp, Artificial
  CRISPR gRNA sequence
aataatgacttttaaaaaat

SEQ ID NO: 681194 - DNA, 20 bp, Artificial
  CRISPR gRNA sequence
ataatgacttttaaaaaatc

SEQ ID NO: 681195 - DNA, 20 bp, Artificial
  CRISPR gRNA sequence
ttaaaaaatctccagaatga

SEQ ID NO: 681196 - DNA, 20 bp, Artificial
  CRISPR gRNA sequence
taaaaaatctccagaatgac

SEQ ID NO: 681197 - DNA, 20 bp, Artificial
  CRISPR gRNA sequence
aaaaaatctccagaatgaca

SEQ ID NO: 681198 - DNA, 20 bp, Artificial
  CRISPR gRNA sequence
aaaaatctccagaatgacat

SEQ ID NO: 681199 - DNA, 20 bp, Artificial
  CRISPR gRNA sequence
cagaatgacatatatgggtt

SEQ ID NO: 681200 - DNA, 20 bp, Artificial
  CRISPR gRNA sequence
tatatattttttctgaaata

SEQ ID NO: 681201 - DNA, 20 bp, Artificial
  CRISPR gRNA sequence
tttctgaaatagtggccgaa

SEQ ID NO: 681202 - DNA, 20 bp, Artificial
  CRISPR gRNA sequence
ttctgaaatagtggccgaat

SEQ ID NO: 681203 - DNA, 20 bp, Artificial
  CRISPR gRNA sequence
tctgaaatagtggccgaatc

SEQ ID NO: 681204 - DNA, 20 bp, Artificial
  CRISPR gRNA sequence
ctgaaatagtggccgaatca

SEQ ID NO: 681205 - DNA, 20 bp, Artificial
  CRISPR gRNA sequence
tgaaatagtggccgaatcaa

SEQ ID NO: 681206 - DNA, 20 bp, Artificial
  CRISPR gRNA sequence
aaatagtggccgaatcaacc

SEQ ID NO: 681207 - DNA, 20 bp, Artificial
  CRISPR gRNA sequence
aaccctacacaacagtgagg

SEQ ID NO: 681208 - DNA, 20 bp, Artificial
  CRISPR gRNA sequence
accctacacaacagtgaggt

SEQ ID NO: 681209 - DNA, 20 bp, Artificial
  CRISPR gRNA sequence
cacaacagtgaggtgccata

SEQ ID NO: 681210 - DNA, 20 bp, Artificial
  CRISPR gRNA sequence
taaccagatcactctcactt

SEQ ID NO: 681211 - DNA, 20 bp, Artificial
  CRISPR gRNA sequence
tcacttttatgatctttgta

SEQ ID NO: 681212 - DNA, 20 bp, Artificial
  CRISPR gRNA sequence
acttttatgatctttgtagc

SEQ ID NO: 681213 - DNA, 20 bp, Artificial
  CRISPR gRNA sequence
ttatgatctttgtagcttgg

SEQ ID NO: 681214 - DNA, 20 bp, Artificial
  CRISPR gRNA sequence
tatgatctttgtagcttggt

SEQ ID NO: 681215 - DNA, 20 bp, Artificial
  CRISPR gRNA sequence
atgatctttgtagcttggtc

SEQ ID NO: 681216 - DNA, 20 bp, Artificial
  CRISPR gRNA sequence
tgatctttgtagcttggtca

SEQ ID NO: 681217 - DNA, 20 bp, Artificial
  CRISPR gRNA sequence
tgtagcttggtcactaatgt

SEQ ID NO: 681218 - DNA, 20 bp, Artificial
  CRISPR gRNA sequence
gtagcttggtcactaatgtt

SEQ ID NO: 681219 - DNA, 20 bp, Artificial
  CRISPR gRNA sequence
tagcttggtcactaatgttt

SEQ ID NO: 681220 - DNA, 20 bp, Artificial
  CRISPR gRNA sequence
ggtcactaatgtttaaaata

SEQ ID NO: 681221 - DNA, 20 bp, Artificial
  CRISPR gRNA sequence
gtcactaatgtttaaaatat

SEQ ID NO: 681222 - DNA, 20 bp, Artificial
  CRISPR gRNA sequence
atgtttaaaatatgcaaaat

SEQ ID NO: 681223 - DNA, 20 bp, Artificial
  CRISPR gRNA sequence
aaaatatgcaaaatcaagca

SEQ ID NO: 681224 - DNA, 20 bp, Artificial
  CRISPR gRNA sequence
aaatatgcaaaatcaagcat

SEQ ID NO: 681225 - DNA, 20 bp, Artificial
  CRISPR gRNA sequence
tgacttgtttttactgggta

SEQ ID NO: 681226 - DNA, 20 bp, Artificial
  CRISPR gRNA sequence
acttgtttttactgggtatt

SEQ ID NO: 681227 - DNA, 20 bp, Artificial
  CRISPR gRNA sequence
gtttttactgggtattcttc

SEQ ID NO: 681228 - DNA, 20 bp, Artificial
  CRISPR gRNA sequence
tttttactgggtattcttcc

SEQ ID NO: 681229 - DNA, 20 bp, Artificial
  CRISPR gRNA sequence
ttactgggtattcttcctcc

SEQ ID NO: 681230 - DNA, 20 bp, Artificial
  CRISPR gRNA sequence
tactgggtattcttcctcct

SEQ ID NO: 681231 - DNA, 20 bp, Artificial
  CRISPR gRNA sequence
actgggtattcttcctccta

SEQ ID NO: 681232 - DNA, 20 bp, Artificial
  CRISPR gRNA sequence
ctgggtattcttcctcctat

SEQ ID NO: 681233 - DNA, 20 bp, Artificial
  CRISPR gRNA sequence
ggtattcttcctcctattct

SEQ ID NO: 681234 - DNA, 20 bp, Artificial
  CRISPR gRNA sequence
ttcctcctattctccttgag

SEQ ID NO: 681235 - DNA, 20 bp, Artificial
  CRISPR gRNA sequence
cctcctattctccttgagct

SEQ ID NO: 681236 - DNA, 20 bp, Artificial
  CRISPR gRNA sequence
ctcctattctccttgagctc

SEQ ID NO: 681237 - DNA, 20 bp, Artificial
  CRISPR gRNA sequence
ctattctccttgagctctat

SEQ ID NO: 681238 - DNA, 20 bp, Artificial
  CRISPR gRNA sequence
ttctccttgagctctattca

SEQ ID NO: 681239 - DNA, 20 bp, Artificial
  CRISPR gRNA sequence
tccttgagctctattcaagt

SEQ ID NO: 681240 - DNA, 20 bp, Artificial
  CRISPR gRNA sequence
cttgagctctattcaagtga

SEQ ID NO: 681241 - DNA, 20 bp, Artificial
  CRISPR gRNA sequence
gagctctattcaagtgagaa

SEQ ID NO: 681242 - DNA, 20 bp, Artificial
  CRISPR gRNA sequence
agctctattcaagtgagaat

SEQ ID NO: 681243 - DNA, 20 bp, Artificial
  CRISPR gRNA sequence
tattcaagtgagaattttaa

SEQ ID NO: 681244 - DNA, 20 bp, Artificial
  CRISPR gRNA sequence
ttcaagtgagaattttaaaa

SEQ ID NO: 681245 - DNA, 20 bp, Artificial
  CRISPR gRNA sequence
aagtgagaattttaaaagaa

SEQ ID NO: 681246 - DNA, 20 bp, Artificial
  CRISPR gRNA sequence
taaaagaaaatgaaaatatg

SEQ ID NO: 681247 - DNA, 20 bp, Artificial
  CRISPR gRNA sequence
aaaagaaaatgaaaatatga

SEQ ID NO: 681248 - DNA, 20 bp, Artificial
  CRISPR gRNA sequence
aaagaaaatgaaaatatgat

SEQ ID NO: 681249 - DNA, 20 bp, Artificial
  CRISPR gRNA sequence
aatcatatctttcagactag

SEQ ID NO: 681250 - DNA, 20 bp, Artificial
  CRISPR gRNA sequence
tcagactagatgcattctca

SEQ ID NO: 681251 - DNA, 20 bp, Artificial
  CRISPR gRNA sequence
cagactagatgcattctcat

SEQ ID NO: 681252 - DNA, 20 bp, Artificial
  CRISPR gRNA sequence
agactagatgcattctcatg

SEQ ID NO: 681253 - DNA, 20 bp, Artificial
  CRISPR gRNA sequence
gatgcattctcatgatggca

SEQ ID NO: 681254 - DNA, 20 bp, Artificial
  CRISPR gRNA sequence
tcatgatggcatcagaacaa

SEQ ID NO: 681255 - DNA, 20 bp, Artificial
  CRISPR gRNA sequence
atgatggcatcagaacaaat

SEQ ID NO: 681256 - DNA, 20 bp, Artificial
  CRISPR gRNA sequence
acaaaatttttattgctttt

SEQ ID NO: 681257 - DNA, 20 bp, Artificial
  CRISPR gRNA sequence
caaaatttttattgctttta

SEQ ID NO: 681258 - DNA, 20 bp, Artificial
  CRISPR gRNA sequence
ttattgcttttatatttttt

SEQ ID NO: 681259 - DNA, 20 bp, Artificial
  CRISPR gRNA sequence
tattgcttttatattttttt

SEQ ID NO: 681260 - DNA, 20 bp, Artificial
  CRISPR gRNA sequence
attgcttttatatttttttc

SEQ ID NO: 681261 - DNA, 20 bp, Artificial
  CRISPR gRNA sequence
ttgcttttatatttttttca

SEQ ID NO: 681262 - DNA, 20 bp, Artificial
  CRISPR gRNA sequence
cttttatatttttttcatgt

SEQ ID NO: 681263 - DNA, 20 bp, Artificial
  CRISPR gRNA sequence
ttatatttttttcatgtcaa

SEQ ID NO: 681264 - DNA, 20 bp, Artificial
  CRISPR gRNA sequence
tatatttttttcatgtcaag

SEQ ID NO: 681265 - DNA, 20 bp, Artificial
  CRISPR gRNA sequence
atatttttttcatgtcaaga

SEQ ID NO: 681266 - DNA, 20 bp, Artificial
  CRISPR gRNA sequence
tatttttttcatgtcaagaa

SEQ ID NO: 681267 - DNA, 20 bp, Artificial
  CRISPR gRNA sequence
ttttcatgtcaagaatattt

SEQ ID NO: 681268 - DNA, 20 bp, Artificial
  CRISPR gRNA sequence
tttcatgtcaagaatatttg

SEQ ID NO: 681269 - DNA, 20 bp, Artificial
  CRISPR gRNA sequence
ttcatgtcaagaatatttgt

SEQ ID NO: 681270 - DNA, 20 bp, Artificial
  CRISPR gRNA sequence
tcatgtcaagaatatttgtg

SEQ ID NO: 681271 - DNA, 20 bp, Artificial
  CRISPR gRNA sequence
catgtcaagaatatttgtgg

SEQ ID NO: 681272 - DNA, 20 bp, Artificial
  CRISPR gRNA sequence
atgtcaagaatatttgtggc

SEQ ID NO: 681273 - DNA, 20 bp, Artificial
  CRISPR gRNA sequence
gtggccagacccagtgtctc

SEQ ID NO: 681274 - DNA, 20 bp, Artificial
  CRISPR gRNA sequence
tggccagacccagtgtctca

SEQ ID NO: 681275 - DNA, 20 bp, Artificial
  CRISPR gRNA sequence
atgcctgtaatcgtaacact

SEQ ID NO: 681276 - DNA, 20 bp, Artificial
  CRISPR gRNA sequence
taatcgtaacactttgggag

SEQ ID NO: 681277 - DNA, 20 bp, Artificial
  CRISPR gRNA sequence
tgggaggccaaggtgggtgg

SEQ ID NO: 681278 - DNA, 20 bp, Artificial
  CRISPR gRNA sequence
gggaggccaaggtgggtgga

SEQ ID NO: 681279 - DNA, 20 bp, Artificial
  CRISPR gRNA sequence
ggaggccaaggtgggtggat

SEQ ID NO: 681280 - DNA, 20 bp, Artificial
  CRISPR gRNA sequence
gaggccaggagttctagacc

SEQ ID NO: 681281 - DNA, 20 bp, Artificial
  CRISPR gRNA sequence
aggccaggagttctagacca

SEQ ID NO: 681282 - DNA, 20 bp, Artificial
  CRISPR gRNA sequence
tagaccagcctggctaacag

SEQ ID NO: 681283 - DNA, 20 bp, Artificial
  CRISPR gRNA sequence
gaccagcctggctaacaggg

SEQ ID NO: 681284 - DNA, 20 bp, Artificial
  CRISPR gRNA sequence
gctaacagggcaaaacccta

SEQ ID NO: 681285 - DNA, 20 bp, Artificial
  CRISPR gRNA sequence
acagggcaaaaccctatctc

SEQ ID NO: 681286 - DNA, 20 bp, Artificial
  CRISPR gRNA sequence
tctctactaaaaatacaaaa

SEQ ID NO: 681287 - DNA, 20 bp, Artificial
  CRISPR gRNA sequence
tactaaaaatacaaaaatta

SEQ ID NO: 681288 - DNA, 20 bp, Artificial
  CRISPR gRNA sequence
ctaaaaatacaaaaattagc

SEQ ID NO: 681289 - DNA, 20 bp, Artificial
  CRISPR gRNA sequence
aaaatacaaaaattagccag

SEQ ID NO: 681290 - DNA, 20 bp, Artificial
  CRISPR gRNA sequence
gccaggtatgggggcgcatg

SEQ ID NO: 681291 - DNA, 20 bp, Artificial
  CRISPR gRNA sequence
taattccagctactcaggtg

SEQ ID NO: 681292 - DNA, 20 bp, Artificial
  CRISPR gRNA sequence
cagctactcaggtggctgag

SEQ ID NO: 681293 - DNA, 20 bp, Artificial
  CRISPR gRNA sequence
ctcaggtggctgaggcatga

SEQ ID NO: 681294 - DNA, 20 bp, Artificial
  CRISPR gRNA sequence
aggtggctgaggcatgagaa

SEQ ID NO: 681295 - DNA, 20 bp, Artificial
  CRISPR gRNA sequence
aggcatgagaatcccttgaa

SEQ ID NO: 681296 - DNA, 20 bp, Artificial
  CRISPR gRNA sequence
gaactggagaggtggaggtt

SEQ ID NO: 681297 - DNA, 20 bp, Artificial
  CRISPR gRNA sequence
aactggagaggtggaggttg

SEQ ID NO: 681298 - DNA, 20 bp, Artificial
  CRISPR gRNA sequence
gagaggtggaggttgcagtg

SEQ ID NO: 681299 - DNA, 20 bp, Artificial
  CRISPR gRNA sequence
cagtgagcagagatcacacc

SEQ ID NO: 681300 - DNA, 20 bp, Artificial
  CRISPR gRNA sequence
agactctgtctcaaaaaaaa

SEQ ID NO: 681301 - DNA, 20 bp, Artificial
  CRISPR gRNA sequence
tgtctcaaaaaaaaaaaaaa

SEQ ID NO: 681302 - DNA, 20 bp, Artificial
  CRISPR gRNA sequence
tctcaaaaaaaaaaaaaatg

SEQ ID NO: 681303 - DNA, 20 bp, Artificial
  CRISPR gRNA sequence
aaaaaaaaaaaaaatgtgtg

SEQ ID NO: 681304 - DNA, 20 bp, Artificial
  CRISPR gRNA sequence
cccaaatacttgacttatag

SEQ ID NO: 681305 - DNA, 20 bp, Artificial
  CRISPR gRNA sequence
gacttatagagtaatatata

SEQ ID NO: 681306 - DNA, 20 bp, Artificial
  CRISPR gRNA sequence
acttatagagtaatatatac

SEQ ID NO: 681307 - DNA, 20 bp, Artificial
  CRISPR gRNA sequence
atagagtaatatataccaaa

SEQ ID NO: 681308 - DNA, 20 bp, Artificial
  CRISPR gRNA sequence
tagagtaatatataccaaat

SEQ ID NO: 681309 - DNA, 20 bp, Artificial
  CRISPR gRNA sequence
tgaaaaatggaggcaatcag

SEQ ID NO: 681310 - DNA, 20 bp, Artificial
  CRISPR gRNA sequence
cgtaccctttcatattttta

SEQ ID NO: 681311 - DNA, 20 bp, Artificial
  CRISPR gRNA sequence
gtaccctttcatatttttaa

SEQ ID NO: 681312 - DNA, 20 bp, Artificial
  CRISPR gRNA sequence
tcatatttttaatctgatac

SEQ ID NO: 681313 - DNA, 20 bp, Artificial
  CRISPR gRNA sequence
catatttttaatctgatact

SEQ ID NO: 681314 - DNA, 20 bp, Artificial
  CRISPR gRNA sequence
atatttttaatctgatacta

SEQ ID NO: 681315 - DNA, 20 bp, Artificial
  CRISPR gRNA sequence
ttaatctgatactaatgttg

SEQ ID NO: 681316 - DNA, 20 bp, Artificial
  CRISPR gRNA sequence
taatctgatactaatgttgt

SEQ ID NO: 681317 - DNA, 20 bp, Artificial
  CRISPR gRNA sequence
aatctgatactaatgttgtt

SEQ ID NO: 681318 - DNA, 20 bp, Artificial
  CRISPR gRNA sequence
atctgatactaatgttgttg

SEQ ID NO: 681319 - DNA, 20 bp, Artificial
  CRISPR gRNA sequence
atactaatgttgttgtattt

SEQ ID NO: 681320 - DNA, 20 bp, Artificial
  CRISPR gRNA sequence
atgttgttgtattttttttt

SEQ ID NO: 681321 - DNA, 20 bp, Artificial
  CRISPR gRNA sequence
ttgtattttttttttttttt

SEQ ID NO: 681322 - DNA, 20 bp, Artificial
  CRISPR gRNA sequence
tattttttttttttttttac

SEQ ID NO: 681323 - DNA, 20 bp, Artificial
  CRISPR gRNA sequence
tttttttttttttacttctt

SEQ ID NO: 681324 - DNA, 20 bp, Artificial
  CRISPR gRNA sequence
ttttttttttttacttcttt

SEQ ID NO: 681325 - DNA, 20 bp, Artificial
  CRISPR gRNA sequence
tttttttttttacttctttc

SEQ ID NO: 681326 - DNA, 20 bp, Artificial
  CRISPR gRNA sequence
ttttttttttacttctttca

SEQ ID NO: 681327 - DNA, 20 bp, Artificial
  CRISPR gRNA sequence
tttttttttacttctttcac

SEQ ID NO: 681328 - DNA, 20 bp, Artificial
  CRISPR gRNA sequence
ttttttttacttctttcacc

SEQ ID NO: 681329 - DNA, 20 bp, Artificial
  CRISPR gRNA sequence
tttttttacttctttcacct

SEQ ID NO: 681330 - DNA, 20 bp, Artificial
  CRISPR gRNA sequence
ttttttacttctttcacctc

SEQ ID NO: 681331 - DNA, 20 bp, Artificial
  CRISPR gRNA sequence
tttttacttctttcacctcc

SEQ ID NO: 681332 - DNA, 20 bp, Artificial
  CRISPR gRNA sequence
ttttacttctttcacctccc

SEQ ID NO: 681333 - DNA, 20 bp, Artificial
  CRISPR gRNA sequence
tttacttctttcacctccca

SEQ ID NO: 681334 - DNA, 20 bp, Artificial
  CRISPR gRNA sequence
ttacttctttcacctcccac

SEQ ID NO: 681335 - DNA, 20 bp, Artificial
  CRISPR gRNA sequence
tacttctttcacctcccact

SEQ ID NO: 681336 - DNA, 20 bp, Artificial
  CRISPR gRNA sequence
acttctttcacctcccactc

SEQ ID NO: 681337 - DNA, 20 bp, Artificial
  CRISPR gRNA sequence
cttctttcacctcccactcc

SEQ ID NO: 681338 - DNA, 20 bp, Artificial
  CRISPR gRNA sequence
ctttcacctcccactccctt

SEQ ID NO: 681339 - DNA, 20 bp, Artificial
  CRISPR gRNA sequence
tttcacctcccactcccttc

SEQ ID NO: 681340 - DNA, 20 bp, Artificial
  CRISPR gRNA sequence
tcacctcccactcccttcca

SEQ ID NO: 681341 - DNA, 20 bp, Artificial
  CRISPR gRNA sequence
cacctcccactcccttccag

SEQ ID NO: 681342 - DNA, 20 bp, Artificial
  CRISPR gRNA sequence
acctcccactcccttccagg

SEQ ID NO: 681343 - DNA, 20 bp, Artificial
  CRISPR gRNA sequence
ccactcccttccaggggaaa

SEQ ID NO: 681344 - DNA, 20 bp, Artificial
  CRISPR gRNA sequence
ccttccaggggaaaagctca

SEQ ID NO: 681345 - DNA, 20 bp, Artificial
  CRISPR gRNA sequence
ccaggggaaaagctcatgcg

SEQ ID NO: 681346 - DNA, 20 bp, Artificial
  CRISPR gRNA sequence
caggggaaaagctcatgcga

SEQ ID NO: 681347 - DNA, 20 bp, Artificial
  CRISPR gRNA sequence
atgcgattcagctacccaga

SEQ ID NO: 681348 - DNA, 20 bp, Artificial
  CRISPR gRNA sequence
agctacccagatattcactt

SEQ ID NO: 681349 - DNA, 20 bp, Artificial
  CRISPR gRNA sequence
cccagatattcactttgata

SEQ ID NO: 681350 - DNA, 20 bp, Artificial
  CRISPR gRNA sequence
actttgatatgaacttaaca

SEQ ID NO: 681351 - DNA, 20 bp, Artificial
  CRISPR gRNA sequence
tgatatgaacttaacatatg

SEQ ID NO: 681352 - DNA, 20 bp, Artificial
  CRISPR gRNA sequence
gatatgaacttaacatatga

SEQ ID NO: 681353 - DNA, 20 bp, Artificial
  CRISPR gRNA sequence
atatgaacttaacatatgag

SEQ ID NO: 681354 - DNA, 20 bp, Artificial
  CRISPR gRNA sequence
aacatatgagaaggaggctg

SEQ ID NO: 681355 - DNA, 20 bp, Artificial
  CRISPR gRNA sequence
acatatgagaaggaggctga

SEQ ID NO: 681356 - DNA, 20 bp, Artificial
  CRISPR gRNA sequence
agctgatgcagtctcatatg

SEQ ID NO: 681357 - DNA, 20 bp, Artificial
  CRISPR gRNA sequence
atgcagtctcatatgatgga

SEQ ID NO: 681358 - DNA, 20 bp, Artificial
  CRISPR gRNA sequence
atatgatggaccaagccatc

SEQ ID NO: 681359 - DNA, 20 bp, Artificial
  CRISPR gRNA sequence
ccttggagctgaggcccttc

SEQ ID NO: 681360 - DNA, 20 bp, Artificial
  CRISPR gRNA sequence
ggagctgaggcccttcaccc

SEQ ID NO: 681361 - DNA, 20 bp, Artificial
  CRISPR gRNA sequence
gagctgaggcccttcaccct

SEQ ID NO: 681362 - DNA, 20 bp, Artificial
  CRISPR gRNA sequence
aggcccttcaccctctgatg

SEQ ID NO: 681363 - DNA, 20 bp, Artificial
  CRISPR gRNA sequence
caccctctgatgcagcaccc

SEQ ID NO: 681364 - DNA, 20 bp, Artificial
  CRISPR gRNA sequence
accctctgatgcagcacccg

SEQ ID NO: 681365 - DNA, 20 bp, Artificial
  CRISPR gRNA sequence
tgatgcagcacccgccaagc

SEQ ID NO: 681366 - DNA, 20 bp, Artificial
  CRISPR gRNA sequence
atgcagcacccgccaagcac

SEQ ID NO: 681367 - DNA, 20 bp, Artificial
  CRISPR gRNA sequence
aagtggccccagttataagc

SEQ ID NO: 681368 - DNA, 20 bp, Artificial
  CRISPR gRNA sequence
taagctcagcttattctcag

SEQ ID NO: 681369 - DNA, 20 bp, Artificial
  CRISPR gRNA sequence
agcttattctcaggtctatc

SEQ ID NO: 681370 - DNA, 20 bp, Artificial
  CRISPR gRNA sequence
attctcaggtctatcatcca

SEQ ID NO: 681371 - DNA, 20 bp, Artificial
  CRISPR gRNA sequence
ttctcaggtctatcatccaa

SEQ ID NO: 681372 - DNA, 20 bp, Artificial
  CRISPR gRNA sequence
tcaggtctatcatccaaata

SEQ ID NO: 681373 - DNA, 20 bp, Artificial
  CRISPR gRNA sequence
aggtctatcatccaaatagg

SEQ ID NO: 681374 - DNA, 20 bp, Artificial
  CRISPR gRNA sequence
tcatccaaataggatagaaa

SEQ ID NO: 681375 - DNA, 20 bp, Artificial
  CRISPR gRNA sequence
gcagggaaactgctgatagt

SEQ ID NO: 681376 - DNA, 20 bp, Artificial
  CRISPR gRNA sequence
ctgatagtcatgaaaacaac

SEQ ID NO: 681377 - DNA, 20 bp, Artificial
  CRISPR gRNA sequence
atagtcatgaaaacaacatg

SEQ ID NO: 681378 - DNA, 20 bp, Artificial
  CRISPR gRNA sequence
tctcatcagaccaaagagtc

SEQ ID NO: 681379 - DNA, 20 bp, Artificial
  CRISPR gRNA sequence
tcatcagaccaaagagtcga

SEQ ID NO: 681380 - DNA, 20 bp, Artificial
  CRISPR gRNA sequence
atcagaccaaagagtcgacc

SEQ ID NO: 681381 - DNA, 20 bp, Artificial
  CRISPR gRNA sequence
tcccagcaatagctgcctgg

SEQ ID NO: 681382 - DNA, 20 bp, Artificial
  CRISPR gRNA sequence
ccagcaatagctgcctggat

SEQ ID NO: 681383 - DNA, 20 bp, Artificial
  CRISPR gRNA sequence
cctggattccactgactcag

SEQ ID NO: 681384 - DNA, 20 bp, Artificial
  CRISPR gRNA sequence
gattccactgactcagaaag

SEQ ID NO: 681385 - DNA, 20 bp, Artificial
  CRISPR gRNA sequence
cactgactcagaaagcagcc

SEQ ID NO: 681386 - DNA, 20 bp, Artificial
  CRISPR gRNA sequence
actcagaaagcagccatgat

SEQ ID NO: 681387 - DNA, 20 bp, Artificial
  CRISPR gRNA sequence
agaaagcagccatgatgacc

SEQ ID NO: 681388 - DNA, 20 bp, Artificial
  CRISPR gRNA sequence
ccaaggacaccctgccttaa

SEQ ID NO: 681389 - DNA, 20 bp, Artificial
  CRISPR gRNA sequence
ccttaaatcccaagaggaaa

SEQ ID NO: 681390 - DNA, 20 bp, Artificial
  CRISPR gRNA sequence
aaatcccaagaggaaacaaa

SEQ ID NO: 681391 - DNA, 20 bp, Artificial
  CRISPR gRNA sequence
aatcccaagaggaaacaaag

SEQ ID NO: 681392 - DNA, 20 bp, Artificial
  CRISPR gRNA sequence
acatgaaggaggatgtcaaa

SEQ ID NO: 681393 - DNA, 20 bp, Artificial
  CRISPR gRNA sequence
catgaaggaggatgtcaaag

SEQ ID NO: 681394 - DNA, 20 bp, Artificial
  CRISPR gRNA sequence
tggatactaccaaggctcct

SEQ ID NO: 681395 - DNA, 20 bp, Artificial
  CRISPR gRNA sequence
ggatactaccaaggctccta

SEQ ID NO: 681396 - DNA, 20 bp, Artificial
  CRISPR gRNA sequence
gatactaccaaggctcctaa

SEQ ID NO: 681397 - DNA, 20 bp, Artificial
  CRISPR gRNA sequence
ccaaggctcctaagggctct

SEQ ID NO: 681398 - DNA, 20 bp, Artificial
  CRISPR gRNA sequence
ctaagggctctctgaaggac

SEQ ID NO: 681399 - DNA, 20 bp, Artificial
  CRISPR gRNA sequence
agggctctctgaaggacatc

SEQ ID NO: 681400 - DNA, 20 bp, Artificial
  CRISPR gRNA sequence
tctgaaggacatctacaagg

SEQ ID NO: 681401 - DNA, 20 bp, Artificial
  CRISPR gRNA sequence
tgaaggacatctacaaggtc

SEQ ID NO: 681402 - DNA, 20 bp, Artificial
  CRISPR gRNA sequence
aaggacatctacaaggtctt

SEQ ID NO: 681403 - DNA, 20 bp, Artificial
  CRISPR gRNA sequence
caaggtcttcaatggagaag

SEQ ID NO: 681404 - DNA, 20 bp, Artificial
  CRISPR gRNA sequence
caatggagaaggagaacaga

SEQ ID NO: 681405 - DNA, 20 bp, Artificial
  CRISPR gRNA sequence
aatggagaaggagaacagat

SEQ ID NO: 681406 - DNA, 20 bp, Artificial
  CRISPR gRNA sequence
gggccttcaagtgtgagcac

SEQ ID NO: 681407 - DNA, 20 bp, Artificial
  CRISPR gRNA sequence
caagtgtgagcactgccgag

SEQ ID NO: 681408 - DNA, 20 bp, Artificial
  CRISPR gRNA sequence
aagtgtgagcactgccgagt

SEQ ID NO: 681409 - DNA, 20 bp, Artificial
  CRISPR gRNA sequence
ccgagtccttttcctagacc

SEQ ID NO: 681410 - DNA, 20 bp, Artificial
  CRISPR gRNA sequence
ttcctagaccatgtcatgta

SEQ ID NO: 681411 - DNA, 20 bp, Artificial
  CRISPR gRNA sequence
tcctagaccatgtcatgtac

SEQ ID NO: 681412 - DNA, 20 bp, Artificial
  CRISPR gRNA sequence
cctagaccatgtcatgtaca

SEQ ID NO: 681413 - DNA, 20 bp, Artificial
  CRISPR gRNA sequence
ctagaccatgtcatgtacac

SEQ ID NO: 681414 - DNA, 20 bp, Artificial
  CRISPR gRNA sequence
gaccatgtcatgtacaccat

SEQ ID NO: 681415 - DNA, 20 bp, Artificial
  CRISPR gRNA sequence
acatgggttgccatggctac

SEQ ID NO: 681416 - DNA, 20 bp, Artificial
  CRISPR gRNA sequence
ccatggctaccgggacccac

SEQ ID NO: 681417 - DNA, 20 bp, Artificial
  CRISPR gRNA sequence
ccgggacccactggaatgca

SEQ ID NO: 681418 - DNA, 20 bp, Artificial
  CRISPR gRNA sequence
gaatgcaacatctgtggcta

SEQ ID NO: 681419 - DNA, 20 bp, Artificial
  CRISPR gRNA sequence
tggctacagaagccaggacc

SEQ ID NO: 681420 - DNA, 20 bp, Artificial
  CRISPR gRNA sequence
cagaagccaggaccgttatg

SEQ ID NO: 681421 - DNA, 20 bp, Artificial
  CRISPR gRNA sequence
tgagttttcatcacacattg

SEQ ID NO: 681422 - DNA, 20 bp, Artificial
  CRISPR gRNA sequence
tcatcacacattgttcgagg

SEQ ID NO: 681423 - DNA, 20 bp, Artificial
  CRISPR gRNA sequence
catcacacattgttcgaggg

SEQ ID NO: 681424 - DNA, 20 bp, Artificial
  CRISPR gRNA sequence
atcacacattgttcgagggg

SEQ ID NO: 681425 - DNA, 20 bp, Artificial
  CRISPR gRNA sequence
ttcgaggggagcacacattc

SEQ ID NO: 681426 - DNA, 20 bp, Artificial
  CRISPR gRNA sequence
gaggggagcacacattccac

SEQ ID NO: 681427 - DNA, 20 bp, Artificial
  CRISPR gRNA sequence
cactaggccttttcattcca

SEQ ID NO: 681428 - DNA, 20 bp, Artificial
  CRISPR gRNA sequence
ggccttttcattccaaaggg

SEQ ID NO: 681429 - DNA, 20 bp, Artificial
  CRISPR gRNA sequence
ttcattccaaaggggacccc

SEQ ID NO: 681430 - DNA, 20 bp, Artificial
  CRISPR gRNA sequence
tcattccaaaggggacccct

SEQ ID NO: 681431 - DNA, 20 bp, Artificial
  CRISPR gRNA sequence
cattccaaaggggaccccta

SEQ ID NO: 681432 - DNA, 20 bp, Artificial
  CRISPR gRNA sequence
attccaaaggggacccctat

SEQ ID NO: 681433 - DNA, 20 bp, Artificial
  CRISPR gRNA sequence
caaaggggacccctatgaag

SEQ ID NO: 681434 - DNA, 20 bp, Artificial
  CRISPR gRNA sequence
tgaagtaaagaactgcacat

SEQ ID NO: 681435 - DNA, 20 bp, Artificial
  CRISPR gRNA sequence
cacatgaagaaatactgcac

SEQ ID NO: 681436 - DNA, 20 bp, Artificial
  CRISPR gRNA sequence
cacttacaatcccacctttc

SEQ ID NO: 681437 - DNA, 20 bp, Artificial
  CRISPR gRNA sequence
acaatcccacctttcctcaa

SEQ ID NO: 681438 - DNA, 20 bp, Artificial
  CRISPR gRNA sequence
caatcccacctttcctcaaa

SEQ ID NO: 681439 - DNA, 20 bp, Artificial
  CRISPR gRNA sequence
tcctcaaatgttgacatacc

SEQ ID NO: 681440 - DNA, 20 bp, Artificial
  CRISPR gRNA sequence
cctcaaatgttgacatacct

SEQ ID NO: 681441 - DNA, 20 bp, Artificial
  CRISPR gRNA sequence
ctcaaatgttgacatacctt

SEQ ID NO: 681442 - DNA, 20 bp, Artificial
  CRISPR gRNA sequence
aaatgttgacatacctttta

SEQ ID NO: 681443 - DNA, 20 bp, Artificial
  CRISPR gRNA sequence
acataccttttatttttttt

SEQ ID NO: 681444 - DNA, 20 bp, Artificial
  CRISPR gRNA sequence
ttattttttttaatattatt

SEQ ID NO: 681445 - DNA, 20 bp, Artificial
  CRISPR gRNA sequence
tattttttttaatattatta

SEQ ID NO: 681446 - DNA, 20 bp, Artificial
  CRISPR gRNA sequence
attttttttaatattattac

SEQ ID NO: 681447 - DNA, 20 bp, Artificial
  CRISPR gRNA sequence
ttttttttaatattattact

SEQ ID NO: 681448 - DNA, 20 bp, Artificial
  CRISPR gRNA sequence
tttttaatattattactgtt

SEQ ID NO: 681449 - DNA, 20 bp, Artificial
  CRISPR gRNA sequence
ttttaatattattactgttg

SEQ ID NO: 681450 - DNA, 20 bp, Artificial
  CRISPR gRNA sequence
tttaatattattactgttga

SEQ ID NO: 681451 - DNA, 20 bp, Artificial
  CRISPR gRNA sequence
ttaatattattactgttgat

SEQ ID NO: 681452 - DNA, 20 bp, Artificial
  CRISPR gRNA sequence
taatattattactgttgata

SEQ ID NO: 681453 - DNA, 20 bp, Artificial
  CRISPR gRNA sequence
aatattattactgttgataa

SEQ ID NO: 681454 - DNA, 20 bp, Artificial
  CRISPR gRNA sequence
atattattactgttgataat

SEQ ID NO: 681455 - DNA, 20 bp, Artificial
  CRISPR gRNA sequence
ttactgttgataattcttat

SEQ ID NO: 681456 - DNA, 20 bp, Artificial
  CRISPR gRNA sequence
ctgttgataattcttatttt

SEQ ID NO: 681457 - DNA, 20 bp, Artificial
  CRISPR gRNA sequence
ttgataattcttattttgtg

SEQ ID NO: 681458 - DNA, 20 bp, Artificial
  CRISPR gRNA sequence
ataattcttattttgtggag

SEQ ID NO: 681459 - DNA, 20 bp, Artificial
  CRISPR gRNA sequence
ttattttgtggaggcagtgt

SEQ ID NO: 681460 - DNA, 20 bp, Artificial
  CRISPR gRNA sequence
attttgtggaggcagtgtca

SEQ ID NO: 681461 - DNA, 20 bp, Artificial
  CRISPR gRNA sequence
ttttgtggaggcagtgtcat

SEQ ID NO: 681462 - DNA, 20 bp, Artificial
  CRISPR gRNA sequence
tgtggaggcagtgtcatttg

SEQ ID NO: 681463 - DNA, 20 bp, Artificial
  CRISPR gRNA sequence
gtggaggcagtgtcatttgc

SEQ ID NO: 681464 - DNA, 20 bp, Artificial
  CRISPR gRNA sequence
tggaggcagtgtcatttgct

SEQ ID NO: 681465 - DNA, 20 bp, Artificial
  CRISPR gRNA sequence
gctctgcctaattacgataa

SEQ ID NO: 681466 - DNA, 20 bp, Artificial
  CRISPR gRNA sequence
ctctgcctaattacgataag

SEQ ID NO: 681467 - DNA, 20 bp, Artificial
  CRISPR gRNA sequence
tgcctaattacgataaggaa

SEQ ID NO: 681468 - DNA, 20 bp, Artificial
  CRISPR gRNA sequence
cctaattacgataaggaaga

SEQ ID NO: 681469 - DNA, 20 bp, Artificial
  CRISPR gRNA sequence
attacgataaggaagaaaca

SEQ ID NO: 681470 - DNA, 20 bp, Artificial
  CRISPR gRNA sequence
cgataaggaagaaacagaag

SEQ ID NO: 681471 - DNA, 20 bp, Artificial
  CRISPR gRNA sequence
tttctttatcacctggcttg

SEQ ID NO: 681472 - DNA, 20 bp, Artificial
  CRISPR gRNA sequence
ctttatcacctggcttgttt

SEQ ID NO: 681473 - DNA, 20 bp, Artificial
  CRISPR gRNA sequence
tttatcacctggcttgttta

SEQ ID NO: 681474 - DNA, 20 bp, Artificial
  CRISPR gRNA sequence
tatcacctggcttgtttatt

SEQ ID NO: 681475 - DNA, 20 bp, Artificial
  CRISPR gRNA sequence
atcacctggcttgtttattt

SEQ ID NO: 681476 - DNA, 20 bp, Artificial
  CRISPR gRNA sequence
tcacctggcttgtttatttt

SEQ ID NO: 681477 - DNA, 20 bp, Artificial
  CRISPR gRNA sequence
gcttgtttattttgtgggaa

SEQ ID NO: 681478 - DNA, 20 bp, Artificial
  CRISPR gRNA sequence
gtttattttgtgggaattta

SEQ ID NO: 681479 - DNA, 20 bp, Artificial
  CRISPR gRNA sequence
tttattttgtgggaatttaa

SEQ ID NO: 681480 - DNA, 20 bp, Artificial
  CRISPR gRNA sequence
attttgtgggaatttaagag

SEQ ID NO: 681481 - DNA, 20 bp, Artificial
  CRISPR gRNA sequence
ttttgtgggaatttaagagc

SEQ ID NO: 681482 - DNA, 20 bp, Artificial
  CRISPR gRNA sequence
tgtgggaatttaagagcagt

SEQ ID NO: 681483 - DNA, 20 bp, Artificial
  CRISPR gRNA sequence
gtgggaatttaagagcagtc

SEQ ID NO: 681484 - DNA, 20 bp, Artificial
  CRISPR gRNA sequence
tgggaatttaagagcagtcc

SEQ ID NO: 681485 - DNA, 20 bp, Artificial
  CRISPR gRNA sequence
aagagcagtccatttctacc

SEQ ID NO: 681486 - DNA, 20 bp, Artificial
  CRISPR gRNA sequence
agagcagtccatttctacca

SEQ ID NO: 681487 - DNA, 20 bp, Artificial
  CRISPR gRNA sequence
ctaccaaggcatatcatgct

SEQ ID NO: 681488 - DNA, 20 bp, Artificial
  CRISPR gRNA sequence
taccaaggcatatcatgctt

SEQ ID NO: 681489 - DNA, 20 bp, Artificial
  CRISPR gRNA sequence
ccaaggcatatcatgctttg

SEQ ID NO: 681490 - DNA, 20 bp, Artificial
  CRISPR gRNA sequence
tgaaaaatcacttgattcat

SEQ ID NO: 681491 - DNA, 20 bp, Artificial
  CRISPR gRNA sequence
gaaaaatcacttgattcata

SEQ ID NO: 681492 - DNA, 20 bp, Artificial
  CRISPR gRNA sequence
aaaaatcacttgattcataa

SEQ ID NO: 681493 - DNA, 20 bp, Artificial
  CRISPR gRNA sequence
gattcataaagattcaccta

SEQ ID NO: 681494 - DNA, 20 bp, Artificial
  CRISPR gRNA sequence
attcataaagattcacctaa

SEQ ID NO: 681495 - DNA, 20 bp, Artificial
  CRISPR gRNA sequence
ataaagattcacctaagaga

SEQ ID NO: 681496 - DNA, 20 bp, Artificial
  CRISPR gRNA sequence
acctaagagattctgatttg

SEQ ID NO: 681497 - DNA, 20 bp, Artificial
  CRISPR gRNA sequence
agagattctgatttgccact

SEQ ID NO: 681498 - DNA, 20 bp, Artificial
  CRISPR gRNA sequence
tgatttgccactgatattca

SEQ ID NO: 681499 - DNA, 20 bp, Artificial
  CRISPR gRNA sequence
atttgccactgatattcaga

SEQ ID NO: 681500 - DNA, 20 bp, Artificial
  CRISPR gRNA sequence
gccactgatattcagaatta

SEQ ID NO: 681501 - DNA, 20 bp, Artificial
  CRISPR gRNA sequence
ccactgatattcagaattat

SEQ ID NO: 681502 - DNA, 20 bp, Artificial
  CRISPR gRNA sequence
atattcagaattatgatgga

SEQ ID NO: 681503 - DNA, 20 bp, Artificial
  CRISPR gRNA sequence
agaattatgatggaagacag

SEQ ID NO: 681504 - DNA, 20 bp, Artificial
  CRISPR gRNA sequence
tgatggaagacaggaaagtt

SEQ ID NO: 681505 - DNA, 20 bp, Artificial
  CRISPR gRNA sequence
agagttttctgggtaggact

SEQ ID NO: 681506 - DNA, 20 bp, Artificial
  CRISPR gRNA sequence
tctgggtaggactttggtgg

SEQ ID NO: 681507 - DNA, 20 bp, Artificial
  CRISPR gRNA sequence
ctgggtaggactttggtggt

SEQ ID NO: 681508 - DNA, 20 bp, Artificial
  CRISPR gRNA sequence
tgggtaggactttggtggtt

SEQ ID NO: 681509 - DNA, 20 bp, Artificial
  CRISPR gRNA sequence
ggtaggactttggtggttta

SEQ ID NO: 681510 - DNA, 20 bp, Artificial
  CRISPR gRNA sequence
tggtggtttaaaaatggtat

SEQ ID NO: 681511 - DNA, 20 bp, Artificial
  CRISPR gRNA sequence
ggtggtttaaaaatggtata

SEQ ID NO: 681512 - DNA, 20 bp, Artificial
  CRISPR gRNA sequence
gtggtttaaaaatggtataa

SEQ ID NO: 681513 - DNA, 20 bp, Artificial
  CRISPR gRNA sequence
aaaaatggtataagtaactt

SEQ ID NO: 681514 - DNA, 20 bp, Artificial
  CRISPR gRNA sequence
aaaatggtataagtaacttt

SEQ ID NO: 681515 - DNA, 20 bp, Artificial
  CRISPR gRNA sequence
tattcttgaaagaagaatgt

SEQ ID NO: 681516 - DNA, 20 bp, Artificial
  CRISPR gRNA sequence
attcttgaaagaagaatgtg

SEQ ID NO: 681517 - DNA, 20 bp, Artificial
  CRISPR gRNA sequence
ttcttgaaagaagaatgtgt

SEQ ID NO: 681518 - DNA, 20 bp, Artificial
  CRISPR gRNA sequence
ttgaaagaagaatgtgtttc

SEQ ID NO: 681519 - DNA, 20 bp, Artificial
  CRISPR gRNA sequence
gaaagaagaatgtgtttcaa

SEQ ID NO: 681520 - DNA, 20 bp, Artificial
  CRISPR gRNA sequence
aaagaagaatgtgtttcaaa

SEQ ID NO: 681521 - DNA, 20 bp, Artificial
  CRISPR gRNA sequence
caaactgtaaaccaattttt

SEQ ID NO: 681522 - DNA, 20 bp, Artificial
  CRISPR gRNA sequence
aaactgtaaaccaatttttt

SEQ ID NO: 681523 - DNA, 20 bp, Artificial
  CRISPR gRNA sequence
taaaccaattttttgttctt

SEQ ID NO: 681524 - DNA, 20 bp, Artificial
  CRISPR gRNA sequence
tttgttcttcagagatcatg

SEQ ID NO: 681525 - DNA, 20 bp, Artificial
  CRISPR gRNA sequence
ttgttcttcagagatcatgg

SEQ ID NO: 681526 - DNA, 20 bp, Artificial
  CRISPR gRNA sequence
tgttcttcagagatcatgga

SEQ ID NO: 681527 - DNA, 20 bp, Artificial
  CRISPR gRNA sequence
gttcttcagagatcatggaa

SEQ ID NO: 681528 - DNA, 20 bp, Artificial
  CRISPR gRNA sequence
ttcttcagagatcatggaac

SEQ ID NO: 681529 - DNA, 20 bp, Artificial
  CRISPR gRNA sequence
ttcagagatcatggaacaca

SEQ ID NO: 681530 - DNA, 20 bp, Artificial
  CRISPR gRNA sequence
cagagatcatggaacacaaa

SEQ ID NO: 681531 - DNA, 20 bp, Artificial
  CRISPR gRNA sequence
agagatcatggaacacaaac

SEQ ID NO: 681532 - DNA, 20 bp, Artificial
  CRISPR gRNA sequence
ttattttcagtgataactcc

SEQ ID NO: 681533 - DNA, 20 bp, Artificial
  CRISPR gRNA sequence
ttttcagtgataactcctaa

SEQ ID NO: 681534 - DNA, 20 bp, Artificial
  CRISPR gRNA sequence
tcagtgataactcctaagag

SEQ ID NO: 681535 - DNA, 20 bp, Artificial
  CRISPR gRNA sequence
cagtgataactcctaagagg

SEQ ID NO: 681536 - DNA, 20 bp, Artificial
  CRISPR gRNA sequence
agtgataactcctaagagga

SEQ ID NO: 681537 - DNA, 20 bp, Artificial
  CRISPR gRNA sequence
ctaagaggagctgagttgtt

SEQ ID NO: 681538 - DNA, 20 bp, Artificial
  CRISPR gRNA sequence
agaggagctgagttgttgtg

SEQ ID NO: 681539 - DNA, 20 bp, Artificial
  CRISPR gRNA sequence
agttgttgtgggttctatgt

SEQ ID NO: 681540 - DNA, 20 bp, Artificial
  CRISPR gRNA sequence
ttgtgggttctatgtttact

SEQ ID NO: 681541 - DNA, 20 bp, Artificial
  CRISPR gRNA sequence
tgggttctatgtttacttcc

SEQ ID NO: 681542 - DNA, 20 bp, Artificial
  CRISPR gRNA sequence
tatgtttacttcccctatgg

SEQ ID NO: 681543 - DNA, 20 bp, Artificial
  CRISPR gRNA sequence
tgtttacttcccctatggaa

SEQ ID NO: 681544 - DNA, 20 bp, Artificial
  CRISPR gRNA sequence
acttcccctatggaatttat

SEQ ID NO: 681545 - DNA, 20 bp, Artificial
  CRISPR gRNA sequence
cttcccctatggaatttata

SEQ ID NO: 681546 - DNA, 20 bp, Artificial
  CRISPR gRNA sequence
cccctatggaatttataatt

SEQ ID NO: 681547 - DNA, 20 bp, Artificial
  CRISPR gRNA sequence
ccctatggaatttataattc

SEQ ID NO: 681548 - DNA, 20 bp, Artificial
  CRISPR gRNA sequence
tggaatttataattcagtat

SEQ ID NO: 681549 - DNA, 20 bp, Artificial
  CRISPR gRNA sequence
ataattcagtatgttttaca

SEQ ID NO: 681550 - DNA, 20 bp, Artificial
  CRISPR gRNA sequence
taattcagtatgttttacac

SEQ ID NO: 681551 - DNA, 20 bp, Artificial
  CRISPR gRNA sequence
agtatgttttacactgtacc

SEQ ID NO: 681552 - DNA, 20 bp, Artificial
  CRISPR gRNA sequence
tacactgtaccatatagcaa

SEQ ID NO: 681553 - DNA, 20 bp, Artificial
  CRISPR gRNA sequence
acactgtaccatatagcaaa

SEQ ID NO: 681554 - DNA, 20 bp, Artificial
  CRISPR gRNA sequence
cactgtaccatatagcaaaa

SEQ ID NO: 681555 - DNA, 20 bp, Artificial
  CRISPR gRNA sequence
taccatatagcaaaactttt

SEQ ID NO: 681556 - DNA, 20 bp, Artificial
  CRISPR gRNA sequence
ttaaactacaggtagttaag

SEQ ID NO: 681557 - DNA, 20 bp, Artificial
  CRISPR gRNA sequence
taaactacaggtagttaagg

SEQ ID NO: 681558 - DNA, 20 bp, Artificial
  CRISPR gRNA sequence
aaactacaggtagttaaggg

SEQ ID NO: 681559 - DNA, 20 bp, Artificial
  CRISPR gRNA sequence
aactacaggtagttaagggc

SEQ ID NO: 681560 - DNA, 20 bp, Artificial
  CRISPR gRNA sequence
caggtagttaagggccacct

SEQ ID NO: 681561 - DNA, 20 bp, Artificial
  CRISPR gRNA sequence
agggccacctacaatacatc

SEQ ID NO: 681562 - DNA, 20 bp, Artificial
  CRISPR gRNA sequence
caatacatctgaggtcctgt

SEQ ID NO: 681563 - DNA, 20 bp, Artificial
  CRISPR gRNA sequence
aggtcctgtgatcttatttt

SEQ ID NO: 681564 - DNA, 20 bp, Artificial
  CRISPR gRNA sequence
tgatcttatttttctaaacg

SEQ ID NO: 681565 - DNA, 20 bp, Artificial
  CRISPR gRNA sequence
atttttctaaacgtaagcac

SEQ ID NO: 681566 - DNA, 20 bp, Artificial
  CRISPR gRNA sequence
tttttctaaacgtaagcact

SEQ ID NO: 681567 - DNA, 20 bp, Artificial
  CRISPR gRNA sequence
ttctaaacgtaagcactgtt

SEQ ID NO: 681568 - DNA, 20 bp, Artificial
  CRISPR gRNA sequence
tctaaacgtaagcactgttt

SEQ ID NO: 681569 - DNA, 20 bp, Artificial
  CRISPR gRNA sequence
ctaaacgtaagcactgtttt

SEQ ID NO: 681570 - DNA, 20 bp, Artificial
  CRISPR gRNA sequence
taaacgtaagcactgttttt

SEQ ID NO: 681571 - DNA, 20 bp, Artificial
  CRISPR gRNA sequence
aacgtaagcactgtttttcc

SEQ ID NO: 681572 - DNA, 20 bp, Artificial
  CRISPR gRNA sequence
tttttccatagttttgatga

SEQ ID NO: 681573 - DNA, 20 bp, Artificial
  CRISPR gRNA sequence
ttccatagttttgatgactg

SEQ ID NO: 681574 - DNA, 20 bp, Artificial
  CRISPR gRNA sequence
tccatagttttgatgactgg

SEQ ID NO: 681575 - DNA, 20 bp, Artificial
  CRISPR gRNA sequence
ccatagttttgatgactggc

SEQ ID NO: 681576 - DNA, 20 bp, Artificial
  CRISPR gRNA sequence
catagttttgatgactggca

SEQ ID NO: 681577 - DNA, 20 bp, Artificial
  CRISPR gRNA sequence
tgatgactggcattttatag

SEQ ID NO: 681578 - DNA, 20 bp, Artificial
  CRISPR gRNA sequence
gatgactggcattttataga

SEQ ID NO: 681579 - DNA, 20 bp, Artificial
  CRISPR gRNA sequence
atgactggcattttatagac

SEQ ID NO: 681580 - DNA, 20 bp, Artificial
  CRISPR gRNA sequence
gcattttatagacaccctgg

SEQ ID NO: 681581 - DNA, 20 bp, Artificial
  CRISPR gRNA sequence
tatagacaccctggcagcct

SEQ ID NO: 681582 - DNA, 20 bp, Artificial
  CRISPR gRNA sequence
atagacaccctggcagcctt

SEQ ID NO: 681583 - DNA, 20 bp, Artificial
  CRISPR gRNA sequence
tagacaccctggcagcctta

SEQ ID NO: 681584 - DNA, 20 bp, Artificial
  CRISPR gRNA sequence
gcagccttacttttaacacc

SEQ ID NO: 681585 - DNA, 20 bp, Artificial
  CRISPR gRNA sequence
acttttaacacctttaagga

SEQ ID NO: 681586 - DNA, 20 bp, Artificial
  CRISPR gRNA sequence
cttttaacacctttaaggaa

SEQ ID NO: 681587 - DNA, 20 bp, Artificial
  CRISPR gRNA sequence
ttaacacctttaaggaatag

SEQ ID NO: 681588 - DNA, 20 bp, Artificial
  CRISPR gRNA sequence
taacacctttaaggaatagt

SEQ ID NO: 681589 - DNA, 20 bp, Artificial
  CRISPR gRNA sequence
aacacctttaaggaatagta

SEQ ID NO: 681590 - DNA, 20 bp, Artificial
  CRISPR gRNA sequence
acacctttaaggaatagtat

SEQ ID NO: 681591 - DNA, 20 bp, Artificial
  CRISPR gRNA sequence
taaggaatagtatttttatg

SEQ ID NO: 681592 - DNA, 20 bp, Artificial
  CRISPR gRNA sequence
aaggaatagtatttttatgt

SEQ ID NO: 681593 - DNA, 20 bp, Artificial
  CRISPR gRNA sequence
aggaatagtatttttatgta

SEQ ID NO: 681594 - DNA, 20 bp, Artificial
  CRISPR gRNA sequence
ttatgtagttttcagaataa

SEQ ID NO: 681595 - DNA, 20 bp, Artificial
  CRISPR gRNA sequence
tatgtagttttcagaataac

SEQ ID NO: 681596 - DNA, 20 bp, Artificial
  CRISPR gRNA sequence
atgtagttttcagaataaca

SEQ ID NO: 681597 - DNA, 20 bp, Artificial
  CRISPR gRNA sequence
tgtagttttcagaataacat

SEQ ID NO: 681598 - DNA, 20 bp, Artificial
  CRISPR gRNA sequence
tcagaataacatatggtcta

SEQ ID NO: 681599 - DNA, 20 bp, Artificial
  CRISPR gRNA sequence
cagaataacatatggtctaa

SEQ ID NO: 681600 - DNA, 20 bp, Artificial
  CRISPR gRNA sequence
agaataacatatggtctaag

SEQ ID NO: 681601 - DNA, 20 bp, Artificial
  CRISPR gRNA sequence
agagtggataaaaggcagtc

SEQ ID NO: 681602 - DNA, 20 bp, Artificial
  CRISPR gRNA sequence
ctgggagggacttctacttt

SEQ ID NO: 681603 - DNA, 20 bp, Artificial
  CRISPR gRNA sequence
tgggagggacttctactttc

SEQ ID NO: 681604 - DNA, 20 bp, Artificial
  CRISPR gRNA sequence
ggagggacttctactttcat

SEQ ID NO: 681605 - DNA, 20 bp, Artificial
  CRISPR gRNA sequence
ctactttcataaatttgttt

SEQ ID NO: 681606 - DNA, 20 bp, Artificial
  CRISPR gRNA sequence
tactttcataaatttgtttg

SEQ ID NO: 681607 - DNA, 20 bp, Artificial
  CRISPR gRNA sequence
ctttcataaatttgtttgag

SEQ ID NO: 681608 - DNA, 20 bp, Artificial
  CRISPR gRNA sequence
tcataaatttgtttgagagg

SEQ ID NO: 681609 - DNA, 20 bp, Artificial
  CRISPR gRNA sequence
cataaatttgtttgagaggt

SEQ ID NO: 681610 - DNA, 20 bp, Artificial
  CRISPR gRNA sequence
ataaatttgtttgagaggtt

SEQ ID NO: 681611 - DNA, 20 bp, Artificial
  CRISPR gRNA sequence
gtttgagaggttttctttta

SEQ ID NO: 681612 - DNA, 20 bp, Artificial
  CRISPR gRNA sequence
tttgagaggttttcttttaa

SEQ ID NO: 681613 - DNA, 20 bp, Artificial
  CRISPR gRNA sequence
gagaggttttcttttaaagt

SEQ ID NO: 681614 - DNA, 20 bp, Artificial
  CRISPR gRNA sequence
agaggttttcttttaaagtt

SEQ ID NO: 681615 - DNA, 20 bp, Artificial
  CRISPR gRNA sequence
tcttttaaagttgtaatgtg

SEQ ID NO: 681616 - DNA, 20 bp, Artificial
  CRISPR gRNA sequence
cttttaaagttgtaatgtga

SEQ ID NO: 681617 - DNA, 20 bp, Artificial
  CRISPR gRNA sequence
ttttaaagttgtaatgtgat

SEQ ID NO: 681618 - DNA, 20 bp, Artificial
  CRISPR gRNA sequence
ttaaagttgtaatgtgatgg

SEQ ID NO: 681619 - DNA, 20 bp, Artificial
  CRISPR gRNA sequence
taaagttgtaatgtgatggc

SEQ ID NO: 681620 - DNA, 20 bp, Artificial
  CRISPR gRNA sequence
aaagttgtaatgtgatggca

SEQ ID NO: 681621 - DNA, 20 bp, Artificial
  CRISPR gRNA sequence
aagttgtaatgtgatggcag

SEQ ID NO: 681622 - DNA, 20 bp, Artificial
  CRISPR gRNA sequence
taatgtgatggcagcatagt

SEQ ID NO: 681623 - DNA, 20 bp, Artificial
  CRISPR gRNA sequence
gtttctaaaagtatgcttac

SEQ ID NO: 681624 - DNA, 20 bp, Artificial
  CRISPR gRNA sequence
tttctaaaagtatgcttacg

SEQ ID NO: 681625 - DNA, 20 bp, Artificial
  CRISPR gRNA sequence
ctaaaagtatgcttacgatt

SEQ ID NO: 681626 - DNA, 20 bp, Artificial
  CRISPR gRNA sequence
taaaagtatgcttacgattg

SEQ ID NO: 681627 - DNA, 20 bp, Artificial
  CRISPR gRNA sequence
aaagtatgcttacgattgtc

SEQ ID NO: 681628 - DNA, 20 bp, Artificial
  CRISPR gRNA sequence
acgattgtcactttatcagc

SEQ ID NO: 681629 - DNA, 20 bp, Artificial
  CRISPR gRNA sequence
cgattgtcactttatcagca

SEQ ID NO: 681630 - DNA, 20 bp, Artificial
  CRISPR gRNA sequence
tcactttatcagcatttaat

SEQ ID NO: 681631 - DNA, 20 bp, Artificial
  CRISPR gRNA sequence
tatcagcatttaatcagtgt

SEQ ID NO: 681632 - DNA, 20 bp, Artificial
  CRISPR gRNA sequence
atcagcatttaatcagtgtt

SEQ ID NO: 681633 - DNA, 20 bp, Artificial
  CRISPR gRNA sequence
tcagcatttaatcagtgtta

SEQ ID NO: 681634 - DNA, 20 bp, Artificial
  CRISPR gRNA sequence
aatcagtgttaaccagtcag

SEQ ID NO: 681635 - DNA, 20 bp, Artificial
  CRISPR gRNA sequence
atcagtgttaaccagtcagc

SEQ ID NO: 681636 - DNA, 20 bp, Artificial
  CRISPR gRNA sequence
accagtcagcagaaaaatat

SEQ ID NO: 681637 - DNA, 20 bp, Artificial
  CRISPR gRNA sequence
tgctaacagtagggggagaa

SEQ ID NO: 681638 - DNA, 20 bp, Artificial
  CRISPR gRNA sequence
acagtagggggagaaaaccc

SEQ ID NO: 681639 - DNA, 20 bp, Artificial
  CRISPR gRNA sequence
agaaatcccttttctggtat

SEQ ID NO: 681640 - DNA, 20 bp, Artificial
  CRISPR gRNA sequence
gaaatcccttttctggtatt

SEQ ID NO: 681641 - DNA, 20 bp, Artificial
  CRISPR gRNA sequence
ttctggtatttctcttttca

SEQ ID NO: 681642 - DNA, 20 bp, Artificial
  CRISPR gRNA sequence
tctggtatttctcttttcac

SEQ ID NO: 681643 - DNA, 20 bp, Artificial
  CRISPR gRNA sequence
ctggtatttctcttttcact

SEQ ID NO: 681644 - DNA, 20 bp, Artificial
  CRISPR gRNA sequence
tggtatttctcttttcacta

SEQ ID NO: 681645 - DNA, 20 bp, Artificial
  CRISPR gRNA sequence
gtatttctcttttcactagt

SEQ ID NO: 681646 - DNA, 20 bp, Artificial
  CRISPR gRNA sequence
ctcttttcactagttttttt

SEQ ID NO: 681647 - DNA, 20 bp, Artificial
  CRISPR gRNA sequence
tcttttcactagtttttttc

SEQ ID NO: 681648 - DNA, 20 bp, Artificial
  CRISPR gRNA sequence
ttttcactagtttttttcaa

SEQ ID NO: 681649 - DNA, 20 bp, Artificial
  CRISPR gRNA sequence
ttcactagtttttttcaaga

SEQ ID NO: 681650 - DNA, 20 bp, Artificial
  CRISPR gRNA sequence
tcactagtttttttcaagat

SEQ ID NO: 681651 - DNA, 20 bp, Artificial
  CRISPR gRNA sequence
cactagtttttttcaagatg

SEQ ID NO: 681652 - DNA, 20 bp, Artificial
  CRISPR gRNA sequence
actagtttttttcaagatgt

SEQ ID NO: 681653 - DNA, 20 bp, Artificial
  CRISPR gRNA sequence
gtttttttcaagatgtgacc

SEQ ID NO: 681654 - DNA, 20 bp, Artificial
  CRISPR gRNA sequence
ttttcaagatgtgacctccc

SEQ ID NO: 681655 - DNA, 20 bp, Artificial
  CRISPR gRNA sequence
tttcaagatgtgacctcccg

SEQ ID NO: 681656 - DNA, 20 bp, Artificial
  CRISPR gRNA sequence
ttcaagatgtgacctcccgg

SEQ ID NO: 681657 - DNA, 20 bp, Artificial
  CRISPR gRNA sequence
tcaagatgtgacctcccggt

SEQ ID NO: 681658 - DNA, 20 bp, Artificial
  CRISPR gRNA sequence
caagatgtgacctcccggtg

SEQ ID NO: 681659 - DNA, 20 bp, Artificial
  CRISPR gRNA sequence
aagatgtgacctcccggtgt

SEQ ID NO: 681660 - DNA, 20 bp, Artificial
  CRISPR gRNA sequence
ccggtgttctgtccatagtt

SEQ ID NO: 681661 - DNA, 20 bp, Artificial
  CRISPR gRNA sequence
tgtccatagttcattcatcc

SEQ ID NO: 681662 - DNA, 20 bp, Artificial
  CRISPR gRNA sequence
tccatagttcattcatcctt

SEQ ID NO: 681663 - DNA, 20 bp, Artificial
  CRISPR gRNA sequence
attcatcctttactcttcga

SEQ ID NO: 681664 - DNA, 20 bp, Artificial
  CRISPR gRNA sequence
atcctttactcttcgagtag

SEQ ID NO: 681665 - DNA, 20 bp, Artificial
  CRISPR gRNA sequence
tactcttcgagtagaaggtc

SEQ ID NO: 681666 - DNA, 20 bp, Artificial
  CRISPR gRNA sequence
actcttcgagtagaaggtct

SEQ ID NO: 681667 - DNA, 20 bp, Artificial
  CRISPR gRNA sequence
ctcttcgagtagaaggtctt

SEQ ID NO: 681668 - DNA, 20 bp, Artificial
  CRISPR gRNA sequence
ttcgagtagaaggtcttaaa

SEQ ID NO: 681669 - DNA, 20 bp, Artificial
  CRISPR gRNA sequence
cgagtagaaggtcttaaaag

SEQ ID NO: 681670 - DNA, 20 bp, Artificial
  CRISPR gRNA sequence
gagtagaaggtcttaaaagt

SEQ ID NO: 681671 - DNA, 20 bp, Artificial
  CRISPR gRNA sequence
aaaagtcttcctgtcggctg

SEQ ID NO: 681672 - DNA, 20 bp, Artificial
  CRISPR gRNA sequence
aaagtcttcctgtcggctgt

SEQ ID NO: 681673 - DNA, 20 bp, Artificial
  CRISPR gRNA sequence
cctgtcggctgtttctttca

SEQ ID NO: 681674 - DNA, 20 bp, Artificial
  CRISPR gRNA sequence
ctgtcggctgtttctttcaa

SEQ ID NO: 681675 - DNA, 20 bp, Artificial
  CRISPR gRNA sequence
tcggctgtttctttcaaaat

SEQ ID NO: 681676 - DNA, 20 bp, Artificial
  CRISPR gRNA sequence
tttctttcaaaatctcctca

SEQ ID NO: 681677 - DNA, 20 bp, Artificial
  CRISPR gRNA sequence
ctttcaaaatctcctcagag

SEQ ID NO: 681678 - DNA, 20 bp, Artificial
  CRISPR gRNA sequence
tttcaaaatctcctcagagc

SEQ ID NO: 681679 - DNA, 20 bp, Artificial
  CRISPR gRNA sequence
tcaaaatctcctcagagcaa

SEQ ID NO: 681680 - DNA, 20 bp, Artificial
  CRISPR gRNA sequence
caaaatctcctcagagcaat

SEQ ID NO: 681681 - DNA, 20 bp, Artificial
  CRISPR gRNA sequence
aaaatctcctcagagcaatt

SEQ ID NO: 681682 - DNA, 20 bp, Artificial
  CRISPR gRNA sequence
ctcagagcaattgctaattt

SEQ ID NO: 681683 - DNA, 20 bp, Artificial
  CRISPR gRNA sequence
agagcaattgctaatttggc

SEQ ID NO: 681684 - DNA, 20 bp, Artificial
  CRISPR gRNA sequence
ctaatttggcctgaatctgg

SEQ ID NO: 681685 - DNA, 20 bp, Artificial
  CRISPR gRNA sequence
atttggcctgaatctggtaa

SEQ ID NO: 681686 - DNA, 20 bp, Artificial
  CRISPR gRNA sequence
ggcctgaatctggtaacttg

SEQ ID NO: 681687 - DNA, 20 bp, Artificial
  CRISPR gRNA sequence
gcctgaatctggtaacttga

SEQ ID NO: 681688 - DNA, 20 bp, Artificial
  CRISPR gRNA sequence
aatctggtaacttgaaccct

SEQ ID NO: 681689 - DNA, 20 bp, Artificial
  CRISPR gRNA sequence
gtaacttgaaccctgtaagg

SEQ ID NO: 681690 - DNA, 20 bp, Artificial
  CRISPR gRNA sequence
gaaccctgtaaggttacaga

SEQ ID NO: 681691 - DNA, 20 bp, Artificial
  CRISPR gRNA sequence
aaccctgtaaggttacagaa

SEQ ID NO: 681692 - DNA, 20 bp, Artificial
  CRISPR gRNA sequence
taaggttacagaactagggc

SEQ ID NO: 681693 - DNA, 20 bp, Artificial
  CRISPR gRNA sequence
cagaactagggctatttatt

SEQ ID NO: 681694 - DNA, 20 bp, Artificial
  CRISPR gRNA sequence
gggctatttattttagcatt

SEQ ID NO: 681695 - DNA, 20 bp, Artificial
  CRISPR gRNA sequence
tttattttagcatttcttca

SEQ ID NO: 681696 - DNA, 20 bp, Artificial
  CRISPR gRNA sequence
attttagcatttcttcagta

SEQ ID NO: 681697 - DNA, 20 bp, Artificial
  CRISPR gRNA sequence
ttttagcatttcttcagtag

SEQ ID NO: 681698 - DNA, 20 bp, Artificial
  CRISPR gRNA sequence
tagcatttcttcagtagtat

SEQ ID NO: 681699 - DNA, 20 bp, Artificial
  CRISPR gRNA sequence
agcatttcttcagtagtatt

SEQ ID NO: 681700 - DNA, 20 bp, Artificial
  CRISPR gRNA sequence
gcatttcttcagtagtattt

SEQ ID NO: 681701 - DNA, 20 bp, Artificial
  CRISPR gRNA sequence
cttcagtagtatttactact

SEQ ID NO: 681702 - DNA, 20 bp, Artificial
  CRISPR gRNA sequence
ttcagtagtatttactactc

SEQ ID NO: 681703 - DNA, 20 bp, Artificial
  CRISPR gRNA sequence
cagtagtatttactactctt

SEQ ID NO: 681704 - DNA, 20 bp, Artificial
  CRISPR gRNA sequence
agtagtatttactactcttg

SEQ ID NO: 681705 - DNA, 20 bp, Artificial
  CRISPR gRNA sequence
actactcttgttgcaaagaa

SEQ ID NO: 681706 - DNA, 20 bp, Artificial
  CRISPR gRNA sequence
ctactcttgttgcaaagaaa

SEQ ID NO: 681707 - DNA, 20 bp, Artificial
  CRISPR gRNA sequence
ctcttgttgcaaagaaaagg

SEQ ID NO: 681708 - DNA, 20 bp, Artificial
  CRISPR gRNA sequence
ttgttgcaaagaaaagggaa

SEQ ID NO: 681709 - DNA, 20 bp, Artificial
  CRISPR gRNA sequence
gttgcaaagaaaagggaatg

SEQ ID NO: 681710 - DNA, 20 bp, Artificial
  CRISPR gRNA sequence
ttgcaaagaaaagggaatgg

SEQ ID NO: 681711 - DNA, 20 bp, Artificial
  CRISPR gRNA sequence
caaagaaaagggaatgggac

SEQ ID NO: 681712 - DNA, 20 bp, Artificial
  CRISPR gRNA sequence
ctttgtaacctgtaccttgg

SEQ ID NO: 681713 - DNA, 20 bp, Artificial
  CRISPR gRNA sequence
tttgtaacctgtaccttgga

SEQ ID NO: 681714 - DNA, 20 bp, Artificial
  CRISPR gRNA sequence
tgtaacctgtaccttggaca

SEQ ID NO: 681715 - DNA, 20 bp, Artificial
  CRISPR gRNA sequence
gtaacctgtaccttggacaa

SEQ ID NO: 681716 - DNA, 20 bp, Artificial
  CRISPR gRNA sequence
taacctgtaccttggacaac

SEQ ID NO: 681717 - DNA, 20 bp, Artificial
  CRISPR gRNA sequence
taccttggacaacagataaa

SEQ ID NO: 681718 - DNA, 20 bp, Artificial
  CRISPR gRNA sequence
ggacaacagataaaagaaac

SEQ ID NO: 681719 - DNA, 20 bp, Artificial
  CRISPR gRNA sequence
gacaacagataaaagaaaca

SEQ ID NO: 681720 - DNA, 20 bp, Artificial
  CRISPR gRNA sequence
acttttacccttcttggagt

SEQ ID NO: 681721 - DNA, 20 bp, Artificial
  CRISPR gRNA sequence
cttttacccttcttggagtc

SEQ ID NO: 681722 - DNA, 20 bp, Artificial
  CRISPR gRNA sequence
ttacccttcttggagtctag

SEQ ID NO: 681723 - DNA, 20 bp, Artificial
  CRISPR gRNA sequence
tacccttcttggagtctaga

SEQ ID NO: 681724 - DNA, 20 bp, Artificial
  CRISPR gRNA sequence
acccttcttggagtctagaa

SEQ ID NO: 681725 - DNA, 20 bp, Artificial
  CRISPR gRNA sequence
cccttcttggagtctagaat

SEQ ID NO: 681726 - DNA, 20 bp, Artificial
  CRISPR gRNA sequence
cttggagtctagaatgtgac

SEQ ID NO: 681727 - DNA, 20 bp, Artificial
  CRISPR gRNA sequence
ttggagtctagaatgtgaca

SEQ ID NO: 681728 - DNA, 20 bp, Artificial
  CRISPR gRNA sequence
ggagtctagaatgtgacaga

SEQ ID NO: 681729 - DNA, 20 bp, Artificial
  CRISPR gRNA sequence
gagtctagaatgtgacagaa

SEQ ID NO: 681730 - DNA, 20 bp, Artificial
  CRISPR gRNA sequence
gaatgtgacagaacccccaa

SEQ ID NO: 681731 - DNA, 20 bp, Artificial
  CRISPR gRNA sequence
cacatttttctgtttccaaa

SEQ ID NO: 681732 - DNA, 20 bp, Artificial
  CRISPR gRNA sequence
ttctgtttccaaaacattta

SEQ ID NO: 681733 - DNA, 20 bp, Artificial
  CRISPR gRNA sequence
tctgtttccaaaacatttaa

SEQ ID NO: 681734 - DNA, 20 bp, Artificial
  CRISPR gRNA sequence
ctgtttccaaaacatttaat

SEQ ID NO: 681735 - DNA, 20 bp, Artificial
  CRISPR gRNA sequence
tgtttccaaaacatttaatt

SEQ ID NO: 681736 - DNA, 20 bp, Artificial
  CRISPR gRNA sequence
tttccaaaacatttaattgt

SEQ ID NO: 681737 - DNA, 20 bp, Artificial
  CRISPR gRNA sequence
ccaaaacatttaattgtgta

SEQ ID NO: 681738 - DNA, 20 bp, Artificial
  CRISPR gRNA sequence
caaaacatttaattgtgtaa

SEQ ID NO: 681739 - DNA, 20 bp, Artificial
  CRISPR gRNA sequence
aattgtgtaagtccttgtca

SEQ ID NO: 681740 - DNA, 20 bp, Artificial
  CRISPR gRNA sequence
attgtgtaagtccttgtcag

SEQ ID NO: 681741 - DNA, 20 bp, Artificial
  CRISPR gRNA sequence
tgtaagtccttgtcagaaat

SEQ ID NO: 681742 - DNA, 20 bp, Artificial
  CRISPR gRNA sequence
gtcagaaatgaatctcaatc

SEQ ID NO: 681743 - DNA, 20 bp, Artificial
  CRISPR gRNA sequence
tcagaaatgaatctcaatcc

SEQ ID NO: 681744 - DNA, 20 bp, Artificial
  CRISPR gRNA sequence
aatcccttagtatagaattc

SEQ ID NO: 681745 - DNA, 20 bp, Artificial
  CRISPR gRNA sequence
agtatagaattccccttaca

SEQ ID NO: 681746 - DNA, 20 bp, Artificial
  CRISPR gRNA sequence
gtatagaattccccttacat

SEQ ID NO: 681747 - DNA, 20 bp, Artificial
  CRISPR gRNA sequence
cccttacatggtataggttg

SEQ ID NO: 681748 - DNA, 20 bp, Artificial
  CRISPR gRNA sequence
acatggtataggttgccata

SEQ ID NO: 681749 - DNA, 20 bp, Artificial
  CRISPR gRNA sequence
catggtataggttgccatat

SEQ ID NO: 681750 - DNA, 20 bp, Artificial
  CRISPR gRNA sequence
ccatatttcatgtgcagatt

SEQ ID NO: 681751 - DNA, 20 bp, Artificial
  CRISPR gRNA sequence
catgtgcagattttaatttc

SEQ ID NO: 681752 - DNA, 20 bp, Artificial
  CRISPR gRNA sequence
atgtgcagattttaatttca

SEQ ID NO: 681753 - DNA, 20 bp, Artificial
  CRISPR gRNA sequence
taatttcatttatgtgggcg

SEQ ID NO: 681754 - DNA, 20 bp, Artificial
  CRISPR gRNA sequence
aatttcatttatgtgggcgc

SEQ ID NO: 681755 - DNA, 20 bp, Artificial
  CRISPR gRNA sequence
atttcatttatgtgggcgct

SEQ ID NO: 681756 - DNA, 20 bp, Artificial
  CRISPR gRNA sequence
catttatgtgggcgctctgt

SEQ ID NO: 681757 - DNA, 20 bp, Artificial
  CRISPR gRNA sequence
atttatgtgggcgctctgtt

SEQ ID NO: 681758 - DNA, 20 bp, Artificial
  CRISPR gRNA sequence
atgtgggcgctctgtttttt

SEQ ID NO: 681759 - DNA, 20 bp, Artificial
  CRISPR gRNA sequence
tgtgggcgctctgttttttc

SEQ ID NO: 681760 - DNA, 20 bp, Artificial
  CRISPR gRNA sequence
tgttttttctttgcagtcca

SEQ ID NO: 681761 - DNA, 20 bp, Artificial
  CRISPR gRNA sequence
ttttttctttgcagtccagc

SEQ ID NO: 681762 - DNA, 20 bp, Artificial
  CRISPR gRNA sequence
tttctttgcagtccagccac

SEQ ID NO: 681763 - DNA, 20 bp, Artificial
  CRISPR gRNA sequence
ttctttgcagtccagccaca

SEQ ID NO: 681764 - DNA, 20 bp, Artificial
  CRISPR gRNA sequence
tctttgcagtccagccacat

SEQ ID NO: 681765 - DNA, 20 bp, Artificial
  CRISPR gRNA sequence
ctttgcagtccagccacatt

SEQ ID NO: 681766 - DNA, 20 bp, Artificial
  CRISPR gRNA sequence
tttgcagtccagccacatta

SEQ ID NO: 681767 - DNA, 20 bp, Artificial
  CRISPR gRNA sequence
tgcagtccagccacattaga

SEQ ID NO: 681768 - DNA, 20 bp, Artificial
  CRISPR gRNA sequence
gcagtccagccacattagag

SEQ ID NO: 681769 - DNA, 20 bp, Artificial
  CRISPR gRNA sequence
cagtccagccacattagagg

SEQ ID NO: 681770 - DNA, 20 bp, Artificial
  CRISPR gRNA sequence
gaggggaggaaccgagtgat

SEQ ID NO: 681771 - DNA, 20 bp, Artificial
  CRISPR gRNA sequence
attcaagtcattttaggggg

SEQ ID NO: 681772 - DNA, 20 bp, Artificial
  CRISPR gRNA sequence
aagtcattttagggggacat

SEQ ID NO: 681773 - DNA, 20 bp, Artificial
  CRISPR gRNA sequence
tagggggacatacttggaag

SEQ ID NO: 681774 - DNA, 20 bp, Artificial
  CRISPR gRNA sequence
agggggacatacttggaagg

SEQ ID NO: 681775 - DNA, 20 bp, Artificial
  CRISPR gRNA sequence
gggggacatacttggaaggc

SEQ ID NO: 681776 - DNA, 20 bp, Artificial
  CRISPR gRNA sequence
ggaaggcagaacttgctgct

SEQ ID NO: 681777 - DNA, 20 bp, Artificial
  CRISPR gRNA sequence
gaaggcagaacttgctgctt

SEQ ID NO: 681778 - DNA, 20 bp, Artificial
  CRISPR gRNA sequence
gctgcttctgtttggggagg

SEQ ID NO: 681779 - DNA, 20 bp, Artificial
  CRISPR gRNA sequence
ctgcttctgtttggggagga

SEQ ID NO: 681780 - DNA, 20 bp, Artificial
  CRISPR gRNA sequence
cttctgtttggggaggacag

SEQ ID NO: 681781 - DNA, 20 bp, Artificial
  CRISPR gRNA sequence
ctgtttggggaggacagacc

SEQ ID NO: 681782 - DNA, 20 bp, Artificial
  CRISPR gRNA sequence
tgtttggggaggacagacct

SEQ ID NO: 681783 - DNA, 20 bp, Artificial
  CRISPR gRNA sequence
tttggggaggacagacctga

SEQ ID NO: 681784 - DNA, 20 bp, Artificial
  CRISPR gRNA sequence
ggggaggacagacctgactg

SEQ ID NO: 681785 - DNA, 20 bp, Artificial
  CRISPR gRNA sequence
gggaggacagacctgactgt

SEQ ID NO: 681786 - DNA, 20 bp, Artificial
  CRISPR gRNA sequence
actgtgactggattatctga

SEQ ID NO: 681787 - DNA, 20 bp, Artificial
  CRISPR gRNA sequence
tgactggattatctgataac

SEQ ID NO: 681788 - DNA, 20 bp, Artificial
  CRISPR gRNA sequence
gattatctgataaccatttg

SEQ ID NO: 681789 - DNA, 20 bp, Artificial
  CRISPR gRNA sequence
tctgataaccatttgtgaat

SEQ ID NO: 681790 - DNA, 20 bp, Artificial
  CRISPR gRNA sequence
ataaccatttgtgaatactg

SEQ ID NO: 681791 - DNA, 20 bp, Artificial
  CRISPR gRNA sequence
gtgaatactgaaattctgtt

SEQ ID NO: 681792 - DNA, 20 bp, Artificial
  CRISPR gRNA sequence
tgaatactgaaattctgtta

SEQ ID NO: 681793 - DNA, 20 bp, Artificial
  CRISPR gRNA sequence
aaattctgttaggcagtaac

SEQ ID NO: 681794 - DNA, 20 bp, Artificial
  CRISPR gRNA sequence
tgttaggcagtaactgataa

SEQ ID NO: 681795 - DNA, 20 bp, Artificial
  CRISPR gRNA sequence
ttaggcagtaactgataact

SEQ ID NO: 681796 - DNA, 20 bp, Artificial
  CRISPR gRNA sequence
ggcagtaactgataactgct

SEQ ID NO: 681797 - DNA, 20 bp, Artificial
  CRISPR gRNA sequence
ataactgctctaaaggatca

SEQ ID NO: 681798 - DNA, 20 bp, Artificial
  CRISPR gRNA sequence
ctctaaaggatcattaaata

SEQ ID NO: 681799 - DNA, 20 bp, Artificial
  CRISPR gRNA sequence
taaaggatcattaaatagga

SEQ ID NO: 681800 - DNA, 20 bp, Artificial
  CRISPR gRNA sequence
aaggatcattaaataggatg

SEQ ID NO: 681801 - DNA, 20 bp, Artificial
  CRISPR gRNA sequence
aataggatgctgaaattatg

SEQ ID NO: 681802 - DNA, 20 bp, Artificial
  CRISPR gRNA sequence
aaattatgtatcttaataca

SEQ ID NO: 681803 - DNA, 20 bp, Artificial
  CRISPR gRNA sequence
tgtatcttaatacagtgtgg

SEQ ID NO: 681804 - DNA, 20 bp, Artificial
  CRISPR gRNA sequence
aatacagtgtggtatgagaa

SEQ ID NO: 681805 - DNA, 20 bp, Artificial
  CRISPR gRNA sequence
atacagtgtggtatgagaat

SEQ ID NO: 681806 - DNA, 20 bp, Artificial
  CRISPR gRNA sequence
ccaagtcaagagaattgtgg

SEQ ID NO: 681807 - DNA, 20 bp, Artificial
  CRISPR gRNA sequence
tggacataagcaagtttggc

SEQ ID NO: 681808 - DNA, 20 bp, Artificial
  CRISPR gRNA sequence
ggccccaatactgctcttaa

SEQ ID NO: 681809 - DNA, 20 bp, Artificial
  CRISPR gRNA sequence
gccccaatactgctcttaac

SEQ ID NO: 681810 - DNA, 20 bp, Artificial
  CRISPR gRNA sequence
ctcttaactcattttccagc

SEQ ID NO: 681811 - DNA, 20 bp, Artificial
  CRISPR gRNA sequence
ttaactcattttccagctta

SEQ ID NO: 681812 - DNA, 20 bp, Artificial
  CRISPR gRNA sequence
aactcattttccagcttact

SEQ ID NO: 681813 - DNA, 20 bp, Artificial
  CRISPR gRNA sequence
actcattttccagcttacta

SEQ ID NO: 681814 - DNA, 20 bp, Artificial
  CRISPR gRNA sequence
attttccagcttactatttg

SEQ ID NO: 681815 - DNA, 20 bp, Artificial
  CRISPR gRNA sequence
tccagcttactatttgctat

SEQ ID NO: 681816 - DNA, 20 bp, Artificial
  CRISPR gRNA sequence
ccagcttactatttgctatt

SEQ ID NO: 681817 - DNA, 20 bp, Artificial
  CRISPR gRNA sequence
cagcttactatttgctattt

SEQ ID NO: 681818 - DNA, 20 bp, Artificial
  CRISPR gRNA sequence
actatttgctatttaaatgg

SEQ ID NO: 681819 - DNA, 20 bp, Artificial
  CRISPR gRNA sequence
ctatttgctatttaaatggt

SEQ ID NO: 681820 - DNA, 20 bp, Artificial
  CRISPR gRNA sequence
tttgctatttaaatggtagg

SEQ ID NO: 681821 - DNA, 20 bp, Artificial
  CRISPR gRNA sequence
gctatttaaatggtaggcac

SEQ ID NO: 681822 - DNA, 20 bp, Artificial
  CRISPR gRNA sequence
ctatttaaatggtaggcacc

SEQ ID NO: 681823 - DNA, 20 bp, Artificial
  CRISPR gRNA sequence
tttaaatggtaggcaccagc

SEQ ID NO: 681824 - DNA, 20 bp, Artificial
  CRISPR gRNA sequence
aaatggtaggcaccagctaa

SEQ ID NO: 681825 - DNA, 20 bp, Artificial
  CRISPR gRNA sequence
aatggtaggcaccagctaag

SEQ ID NO: 681826 - DNA, 20 bp, Artificial
  CRISPR gRNA sequence
agcacttctaagcactaaca

SEQ ID NO: 681827 - DNA, 20 bp, Artificial
  CRISPR gRNA sequence
ctaagcactaacacagctag

SEQ ID NO: 681828 - DNA, 20 bp, Artificial
  CRISPR gRNA sequence
taagcactaacacagctaga

SEQ ID NO: 681829 - DNA, 20 bp, Artificial
  CRISPR gRNA sequence
agcactaacacagctagaac

SEQ ID NO: 681830 - DNA, 20 bp, Artificial
  CRISPR gRNA sequence
acacagctagaactaggcaa

SEQ ID NO: 681831 - DNA, 20 bp, Artificial
  CRISPR gRNA sequence
gaactaggcaaaaatggtta

SEQ ID NO: 681832 - DNA, 20 bp, Artificial
  CRISPR gRNA sequence
ggcaaaaatggttagaactc

SEQ ID NO: 681833 - DNA, 20 bp, Artificial
  CRISPR gRNA sequence
gaactcagctctcttctact

SEQ ID NO: 681834 - DNA, 20 bp, Artificial
  CRISPR gRNA sequence
agctctcttctactagtccc

SEQ ID NO: 681835 - DNA, 20 bp, Artificial
  CRISPR gRNA sequence
tcttctactagtccctgtca

SEQ ID NO: 681836 - DNA, 20 bp, Artificial
  CRISPR gRNA sequence
ttctactagtccctgtcata

SEQ ID NO: 681837 - DNA, 20 bp, Artificial
  CRISPR gRNA sequence
ctactagtccctgtcataat

SEQ ID NO: 681838 - DNA, 20 bp, Artificial
  CRISPR gRNA sequence
tactagtccctgtcataatt

SEQ ID NO: 681839 - DNA, 20 bp, Artificial
  CRISPR gRNA sequence
ctagtccctgtcataattat

SEQ ID NO: 681840 - DNA, 20 bp, Artificial
  CRISPR gRNA sequence
gtccctgtcataattatttt

SEQ ID NO: 681841 - DNA, 20 bp, Artificial
  CRISPR gRNA sequence
tcataattatttttgggaaa

SEQ ID NO: 681842 - DNA, 20 bp, Artificial
  CRISPR gRNA sequence
tttttgggaaaatgtccaaa

SEQ ID NO: 681843 - DNA, 20 bp, Artificial
  CRISPR gRNA sequence
ttgggaaaatgtccaaactg

SEQ ID NO: 681844 - DNA, 20 bp, Artificial
  CRISPR gRNA sequence
tgggaaaatgtccaaactgc

SEQ ID NO: 681845 - DNA, 20 bp, Artificial
  CRISPR gRNA sequence
gggaaaatgtccaaactgcc

SEQ ID NO: 681846 - DNA, 20 bp, Artificial
  CRISPR gRNA sequence
ggaaaatgtccaaactgccc

SEQ ID NO: 681847 - DNA, 20 bp, Artificial
  CRISPR gRNA sequence
ccccctttaaatctaaggga

SEQ ID NO: 681848 - DNA, 20 bp, Artificial
  CRISPR gRNA sequence
taaatctaagggaatgcacc

SEQ ID NO: 681849 - DNA, 20 bp, Artificial
  CRISPR gRNA sequence
aaatctaagggaatgcacca

SEQ ID NO: 681850 - DNA, 20 bp, Artificial
  CRISPR gRNA sequence
aatctaagggaatgcaccaa

SEQ ID NO: 681851 - DNA, 20 bp, Artificial
  CRISPR gRNA sequence
agggaatgcaccaaaacaga

SEQ ID NO: 681852 - DNA, 20 bp, Artificial
  CRISPR gRNA sequence
catttttttttttctgcatg

SEQ ID NO: 681853 - DNA, 20 bp, Artificial
  CRISPR gRNA sequence
atttttttttttctgcatgc

SEQ ID NO: 681854 - DNA, 20 bp, Artificial
  CRISPR gRNA sequence
ttttttttctgcatgccttg

SEQ ID NO: 681855 - DNA, 20 bp, Artificial
  CRISPR gRNA sequence
tttttttctgcatgccttgg

SEQ ID NO: 681856 - DNA, 20 bp, Artificial
  CRISPR gRNA sequence
ttttttctgcatgccttggt

SEQ ID NO: 681857 - DNA, 20 bp, Artificial
  CRISPR gRNA sequence
tttttctgcatgccttggta

SEQ ID NO: 681858 - DNA, 20 bp, Artificial
  CRISPR gRNA sequence
ttttctgcatgccttggtac

SEQ ID NO: 681859 - DNA, 20 bp, Artificial
  CRISPR gRNA sequence
tttctgcatgccttggtaca

SEQ ID NO: 681860 - DNA, 20 bp, Artificial
  CRISPR gRNA sequence
ttctgcatgccttggtacat

SEQ ID NO: 681861 - DNA, 20 bp, Artificial
  CRISPR gRNA sequence
tctgcatgccttggtacata

SEQ ID NO: 681862 - DNA, 20 bp, Artificial
  CRISPR gRNA sequence
ctgcatgccttggtacatag

SEQ ID NO: 681863 - DNA, 20 bp, Artificial
  CRISPR gRNA sequence
tgcatgccttggtacatagt

SEQ ID NO: 681864 - DNA, 20 bp, Artificial
  CRISPR gRNA sequence
catgccttggtacatagtga

SEQ ID NO: 681865 - DNA, 20 bp, Artificial
  CRISPR gRNA sequence
ggtacatagtgaacatacaa

SEQ ID NO: 681866 - DNA, 20 bp, Artificial
  CRISPR gRNA sequence
gtacatagtgaacatacaac

SEQ ID NO: 681867 - DNA, 20 bp, Artificial
  CRISPR gRNA sequence
tttaaagataaagcatgttt

SEQ ID NO: 681868 - DNA, 20 bp, Artificial
  CRISPR gRNA sequence
aaagataaagcatgtttttg

SEQ ID NO: 681869 - DNA, 20 bp, Artificial
  CRISPR gRNA sequence
aagataaagcatgtttttga

SEQ ID NO: 681870 - DNA, 20 bp, Artificial
  CRISPR gRNA sequence
ttgagactcgctcacccccc

SEQ ID NO: 681871 - DNA, 20 bp, Artificial
  CRISPR gRNA sequence
tgagactcgctcaccccccc

SEQ ID NO: 681872 - DNA, 20 bp, Artificial
  CRISPR gRNA sequence
gagactcgctcacccccccc

SEQ ID NO: 681873 - DNA, 20 bp, Artificial
  CRISPR gRNA sequence
agactcgctcaccccccccc

SEQ ID NO: 681874 - DNA, 20 bp, Artificial
  CRISPR gRNA sequence
gctcacccccccccacccaa

SEQ ID NO: 681875 - DNA, 20 bp, Artificial
  CRISPR gRNA sequence
acccccccccacccaaccac

SEQ ID NO: 681876 - DNA, 20 bp, Artificial
  CRISPR gRNA sequence
ccaaataataattgggatgc

SEQ ID NO: 681877 - DNA, 20 bp, Artificial
  CRISPR gRNA sequence
ggatgccattttttttcctt

SEQ ID NO: 681878 - DNA, 20 bp, Artificial
  CRISPR gRNA sequence
tttttccttttggatgaggt

SEQ ID NO: 681879 - DNA, 20 bp, Artificial
  CRISPR gRNA sequence
ttttccttttggatgaggta

SEQ ID NO: 681880 - DNA, 20 bp, Artificial
  CRISPR gRNA sequence
tttccttttggatgaggtaa

SEQ ID NO: 681881 - DNA, 20 bp, Artificial
  CRISPR gRNA sequence
ttccttttggatgaggtaaa

SEQ ID NO: 681882 - DNA, 20 bp, Artificial
  CRISPR gRNA sequence
tccttttggatgaggtaaat

SEQ ID NO: 681883 - DNA, 20 bp, Artificial
  CRISPR gRNA sequence
ccttttggatgaggtaaata

SEQ ID NO: 681884 - DNA, 20 bp, Artificial
  CRISPR gRNA sequence
cttttggatgaggtaaataa

SEQ ID NO: 681885 - DNA, 20 bp, Artificial
  CRISPR gRNA sequence
ttggatgaggtaaataattt

SEQ ID NO: 681886 - DNA, 20 bp, Artificial
  CRISPR gRNA sequence
tggatgaggtaaataatttt

SEQ ID NO: 681887 - DNA, 20 bp, Artificial
  CRISPR gRNA sequence
ggatgaggtaaataatttta

SEQ ID NO: 681888 - DNA, 20 bp, Artificial
  CRISPR gRNA sequence
gatgaggtaaataattttaa

SEQ ID NO: 681889 - DNA, 20 bp, Artificial
  CRISPR gRNA sequence
taaggttcacaattttgtct

SEQ ID NO: 681890 - DNA, 20 bp, Artificial
  CRISPR gRNA sequence
aaggttcacaattttgtctt

SEQ ID NO: 681891 - DNA, 20 bp, Artificial
  CRISPR gRNA sequence
aggttcacaattttgtcttt

SEQ ID NO: 681892 - DNA, 20 bp, Artificial
  CRISPR gRNA sequence
acaattttgtcttttactgc

SEQ ID NO: 681893 - DNA, 20 bp, Artificial
  CRISPR gRNA sequence
tgtcttttactgcaatttaa

SEQ ID NO: 681894 - DNA, 20 bp, Artificial
  CRISPR gRNA sequence
gtcttttactgcaatttaag

SEQ ID NO: 681895 - DNA, 20 bp, Artificial
  CRISPR gRNA sequence
tcttttactgcaatttaagg

SEQ ID NO: 681896 - DNA, 20 bp, Artificial
  CRISPR gRNA sequence
ttactgcaatttaaggaaac

SEQ ID NO: 681897 - DNA, 20 bp, Artificial
  CRISPR gRNA sequence
tactgcaatttaaggaaaca

SEQ ID NO: 681898 - DNA, 20 bp, Artificial
  CRISPR gRNA sequence
actgcaatttaaggaaacat

SEQ ID NO: 681899 - DNA, 20 bp, Artificial
  CRISPR gRNA sequence
ctgcaatttaaggaaacatt

SEQ ID NO: 681900 - DNA, 20 bp, Artificial
  CRISPR gRNA sequence
caatttaaggaaacatttgg

SEQ ID NO: 681901 - DNA, 20 bp, Artificial
  CRISPR gRNA sequence
aaggaaacatttggatgtca

SEQ ID NO: 681902 - DNA, 20 bp, Artificial
  CRISPR gRNA sequence
aggaaacatttggatgtcag

SEQ ID NO: 681903 - DNA, 20 bp, Artificial
  CRISPR gRNA sequence
ggatgtcagtcaatatgttc

SEQ ID NO: 681904 - DNA, 20 bp, Artificial
  CRISPR gRNA sequence
gatgtcagtcaatatgttca

SEQ ID NO: 681905 - DNA, 20 bp, Artificial
  CRISPR gRNA sequence
ataattttggctgtgtgcga

SEQ ID NO: 681906 - DNA, 20 bp, Artificial
  CRISPR gRNA sequence
tggctgtgtgcgaatttctg

SEQ ID NO: 681907 - DNA, 20 bp, Artificial
  CRISPR gRNA sequence
ggctgtgtgcgaatttctgc

SEQ ID NO: 681908 - DNA, 20 bp, Artificial
  CRISPR gRNA sequence
gctgtgtgcgaatttctgct

SEQ ID NO: 681909 - DNA, 20 bp, Artificial
  CRISPR gRNA sequence
tgtgcgaatttctgctggca

SEQ ID NO: 681910 - DNA, 20 bp, Artificial
  CRISPR gRNA sequence
ctgctggcattatctatgaa

SEQ ID NO: 681911 - DNA, 20 bp, Artificial
  CRISPR gRNA sequence
tgctggcattatctatgaat

SEQ ID NO: 681912 - DNA, 20 bp, Artificial
  CRISPR gRNA sequence
ctggcattatctatgaattt

SEQ ID NO: 681913 - DNA, 20 bp, Artificial
  CRISPR gRNA sequence
gcattatctatgaattttct

SEQ ID NO: 681914 - DNA, 20 bp, Artificial
  CRISPR gRNA sequence
tctatgaattttcttcctac

SEQ ID NO: 681915 - DNA, 20 bp, Artificial
  CRISPR gRNA sequence
tgaattttcttcctacttat

SEQ ID NO: 681916 - DNA, 20 bp, Artificial
  CRISPR gRNA sequence
tcttcctacttatttttttt

SEQ ID NO: 681917 - DNA, 20 bp, Artificial
  CRISPR gRNA sequence
cttcctacttattttttttt

SEQ ID NO: 681918 - DNA, 20 bp, Artificial
  CRISPR gRNA sequence
ttcctacttatttttttttc

SEQ ID NO: 681919 - DNA, 20 bp, Artificial
  CRISPR gRNA sequence
cctacttatttttttttcag

SEQ ID NO: 681920 - DNA, 20 bp, Artificial
  CRISPR gRNA sequence
ctacttatttttttttcagt

SEQ ID NO: 681921 - DNA, 20 bp, Artificial
  CRISPR gRNA sequence
cttatttttttttcagtata

SEQ ID NO: 681922 - DNA, 20 bp, Artificial
  CRISPR gRNA sequence
atttttttttcagtatatga

SEQ ID NO: 681923 - DNA, 20 bp, Artificial
  CRISPR gRNA sequence
tttttttttcagtatatgaa

SEQ ID NO: 681924 - DNA, 20 bp, Artificial
  CRISPR gRNA sequence
ttttttcagtatatgaacaa

SEQ ID NO: 681925 - DNA, 20 bp, Artificial
  CRISPR gRNA sequence
tttttcagtatatgaacaat

SEQ ID NO: 681926 - DNA, 20 bp, Artificial
  CRISPR gRNA sequence
ttttcagtatatgaacaatc

SEQ ID NO: 681927 - DNA, 20 bp, Artificial
  CRISPR gRNA sequence
tttcagtatatgaacaatca

SEQ ID NO: 681928 - DNA, 20 bp, Artificial
  CRISPR gRNA sequence
ttcagtatatgaacaatcat

SEQ ID NO: 681929 - DNA, 20 bp, Artificial
  CRISPR gRNA sequence
tcagtatatgaacaatcatg

SEQ ID NO: 681930 - DNA, 20 bp, Artificial
  CRISPR gRNA sequence
cagtatatgaacaatcatgt

SEQ ID NO: 681931 - DNA, 20 bp, Artificial
  CRISPR gRNA sequence
agtatatgaacaatcatgta

SEQ ID NO: 681932 - DNA, 20 bp, Artificial
  CRISPR gRNA sequence
cctgccccaggatgaaacta

SEQ ID NO: 681933 - DNA, 20 bp, Artificial
  CRISPR gRNA sequence
ccccaggatgaaactaaatt

SEQ ID NO: 681934 - DNA, 20 bp, Artificial
  CRISPR gRNA sequence
aatttaggtggaccctaaac

SEQ ID NO: 681935 - DNA, 20 bp, Artificial
  CRISPR gRNA sequence
aggtggaccctaaaccttat

SEQ ID NO: 681936 - DNA, 20 bp, Artificial
  CRISPR gRNA sequence
ggtggaccctaaaccttatg

SEQ ID NO: 681937 - DNA, 20 bp, Artificial
  CRISPR gRNA sequence
aaccttatgaagacagtgct

SEQ ID NO: 681938 - DNA, 20 bp, Artificial
  CRISPR gRNA sequence
atgaagacagtgctgaggca

SEQ ID NO: 681939 - DNA, 20 bp, Artificial
  CRISPR gRNA sequence
tgaagacagtgctgaggcac

SEQ ID NO: 681940 - DNA, 20 bp, Artificial
  CRISPR gRNA sequence
aggcactttccttttctgat

SEQ ID NO: 681941 - DNA, 20 bp, Artificial
  CRISPR gRNA sequence
tccttttctgatttcatctt

SEQ ID NO: 681942 - DNA, 20 bp, Artificial
  CRISPR gRNA sequence
ccttttctgatttcatcttt

SEQ ID NO: 681943 - DNA, 20 bp, Artificial
  CRISPR gRNA sequence
cttttctgatttcatctttt

SEQ ID NO: 681944 - DNA, 20 bp, Artificial
  CRISPR gRNA sequence
ttctgatttcatctttttgg

SEQ ID NO: 681945 - DNA, 20 bp, Artificial
  CRISPR gRNA sequence
tctgatttcatctttttggg

SEQ ID NO: 681946 - DNA, 20 bp, Artificial
  CRISPR gRNA sequence
ctgatttcatctttttggga

SEQ ID NO: 681947 - DNA, 20 bp, Artificial
  CRISPR gRNA sequence
tgatttcatctttttgggaa

SEQ ID NO: 681948 - DNA, 20 bp, Artificial
  CRISPR gRNA sequence
atttcatctttttgggaatc

SEQ ID NO: 681949 - DNA, 20 bp, Artificial
  CRISPR gRNA sequence
catctttttgggaatctgtt

SEQ ID NO: 681950 - DNA, 20 bp, Artificial
  CRISPR gRNA sequence
atctttttgggaatctgttt

SEQ ID NO: 681951 - DNA, 20 bp, Artificial
  CRISPR gRNA sequence
tttgggaatctgttttattg

SEQ ID NO: 681952 - DNA, 20 bp, Artificial
  CRISPR gRNA sequence
ttgggaatctgttttattga

SEQ ID NO: 681953 - DNA, 20 bp, Artificial
  CRISPR gRNA sequence
tgggaatctgttttattgaa

SEQ ID NO: 681954 - DNA, 20 bp, Artificial
  CRISPR gRNA sequence
gggaatctgttttattgaag

SEQ ID NO: 681955 - DNA, 20 bp, Artificial
  CRISPR gRNA sequence
ggaatctgttttattgaagg

SEQ ID NO: 681956 - DNA, 20 bp, Artificial
  CRISPR gRNA sequence
ttttattgaaggtagttagt

SEQ ID NO: 681957 - DNA, 20 bp, Artificial
  CRISPR gRNA sequence
tattgaaggtagttagtagt

SEQ ID NO: 681958 - DNA, 20 bp, Artificial
  CRISPR gRNA sequence
attgaaggtagttagtagtt

SEQ ID NO: 681959 - DNA, 20 bp, Artificial
  CRISPR gRNA sequence
ttgaaggtagttagtagttg

SEQ ID NO: 681960 - DNA, 20 bp, Artificial
  CRISPR gRNA sequence
aaggtagttagtagttgaga

SEQ ID NO: 681961 - DNA, 20 bp, Artificial
  CRISPR gRNA sequence
gtagttgagagtgcatttgc

SEQ ID NO: 681962 - DNA, 20 bp, Artificial
  CRISPR gRNA sequence
agagtgcatttgctacaagc

SEQ ID NO: 681963 - DNA, 20 bp, Artificial
  CRISPR gRNA sequence
gctacaagcatatacttgta

SEQ ID NO: 681964 - DNA, 20 bp, Artificial
  CRISPR gRNA sequence
ctacaagcatatacttgtat

SEQ ID NO: 681965 - DNA, 20 bp, Artificial
  CRISPR gRNA sequence
caagcatatacttgtatctt

SEQ ID NO: 681966 - DNA, 20 bp, Artificial
  CRISPR gRNA sequence
gtatcttcctagcttcatga

SEQ ID NO: 681967 - DNA, 20 bp, Artificial
  CRISPR gRNA sequence
tatcttcctagcttcatgag

SEQ ID NO: 681968 - DNA, 20 bp, Artificial
  CRISPR gRNA sequence
cctagcttcatgaggaacag

SEQ ID NO: 681969 - DNA, 20 bp, Artificial
  CRISPR gRNA sequence
ctagcttcatgaggaacaga

SEQ ID NO: 681970 - DNA, 20 bp, Artificial
  CRISPR gRNA sequence
gcttcatgaggaacagaaag

SEQ ID NO: 681971 - DNA, 20 bp, Artificial
  CRISPR gRNA sequence
catgaggaacagaaagaggt

SEQ ID NO: 681972 - DNA, 20 bp, Artificial
  CRISPR gRNA sequence
atgaggaacagaaagaggtg

SEQ ID NO: 681973 - DNA, 20 bp, Artificial
  CRISPR gRNA sequence
agggtgtggcagggacaatt

SEQ ID NO: 681974 - DNA, 20 bp, Artificial
  CRISPR gRNA sequence
aggacaaagtcaattcaaat

SEQ ID NO: 681975 - DNA, 20 bp, Artificial
  CRISPR gRNA sequence
aaatttgtgggtcagaaaga

SEQ ID NO: 681976 - DNA, 20 bp, Artificial
  CRISPR gRNA sequence
gtgggtcagaaagaattttt

SEQ ID NO: 681977 - DNA, 20 bp, Artificial
  CRISPR gRNA sequence
tgggtcagaaagaatttttg

SEQ ID NO: 681978 - DNA, 20 bp, Artificial
  CRISPR gRNA sequence
ttgtggacgtagtgtttttg

SEQ ID NO: 681979 - DNA, 20 bp, Artificial
  CRISPR gRNA sequence
tgtggacgtagtgtttttgg

SEQ ID NO: 681980 - DNA, 20 bp, Artificial
  CRISPR gRNA sequence
gtggacgtagtgtttttgga

SEQ ID NO: 681981 - DNA, 20 bp, Artificial
  CRISPR gRNA sequence
tggacgtagtgtttttggag

SEQ ID NO: 681982 - DNA, 20 bp, Artificial
  CRISPR gRNA sequence
ttggagaaactctggatggt

SEQ ID NO: 681983 - DNA, 20 bp, Artificial
  CRISPR gRNA sequence
tggagaaactctggatggtt

SEQ ID NO: 681984 - DNA, 20 bp, Artificial
  CRISPR gRNA sequence
ggagaaactctggatggtta

SEQ ID NO: 681985 - DNA, 20 bp, Artificial
  CRISPR gRNA sequence
gagaaactctggatggttat

SEQ ID NO: 681986 - DNA, 20 bp, Artificial
  CRISPR gRNA sequence
tggatggttatatgtgcatg

SEQ ID NO: 681987 - DNA, 20 bp, Artificial
  CRISPR gRNA sequence
gatggttatatgtgcatgcc

SEQ ID NO: 681988 - DNA, 20 bp, Artificial
  CRISPR gRNA sequence
tatgtgcatgccttttcttc

SEQ ID NO: 681989 - DNA, 20 bp, Artificial
  CRISPR gRNA sequence
ttcttcaaaaggaaatacgc

SEQ ID NO: 681990 - DNA, 20 bp, Artificial
  CRISPR gRNA sequence
tcttcaaaaggaaatacgca

SEQ ID NO: 681991 - DNA, 20 bp, Artificial
  CRISPR gRNA sequence
cttcaaaaggaaatacgcaa

SEQ ID NO: 681992 - DNA, 20 bp, Artificial
  CRISPR gRNA sequence
ttcaaaaggaaatacgcaag

SEQ ID NO: 681993 - DNA, 20 bp, Artificial
  CRISPR gRNA sequence
caaaaggaaatacgcaaggt

SEQ ID NO: 681994 - DNA, 20 bp, Artificial
  CRISPR gRNA sequence
aaaaggaaatacgcaaggtt

SEQ ID NO: 681995 - DNA, 20 bp, Artificial
  CRISPR gRNA sequence
tagcatctaaaaataaacat

SEQ ID NO: 681996 - DNA, 20 bp, Artificial
  CRISPR gRNA sequence
aaaataaacataagagtcag

SEQ ID NO: 681997 - DNA, 20 bp, Artificial
  CRISPR gRNA sequence
tacataacagttgtatgccc

SEQ ID NO: 681998 - DNA, 20 bp, Artificial
  CRISPR gRNA sequence
acataacagttgtatgccca

SEQ ID NO: 681999 - DNA, 20 bp, Artificial
  CRISPR gRNA sequence
cataacagttgtatgcccag

SEQ ID NO: 682000 - DNA, 20 bp, Artificial
  CRISPR gRNA sequence
tatgcccagtttgtttaggt

SEQ ID NO: 682001 - DNA, 20 bp, Artificial
  CRISPR gRNA sequence
gtttaggtgagatttcacat

SEQ ID NO: 682002 - DNA, 20 bp, Artificial
  CRISPR gRNA sequence
tttaggtgagatttcacatt

SEQ ID NO: 682003 - DNA, 20 bp, Artificial
  CRISPR gRNA sequence
aggtgagatttcacattaca

SEQ ID NO: 682004 - DNA, 20 bp, Artificial
  CRISPR gRNA sequence
ggtgagatttcacattacag

SEQ ID NO: 682005 - DNA, 20 bp, Artificial
  CRISPR gRNA sequence
cacattacagaaagtatttg

SEQ ID NO: 682006 - DNA, 20 bp, Artificial
  CRISPR gRNA sequence
acattacagaaagtatttga

SEQ ID NO: 682007 - DNA, 20 bp, Artificial
  CRISPR gRNA sequence
cagaaagtatttgaggagca

SEQ ID NO: 682008 - DNA, 20 bp, Artificial
  CRISPR gRNA sequence
gaggagcatgaaaatgggtt

SEQ ID NO: 682009 - DNA, 20 bp, Artificial
  CRISPR gRNA sequence
aggagcatgaaaatgggtta

SEQ ID NO: 682010 - DNA, 20 bp, Artificial
  CRISPR gRNA sequence
tcttctgtattttccagttt

SEQ ID NO: 682011 - DNA, 20 bp, Artificial
  CRISPR gRNA sequence
ctgtattttccagtttggca

SEQ ID NO: 682012 - DNA, 20 bp, Artificial
  CRISPR gRNA sequence
tgtattttccagtttggcaa

SEQ ID NO: 682013 - DNA, 20 bp, Artificial
  CRISPR gRNA sequence
tattttccagtttggcaaaa

SEQ ID NO: 682014 - DNA, 20 bp, Artificial
  CRISPR gRNA sequence
tccagtttggcaaaagttca

SEQ ID NO: 682015 - DNA, 20 bp, Artificial
  CRISPR gRNA sequence
ccagtttggcaaaagttcag

SEQ ID NO: 682016 - DNA, 20 bp, Artificial
  CRISPR gRNA sequence
cagtttggcaaaagttcaga

SEQ ID NO: 682017 - DNA, 20 bp, Artificial
  CRISPR gRNA sequence
ggcaaaagttcagaatttca

SEQ ID NO: 682018 - DNA, 20 bp, Artificial
  CRISPR gRNA sequence
gcaaaagttcagaatttcat

SEQ ID NO: 682019 - DNA, 20 bp, Artificial
  CRISPR gRNA sequence
agaatttcatcacattgctt

SEQ ID NO: 682020 - DNA, 20 bp, Artificial
  CRISPR gRNA sequence
catcacattgctttgcccta

SEQ ID NO: 682021 - DNA, 20 bp, Artificial
  CRISPR gRNA sequence
atcacattgctttgccctaa

SEQ ID NO: 682022 - DNA, 20 bp, Artificial
  CRISPR gRNA sequence
ctttgccctaattttgccca

SEQ ID NO: 682023 - DNA, 20 bp, Artificial
  CRISPR gRNA sequence
tgccctaattttgcccagaa

SEQ ID NO: 682024 - DNA, 20 bp, Artificial
  CRISPR gRNA sequence
gccctaattttgcccagaat

SEQ ID NO: 682025 - DNA, 20 bp, Artificial
  CRISPR gRNA sequence
ccctaattttgcccagaatt

SEQ ID NO: 682026 - DNA, 20 bp, Artificial
  CRISPR gRNA sequence
attttgcccagaattttatc

SEQ ID NO: 682027 - DNA, 20 bp, Artificial
  CRISPR gRNA sequence
tgcccagaattttatcttag

SEQ ID NO: 682028 - DNA, 20 bp, Artificial
  CRISPR gRNA sequence
gcccagaattttatcttagc

SEQ ID NO: 682029 - DNA, 20 bp, Artificial
  CRISPR gRNA sequence
cccagaattttatcttagcc

SEQ ID NO: 682030 - DNA, 20 bp, Artificial
  CRISPR gRNA sequence
tatcttagcctctctctgac

SEQ ID NO: 682031 - DNA, 20 bp, Artificial
  CRISPR gRNA sequence
atcttagcctctctctgaca

SEQ ID NO: 682032 - DNA, 20 bp, Artificial
  CRISPR gRNA sequence
tcttagcctctctctgacag

SEQ ID NO: 682033 - DNA, 20 bp, Artificial
  CRISPR gRNA sequence
agcctctctctgacagtgat

SEQ ID NO: 682034 - DNA, 20 bp, Artificial
  CRISPR gRNA sequence
gcctctctctgacagtgatg

SEQ ID NO: 682035 - DNA, 20 bp, Artificial
  CRISPR gRNA sequence
tctctgacagtgatgaatca

SEQ ID NO: 682036 - DNA, 20 bp, Artificial
  CRISPR gRNA sequence
tctgacagtgatgaatcatg

SEQ ID NO: 682037 - DNA, 20 bp, Artificial
  CRISPR gRNA sequence
tgacagtgatgaatcatgct

SEQ ID NO: 682038 - DNA, 20 bp, Artificial
  CRISPR gRNA sequence
acagtgatgaatcatgctca

SEQ ID NO: 682039 - DNA, 20 bp, Artificial
  CRISPR gRNA sequence
aaaagccattctaattggac

SEQ ID NO: 682040 - DNA, 20 bp, Artificial
  CRISPR gRNA sequence
taattggacctttttaagac

SEQ ID NO: 682041 - DNA, 20 bp, Artificial
  CRISPR gRNA sequence
attggacctttttaagacag

SEQ ID NO: 682042 - DNA, 20 bp, Artificial
  CRISPR gRNA sequence
gacctttttaagacagggaa

SEQ ID NO: 682043 - DNA, 20 bp, Artificial
  CRISPR gRNA sequence
tttaagacagggaaagggat

SEQ ID NO: 682044 - DNA, 20 bp, Artificial
  CRISPR gRNA sequence
ttaagacagggaaagggatc

SEQ ID NO: 682045 - DNA, 20 bp, Artificial
  CRISPR gRNA sequence
taagacagggaaagggatca

SEQ ID NO: 682046 - DNA, 20 bp, Artificial
  CRISPR gRNA sequence
aagacagggaaagggatcag

SEQ ID NO: 682047 - DNA, 20 bp, Artificial
  CRISPR gRNA sequence
agacagggaaagggatcagt

SEQ ID NO: 682048 - DNA, 20 bp, Artificial
  CRISPR gRNA sequence
gaagaaatttcaagtcattg

SEQ ID NO: 682049 - DNA, 20 bp, Artificial
  CRISPR gRNA sequence
caagtcattgaaatattcca

SEQ ID NO: 682050 - DNA, 20 bp, Artificial
  CRISPR gRNA sequence
aagtcattgaaatattccat

SEQ ID NO: 682051 - DNA, 20 bp, Artificial
  CRISPR gRNA sequence
aaatattccattgagatttc

SEQ ID NO: 682052 - DNA, 20 bp, Artificial
  CRISPR gRNA sequence
cattgagatttcctaaaggg

SEQ ID NO: 682053 - DNA, 20 bp, Artificial
  CRISPR gRNA sequence
agatttcctaaagggacaaa

SEQ ID NO: 682054 - DNA, 20 bp, Artificial
  CRISPR gRNA sequence
cctaaagggacaaaattggg

SEQ ID NO: 682055 - DNA, 20 bp, Artificial
  CRISPR gRNA sequence
ctaaagggacaaaattggga

SEQ ID NO: 682056 - DNA, 20 bp, Artificial
  CRISPR gRNA sequence
aagggacaaaattgggaaaa

SEQ ID NO: 682057 - DNA, 20 bp, Artificial
  CRISPR gRNA sequence
ggaaaataagaaactacgac

SEQ ID NO: 682058 - DNA, 20 bp, Artificial
  CRISPR gRNA sequence
cgacttagatttggctacgt

SEQ ID NO: 682059 - DNA, 20 bp, Artificial
  CRISPR gRNA sequence
agatttggctacgtagtaga

SEQ ID NO: 682060 - DNA, 20 bp, Artificial
  CRISPR gRNA sequence
gatttggctacgtagtagaa

SEQ ID NO: 682061 - DNA, 20 bp, Artificial
  CRISPR gRNA sequence
ggctacgtagtagaaagtat

SEQ ID NO: 682062 - DNA, 20 bp, Artificial
  CRISPR gRNA sequence
gctacgtagtagaaagtatc

SEQ ID NO: 682063 - DNA, 20 bp, Artificial
  CRISPR gRNA sequence
cgtagtagaaagtatctccc

SEQ ID NO: 682064 - DNA, 20 bp, Artificial
  CRISPR gRNA sequence
ccctacatacatacaggcaa

SEQ ID NO: 682065 - DNA, 20 bp, Artificial
  CRISPR gRNA sequence
catacatacaggcaattgta

SEQ ID NO: 682066 - DNA, 20 bp, Artificial
  CRISPR gRNA sequence
tatgtatgaatcatagggta

SEQ ID NO: 682067 - DNA, 20 bp, Artificial
  CRISPR gRNA sequence
cacacacattcttttaaaga

SEQ ID NO: 682068 - DNA, 20 bp, Artificial
  CRISPR gRNA sequence
ttttaaagagaattcatgga

SEQ ID NO: 682069 - DNA, 20 bp, Artificial
  CRISPR gRNA sequence
ttaaagagaattcatggaaa

SEQ ID NO: 682070 - DNA, 20 bp, Artificial
  CRISPR gRNA sequence
taaagagaattcatggaaaa

SEQ ID NO: 682071 - DNA, 20 bp, Artificial
  CRISPR gRNA sequence
aaagagaattcatggaaaaa

SEQ ID NO: 682072 - DNA, 20 bp, Artificial
  CRISPR gRNA sequence
aagagaattcatggaaaaaa

SEQ ID NO: 682073 - DNA, 20 bp, Artificial
  CRISPR gRNA sequence
atggaaaaaaaagcagttgg

SEQ ID NO: 682074 - DNA, 20 bp, Artificial
  CRISPR gRNA sequence
gagtgatcagatgtattgca

SEQ ID NO: 682075 - DNA, 20 bp, Artificial
  CRISPR gRNA sequence
caaaaacatacagagaattt

SEQ ID NO: 682076 - DNA, 20 bp, Artificial
  CRISPR gRNA sequence
aaatgacagttaataccaag

SEQ ID NO: 682077 - DNA, 20 bp, Artificial
  CRISPR gRNA sequence
aatgacagttaataccaaga

SEQ ID NO: 682078 - DNA, 20 bp, Artificial
  CRISPR gRNA sequence
ataccaagaaattagttggg

SEQ ID NO: 682079 - DNA, 20 bp, Artificial
  CRISPR gRNA sequence
gttgggtttactttatcagg

SEQ ID NO: 682080 - DNA, 20 bp, Artificial
  CRISPR gRNA sequence
ggtttactttatcaggtcgt

SEQ ID NO: 682081 - DNA, 20 bp, Artificial
  CRISPR gRNA sequence
actttatcaggtcgtaatag

SEQ ID NO: 682082 - DNA, 20 bp, Artificial
  CRISPR gRNA sequence
ctttatcaggtcgtaatagg

SEQ ID NO: 682083 - DNA, 20 bp, Artificial
  CRISPR gRNA sequence
tatcaggtcgtaataggaat

SEQ ID NO: 682084 - DNA, 20 bp, Artificial
  CRISPR gRNA sequence
atcaggtcgtaataggaatc

SEQ ID NO: 682085 - DNA, 20 bp, Artificial
  CRISPR gRNA sequence
tcaggtcgtaataggaatca

SEQ ID NO: 682086 - DNA, 20 bp, Artificial
  CRISPR gRNA sequence
aagaagttactagtgtgtct

SEQ ID NO: 682087 - DNA, 20 bp, Artificial
  CRISPR gRNA sequence
ctagtgtgtctttaggacca

SEQ ID NO: 682088 - DNA, 20 bp, Artificial
  CRISPR gRNA sequence
gtgtgtctttaggaccagtg

SEQ ID NO: 682089 - DNA, 20 bp, Artificial
  CRISPR gRNA sequence
taggaccagtggcaactctt

SEQ ID NO: 682090 - DNA, 20 bp, Artificial
  CRISPR gRNA sequence
aggaccagtggcaactctta

SEQ ID NO: 682091 - DNA, 20 bp, Artificial
  CRISPR gRNA sequence
ggaccagtggcaactcttaa

SEQ ID NO: 682092 - DNA, 20 bp, Artificial
  CRISPR gRNA sequence
ttaaactaaaactttgggtc

SEQ ID NO: 682093 - DNA, 20 bp, Artificial
  CRISPR gRNA sequence
aaactaaaactttgggtcct

SEQ ID NO: 682094 - DNA, 20 bp, Artificial
  CRISPR gRNA sequence
aactaaaactttgggtcctt

SEQ ID NO: 682095 - DNA, 20 bp, Artificial
  CRISPR gRNA sequence
aaactttgggtccttattat

SEQ ID NO: 682096 - DNA, 20 bp, Artificial
  CRISPR gRNA sequence
tgggtccttattatctactt

SEQ ID NO: 682097 - DNA, 20 bp, Artificial
  CRISPR gRNA sequence
gggtccttattatctactta

SEQ ID NO: 682098 - DNA, 20 bp, Artificial
  CRISPR gRNA sequence
ggtccttattatctacttac

SEQ ID NO: 682099 - DNA, 20 bp, Artificial
  CRISPR gRNA sequence
attatctacttacagaacaa

SEQ ID NO: 682100 - DNA, 20 bp, Artificial
  CRISPR gRNA sequence
ttatctacttacagaacaaa

SEQ ID NO: 682101 - DNA, 20 bp, Artificial
  CRISPR gRNA sequence
tctacttacagaacaaagtg

SEQ ID NO: 682102 - DNA, 20 bp, Artificial
  CRISPR gRNA sequence
cttacagaacaaagtgaaac

SEQ ID NO: 682103 - DNA, 20 bp, Artificial
  CRISPR gRNA sequence
acagaacaaagtgaaacaaa

SEQ ID NO: 682104 - DNA, 20 bp, Artificial
  CRISPR gRNA sequence
cagaacaaagtgaaacaaac

SEQ ID NO: 682105 - DNA, 20 bp, Artificial
  CRISPR gRNA sequence
agctgattggatatacattc

SEQ ID NO: 682106 - DNA, 20 bp, Artificial
  CRISPR gRNA sequence
attggatatacattcaaaga

SEQ ID NO: 682107 - DNA, 20 bp, Artificial
  CRISPR gRNA sequence
gatatacattcaaagatatt

SEQ ID NO: 682108 - DNA, 20 bp, Artificial
  CRISPR gRNA sequence
aaagatatttaatgtaaagt

SEQ ID NO: 682109 - DNA, 20 bp, Artificial
  CRISPR gRNA sequence
aatgtaaagttttttggaat

SEQ ID NO: 682110 - DNA, 20 bp, Artificial
  CRISPR gRNA sequence
atgtaaagttttttggaata

SEQ ID NO: 682111 - DNA, 20 bp, Artificial
  CRISPR gRNA sequence
tttggaatacgaagaaaatt

SEQ ID NO: 682112 - DNA, 20 bp, Artificial
  CRISPR gRNA sequence
ttggaatacgaagaaaattc

SEQ ID NO: 682113 - DNA, 20 bp, Artificial
  CRISPR gRNA sequence
tggaatacgaagaaaattca

SEQ ID NO: 682114 - DNA, 20 bp, Artificial
  CRISPR gRNA sequence
ggaatacgaagaaaattcag

SEQ ID NO: 682115 - DNA, 20 bp, Artificial
  CRISPR gRNA sequence
gaatacgaagaaaattcaga

SEQ ID NO: 682116 - DNA, 20 bp, Artificial
  CRISPR gRNA sequence
agaaaataaatattatcaac

SEQ ID NO: 682117 - DNA, 20 bp, Artificial
  CRISPR gRNA sequence
tcaacagttacttattggca

SEQ ID NO: 682118 - DNA, 20 bp, Artificial
  CRISPR gRNA sequence
cttattggcaaatagagaaa

SEQ ID NO: 682119 - DNA, 20 bp, Artificial
  CRISPR gRNA sequence
attggcaaatagagaaagac

SEQ ID NO: 682120 - DNA, 20 bp, Artificial
  CRISPR gRNA sequence
ttggcaaatagagaaagaca

SEQ ID NO: 682121 - DNA, 20 bp, Artificial
  CRISPR gRNA sequence
gcaaatagagaaagacaaga

SEQ ID NO: 682122 - DNA, 20 bp, Artificial
  CRISPR gRNA sequence
agtgagcccggtattttgtt

SEQ ID NO: 682123 - DNA, 20 bp, Artificial
  CRISPR gRNA sequence
gtgagcccggtattttgttt

SEQ ID NO: 682124 - DNA, 20 bp, Artificial
  CRISPR gRNA sequence
tgtttttatagtttttatct

SEQ ID NO: 682125 - DNA, 20 bp, Artificial
  CRISPR gRNA sequence
gtttttatagtttttatctc

SEQ ID NO: 682126 - DNA, 20 bp, Artificial
  CRISPR gRNA sequence
tttttatagtttttatctca

SEQ ID NO: 682127 - DNA, 20 bp, Artificial
  CRISPR gRNA sequence
ttatagtttttatctcagtt

SEQ ID NO: 682128 - DNA, 20 bp, Artificial
  CRISPR gRNA sequence
tatagtttttatctcagttg

SEQ ID NO: 682129 - DNA, 20 bp, Artificial
  CRISPR gRNA sequence
atagtttttatctcagttgt

SEQ ID NO: 682130 - DNA, 20 bp, Artificial
  CRISPR gRNA sequence
tagtttttatctcagttgta

SEQ ID NO: 682131 - DNA, 20 bp, Artificial
  CRISPR gRNA sequence
ttatctcagttgtacaactc

SEQ ID NO: 682132 - DNA, 20 bp, Artificial
  CRISPR gRNA sequence
tatctcagttgtacaactca

SEQ ID NO: 682133 - DNA, 20 bp, Artificial
  CRISPR gRNA sequence
atctcagttgtacaactcac

SEQ ID NO: 682134 - DNA, 20 bp, Artificial
  CRISPR gRNA sequence
tctcagttgtacaactcaca

SEQ ID NO: 682135 - DNA, 20 bp, Artificial
  CRISPR gRNA sequence
agttgtacaactcacaaaac

SEQ ID NO: 682136 - DNA, 20 bp, Artificial
  CRISPR gRNA sequence
tacaactcacaaaaccatga

SEQ ID NO: 682137 - DNA, 20 bp, Artificial
  CRISPR gRNA sequence
acaaaaccatgaagtctttg

SEQ ID NO: 682138 - DNA, 20 bp, Artificial
  CRISPR gRNA sequence
tggtattttataaatgttta

SEQ ID NO: 682139 - DNA, 20 bp, Artificial
  CRISPR gRNA sequence
ggtattttataaatgtttaa

SEQ ID NO: 682140 - DNA, 20 bp, Artificial
  CRISPR gRNA sequence
gtattttataaatgtttaac

SEQ ID NO: 682141 - DNA, 20 bp, Artificial
  CRISPR gRNA sequence
tataaatgtttaacaaaatt

SEQ ID NO: 682142 - DNA, 20 bp, Artificial
  CRISPR gRNA sequence
ataaatgtttaacaaaattt

SEQ ID NO: 682143 - DNA, 20 bp, Artificial
  CRISPR gRNA sequence
taaatgtttaacaaaattta

SEQ ID NO: 682144 - DNA, 20 bp, Artificial
  CRISPR gRNA sequence
aacaaaatttacatcagatt

SEQ ID NO: 682145 - DNA, 20 bp, Artificial
  CRISPR gRNA sequence
acaaaatttacatcagatta

SEQ ID NO: 682146 - DNA, 20 bp, Artificial
  CRISPR gRNA sequence
acatcagattaaggcattta

SEQ ID NO: 682147 - DNA, 20 bp, Artificial
  CRISPR gRNA sequence
catcagattaaggcatttag

SEQ ID NO: 682148 - DNA, 20 bp, Artificial
  CRISPR gRNA sequence
aggcatttagatgaaaatta

SEQ ID NO: 682149 - DNA, 20 bp, Artificial
  CRISPR gRNA sequence
agatgaaaattattatgttc

SEQ ID NO: 682150 - DNA, 20 bp, Artificial
  CRISPR gRNA sequence
gatgaaaattattatgttct

SEQ ID NO: 682151 - DNA, 20 bp, Artificial
  CRISPR gRNA sequence
ttatgttctcactatcttcc

SEQ ID NO: 682152 - DNA, 20 bp, Artificial
  CRISPR gRNA sequence
tgttctcactatcttccaaa

SEQ ID NO: 682153 - DNA, 20 bp, Artificial
  CRISPR gRNA sequence
tcactatcttccaaatttta

SEQ ID NO: 682154 - DNA, 20 bp, Artificial
  CRISPR gRNA sequence
actatcttccaaattttatt

SEQ ID NO: 682155 - DNA, 20 bp, Artificial
  CRISPR gRNA sequence
tcttccaaattttatttcat

SEQ ID NO: 682156 - DNA, 20 bp, Artificial
  CRISPR gRNA sequence
ccaaattttatttcatccta

SEQ ID NO: 682157 - DNA, 20 bp, Artificial
  CRISPR gRNA sequence
caaattttatttcatcctat

SEQ ID NO: 682158 - DNA, 20 bp, Artificial
  CRISPR gRNA sequence
tatttcatcctatctccaaa

SEQ ID NO: 682159 - DNA, 20 bp, Artificial
  CRISPR gRNA sequence
atttcatcctatctccaaaa

SEQ ID NO: 682160 - DNA, 20 bp, Artificial
  CRISPR gRNA sequence
tttcatcctatctccaaaat

SEQ ID NO: 682161 - DNA, 20 bp, Artificial
  CRISPR gRNA sequence
catcctatctccaaaatgat

SEQ ID NO: 682162 - DNA, 20 bp, Artificial
  CRISPR gRNA sequence
atcctatctccaaaatgatt

SEQ ID NO: 682163 - DNA, 20 bp, Artificial
  CRISPR gRNA sequence
tctccaaaatgatttcttag

SEQ ID NO: 682164 - DNA, 20 bp, Artificial
  CRISPR gRNA sequence
caaaatgatttcttagggta

SEQ ID NO: 682165 - DNA, 20 bp, Artificial
  CRISPR gRNA sequence
cttagggtacaaaaagagca

SEQ ID NO: 682166 - DNA, 20 bp, Artificial
  CRISPR gRNA sequence
ttagggtacaaaaagagcag

SEQ ID NO: 682167 - DNA, 20 bp, Artificial
  CRISPR gRNA sequence
agggtacaaaaagagcagac

SEQ ID NO: 682168 - DNA, 20 bp, Artificial
  CRISPR gRNA sequence
gggtacaaaaagagcagacg

SEQ ID NO: 682169 - DNA, 20 bp, Artificial
  CRISPR gRNA sequence
taaaaatacaagcaaaaaac

SEQ ID NO: 682170 - DNA, 20 bp, Artificial
  CRISPR gRNA sequence
tgtgcccctagtttcaggca

SEQ ID NO: 682171 - DNA, 20 bp, Artificial
  CRISPR gRNA sequence
gtttcaggcagaacttaaac

SEQ ID NO: 682172 - DNA, 20 bp, Artificial
  CRISPR gRNA sequence
caggcagaacttaaactgtc

SEQ ID NO: 682173 - DNA, 20 bp, Artificial
  CRISPR gRNA sequence
aggcagaacttaaactgtca

SEQ ID NO: 682174 - DNA, 20 bp, Artificial
  CRISPR gRNA sequence
aaactgtcagaggtactagc

SEQ ID NO: 682175 - DNA, 20 bp, Artificial
  CRISPR gRNA sequence
aactgtcagaggtactagct

SEQ ID NO: 682176 - DNA, 20 bp, Artificial
  CRISPR gRNA sequence
tcagaggtactagctacatg

SEQ ID NO: 682177 - DNA, 20 bp, Artificial
  CRISPR gRNA sequence
gctacatgatttgtttttta

SEQ ID NO: 682178 - DNA, 20 bp, Artificial
  CRISPR gRNA sequence
catgatttgttttttaactt

SEQ ID NO: 682179 - DNA, 20 bp, Artificial
  CRISPR gRNA sequence
gttttttaactttggattgt

SEQ ID NO: 682180 - DNA, 20 bp, Artificial
  CRISPR gRNA sequence
ttttttaactttggattgtt

SEQ ID NO: 682181 - DNA, 20 bp, Artificial
  CRISPR gRNA sequence
tttaactttggattgttcac

SEQ ID NO: 682182 - DNA, 20 bp, Artificial
  CRISPR gRNA sequence
ttaactttggattgttcacg

SEQ ID NO: 682183 - DNA, 20 bp, Artificial
  CRISPR gRNA sequence
taactttggattgttcacgt

SEQ ID NO: 682184 - DNA, 20 bp, Artificial
  CRISPR gRNA sequence
aactttggattgttcacgtc

SEQ ID NO: 682185 - DNA, 20 bp, Artificial
  CRISPR gRNA sequence
actttggattgttcacgtcc

SEQ ID NO: 682186 - DNA, 20 bp, Artificial
  CRISPR gRNA sequence
tggattgttcacgtccaaaa

SEQ ID NO: 682187 - DNA, 20 bp, Artificial
  CRISPR gRNA sequence
ggattgttcacgtccaaaaa

SEQ ID NO: 682188 - DNA, 20 bp, Artificial
  CRISPR gRNA sequence
gattgttcacgtccaaaaat

SEQ ID NO: 682189 - DNA, 20 bp, Artificial
  CRISPR gRNA sequence
ttcacgtccaaaaatggata

SEQ ID NO: 682190 - DNA, 20 bp, Artificial
  CRISPR gRNA sequence
acgtccaaaaatggataaat

SEQ ID NO: 682191 - DNA, 20 bp, Artificial
  CRISPR gRNA sequence
catttgtgtttatcatcagt

SEQ ID NO: 682192 - DNA, 20 bp, Artificial
  CRISPR gRNA sequence
gtgtttatcatcagttgcat

SEQ ID NO: 682193 - DNA, 20 bp, Artificial
  CRISPR gRNA sequence
tgtttatcatcagttgcatt

SEQ ID NO: 682194 - DNA, 20 bp, Artificial
  CRISPR gRNA sequence
atcatcagttgcattttatg

SEQ ID NO: 682195 - DNA, 20 bp, Artificial
  CRISPR gRNA sequence
tcatcagttgcattttatgt

SEQ ID NO: 682196 - DNA, 20 bp, Artificial
  CRISPR gRNA sequence
cattttatgtattattttaa

SEQ ID NO: 682197 - DNA, 20 bp, Artificial
  CRISPR gRNA sequence
tatgtattattttaataaat

SEQ ID NO: 682198 - DNA, 20 bp, Artificial
  CRISPR gRNA sequence
atgtattattttaataaata

SEQ ID NO: 682199 - DNA, 20 bp, Artificial
  CRISPR gRNA sequence
tgtattattttaataaatac

SEQ ID NO: 682200 - DNA, 20 bp, Artificial
  CRISPR gRNA sequence
ttttaataaatactatctga

SEQ ID NO: 682201 - DNA, 20 bp, Artificial
  CRISPR gRNA sequence
taataaatactatctgaatg

SEQ ID NO: 682202 - DNA, 20 bp, Artificial
  CRISPR gRNA sequence
aataaatactatctgaatga

SEQ ID NO: 682203 - DNA, 20 bp, Artificial
  CRISPR gRNA sequence
ataaatactatctgaatgaa

SEQ ID NO: 682204 - DNA, 20 bp, Artificial
  CRISPR gRNA sequence
tctgaatgaagactattcta

SEQ ID NO: 682205 - DNA, 20 bp, Artificial
  CRISPR gRNA sequence
aatgaagactattctaaacc

SEQ ID NO: 682206 - DNA, 20 bp, Artificial
  CRISPR gRNA sequence
ttctaaaccagaaaattccc

SEQ ID NO: 682207 - DNA, 20 bp, Artificial
  CRISPR gRNA sequence
taaaccagaaaattccccaa

SEQ ID NO: 682208 - DNA, 20 bp, Artificial
  CRISPR gRNA sequence
aaccagaaaattccccaaat

SEQ ID NO: 682209 - DNA, 20 bp, Artificial
  CRISPR gRNA sequence
cccaaatccaaaagaaaaaa

SEQ ID NO: 682210 - DNA, 20 bp, Artificial
  CRISPR gRNA sequence
aagtttgtgtatatgaaagt

SEQ ID NO: 682211 - DNA, 20 bp, Artificial
  CRISPR gRNA sequence
gtgtatatgaaagttatctt

SEQ ID NO: 682212 - DNA, 20 bp, Artificial
  CRISPR gRNA sequence
tgtatatgaaagttatctta

SEQ ID NO: 682213 - DNA, 20 bp, Artificial
  CRISPR gRNA sequence
tcttagacatatttttaatt

SEQ ID NO: 682214 - DNA, 20 bp, Artificial
  CRISPR gRNA sequence
agacatatttttaattctcc

SEQ ID NO: 682215 - DNA, 20 bp, Artificial
  CRISPR gRNA sequence
gacatatttttaattctcca

SEQ ID NO: 682216 - DNA, 20 bp, Artificial
  CRISPR gRNA sequence
ttaattctccagtttctgca

SEQ ID NO: 682217 - DNA, 20 bp, Artificial
  CRISPR gRNA sequence
taattctccagtttctgcaa

SEQ ID NO: 682218 - DNA, 20 bp, Artificial
  CRISPR gRNA sequence
aattctccagtttctgcaaa

SEQ ID NO: 682219 - DNA, 20 bp, Artificial
  CRISPR gRNA sequence
attctccagtttctgcaaaa

SEQ ID NO: 682220 - DNA, 20 bp, Artificial
  CRISPR gRNA sequence
tccagtttctgcaaaataat

SEQ ID NO: 682221 - DNA, 20 bp, Artificial
  CRISPR gRNA sequence
cagtttctgcaaaataatta

SEQ ID NO: 682222 - DNA, 20 bp, Artificial
  CRISPR gRNA sequence
ctgcaaaataattaaaatat

SEQ ID NO: 682223 - DNA, 20 bp, Artificial
  CRISPR gRNA sequence
tgcaaaataattaaaatata

SEQ ID NO: 682224 - DNA, 20 bp, Artificial
  CRISPR gRNA sequence
caaaataattaaaatataca

SEQ ID NO: 682225 - DNA, 20 bp, Artificial
  CRISPR gRNA sequence
aaatatacagtaactggtct

SEQ ID NO: 682226 - DNA, 20 bp, Artificial
  CRISPR gRNA sequence
gtctcctaaatcctgaattt

SEQ ID NO: 682227 - DNA, 20 bp, Artificial
  CRISPR gRNA sequence
ctaaatcctgaatttaatgt

SEQ ID NO: 682228 - DNA, 20 bp, Artificial
  CRISPR gRNA sequence
aatcctgaatttaatgtatt

SEQ ID NO: 682229 - DNA, 20 bp, Artificial
  CRISPR gRNA sequence
aatttaatgtattaaatact

SEQ ID NO: 682230 - DNA, 20 bp, Artificial
  CRISPR gRNA sequence
aatgtattaaatacttatgt

SEQ ID NO: 682231 - DNA, 20 bp, Artificial
  CRISPR gRNA sequence
atgtattaaatacttatgtt

SEQ ID NO: 682232 - DNA, 20 bp, Artificial
  CRISPR gRNA sequence
aatacttatgttctttatat

SEQ ID NO: 682233 - DNA, 20 bp, Artificial
  CRISPR gRNA sequence
atgttctttatattggtgcc

SEQ ID NO: 682234 - DNA, 20 bp, Artificial
  CRISPR gRNA sequence
tgttctttatattggtgcct

SEQ ID NO: 682235 - DNA, 20 bp, Artificial
  CRISPR gRNA sequence
tttatattggtgccttttta

SEQ ID NO: 682236 - DNA, 20 bp, Artificial
  CRISPR gRNA sequence
tatattggtgcctttttaaa

SEQ ID NO: 682237 - DNA, 20 bp, Artificial
  CRISPR gRNA sequence
atattggtgcctttttaaaa

SEQ ID NO: 682238 - DNA, 20 bp, Artificial
  CRISPR gRNA sequence
tattggtgcctttttaaaat

SEQ ID NO: 682239 - DNA, 20 bp, Artificial
  CRISPR gRNA sequence
gtgcctttttaaaatgcatt

SEQ ID NO: 682240 - DNA, 20 bp, Artificial
  CRISPR gRNA sequence
tttaaaatgcattgagagtg

SEQ ID NO: 682241 - DNA, 20 bp, Artificial
  CRISPR gRNA sequence
ttaaaatgcattgagagtgt

SEQ ID NO: 682242 - DNA, 20 bp, Artificial
  CRISPR gRNA sequence
taaaatgcattgagagtgtt

SEQ ID NO: 682243 - DNA, 20 bp, Artificial
  CRISPR gRNA sequence
aaaatgcattgagagtgttg

SEQ ID NO: 682244 - DNA, 20 bp, Artificial
  CRISPR gRNA sequence
aaatgcattgagagtgttgg

SEQ ID NO: 682245 - DNA, 20 bp, Artificial
  CRISPR gRNA sequence
agagtgttggttagctgttg

SEQ ID NO: 682246 - DNA, 20 bp, Artificial
  CRISPR gRNA sequence
gttagctgttgcagctgtac

SEQ ID NO: 682247 - DNA, 20 bp, Artificial
  CRISPR gRNA sequence
gctgttgcagctgtacaaca

SEQ ID NO: 682248 - DNA, 20 bp, Artificial
  CRISPR gRNA sequence
ttgcagctgtacaacacttt

SEQ ID NO: 682249 - DNA, 20 bp, Artificial
  CRISPR gRNA sequence
cagctgtacaacacttttaa

SEQ ID NO: 682250 - DNA, 20 bp, Artificial
  CRISPR gRNA sequence
tacaacacttttaatatgca

SEQ ID NO: 682251 - DNA, 20 bp, Artificial
  CRISPR gRNA sequence
ttaatatgcatttttaaaaa

SEQ ID NO: 682252 - DNA, 20 bp, Artificial
  CRISPR gRNA sequence
taatatgcatttttaaaaat

SEQ ID NO: 682253 - DNA, 20 bp, Artificial
  CRISPR gRNA sequence
aatatgcatttttaaaaatc

SEQ ID NO: 682254 - DNA, 20 bp, Artificial
  CRISPR gRNA sequence
atatgcatttttaaaaatca

SEQ ID NO: 682255 - DNA, 20 bp, Artificial
  CRISPR gRNA sequence
ttaaaaatcacttaaaattg

SEQ ID NO: 682256 - DNA, 20 bp, Artificial
  CRISPR gRNA sequence
taaaaatcacttaaaattga

SEQ ID NO: 682257 - DNA, 20 bp, Artificial
  CRISPR gRNA sequence
aaaaatcacttaaaattgag

SEQ ID NO: 682258 - DNA, 20 bp, Artificial
  CRISPR gRNA sequence
aaaatcacttaaaattgagt

SEQ ID NO: 682259 - DNA, 20 bp, Artificial
  CRISPR gRNA sequence
aaaattgagtactatataat

SEQ ID NO: 682260 - DNA, 20 bp, Artificial
  CRISPR gRNA sequence
aaattgagtactatataatt

SEQ ID NO: 682261 - DNA, 20 bp, Artificial
  CRISPR gRNA sequence
agtactatataattcatctc

SEQ ID NO: 682262 - DNA, 20 bp, Artificial
  CRISPR gRNA sequence
tataattcatctctgcattt

SEQ ID NO: 682263 - DNA, 20 bp, Artificial
  CRISPR gRNA sequence
atctctgcatttttagtgca

SEQ ID NO: 682264 - DNA, 20 bp, Artificial
  CRISPR gRNA sequence
tgcatttttagtgcaaatct

SEQ ID NO: 682265 - DNA, 20 bp, Artificial
  CRISPR gRNA sequence
catttttagtgcaaatcttt

SEQ ID NO: 682266 - DNA, 20 bp, Artificial
  CRISPR gRNA sequence
ttagtgcaaatctttagagc

SEQ ID NO: 682267 - DNA, 20 bp, Artificial
  CRISPR gRNA sequence
tagtgcaaatctttagagca

SEQ ID NO: 682268 - DNA, 20 bp, Artificial
  CRISPR gRNA sequence
agtgcaaatctttagagcaa

SEQ ID NO: 682269 - DNA, 20 bp, Artificial
  CRISPR gRNA sequence
gtgcaaatctttagagcaat

SEQ ID NO: 682270 - DNA, 20 bp, Artificial
  CRISPR gRNA sequence
tagagcaatttctaatagag

SEQ ID NO: 682271 - DNA, 20 bp, Artificial
  CRISPR gRNA sequence
agagcaatttctaatagaga

SEQ ID NO: 682272 - DNA, 20 bp, Artificial
  CRISPR gRNA sequence
gagcaatttctaatagagaa

SEQ ID NO: 682273 - DNA, 20 bp, Artificial
  CRISPR gRNA sequence
ctaatagagaaattttcagc

SEQ ID NO: 682274 - DNA, 20 bp, Artificial
  CRISPR gRNA sequence
taatagagaaattttcagct

SEQ ID NO: 682275 - DNA, 20 bp, Artificial
  CRISPR gRNA sequence
atagagaaattttcagctca

SEQ ID NO: 682276 - DNA, 20 bp, Artificial
  CRISPR gRNA sequence
tcagctcagctgttaaaagg

SEQ ID NO: 682277 - DNA, 20 bp, Artificial
  CRISPR gRNA sequence
cagctcagctgttaaaagga

SEQ ID NO: 682278 - DNA, 20 bp, Artificial
  CRISPR gRNA sequence
agctcagctgttaaaaggaa

SEQ ID NO: 682279 - DNA, 20 bp, Artificial
  CRISPR gRNA sequence
agctgttaaaaggaaaagga

SEQ ID NO: 682280 - DNA, 20 bp, Artificial
  CRISPR gRNA sequence
ttaaaaggaaaaggaaactt

SEQ ID NO: 682281 - DNA, 20 bp, Artificial
  CRISPR gRNA sequence
aaaggaaaaggaaactttga

SEQ ID NO: 682282 - DNA, 20 bp, Artificial
  CRISPR gRNA sequence
tgaaactagactttactacc

SEQ ID NO: 682283 - DNA, 20 bp, Artificial
  CRISPR gRNA sequence
gaaactagactttactacct

SEQ ID NO: 682284 - DNA, 20 bp, Artificial
  CRISPR gRNA sequence
aaactagactttactacctt

SEQ ID NO: 682285 - DNA, 20 bp, Artificial
  CRISPR gRNA sequence
gactttactacctttttagt

SEQ ID NO: 682286 - DNA, 20 bp, Artificial
  CRISPR gRNA sequence
tactacctttttagtttcat

SEQ ID NO: 682287 - DNA, 20 bp, Artificial
  CRISPR gRNA sequence
actacctttttagtttcata

SEQ ID NO: 682288 - DNA, 20 bp, Artificial
  CRISPR gRNA sequence
ctacctttttagtttcatag

SEQ ID NO: 682289 - DNA, 20 bp, Artificial
  CRISPR gRNA sequence
cctttttagtttcatagtat

SEQ ID NO: 682290 - DNA, 20 bp, Artificial
  CRISPR gRNA sequence
tttagtttcatagtatttct

SEQ ID NO: 682291 - DNA, 20 bp, Artificial
  CRISPR gRNA sequence
ttagtttcatagtatttctg

SEQ ID NO: 682292 - DNA, 20 bp, Artificial
  CRISPR gRNA sequence
tagtttcatagtatttctga

SEQ ID NO: 682293 - DNA, 20 bp, Artificial
  CRISPR gRNA sequence
agtttcatagtatttctgaa

SEQ ID NO: 682294 - DNA, 20 bp, Artificial
  CRISPR gRNA sequence
gtttcatagtatttctgaat

SEQ ID NO: 682295 - DNA, 20 bp, Artificial
  CRISPR gRNA sequence
catagtatttctgaatatga

SEQ ID NO: 682296 - DNA, 20 bp, Artificial
  CRISPR gRNA sequence
atagtatttctgaatatgat

SEQ ID NO: 682297 - DNA, 20 bp, Artificial
  CRISPR gRNA sequence
ctgaatatgattacaagatt

SEQ ID NO: 682298 - DNA, 20 bp, Artificial
  CRISPR gRNA sequence
tgaatatgattacaagatta

SEQ ID NO: 682299 - DNA, 20 bp, Artificial
  CRISPR gRNA sequence
aatatgattacaagattatg

SEQ ID NO: 682300 - DNA, 20 bp, Artificial
  CRISPR gRNA sequence
caagattatgcaggtaaaat

SEQ ID NO: 682301 - DNA, 20 bp, Artificial
  CRISPR gRNA sequence
tgcaggtaaaatatagagtg

SEQ ID NO: 682302 - DNA, 20 bp, Artificial
  CRISPR gRNA sequence
tacctgtgaattgaattata

SEQ ID NO: 682303 - DNA, 20 bp, Artificial
  CRISPR gRNA sequence
acctgtgaattgaattataa

SEQ ID NO: 682304 - DNA, 20 bp, Artificial
  CRISPR gRNA sequence
cctgtgaattgaattataat

SEQ ID NO: 682305 - DNA, 20 bp, Artificial
  CRISPR gRNA sequence
tgaattgaattataatttgt

SEQ ID NO: 682306 - DNA, 20 bp, Artificial
  CRISPR gRNA sequence
aattataatttgtgtttttg

SEQ ID NO: 682307 - DNA, 20 bp, Artificial
  CRISPR gRNA sequence
taatttgtgtttttgttttg

SEQ ID NO: 682308 - DNA, 20 bp, Artificial
  CRISPR gRNA sequence
gtgtttttgttttgttttta

SEQ ID NO: 682309 - DNA, 20 bp, Artificial
  CRISPR gRNA sequence
tgtttttgttttgtttttaa

SEQ ID NO: 682310 - DNA, 20 bp, Artificial
  CRISPR gRNA sequence
ttgttttgtttttaaggaag

SEQ ID NO: 682311 - DNA, 20 bp, Artificial
  CRISPR gRNA sequence
tgttttgtttttaaggaaga

SEQ ID NO: 682312 - DNA, 20 bp, Artificial
  CRISPR gRNA sequence
gttttgtttttaaggaagaa

SEQ ID NO: 682313 - DNA, 20 bp, Artificial
  CRISPR gRNA sequence
ttttgtttttaaggaagaat

SEQ ID NO: 682314 - DNA, 20 bp, Artificial
  CRISPR gRNA sequence
tgtttttaaggaagaataag

SEQ ID NO: 682315 - DNA, 20 bp, Artificial
  CRISPR gRNA sequence
gtttttaaggaagaataagt

SEQ ID NO: 682316 - DNA, 20 bp, Artificial
  CRISPR gRNA sequence
tttttaaggaagaataagtt

SEQ ID NO: 682317 - DNA, 20 bp, Artificial
  CRISPR gRNA sequence
ttaaggaagaataagttctg

SEQ ID NO: 682318 - DNA, 20 bp, Artificial
  CRISPR gRNA sequence
taaggaagaataagttctgt

SEQ ID NO: 682319 - DNA, 20 bp, Artificial
  CRISPR gRNA sequence
aaggaagaataagttctgta

SEQ ID NO: 682320 - DNA, 20 bp, Artificial
  CRISPR gRNA sequence
aggaagaataagttctgtat

SEQ ID NO: 682321 - DNA, 20 bp, Artificial
  CRISPR gRNA sequence
tgtatcaaacaagaatttat

SEQ ID NO: 682322 - DNA, 20 bp, Artificial
  CRISPR gRNA sequence
tatcaaacaagaatttatta

SEQ ID NO: 682323 - DNA, 20 bp, Artificial
  CRISPR gRNA sequence
attagataattttttggtca

SEQ ID NO: 682324 - DNA, 20 bp, Artificial
  CRISPR gRNA sequence
ttagataattttttggtcaa

SEQ ID NO: 682325 - DNA, 20 bp, Artificial
  CRISPR gRNA sequence
gataattttttggtcaataa

SEQ ID NO: 682326 - DNA, 20 bp, Artificial
  CRISPR gRNA sequence
tttggtcaataaaatacagt

SEQ ID NO: 682327 - DNA, 20 bp, Artificial
  CRISPR gRNA sequence
ttggtcaataaaatacagta

SEQ ID NO: 682328 - DNA, 20 bp, Artificial
  CRISPR gRNA sequence
tggtcaataaaatacagtat

SEQ ID NO: 682329 - DNA, 20 bp, Artificial
  CRISPR gRNA sequence
ggtcaataaaatacagtatt

SEQ ID NO: 682330 - DNA, 20 bp, Artificial
  CRISPR gRNA sequence
gtcaataaaatacagtattc

SEQ ID NO: 682331 - DNA, 20 bp, Artificial
  CRISPR gRNA sequence
atttggattttcatctccag

SEQ ID NO: 682332 - DNA, 20 bp, Artificial
  CRISPR gRNA sequence
ggattttcatctccagacta

SEQ ID NO: 682333 - DNA, 20 bp, Artificial
  CRISPR gRNA sequence
gattttcatctccagactag

SEQ ID NO: 682334 - DNA, 20 bp, Artificial
  CRISPR gRNA sequence
tcatctccagactagtattg

SEQ ID NO: 682335 - DNA, 20 bp, Artificial
  CRISPR gRNA sequence
catctccagactagtattgt

SEQ ID NO: 682336 - DNA, 20 bp, Artificial
  CRISPR gRNA sequence
atctccagactagtattgtt

SEQ ID NO: 682337 - DNA, 20 bp, Artificial
  CRISPR gRNA sequence
cagactagtattgttctagt

SEQ ID NO: 682338 - DNA, 20 bp, Artificial
  CRISPR gRNA sequence
gtattgttctagtcttggaa

SEQ ID NO: 682339 - DNA, 20 bp, Artificial
  CRISPR gRNA sequence
ttctagtcttggaatctgta

SEQ ID NO: 682340 - DNA, 20 bp, Artificial
  CRISPR gRNA sequence
tagtcttggaatctgtattt

SEQ ID NO: 682341 - DNA, 20 bp, Artificial
  CRISPR gRNA sequence
gtcttggaatctgtattttc

SEQ ID NO: 682342 - DNA, 20 bp, Artificial
  CRISPR gRNA sequence
ggaatctgtattttctaatc

SEQ ID NO: 682343 - DNA, 20 bp, Artificial
  CRISPR gRNA sequence
gaatctgtattttctaatct

SEQ ID NO: 682344 - DNA, 20 bp, Artificial
  CRISPR gRNA sequence
tattttctaatctgttagaa

SEQ ID NO: 682345 - DNA, 20 bp, Artificial
  CRISPR gRNA sequence
tctaatctgttagaaaatag

SEQ ID NO: 682346 - DNA, 20 bp, Artificial
  CRISPR gRNA sequence
ctaatctgttagaaaataga

SEQ ID NO: 682347 - DNA, 20 bp, Artificial
  CRISPR gRNA sequence
taatctgttagaaaatagag

SEQ ID NO: 682348 - DNA, 20 bp, Artificial
  CRISPR gRNA sequence
atctgttagaaaatagagat

SEQ ID NO: 682349 - DNA, 20 bp, Artificial
  CRISPR gRNA sequence
ttagaaaatagagattgaaa

SEQ ID NO: 682350 - DNA, 20 bp, Artificial
  CRISPR gRNA sequence
gaaaatagagattgaaaatt

SEQ ID NO: 682351 - DNA, 20 bp, Artificial
  CRISPR gRNA sequence
aaaattgatggaataatgtg

SEQ ID NO: 682352 - DNA, 20 bp, Artificial
  CRISPR gRNA sequence
atggaataatgtgaaaaagc

SEQ ID NO: 682353 - DNA, 20 bp, Artificial
  CRISPR gRNA sequence
attctccttgaacaaagcaa

SEQ ID NO: 682354 - DNA, 20 bp, Artificial
  CRISPR gRNA sequence
tccttgaacaaagcaaaact

SEQ ID NO: 682355 - DNA, 20 bp, Artificial
  CRISPR gRNA sequence
cttgaacaaagcaaaactga

SEQ ID NO: 682356 - DNA, 20 bp, Artificial
  CRISPR gRNA sequence
gaacaaagcaaaactgaaca

SEQ ID NO: 682357 - DNA, 20 bp, Artificial
  CRISPR gRNA sequence
aacaaagcaaaactgaacag

SEQ ID NO: 682358 - DNA, 20 bp, Artificial
  CRISPR gRNA sequence
aacagtcatatcacattgct

SEQ ID NO: 682359 - DNA, 20 bp, Artificial
  CRISPR gRNA sequence
ctattctccaaagcataatc

SEQ ID NO: 682360 - DNA, 20 bp, Artificial
  CRISPR gRNA sequence
ttctccaaagcataatctca

SEQ ID NO: 682361 - DNA, 20 bp, Artificial
  CRISPR gRNA sequence
tccaaagcataatctcaaat

SEQ ID NO: 682362 - DNA, 20 bp, Artificial
  CRISPR gRNA sequence
caaagcataatctcaaatgg

SEQ ID NO: 682363 - DNA, 20 bp, Artificial
  CRISPR gRNA sequence
aaatggtttcatatcatggt

SEQ ID NO: 682364 - DNA, 20 bp, Artificial
  CRISPR gRNA sequence
catatcatggttgtgtatta

SEQ ID NO: 682365 - DNA, 20 bp, Artificial
  CRISPR gRNA sequence
atatcatggttgtgtattac

SEQ ID NO: 682366 - DNA, 20 bp, Artificial
  CRISPR gRNA sequence
tgtattacttgcaatgggtg

SEQ ID NO: 682367 - DNA, 20 bp, Artificial
  CRISPR gRNA sequence
cttgcaatgggtgtgttagg

SEQ ID NO: 682368 - DNA, 20 bp, Artificial
  CRISPR gRNA sequence
gcaatgggtgtgttaggata

SEQ ID NO: 682369 - DNA, 20 bp, Artificial
  CRISPR gRNA sequence
caatgggtgtgttaggatat

SEQ ID NO: 682370 - DNA, 20 bp, Artificial
  CRISPR gRNA sequence
ggatatgacagctttttaaa

SEQ ID NO: 682371 - DNA, 20 bp, Artificial
  CRISPR gRNA sequence
tttaaaaaaatgagctgctg

SEQ ID NO: 682372 - DNA, 20 bp, Artificial
  CRISPR gRNA sequence
ttaaaaaaatgagctgctgg

SEQ ID NO: 682373 - DNA, 20 bp, Artificial
  CRISPR gRNA sequence
taaaaaaatgagctgctggt

SEQ ID NO: 682374 - DNA, 20 bp, Artificial
  CRISPR gRNA sequence
aaaaaaatgagctgctggtt

SEQ ID NO: 682375 - DNA, 20 bp, Artificial
  CRISPR gRNA sequence
aaaaaatgagctgctggtta

SEQ ID NO: 682376 - DNA, 20 bp, Artificial
  CRISPR gRNA sequence
ctggttatacaaagcaaatg

SEQ ID NO: 682377 - DNA, 20 bp, Artificial
  CRISPR gRNA sequence
gttatacaaagcaaatggca

SEQ ID NO: 682378 - DNA, 20 bp, Artificial
  CRISPR gRNA sequence
tacaaagcaaatggcatatg

SEQ ID NO: 682379 - DNA, 20 bp, Artificial
  CRISPR gRNA sequence
tgatatgctagtgtttcttt

SEQ ID NO: 682380 - DNA, 20 bp, Artificial
  CRISPR gRNA sequence
gtgtttctttttatcatagt

SEQ ID NO: 682381 - DNA, 20 bp, Artificial
  CRISPR gRNA sequence
ctttttatcatagtgtatta

SEQ ID NO: 682382 - DNA, 20 bp, Artificial
  CRISPR gRNA sequence
tttttatcatagtgtattac

SEQ ID NO: 682383 - DNA, 20 bp, Artificial
  CRISPR gRNA sequence
tttatcatagtgtattacta

SEQ ID NO: 682384 - DNA, 20 bp, Artificial
  CRISPR gRNA sequence
ttatcatagtgtattactag

SEQ ID NO: 682385 - DNA, 20 bp, Artificial
  CRISPR gRNA sequence
tatcatagtgtattactagg

SEQ ID NO: 682386 - DNA, 20 bp, Artificial
  CRISPR gRNA sequence
atcatagtgtattactaggc

SEQ ID NO: 682387 - DNA, 20 bp, Artificial
  CRISPR gRNA sequence
tcatagtgtattactaggcc

SEQ ID NO: 682388 - DNA, 20 bp, Artificial
  CRISPR gRNA sequence
ctaggccaaataatgacacc

SEQ ID NO: 682389 - DNA, 20 bp, Artificial
  CRISPR gRNA sequence
ggccaaataatgacaccttg

SEQ ID NO: 682390 - DNA, 20 bp, Artificial
  CRISPR gRNA sequence
gaatatttttacatttattg

SEQ ID NO: 682391 - DNA, 20 bp, Artificial
  CRISPR gRNA sequence
aatatttttacatttattgc

SEQ ID NO: 682392 - DNA, 20 bp, Artificial
  CRISPR gRNA sequence
ttacatttattgcagaaacc

SEQ ID NO: 682393 - DNA, 20 bp, Artificial
  CRISPR gRNA sequence
tacatttattgcagaaacct

SEQ ID NO: 682394 - DNA, 20 bp, Artificial
  CRISPR gRNA sequence
acatttattgcagaaacctt

SEQ ID NO: 682395 - DNA, 20 bp, Artificial
  CRISPR gRNA sequence
catttattgcagaaacctta

SEQ ID NO: 682396 - DNA, 20 bp, Artificial
  CRISPR gRNA sequence
attgcagaaaccttaaactt

SEQ ID NO: 682397 - DNA, 20 bp, Artificial
  CRISPR gRNA sequence
ttgcagaaaccttaaacttt

SEQ ID NO: 682398 - DNA, 20 bp, Artificial
  CRISPR gRNA sequence
cagaaaccttaaactttgga

SEQ ID NO: 682399 - DNA, 20 bp, Artificial
  CRISPR gRNA sequence
aaactttggaatttccataa

SEQ ID NO: 682400 - DNA, 20 bp, Artificial
  CRISPR gRNA sequence
aactttggaatttccataag

SEQ ID NO: 682401 - DNA, 20 bp, Artificial
  CRISPR gRNA sequence
tggaatttccataaggtttt

SEQ ID NO: 682402 - DNA, 20 bp, Artificial
  CRISPR gRNA sequence
ggaatttccataaggttttt

SEQ ID NO: 682403 - DNA, 20 bp, Artificial
  CRISPR gRNA sequence
gaatttccataaggttttta

SEQ ID NO: 682404 - DNA, 20 bp, Artificial
  CRISPR gRNA sequence
ccataaggtttttatgtaat

SEQ ID NO: 682405 - DNA, 20 bp, Artificial
  CRISPR gRNA sequence
cataaggtttttatgtaata

SEQ ID NO: 682406 - DNA, 20 bp, Artificial
  CRISPR gRNA sequence
ttatgtaatattctatttct

SEQ ID NO: 682407 - DNA, 20 bp, Artificial
  CRISPR gRNA sequence
tatgtaatattctatttcta

SEQ ID NO: 682408 - DNA, 20 bp, Artificial
  CRISPR gRNA sequence
atgtaatattctatttctag

SEQ ID NO: 682409 - DNA, 20 bp, Artificial
  CRISPR gRNA sequence
tgtaatattctatttctagc

SEQ ID NO: 682410 - DNA, 20 bp, Artificial
  CRISPR gRNA sequence
tatttctagctttttagttt

SEQ ID NO: 682411 - DNA, 20 bp, Artificial
  CRISPR gRNA sequence
tttctagctttttagtttta

SEQ ID NO: 682412 - DNA, 20 bp, Artificial
  CRISPR gRNA sequence
ctagctttttagttttatct

SEQ ID NO: 682413 - DNA, 20 bp, Artificial
  CRISPR gRNA sequence
tagctttttagttttatctt

SEQ ID NO: 682414 - DNA, 20 bp, Artificial
  CRISPR gRNA sequence
gctttttagttttatcttgc

SEQ ID NO: 682415 - DNA, 20 bp, Artificial
  CRISPR gRNA sequence
tttagttttatcttgctgta

SEQ ID NO: 682416 - DNA, 20 bp, Artificial
  CRISPR gRNA sequence
ttagttttatcttgctgtac

SEQ ID NO: 682417 - DNA, 20 bp, Artificial
  CRISPR gRNA sequence
tagttttatcttgctgtact

SEQ ID NO: 682418 - DNA, 20 bp, Artificial
  CRISPR gRNA sequence
agttttatcttgctgtactg

SEQ ID NO: 682419 - DNA, 20 bp, Artificial
  CRISPR gRNA sequence
gttttatcttgctgtactgt

SEQ ID NO: 682420 - DNA, 20 bp, Artificial
  CRISPR gRNA sequence
tatcttgctgtactgtaagt

SEQ ID NO: 682421 - DNA, 20 bp, Artificial
  CRISPR gRNA sequence
atcttgctgtactgtaagtt

SEQ ID NO: 682422 - DNA, 20 bp, Artificial
  CRISPR gRNA sequence
tcttgctgtactgtaagttt

SEQ ID NO: 682423 - DNA, 20 bp, Artificial
  CRISPR gRNA sequence
gctgtactgtaagtttgagg

SEQ ID NO: 682424 - DNA, 20 bp, Artificial
  CRISPR gRNA sequence
ctgtactgtaagtttgagga

SEQ ID NO: 682425 - DNA, 20 bp, Artificial
  CRISPR gRNA sequence
tactgtaagtttgaggatat

SEQ ID NO: 682426 - DNA, 20 bp, Artificial
  CRISPR gRNA sequence
taagtttgaggatatttttc

SEQ ID NO: 682427 - DNA, 20 bp, Artificial
  CRISPR gRNA sequence
gaggatatttttcacctgca

SEQ ID NO: 682428 - DNA, 20 bp, Artificial
  CRISPR gRNA sequence
aggatatttttcacctgcac

SEQ ID NO: 682429 - DNA, 20 bp, Artificial
  CRISPR gRNA sequence
ttcacctgcactcttaggaa

SEQ ID NO: 682430 - DNA, 20 bp, Artificial
  CRISPR gRNA sequence
tcacctgcactcttaggaat

SEQ ID NO: 682431 - DNA, 20 bp, Artificial
  CRISPR gRNA sequence
cacctgcactcttaggaata

SEQ ID NO: 682432 - DNA, 20 bp, Artificial
  CRISPR gRNA sequence
acctgcactcttaggaataa

SEQ ID NO: 682433 - DNA, 20 bp, Artificial
  CRISPR gRNA sequence
cactcttaggaataagttca

SEQ ID NO: 682434 - DNA, 20 bp, Artificial
  CRISPR gRNA sequence
ttaggaataagttcataatt

SEQ ID NO: 682435 - DNA, 20 bp, Artificial
  CRISPR gRNA sequence
aggaataagttcataattct

SEQ ID NO: 682436 - DNA, 20 bp, Artificial
  CRISPR gRNA sequence
ggaataagttcataattctg

SEQ ID NO: 682437 - DNA, 20 bp, Artificial
  CRISPR gRNA sequence
ataattctgtttatggggct

SEQ ID NO: 682438 - DNA, 20 bp, Artificial
  CRISPR gRNA sequence
tgtttatggggctttcctcc

SEQ ID NO: 682439 - DNA, 20 bp, Artificial
  CRISPR gRNA sequence
tttatggggctttcctccca

SEQ ID NO: 682440 - DNA, 20 bp, Artificial
  CRISPR gRNA sequence
atggggctttcctcccataa

SEQ ID NO: 682441 - DNA, 20 bp, Artificial
  CRISPR gRNA sequence
tggggctttcctcccataac

SEQ ID NO: 682442 - DNA, 20 bp, Artificial
  CRISPR gRNA sequence
tcctcccataacactgcatt

SEQ ID NO: 682443 - DNA, 20 bp, Artificial
  CRISPR gRNA sequence
cctcccataacactgcattt

SEQ ID NO: 682444 - DNA, 20 bp, Artificial
  CRISPR gRNA sequence
ctcccataacactgcatttg

SEQ ID NO: 682445 - DNA, 20 bp, Artificial
  CRISPR gRNA sequence
ccataacactgcatttgtat

SEQ ID NO: 682446 - DNA, 20 bp, Artificial
  CRISPR gRNA sequence
catttgtatattttctgtat

SEQ ID NO: 682447 - DNA, 20 bp, Artificial
  CRISPR gRNA sequence
gtatattttctgtataaaat

SEQ ID NO: 682448 - DNA, 20 bp, Artificial
  CRISPR gRNA sequence
tatattttctgtataaaata

SEQ ID NO: 682449 - DNA, 20 bp, Artificial
  CRISPR gRNA sequence
tctgtataaaatatgtgttg

SEQ ID NO: 682450 - DNA, 20 bp, Artificial
  CRISPR gRNA sequence
ctgtataaaatatgtgttgt

SEQ ID NO: 682451 - DNA, 20 bp, Artificial
  CRISPR gRNA sequence
tgtataaaatatgtgttgtg

SEQ ID NO: 682452 - DNA, 20 bp, Artificial
  CRISPR gRNA sequence
tataaaatatgtgttgtgta

SEQ ID NO: 682453 - DNA, 20 bp, Artificial
  CRISPR gRNA sequence
tgtattaacctttatcccat

SEQ ID NO: 682454 - DNA, 20 bp, Artificial
  CRISPR gRNA sequence
acctttatcccatacagaga

SEQ ID NO: 682455 - DNA, 20 bp, Artificial
  CRISPR gRNA sequence
tatcccatacagagagtggt

SEQ ID NO: 682456 - DNA, 20 bp, Artificial
  CRISPR gRNA sequence
atcccatacagagagtggta

SEQ ID NO: 682457 - DNA, 20 bp, Artificial
  CRISPR gRNA sequence
tcccatacagagagtggtac

SEQ ID NO: 682458 - DNA, 20 bp, Artificial
  CRISPR gRNA sequence
gttttctaagatgtcctttt

SEQ ID NO: 682459 - DNA, 20 bp, Artificial
  CRISPR gRNA sequence
tctaagatgtcctttttatt

SEQ ID NO: 682460 - DNA, 20 bp, Artificial
  CRISPR gRNA sequence
ctaagatgtcctttttattg

SEQ ID NO: 682461 - DNA, 20 bp, Artificial
  CRISPR gRNA sequence
taagatgtcctttttattgt

SEQ ID NO: 682462 - DNA, 20 bp, Artificial
  CRISPR gRNA sequence
agatgtcctttttattgtga

SEQ ID NO: 682463 - DNA, 20 bp, Artificial
  CRISPR gRNA sequence
tttattgtgaataaaatata

SEQ ID NO: 682464 - DNA, 20 bp, Artificial
  CRISPR gRNA sequence
ttattgtgaataaaatataa

SEQ ID NO: 682465 - DNA, 20 bp, Artificial
  CRISPR gRNA sequence
tattgtgaataaaatataaa

SEQ ID NO: 682466 - DNA, 20 bp, Artificial
  CRISPR gRNA sequence
attgtgaataaaatataaaa

SEQ ID NO: 682467 - DNA, 20 bp, Artificial
  CRISPR gRNA sequence
ttgtgaataaaatataaaag

SEQ ID NO: 682468 - DNA, 20 bp, Artificial
  CRISPR gRNA sequence
tgaataaaatataaaagtta

SEQ ID NO: 682469 - DNA, 20 bp, Artificial
  CRISPR gRNA sequence
aaggccctctgctaagtcac

SEQ ID NO: 682470 - DNA, 20 bp, Artificial
  CRISPR gRNA sequence
tgctaagtcacataaagtac

SEQ ID NO: 682471 - DNA, 20 bp, Artificial
  CRISPR gRNA sequence
ctaagtcacataaagtacag

SEQ ID NO: 682472 - DNA, 20 bp, Artificial
  CRISPR gRNA sequence
agtcacataaagtacagcat

SEQ ID NO: 682473 - DNA, 20 bp, Artificial
  CRISPR gRNA sequence
atataggtacaaataaatga

SEQ ID NO: 682474 - DNA, 20 bp, Artificial
  CRISPR gRNA sequence
gcagtgaattgggccttcaa

SEQ ID NO: 682475 - DNA, 20 bp, Artificial
  CRISPR gRNA sequence
cagtgaattgggccttcaaa

SEQ ID NO: 682476 - DNA, 20 bp, Artificial
  CRISPR gRNA sequence
ggccttcaaattacctcaag

SEQ ID NO: 682477 - DNA, 20 bp, Artificial
  CRISPR gRNA sequence
caaattacctcaagtgacag

SEQ ID NO: 682478 - DNA, 20 bp, Artificial
  CRISPR gRNA sequence
aaattacctcaagtgacaga

SEQ ID NO: 682479 - DNA, 20 bp, Artificial
  CRISPR gRNA sequence
cctcaagtgacagatagtaa

SEQ ID NO: 682480 - DNA, 20 bp, Artificial
  CRISPR gRNA sequence
aagtgacagatagtaagaaa

SEQ ID NO: 682481 - DNA, 20 bp, Artificial
  CRISPR gRNA sequence
cttgagcaggtggaggtcac

SEQ ID NO: 682482 - DNA, 20 bp, Artificial
  CRISPR gRNA sequence
ttgagcaggtggaggtcact

SEQ ID NO: 682483 - DNA, 20 bp, Artificial
  CRISPR gRNA sequence
gagcaggtggaggtcactga

SEQ ID NO: 682484 - DNA, 20 bp, Artificial
  CRISPR gRNA sequence
agcaggtggaggtcactgaa

SEQ ID NO: 682485 - DNA, 20 bp, Artificial
  CRISPR gRNA sequence
aatcccctactatgcactta

SEQ ID NO: 682486 - DNA, 20 bp, Artificial
  CRISPR gRNA sequence
ctatgcacttaccaagattt

SEQ ID NO: 682487 - DNA, 20 bp, Artificial
  CRISPR gRNA sequence
tgcacttaccaagattttac

SEQ ID NO: 682488 - DNA, 20 bp, Artificial
  CRISPR gRNA sequence
accaagattttacttacttt

SEQ ID NO: 682489 - DNA, 20 bp, Artificial
  CRISPR gRNA sequence
ccaagattttacttacttta

SEQ ID NO: 682490 - DNA, 20 bp, Artificial
  CRISPR gRNA sequence
tacttactttaatttactgg

SEQ ID NO: 682491 - DNA, 20 bp, Artificial
  CRISPR gRNA sequence
acttactttaatttactgga

SEQ ID NO: 682492 - DNA, 20 bp, Artificial
  CRISPR gRNA sequence
cttactttaatttactggaa

SEQ ID NO: 682493 - DNA, 20 bp, Artificial
  CRISPR gRNA sequence
actttaatttactggaaatt

SEQ ID NO: 682494 - DNA, 20 bp, Artificial
  CRISPR gRNA sequence
ctttaatttactggaaattg

SEQ ID NO: 682495 - DNA, 20 bp, Artificial
  CRISPR gRNA sequence
taatttactggaaattgatt

SEQ ID NO: 682496 - DNA, 20 bp, Artificial
  CRISPR gRNA sequence
aatttactggaaattgattt

SEQ ID NO: 682497 - DNA, 20 bp, Artificial
  CRISPR gRNA sequence
atttactggaaattgatttt

SEQ ID NO: 682498 - DNA, 20 bp, Artificial
  CRISPR gRNA sequence
actggaaattgattttttaa

SEQ ID NO: 682499 - DNA, 20 bp, Artificial
  CRISPR gRNA sequence
ctggaaattgattttttaaa

SEQ ID NO: 682500 - DNA, 20 bp, Artificial
  CRISPR gRNA sequence
gaaattgattttttaaaaaa

SEQ ID NO: 682501 - DNA, 20 bp, Artificial
  CRISPR gRNA sequence
attttttaaaaaatgactac

SEQ ID NO: 682502 - DNA, 20 bp, Artificial
  CRISPR gRNA sequence
tttaaaaaatgactacactg

SEQ ID NO: 682503 - DNA, 20 bp, Artificial
  CRISPR gRNA sequence
ttaaaaaatgactacactgt

SEQ ID NO: 682504 - DNA, 20 bp, Artificial
  CRISPR gRNA sequence
taaaaaatgactacactgta

SEQ ID NO: 682505 - DNA, 20 bp, Artificial
  CRISPR gRNA sequence
aaaaaatgactacactgtaa

SEQ ID NO: 682506 - DNA, 20 bp, Artificial
  CRISPR gRNA sequence
aaaaatgactacactgtaac

SEQ ID NO: 682507 - DNA, 20 bp, Artificial
  CRISPR gRNA sequence
cactgtaacaagggaaggga

SEQ ID NO: 682508 - DNA, 20 bp, Artificial
  CRISPR gRNA sequence
taacaagggaagggatctgg

SEQ ID NO: 682509 - DNA, 20 bp, Artificial
  CRISPR gRNA sequence
ggtttttttgttgttttatt

SEQ ID NO: 682510 - DNA, 20 bp, Artificial
  CRISPR gRNA sequence
ttttgttgttttattcttgt

SEQ ID NO: 682511 - DNA, 20 bp, Artificial
  CRISPR gRNA sequence
tttgttgttttattcttgtt

SEQ ID NO: 682512 - DNA, 20 bp, Artificial
  CRISPR gRNA sequence
ttgttgttttattcttgttt

SEQ ID NO: 682513 - DNA, 20 bp, Artificial
  CRISPR gRNA sequence
tgttgttttattcttgtttt

SEQ ID NO: 682514 - DNA, 20 bp, Artificial
  CRISPR gRNA sequence
gttgttttattcttgttttt

SEQ ID NO: 682515 - DNA, 20 bp, Artificial
  CRISPR gRNA sequence
ttgttttattcttgtttttt

SEQ ID NO: 682516 - DNA, 20 bp, Artificial
  CRISPR gRNA sequence
ttttattcttgtttttttta

SEQ ID NO: 682517 - DNA, 20 bp, Artificial
  CRISPR gRNA sequence
tattcttgttttttttaagt

SEQ ID NO: 682518 - DNA, 20 bp, Artificial
  CRISPR gRNA sequence
attcttgttttttttaagta

SEQ ID NO: 682519 - DNA, 20 bp, Artificial
  CRISPR gRNA sequence
ttcttgttttttttaagtag

SEQ ID NO: 682520 - DNA, 20 bp, Artificial
  CRISPR gRNA sequence
ttgttttttttaagtagttc

SEQ ID NO: 682521 - DNA, 20 bp, Artificial
  CRISPR gRNA sequence
gttttttttaagtagttcaa

SEQ ID NO: 682522 - DNA, 20 bp, Artificial
  CRISPR gRNA sequence
ttttttttaagtagttcaaa

SEQ ID NO: 682523 - DNA, 20 bp, Artificial
  CRISPR gRNA sequence
tttttaagtagttcaaattc

SEQ ID NO: 682524 - DNA, 20 bp, Artificial
  CRISPR gRNA sequence
ttttaagtagttcaaattct

SEQ ID NO: 682525 - DNA, 20 bp, Artificial
  CRISPR gRNA sequence
tttaagtagttcaaattctg

SEQ ID NO: 682526 - DNA, 20 bp, Artificial
  CRISPR gRNA sequence
ttaagtagttcaaattctga

SEQ ID NO: 682527 - DNA, 20 bp, Artificial
  CRISPR gRNA sequence
taagtagttcaaattctgaa

SEQ ID NO: 682528 - DNA, 20 bp, Artificial
  CRISPR gRNA sequence
aagtagttcaaattctgaaa

SEQ ID NO: 682529 - DNA, 20 bp, Artificial
  CRISPR gRNA sequence
agtagttcaaattctgaaac

SEQ ID NO: 682530 - DNA, 20 bp, Artificial
  CRISPR gRNA sequence
aaattctgaaactgtgattt

SEQ ID NO: 682531 - DNA, 20 bp, Artificial
  CRISPR gRNA sequence
tgaaactgtgatttaaaaat

SEQ ID NO: 682532 - DNA, 20 bp, Artificial
  CRISPR gRNA sequence
aaactgtgatttaaaaattt

SEQ ID NO: 682533 - DNA, 20 bp, Artificial
  CRISPR gRNA sequence
tgatttaaaaattttttaca

SEQ ID NO: 682534 - DNA, 20 bp, Artificial
  CRISPR gRNA sequence
aaaaattttttacagtcaag

SEQ ID NO: 682535 - DNA, 20 bp, Artificial
  CRISPR gRNA sequence
aaaattttttacagtcaagc

SEQ ID NO: 682536 - DNA, 20 bp, Artificial
  CRISPR gRNA sequence
tttacagtcaagcattctga

SEQ ID NO: 682537 - DNA, 20 bp, Artificial
  CRISPR gRNA sequence
ttacagtcaagcattctgat

SEQ ID NO: 682538 - DNA, 20 bp, Artificial
  CRISPR gRNA sequence
tacagtcaagcattctgatt

SEQ ID NO: 682539 - DNA, 20 bp, Artificial
  CRISPR gRNA sequence
acagtcaagcattctgattt

SEQ ID NO: 682540 - DNA, 20 bp, Artificial
  CRISPR gRNA sequence
cagtcaagcattctgatttt

SEQ ID NO: 682541 - DNA, 20 bp, Artificial
  CRISPR gRNA sequence
tgattttgaacataactccc

SEQ ID NO: 682542 - DNA, 20 bp, Artificial
  CRISPR gRNA sequence
attttgaacataactccctt

SEQ ID NO: 682543 - DNA, 20 bp, Artificial
  CRISPR gRNA sequence
tgaacataactcccttccct

SEQ ID NO: 682544 - DNA, 20 bp, Artificial
  CRISPR gRNA sequence
gaacataactcccttccctt

SEQ ID NO: 682545 - DNA, 20 bp, Artificial
  CRISPR gRNA sequence
aacataactcccttcccttt

SEQ ID NO: 682546 - DNA, 20 bp, Artificial
  CRISPR gRNA sequence
ccttccctttctgtgtaaca

SEQ ID NO: 682547 - DNA, 20 bp, Artificial
  CRISPR gRNA sequence
ccctttctgtgtaacaaagg

SEQ ID NO: 682548 - DNA, 20 bp, Artificial
  CRISPR gRNA sequence
cctttctgtgtaacaaaggt

SEQ ID NO: 682549 - DNA, 20 bp, Artificial
  CRISPR gRNA sequence
tctgtgtaacaaaggtctct

SEQ ID NO: 682550 - DNA, 20 bp, Artificial
  CRISPR gRNA sequence
ctgtgtaacaaaggtctctc

SEQ ID NO: 682551 - DNA, 20 bp, Artificial
  CRISPR gRNA sequence
tgtgtaacaaaggtctctct

SEQ ID NO: 682552 - DNA, 20 bp, Artificial
  CRISPR gRNA sequence
tgtaacaaaggtctctctgt

SEQ ID NO: 682553 - DNA, 20 bp, Artificial
  CRISPR gRNA sequence
tctgttatctcttaaatttt

SEQ ID NO: 682554 - DNA, 20 bp, Artificial
  CRISPR gRNA sequence
tgttatctcttaaattttgt

SEQ ID NO: 682555 - DNA, 20 bp, Artificial
  CRISPR gRNA sequence
ttatctcttaaattttgtta

SEQ ID NO: 682556 - DNA, 20 bp, Artificial
  CRISPR gRNA sequence
tctcttaaattttgttacat

SEQ ID NO: 682557 - DNA, 20 bp, Artificial
  CRISPR gRNA sequence
ttaaattttgttacatctcc

SEQ ID NO: 682558 - DNA, 20 bp, Artificial
  CRISPR gRNA sequence
aaattttgttacatctccct

SEQ ID NO: 682559 - DNA, 20 bp, Artificial
  CRISPR gRNA sequence
aattttgttacatctccctc

SEQ ID NO: 682560 - DNA, 20 bp, Artificial
  CRISPR gRNA sequence
tgttacatctccctcagcct

SEQ ID NO: 682561 - DNA, 20 bp, Artificial
  CRISPR gRNA sequence
gttacatctccctcagcctc

SEQ ID NO: 682562 - DNA, 20 bp, Artificial
  CRISPR gRNA sequence
ttacatctccctcagcctct

SEQ ID NO: 682563 - DNA, 20 bp, Artificial
  CRISPR gRNA sequence
catctccctcagcctctttc

SEQ ID NO: 682564 - DNA, 20 bp, Artificial
  CRISPR gRNA sequence
cctcagcctctttctttgtc

SEQ ID NO: 682565 - DNA, 20 bp, Artificial
  CRISPR gRNA sequence
agcctctttctttgtccgtc

SEQ ID NO: 682566 - DNA, 20 bp, Artificial
  CRISPR gRNA sequence
tttctttgtccgtctccctt

SEQ ID NO: 682567 - DNA, 20 bp, Artificial
  CRISPR gRNA sequence
tctttgtccgtctcccttct

SEQ ID NO: 682568 - DNA, 20 bp, Artificial
  CRISPR gRNA sequence
ctttgtccgtctcccttctg

SEQ ID NO: 682569 - DNA, 20 bp, Artificial
  CRISPR gRNA sequence
tttgtccgtctcccttctgt

SEQ ID NO: 682570 - DNA, 20 bp, Artificial
  CRISPR gRNA sequence
tgtccgtctcccttctgtca

SEQ ID NO: 682571 - DNA, 20 bp, Artificial
  CRISPR gRNA sequence
gtccgtctcccttctgtcat

SEQ ID NO: 682572 - DNA, 20 bp, Artificial
  CRISPR gRNA sequence
tccgtctcccttctgtcatt

SEQ ID NO: 682573 - DNA, 20 bp, Artificial
  CRISPR gRNA sequence
ccttctgtcattgtctatgg

SEQ ID NO: 682574 - DNA, 20 bp, Artificial
  CRISPR gRNA sequence
ctgtcattgtctatggatgt

SEQ ID NO: 682575 - DNA, 20 bp, Artificial
  CRISPR gRNA sequence
tgtcattgtctatggatgtt

SEQ ID NO: 682576 - DNA, 20 bp, Artificial
  CRISPR gRNA sequence
tcattgtctatggatgttta

SEQ ID NO: 682577 - DNA, 20 bp, Artificial
  CRISPR gRNA sequence
tctatggatgtttacctctc

SEQ ID NO: 682578 - DNA, 20 bp, Artificial
  CRISPR gRNA sequence
tggatgtttacctctctgtt

SEQ ID NO: 682579 - DNA, 20 bp, Artificial
  CRISPR gRNA sequence
acctctctgttctcctaaaa

SEQ ID NO: 682580 - DNA, 20 bp, Artificial
  CRISPR gRNA sequence
cctctctgttctcctaaaag

SEQ ID NO: 682581 - DNA, 20 bp, Artificial
  CRISPR gRNA sequence
tctgttctcctaaaagtttg

SEQ ID NO: 682582 - DNA, 20 bp, Artificial
  CRISPR gRNA sequence
tgttctcctaaaagtttgaa

SEQ ID NO: 682583 - DNA, 20 bp, Artificial
  CRISPR gRNA sequence
ttctcctaaaagtttgaaga

SEQ ID NO: 682584 - DNA, 20 bp, Artificial
  CRISPR gRNA sequence
tcctaaaagtttgaagatta

SEQ ID NO: 682585 - DNA, 20 bp, Artificial
  CRISPR gRNA sequence
ctaaaagtttgaagattagg

SEQ ID NO: 682586 - DNA, 20 bp, Artificial
  CRISPR gRNA sequence
aaagtttgaagattaggtca

SEQ ID NO: 682587 - DNA, 20 bp, Artificial
  CRISPR gRNA sequence
gaagattaggtcaactctta

SEQ ID NO: 682588 - DNA, 20 bp, Artificial
  CRISPR gRNA sequence
aagattaggtcaactcttat

SEQ ID NO: 682589 - DNA, 20 bp, Artificial
  CRISPR gRNA sequence
ggtcaactcttatttctagt

SEQ ID NO: 682590 - DNA, 20 bp, Artificial
  CRISPR gRNA sequence
ttatttctagttcattggta

SEQ ID NO: 682591 - DNA, 20 bp, Artificial
  CRISPR gRNA sequence
atttctagttcattggtaat

SEQ ID NO: 682592 - DNA, 20 bp, Artificial
  CRISPR gRNA sequence
tttctagttcattggtaatt

SEQ ID NO: 682593 - DNA, 20 bp, Artificial
  CRISPR gRNA sequence
ctagttcattggtaatttaa

SEQ ID NO: 682594 - DNA, 20 bp, Artificial
  CRISPR gRNA sequence
tagttcattggtaatttaat

SEQ ID NO: 682595 - DNA, 20 bp, Artificial
  CRISPR gRNA sequence
gttcattggtaatttaatct

SEQ ID NO: 682596 - DNA, 20 bp, Artificial
  CRISPR gRNA sequence
attggtaatttaatcttaat

SEQ ID NO: 682597 - DNA, 20 bp, Artificial
  CRISPR gRNA sequence
gtaatttaatcttaattttt

SEQ ID NO: 682598 - DNA, 20 bp, Artificial
  CRISPR gRNA sequence
aatcttaatttttttttcgt

SEQ ID NO: 682599 - DNA, 20 bp, Artificial
  CRISPR gRNA sequence
atcttaatttttttttcgtg

SEQ ID NO: 682600 - DNA, 20 bp, Artificial
  CRISPR gRNA sequence
aatttttttttcgtgatttt

SEQ ID NO: 682601 - DNA, 20 bp, Artificial
  CRISPR gRNA sequence
atttttttttcgtgattttt

SEQ ID NO: 682602 - DNA, 20 bp, Artificial
  CRISPR gRNA sequence
ttttttcgtgatttttgttg

SEQ ID NO: 682603 - DNA, 20 bp, Artificial
  CRISPR gRNA sequence
tttttcgtgatttttgttgg

SEQ ID NO: 682604 - DNA, 20 bp, Artificial
  CRISPR gRNA sequence
ttttcgtgatttttgttggt

SEQ ID NO: 682605 - DNA, 20 bp, Artificial
  CRISPR gRNA sequence
tttcgtgatttttgttggtt

SEQ ID NO: 682606 - DNA, 20 bp, Artificial
  CRISPR gRNA sequence
ttcgtgatttttgttggttg

SEQ ID NO: 682607 - DNA, 20 bp, Artificial
  CRISPR gRNA sequence
tcgtgatttttgttggttgt

SEQ ID NO: 682608 - DNA, 20 bp, Artificial
  CRISPR gRNA sequence
cgtgatttttgttggttgta

SEQ ID NO: 682609 - DNA, 20 bp, Artificial
  CRISPR gRNA sequence
gtgatttttgttggttgtat

SEQ ID NO: 682610 - DNA, 20 bp, Artificial
  CRISPR gRNA sequence
ttgttggttgtataatctgc

SEQ ID NO: 682611 - DNA, 20 bp, Artificial
  CRISPR gRNA sequence
tgttggttgtataatctgct

SEQ ID NO: 682612 - DNA, 20 bp, Artificial
  CRISPR gRNA sequence
gttggttgtataatctgctg

SEQ ID NO: 682613 - DNA, 20 bp, Artificial
  CRISPR gRNA sequence
ttggttgtataatctgctga

SEQ ID NO: 682614 - DNA, 20 bp, Artificial
  CRISPR gRNA sequence
gttgtataatctgctgacgt

SEQ ID NO: 682615 - DNA, 20 bp, Artificial
  CRISPR gRNA sequence
tataatctgctgacgtattt

SEQ ID NO: 682616 - DNA, 20 bp, Artificial
  CRISPR gRNA sequence
ctgacgtatttttatactca

SEQ ID NO: 682617 - DNA, 20 bp, Artificial
  CRISPR gRNA sequence
acgtatttttatactcaagt

SEQ ID NO: 682618 - DNA, 20 bp, Artificial
  CRISPR gRNA sequence
ttatactcaagtgtagtttt

SEQ ID NO: 682619 - DNA, 20 bp, Artificial
  CRISPR gRNA sequence
tatactcaagtgtagttttc

SEQ ID NO: 682620 - DNA, 20 bp, Artificial
  CRISPR gRNA sequence
atactcaagtgtagttttct

SEQ ID NO: 682621 - DNA, 20 bp, Artificial
  CRISPR gRNA sequence
tactcaagtgtagttttcta

SEQ ID NO: 682622 - DNA, 20 bp, Artificial
  CRISPR gRNA sequence
aagtgtagttttctattaaa

SEQ ID NO: 682623 - DNA, 20 bp, Artificial
  CRISPR gRNA sequence
tctattaaaaagaaaagtgg

SEQ ID NO: 682624 - DNA, 20 bp, Artificial
  CRISPR gRNA sequence
ctattaaaaagaaaagtggt

SEQ ID NO: 682625 - DNA, 20 bp, Artificial
  CRISPR gRNA sequence
tattaaaaagaaaagtggtt

SEQ ID NO: 682626 - DNA, 20 bp, Artificial
  CRISPR gRNA sequence
ttaaaaagaaaagtggttgg

SEQ ID NO: 682627 - DNA, 20 bp, Artificial
  CRISPR gRNA sequence
aaaagaaaagtggttggatt

SEQ ID NO: 682628 - DNA, 20 bp, Artificial
  CRISPR gRNA sequence
gattaaaaatagtaagctat

SEQ ID NO: 682629 - DNA, 20 bp, Artificial
  CRISPR gRNA sequence
aaaatagtaagctatgtaac

SEQ ID NO: 682630 - DNA, 20 bp, Artificial
  CRISPR gRNA sequence
tgtaaccctcatgttacttt

SEQ ID NO: 682631 - DNA, 20 bp, Artificial
  CRISPR gRNA sequence
atgttactttcactttcaaa

SEQ ID NO: 682632 - DNA, 20 bp, Artificial
  CRISPR gRNA sequence
ctttcactttcaaatattgg

SEQ ID NO: 682633 - DNA, 20 bp, Artificial
  CRISPR gRNA sequence
tcactttcaaatattgggta

SEQ ID NO: 682634 - DNA, 20 bp, Artificial
  CRISPR gRNA sequence
cactttcaaatattgggtac

SEQ ID NO: 682635 - DNA, 20 bp, Artificial
  CRISPR gRNA sequence
actttcaaatattgggtacc

SEQ ID NO: 682636 - DNA, 20 bp, Artificial
  CRISPR gRNA sequence
tcaaatattgggtacctaaa

SEQ ID NO: 682637 - DNA, 20 bp, Artificial
  CRISPR gRNA sequence
caaatattgggtacctaaaa

SEQ ID NO: 682638 - DNA, 20 bp, Artificial
  CRISPR gRNA sequence
aaatattgggtacctaaaac

SEQ ID NO: 682639 - DNA, 20 bp, Artificial
  CRISPR gRNA sequence
ggtacctaaaacattacttc

SEQ ID NO: 682640 - DNA, 20 bp, Artificial
  CRISPR gRNA sequence
aaacattacttcagagatta

SEQ ID NO: 682641 - DNA, 20 bp, Artificial
  CRISPR gRNA sequence
cttcagagattatgtaatcc

SEQ ID NO: 682642 - DNA, 20 bp, Artificial
  CRISPR gRNA sequence
cagagattatgtaatcctat

SEQ ID NO: 682643 - DNA, 20 bp, Artificial
  CRISPR gRNA sequence
agagattatgtaatcctatt

SEQ ID NO: 682644 - DNA, 20 bp, Artificial
  CRISPR gRNA sequence
tgtaatcctattatagtatg

SEQ ID NO: 682645 - DNA, 20 bp, Artificial
  CRISPR gRNA sequence
ttatagtatgtttgctttcc

SEQ ID NO: 682646 - DNA, 20 bp, Artificial
  CRISPR gRNA sequence
tagtatgtttgctttccttt

SEQ ID NO: 682647 - DNA, 20 bp, Artificial
  CRISPR gRNA sequence
gctttcctttattgttggat

SEQ ID NO: 682648 - DNA, 20 bp, Artificial
  CRISPR gRNA sequence
ctttcctttattgttggatt

SEQ ID NO: 682649 - DNA, 20 bp, Artificial
  CRISPR gRNA sequence
tcctttattgttggatttta

SEQ ID NO: 682650 - DNA, 20 bp, Artificial
  CRISPR gRNA sequence
cctttattgttggattttac

SEQ ID NO: 682651 - DNA, 20 bp, Artificial
  CRISPR gRNA sequence
ctttattgttggattttaca

SEQ ID NO: 682652 - DNA, 20 bp, Artificial
  CRISPR gRNA sequence
tattgttggattttacattc

SEQ ID NO: 682653 - DNA, 20 bp, Artificial
  CRISPR gRNA sequence
attgttggattttacattct

SEQ ID NO: 682654 - DNA, 20 bp, Artificial
  CRISPR gRNA sequence
ttgttggattttacattctg

SEQ ID NO: 682655 - DNA, 20 bp, Artificial
  CRISPR gRNA sequence
ttggattttacattctgatt

SEQ ID NO: 682656 - DNA, 20 bp, Artificial
  CRISPR gRNA sequence
gattttacattctgatttgg

SEQ ID NO: 682657 - DNA, 20 bp, Artificial
  CRISPR gRNA sequence
tacattctgatttggctttc

SEQ ID NO: 682658 - DNA, 20 bp, Artificial
  CRISPR gRNA sequence
acattctgatttggctttcc

SEQ ID NO: 682659 - DNA, 20 bp, Artificial
  CRISPR gRNA sequence
cattctgatttggctttcct

SEQ ID NO: 682660 - DNA, 20 bp, Artificial
  CRISPR gRNA sequence
tgatttggctttcctccaaa

SEQ ID NO: 682661 - DNA, 20 bp, Artificial
  CRISPR gRNA sequence
atttggctttcctccaaaaa

SEQ ID NO: 682662 - DNA, 20 bp, Artificial
  CRISPR gRNA sequence
ggctttcctccaaaaaatgt

SEQ ID NO: 682663 - DNA, 20 bp, Artificial
  CRISPR gRNA sequence
gctttcctccaaaaaatgta

SEQ ID NO: 682664 - DNA, 20 bp, Artificial
  CRISPR gRNA sequence
tcctccaaaaaatgtatatc

SEQ ID NO: 682665 - DNA, 20 bp, Artificial
  CRISPR gRNA sequence
cctccaaaaaatgtatatca

SEQ ID NO: 682666 - DNA, 20 bp, Artificial
  CRISPR gRNA sequence
ctccaaaaaatgtatatcat

SEQ ID NO: 682667 - DNA, 20 bp, Artificial
  CRISPR gRNA sequence
caaaaaatgtatatcatgaa

SEQ ID NO: 682668 - DNA, 20 bp, Artificial
  CRISPR gRNA sequence
gacagttatttgcaagtgtt

SEQ ID NO: 682669 - DNA, 20 bp, Artificial
  CRISPR gRNA sequence
tttgcaagtgtttagaaagg

SEQ ID NO: 682670 - DNA, 20 bp, Artificial
  CRISPR gRNA sequence
gcaagtgtttagaaaggtgt

SEQ ID NO: 682671 - DNA, 20 bp, Artificial
  CRISPR gRNA sequence
caagtgtttagaaaggtgtt

SEQ ID NO: 682672 - DNA, 20 bp, Artificial
  CRISPR gRNA sequence
agaaaggtgttaaaaatgta

SEQ ID NO: 682673 - DNA, 20 bp, Artificial
  CRISPR gRNA sequence
gaaaggtgttaaaaatgtaa

SEQ ID NO: 682674 - DNA, 20 bp, Artificial
  CRISPR gRNA sequence
aaaatgtaaagcaaagagtc

SEQ ID NO: 682675 - DNA, 20 bp, Artificial
  CRISPR gRNA sequence
aactttctcctaattgggag

SEQ ID NO: 682676 - DNA, 20 bp, Artificial
  CRISPR gRNA sequence
actttctcctaattgggaga

SEQ ID NO: 682677 - DNA, 20 bp, Artificial
  CRISPR gRNA sequence
tctcctaattgggagaaaaa

SEQ ID NO: 682678 - DNA, 20 bp, Artificial
  CRISPR gRNA sequence
ctcctaattgggagaaaaat

SEQ ID NO: 682679 - DNA, 20 bp, Artificial
  CRISPR gRNA sequence
tcctaattgggagaaaaatg

SEQ ID NO: 682680 - DNA, 20 bp, Artificial
  CRISPR gRNA sequence
ctaattgggagaaaaatgct

SEQ ID NO: 682681 - DNA, 20 bp, Artificial
  CRISPR gRNA sequence
attgggagaaaaatgcttta

SEQ ID NO: 682682 - DNA, 20 bp, Artificial
  CRISPR gRNA sequence
ggagaaaaatgctttaacat

SEQ ID NO: 682683 - DNA, 20 bp, Artificial
  CRISPR gRNA sequence
taacattactataataatat

SEQ ID NO: 682684 - DNA, 20 bp, Artificial
  CRISPR gRNA sequence
aacattactataataatatt

SEQ ID NO: 682685 - DNA, 20 bp, Artificial
  CRISPR gRNA sequence
acattactataataatattc

SEQ ID NO: 682686 - DNA, 20 bp, Artificial
  CRISPR gRNA sequence
ctataataatattccaggtt

SEQ ID NO: 682687 - DNA, 20 bp, Artificial
  CRISPR gRNA sequence
taataatattccaggtttgg

SEQ ID NO: 682688 - DNA, 20 bp, Artificial
  CRISPR gRNA sequence
caggtttggagggggtctcc

SEQ ID NO: 682689 - DNA, 20 bp, Artificial
  CRISPR gRNA sequence
ggagggggtctccaggcccc

SEQ ID NO: 682690 - DNA, 20 bp, Artificial
  CRISPR gRNA sequence
gagggggtctccaggcccca

SEQ ID NO: 682691 - DNA, 20 bp, Artificial
  CRISPR gRNA sequence
caggccccatatttgctgtt

SEQ ID NO: 682692 - DNA, 20 bp, Artificial
  CRISPR gRNA sequence
gctgttaatagttggacctt

SEQ ID NO: 682693 - DNA, 20 bp, Artificial
  CRISPR gRNA sequence
ctgttaatagttggaccttt

SEQ ID NO: 682694 - DNA, 20 bp, Artificial
  CRISPR gRNA sequence
ttaatagttggaccttttag

SEQ ID NO: 682695 - DNA, 20 bp, Artificial
  CRISPR gRNA sequence
atagttggaccttttagacc

SEQ ID NO: 682696 - DNA, 20 bp, Artificial
  CRISPR gRNA sequence
gaccttttagaccatgtgtt

SEQ ID NO: 682697 - DNA, 20 bp, Artificial
  CRISPR gRNA sequence
ttagaccatgtgttatttgc

SEQ ID NO: 682698 - DNA, 20 bp, Artificial
  CRISPR gRNA sequence
tagaccatgtgttatttgca

SEQ ID NO: 682699 - DNA, 20 bp, Artificial
  CRISPR gRNA sequence
agaccatgtgttatttgcaa

SEQ ID NO: 682700 - DNA, 20 bp, Artificial
  CRISPR gRNA sequence
gaccatgtgttatttgcaat

SEQ ID NO: 682701 - DNA, 20 bp, Artificial
  CRISPR gRNA sequence
tttgcaatcccagaatgatt

SEQ ID NO: 682702 - DNA, 20 bp, Artificial
  CRISPR gRNA sequence
gcaatcccagaatgattgct

SEQ ID NO: 682703 - DNA, 20 bp, Artificial
  CRISPR gRNA sequence
caatcccagaatgattgctt

SEQ ID NO: 682704 - DNA, 20 bp, Artificial
  CRISPR gRNA sequence
cttctgctattagttaaaaa

SEQ ID NO: 682705 - DNA, 20 bp, Artificial
  CRISPR gRNA sequence
ctgctattagttaaaaagat

SEQ ID NO: 682706 - DNA, 20 bp, Artificial
  CRISPR gRNA sequence
tgctattagttaaaaagata

SEQ ID NO: 682707 - DNA, 20 bp, Artificial
  CRISPR gRNA sequence
ctattagttaaaaagatact

SEQ ID NO: 682708 - DNA, 20 bp, Artificial
  CRISPR gRNA sequence
ttagttaaaaagatactatt

SEQ ID NO: 682709 - DNA, 20 bp, Artificial
  CRISPR gRNA sequence
gttaaaaagatactattctt

SEQ ID NO: 682710 - DNA, 20 bp, Artificial
  CRISPR gRNA sequence
aaaagatactattcttttct

SEQ ID NO: 682711 - DNA, 20 bp, Artificial
  CRISPR gRNA sequence
ttcttttctttctgtacaag

SEQ ID NO: 682712 - DNA, 20 bp, Artificial
  CRISPR gRNA sequence
ttttctttctgtacaagtgc

SEQ ID NO: 682713 - DNA, 20 bp, Artificial
  CRISPR gRNA sequence
ttctttctgtacaagtgcaa

SEQ ID NO: 682714 - DNA, 20 bp, Artificial
  CRISPR gRNA sequence
tctttctgtacaagtgcaat

SEQ ID NO: 682715 - DNA, 20 bp, Artificial
  CRISPR gRNA sequence
ctttctgtacaagtgcaata

SEQ ID NO: 682716 - DNA, 20 bp, Artificial
  CRISPR gRNA sequence
tttctgtacaagtgcaatac

SEQ ID NO: 682717 - DNA, 20 bp, Artificial
  CRISPR gRNA sequence
tctgtacaagtgcaatactc

SEQ ID NO: 682718 - DNA, 20 bp, Artificial
  CRISPR gRNA sequence
ctgtacaagtgcaatactcc

SEQ ID NO: 682719 - DNA, 20 bp, Artificial
  CRISPR gRNA sequence
tgtacaagtgcaatactccc

SEQ ID NO: 682720 - DNA, 20 bp, Artificial
  CRISPR gRNA sequence
tacaagtgcaatactcccct

SEQ ID NO: 682721 - DNA, 20 bp, Artificial
  CRISPR gRNA sequence
cccttgaagtcttaaaaact

SEQ ID NO: 682722 - DNA, 20 bp, Artificial
  CRISPR gRNA sequence
gaagtcttaaaaactatggt

SEQ ID NO: 682723 - DNA, 20 bp, Artificial
  CRISPR gRNA sequence
aagtcttaaaaactatggtg

SEQ ID NO: 682724 - DNA, 20 bp, Artificial
  CRISPR gRNA sequence
aaaaactatggtgatttttt

SEQ ID NO: 682725 - DNA, 20 bp, Artificial
  CRISPR gRNA sequence
aaaactatggtgattttttt

SEQ ID NO: 682726 - DNA, 20 bp, Artificial
  CRISPR gRNA sequence
tggtgatttttttttctttt

SEQ ID NO: 682727 - DNA, 20 bp, Artificial
  CRISPR gRNA sequence
ttttttcttttctgacctat

SEQ ID NO: 682728 - DNA, 20 bp, Artificial
  CRISPR gRNA sequence
tttttcttttctgacctatt

SEQ ID NO: 682729 - DNA, 20 bp, Artificial
  CRISPR gRNA sequence
ttttcttttctgacctattc

SEQ ID NO: 682730 - DNA, 20 bp, Artificial
  CRISPR gRNA sequence
tttcttttctgacctattct

SEQ ID NO: 682731 - DNA, 20 bp, Artificial
  CRISPR gRNA sequence
ttcttttctgacctattctt

SEQ ID NO: 682732 - DNA, 20 bp, Artificial
  CRISPR gRNA sequence
tcttttctgacctattcttc

SEQ ID NO: 682733 - DNA, 20 bp, Artificial
  CRISPR gRNA sequence
cttttctgacctattcttcc

SEQ ID NO: 682734 - DNA, 20 bp, Artificial
  CRISPR gRNA sequence
ttttctgacctattcttcct

SEQ ID NO: 682735 - DNA, 20 bp, Artificial
  CRISPR gRNA sequence
ttctgacctattcttccttt

SEQ ID NO: 682736 - DNA, 20 bp, Artificial
  CRISPR gRNA sequence
tctgacctattcttccttta

SEQ ID NO: 682737 - DNA, 20 bp, Artificial
  CRISPR gRNA sequence
ctgacctattcttcctttag

SEQ ID NO: 682738 - DNA, 20 bp, Artificial
  CRISPR gRNA sequence
tgacctattcttcctttagc

SEQ ID NO: 682739 - DNA, 20 bp, Artificial
  CRISPR gRNA sequence
acctattcttcctttagcta

SEQ ID NO: 682740 - DNA, 20 bp, Artificial
  CRISPR gRNA sequence
ttcttcctttagctaatgac

SEQ ID NO: 682741 - DNA, 20 bp, Artificial
  CRISPR gRNA sequence
ttcctttagctaatgacaaa

SEQ ID NO: 682742 - DNA, 20 bp, Artificial
  CRISPR gRNA sequence
cctttagctaatgacaaaaa

SEQ ID NO: 682743 - DNA, 20 bp, Artificial
  CRISPR gRNA sequence
ctttagctaatgacaaaaag

SEQ ID NO: 682744 - DNA, 20 bp, Artificial
  CRISPR gRNA sequence
tagctaatgacaaaaagaaa

SEQ ID NO: 682745 - DNA, 20 bp, Artificial
  CRISPR gRNA sequence
agctaatgacaaaaagaaac

SEQ ID NO: 682746 - DNA, 20 bp, Artificial
  CRISPR gRNA sequence
gctaatgacaaaaagaaact

SEQ ID NO: 682747 - DNA, 20 bp, Artificial
  CRISPR gRNA sequence
atgacaaaaagaaactcata

SEQ ID NO: 682748 - DNA, 20 bp, Artificial
  CRISPR gRNA sequence
ataaaagtcatagtatgtta

SEQ ID NO: 682749 - DNA, 20 bp, Artificial
  CRISPR gRNA sequence
aaggacacaacaagcaaaga

SEQ ID NO: 682750 - DNA, 20 bp, Artificial
  CRISPR gRNA sequence
cacaatcaaaagattacaga

SEQ ID NO: 682751 - DNA, 20 bp, Artificial
  CRISPR gRNA sequence
cagaatgtggaaaccactag

SEQ ID NO: 682752 - DNA, 20 bp, Artificial
  CRISPR gRNA sequence
gtctgatctcatggtatctt

SEQ ID NO: 682753 - DNA, 20 bp, Artificial
  CRISPR gRNA sequence
atctcatggtatctttattt

SEQ ID NO: 682754 - DNA, 20 bp, Artificial
  CRISPR gRNA sequence
atggtatctttatttaagct

SEQ ID NO: 682755 - DNA, 20 bp, Artificial
  CRISPR gRNA sequence
tatttaagctaaatttccat

SEQ ID NO: 682756 - DNA, 20 bp, Artificial
  CRISPR gRNA sequence
atttaagctaaatttccatg

SEQ ID NO: 682757 - DNA, 20 bp, Artificial
  CRISPR gRNA sequence
tttaagctaaatttccatgg

SEQ ID NO: 682758 - DNA, 20 bp, Artificial
  CRISPR gRNA sequence
aagctaaatttccatggaaa

SEQ ID NO: 682759 - DNA, 20 bp, Artificial
  CRISPR gRNA sequence
agctaaatttccatggaaat

SEQ ID NO: 682760 - DNA, 20 bp, Artificial
  CRISPR gRNA sequence
aatttccatggaaattagta

SEQ ID NO: 682761 - DNA, 20 bp, Artificial
  CRISPR gRNA sequence
ccatggaaattagtaatctt

SEQ ID NO: 682762 - DNA, 20 bp, Artificial
  CRISPR gRNA sequence
catggaaattagtaatcttt

SEQ ID NO: 682763 - DNA, 20 bp, Artificial
  CRISPR gRNA sequence
gtaatcttttgcttgaaaaa

SEQ ID NO: 682764 - DNA, 20 bp, Artificial
  CRISPR gRNA sequence
ttgcttgaaaaatgtgtcct

SEQ ID NO: 682765 - DNA, 20 bp, Artificial
  CRISPR gRNA sequence
tgcttgaaaaatgtgtccta

SEQ ID NO: 682766 - DNA, 20 bp, Artificial
  CRISPR gRNA sequence
gcttgaaaaatgtgtcctaa

SEQ ID NO: 682767 - DNA, 20 bp, Artificial
  CRISPR gRNA sequence
cttgaaaaatgtgtcctaaa

SEQ ID NO: 682768 - DNA, 20 bp, Artificial
  CRISPR gRNA sequence
gaaaaatgtgtcctaaagtt

SEQ ID NO: 682769 - DNA, 20 bp, Artificial
  CRISPR gRNA sequence
aaaaatgtgtcctaaagttg

SEQ ID NO: 682770 - DNA, 20 bp, Artificial
  CRISPR gRNA sequence
aagttgaactttttacagat

SEQ ID NO: 682771 - DNA, 20 bp, Artificial
  CRISPR gRNA sequence
aactttttacagattgaatc

SEQ ID NO: 682772 - DNA, 20 bp, Artificial
  CRISPR gRNA sequence
tttacagattgaatcttctt

SEQ ID NO: 682773 - DNA, 20 bp, Artificial
  CRISPR gRNA sequence
ttacagattgaatcttctta

SEQ ID NO: 682774 - DNA, 20 bp, Artificial
  CRISPR gRNA sequence
tacagattgaatcttcttag

SEQ ID NO: 682775 - DNA, 20 bp, Artificial
  CRISPR gRNA sequence
acagattgaatcttcttaga

SEQ ID NO: 682776 - DNA, 20 bp, Artificial
  CRISPR gRNA sequence
cagattgaatcttcttagac

SEQ ID NO: 682777 - DNA, 20 bp, Artificial
  CRISPR gRNA sequence
aatcttcttagaccctcgcc

SEQ ID NO: 682778 - DNA, 20 bp, Artificial
  CRISPR gRNA sequence
cttagaccctcgcccaatgc

SEQ ID NO: 682779 - DNA, 20 bp, Artificial
  CRISPR gRNA sequence
ttagaccctcgcccaatgct

SEQ ID NO: 682780 - DNA, 20 bp, Artificial
  CRISPR gRNA sequence
agaccctcgcccaatgctct

SEQ ID NO: 682781 - DNA, 20 bp, Artificial
  CRISPR gRNA sequence
gaccctcgcccaatgctcta

SEQ ID NO: 682782 - DNA, 20 bp, Artificial
  CRISPR gRNA sequence
gcccaatgctctaaattaag

SEQ ID NO: 682783 - DNA, 20 bp, Artificial
  CRISPR gRNA sequence
taaattaagaacctaatact

SEQ ID NO: 682784 - DNA, 20 bp, Artificial
  CRISPR gRNA sequence
aattaagaacctaatactta

SEQ ID NO: 682785 - DNA, 20 bp, Artificial
  CRISPR gRNA sequence
agaacctaatacttaatatt

SEQ ID NO: 682786 - DNA, 20 bp, Artificial
  CRISPR gRNA sequence
atacttaatatttttatttt

SEQ ID NO: 682787 - DNA, 20 bp, Artificial
  CRISPR gRNA sequence
aatatttttattttacttct

SEQ ID NO: 682788 - DNA, 20 bp, Artificial
  CRISPR gRNA sequence
atatttttattttacttctc

SEQ ID NO: 682789 - DNA, 20 bp, Artificial
  CRISPR gRNA sequence
ttattttacttctccccttt

SEQ ID NO: 682790 - DNA, 20 bp, Artificial
  CRISPR gRNA sequence
tattttacttctcccctttt

SEQ ID NO: 682791 - DNA, 20 bp, Artificial
  CRISPR gRNA sequence
attttacttctcccctttta

SEQ ID NO: 682792 - DNA, 20 bp, Artificial
  CRISPR gRNA sequence
ttttacttctccccttttag

SEQ ID NO: 682793 - DNA, 20 bp, Artificial
  CRISPR gRNA sequence
tacttctccccttttagaaa

SEQ ID NO: 682794 - DNA, 20 bp, Artificial
  CRISPR gRNA sequence
acttctccccttttagaaat

SEQ ID NO: 682795 - DNA, 20 bp, Artificial
  CRISPR gRNA sequence
cttctccccttttagaaata

SEQ ID NO: 682796 - DNA, 20 bp, Artificial
  CRISPR gRNA sequence
ctccccttttagaaataaac

SEQ ID NO: 682797 - DNA, 20 bp, Artificial
  CRISPR gRNA sequence
tccccttttagaaataaact

SEQ ID NO: 682798 - DNA, 20 bp, Artificial
  CRISPR gRNA sequence
cccttttagaaataaacttt

SEQ ID NO: 682799 - DNA, 20 bp, Artificial
  CRISPR gRNA sequence
ttagaaataaacttttaaat

SEQ ID NO: 682800 - DNA, 20 bp, Artificial
  CRISPR gRNA sequence
tagaaataaacttttaaata

SEQ ID NO: 682801 - DNA, 20 bp, Artificial
  CRISPR gRNA sequence
agaaataaacttttaaataa

SEQ ID NO: 682802 - DNA, 20 bp, Artificial
  CRISPR gRNA sequence
gaaataaacttttaaataaa

SEQ ID NO: 682803 - DNA, 20 bp, Artificial
  CRISPR gRNA sequence
ttaaataaaagcaaagcact

SEQ ID NO: 682804 - DNA, 20 bp, Artificial
  CRISPR gRNA sequence
taaataaaagcaaagcactt

SEQ ID NO: 682805 - DNA, 20 bp, Artificial
  CRISPR gRNA sequence
aaataaaagcaaagcactta

SEQ ID NO: 682806 - DNA, 20 bp, Artificial
  CRISPR gRNA sequence
aataaaagcaaagcacttag

SEQ ID NO: 682807 - DNA, 20 bp, Artificial
  CRISPR gRNA sequence
agctgagttttaaacactta

SEQ ID NO: 682808 - DNA, 20 bp, Artificial
  CRISPR gRNA sequence
gctgagttttaaacacttac

SEQ ID NO: 682809 - DNA, 20 bp, Artificial
  CRISPR gRNA sequence
agttttaaacacttacatat

SEQ ID NO: 682810 - DNA, 20 bp, Artificial
  CRISPR gRNA sequence
taaacacttacatatcacct

SEQ ID NO: 682811 - DNA, 20 bp, Artificial
  CRISPR gRNA sequence
aaacacttacatatcaccta

SEQ ID NO: 682812 - DNA, 20 bp, Artificial
  CRISPR gRNA sequence
aacacttacatatcacctat

SEQ ID NO: 682813 - DNA, 20 bp, Artificial
  CRISPR gRNA sequence
acatatcacctattggagaa

SEQ ID NO: 682814 - DNA, 20 bp, Artificial
  CRISPR gRNA sequence
catatcacctattggagaaa

SEQ ID NO: 682815 - DNA, 20 bp, Artificial
  CRISPR gRNA sequence
ttggagaaattttttttaaa

SEQ ID NO: 682816 - DNA, 20 bp, Artificial
  CRISPR gRNA sequence
gagaaattttttttaaaaat

SEQ ID NO: 682817 - DNA, 20 bp, Artificial
  CRISPR gRNA sequence
tttttaaaaatatttggagc

SEQ ID NO: 682818 - DNA, 20 bp, Artificial
  CRISPR gRNA sequence
ttttaaaaatatttggagca

SEQ ID NO: 682819 - DNA, 20 bp, Artificial
  CRISPR gRNA sequence
tttaaaaatatttggagcag

SEQ ID NO: 682820 - DNA, 20 bp, Artificial
  CRISPR gRNA sequence
ttaaaaatatttggagcagt

SEQ ID NO: 682821 - DNA, 20 bp, Artificial
  CRISPR gRNA sequence
taaaaatatttggagcagtc

SEQ ID NO: 682822 - DNA, 20 bp, Artificial
  CRISPR gRNA sequence
aaaaatatttggagcagtcc

SEQ ID NO: 682823 - DNA, 20 bp, Artificial
  CRISPR gRNA sequence
aaaatatttggagcagtcct

SEQ ID NO: 682824 - DNA, 20 bp, Artificial
  CRISPR gRNA sequence
ggagcagtcctgttttcata

SEQ ID NO: 682825 - DNA, 20 bp, Artificial
  CRISPR gRNA sequence
gagcagtcctgttttcatac

SEQ ID NO: 682826 - DNA, 20 bp, Artificial
  CRISPR gRNA sequence
ttttcatacaaatttaagta

SEQ ID NO: 682827 - DNA, 20 bp, Artificial
  CRISPR gRNA sequence
tcatacaaatttaagtaaga

SEQ ID NO: 682828 - DNA, 20 bp, Artificial
  CRISPR gRNA sequence
catacaaatttaagtaagag

SEQ ID NO: 682829 - DNA, 20 bp, Artificial
  CRISPR gRNA sequence
atacaaatttaagtaagagg

SEQ ID NO: 682830 - DNA, 20 bp, Artificial
  CRISPR gRNA sequence
aagtaagaggtatttttctt

SEQ ID NO: 682831 - DNA, 20 bp, Artificial
  CRISPR gRNA sequence
agtaagaggtatttttctta

SEQ ID NO: 682832 - DNA, 20 bp, Artificial
  CRISPR gRNA sequence
ttcttatacatatttatatg

SEQ ID NO: 682833 - DNA, 20 bp, Artificial
  CRISPR gRNA sequence
tcttatacatatttatatgt

SEQ ID NO: 682834 - DNA, 20 bp, Artificial
  CRISPR gRNA sequence
cttatacatatttatatgta

SEQ ID NO: 682835 - DNA, 20 bp, Artificial
  CRISPR gRNA sequence
ttatacatatttatatgtag

SEQ ID NO: 682836 - DNA, 20 bp, Artificial
  CRISPR gRNA sequence
atacatatttatatgtagtg

SEQ ID NO: 682837 - DNA, 20 bp, Artificial
  CRISPR gRNA sequence
tacatatttatatgtagtgt

SEQ ID NO: 682838 - DNA, 20 bp, Artificial
  CRISPR gRNA sequence
atatgtagtgtgctaatttt

SEQ ID NO: 682839 - DNA, 20 bp, Artificial
  CRISPR gRNA sequence
tatgtagtgtgctaattttc

SEQ ID NO: 682840 - DNA, 20 bp, Artificial
  CRISPR gRNA sequence
attttctttttttatacctg

SEQ ID NO: 682841 - DNA, 20 bp, Artificial
  CRISPR gRNA sequence
tctttttttatacctgtgtc

SEQ ID NO: 682842 - DNA, 20 bp, Artificial
  CRISPR gRNA sequence
ctttttttatacctgtgtcc

SEQ ID NO: 682843 - DNA, 20 bp, Artificial
  CRISPR gRNA sequence
tttttttatacctgtgtccc

SEQ ID NO: 682844 - DNA, 20 bp, Artificial
  CRISPR gRNA sequence
tttttatacctgtgtccctg

SEQ ID NO: 682845 - DNA, 20 bp, Artificial
  CRISPR gRNA sequence
ttttatacctgtgtccctgt

SEQ ID NO: 682846 - DNA, 20 bp, Artificial
  CRISPR gRNA sequence
tttatacctgtgtccctgta

SEQ ID NO: 682847 - DNA, 20 bp, Artificial
  CRISPR gRNA sequence
ttatacctgtgtccctgtag

SEQ ID NO: 682848 - DNA, 20 bp, Artificial
  CRISPR gRNA sequence
tatacctgtgtccctgtagt

SEQ ID NO: 682849 - DNA, 20 bp, Artificial
  CRISPR gRNA sequence
atacctgtgtccctgtagta

SEQ ID NO: 682850 - DNA, 20 bp, Artificial
  CRISPR gRNA sequence
tacctgtgtccctgtagtaa

SEQ ID NO: 682851 - DNA, 20 bp, Artificial
  CRISPR gRNA sequence
tgtccctgtagtaaaactgc

SEQ ID NO: 682852 - DNA, 20 bp, Artificial
  CRISPR gRNA sequence
tagtaaaactgctgtaatat

SEQ ID NO: 682853 - DNA, 20 bp, Artificial
  CRISPR gRNA sequence
ctgtaatataaatacatgtt

SEQ ID NO: 682854 - DNA, 20 bp, Artificial
  CRISPR gRNA sequence
taatataaatacatgttttg

SEQ ID NO: 682855 - DNA, 20 bp, Artificial
  CRISPR gRNA sequence
tgttaaaagataacatttct

SEQ ID NO: 682856 - DNA, 20 bp, Artificial
  CRISPR gRNA sequence
gttaaaagataacatttctt

SEQ ID NO: 682857 - DNA, 20 bp, Artificial
  CRISPR gRNA sequence
ttaaaagataacatttcttt

SEQ ID NO: 682858 - DNA, 20 bp, Artificial
  CRISPR gRNA sequence
aaagataacatttctttggc

SEQ ID NO: 682859 - DNA, 20 bp, Artificial
  CRISPR gRNA sequence
ctttggcatttcttttaaag

SEQ ID NO: 682860 - DNA, 20 bp, Artificial
  CRISPR gRNA sequence
tttggcatttcttttaaagg

SEQ ID NO: 682861 - DNA, 20 bp, Artificial
  CRISPR gRNA sequence
tggcatttcttttaaaggca

SEQ ID NO: 682862 - DNA, 20 bp, Artificial
  CRISPR gRNA sequence
ggcatttcttttaaaggcag

SEQ ID NO: 682863 - DNA, 20 bp, Artificial
  CRISPR gRNA sequence
gcatttcttttaaaggcagt

SEQ ID NO: 682864 - DNA, 20 bp, Artificial
  CRISPR gRNA sequence
cttttaaaggcagttactgc

SEQ ID NO: 682865 - DNA, 20 bp, Artificial
  CRISPR gRNA sequence
ttttaaaggcagttactgca

SEQ ID NO: 682866 - DNA, 20 bp, Artificial
  CRISPR gRNA sequence
ttaaaggcagttactgcatt

SEQ ID NO: 682867 - DNA, 20 bp, Artificial
  CRISPR gRNA sequence
taaaggcagttactgcattt

SEQ ID NO: 682868 - DNA, 20 bp, Artificial
  CRISPR gRNA sequence
aaaggcagttactgcatttc

SEQ ID NO: 682869 - DNA, 20 bp, Artificial
  CRISPR gRNA sequence
aaggcagttactgcatttct

SEQ ID NO: 682870 - DNA, 20 bp, Artificial
  CRISPR gRNA sequence
ctgcatttctgcatttgtac

SEQ ID NO: 682871 - DNA, 20 bp, Artificial
  CRISPR gRNA sequence
catttctgcatttgtacagt

SEQ ID NO: 682872 - DNA, 20 bp, Artificial
  CRISPR gRNA sequence
ctgcatttgtacagtatgtg

SEQ ID NO: 682873 - DNA, 20 bp, Artificial
  CRISPR gRNA sequence
tgcatttgtacagtatgtgt

SEQ ID NO: 682874 - DNA, 20 bp, Artificial
  CRISPR gRNA sequence
catttgtacagtatgtgtct

SEQ ID NO: 682875 - DNA, 20 bp, Artificial
  CRISPR gRNA sequence
gtacagtatgtgtcttggcc

SEQ ID NO: 682876 - DNA, 20 bp, Artificial
  CRISPR gRNA sequence
tacagtatgtgtcttggcca

SEQ ID NO: 682877 - DNA, 20 bp, Artificial
  CRISPR gRNA sequence
ggccattttagatattcttt

SEQ ID NO: 682878 - DNA, 20 bp, Artificial
  CRISPR gRNA sequence
gccattttagatattctttc

SEQ ID NO: 682879 - DNA, 20 bp, Artificial
  CRISPR gRNA sequence
tagatattctttctttaaca

SEQ ID NO: 682880 - DNA, 20 bp, Artificial
  CRISPR gRNA sequence
agatattctttctttaacaa

SEQ ID NO: 682881 - DNA, 20 bp, Artificial
  CRISPR gRNA sequence
gatattctttctttaacaat

SEQ ID NO: 682882 - DNA, 20 bp, Artificial
  CRISPR gRNA sequence
tttctttaacaataccaaag

SEQ ID NO: 682883 - DNA, 20 bp, Artificial
  CRISPR gRNA sequence
tctttaacaataccaaaggt

SEQ ID NO: 682884 - DNA, 20 bp, Artificial
  CRISPR gRNA sequence
ctttaacaataccaaaggta

SEQ ID NO: 682885 - DNA, 20 bp, Artificial
  CRISPR gRNA sequence
tttaacaataccaaaggtaa

SEQ ID NO: 682886 - DNA, 20 bp, Artificial
  CRISPR gRNA sequence
taacaataccaaaggtaatt

SEQ ID NO: 682887 - DNA, 20 bp, Artificial
  CRISPR gRNA sequence
aacaataccaaaggtaatta

SEQ ID NO: 682888 - DNA, 20 bp, Artificial
  CRISPR gRNA sequence
acaataccaaaggtaattag

SEQ ID NO: 682889 - DNA, 20 bp, Artificial
  CRISPR gRNA sequence
gactattttaaagactaatt

SEQ ID NO: 682890 - DNA, 20 bp, Artificial
  CRISPR gRNA sequence
ttttaaagactaattgcttg

SEQ ID NO: 682891 - DNA, 20 bp, Artificial
  CRISPR gRNA sequence
taaagactaattgcttgaca

SEQ ID NO: 682892 - DNA, 20 bp, Artificial
  CRISPR gRNA sequence
aaagactaattgcttgacag

SEQ ID NO: 682893 - DNA, 20 bp, Artificial
  CRISPR gRNA sequence
aagactaattgcttgacagt

SEQ ID NO: 682894 - DNA, 20 bp, Artificial
  CRISPR gRNA sequence
attgcttgacagtttctagg

SEQ ID NO: 682895 - DNA, 20 bp, Artificial
  CRISPR gRNA sequence
cttgacagtttctagggtat

SEQ ID NO: 682896 - DNA, 20 bp, Artificial
  CRISPR gRNA sequence
gacagtttctagggtatttt

SEQ ID NO: 682897 - DNA, 20 bp, Artificial
  CRISPR gRNA sequence
acagtttctagggtattttg

SEQ ID NO: 682898 - DNA, 20 bp, Artificial
  CRISPR gRNA sequence
ctagggtattttgtgtttta

SEQ ID NO: 682899 - DNA, 20 bp, Artificial
  CRISPR gRNA sequence
tagggtattttgtgttttag

SEQ ID NO: 682900 - DNA, 20 bp, Artificial
  CRISPR gRNA sequence
gggtattttgtgttttagaa

SEQ ID NO: 682901 - DNA, 20 bp, Artificial
  CRISPR gRNA sequence
tgtgttttagaagcaaaaaa

SEQ ID NO: 682902 - DNA, 20 bp, Artificial
  CRISPR gRNA sequence
gtgttttagaagcaaaaaaa

SEQ ID NO: 682903 - DNA, 20 bp, Artificial
  CRISPR gRNA sequence
tgttttagaagcaaaaaaag

SEQ ID NO: 682904 - DNA, 20 bp, Artificial
  CRISPR gRNA sequence
tagaagcaaaaaaagaaaaa

SEQ ID NO: 682905 - DNA, 20 bp, Artificial
  CRISPR gRNA sequence
agaagcaaaaaaagaaaaaa

SEQ ID NO: 682906 - DNA, 20 bp, Artificial
  CRISPR gRNA sequence
gaagcaaaaaaagaaaaaaa

SEQ ID NO: 682907 - DNA, 20 bp, Artificial
  CRISPR gRNA sequence
attttttttcaaactaataa

SEQ ID NO: 682908 - DNA, 20 bp, Artificial
  CRISPR gRNA sequence
tttttcaaactaataatttg

SEQ ID NO: 682909 - DNA, 20 bp, Artificial
  CRISPR gRNA sequence
ttttcaaactaataatttgg

SEQ ID NO: 682910 - DNA, 20 bp, Artificial
  CRISPR gRNA sequence
tttcaaactaataatttggg

SEQ ID NO: 682911 - DNA, 20 bp, Artificial
  CRISPR gRNA sequence
ttcaaactaataatttgggg

SEQ ID NO: 682912 - DNA, 20 bp, Artificial
  CRISPR gRNA sequence
tcaaactaataatttgggga

SEQ ID NO: 682913 - DNA, 20 bp, Artificial
  CRISPR gRNA sequence
caaactaataatttggggaa

SEQ ID NO: 682914 - DNA, 20 bp, Artificial
  CRISPR gRNA sequence
aaactaataatttggggaaa

SEQ ID NO: 682915 - DNA, 20 bp, Artificial
  CRISPR gRNA sequence
ataatttggggaaataaaaa

SEQ ID NO: 682916 - DNA, 20 bp, Artificial
  CRISPR gRNA sequence
ggggaaataaaaactattgt

SEQ ID NO: 682917 - DNA, 20 bp, Artificial
  CRISPR gRNA sequence
gggaaataaaaactattgtt

SEQ ID NO: 682918 - DNA, 20 bp, Artificial
  CRISPR gRNA sequence
ttgtttaaaaaagaaatata

SEQ ID NO: 682919 - DNA, 20 bp, Artificial
  CRISPR gRNA sequence
tttaaaaaagaaatatatat

SEQ ID NO: 682920 - DNA, 20 bp, Artificial
  CRISPR gRNA sequence
aaaaaagaaatatatatata

SEQ ID NO: 682921 - DNA, 20 bp, Artificial
  CRISPR gRNA sequence
aaaaagaaatatatatatat

SEQ ID NO: 682922 - DNA, 20 bp, Artificial
  CRISPR gRNA sequence
aaattccataccttgtatgt

SEQ ID NO: 682923 - DNA, 20 bp, Artificial
  CRISPR gRNA sequence
cataccttgtatgtcaggtt

SEQ ID NO: 682924 - DNA, 20 bp, Artificial
  CRISPR gRNA sequence
gtatgtcaggtttgctaagt

SEQ ID NO: 682925 - DNA, 20 bp, Artificial
  CRISPR gRNA sequence
tatgtcaggtttgctaagtg

SEQ ID NO: 682926 - DNA, 20 bp, Artificial
  CRISPR gRNA sequence
gctaagtgtaatgtagtttt

SEQ ID NO: 682927 - DNA, 20 bp, Artificial
  CRISPR gRNA sequence
ctaagtgtaatgtagttttt

SEQ ID NO: 682928 - DNA, 20 bp, Artificial
  CRISPR gRNA sequence
agtgtaatgtagttttttta

SEQ ID NO: 682929 - DNA, 20 bp, Artificial
  CRISPR gRNA sequence
ttttaaggctcaaataccat

SEQ ID NO: 682930 - DNA, 20 bp, Artificial
  CRISPR gRNA sequence
tttaaggctcaaataccata

SEQ ID NO: 682931 - DNA, 20 bp, Artificial
  CRISPR gRNA sequence
ttaaggctcaaataccatac

SEQ ID NO: 682932 - DNA, 20 bp, Artificial
  CRISPR gRNA sequence
taaggctcaaataccatacc

SEQ ID NO: 682933 - DNA, 20 bp, Artificial
  CRISPR gRNA sequence
aaggctcaaataccatacct

SEQ ID NO: 682934 - DNA, 20 bp, Artificial
  CRISPR gRNA sequence
aggctcaaataccatacctc

SEQ ID NO: 682935 - DNA, 20 bp, Artificial
  CRISPR gRNA sequence
aaataccatacctcagaaaa

SEQ ID NO: 682936 - DNA, 20 bp, Artificial
  CRISPR gRNA sequence
agaaaatgaggtttactatg

SEQ ID NO: 682937 - DNA, 20 bp, Artificial
  CRISPR gRNA sequence
actatggaaatactgaaaca

SEQ ID NO: 682938 - DNA, 20 bp, Artificial
  CRISPR gRNA sequence
ctatggaaatactgaaacag

SEQ ID NO: 682939 - DNA, 20 bp, Artificial
  CRISPR gRNA sequence
tggaaatactgaaacagtct

SEQ ID NO: 682940 - DNA, 20 bp, Artificial
  CRISPR gRNA sequence
aaacagtctttgcagctgtg

SEQ ID NO: 682941 - DNA, 20 bp, Artificial
  CRISPR gRNA sequence
tgcagctgtgtgacaagtca

SEQ ID NO: 682942 - DNA, 20 bp, Artificial
  CRISPR gRNA sequence
gcagctgtgtgacaagtcac

SEQ ID NO: 682943 - DNA, 20 bp, Artificial
  CRISPR gRNA sequence
cagctgtgtgacaagtcact

SEQ ID NO: 682944 - DNA, 20 bp, Artificial
  CRISPR gRNA sequence
tgtgacaagtcactctacta

SEQ ID NO: 682945 - DNA, 20 bp, Artificial
  CRISPR gRNA sequence
tactacatactgatttggag

SEQ ID NO: 682946 - DNA, 20 bp, Artificial
  CRISPR gRNA sequence
ctacatactgatttggagac

SEQ ID NO: 682947 - DNA, 20 bp, Artificial
  CRISPR gRNA sequence
catactgatttggagacctc

SEQ ID NO: 682948 - DNA, 20 bp, Artificial
  CRISPR gRNA sequence
atttggagacctccgctaaa

SEQ ID NO: 682949 - DNA, 20 bp, Artificial
  CRISPR gRNA sequence
ggagacctccgctaaatagt

SEQ ID NO: 682950 - DNA, 20 bp, Artificial
  CRISPR gRNA sequence
gagacctccgctaaatagtt

SEQ ID NO: 682951 - DNA, 20 bp, Artificial
  CRISPR gRNA sequence
cgctaaatagttttatcact

SEQ ID NO: 682952 - DNA, 20 bp, Artificial
  CRISPR gRNA sequence
aatagttttatcactgcaga

SEQ ID NO: 682953 - DNA, 20 bp, Artificial
  CRISPR gRNA sequence
tatcactgcagactaaaatg

SEQ ID NO: 682954 - DNA, 20 bp, Artificial
  CRISPR gRNA sequence
atcactgcagactaaaatgt

SEQ ID NO: 682955 - DNA, 20 bp, Artificial
  CRISPR gRNA sequence
tcactgcagactaaaatgtg

SEQ ID NO: 682956 - DNA, 20 bp, Artificial
  CRISPR gRNA sequence
cagactaaaatgtgggactt

SEQ ID NO: 682957 - DNA, 20 bp, Artificial
  CRISPR gRNA sequence
aaatgtgggacttgtatctt

SEQ ID NO: 682958 - DNA, 20 bp, Artificial
  CRISPR gRNA sequence
gtatcttctttgtttttaat

SEQ ID NO: 682959 - DNA, 20 bp, Artificial
  CRISPR gRNA sequence
tatcttctttgtttttaatg

SEQ ID NO: 682960 - DNA, 20 bp, Artificial
  CRISPR gRNA sequence
ctttgtttttaatgcacaca

SEQ ID NO: 682961 - DNA, 20 bp, Artificial
  CRISPR gRNA sequence
tttgtttttaatgcacacac

SEQ ID NO: 682962 - DNA, 20 bp, Artificial
  CRISPR gRNA sequence
tgtttttaatgcacacacat

SEQ ID NO: 682963 - DNA, 20 bp, Artificial
  CRISPR gRNA sequence
gtttttaatgcacacacata

SEQ ID NO: 682964 - DNA, 20 bp, Artificial
  CRISPR gRNA sequence
tttttaatgcacacacatac

SEQ ID NO: 682965 - DNA, 20 bp, Artificial
  CRISPR gRNA sequence
ttaatgcacacacatacatg

SEQ ID NO: 682966 - DNA, 20 bp, Artificial
  CRISPR gRNA sequence
taatgcacacacatacatgt

SEQ ID NO: 682967 - DNA, 20 bp, Artificial
  CRISPR gRNA sequence
aatgcacacacatacatgtt

SEQ ID NO: 682968 - DNA, 20 bp, Artificial
  CRISPR gRNA sequence
atgcacacacatacatgttc

SEQ ID NO: 682969 - DNA, 20 bp, Artificial
  CRISPR gRNA sequence
tgtgcatgtatgtggttact

SEQ ID NO: 682970 - DNA, 20 bp, Artificial
  CRISPR gRNA sequence
tgcatgtatgtggttactgt

SEQ ID NO: 682971 - DNA, 20 bp, Artificial
  CRISPR gRNA sequence
ctgtgtatatgtgtatgagt

SEQ ID NO: 682972 - DNA, 20 bp, Artificial
  CRISPR gRNA sequence
tgtatatgtgtatgagtgtt

SEQ ID NO: 682973 - DNA, 20 bp, Artificial
  CRISPR gRNA sequence
tatatgcatgtgtgagtgtg

SEQ ID NO: 682974 - DNA, 20 bp, Artificial
  CRISPR gRNA sequence
tatgtgtgtacaactaaaga

SEQ ID NO: 682975 - DNA, 20 bp, Artificial
  CRISPR gRNA sequence
aagaagctgcagaaactttg

SEQ ID NO: 682976 - DNA, 20 bp, Artificial
  CRISPR gRNA sequence
cagaaactttgtaatacttt

SEQ ID NO: 682977 - DNA, 20 bp, Artificial
  CRISPR gRNA sequence
tgtaatactttgtgaaaagg

SEQ ID NO: 682978 - DNA, 20 bp, Artificial
  CRISPR gRNA sequence
gtaatactttgtgaaaagga

SEQ ID NO: 682979 - DNA, 20 bp, Artificial
  CRISPR gRNA sequence
taatactttgtgaaaaggat

SEQ ID NO: 682980 - DNA, 20 bp, Artificial
  CRISPR gRNA sequence
tgtgaaaaggattatattat

SEQ ID NO: 682981 - DNA, 20 bp, Artificial
  CRISPR gRNA sequence
gtgaaaaggattatattata

SEQ ID NO: 682982 - DNA, 20 bp, Artificial
  CRISPR gRNA sequence
tgaaaaggattatattataa

SEQ ID NO: 682983 - DNA, 20 bp, Artificial
  CRISPR gRNA sequence
tattataaaggtttgtactg

SEQ ID NO: 682984 - DNA, 20 bp, Artificial
  CRISPR gRNA sequence
taaaggtttgtactgtctga

SEQ ID NO: 682985 - DNA, 20 bp, Artificial
  CRISPR gRNA sequence
gtactgtctgagtgcacagc

SEQ ID NO: 682986 - DNA, 20 bp, Artificial
  CRISPR gRNA sequence
tactgtctgagtgcacagct

SEQ ID NO: 682987 - DNA, 20 bp, Artificial
  CRISPR gRNA sequence
tctgagtgcacagctactgg

SEQ ID NO: 682988 - DNA, 20 bp, Artificial
  CRISPR gRNA sequence
agtgcacagctactggaata

SEQ ID NO: 682989 - DNA, 20 bp, Artificial
  CRISPR gRNA sequence
ctggaataaatttagggaat

SEQ ID NO: 682990 - DNA, 20 bp, Artificial
  CRISPR gRNA sequence
gaataaatttagggaatctc

SEQ ID NO: 682991 - DNA, 20 bp, Artificial
  CRISPR gRNA sequence
agggaatctcaggaacaagc

SEQ ID NO: 682992 - DNA, 20 bp, Artificial
  CRISPR gRNA sequence
gggaatctcaggaacaagca

SEQ ID NO: 682993 - DNA, 20 bp, Artificial
  CRISPR gRNA sequence
aggaacaagcatataatttg

SEQ ID NO: 682994 - DNA, 20 bp, Artificial
  CRISPR gRNA sequence
gtccaagatttatttcttct

SEQ ID NO: 682995 - DNA, 20 bp, Artificial
  CRISPR gRNA sequence
tccaagatttatttcttctc

SEQ ID NO: 682996 - DNA, 20 bp, Artificial
  CRISPR gRNA sequence
atttcttctcagaagtgtaa

SEQ ID NO: 682997 - DNA, 20 bp, Artificial
  CRISPR gRNA sequence
tttcttctcagaagtgtaag

SEQ ID NO: 682998 - DNA, 20 bp, Artificial
  CRISPR gRNA sequence
cttctcagaagtgtaagtgc

SEQ ID NO: 682999 - DNA, 20 bp, Artificial
  CRISPR gRNA sequence
ttctcagaagtgtaagtgca

SEQ ID NO: 683000 - DNA, 20 bp, Artificial
  CRISPR gRNA sequence
ctcagaagtgtaagtgcagt

SEQ ID NO: 683001 - DNA, 20 bp, Artificial
  CRISPR gRNA sequence
tcagaagtgtaagtgcagtt

SEQ ID NO: 683002 - DNA, 20 bp, Artificial
  CRISPR gRNA sequence
agaagtgtaagtgcagtttt

SEQ ID NO: 683003 - DNA, 20 bp, Artificial
  CRISPR gRNA sequence
ttaattctgtatattattta

SEQ ID NO: 683004 - DNA, 20 bp, Artificial
  CRISPR gRNA sequence
taattctgtatattatttaa

SEQ ID NO: 683005 - DNA, 20 bp, Artificial
  CRISPR gRNA sequence
aattctgtatattatttaat

SEQ ID NO: 683006 - DNA, 20 bp, Artificial
  CRISPR gRNA sequence
attctgtatattatttaata

SEQ ID NO: 683007 - DNA, 20 bp, Artificial
  CRISPR gRNA sequence
tgtatattatttaatatttt

SEQ ID NO: 683008 - DNA, 20 bp, Artificial
  CRISPR gRNA sequence
tatattatttaatattttac

SEQ ID NO: 683009 - DNA, 20 bp, Artificial
  CRISPR gRNA sequence
tttaatattttaccaataaa

SEQ ID NO: 683010 - DNA, 20 bp, Artificial
  CRISPR gRNA sequence
aatattttaccaataaaata

SEQ ID NO: 683011 - DNA, 20 bp, Artificial
  CRISPR gRNA sequence
atattttaccaataaaataa

SEQ ID NO: 683012 - DNA, 20 bp, Artificial
  CRISPR gRNA sequence
taccaataaaataaacttct

SEQ ID NO: 683013 - DNA, 20 bp, Artificial
  CRISPR gRNA sequence
accaataaaataaacttctg

SEQ ID NO: 683014 - DNA, 20 bp, Artificial
  CRISPR gRNA sequence
ccaataaaataaacttctga

SEQ ID NO: 683015 - DNA, 20 bp, Artificial
  CRISPR gRNA sequence
ctgacataaaaagtttgcta

SEQ ID NO: 683016 - DNA, 20 bp, Artificial
  CRISPR gRNA sequence
tgacataaaaagtttgctat

SEQ ID NO: 683017 - DNA, 20 bp, Artificial
  CRISPR gRNA sequence
acataaaaagtttgctataa

SEQ ID NO: 683018 - DNA, 20 bp, Artificial
  CRISPR gRNA sequence
gctataaaaactttctggtg

SEQ ID NO: 683019 - DNA, 20 bp, Artificial
  CRISPR gRNA sequence
ctataaaaactttctggtga

SEQ ID NO: 683020 - DNA, 20 bp, Artificial
  CRISPR gRNA sequence
taaaaactttctggtgaaaa

SEQ ID NO: 683021 - DNA, 20 bp, Artificial
  CRISPR gRNA sequence
tctggtgaaaattctgtaca

SEQ ID NO: 683022 - DNA, 20 bp, Artificial
  CRISPR gRNA sequence
ctggtgaaaattctgtacac

SEQ ID NO: 683023 - DNA, 20 bp, Artificial
  CRISPR gRNA sequence
tggtgaaaattctgtacaca

SEQ ID NO: 683024 - DNA, 20 bp, Artificial
  CRISPR gRNA sequence
gtgaaaattctgtacacaaa

SEQ ID NO: 683025 - DNA, 20 bp, Artificial
  CRISPR gRNA sequence
tgtacacaaacatgtcttcc

SEQ ID NO: 683026 - DNA, 20 bp, Artificial
  CRISPR gRNA sequence
tacacaaacatgtcttccaa

SEQ ID NO: 683027 - DNA, 20 bp, Artificial
  CRISPR gRNA sequence
ccaaatacagaagactaaat

SEQ ID NO: 683028 - DNA, 20 bp, Artificial
  CRISPR gRNA sequence
caaatacagaagactaaatt

SEQ ID NO: 683029 - DNA, 20 bp, Artificial
  CRISPR gRNA sequence
aattgttgactataccaggc

SEQ ID NO: 683030 - DNA, 20 bp, Artificial
  CRISPR gRNA sequence
ttgactataccaggcttaaa

SEQ ID NO: 683031 - DNA, 20 bp, Artificial
  CRISPR gRNA sequence
actataccaggcttaaatta

SEQ ID NO: 683032 - DNA, 20 bp, Artificial
  CRISPR gRNA sequence
taccaggcttaaattatcat

SEQ ID NO: 683033 - DNA, 20 bp, Artificial
  CRISPR gRNA sequence
atgcaccagcatttttgaac

SEQ ID NO: 683034 - DNA, 20 bp, Artificial
  CRISPR gRNA sequence
cagcatttttgaacaagtca

SEQ ID NO: 683035 - DNA, 20 bp, Artificial
  CRISPR gRNA sequence
ttttgaacaagtcatagatt

SEQ ID NO: 683036 - DNA, 20 bp, Artificial
  CRISPR gRNA sequence
tttggccacaaatcaaattt

SEQ ID NO: 683037 - DNA, 20 bp, Artificial
  CRISPR gRNA sequence
ttggccacaaatcaaatttc

SEQ ID NO: 683038 - DNA, 20 bp, Artificial
  CRISPR gRNA sequence
ccacaaatcaaatttcagga

SEQ ID NO: 683039 - DNA, 20 bp, Artificial
  CRISPR gRNA sequence
cacaaatcaaatttcaggat

SEQ ID NO: 683040 - DNA, 20 bp, Artificial
  CRISPR gRNA sequence
caaatcaaatttcaggatgg

SEQ ID NO: 683041 - DNA, 20 bp, Artificial
  CRISPR gRNA sequence
aaatcaaatttcaggatggg

SEQ ID NO: 683042 - DNA, 20 bp, Artificial
  CRISPR gRNA sequence
atcaaatttcaggatgggag

SEQ ID NO: 683043 - DNA, 20 bp, Artificial
  CRISPR gRNA sequence
ggagtgtctcccctttaaaa

SEQ ID NO: 683044 - DNA, 20 bp, Artificial
  CRISPR gRNA sequence
gtgtctcccctttaaaatag

SEQ ID NO: 683045 - DNA, 20 bp, Artificial
  CRISPR gRNA sequence
gtctcccctttaaaatagaa

SEQ ID NO: 683046 - DNA, 20 bp, Artificial
  CRISPR gRNA sequence
ctcccctttaaaatagaaga

SEQ ID NO: 683047 - DNA, 20 bp, Artificial
  CRISPR gRNA sequence
cctttaaaatagaagagagt

SEQ ID NO: 683048 - DNA, 20 bp, Artificial
  CRISPR gRNA sequence
ttaaaatagaagagagtgag

SEQ ID NO: 683049 - DNA, 20 bp, Artificial
  CRISPR gRNA sequence
gaagagagtgagtagtctat

SEQ ID NO: 683050 - DNA, 20 bp, Artificial
  CRISPR gRNA sequence
aagagagtgagtagtctatg

SEQ ID NO: 683051 - DNA, 20 bp, Artificial
  CRISPR gRNA sequence
gagagtgagtagtctatgag

SEQ ID NO: 683052 - DNA, 20 bp, Artificial
  CRISPR gRNA sequence
agagtgagtagtctatgagg

SEQ ID NO: 683053 - DNA, 20 bp, Artificial
  CRISPR gRNA sequence
gagtgagtagtctatgagga

SEQ ID NO: 683054 - DNA, 20 bp, Artificial
  CRISPR gRNA sequence
tctatgaggagggacctaca

SEQ ID NO: 683055 - DNA, 20 bp, Artificial
  CRISPR gRNA sequence
gaggagggacctacaaagac

SEQ ID NO: 683056 - DNA, 20 bp, Artificial
  CRISPR gRNA sequence
caaagactggaaactattct

SEQ ID NO: 683057 - DNA, 20 bp, Artificial
  CRISPR gRNA sequence
ttagctccgtcactgactcc

SEQ ID NO: 683058 - DNA, 20 bp, Artificial
  CRISPR gRNA sequence
agttcatcccctctgtcttt

SEQ ID NO: 683059 - DNA, 20 bp, Artificial
  CRISPR gRNA sequence
atcccctctgtctttcagtt

SEQ ID NO: 683060 - DNA, 20 bp, Artificial
  CRISPR gRNA sequence
tcccctctgtctttcagttt

SEQ ID NO: 683061 - DNA, 20 bp, Artificial
  CRISPR gRNA sequence
ctctgtctttcagtttgggt

SEQ ID NO: 683062 - DNA, 20 bp, Artificial
  CRISPR gRNA sequence
acttatctaaaatttgtaat

SEQ ID NO: 683063 - DNA, 20 bp, Artificial
  CRISPR gRNA sequence
tctaaaatttgtaataagaa

SEQ ID NO: 683064 - DNA, 20 bp, Artificial
  CRISPR gRNA sequence
gattgtgtttatctttatgt

SEQ ID NO: 683065 - DNA, 20 bp, Artificial
  CRISPR gRNA sequence
atgttagtaaatttctatgt

SEQ ID NO: 683066 - DNA, 20 bp, Artificial
  CRISPR gRNA sequence
tattcttccccttatatttt

SEQ ID NO: 683067 - DNA, 20 bp, Artificial
  CRISPR gRNA sequence
ttccccttatattttaagaa

SEQ ID NO: 683068 - DNA, 20 bp, Artificial
  CRISPR gRNA sequence
cccttatattttaagaaaag

SEQ ID NO: 683069 - DNA, 20 bp, Artificial
  CRISPR gRNA sequence
tatattttaagaaaagaagt

SEQ ID NO: 683070 - DNA, 20 bp, Artificial
  CRISPR gRNA sequence
ttttaagaaaagaagtaaga

SEQ ID NO: 683071 - DNA, 20 bp, Artificial
  CRISPR gRNA sequence
gtaaatgattatttttctga

SEQ ID NO: 683072 - DNA, 20 bp, Artificial
  CRISPR gRNA sequence
aatgtatttattattattca

SEQ ID NO: 683073 - DNA, 20 bp, Artificial
  CRISPR gRNA sequence
catagaccttcaactactct

SEQ ID NO: 683074 - DNA, 20 bp, Artificial
  CRISPR gRNA sequence
gaccttcaactactcttaga

SEQ ID NO: 683075 - DNA, 20 bp, Artificial
  CRISPR gRNA sequence
aactactcttagaaagcctt

SEQ ID NO: 683076 - DNA, 20 bp, Artificial
  CRISPR gRNA sequence
agaaagcctttggtgactcc

SEQ ID NO: 683077 - DNA, 20 bp, Artificial
  CRISPR gRNA sequence
gaaagcctttggtgactcct

SEQ ID NO: 683078 - DNA, 20 bp, Artificial
  CRISPR gRNA sequence
ctttggtgactcctgggaac

SEQ ID NO: 683079 - DNA, 20 bp, Artificial
  CRISPR gRNA sequence
gtgactcctgggaacaagct

SEQ ID NO: 683080 - DNA, 20 bp, Artificial
  CRISPR gRNA sequence
ctcctgggaacaagctgagt

SEQ ID NO: 683081 - DNA, 20 bp, Artificial
  CRISPR gRNA sequence
tcctgggaacaagctgagtc

SEQ ID NO: 683082 - DNA, 20 bp, Artificial
  CRISPR gRNA sequence
acaagctgagtcaggaacaa

SEQ ID NO: 683083 - DNA, 20 bp, Artificial
  CRISPR gRNA sequence
tgagtcaggaacaaaagttt

SEQ ID NO: 683084 - DNA, 20 bp, Artificial
  CRISPR gRNA sequence
gagtcaggaacaaaagtttg

SEQ ID NO: 683085 - DNA, 20 bp, Artificial
  CRISPR gRNA sequence
agtcaggaacaaaagtttga

SEQ ID NO: 683086 - DNA, 20 bp, Artificial
  CRISPR gRNA sequence
ggaacaaaagtttgagggtt

SEQ ID NO: 683087 - DNA, 20 bp, Artificial
  CRISPR gRNA sequence
gaacaaaagtttgagggttt

SEQ ID NO: 683088 - DNA, 20 bp, Artificial
  CRISPR gRNA sequence
aacaaaagtttgagggtttg

SEQ ID NO: 683089 - DNA, 20 bp, Artificial
  CRISPR gRNA sequence
aagtttgagggtttggggtt

SEQ ID NO: 683090 - DNA, 20 bp, Artificial
  CRISPR gRNA sequence
tgagggtttggggttgagaa

SEQ ID NO: 683091 - DNA, 20 bp, Artificial
  CRISPR gRNA sequence
gagggtttggggttgagaat

SEQ ID NO: 683092 - DNA, 20 bp, Artificial
  CRISPR gRNA sequence
ttgagaataggacaattact

SEQ ID NO: 683093 - DNA, 20 bp, Artificial
  CRISPR gRNA sequence
caattacttggctaatgctt

SEQ ID NO: 683094 - DNA, 20 bp, Artificial
  CRISPR gRNA sequence
acttggctaatgctttagtc

SEQ ID NO: 683095 - DNA, 20 bp, Artificial
  CRISPR gRNA sequence
gttctgattttgctactcct

SEQ ID NO: 683096 - DNA, 20 bp, Artificial
  CRISPR gRNA sequence
ttgcacatgtgtctgtttgt

SEQ ID NO: 683097 - DNA, 20 bp, Artificial
  CRISPR gRNA sequence
tgtttgtgagttatttttgt

SEQ ID NO: 683098 - DNA, 20 bp, Artificial
  CRISPR gRNA sequence
ttttgtgagcatgctgctac

SEQ ID NO: 683099 - DNA, 20 bp, Artificial
  CRISPR gRNA sequence
catgctgctaccagcctgtg

SEQ ID NO: 683100 - DNA, 20 bp, Artificial
  CRISPR gRNA sequence
ccagcctgtgtggatgtctg

SEQ ID NO: 683101 - DNA, 20 bp, Artificial
  CRISPR gRNA sequence
atgatacattttattttcta

SEQ ID NO: 683102 - DNA, 20 bp, Artificial
  CRISPR gRNA sequence
ctaaagtctactgaatttta

SEQ ID NO: 683103 - DNA, 20 bp, Artificial
  CRISPR gRNA sequence
tatggtttttttttcaaaaa

SEQ ID NO: 683104 - DNA, 20 bp, Artificial
  CRISPR gRNA sequence
atattctttccttcttaatt

SEQ ID NO: 683105 - DNA, 20 bp, Artificial
  CRISPR gRNA sequence
cttcttaatttagtttcttt

SEQ ID NO: 683106 - DNA, 20 bp, Artificial
  CRISPR gRNA sequence
ttcttaatttagtttctttc

SEQ ID NO: 683107 - DNA, 20 bp, Artificial
  CRISPR gRNA sequence
ttctttcaggacattctcat

SEQ ID NO: 683108 - DNA, 20 bp, Artificial
  CRISPR gRNA sequence
tcaggacattctcatgagac

SEQ ID NO: 683109 - DNA, 20 bp, Artificial
  CRISPR gRNA sequence
actggtgaaatataactgcg

SEQ ID NO: 683110 - DNA, 20 bp, Artificial
  CRISPR gRNA sequence
ggtgaaatataactgcgaag

SEQ ID NO: 683111 - DNA, 20 bp, Artificial
  CRISPR gRNA sequence
gtagcatgataactgtgaaa

SEQ ID NO: 683112 - DNA, 20 bp, Artificial
  CRISPR gRNA sequence
aaatagcatgatcattgtga

SEQ ID NO: 683113 - DNA, 20 bp, Artificial
  CRISPR gRNA sequence
tatatgacccaaaacttcca

SEQ ID NO: 683114 - DNA, 20 bp, Artificial
  CRISPR gRNA sequence
atatgacccaaaacttccat

SEQ ID NO: 683115 - DNA, 20 bp, Artificial
  CRISPR gRNA sequence
cccaaaacttccataggaat

SEQ ID NO: 683116 - DNA, 20 bp, Artificial
  CRISPR gRNA sequence
tgttgactgattcattctcc

SEQ ID NO: 683117 - DNA, 20 bp, Artificial
  CRISPR gRNA sequence
gttgactgattcattctcct

SEQ ID NO: 683118 - DNA, 20 bp, Artificial
  CRISPR gRNA sequence
gactgattcattctcctggg

SEQ ID NO: 683119 - DNA, 20 bp, Artificial
  CRISPR gRNA sequence
tcattctcctgggtggtgct

SEQ ID NO: 683120 - DNA, 20 bp, Artificial
  CRISPR gRNA sequence
tctcctgggtggtgctgaga

SEQ ID NO: 683121 - DNA, 20 bp, Artificial
  CRISPR gRNA sequence
tgctgagaaagtaaaaatca

SEQ ID NO: 683122 - DNA, 20 bp, Artificial
  CRISPR gRNA sequence
gctgataaaaattctgttta

SEQ ID NO: 683123 - DNA, 20 bp, Artificial
  CRISPR gRNA sequence
gttttgtctaacttattttt

SEQ ID NO: 683124 - DNA, 20 bp, Artificial
  CRISPR gRNA sequence
gtctaacttatttttcagtt

SEQ ID NO: 683125 - DNA, 20 bp, Artificial
  CRISPR gRNA sequence
cttatttttcagttgagata

SEQ ID NO: 683126 - DNA, 20 bp, Artificial
  CRISPR gRNA sequence
ttatttttcagttgagatat

SEQ ID NO: 683127 - DNA, 20 bp, Artificial
  CRISPR gRNA sequence
ataggctactcttcccaact

SEQ ID NO: 683128 - DNA, 20 bp, Artificial
  CRISPR gRNA sequence
ctcttcccaactcagtcttg

SEQ ID NO: 683129 - DNA, 20 bp, Artificial
  CRISPR gRNA sequence
cttcccaactcagtcttgaa

SEQ ID NO: 683130 - DNA, 20 bp, Artificial
  CRISPR gRNA sequence
atcaccaactgcctcatgtg

SEQ ID NO: 683131 - DNA, 20 bp, Artificial
  CRISPR gRNA sequence
tgaccttcactgtcgtatgc

SEQ ID NO: 683132 - DNA, 20 bp, Artificial
  CRISPR gRNA sequence
tcgtatgccagtgactcatc

SEQ ID NO: 683133 - DNA, 20 bp, Artificial
  CRISPR gRNA sequence
gtatgccagtgactcatctg

SEQ ID NO: 683134 - DNA, 20 bp, Artificial
  CRISPR gRNA sequence
tctggagtaatctcaacaac

SEQ ID NO: 683135 - DNA, 20 bp, Artificial
  CRISPR gRNA sequence
acttgctcttgattgataaa

SEQ ID NO: 683136 - DNA, 20 bp, Artificial
  CRISPR gRNA sequence
ctcttgattgataaacagaa

SEQ ID NO: 683137 - DNA, 20 bp, Artificial
  CRISPR gRNA sequence
tcttgattgataaacagaat

SEQ ID NO: 683138 - DNA, 20 bp, Artificial
  CRISPR gRNA sequence
cttgattgataaacagaatg

SEQ ID NO: 683139 - DNA, 20 bp, Artificial
  CRISPR gRNA sequence
tgataaacagaatggggttt

SEQ ID NO: 683140 - DNA, 20 bp, Artificial
  CRISPR gRNA sequence
cagaatggggttttggatct

SEQ ID NO: 683141 - DNA, 20 bp, Artificial
  CRISPR gRNA sequence
cacaattctcatgtattcca

SEQ ID NO: 683142 - DNA, 20 bp, Artificial
  CRISPR gRNA sequence
aattctcatgtattccacag

SEQ ID NO: 683143 - DNA, 20 bp, Artificial
  CRISPR gRNA sequence
tcatgtattccacagcagca

SEQ ID NO: 683144 - DNA, 20 bp, Artificial
  CRISPR gRNA sequence
tattccacagcagcaaagtt

SEQ ID NO: 683145 - DNA, 20 bp, Artificial
  CRISPR gRNA sequence
ccacagcagcaaagtttagt

SEQ ID NO: 683146 - DNA, 20 bp, Artificial
  CRISPR gRNA sequence
tttagtaagtattgccttct

SEQ ID NO: 683147 - DNA, 20 bp, Artificial
  CRISPR gRNA sequence
tttataaattaaataatttc

SEQ ID NO: 683148 - DNA, 20 bp, Artificial
  CRISPR gRNA sequence
aagaacatttaccttgtttt

SEQ ID NO: 683149 - DNA, 20 bp, Artificial
  CRISPR gRNA sequence
aacatttaccttgttttaag

SEQ ID NO: 683150 - DNA, 20 bp, Artificial
  CRISPR gRNA sequence
tgttttaagcagtttgcttc

SEQ ID NO: 683151 - DNA, 20 bp, Artificial
  CRISPR gRNA sequence
cagtttgcttccagttgttc

SEQ ID NO: 683152 - DNA, 20 bp, Artificial
  CRISPR gRNA sequence
atttttcattacaaatctat

SEQ ID NO: 683153 - DNA, 20 bp, Artificial
  CRISPR gRNA sequence
tttcattacaaatctatcag

SEQ ID NO: 683154 - DNA, 20 bp, Artificial
  CRISPR gRNA sequence
ctttgtaatgaatatatcat

SEQ ID NO: 683155 - DNA, 20 bp, Artificial
  CRISPR gRNA sequence
taatgaatatatcatcagtt

SEQ ID NO: 683156 - DNA, 20 bp, Artificial
  CRISPR gRNA sequence
tggctttgcatattcaaatg

SEQ ID NO: 683157 - DNA, 20 bp, Artificial
  CRISPR gRNA sequence
ctttgcatattcaaatgcag

SEQ ID NO: 683158 - DNA, 20 bp, Artificial
  CRISPR gRNA sequence
aaatgcagcagaatttaatg

SEQ ID NO: 683159 - DNA, 20 bp, Artificial
  CRISPR gRNA sequence
tttaatgtggtgcctgcaca

SEQ ID NO: 683160 - DNA, 20 bp, Artificial
  CRISPR gRNA sequence
ttaatgtggtgcctgcacat

SEQ ID NO: 683161 - DNA, 20 bp, Artificial
  CRISPR gRNA sequence
atgtggtgcctgcacatggg

SEQ ID NO: 683162 - DNA, 20 bp, Artificial
  CRISPR gRNA sequence
cctgcacatgggaagtgttg

SEQ ID NO: 683163 - DNA, 20 bp, Artificial
  CRISPR gRNA sequence
gatgtttattgactgacaca

SEQ ID NO: 683164 - DNA, 20 bp, Artificial
  CRISPR gRNA sequence
tgactgacacacagtttgtt

SEQ ID NO: 683165 - DNA, 20 bp, Artificial
  CRISPR gRNA sequence
tgacacacagtttgtttaga

SEQ ID NO: 683166 - DNA, 20 bp, Artificial
  CRISPR gRNA sequence
cacagtttgtttagatagat

SEQ ID NO: 683167 - DNA, 20 bp, Artificial
  CRISPR gRNA sequence
acagtttgtttagatagata

SEQ ID NO: 683168 - DNA, 20 bp, Artificial
  CRISPR gRNA sequence
agataaggctgcttttccat

SEQ ID NO: 683169 - DNA, 20 bp, Artificial
  CRISPR gRNA sequence
gcttttccattggataactg

SEQ ID NO: 683170 - DNA, 20 bp, Artificial
  CRISPR gRNA sequence
cttttccattggataactgt

SEQ ID NO: 683171 - DNA, 20 bp, Artificial
  CRISPR gRNA sequence
ttttccattggataactgtg

SEQ ID NO: 683172 - DNA, 20 bp, Artificial
  CRISPR gRNA sequence
tttccattggataactgtgg

SEQ ID NO: 683173 - DNA, 20 bp, Artificial
  CRISPR gRNA sequence
ttggataactgtgggggatt

SEQ ID NO: 683174 - DNA, 20 bp, Artificial
  CRISPR gRNA sequence
ttaattcattaacatttcat

SEQ ID NO: 683175 - DNA, 20 bp, Artificial
  CRISPR gRNA sequence
aattcattaacatttcataa

SEQ ID NO: 683176 - DNA, 20 bp, Artificial
  CRISPR gRNA sequence
catttcataagagatcttaa

SEQ ID NO: 683177 - DNA, 20 bp, Artificial
  CRISPR gRNA sequence
acagttacttattctttccc

SEQ ID NO: 683178 - DNA, 20 bp, Artificial
  CRISPR gRNA sequence
cagttacttattctttccca

SEQ ID NO: 683179 - DNA, 20 bp, Artificial
  CRISPR gRNA sequence
tattctttcccaaggtatca

SEQ ID NO: 683180 - DNA, 20 bp, Artificial
  CRISPR gRNA sequence
aaggtatcacagtatatgac

SEQ ID NO: 683181 - DNA, 20 bp, Artificial
  CRISPR gRNA sequence
ccggcttctaaatttaatcc

SEQ ID NO: 683182 - DNA, 20 bp, Artificial
  CRISPR gRNA sequence
gcttctaaatttaatcctag

SEQ ID NO: 683183 - DNA, 20 bp, Artificial
  CRISPR gRNA sequence
taatcctagaagaaaatatt

SEQ ID NO: 683184 - DNA, 20 bp, Artificial
  CRISPR gRNA sequence
atcctagaagaaaatattga

SEQ ID NO: 683185 - DNA, 20 bp, Artificial
  CRISPR gRNA sequence
gaagaaaatattgagagtat

SEQ ID NO: 683186 - DNA, 20 bp, Artificial
  CRISPR gRNA sequence
atcttttcatttgatcattt

SEQ ID NO: 683187 - DNA, 20 bp, Artificial
  CRISPR gRNA sequence
tcttttcatttgatcatttc

SEQ ID NO: 683188 - DNA, 20 bp, Artificial
  CRISPR gRNA sequence
gtctttatatcttttatttg

SEQ ID NO: 683189 - DNA, 20 bp, Artificial
  CRISPR gRNA sequence
tctttatatcttttatttgc

SEQ ID NO: 683190 - DNA, 20 bp, Artificial
  CRISPR gRNA sequence
tatttgcaggtaaacaatca

SEQ ID NO: 683191 - DNA, 20 bp, Artificial
  CRISPR gRNA sequence
atttgcaggtaaacaatcat

SEQ ID NO: 683192 - DNA, 20 bp, Artificial
  CRISPR gRNA sequence
tttgcaggtaaacaatcatg

SEQ ID NO: 683193 - DNA, 20 bp, Artificial
  CRISPR gRNA sequence
aggtaaacaatcatggggcc

SEQ ID NO: 683194 - DNA, 20 bp, Artificial
  CRISPR gRNA sequence
aatcatggggcctggaaaat

SEQ ID NO: 683195 - DNA, 20 bp, Artificial
  CRISPR gRNA sequence
atcatggggcctggaaaatg

SEQ ID NO: 683196 - DNA, 20 bp, Artificial
  CRISPR gRNA sequence
gaaaatgaggctttaattgt

SEQ ID NO: 683197 - DNA, 20 bp, Artificial
  CRISPR gRNA sequence
gctttaattgtaagatgtcc

SEQ ID NO: 683198 - DNA, 20 bp, Artificial
  CRISPR gRNA sequence
aattgtaagatgtcctagac

SEQ ID NO: 683199 - DNA, 20 bp, Artificial
  CRISPR gRNA sequence
attgtaagatgtcctagaca

SEQ ID NO: 683200 - DNA, 20 bp, Artificial
  CRISPR gRNA sequence
tgtcctagacaaggaaaacc

SEQ ID NO: 683201 - DNA, 20 bp, Artificial
  CRISPR gRNA sequence
aggaaaacctagttacaccg

SEQ ID NO: 683202 - DNA, 20 bp, Artificial
  CRISPR gRNA sequence
aacctagttacaccgtggat

SEQ ID NO: 683203 - DNA, 20 bp, Artificial
  CRISPR gRNA sequence
tattactcacaaacaaacaa

SEQ ID NO: 683204 - DNA, 20 bp, Artificial
  CRISPR gRNA sequence
caaacaaaagtattcccact

SEQ ID NO: 683205 - DNA, 20 bp, Artificial
  CRISPR gRNA sequence
aaacaaaagtattcccactc

SEQ ID NO: 683206 - DNA, 20 bp, Artificial
  CRISPR gRNA sequence
aaaagtattcccactcagga

SEQ ID NO: 683207 - DNA, 20 bp, Artificial
  CRISPR gRNA sequence
aagaaatcgtgtgtttgcct

SEQ ID NO: 683208 - DNA, 20 bp, Artificial
  CRISPR gRNA sequence
agaaatcgtgtgtttgcctc

SEQ ID NO: 683209 - DNA, 20 bp, Artificial
  CRISPR gRNA sequence
ttgcctcaggccaacttctg

SEQ ID NO: 683210 - DNA, 20 bp, Artificial
  CRISPR gRNA sequence
ccaacttctgaagtttctac

SEQ ID NO: 683211 - DNA, 20 bp, Artificial
  CRISPR gRNA sequence
tctgaagtttctaccagctg

SEQ ID NO: 683212 - DNA, 20 bp, Artificial
  CRISPR gRNA sequence
ccagctgcagttgctgattc

SEQ ID NO: 683213 - DNA, 20 bp, Artificial
  CRISPR gRNA sequence
ggtatttatacctgtattgt

SEQ ID NO: 683214 - DNA, 20 bp, Artificial
  CRISPR gRNA sequence
atttatacctgtattgtcag

SEQ ID NO: 683215 - DNA, 20 bp, Artificial
  CRISPR gRNA sequence
tttatacctgtattgtcaga

SEQ ID NO: 683216 - DNA, 20 bp, Artificial
  CRISPR gRNA sequence
tattgtcagaaggtattatg

SEQ ID NO: 683217 - DNA, 20 bp, Artificial
  CRISPR gRNA sequence
tgtcagaaggtattatgcag

SEQ ID NO: 683218 - DNA, 20 bp, Artificial
  CRISPR gRNA sequence
gtcagaaggtattatgcaga

SEQ ID NO: 683219 - DNA, 20 bp, Artificial
  CRISPR gRNA sequence
tcaccctgctcccctttctt

SEQ ID NO: 683220 - DNA, 20 bp, Artificial
  CRISPR gRNA sequence
ccctgctcccctttcttcag

SEQ ID NO: 683221 - DNA, 20 bp, Artificial
  CRISPR gRNA sequence
tcttcagtggttgattgcct

SEQ ID NO: 683222 - DNA, 20 bp, Artificial
  CRISPR gRNA sequence
ccttgctttcattccttccc

SEQ ID NO: 683223 - DNA, 20 bp, Artificial
  CRISPR gRNA sequence
attccttccctagtcctttc

SEQ ID NO: 683224 - DNA, 20 bp, Artificial
  CRISPR gRNA sequence
ttccctagtcctttctggaa

SEQ ID NO: 683225 - DNA, 20 bp, Artificial
  CRISPR gRNA sequence
ttataaaatgatttgaataa

SEQ ID NO: 683226 - DNA, 20 bp, Artificial
  CRISPR gRNA sequence
tgatttgaataaaagtgatt

SEQ ID NO: 683227 - DNA, 20 bp, Artificial
  CRISPR gRNA sequence
aagtgatttggataaacttc

SEQ ID NO: 683228 - DNA, 20 bp, Artificial
  CRISPR gRNA sequence
agtgatttggataaacttct

SEQ ID NO: 683229 - DNA, 20 bp, Artificial
  CRISPR gRNA sequence
taaacttctaggaatactat

SEQ ID NO: 683230 - DNA, 20 bp, Artificial
  CRISPR gRNA sequence
aaacttctaggaatactatc

SEQ ID NO: 683231 - DNA, 20 bp, Artificial
  CRISPR gRNA sequence
tctaggaatactatcaggtt

SEQ ID NO: 683232 - DNA, 20 bp, Artificial
  CRISPR gRNA sequence
ctaggaatactatcaggttg

SEQ ID NO: 683233 - DNA, 20 bp, Artificial
  CRISPR gRNA sequence
aatactatcaggttgaggtc

SEQ ID NO: 683234 - DNA, 20 bp, Artificial
  CRISPR gRNA sequence
gttgaggtctagctcattct

SEQ ID NO: 683235 - DNA, 20 bp, Artificial
  CRISPR gRNA sequence
ctagctcattctgagctatt

SEQ ID NO: 683236 - DNA, 20 bp, Artificial
  CRISPR gRNA sequence
ttctgagctatttggattta

SEQ ID NO: 683237 - DNA, 20 bp, Artificial
  CRISPR gRNA sequence
gctatttggatttacagttg

SEQ ID NO: 683238 - DNA, 20 bp, Artificial
  CRISPR gRNA sequence
ctatttggatttacagttgc

SEQ ID NO: 683239 - DNA, 20 bp, Artificial
  CRISPR gRNA sequence
tatttggatttacagttgca

SEQ ID NO: 683240 - DNA, 20 bp, Artificial
  CRISPR gRNA sequence
cagttgcagggattgatttg

SEQ ID NO: 683241 - DNA, 20 bp, Artificial
  CRISPR gRNA sequence
ggattgatttgtagctgact

SEQ ID NO: 683242 - DNA, 20 bp, Artificial
  CRISPR gRNA sequence
attgatttgtagctgactta

SEQ ID NO: 683243 - DNA, 20 bp, Artificial
  CRISPR gRNA sequence
agctgacttagagaaaaacc

SEQ ID NO: 683244 - DNA, 20 bp, Artificial
  CRISPR gRNA sequence
agagaaaaacctagctttcc

SEQ ID NO: 683245 - DNA, 20 bp, Artificial
  CRISPR gRNA sequence
acctagctttcctagtgacc

SEQ ID NO: 683246 - DNA, 20 bp, Artificial
  CRISPR gRNA sequence
tcctagtgaccaagataact

SEQ ID NO: 683247 - DNA, 20 bp, Artificial
  CRISPR gRNA sequence
ctagtgaccaagataactga

SEQ ID NO: 683248 - DNA, 20 bp, Artificial
  CRISPR gRNA sequence
tgagagcaattgcttacttt

SEQ ID NO: 683249 - DNA, 20 bp, Artificial
  CRISPR gRNA sequence
agcaattgcttacttttggc

SEQ ID NO: 683250 - DNA, 20 bp, Artificial
  CRISPR gRNA sequence
gcttacttttggctggaatt

SEQ ID NO: 683251 - DNA, 20 bp, Artificial
  CRISPR gRNA sequence
ggctggaattaagaacaaac

SEQ ID NO: 683252 - DNA, 20 bp, Artificial
  CRISPR gRNA sequence
gaattaagaacaaactagca

SEQ ID NO: 683253 - DNA, 20 bp, Artificial
  CRISPR gRNA sequence
gaacaaactagcacagaaaa

SEQ ID NO: 683254 - DNA, 20 bp, Artificial
  CRISPR gRNA sequence
tagcacagaaaatagtaatc

SEQ ID NO: 683255 - DNA, 20 bp, Artificial
  CRISPR gRNA sequence
aatctggatgttttccatct

SEQ ID NO: 683256 - DNA, 20 bp, Artificial
  CRISPR gRNA sequence
atctggatgttttccatctc

SEQ ID NO: 683257 - DNA, 20 bp, Artificial
  CRISPR gRNA sequence
tctggatgttttccatctca

SEQ ID NO: 683258 - DNA, 20 bp, Artificial
  CRISPR gRNA sequence
ctggatgttttccatctcag

SEQ ID NO: 683259 - DNA, 20 bp, Artificial
  CRISPR gRNA sequence
tggatgttttccatctcagg

SEQ ID NO: 683260 - DNA, 20 bp, Artificial
  CRISPR gRNA sequence
tttccatctcagggggcctc

SEQ ID NO: 683261 - DNA, 20 bp, Artificial
  CRISPR gRNA sequence
ccatctcagggggcctctag

SEQ ID NO: 683262 - DNA, 20 bp, Artificial
  CRISPR gRNA sequence
catctcagggggcctctagt

SEQ ID NO: 683263 - DNA, 20 bp, Artificial
  CRISPR gRNA sequence
gggggcctctagtaggtgaa

SEQ ID NO: 683264 - DNA, 20 bp, Artificial
  CRISPR gRNA sequence
ggggcctctagtaggtgaaa

SEQ ID NO: 683265 - DNA, 20 bp, Artificial
  CRISPR gRNA sequence
gggcctctagtaggtgaaaa

SEQ ID NO: 683266 - DNA, 20 bp, Artificial
  CRISPR gRNA sequence
ggcctctagtaggtgaaaag

SEQ ID NO: 683267 - DNA, 20 bp, Artificial
  CRISPR gRNA sequence
aaaaggggcttctaaccttc

SEQ ID NO: 683268 - DNA, 20 bp, Artificial
  CRISPR gRNA sequence
gggcttctaaccttcaagtt

SEQ ID NO: 683269 - DNA, 20 bp, Artificial
  CRISPR gRNA sequence
ctaaccttcaagttaagcca

SEQ ID NO: 683270 - DNA, 20 bp, Artificial
  CRISPR gRNA sequence
accttcaagttaagccacag

SEQ ID NO: 683271 - DNA, 20 bp, Artificial
  CRISPR gRNA sequence
ccttcaagttaagccacaga

SEQ ID NO: 683272 - DNA, 20 bp, Artificial
  CRISPR gRNA sequence
ttaagccacagaaggctgat

SEQ ID NO: 683273 - DNA, 20 bp, Artificial
  CRISPR gRNA sequence
tgttaaatgttttgattttg

SEQ ID NO: 683274 - DNA, 20 bp, Artificial
  CRISPR gRNA sequence
tttgattttgtggctgtatt

SEQ ID NO: 683275 - DNA, 20 bp, Artificial
  CRISPR gRNA sequence
gtcaaatgaattaaatcaaa

SEQ ID NO: 683276 - DNA, 20 bp, Artificial
  CRISPR gRNA sequence
aaatgaattaaatcaaaaag

SEQ ID NO: 683277 - DNA, 20 bp, Artificial
  CRISPR gRNA sequence
aatgaattaaatcaaaaagc

SEQ ID NO: 683278 - DNA, 20 bp, Artificial
  CRISPR gRNA sequence
aatcaaaaagcaggatgtat

SEQ ID NO: 683279 - DNA, 20 bp, Artificial
  CRISPR gRNA sequence
aaaagcaggatgtattagtt

SEQ ID NO: 683280 - DNA, 20 bp, Artificial
  CRISPR gRNA sequence
aaagcaggatgtattagtta

SEQ ID NO: 683281 - DNA, 20 bp, Artificial
  CRISPR gRNA sequence
aagcaggatgtattagttaa

SEQ ID NO: 683282 - DNA, 20 bp, Artificial
  CRISPR gRNA sequence
ggatgtattagttaagggcc

SEQ ID NO: 683283 - DNA, 20 bp, Artificial
  CRISPR gRNA sequence
gatgtattagttaagggcct

SEQ ID NO: 683284 - DNA, 20 bp, Artificial
  CRISPR gRNA sequence
ttagttaagggcctaggtct

SEQ ID NO: 683285 - DNA, 20 bp, Artificial
  CRISPR gRNA sequence
taagggcctaggtctgagac

SEQ ID NO: 683286 - DNA, 20 bp, Artificial
  CRISPR gRNA sequence
gcctaggtctgagactagac

SEQ ID NO: 683287 - DNA, 20 bp, Artificial
  CRISPR gRNA sequence
tcaaattcatgctctgccac

SEQ ID NO: 683288 - DNA, 20 bp, Artificial
  CRISPR gRNA sequence
actagttaactgtgcgatgc

SEQ ID NO: 683289 - DNA, 20 bp, Artificial
  CRISPR gRNA sequence
gttaactgtgcgatgccagc

SEQ ID NO: 683290 - DNA, 20 bp, Artificial
  CRISPR gRNA sequence
caagttacttctctgccctt

SEQ ID NO: 683291 - DNA, 20 bp, Artificial
  CRISPR gRNA sequence
taataatatatttcatctca

SEQ ID NO: 683292 - DNA, 20 bp, Artificial
  CRISPR gRNA sequence
cattattgtgaaaataaact

SEQ ID NO: 683293 - DNA, 20 bp, Artificial
  CRISPR gRNA sequence
attattgtgaaaataaacta

SEQ ID NO: 683294 - DNA, 20 bp, Artificial
  CRISPR gRNA sequence
aaactaaggtaatgtgtgaa

SEQ ID NO: 683295 - DNA, 20 bp, Artificial
  CRISPR gRNA sequence
aaagtgctcatcatcatcac

SEQ ID NO: 683296 - DNA, 20 bp, Artificial
  CRISPR gRNA sequence
gctcatcatcatcactggta

SEQ ID NO: 683297 - DNA, 20 bp, Artificial
  CRISPR gRNA sequence
tcatcatcatcactggtaca

SEQ ID NO: 683298 - DNA, 20 bp, Artificial
  CRISPR gRNA sequence
cagagtaaactctgaataaa

SEQ ID NO: 683299 - DNA, 20 bp, Artificial
  CRISPR gRNA sequence
agtaattatctttattacac

SEQ ID NO: 683300 - DNA, 20 bp, Artificial
  CRISPR gRNA sequence
gtaattatctttattacact

SEQ ID NO: 683301 - DNA, 20 bp, Artificial
  CRISPR gRNA sequence
tctttattacactgggatta

SEQ ID NO: 683302 - DNA, 20 bp, Artificial
  CRISPR gRNA sequence
acactgggattacagcatta

SEQ ID NO: 683303 - DNA, 20 bp, Artificial
  CRISPR gRNA sequence
ctgggattacagcattacag

SEQ ID NO: 683304 - DNA, 20 bp, Artificial
  CRISPR gRNA sequence
ttacagcattacagcagatg

SEQ ID NO: 683305 - DNA, 20 bp, Artificial
  CRISPR gRNA sequence
agatgtagtgtatgaataaa

SEQ ID NO: 683306 - DNA, 20 bp, Artificial
  CRISPR gRNA sequence
tagtgtatgaataaatggtg

SEQ ID NO: 683307 - DNA, 20 bp, Artificial
  CRISPR gRNA sequence
tgtatgaataaatggtgaag

SEQ ID NO: 683308 - DNA, 20 bp, Artificial
  CRISPR gRNA sequence
aatggtgaagaagtcattgt

SEQ ID NO: 683309 - DNA, 20 bp, Artificial
  CRISPR gRNA sequence
atggtgaagaagtcattgtt

SEQ ID NO: 683310 - DNA, 20 bp, Artificial
  CRISPR gRNA sequence
tggtgaagaagtcattgtta

SEQ ID NO: 683311 - DNA, 20 bp, Artificial
  CRISPR gRNA sequence
agtcattgttagggctacta

SEQ ID NO: 683312 - DNA, 20 bp, Artificial
  CRISPR gRNA sequence
gtcattgttagggctactat

SEQ ID NO: 683313 - DNA, 20 bp, Artificial
  CRISPR gRNA sequence
tcattgttagggctactatg

SEQ ID NO: 683314 - DNA, 20 bp, Artificial
  CRISPR gRNA sequence
cattgttagggctactatgg

SEQ ID NO: 683315 - DNA, 20 bp, Artificial
  CRISPR gRNA sequence
tactatgggggctatgtttt

SEQ ID NO: 683316 - DNA, 20 bp, Artificial
  CRISPR gRNA sequence
gggggctatgtttttagctc

SEQ ID NO: 683317 - DNA, 20 bp, Artificial
  CRISPR gRNA sequence
ttagctcaagtgtaacaaaa

SEQ ID NO: 683318 - DNA, 20 bp, Artificial
  CRISPR gRNA sequence
acaaaaaagtatttaaactc

SEQ ID NO: 683319 - DNA, 20 bp, Artificial
  CRISPR gRNA sequence
ataaccattatgtatattga

SEQ ID NO: 683320 - DNA, 20 bp, Artificial
  CRISPR gRNA sequence
tatgtatattgatggttttt

SEQ ID NO: 683321 - DNA, 20 bp, Artificial
  CRISPR gRNA sequence
gtatattgatggtttttaag

SEQ ID NO: 683322 - DNA, 20 bp, Artificial
  CRISPR gRNA sequence
ttgatggtttttaagaagaa

SEQ ID NO: 683323 - DNA, 20 bp, Artificial
  CRISPR gRNA sequence
ttaagaagaaaagcaatatt

SEQ ID NO: 683324 - DNA, 20 bp, Artificial
  CRISPR gRNA sequence
aagaaaagcaatattaagta

SEQ ID NO: 683325 - DNA, 20 bp, Artificial
  CRISPR gRNA sequence
agaaaagcaatattaagtaa

SEQ ID NO: 683326 - DNA, 20 bp, Artificial
  CRISPR gRNA sequence
tattaagtaaaggctgaatt

SEQ ID NO: 683327 - DNA, 20 bp, Artificial
  CRISPR gRNA sequence
gtaaaggctgaatttagatt

SEQ ID NO: 683328 - DNA, 20 bp, Artificial
  CRISPR gRNA sequence
ttaagttatttcacaatgct

SEQ ID NO: 683329 - DNA, 20 bp, Artificial
  CRISPR gRNA sequence
aattgtctgacttattttaa

SEQ ID NO: 683330 - DNA, 20 bp, Artificial
  CRISPR gRNA sequence
tttaacagtcccacattcaa

SEQ ID NO: 683331 - DNA, 20 bp, Artificial
  CRISPR gRNA sequence
ttaacagtcccacattcaat

SEQ ID NO: 683332 - DNA, 20 bp, Artificial
  CRISPR gRNA sequence
agtcccacattcaataggac

SEQ ID NO: 683333 - DNA, 20 bp, Artificial
  CRISPR gRNA sequence
caccatatataaaaaacaat

SEQ ID NO: 683334 - DNA, 20 bp, Artificial
  CRISPR gRNA sequence
acaatcagattgcaatgttc

SEQ ID NO: 683335 - DNA, 20 bp, Artificial
  CRISPR gRNA sequence
agattatttgatgtattcaa

SEQ ID NO: 683336 - DNA, 20 bp, Artificial
  CRISPR gRNA sequence
ttgatgtattcaacagtatc

SEQ ID NO: 683337 - DNA, 20 bp, Artificial
  CRISPR gRNA sequence
gtattcaacagtatctggat

SEQ ID NO: 683338 - DNA, 20 bp, Artificial
  CRISPR gRNA sequence
ctaccattgacctctacaac

SEQ ID NO: 683339 - DNA, 20 bp, Artificial
  CRISPR gRNA sequence
cattgacctctacaactgga

SEQ ID NO: 683340 - DNA, 20 bp, Artificial
  CRISPR gRNA sequence
acaactggacagcacctctt

SEQ ID NO: 683341 - DNA, 20 bp, Artificial
  CRISPR gRNA sequence
actggacagcacctcttgag

SEQ ID NO: 683342 - DNA, 20 bp, Artificial
  CRISPR gRNA sequence
cagcacctcttgagtggttt

SEQ ID NO: 683343 - DNA, 20 bp, Artificial
  CRISPR gRNA sequence
agcacctcttgagtggttta

SEQ ID NO: 683344 - DNA, 20 bp, Artificial
  CRISPR gRNA sequence
cctcttgagtggtttaaggt

SEQ ID NO: 683345 - DNA, 20 bp, Artificial
  CRISPR gRNA sequence
cttgagtggtttaaggtaag

SEQ ID NO: 683346 - DNA, 20 bp, Artificial
  CRISPR gRNA sequence
gtttaaggtaagaagaaatt

SEQ ID NO: 683347 - DNA, 20 bp, Artificial
  CRISPR gRNA sequence
taaggtaagaagaaatttgg

SEQ ID NO: 683348 - DNA, 20 bp, Artificial
  CRISPR gRNA sequence
aaggtaagaagaaatttgga

SEQ ID NO: 683349 - DNA, 20 bp, Artificial
  CRISPR gRNA sequence
agaagaaatttggaaggaaa

SEQ ID NO: 683350 - DNA, 20 bp, Artificial
  CRISPR gRNA sequence
tgaaaattacacaattaaaa

SEQ ID NO: 683351 - DNA, 20 bp, Artificial
  CRISPR gRNA sequence
tacacaattaaaatagacac

SEQ ID NO: 683352 - DNA, 20 bp, Artificial
  CRISPR gRNA sequence
acaattaaaatagacacaag

SEQ ID NO: 683353 - DNA, 20 bp, Artificial
  CRISPR gRNA sequence
ttaaaatagacacaagtggc

SEQ ID NO: 683354 - DNA, 20 bp, Artificial
  CRISPR gRNA sequence
taaaatagacacaagtggcc

SEQ ID NO: 683355 - DNA, 20 bp, Artificial
  CRISPR gRNA sequence
tagacacaagtggccgggca

SEQ ID NO: 683356 - DNA, 20 bp, Artificial
  CRISPR gRNA sequence
acacaagtggccgggcacag

SEQ ID NO: 683357 - DNA, 20 bp, Artificial
  CRISPR gRNA sequence
gtggctcatgcctgtaatcc

SEQ ID NO: 683358 - DNA, 20 bp, Artificial
  CRISPR gRNA sequence
tgcctgtaatcctagcactt

SEQ ID NO: 683359 - DNA, 20 bp, Artificial
  CRISPR gRNA sequence
gcctgtaatcctagcacttt

SEQ ID NO: 683360 - DNA, 20 bp, Artificial
  CRISPR gRNA sequence
ctgtaatcctagcactttgg

SEQ ID NO: 683361 - DNA, 20 bp, Artificial
  CRISPR gRNA sequence
tgtaatcctagcactttggg

SEQ ID NO: 683362 - DNA, 20 bp, Artificial
  CRISPR gRNA sequence
tcctagcactttgggaggcc

SEQ ID NO: 683363 - DNA, 20 bp, Artificial
  CRISPR gRNA sequence
cctagcactttgggaggcca

SEQ ID NO: 683364 - DNA, 20 bp, Artificial
  CRISPR gRNA sequence
agcactttgggaggccaagg

SEQ ID NO: 683365 - DNA, 20 bp, Artificial
  CRISPR gRNA sequence
gcactttgggaggccaaggc

SEQ ID NO: 683366 - DNA, 20 bp, Artificial
  CRISPR gRNA sequence
ctttgggaggccaaggcagg

SEQ ID NO: 683367 - DNA, 20 bp, Artificial
  CRISPR gRNA sequence
ccaaggcaggcagatcactt

SEQ ID NO: 683368 - DNA, 20 bp, Artificial
  CRISPR gRNA sequence
caaggcaggcagatcacttg

SEQ ID NO: 683369 - DNA, 20 bp, Artificial
  CRISPR gRNA sequence
gcaggcagatcacttgaggc

SEQ ID NO: 683370 - DNA, 20 bp, Artificial
  CRISPR gRNA sequence
caggcagatcacttgaggcc

SEQ ID NO: 683371 - DNA, 20 bp, Artificial
  CRISPR gRNA sequence
ggcagatcacttgaggccag

SEQ ID NO: 683372 - DNA, 20 bp, Artificial
  CRISPR gRNA sequence
tcacttgaggccaggagttt

SEQ ID NO: 683373 - DNA, 20 bp, Artificial
  CRISPR gRNA sequence
tgaggccaggagtttgagac

SEQ ID NO: 683374 - DNA, 20 bp, Artificial
  CRISPR gRNA sequence
ccaggagtttgagaccagcc

SEQ ID NO: 683375 - DNA, 20 bp, Artificial
  CRISPR gRNA sequence
gagaccagcctggccaacat

SEQ ID NO: 683376 - DNA, 20 bp, Artificial
  CRISPR gRNA sequence
agaccagcctggccaacatg

SEQ ID NO: 683377 - DNA, 20 bp, Artificial
  CRISPR gRNA sequence
tctactaaaaatataaaaat

SEQ ID NO: 683378 - DNA, 20 bp, Artificial
  CRISPR gRNA sequence
ctaaaaatataaaaatcagc

SEQ ID NO: 683379 - DNA, 20 bp, Artificial
  CRISPR gRNA sequence
taaaaatataaaaatcagct

SEQ ID NO: 683380 - DNA, 20 bp, Artificial
  CRISPR gRNA sequence
atataaaaatcagctgggtg

SEQ ID NO: 683381 - DNA, 20 bp, Artificial
  CRISPR gRNA sequence
taaaaatcagctgggtgtgg

SEQ ID NO: 683382 - DNA, 20 bp, Artificial
  CRISPR gRNA sequence
gtggcacacacctgtaatcc

SEQ ID NO: 683383 - DNA, 20 bp, Artificial
  CRISPR gRNA sequence
gcacacacctgtaatcccag

SEQ ID NO: 683384 - DNA, 20 bp, Artificial
  CRISPR gRNA sequence
cacctgtaatcccagcagct

SEQ ID NO: 683385 - DNA, 20 bp, Artificial
  CRISPR gRNA sequence
acctgtaatcccagcagctt

SEQ ID NO: 683386 - DNA, 20 bp, Artificial
  CRISPR gRNA sequence
ctgtaatcccagcagcttgg

SEQ ID NO: 683387 - DNA, 20 bp, Artificial
  CRISPR gRNA sequence
tgtaatcccagcagcttggg

SEQ ID NO: 683388 - DNA, 20 bp, Artificial
  CRISPR gRNA sequence
tcccagcagcttgggaggct

SEQ ID NO: 683389 - DNA, 20 bp, Artificial
  CRISPR gRNA sequence
cccagcagcttgggaggctg

SEQ ID NO: 683390 - DNA, 20 bp, Artificial
  CRISPR gRNA sequence
gtatgaaaatcacttgaacc

SEQ ID NO: 683391 - DNA, 20 bp, Artificial
  CRISPR gRNA sequence
tgaaaatcacttgaacctag

SEQ ID NO: 683392 - DNA, 20 bp, Artificial
  CRISPR gRNA sequence
gaaaatcacttgaacctaga

SEQ ID NO: 683393 - DNA, 20 bp, Artificial
  CRISPR gRNA sequence
aatcacttgaacctagaagg

SEQ ID NO: 683394 - DNA, 20 bp, Artificial
  CRISPR gRNA sequence
tcacttgaacctagaaggca

SEQ ID NO: 683395 - DNA, 20 bp, Artificial
  CRISPR gRNA sequence
cacttgaacctagaaggcag

SEQ ID NO: 683396 - DNA, 20 bp, Artificial
  CRISPR gRNA sequence
aacctagaaggcagaggtta

SEQ ID NO: 683397 - DNA, 20 bp, Artificial
  CRISPR gRNA sequence
tagaaggcagaggttacagc

SEQ ID NO: 683398 - DNA, 20 bp, Artificial
  CRISPR gRNA sequence
ggcagaggttacagcgagcc

SEQ ID NO: 683399 - DNA, 20 bp, Artificial
  CRISPR gRNA sequence
ccagattgcaccactcactc

SEQ ID NO: 683400 - DNA, 20 bp, Artificial
  CRISPR gRNA sequence
ttgcaccactcactccagcc

SEQ ID NO: 683401 - DNA, 20 bp, Artificial
  CRISPR gRNA sequence
tgcaccactcactccagcct

SEQ ID NO: 683402 - DNA, 20 bp, Artificial
  CRISPR gRNA sequence
ggcaacaaacattctgtcaa

SEQ ID NO: 683403 - DNA, 20 bp, Artificial
  CRISPR gRNA sequence
gtcaacagataaataaataa

SEQ ID NO: 683404 - DNA, 20 bp, Artificial
  CRISPR gRNA sequence
cagataaataaataaaagtg

SEQ ID NO: 683405 - DNA, 20 bp, Artificial
  CRISPR gRNA sequence
aataaaagtgaagaattact

SEQ ID NO: 683406 - DNA, 20 bp, Artificial
  CRISPR gRNA sequence
aaaagtgaagaattactgag

SEQ ID NO: 683407 - DNA, 20 bp, Artificial
  CRISPR gRNA sequence
aaagtgaagaattactgaga

SEQ ID NO: 683408 - DNA, 20 bp, Artificial
  CRISPR gRNA sequence
aagaattactgagaaggaaa

SEQ ID NO: 683409 - DNA, 20 bp, Artificial
  CRISPR gRNA sequence
ggaaatggaatttcttattt

SEQ ID NO: 683410 - DNA, 20 bp, Artificial
  CRISPR gRNA sequence
atttcttatttcagaattgt

SEQ ID NO: 683411 - DNA, 20 bp, Artificial
  CRISPR gRNA sequence
tttcttatttcagaattgtc

SEQ ID NO: 683412 - DNA, 20 bp, Artificial
  CRISPR gRNA sequence
tcagaattgtcaggctcttc

SEQ ID NO: 683413 - DNA, 20 bp, Artificial
  CRISPR gRNA sequence
cagaattgtcaggctcttca

SEQ ID NO: 683414 - DNA, 20 bp, Artificial
  CRISPR gRNA sequence
tgtcaggctcttcaaggatc

SEQ ID NO: 683415 - DNA, 20 bp, Artificial
  CRISPR gRNA sequence
gtcaggctcttcaaggatca

SEQ ID NO: 683416 - DNA, 20 bp, Artificial
  CRISPR gRNA sequence
gctcttcaaggatcaaggta

SEQ ID NO: 683417 - DNA, 20 bp, Artificial
  CRISPR gRNA sequence
ctcttcaaggatcaaggtac

SEQ ID NO: 683418 - DNA, 20 bp, Artificial
  CRISPR gRNA sequence
tcttcaaggatcaaggtaca

SEQ ID NO: 683419 - DNA, 20 bp, Artificial
  CRISPR gRNA sequence
gatcaaggtacagggcgcac

SEQ ID NO: 683420 - DNA, 20 bp, Artificial
  CRISPR gRNA sequence
cagggcgcacaagtcatttt

SEQ ID NO: 683421 - DNA, 20 bp, Artificial
  CRISPR gRNA sequence
tcattgataatgtgatgact

SEQ ID NO: 683422 - DNA, 20 bp, Artificial
  CRISPR gRNA sequence
cattgataatgtgatgactg

SEQ ID NO: 683423 - DNA, 20 bp, Artificial
  CRISPR gRNA sequence
taatgtgatgactgaggacg

SEQ ID NO: 683424 - DNA, 20 bp, Artificial
  CRISPR gRNA sequence
aatgtgatgactgaggacgc

SEQ ID NO: 683425 - DNA, 20 bp, Artificial
  CRISPR gRNA sequence
aaatttatacacaatgaaaa

SEQ ID NO: 683426 - DNA, 20 bp, Artificial
  CRISPR gRNA sequence
atttatacacaatgaaaatg

SEQ ID NO: 683427 - DNA, 20 bp, Artificial
  CRISPR gRNA sequence
aatgaaaatggagccaatta

SEQ ID NO: 683428 - DNA, 20 bp, Artificial
  CRISPR gRNA sequence
tggagccaattatagtgtga

SEQ ID NO: 683429 - DNA, 20 bp, Artificial
  CRISPR gRNA sequence
aattatagtgtgacggcgac

SEQ ID NO: 683430 - DNA, 20 bp, Artificial
  CRISPR gRNA sequence
attatagtgtgacggcgacc

SEQ ID NO: 683431 - DNA, 20 bp, Artificial
  CRISPR gRNA sequence
gacggcgaccaggtccttca

SEQ ID NO: 683432 - DNA, 20 bp, Artificial
  CRISPR gRNA sequence
cgaccaggtccttcacggtc

SEQ ID NO: 683433 - DNA, 20 bp, Artificial
  CRISPR gRNA sequence
gaccaggtccttcacggtca

SEQ ID NO: 683434 - DNA, 20 bp, Artificial
  CRISPR gRNA sequence
accaggtccttcacggtcaa

SEQ ID NO: 683435 - DNA, 20 bp, Artificial
  CRISPR gRNA sequence
ggtccttcacggtcaagggt

SEQ ID NO: 683436 - DNA, 20 bp, Artificial
  CRISPR gRNA sequence
ggtaagctactgacattaat

SEQ ID NO: 683437 - DNA, 20 bp, Artificial
  CRISPR gRNA sequence
agctactgacattaatgaga

SEQ ID NO: 683438 - DNA, 20 bp, Artificial
  CRISPR gRNA sequence
tgagatagaatactacgtga

SEQ ID NO: 683439 - DNA, 20 bp, Artificial
  CRISPR gRNA sequence
gatagaatactacgtgaaag

SEQ ID NO: 683440 - DNA, 20 bp, Artificial
  CRISPR gRNA sequence
atactacgtgaaagaagtcg

SEQ ID NO: 683441 - DNA, 20 bp, Artificial
  CRISPR gRNA sequence
ctacgtgaaagaagtcgaag

SEQ ID NO: 683442 - DNA, 20 bp, Artificial
  CRISPR gRNA sequence
tacgtgaaagaagtcgaagt

SEQ ID NO: 683443 - DNA, 20 bp, Artificial
  CRISPR gRNA sequence
gaaagaagtcgaagtgggaa

SEQ ID NO: 683444 - DNA, 20 bp, Artificial
  CRISPR gRNA sequence
agaagtcgaagtgggaacag

SEQ ID NO: 683445 - DNA, 20 bp, Artificial
  CRISPR gRNA sequence
tgggaacagcggtgcccttc

SEQ ID NO: 683446 - DNA, 20 bp, Artificial
  CRISPR gRNA sequence
aacagcggtgcccttctggt

SEQ ID NO: 683447 - DNA, 20 bp, Artificial
  CRISPR gRNA sequence
acagcggtgcccttctggtt

SEQ ID NO: 683448 - DNA, 20 bp, Artificial
  CRISPR gRNA sequence
acattctgaactatgacgca

SEQ ID NO: 683449 - DNA, 20 bp, Artificial
  CRISPR gRNA sequence
attctgaactatgacgcaaa

SEQ ID NO: 683450 - DNA, 20 bp, Artificial
  CRISPR gRNA sequence
ttctgaactatgacgcaaag

SEQ ID NO: 683451 - DNA, 20 bp, Artificial
  CRISPR gRNA sequence
ggttttctgaacacactatc

SEQ ID NO: 683452 - DNA, 20 bp, Artificial
  CRISPR gRNA sequence
tgaacacactatcaagattt

SEQ ID NO: 683453 - DNA, 20 bp, Artificial
  CRISPR gRNA sequence
tatcaagatttaagaaattt

SEQ ID NO: 683454 - DNA, 20 bp, Artificial
  CRISPR gRNA sequence
atcaagatttaagaaatttc

SEQ ID NO: 683455 - DNA, 20 bp, Artificial
  CRISPR gRNA sequence
tcaagatttaagaaatttca

SEQ ID NO: 683456 - DNA, 20 bp, Artificial
  CRISPR gRNA sequence
caagatttaagaaatttcag

SEQ ID NO: 683457 - DNA, 20 bp, Artificial
  CRISPR gRNA sequence
aagatttaagaaatttcagg

SEQ ID NO: 683458 - DNA, 20 bp, Artificial
  CRISPR gRNA sequence
gaaattacattactaattca

SEQ ID NO: 683459 - DNA, 20 bp, Artificial
  CRISPR gRNA sequence
ttttgtgacttaattttcca

SEQ ID NO: 683460 - DNA, 20 bp, Artificial
  CRISPR gRNA sequence
gacttaattttccaaagata

SEQ ID NO: 683461 - DNA, 20 bp, Artificial
  CRISPR gRNA sequence
cttaacttactttttttgaa

SEQ ID NO: 683462 - DNA, 20 bp, Artificial
  CRISPR gRNA sequence
tgaatggcaatacaactatt

SEQ ID NO: 683463 - DNA, 20 bp, Artificial
  CRISPR gRNA sequence
aatggcaatacaactatttg

SEQ ID NO: 683464 - DNA, 20 bp, Artificial
  CRISPR gRNA sequence
tggcaatacaactatttgga

SEQ ID NO: 683465 - DNA, 20 bp, Artificial
  CRISPR gRNA sequence
aactatttggagagcaaaac

SEQ ID NO: 683466 - DNA, 20 bp, Artificial
  CRISPR gRNA sequence
cagctttttttttttttttc

SEQ ID NO: 683467 - DNA, 20 bp, Artificial
  CRISPR gRNA sequence
ttttttttttttttctagtt

SEQ ID NO: 683468 - DNA, 20 bp, Artificial
  CRISPR gRNA sequence
ttttttttctagtttggtgt

SEQ ID NO: 683469 - DNA, 20 bp, Artificial
  CRISPR gRNA sequence
ttttttctagtttggtgtca

SEQ ID NO: 683470 - DNA, 20 bp, Artificial
  CRISPR gRNA sequence
agagtttctgcaaattaaaa

SEQ ID NO: 683471 - DNA, 20 bp, Artificial
  CRISPR gRNA sequence
agtttctgcaaattaaaaaa

SEQ ID NO: 683472 - DNA, 20 bp, Artificial
  CRISPR gRNA sequence
ttaaaaaagagcttaatctt

SEQ ID NO: 683473 - DNA, 20 bp, Artificial
  CRISPR gRNA sequence
taatctttagtaatactcat

SEQ ID NO: 683474 - DNA, 20 bp, Artificial
  CRISPR gRNA sequence
agtaatactcattggattca

SEQ ID NO: 683475 - DNA, 20 bp, Artificial
  CRISPR gRNA sequence
cattggattcaaagtctaat

SEQ ID NO: 683476 - DNA, 20 bp, Artificial
  CRISPR gRNA sequence
ttggattcaaagtctaatga

SEQ ID NO: 683477 - DNA, 20 bp, Artificial
  CRISPR gRNA sequence
tggattcaaagtctaatgag

SEQ ID NO: 683478 - DNA, 20 bp, Artificial
  CRISPR gRNA sequence
tctaatgagaggctttgtga

SEQ ID NO: 683479 - DNA, 20 bp, Artificial
  CRISPR gRNA sequence
ggctttgtgatggtatacta

SEQ ID NO: 683480 - DNA, 20 bp, Artificial
  CRISPR gRNA sequence
tggtgtacataaatgttgtc

SEQ ID NO: 683481 - DNA, 20 bp, Artificial
  CRISPR gRNA sequence
tgtacataaatgttgtcgag

SEQ ID NO: 683482 - DNA, 20 bp, Artificial
  CRISPR gRNA sequence
aatactttcaacatcatcaa

SEQ ID NO: 683483 - DNA, 20 bp, Artificial
  CRISPR gRNA sequence
tcaacatcatcaatggcctt

SEQ ID NO: 683484 - DNA, 20 bp, Artificial
  CRISPR gRNA sequence
catcatcaatggccttgagt

SEQ ID NO: 683485 - DNA, 20 bp, Artificial
  CRISPR gRNA sequence
attctaaaaatgtgttttcc

SEQ ID NO: 683486 - DNA, 20 bp, Artificial
  CRISPR gRNA sequence
agttattttaaattttataa

SEQ ID NO: 683487 - DNA, 20 bp, Artificial
  CRISPR gRNA sequence
aattttataaaagcttattt

SEQ ID NO: 683488 - DNA, 20 bp, Artificial
  CRISPR gRNA sequence
attttataaaagcttattta

SEQ ID NO: 683489 - DNA, 20 bp, Artificial
  CRISPR gRNA sequence
ttttataaaagcttatttaa

SEQ ID NO: 683490 - DNA, 20 bp, Artificial
  CRISPR gRNA sequence
ataaaagcttatttaaggga

SEQ ID NO: 683491 - DNA, 20 bp, Artificial
  CRISPR gRNA sequence
agggaaagatttcacaatca

SEQ ID NO: 683492 - DNA, 20 bp, Artificial
  CRISPR gRNA sequence
tcatagcttatcaatctaca

SEQ ID NO: 683493 - DNA, 20 bp, Artificial
  CRISPR gRNA sequence
catagcttatcaatctacaa

SEQ ID NO: 683494 - DNA, 20 bp, Artificial
  CRISPR gRNA sequence
cttatcaatctacaaaggat

SEQ ID NO: 683495 - DNA, 20 bp, Artificial
  CRISPR gRNA sequence
ttatcaatctacaaaggatt

SEQ ID NO: 683496 - DNA, 20 bp, Artificial
  CRISPR gRNA sequence
tatcaatctacaaaggattg

SEQ ID NO: 683497 - DNA, 20 bp, Artificial
  CRISPR gRNA sequence
acaaaggattggggtctcct

SEQ ID NO: 683498 - DNA, 20 bp, Artificial
  CRISPR gRNA sequence
gattggggtctccttagcac

SEQ ID NO: 683499 - DNA, 20 bp, Artificial
  CRISPR gRNA sequence
ccttagcacaagtcgatcta

SEQ ID NO: 683500 - DNA, 20 bp, Artificial
  CRISPR gRNA sequence
cacaagtcgatctacagacg

SEQ ID NO: 683501 - DNA, 20 bp, Artificial
  CRISPR gRNA sequence
atctacagacgtagatgtaa

SEQ ID NO: 683502 - DNA, 20 bp, Artificial
  CRISPR gRNA sequence
aatagcccctttacgtatga

SEQ ID NO: 683503 - DNA, 20 bp, Artificial
  CRISPR gRNA sequence
tttacgtatgacagtttttt

SEQ ID NO: 683504 - DNA, 20 bp, Artificial
  CRISPR gRNA sequence
ttacgtatgacagttttttc

SEQ ID NO: 683505 - DNA, 20 bp, Artificial
  CRISPR gRNA sequence
tacgtatgacagttttttca

SEQ ID NO: 683506 - DNA, 20 bp, Artificial
  CRISPR gRNA sequence
atgacagttttttcagggca

SEQ ID NO: 683507 - DNA, 20 bp, Artificial
  CRISPR gRNA sequence
ttttcagggcaaagcaatat

SEQ ID NO: 683508 - DNA, 20 bp, Artificial
  CRISPR gRNA sequence
ttcagggcaaagcaatattg

SEQ ID NO: 683509 - DNA, 20 bp, Artificial
  CRISPR gRNA sequence
caatattggagacaaatttt

SEQ ID NO: 683510 - DNA, 20 bp, Artificial
  CRISPR gRNA sequence
atattggagacaaatttttg

SEQ ID NO: 683511 - DNA, 20 bp, Artificial
  CRISPR gRNA sequence
atactccaccgctgtaaaat

SEQ ID NO: 683512 - DNA, 20 bp, Artificial
  CRISPR gRNA sequence
cgctgtaaaataagcatcac

SEQ ID NO: 683513 - DNA, 20 bp, Artificial
  CRISPR gRNA sequence
tcaccagaccacattcctat

SEQ ID NO: 683514 - DNA, 20 bp, Artificial
  CRISPR gRNA sequence
ctgtttaatatcaaccctta

SEQ ID NO: 683515 - DNA, 20 bp, Artificial
  CRISPR gRNA sequence
tttaatatcaacccttacag

SEQ ID NO: 683516 - DNA, 20 bp, Artificial
  CRISPR gRNA sequence
cacactgtcattaaataaat

SEQ ID NO: 683517 - DNA, 20 bp, Artificial
  CRISPR gRNA sequence
tcattaaataaatgagcatg

SEQ ID NO: 683518 - DNA, 20 bp, Artificial
  CRISPR gRNA sequence
cattaaataaatgagcatga

SEQ ID NO: 683519 - DNA, 20 bp, Artificial
  CRISPR gRNA sequence
attaaataaatgagcatgaa

SEQ ID NO: 683520 - DNA, 20 bp, Artificial
  CRISPR gRNA sequence
aataaatgagcatgaaggga

SEQ ID NO: 683521 - DNA, 20 bp, Artificial
  CRISPR gRNA sequence
taaatgagcatgaagggatg

SEQ ID NO: 683522 - DNA, 20 bp, Artificial
  CRISPR gRNA sequence
aaatgagcatgaagggatgg

SEQ ID NO: 683523 - DNA, 20 bp, Artificial
  CRISPR gRNA sequence
catgaagggatggaggattg

SEQ ID NO: 683524 - DNA, 20 bp, Artificial
  CRISPR gRNA sequence
gaagggatggaggattgcag

SEQ ID NO: 683525 - DNA, 20 bp, Artificial
  CRISPR gRNA sequence
ggattgcagcagtgctccat

SEQ ID NO: 683526 - DNA, 20 bp, Artificial
  CRISPR gRNA sequence
cataagcactgcccgtcttt

SEQ ID NO: 683527 - DNA, 20 bp, Artificial
  CRISPR gRNA sequence
cactgcccgtctttcagcct

SEQ ID NO: 683528 - DNA, 20 bp, Artificial
  CRISPR gRNA sequence
tgcccgtctttcagccttag

SEQ ID NO: 683529 - DNA, 20 bp, Artificial
  CRISPR gRNA sequence
tctttcagccttagtggtca

SEQ ID NO: 683530 - DNA, 20 bp, Artificial
  CRISPR gRNA sequence
ctttcagccttagtggtcac

SEQ ID NO: 683531 - DNA, 20 bp, Artificial
  CRISPR gRNA sequence
ttcagccttagtggtcacag

SEQ ID NO: 683532 - DNA, 20 bp, Artificial
  CRISPR gRNA sequence
gccttagtggtcacaggagt

SEQ ID NO: 683533 - DNA, 20 bp, Artificial
  CRISPR gRNA sequence
acaggagtcagaattccgta

SEQ ID NO: 683534 - DNA, 20 bp, Artificial
  CRISPR gRNA sequence
caggagtcagaattccgtac

SEQ ID NO: 683535 - DNA, 20 bp, Artificial
  CRISPR gRNA sequence
aggagtcagaattccgtacg

SEQ ID NO: 683536 - DNA, 20 bp, Artificial
  CRISPR gRNA sequence
agtcagaattccgtacgggg

SEQ ID NO: 683537 - DNA, 20 bp, Artificial
  CRISPR gRNA sequence
cgtacggggaagatttcact

SEQ ID NO: 683538 - DNA, 20 bp, Artificial
  CRISPR gRNA sequence
gtacggggaagatttcactg

SEQ ID NO: 683539 - DNA, 20 bp, Artificial
  CRISPR gRNA sequence
ggggaagatttcactgagga

SEQ ID NO: 683540 - DNA, 20 bp, Artificial
  CRISPR gRNA sequence
gggaagatttcactgaggat

SEQ ID NO: 683541 - DNA, 20 bp, Artificial
  CRISPR gRNA sequence
tcactgaggatgggccaccc

SEQ ID NO: 683542 - DNA, 20 bp, Artificial
  CRISPR gRNA sequence
ctgaggatgggccaccctag

SEQ ID NO: 683543 - DNA, 20 bp, Artificial
  CRISPR gRNA sequence
gaggatgggccaccctagtg

SEQ ID NO: 683544 - DNA, 20 bp, Artificial
  CRISPR gRNA sequence
ccaccctagtggagaactgc

SEQ ID NO: 683545 - DNA, 20 bp, Artificial
  CRISPR gRNA sequence
gagaactgcgagcaaatctg

SEQ ID NO: 683546 - DNA, 20 bp, Artificial
  CRISPR gRNA sequence
tcatccatttattattttca

SEQ ID NO: 683547 - DNA, 20 bp, Artificial
  CRISPR gRNA sequence
catccatttattattttcat

SEQ ID NO: 683548 - DNA, 20 bp, Artificial
  CRISPR gRNA sequence
gtcttttgaaatcttctctg

SEQ ID NO: 683549 - DNA, 20 bp, Artificial
  CRISPR gRNA sequence
gtagtcttattcttattctg

SEQ ID NO: 683550 - DNA, 20 bp, Artificial
  CRISPR gRNA sequence
gtcttattcttattctgtag

SEQ ID NO: 683551 - DNA, 20 bp, Artificial
  CRISPR gRNA sequence
cttattcttattctgtagaa

SEQ ID NO: 683552 - DNA, 20 bp, Artificial
  CRISPR gRNA sequence
attcttattctgtagaagag

SEQ ID NO: 683553 - DNA, 20 bp, Artificial
  CRISPR gRNA sequence
agtagttttctaacaactac

SEQ ID NO: 683554 - DNA, 20 bp, Artificial
  CRISPR gRNA sequence
gtagttttctaacaactact

SEQ ID NO: 683555 - DNA, 20 bp, Artificial
  CRISPR gRNA sequence
caactactaggtcatgtaat

SEQ ID NO: 683556 - DNA, 20 bp, Artificial
  CRISPR gRNA sequence
aggtcatgtaattagtttta

SEQ ID NO: 683557 - DNA, 20 bp, Artificial
  CRISPR gRNA sequence
ggtcatgtaattagttttat

SEQ ID NO: 683558 - DNA, 20 bp, Artificial
  CRISPR gRNA sequence
atgtaattagttttatgggt

SEQ ID NO: 683559 - DNA, 20 bp, Artificial
  CRISPR gRNA sequence
ggttggatctgcatttgttt

SEQ ID NO: 683560 - DNA, 20 bp, Artificial
  CRISPR gRNA sequence
tgcatttgtttaagtgatat

SEQ ID NO: 683561 - DNA, 20 bp, Artificial
  CRISPR gRNA sequence
catttgtttaagtgatatca

SEQ ID NO: 683562 - DNA, 20 bp, Artificial
  CRISPR gRNA sequence
atcagagaataatgatatta

SEQ ID NO: 683563 - DNA, 20 bp, Artificial
  CRISPR gRNA sequence
cagagaataatgatattaaa

SEQ ID NO: 683564 - DNA, 20 bp, Artificial
  CRISPR gRNA sequence
aatgatattaaagagcatca

SEQ ID NO: 683565 - DNA, 20 bp, Artificial
  CRISPR gRNA sequence
atgatattaaagagcatcat

SEQ ID NO: 683566 - DNA, 20 bp, Artificial
  CRISPR gRNA sequence
aagagcatcataggtaataa

SEQ ID NO: 683567 - DNA, 20 bp, Artificial
  CRISPR gRNA sequence
gcatcataggtaataaaaga

SEQ ID NO: 683568 - DNA, 20 bp, Artificial
  CRISPR gRNA sequence
aataaaagaaagttttattt

SEQ ID NO: 683569 - DNA, 20 bp, Artificial
  CRISPR gRNA sequence
tgtgtgtgtgtttgtcatta

SEQ ID NO: 683570 - DNA, 20 bp, Artificial
  CRISPR gRNA sequence
gtgtgtgtgtttgtcattat

SEQ ID NO: 683571 - DNA, 20 bp, Artificial
  CRISPR gRNA sequence
ttgtcattatgggttattgt

SEQ ID NO: 683572 - DNA, 20 bp, Artificial
  CRISPR gRNA sequence
tcattatgggttattgtcag

SEQ ID NO: 683573 - DNA, 20 bp, Artificial
  CRISPR gRNA sequence
tgaaaaacattgctatgaaa

SEQ ID NO: 683574 - DNA, 20 bp, Artificial
  CRISPR gRNA sequence
aacattgctatgaaatagaa

SEQ ID NO: 683575 - DNA, 20 bp, Artificial
  CRISPR gRNA sequence
gaatagaaacatgaaaatac

SEQ ID NO: 683576 - DNA, 20 bp, Artificial
  CRISPR gRNA sequence
aatacaagctttatattgac

SEQ ID NO: 683577 - DNA, 20 bp, Artificial
  CRISPR gRNA sequence
ttatatttctttttgtcttt

SEQ ID NO: 683578 - DNA, 20 bp, Artificial
  CRISPR gRNA sequence
tttctttttgtctttaagat

SEQ ID NO: 683579 - DNA, 20 bp, Artificial
  CRISPR gRNA sequence
tttttgtctttaagatgagc

SEQ ID NO: 683580 - DNA, 20 bp, Artificial
  CRISPR gRNA sequence
ttttgtctttaagatgagca

SEQ ID NO: 683581 - DNA, 20 bp, Artificial
  CRISPR gRNA sequence
gcaaggcttttctctgtttc

SEQ ID NO: 683582 - DNA, 20 bp, Artificial
  CRISPR gRNA sequence
ttttctctgtttccagtaat

SEQ ID NO: 683583 - DNA, 20 bp, Artificial
  CRISPR gRNA sequence
ttctctgtttccagtaatcg

SEQ ID NO: 683584 - DNA, 20 bp, Artificial
  CRISPR gRNA sequence
cccctgcacaaaatgaaata

SEQ ID NO: 683585 - DNA, 20 bp, Artificial
  CRISPR gRNA sequence
ccctgcacaaaatgaaataa

SEQ ID NO: 683586 - DNA, 20 bp, Artificial
  CRISPR gRNA sequence
tgcacaaaatgaaataaagg

SEQ ID NO: 683587 - DNA, 20 bp, Artificial
  CRISPR gRNA sequence
acaaaatgaaataaaggaag

SEQ ID NO: 683588 - DNA, 20 bp, Artificial
  CRISPR gRNA sequence
gaaataaaggaagtggaaat

SEQ ID NO: 683589 - DNA, 20 bp, Artificial
  CRISPR gRNA sequence
taaaggaagtggaaattggt

SEQ ID NO: 683590 - DNA, 20 bp, Artificial
  CRISPR gRNA sequence
aaattggtaagaaaatttat

SEQ ID NO: 683591 - DNA, 20 bp, Artificial
  CRISPR gRNA sequence
agaatgctgtaaatattgcc

SEQ ID NO: 683592 - DNA, 20 bp, Artificial
  CRISPR gRNA sequence
acccctgttctgaattccct

SEQ ID NO: 683593 - DNA, 20 bp, Artificial
  CRISPR gRNA sequence
cctgttctgaattcccttag

SEQ ID NO: 683594 - DNA, 20 bp, Artificial
  CRISPR gRNA sequence
ctgttctgaattcccttagc

SEQ ID NO: 683595 - DNA, 20 bp, Artificial
  CRISPR gRNA sequence
tgttctgaattcccttagca

SEQ ID NO: 683596 - DNA, 20 bp, Artificial
  CRISPR gRNA sequence
gttctgaattcccttagcag

SEQ ID NO: 683597 - DNA, 20 bp, Artificial
  CRISPR gRNA sequence
tgaattcccttagcaggggt

SEQ ID NO: 683598 - DNA, 20 bp, Artificial
  CRISPR gRNA sequence
gaattcccttagcaggggtc

SEQ ID NO: 683599 - DNA, 20 bp, Artificial
  CRISPR gRNA sequence
cttagcaggggtcaggcaat

SEQ ID NO: 683600 - DNA, 20 bp, Artificial
  CRISPR gRNA sequence
aggggtcaggcaattagcat

SEQ ID NO: 683601 - DNA, 20 bp, Artificial
  CRISPR gRNA sequence
ggggtcaggcaattagcata

SEQ ID NO: 683602 - DNA, 20 bp, Artificial
  CRISPR gRNA sequence
caattagcataaggaacctt

SEQ ID NO: 683603 - DNA, 20 bp, Artificial
  CRISPR gRNA sequence
aattagcataaggaaccttg

SEQ ID NO: 683604 - DNA, 20 bp, Artificial
  CRISPR gRNA sequence
ttagcataaggaaccttgag

SEQ ID NO: 683605 - DNA, 20 bp, Artificial
  CRISPR gRNA sequence
cataaggaaccttgaggagt

SEQ ID NO: 683606 - DNA, 20 bp, Artificial
  CRISPR gRNA sequence
aggaaccttgaggagtaagt

SEQ ID NO: 683607 - DNA, 20 bp, Artificial
  CRISPR gRNA sequence
ggaaccttgaggagtaagtg

SEQ ID NO: 683608 - DNA, 20 bp, Artificial
  CRISPR gRNA sequence
aagtgaggtgacatccctga

SEQ ID NO: 683609 - DNA, 20 bp, Artificial
  CRISPR gRNA sequence
tccctgaaagcacctgcccc

SEQ ID NO: 683610 - DNA, 20 bp, Artificial
  CRISPR gRNA sequence
ccccaagcatttgctaatat

SEQ ID NO: 683611 - DNA, 20 bp, Artificial
  CRISPR gRNA sequence
cccaagcatttgctaatatt

SEQ ID NO: 683612 - DNA, 20 bp, Artificial
  CRISPR gRNA sequence
gcatttgctaatattgggaa

SEQ ID NO: 683613 - DNA, 20 bp, Artificial
  CRISPR gRNA sequence
catttgctaatattgggaac

SEQ ID NO: 683614 - DNA, 20 bp, Artificial
  CRISPR gRNA sequence
atttgctaatattgggaaca

SEQ ID NO: 683615 - DNA, 20 bp, Artificial
  CRISPR gRNA sequence
taatattgggaacagggaca

SEQ ID NO: 683616 - DNA, 20 bp, Artificial
  CRISPR gRNA sequence
gaacagggacacagcaattg

SEQ ID NO: 683617 - DNA, 20 bp, Artificial
  CRISPR gRNA sequence
tttcatcttcatctctatcc

SEQ ID NO: 683618 - DNA, 20 bp, Artificial
  CRISPR gRNA sequence
tcatcttcatctctatccca

SEQ ID NO: 683619 - DNA, 20 bp, Artificial
  CRISPR gRNA sequence
ttcatctctatcccagagct

SEQ ID NO: 683620 - DNA, 20 bp, Artificial
  CRISPR gRNA sequence
tcatctctatcccagagctt

SEQ ID NO: 683621 - DNA, 20 bp, Artificial
  CRISPR gRNA sequence
ctctatcccagagcttggga

SEQ ID NO: 683622 - DNA, 20 bp, Artificial
  CRISPR gRNA sequence
ctatcccagagcttgggatg

SEQ ID NO: 683623 - DNA, 20 bp, Artificial
  CRISPR gRNA sequence
gagcttgggatggagacctg

SEQ ID NO: 683624 - DNA, 20 bp, Artificial
  CRISPR gRNA sequence
agcttgggatggagacctgc

SEQ ID NO: 683625 - DNA, 20 bp, Artificial
  CRISPR gRNA sequence
gcttgggatggagacctgca

SEQ ID NO: 683626 - DNA, 20 bp, Artificial
  CRISPR gRNA sequence
gacctgcagggtgttcattc

SEQ ID NO: 683627 - DNA, 20 bp, Artificial
  CRISPR gRNA sequence
acctgcagggtgttcattct

SEQ ID NO: 683628 - DNA, 20 bp, Artificial
  CRISPR gRNA sequence
agggtgttcattctgggcaa

SEQ ID NO: 683629 - DNA, 20 bp, Artificial
  CRISPR gRNA sequence
gtgttcattctgggcaatgg

SEQ ID NO: 683630 - DNA, 20 bp, Artificial
  CRISPR gRNA sequence
tcattctgggcaatggtagc

SEQ ID NO: 683631 - DNA, 20 bp, Artificial
  CRISPR gRNA sequence
tgggcaatggtagccagatc

SEQ ID NO: 683632 - DNA, 20 bp, Artificial
  CRISPR gRNA sequence
gtaaaacatgtttatcttca

SEQ ID NO: 683633 - DNA, 20 bp, Artificial
  CRISPR gRNA sequence
aaacatgtttatcttcaaag

SEQ ID NO: 683634 - DNA, 20 bp, Artificial
  CRISPR gRNA sequence
tttatcttcaaagtagctta

SEQ ID NO: 683635 - DNA, 20 bp, Artificial
  CRISPR gRNA sequence
tatcttcaaagtagcttatg

SEQ ID NO: 683636 - DNA, 20 bp, Artificial
  CRISPR gRNA sequence
tcttcaaagtagcttatgga

SEQ ID NO: 683637 - DNA, 20 bp, Artificial
  CRISPR gRNA sequence
aagtagcttatggagagatg

SEQ ID NO: 683638 - DNA, 20 bp, Artificial
  CRISPR gRNA sequence
gtagcttatggagagatgaa

SEQ ID NO: 683639 - DNA, 20 bp, Artificial
  CRISPR gRNA sequence
agcttatggagagatgaaga

SEQ ID NO: 683640 - DNA, 20 bp, Artificial
  CRISPR gRNA sequence
gagagatgaagagagttctg

SEQ ID NO: 683641 - DNA, 20 bp, Artificial
  CRISPR gRNA sequence
gatgaagagagttctgtaga

SEQ ID NO: 683642 - DNA, 20 bp, Artificial
  CRISPR gRNA sequence
gagagttctgtagaaagatg

SEQ ID NO: 683643 - DNA, 20 bp, Artificial
  CRISPR gRNA sequence
agttctgtagaaagatgtgg

SEQ ID NO: 683644 - DNA, 20 bp, Artificial
  CRISPR gRNA sequence
ttctgtagaaagatgtggaa

SEQ ID NO: 683645 - DNA, 20 bp, Artificial
  CRISPR gRNA sequence
tctgtagaaagatgtggaag

SEQ ID NO: 683646 - DNA, 20 bp, Artificial
  CRISPR gRNA sequence
ctgtagaaagatgtggaaga

SEQ ID NO: 683647 - DNA, 20 bp, Artificial
  CRISPR gRNA sequence
tagaaagatgtggaagaggg

SEQ ID NO: 683648 - DNA, 20 bp, Artificial
  CRISPR gRNA sequence
aagatgtggaagagggcagt

SEQ ID NO: 683649 - DNA, 20 bp, Artificial
  CRISPR gRNA sequence
tgtggaagagggcagttgga

SEQ ID NO: 683650 - DNA, 20 bp, Artificial
  CRISPR gRNA sequence
tggaaagaaactctaatttc

SEQ ID NO: 683651 - DNA, 20 bp, Artificial
  CRISPR gRNA sequence
aaagaaactctaatttctag

SEQ ID NO: 683652 - DNA, 20 bp, Artificial
  CRISPR gRNA sequence
agaaactctaatttctagta

SEQ ID NO: 683653 - DNA, 20 bp, Artificial
  CRISPR gRNA sequence
gaaactctaatttctagtag

SEQ ID NO: 683654 - DNA, 20 bp, Artificial
  CRISPR gRNA sequence
aaactctaatttctagtaga

SEQ ID NO: 683655 - DNA, 20 bp, Artificial
  CRISPR gRNA sequence
gtagagggcaatccttttac

SEQ ID NO: 683656 - DNA, 20 bp, Artificial
  CRISPR gRNA sequence
actagaaatcctttgtaatg

SEQ ID NO: 683657 - DNA, 20 bp, Artificial
  CRISPR gRNA sequence
ctagaaatcctttgtaatgt

SEQ ID NO: 683658 - DNA, 20 bp, Artificial
  CRISPR gRNA sequence
tagaaatcctttgtaatgtg

SEQ ID NO: 683659 - DNA, 20 bp, Artificial
  CRISPR gRNA sequence
aatcctttgtaatgtggggt

SEQ ID NO: 683660 - DNA, 20 bp, Artificial
  CRISPR gRNA sequence
tttgtaatgtggggttggtg

SEQ ID NO: 683661 - DNA, 20 bp, Artificial
  CRISPR gRNA sequence
ttgtaatgtggggttggtga

SEQ ID NO: 683662 - DNA, 20 bp, Artificial
  CRISPR gRNA sequence
taatgtggggttggtgaagg

SEQ ID NO: 683663 - DNA, 20 bp, Artificial
  CRISPR gRNA sequence
gttggtgaaggcagaatcat

SEQ ID NO: 683664 - DNA, 20 bp, Artificial
  CRISPR gRNA sequence
ggcagaatcattggccttgt

SEQ ID NO: 683665 - DNA, 20 bp, Artificial
  CRISPR gRNA sequence
ggccttgttagtttcccatg

SEQ ID NO: 683666 - DNA, 20 bp, Artificial
  CRISPR gRNA sequence
tgttagtttcccatgcagat

SEQ ID NO: 683667 - DNA, 20 bp, Artificial
  CRISPR gRNA sequence
ttcccatgcagatgagaata

SEQ ID NO: 683668 - DNA, 20 bp, Artificial
  CRISPR gRNA sequence
ccatgcagatgagaatatag

SEQ ID NO: 683669 - DNA, 20 bp, Artificial
  CRISPR gRNA sequence
catgcagatgagaatatagt

SEQ ID NO: 683670 - DNA, 20 bp, Artificial
  CRISPR gRNA sequence
tgcagatgagaatatagtgg

SEQ ID NO: 683671 - DNA, 20 bp, Artificial
  CRISPR gRNA sequence
atgagaatatagtgggagct

SEQ ID NO: 683672 - DNA, 20 bp, Artificial
  CRISPR gRNA sequence
tgggagctgagcttcaaacc

SEQ ID NO: 683673 - DNA, 20 bp, Artificial
  CRISPR gRNA sequence
agctgagcttcaaacccagc

SEQ ID NO: 683674 - DNA, 20 bp, Artificial
  CRISPR gRNA sequence
gctgagcttcaaacccagct

SEQ ID NO: 683675 - DNA, 20 bp, Artificial
  CRISPR gRNA sequence
caaacccagctgggtgaatg

SEQ ID NO: 683676 - DNA, 20 bp, Artificial
  CRISPR gRNA sequence
aaacccagctgggtgaatga

SEQ ID NO: 683677 - DNA, 20 bp, Artificial
  CRISPR gRNA sequence
agctgggtgaatgaaggtaa

SEQ ID NO: 683678 - DNA, 20 bp, Artificial
  CRISPR gRNA sequence
tgggtgaatgaaggtaatgg

SEQ ID NO: 683679 - DNA, 20 bp, Artificial
  CRISPR gRNA sequence
gtgaatgaaggtaatggaag

SEQ ID NO: 683680 - DNA, 20 bp, Artificial
  CRISPR gRNA sequence
tgaatgaaggtaatggaagc

SEQ ID NO: 683681 - DNA, 20 bp, Artificial
  CRISPR gRNA sequence
gaatgaaggtaatggaagca

SEQ ID NO: 683682 - DNA, 20 bp, Artificial
  CRISPR gRNA sequence
atgaaggtaatggaagcagg

SEQ ID NO: 683683 - DNA, 20 bp, Artificial
  CRISPR gRNA sequence
tgaaggtaatggaagcaggg

SEQ ID NO: 683684 - DNA, 20 bp, Artificial
  CRISPR gRNA sequence
aaggtaatggaagcagggag

SEQ ID NO: 683685 - DNA, 20 bp, Artificial
  CRISPR gRNA sequence
aggtaatggaagcagggagg

SEQ ID NO: 683686 - DNA, 20 bp, Artificial
  CRISPR gRNA sequence
aatggaagcagggaggaggc

SEQ ID NO: 683687 - DNA, 20 bp, Artificial
  CRISPR gRNA sequence
tggaagcagggaggaggcaa

SEQ ID NO: 683688 - DNA, 20 bp, Artificial
  CRISPR gRNA sequence
gaagcagggaggaggcaaga

SEQ ID NO: 683689 - DNA, 20 bp, Artificial
  CRISPR gRNA sequence
aagcagggaggaggcaagag

SEQ ID NO: 683690 - DNA, 20 bp, Artificial
  CRISPR gRNA sequence
ggaggaggcaagagaggaca

SEQ ID NO: 683691 - DNA, 20 bp, Artificial
  CRISPR gRNA sequence
gaggcaagagaggacataga

SEQ ID NO: 683692 - DNA, 20 bp, Artificial
  CRISPR gRNA sequence
ggcaagagaggacatagaaa

SEQ ID NO: 683693 - DNA, 20 bp, Artificial
  CRISPR gRNA sequence
gcaagagaggacatagaaag

SEQ ID NO: 683694 - DNA, 20 bp, Artificial
  CRISPR gRNA sequence
agagaggacatagaaagagg

SEQ ID NO: 683695 - DNA, 20 bp, Artificial
  CRISPR gRNA sequence
gagaggacatagaaagagga

SEQ ID NO: 683696 - DNA, 20 bp, Artificial
  CRISPR gRNA sequence
acatagaaagaggaaggtgc

SEQ ID NO: 683697 - DNA, 20 bp, Artificial
  CRISPR gRNA sequence
atagaaagaggaaggtgcta

SEQ ID NO: 683698 - DNA, 20 bp, Artificial
  CRISPR gRNA sequence
aagaggaaggtgctagagat

SEQ ID NO: 683699 - DNA, 20 bp, Artificial
  CRISPR gRNA sequence
agaggaaggtgctagagatg

SEQ ID NO: 683700 - DNA, 20 bp, Artificial
  CRISPR gRNA sequence
gaggaaggtgctagagatga

SEQ ID NO: 683701 - DNA, 20 bp, Artificial
  CRISPR gRNA sequence
ggaaggtgctagagatgagg

SEQ ID NO: 683702 - DNA, 20 bp, Artificial
  CRISPR gRNA sequence
gaaggtgctagagatgaggg

SEQ ID NO: 683703 - DNA, 20 bp, Artificial
  CRISPR gRNA sequence
aaggtgctagagatgaggga

SEQ ID NO: 683704 - DNA, 20 bp, Artificial
  CRISPR gRNA sequence
ggtgctagagatgagggagg

SEQ ID NO: 683705 - DNA, 20 bp, Artificial
  CRISPR gRNA sequence
gtgctagagatgagggaggg

SEQ ID NO: 683706 - DNA, 20 bp, Artificial
  CRISPR gRNA sequence
gagatgagggagggaggtcc

SEQ ID NO: 683707 - DNA, 20 bp, Artificial
  CRISPR gRNA sequence
atgagggagggaggtcctgg

SEQ ID NO: 683708 - DNA, 20 bp, Artificial
  CRISPR gRNA sequence
tgagggagggaggtcctggt

SEQ ID NO: 683709 - DNA, 20 bp, Artificial
  CRISPR gRNA sequence
gagggagggaggtcctggtg

SEQ ID NO: 683710 - DNA, 20 bp, Artificial
  CRISPR gRNA sequence
gtcctggtggggtgcatact

SEQ ID NO: 683711 - DNA, 20 bp, Artificial
  CRISPR gRNA sequence
tggggtgcatactaagtgtt

SEQ ID NO: 683712 - DNA, 20 bp, Artificial
  CRISPR gRNA sequence
gtgcatactaagtgttcagt

SEQ ID NO: 683713 - DNA, 20 bp, Artificial
  CRISPR gRNA sequence
tgcatactaagtgttcagta

SEQ ID NO: 683714 - DNA, 20 bp, Artificial
  CRISPR gRNA sequence
ggttttttttttacattaaa

SEQ ID NO: 683715 - DNA, 20 bp, Artificial
  CRISPR gRNA sequence
gttttttttttacattaaat

SEQ ID NO: 683716 - DNA, 20 bp, Artificial
  CRISPR gRNA sequence
cattaaatgggataaaatgc

SEQ ID NO: 683717 - DNA, 20 bp, Artificial
  CRISPR gRNA sequence
atgggataaaatgccagtcg

SEQ ID NO: 683718 - DNA, 20 bp, Artificial
  CRISPR gRNA sequence
ggataaaatgccagtcgcag

SEQ ID NO: 683719 - DNA, 20 bp, Artificial
  CRISPR gRNA sequence
gtcgcagaagttaattttat

SEQ ID NO: 683720 - DNA, 20 bp, Artificial
  CRISPR gRNA sequence
tgaatgtccttactcccctc

SEQ ID NO: 683721 - DNA, 20 bp, Artificial
  CRISPR gRNA sequence
gaatgtccttactcccctct

SEQ ID NO: 683722 - DNA, 20 bp, Artificial
  CRISPR gRNA sequence
ctaacttgctctgcttgttt

SEQ ID NO: 683723 - DNA, 20 bp, Artificial
  CRISPR gRNA sequence
ttgctctgcttgttttggaa

SEQ ID NO: 683724 - DNA, 20 bp, Artificial
  CRISPR gRNA sequence
tgctctgcttgttttggaaa

SEQ ID NO: 683725 - DNA, 20 bp, Artificial
  CRISPR gRNA sequence
cttgttttggaaaaggcact

SEQ ID NO: 683726 - DNA, 20 bp, Artificial
  CRISPR gRNA sequence
tggaaaaggcactcagttct

SEQ ID NO: 683727 - DNA, 20 bp, Artificial
  CRISPR gRNA sequence
agttcttggctgccgtcctg

SEQ ID NO: 683728 - DNA, 20 bp, Artificial
  CRISPR gRNA sequence
tcttggctgccgtcctgtgg

SEQ ID NO: 683729 - DNA, 20 bp, Artificial
  CRISPR gRNA sequence
gccgtcctgtggcagcttaa

SEQ ID NO: 683730 - DNA, 20 bp, Artificial
  CRISPR gRNA sequence
gcttaatggaacaaaaatta

SEQ ID NO: 683731 - DNA, 20 bp, Artificial
  CRISPR gRNA sequence
ggaacaaaaattacagactt

SEQ ID NO: 683732 - DNA, 20 bp, Artificial
  CRISPR gRNA sequence
attacagactttggtgaacc

SEQ ID NO: 683733 - DNA, 20 bp, Artificial
  CRISPR gRNA sequence
tggtgaaccaagaattcaac

SEQ ID NO: 683734 - DNA, 20 bp, Artificial
  CRISPR gRNA sequence
gtgaaccaagaattcaacaa

SEQ ID NO: 683735 - DNA, 20 bp, Artificial
  CRISPR gRNA sequence
tgaaccaagaattcaacaag

SEQ ID NO: 683736 - DNA, 20 bp, Artificial
  CRISPR gRNA sequence
accaagaattcaacaagagg

SEQ ID NO: 683737 - DNA, 20 bp, Artificial
  CRISPR gRNA sequence
ccaagaattcaacaagagga

SEQ ID NO: 683738 - DNA, 20 bp, Artificial
  CRISPR gRNA sequence
caagaattcaacaagaggaa

SEQ ID NO: 683739 - DNA, 20 bp, Artificial
  CRISPR gRNA sequence
caagaggaagggcaaaatca

SEQ ID NO: 683740 - DNA, 20 bp, Artificial
  CRISPR gRNA sequence
aagaggaagggcaaaatcaa

SEQ ID NO: 683741 - DNA, 20 bp, Artificial
  CRISPR gRNA sequence
tcaaaggtatttttatattg

SEQ ID NO: 683742 - DNA, 20 bp, Artificial
  CRISPR gRNA sequence
aaaggtatttttatattgaa

SEQ ID NO: 683743 - DNA, 20 bp, Artificial
  CRISPR gRNA sequence
catcctcttccccttgcaca

SEQ ID NO: 683744 - DNA, 20 bp, Artificial
  CRISPR gRNA sequence
gcacatggtttgcacctgca

SEQ ID NO: 683745 - DNA, 20 bp, Artificial
  CRISPR gRNA sequence
catggtttgcacctgcaaag

SEQ ID NO: 683746 - DNA, 20 bp, Artificial
  CRISPR gRNA sequence
atggtttgcacctgcaaagt

SEQ ID NO: 683747 - DNA, 20 bp, Artificial
  CRISPR gRNA sequence
acctgcaaagtaggcattaa

SEQ ID NO: 683748 - DNA, 20 bp, Artificial
  CRISPR gRNA sequence
aaagtaggcattaaaagtaa

SEQ ID NO: 683749 - DNA, 20 bp, Artificial
  CRISPR gRNA sequence
aagtaggcattaaaagtaac

SEQ ID NO: 683750 - DNA, 20 bp, Artificial
  CRISPR gRNA sequence
aaagtaacaggttgctttct

SEQ ID NO: 683751 - DNA, 20 bp, Artificial
  CRISPR gRNA sequence
acaggttgctttcttagttt

SEQ ID NO: 683752 - DNA, 20 bp, Artificial
  CRISPR gRNA sequence
tgctttcttagtttcagcaa

SEQ ID NO: 683753 - DNA, 20 bp, Artificial
  CRISPR gRNA sequence
gctttcttagtttcagcaat

SEQ ID NO: 683754 - DNA, 20 bp, Artificial
  CRISPR gRNA sequence
tcttagtttcagcaatgggc

SEQ ID NO: 683755 - DNA, 20 bp, Artificial
  CRISPR gRNA sequence
cagcaatgggctggcttgtc

SEQ ID NO: 683756 - DNA, 20 bp, Artificial
  CRISPR gRNA sequence
tgggctggcttgtctagaca

SEQ ID NO: 683757 - DNA, 20 bp, Artificial
  CRISPR gRNA sequence
gcttgtctagacatggtttt

SEQ ID NO: 683758 - DNA, 20 bp, Artificial
  CRISPR gRNA sequence
tctagacatggttttaagaa

SEQ ID NO: 683759 - DNA, 20 bp, Artificial
  CRISPR gRNA sequence
ttttaagaatagctgacgtg

SEQ ID NO: 683760 - DNA, 20 bp, Artificial
  CRISPR gRNA sequence
tttaagaatagctgacgtga

SEQ ID NO: 683761 - DNA, 20 bp, Artificial
  CRISPR gRNA sequence
aagaatagctgacgtgaagg

SEQ ID NO: 683762 - DNA, 20 bp, Artificial
  CRISPR gRNA sequence
gaatagctgacgtgaaggaa

SEQ ID NO: 683763 - DNA, 20 bp, Artificial
  CRISPR gRNA sequence
aatagctgacgtgaaggaag

SEQ ID NO: 683764 - DNA, 20 bp, Artificial
  CRISPR gRNA sequence
aggaagaggatttattgctg

SEQ ID NO: 683765 - DNA, 20 bp, Artificial
  CRISPR gRNA sequence
attgctgcagtacgactgtc

SEQ ID NO: 683766 - DNA, 20 bp, Artificial
  CRISPR gRNA sequence
tgtctggccctgaatttgca

SEQ ID NO: 683767 - DNA, 20 bp, Artificial
  CRISPR gRNA sequence
gccctgaatttgcatggctt

SEQ ID NO: 683768 - DNA, 20 bp, Artificial
  CRISPR gRNA sequence
ctgaatttgcatggcttgag

SEQ ID NO: 683769 - DNA, 20 bp, Artificial
  CRISPR gRNA sequence
tgaatttgcatggcttgaga

SEQ ID NO: 683770 - DNA, 20 bp, Artificial
  CRISPR gRNA sequence
ggcttgagaaggcacaccgt

SEQ ID NO: 683771 - DNA, 20 bp, Artificial
  CRISPR gRNA sequence
agaaggcacaccgtaagact

SEQ ID NO: 683772 - DNA, 20 bp, Artificial
  CRISPR gRNA sequence
aggcacaccgtaagactaag

SEQ ID NO: 683773 - DNA, 20 bp, Artificial
  CRISPR gRNA sequence
ggcacaccgtaagactaagt

SEQ ID NO: 683774 - DNA, 20 bp, Artificial
  CRISPR gRNA sequence
agactaagtaggaaaaatcc

SEQ ID NO: 683775 - DNA, 20 bp, Artificial
  CRISPR gRNA sequence
taagtaggaaaaatccaagt

SEQ ID NO: 683776 - DNA, 20 bp, Artificial
  CRISPR gRNA sequence
aagtaggaaaaatccaagta

SEQ ID NO: 683777 - DNA, 20 bp, Artificial
  CRISPR gRNA sequence
gtaggaaaaatccaagtaag

SEQ ID NO: 683778 - DNA, 20 bp, Artificial
  CRISPR gRNA sequence
tccaagtaaggagtgtttct

SEQ ID NO: 683779 - DNA, 20 bp, Artificial
  CRISPR gRNA sequence
ttgatcacctgaactttctc

SEQ ID NO: 683780 - DNA, 20 bp, Artificial
  CRISPR gRNA sequence
tcacctgaactttctctagc

SEQ ID NO: 683781 - DNA, 20 bp, Artificial
  CRISPR gRNA sequence
gaactttctctagcaagtgt

SEQ ID NO: 683782 - DNA, 20 bp, Artificial
  CRISPR gRNA sequence
ctttctctagcaagtgtaag

SEQ ID NO: 683783 - DNA, 20 bp, Artificial
  CRISPR gRNA sequence
tctagcaagtgtaagcagaa

SEQ ID NO: 683784 - DNA, 20 bp, Artificial
  CRISPR gRNA sequence
tagcaagtgtaagcagaatg

SEQ ID NO: 683785 - DNA, 20 bp, Artificial
  CRISPR gRNA sequence
agtgtaagcagaatggagtg

SEQ ID NO: 683786 - DNA, 20 bp, Artificial
  CRISPR gRNA sequence
gcagaatggagtgtggttcc

SEQ ID NO: 683787 - DNA, 20 bp, Artificial
  CRISPR gRNA sequence
agaatggagtgtggttccaa

SEQ ID NO: 683788 - DNA, 20 bp, Artificial
  CRISPR gRNA sequence
gtggttccaagagatccatc

SEQ ID NO: 683789 - DNA, 20 bp, Artificial
  CRISPR gRNA sequence
caagagatccatcaagacaa

SEQ ID NO: 683790 - DNA, 20 bp, Artificial
  CRISPR gRNA sequence
aagagatccatcaagacaat

SEQ ID NO: 683791 - DNA, 20 bp, Artificial
  CRISPR gRNA sequence
atccatcaagacaatgggaa

SEQ ID NO: 683792 - DNA, 20 bp, Artificial
  CRISPR gRNA sequence
taaaatgtgcttctcttctt

SEQ ID NO: 683793 - DNA, 20 bp, Artificial
  CRISPR gRNA sequence
aaaatgtgcttctcttcttc

SEQ ID NO: 683794 - DNA, 20 bp, Artificial
  CRISPR gRNA sequence
tgtttgctgtctgatctttg

SEQ ID NO: 683795 - DNA, 20 bp, Artificial
  CRISPR gRNA sequence
tgtagactgttcctgtttgc

SEQ ID NO: 683796 - DNA, 20 bp, Artificial
  CRISPR gRNA sequence
gtagactgttcctgtttgct

SEQ ID NO: 683797 - DNA, 20 bp, Artificial
  CRISPR gRNA sequence
agactgttcctgtttgctgg

SEQ ID NO: 683798 - DNA, 20 bp, Artificial
  CRISPR gRNA sequence
cccccactccctcctatcgt

SEQ ID NO: 683799 - DNA, 20 bp, Artificial
  CRISPR gRNA sequence
cctcctatcgttggtttgtc

SEQ ID NO: 683800 - DNA, 20 bp, Artificial
  CRISPR gRNA sequence
gttggtttgtctagaacact

SEQ ID NO: 683801 - DNA, 20 bp, Artificial
  CRISPR gRNA sequence
agaacactcagctgcttctt

SEQ ID NO: 683802 - DNA, 20 bp, Artificial
  CRISPR gRNA sequence
ctctgtgtcactgtatgtga

SEQ ID NO: 683803 - DNA, 20 bp, Artificial
  CRISPR gRNA sequence
tctgtgtcactgtatgtgaa

SEQ ID NO: 683804 - DNA, 20 bp, Artificial
  CRISPR gRNA sequence
taacttgcattacatgttgt

SEQ ID NO: 683805 - DNA, 20 bp, Artificial
  CRISPR gRNA sequence
tgcattacatgttgtaagca

SEQ ID NO: 683806 - DNA, 20 bp, Artificial
  CRISPR gRNA sequence
gtccgttctatacctttttc

SEQ ID NO: 683807 - DNA, 20 bp, Artificial
  CRISPR gRNA sequence
ataatgaacactcattttgt

SEQ ID NO: 683808 - DNA, 20 bp, Artificial
  CRISPR gRNA sequence
tgaacactcattttgttagc

SEQ ID NO: 683809 - DNA, 20 bp, Artificial
  CRISPR gRNA sequence
gaacactcattttgttagcg

SEQ ID NO: 683810 - DNA, 20 bp, Artificial
  CRISPR gRNA sequence
aacactcattttgttagcga

SEQ ID NO: 683811 - DNA, 20 bp, Artificial
  CRISPR gRNA sequence
actcattttgttagcgaggg

SEQ ID NO: 683812 - DNA, 20 bp, Artificial
  CRISPR gRNA sequence
ttttgttagcgagggtggta

SEQ ID NO: 683813 - DNA, 20 bp, Artificial
  CRISPR gRNA sequence
agggtggtaaagtgaacaaa

SEQ ID NO: 683814 - DNA, 20 bp, Artificial
  CRISPR gRNA sequence
gggtggtaaagtgaacaaaa

SEQ ID NO: 683815 - DNA, 20 bp, Artificial
  CRISPR gRNA sequence
ggtggtaaagtgaacaaaaa

SEQ ID NO: 683816 - DNA, 20 bp, Artificial
  CRISPR gRNA sequence
gtggtaaagtgaacaaaaag

SEQ ID NO: 683817 - DNA, 20 bp, Artificial
  CRISPR gRNA sequence
gtaaagtgaacaaaaagggg

SEQ ID NO: 683818 - DNA, 20 bp, Artificial
  CRISPR gRNA sequence
gtatcaaactactgccattt

SEQ ID NO: 683819 - DNA, 20 bp, Artificial
  CRISPR gRNA sequence
caaactactgccatttcagt

SEQ ID NO: 683820 - DNA, 20 bp, Artificial
  CRISPR gRNA sequence
ccatttcagtgagaaaatcc

SEQ ID NO: 683821 - DNA, 20 bp, Artificial
  CRISPR gRNA sequence
catttcagtgagaaaatcct

SEQ ID NO: 683822 - DNA, 20 bp, Artificial
  CRISPR gRNA sequence
cctaggtgctactttataat

SEQ ID NO: 683823 - DNA, 20 bp, Artificial
  CRISPR gRNA sequence
ctttataataagacatttgt

SEQ ID NO: 683824 - DNA, 20 bp, Artificial
  CRISPR gRNA sequence
tttataataagacatttgtt

SEQ ID NO: 683825 - DNA, 20 bp, Artificial
  CRISPR gRNA sequence
gccattcttgcattgatata

SEQ ID NO: 683826 - DNA, 20 bp, Artificial
  CRISPR gRNA sequence
attgatataaagaaatacct

SEQ ID NO: 683827 - DNA, 20 bp, Artificial
  CRISPR gRNA sequence
tataaagaaatacctgagac

SEQ ID NO: 683828 - DNA, 20 bp, Artificial
  CRISPR gRNA sequence
ataaagaaatacctgagact

SEQ ID NO: 683829 - DNA, 20 bp, Artificial
  CRISPR gRNA sequence
gactgggtgatttatatgaa

SEQ ID NO: 683830 - DNA, 20 bp, Artificial
  CRISPR gRNA sequence
ctgggtgatttatatgaaaa

SEQ ID NO: 683831 - DNA, 20 bp, Artificial
  CRISPR gRNA sequence
tgggtgatttatatgaaaag

SEQ ID NO: 683832 - DNA, 20 bp, Artificial
  CRISPR gRNA sequence
tatatgaaaagaggtttaat

SEQ ID NO: 683833 - DNA, 20 bp, Artificial
  CRISPR gRNA sequence
aaagaggtttaattggctca

SEQ ID NO: 683834 - DNA, 20 bp, Artificial
  CRISPR gRNA sequence
ttaattggctcacagttctg

SEQ ID NO: 683835 - DNA, 20 bp, Artificial
  CRISPR gRNA sequence
taattggctcacagttctgc

SEQ ID NO: 683836 - DNA, 20 bp, Artificial
  CRISPR gRNA sequence
tcacagttctgcaggctgta

SEQ ID NO: 683837 - DNA, 20 bp, Artificial
  CRISPR gRNA sequence
cacagttctgcaggctgtat

SEQ ID NO: 683838 - DNA, 20 bp, Artificial
  CRISPR gRNA sequence
agttctgcaggctgtatggg

SEQ ID NO: 683839 - DNA, 20 bp, Artificial
  CRISPR gRNA sequence
tgcaggctgtatgggaagca

SEQ ID NO: 683840 - DNA, 20 bp, Artificial
  CRISPR gRNA sequence
aggctgtatgggaagcatgg

SEQ ID NO: 683841 - DNA, 20 bp, Artificial
  CRISPR gRNA sequence
agcatggcggcatctgcttc

SEQ ID NO: 683842 - DNA, 20 bp, Artificial
  CRISPR gRNA sequence
gcatggcggcatctgcttct

SEQ ID NO: 683843 - DNA, 20 bp, Artificial
  CRISPR gRNA sequence
catggcggcatctgcttctg

SEQ ID NO: 683844 - DNA, 20 bp, Artificial
  CRISPR gRNA sequence
atctgcttctggggacacct

SEQ ID NO: 683845 - DNA, 20 bp, Artificial
  CRISPR gRNA sequence
tctgcttctggggacacctc

SEQ ID NO: 683846 - DNA, 20 bp, Artificial
  CRISPR gRNA sequence
tgcttctggggacacctcag

SEQ ID NO: 683847 - DNA, 20 bp, Artificial
  CRISPR gRNA sequence
cacctcaggagctttactca

SEQ ID NO: 683848 - DNA, 20 bp, Artificial
  CRISPR gRNA sequence
ctcaggagctttactcatgg

SEQ ID NO: 683849 - DNA, 20 bp, Artificial
  CRISPR gRNA sequence
aggagctttactcatggcag

SEQ ID NO: 683850 - DNA, 20 bp, Artificial
  CRISPR gRNA sequence
ggagctttactcatggcaga

SEQ ID NO: 683851 - DNA, 20 bp, Artificial
  CRISPR gRNA sequence
tttactcatggcagaaggca

SEQ ID NO: 683852 - DNA, 20 bp, Artificial
  CRISPR gRNA sequence
tcatggcagaaggcaaagca

SEQ ID NO: 683853 - DNA, 20 bp, Artificial
  CRISPR gRNA sequence
catggcagaaggcaaagcaa

SEQ ID NO: 683854 - DNA, 20 bp, Artificial
  CRISPR gRNA sequence
ggcagaaggcaaagcaaagg

SEQ ID NO: 683855 - DNA, 20 bp, Artificial
  CRISPR gRNA sequence
gcagaaggcaaagcaaaggc

SEQ ID NO: 683856 - DNA, 20 bp, Artificial
  CRISPR gRNA sequence
gcaaaggcaggcacttcaca

SEQ ID NO: 683857 - DNA, 20 bp, Artificial
  CRISPR gRNA sequence
gcaggcacttcacacagtaa

SEQ ID NO: 683858 - DNA, 20 bp, Artificial
  CRISPR gRNA sequence
ggcacttcacacagtaaaag

SEQ ID NO: 683859 - DNA, 20 bp, Artificial
  CRISPR gRNA sequence
gcacttcacacagtaaaagc

SEQ ID NO: 683860 - DNA, 20 bp, Artificial
  CRISPR gRNA sequence
acttcacacagtaaaagcag

SEQ ID NO: 683861 - DNA, 20 bp, Artificial
  CRISPR gRNA sequence
cacacagtaaaagcaggagc

SEQ ID NO: 683862 - DNA, 20 bp, Artificial
  CRISPR gRNA sequence
cacagtaaaagcaggagcga

SEQ ID NO: 683863 - DNA, 20 bp, Artificial
  CRISPR gRNA sequence
cagtaaaagcaggagcgaga

SEQ ID NO: 683864 - DNA, 20 bp, Artificial
  CRISPR gRNA sequence
gtaaaagcaggagcgagaga

SEQ ID NO: 683865 - DNA, 20 bp, Artificial
  CRISPR gRNA sequence
taaaagcaggagcgagagag

SEQ ID NO: 683866 - DNA, 20 bp, Artificial
  CRISPR gRNA sequence
agagaggtgccacactgaaa

SEQ ID NO: 683867 - DNA, 20 bp, Artificial
  CRISPR gRNA sequence
aggtgccacactgaaacagc

SEQ ID NO: 683868 - DNA, 20 bp, Artificial
  CRISPR gRNA sequence
ctgaaacagccagatctcat

SEQ ID NO: 683869 - DNA, 20 bp, Artificial
  CRISPR gRNA sequence
aaacagccagatctcatgag

SEQ ID NO: 683870 - DNA, 20 bp, Artificial
  CRISPR gRNA sequence
gagaagtcactcactattgc

SEQ ID NO: 683871 - DNA, 20 bp, Artificial
  CRISPR gRNA sequence
agaagtcactcactattgca

SEQ ID NO: 683872 - DNA, 20 bp, Artificial
  CRISPR gRNA sequence
gtcactcactattgcaagga

SEQ ID NO: 683873 - DNA, 20 bp, Artificial
  CRISPR gRNA sequence
ctattgcaaggacagcatca

SEQ ID NO: 683874 - DNA, 20 bp, Artificial
  CRISPR gRNA sequence
attgcaaggacagcatcaaa

SEQ ID NO: 683875 - DNA, 20 bp, Artificial
  CRISPR gRNA sequence
caaggacagcatcaaagaga

SEQ ID NO: 683876 - DNA, 20 bp, Artificial
  CRISPR gRNA sequence
atgatccaatcacctcccac

SEQ ID NO: 683877 - DNA, 20 bp, Artificial
  CRISPR gRNA sequence
tgatccaatcacctcccacc

SEQ ID NO: 683878 - DNA, 20 bp, Artificial
  CRISPR gRNA sequence
ccaggctccacctcgaatac

SEQ ID NO: 683879 - DNA, 20 bp, Artificial
  CRISPR gRNA sequence
caggctccacctcgaatact

SEQ ID NO: 683880 - DNA, 20 bp, Artificial
  CRISPR gRNA sequence
aggctccacctcgaatactg

SEQ ID NO: 683881 - DNA, 20 bp, Artificial
  CRISPR gRNA sequence
gaatactggggattaccatt

SEQ ID NO: 683882 - DNA, 20 bp, Artificial
  CRISPR gRNA sequence
tggggattaccattcagcat

SEQ ID NO: 683883 - DNA, 20 bp, Artificial
  CRISPR gRNA sequence
ttaccattcagcatgagatt

SEQ ID NO: 683884 - DNA, 20 bp, Artificial
  CRISPR gRNA sequence
taccattcagcatgagattt

SEQ ID NO: 683885 - DNA, 20 bp, Artificial
  CRISPR gRNA sequence
cattcagcatgagatttggg

SEQ ID NO: 683886 - DNA, 20 bp, Artificial
  CRISPR gRNA sequence
attcagcatgagatttgggc

SEQ ID NO: 683887 - DNA, 20 bp, Artificial
  CRISPR gRNA sequence
atgagatttgggcaggaaca

SEQ ID NO: 683888 - DNA, 20 bp, Artificial
  CRISPR gRNA sequence
tatcattgttaaactttgta

SEQ ID NO: 683889 - DNA, 20 bp, Artificial
  CRISPR gRNA sequence
ttaaactttgtaaagtattt

SEQ ID NO: 683890 - DNA, 20 bp, Artificial
  CRISPR gRNA sequence
taaactttgtaaagtattta

SEQ ID NO: 683891 - DNA, 20 bp, Artificial
  CRISPR gRNA sequence
tgtaaagtatttaaggtaca

SEQ ID NO: 683892 - DNA, 20 bp, Artificial
  CRISPR gRNA sequence
tttaaggtacatggaacaca

SEQ ID NO: 683893 - DNA, 20 bp, Artificial
  CRISPR gRNA sequence
ttaaggtacatggaacacac

SEQ ID NO: 683894 - DNA, 20 bp, Artificial
  CRISPR gRNA sequence
aggtacatggaacacacggg

SEQ ID NO: 683895 - DNA, 20 bp, Artificial
  CRISPR gRNA sequence
catggaacacacgggaagtc

SEQ ID NO: 683896 - DNA, 20 bp, Artificial
  CRISPR gRNA sequence
ggaacacacgggaagtctgg

SEQ ID NO: 683897 - DNA, 20 bp, Artificial
  CRISPR gRNA sequence
acacgggaagtctggtagct

SEQ ID NO: 683898 - DNA, 20 bp, Artificial
  CRISPR gRNA sequence
ctgttattcaccatgtaatt

SEQ ID NO: 683899 - DNA, 20 bp, Artificial
  CRISPR gRNA sequence
tgttattcaccatgtaattc

SEQ ID NO: 683900 - DNA, 20 bp, Artificial
  CRISPR gRNA sequence
aattcaggtaccacgtattc

SEQ ID NO: 683901 - DNA, 20 bp, Artificial
  CRISPR gRNA sequence
attcaggtaccacgtattcc

SEQ ID NO: 683902 - DNA, 20 bp, Artificial
  CRISPR gRNA sequence
ttcaggtaccacgtattcca

SEQ ID NO: 683903 - DNA, 20 bp, Artificial
  CRISPR gRNA sequence
caggtaccacgtattccagg

SEQ ID NO: 683904 - DNA, 20 bp, Artificial
  CRISPR gRNA sequence
gtattccagggagcctttct

SEQ ID NO: 683905 - DNA, 20 bp, Artificial
  CRISPR gRNA sequence
agggagcctttcttggccct

SEQ ID NO: 683906 - DNA, 20 bp, Artificial
  CRISPR gRNA sequence
ctttcttggccctcagtttg

SEQ ID NO: 683907 - DNA, 20 bp, Artificial
  CRISPR gRNA sequence
ttgcagtatacacactttcc

SEQ ID NO: 683908 - DNA, 20 bp, Artificial
  CRISPR gRNA sequence
acactttccaagtactcttg

SEQ ID NO: 683909 - DNA, 20 bp, Artificial
  CRISPR gRNA sequence
gtagcatcctgtttgtatca

SEQ ID NO: 683910 - DNA, 20 bp, Artificial
  CRISPR gRNA sequence
tcctgtttgtatcatagcac

SEQ ID NO: 683911 - DNA, 20 bp, Artificial
  CRISPR gRNA sequence
ccttacctaaatctgtttga

SEQ ID NO: 683912 - DNA, 20 bp, Artificial
  CRISPR gRNA sequence
agtctgctcaacacgactgc

SEQ ID NO: 683913 - DNA, 20 bp, Artificial
  CRISPR gRNA sequence
aacacgactgcaagctccat

SEQ ID NO: 683914 - DNA, 20 bp, Artificial
  CRISPR gRNA sequence
acacgactgcaagctccatg

SEQ ID NO: 683915 - DNA, 20 bp, Artificial
  CRISPR gRNA sequence
cacgactgcaagctccatga

SEQ ID NO: 683916 - DNA, 20 bp, Artificial
  CRISPR gRNA sequence
gactgcaagctccatgaggg

SEQ ID NO: 683917 - DNA, 20 bp, Artificial
  CRISPR gRNA sequence
actgcaagctccatgagggc

SEQ ID NO: 683918 - DNA, 20 bp, Artificial
  CRISPR gRNA sequence
ctgcaagctccatgagggca

SEQ ID NO: 683919 - DNA, 20 bp, Artificial
  CRISPR gRNA sequence
gacatcatctcttccatctt

SEQ ID NO: 683920 - DNA, 20 bp, Artificial
  CRISPR gRNA sequence
acatcatctcttccatcttt

SEQ ID NO: 683921 - DNA, 20 bp, Artificial
  CRISPR gRNA sequence
ctcttccatctttgggtcct

SEQ ID NO: 683922 - DNA, 20 bp, Artificial
  CRISPR gRNA sequence
tgggtccttagtgcaatacc

SEQ ID NO: 683923 - DNA, 20 bp, Artificial
  CRISPR gRNA sequence
gtccttagtgcaatacctgg

SEQ ID NO: 683924 - DNA, 20 bp, Artificial
  CRISPR gRNA sequence
ttagtgcaatacctggcagc

SEQ ID NO: 683925 - DNA, 20 bp, Artificial
  CRISPR gRNA sequence
tgcaatacctggcagctagc

SEQ ID NO: 683926 - DNA, 20 bp, Artificial
  CRISPR gRNA sequence
cctggcagctagccagtgct

SEQ ID NO: 683927 - DNA, 20 bp, Artificial
  CRISPR gRNA sequence
tgtgtacatttctacttctc

SEQ ID NO: 683928 - DNA, 20 bp, Artificial
  CRISPR gRNA sequence
atttctacttctctagctat

SEQ ID NO: 683929 - DNA, 20 bp, Artificial
  CRISPR gRNA sequence
actatttttatatttatgtt

SEQ ID NO: 683930 - DNA, 20 bp, Artificial
  CRISPR gRNA sequence
caataactttcctcatcatt

SEQ ID NO: 683931 - DNA, 20 bp, Artificial
  CRISPR gRNA sequence
aactttcctcatcatttgga

SEQ ID NO: 683932 - DNA, 20 bp, Artificial
  CRISPR gRNA sequence
aattgtttattgcttcccta

SEQ ID NO: 683933 - DNA, 20 bp, Artificial
  CRISPR gRNA sequence
cctacagttttttctgaatc

SEQ ID NO: 683934 - DNA, 20 bp, Artificial
  CRISPR gRNA sequence
acagttttttctgaatctag

SEQ ID NO: 683935 - DNA, 20 bp, Artificial
  CRISPR gRNA sequence
cagttttttctgaatctagc

SEQ ID NO: 683936 - DNA, 20 bp, Artificial
  CRISPR gRNA sequence
attataatttgacacaataa

SEQ ID NO: 683937 - DNA, 20 bp, Artificial
  CRISPR gRNA sequence
ttataatttgacacaataaa

SEQ ID NO: 683938 - DNA, 20 bp, Artificial
  CRISPR gRNA sequence
tgaaactgatgaatctttat

SEQ ID NO: 683939 - DNA, 20 bp, Artificial
  CRISPR gRNA sequence
gaaactgatgaatctttatt

SEQ ID NO: 683940 - DNA, 20 bp, Artificial
  CRISPR gRNA sequence
aatctttattgggttaattt

SEQ ID NO: 683941 - DNA, 20 bp, Artificial
  CRISPR gRNA sequence
cttttttatatataaataat

SEQ ID NO: 683942 - DNA, 20 bp, Artificial
  CRISPR gRNA sequence
ttttatatataaataattgg

SEQ ID NO: 683943 - DNA, 20 bp, Artificial
  CRISPR gRNA sequence
ataattggtggcatcacaaa

SEQ ID NO: 683944 - DNA, 20 bp, Artificial
  CRISPR gRNA sequence
ggtggcatcacaaatagcca

SEQ ID NO: 683945 - DNA, 20 bp, Artificial
  CRISPR gRNA sequence
ggcatcacaaatagccaaag

SEQ ID NO: 683946 - DNA, 20 bp, Artificial
  CRISPR gRNA sequence
gcatcacaaatagccaaagc

SEQ ID NO: 683947 - DNA, 20 bp, Artificial
  CRISPR gRNA sequence
catcacaaatagccaaagca

SEQ ID NO: 683948 - DNA, 20 bp, Artificial
  CRISPR gRNA sequence
cacaaatagccaaagcaggg

SEQ ID NO: 683949 - DNA, 20 bp, Artificial
  CRISPR gRNA sequence
caaatagccaaagcagggtg

SEQ ID NO: 683950 - DNA, 20 bp, Artificial
  CRISPR gRNA sequence
aatagccaaagcagggtgga

SEQ ID NO: 683951 - DNA, 20 bp, Artificial
  CRISPR gRNA sequence
tagccaaagcagggtggaga

SEQ ID NO: 683952 - DNA, 20 bp, Artificial
  CRISPR gRNA sequence
gtggagagagtgatccttcc

SEQ ID NO: 683953 - DNA, 20 bp, Artificial
  CRISPR gRNA sequence
tggagagagtgatccttcct

SEQ ID NO: 683954 - DNA, 20 bp, Artificial
  CRISPR gRNA sequence
agagtgatccttcctgggtg

SEQ ID NO: 683955 - DNA, 20 bp, Artificial
  CRISPR gRNA sequence
gagtgatccttcctgggtgc

SEQ ID NO: 683956 - DNA, 20 bp, Artificial
  CRISPR gRNA sequence
gatccttcctgggtgcaggc

SEQ ID NO: 683957 - DNA, 20 bp, Artificial
  CRISPR gRNA sequence
ccttcctgggtgcaggcaag

SEQ ID NO: 683958 - DNA, 20 bp, Artificial
  CRISPR gRNA sequence
cttcctgggtgcaggcaaga

SEQ ID NO: 683959 - DNA, 20 bp, Artificial
  CRISPR gRNA sequence
ttcctgggtgcaggcaagaa

SEQ ID NO: 683960 - DNA, 20 bp, Artificial
  CRISPR gRNA sequence
tcctgggtgcaggcaagaag

SEQ ID NO: 683961 - DNA, 20 bp, Artificial
  CRISPR gRNA sequence
agaaggggatatgttttcta

SEQ ID NO: 683962 - DNA, 20 bp, Artificial
  CRISPR gRNA sequence
aaggggatatgttttctaca

SEQ ID NO: 683963 - DNA, 20 bp, Artificial
  CRISPR gRNA sequence
tttctacagagttttcaaaa

SEQ ID NO: 683964 - DNA, 20 bp, Artificial
  CRISPR gRNA sequence
gagttttcaaaacagtgata

SEQ ID NO: 683965 - DNA, 20 bp, Artificial
  CRISPR gRNA sequence
acagtgataaagctgtctac

SEQ ID NO: 683966 - DNA, 20 bp, Artificial
  CRISPR gRNA sequence
ctttttatcatcactatgcc

SEQ ID NO: 683967 - DNA, 20 bp, Artificial
  CRISPR gRNA sequence
gcccagacaatgtgaaacat

SEQ ID NO: 683968 - DNA, 20 bp, Artificial
  CRISPR gRNA sequence
ccagacaatgtgaaacatca

SEQ ID NO: 683969 - DNA, 20 bp, Artificial
  CRISPR gRNA sequence
aatgtgaaacatcagagatg

SEQ ID NO: 683970 - DNA, 20 bp, Artificial
  CRISPR gRNA sequence
gagatgaagtgctcttccca

SEQ ID NO: 683971 - DNA, 20 bp, Artificial
  CRISPR gRNA sequence
gatgaagtgctcttcccaca

SEQ ID NO: 683972 - DNA, 20 bp, Artificial
  CRISPR gRNA sequence
atgaagtgctcttcccacag

SEQ ID NO: 683973 - DNA, 20 bp, Artificial
  CRISPR gRNA sequence
aagtgctcttcccacagagg

SEQ ID NO: 683974 - DNA, 20 bp, Artificial
  CRISPR gRNA sequence
gatccttctccccactccct

SEQ ID NO: 683975 - DNA, 20 bp, Artificial
  CRISPR gRNA sequence
ctctgaatgcaatgttgtct

SEQ ID NO: 683976 - DNA, 20 bp, Artificial
  CRISPR gRNA sequence
tgcaatgttgtcttggaaaa

SEQ ID NO: 683977 - DNA, 20 bp, Artificial
  CRISPR gRNA sequence
gtcttggaaaacagctttcc

SEQ ID NO: 683978 - DNA, 20 bp, Artificial
  CRISPR gRNA sequence
tttccaagcatttcactcct

SEQ ID NO: 683979 - DNA, 20 bp, Artificial
  CRISPR gRNA sequence
tttcactcctgagcacttgc

SEQ ID NO: 683980 - DNA, 20 bp, Artificial
  CRISPR gRNA sequence
tcacttgttcttcacatatc

SEQ ID NO: 683981 - DNA, 20 bp, Artificial
  CRISPR gRNA sequence
cacttgttcttcacatatcc

SEQ ID NO: 683982 - DNA, 20 bp, Artificial
  CRISPR gRNA sequence
gttcttcacatatccaggca

SEQ ID NO: 683983 - DNA, 20 bp, Artificial
  CRISPR gRNA sequence
gacatcctgtttgctatatg

SEQ ID NO: 683984 - DNA, 20 bp, Artificial
  CRISPR gRNA sequence
aagcattgtatcccgtataa

SEQ ID NO: 683985 - DNA, 20 bp, Artificial
  CRISPR gRNA sequence
agcattgtatcccgtataaa

SEQ ID NO: 683986 - DNA, 20 bp, Artificial
  CRISPR gRNA sequence
attgtatcccgtataaaagg

SEQ ID NO: 683987 - DNA, 20 bp, Artificial
  CRISPR gRNA sequence
ttgtatcccgtataaaagga

SEQ ID NO: 683988 - DNA, 20 bp, Artificial
  CRISPR gRNA sequence
atcccgtataaaaggaagga

SEQ ID NO: 683989 - DNA, 20 bp, Artificial
  CRISPR gRNA sequence
cccgtataaaaggaaggaaa

SEQ ID NO: 683990 - DNA, 20 bp, Artificial
  CRISPR gRNA sequence
cgtataaaaggaaggaaaga

SEQ ID NO: 683991 - DNA, 20 bp, Artificial
  CRISPR gRNA sequence
tttttacactcatcactcct

SEQ ID NO: 683992 - DNA, 20 bp, Artificial
  CRISPR gRNA sequence
ttttacactcatcactcctc

SEQ ID NO: 683993 - DNA, 20 bp, Artificial
  CRISPR gRNA sequence
tttacactcatcactcctca

SEQ ID NO: 683994 - DNA, 20 bp, Artificial
  CRISPR gRNA sequence
ttacactcatcactcctcag

SEQ ID NO: 683995 - DNA, 20 bp, Artificial
  CRISPR gRNA sequence
tcaggggctgtacaatcatg

SEQ ID NO: 683996 - DNA, 20 bp, Artificial
  CRISPR gRNA sequence
tgtttaatgtgcctgtcaaa

SEQ ID NO: 683997 - DNA, 20 bp, Artificial
  CRISPR gRNA sequence
atgtgcctgtcaaatagcca

SEQ ID NO: 683998 - DNA, 20 bp, Artificial
  CRISPR gRNA sequence
gtgcctgtcaaatagccaaa

SEQ ID NO: 683999 - DNA, 20 bp, Artificial
  CRISPR gRNA sequence
gccaaagagtgttaaaccct

SEQ ID NO: 684000 - DNA, 20 bp, Artificial
  CRISPR gRNA sequence
tgagttcccacccatgtgtg

SEQ ID NO: 684001 - DNA, 20 bp, Artificial
  CRISPR gRNA sequence
tcccacccatgtgtgtggta

SEQ ID NO: 684002 - DNA, 20 bp, Artificial
  CRISPR gRNA sequence
acccatgtgtgtggtatggt

SEQ ID NO: 684003 - DNA, 20 bp, Artificial
  CRISPR gRNA sequence
cccatgtgtgtggtatggtt

SEQ ID NO: 684004 - DNA, 20 bp, Artificial
  CRISPR gRNA sequence
tggtatggttaggattcatc

SEQ ID NO: 684005 - DNA, 20 bp, Artificial
  CRISPR gRNA sequence
ttaggattcatccagataca

SEQ ID NO: 684006 - DNA, 20 bp, Artificial
  CRISPR gRNA sequence
aggattcatccagatacaca

SEQ ID NO: 684007 - DNA, 20 bp, Artificial
  CRISPR gRNA sequence
gattcatccagatacacaga

SEQ ID NO: 684008 - DNA, 20 bp, Artificial
  CRISPR gRNA sequence
ttcatccagatacacagaga

SEQ ID NO: 684009 - DNA, 20 bp, Artificial
  CRISPR gRNA sequence
tcatccagatacacagagag

SEQ ID NO: 684010 - DNA, 20 bp, Artificial
  CRISPR gRNA sequence
atacacagagagaggcacaa

SEQ ID NO: 684011 - DNA, 20 bp, Artificial
  CRISPR gRNA sequence
tacacagagagaggcacaac

SEQ ID NO: 684012 - DNA, 20 bp, Artificial
  CRISPR gRNA sequence
cacagagagaggcacaacag

SEQ ID NO: 684013 - DNA, 20 bp, Artificial
  CRISPR gRNA sequence
acagagagaggcacaacagg

SEQ ID NO: 684014 - DNA, 20 bp, Artificial
  CRISPR gRNA sequence
agagagaggcacaacaggag

SEQ ID NO: 684015 - DNA, 20 bp, Artificial
  CRISPR gRNA sequence
agaggcacaacaggaggaga

SEQ ID NO: 684016 - DNA, 20 bp, Artificial
  CRISPR gRNA sequence
gaggcacaacaggaggagaa

SEQ ID NO: 684017 - DNA, 20 bp, Artificial
  CRISPR gRNA sequence
cacaacaggaggagaaagga

SEQ ID NO: 684018 - DNA, 20 bp, Artificial
  CRISPR gRNA sequence
acaacaggaggagaaaggat

SEQ ID NO: 684019 - DNA, 20 bp, Artificial
  CRISPR gRNA sequence
caacaggaggagaaaggata

SEQ ID NO: 684020 - DNA, 20 bp, Artificial
  CRISPR gRNA sequence
aacaggaggagaaaggatag

SEQ ID NO: 684021 - DNA, 20 bp, Artificial
  CRISPR gRNA sequence
gaggagaaaggataggggtg

SEQ ID NO: 684022 - DNA, 20 bp, Artificial
  CRISPR gRNA sequence
aggagaaaggataggggtgt

SEQ ID NO: 684023 - DNA, 20 bp, Artificial
  CRISPR gRNA sequence
ggagaaaggataggggtgtg

SEQ ID NO: 684024 - DNA, 20 bp, Artificial
  CRISPR gRNA sequence
aaaggataggggtgtgggga

SEQ ID NO: 684025 - DNA, 20 bp, Artificial
  CRISPR gRNA sequence
ggataggggtgtggggacag

SEQ ID NO: 684026 - DNA, 20 bp, Artificial
  CRISPR gRNA sequence
gataggggtgtggggacagc

SEQ ID NO: 684027 - DNA, 20 bp, Artificial
  CRISPR gRNA sequence
gggacagcgggcccccaata

SEQ ID NO: 684028 - DNA, 20 bp, Artificial
  CRISPR gRNA sequence
cccccaatatggtgtaatcg

SEQ ID NO: 684029 - DNA, 20 bp, Artificial
  CRISPR gRNA sequence
ccaatatggtgtaatcgtgg

SEQ ID NO: 684030 - DNA, 20 bp, Artificial
  CRISPR gRNA sequence
caatatggtgtaatcgtggc

SEQ ID NO: 684031 - DNA, 20 bp, Artificial
  CRISPR gRNA sequence
tcgtggcaggtctctgcctg

SEQ ID NO: 684032 - DNA, 20 bp, Artificial
  CRISPR gRNA sequence
tctctgcctgaagtgctatg

SEQ ID NO: 684033 - DNA, 20 bp, Artificial
  CRISPR gRNA sequence
ctctgcctgaagtgctatgt

SEQ ID NO: 684034 - DNA, 20 bp, Artificial
  CRISPR gRNA sequence
tctgcctgaagtgctatgtg

SEQ ID NO: 684035 - DNA, 20 bp, Artificial
  CRISPR gRNA sequence
gactttaacccctgatttgt

SEQ ID NO: 684036 - DNA, 20 bp, Artificial
  CRISPR gRNA sequence
taagtttttcataaaataaa

SEQ ID NO: 684037 - DNA, 20 bp, Artificial
  CRISPR gRNA sequence
aaacagaatcataactcatg

SEQ ID NO: 684038 - DNA, 20 bp, Artificial
  CRISPR gRNA sequence
agaatcataactcatgtaga

SEQ ID NO: 684039 - DNA, 20 bp, Artificial
  CRISPR gRNA sequence
taactcatgtagatggctat

SEQ ID NO: 684040 - DNA, 20 bp, Artificial
  CRISPR gRNA sequence
gtagatggctataagtgccg

SEQ ID NO: 684041 - DNA, 20 bp, Artificial
  CRISPR gRNA sequence
ataagtgccgtagtgttctg

SEQ ID NO: 684042 - DNA, 20 bp, Artificial
  CRISPR gRNA sequence
taagtgccgtagtgttctgt

SEQ ID NO: 684043 - DNA, 20 bp, Artificial
  CRISPR gRNA sequence
cgtagtgttctgtgggtctc

SEQ ID NO: 684044 - DNA, 20 bp, Artificial
  CRISPR gRNA sequence
tgtgggtctctggtgtctgc

SEQ ID NO: 684045 - DNA, 20 bp, Artificial
  CRISPR gRNA sequence
ctctggtgtctgccagtgat

SEQ ID NO: 684046 - DNA, 20 bp, Artificial
  CRISPR gRNA sequence
gtgtctgccagtgataagtg

SEQ ID NO: 684047 - DNA, 20 bp, Artificial
  CRISPR gRNA sequence
cagtgataagtgtggcaccc

SEQ ID NO: 684048 - DNA, 20 bp, Artificial
  CRISPR gRNA sequence
agtgataagtgtggcacccc

SEQ ID NO: 684049 - DNA, 20 bp, Artificial
  CRISPR gRNA sequence
gataagtgtggcaccccagg

SEQ ID NO: 684050 - DNA, 20 bp, Artificial
  CRISPR gRNA sequence
ataagtgtggcaccccagga

SEQ ID NO: 684051 - DNA, 20 bp, Artificial
  CRISPR gRNA sequence
gtggcaccccaggaaggctg

SEQ ID NO: 684052 - DNA, 20 bp, Artificial
  CRISPR gRNA sequence
ggaaggctgtggaccccatc

SEQ ID NO: 684053 - DNA, 20 bp, Artificial
  CRISPR gRNA sequence
gaaggctgtggaccccatca

SEQ ID NO: 684054 - DNA, 20 bp, Artificial
  CRISPR gRNA sequence
accccatcaaggtgctatgt

SEQ ID NO: 684055 - DNA, 20 bp, Artificial
  CRISPR gRNA sequence
ccccatcaaggtgctatgtg

SEQ ID NO: 684056 - DNA, 20 bp, Artificial
  CRISPR gRNA sequence
cccatcaaggtgctatgtga

SEQ ID NO: 684057 - DNA, 20 bp, Artificial
  CRISPR gRNA sequence
tgctatgtgagggccatgct

SEQ ID NO: 684058 - DNA, 20 bp, Artificial
  CRISPR gRNA sequence
gctatgtgagggccatgctt

SEQ ID NO: 684059 - DNA, 20 bp, Artificial
  CRISPR gRNA sequence
ctatgtgagggccatgcttg

SEQ ID NO: 684060 - DNA, 20 bp, Artificial
  CRISPR gRNA sequence
tgtgagggccatgcttgggg

SEQ ID NO: 684061 - DNA, 20 bp, Artificial
  CRISPR gRNA sequence
gagggccatgcttggggtgg

SEQ ID NO: 684062 - DNA, 20 bp, Artificial
  CRISPR gRNA sequence
ggccatgcttggggtggtgg

SEQ ID NO: 684063 - DNA, 20 bp, Artificial
  CRISPR gRNA sequence
gccatgcttggggtggtggt

SEQ ID NO: 684064 - DNA, 20 bp, Artificial
  CRISPR gRNA sequence
gcttggggtggtggtgggcc

SEQ ID NO: 684065 - DNA, 20 bp, Artificial
  CRISPR gRNA sequence
tggggtggtggtgggcccag

SEQ ID NO: 684066 - DNA, 20 bp, Artificial
  CRISPR gRNA sequence
ggtgggcccagtagaccctg

SEQ ID NO: 684067 - DNA, 20 bp, Artificial
  CRISPR gRNA sequence
agaccctgcagccatccatc

SEQ ID NO: 684068 - DNA, 20 bp, Artificial
  CRISPR gRNA sequence
ttatcattgatcaatgtccc

SEQ ID NO: 684069 - DNA, 20 bp, Artificial
  CRISPR gRNA sequence
tttgaattatcttcgtgtta

SEQ ID NO: 684070 - DNA, 20 bp, Artificial
  CRISPR gRNA sequence
ttgaattatcttcgtgttac

SEQ ID NO: 684071 - DNA, 20 bp, Artificial
  CRISPR gRNA sequence
tttaatgattttgctccttc

SEQ ID NO: 684072 - DNA, 20 bp, Artificial
  CRISPR gRNA sequence
tgtttttctttaaatcaaca

SEQ ID NO: 684073 - DNA, 20 bp, Artificial
  CRISPR gRNA sequence
aacatggttacactctgttt

SEQ ID NO: 684074 - DNA, 20 bp, Artificial
  CRISPR gRNA sequence
aaattattactactgctatt

SEQ ID NO: 684075 - DNA, 20 bp, Artificial
  CRISPR gRNA sequence
cttttttatttctgaaatta

SEQ ID NO: 684076 - DNA, 20 bp, Artificial
  CRISPR gRNA sequence
ttatagcatttcttgaattt

SEQ ID NO: 684077 - DNA, 20 bp, Artificial
  CRISPR gRNA sequence
atagcatttcttgaatttaa

SEQ ID NO: 684078 - DNA, 20 bp, Artificial
  CRISPR gRNA sequence
ttaagagaacaaaaacttga

SEQ ID NO: 684079 - DNA, 20 bp, Artificial
  CRISPR gRNA sequence
taagagaacaaaaacttgaa

SEQ ID NO: 684080 - DNA, 20 bp, Artificial
  CRISPR gRNA sequence
aatggagacataggcctttc

SEQ ID NO: 684081 - DNA, 20 bp, Artificial
  CRISPR gRNA sequence
gtttttgttctcttaaattc

SEQ ID NO: 684082 - DNA, 20 bp, Artificial
  CRISPR gRNA sequence
ttcaagaaatgctataattt

SEQ ID NO: 684083 - DNA, 20 bp, Artificial
  CRISPR gRNA sequence
ctataatttcagaaataaaa

SEQ ID NO: 684084 - DNA, 20 bp, Artificial
  CRISPR gRNA sequence
aattcatcatgacaactcaa

SEQ ID NO: 684085 - DNA, 20 bp, Artificial
  CRISPR gRNA sequence
tcatcatgacaactcaatag

SEQ ID NO: 684086 - DNA, 20 bp, Artificial
  CRISPR gRNA sequence
tcatgacaactcaatagcag

SEQ ID NO: 684087 - DNA, 20 bp, Artificial
  CRISPR gRNA sequence
taatttgtgtttaatttata

SEQ ID NO: 684088 - DNA, 20 bp, Artificial
  CRISPR gRNA sequence
aatttatacagttgctgaaa

SEQ ID NO: 684089 - DNA, 20 bp, Artificial
  CRISPR gRNA sequence
tttatacagttgctgaaaca

SEQ ID NO: 684090 - DNA, 20 bp, Artificial
  CRISPR gRNA sequence
agtgtaaccatgttgattta

SEQ ID NO: 684091 - DNA, 20 bp, Artificial
  CRISPR gRNA sequence
catgttgatttaaagaaaaa

SEQ ID NO: 684092 - DNA, 20 bp, Artificial
  CRISPR gRNA sequence
atgttgatttaaagaaaaac

SEQ ID NO: 684093 - DNA, 20 bp, Artificial
  CRISPR gRNA sequence
aaaacaggtgaaatacaaat

SEQ ID NO: 684094 - DNA, 20 bp, Artificial
  CRISPR gRNA sequence
caggtgaaatacaaataagc

SEQ ID NO: 684095 - DNA, 20 bp, Artificial
  CRISPR gRNA sequence
gtgaaatacaaataagctag

SEQ ID NO: 684096 - DNA, 20 bp, Artificial
  CRISPR gRNA sequence
tgaaatacaaataagctaga

SEQ ID NO: 684097 - DNA, 20 bp, Artificial
  CRISPR gRNA sequence
aaatacaaataagctagaag

SEQ ID NO: 684098 - DNA, 20 bp, Artificial
  CRISPR gRNA sequence
cattaaacacctgtaacacg

SEQ ID NO: 684099 - DNA, 20 bp, Artificial
  CRISPR gRNA sequence
acgaagataattcaaacaca

SEQ ID NO: 684100 - DNA, 20 bp, Artificial
  CRISPR gRNA sequence
cgaagataattcaaacacat

SEQ ID NO: 684101 - DNA, 20 bp, Artificial
  CRISPR gRNA sequence
aattcaaacacataggtaac

SEQ ID NO: 684102 - DNA, 20 bp, Artificial
  CRISPR gRNA sequence
attcaaacacataggtaacc

SEQ ID NO: 684103 - DNA, 20 bp, Artificial
  CRISPR gRNA sequence
ttcaaacacataggtaacca

SEQ ID NO: 684104 - DNA, 20 bp, Artificial
  CRISPR gRNA sequence
gacattgatcaatgataacg

SEQ ID NO: 684105 - DNA, 20 bp, Artificial
  CRISPR gRNA sequence
tgatcaatgataacgtagca

SEQ ID NO: 684106 - DNA, 20 bp, Artificial
  CRISPR gRNA sequence
tcaatgataacgtagcaaag

SEQ ID NO: 684107 - DNA, 20 bp, Artificial
  CRISPR gRNA sequence
caatgataacgtagcaaagc

SEQ ID NO: 684108 - DNA, 20 bp, Artificial
  CRISPR gRNA sequence
atgataacgtagcaaagcag

SEQ ID NO: 684109 - DNA, 20 bp, Artificial
  CRISPR gRNA sequence
gtagcaaagcaggagtacac

SEQ ID NO: 684110 - DNA, 20 bp, Artificial
  CRISPR gRNA sequence
tagcaaagcaggagtacaca

SEQ ID NO: 684111 - DNA, 20 bp, Artificial
  CRISPR gRNA sequence
agcaaagcaggagtacacaa

SEQ ID NO: 684112 - DNA, 20 bp, Artificial
  CRISPR gRNA sequence
aaagcaggagtacacaaggg

SEQ ID NO: 684113 - DNA, 20 bp, Artificial
  CRISPR gRNA sequence
ggagtacacaagggcagtgt

SEQ ID NO: 684114 - DNA, 20 bp, Artificial
  CRISPR gRNA sequence
gtacacaagggcagtgtgag

SEQ ID NO: 684115 - DNA, 20 bp, Artificial
  CRISPR gRNA sequence
tacacaagggcagtgtgagt

SEQ ID NO: 684116 - DNA, 20 bp, Artificial
  CRISPR gRNA sequence
acaagggcagtgtgagtggg

SEQ ID NO: 684117 - DNA, 20 bp, Artificial
  CRISPR gRNA sequence
caagggcagtgtgagtgggc

SEQ ID NO: 684118 - DNA, 20 bp, Artificial
  CRISPR gRNA sequence
ggcagtgtgagtgggcaggc

SEQ ID NO: 684119 - DNA, 20 bp, Artificial
  CRISPR gRNA sequence
gtgtgagtgggcaggctgga

SEQ ID NO: 684120 - DNA, 20 bp, Artificial
  CRISPR gRNA sequence
gagtgggcaggctggatgga

SEQ ID NO: 684121 - DNA, 20 bp, Artificial
  CRISPR gRNA sequence
gcaggctggatggatggctg

SEQ ID NO: 684122 - DNA, 20 bp, Artificial
  CRISPR gRNA sequence
caggctggatggatggctgc

SEQ ID NO: 684123 - DNA, 20 bp, Artificial
  CRISPR gRNA sequence
aggctggatggatggctgca

SEQ ID NO: 684124 - DNA, 20 bp, Artificial
  CRISPR gRNA sequence
tggatggctgcagggtctac

SEQ ID NO: 684125 - DNA, 20 bp, Artificial
  CRISPR gRNA sequence
ggatggctgcagggtctact

SEQ ID NO: 684126 - DNA, 20 bp, Artificial
  CRISPR gRNA sequence
actgggcccaccaccacccc

SEQ ID NO: 684127 - DNA, 20 bp, Artificial
  CRISPR gRNA sequence
gcccaccaccaccccaagca

SEQ ID NO: 684128 - DNA, 20 bp, Artificial
  CRISPR gRNA sequence
ccccaagcatggccctcaca

SEQ ID NO: 684129 - DNA, 20 bp, Artificial
  CRISPR gRNA sequence
gccctcacatagcaccttga

SEQ ID NO: 684130 - DNA, 20 bp, Artificial
  CRISPR gRNA sequence
ccctcacatagcaccttgat

SEQ ID NO: 684131 - DNA, 20 bp, Artificial
  CRISPR gRNA sequence
cctcacatagcaccttgatg

SEQ ID NO: 684132 - DNA, 20 bp, Artificial
  CRISPR gRNA sequence
tagcaccttgatggggtcca

SEQ ID NO: 684133 - DNA, 20 bp, Artificial
  CRISPR gRNA sequence
gatggggtccacagccttcc

SEQ ID NO: 684134 - DNA, 20 bp, Artificial
  CRISPR gRNA sequence
atggggtccacagccttcct

SEQ ID NO: 684135 - DNA, 20 bp, Artificial
  CRISPR gRNA sequence
tggggtccacagccttcctg

SEQ ID NO: 684136 - DNA, 20 bp, Artificial
  CRISPR gRNA sequence
tggggtgccacacttatcac

SEQ ID NO: 684137 - DNA, 20 bp, Artificial
  CRISPR gRNA sequence
ggtgccacacttatcactgg

SEQ ID NO: 684138 - DNA, 20 bp, Artificial
  CRISPR gRNA sequence
cacttatcactggcagacac

SEQ ID NO: 684139 - DNA, 20 bp, Artificial
  CRISPR gRNA sequence
cttatcactggcagacacca

SEQ ID NO: 684140 - DNA, 20 bp, Artificial
  CRISPR gRNA sequence
tggcagacaccagagaccca

SEQ ID NO: 684141 - DNA, 20 bp, Artificial
  CRISPR gRNA sequence
cagagacccacagaacacta

SEQ ID NO: 684142 - DNA, 20 bp, Artificial
  CRISPR gRNA sequence
acagaacactacggcactta

SEQ ID NO: 684143 - DNA, 20 bp, Artificial
  CRISPR gRNA sequence
gcacttatagccatctacat

SEQ ID NO: 684144 - DNA, 20 bp, Artificial
  CRISPR gRNA sequence
tttatgaaaaacttacaaat

SEQ ID NO: 684145 - DNA, 20 bp, Artificial
  CRISPR gRNA sequence
ttatgaaaaacttacaaatc

SEQ ID NO: 684146 - DNA, 20 bp, Artificial
  CRISPR gRNA sequence
tatgaaaaacttacaaatca

SEQ ID NO: 684147 - DNA, 20 bp, Artificial
  CRISPR gRNA sequence
atgaaaaacttacaaatcag

SEQ ID NO: 684148 - DNA, 20 bp, Artificial
  CRISPR gRNA sequence
aacttacaaatcaggggtta

SEQ ID NO: 684149 - DNA, 20 bp, Artificial
  CRISPR gRNA sequence
gttaaagtcaaaattaaaac

SEQ ID NO: 684150 - DNA, 20 bp, Artificial
  CRISPR gRNA sequence
aaaacaagaaaaaccccaca

SEQ ID NO: 684151 - DNA, 20 bp, Artificial
  CRISPR gRNA sequence
aaaaaccccacatagcactt

SEQ ID NO: 684152 - DNA, 20 bp, Artificial
  CRISPR gRNA sequence
aaaaccccacatagcacttc

SEQ ID NO: 684153 - DNA, 20 bp, Artificial
  CRISPR gRNA sequence
accccacatagcacttcagg

SEQ ID NO: 684154 - DNA, 20 bp, Artificial
  CRISPR gRNA sequence
cccacatagcacttcaggca

SEQ ID NO: 684155 - DNA, 20 bp, Artificial
  CRISPR gRNA sequence
ctgccacgattacaccatat

SEQ ID NO: 684156 - DNA, 20 bp, Artificial
  CRISPR gRNA sequence
tgccacgattacaccatatt

SEQ ID NO: 684157 - DNA, 20 bp, Artificial
  CRISPR gRNA sequence
gccacgattacaccatattg

SEQ ID NO: 684158 - DNA, 20 bp, Artificial
  CRISPR gRNA sequence
ccacgattacaccatattgg

SEQ ID NO: 684159 - DNA, 20 bp, Artificial
  CRISPR gRNA sequence
tgtgcctctctctgtgtatc

SEQ ID NO: 684160 - DNA, 20 bp, Artificial
  CRISPR gRNA sequence
tcctaaccataccacacaca

SEQ ID NO: 684161 - DNA, 20 bp, Artificial
  CRISPR gRNA sequence
cctaaccataccacacacat

SEQ ID NO: 684162 - DNA, 20 bp, Artificial
  CRISPR gRNA sequence
aaccataccacacacatggg

SEQ ID NO: 684163 - DNA, 20 bp, Artificial
  CRISPR gRNA sequence
accataccacacacatgggt

SEQ ID NO: 684164 - DNA, 20 bp, Artificial
  CRISPR gRNA sequence
cacacacatgggtgggaact

SEQ ID NO: 684165 - DNA, 20 bp, Artificial
  CRISPR gRNA sequence
acacacatgggtgggaactc

SEQ ID NO: 684166 - DNA, 20 bp, Artificial
  CRISPR gRNA sequence
cacacatgggtgggaactca

SEQ ID NO: 684167 - DNA, 20 bp, Artificial
  CRISPR gRNA sequence
actcagggtttaacactctt

SEQ ID NO: 684168 - DNA, 20 bp, Artificial
  CRISPR gRNA sequence
aacactctttggctatttga

SEQ ID NO: 684169 - DNA, 20 bp, Artificial
  CRISPR gRNA sequence
acactctttggctatttgac

SEQ ID NO: 684170 - DNA, 20 bp, Artificial
  CRISPR gRNA sequence
acaatttctacatgattgta

SEQ ID NO: 684171 - DNA, 20 bp, Artificial
  CRISPR gRNA sequence
tacatgattgtacagcccct

SEQ ID NO: 684172 - DNA, 20 bp, Artificial
  CRISPR gRNA sequence
acatgattgtacagcccctg

SEQ ID NO: 684173 - DNA, 20 bp, Artificial
  CRISPR gRNA sequence
atgattgtacagcccctgag

SEQ ID NO: 684174 - DNA, 20 bp, Artificial
  CRISPR gRNA sequence
tacagcccctgaggagtgat

SEQ ID NO: 684175 - DNA, 20 bp, Artificial
  CRISPR gRNA sequence
tctctttccttccttttata

SEQ ID NO: 684176 - DNA, 20 bp, Artificial
  CRISPR gRNA sequence
ctctttccttccttttatac

SEQ ID NO: 684177 - DNA, 20 bp, Artificial
  CRISPR gRNA sequence
acgggatacaatgcttcata

SEQ ID NO: 684178 - DNA, 20 bp, Artificial
  CRISPR gRNA sequence
acaatgcttcatatagcaaa

SEQ ID NO: 684179 - DNA, 20 bp, Artificial
  CRISPR gRNA sequence
caatgcttcatatagcaaac

SEQ ID NO: 684180 - DNA, 20 bp, Artificial
  CRISPR gRNA sequence
gcaaacaggatgtctttgcc

SEQ ID NO: 684181 - DNA, 20 bp, Artificial
  CRISPR gRNA sequence
tgtctttgcctggatatgtg

SEQ ID NO: 684182 - DNA, 20 bp, Artificial
  CRISPR gRNA sequence
tgcctggatatgtgaagaac

SEQ ID NO: 684183 - DNA, 20 bp, Artificial
  CRISPR gRNA sequence
tggatatgtgaagaacaagt

SEQ ID NO: 684184 - DNA, 20 bp, Artificial
  CRISPR gRNA sequence
ggatatgtgaagaacaagtg

SEQ ID NO: 684185 - DNA, 20 bp, Artificial
  CRISPR gRNA sequence
tgaagaacaagtgaggaaac

SEQ ID NO: 684186 - DNA, 20 bp, Artificial
  CRISPR gRNA sequence
gaacaagtgaggaaactggc

SEQ ID NO: 684187 - DNA, 20 bp, Artificial
  CRISPR gRNA sequence
tgaggaaactggcaagtgct

SEQ ID NO: 684188 - DNA, 20 bp, Artificial
  CRISPR gRNA sequence
gaggaaactggcaagtgctc

SEQ ID NO: 684189 - DNA, 20 bp, Artificial
  CRISPR gRNA sequence
ggaaactggcaagtgctcag

SEQ ID NO: 684190 - DNA, 20 bp, Artificial
  CRISPR gRNA sequence
gtgctcaggagtgaaatgct

SEQ ID NO: 684191 - DNA, 20 bp, Artificial
  CRISPR gRNA sequence
tcaggagtgaaatgcttgga

SEQ ID NO: 684192 - DNA, 20 bp, Artificial
  CRISPR gRNA sequence
tgcttggaaagctgttttcc

SEQ ID NO: 684193 - DNA, 20 bp, Artificial
  CRISPR gRNA sequence
ttccaagacaacattgcatt

SEQ ID NO: 684194 - DNA, 20 bp, Artificial
  CRISPR gRNA sequence
ccaagacaacattgcattca

SEQ ID NO: 684195 - DNA, 20 bp, Artificial
  CRISPR gRNA sequence
attgcattcagagacacacc

SEQ ID NO: 684196 - DNA, 20 bp, Artificial
  CRISPR gRNA sequence
ttgcattcagagacacacca

SEQ ID NO: 684197 - DNA, 20 bp, Artificial
  CRISPR gRNA sequence
tgcattcagagacacaccaa

SEQ ID NO: 684198 - DNA, 20 bp, Artificial
  CRISPR gRNA sequence
cattcagagacacaccaagg

SEQ ID NO: 684199 - DNA, 20 bp, Artificial
  CRISPR gRNA sequence
tcagagacacaccaagggag

SEQ ID NO: 684200 - DNA, 20 bp, Artificial
  CRISPR gRNA sequence
cagagacacaccaagggagt

SEQ ID NO: 684201 - DNA, 20 bp, Artificial
  CRISPR gRNA sequence
agagacacaccaagggagtg

SEQ ID NO: 684202 - DNA, 20 bp, Artificial
  CRISPR gRNA sequence
agacacaccaagggagtggg

SEQ ID NO: 684203 - DNA, 20 bp, Artificial
  CRISPR gRNA sequence
cacaccaagggagtggggag

SEQ ID NO: 684204 - DNA, 20 bp, Artificial
  CRISPR gRNA sequence
acaccaagggagtggggaga

SEQ ID NO: 684205 - DNA, 20 bp, Artificial
  CRISPR gRNA sequence
aagggagtggggagaaggat

SEQ ID NO: 684206 - DNA, 20 bp, Artificial
  CRISPR gRNA sequence
gaaggatcagtccacctctg

SEQ ID NO: 684207 - DNA, 20 bp, Artificial
  CRISPR gRNA sequence
aaggatcagtccacctctgt

SEQ ID NO: 684208 - DNA, 20 bp, Artificial
  CRISPR gRNA sequence
gatcagtccacctctgtggg

SEQ ID NO: 684209 - DNA, 20 bp, Artificial
  CRISPR gRNA sequence
tcagtccacctctgtgggaa

SEQ ID NO: 684210 - DNA, 20 bp, Artificial
  CRISPR gRNA sequence
ctctgatgtttcacattgtc

SEQ ID NO: 684211 - DNA, 20 bp, Artificial
  CRISPR gRNA sequence
tctgatgtttcacattgtct

SEQ ID NO: 684212 - DNA, 20 bp, Artificial
  CRISPR gRNA sequence
tgtttcacattgtctgggca

SEQ ID NO: 684213 - DNA, 20 bp, Artificial
  CRISPR gRNA sequence
ctgggcatagtgatgataaa

SEQ ID NO: 684214 - DNA, 20 bp, Artificial
  CRISPR gRNA sequence
ataaaaagcacaatgacttg

SEQ ID NO: 684215 - DNA, 20 bp, Artificial
  CRISPR gRNA sequence
aaagcacaatgacttgtaga

SEQ ID NO: 684216 - DNA, 20 bp, Artificial
  CRISPR gRNA sequence
tcactgttttgaaaactctg

SEQ ID NO: 684217 - DNA, 20 bp, Artificial
  CRISPR gRNA sequence
atccccttcttgcctgcacc

SEQ ID NO: 684218 - DNA, 20 bp, Artificial
  CRISPR gRNA sequence
tccccttcttgcctgcaccc

SEQ ID NO: 684219 - DNA, 20 bp, Artificial
  CRISPR gRNA sequence
ccttcttgcctgcacccagg

SEQ ID NO: 684220 - DNA, 20 bp, Artificial
  CRISPR gRNA sequence
cttcttgcctgcacccagga

SEQ ID NO: 684221 - DNA, 20 bp, Artificial
  CRISPR gRNA sequence
tcactctctccaccctgctt

SEQ ID NO: 684222 - DNA, 20 bp, Artificial
  CRISPR gRNA sequence
ccaattatttatatataaaa

SEQ ID NO: 684223 - DNA, 20 bp, Artificial
  CRISPR gRNA sequence
aaagaatgttacatttttaa

SEQ ID NO: 684224 - DNA, 20 bp, Artificial
  CRISPR gRNA sequence
tacatttttaaaagattata

SEQ ID NO: 684225 - DNA, 20 bp, Artificial
  CRISPR gRNA sequence
tgtctgaaattaacccaata

SEQ ID NO: 684226 - DNA, 20 bp, Artificial
  CRISPR gRNA sequence
ttaacccaataaagattcat

SEQ ID NO: 684227 - DNA, 20 bp, Artificial
  CRISPR gRNA sequence
tgatatcattaaaatcctgc

SEQ ID NO: 684228 - DNA, 20 bp, Artificial
  CRISPR gRNA sequence
cattaaaatcctgctagatt

SEQ ID NO: 684229 - DNA, 20 bp, Artificial
  CRISPR gRNA sequence
gctagattcagaaaaaactg

SEQ ID NO: 684230 - DNA, 20 bp, Artificial
  CRISPR gRNA sequence
ctagattcagaaaaaactgt

SEQ ID NO: 684231 - DNA, 20 bp, Artificial
  CRISPR gRNA sequence
tagattcagaaaaaactgta

SEQ ID NO: 684232 - DNA, 20 bp, Artificial
  CRISPR gRNA sequence
attcagaaaaaactgtaggg

SEQ ID NO: 684233 - DNA, 20 bp, Artificial
  CRISPR gRNA sequence
aatttgactttccaaatgat

SEQ ID NO: 684234 - DNA, 20 bp, Artificial
  CRISPR gRNA sequence
atttgactttccaaatgatg

SEQ ID NO: 684235 - DNA, 20 bp, Artificial
  CRISPR gRNA sequence
gactttccaaatgatgagga

SEQ ID NO: 684236 - DNA, 20 bp, Artificial
  CRISPR gRNA sequence
accaaacataaatataaaaa

SEQ ID NO: 684237 - DNA, 20 bp, Artificial
  CRISPR gRNA sequence
tagtattttgttgtataatt

SEQ ID NO: 684238 - DNA, 20 bp, Artificial
  CRISPR gRNA sequence
tgttgtataattaagactta

SEQ ID NO: 684239 - DNA, 20 bp, Artificial
  CRISPR gRNA sequence
gtataattaagacttatagc

SEQ ID NO: 684240 - DNA, 20 bp, Artificial
  CRISPR gRNA sequence
ataattaagacttatagcta

SEQ ID NO: 684241 - DNA, 20 bp, Artificial
  CRISPR gRNA sequence
attaagacttatagctagag

SEQ ID NO: 684242 - DNA, 20 bp, Artificial
  CRISPR gRNA sequence
aagacttatagctagagaag

SEQ ID NO: 684243 - DNA, 20 bp, Artificial
  CRISPR gRNA sequence
atgtacacaaaaaaaacatt

SEQ ID NO: 684244 - DNA, 20 bp, Artificial
  CRISPR gRNA sequence
aacatttggtatcaataatt

SEQ ID NO: 684245 - DNA, 20 bp, Artificial
  CRISPR gRNA sequence
tggttgtgcattcatttatt

SEQ ID NO: 684246 - DNA, 20 bp, Artificial
  CRISPR gRNA sequence
ttattcagtcaacaaatatt

SEQ ID NO: 684247 - DNA, 20 bp, Artificial
  CRISPR gRNA sequence
cagtcaacaaatatttagct

SEQ ID NO: 684248 - DNA, 20 bp, Artificial
  CRISPR gRNA sequence
acaaatatttagctgagcac

SEQ ID NO: 684249 - DNA, 20 bp, Artificial
  CRISPR gRNA sequence
atatttagctgagcactggc

SEQ ID NO: 684250 - DNA, 20 bp, Artificial
  CRISPR gRNA sequence
gctgagcactggctagctgc

SEQ ID NO: 684251 - DNA, 20 bp, Artificial
  CRISPR gRNA sequence
ctgagcactggctagctgcc

SEQ ID NO: 684252 - DNA, 20 bp, Artificial
  CRISPR gRNA sequence
tagctgccaggtattgcact

SEQ ID NO: 684253 - DNA, 20 bp, Artificial
  CRISPR gRNA sequence
agctgccaggtattgcacta

SEQ ID NO: 684254 - DNA, 20 bp, Artificial
  CRISPR gRNA sequence
ggtattgcactaaggaccca

SEQ ID NO: 684255 - DNA, 20 bp, Artificial
  CRISPR gRNA sequence
ttgcactaaggacccaaaga

SEQ ID NO: 684256 - DNA, 20 bp, Artificial
  CRISPR gRNA sequence
cactaaggacccaaagatgg

SEQ ID NO: 684257 - DNA, 20 bp, Artificial
  CRISPR gRNA sequence
ctaaggacccaaagatggaa

SEQ ID NO: 684258 - DNA, 20 bp, Artificial
  CRISPR gRNA sequence
agatgatgtccctgccctca

SEQ ID NO: 684259 - DNA, 20 bp, Artificial
  CRISPR gRNA sequence
atgatgtccctgccctcatg

SEQ ID NO: 684260 - DNA, 20 bp, Artificial
  CRISPR gRNA sequence
ccctgccctcatggagcttg

SEQ ID NO: 684261 - DNA, 20 bp, Artificial
  CRISPR gRNA sequence
atggagcttgcagtcgtgtt

SEQ ID NO: 684262 - DNA, 20 bp, Artificial
  CRISPR gRNA sequence
gagcttgcagtcgtgttgag

SEQ ID NO: 684263 - DNA, 20 bp, Artificial
  CRISPR gRNA sequence
gtgttgagcagactgtcaaa

SEQ ID NO: 684264 - DNA, 20 bp, Artificial
  CRISPR gRNA sequence
agcagactgtcaaacagatt

SEQ ID NO: 684265 - DNA, 20 bp, Artificial
  CRISPR gRNA sequence
gcagactgtcaaacagattt

SEQ ID NO: 684266 - DNA, 20 bp, Artificial
  CRISPR gRNA sequence
actgtcaaacagatttaggt

SEQ ID NO: 684267 - DNA, 20 bp, Artificial
  CRISPR gRNA sequence
ctgtcaaacagatttaggta

SEQ ID NO: 684268 - DNA, 20 bp, Artificial
  CRISPR gRNA sequence
tttaggtaaggcaatgtgac

SEQ ID NO: 684269 - DNA, 20 bp, Artificial
  CRISPR gRNA sequence
gaccagtgctatgatacaaa

SEQ ID NO: 684270 - DNA, 20 bp, Artificial
  CRISPR gRNA sequence
accagtgctatgatacaaac

SEQ ID NO: 684271 - DNA, 20 bp, Artificial
  CRISPR gRNA sequence
tgatacaaacaggatgctac

SEQ ID NO: 684272 - DNA, 20 bp, Artificial
  CRISPR gRNA sequence
atacaaacaggatgctacaa

SEQ ID NO: 684273 - DNA, 20 bp, Artificial
  CRISPR gRNA sequence
caggatgctacaagagtact

SEQ ID NO: 684274 - DNA, 20 bp, Artificial
  CRISPR gRNA sequence
atgctacaagagtacttgga

SEQ ID NO: 684275 - DNA, 20 bp, Artificial
  CRISPR gRNA sequence
aagtgtgtatactgcaaact

SEQ ID NO: 684276 - DNA, 20 bp, Artificial
  CRISPR gRNA sequence
agtgtgtatactgcaaactg

SEQ ID NO: 684277 - DNA, 20 bp, Artificial
  CRISPR gRNA sequence
gtgtgtatactgcaaactga

SEQ ID NO: 684278 - DNA, 20 bp, Artificial
  CRISPR gRNA sequence
tatactgcaaactgagggcc

SEQ ID NO: 684279 - DNA, 20 bp, Artificial
  CRISPR gRNA sequence
ctgcaaactgagggccaaga

SEQ ID NO: 684280 - DNA, 20 bp, Artificial
  CRISPR gRNA sequence
tgcaaactgagggccaagaa

SEQ ID NO: 684281 - DNA, 20 bp, Artificial
  CRISPR gRNA sequence
gagggccaagaaaggctccc

SEQ ID NO: 684282 - DNA, 20 bp, Artificial
  CRISPR gRNA sequence
gaaaggctccctggaatacg

SEQ ID NO: 684283 - DNA, 20 bp, Artificial
  CRISPR gRNA sequence
tacgtggtacctgaattaca

SEQ ID NO: 684284 - DNA, 20 bp, Artificial
  CRISPR gRNA sequence
ctgaattacatggtgaataa

SEQ ID NO: 684285 - DNA, 20 bp, Artificial
  CRISPR gRNA sequence
ggtgaataacagatgcaata

SEQ ID NO: 684286 - DNA, 20 bp, Artificial
  CRISPR gRNA sequence
taacagatgcaataaagaaa

SEQ ID NO: 684287 - DNA, 20 bp, Artificial
  CRISPR gRNA sequence
aacagatgcaataaagaaat

SEQ ID NO: 684288 - DNA, 20 bp, Artificial
  CRISPR gRNA sequence
atgcaataaagaaatgggct

SEQ ID NO: 684289 - DNA, 20 bp, Artificial
  CRISPR gRNA sequence
aaagaaatgggctgagctac

SEQ ID NO: 684290 - DNA, 20 bp, Artificial
  CRISPR gRNA sequence
tgtaccttaaatactttaca

SEQ ID NO: 684291 - DNA, 20 bp, Artificial
  CRISPR gRNA sequence
tttaacaatgataatgtgtg

SEQ ID NO: 684292 - DNA, 20 bp, Artificial
  CRISPR gRNA sequence
caatgataatgtgtgtggta

SEQ ID NO: 684293 - DNA, 20 bp, Artificial
  CRISPR gRNA sequence
ataatgtgtgtggtatggtt

SEQ ID NO: 684294 - DNA, 20 bp, Artificial
  CRISPR gRNA sequence
taatgtgtgtggtatggttt

SEQ ID NO: 684295 - DNA, 20 bp, Artificial
  CRISPR gRNA sequence
tgcccaaatctcatgctgaa

SEQ ID NO: 684296 - DNA, 20 bp, Artificial
  CRISPR gRNA sequence
tcatgctgaatggtaatccc

SEQ ID NO: 684297 - DNA, 20 bp, Artificial
  CRISPR gRNA sequence
aatggtaatccccagtattc

SEQ ID NO: 684298 - DNA, 20 bp, Artificial
  CRISPR gRNA sequence
atggtaatccccagtattcg

SEQ ID NO: 684299 - DNA, 20 bp, Artificial
  CRISPR gRNA sequence
gtaatccccagtattcgagg

SEQ ID NO: 684300 - DNA, 20 bp, Artificial
  CRISPR gRNA sequence
aatccccagtattcgaggtg

SEQ ID NO: 684301 - DNA, 20 bp, Artificial
  CRISPR gRNA sequence
ccagtattcgaggtggagcc

SEQ ID NO: 684302 - DNA, 20 bp, Artificial
  CRISPR gRNA sequence
gtattcgaggtggagcctgg

SEQ ID NO: 684303 - DNA, 20 bp, Artificial
  CRISPR gRNA sequence
tattcgaggtggagcctggt

SEQ ID NO: 684304 - DNA, 20 bp, Artificial
  CRISPR gRNA sequence
ttcgaggtggagcctggtgg

SEQ ID NO: 684305 - DNA, 20 bp, Artificial
  CRISPR gRNA sequence
tcgaggtggagcctggtggg

SEQ ID NO: 684306 - DNA, 20 bp, Artificial
  CRISPR gRNA sequence
ggagcctggtgggaggtgat

SEQ ID NO: 684307 - DNA, 20 bp, Artificial
  CRISPR gRNA sequence
ggtgggaggtgattggatca

SEQ ID NO: 684308 - DNA, 20 bp, Artificial
  CRISPR gRNA sequence
gtgggaggtgattggatcat

SEQ ID NO: 684309 - DNA, 20 bp, Artificial
  CRISPR gRNA sequence
tgggaggtgattggatcatg

SEQ ID NO: 684310 - DNA, 20 bp, Artificial
  CRISPR gRNA sequence
gggaggtgattggatcatgg

SEQ ID NO: 684311 - DNA, 20 bp, Artificial
  CRISPR gRNA sequence
ggtgattggatcatgggggt

SEQ ID NO: 684312 - DNA, 20 bp, Artificial
  CRISPR gRNA sequence
gggggtgagttcatcatgaa

SEQ ID NO: 684313 - DNA, 20 bp, Artificial
  CRISPR gRNA sequence
tgagttcatcatgaatggtt

SEQ ID NO: 684314 - DNA, 20 bp, Artificial
  CRISPR gRNA sequence
ctttgatgctgtccttgcaa

SEQ ID NO: 684315 - DNA, 20 bp, Artificial
  CRISPR gRNA sequence
gatgctgtccttgcaatagt

SEQ ID NO: 684316 - DNA, 20 bp, Artificial
  CRISPR gRNA sequence
aatagtgagtgacttctcat

SEQ ID NO: 684317 - DNA, 20 bp, Artificial
  CRISPR gRNA sequence
gagtgacttctcatgagatc

SEQ ID NO: 684318 - DNA, 20 bp, Artificial
  CRISPR gRNA sequence
ctcatgagatctggctgttt

SEQ ID NO: 684319 - DNA, 20 bp, Artificial
  CRISPR gRNA sequence
gagatctggctgtttcagtg

SEQ ID NO: 684320 - DNA, 20 bp, Artificial
  CRISPR gRNA sequence
gctcctgcttttactgtgtg

SEQ ID NO: 684321 - DNA, 20 bp, Artificial
  CRISPR gRNA sequence
tttgctttgccttctgccat

SEQ ID NO: 684322 - DNA, 20 bp, Artificial
  CRISPR gRNA sequence
tttgccttctgccatgagta

SEQ ID NO: 684323 - DNA, 20 bp, Artificial
  CRISPR gRNA sequence
ctgccatgagtaaagctcct

SEQ ID NO: 684324 - DNA, 20 bp, Artificial
  CRISPR gRNA sequence
tgccatgagtaaagctcctg

SEQ ID NO: 684325 - DNA, 20 bp, Artificial
  CRISPR gRNA sequence
taaagctcctgaggtgtccc

SEQ ID NO: 684326 - DNA, 20 bp, Artificial
  CRISPR gRNA sequence
agctcctgaggtgtccccag

SEQ ID NO: 684327 - DNA, 20 bp, Artificial
  CRISPR gRNA sequence
tcctgaggtgtccccagaag

SEQ ID NO: 684328 - DNA, 20 bp, Artificial
  CRISPR gRNA sequence
atgccgccatgcttcccata

SEQ ID NO: 684329 - DNA, 20 bp, Artificial
  CRISPR gRNA sequence
catgcttcccatacagcctg

SEQ ID NO: 684330 - DNA, 20 bp, Artificial
  CRISPR gRNA sequence
catacagcctgcagaactgt

SEQ ID NO: 684331 - DNA, 20 bp, Artificial
  CRISPR gRNA sequence
ctcttttcatataaatcacc

SEQ ID NO: 684332 - DNA, 20 bp, Artificial
  CRISPR gRNA sequence
tcatataaatcacccagtct

SEQ ID NO: 684333 - DNA, 20 bp, Artificial
  CRISPR gRNA sequence
catataaatcacccagtctc

SEQ ID NO: 684334 - DNA, 20 bp, Artificial
  CRISPR gRNA sequence
gtatttctttatatcaatgc

SEQ ID NO: 684335 - DNA, 20 bp, Artificial
  CRISPR gRNA sequence
tctttatatcaatgcaagaa

SEQ ID NO: 684336 - DNA, 20 bp, Artificial
  CRISPR gRNA sequence
ctaacaaatgtcttattata

SEQ ID NO: 684337 - DNA, 20 bp, Artificial
  CRISPR gRNA sequence
acaaatgtcttattataaag

SEQ ID NO: 684338 - DNA, 20 bp, Artificial
  CRISPR gRNA sequence
tcttattataaagtagcacc

SEQ ID NO: 684339 - DNA, 20 bp, Artificial
  CRISPR gRNA sequence
cttattataaagtagcacct

SEQ ID NO: 684340 - DNA, 20 bp, Artificial
  CRISPR gRNA sequence
ctaggattttctcactgaaa

SEQ ID NO: 684341 - DNA, 20 bp, Artificial
  CRISPR gRNA sequence
ggattttctcactgaaatgg

SEQ ID NO: 684342 - DNA, 20 bp, Artificial
  CRISPR gRNA sequence
ttttctcactgaaatggcag

SEQ ID NO: 684343 - DNA, 20 bp, Artificial
  CRISPR gRNA sequence
accaccctcgctaacaaaat

SEQ ID NO: 684344 - DNA, 20 bp, Artificial
  CRISPR gRNA sequence
aaatgagtgttcattatgac

SEQ ID NO: 684345 - DNA, 20 bp, Artificial
  CRISPR gRNA sequence
gtgttcattatgaccagaaa

SEQ ID NO: 684346 - DNA, 20 bp, Artificial
  CRISPR gRNA sequence
tgttcattatgaccagaaaa

SEQ ID NO: 684347 - DNA, 20 bp, Artificial
  CRISPR gRNA sequence
attatgaccagaaaaaggta

SEQ ID NO: 684348 - DNA, 20 bp, Artificial
  CRISPR gRNA sequence
gaccagaaaaaggtatagaa

SEQ ID NO: 684349 - DNA, 20 bp, Artificial
  CRISPR gRNA sequence
atgcttacaacatgtaatgc

SEQ ID NO: 684350 - DNA, 20 bp, Artificial
  CRISPR gRNA sequence
acatgtaatgcaagttataa

SEQ ID NO: 684351 - DNA, 20 bp, Artificial
  CRISPR gRNA sequence
atgtaatgcaagttataaaa

SEQ ID NO: 684352 - DNA, 20 bp, Artificial
  CRISPR gRNA sequence
caagttataaaagagcacaa

SEQ ID NO: 684353 - DNA, 20 bp, Artificial
  CRISPR gRNA sequence
agagcacaaaagaacacgtt

SEQ ID NO: 684354 - DNA, 20 bp, Artificial
  CRISPR gRNA sequence
aaaagaacacgttcagttta

SEQ ID NO: 684355 - DNA, 20 bp, Artificial
  CRISPR gRNA sequence
cacgttcagtttacggttgt

SEQ ID NO: 684356 - DNA, 20 bp, Artificial
  CRISPR gRNA sequence
ggtgcatttcctttcacata

SEQ ID NO: 684357 - DNA, 20 bp, Artificial
  CRISPR gRNA sequence
tcctttcacatacagtgaca

SEQ ID NO: 684358 - DNA, 20 bp, Artificial
  CRISPR gRNA sequence
ctttcacatacagtgacaca

SEQ ID NO: 684359 - DNA, 20 bp, Artificial
  CRISPR gRNA sequence
tttcacatacagtgacacag

SEQ ID NO: 684360 - DNA, 20 bp, Artificial
  CRISPR gRNA sequence
ttcacatacagtgacacaga

SEQ ID NO: 684361 - DNA, 20 bp, Artificial
  CRISPR gRNA sequence
cacatacagtgacacagagg

SEQ ID NO: 684362 - DNA, 20 bp, Artificial
  CRISPR gRNA sequence
tgacacagagggagttcata

SEQ ID NO: 684363 - DNA, 20 bp, Artificial
  CRISPR gRNA sequence
acagagggagttcataaagt

SEQ ID NO: 684364 - DNA, 20 bp, Artificial
  CRISPR gRNA sequence
agttcataaagttagaaaac

SEQ ID NO: 684365 - DNA, 20 bp, Artificial
  CRISPR gRNA sequence
gttcataaagttagaaaaca

SEQ ID NO: 684366 - DNA, 20 bp, Artificial
  CRISPR gRNA sequence
ttagaaaacaaggatgacca

SEQ ID NO: 684367 - DNA, 20 bp, Artificial
  CRISPR gRNA sequence
gaaaacaaggatgaccaaag

SEQ ID NO: 684368 - DNA, 20 bp, Artificial
  CRISPR gRNA sequence
aacaaggatgaccaaagaag

SEQ ID NO: 684369 - DNA, 20 bp, Artificial
  CRISPR gRNA sequence
ggatgaccaaagaagcagct

SEQ ID NO: 684370 - DNA, 20 bp, Artificial
  CRISPR gRNA sequence
aaagaagcagctgagtgttc

SEQ ID NO: 684371 - DNA, 20 bp, Artificial
  CRISPR gRNA sequence
tgttctagacaaaccaacga

SEQ ID NO: 684372 - DNA, 20 bp, Artificial
  CRISPR gRNA sequence
gttctagacaaaccaacgat

SEQ ID NO: 684373 - DNA, 20 bp, Artificial
  CRISPR gRNA sequence
tctagacaaaccaacgatag

SEQ ID NO: 684374 - DNA, 20 bp, Artificial
  CRISPR gRNA sequence
ctagacaaaccaacgatagg

SEQ ID NO: 684375 - DNA, 20 bp, Artificial
  CRISPR gRNA sequence
tagacaaaccaacgatagga

SEQ ID NO: 684376 - DNA, 20 bp, Artificial
  CRISPR gRNA sequence
gacaaaccaacgataggagg

SEQ ID NO: 684377 - DNA, 20 bp, Artificial
  CRISPR gRNA sequence
aaaccaacgataggagggag

SEQ ID NO: 684378 - DNA, 20 bp, Artificial
  CRISPR gRNA sequence
aaccaacgataggagggagt

SEQ ID NO: 684379 - DNA, 20 bp, Artificial
  CRISPR gRNA sequence
accaacgataggagggagtg

SEQ ID NO: 684380 - DNA, 20 bp, Artificial
  CRISPR gRNA sequence
ccaacgataggagggagtgg

SEQ ID NO: 684381 - DNA, 20 bp, Artificial
  CRISPR gRNA sequence
aacgataggagggagtgggg

SEQ ID NO: 684382 - DNA, 20 bp, Artificial
  CRISPR gRNA sequence
acgataggagggagtggggg

SEQ ID NO: 684383 - DNA, 20 bp, Artificial
  CRISPR gRNA sequence
tgggggaggacgaacaattt

SEQ ID NO: 684384 - DNA, 20 bp, Artificial
  CRISPR gRNA sequence
gggaggacgaacaatttaag

SEQ ID NO: 684385 - DNA, 20 bp, Artificial
  CRISPR gRNA sequence
aggacgaacaatttaagcag

SEQ ID NO: 684386 - DNA, 20 bp, Artificial
  CRISPR gRNA sequence
gacgaacaatttaagcagca

SEQ ID NO: 684387 - DNA, 20 bp, Artificial
  CRISPR gRNA sequence
gaacaatttaagcagcagag

SEQ ID NO: 684388 - DNA, 20 bp, Artificial
  CRISPR gRNA sequence
ttaagcagcagagaagctcc

SEQ ID NO: 684389 - DNA, 20 bp, Artificial
  CRISPR gRNA sequence
gcagagaagctcccagcaaa

SEQ ID NO: 684390 - DNA, 20 bp, Artificial
  CRISPR gRNA sequence
cagagaagctcccagcaaac

SEQ ID NO: 684391 - DNA, 20 bp, Artificial
  CRISPR gRNA sequence
aagctcccagcaaacaggaa

SEQ ID NO: 684392 - DNA, 20 bp, Artificial
  CRISPR gRNA sequence
gcaaacaggaacagtctaca

SEQ ID NO: 684393 - DNA, 20 bp, Artificial
  CRISPR gRNA sequence
caggaacagtctacaaagat

SEQ ID NO: 684394 - DNA, 20 bp, Artificial
  CRISPR gRNA sequence
aacagtctacaaagatcaga

SEQ ID NO: 684395 - DNA, 20 bp, Artificial
  CRISPR gRNA sequence
agacagcaaacaacatcccg

SEQ ID NO: 684396 - DNA, 20 bp, Artificial
  CRISPR gRNA sequence
cagcaaacaacatcccgaag

SEQ ID NO: 684397 - DNA, 20 bp, Artificial
  CRISPR gRNA sequence
gcaaacaacatcccgaagaa

SEQ ID NO: 684398 - DNA, 20 bp, Artificial
  CRISPR gRNA sequence
aacaacatcccgaagaagag

SEQ ID NO: 684399 - DNA, 20 bp, Artificial
  CRISPR gRNA sequence
aagaagagaagcacatttta

SEQ ID NO: 684400 - DNA, 20 bp, Artificial
  CRISPR gRNA sequence
gagaagcacattttatggca

SEQ ID NO: 684401 - DNA, 20 bp, Artificial
  CRISPR gRNA sequence
agaagcacattttatggcac

SEQ ID NO: 684402 - DNA, 20 bp, Artificial
  CRISPR gRNA sequence
ggccattcccattgtcttga

SEQ ID NO: 684403 - DNA, 20 bp, Artificial
  CRISPR gRNA sequence
cattgtcttgatggatctct

SEQ ID NO: 684404 - DNA, 20 bp, Artificial
  CRISPR gRNA sequence
tccattctgcttacacttgc

SEQ ID NO: 684405 - DNA, 20 bp, Artificial
  CRISPR gRNA sequence
cattctgcttacacttgcta

SEQ ID NO: 684406 - DNA, 20 bp, Artificial
  CRISPR gRNA sequence
ctgcttacacttgctagaga

SEQ ID NO: 684407 - DNA, 20 bp, Artificial
  CRISPR gRNA sequence
tacacttgctagagaaagtt

SEQ ID NO: 684408 - DNA, 20 bp, Artificial
  CRISPR gRNA sequence
acacttgctagagaaagttc

SEQ ID NO: 684409 - DNA, 20 bp, Artificial
  CRISPR gRNA sequence
agagaaagttcaggtgatca

SEQ ID NO: 684410 - DNA, 20 bp, Artificial
  CRISPR gRNA sequence
agttcaggtgatcaaagtct

SEQ ID NO: 684411 - DNA, 20 bp, Artificial
  CRISPR gRNA sequence
tctcagaaacactccttact

SEQ ID NO: 684412 - DNA, 20 bp, Artificial
  CRISPR gRNA sequence
ttacttggatttttcctact

SEQ ID NO: 684413 - DNA, 20 bp, Artificial
  CRISPR gRNA sequence
atttttcctacttagtctta

SEQ ID NO: 684414 - DNA, 20 bp, Artificial
  CRISPR gRNA sequence
gtcttacggtgtgccttctc

SEQ ID NO: 684415 - DNA, 20 bp, Artificial
  CRISPR gRNA sequence
cttctcaagccatgcaaatt

SEQ ID NO: 684416 - DNA, 20 bp, Artificial
  CRISPR gRNA sequence
ttctcaagccatgcaaattc

SEQ ID NO: 684417 - DNA, 20 bp, Artificial
  CRISPR gRNA sequence
tctcaagccatgcaaattca

SEQ ID NO: 684418 - DNA, 20 bp, Artificial
  CRISPR gRNA sequence
aagccatgcaaattcagggc

SEQ ID NO: 684419 - DNA, 20 bp, Artificial
  CRISPR gRNA sequence
catgcaaattcagggccaga

SEQ ID NO: 684420 - DNA, 20 bp, Artificial
  CRISPR gRNA sequence
agggccagacagtcgtactg

SEQ ID NO: 684421 - DNA, 20 bp, Artificial
  CRISPR gRNA sequence
taaatcctcttccttcacgt

SEQ ID NO: 684422 - DNA, 20 bp, Artificial
  CRISPR gRNA sequence
gctattcttaaaaccatgtc

SEQ ID NO: 684423 - DNA, 20 bp, Artificial
  CRISPR gRNA sequence
tcttaaaaccatgtctagac

SEQ ID NO: 684424 - DNA, 20 bp, Artificial
  CRISPR gRNA sequence
aaaaccatgtctagacaagc

SEQ ID NO: 684425 - DNA, 20 bp, Artificial
  CRISPR gRNA sequence
gccagcccattgctgaaact

SEQ ID NO: 684426 - DNA, 20 bp, Artificial
  CRISPR gRNA sequence
gcccattgctgaaactaaga

SEQ ID NO: 684427 - DNA, 20 bp, Artificial
  CRISPR gRNA sequence
tacttttaatgcctactttg

SEQ ID NO: 684428 - DNA, 20 bp, Artificial
  CRISPR gRNA sequence
acttttaatgcctactttgc

SEQ ID NO: 684429 - DNA, 20 bp, Artificial
  CRISPR gRNA sequence
tgcaggtgcaaaccatgtgc

SEQ ID NO: 684430 - DNA, 20 bp, Artificial
  CRISPR gRNA sequence
gcaggtgcaaaccatgtgca

SEQ ID NO: 684431 - DNA, 20 bp, Artificial
  CRISPR gRNA sequence
caggtgcaaaccatgtgcaa

SEQ ID NO: 684432 - DNA, 20 bp, Artificial
  CRISPR gRNA sequence
aggtgcaaaccatgtgcaag

SEQ ID NO: 684433 - DNA, 20 bp, Artificial
  CRISPR gRNA sequence
tgcaaaccatgtgcaagggg

SEQ ID NO: 684434 - DNA, 20 bp, Artificial
  CRISPR gRNA sequence
caaaccatgtgcaaggggaa

SEQ ID NO: 684435 - DNA, 20 bp, Artificial
  CRISPR gRNA sequence
aaaccatgtgcaaggggaag

SEQ ID NO: 684436 - DNA, 20 bp, Artificial
  CRISPR gRNA sequence
catgtgcaaggggaagagga

SEQ ID NO: 684437 - DNA, 20 bp, Artificial
  CRISPR gRNA sequence
ccttcctcttgttgaattct

SEQ ID NO: 684438 - DNA, 20 bp, Artificial
  CRISPR gRNA sequence
gttgaattcttggttcacca

SEQ ID NO: 684439 - DNA, 20 bp, Artificial
  CRISPR gRNA sequence
tctgtaatttttgttccatt

SEQ ID NO: 684440 - DNA, 20 bp, Artificial
  CRISPR gRNA sequence
tttgttccattaagctgcca

SEQ ID NO: 684441 - DNA, 20 bp, Artificial
  CRISPR gRNA sequence
ttgttccattaagctgccac

SEQ ID NO: 684442 - DNA, 20 bp, Artificial
  CRISPR gRNA sequence
tccattaagctgccacagga

SEQ ID NO: 684443 - DNA, 20 bp, Artificial
  CRISPR gRNA sequence
attaagctgccacaggacgg

SEQ ID NO: 684444 - DNA, 20 bp, Artificial
  CRISPR gRNA sequence
gctgccacaggacggcagcc

SEQ ID NO: 684445 - DNA, 20 bp, Artificial
  CRISPR gRNA sequence
caggacggcagccaagaact

SEQ ID NO: 684446 - DNA, 20 bp, Artificial
  CRISPR gRNA sequence
ctgagtgccttttccaaaac

SEQ ID NO: 684447 - DNA, 20 bp, Artificial
  CRISPR gRNA sequence
agtgccttttccaaaacaag

SEQ ID NO: 684448 - DNA, 20 bp, Artificial
  CRISPR gRNA sequence
tgccttttccaaaacaagca

SEQ ID NO: 684449 - DNA, 20 bp, Artificial
  CRISPR gRNA sequence
ttttccaaaacaagcagagc

SEQ ID NO: 684450 - DNA, 20 bp, Artificial
  CRISPR gRNA sequence
ccaaaacaagcagagcaagt

SEQ ID NO: 684451 - DNA, 20 bp, Artificial
  CRISPR gRNA sequence
caaaacaagcagagcaagtt

SEQ ID NO: 684452 - DNA, 20 bp, Artificial
  CRISPR gRNA sequence
gttaggtttgcgttttttcc

SEQ ID NO: 684453 - DNA, 20 bp, Artificial
  CRISPR gRNA sequence
taggtttgcgttttttccta

SEQ ID NO: 684454 - DNA, 20 bp, Artificial
  CRISPR gRNA sequence
aggtttgcgttttttcctag

SEQ ID NO: 684455 - DNA, 20 bp, Artificial
  CRISPR gRNA sequence
ggtttgcgttttttcctaga

SEQ ID NO: 684456 - DNA, 20 bp, Artificial
  CRISPR gRNA sequence
gtttgcgttttttcctagag

SEQ ID NO: 684457 - DNA, 20 bp, Artificial
  CRISPR gRNA sequence
ttgcgttttttcctagaggg

SEQ ID NO: 684458 - DNA, 20 bp, Artificial
  CRISPR gRNA sequence
gttttttcctagaggggagt

SEQ ID NO: 684459 - DNA, 20 bp, Artificial
  CRISPR gRNA sequence
ttttttcctagaggggagta

SEQ ID NO: 684460 - DNA, 20 bp, Artificial
  CRISPR gRNA sequence
ataaaattaacttctgcgac

SEQ ID NO: 684461 - DNA, 20 bp, Artificial
  CRISPR gRNA sequence
aaaaaaccttactgaacact

SEQ ID NO: 684462 - DNA, 20 bp, Artificial
  CRISPR gRNA sequence
acacttagtatgcaccccac

SEQ ID NO: 684463 - DNA, 20 bp, Artificial
  CRISPR gRNA sequence
cacttagtatgcaccccacc

SEQ ID NO: 684464 - DNA, 20 bp, Artificial
  CRISPR gRNA sequence
ggacctccctccctcatctc

SEQ ID NO: 684465 - DNA, 20 bp, Artificial
  CRISPR gRNA sequence
ttccattaccttcattcacc

SEQ ID NO: 684466 - DNA, 20 bp, Artificial
  CRISPR gRNA sequence
attaccttcattcacccagc

SEQ ID NO: 684467 - DNA, 20 bp, Artificial
  CRISPR gRNA sequence
ttaccttcattcacccagct

SEQ ID NO: 684468 - DNA, 20 bp, Artificial
  CRISPR gRNA sequence
cattcacccagctgggtttg

SEQ ID NO: 684469 - DNA, 20 bp, Artificial
  CRISPR gRNA sequence
acccagctgggtttgaagct

SEQ ID NO: 684470 - DNA, 20 bp, Artificial
  CRISPR gRNA sequence
ccactatattctcatctgca

SEQ ID NO: 684471 - DNA, 20 bp, Artificial
  CRISPR gRNA sequence
cactatattctcatctgcat

SEQ ID NO: 684472 - DNA, 20 bp, Artificial
  CRISPR gRNA sequence
catctgcatgggaaactaac

SEQ ID NO: 684473 - DNA, 20 bp, Artificial
  CRISPR gRNA sequence
atctgcatgggaaactaaca

SEQ ID NO: 684474 - DNA, 20 bp, Artificial
  CRISPR gRNA sequence
ttcaccaaccccacattaca

SEQ ID NO: 684475 - DNA, 20 bp, Artificial
  CRISPR gRNA sequence
tcaccaaccccacattacaa

SEQ ID NO: 684476 - DNA, 20 bp, Artificial
  CRISPR gRNA sequence
cccacattacaaaggatttc

SEQ ID NO: 684477 - DNA, 20 bp, Artificial
  CRISPR gRNA sequence
ttacaaaggatttctagtaa

SEQ ID NO: 684478 - DNA, 20 bp, Artificial
  CRISPR gRNA sequence
tacaaaggatttctagtaaa

SEQ ID NO: 684479 - DNA, 20 bp, Artificial
  CRISPR gRNA sequence
gtaaaaggattgccctctac

SEQ ID NO: 684480 - DNA, 20 bp, Artificial
  CRISPR gRNA sequence
gattgccctctactagaaat

SEQ ID NO: 684481 - DNA, 20 bp, Artificial
  CRISPR gRNA sequence
ttgccctctactagaaatta

SEQ ID NO: 684482 - DNA, 20 bp, Artificial
  CRISPR gRNA sequence
ccctcttccacatctttcta

SEQ ID NO: 684483 - DNA, 20 bp, Artificial
  CRISPR gRNA sequence
aactctcttcatctctccat

SEQ ID NO: 684484 - DNA, 20 bp, Artificial
  CRISPR gRNA sequence
tctctccataagctactttg

SEQ ID NO: 684485 - DNA, 20 bp, Artificial
  CRISPR gRNA sequence
tgaagataaacatgttttac

SEQ ID NO: 684486 - DNA, 20 bp, Artificial
  CRISPR gRNA sequence
taaacatgttttaccggatc

SEQ ID NO: 684487 - DNA, 20 bp, Artificial
  CRISPR gRNA sequence
cggatctggctaccattgcc

SEQ ID NO: 684488 - DNA, 20 bp, Artificial
  CRISPR gRNA sequence
tgcccagaatgaacaccctg

SEQ ID NO: 684489 - DNA, 20 bp, Artificial
  CRISPR gRNA sequence
gcccagaatgaacaccctgc

SEQ ID NO: 684490 - DNA, 20 bp, Artificial
  CRISPR gRNA sequence
accctgcaggtctccatccc

SEQ ID NO: 684491 - DNA, 20 bp, Artificial
  CRISPR gRNA sequence
caggtctccatcccaagctc

SEQ ID NO: 684492 - DNA, 20 bp, Artificial
  CRISPR gRNA sequence
aggtctccatcccaagctct

SEQ ID NO: 684493 - DNA, 20 bp, Artificial
  CRISPR gRNA sequence
ctccatcccaagctctggga

SEQ ID NO: 684494 - DNA, 20 bp, Artificial
  CRISPR gRNA sequence
ccatcccaagctctgggata

SEQ ID NO: 684495 - DNA, 20 bp, Artificial
  CRISPR gRNA sequence
caagctctgggatagagatg

SEQ ID NO: 684496 - DNA, 20 bp, Artificial
  CRISPR gRNA sequence
gatagagatgaagatgaaat

SEQ ID NO: 684497 - DNA, 20 bp, Artificial
  CRISPR gRNA sequence
gaaattagatgcatacatga

SEQ ID NO: 684498 - DNA, 20 bp, Artificial
  CRISPR gRNA sequence
tgaaagcatcatgaattaca

SEQ ID NO: 684499 - DNA, 20 bp, Artificial
  CRISPR gRNA sequence
tgtgtccctgttcccaatat

SEQ ID NO: 684500 - DNA, 20 bp, Artificial
  CRISPR gRNA sequence
tcccaatattagcaaatgct

SEQ ID NO: 684501 - DNA, 20 bp, Artificial
  CRISPR gRNA sequence
cccaatattagcaaatgctt

SEQ ID NO: 684502 - DNA, 20 bp, Artificial
  CRISPR gRNA sequence
ccaatattagcaaatgcttg

SEQ ID NO: 684503 - DNA, 20 bp, Artificial
  CRISPR gRNA sequence
atattagcaaatgcttgggg

SEQ ID NO: 684504 - DNA, 20 bp, Artificial
  CRISPR gRNA sequence
tattagcaaatgcttggggc

SEQ ID NO: 684505 - DNA, 20 bp, Artificial
  CRISPR gRNA sequence
atgcttggggcaggtgcttt

SEQ ID NO: 684506 - DNA, 20 bp, Artificial
  CRISPR gRNA sequence
tgcttggggcaggtgctttc

SEQ ID NO: 684507 - DNA, 20 bp, Artificial
  CRISPR gRNA sequence
gcttggggcaggtgctttca

SEQ ID NO: 684508 - DNA, 20 bp, Artificial
  CRISPR gRNA sequence
tgtcacctcacttactcctc

SEQ ID NO: 684509 - DNA, 20 bp, Artificial
  CRISPR gRNA sequence
gtcacctcacttactcctca

SEQ ID NO: 684510 - DNA, 20 bp, Artificial
  CRISPR gRNA sequence
ctaattgcctgacccctgct

SEQ ID NO: 684511 - DNA, 20 bp, Artificial
  CRISPR gRNA sequence
taattgcctgacccctgcta

SEQ ID NO: 684512 - DNA, 20 bp, Artificial
  CRISPR gRNA sequence
aattgcctgacccctgctaa

SEQ ID NO: 684513 - DNA, 20 bp, Artificial
  CRISPR gRNA sequence
tgacccctgctaagggaatt

SEQ ID NO: 684514 - DNA, 20 bp, Artificial
  CRISPR gRNA sequence
cctgctaagggaattcagaa

SEQ ID NO: 684515 - DNA, 20 bp, Artificial
  CRISPR gRNA sequence
ctgctaagggaattcagaac

SEQ ID NO: 684516 - DNA, 20 bp, Artificial
  CRISPR gRNA sequence
tgctaagggaattcagaaca

SEQ ID NO: 684517 - DNA, 20 bp, Artificial
  CRISPR gRNA sequence
gctaagggaattcagaacag

SEQ ID NO: 684518 - DNA, 20 bp, Artificial
  CRISPR gRNA sequence
aattcagaacaggggtcata

SEQ ID NO: 684519 - DNA, 20 bp, Artificial
  CRISPR gRNA sequence
tcagaacaggggtcatatgg

SEQ ID NO: 684520 - DNA, 20 bp, Artificial
  CRISPR gRNA sequence
cagaacaggggtcatatgga

SEQ ID NO: 684521 - DNA, 20 bp, Artificial
  CRISPR gRNA sequence
gtcatatggaaggatttttc

SEQ ID NO: 684522 - DNA, 20 bp, Artificial
  CRISPR gRNA sequence
tcatatggaaggatttttcc

SEQ ID NO: 684523 - DNA, 20 bp, Artificial
  CRISPR gRNA sequence
atttttccaggcaatattta

SEQ ID NO: 684524 - DNA, 20 bp, Artificial
  CRISPR gRNA sequence
ttcctttatttcattttgtg

SEQ ID NO: 684525 - DNA, 20 bp, Artificial
  CRISPR gRNA sequence
tcctttatttcattttgtgc

SEQ ID NO: 684526 - DNA, 20 bp, Artificial
  CRISPR gRNA sequence
cctttatttcattttgtgca

SEQ ID NO: 684527 - DNA, 20 bp, Artificial
  CRISPR gRNA sequence
ctttatttcattttgtgcag

SEQ ID NO: 684528 - DNA, 20 bp, Artificial
  CRISPR gRNA sequence
tgtgcaggggctccgattac

SEQ ID NO: 684529 - DNA, 20 bp, Artificial
  CRISPR gRNA sequence
ggggctccgattactggaaa

SEQ ID NO: 684530 - DNA, 20 bp, Artificial
  CRISPR gRNA sequence
ggctccgattactggaaaca

SEQ ID NO: 684531 - DNA, 20 bp, Artificial
  CRISPR gRNA sequence
cgattactggaaacagagaa

SEQ ID NO: 684532 - DNA, 20 bp, Artificial
  CRISPR gRNA sequence
gaaaagccttgctcatctta

SEQ ID NO: 684533 - DNA, 20 bp, Artificial
  CRISPR gRNA sequence
ttgctcatcttaaagacaaa

SEQ ID NO: 684534 - DNA, 20 bp, Artificial
  CRISPR gRNA sequence
acaaaaagaaatataaatat

SEQ ID NO: 684535 - DNA, 20 bp, Artificial
  CRISPR gRNA sequence
caaaaagaaatataaatatt

SEQ ID NO: 684536 - DNA, 20 bp, Artificial
  CRISPR gRNA sequence
aaaagaaatataaatattag

SEQ ID NO: 684537 - DNA, 20 bp, Artificial
  CRISPR gRNA sequence
aagaaatataaatattagga

SEQ ID NO: 684538 - DNA, 20 bp, Artificial
  CRISPR gRNA sequence
attaggagagcattgaatgc

SEQ ID NO: 684539 - DNA, 20 bp, Artificial
  CRISPR gRNA sequence
attgaatgctagtcaatata

SEQ ID NO: 684540 - DNA, 20 bp, Artificial
  CRISPR gRNA sequence
catgtttctattctatttca

SEQ ID NO: 684541 - DNA, 20 bp, Artificial
  CRISPR gRNA sequence
atttcatagcaatgtttttc

SEQ ID NO: 684542 - DNA, 20 bp, Artificial
  CRISPR gRNA sequence
acacacacacacacacgaaa

SEQ ID NO: 684543 - DNA, 20 bp, Artificial
  CRISPR gRNA sequence
acacacacacacgaaacaga

SEQ ID NO: 684544 - DNA, 20 bp, Artificial
  CRISPR gRNA sequence
cacacacacacgaaacagaa

SEQ ID NO: 684545 - DNA, 20 bp, Artificial
  CRISPR gRNA sequence
tgatatcacttaaacaaatg

SEQ ID NO: 684546 - DNA, 20 bp, Artificial
  CRISPR gRNA sequence
ataaaactaattacatgacc

SEQ ID NO: 684547 - DNA, 20 bp, Artificial
  CRISPR gRNA sequence
aaactaattacatgacctag

SEQ ID NO: 684548 - DNA, 20 bp, Artificial
  CRISPR gRNA sequence
ttacatgacctagtagttgt

SEQ ID NO: 684549 - DNA, 20 bp, Artificial
  CRISPR gRNA sequence
gttagaaaactactcttcta

SEQ ID NO: 684550 - DNA, 20 bp, Artificial
  CRISPR gRNA sequence
aaactactcttctacagaat

SEQ ID NO: 684551 - DNA, 20 bp, Artificial
  CRISPR gRNA sequence
ctcttctacagaataagaat

SEQ ID NO: 684552 - DNA, 20 bp, Artificial
  CRISPR gRNA sequence
acagaataagaataagacta

SEQ ID NO: 684553 - DNA, 20 bp, Artificial
  CRISPR gRNA sequence
agaataagaataagactaca

SEQ ID NO: 684554 - DNA, 20 bp, Artificial
  CRISPR gRNA sequence
ataagaataagactacagag

SEQ ID NO: 684555 - DNA, 20 bp, Artificial
  CRISPR gRNA sequence
gactacagagaagatttcaa

SEQ ID NO: 684556 - DNA, 20 bp, Artificial
  CRISPR gRNA sequence
agacccatgaaaataataaa

SEQ ID NO: 684557 - DNA, 20 bp, Artificial
  CRISPR gRNA sequence
catgaaaataataaatggat

SEQ ID NO: 684558 - DNA, 20 bp, Artificial
  CRISPR gRNA sequence
ataataaatggatgagtcca

SEQ ID NO: 684559 - DNA, 20 bp, Artificial
  CRISPR gRNA sequence
tgagtccacagatttgctcg

SEQ ID NO: 684560 - DNA, 20 bp, Artificial
  CRISPR gRNA sequence
atttgctcgcagttctccac

SEQ ID NO: 684561 - DNA, 20 bp, Artificial
  CRISPR gRNA sequence
tttgctcgcagttctccact

SEQ ID NO: 684562 - DNA, 20 bp, Artificial
  CRISPR gRNA sequence
ttgctcgcagttctccacta

SEQ ID NO: 684563 - DNA, 20 bp, Artificial
  CRISPR gRNA sequence
ctcgcagttctccactaggg

SEQ ID NO: 684564 - DNA, 20 bp, Artificial
  CRISPR gRNA sequence
ccactagggtggcccatcct

SEQ ID NO: 684565 - DNA, 20 bp, Artificial
  CRISPR gRNA sequence
tcagtgaaatcttccccgta

SEQ ID NO: 684566 - DNA, 20 bp, Artificial
  CRISPR gRNA sequence
ttctgactcctgtgaccact

SEQ ID NO: 684567 - DNA, 20 bp, Artificial
  CRISPR gRNA sequence
tctgactcctgtgaccacta

SEQ ID NO: 684568 - DNA, 20 bp, Artificial
  CRISPR gRNA sequence
cctgtgaccactaaggctga

SEQ ID NO: 684569 - DNA, 20 bp, Artificial
  CRISPR gRNA sequence
tgaccactaaggctgaaaga

SEQ ID NO: 684570 - DNA, 20 bp, Artificial
  CRISPR gRNA sequence
gaccactaaggctgaaagac

SEQ ID NO: 684571 - DNA, 20 bp, Artificial
  CRISPR gRNA sequence
cactaaggctgaaagacggg

SEQ ID NO: 684572 - DNA, 20 bp, Artificial
  CRISPR gRNA sequence
tgaaagacgggcagtgctta

SEQ ID NO: 684573 - DNA, 20 bp, Artificial
  CRISPR gRNA sequence
aaagacgggcagtgcttatg

SEQ ID NO: 684574 - DNA, 20 bp, Artificial
  CRISPR gRNA sequence
catgctcatttatttaatga

SEQ ID NO: 684575 - DNA, 20 bp, Artificial
  CRISPR gRNA sequence
tatttaatgacagtgtgatt

SEQ ID NO: 684576 - DNA, 20 bp, Artificial
  CRISPR gRNA sequence
atttaatgacagtgtgatta

SEQ ID NO: 684577 - DNA, 20 bp, Artificial
  CRISPR gRNA sequence
gtgtgattaaggaccactgt

SEQ ID NO: 684578 - DNA, 20 bp, Artificial
  CRISPR gRNA sequence
tgtgattaaggaccactgta

SEQ ID NO: 684579 - DNA, 20 bp, Artificial
  CRISPR gRNA sequence
gtgattaaggaccactgtaa

SEQ ID NO: 684580 - DNA, 20 bp, Artificial
  CRISPR gRNA sequence
ctgtaagggttgatattaaa

SEQ ID NO: 684581 - DNA, 20 bp, Artificial
  CRISPR gRNA sequence
aagggttgatattaaacaga

SEQ ID NO: 684582 - DNA, 20 bp, Artificial
  CRISPR gRNA sequence
gggttgatattaaacagaaa

SEQ ID NO: 684583 - DNA, 20 bp, Artificial
  CRISPR gRNA sequence
ggttgatattaaacagaaag

SEQ ID NO: 684584 - DNA, 20 bp, Artificial
  CRISPR gRNA sequence
taaacagaaagaggcactga

SEQ ID NO: 684585 - DNA, 20 bp, Artificial
  CRISPR gRNA sequence
aaacagaaagaggcactgat

SEQ ID NO: 684586 - DNA, 20 bp, Artificial
  CRISPR gRNA sequence
aagaggcactgataggaatg

SEQ ID NO: 684587 - DNA, 20 bp, Artificial
  CRISPR gRNA sequence
gcactgataggaatgtggtc

SEQ ID NO: 684588 - DNA, 20 bp, Artificial
  CRISPR gRNA sequence
gtctggtgatgcttatttta

SEQ ID NO: 684589 - DNA, 20 bp, Artificial
  CRISPR gRNA sequence
tggtgatgcttattttacag

SEQ ID NO: 684590 - DNA, 20 bp, Artificial
  CRISPR gRNA sequence
tgatgcttattttacagcgg

SEQ ID NO: 684591 - DNA, 20 bp, Artificial
  CRISPR gRNA sequence
atgcttattttacagcggtg

SEQ ID NO: 684592 - DNA, 20 bp, Artificial
  CRISPR gRNA sequence
tgaaaaaactgtcatacgta

SEQ ID NO: 684593 - DNA, 20 bp, Artificial
  CRISPR gRNA sequence
gaaaaaactgtcatacgtaa

SEQ ID NO: 684594 - DNA, 20 bp, Artificial
  CRISPR gRNA sequence
aaaaaactgtcatacgtaaa

SEQ ID NO: 684595 - DNA, 20 bp, Artificial
  CRISPR gRNA sequence
aaaaactgtcatacgtaaag

SEQ ID NO: 684596 - DNA, 20 bp, Artificial
  CRISPR gRNA sequence
ggctattacatctacgtctg

SEQ ID NO: 684597 - DNA, 20 bp, Artificial
  CRISPR gRNA sequence
tctgtagatcgacttgtgct

SEQ ID NO: 684598 - DNA, 20 bp, Artificial
  CRISPR gRNA sequence
ctgtagatcgacttgtgcta

SEQ ID NO: 684599 - DNA, 20 bp, Artificial
  CRISPR gRNA sequence
gtagatcgacttgtgctaag

SEQ ID NO: 684600 - DNA, 20 bp, Artificial
  CRISPR gRNA sequence
aaggagaccccaatcctttg

SEQ ID NO: 684601 - DNA, 20 bp, Artificial
  CRISPR gRNA sequence
ccaatcctttgtagattgat

SEQ ID NO: 684602 - DNA, 20 bp, Artificial
  CRISPR gRNA sequence
gtgaaatctttcccttaaat

SEQ ID NO: 684603 - DNA, 20 bp, Artificial
  CRISPR gRNA sequence
ttataaaatttaaaataact

SEQ ID NO: 684604 - DNA, 20 bp, Artificial
  CRISPR gRNA sequence
taacttggaaaacacatttt

SEQ ID NO: 684605 - DNA, 20 bp, Artificial
  CRISPR gRNA sequence
gaaaacacatttttagaatg

SEQ ID NO: 684606 - DNA, 20 bp, Artificial
  CRISPR gRNA sequence
tagaatgaagtgacttactc

SEQ ID NO: 684607 - DNA, 20 bp, Artificial
  CRISPR gRNA sequence
agaatgaagtgacttactca

SEQ ID NO: 684608 - DNA, 20 bp, Artificial
  CRISPR gRNA sequence
aaggccattgatgatgttga

SEQ ID NO: 684609 - DNA, 20 bp, Artificial
  CRISPR gRNA sequence
tgttgaaagtattgcaaaca

SEQ ID NO: 684610 - DNA, 20 bp, Artificial
  CRISPR gRNA sequence
gacaacatttatgtacacca

SEQ ID NO: 684611 - DNA, 20 bp, Artificial
  CRISPR gRNA sequence
caccatagtataccatcaca

SEQ ID NO: 684612 - DNA, 20 bp, Artificial
  CRISPR gRNA sequence
accatcacaaagcctctcat

SEQ ID NO: 684613 - DNA, 20 bp, Artificial
  CRISPR gRNA sequence
cattagactttgaatccaat

SEQ ID NO: 684614 - DNA, 20 bp, Artificial
  CRISPR gRNA sequence
gaatccaatgagtattacta

SEQ ID NO: 684615 - DNA, 20 bp, Artificial
  CRISPR gRNA sequence
aatgagtattactaaagatt

SEQ ID NO: 684616 - DNA, 20 bp, Artificial
  CRISPR gRNA sequence
ttaagctcttttttaatttg

SEQ ID NO: 684617 - DNA, 20 bp, Artificial
  CRISPR gRNA sequence
cagaaactctgacaccaaac

SEQ ID NO: 684618 - DNA, 20 bp, Artificial
  CRISPR gRNA sequence
aaactagaaaaaaaaaaaaa

SEQ ID NO: 684619 - DNA, 20 bp, Artificial
  CRISPR gRNA sequence
tagaaaaaaaaaaaaaaagc

SEQ ID NO: 684620 - DNA, 20 bp, Artificial
  CRISPR gRNA sequence
agctggttttgctctccaaa

SEQ ID NO: 684621 - DNA, 20 bp, Artificial
  CRISPR gRNA sequence
gttgtattgccattcaaaaa

SEQ ID NO: 684622 - DNA, 20 bp, Artificial
  CRISPR gRNA sequence
tattgccattcaaaaaaagt

SEQ ID NO: 684623 - DNA, 20 bp, Artificial
  CRISPR gRNA sequence
ccattcaaaaaaagtaagtt

SEQ ID NO: 684624 - DNA, 20 bp, Artificial
  CRISPR gRNA sequence
tcaaaaaaagtaagttaagt

SEQ ID NO: 684625 - DNA, 20 bp, Artificial
  CRISPR gRNA sequence
aagtaagttaagttagcatt

SEQ ID NO: 684626 - DNA, 20 bp, Artificial
  CRISPR gRNA sequence
cattcagattgctttatctt

SEQ ID NO: 684627 - DNA, 20 bp, Artificial
  CRISPR gRNA sequence
tgctttatctttggaaaatt

SEQ ID NO: 684628 - DNA, 20 bp, Artificial
  CRISPR gRNA sequence
ggaaaattaagtcacaaaaa

SEQ ID NO: 684629 - DNA, 20 bp, Artificial
  CRISPR gRNA sequence
taagtcacaaaaaaagaata

SEQ ID NO: 684630 - DNA, 20 bp, Artificial
  CRISPR gRNA sequence
cacaaaaaaagaataaagaa

SEQ ID NO: 684631 - DNA, 20 bp, Artificial
  CRISPR gRNA sequence
aaaagaataaagaacagatg

SEQ ID NO: 684632 - DNA, 20 bp, Artificial
  CRISPR gRNA sequence
gaacagatgtggctttgaat

SEQ ID NO: 684633 - DNA, 20 bp, Artificial
  CRISPR gRNA sequence
tgaaatttcttaaatcttga

SEQ ID NO: 684634 - DNA, 20 bp, Artificial
  CRISPR gRNA sequence
ttaaatcttgatagtgtgtt

SEQ ID NO: 684635 - DNA, 20 bp, Artificial
  CRISPR gRNA sequence
cagaaaacctctttgcgtca

SEQ ID NO: 684636 - DNA, 20 bp, Artificial
  CRISPR gRNA sequence
aacctctttgcgtcatagtt

SEQ ID NO: 684637 - DNA, 20 bp, Artificial
  CRISPR gRNA sequence
cgtcatagttcagaatgtat

SEQ ID NO: 684638 - DNA, 20 bp, Artificial
  CRISPR gRNA sequence
tagttcagaatgtataagat

SEQ ID NO: 684639 - DNA, 20 bp, Artificial
  CRISPR gRNA sequence
tcagaatgtataagataaga

SEQ ID NO: 684640 - DNA, 20 bp, Artificial
  CRISPR gRNA sequence
agaatgtataagataagatg

SEQ ID NO: 684641 - DNA, 20 bp, Artificial
  CRISPR gRNA sequence
atgtataagataagatggag

SEQ ID NO: 684642 - DNA, 20 bp, Artificial
  CRISPR gRNA sequence
tgtataagataagatggagc

SEQ ID NO: 684643 - DNA, 20 bp, Artificial
  CRISPR gRNA sequence
tataagataagatggagcag

SEQ ID NO: 684644 - DNA, 20 bp, Artificial
  CRISPR gRNA sequence
ataagataagatggagcagg

SEQ ID NO: 684645 - DNA, 20 bp, Artificial
  CRISPR gRNA sequence
agataagatggagcaggagg

SEQ ID NO: 684646 - DNA, 20 bp, Artificial
  CRISPR gRNA sequence
agatggagcaggaggaagta

SEQ ID NO: 684647 - DNA, 20 bp, Artificial
  CRISPR gRNA sequence
gatggagcaggaggaagtaa

SEQ ID NO: 684648 - DNA, 20 bp, Artificial
  CRISPR gRNA sequence
atggagcaggaggaagtaaa

SEQ ID NO: 684649 - DNA, 20 bp, Artificial
  CRISPR gRNA sequence
ggagcaggaggaagtaaagg

SEQ ID NO: 684650 - DNA, 20 bp, Artificial
  CRISPR gRNA sequence
gagcaggaggaagtaaaggg

SEQ ID NO: 684651 - DNA, 20 bp, Artificial
  CRISPR gRNA sequence
gcaggaggaagtaaagggag

SEQ ID NO: 684652 - DNA, 20 bp, Artificial
  CRISPR gRNA sequence
caggaggaagtaaagggagg

SEQ ID NO: 684653 - DNA, 20 bp, Artificial
  CRISPR gRNA sequence
aggaggaagtaaagggagga

SEQ ID NO: 684654 - DNA, 20 bp, Artificial
  CRISPR gRNA sequence
gaggaagtaaagggaggagg

SEQ ID NO: 684655 - DNA, 20 bp, Artificial
  CRISPR gRNA sequence
gaagtaaagggaggagggag

SEQ ID NO: 684656 - DNA, 20 bp, Artificial
  CRISPR gRNA sequence
aagggaggagggagaagtgc

SEQ ID NO: 684657 - DNA, 20 bp, Artificial
  CRISPR gRNA sequence
agaagtgcaagaaacccaac

SEQ ID NO: 684658 - DNA, 20 bp, Artificial
  CRISPR gRNA sequence
agtgcaagaaacccaaccag

SEQ ID NO: 684659 - DNA, 20 bp, Artificial
  CRISPR gRNA sequence
gtgcaagaaacccaaccaga

SEQ ID NO: 684660 - DNA, 20 bp, Artificial
  CRISPR gRNA sequence
tgcaagaaacccaaccagaa

SEQ ID NO: 684661 - DNA, 20 bp, Artificial
  CRISPR gRNA sequence
ccacttcgacttctttcacg

SEQ ID NO: 684662 - DNA, 20 bp, Artificial
  CRISPR gRNA sequence
gtattctatctcattaatgt

SEQ ID NO: 684663 - DNA, 20 bp, Artificial
  CRISPR gRNA sequence
ttctatctcattaatgtcag

SEQ ID NO: 684664 - DNA, 20 bp, Artificial
  CRISPR gRNA sequence
gtagcttacccttgaccgtg

SEQ ID NO: 684665 - DNA, 20 bp, Artificial
  CRISPR gRNA sequence
tagcttacccttgaccgtga

SEQ ID NO: 684666 - DNA, 20 bp, Artificial
  CRISPR gRNA sequence
acccttgaccgtgaaggacc

SEQ ID NO: 684667 - DNA, 20 bp, Artificial
  CRISPR gRNA sequence
ggtcgccgtcacactataat

SEQ ID NO: 684668 - DNA, 20 bp, Artificial
  CRISPR gRNA sequence
tttcattgtgtataaattta

SEQ ID NO: 684669 - DNA, 20 bp, Artificial
  CRISPR gRNA sequence
ttcattgtgtataaatttac

SEQ ID NO: 684670 - DNA, 20 bp, Artificial
  CRISPR gRNA sequence
ggtgtaatcacctgcgtcct

SEQ ID NO: 684671 - DNA, 20 bp, Artificial
  CRISPR gRNA sequence
gccctgtaccttgatccttg

SEQ ID NO: 684672 - DNA, 20 bp, Artificial
  CRISPR gRNA sequence
cctgtaccttgatccttgaa

SEQ ID NO: 684673 - DNA, 20 bp, Artificial
  CRISPR gRNA sequence
gagcctgacaattctgaaat

SEQ ID NO: 684674 - DNA, 20 bp, Artificial
  CRISPR gRNA sequence
aagaaattccatttccttct

SEQ ID NO: 684675 - DNA, 20 bp, Artificial
  CRISPR gRNA sequence
tttatttatttatctgttga

SEQ ID NO: 684676 - DNA, 20 bp, Artificial
  CRISPR gRNA sequence
ttgacagaatgtttgttgcc

SEQ ID NO: 684677 - DNA, 20 bp, Artificial
  CRISPR gRNA sequence
tgacagaatgtttgttgcct

SEQ ID NO: 684678 - DNA, 20 bp, Artificial
  CRISPR gRNA sequence
agaatgtttgttgcctaggc

SEQ ID NO: 684679 - DNA, 20 bp, Artificial
  CRISPR gRNA sequence
aatgtttgttgcctaggctg

SEQ ID NO: 684680 - DNA, 20 bp, Artificial
  CRISPR gRNA sequence
tttgttgcctaggctggagt

SEQ ID NO: 684681 - DNA, 20 bp, Artificial
  CRISPR gRNA sequence
gttgcctaggctggagtgag

SEQ ID NO: 684682 - DNA, 20 bp, Artificial
  CRISPR gRNA sequence
ctggagtgagtggtgcaatc

SEQ ID NO: 684683 - DNA, 20 bp, Artificial
  CRISPR gRNA sequence
tggagtgagtggtgcaatct

SEQ ID NO: 684684 - DNA, 20 bp, Artificial
  CRISPR gRNA sequence
tcgctgtaacctctgccttc

SEQ ID NO: 684685 - DNA, 20 bp, Artificial
  CRISPR gRNA sequence
cgctgtaacctctgccttct

SEQ ID NO: 684686 - DNA, 20 bp, Artificial
  CRISPR gRNA sequence
aacctctgccttctaggttc

SEQ ID NO: 684687 - DNA, 20 bp, Artificial
  CRISPR gRNA sequence
ttcaagtgattttcatacct

SEQ ID NO: 684688 - DNA, 20 bp, Artificial
  CRISPR gRNA sequence
ttttcatacctcagcctccc

SEQ ID NO: 684689 - DNA, 20 bp, Artificial
  CRISPR gRNA sequence
acctcagcctcccaagctgc

SEQ ID NO: 684690 - DNA, 20 bp, Artificial
  CRISPR gRNA sequence
cctcagcctcccaagctgct

SEQ ID NO: 684691 - DNA, 20 bp, Artificial
  CRISPR gRNA sequence
ctcccaagctgctgggatta

SEQ ID NO: 684692 - DNA, 20 bp, Artificial
  CRISPR gRNA sequence
tcccaagctgctgggattac

SEQ ID NO: 684693 - DNA, 20 bp, Artificial
  CRISPR gRNA sequence
caggtgtgtgccaccacacc

SEQ ID NO: 684694 - DNA, 20 bp, Artificial
  CRISPR gRNA sequence
ccagctgatttttatatttt

SEQ ID NO: 684695 - DNA, 20 bp, Artificial
  CRISPR gRNA sequence
gctgatttttatatttttag

SEQ ID NO: 684696 - DNA, 20 bp, Artificial
  CRISPR gRNA sequence
tgatttttatatttttagta

SEQ ID NO: 684697 - DNA, 20 bp, Artificial
  CRISPR gRNA sequence
ttttatatttttagtagaga

SEQ ID NO: 684698 - DNA, 20 bp, Artificial
  CRISPR gRNA sequence
tttatatttttagtagagat

SEQ ID NO: 684699 - DNA, 20 bp, Artificial
  CRISPR gRNA sequence
ttatatttttagtagagatg

SEQ ID NO: 684700 - DNA, 20 bp, Artificial
  CRISPR gRNA sequence
gagatggggtttcctcatgt

SEQ ID NO: 684701 - DNA, 20 bp, Artificial
  CRISPR gRNA sequence
tggggtttcctcatgttggc

SEQ ID NO: 684702 - DNA, 20 bp, Artificial
  CRISPR gRNA sequence
ggggtttcctcatgttggcc

SEQ ID NO: 684703 - DNA, 20 bp, Artificial
  CRISPR gRNA sequence
tttcctcatgttggccaggc

SEQ ID NO: 684704 - DNA, 20 bp, Artificial
  CRISPR gRNA sequence
ccaggctggtctcaaactcc

SEQ ID NO: 684705 - DNA, 20 bp, Artificial
  CRISPR gRNA sequence
ggtctcaaactcctggcctc

SEQ ID NO: 684706 - DNA, 20 bp, Artificial
  CRISPR gRNA sequence
ctcaagtgatctgcctgcct

SEQ ID NO: 684707 - DNA, 20 bp, Artificial
  CRISPR gRNA sequence
ctgcctgccttggcctccca

SEQ ID NO: 684708 - DNA, 20 bp, Artificial
  CRISPR gRNA sequence
gccttggcctcccaaagtgc

SEQ ID NO: 684709 - DNA, 20 bp, Artificial
  CRISPR gRNA sequence
ccttggcctcccaaagtgct

SEQ ID NO: 684710 - DNA, 20 bp, Artificial
  CRISPR gRNA sequence
ctcccaaagtgctaggatta

SEQ ID NO: 684711 - DNA, 20 bp, Artificial
  CRISPR gRNA sequence
tcccaaagtgctaggattac

SEQ ID NO: 684712 - DNA, 20 bp, Artificial
  CRISPR gRNA sequence
agtgctaggattacaggcat

SEQ ID NO: 684713 - DNA, 20 bp, Artificial
  CRISPR gRNA sequence
caggcatgagccactgtgcc

SEQ ID NO: 684714 - DNA, 20 bp, Artificial
  CRISPR gRNA sequence
cttcttaccttaaaccactc

SEQ ID NO: 684715 - DNA, 20 bp, Artificial
  CRISPR gRNA sequence
tcttaccttaaaccactcaa

SEQ ID NO: 684716 - DNA, 20 bp, Artificial
  CRISPR gRNA sequence
cttaccttaaaccactcaag

SEQ ID NO: 684717 - DNA, 20 bp, Artificial
  CRISPR gRNA sequence
accactcaagaggtgctgtc

SEQ ID NO: 684718 - DNA, 20 bp, Artificial
  CRISPR gRNA sequence
caagaggtgctgtccagttg

SEQ ID NO: 684719 - DNA, 20 bp, Artificial
  CRISPR gRNA sequence
agaggtgctgtccagttgta

SEQ ID NO: 684720 - DNA, 20 bp, Artificial
  CRISPR gRNA sequence
gaggtgctgtccagttgtag

SEQ ID NO: 684721 - DNA, 20 bp, Artificial
  CRISPR gRNA sequence
tgtccagttgtagaggtcaa

SEQ ID NO: 684722 - DNA, 20 bp, Artificial
  CRISPR gRNA sequence
ccagttgtagaggtcaatgg

SEQ ID NO: 684723 - DNA, 20 bp, Artificial
  CRISPR gRNA sequence
cagttgtagaggtcaatggt

SEQ ID NO: 684724 - DNA, 20 bp, Artificial
  CRISPR gRNA sequence
aatggtaggacaataaattt

SEQ ID NO: 684725 - DNA, 20 bp, Artificial
  CRISPR gRNA sequence
tttggaatttttttctgatc

SEQ ID NO: 684726 - DNA, 20 bp, Artificial
  CRISPR gRNA sequence
gttgaatacatcaaataatc

SEQ ID NO: 684727 - DNA, 20 bp, Artificial
  CRISPR gRNA sequence
atctgattgttttttatata

SEQ ID NO: 684728 - DNA, 20 bp, Artificial
  CRISPR gRNA sequence
tatggtgacattcgcatatc

SEQ ID NO: 684729 - DNA, 20 bp, Artificial
  CRISPR gRNA sequence
atatccagtcctattgaatg

SEQ ID NO: 684730 - DNA, 20 bp, Artificial
  CRISPR gRNA sequence
tatccagtcctattgaatgt

SEQ ID NO: 684731 - DNA, 20 bp, Artificial
  CRISPR gRNA sequence
gaatgtgggactgttaaaat

SEQ ID NO: 684732 - DNA, 20 bp, Artificial
  CRISPR gRNA sequence
gtgggactgttaaaataagt

SEQ ID NO: 684733 - DNA, 20 bp, Artificial
  CRISPR gRNA sequence
aaaataagtcagacaattaa

SEQ ID NO: 684734 - DNA, 20 bp, Artificial
  CRISPR gRNA sequence
aataagtcagacaattaaaa

SEQ ID NO: 684735 - DNA, 20 bp, Artificial
  CRISPR gRNA sequence
agacaattaaaagagtcact

SEQ ID NO: 684736 - DNA, 20 bp, Artificial
  CRISPR gRNA sequence
gaaataacttaatctaaatt

SEQ ID NO: 684737 - DNA, 20 bp, Artificial
  CRISPR gRNA sequence
aaaaccatcaatatacataa

SEQ ID NO: 684738 - DNA, 20 bp, Artificial
  CRISPR gRNA sequence
taaaaataaacattaaaatc

SEQ ID NO: 684739 - DNA, 20 bp, Artificial
  CRISPR gRNA sequence
aaaataaacattaaaatcta

SEQ ID NO: 684740 - DNA, 20 bp, Artificial
  CRISPR gRNA sequence
aatacttttttgttacactt

SEQ ID NO: 684741 - DNA, 20 bp, Artificial
  CRISPR gRNA sequence
ttacacttgagctaaaaaca

SEQ ID NO: 684742 - DNA, 20 bp, Artificial
  CRISPR gRNA sequence
agctaaaaacatagccccca

SEQ ID NO: 684743 - DNA, 20 bp, Artificial
  CRISPR gRNA sequence
taaaaacatagcccccatag

SEQ ID NO: 684744 - DNA, 20 bp, Artificial
  CRISPR gRNA sequence
ctgctgtaatgctgtaatcc

SEQ ID NO: 684745 - DNA, 20 bp, Artificial
  CRISPR gRNA sequence
gctgtaatcccagtgtaata

SEQ ID NO: 684746 - DNA, 20 bp, Artificial
  CRISPR gRNA sequence
aaagataattactatttatt

SEQ ID NO: 684747 - DNA, 20 bp, Artificial
  CRISPR gRNA sequence
agataattactatttattca

SEQ ID NO: 684748 - DNA, 20 bp, Artificial
  CRISPR gRNA sequence
attcagagtttactctgtac

SEQ ID NO: 684749 - DNA, 20 bp, Artificial
  CRISPR gRNA sequence
tctgtaccagtgatgatgat

SEQ ID NO: 684750 - DNA, 20 bp, Artificial
  CRISPR gRNA sequence
gcacttttcacacattacct

SEQ ID NO: 684751 - DNA, 20 bp, Artificial
  CRISPR gRNA sequence
tattttcacaataatgcttt

SEQ ID NO: 684752 - DNA, 20 bp, Artificial
  CRISPR gRNA sequence
attacattatatgcatttta

SEQ ID NO: 684753 - DNA, 20 bp, Artificial
  CRISPR gRNA sequence
tacattatatgcattttaca

SEQ ID NO: 684754 - DNA, 20 bp, Artificial
  CRISPR gRNA sequence
attatatgcattttacagag

SEQ ID NO: 684755 - DNA, 20 bp, Artificial
  CRISPR gRNA sequence
ttatatgcattttacagaga

SEQ ID NO: 684756 - DNA, 20 bp, Artificial
  CRISPR gRNA sequence
ttttacagagaaggaaactg

SEQ ID NO: 684757 - DNA, 20 bp, Artificial
  CRISPR gRNA sequence
tttacagagaaggaaactga

SEQ ID NO: 684758 - DNA, 20 bp, Artificial
  CRISPR gRNA sequence
ttacagagaaggaaactgaa

SEQ ID NO: 684759 - DNA, 20 bp, Artificial
  CRISPR gRNA sequence
cagagaaggaaactgaaggg

SEQ ID NO: 684760 - DNA, 20 bp, Artificial
  CRISPR gRNA sequence
gagaaggaaactgaagggca

SEQ ID NO: 684761 - DNA, 20 bp, Artificial
  CRISPR gRNA sequence
aaggaaactgaagggcagag

SEQ ID NO: 684762 - DNA, 20 bp, Artificial
  CRISPR gRNA sequence
agggcagagaagtaacttgc

SEQ ID NO: 684763 - DNA, 20 bp, Artificial
  CRISPR gRNA sequence
agtaacttgctggcatcgca

SEQ ID NO: 684764 - DNA, 20 bp, Artificial
  CRISPR gRNA sequence
gctggcatcgcacagttaac

SEQ ID NO: 684765 - DNA, 20 bp, Artificial
  CRISPR gRNA sequence
ggcatcgcacagttaactag

SEQ ID NO: 684766 - DNA, 20 bp, Artificial
  CRISPR gRNA sequence
atcgcacagttaactagtgg

SEQ ID NO: 684767 - DNA, 20 bp, Artificial
  CRISPR gRNA sequence
cgcacagttaactagtggca

SEQ ID NO: 684768 - DNA, 20 bp, Artificial
  CRISPR gRNA sequence
gcatgaatttgacacttgtc

SEQ ID NO: 684769 - DNA, 20 bp, Artificial
  CRISPR gRNA sequence
atttgacacttgtctagtct

SEQ ID NO: 684770 - DNA, 20 bp, Artificial
  CRISPR gRNA sequence
cacttgtctagtctcagacc

SEQ ID NO: 684771 - DNA, 20 bp, Artificial
  CRISPR gRNA sequence
acttgtctagtctcagacct

SEQ ID NO: 684772 - DNA, 20 bp, Artificial
  CRISPR gRNA sequence
cattttgtgtgtgccaaata

SEQ ID NO: 684773 - DNA, 20 bp, Artificial
  CRISPR gRNA sequence
atttaacaatttgtgaacaa

SEQ ID NO: 684774 - DNA, 20 bp, Artificial
  CRISPR gRNA sequence
gaacaaaagtaattaatttt

SEQ ID NO: 684775 - DNA, 20 bp, Artificial
  CRISPR gRNA sequence
aacaaaagtaattaattttt

SEQ ID NO: 684776 - DNA, 20 bp, Artificial
  CRISPR gRNA sequence
ttttaggcacacaatctcat

SEQ ID NO: 684777 - DNA, 20 bp, Artificial
  CRISPR gRNA sequence
acaatctcatcagccttctg

SEQ ID NO: 684778 - DNA, 20 bp, Artificial
  CRISPR gRNA sequence
gccttctgtggcttaacttg

SEQ ID NO: 684779 - DNA, 20 bp, Artificial
  CRISPR gRNA sequence
ccttctgtggcttaacttga

SEQ ID NO: 684780 - DNA, 20 bp, Artificial
  CRISPR gRNA sequence
ctgtggcttaacttgaaggt

SEQ ID NO: 684781 - DNA, 20 bp, Artificial
  CRISPR gRNA sequence
tggcttaacttgaaggttag

SEQ ID NO: 684782 - DNA, 20 bp, Artificial
  CRISPR gRNA sequence
agaagccccttttcacctac

SEQ ID NO: 684783 - DNA, 20 bp, Artificial
  CRISPR gRNA sequence
aagccccttttcacctacta

SEQ ID NO: 684784 - DNA, 20 bp, Artificial
  CRISPR gRNA sequence
agccccttttcacctactag

SEQ ID NO: 684785 - DNA, 20 bp, Artificial
  CRISPR gRNA sequence
tcacctactagaggccccct

SEQ ID NO: 684786 - DNA, 20 bp, Artificial
  CRISPR gRNA sequence
ctactagaggccccctgaga

SEQ ID NO: 684787 - DNA, 20 bp, Artificial
  CRISPR gRNA sequence
cccctgagatggaaaacatc

SEQ ID NO: 684788 - DNA, 20 bp, Artificial
  CRISPR gRNA sequence
cagattactattttctgtgc

SEQ ID NO: 684789 - DNA, 20 bp, Artificial
  CRISPR gRNA sequence
tgctagtttgttcttaattc

SEQ ID NO: 684790 - DNA, 20 bp, Artificial
  CRISPR gRNA sequence
ttgttcttaattccagccaa

SEQ ID NO: 684791 - DNA, 20 bp, Artificial
  CRISPR gRNA sequence
tcttaattccagccaaaagt

SEQ ID NO: 684792 - DNA, 20 bp, Artificial
  CRISPR gRNA sequence
caaaagtaagcaattgctct

SEQ ID NO: 684793 - DNA, 20 bp, Artificial
  CRISPR gRNA sequence
gcaattgctctcagttatct

SEQ ID NO: 684794 - DNA, 20 bp, Artificial
  CRISPR gRNA sequence
ctctcagttatcttggtcac

SEQ ID NO: 684795 - DNA, 20 bp, Artificial
  CRISPR gRNA sequence
tctcagttatcttggtcact

SEQ ID NO: 684796 - DNA, 20 bp, Artificial
  CRISPR gRNA sequence
agttatcttggtcactagga

SEQ ID NO: 684797 - DNA, 20 bp, Artificial
  CRISPR gRNA sequence
atcttggtcactaggaaagc

SEQ ID NO: 684798 - DNA, 20 bp, Artificial
  CRISPR gRNA sequence
tcttggtcactaggaaagct

SEQ ID NO: 684799 - DNA, 20 bp, Artificial
  CRISPR gRNA sequence
ggaaagctaggtttttctct

SEQ ID NO: 684800 - DNA, 20 bp, Artificial
  CRISPR gRNA sequence
agctaggtttttctctaagt

SEQ ID NO: 684801 - DNA, 20 bp, Artificial
  CRISPR gRNA sequence
cctgcaactgtaaatccaaa

SEQ ID NO: 684802 - DNA, 20 bp, Artificial
  CRISPR gRNA sequence
aactgtaaatccaaatagct

SEQ ID NO: 684803 - DNA, 20 bp, Artificial
  CRISPR gRNA sequence
aaatccaaatagctcagaat

SEQ ID NO: 684804 - DNA, 20 bp, Artificial
  CRISPR gRNA sequence
ccaaatagctcagaatgagc

SEQ ID NO: 684805 - DNA, 20 bp, Artificial
  CRISPR gRNA sequence
tgagctagacctcaacctga

SEQ ID NO: 684806 - DNA, 20 bp, Artificial
  CRISPR gRNA sequence
cctcaacctgatagtattcc

SEQ ID NO: 684807 - DNA, 20 bp, Artificial
  CRISPR gRNA sequence
caacctgatagtattcctag

SEQ ID NO: 684808 - DNA, 20 bp, Artificial
  CRISPR gRNA sequence
ttttataaatttaactgttc

SEQ ID NO: 684809 - DNA, 20 bp, Artificial
  CRISPR gRNA sequence
ataaatttaactgttccaga

SEQ ID NO: 684810 - DNA, 20 bp, Artificial
  CRISPR gRNA sequence
taaatttaactgttccagaa

SEQ ID NO: 684811 - DNA, 20 bp, Artificial
  CRISPR gRNA sequence
ttaactgttccagaaaggac

SEQ ID NO: 684812 - DNA, 20 bp, Artificial
  CRISPR gRNA sequence
taactgttccagaaaggact

SEQ ID NO: 684813 - DNA, 20 bp, Artificial
  CRISPR gRNA sequence
aactgttccagaaaggacta

SEQ ID NO: 684814 - DNA, 20 bp, Artificial
  CRISPR gRNA sequence
tgttccagaaaggactaggg

SEQ ID NO: 684815 - DNA, 20 bp, Artificial
  CRISPR gRNA sequence
gttccagaaaggactaggga

SEQ ID NO: 684816 - DNA, 20 bp, Artificial
  CRISPR gRNA sequence
aaggactagggaaggaatga

SEQ ID NO: 684817 - DNA, 20 bp, Artificial
  CRISPR gRNA sequence
actagggaaggaatgaaagc

SEQ ID NO: 684818 - DNA, 20 bp, Artificial
  CRISPR gRNA sequence
ctagggaaggaatgaaagca

SEQ ID NO: 684819 - DNA, 20 bp, Artificial
  CRISPR gRNA sequence
tagggaaggaatgaaagcaa

SEQ ID NO: 684820 - DNA, 20 bp, Artificial
  CRISPR gRNA sequence
ggaaggaatgaaagcaaggg

SEQ ID NO: 684821 - DNA, 20 bp, Artificial
  CRISPR gRNA sequence
gaatgaaagcaagggcagct

SEQ ID NO: 684822 - DNA, 20 bp, Artificial
  CRISPR gRNA sequence
aatgaaagcaagggcagctc

SEQ ID NO: 684823 - DNA, 20 bp, Artificial
  CRISPR gRNA sequence
gctcaggcaatcaaccactg

SEQ ID NO: 684824 - DNA, 20 bp, Artificial
  CRISPR gRNA sequence
aggcaatcaaccactgaaga

SEQ ID NO: 684825 - DNA, 20 bp, Artificial
  CRISPR gRNA sequence
ggcaatcaaccactgaagaa

SEQ ID NO: 684826 - DNA, 20 bp, Artificial
  CRISPR gRNA sequence
gcaatcaaccactgaagaaa

SEQ ID NO: 684827 - DNA, 20 bp, Artificial
  CRISPR gRNA sequence
caatcaaccactgaagaaag

SEQ ID NO: 684828 - DNA, 20 bp, Artificial
  CRISPR gRNA sequence
atcaaccactgaagaaaggg

SEQ ID NO: 684829 - DNA, 20 bp, Artificial
  CRISPR gRNA sequence
aaccactgaagaaaggggag

SEQ ID NO: 684830 - DNA, 20 bp, Artificial
  CRISPR gRNA sequence
accactgaagaaaggggagc

SEQ ID NO: 684831 - DNA, 20 bp, Artificial
  CRISPR gRNA sequence
ccactgaagaaaggggagca

SEQ ID NO: 684832 - DNA, 20 bp, Artificial
  CRISPR gRNA sequence
aagaaaggggagcagggtga

SEQ ID NO: 684833 - DNA, 20 bp, Artificial
  CRISPR gRNA sequence
aaaggggagcagggtgaaag

SEQ ID NO: 684834 - DNA, 20 bp, Artificial
  CRISPR gRNA sequence
gggagcagggtgaaagaaga

SEQ ID NO: 684835 - DNA, 20 bp, Artificial
  CRISPR gRNA sequence
ggagcagggtgaaagaagat

SEQ ID NO: 684836 - DNA, 20 bp, Artificial
  CRISPR gRNA sequence
agcagggtgaaagaagatgg

SEQ ID NO: 684837 - DNA, 20 bp, Artificial
  CRISPR gRNA sequence
cataataccttctgacaata

SEQ ID NO: 684838 - DNA, 20 bp, Artificial
  CRISPR gRNA sequence
ataataccttctgacaatac

SEQ ID NO: 684839 - DNA, 20 bp, Artificial
  CRISPR gRNA sequence
gacaatacaggtataaatac

SEQ ID NO: 684840 - DNA, 20 bp, Artificial
  CRISPR gRNA sequence
acaggtataaataccagaat

SEQ ID NO: 684841 - DNA, 20 bp, Artificial
  CRISPR gRNA sequence
aataccagaatcagcaactg

SEQ ID NO: 684842 - DNA, 20 bp, Artificial
  CRISPR gRNA sequence
ccagaatcagcaactgcagc

SEQ ID NO: 684843 - DNA, 20 bp, Artificial
  CRISPR gRNA sequence
gaatcagcaactgcagctgg

SEQ ID NO: 684844 - DNA, 20 bp, Artificial
  CRISPR gRNA sequence
actgcagctggtagaaactt

SEQ ID NO: 684845 - DNA, 20 bp, Artificial
  CRISPR gRNA sequence
gcagctggtagaaacttcag

SEQ ID NO: 684846 - DNA, 20 bp, Artificial
  CRISPR gRNA sequence
ctggtagaaacttcagaagt

SEQ ID NO: 684847 - DNA, 20 bp, Artificial
  CRISPR gRNA sequence
gaaacttcagaagttggcct

SEQ ID NO: 684848 - DNA, 20 bp, Artificial
  CRISPR gRNA sequence
aaacttcagaagttggcctg

SEQ ID NO: 684849 - DNA, 20 bp, Artificial
  CRISPR gRNA sequence
aaacacacgatttctttcct

SEQ ID NO: 684850 - DNA, 20 bp, Artificial
  CRISPR gRNA sequence
cacacgatttctttcctgag

SEQ ID NO: 684851 - DNA, 20 bp, Artificial
  CRISPR gRNA sequence
acacgatttctttcctgagt

SEQ ID NO: 684852 - DNA, 20 bp, Artificial
  CRISPR gRNA sequence
gaatacttttgtttgtttgt

SEQ ID NO: 684853 - DNA, 20 bp, Artificial
  CRISPR gRNA sequence
ttgtgagtaataccaatcca

SEQ ID NO: 684854 - DNA, 20 bp, Artificial
  CRISPR gRNA sequence
ataccaatccacggtgtaac

SEQ ID NO: 684855 - DNA, 20 bp, Artificial
  CRISPR gRNA sequence
taccaatccacggtgtaact

SEQ ID NO: 684856 - DNA, 20 bp, Artificial
  CRISPR gRNA sequence
gtaactaggttttccttgtc

SEQ ID NO: 684857 - DNA, 20 bp, Artificial
  CRISPR gRNA sequence
taactaggttttccttgtct

SEQ ID NO: 684858 - DNA, 20 bp, Artificial
  CRISPR gRNA sequence
tctaggacatcttacaatta

SEQ ID NO: 684859 - DNA, 20 bp, Artificial
  CRISPR gRNA sequence
acaattaaagcctcattttc

SEQ ID NO: 684860 - DNA, 20 bp, Artificial
  CRISPR gRNA sequence
caattaaagcctcattttcc

SEQ ID NO: 684861 - DNA, 20 bp, Artificial
  CRISPR gRNA sequence
gattgtttacctgcaaataa

SEQ ID NO: 684862 - DNA, 20 bp, Artificial
  CRISPR gRNA sequence
acctgcaaataaaagatata

SEQ ID NO: 684863 - DNA, 20 bp, Artificial
  CRISPR gRNA sequence
tcctgaaatgatcaaatgaa

SEQ ID NO: 684864 - DNA, 20 bp, Artificial
  CRISPR gRNA sequence
atactctcaatattttcttc

SEQ ID NO: 684865 - DNA, 20 bp, Artificial
  CRISPR gRNA sequence
tactctcaatattttcttct

SEQ ID NO: 684866 - DNA, 20 bp, Artificial
  CRISPR gRNA sequence
ttttcttctaggattaaatt

SEQ ID NO: 684867 - DNA, 20 bp, Artificial
  CRISPR gRNA sequence
tcttctaggattaaatttag

SEQ ID NO: 684868 - DNA, 20 bp, Artificial
  CRISPR gRNA sequence
ctaggattaaatttagaagc

SEQ ID NO: 684869 - DNA, 20 bp, Artificial
  CRISPR gRNA sequence
ggtcatatactgtgatacct

SEQ ID NO: 684870 - DNA, 20 bp, Artificial
  CRISPR gRNA sequence
gtcatatactgtgatacctt

SEQ ID NO: 684871 - DNA, 20 bp, Artificial
  CRISPR gRNA sequence
tatactgtgataccttggga

SEQ ID NO: 684872 - DNA, 20 bp, Artificial
  CRISPR gRNA sequence
gtgataccttgggaaagaat

SEQ ID NO: 684873 - DNA, 20 bp, Artificial
  CRISPR gRNA sequence
ggaaagaataagtaactgtt

SEQ ID NO: 684874 - DNA, 20 bp, Artificial
  CRISPR gRNA sequence
gaaatgttaatgaattaatt

SEQ ID NO: 684875 - DNA, 20 bp, Artificial
  CRISPR gRNA sequence
aatgttaatgaattaatttg

SEQ ID NO: 684876 - DNA, 20 bp, Artificial
  CRISPR gRNA sequence
atttggagctaaatccccca

SEQ ID NO: 684877 - DNA, 20 bp, Artificial
  CRISPR gRNA sequence
aatcccccacagttatccaa

SEQ ID NO: 684878 - DNA, 20 bp, Artificial
  CRISPR gRNA sequence
cccacagttatccaatggaa

SEQ ID NO: 684879 - DNA, 20 bp, Artificial
  CRISPR gRNA sequence
acagttatccaatggaaaag

SEQ ID NO: 684880 - DNA, 20 bp, Artificial
  CRISPR gRNA sequence
tatctaaacaaactgtgtgt

SEQ ID NO: 684881 - DNA, 20 bp, Artificial
  CRISPR gRNA sequence
tccacaacacttcccatgtg

SEQ ID NO: 684882 - DNA, 20 bp, Artificial
  CRISPR gRNA sequence
ccacaacacttcccatgtgc

SEQ ID NO: 684883 - DNA, 20 bp, Artificial
  CRISPR gRNA sequence
ctgctgcatttgaatatgca

SEQ ID NO: 684884 - DNA, 20 bp, Artificial
  CRISPR gRNA sequence
ctgatgatatattcattaca

SEQ ID NO: 684885 - DNA, 20 bp, Artificial
  CRISPR gRNA sequence
ttacaaagaatttcttctga

SEQ ID NO: 684886 - DNA, 20 bp, Artificial
  CRISPR gRNA sequence
aatgaaaaatgattgtacaa

SEQ ID NO: 684887 - DNA, 20 bp, Artificial
  CRISPR gRNA sequence
tacaaaagcaatatattttt

SEQ ID NO: 684888 - DNA, 20 bp, Artificial
  CRISPR gRNA sequence
ttttcagtttacaattcaac

SEQ ID NO: 684889 - DNA, 20 bp, Artificial
  CRISPR gRNA sequence
tacaattcaactggaacaac

SEQ ID NO: 684890 - DNA, 20 bp, Artificial
  CRISPR gRNA sequence
aattcaactggaacaactgg

SEQ ID NO: 684891 - DNA, 20 bp, Artificial
  CRISPR gRNA sequence
ggaagcaaactgcttaaaac

SEQ ID NO: 684892 - DNA, 20 bp, Artificial
  CRISPR gRNA sequence
gaagcaaactgcttaaaaca

SEQ ID NO: 684893 - DNA, 20 bp, Artificial
  CRISPR gRNA sequence
ataaaaatttaaattatact

SEQ ID NO: 684894 - DNA, 20 bp, Artificial
  CRISPR gRNA sequence
aaaatttaaattatacttag

SEQ ID NO: 684895 - DNA, 20 bp, Artificial
  CRISPR gRNA sequence
aaatttaaattatacttaga

SEQ ID NO: 684896 - DNA, 20 bp, Artificial
  CRISPR gRNA sequence
cttactaaactttgctgctg

SEQ ID NO: 684897 - DNA, 20 bp, Artificial
  CRISPR gRNA sequence
tttgctgctgtggaatacat

SEQ ID NO: 684898 - DNA, 20 bp, Artificial
  CRISPR gRNA sequence
gtggaatacatgagaattgt

SEQ ID NO: 684899 - DNA, 20 bp, Artificial
  CRISPR gRNA sequence
tgagaattgtgagaattgct

SEQ ID NO: 684900 - DNA, 20 bp, Artificial
  CRISPR gRNA sequence
ccccattctgtttatcaatc

SEQ ID NO: 684901 - DNA, 20 bp, Artificial
  CRISPR gRNA sequence
ccattctgtttatcaatcaa

SEQ ID NO: 684902 - DNA, 20 bp, Artificial
  CRISPR gRNA sequence
tctgtttatcaatcaagagc

SEQ ID NO: 684903 - DNA, 20 bp, Artificial
  CRISPR gRNA sequence
tatcaatcaagagcaagtat

SEQ ID NO: 684904 - DNA, 20 bp, Artificial
  CRISPR gRNA sequence
agtattggtaactcgttgtt

SEQ ID NO: 684905 - DNA, 20 bp, Artificial
  CRISPR gRNA sequence
actcgttgttgagattactc

SEQ ID NO: 684906 - DNA, 20 bp, Artificial
  CRISPR gRNA sequence
ttgttgagattactccagat

SEQ ID NO: 684907 - DNA, 20 bp, Artificial
  CRISPR gRNA sequence
gattactccagatgagtcac

SEQ ID NO: 684908 - DNA, 20 bp, Artificial
  CRISPR gRNA sequence
gatgagtcactggcatacga

SEQ ID NO: 684909 - DNA, 20 bp, Artificial
  CRISPR gRNA sequence
gtcactggcatacgacagtg

SEQ ID NO: 684910 - DNA, 20 bp, Artificial
  CRISPR gRNA sequence
tcactggcatacgacagtga

SEQ ID NO: 684911 - DNA, 20 bp, Artificial
  CRISPR gRNA sequence
cagtgaaggtcaccacacat

SEQ ID NO: 684912 - DNA, 20 bp, Artificial
  CRISPR gRNA sequence
agtgaaggtcaccacacatg

SEQ ID NO: 684913 - DNA, 20 bp, Artificial
  CRISPR gRNA sequence
gaaggtcaccacacatgagg

SEQ ID NO: 684914 - DNA, 20 bp, Artificial
  CRISPR gRNA sequence
gtcaccacacatgaggcagt

SEQ ID NO: 684915 - DNA, 20 bp, Artificial
  CRISPR gRNA sequence
ggcagttggtgatactcttc

SEQ ID NO: 684916 - DNA, 20 bp, Artificial
  CRISPR gRNA sequence
tggtgatactcttcaagact

SEQ ID NO: 684917 - DNA, 20 bp, Artificial
  CRISPR gRNA sequence
gatactcttcaagactgagt

SEQ ID NO: 684918 - DNA, 20 bp, Artificial
  CRISPR gRNA sequence
atactcttcaagactgagtt

SEQ ID NO: 684919 - DNA, 20 bp, Artificial
  CRISPR gRNA sequence
ctcttcaagactgagttggg

SEQ ID NO: 684920 - DNA, 20 bp, Artificial
  CRISPR gRNA sequence
cttcaagactgagttgggaa

SEQ ID NO: 684921 - DNA, 20 bp, Artificial
  CRISPR gRNA sequence
caagactgagttgggaagag

SEQ ID NO: 684922 - DNA, 20 bp, Artificial
  CRISPR gRNA sequence
ctatatctcaactgaaaaat

SEQ ID NO: 684923 - DNA, 20 bp, Artificial
  CRISPR gRNA sequence
atctcaactgaaaaataagt

SEQ ID NO: 684924 - DNA, 20 bp, Artificial
  CRISPR gRNA sequence
aagttagacaaaaccataaa

SEQ ID NO: 684925 - DNA, 20 bp, Artificial
  CRISPR gRNA sequence
accataaacagaatttttat

SEQ ID NO: 684926 - DNA, 20 bp, Artificial
  CRISPR gRNA sequence
agccatgatttttactttct

SEQ ID NO: 684927 - DNA, 20 bp, Artificial
  CRISPR gRNA sequence
tttactttctcagcaccacc

SEQ ID NO: 684928 - DNA, 20 bp, Artificial
  CRISPR gRNA sequence
ttactttctcagcaccaccc

SEQ ID NO: 684929 - DNA, 20 bp, Artificial
  CRISPR gRNA sequence
actttctcagcaccacccag

SEQ ID NO: 684930 - DNA, 20 bp, Artificial
  CRISPR gRNA sequence
caccacccaggagaatgaat

SEQ ID NO: 684931 - DNA, 20 bp, Artificial
  CRISPR gRNA sequence
tcagtcaacacatatttatt

SEQ ID NO: 684932 - DNA, 20 bp, Artificial
  CRISPR gRNA sequence
acacatatttattaagtgca

SEQ ID NO: 684933 - DNA, 20 bp, Artificial
  CRISPR gRNA sequence
acatatttattaagtgcaaa

SEQ ID NO: 684934 - DNA, 20 bp, Artificial
  CRISPR gRNA sequence
ttaagtgcaaagagatgtaa

SEQ ID NO: 684935 - DNA, 20 bp, Artificial
  CRISPR gRNA sequence
agtgcaaagagatgtaacag

SEQ ID NO: 684936 - DNA, 20 bp, Artificial
  CRISPR gRNA sequence
gtgcaaagagatgtaacagc

SEQ ID NO: 684937 - DNA, 20 bp, Artificial
  CRISPR gRNA sequence
agagatgtaacagcaggttt

SEQ ID NO: 684938 - DNA, 20 bp, Artificial
  CRISPR gRNA sequence
acagcaggtttcagatatgc

SEQ ID NO: 684939 - DNA, 20 bp, Artificial
  CRISPR gRNA sequence
aagcattgcacttattccta

SEQ ID NO: 684940 - DNA, 20 bp, Artificial
  CRISPR gRNA sequence
cattgcacttattcctatgg

SEQ ID NO: 684941 - DNA, 20 bp, Artificial
  CRISPR gRNA sequence
acttattcctatggaagttt

SEQ ID NO: 684942 - DNA, 20 bp, Artificial
  CRISPR gRNA sequence
cttattcctatggaagtttt

SEQ ID NO: 684943 - DNA, 20 bp, Artificial
  CRISPR gRNA sequence
tatggaagttttgggtcata

SEQ ID NO: 684944 - DNA, 20 bp, Artificial
  CRISPR gRNA sequence
acaatgatcatgctatttca

SEQ ID NO: 684945 - DNA, 20 bp, Artificial
  CRISPR gRNA sequence
acagttatcatgctacttcg

SEQ ID NO: 684946 - DNA, 20 bp, Artificial
  CRISPR gRNA sequence
acttcgcagttatatttcac

SEQ ID NO: 684947 - DNA, 20 bp, Artificial
  CRISPR gRNA sequence
ttatatttcaccagtctcat

SEQ ID NO: 684948 - DNA, 20 bp, Artificial
  CRISPR gRNA sequence
gtctcatgagaatgtcctga

SEQ ID NO: 684949 - DNA, 20 bp, Artificial
  CRISPR gRNA sequence
gtcctgaaagaaactaaatt

SEQ ID NO: 684950 - DNA, 20 bp, Artificial
  CRISPR gRNA sequence
ctgaaagaaactaaattaag

SEQ ID NO: 684951 - DNA, 20 bp, Artificial
  CRISPR gRNA sequence
tgaaagaaactaaattaaga

SEQ ID NO: 684952 - DNA, 20 bp, Artificial
  CRISPR gRNA sequence
agaaactaaattaagaagga

SEQ ID NO: 684953 - DNA, 20 bp, Artificial
  CRISPR gRNA sequence
aattaagaaggaaagaatat

SEQ ID NO: 684954 - DNA, 20 bp, Artificial
  CRISPR gRNA sequence
gaaaaaaaaaccataaaatt

SEQ ID NO: 684955 - DNA, 20 bp, Artificial
  CRISPR gRNA sequence
aaaaaaaccataaaattcag

SEQ ID NO: 684956 - DNA, 20 bp, Artificial
  CRISPR gRNA sequence
ccataaaattcagtagactt

SEQ ID NO: 684957 - DNA, 20 bp, Artificial
  CRISPR gRNA sequence
aaatgtatcatgtgaaacca

SEQ ID NO: 684958 - DNA, 20 bp, Artificial
  CRISPR gRNA sequence
tgaaaccacagacatccaca

SEQ ID NO: 684959 - DNA, 20 bp, Artificial
  CRISPR gRNA sequence
gaaaccacagacatccacac

SEQ ID NO: 684960 - DNA, 20 bp, Artificial
  CRISPR gRNA sequence
ccacagacatccacacaggc

SEQ ID NO: 684961 - DNA, 20 bp, Artificial
  CRISPR gRNA sequence
cagacatccacacaggctgg

SEQ ID NO: 684962 - DNA, 20 bp, Artificial
  CRISPR gRNA sequence
acatccacacaggctggtag

SEQ ID NO: 684963 - DNA, 20 bp, Artificial
  CRISPR gRNA sequence
tcacaaaaataactcacaaa

SEQ ID NO: 684964 - DNA, 20 bp, Artificial
  CRISPR gRNA sequence
tcacaaacagacacatgtgc

SEQ ID NO: 684965 - DNA, 20 bp, Artificial
  CRISPR gRNA sequence
caaacagacacatgtgcaag

SEQ ID NO: 684966 - DNA, 20 bp, Artificial
  CRISPR gRNA sequence
atgtgcaagtagtcatcaca

SEQ ID NO: 684967 - DNA, 20 bp, Artificial
  CRISPR gRNA sequence
gtagtcatcacaaagcaact

SEQ ID NO: 684968 - DNA, 20 bp, Artificial
  CRISPR gRNA sequence
tagtcatcacaaagcaacta

SEQ ID NO: 684969 - DNA, 20 bp, Artificial
  CRISPR gRNA sequence
gtcatcacaaagcaactaag

SEQ ID NO: 684970 - DNA, 20 bp, Artificial
  CRISPR gRNA sequence
atcacaaagcaactaaggag

SEQ ID NO: 684971 - DNA, 20 bp, Artificial
  CRISPR gRNA sequence
caactaaggagtagcaaaat

SEQ ID NO: 684972 - DNA, 20 bp, Artificial
  CRISPR gRNA sequence
aggagtagcaaaatcagaac

SEQ ID NO: 684973 - DNA, 20 bp, Artificial
  CRISPR gRNA sequence
gcaaaatcagaactagacta

SEQ ID NO: 684974 - DNA, 20 bp, Artificial
  CRISPR gRNA sequence
tcagaactagactaaagcat

SEQ ID NO: 684975 - DNA, 20 bp, Artificial
  CRISPR gRNA sequence
actagactaaagcattagcc

SEQ ID NO: 684976 - DNA, 20 bp, Artificial
  CRISPR gRNA sequence
tcaaacttttgttcctgact

SEQ ID NO: 684977 - DNA, 20 bp, Artificial
  CRISPR gRNA sequence
ttcctgactcagcttgttcc

SEQ ID NO: 684978 - DNA, 20 bp, Artificial
  CRISPR gRNA sequence
tcctgactcagcttgttccc

SEQ ID NO: 684979 - DNA, 20 bp, Artificial
  CRISPR gRNA sequence
ctgactcagcttgttcccag

SEQ ID NO: 684980 - DNA, 20 bp, Artificial
  CRISPR gRNA sequence
cttgttcccaggagtcacca

SEQ ID NO: 684981 - DNA, 20 bp, Artificial
  CRISPR gRNA sequence
ttgttcccaggagtcaccaa

SEQ ID NO: 684982 - DNA, 20 bp, Artificial
  CRISPR gRNA sequence
ggagtcaccaaaggctttct

SEQ ID NO: 684983 - DNA, 20 bp, Artificial
  CRISPR gRNA sequence
agtcaccaaaggctttctaa

SEQ ID NO: 684984 - DNA, 20 bp, Artificial
  CRISPR gRNA sequence
caccaaaggctttctaagag

SEQ ID NO: 684985 - DNA, 20 bp, Artificial
  CRISPR gRNA sequence
aggctttctaagagtagttg

SEQ ID NO: 684986 - DNA, 20 bp, Artificial
  CRISPR gRNA sequence
ggctttctaagagtagttga

SEQ ID NO: 684987 - DNA, 20 bp, Artificial
  CRISPR gRNA sequence
aatacattaattttttcttt

SEQ ID NO: 684988 - DNA, 20 bp, Artificial
  CRISPR gRNA sequence
tacttcttttcttaaaatat

SEQ ID NO: 684989 - DNA, 20 bp, Artificial
  CRISPR gRNA sequence
acttcttttcttaaaatata

SEQ ID NO: 684990 - DNA, 20 bp, Artificial
  CRISPR gRNA sequence
cttcttttcttaaaatataa

SEQ ID NO: 684991 - DNA, 20 bp, Artificial
  CRISPR gRNA sequence
ttcttttcttaaaatataag

SEQ ID NO: 684992 - DNA, 20 bp, Artificial
  CRISPR gRNA sequence
ttttcttaaaatataagggg

SEQ ID NO: 684993 - DNA, 20 bp, Artificial
  CRISPR gRNA sequence
ttaaaatataaggggaagaa

SEQ ID NO: 684994 - DNA, 20 bp, Artificial
  CRISPR gRNA sequence
ggggaagaatagaaccaaca

SEQ ID NO: 684995 - DNA, 20 bp, Artificial
  CRISPR gRNA sequence
catagaaatttactaacata

SEQ ID NO: 684996 - DNA, 20 bp, Artificial
  CRISPR gRNA sequence
aaacacaatcatgaattatg

SEQ ID NO: 684997 - DNA, 20 bp, Artificial
  CRISPR gRNA sequence
acttttcttattacaaattt

SEQ ID NO: 684998 - DNA, 20 bp, Artificial
  CRISPR gRNA sequence
tcttattacaaattttagat

SEQ ID NO: 684999 - DNA, 20 bp, Artificial
  CRISPR gRNA sequence
ttgatgcttacccaaactga

SEQ ID NO: 685000 - DNA, 20 bp, Artificial
  CRISPR gRNA sequence
tgcttacccaaactgaaaga

SEQ ID NO: 685001 - DNA, 20 bp, Artificial
  CRISPR gRNA sequence
cttacccaaactgaaagaca

SEQ ID NO: 685002 - DNA, 20 bp, Artificial
  CRISPR gRNA sequence
ttacccaaactgaaagacag

SEQ ID NO: 685003 - DNA, 20 bp, Artificial
  CRISPR gRNA sequence
tacccaaactgaaagacaga

SEQ ID NO: 685004 - DNA, 20 bp, Artificial
  CRISPR gRNA sequence
acccaaactgaaagacagag

SEQ ID NO: 685005 - DNA, 20 bp, Artificial
  CRISPR gRNA sequence
aaagacagaggggatgaact

SEQ ID NO: 685006 - DNA, 20 bp, Artificial
  CRISPR gRNA sequence
agacagaggggatgaacttg

SEQ ID NO: 685007 - DNA, 20 bp, Artificial
  CRISPR gRNA sequence
agaggggatgaacttggagt

SEQ ID NO: 685008 - DNA, 20 bp, Artificial
  CRISPR gRNA sequence
gatgaacttggagtcagtga

SEQ ID NO: 685009 - DNA, 20 bp, Artificial
  CRISPR gRNA sequence
tgaacttggagtcagtgacg

SEQ ID NO: 685010 - DNA, 20 bp, Artificial
  CRISPR gRNA sequence
ttggagtcagtgacggagct

SEQ ID NO: 685011 - DNA, 20 bp, Artificial
  CRISPR gRNA sequence
gtcagtgacggagctaagaa

SEQ ID NO: 685012 - DNA, 20 bp, Artificial
  CRISPR gRNA sequence
acggagctaagaatagtttc

SEQ ID NO: 685013 - DNA, 20 bp, Artificial
  CRISPR gRNA sequence
agaatagtttccagtctttg

SEQ ID NO: 685014 - DNA, 20 bp, Artificial
  CRISPR gRNA sequence
gaatagtttccagtctttgt

SEQ ID NO: 685015 - DNA, 20 bp, Artificial
  CRISPR gRNA sequence
tctttgtaggtccctcctca

SEQ ID NO: 685016 - DNA, 20 bp, Artificial
  CRISPR gRNA sequence
actcactctcttctatttta

SEQ ID NO: 685017 - DNA, 20 bp, Artificial
  CRISPR gRNA sequence
ctcactctcttctattttaa

SEQ ID NO: 685018 - DNA, 20 bp, Artificial
  CRISPR gRNA sequence
tcactctcttctattttaaa

SEQ ID NO: 685019 - DNA, 20 bp, Artificial
  CRISPR gRNA sequence
cactctcttctattttaaag

SEQ ID NO: 685020 - DNA, 20 bp, Artificial
  CRISPR gRNA sequence
ctctcttctattttaaaggg

SEQ ID NO: 685021 - DNA, 20 bp, Artificial
  CRISPR gRNA sequence
ccatcctgaaatttgatttg

SEQ ID NO: 685022 - DNA, 20 bp, Artificial
  CRISPR gRNA sequence
tatgacttgttcaaaaatgc

SEQ ID NO: 685023 - DNA, 20 bp, Artificial
  CRISPR gRNA sequence
tttggccacaaatcaaattt

SEQ ID NO: 685024 - DNA, 20 bp, Artificial
  CRISPR gRNA sequence
aaatcaaatttcaggatggg

SEQ ID NO: 685025 - DNA, 20 bp, Artificial
  CRISPR gRNA sequence
gtctcccctttaaaatagaa

SEQ ID NO: 685026 - DNA, 20 bp, Artificial
  CRISPR gRNA sequence
cccctttaaaatagaagaga

SEQ ID NO: 685027 - DNA, 20 bp, Artificial
  CRISPR gRNA sequence
catcccctctgtctttcagt

SEQ ID NO: 685028 - DNA, 20 bp, Artificial
  CRISPR gRNA sequence
tggtgactcctgggaacaag

SEQ ID NO: 685029 - DNA, 20 bp, Artificial
  CRISPR gRNA sequence
tgagtcaggaacaaaagttt

SEQ ID NO: 685030 - DNA, 20 bp, Artificial
  CRISPR gRNA sequence
ggaacaaaagtttgagggtt

SEQ ID NO: 685031 - DNA, 20 bp, Artificial
  CRISPR gRNA sequence
aagtttgagggtttggggtt

SEQ ID NO: 685032 - DNA, 20 bp, Artificial
  CRISPR gRNA sequence
acttgcacatgtgtctgttt

SEQ ID NO: 685033 - DNA, 20 bp, Artificial
  CRISPR gRNA sequence
gcatgctgctaccagcctgt

SEQ ID NO: 685034 - DNA, 20 bp, Artificial
  CRISPR gRNA sequence
attttattttctaaagtcta

SEQ ID NO: 685035 - DNA, 20 bp, Artificial
  CRISPR gRNA sequence
atatgacccaaaacttccat

SEQ ID NO: 685036 - DNA, 20 bp, Artificial
  CRISPR gRNA sequence
gtgttgactgattcattctc

SEQ ID NO: 685037 - DNA, 20 bp, Artificial
  CRISPR gRNA sequence
ctcttcccaactcagtcttg

SEQ ID NO: 685038 - DNA, 20 bp, Artificial
  CRISPR gRNA sequence
tcgtatgccagtgactcatc

SEQ ID NO: 685039 - DNA, 20 bp, Artificial
  CRISPR gRNA sequence
catctggagtaatctcaaca

SEQ ID NO: 685040 - DNA, 20 bp, Artificial
  CRISPR gRNA sequence
acttgctcttgattgataaa

SEQ ID NO: 685041 - DNA, 20 bp, Artificial
  CRISPR gRNA sequence
ctcttgattgataaacagaa

SEQ ID NO: 685042 - DNA, 20 bp, Artificial
  CRISPR gRNA sequence
ttgataaacagaatggggtt

SEQ ID NO: 685043 - DNA, 20 bp, Artificial
  CRISPR gRNA sequence
tttgcttccagttgttccag

SEQ ID NO: 685044 - DNA, 20 bp, Artificial
  CRISPR gRNA sequence
atcagaagaaattctttgta

SEQ ID NO: 685045 - DNA, 20 bp, Artificial
  CRISPR gRNA sequence
ctttgcatattcaaatgcag

SEQ ID NO: 685046 - DNA, 20 bp, Artificial
  CRISPR gRNA sequence
gcctgcacatgggaagtgtt

SEQ ID NO: 685047 - DNA, 20 bp, Artificial
  CRISPR gRNA sequence
tagataaggctgcttttcca

SEQ ID NO: 685048 - DNA, 20 bp, Artificial
  CRISPR gRNA sequence
ttttccattggataactgtg

SEQ ID NO: 685049 - DNA, 20 bp, Artificial
  CRISPR gRNA sequence
taatcctagaagaaaatatt

SEQ ID NO: 685050 - DNA, 20 bp, Artificial
  CRISPR gRNA sequence
gaagaaaatattgagagtat

SEQ ID NO: 685051 - DNA, 20 bp, Artificial
  CRISPR gRNA sequence
atcttttcatttgatcattt

SEQ ID NO: 685052 - DNA, 20 bp, Artificial
  CRISPR gRNA sequence
aaggaaaacctagttacacc

SEQ ID NO: 685053 - DNA, 20 bp, Artificial
  CRISPR gRNA sequence
agttaaatttataaaatgat

SEQ ID NO: 685054 - DNA, 20 bp, Artificial
  CRISPR gRNA sequence
atgatttgaataaaagtgat

SEQ ID NO: 685055 - DNA, 20 bp, Artificial
  CRISPR gRNA sequence
agtgatttggataaacttct

SEQ ID NO: 685056 - DNA, 20 bp, Artificial
  CRISPR gRNA sequence
tctagctcattctgagctat

SEQ ID NO: 685057 - DNA, 20 bp, Artificial
  CRISPR gRNA sequence
ctatttggatttacagttgc

SEQ ID NO: 685058 - DNA, 20 bp, Artificial
  CRISPR gRNA sequence
agcaattgcttacttttggc

SEQ ID NO: 685059 - DNA, 20 bp, Artificial
  CRISPR gRNA sequence
ctagcacagaaaatagtaat

SEQ ID NO: 685060 - DNA, 20 bp, Artificial
  CRISPR gRNA sequence
tggcacacacaaaatgtcaa

SEQ ID NO: 685061 - DNA, 20 bp, Artificial
  CRISPR gRNA sequence
aaatgaattaaatcaaaaag

SEQ ID NO: 685062 - DNA, 20 bp, Artificial
  CRISPR gRNA sequence
gctcatcatcatcactggta

SEQ ID NO: 685063 - DNA, 20 bp, Artificial
  CRISPR gRNA sequence
tcactggtacagagtaaact

SEQ ID NO: 685064 - DNA, 20 bp, Artificial
  CRISPR gRNA sequence
agtaattatctttattacac

SEQ ID NO: 685065 - DNA, 20 bp, Artificial
  CRISPR gRNA sequence
cattacagcagatgtagtgt

SEQ ID NO: 685066 - DNA, 20 bp, Artificial
  CRISPR gRNA sequence
aaagcaatattaagtaaagg

SEQ ID NO: 685067 - DNA, 20 bp, Artificial
  CRISPR gRNA sequence
cagtcccacattcaatagga

SEQ ID NO: 685068 - DNA, 20 bp, Artificial
  CRISPR gRNA sequence
cattcaataggactggatat

SEQ ID NO: 685069 - DNA, 20 bp, Artificial
  CRISPR gRNA sequence
tttgatgtattcaacagtat

SEQ ID NO: 685070 - DNA, 20 bp, Artificial
  CRISPR gRNA sequence
ctacaactggacagcacctc

SEQ ID NO: 685071 - DNA, 20 bp, Artificial
  CRISPR gRNA sequence
caggcagatcacttgaggcc

SEQ ID NO: 685072 - DNA, 20 bp, Artificial
  CRISPR gRNA sequence
actaaaaatataaaaatcag

SEQ ID NO: 685073 - DNA, 20 bp, Artificial
  CRISPR gRNA sequence
cagataaataaataaaagtg

SEQ ID NO: 685074 - DNA, 20 bp, Artificial
  CRISPR gRNA sequence
aagaattactgagaaggaaa

SEQ ID NO: 685075 - DNA, 20 bp, Artificial
  CRISPR gRNA sequence
ggaaatggaatttcttattt

SEQ ID NO: 685076 - DNA, 20 bp, Artificial
  CRISPR gRNA sequence
tcagaattgtcaggctcttc

SEQ ID NO: 685077 - DNA, 20 bp, Artificial
  CRISPR gRNA sequence
cgaccaggtccttcacggtc

SEQ ID NO: 685078 - DNA, 20 bp, Artificial
  CRISPR gRNA sequence
agctactgacattaatgaga

SEQ ID NO: 685079 - DNA, 20 bp, Artificial
  CRISPR gRNA sequence
gaacagcggtgcccttctgg

SEQ ID NO: 685080 - DNA, 20 bp, Artificial
  CRISPR gRNA sequence
ttttccaaagataaagcaat

SEQ ID NO: 685081 - DNA, 20 bp, Artificial
  CRISPR gRNA sequence
gctaacttaacttacttttt

SEQ ID NO: 685082 - DNA, 20 bp, Artificial
  CRISPR gRNA sequence
ttttttttctagtttggtgt

SEQ ID NO: 685083 - DNA, 20 bp, Artificial
  CRISPR gRNA sequence
ttaatctttagtaatactca

SEQ ID NO: 685084 - DNA, 20 bp, Artificial
  CRISPR gRNA sequence
tatggtgtacataaatgttg

SEQ ID NO: 685085 - DNA, 20 bp, Artificial
  CRISPR gRNA sequence
tttcaacatcatcaatggcc

SEQ ID NO: 685086 - DNA, 20 bp, Artificial
  CRISPR gRNA sequence
tcatagcttatcaatctaca

SEQ ID NO: 685087 - DNA, 20 bp, Artificial
  CRISPR gRNA sequence
cttatcaatctacaaaggat

SEQ ID NO: 685088 - DNA, 20 bp, Artificial
  CRISPR gRNA sequence
caatattggagacaaatttt

SEQ ID NO: 685089 - DNA, 20 bp, Artificial
  CRISPR gRNA sequence
cattaaataaatgagcatga

SEQ ID NO: 685090 - DNA, 20 bp, Artificial
  CRISPR gRNA sequence
taaatgagcatgaagggatg

SEQ ID NO: 685091 - DNA, 20 bp, Artificial
  CRISPR gRNA sequence
ctttcagccttagtggtcac

SEQ ID NO: 685092 - DNA, 20 bp, Artificial
  CRISPR gRNA sequence
gccttagtggtcacaggagt

SEQ ID NO: 685093 - DNA, 20 bp, Artificial
  CRISPR gRNA sequence
cgtacggggaagatttcact

SEQ ID NO: 685094 - DNA, 20 bp, Artificial
  CRISPR gRNA sequence
ctcatccatttattattttc

SEQ ID NO: 685095 - DNA, 20 bp, Artificial
  CRISPR gRNA sequence
gtcttattcttattctgtag

SEQ ID NO: 685096 - DNA, 20 bp, Artificial
  CRISPR gRNA sequence
taggtcatgtaattagtttt

SEQ ID NO: 685097 - DNA, 20 bp, Artificial
  CRISPR gRNA sequence
catgtaattagttttatggg

SEQ ID NO: 685098 - DNA, 20 bp, Artificial
  CRISPR gRNA sequence
catttgtttaagtgatatca

SEQ ID NO: 685099 - DNA, 20 bp, Artificial
  CRISPR gRNA sequence
gtgtgtgtgtgtttgtcatt

SEQ ID NO: 685100 - DNA, 20 bp, Artificial
  CRISPR gRNA sequence
tgaaaaacattgctatgaaa

SEQ ID NO: 685101 - DNA, 20 bp, Artificial
  CRISPR gRNA sequence
aaattggtaagaaaatttat

SEQ ID NO: 685102 - DNA, 20 bp, Artificial
  CRISPR gRNA sequence
ccttccatatgacccctgtt

SEQ ID NO: 685103 - DNA, 20 bp, Artificial
  CRISPR gRNA sequence
ctgttctgaattcccttagc

SEQ ID NO: 685104 - DNA, 20 bp, Artificial
  CRISPR gRNA sequence
aattagcataaggaaccttg

SEQ ID NO: 685105 - DNA, 20 bp, Artificial
  CRISPR gRNA sequence
ttcatctctatcccagagct

SEQ ID NO: 685106 - DNA, 20 bp, Artificial
  CRISPR gRNA sequence
gagcttgggatggagacctg

SEQ ID NO: 685107 - DNA, 20 bp, Artificial
  CRISPR gRNA sequence
gtagcttatggagagatgaa

SEQ ID NO: 685108 - DNA, 20 bp, Artificial
  CRISPR gRNA sequence
actagaaatcctttgtaatg

SEQ ID NO: 685109 - DNA, 20 bp, Artificial
  CRISPR gRNA sequence
taatgtggggttggtgaagg

SEQ ID NO: 685110 - DNA, 20 bp, Artificial
  CRISPR gRNA sequence
tgttagtttcccatgcagat

SEQ ID NO: 685111 - DNA, 20 bp, Artificial
  CRISPR gRNA sequence
gagctgagcttcaaacccag

SEQ ID NO: 685112 - DNA, 20 bp, Artificial
  CRISPR gRNA sequence
tgagcttcaaacccagctgg

SEQ ID NO: 685113 - DNA, 20 bp, Artificial
  CRISPR gRNA sequence
atgagggagggaggtcctgg

SEQ ID NO: 685114 - DNA, 20 bp, Artificial
  CRISPR gRNA sequence
ggttttttttttacattaaa

SEQ ID NO: 685115 - DNA, 20 bp, Artificial
  CRISPR gRNA sequence
cgcagaagttaattttattg

SEQ ID NO: 685116 - DNA, 20 bp, Artificial
  CRISPR gRNA sequence
attacagactttggtgaacc

SEQ ID NO: 685117 - DNA, 20 bp, Artificial
  CRISPR gRNA sequence
gcttgtctagacatggtttt

SEQ ID NO: 685118 - DNA, 20 bp, Artificial
  CRISPR gRNA sequence
gaatagctgacgtgaaggaa

SEQ ID NO: 685119 - DNA, 20 bp, Artificial
  CRISPR gRNA sequence
tgcagtacgactgtctggcc

SEQ ID NO: 685120 - DNA, 20 bp, Artificial
  CRISPR gRNA sequence
aagtaggaaaaatccaagta

SEQ ID NO: 685121 - DNA, 20 bp, Artificial
  CRISPR gRNA sequence
ctttctctagcaagtgtaag

SEQ ID NO: 685122 - DNA, 20 bp, Artificial
  CRISPR gRNA sequence
tctagcaagtgtaagcagaa

SEQ ID NO: 685123 - DNA, 20 bp, Artificial
  CRISPR gRNA sequence
aagagatccatcaagacaat

SEQ ID NO: 685124 - DNA, 20 bp, Artificial
  CRISPR gRNA sequence
taaaatgtgcttctcttctt

SEQ ID NO: 685125 - DNA, 20 bp, Artificial
  CRISPR gRNA sequence
tgaacactcattttgttagc

SEQ ID NO: 685126 - DNA, 20 bp, Artificial
  CRISPR gRNA sequence
atataaagaaatacctgaga

SEQ ID NO: 685127 - DNA, 20 bp, Artificial
  CRISPR gRNA sequence
acctcccaccaggctccacc

SEQ ID NO: 685128 - DNA, 20 bp, Artificial
  CRISPR gRNA sequence
caggctccacctcgaatact

SEQ ID NO: 685129 - DNA, 20 bp, Artificial
  CRISPR gRNA sequence
ggacatcatctcttccatct

SEQ ID NO: 685130 - DNA, 20 bp, Artificial
  CRISPR gRNA sequence
ctcagctaaatatttgttga

SEQ ID NO: 685131 - DNA, 20 bp, Artificial
  CRISPR gRNA sequence
aatatttgttgactgaataa

SEQ ID NO: 685132 - DNA, 20 bp, Artificial
  CRISPR gRNA sequence
ttgcttccctacagtttttt

SEQ ID NO: 685133 - DNA, 20 bp, Artificial
  CRISPR gRNA sequence
acagttttttctgaatctag

SEQ ID NO: 685134 - DNA, 20 bp, Artificial
  CRISPR gRNA sequence
aaaaggacaacatgaaactg

SEQ ID NO: 685135 - DNA, 20 bp, Artificial
  CRISPR gRNA sequence
atgaaactgatgaatcttta

SEQ ID NO: 685136 - DNA, 20 bp, Artificial
  CRISPR gRNA sequence
ggcatcacaaatagccaaag

SEQ ID NO: 685137 - DNA, 20 bp, Artificial
  CRISPR gRNA sequence
aatagccaaagcagggtgga

SEQ ID NO: 685138 - DNA, 20 bp, Artificial
  CRISPR gRNA sequence
ggtggagagagtgatccttc

SEQ ID NO: 685139 - DNA, 20 bp, Artificial
  CRISPR gRNA sequence
ttcctgggtgcaggcaagaa

SEQ ID NO: 685140 - DNA, 20 bp, Artificial
  CRISPR gRNA sequence
agaaggggatatgttttcta

SEQ ID NO: 685141 - DNA, 20 bp, Artificial
  CRISPR gRNA sequence
cccactcccttggtgtgtct

SEQ ID NO: 685142 - DNA, 20 bp, Artificial
  CRISPR gRNA sequence
atgtgcctgtcaaatagcca

SEQ ID NO: 685143 - DNA, 20 bp, Artificial
  CRISPR gRNA sequence
tagccaaagagtgttaaacc

SEQ ID NO: 685144 - DNA, 20 bp, Artificial
  CRISPR gRNA sequence
acccatgtgtgtggtatggt

SEQ ID NO: 685145 - DNA, 20 bp, Artificial
  CRISPR gRNA sequence
agaggcacaacaggaggaga

SEQ ID NO: 685146 - DNA, 20 bp, Artificial
  CRISPR gRNA sequence
acaacaggaggagaaaggat

SEQ ID NO: 685147 - DNA, 20 bp, Artificial
  CRISPR gRNA sequence
tctctgcctgaagtgctatg

SEQ ID NO: 685148 - DNA, 20 bp, Artificial
  CRISPR gRNA sequence
taagtttttcataaaataaa

SEQ ID NO: 685149 - DNA, 20 bp, Artificial
  CRISPR gRNA sequence
tataagtgccgtagtgttct

SEQ ID NO: 685150 - DNA, 20 bp, Artificial
  CRISPR gRNA sequence
tgctatgtgagggccatgct

SEQ ID NO: 685151 - DNA, 20 bp, Artificial
  CRISPR gRNA sequence
gtccctggttacctatgtgt

SEQ ID NO: 685152 - DNA, 20 bp, Artificial
  CRISPR gRNA sequence
acaaattattactactgcta

SEQ ID NO: 685153 - DNA, 20 bp, Artificial
  CRISPR gRNA sequence
actgctattgagttgtcatg

SEQ ID NO: 685154 - DNA, 20 bp, Artificial
  CRISPR gRNA sequence
ttctgaaattatagcatttc

SEQ ID NO: 685155 - DNA, 20 bp, Artificial
  CRISPR gRNA sequence
ctataatttcagaaataaaa

SEQ ID NO: 685156 - DNA, 20 bp, Artificial
  CRISPR gRNA sequence
aatttatacagttgctgaaa

SEQ ID NO: 685157 - DNA, 20 bp, Artificial
  CRISPR gRNA sequence
caatgataacgtagcaaagc

SEQ ID NO: 685158 - DNA, 20 bp, Artificial
  CRISPR gRNA sequence
caggagtacacaagggcagt

SEQ ID NO: 685159 - DNA, 20 bp, Artificial
  CRISPR gRNA sequence
gggcagtgtgagtgggcagg

SEQ ID NO: 685160 - DNA, 20 bp, Artificial
  CRISPR gRNA sequence
agtgtgagtgggcaggctgg

SEQ ID NO: 685161 - DNA, 20 bp, Artificial
  CRISPR gRNA sequence
gcaggctggatggatggctg

SEQ ID NO: 685162 - DNA, 20 bp, Artificial
  CRISPR gRNA sequence
gccctcacatagcaccttga

SEQ ID NO: 685163 - DNA, 20 bp, Artificial
  CRISPR gRNA sequence
gatggggtccacagccttcc

SEQ ID NO: 685164 - DNA, 20 bp, Artificial
  CRISPR gRNA sequence
cggcacttatagccatctac

SEQ ID NO: 685165 - DNA, 20 bp, Artificial
  CRISPR gRNA sequence
ttatgaaaaacttacaaatc

SEQ ID NO: 685166 - DNA, 20 bp, Artificial
  CRISPR gRNA sequence
ttgtgcctctctctgtgtat

SEQ ID NO: 685167 - DNA, 20 bp, Artificial
  CRISPR gRNA sequence
gcctctctctgtgtatctgg

SEQ ID NO: 685168 - DNA, 20 bp, Artificial
  CRISPR gRNA sequence
atcctaaccataccacacac

SEQ ID NO: 685169 - DNA, 20 bp, Artificial
  CRISPR gRNA sequence
cacacacatgggtgggaact

SEQ ID NO: 685170 - DNA, 20 bp, Artificial
  CRISPR gRNA sequence
acatgattgtacagcccctg

SEQ ID NO: 685171 - DNA, 20 bp, Artificial
  CRISPR gRNA sequence
tgtacagcccctgaggagtg

SEQ ID NO: 685172 - DNA, 20 bp, Artificial
  CRISPR gRNA sequence
tctctttccttccttttata

SEQ ID NO: 685173 - DNA, 20 bp, Artificial
  CRISPR gRNA sequence
acaatgcttcatatagcaaa

SEQ ID NO: 685174 - DNA, 20 bp, Artificial
  CRISPR gRNA sequence
agcaaacaggatgtctttgc

SEQ ID NO: 685175 - DNA, 20 bp, Artificial
  CRISPR gRNA sequence
gaggaaactggcaagtgctc

SEQ ID NO: 685176 - DNA, 20 bp, Artificial
  CRISPR gRNA sequence
tgcattcagagacacaccaa

SEQ ID NO: 685177 - DNA, 20 bp, Artificial
  CRISPR gRNA sequence
cacaccaagggagtggggag

SEQ ID NO: 685178 - DNA, 20 bp, Artificial
  CRISPR gRNA sequence
ccttcttgcctgcacccagg

SEQ ID NO: 685179 - DNA, 20 bp, Artificial
  CRISPR gRNA sequence
ccaattatttatatataaaa

SEQ ID NO: 685180 - DNA, 20 bp, Artificial
  CRISPR gRNA sequence
ccaaatgatgaggaaagtta

SEQ ID NO: 685181 - DNA, 20 bp, Artificial
  CRISPR gRNA sequence
gaccagtgctatgatacaaa

SEQ ID NO: 685182 - DNA, 20 bp, Artificial
  CRISPR gRNA sequence
tgatacaaacaggatgctac

SEQ ID NO: 685183 - DNA, 20 bp, Artificial
  CRISPR gRNA sequence
gagggccaagaaaggctccc

SEQ ID NO: 685184 - DNA, 20 bp, Artificial
  CRISPR gRNA sequence
ctccctggaatacgtggtac

SEQ ID NO: 685185 - DNA, 20 bp, Artificial
  CRISPR gRNA sequence
cgtggtacctgaattacatg

SEQ ID NO: 685186 - DNA, 20 bp, Artificial
  CRISPR gRNA sequence
gataatgtgtgtggtatggt

SEQ ID NO: 685187 - DNA, 20 bp, Artificial
  CRISPR gRNA sequence
gttcctgcccaaatctcatg

SEQ ID NO: 685188 - DNA, 20 bp, Artificial
  CRISPR gRNA sequence
tggagcctggtgggaggtga

SEQ ID NO: 685189 - DNA, 20 bp, Artificial
  CRISPR gRNA sequence
gtgggaggtgattggatcat

SEQ ID NO: 685190 - DNA, 20 bp, Artificial
  CRISPR gRNA sequence
gaggtgattggatcatgggg

SEQ ID NO: 685191 - DNA, 20 bp, Artificial
  CRISPR gRNA sequence
atcatgggggtgagttcatc

SEQ ID NO: 685192 - DNA, 20 bp, Artificial
  CRISPR gRNA sequence
ttgatgctgtccttgcaata

SEQ ID NO: 685193 - DNA, 20 bp, Artificial
  CRISPR gRNA sequence
cctttgctttgccttctgcc

SEQ ID NO: 685194 - DNA, 20 bp, Artificial
  CRISPR gRNA sequence
gtatttctttatatcaatgc

SEQ ID NO: 685195 - DNA, 20 bp, Artificial
  CRISPR gRNA sequence
tcttattataaagtagcacc

SEQ ID NO: 685196 - DNA, 20 bp, Artificial
  CRISPR gRNA sequence
ttaccaccctcgctaacaaa

SEQ ID NO: 685197 - DNA, 20 bp, Artificial
  CRISPR gRNA sequence
ttcacatacagtgacacaga

SEQ ID NO: 685198 - DNA, 20 bp, Artificial
  CRISPR gRNA sequence
agttcataaagttagaaaac

SEQ ID NO: 685199 - DNA, 20 bp, Artificial
  CRISPR gRNA sequence
aaggatgaccaaagaagcag

SEQ ID NO: 685200 - DNA, 20 bp, Artificial
  CRISPR gRNA sequence
tagacaaaccaacgatagga

SEQ ID NO: 685201 - DNA, 20 bp, Artificial
  CRISPR gRNA sequence
aggccattcccattgtcttg

SEQ ID NO: 685202 - DNA, 20 bp, Artificial
  CRISPR gRNA sequence
gtctcagaaacactccttac

SEQ ID NO: 685203 - DNA, 20 bp, Artificial
  CRISPR gRNA sequence
caaaccatgtgcaaggggaa

SEQ ID NO: 685204 - DNA, 20 bp, Artificial
  CRISPR gRNA sequence
tgattttgcccttcctcttg

SEQ ID NO: 685205 - DNA, 20 bp, Artificial
  CRISPR gRNA sequence
cacaggacggcagccaagaa

SEQ ID NO: 685206 - DNA, 20 bp, Artificial
  CRISPR gRNA sequence
gtttgcgttttttcctagag

SEQ ID NO: 685207 - DNA, 20 bp, Artificial
  CRISPR gRNA sequence
cattaccttcattcacccag

SEQ ID NO: 685208 - DNA, 20 bp, Artificial
  CRISPR gRNA sequence
ttcaccaaccccacattaca

SEQ ID NO: 685209 - DNA, 20 bp, Artificial
  CRISPR gRNA sequence
ttacaaaggatttctagtaa

SEQ ID NO: 685210 - DNA, 20 bp, Artificial
  CRISPR gRNA sequence
gattgccctctactagaaat

SEQ ID NO: 685211 - DNA, 20 bp, Artificial
  CRISPR gRNA sequence
ttgaagataaacatgtttta

SEQ ID NO: 685212 - DNA, 20 bp, Artificial
  CRISPR gRNA sequence
cggatctggctaccattgcc

SEQ ID NO: 685213 - DNA, 20 bp, Artificial
  CRISPR gRNA sequence
caggtctccatcccaagctc

SEQ ID NO: 685214 - DNA, 20 bp, Artificial
  CRISPR gRNA sequence
gatgcatacatgaaagcatc

SEQ ID NO: 685215 - DNA, 20 bp, Artificial
  CRISPR gRNA sequence
tgcttggggcaggtgctttc

SEQ ID NO: 685216 - DNA, 20 bp, Artificial
  CRISPR gRNA sequence
aattgcctgacccctgctaa

SEQ ID NO: 685217 - DNA, 20 bp, Artificial
  CRISPR gRNA sequence
ctgctaagggaattcagaac

SEQ ID NO: 685218 - DNA, 20 bp, Artificial
  CRISPR gRNA sequence
tcagaacaggggtcatatgg

SEQ ID NO: 685219 - DNA, 20 bp, Artificial
  CRISPR gRNA sequence
atataaatattaggagagca

SEQ ID NO: 685220 - DNA, 20 bp, Artificial
  CRISPR gRNA sequence
gttagaaaactactcttcta

SEQ ID NO: 685221 - DNA, 20 bp, Artificial
  CRISPR gRNA sequence
aaactactcttctacagaat

SEQ ID NO: 685222 - DNA, 20 bp, Artificial
  CRISPR gRNA sequence
aagacccatgaaaataataa

SEQ ID NO: 685223 - DNA, 20 bp, Artificial
  CRISPR gRNA sequence
cccatgaaaataataaatgg

SEQ ID NO: 685224 - DNA, 20 bp, Artificial
  CRISPR gRNA sequence
atttgctcgcagttctccac

SEQ ID NO: 685225 - DNA, 20 bp, Artificial
  CRISPR gRNA sequence
tcagtgaaatcttccccgta

SEQ ID NO: 685226 - DNA, 20 bp, Artificial
  CRISPR gRNA sequence
gtgtgattaaggaccactgt

SEQ ID NO: 685227 - DNA, 20 bp, Artificial
  CRISPR gRNA sequence
aaacagaaagaggcactgat

SEQ ID NO: 685228 - DNA, 20 bp, Artificial
  CRISPR gRNA sequence
tgatgcttattttacagcgg

SEQ ID NO: 685229 - DNA, 20 bp, Artificial
  CRISPR gRNA sequence
taacttggaaaacacatttt

SEQ ID NO: 685230 - DNA, 20 bp, Artificial
  CRISPR gRNA sequence
acaaagcctctcattagact

SEQ ID NO: 685231 - DNA, 20 bp, Artificial
  CRISPR gRNA sequence
ctcattagactttgaatcca

SEQ ID NO: 685232 - DNA, 20 bp, Artificial
  CRISPR gRNA sequence
ggaaaattaagtcacaaaaa

SEQ ID NO: 685233 - DNA, 20 bp, Artificial
  CRISPR gRNA sequence
aataaagaacagatgtggct

SEQ ID NO: 685234 - DNA, 20 bp, Artificial
  CRISPR gRNA sequence
aacctctttgcgtcatagtt

SEQ ID NO: 685235 - DNA, 20 bp, Artificial
  CRISPR gRNA sequence
tttatttatttatctgttga

SEQ ID NO: 685236 - DNA, 20 bp, Artificial
  CRISPR gRNA sequence
agaatgtttgttgcctaggc

SEQ ID NO: 685237 - DNA, 20 bp, Artificial
  CRISPR gRNA sequence
tgtttgttgcctaggctgga

SEQ ID NO: 685238 - DNA, 20 bp, Artificial
  CRISPR gRNA sequence
acctcagcctcccaagctgc

SEQ ID NO: 685239 - DNA, 20 bp, Artificial
  CRISPR gRNA sequence
ttttatatttttagtagaga

SEQ ID NO: 685240 - DNA, 20 bp, Artificial
  CRISPR gRNA sequence
gccttggcctcccaaagtgc

SEQ ID NO: 685241 - DNA, 20 bp, Artificial
  CRISPR gRNA sequence
aatggtaggacaataaattt

SEQ ID NO: 685242 - DNA, 20 bp, Artificial
  CRISPR gRNA sequence
tttttctgatccagatactg

SEQ ID NO: 685243 - DNA, 20 bp, Artificial
  CRISPR gRNA sequence
cattcgcatatccagtccta

SEQ ID NO: 685244 - DNA, 20 bp, Artificial
  CRISPR gRNA sequence
aaaataagtcagacaattaa

SEQ ID NO: 685245 - DNA, 20 bp, Artificial
  CRISPR gRNA sequence
taaaaataaacattaaaatc

SEQ ID NO: 685246 - DNA, 20 bp, Artificial
  CRISPR gRNA sequence
aaagataattactatttatt

SEQ ID NO: 685247 - DNA, 20 bp, Artificial
  CRISPR gRNA sequence
cagttaactagtggcagagc

SEQ ID NO: 685248 - DNA, 20 bp, Artificial
  CRISPR gRNA sequence
aactgtaaatccaaatagct

SEQ ID NO: 685249 - DNA, 20 bp, Artificial
  CRISPR gRNA sequence
gttccagaaaggactaggga

SEQ ID NO: 685250 - DNA, 20 bp, Artificial
  CRISPR gRNA sequence
aaccactgaagaaaggggag

SEQ ID NO: 685251 - DNA, 20 bp, Artificial
  CRISPR gRNA sequence
gacaatacaggtataaatac

SEQ ID NO: 685252 - DNA, 20 bp, Artificial
  CRISPR gRNA sequence
gcaaacacacgatttctttc

SEQ ID NO: 685253 - DNA, 20 bp, Artificial
  CRISPR gRNA sequence
acacgatttctttcctgagt

SEQ ID NO: 685254 - DNA, 20 bp, Artificial
  CRISPR gRNA sequence
gggaatacttttgtttgttt

SEQ ID NO: 685255 - DNA, 20 bp, Artificial
  CRISPR gRNA sequence
atactctcaatattttcttc

SEQ ID NO: 685256 - DNA, 20 bp, Artificial
  CRISPR gRNA sequence
tatactgtgataccttggga

SEQ ID NO: 685257 - DNA, 20 bp, Artificial
  CRISPR gRNA sequence
agatctcttatgaaatgtta

SEQ ID NO: 685258 - DNA, 20 bp, Artificial
  CRISPR gRNA sequence
cacattaaattctgctgcat

SEQ ID NO: 685259 - DNA, 20 bp, Artificial
  CRISPR gRNA sequence
ctgatgatatattcattaca

SEQ ID NO: 685260 - DNA, 20 bp, Artificial
  CRISPR gRNA sequence
cttactaaactttgctgctg

SEQ ID NO: 685261 - DNA, 20 bp, Artificial
  CRISPR gRNA sequence
tttgctgctgtggaatacat

SEQ ID NO: 685262 - DNA, 20 bp, Artificial
  CRISPR gRNA sequence
gtggaatacatgagaattgt

SEQ ID NO: 685263 - DNA, 20 bp, Artificial
  CRISPR gRNA sequence
cgttgttgagattactccag

SEQ ID NO: 685264 - DNA, 20 bp, Artificial
  CRISPR gRNA sequence
gttggtgatactcttcaaga

SEQ ID NO: 685265 - DNA, 20 bp, Artificial
  CRISPR gRNA sequence
ctcttcaagactgagttggg

SEQ ID NO: 685266 - DNA, 20 bp, Artificial
  CRISPR gRNA sequence
aagttagacaaaaccataaa

SEQ ID NO: 685267 - DNA, 20 bp, Artificial
  CRISPR gRNA sequence
actttctcagcaccacccag

SEQ ID NO: 685268 - DNA, 20 bp, Artificial
  CRISPR gRNA sequence
tctcagcaccacccaggaga

SEQ ID NO: 685269 - DNA, 20 bp, Artificial
  CRISPR gRNA sequence
cacttattcctatggaagtt

SEQ ID NO: 685270 - DNA, 20 bp, Artificial
  CRISPR gRNA sequence
ttatatttcaccagtctcat

SEQ ID NO: 685271 - DNA, 20 bp, Artificial
  CRISPR gRNA sequence
agaaactaaattaagaagga

SEQ ID NO: 685272 - DNA, 20 bp, Artificial
  CRISPR gRNA sequence
taaattaagaaggaaagaat

SEQ ID NO: 685273 - DNA, 20 bp, Artificial
  CRISPR gRNA sequence
tagtcatcacaaagcaacta

SEQ ID NO: 685274 - DNA, 20 bp, Artificial
  CRISPR gRNA sequence
tcctgactcagcttgttccc

SEQ ID NO: 685275 - DNA, 20 bp, Artificial
  CRISPR gRNA sequence
ggagtcaccaaaggctttct

SEQ ID NO: 685276 - DNA, 20 bp, Artificial
  CRISPR gRNA sequence
ctaagagtagttgaaggtct

SEQ ID NO: 685277 - DNA, 20 bp, Artificial
  CRISPR gRNA sequence
ttttcttaaaatataagggg

SEQ ID NO: 685278 - DNA, 20 bp, Artificial
  CRISPR gRNA sequence
acataaagataaacacaatc

SEQ ID NO: 685279 - DNA, 20 bp, Artificial
  CRISPR gRNA sequence
tacccaaactgaaagacaga

SEQ ID NO: 685280 - DNA, 20 bp, Artificial
  CRISPR gRNA sequence
aaagacagaggggatgaact

SEQ ID NO: 685281 - DNA, 20 bp, Artificial
  CRISPR gRNA sequence
ttggagtcagtgacggagct

SEQ ID NO: 685282 - DNA, 20 bp, Artificial
  CRISPR gRNA sequence
accagcatttttgaacaagt

SEQ ID NO: 685283 - DNA, 20 bp, Artificial
  CRISPR gRNA sequence
caagttcatcccctctgtct

SEQ ID NO: 685284 - DNA, 20 bp, Artificial
  CRISPR gRNA sequence
ataagaaaagtcttcataat

SEQ ID NO: 685285 - DNA, 20 bp, Artificial
  CRISPR gRNA sequence
aaagtcttcataattcatga

SEQ ID NO: 685286 - DNA, 20 bp, Artificial
  CRISPR gRNA sequence
aagaaaagaagtaagaaagt

SEQ ID NO: 685287 - DNA, 20 bp, Artificial
  CRISPR gRNA sequence
gaacaagctgagtcaggaac

SEQ ID NO: 685288 - DNA, 20 bp, Artificial
  CRISPR gRNA sequence
tgagtcaggaacaaaagttt

SEQ ID NO: 685289 - DNA, 20 bp, Artificial
  CRISPR gRNA sequence
gaataggacaattacttggc

SEQ ID NO: 685290 - DNA, 20 bp, Artificial
  CRISPR gRNA sequence
tggctaatgctttagtctag

SEQ ID NO: 685291 - DNA, 20 bp, Artificial
  CRISPR gRNA sequence
ttctgattttgctactcctt

SEQ ID NO: 685292 - DNA, 20 bp, Artificial
  CRISPR gRNA sequence
tgatgactacttgcacatgt

SEQ ID NO: 685293 - DNA, 20 bp, Artificial
  CRISPR gRNA sequence
taccagcctgtgtggatgtc

SEQ ID NO: 685294 - DNA, 20 bp, Artificial
  CRISPR gRNA sequence
ttctaaagtctactgaattt

SEQ ID NO: 685295 - DNA, 20 bp, Artificial
  CRISPR gRNA sequence
tcatattctttccttcttaa

SEQ ID NO: 685296 - DNA, 20 bp, Artificial
  CRISPR gRNA sequence
aacttccataggaataagtg

SEQ ID NO: 685297 - DNA, 20 bp, Artificial
  CRISPR gRNA sequence
gcacttaataaatatgtgtt

SEQ ID NO: 685298 - DNA, 20 bp, Artificial
  CRISPR gRNA sequence
aaaatcatggctgataaaaa

SEQ ID NO: 685299 - DNA, 20 bp, Artificial
  CRISPR gRNA sequence
tggctgataaaaattctgtt

SEQ ID NO: 685300 - DNA, 20 bp, Artificial
  CRISPR gRNA sequence
aacgagttaccaatacttgc

SEQ ID NO: 685301 - DNA, 20 bp, Artificial
  CRISPR gRNA sequence
ctcttgattgataaacagaa

SEQ ID NO: 685302 - DNA, 20 bp, Artificial
  CRISPR gRNA sequence
tctcatgtattccacagcag

SEQ ID NO: 685303 - DNA, 20 bp, Artificial
  CRISPR gRNA sequence
aataatttcaagaacattta

SEQ ID NO: 685304 - DNA, 20 bp, Artificial
  CRISPR gRNA sequence
agaacatttaccttgtttta

SEQ ID NO: 685305 - DNA, 20 bp, Artificial
  CRISPR gRNA sequence
catttaccttgttttaagca

SEQ ID NO: 685306 - DNA, 20 bp, Artificial
  CRISPR gRNA sequence
gaattgtaaactgaaaaata

SEQ ID NO: 685307 - DNA, 20 bp, Artificial
  CRISPR gRNA sequence
ttctttgtaatgaatatatc

SEQ ID NO: 685308 - DNA, 20 bp, Artificial
  CRISPR gRNA sequence
tgtaatgaatatatcatcag

SEQ ID NO: 685309 - DNA, 20 bp, Artificial
  CRISPR gRNA sequence
ctgcacatgggaagtgttgt

SEQ ID NO: 685310 - DNA, 20 bp, Artificial
  CRISPR gRNA sequence
tggatgtttattgactgaca

SEQ ID NO: 685311 - DNA, 20 bp, Artificial
  CRISPR gRNA sequence
tgtttattgactgacacaca

SEQ ID NO: 685312 - DNA, 20 bp, Artificial
  CRISPR gRNA sequence
cagtttgtttagatagataa

SEQ ID NO: 685313 - DNA, 20 bp, Artificial
  CRISPR gRNA sequence
cttttccattggataactgt

SEQ ID NO: 685314 - DNA, 20 bp, Artificial
  CRISPR gRNA sequence
ccaaggtatcacagtatatg

SEQ ID NO: 685315 - DNA, 20 bp, Artificial
  CRISPR gRNA sequence
gatcttttcatttgatcatt

SEQ ID NO: 685316 - DNA, 20 bp, Artificial
  CRISPR gRNA sequence
caatcatggggcctggaaaa

SEQ ID NO: 685317 - DNA, 20 bp, Artificial
  CRISPR gRNA sequence
caaggaaaacctagttacac

SEQ ID NO: 685318 - DNA, 20 bp, Artificial
  CRISPR gRNA sequence
tcccactcaggaaagaaatc

SEQ ID NO: 685319 - DNA, 20 bp, Artificial
  CRISPR gRNA sequence
gtttgcctcaggccaacttc

SEQ ID NO: 685320 - DNA, 20 bp, Artificial
  CRISPR gRNA sequence
aagtttctaccagctgcagt

SEQ ID NO: 685321 - DNA, 20 bp, Artificial
  CRISPR gRNA sequence
cctgctcccctttcttcagt

SEQ ID NO: 685322 - DNA, 20 bp, Artificial
  CRISPR gRNA sequence
tggttgattgcctgagctgc

SEQ ID NO: 685323 - DNA, 20 bp, Artificial
  CRISPR gRNA sequence
ctggaacagttaaatttata

SEQ ID NO: 685324 - DNA, 20 bp, Artificial
  CRISPR gRNA sequence
ttataaaatgatttgaataa

SEQ ID NO: 685325 - DNA, 20 bp, Artificial
  CRISPR gRNA sequence
gtctagctcattctgagcta

SEQ ID NO: 685326 - DNA, 20 bp, Artificial
  CRISPR gRNA sequence
gctatttggatttacagttg

SEQ ID NO: 685327 - DNA, 20 bp, Artificial
  CRISPR gRNA sequence
tttggatttacagttgcagg

SEQ ID NO: 685328 - DNA, 20 bp, Artificial
  CRISPR gRNA sequence
gtagctgacttagagaaaaa

SEQ ID NO: 685329 - DNA, 20 bp, Artificial
  CRISPR gRNA sequence
tgaccaagataactgagagc

SEQ ID NO: 685330 - DNA, 20 bp, Artificial
  CRISPR gRNA sequence
agcacagaaaatagtaatct

SEQ ID NO: 685331 - DNA, 20 bp, Artificial
  CRISPR gRNA sequence
ggggcctctagtaggtgaaa

SEQ ID NO: 685332 - DNA, 20 bp, Artificial
  CRISPR gRNA sequence
agttaagccacagaaggctg

SEQ ID NO: 685333 - DNA, 20 bp, Artificial
  CRISPR gRNA sequence
acttttgttcacaaattgtt

SEQ ID NO: 685334 - DNA, 20 bp, Artificial
  CRISPR gRNA sequence
tgttcacaaattgttaaatg

SEQ ID NO: 685335 - DNA, 20 bp, Artificial
  CRISPR gRNA sequence
agcaagttacttctctgccc

SEQ ID NO: 685336 - DNA, 20 bp, Artificial
  CRISPR gRNA sequence
tagtaattatctttattaca

SEQ ID NO: 685337 - DNA, 20 bp, Artificial
  CRISPR gRNA sequence
tgttagggctactatggggg

SEQ ID NO: 685338 - DNA, 20 bp, Artificial
  CRISPR gRNA sequence
taacaaaaaagtatttaaac

SEQ ID NO: 685339 - DNA, 20 bp, Artificial
  CRISPR gRNA sequence
agtatttaaactctagattt

SEQ ID NO: 685340 - DNA, 20 bp, Artificial
  CRISPR gRNA sequence
aaataaccattatgtatatt

SEQ ID NO: 685341 - DNA, 20 bp, Artificial
  CRISPR gRNA sequence
aatattaagtaaaggctgaa

SEQ ID NO: 685342 - DNA, 20 bp, Artificial
  CRISPR gRNA sequence
gtcaccatatataaaaaaca

SEQ ID NO: 685343 - DNA, 20 bp, Artificial
  CRISPR gRNA sequence
aaacaatcagattgcaatgt

SEQ ID NO: 685344 - DNA, 20 bp, Artificial
  CRISPR gRNA sequence
caactggacagcacctcttg

SEQ ID NO: 685345 - DNA, 20 bp, Artificial
  CRISPR gRNA sequence
caggcagatcacttgaggcc

SEQ ID NO: 685346 - DNA, 20 bp, Artificial
  CRISPR gRNA sequence
tggcacacacctgtaatccc

SEQ ID NO: 685347 - DNA, 20 bp, Artificial
  CRISPR gRNA sequence
aaggcagaggttacagcgag

SEQ ID NO: 685348 - DNA, 20 bp, Artificial
  CRISPR gRNA sequence
aatgtgatgactgaggacgc

SEQ ID NO: 685349 - DNA, 20 bp, Artificial
  CRISPR gRNA sequence
gaacagcggtgcccttctgg

SEQ ID NO: 685350 - DNA, 20 bp, Artificial
  CRISPR gRNA sequence
cattctgaactatgacgcaa

SEQ ID NO: 685351 - DNA, 20 bp, Artificial
  CRISPR gRNA sequence
gaggttttctgaacacacta

SEQ ID NO: 685352 - DNA, 20 bp, Artificial
  CRISPR gRNA sequence
acaactatttggagagcaaa

SEQ ID NO: 685353 - DNA, 20 bp, Artificial
  CRISPR gRNA sequence
accagctttttttttttttt

SEQ ID NO: 685354 - DNA, 20 bp, Artificial
  CRISPR gRNA sequence
ttttttttctagtttggtgt

SEQ ID NO: 685355 - DNA, 20 bp, Artificial
  CRISPR gRNA sequence
agagtttctgcaaattaaaa

SEQ ID NO: 685356 - DNA, 20 bp, Artificial
  CRISPR gRNA sequence
cttaatctttagtaatactc

SEQ ID NO: 685357 - DNA, 20 bp, Artificial
  CRISPR gRNA sequence
attggattcaaagtctaatg

SEQ ID NO: 685358 - DNA, 20 bp, Artificial
  CRISPR gRNA sequence
ggtgtacataaatgttgtcg

SEQ ID NO: 685359 - DNA, 20 bp, Artificial
  CRISPR gRNA sequence
gttgtcgagtggtttttaat

SEQ ID NO: 685360 - DNA, 20 bp, Artificial
  CRISPR gRNA sequence
taagtcacttcattctaaaa

SEQ ID NO: 685361 - DNA, 20 bp, Artificial
  CRISPR gRNA sequence
caagttattttaaattttat

SEQ ID NO: 685362 - DNA, 20 bp, Artificial
  CRISPR gRNA sequence
ttataaaagcttatttaagg

SEQ ID NO: 685363 - DNA, 20 bp, Artificial
  CRISPR gRNA sequence
taagggaaagatttcacaat

SEQ ID NO: 685364 - DNA, 20 bp, Artificial
  CRISPR gRNA sequence
atcatagcttatcaatctac

SEQ ID NO: 685365 - DNA, 20 bp, Artificial
  CRISPR gRNA sequence
gtaatagcccctttacgtat

SEQ ID NO: 685366 - DNA, 20 bp, Artificial
  CRISPR gRNA sequence
caatattggagacaaatttt

SEQ ID NO: 685367 - DNA, 20 bp, Artificial
  CRISPR gRNA sequence
acattcctatcagtgcctct

SEQ ID NO: 685368 - DNA, 20 bp, Artificial
  CRISPR gRNA sequence
ataaatgagcatgaagggat

SEQ ID NO: 685369 - DNA, 20 bp, Artificial
  CRISPR gRNA sequence
ggagtcagaattccgtacgg

SEQ ID NO: 685370 - DNA, 20 bp, Artificial
  CRISPR gRNA sequence
ttattcttattctgtagaag

SEQ ID NO: 685371 - DNA, 20 bp, Artificial
  CRISPR gRNA sequence
aacaactactaggtcatgta

SEQ ID NO: 685372 - DNA, 20 bp, Artificial
  CRISPR gRNA sequence
gttttatgggttggatctgc

SEQ ID NO: 685373 - DNA, 20 bp, Artificial
  CRISPR gRNA sequence
gagcatcataggtaataaaa

SEQ ID NO: 685374 - DNA, 20 bp, Artificial
  CRISPR gRNA sequence
aaagttttatttaagtgcct

SEQ ID NO: 685375 - DNA, 20 bp, Artificial
  CRISPR gRNA sequence
gtgtgtgtgtgtgtgtgtgt

SEQ ID NO: 685376 - DNA, 20 bp, Artificial
  CRISPR gRNA sequence
tagaatagaaacatgaaaat

SEQ ID NO: 685377 - DNA, 20 bp, Artificial
  CRISPR gRNA sequence
ctttttgtctttaagatgag

SEQ ID NO: 685378 - DNA, 20 bp, Artificial
  CRISPR gRNA sequence
ttaagatgagcaaggctttt

SEQ ID NO: 685379 - DNA, 20 bp, Artificial
  CRISPR gRNA sequence
gaacagggacacagcaattg

SEQ ID NO: 685380 - DNA, 20 bp, Artificial
  CRISPR gRNA sequence
acagcaattgcagtgtttac

SEQ ID NO: 685381 - DNA, 20 bp, Artificial
  CRISPR gRNA sequence
ttattgtactttgtaattca

SEQ ID NO: 685382 - DNA, 20 bp, Artificial
  CRISPR gRNA sequence
tttcatcttcatctctatcc

SEQ ID NO: 685383 - DNA, 20 bp, Artificial
  CRISPR gRNA sequence
tggtagccagatccggtaaa

SEQ ID NO: 685384 - DNA, 20 bp, Artificial
  CRISPR gRNA sequence
taaaacatgtttatcttcaa

SEQ ID NO: 685385 - DNA, 20 bp, Artificial
  CRISPR gRNA sequence
aaggcagaatcattggcctt

SEQ ID NO: 685386 - DNA, 20 bp, Artificial
  CRISPR gRNA sequence
agatgagaatatagtgggag

SEQ ID NO: 685387 - DNA, 20 bp, Artificial
  CRISPR gRNA sequence
ggtgcatactaagtgttcag

SEQ ID NO: 685388 - DNA, 20 bp, Artificial
  CRISPR gRNA sequence
aaaaacgcaaacctaacttg

SEQ ID NO: 685389 - DNA, 20 bp, Artificial
  CRISPR gRNA sequence
acgcaaacctaacttgctct

SEQ ID NO: 685390 - DNA, 20 bp, Artificial
  CRISPR gRNA sequence
gttcttggctgccgtcctgt

SEQ ID NO: 685391 - DNA, 20 bp, Artificial
  CRISPR gRNA sequence
accatcctcttccccttgca

SEQ ID NO: 685392 - DNA, 20 bp, Artificial
  CRISPR gRNA sequence
agtaggcattaaaagtaaca

SEQ ID NO: 685393 - DNA, 20 bp, Artificial
  CRISPR gRNA sequence
taaaagtaacaggttgcttt

SEQ ID NO: 685394 - DNA, 20 bp, Artificial
  CRISPR gRNA sequence
tttcttagtttcagcaatgg

SEQ ID NO: 685395 - DNA, 20 bp, Artificial
  CRISPR gRNA sequence
aatgggctggcttgtctaga

SEQ ID NO: 685396 - DNA, 20 bp, Artificial
  CRISPR gRNA sequence
agaatagctgacgtgaagga

SEQ ID NO: 685397 - DNA, 20 bp, Artificial
  CRISPR gRNA sequence
actgtctggccctgaatttg

SEQ ID NO: 685398 - DNA, 20 bp, Artificial
  CRISPR gRNA sequence
gtaggaaaaatccaagtaag

SEQ ID NO: 685399 - DNA, 20 bp, Artificial
  CRISPR gRNA sequence
ggaatggcctgtgccataaa

SEQ ID NO: 685400 - DNA, 20 bp, Artificial
  CRISPR gRNA sequence
tgtgcttctcttcttcggga

SEQ ID NO: 685401 - DNA, 20 bp, Artificial
  CRISPR gRNA sequence
gtctgatctttgtagactgt

SEQ ID NO: 685402 - DNA, 20 bp, Artificial
  CRISPR gRNA sequence
gtagactgttcctgtttgct

SEQ ID NO: 685403 - DNA, 20 bp, Artificial
  CRISPR gRNA sequence
ctgtttgctgggagcttctc

SEQ ID NO: 685404 - DNA, 20 bp, Artificial
  CRISPR gRNA sequence
ctcccccactccctcctatc

SEQ ID NO: 685405 - DNA, 20 bp, Artificial
  CRISPR gRNA sequence
ttggtttgtctagaacactc

SEQ ID NO: 685406 - DNA, 20 bp, Artificial
  CRISPR gRNA sequence
tcagctgcttctttggtcat

SEQ ID NO: 685407 - DNA, 20 bp, Artificial
  CRISPR gRNA sequence
ataaagaaatacctgagact

SEQ ID NO: 685408 - DNA, 20 bp, Artificial
  CRISPR gRNA sequence
actgggtgatttatatgaaa

SEQ ID NO: 685409 - DNA, 20 bp, Artificial
  CRISPR gRNA sequence
tgtatgggaagcatggcggc

SEQ ID NO: 685410 - DNA, 20 bp, Artificial
  CRISPR gRNA sequence
tctgcttctggggacacctc

SEQ ID NO: 685411 - DNA, 20 bp, Artificial
  CRISPR gRNA sequence
ccaggctccacctcgaatac

SEQ ID NO: 685412 - DNA, 20 bp, Artificial
  CRISPR gRNA sequence
actggggattaccattcagc

SEQ ID NO: 685413 - DNA, 20 bp, Artificial
  CRISPR gRNA sequence
ccagggagcctttcttggcc

SEQ ID NO: 685414 - DNA, 20 bp, Artificial
  CRISPR gRNA sequence
ttccaagtactcttgtagca

SEQ ID NO: 685415 - DNA, 20 bp, Artificial
  CRISPR gRNA sequence
ggtcacattgccttacctaa

SEQ ID NO: 685416 - DNA, 20 bp, Artificial
  CRISPR gRNA sequence
acaaccaaattattgatacc

SEQ ID NO: 685417 - DNA, 20 bp, Artificial
  CRISPR gRNA sequence
acaaaatactatttttatat

SEQ ID NO: 685418 - DNA, 20 bp, Artificial
  CRISPR gRNA sequence
cctcatcatttggaaagtca

SEQ ID NO: 685419 - DNA, 20 bp, Artificial
  CRISPR gRNA sequence
atttggaaagtcaaattgtt

SEQ ID NO: 685420 - DNA, 20 bp, Artificial
  CRISPR gRNA sequence
caaattgtttattgcttccc

SEQ ID NO: 685421 - DNA, 20 bp, Artificial
  CRISPR gRNA sequence
tacagttttttctgaatcta

SEQ ID NO: 685422 - DNA, 20 bp, Artificial
  CRISPR gRNA sequence
tgggtgcaggcaagaagggg

SEQ ID NO: 685423 - DNA, 20 bp, Artificial
  CRISPR gRNA sequence
agaaggggatatgttttcta

SEQ ID NO: 685424 - DNA, 20 bp, Artificial
  CRISPR gRNA sequence
ataaagctgtctacaagtca

SEQ ID NO: 685425 - DNA, 20 bp, Artificial
  CRISPR gRNA sequence
aatgcaatgttgtcttggaa

SEQ ID NO: 685426 - DNA, 20 bp, Artificial
  CRISPR gRNA sequence
catttcactcctgagcactt

SEQ ID NO: 685427 - DNA, 20 bp, Artificial
  CRISPR gRNA sequence
cacatatccaggcaaagaca

SEQ ID NO: 685428 - DNA, 20 bp, Artificial
  CRISPR gRNA sequence
gggctgtacaatcatgtaga

SEQ ID NO: 685429 - DNA, 20 bp, Artificial
  CRISPR gRNA sequence
cacccatgtgtgtggtatgg

SEQ ID NO: 685430 - DNA, 20 bp, Artificial
  CRISPR gRNA sequence
tctctgcctgaagtgctatg

SEQ ID NO: 685431 - DNA, 20 bp, Artificial
  CRISPR gRNA sequence
gaagtgctatgtggggtttt

SEQ ID NO: 685432 - DNA, 20 bp, Artificial
  CRISPR gRNA sequence
gttttaattttgactttaac

SEQ ID NO: 685433 - DNA, 20 bp, Artificial
  CRISPR gRNA sequence
ttgactttaacccctgattt

SEQ ID NO: 685434 - DNA, 20 bp, Artificial
  CRISPR gRNA sequence
atcaaggtgctatgtgaggg

SEQ ID NO: 685435 - DNA, 20 bp, Artificial
  CRISPR gRNA sequence
ctcacactgcccttgtgtac

SEQ ID NO: 685436 - DNA, 20 bp, Artificial
  CRISPR gRNA sequence
atcaatgtccctggttacct

SEQ ID NO: 685437 - DNA, 20 bp, Artificial
  CRISPR gRNA sequence
ttgaattatcttcgtgttac

SEQ ID NO: 685438 - DNA, 20 bp, Artificial
  CRISPR gRNA sequence
atcttcgtgttacaggtgtt

SEQ ID NO: 685439 - DNA, 20 bp, Artificial
  CRISPR gRNA sequence
tgtttaatgattttgctcct

SEQ ID NO: 685440 - DNA, 20 bp, Artificial
  CRISPR gRNA sequence
ttctagcttatttgtatttc

SEQ ID NO: 685441 - DNA, 20 bp, Artificial
  CRISPR gRNA sequence
tttaaatcaacatggttaca

SEQ ID NO: 685442 - DNA, 20 bp, Artificial
  CRISPR gRNA sequence
aaaatggagacataggcctt

SEQ ID NO: 685443 - DNA, 20 bp, Artificial
  CRISPR gRNA sequence
tcaatagcagtagtaataat

SEQ ID NO: 685444 - DNA, 20 bp, Artificial
  CRISPR gRNA sequence
gctgaaacagagtgtaacca

SEQ ID NO: 685445 - DNA, 20 bp, Artificial
  CRISPR gRNA sequence
cttatagccatctacatgag

SEQ ID NO: 685446 - DNA, 20 bp, Artificial
  CRISPR gRNA sequence
gccatctacatgagttatga

SEQ ID NO: 685447 - DNA, 20 bp, Artificial
  CRISPR gRNA sequence
gcacttcaggcagagacctg

SEQ ID NO: 685448 - DNA, 20 bp, Artificial
  CRISPR gRNA sequence
cacacacatgggtgggaact

SEQ ID NO: 685449 - DNA, 20 bp, Artificial
  CRISPR gRNA sequence
aggcacattaaacaatttct

SEQ ID NO: 685450 - DNA, 20 bp, Artificial
  CRISPR gRNA sequence
ccttccttttatacgggata

SEQ ID NO: 685451 - DNA, 20 bp, Artificial
  CRISPR gRNA sequence
ctggcaagtgctcaggagtg

SEQ ID NO: 685452 - DNA, 20 bp, Artificial
  CRISPR gRNA sequence
caggagtgaaatgcttggaa

SEQ ID NO: 685453 - DNA, 20 bp, Artificial
  CRISPR gRNA sequence
tgggaagagcacttcatctc

SEQ ID NO: 685454 - DNA, 20 bp, Artificial
  CRISPR gRNA sequence
aaaaagcacaatgacttgta

SEQ ID NO: 685455 - DNA, 20 bp, Artificial
  CRISPR gRNA sequence
tgacttgtagacagctttat

SEQ ID NO: 685456 - DNA, 20 bp, Artificial
  CRISPR gRNA sequence
aggaaggatcactctctcca

SEQ ID NO: 685457 - DNA, 20 bp, Artificial
  CRISPR gRNA sequence
aaaaagaatgttacattttt

SEQ ID NO: 685458 - DNA, 20 bp, Artificial
  CRISPR gRNA sequence
agtgtctgaaattaacccaa

SEQ ID NO: 685459 - DNA, 20 bp, Artificial
  CRISPR gRNA sequence
aattaacccaataaagattc

SEQ ID NO: 685460 - DNA, 20 bp, Artificial
  CRISPR gRNA sequence
aatgatatcattaaaatcct

SEQ ID NO: 685461 - DNA, 20 bp, Artificial
  CRISPR gRNA sequence
agatgatgtccctgccctca

SEQ ID NO: 685462 - DNA, 20 bp, Artificial
  CRISPR gRNA sequence
tcgtgttgagcagactgtca

SEQ ID NO: 685463 - DNA, 20 bp, Artificial
  CRISPR gRNA sequence
catgtaccttaaatacttta

SEQ ID NO: 685464 - DNA, 20 bp, Artificial
  CRISPR gRNA sequence
aacaatgataatgtgtgtgg

SEQ ID NO: 685465 - DNA, 20 bp, Artificial
  CRISPR gRNA sequence
tcgaggtggagcctggtggg

SEQ ID NO: 685466 - DNA, 20 bp, Artificial
  CRISPR gRNA sequence
atgggggtgagttcatcatg

SEQ ID NO: 685467 - DNA, 20 bp, Artificial
  CRISPR gRNA sequence
agtgacttctcatgagatct

SEQ ID NO: 685468 - DNA, 20 bp, Artificial
  CRISPR gRNA sequence
gtgtggcacctctctctcgc

SEQ ID NO: 685469 - DNA, 20 bp, Artificial
  CRISPR gRNA sequence
ttactgtgtgaagtgcctgc

SEQ ID NO: 685470 - DNA, 20 bp, Artificial
  CRISPR gRNA sequence
gtccccagaagcagatgccg

SEQ ID NO: 685471 - DNA, 20 bp, Artificial
  CRISPR gRNA sequence
gtcttattataaagtagcac

SEQ ID NO: 685472 - DNA, 20 bp, Artificial
  CRISPR gRNA sequence
gattttctcactgaaatggc

SEQ ID NO: 685473 - DNA, 20 bp, Artificial
  CRISPR gRNA sequence
agaaaaaggtatagaacgga

SEQ ID NO: 685474 - DNA, 20 bp, Artificial
  CRISPR gRNA sequence
aaagagcacaaaagaacacg

SEQ ID NO: 685475 - DNA, 20 bp, Artificial
  CRISPR gRNA sequence
tctcttggaaccacactcca

SEQ ID NO: 685476 - DNA, 20 bp, Artificial
  CRISPR gRNA sequence
agtctcagaaacactcctta

SEQ ID NO: 685477 - DNA, 20 bp, Artificial
  CRISPR gRNA sequence
tctcttcaatataaaaatac

SEQ ID NO: 685478 - DNA, 20 bp, Artificial
  CRISPR gRNA sequence
tccaaaacaagcagagcaag

SEQ ID NO: 685479 - DNA, 20 bp, Artificial
  CRISPR gRNA sequence
acaagcagagcaagttaggt

SEQ ID NO: 685480 - DNA, 20 bp, Artificial
  CRISPR gRNA sequence
tatgtcctctcttgcctcct

SEQ ID NO: 685481 - DNA, 20 bp, Artificial
  CRISPR gRNA sequence
cattaccttcattcacccag

SEQ ID NO: 685482 - DNA, 20 bp, Artificial
  CRISPR gRNA sequence
gcatgggaaactaacaaggc

SEQ ID NO: 685483 - DNA, 20 bp, Artificial
  CRISPR gRNA sequence
cttcaccaaccccacattac

SEQ ID NO: 685484 - DNA, 20 bp, Artificial
  CRISPR gRNA sequence
attacaaaggatttctagta

SEQ ID NO: 685485 - DNA, 20 bp, Artificial
  CRISPR gRNA sequence
gattgccctctactagaaat

SEQ ID NO: 685486 - DNA, 20 bp, Artificial
  CRISPR gRNA sequence
ataagctactttgaagataa

SEQ ID NO: 685487 - DNA, 20 bp, Artificial
  CRISPR gRNA sequence
tccctgttcccaatattagc

SEQ ID NO: 685488 - DNA, 20 bp, Artificial
  CRISPR gRNA sequence
tattagcaaatgcttggggc

SEQ ID NO: 685489 - DNA, 20 bp, Artificial
  CRISPR gRNA sequence
ttcagaacaggggtcatatg

SEQ ID NO: 685490 - DNA, 20 bp, Artificial
  CRISPR gRNA sequence
tatttcattttgtgcagggg

SEQ ID NO: 685491 - DNA, 20 bp, Artificial
  CRISPR gRNA sequence
gcattgaatgctagtcaata

SEQ ID NO: 685492 - DNA, 20 bp, Artificial
  CRISPR gRNA sequence
tcaatataaagcttgtattt

SEQ ID NO: 685493 - DNA, 20 bp, Artificial
  CRISPR gRNA sequence
gtttctattctatttcatag

SEQ ID NO: 685494 - DNA, 20 bp, Artificial
  CRISPR gRNA sequence
gaataagaataagactacag

SEQ ID NO: 685495 - DNA, 20 bp, Artificial
  CRISPR gRNA sequence
aaataataaatggatgagtc

SEQ ID NO: 685496 - DNA, 20 bp, Artificial
  CRISPR gRNA sequence
cactaaggctgaaagacggg

SEQ ID NO: 685497 - DNA, 20 bp, Artificial
  CRISPR gRNA sequence
tgctcatttatttaatgaca

SEQ ID NO: 685498 - DNA, 20 bp, Artificial
  CRISPR gRNA sequence
ctgataggaatgtggtctgg

SEQ ID NO: 685499 - DNA, 20 bp, Artificial
  CRISPR gRNA sequence
ctccaaaaatttgtctccaa

SEQ ID NO: 685500 - DNA, 20 bp, Artificial
  CRISPR gRNA sequence
ctaaggagaccccaatcctt

SEQ ID NO: 685501 - DNA, 20 bp, Artificial
  CRISPR gRNA sequence
atcctttgtagattgataag

SEQ ID NO: 685502 - DNA, 20 bp, Artificial
  CRISPR gRNA sequence
ttgtgaaatctttcccttaa

SEQ ID NO: 685503 - DNA, 20 bp, Artificial
  CRISPR gRNA sequence
gatgttgaaagtattgcaaa

SEQ ID NO: 685504 - DNA, 20 bp, Artificial
  CRISPR gRNA sequence
ttgaatccaatgagtattac

SEQ ID NO: 685505 - DNA, 20 bp, Artificial
  CRISPR gRNA sequence
actagaaaaaaaaaaaaaaa

SEQ ID NO: 685506 - DNA, 20 bp, Artificial
  CRISPR gRNA sequence
aaaagtaagttaagttagca

SEQ ID NO: 685507 - DNA, 20 bp, Artificial
  CRISPR gRNA sequence
gtaagttaagttagcattca

SEQ ID NO: 685508 - DNA, 20 bp, Artificial
  CRISPR gRNA sequence
aaaaaagaataaagaacaga

SEQ ID NO: 685509 - DNA, 20 bp, Artificial
  CRISPR gRNA sequence
tattctatctcattaatgtc

SEQ ID NO: 685510 - DNA, 20 bp, Artificial
  CRISPR gRNA sequence
tatttatttatctgttgaca

SEQ ID NO: 685511 - DNA, 20 bp, Artificial
  CRISPR gRNA sequence
aacctctgccttctaggttc

SEQ ID NO: 685512 - DNA, 20 bp, Artificial
  CRISPR gRNA sequence
tacctcagcctcccaagctg

SEQ ID NO: 685513 - DNA, 20 bp, Artificial
  CRISPR gRNA sequence
aggtgtgtgccaccacaccc

SEQ ID NO: 685514 - DNA, 20 bp, Artificial
  CRISPR gRNA sequence
ttttatatttttagtagaga

SEQ ID NO: 685515 - DNA, 20 bp, Artificial
  CRISPR gRNA sequence
tgccttggcctcccaaagtg

SEQ ID NO: 685516 - DNA, 20 bp, Artificial
  CRISPR gRNA sequence
aaataatctggaacattgca

SEQ ID NO: 685517 - DNA, 20 bp, Artificial
  CRISPR gRNA sequence
aatctggaacattgcaatct

SEQ ID NO: 685518 - DNA, 20 bp, Artificial
  CRISPR gRNA sequence
taaattcagcctttacttaa

SEQ ID NO: 685519 - DNA, 20 bp, Artificial
  CRISPR gRNA sequence
taaaaataaacattaaaatc

SEQ ID NO: 685520 - DNA, 20 bp, Artificial
  CRISPR gRNA sequence
aaagataattactatttatt

SEQ ID NO: 685521 - DNA, 20 bp, Artificial
  CRISPR gRNA sequence
gagcacttttcacacattac

SEQ ID NO: 685522 - DNA, 20 bp, Artificial
  CRISPR gRNA sequence
accttagtttattttcacaa

SEQ ID NO: 685523 - DNA, 20 bp, Artificial
  CRISPR gRNA sequence
ctaggcccttaactaataca

SEQ ID NO: 685524 - DNA, 20 bp, Artificial
  CRISPR gRNA sequence
cttaactaatacatcctgct

SEQ ID NO: 685525 - DNA, 20 bp, Artificial
  CRISPR gRNA sequence
acacaatctcatcagccttc

SEQ ID NO: 685526 - DNA, 20 bp, Artificial
  CRISPR gRNA sequence
gccccctgagatggaaaaca

SEQ ID NO: 685527 - DNA, 20 bp, Artificial
  CRISPR gRNA sequence
tccagattactattttctgt

SEQ ID NO: 685528 - DNA, 20 bp, Artificial
  CRISPR gRNA sequence
tatcttggtcactaggaaag

SEQ ID NO: 685529 - DNA, 20 bp, Artificial
  CRISPR gRNA sequence
ctcaacctgatagtattcct

SEQ ID NO: 685530 - DNA, 20 bp, Artificial
  CRISPR gRNA sequence
gaagttggcctgaggcaaac

SEQ ID NO: 685531 - DNA, 20 bp, Artificial
  CRISPR gRNA sequence
tctttcctgagtgggaatac

SEQ ID NO: 685532 - DNA, 20 bp, Artificial
  CRISPR gRNA sequence
tcctgagtgggaatactttt

SEQ ID NO: 685533 - DNA, 20 bp, Artificial
  CRISPR gRNA sequence
aataccaatccacggtgtaa

SEQ ID NO: 685534 - DNA, 20 bp, Artificial
  CRISPR gRNA sequence
aaagcctcattttccaggcc

SEQ ID NO: 685535 - DNA, 20 bp, Artificial
  CRISPR gRNA sequence
cctcattttccaggccccat

SEQ ID NO: 685536 - DNA, 20 bp, Artificial
  CRISPR gRNA sequence
tatactctcaatattttctt

SEQ ID NO: 685537 - DNA, 20 bp, Artificial
  CRISPR gRNA sequence
cattacaaagaatttcttct

SEQ ID NO: 685538 - DNA, 20 bp, Artificial
  CRISPR gRNA sequence
tctgatagatttgtaatgaa

SEQ ID NO: 685539 - DNA, 20 bp, Artificial
  CRISPR gRNA sequence
tgtacaaaagcaatatattt

SEQ ID NO: 685540 - DNA, 20 bp, Artificial
  CRISPR gRNA sequence
aactggaacaactggaagca

SEQ ID NO: 685541 - DNA, 20 bp, Artificial
  CRISPR gRNA sequence
tgctaagatccaaaacccca

SEQ ID NO: 685542 - DNA, 20 bp, Artificial
  CRISPR gRNA sequence
caagtattggtaactcgttg

SEQ ID NO: 685543 - DNA, 20 bp, Artificial
  CRISPR gRNA sequence
ataaacagaatttttatcag

SEQ ID NO: 685544 - DNA, 20 bp, Artificial
  CRISPR gRNA sequence
aagtgcaaagagatgtaaca

SEQ ID NO: 685545 - DNA, 20 bp, Artificial
  CRISPR gRNA sequence
agcattgcacttattcctat

SEQ ID NO: 685546 - DNA, 20 bp, Artificial
  CRISPR gRNA sequence
cctatggaagttttgggtca

SEQ ID NO: 685547 - DNA, 20 bp, Artificial
  CRISPR gRNA sequence
taaattaagaaggaaagaat

SEQ ID NO: 685548 - DNA, 20 bp, Artificial
  CRISPR gRNA sequence
cctcaaacttttgttcctga

SEQ ID NO: 685549 - DNA, 20 bp, Artificial
  CRISPR gRNA sequence
gcttgttcccaggagtcacc

SEQ ID NO: 685550 - DNA, 20 bp, Artificial
  CRISPR gRNA sequence
acaaattttagataagtaat

SEQ ID NO: 685551 - DNA, 20 bp, Artificial
  CRISPR gRNA sequence
gagtcagtgacggagctaag

SEQ ID NO: 685552 - DNA, 20 bp, Artificial
  CRISPR gRNA sequence
gacactcctcccatcctgaa

SEQ ID NO: 685553 - DNA, 20 bp, Artificial
  CRISPR gRNA sequence
tacttatctaaaatttgtaa

SEQ ID NO: 685554 - DNA, 20 bp, Artificial
  CRISPR gRNA sequence
ctattcttccccttatattt

SEQ ID NO: 685555 - DNA, 20 bp, Artificial
  CRISPR gRNA sequence
ttatattttaagaaaagaag

SEQ ID NO: 685556 - DNA, 20 bp, Artificial
  CRISPR gRNA sequence
agtaaatgattatttttctg

SEQ ID NO: 685557 - DNA, 20 bp, Artificial
  CRISPR gRNA sequence
tcatagaccttcaactactc

SEQ ID NO: 685558 - DNA, 20 bp, Artificial
  CRISPR gRNA sequence
aaagtttgagggtttggggt

SEQ ID NO: 685559 - DNA, 20 bp, Artificial
  CRISPR gRNA sequence
ttatggtttttttttcaaaa

SEQ ID NO: 685560 - DNA, 20 bp, Artificial
  CRISPR gRNA sequence
ttcattctcctgggtggtgc

SEQ ID NO: 685561 - DNA, 20 bp, Artificial
  CRISPR gRNA sequence
tacttgctcttgattgataa

SEQ ID NO: 685562 - DNA, 20 bp, Artificial
  CRISPR gRNA sequence
ttttcattacaaatctatca

SEQ ID NO: 685563 - DNA, 20 bp, Artificial
  CRISPR gRNA sequence
gctttgcatattcaaatgca

SEQ ID NO: 685564 - DNA, 20 bp, Artificial
  CRISPR gRNA sequence
ggcttctaaatttaatccta

SEQ ID NO: 685565 - DNA, 20 bp, Artificial
  CRISPR gRNA sequence
agaagaaaatattgagagta

SEQ ID NO: 685566 - DNA, 20 bp, Artificial
  CRISPR gRNA sequence
caaaagtattcccactcagg

SEQ ID NO: 685567 - DNA, 20 bp, Artificial
  CRISPR gRNA sequence
gattgatttgtagctgactt

SEQ ID NO: 685568 - DNA, 20 bp, Artificial
  CRISPR gRNA sequence
ggaattaagaacaaactagc

SEQ ID NO: 685569 - DNA, 20 bp, Artificial
  CRISPR gRNA sequence
tgtatattgatggtttttaa

SEQ ID NO: 685570 - DNA, 20 bp, Artificial
  CRISPR gRNA sequence
tgtattcaacagtatctgga

SEQ ID NO: 685571 - DNA, 20 bp, Artificial
  CRISPR gRNA sequence
tcttgagtggtttaaggtaa

SEQ ID NO: 685572 - DNA, 20 bp, Artificial
  CRISPR gRNA sequence
acagataaataaataaaagt

SEQ ID NO: 685573 - DNA, 20 bp, Artificial
  CRISPR gRNA sequence
aggaaatggaatttcttatt

SEQ ID NO: 685574 - DNA, 20 bp, Artificial
  CRISPR gRNA sequence
aagctactgacattaatgag

SEQ ID NO: 685575 - DNA, 20 bp, Artificial
  CRISPR gRNA sequence
ctgaacacactatcaagatt

SEQ ID NO: 685576 - DNA, 20 bp, Artificial
  CRISPR gRNA sequence
agccttagtggtcacaggag

SEQ ID NO: 685577 - DNA, 20 bp, Artificial
  CRISPR gRNA sequence
gcatttgtttaagtgatatc

SEQ ID NO: 685578 - DNA, 20 bp, Artificial
  CRISPR gRNA sequence
aaagagcatcataggtaata

SEQ ID NO: 685579 - DNA, 20 bp, Artificial
  CRISPR gRNA sequence
ttgaaaaacattgctatgaa

SEQ ID NO: 685580 - DNA, 20 bp, Artificial
  CRISPR gRNA sequence
aaacattgctatgaaataga

SEQ ID NO: 685581 - DNA, 20 bp, Artificial
  CRISPR gRNA sequence
ataaaggaagtggaaattgg

SEQ ID NO: 685582 - DNA, 20 bp, Artificial
  CRISPR gRNA sequence
gaaattggtaagaaaattta

SEQ ID NO: 685583 - DNA, 20 bp, Artificial
  CRISPR gRNA sequence
ggagagatgaagagagttct

SEQ ID NO: 685584 - DNA, 20 bp, Artificial
  CRISPR gRNA sequence
atgtggaagagggcagttgg

SEQ ID NO: 685585 - DNA, 20 bp, Artificial
  CRISPR gRNA sequence
agtagagggcaatcctttta

SEQ ID NO: 685586 - DNA, 20 bp, Artificial
  CRISPR gRNA sequence
gtaatgtggggttggtgaag

SEQ ID NO: 685587 - DNA, 20 bp, Artificial
  CRISPR gRNA sequence
ttgttagtttcccatgcaga

SEQ ID NO: 685588 - DNA, 20 bp, Artificial
  CRISPR gRNA sequence
gggaggaggcaagagaggac

SEQ ID NO: 685589 - DNA, 20 bp, Artificial
  CRISPR gRNA sequence
aattacagactttggtgaac

SEQ ID NO: 685590 - DNA, 20 bp, Artificial
  CRISPR gRNA sequence
ggcttgtctagacatggttt

SEQ ID NO: 685591 - DNA, 20 bp, Artificial
  CRISPR gRNA sequence
actttctctagcaagtgtaa

SEQ ID NO: 685592 - DNA, 20 bp, Artificial
  CRISPR gRNA sequence
tcaaactactgccatttcag

SEQ ID NO: 685593 - DNA, 20 bp, Artificial
  CRISPR gRNA sequence
ggccattcttgcattgatat

SEQ ID NO: 685594 - DNA, 20 bp, Artificial
  CRISPR gRNA sequence
ccgtataaaaggaaggaaag

SEQ ID NO: 685595 - DNA, 20 bp, Artificial
  CRISPR gRNA sequence
ctcaggggctgtacaatcat

SEQ ID NO: 685596 - DNA, 20 bp, Artificial
  CRISPR gRNA sequence
cagagagaggcacaacagga

SEQ ID NO: 685597 - DNA, 20 bp, Artificial
  CRISPR gRNA sequence
gtaagtttttcataaaataa

SEQ ID NO: 685598 - DNA, 20 bp, Artificial
  CRISPR gRNA sequence
agtttttgttctcttaaatt

SEQ ID NO: 685599 - DNA, 20 bp, Artificial
  CRISPR gRNA sequence
attcaagaaatgctataatt

SEQ ID NO: 685600 - DNA, 20 bp, Artificial
  CRISPR gRNA sequence
gctataatttcagaaataaa

SEQ ID NO: 685601 - DNA, 20 bp, Artificial
  CRISPR gRNA sequence
gagtgtaaccatgttgattt

SEQ ID NO: 685602 - DNA, 20 bp, Artificial
  CRISPR gRNA sequence
ggttaaagtcaaaattaaaa

SEQ ID NO: 685603 - DNA, 20 bp, Artificial
  CRISPR gRNA sequence
atcactgttttgaaaactct

SEQ ID NO: 685604 - DNA, 20 bp, Artificial
  CRISPR gRNA sequence
accaattatttatatataaa

SEQ ID NO: 685605 - DNA, 20 bp, Artificial
  CRISPR gRNA sequence
tcattaaaatcctgctagat

SEQ ID NO: 685606 - DNA, 20 bp, Artificial
  CRISPR gRNA sequence
taagacttatagctagagaa

SEQ ID NO: 685607 - DNA, 20 bp, Artificial
  CRISPR gRNA sequence
gtatactgcaaactgagggc

SEQ ID NO: 685608 - DNA, 20 bp, Artificial
  CRISPR gRNA sequence
tggtgaataacagatgcaat

SEQ ID NO: 685609 - DNA, 20 bp, Artificial
  CRISPR gRNA sequence
ggtatttctttatatcaatg

SEQ ID NO: 685610 - DNA, 20 bp, Artificial
  CRISPR gRNA sequence
aaaatgagtgttcattatga

SEQ ID NO: 685611 - DNA, 20 bp, Artificial
  CRISPR gRNA sequence
cacagagggagttcataaag

SEQ ID NO: 685612 - DNA, 20 bp, Artificial
  CRISPR gRNA sequence
ccattctgcttacacttgct

SEQ ID NO: 685613 - DNA, 20 bp, Artificial
  CRISPR gRNA sequence
aagttcaggtgatcaaagtc

SEQ ID NO: 685614 - DNA, 20 bp, Artificial
  CRISPR gRNA sequence
agccagcccattgctgaaac

SEQ ID NO: 685615 - DNA, 20 bp, Artificial
  CRISPR gRNA sequence
agtaaaaggattgccctcta

SEQ ID NO: 685616 - DNA, 20 bp, Artificial
  CRISPR gRNA sequence
ccggatctggctaccattgc

SEQ ID NO: 685617 - DNA, 20 bp, Artificial
  CRISPR gRNA sequence
gggctccgattactggaaac

SEQ ID NO: 685618 - DNA, 20 bp, Artificial
  CRISPR gRNA sequence
cttgctcatcttaaagacaa

SEQ ID NO: 685619 - DNA, 20 bp, Artificial
  CRISPR gRNA sequence
cacacacacacacacacgaa

SEQ ID NO: 685620 - DNA, 20 bp, Artificial
  CRISPR gRNA sequence
attacatgacctagtagttg

SEQ ID NO: 685621 - DNA, 20 bp, Artificial
  CRISPR gRNA sequence
tgttagaaaactactcttct

SEQ ID NO: 685622 - DNA, 20 bp, Artificial
  CRISPR gRNA sequence
aaaactactcttctacagaa

SEQ ID NO: 685623 - DNA, 20 bp, Artificial
  CRISPR gRNA sequence
actgtaagggttgatattaa

SEQ ID NO: 685624 - DNA, 20 bp, Artificial
  CRISPR gRNA sequence
ataacttggaaaacacattt

SEQ ID NO: 685625 - DNA, 20 bp, Artificial
  CRISPR gRNA sequence
attaagctcttttttaattt

SEQ ID NO: 685626 - DNA, 20 bp, Artificial
  CRISPR gRNA sequence
gcagaaactctgacaccaaa

SEQ ID NO: 685627 - DNA, 20 bp, Artificial
  CRISPR gRNA sequence
tggaaaattaagtcacaaaa

SEQ ID NO: 685628 - DNA, 20 bp, Artificial
  CRISPR gRNA sequence
cttaaatcttgatagtgtgt

SEQ ID NO: 685629 - DNA, 20 bp, Artificial
  CRISPR gRNA sequence
aaacctctttgcgtcatagt

SEQ ID NO: 685630 - DNA, 20 bp, Artificial
  CRISPR gRNA sequence
aaagggaggagggagaagtg

SEQ ID NO: 685631 - DNA, 20 bp, Artificial
  CRISPR gRNA sequence
agagcctgacaattctgaaa

SEQ ID NO: 685632 - DNA, 20 bp, Artificial
  CRISPR gRNA sequence
ttttatttatttatctgttg

SEQ ID NO: 685633 - DNA, 20 bp, Artificial
  CRISPR gRNA sequence
caactgtaaatccaaatagc

SEQ ID NO: 685634 - DNA, 20 bp, Artificial
  CRISPR gRNA sequence
attttataaatttaactgtt

SEQ ID NO: 685635 - DNA, 20 bp, Artificial
  CRISPR gRNA sequence
agctcaggcaatcaaccact

SEQ ID NO: 685636 - DNA, 20 bp, Artificial
  CRISPR gRNA sequence
tgacaatacaggtataaata

SEQ ID NO: 685637 - DNA, 20 bp, Artificial
  CRISPR gRNA sequence
agaatcagcaactgcagctg

SEQ ID NO: 685638 - DNA, 20 bp, Artificial
  CRISPR gRNA sequence
atatactgtgataccttggg

SEQ ID NO: 685639 - DNA, 20 bp, Artificial
  CRISPR gRNA sequence
actgatgatatattcattac

SEQ ID NO: 685640 - DNA, 20 bp, Artificial
  CRISPR gRNA sequence
ctttgctgctgtggaataca

SEQ ID NO: 685641 - DNA, 20 bp, Artificial
  CRISPR gRNA sequence
tgtggaatacatgagaattg

SEQ ID NO: 685642 - DNA, 20 bp, Artificial
  CRISPR gRNA sequence
taagttagacaaaaccataa

SEQ ID NO: 685643 - DNA, 20 bp, Artificial
  CRISPR gRNA sequence
tactttctcagcaccaccca

SEQ ID NO: 685644 - DNA, 20 bp, Artificial
  CRISPR gRNA sequence
gttatatttcaccagtctca

SEQ ID NO: 685645 - DNA, 20 bp, Artificial
  CRISPR gRNA sequence
agtctcatgagaatgtcctg

SEQ ID NO: 685646 - DNA, 20 bp, Artificial
  CRISPR gRNA sequence
aagaaactaaattaagaagg

SEQ ID NO: 685647 - DNA, 20 bp, Artificial
  CRISPR gRNA sequence
accataaaattcagtagact

SEQ ID NO: 685648 - DNA, 20 bp, Artificial
  CRISPR gRNA sequence
aaatacattaattttttctt

SEQ ID NO: 685649 - DNA, 20 bp, Artificial
  CRISPR gRNA sequence
cttttcttaaaatataaggg

SEQ ID NO: 685650 - DNA, 20 bp, Artificial
  CRISPR gRNA sequence
aggggaagaatagaaccaac

SEQ ID NO: 685651 - DNA, 20 bp, Artificial
  CRISPR gRNA sequence
cttggagtcagtgacggagc

SEQ ID NO: 685652 - DNA, 20 bp, Artificial
  CRISPR gRNA sequence
attgtgaaagctatatgacc

SEQ ID NO: 685653 - DNA, 20 bp, Artificial
  CRISPR gRNA sequence
tgtaagatgtcctagacaag

SEQ ID NO: 685654 - DNA, 20 bp, Artificial
  CRISPR gRNA sequence
gatttgtagctgacttagag

SEQ ID NO: 685655 - DNA, 20 bp, Artificial
  CRISPR gRNA sequence
tgcgaatgtcaccatatata

SEQ ID NO: 685656 - DNA, 20 bp, Artificial
  CRISPR gRNA sequence
caatacaactatttggagag

SEQ ID NO: 685657 - DNA, 20 bp, Artificial
  CRISPR gRNA sequence
gttattgtcagaagaacttg

SEQ ID NO: 685658 - DNA, 20 bp, Artificial
  CRISPR gRNA sequence
gcaatggtagccagatccgg

SEQ ID NO: 685659 - DNA, 20 bp, Artificial
  CRISPR gRNA sequence
gtccttactcccctctagga

SEQ ID NO: 685660 - DNA, 20 bp, Artificial
  CRISPR gRNA sequence
tatgttttctacagagtttt

SEQ ID NO: 685661 - DNA, 20 bp, Artificial
  CRISPR gRNA sequence
ctgaatgcaatgttgtcttg

SEQ ID NO: 685662 - DNA, 20 bp, Artificial
  CRISPR gRNA sequence
tttcttgaatttaagagaac

SEQ ID NO: 685663 - DNA, 20 bp, Artificial
  CRISPR gRNA sequence
gtaaccatgttgatttaaag

SEQ ID NO: 685664 - DNA, 20 bp, Artificial
  CRISPR gRNA sequence
atgattctgtttattttatg

SEQ ID NO: 685665 - DNA, 20 bp, Artificial
  CRISPR gRNA sequence
tcaggggttaaagtcaaaat

SEQ ID NO: 685666 - DNA, 20 bp, Artificial
  CRISPR gRNA sequence
aaagtcaaaattaaaacaag

SEQ ID NO: 685667 - DNA, 20 bp, Artificial
  CRISPR gRNA sequence
gacagctttatcactgtttt

SEQ ID NO: 685668 - DNA, 20 bp, Artificial
  CRISPR gRNA sequence
actgttttgaaaactctgta

SEQ ID NO: 685669 - DNA, 20 bp, Artificial
  CRISPR gRNA sequence
aaaatcctgctagattcaga

SEQ ID NO: 685670 - DNA, 20 bp, Artificial
  CRISPR gRNA sequence
gaagtagaaatgtacacaaa

SEQ ID NO: 685671 - DNA, 20 bp, Artificial
  CRISPR gRNA sequence
agagggagttcataaagtta

SEQ ID NO: 685672 - DNA, 20 bp, Artificial
  CRISPR gRNA sequence
tccttcacgtcagctattct

SEQ ID NO: 685673 - DNA, 20 bp, Artificial
  CRISPR gRNA sequence
caagaactgagtgccttttc

SEQ ID NO: 685674 - DNA, 20 bp, Artificial
  CRISPR gRNA sequence
tatcccatttaatgtaaaaa

SEQ ID NO: 685675 - DNA, 20 bp, Artificial
  CRISPR gRNA sequence
gaaacagaaaggcacttaaa

SEQ ID NO: 685676 - DNA, 20 bp, Artificial
  CRISPR gRNA sequence
acaaatgcagatccaaccca

SEQ ID NO: 685677 - DNA, 20 bp, Artificial
  CRISPR gRNA sequence
acatgacctagtagttgtta

SEQ ID NO: 685678 - DNA, 20 bp, Artificial
  CRISPR gRNA sequence
tttacagcggtggagtattg

SEQ ID NO: 685679 - DNA, 20 bp, Artificial
  CRISPR gRNA sequence
ccaatattgctttgccctga

SEQ ID NO: 685680 - DNA, 20 bp, Artificial
  CRISPR gRNA sequence
ataaaatttaaaataacttg

SEQ ID NO: 685681 - DNA, 20 bp, Artificial
  CRISPR gRNA sequence
aagtattgcaaacaaagatt

SEQ ID NO: 685682 - DNA, 20 bp, Artificial
  CRISPR gRNA sequence
aaatcttgatagtgtgttca

SEQ ID NO: 685683 - DNA, 20 bp, Artificial
  CRISPR gRNA sequence
ttaatattgcttttcttctt

SEQ ID NO: 685684 - DNA, 20 bp, Artificial
  CRISPR gRNA sequence
ttttttgttacacttgagct

SEQ ID NO: 685685 - DNA, 20 bp, Artificial
  CRISPR gRNA sequence
gccaaatacagccacaaaat

SEQ ID NO: 685686 - DNA, 20 bp, Artificial
  CRISPR gRNA sequence
actagaggccccctgagatg

SEQ ID NO: 685687 - DNA, 20 bp, Artificial
  CRISPR gRNA sequence
acaactggaagcaaactgct

SEQ ID NO: 685688 - DNA, 20 bp, Artificial
  CRISPR gRNA sequence
ttgtgagaattgctaagatc

SEQ ID NO: 685689 - DNA, 20 bp, Artificial
  CRISPR gRNA sequence
caactgaaaaataagttaga

SEQ ID NO: 685690 - DNA, 20 bp, Artificial
  CRISPR gRNA sequence
tgagtttctatttttgaaaa

SEQ ID NO: 685691 - DNA, 20 bp, Artificial
  CRISPR gRNA sequence
ttgaacaagtcatagatttg

SEQ ID NO: 685692 - DNA, 20 bp, Artificial
  CRISPR gRNA sequence
tgaacaagtcatagatttgg

SEQ ID NO: 685693 - DNA, 20 bp, Artificial
  CRISPR gRNA sequence
gaacaagtcatagatttggc

SEQ ID NO: 685694 - DNA, 20 bp, Artificial
  CRISPR gRNA sequence
aacaagtcatagatttggcc

SEQ ID NO: 685695 - DNA, 20 bp, Artificial
  CRISPR gRNA sequence
ggccacaaatcaaatttcag

SEQ ID NO: 685696 - DNA, 20 bp, Artificial
  CRISPR gRNA sequence
gccacaaatcaaatttcagg

SEQ ID NO: 685697 - DNA, 20 bp, Artificial
  CRISPR gRNA sequence
caggatgggaggagtgtctc

SEQ ID NO: 685698 - DNA, 20 bp, Artificial
  CRISPR gRNA sequence
aggatgggaggagtgtctcc

SEQ ID NO: 685699 - DNA, 20 bp, Artificial
  CRISPR gRNA sequence
ccctttaaaatagaagagag

SEQ ID NO: 685700 - DNA, 20 bp, Artificial
  CRISPR gRNA sequence
taaaatagaagagagtgagt

SEQ ID NO: 685701 - DNA, 20 bp, Artificial
  CRISPR gRNA sequence
aaaatagaagagagtgagta

SEQ ID NO: 685702 - DNA, 20 bp, Artificial
  CRISPR gRNA sequence
aaatagaagagagtgagtag

SEQ ID NO: 685703 - DNA, 20 bp, Artificial
  CRISPR gRNA sequence
tgaggagggacctacaaaga

SEQ ID NO: 685704 - DNA, 20 bp, Artificial
  CRISPR gRNA sequence
caaagactggaaactattct

SEQ ID NO: 685705 - DNA, 20 bp, Artificial
  CRISPR gRNA sequence
gaaactattcttagctccgt

SEQ ID NO: 685706 - DNA, 20 bp, Artificial
  CRISPR gRNA sequence
ttcttagctccgtcactgac

SEQ ID NO: 685707 - DNA, 20 bp, Artificial
  CRISPR gRNA sequence
ttagctccgtcactgactcc

SEQ ID NO: 685708 - DNA, 20 bp, Artificial
  CRISPR gRNA sequence
agctccgtcactgactccaa

SEQ ID NO: 685709 - DNA, 20 bp, Artificial
  CRISPR gRNA sequence
gctccgtcactgactccaag

SEQ ID NO: 685710 - DNA, 20 bp, Artificial
  CRISPR gRNA sequence
cgtcactgactccaagttca

SEQ ID NO: 685711 - DNA, 20 bp, Artificial
  CRISPR gRNA sequence
actccaagttcatcccctct

SEQ ID NO: 685712 - DNA, 20 bp, Artificial
  CRISPR gRNA sequence
caagttcatcccctctgtct

SEQ ID NO: 685713 - DNA, 20 bp, Artificial
  CRISPR gRNA sequence
atcccctctgtctttcagtt

SEQ ID NO: 685714 - DNA, 20 bp, Artificial
  CRISPR gRNA sequence
tgtctttcagtttgggtaag

SEQ ID NO: 685715 - DNA, 20 bp, Artificial
  CRISPR gRNA sequence
tctttcagtttgggtaagca

SEQ ID NO: 685716 - DNA, 20 bp, Artificial
  CRISPR gRNA sequence
tcagtttgggtaagcatcaa

SEQ ID NO: 685717 - DNA, 20 bp, Artificial
  CRISPR gRNA sequence
cagtttgggtaagcatcaat

SEQ ID NO: 685718 - DNA, 20 bp, Artificial
  CRISPR gRNA sequence
agtttgggtaagcatcaatt

SEQ ID NO: 685719 - DNA, 20 bp, Artificial
  CRISPR gRNA sequence
gggtaagcatcaattactta

SEQ ID NO: 685720 - DNA, 20 bp, Artificial
  CRISPR gRNA sequence
ggtaagcatcaattacttat

SEQ ID NO: 685721 - DNA, 20 bp, Artificial
  CRISPR gRNA sequence
cttatctaaaatttgtaata

SEQ ID NO: 685722 - DNA, 20 bp, Artificial
  CRISPR gRNA sequence
atctaaaatttgtaataaga

SEQ ID NO: 685723 - DNA, 20 bp, Artificial
  CRISPR gRNA sequence
tctaaaatttgtaataagaa

SEQ ID NO: 685724 - DNA, 20 bp, Artificial
  CRISPR gRNA sequence
aaatttgtaataagaaaagt

SEQ ID NO: 685725 - DNA, 20 bp, Artificial
  CRISPR gRNA sequence
gtaataagaaaagtcttcat

SEQ ID NO: 685726 - DNA, 20 bp, Artificial
  CRISPR gRNA sequence
taataagaaaagtcttcata

SEQ ID NO: 685727 - DNA, 20 bp, Artificial
  CRISPR gRNA sequence
cataattcatgattgtgttt

SEQ ID NO: 685728 - DNA, 20 bp, Artificial
  CRISPR gRNA sequence
ataattcatgattgtgttta

SEQ ID NO: 685729 - DNA, 20 bp, Artificial
  CRISPR gRNA sequence
atgattgtgtttatctttat

SEQ ID NO: 685730 - DNA, 20 bp, Artificial
  CRISPR gRNA sequence
tgtttatctttatgttagta

SEQ ID NO: 685731 - DNA, 20 bp, Artificial
  CRISPR gRNA sequence
atctttatgttagtaaattt

SEQ ID NO: 685732 - DNA, 20 bp, Artificial
  CRISPR gRNA sequence
tctttatgttagtaaatttc

SEQ ID NO: 685733 - DNA, 20 bp, Artificial
  CRISPR gRNA sequence
tatgttagtaaatttctatg

SEQ ID NO: 685734 - DNA, 20 bp, Artificial
  CRISPR gRNA sequence
atgttagtaaatttctatgt

SEQ ID NO: 685735 - DNA, 20 bp, Artificial
  CRISPR gRNA sequence
tgttagtaaatttctatgtt

SEQ ID NO: 685736 - DNA, 20 bp, Artificial
  CRISPR gRNA sequence
gtaaatttctatgttggttc

SEQ ID NO: 685737 - DNA, 20 bp, Artificial
  CRISPR gRNA sequence
ctatgttggttctattcttc

SEQ ID NO: 685738 - DNA, 20 bp, Artificial
  CRISPR gRNA sequence
tatgttggttctattcttcc

SEQ ID NO: 685739 - DNA, 20 bp, Artificial
  CRISPR gRNA sequence
tgttggttctattcttcccc

SEQ ID NO: 685740 - DNA, 20 bp, Artificial
  CRISPR gRNA sequence
gttctattcttccccttata

SEQ ID NO: 685741 - DNA, 20 bp, Artificial
  CRISPR gRNA sequence
tattcttccccttatatttt

SEQ ID NO: 685742 - DNA, 20 bp, Artificial
  CRISPR gRNA sequence
ttcttccccttatattttaa

SEQ ID NO: 685743 - DNA, 20 bp, Artificial
  CRISPR gRNA sequence
ttccccttatattttaagaa

SEQ ID NO: 685744 - DNA, 20 bp, Artificial
  CRISPR gRNA sequence
ccccttatattttaagaaaa

SEQ ID NO: 685745 - DNA, 20 bp, Artificial
  CRISPR gRNA sequence
cccttatattttaagaaaag

SEQ ID NO: 685746 - DNA, 20 bp, Artificial
  CRISPR gRNA sequence
atattttaagaaaagaagta

SEQ ID NO: 685747 - DNA, 20 bp, Artificial
  CRISPR gRNA sequence
tattttaagaaaagaagtaa

SEQ ID NO: 685748 - DNA, 20 bp, Artificial
  CRISPR gRNA sequence
taagaaaagaagtaagaaag

SEQ ID NO: 685749 - DNA, 20 bp, Artificial
  CRISPR gRNA sequence
aagaaaagaagtaagaaagt

SEQ ID NO: 685750 - DNA, 20 bp, Artificial
  CRISPR gRNA sequence
agaaaagaagtaagaaagta

SEQ ID NO: 685751 - DNA, 20 bp, Artificial
  CRISPR gRNA sequence
tttttctgaaagaaaaaatt

SEQ ID NO: 685752 - DNA, 20 bp, Artificial
  CRISPR gRNA sequence
ttctgaaagaaaaaattaat

SEQ ID NO: 685753 - DNA, 20 bp, Artificial
  CRISPR gRNA sequence
tctgaaagaaaaaattaatg

SEQ ID NO: 685754 - DNA, 20 bp, Artificial
  CRISPR gRNA sequence
ctgaaagaaaaaattaatgt

SEQ ID NO: 685755 - DNA, 20 bp, Artificial
  CRISPR gRNA sequence
tgaaagaaaaaattaatgta

SEQ ID NO: 685756 - DNA, 20 bp, Artificial
  CRISPR gRNA sequence
aaagaaaaaattaatgtatt

SEQ ID NO: 685757 - DNA, 20 bp, Artificial
  CRISPR gRNA sequence
atgtatttattattattcat

SEQ ID NO: 685758 - DNA, 20 bp, Artificial
  CRISPR gRNA sequence
attattattcatagaccttc

SEQ ID NO: 685759 - DNA, 20 bp, Artificial
  CRISPR gRNA sequence
ttattattcatagaccttca

SEQ ID NO: 685760 - DNA, 20 bp, Artificial
  CRISPR gRNA sequence
ttattcatagaccttcaact

SEQ ID NO: 685761 - DNA, 20 bp, Artificial
  CRISPR gRNA sequence
ttcatagaccttcaactact

SEQ ID NO: 685762 - DNA, 20 bp, Artificial
  CRISPR gRNA sequence
atagaccttcaactactctt

SEQ ID NO: 685763 - DNA, 20 bp, Artificial
  CRISPR gRNA sequence
caactactcttagaaagcct

SEQ ID NO: 685764 - DNA, 20 bp, Artificial
  CRISPR gRNA sequence
aactactcttagaaagcctt

SEQ ID NO: 685765 - DNA, 20 bp, Artificial
  CRISPR gRNA sequence
ctcttagaaagcctttggtg

SEQ ID NO: 685766 - DNA, 20 bp, Artificial
  CRISPR gRNA sequence
ttagaaagcctttggtgact

SEQ ID NO: 685767 - DNA, 20 bp, Artificial
  CRISPR gRNA sequence
agaaagcctttggtgactcc

SEQ ID NO: 685768 - DNA, 20 bp, Artificial
  CRISPR gRNA sequence
gaaagcctttggtgactcct

SEQ ID NO: 685769 - DNA, 20 bp, Artificial
  CRISPR gRNA sequence
tggtgactcctgggaacaag

SEQ ID NO: 685770 - DNA, 20 bp, Artificial
  CRISPR gRNA sequence
ggtgactcctgggaacaagc

SEQ ID NO: 685771 - DNA, 20 bp, Artificial
  CRISPR gRNA sequence
gtgactcctgggaacaagct

SEQ ID NO: 685772 - DNA, 20 bp, Artificial
  CRISPR gRNA sequence
ctgggaacaagctgagtcag

SEQ ID NO: 685773 - DNA, 20 bp, Artificial
  CRISPR gRNA sequence
ggaacaagctgagtcaggaa

SEQ ID NO: 685774 - DNA, 20 bp, Artificial
  CRISPR gRNA sequence
agtcaggaacaaaagtttga

SEQ ID NO: 685775 - DNA, 20 bp, Artificial
  CRISPR gRNA sequence
gagggtttggggttgagaat

SEQ ID NO: 685776 - DNA, 20 bp, Artificial
  CRISPR gRNA sequence
agggtttggggttgagaata

SEQ ID NO: 685777 - DNA, 20 bp, Artificial
  CRISPR gRNA sequence
ggggttgagaataggacaat

SEQ ID NO: 685778 - DNA, 20 bp, Artificial
  CRISPR gRNA sequence
gggttgagaataggacaatt

SEQ ID NO: 685779 - DNA, 20 bp, Artificial
  CRISPR gRNA sequence
agaataggacaattacttgg

SEQ ID NO: 685780 - DNA, 20 bp, Artificial
  CRISPR gRNA sequence
cttggctaatgctttagtct

SEQ ID NO: 685781 - DNA, 20 bp, Artificial
  CRISPR gRNA sequence
ggctaatgctttagtctagt

SEQ ID NO: 685782 - DNA, 20 bp, Artificial
  CRISPR gRNA sequence
gctaatgctttagtctagtt

SEQ ID NO: 685783 - DNA, 20 bp, Artificial
  CRISPR gRNA sequence
atgctttagtctagttctga

SEQ ID NO: 685784 - DNA, 20 bp, Artificial
  CRISPR gRNA sequence
tagtctagttctgattttgc

SEQ ID NO: 685785 - DNA, 20 bp, Artificial
  CRISPR gRNA sequence
agtctagttctgattttgct

SEQ ID NO: 685786 - DNA, 20 bp, Artificial
  CRISPR gRNA sequence
gtctagttctgattttgcta

SEQ ID NO: 685787 - DNA, 20 bp, Artificial
  CRISPR gRNA sequence
gttctgattttgctactcct

SEQ ID NO: 685788 - DNA, 20 bp, Artificial
  CRISPR gRNA sequence
tgattttgctactccttagt

SEQ ID NO: 685789 - DNA, 20 bp, Artificial
  CRISPR gRNA sequence
attttgctactccttagttg

SEQ ID NO: 685790 - DNA, 20 bp, Artificial
  CRISPR gRNA sequence
tgctactccttagttgcttt

SEQ ID NO: 685791 - DNA, 20 bp, Artificial
  CRISPR gRNA sequence
gctactccttagttgctttg

SEQ ID NO: 685792 - DNA, 20 bp, Artificial
  CRISPR gRNA sequence
ctactccttagttgctttgt

SEQ ID NO: 685793 - DNA, 20 bp, Artificial
  CRISPR gRNA sequence
ctccttagttgctttgtgat

SEQ ID NO: 685794 - DNA, 20 bp, Artificial
  CRISPR gRNA sequence
cttagttgctttgtgatgac

SEQ ID NO: 685795 - DNA, 20 bp, Artificial
  CRISPR gRNA sequence
agttgctttgtgatgactac

SEQ ID NO: 685796 - DNA, 20 bp, Artificial
  CRISPR gRNA sequence
gttgctttgtgatgactact

SEQ ID NO: 685797 - DNA, 20 bp, Artificial
  CRISPR gRNA sequence
ctttgtgatgactacttgca

SEQ ID NO: 685798 - DNA, 20 bp, Artificial
  CRISPR gRNA sequence
tgtgatgactacttgcacat

SEQ ID NO: 685799 - DNA, 20 bp, Artificial
  CRISPR gRNA sequence
gtgatgactacttgcacatg

SEQ ID NO: 685800 - DNA, 20 bp, Artificial
  CRISPR gRNA sequence
tgatgactacttgcacatgt

SEQ ID NO: 685801 - DNA, 20 bp, Artificial
  CRISPR gRNA sequence
cttgcacatgtgtctgtttg

SEQ ID NO: 685802 - DNA, 20 bp, Artificial
  CRISPR gRNA sequence
gcacatgtgtctgtttgtga

SEQ ID NO: 685803 - DNA, 20 bp, Artificial
  CRISPR gRNA sequence
cacatgtgtctgtttgtgag

SEQ ID NO: 685804 - DNA, 20 bp, Artificial
  CRISPR gRNA sequence
tttgtgagttatttttgtga

SEQ ID NO: 685805 - DNA, 20 bp, Artificial
  CRISPR gRNA sequence
gtgagttatttttgtgagca

SEQ ID NO: 685806 - DNA, 20 bp, Artificial
  CRISPR gRNA sequence
tgagttatttttgtgagcat

SEQ ID NO: 685807 - DNA, 20 bp, Artificial
  CRISPR gRNA sequence
tttttgtgagcatgctgcta

SEQ ID NO: 685808 - DNA, 20 bp, Artificial
  CRISPR gRNA sequence
ttgtgagcatgctgctacca

SEQ ID NO: 685809 - DNA, 20 bp, Artificial
  CRISPR gRNA sequence
tgtgagcatgctgctaccag

SEQ ID NO: 685810 - DNA, 20 bp, Artificial
  CRISPR gRNA sequence
gtgagcatgctgctaccagc

SEQ ID NO: 685811 - DNA, 20 bp, Artificial
  CRISPR gRNA sequence
tgagcatgctgctaccagcc

SEQ ID NO: 685812 - DNA, 20 bp, Artificial
  CRISPR gRNA sequence
ctaccagcctgtgtggatgt

SEQ ID NO: 685813 - DNA, 20 bp, Artificial
  CRISPR gRNA sequence
ccagcctgtgtggatgtctg

SEQ ID NO: 685814 - DNA, 20 bp, Artificial
  CRISPR gRNA sequence
tgtggatgtctgtggtttca

SEQ ID NO: 685815 - DNA, 20 bp, Artificial
  CRISPR gRNA sequence
tggtttcacatgatacattt

SEQ ID NO: 685816 - DNA, 20 bp, Artificial
  CRISPR gRNA sequence
cacatgatacattttatttt

SEQ ID NO: 685817 - DNA, 20 bp, Artificial
  CRISPR gRNA sequence
acatgatacattttattttc

SEQ ID NO: 685818 - DNA, 20 bp, Artificial
  CRISPR gRNA sequence
tattttctaaagtctactga

SEQ ID NO: 685819 - DNA, 20 bp, Artificial
  CRISPR gRNA sequence
attttctaaagtctactgaa

SEQ ID NO: 685820 - DNA, 20 bp, Artificial
  CRISPR gRNA sequence
ttttctaaagtctactgaat

SEQ ID NO: 685821 - DNA, 20 bp, Artificial
  CRISPR gRNA sequence
tctaaagtctactgaatttt

SEQ ID NO: 685822 - DNA, 20 bp, Artificial
  CRISPR gRNA sequence
ctaaagtctactgaatttta

SEQ ID NO: 685823 - DNA, 20 bp, Artificial
  CRISPR gRNA sequence
taaagtctactgaattttat

SEQ ID NO: 685824 - DNA, 20 bp, Artificial
  CRISPR gRNA sequence
aagtctactgaattttatgg

SEQ ID NO: 685825 - DNA, 20 bp, Artificial
  CRISPR gRNA sequence
ctgaattttatggttttttt

SEQ ID NO: 685826 - DNA, 20 bp, Artificial
  CRISPR gRNA sequence
aattttatggtttttttttc

SEQ ID NO: 685827 - DNA, 20 bp, Artificial
  CRISPR gRNA sequence
tatggtttttttttcaaaaa

SEQ ID NO: 685828 - DNA, 20 bp, Artificial
  CRISPR gRNA sequence
atggtttttttttcaaaaat

SEQ ID NO: 685829 - DNA, 20 bp, Artificial
  CRISPR gRNA sequence
tggtttttttttcaaaaata

SEQ ID NO: 685830 - DNA, 20 bp, Artificial
  CRISPR gRNA sequence
ttttttcaaaaatagaaact

SEQ ID NO: 685831 - DNA, 20 bp, Artificial
  CRISPR gRNA sequence
tttttcaaaaatagaaactc

SEQ ID NO: 685832 - DNA, 20 bp, Artificial
  CRISPR gRNA sequence
ttttcaaaaatagaaactca

SEQ ID NO: 685833 - DNA, 20 bp, Artificial
  CRISPR gRNA sequence
tttcaaaaatagaaactcat

SEQ ID NO: 685834 - DNA, 20 bp, Artificial
  CRISPR gRNA sequence
ttcaaaaatagaaactcata

SEQ ID NO: 685835 - DNA, 20 bp, Artificial
  CRISPR gRNA sequence
tcaaaaatagaaactcatat

SEQ ID NO: 685836 - DNA, 20 bp, Artificial
  CRISPR gRNA sequence
caaaaatagaaactcatatt

SEQ ID NO: 685837 - DNA, 20 bp, Artificial
  CRISPR gRNA sequence
aaaaatagaaactcatattc

SEQ ID NO: 685838 - DNA, 20 bp, Artificial
  CRISPR gRNA sequence
atattctttccttcttaatt

SEQ ID NO: 685839 - DNA, 20 bp, Artificial
  CRISPR gRNA sequence
tttccttcttaatttagttt

SEQ ID NO: 685840 - DNA, 20 bp, Artificial
  CRISPR gRNA sequence
tccttcttaatttagtttct

SEQ ID NO: 685841 - DNA, 20 bp, Artificial
  CRISPR gRNA sequence
ccttcttaatttagtttctt

SEQ ID NO: 685842 - DNA, 20 bp, Artificial
  CRISPR gRNA sequence
cttcttaatttagtttcttt

SEQ ID NO: 685843 - DNA, 20 bp, Artificial
  CRISPR gRNA sequence
cttaatttagtttctttcag

SEQ ID NO: 685844 - DNA, 20 bp, Artificial
  CRISPR gRNA sequence
ttaatttagtttctttcagg

SEQ ID NO: 685845 - DNA, 20 bp, Artificial
  CRISPR gRNA sequence
aatttagtttctttcaggac

SEQ ID NO: 685846 - DNA, 20 bp, Artificial
  CRISPR gRNA sequence
atttagtttctttcaggaca

SEQ ID NO: 685847 - DNA, 20 bp, Artificial
  CRISPR gRNA sequence
agtttctttcaggacattct

SEQ ID NO: 685848 - DNA, 20 bp, Artificial
  CRISPR gRNA sequence
gtttctttcaggacattctc

SEQ ID NO: 685849 - DNA, 20 bp, Artificial
  CRISPR gRNA sequence
ctttcaggacattctcatga

SEQ ID NO: 685850 - DNA, 20 bp, Artificial
  CRISPR gRNA sequence
tttcaggacattctcatgag

SEQ ID NO: 685851 - DNA, 20 bp, Artificial
  CRISPR gRNA sequence
tcaggacattctcatgagac

SEQ ID NO: 685852 - DNA, 20 bp, Artificial
  CRISPR gRNA sequence
caggacattctcatgagact

SEQ ID NO: 685853 - DNA, 20 bp, Artificial
  CRISPR gRNA sequence
aggacattctcatgagactg

SEQ ID NO: 685854 - DNA, 20 bp, Artificial
  CRISPR gRNA sequence
tcatgagactggtgaaatat

SEQ ID NO: 685855 - DNA, 20 bp, Artificial
  CRISPR gRNA sequence
atgagactggtgaaatataa

SEQ ID NO: 685856 - DNA, 20 bp, Artificial
  CRISPR gRNA sequence
gtgaaatataactgcgaagt

SEQ ID NO: 685857 - DNA, 20 bp, Artificial
  CRISPR gRNA sequence
cgaagtagcatgataactgt

SEQ ID NO: 685858 - DNA, 20 bp, Artificial
  CRISPR gRNA sequence
tgaaatagcatgatcattgt

SEQ ID NO: 685859 - DNA, 20 bp, Artificial
  CRISPR gRNA sequence
tgaaagctatatgacccaaa

SEQ ID NO: 685860 - DNA, 20 bp, Artificial
  CRISPR gRNA sequence
tatgacccaaaacttccata

SEQ ID NO: 685861 - DNA, 20 bp, Artificial
  CRISPR gRNA sequence
ccataggaataagtgcaatg

SEQ ID NO: 685862 - DNA, 20 bp, Artificial
  CRISPR gRNA sequence
cataggaataagtgcaatgc

SEQ ID NO: 685863 - DNA, 20 bp, Artificial
  CRISPR gRNA sequence
gcatatctgaaacctgctgt

SEQ ID NO: 685864 - DNA, 20 bp, Artificial
  CRISPR gRNA sequence
catatctgaaacctgctgtt

SEQ ID NO: 685865 - DNA, 20 bp, Artificial
  CRISPR gRNA sequence
aaacctgctgttacatctct

SEQ ID NO: 685866 - DNA, 20 bp, Artificial
  CRISPR gRNA sequence
ctgttacatctctttgcact

SEQ ID NO: 685867 - DNA, 20 bp, Artificial
  CRISPR gRNA sequence
ttacatctctttgcacttaa

SEQ ID NO: 685868 - DNA, 20 bp, Artificial
  CRISPR gRNA sequence
catctctttgcacttaataa

SEQ ID NO: 685869 - DNA, 20 bp, Artificial
  CRISPR gRNA sequence
tttgcacttaataaatatgt

SEQ ID NO: 685870 - DNA, 20 bp, Artificial
  CRISPR gRNA sequence
tgcacttaataaatatgtgt

SEQ ID NO: 685871 - DNA, 20 bp, Artificial
  CRISPR gRNA sequence
gcacttaataaatatgtgtt

SEQ ID NO: 685872 - DNA, 20 bp, Artificial
  CRISPR gRNA sequence
cacttaataaatatgtgttg

SEQ ID NO: 685873 - DNA, 20 bp, Artificial
  CRISPR gRNA sequence
aataaatatgtgttgactga

SEQ ID NO: 685874 - DNA, 20 bp, Artificial
  CRISPR gRNA sequence
ataaatatgtgttgactgat

SEQ ID NO: 685875 - DNA, 20 bp, Artificial
  CRISPR gRNA sequence
actgattcattctcctgggt

SEQ ID NO: 685876 - DNA, 20 bp, Artificial
  CRISPR gRNA sequence
attcattctcctgggtggtg

SEQ ID NO: 685877 - DNA, 20 bp, Artificial
  CRISPR gRNA sequence
attctcctgggtggtgctga

SEQ ID NO: 685878 - DNA, 20 bp, Artificial
  CRISPR gRNA sequence
tcctgggtggtgctgagaaa

SEQ ID NO: 685879 - DNA, 20 bp, Artificial
  CRISPR gRNA sequence
ctgggtggtgctgagaaagt

SEQ ID NO: 685880 - DNA, 20 bp, Artificial
  CRISPR gRNA sequence
ggtggtgctgagaaagtaaa

SEQ ID NO: 685881 - DNA, 20 bp, Artificial
  CRISPR gRNA sequence
agaaagtaaaaatcatggct

SEQ ID NO: 685882 - DNA, 20 bp, Artificial
  CRISPR gRNA sequence
ataaaaattctgtttatggt

SEQ ID NO: 685883 - DNA, 20 bp, Artificial
  CRISPR gRNA sequence
tgtttatggttttgtctaac

SEQ ID NO: 685884 - DNA, 20 bp, Artificial
  CRISPR gRNA sequence
tttatggttttgtctaactt

SEQ ID NO: 685885 - DNA, 20 bp, Artificial
  CRISPR gRNA sequence
atggttttgtctaacttatt

SEQ ID NO: 685886 - DNA, 20 bp, Artificial
  CRISPR gRNA sequence
tggttttgtctaacttattt

SEQ ID NO: 685887 - DNA, 20 bp, Artificial
  CRISPR gRNA sequence
tgtctaacttatttttcagt

SEQ ID NO: 685888 - DNA, 20 bp, Artificial
  CRISPR gRNA sequence
gtctaacttatttttcagtt

SEQ ID NO: 685889 - DNA, 20 bp, Artificial
  CRISPR gRNA sequence
tctaacttatttttcagttg

SEQ ID NO: 685890 - DNA, 20 bp, Artificial
  CRISPR gRNA sequence
acttatttttcagttgagat

SEQ ID NO: 685891 - DNA, 20 bp, Artificial
  CRISPR gRNA sequence
atttttcagttgagatatag

SEQ ID NO: 685892 - DNA, 20 bp, Artificial
  CRISPR gRNA sequence
tttttcagttgagatatagg

SEQ ID NO: 685893 - DNA, 20 bp, Artificial
  CRISPR gRNA sequence
ttcagttgagatataggcta

SEQ ID NO: 685894 - DNA, 20 bp, Artificial
  CRISPR gRNA sequence
tcagttgagatataggctac

SEQ ID NO: 685895 - DNA, 20 bp, Artificial
  CRISPR gRNA sequence
cagttgagatataggctact

SEQ ID NO: 685896 - DNA, 20 bp, Artificial
  CRISPR gRNA sequence
agttgagatataggctactc

SEQ ID NO: 685897 - DNA, 20 bp, Artificial
  CRISPR gRNA sequence
agatataggctactcttccc

SEQ ID NO: 685898 - DNA, 20 bp, Artificial
  CRISPR gRNA sequence
ctcttcccaactcagtcttg

SEQ ID NO: 685899 - DNA, 20 bp, Artificial
  CRISPR gRNA sequence
ttcccaactcagtcttgaag

SEQ ID NO: 685900 - DNA, 20 bp, Artificial
  CRISPR gRNA sequence
cccaactcagtcttgaagag

SEQ ID NO: 685901 - DNA, 20 bp, Artificial
  CRISPR gRNA sequence
ccaactcagtcttgaagagt

SEQ ID NO: 685902 - DNA, 20 bp, Artificial
  CRISPR gRNA sequence
agtcttgaagagtatcacca

SEQ ID NO: 685903 - DNA, 20 bp, Artificial
  CRISPR gRNA sequence
gaagagtatcaccaactgcc

SEQ ID NO: 685904 - DNA, 20 bp, Artificial
  CRISPR gRNA sequence
aagagtatcaccaactgcct

SEQ ID NO: 685905 - DNA, 20 bp, Artificial
  CRISPR gRNA sequence
cctcatgtgtggtgaccttc

SEQ ID NO: 685906 - DNA, 20 bp, Artificial
  CRISPR gRNA sequence
atgtgtggtgaccttcactg

SEQ ID NO: 685907 - DNA, 20 bp, Artificial
  CRISPR gRNA sequence
cactgtcgtatgccagtgac

SEQ ID NO: 685908 - DNA, 20 bp, Artificial
  CRISPR gRNA sequence
actgtcgtatgccagtgact

SEQ ID NO: 685909 - DNA, 20 bp, Artificial
  CRISPR gRNA sequence
tcgtatgccagtgactcatc

SEQ ID NO: 685910 - DNA, 20 bp, Artificial
  CRISPR gRNA sequence
atctggagtaatctcaacaa

SEQ ID NO: 685911 - DNA, 20 bp, Artificial
  CRISPR gRNA sequence
gagtaatctcaacaacgagt

SEQ ID NO: 685912 - DNA, 20 bp, Artificial
  CRISPR gRNA sequence
aacaacgagttaccaatact

SEQ ID NO: 685913 - DNA, 20 bp, Artificial
  CRISPR gRNA sequence
ccaatacttgctcttgattg

SEQ ID NO: 685914 - DNA, 20 bp, Artificial
  CRISPR gRNA sequence
gctcttgattgataaacaga

SEQ ID NO: 685915 - DNA, 20 bp, Artificial
  CRISPR gRNA sequence
ctcttgattgataaacagaa

SEQ ID NO: 685916 - DNA, 20 bp, Artificial
  CRISPR gRNA sequence
ttgattgataaacagaatgg

SEQ ID NO: 685917 - DNA, 20 bp, Artificial
  CRISPR gRNA sequence
gattgataaacagaatgggg

SEQ ID NO: 685918 - DNA, 20 bp, Artificial
  CRISPR gRNA sequence
attgataaacagaatggggt

SEQ ID NO: 685919 - DNA, 20 bp, Artificial
  CRISPR gRNA sequence
ataaacagaatggggttttg

SEQ ID NO: 685920 - DNA, 20 bp, Artificial
  CRISPR gRNA sequence
tggatcttagcaattctcac

SEQ ID NO: 685921 - DNA, 20 bp, Artificial
  CRISPR gRNA sequence
ggatcttagcaattctcaca

SEQ ID NO: 685922 - DNA, 20 bp, Artificial
  CRISPR gRNA sequence
gatcttagcaattctcacaa

SEQ ID NO: 685923 - DNA, 20 bp, Artificial
  CRISPR gRNA sequence
agcaattctcacaattctca

SEQ ID NO: 685924 - DNA, 20 bp, Artificial
  CRISPR gRNA sequence
gcaattctcacaattctcat

SEQ ID NO: 685925 - DNA, 20 bp, Artificial
  CRISPR gRNA sequence
tcacaattctcatgtattcc

SEQ ID NO: 685926 - DNA, 20 bp, Artificial
  CRISPR gRNA sequence
acaattctcatgtattccac

SEQ ID NO: 685927 - DNA, 20 bp, Artificial
  CRISPR gRNA sequence
tcatgtattccacagcagca

SEQ ID NO: 685928 - DNA, 20 bp, Artificial
  CRISPR gRNA sequence
atgtattccacagcagcaaa

SEQ ID NO: 685929 - DNA, 20 bp, Artificial
  CRISPR gRNA sequence
cacagcagcaaagtttagta

SEQ ID NO: 685930 - DNA, 20 bp, Artificial
  CRISPR gRNA sequence
agtaagtattgccttctaag

SEQ ID NO: 685931 - DNA, 20 bp, Artificial
  CRISPR gRNA sequence
gtaagtattgccttctaagt

SEQ ID NO: 685932 - DNA, 20 bp, Artificial
  CRISPR gRNA sequence
ccttctaagtataatttaaa

SEQ ID NO: 685933 - DNA, 20 bp, Artificial
  CRISPR gRNA sequence
ctaagtataatttaaatttt

SEQ ID NO: 685934 - DNA, 20 bp, Artificial
  CRISPR gRNA sequence
taagtataatttaaattttt

SEQ ID NO: 685935 - DNA, 20 bp, Artificial
  CRISPR gRNA sequence
agtataatttaaatttttat

SEQ ID NO: 685936 - DNA, 20 bp, Artificial
  CRISPR gRNA sequence
aaatttttataaattaaata

SEQ ID NO: 685937 - DNA, 20 bp, Artificial
  CRISPR gRNA sequence
aatttttataaattaaataa

SEQ ID NO: 685938 - DNA, 20 bp, Artificial
  CRISPR gRNA sequence
ttataaattaaataatttca

SEQ ID NO: 685939 - DNA, 20 bp, Artificial
  CRISPR gRNA sequence
tataaattaaataatttcaa

SEQ ID NO: 685940 - DNA, 20 bp, Artificial
  CRISPR gRNA sequence
ataaattaaataatttcaag

SEQ ID NO: 685941 - DNA, 20 bp, Artificial
  CRISPR gRNA sequence
taaattaaataatttcaaga

SEQ ID NO: 685942 - DNA, 20 bp, Artificial
  CRISPR gRNA sequence
aataatttcaagaacattta

SEQ ID NO: 685943 - DNA, 20 bp, Artificial
  CRISPR gRNA sequence
caagaacatttaccttgttt

SEQ ID NO: 685944 - DNA, 20 bp, Artificial
  CRISPR gRNA sequence
aagaacatttaccttgtttt

SEQ ID NO: 685945 - DNA, 20 bp, Artificial
  CRISPR gRNA sequence
accttgttttaagcagtttg

SEQ ID NO: 685946 - DNA, 20 bp, Artificial
  CRISPR gRNA sequence
ccttgttttaagcagtttgc

SEQ ID NO: 685947 - DNA, 20 bp, Artificial
  CRISPR gRNA sequence
gttttaagcagtttgcttcc

SEQ ID NO: 685948 - DNA, 20 bp, Artificial
  CRISPR gRNA sequence
ttttaagcagtttgcttcca

SEQ ID NO: 685949 - DNA, 20 bp, Artificial
  CRISPR gRNA sequence
taagcagtttgcttccagtt

SEQ ID NO: 685950 - DNA, 20 bp, Artificial
  CRISPR gRNA sequence
aagcagtttgcttccagttg

SEQ ID NO: 685951 - DNA, 20 bp, Artificial
  CRISPR gRNA sequence
agcagtttgcttccagttgt

SEQ ID NO: 685952 - DNA, 20 bp, Artificial
  CRISPR gRNA sequence
gcttccagttgttccagttg

SEQ ID NO: 685953 - DNA, 20 bp, Artificial
  CRISPR gRNA sequence
cttccagttgttccagttga

SEQ ID NO: 685954 - DNA, 20 bp, Artificial
  CRISPR gRNA sequence
ccagttgttccagttgaatt

SEQ ID NO: 685955 - DNA, 20 bp, Artificial
  CRISPR gRNA sequence
cagttgttccagttgaattg

SEQ ID NO: 685956 - DNA, 20 bp, Artificial
  CRISPR gRNA sequence
ttccagttgaattgtaaact

SEQ ID NO: 685957 - DNA, 20 bp, Artificial
  CRISPR gRNA sequence
cagttgaattgtaaactgaa

SEQ ID NO: 685958 - DNA, 20 bp, Artificial
  CRISPR gRNA sequence
aattgtaaactgaaaaatat

SEQ ID NO: 685959 - DNA, 20 bp, Artificial
  CRISPR gRNA sequence
taaactgaaaaatatattgc

SEQ ID NO: 685960 - DNA, 20 bp, Artificial
  CRISPR gRNA sequence
aaaaatatattgcttttgta

SEQ ID NO: 685961 - DNA, 20 bp, Artificial
  CRISPR gRNA sequence
cttttgtacaatcatttttc

SEQ ID NO: 685962 - DNA, 20 bp, Artificial
  CRISPR gRNA sequence
ttgtacaatcatttttcatt

SEQ ID NO: 685963 - DNA, 20 bp, Artificial
  CRISPR gRNA sequence
tgtacaatcatttttcatta

SEQ ID NO: 685964 - DNA, 20 bp, Artificial
  CRISPR gRNA sequence
gtacaatcatttttcattac

SEQ ID NO: 685965 - DNA, 20 bp, Artificial
  CRISPR gRNA sequence
tacaatcatttttcattaca

SEQ ID NO: 685966 - DNA, 20 bp, Artificial
  CRISPR gRNA sequence
ttcattacaaatctatcaga

SEQ ID NO: 685967 - DNA, 20 bp, Artificial
  CRISPR gRNA sequence
tcattacaaatctatcagaa

SEQ ID NO: 685968 - DNA, 20 bp, Artificial
  CRISPR gRNA sequence
cattacaaatctatcagaag

SEQ ID NO: 685969 - DNA, 20 bp, Artificial
  CRISPR gRNA sequence
attacaaatctatcagaaga

SEQ ID NO: 685970 - DNA, 20 bp, Artificial
  CRISPR gRNA sequence
caaatctatcagaagaaatt

SEQ ID NO: 685971 - DNA, 20 bp, Artificial
  CRISPR gRNA sequence
tcagaagaaattctttgtaa

SEQ ID NO: 685972 - DNA, 20 bp, Artificial
  CRISPR gRNA sequence
tttgtaatgaatatatcatc

SEQ ID NO: 685973 - DNA, 20 bp, Artificial
  CRISPR gRNA sequence
tgtaatgaatatatcatcag

SEQ ID NO: 685974 - DNA, 20 bp, Artificial
  CRISPR gRNA sequence
gtaatgaatatatcatcagt

SEQ ID NO: 685975 - DNA, 20 bp, Artificial
  CRISPR gRNA sequence
taatgaatatatcatcagtt

SEQ ID NO: 685976 - DNA, 20 bp, Artificial
  CRISPR gRNA sequence
ggctttgcatattcaaatgc

SEQ ID NO: 685977 - DNA, 20 bp, Artificial
  CRISPR gRNA sequence
gctttgcatattcaaatgca

SEQ ID NO: 685978 - DNA, 20 bp, Artificial
  CRISPR gRNA sequence
tgcatattcaaatgcagcag

SEQ ID NO: 685979 - DNA, 20 bp, Artificial
  CRISPR gRNA sequence
gcatattcaaatgcagcaga

SEQ ID NO: 685980 - DNA, 20 bp, Artificial
  CRISPR gRNA sequence
catattcaaatgcagcagaa

SEQ ID NO: 685981 - DNA, 20 bp, Artificial
  CRISPR gRNA sequence
aaatgcagcagaatttaatg

SEQ ID NO: 685982 - DNA, 20 bp, Artificial
  CRISPR gRNA sequence
aatgtggtgcctgcacatgg

SEQ ID NO: 685983 - DNA, 20 bp, Artificial
  CRISPR gRNA sequence
atgtggtgcctgcacatggg

SEQ ID NO: 685984 - DNA, 20 bp, Artificial
  CRISPR gRNA sequence
cacatgggaagtgttgtgga

SEQ ID NO: 685985 - DNA, 20 bp, Artificial
  CRISPR gRNA sequence
tggatgtttattgactgaca

SEQ ID NO: 685986 - DNA, 20 bp, Artificial
  CRISPR gRNA sequence
attgactgacacacagtttg

SEQ ID NO: 685987 - DNA, 20 bp, Artificial
  CRISPR gRNA sequence
ttgactgacacacagtttgt

SEQ ID NO: 685988 - DNA, 20 bp, Artificial
  CRISPR gRNA sequence
actgacacacagtttgttta

SEQ ID NO: 685989 - DNA, 20 bp, Artificial
  CRISPR gRNA sequence
acacacagtttgtttagata

SEQ ID NO: 685990 - DNA, 20 bp, Artificial
  CRISPR gRNA sequence
gtttagatagataaggctgc

SEQ ID NO: 685991 - DNA, 20 bp, Artificial
  CRISPR gRNA sequence
tttagatagataaggctgct

SEQ ID NO: 685992 - DNA, 20 bp, Artificial
  CRISPR gRNA sequence
agatagataaggctgctttt

SEQ ID NO: 685993 - DNA, 20 bp, Artificial
  CRISPR gRNA sequence
gatagataaggctgcttttc

SEQ ID NO: 685994 - DNA, 20 bp, Artificial
  CRISPR gRNA sequence
cttttccattggataactgt

SEQ ID NO: 685995 - DNA, 20 bp, Artificial
  CRISPR gRNA sequence
ttccattggataactgtggg

SEQ ID NO: 685996 - DNA, 20 bp, Artificial
  CRISPR gRNA sequence
tccattggataactgtgggg

SEQ ID NO: 685997 - DNA, 20 bp, Artificial
  CRISPR gRNA sequence
ccattggataactgtggggg

SEQ ID NO: 685998 - DNA, 20 bp, Artificial
  CRISPR gRNA sequence
cattggataactgtggggga

SEQ ID NO: 685999 - DNA, 20 bp, Artificial
  CRISPR gRNA sequence
gataactgtgggggatttag

SEQ ID NO: 686000 - DNA, 20 bp, Artificial
  CRISPR gRNA sequence
tgggggatttagctccaaat

SEQ ID NO: 686001 - DNA, 20 bp, Artificial
  CRISPR gRNA sequence
agctccaaattaattcatta

SEQ ID NO: 686002 - DNA, 20 bp, Artificial
  CRISPR gRNA sequence
gctccaaattaattcattaa

SEQ ID NO: 686003 - DNA, 20 bp, Artificial
  CRISPR gRNA sequence
caaattaattcattaacatt

SEQ ID NO: 686004 - DNA, 20 bp, Artificial
  CRISPR gRNA sequence
attcattaacatttcataag

SEQ ID NO: 686005 - DNA, 20 bp, Artificial
  CRISPR gRNA sequence
attaacatttcataagagat

SEQ ID NO: 686006 - DNA, 20 bp, Artificial
  CRISPR gRNA sequence
acatttcataagagatctta

SEQ ID NO: 686007 - DNA, 20 bp, Artificial
  CRISPR gRNA sequence
cataagagatcttaacagtt

SEQ ID NO: 686008 - DNA, 20 bp, Artificial
  CRISPR gRNA sequence
ataagagatcttaacagtta

SEQ ID NO: 686009 - DNA, 20 bp, Artificial
  CRISPR gRNA sequence
aacagttacttattctttcc

SEQ ID NO: 686010 - DNA, 20 bp, Artificial
  CRISPR gRNA sequence
acagttacttattctttccc

SEQ ID NO: 686011 - DNA, 20 bp, Artificial
  CRISPR gRNA sequence
cttattctttcccaaggtat

SEQ ID NO: 686012 - DNA, 20 bp, Artificial
  CRISPR gRNA sequence
attctttcccaaggtatcac

SEQ ID NO: 686013 - DNA, 20 bp, Artificial
  CRISPR gRNA sequence
ttctttcccaaggtatcaca

SEQ ID NO: 686014 - DNA, 20 bp, Artificial
  CRISPR gRNA sequence
tttcccaaggtatcacagta

SEQ ID NO: 686015 - DNA, 20 bp, Artificial
  CRISPR gRNA sequence
tcccaaggtatcacagtata

SEQ ID NO: 686016 - DNA, 20 bp, Artificial
  CRISPR gRNA sequence
cccaaggtatcacagtatat

SEQ ID NO: 686017 - DNA, 20 bp, Artificial
  CRISPR gRNA sequence
ccaaggtatcacagtatatg

SEQ ID NO: 686018 - DNA, 20 bp, Artificial
  CRISPR gRNA sequence
ctaaatttaatcctagaaga

SEQ ID NO: 686019 - DNA, 20 bp, Artificial
  CRISPR gRNA sequence
taaatttaatcctagaagaa

SEQ ID NO: 686020 - DNA, 20 bp, Artificial
  CRISPR gRNA sequence
aatttaatcctagaagaaaa

SEQ ID NO: 686021 - DNA, 20 bp, Artificial
  CRISPR gRNA sequence
aatcctagaagaaaatattg

SEQ ID NO: 686022 - DNA, 20 bp, Artificial
  CRISPR gRNA sequence
atcctagaagaaaatattga

SEQ ID NO: 686023 - DNA, 20 bp, Artificial
  CRISPR gRNA sequence
gaagaaaatattgagagtat

SEQ ID NO: 686024 - DNA, 20 bp, Artificial
  CRISPR gRNA sequence
agagtataagaattatgatc

SEQ ID NO: 686025 - DNA, 20 bp, Artificial
  CRISPR gRNA sequence
tgatcttttcatttgatcat

SEQ ID NO: 686026 - DNA, 20 bp, Artificial
  CRISPR gRNA sequence
ttcatttgatcatttcagga

SEQ ID NO: 686027 - DNA, 20 bp, Artificial
  CRISPR gRNA sequence
tcatttgatcatttcaggat

SEQ ID NO: 686028 - DNA, 20 bp, Artificial
  CRISPR gRNA sequence
catttgatcatttcaggatt

SEQ ID NO: 686029 - DNA, 20 bp, Artificial
  CRISPR gRNA sequence
atttgatcatttcaggattg

SEQ ID NO: 686030 - DNA, 20 bp, Artificial
  CRISPR gRNA sequence
gatcatttcaggattgtctt

SEQ ID NO: 686031 - DNA, 20 bp, Artificial
  CRISPR gRNA sequence
atcatttcaggattgtcttt

SEQ ID NO: 686032 - DNA, 20 bp, Artificial
  CRISPR gRNA sequence
caggattgtctttatatctt

SEQ ID NO: 686033 - DNA, 20 bp, Artificial
  CRISPR gRNA sequence
aggattgtctttatatcttt

SEQ ID NO: 686034 - DNA, 20 bp, Artificial
  CRISPR gRNA sequence
tctttatatcttttatttgc

SEQ ID NO: 686035 - DNA, 20 bp, Artificial
  CRISPR gRNA sequence
tatatcttttatttgcaggt

SEQ ID NO: 686036 - DNA, 20 bp, Artificial
  CRISPR gRNA sequence
atatcttttatttgcaggta

SEQ ID NO: 686037 - DNA, 20 bp, Artificial
  CRISPR gRNA sequence
tatcttttatttgcaggtaa

SEQ ID NO: 686038 - DNA, 20 bp, Artificial
  CRISPR gRNA sequence
ttatttgcaggtaaacaatc

SEQ ID NO: 686039 - DNA, 20 bp, Artificial
  CRISPR gRNA sequence
tatttgcaggtaaacaatca

SEQ ID NO: 686040 - DNA, 20 bp, Artificial
  CRISPR gRNA sequence
atttgcaggtaaacaatcat

SEQ ID NO: 686041 - DNA, 20 bp, Artificial
  CRISPR gRNA sequence
tttgcaggtaaacaatcatg

SEQ ID NO: 686042 - DNA, 20 bp, Artificial
  CRISPR gRNA sequence
gcaggtaaacaatcatgggg

SEQ ID NO: 686043 - DNA, 20 bp, Artificial
  CRISPR gRNA sequence
caggtaaacaatcatggggc

SEQ ID NO: 686044 - DNA, 20 bp, Artificial
  CRISPR gRNA sequence
gaaaatgaggctttaattgt

SEQ ID NO: 686045 - DNA, 20 bp, Artificial
  CRISPR gRNA sequence
taattgtaagatgtcctaga

SEQ ID NO: 686046 - DNA, 20 bp, Artificial
  CRISPR gRNA sequence
aattgtaagatgtcctagac

SEQ ID NO: 686047 - DNA, 20 bp, Artificial
  CRISPR gRNA sequence
attgtaagatgtcctagaca

SEQ ID NO: 686048 - DNA, 20 bp, Artificial
  CRISPR gRNA sequence
taagatgtcctagacaagga

SEQ ID NO: 686049 - DNA, 20 bp, Artificial
  CRISPR gRNA sequence
gacaaggaaaacctagttac

SEQ ID NO: 686050 - DNA, 20 bp, Artificial
  CRISPR gRNA sequence
gttacaccgtggattggtat

SEQ ID NO: 686051 - DNA, 20 bp, Artificial
  CRISPR gRNA sequence
caccgtggattggtattact

SEQ ID NO: 686052 - DNA, 20 bp, Artificial
  CRISPR gRNA sequence
gtattactcacaaacaaaca

SEQ ID NO: 686053 - DNA, 20 bp, Artificial
  CRISPR gRNA sequence
ctcacaaacaaacaaaagta

SEQ ID NO: 686054 - DNA, 20 bp, Artificial
  CRISPR gRNA sequence
acaaacaaacaaaagtattc

SEQ ID NO: 686055 - DNA, 20 bp, Artificial
  CRISPR gRNA sequence
ccactcaggaaagaaatcgt

SEQ ID NO: 686056 - DNA, 20 bp, Artificial
  CRISPR gRNA sequence
aggaaagaaatcgtgtgttt

SEQ ID NO: 686057 - DNA, 20 bp, Artificial
  CRISPR gRNA sequence
gcctcaggccaacttctgaa

SEQ ID NO: 686058 - DNA, 20 bp, Artificial
  CRISPR gRNA sequence
cctcaggccaacttctgaag

SEQ ID NO: 686059 - DNA, 20 bp, Artificial
  CRISPR gRNA sequence
aggccaacttctgaagtttc

SEQ ID NO: 686060 - DNA, 20 bp, Artificial
  CRISPR gRNA sequence
ctgaagtttctaccagctgc

SEQ ID NO: 686061 - DNA, 20 bp, Artificial
  CRISPR gRNA sequence
tgaagtttctaccagctgca

SEQ ID NO: 686062 - DNA, 20 bp, Artificial
  CRISPR gRNA sequence
aagtttctaccagctgcagt

SEQ ID NO: 686063 - DNA, 20 bp, Artificial
  CRISPR gRNA sequence
ctaccagctgcagttgctga

SEQ ID NO: 686064 - DNA, 20 bp, Artificial
  CRISPR gRNA sequence
taccagctgcagttgctgat

SEQ ID NO: 686065 - DNA, 20 bp, Artificial
  CRISPR gRNA sequence
ccagctgcagttgctgattc

SEQ ID NO: 686066 - DNA, 20 bp, Artificial
  CRISPR gRNA sequence
cagttgctgattctggtatt

SEQ ID NO: 686067 - DNA, 20 bp, Artificial
  CRISPR gRNA sequence
ctgattctggtatttatacc

SEQ ID NO: 686068 - DNA, 20 bp, Artificial
  CRISPR gRNA sequence
attctggtatttatacctgt

SEQ ID NO: 686069 - DNA, 20 bp, Artificial
  CRISPR gRNA sequence
tggtatttatacctgtattg

SEQ ID NO: 686070 - DNA, 20 bp, Artificial
  CRISPR gRNA sequence
gtatttatacctgtattgtc

SEQ ID NO: 686071 - DNA, 20 bp, Artificial
  CRISPR gRNA sequence
atacctgtattgtcagaagg

SEQ ID NO: 686072 - DNA, 20 bp, Artificial
  CRISPR gRNA sequence
tacctgtattgtcagaaggt

SEQ ID NO: 686073 - DNA, 20 bp, Artificial
  CRISPR gRNA sequence
tattgtcagaaggtattatg

SEQ ID NO: 686074 - DNA, 20 bp, Artificial
  CRISPR gRNA sequence
tcagaaggtattatgcagaa

SEQ ID NO: 686075 - DNA, 20 bp, Artificial
  CRISPR gRNA sequence
tgcagaaggctcccatcttc

SEQ ID NO: 686076 - DNA, 20 bp, Artificial
  CRISPR gRNA sequence
ccatcttctttcaccctgct

SEQ ID NO: 686077 - DNA, 20 bp, Artificial
  CRISPR gRNA sequence
ctttcaccctgctccccttt

SEQ ID NO: 686078 - DNA, 20 bp, Artificial
  CRISPR gRNA sequence
tttcaccctgctcccctttc

SEQ ID NO: 686079 - DNA, 20 bp, Artificial
  CRISPR gRNA sequence
tcaccctgctcccctttctt

SEQ ID NO: 686080 - DNA, 20 bp, Artificial
  CRISPR gRNA sequence
caccctgctcccctttcttc

SEQ ID NO: 686081 - DNA, 20 bp, Artificial
  CRISPR gRNA sequence
accctgctcccctttcttca

SEQ ID NO: 686082 - DNA, 20 bp, Artificial
  CRISPR gRNA sequence
ctcccctttcttcagtggtt

SEQ ID NO: 686083 - DNA, 20 bp, Artificial
  CRISPR gRNA sequence
ccctttcttcagtggttgat

SEQ ID NO: 686084 - DNA, 20 bp, Artificial
  CRISPR gRNA sequence
tcttcagtggttgattgcct

SEQ ID NO: 686085 - DNA, 20 bp, Artificial
  CRISPR gRNA sequence
cttcagtggttgattgcctg

SEQ ID NO: 686086 - DNA, 20 bp, Artificial
  CRISPR gRNA sequence
ttcagtggttgattgcctga

SEQ ID NO: 686087 - DNA, 20 bp, Artificial
  CRISPR gRNA sequence
cagtggttgattgcctgagc

SEQ ID NO: 686088 - DNA, 20 bp, Artificial
  CRISPR gRNA sequence
agtggttgattgcctgagct

SEQ ID NO: 686089 - DNA, 20 bp, Artificial
  CRISPR gRNA sequence
attgcctgagctgcccttgc

SEQ ID NO: 686090 - DNA, 20 bp, Artificial
  CRISPR gRNA sequence
cctgagctgcccttgctttc

SEQ ID NO: 686091 - DNA, 20 bp, Artificial
  CRISPR gRNA sequence
agctgcccttgctttcattc

SEQ ID NO: 686092 - DNA, 20 bp, Artificial
  CRISPR gRNA sequence
cccttgctttcattccttcc

SEQ ID NO: 686093 - DNA, 20 bp, Artificial
  CRISPR gRNA sequence
gctttcattccttccctagt

SEQ ID NO: 686094 - DNA, 20 bp, Artificial
  CRISPR gRNA sequence
ctttcattccttccctagtc

SEQ ID NO: 686095 - DNA, 20 bp, Artificial
  CRISPR gRNA sequence
tcattccttccctagtcctt

SEQ ID NO: 686096 - DNA, 20 bp, Artificial
  CRISPR gRNA sequence
cattccttccctagtccttt

SEQ ID NO: 686097 - DNA, 20 bp, Artificial
  CRISPR gRNA sequence
attccttccctagtcctttc

SEQ ID NO: 686098 - DNA, 20 bp, Artificial
  CRISPR gRNA sequence
cttccctagtcctttctgga

SEQ ID NO: 686099 - DNA, 20 bp, Artificial
  CRISPR gRNA sequence
ccctagtcctttctggaaca

SEQ ID NO: 686100 - DNA, 20 bp, Artificial
  CRISPR gRNA sequence
cctagtcctttctggaacag

SEQ ID NO: 686101 - DNA, 20 bp, Artificial
  CRISPR gRNA sequence
gtcctttctggaacagttaa

SEQ ID NO: 686102 - DNA, 20 bp, Artificial
  CRISPR gRNA sequence
tctggaacagttaaatttat

SEQ ID NO: 686103 - DNA, 20 bp, Artificial
  CRISPR gRNA sequence
ctggaacagttaaatttata

SEQ ID NO: 686104 - DNA, 20 bp, Artificial
  CRISPR gRNA sequence
tggaacagttaaatttataa

SEQ ID NO: 686105 - DNA, 20 bp, Artificial
  CRISPR gRNA sequence
gaacagttaaatttataaaa

SEQ ID NO: 686106 - DNA, 20 bp, Artificial
  CRISPR gRNA sequence
aatttataaaatgatttgaa

SEQ ID NO: 686107 - DNA, 20 bp, Artificial
  CRISPR gRNA sequence
ataaaatgatttgaataaaa

SEQ ID NO: 686108 - DNA, 20 bp, Artificial
  CRISPR gRNA sequence
taaaatgatttgaataaaag

SEQ ID NO: 686109 - DNA, 20 bp, Artificial
  CRISPR gRNA sequence
gaataaaagtgatttggata

SEQ ID NO: 686110 - DNA, 20 bp, Artificial
  CRISPR gRNA sequence
aataaaagtgatttggataa

SEQ ID NO: 686111 - DNA, 20 bp, Artificial
  CRISPR gRNA sequence
ggataaacttctaggaatac

SEQ ID NO: 686112 - DNA, 20 bp, Artificial
  CRISPR gRNA sequence
gataaacttctaggaatact

SEQ ID NO: 686113 - DNA, 20 bp, Artificial
  CRISPR gRNA sequence
ctaggaatactatcaggttg

SEQ ID NO: 686114 - DNA, 20 bp, Artificial
  CRISPR gRNA sequence
taggaatactatcaggttga

SEQ ID NO: 686115 - DNA, 20 bp, Artificial
  CRISPR gRNA sequence
ggaatactatcaggttgagg

SEQ ID NO: 686116 - DNA, 20 bp, Artificial
  CRISPR gRNA sequence
tcaggttgaggtctagctca

SEQ ID NO: 686117 - DNA, 20 bp, Artificial
  CRISPR gRNA sequence
aggtctagctcattctgagc

SEQ ID NO: 686118 - DNA, 20 bp, Artificial
  CRISPR gRNA sequence
gctcattctgagctatttgg

SEQ ID NO: 686119 - DNA, 20 bp, Artificial
  CRISPR gRNA sequence
attctgagctatttggattt

SEQ ID NO: 686120 - DNA, 20 bp, Artificial
  CRISPR gRNA sequence
tgagctatttggatttacag

SEQ ID NO: 686121 - DNA, 20 bp, Artificial
  CRISPR gRNA sequence
agctatttggatttacagtt

SEQ ID NO: 686122 - DNA, 20 bp, Artificial
  CRISPR gRNA sequence
tttggatttacagttgcagg

SEQ ID NO: 686123 - DNA, 20 bp, Artificial
  CRISPR gRNA sequence
ggatttacagttgcagggat

SEQ ID NO: 686124 - DNA, 20 bp, Artificial
  CRISPR gRNA sequence
gatttacagttgcagggatt

SEQ ID NO: 686125 - DNA, 20 bp, Artificial
  CRISPR gRNA sequence
acagttgcagggattgattt

SEQ ID NO: 686126 - DNA, 20 bp, Artificial
  CRISPR gRNA sequence
cagttgcagggattgatttg

SEQ ID NO: 686127 - DNA, 20 bp, Artificial
  CRISPR gRNA sequence
cagggattgatttgtagctg

SEQ ID NO: 686128 - DNA, 20 bp, Artificial
  CRISPR gRNA sequence
atttgtagctgacttagaga

SEQ ID NO: 686129 - DNA, 20 bp, Artificial
  CRISPR gRNA sequence
gtagctgacttagagaaaaa

SEQ ID NO: 686130 - DNA, 20 bp, Artificial
  CRISPR gRNA sequence
tagctgacttagagaaaaac

SEQ ID NO: 686131 - DNA, 20 bp, Artificial
  CRISPR gRNA sequence
acttagagaaaaacctagct

SEQ ID NO: 686132 - DNA, 20 bp, Artificial
  CRISPR gRNA sequence
agagaaaaacctagctttcc

SEQ ID NO: 686133 - DNA, 20 bp, Artificial
  CRISPR gRNA sequence
gagaaaaacctagctttcct

SEQ ID NO: 686134 - DNA, 20 bp, Artificial
  CRISPR gRNA sequence
gctttcctagtgaccaagat

SEQ ID NO: 686135 - DNA, 20 bp, Artificial
  CRISPR gRNA sequence
tcctagtgaccaagataact

SEQ ID NO: 686136 - DNA, 20 bp, Artificial
  CRISPR gRNA sequence
cctagtgaccaagataactg

SEQ ID NO: 686137 - DNA, 20 bp, Artificial
  CRISPR gRNA sequence
ctagtgaccaagataactga

SEQ ID NO: 686138 - DNA, 20 bp, Artificial
  CRISPR gRNA sequence
gtgaccaagataactgagag

SEQ ID NO: 686139 - DNA, 20 bp, Artificial
  CRISPR gRNA sequence
agagcaattgcttacttttg

SEQ ID NO: 686140 - DNA, 20 bp, Artificial
  CRISPR gRNA sequence
cttacttttggctggaatta

SEQ ID NO: 686141 - DNA, 20 bp, Artificial
  CRISPR gRNA sequence
acttttggctggaattaaga

SEQ ID NO: 686142 - DNA, 20 bp, Artificial
  CRISPR gRNA sequence
cttttggctggaattaagaa

SEQ ID NO: 686143 - DNA, 20 bp, Artificial
  CRISPR gRNA sequence
ttggctggaattaagaacaa

SEQ ID NO: 686144 - DNA, 20 bp, Artificial
  CRISPR gRNA sequence
tggctggaattaagaacaaa

SEQ ID NO: 686145 - DNA, 20 bp, Artificial
  CRISPR gRNA sequence
ggctggaattaagaacaaac

SEQ ID NO: 686146 - DNA, 20 bp, Artificial
  CRISPR gRNA sequence
gctggaattaagaacaaact

SEQ ID NO: 686147 - DNA, 20 bp, Artificial
  CRISPR gRNA sequence
gaattaagaacaaactagca

SEQ ID NO: 686148 - DNA, 20 bp, Artificial
  CRISPR gRNA sequence
agaacaaactagcacagaaa

SEQ ID NO: 686149 - DNA, 20 bp, Artificial
  CRISPR gRNA sequence
gcacagaaaatagtaatctg

SEQ ID NO: 686150 - DNA, 20 bp, Artificial
  CRISPR gRNA sequence
gatgttttccatctcagggg

SEQ ID NO: 686151 - DNA, 20 bp, Artificial
  CRISPR gRNA sequence
tccatctcagggggcctcta

SEQ ID NO: 686152 - DNA, 20 bp, Artificial
  CRISPR gRNA sequence
ccatctcagggggcctctag

SEQ ID NO: 686153 - DNA, 20 bp, Artificial
  CRISPR gRNA sequence
catctcagggggcctctagt

SEQ ID NO: 686154 - DNA, 20 bp, Artificial
  CRISPR gRNA sequence
agggggcctctagtaggtga

SEQ ID NO: 686155 - DNA, 20 bp, Artificial
  CRISPR gRNA sequence
tagtaggtgaaaaggggctt

SEQ ID NO: 686156 - DNA, 20 bp, Artificial
  CRISPR gRNA sequence
gtaggtgaaaaggggcttct

SEQ ID NO: 686157 - DNA, 20 bp, Artificial
  CRISPR gRNA sequence
ctaaccttcaagttaagcca

SEQ ID NO: 686158 - DNA, 20 bp, Artificial
  CRISPR gRNA sequence
taaccttcaagttaagccac

SEQ ID NO: 686159 - DNA, 20 bp, Artificial
  CRISPR gRNA sequence
accttcaagttaagccacag

SEQ ID NO: 686160 - DNA, 20 bp, Artificial
  CRISPR gRNA sequence
caagttaagccacagaaggc

SEQ ID NO: 686161 - DNA, 20 bp, Artificial
  CRISPR gRNA sequence
aagttaagccacagaaggct

SEQ ID NO: 686162 - DNA, 20 bp, Artificial
  CRISPR gRNA sequence
agccacagaaggctgatgag

SEQ ID NO: 686163 - DNA, 20 bp, Artificial
  CRISPR gRNA sequence
atgagattgtgtgcctaaaa

SEQ ID NO: 686164 - DNA, 20 bp, Artificial
  CRISPR gRNA sequence
tgtgcctaaaaattaattac

SEQ ID NO: 686165 - DNA, 20 bp, Artificial
  CRISPR gRNA sequence
aaaattaattacttttgttc

SEQ ID NO: 686166 - DNA, 20 bp, Artificial
  CRISPR gRNA sequence
attacttttgttcacaaatt

SEQ ID NO: 686167 - DNA, 20 bp, Artificial
  CRISPR gRNA sequence
cttttgttcacaaattgtta

SEQ ID NO: 686168 - DNA, 20 bp, Artificial
  CRISPR gRNA sequence
ttgttcacaaattgttaaat

SEQ ID NO: 686169 - DNA, 20 bp, Artificial
  CRISPR gRNA sequence
tgttcacaaattgttaaatg

SEQ ID NO: 686170 - DNA, 20 bp, Artificial
  CRISPR gRNA sequence
gttcacaaattgttaaatgt

SEQ ID NO: 686171 - DNA, 20 bp, Artificial
  CRISPR gRNA sequence
ttcacaaattgttaaatgtt

SEQ ID NO: 686172 - DNA, 20 bp, Artificial
  CRISPR gRNA sequence
acaaattgttaaatgttttg

SEQ ID NO: 686173 - DNA, 20 bp, Artificial
  CRISPR gRNA sequence
ttaaatgttttgattttgtg

SEQ ID NO: 686174 - DNA, 20 bp, Artificial
  CRISPR gRNA sequence
aatgttttgattttgtggct

SEQ ID NO: 686175 - DNA, 20 bp, Artificial
  CRISPR gRNA sequence
tgattttgtggctgtatttg

SEQ ID NO: 686176 - DNA, 20 bp, Artificial
  CRISPR gRNA sequence
gattttgtggctgtatttgg

SEQ ID NO: 686177 - DNA, 20 bp, Artificial
  CRISPR gRNA sequence
attttgtggctgtatttggc

SEQ ID NO: 686178 - DNA, 20 bp, Artificial
  CRISPR gRNA sequence
tgtggctgtatttggcacac

SEQ ID NO: 686179 - DNA, 20 bp, Artificial
  CRISPR gRNA sequence
gtggctgtatttggcacaca

SEQ ID NO: 686180 - DNA, 20 bp, Artificial
  CRISPR gRNA sequence
tggctgtatttggcacacac

SEQ ID NO: 686181 - DNA, 20 bp, Artificial
  CRISPR gRNA sequence
tatttggcacacacaaaatg

SEQ ID NO: 686182 - DNA, 20 bp, Artificial
  CRISPR gRNA sequence
ggcacacacaaaatgtcaaa

SEQ ID NO: 686183 - DNA, 20 bp, Artificial
  CRISPR gRNA sequence
gcacacacaaaatgtcaaat

SEQ ID NO: 686184 - DNA, 20 bp, Artificial
  CRISPR gRNA sequence
aatcaaaaagcaggatgtat

SEQ ID NO: 686185 - DNA, 20 bp, Artificial
  CRISPR gRNA sequence
gttaagggcctaggtctgag

SEQ ID NO: 686186 - DNA, 20 bp, Artificial
  CRISPR gRNA sequence
agggcctaggtctgagacta

SEQ ID NO: 686187 - DNA, 20 bp, Artificial
  CRISPR gRNA sequence
ggtctgagactagacaagtg

SEQ ID NO: 686188 - DNA, 20 bp, Artificial
  CRISPR gRNA sequence
agactagacaagtgtcaaat

SEQ ID NO: 686189 - DNA, 20 bp, Artificial
  CRISPR gRNA sequence
gacaagtgtcaaattcatgc

SEQ ID NO: 686190 - DNA, 20 bp, Artificial
  CRISPR gRNA sequence
atgctctgccactagttaac

SEQ ID NO: 686191 - DNA, 20 bp, Artificial
  CRISPR gRNA sequence
tgccactagttaactgtgcg

SEQ ID NO: 686192 - DNA, 20 bp, Artificial
  CRISPR gRNA sequence
ccactagttaactgtgcgat

SEQ ID NO: 686193 - DNA, 20 bp, Artificial
  CRISPR gRNA sequence
gttaactgtgcgatgccagc

SEQ ID NO: 686194 - DNA, 20 bp, Artificial
  CRISPR gRNA sequence
actgtgcgatgccagcaagt

SEQ ID NO: 686195 - DNA, 20 bp, Artificial
  CRISPR gRNA sequence
tgcgatgccagcaagttact

SEQ ID NO: 686196 - DNA, 20 bp, Artificial
  CRISPR gRNA sequence
cttctctgcccttcagtttc

SEQ ID NO: 686197 - DNA, 20 bp, Artificial
  CRISPR gRNA sequence
ctctgcccttcagtttcctt

SEQ ID NO: 686198 - DNA, 20 bp, Artificial
  CRISPR gRNA sequence
tctgcccttcagtttccttc

SEQ ID NO: 686199 - DNA, 20 bp, Artificial
  CRISPR gRNA sequence
tgcccttcagtttccttctc

SEQ ID NO: 686200 - DNA, 20 bp, Artificial
  CRISPR gRNA sequence
cccttcagtttccttctctg

SEQ ID NO: 686201 - DNA, 20 bp, Artificial
  CRISPR gRNA sequence
cagtttccttctctgtaaaa

SEQ ID NO: 686202 - DNA, 20 bp, Artificial
  CRISPR gRNA sequence
agtttccttctctgtaaaat

SEQ ID NO: 686203 - DNA, 20 bp, Artificial
  CRISPR gRNA sequence
ccttctctgtaaaatgcata

SEQ ID NO: 686204 - DNA, 20 bp, Artificial
  CRISPR gRNA sequence
cttctctgtaaaatgcatat

SEQ ID NO: 686205 - DNA, 20 bp, Artificial
  CRISPR gRNA sequence
ctctgtaaaatgcatataat

SEQ ID NO: 686206 - DNA, 20 bp, Artificial
  CRISPR gRNA sequence
tctgtaaaatgcatataatg

SEQ ID NO: 686207 - DNA, 20 bp, Artificial
  CRISPR gRNA sequence
tgtaaaatgcatataatgta

SEQ ID NO: 686208 - DNA, 20 bp, Artificial
  CRISPR gRNA sequence
taaaatgcatataatgtaat

SEQ ID NO: 686209 - DNA, 20 bp, Artificial
  CRISPR gRNA sequence
catctcaaagcattattgtg

SEQ ID NO: 686210 - DNA, 20 bp, Artificial
  CRISPR gRNA sequence
atctcaaagcattattgtga

SEQ ID NO: 686211 - DNA, 20 bp, Artificial
  CRISPR gRNA sequence
aaagcattattgtgaaaata

SEQ ID NO: 686212 - DNA, 20 bp, Artificial
  CRISPR gRNA sequence
ttgtgaaaataaactaaggt

SEQ ID NO: 686213 - DNA, 20 bp, Artificial
  CRISPR gRNA sequence
tgaaaataaactaaggtaat

SEQ ID NO: 686214 - DNA, 20 bp, Artificial
  CRISPR gRNA sequence
aggtaatgtgtgaaaagtgc

SEQ ID NO: 686215 - DNA, 20 bp, Artificial
  CRISPR gRNA sequence
atcatcatcactggtacaga

SEQ ID NO: 686216 - DNA, 20 bp, Artificial
  CRISPR gRNA sequence
gtacagagtaaactctgaat

SEQ ID NO: 686217 - DNA, 20 bp, Artificial
  CRISPR gRNA sequence
tgaataaatagtaattatct

SEQ ID NO: 686218 - DNA, 20 bp, Artificial
  CRISPR gRNA sequence
aataaatagtaattatcttt

SEQ ID NO: 686219 - DNA, 20 bp, Artificial
  CRISPR gRNA sequence
tctttattacactgggatta

SEQ ID NO: 686220 - DNA, 20 bp, Artificial
  CRISPR gRNA sequence
tattacactgggattacagc

SEQ ID NO: 686221 - DNA, 20 bp, Artificial
  CRISPR gRNA sequence
attacactgggattacagca

SEQ ID NO: 686222 - DNA, 20 bp, Artificial
  CRISPR gRNA sequence
ttacactgggattacagcat

SEQ ID NO: 686223 - DNA, 20 bp, Artificial
  CRISPR gRNA sequence
cactgggattacagcattac

SEQ ID NO: 686224 - DNA, 20 bp, Artificial
  CRISPR gRNA sequence
ggattacagcattacagcag

SEQ ID NO: 686225 - DNA, 20 bp, Artificial
  CRISPR gRNA sequence
cagcattacagcagatgtag

SEQ ID NO: 686226 - DNA, 20 bp, Artificial
  CRISPR gRNA sequence
cagcagatgtagtgtatgaa

SEQ ID NO: 686227 - DNA, 20 bp, Artificial
  CRISPR gRNA sequence
ttagggctactatgggggct

SEQ ID NO: 686228 - DNA, 20 bp, Artificial
  CRISPR gRNA sequence
gggctactatgggggctatg

SEQ ID NO: 686229 - DNA, 20 bp, Artificial
  CRISPR gRNA sequence
ctatgggggctatgttttta

SEQ ID NO: 686230 - DNA, 20 bp, Artificial
  CRISPR gRNA sequence
tgggggctatgtttttagct

SEQ ID NO: 686231 - DNA, 20 bp, Artificial
  CRISPR gRNA sequence
tgtttttagctcaagtgtaa

SEQ ID NO: 686232 - DNA, 20 bp, Artificial
  CRISPR gRNA sequence
ttagctcaagtgtaacaaaa

SEQ ID NO: 686233 - DNA, 20 bp, Artificial
  CRISPR gRNA sequence
tagctcaagtgtaacaaaaa

SEQ ID NO: 686234 - DNA, 20 bp, Artificial
  CRISPR gRNA sequence
agctcaagtgtaacaaaaaa

SEQ ID NO: 686235 - DNA, 20 bp, Artificial
  CRISPR gRNA sequence
gctcaagtgtaacaaaaaag

SEQ ID NO: 686236 - DNA, 20 bp, Artificial
  CRISPR gRNA sequence
aagtgtaacaaaaaagtatt

SEQ ID NO: 686237 - DNA, 20 bp, Artificial
  CRISPR gRNA sequence
aaactctagattttaatgtt

SEQ ID NO: 686238 - DNA, 20 bp, Artificial
  CRISPR gRNA sequence
aactctagattttaatgttt

SEQ ID NO: 686239 - DNA, 20 bp, Artificial
  CRISPR gRNA sequence
tagattttaatgtttatttt

SEQ ID NO: 686240 - DNA, 20 bp, Artificial
  CRISPR gRNA sequence
gattttaatgtttattttta

SEQ ID NO: 686241 - DNA, 20 bp, Artificial
  CRISPR gRNA sequence
taatgtttatttttaaataa

SEQ ID NO: 686242 - DNA, 20 bp, Artificial
  CRISPR gRNA sequence
aatgtttatttttaaataat

SEQ ID NO: 686243 - DNA, 20 bp, Artificial
  CRISPR gRNA sequence
atgtttatttttaaataata

SEQ ID NO: 686244 - DNA, 20 bp, Artificial
  CRISPR gRNA sequence
atttttaaataataaaataa

SEQ ID NO: 686245 - DNA, 20 bp, Artificial
  CRISPR gRNA sequence
tttttaaataataaaataac

SEQ ID NO: 686246 - DNA, 20 bp, Artificial
  CRISPR gRNA sequence
ttaaataataaaataaccat

SEQ ID NO: 686247 - DNA, 20 bp, Artificial
  CRISPR gRNA sequence
taaataataaaataaccatt

SEQ ID NO: 686248 - DNA, 20 bp, Artificial
  CRISPR gRNA sequence
aaataataaaataaccatta

SEQ ID NO: 686249 - DNA, 20 bp, Artificial
  CRISPR gRNA sequence
aataataaaataaccattat

SEQ ID NO: 686250 - DNA, 20 bp, Artificial
  CRISPR gRNA sequence
tgtatattgatggtttttaa

SEQ ID NO: 686251 - DNA, 20 bp, Artificial
  CRISPR gRNA sequence
atggtttttaagaagaaaag

SEQ ID NO: 686252 - DNA, 20 bp, Artificial
  CRISPR gRNA sequence
ttaagaagaaaagcaatatt

SEQ ID NO: 686253 - DNA, 20 bp, Artificial
  CRISPR gRNA sequence
taagaagaaaagcaatatta

SEQ ID NO: 686254 - DNA, 20 bp, Artificial
  CRISPR gRNA sequence
aagaagaaaagcaatattaa

SEQ ID NO: 686255 - DNA, 20 bp, Artificial
  CRISPR gRNA sequence
agaagaaaagcaatattaag

SEQ ID NO: 686256 - DNA, 20 bp, Artificial
  CRISPR gRNA sequence
agtaaaggctgaatttagat

SEQ ID NO: 686257 - DNA, 20 bp, Artificial
  CRISPR gRNA sequence
aatttagattaagttatttc

SEQ ID NO: 686258 - DNA, 20 bp, Artificial
  CRISPR gRNA sequence
agattaagttatttcacaat

SEQ ID NO: 686259 - DNA, 20 bp, Artificial
  CRISPR gRNA sequence
gattaagttatttcacaatg

SEQ ID NO: 686260 - DNA, 20 bp, Artificial
  CRISPR gRNA sequence
agttatttcacaatgctaag

SEQ ID NO: 686261 - DNA, 20 bp, Artificial
  CRISPR gRNA sequence
tttcacaatgctaagtgact

SEQ ID NO: 686262 - DNA, 20 bp, Artificial
  CRISPR gRNA sequence
cacaatgctaagtgactctt

SEQ ID NO: 686263 - DNA, 20 bp, Artificial
  CRISPR gRNA sequence
acaatgctaagtgactcttt

SEQ ID NO: 686264 - DNA, 20 bp, Artificial
  CRISPR gRNA sequence
agtgactcttttaattgtct

SEQ ID NO: 686265 - DNA, 20 bp, Artificial
  CRISPR gRNA sequence
ttttaattgtctgacttatt

SEQ ID NO: 686266 - DNA, 20 bp, Artificial
  CRISPR gRNA sequence
ttaattgtctgacttatttt

SEQ ID NO: 686267 - DNA, 20 bp, Artificial
  CRISPR gRNA sequence
taattgtctgacttatttta

SEQ ID NO: 686268 - DNA, 20 bp, Artificial
  CRISPR gRNA sequence
aattgtctgacttattttaa

SEQ ID NO: 686269 - DNA, 20 bp, Artificial
  CRISPR gRNA sequence
attgtctgacttattttaac

SEQ ID NO: 686270 - DNA, 20 bp, Artificial
  CRISPR gRNA sequence
tctgacttattttaacagtc

SEQ ID NO: 686271 - DNA, 20 bp, Artificial
  CRISPR gRNA sequence
acttattttaacagtcccac

SEQ ID NO: 686272 - DNA, 20 bp, Artificial
  CRISPR gRNA sequence
attttaacagtcccacattc

SEQ ID NO: 686273 - DNA, 20 bp, Artificial
  CRISPR gRNA sequence
ttttaacagtcccacattca

SEQ ID NO: 686274 - DNA, 20 bp, Artificial
  CRISPR gRNA sequence
taacagtcccacattcaata

SEQ ID NO: 686275 - DNA, 20 bp, Artificial
  CRISPR gRNA sequence
aacagtcccacattcaatag

SEQ ID NO: 686276 - DNA, 20 bp, Artificial
  CRISPR gRNA sequence
acagtcccacattcaatagg

SEQ ID NO: 686277 - DNA, 20 bp, Artificial
  CRISPR gRNA sequence
aataggactggatatgcgaa

SEQ ID NO: 686278 - DNA, 20 bp, Artificial
  CRISPR gRNA sequence
gatatgcgaatgtcaccata

SEQ ID NO: 686279 - DNA, 20 bp, Artificial
  CRISPR gRNA sequence
caatgttccagattatttga

SEQ ID NO: 686280 - DNA, 20 bp, Artificial
  CRISPR gRNA sequence
cagattatttgatgtattca

SEQ ID NO: 686281 - DNA, 20 bp, Artificial
  CRISPR gRNA sequence
tttgatgtattcaacagtat

SEQ ID NO: 686282 - DNA, 20 bp, Artificial
  CRISPR gRNA sequence
gatgtattcaacagtatctg

SEQ ID NO: 686283 - DNA, 20 bp, Artificial
  CRISPR gRNA sequence
atgtattcaacagtatctgg

SEQ ID NO: 686284 - DNA, 20 bp, Artificial
  CRISPR gRNA sequence
aacagtatctggatcagaaa

SEQ ID NO: 686285 - DNA, 20 bp, Artificial
  CRISPR gRNA sequence
gatcagaaaaaaattccaaa

SEQ ID NO: 686286 - DNA, 20 bp, Artificial
  CRISPR gRNA sequence
caaaatttattgtcctacca

SEQ ID NO: 686287 - DNA, 20 bp, Artificial
  CRISPR gRNA sequence
attgtcctaccattgacctc

SEQ ID NO: 686288 - DNA, 20 bp, Artificial
  CRISPR gRNA sequence
ttgtcctaccattgacctct

SEQ ID NO: 686289 - DNA, 20 bp, Artificial
  CRISPR gRNA sequence
tcctaccattgacctctaca

SEQ ID NO: 686290 - DNA, 20 bp, Artificial
  CRISPR gRNA sequence
ccattgacctctacaactgg

SEQ ID NO: 686291 - DNA, 20 bp, Artificial
  CRISPR gRNA sequence
acctctacaactggacagca

SEQ ID NO: 686292 - DNA, 20 bp, Artificial
  CRISPR gRNA sequence
tacaactggacagcacctct

SEQ ID NO: 686293 - DNA, 20 bp, Artificial
  CRISPR gRNA sequence
caactggacagcacctcttg

SEQ ID NO: 686294 - DNA, 20 bp, Artificial
  CRISPR gRNA sequence
gacagcacctcttgagtggt

SEQ ID NO: 686295 - DNA, 20 bp, Artificial
  CRISPR gRNA sequence
ttgagtggtttaaggtaaga

SEQ ID NO: 686296 - DNA, 20 bp, Artificial
  CRISPR gRNA sequence
gagtggtttaaggtaagaag

SEQ ID NO: 686297 - DNA, 20 bp, Artificial
  CRISPR gRNA sequence
agtggtttaaggtaagaaga

SEQ ID NO: 686298 - DNA, 20 bp, Artificial
  CRISPR gRNA sequence
aaggtaagaagaaatttgga

SEQ ID NO: 686299 - DNA, 20 bp, Artificial
  CRISPR gRNA sequence
aggtaagaagaaatttggaa

SEQ ID NO: 686300 - DNA, 20 bp, Artificial
  CRISPR gRNA sequence
ggaaggaaatagatgaaaat

SEQ ID NO: 686301 - DNA, 20 bp, Artificial
  CRISPR gRNA sequence
gaaggaaatagatgaaaatt

SEQ ID NO: 686302 - DNA, 20 bp, Artificial
  CRISPR gRNA sequence
cacaattaaaatagacacaa

SEQ ID NO: 686303 - DNA, 20 bp, Artificial
  CRISPR gRNA sequence
aaatagacacaagtggccgg

SEQ ID NO: 686304 - DNA, 20 bp, Artificial
  CRISPR gRNA sequence
atgcctgtaatcctagcact

SEQ ID NO: 686305 - DNA, 20 bp, Artificial
  CRISPR gRNA sequence
taatcctagcactttgggag

SEQ ID NO: 686306 - DNA, 20 bp, Artificial
  CRISPR gRNA sequence
gcactttgggaggccaaggc

SEQ ID NO: 686307 - DNA, 20 bp, Artificial
  CRISPR gRNA sequence
tgggaggccaaggcaggcag

SEQ ID NO: 686308 - DNA, 20 bp, Artificial
  CRISPR gRNA sequence
gggaggccaaggcaggcaga

SEQ ID NO: 686309 - DNA, 20 bp, Artificial
  CRISPR gRNA sequence
ggaggccaaggcaggcagat

SEQ ID NO: 686310 - DNA, 20 bp, Artificial
  CRISPR gRNA sequence
gaggccaggagtttgagacc

SEQ ID NO: 686311 - DNA, 20 bp, Artificial
  CRISPR gRNA sequence
aggccaggagtttgagacca

SEQ ID NO: 686312 - DNA, 20 bp, Artificial
  CRISPR gRNA sequence
gagaccagcctggccaacat

SEQ ID NO: 686313 - DNA, 20 bp, Artificial
  CRISPR gRNA sequence
agaccagcctggccaacatg

SEQ ID NO: 686314 - DNA, 20 bp, Artificial
  CRISPR gRNA sequence
gccaacatgaggaaacccca

SEQ ID NO: 686315 - DNA, 20 bp, Artificial
  CRISPR gRNA sequence
tactaaaaatataaaaatca

SEQ ID NO: 686316 - DNA, 20 bp, Artificial
  CRISPR gRNA sequence
ctaaaaatataaaaatcagc

SEQ ID NO: 686317 - DNA, 20 bp, Artificial
  CRISPR gRNA sequence
aaaatataaaaatcagctgg

SEQ ID NO: 686318 - DNA, 20 bp, Artificial
  CRISPR gRNA sequence
ggtgtggtggcacacacctg

SEQ ID NO: 686319 - DNA, 20 bp, Artificial
  CRISPR gRNA sequence
taatcccagcagcttgggag

SEQ ID NO: 686320 - DNA, 20 bp, Artificial
  CRISPR gRNA sequence
gggaggctgaggtatgaaaa

SEQ ID NO: 686321 - DNA, 20 bp, Artificial
  CRISPR gRNA sequence
ggaggctgaggtatgaaaat

SEQ ID NO: 686322 - DNA, 20 bp, Artificial
  CRISPR gRNA sequence
aggtatgaaaatcacttgaa

SEQ ID NO: 686323 - DNA, 20 bp, Artificial
  CRISPR gRNA sequence
gaacctagaaggcagaggtt

SEQ ID NO: 686324 - DNA, 20 bp, Artificial
  CRISPR gRNA sequence
aacctagaaggcagaggtta

SEQ ID NO: 686325 - DNA, 20 bp, Artificial
  CRISPR gRNA sequence
gaaggcagaggttacagcga

SEQ ID NO: 686326 - DNA, 20 bp, Artificial
  CRISPR gRNA sequence
cagcgagcccagattgcacc

SEQ ID NO: 686327 - DNA, 20 bp, Artificial
  CRISPR gRNA sequence
caccactcactccagcctag

SEQ ID NO: 686328 - DNA, 20 bp, Artificial
  CRISPR gRNA sequence
actccagcctaggcaacaaa

SEQ ID NO: 686329 - DNA, 20 bp, Artificial
  CRISPR gRNA sequence
cagcctaggcaacaaacatt

SEQ ID NO: 686330 - DNA, 20 bp, Artificial
  CRISPR gRNA sequence
ggcaacaaacattctgtcaa

SEQ ID NO: 686331 - DNA, 20 bp, Artificial
  CRISPR gRNA sequence
tgtcaacagataaataaata

SEQ ID NO: 686332 - DNA, 20 bp, Artificial
  CRISPR gRNA sequence
tcaacagataaataaataaa

SEQ ID NO: 686333 - DNA, 20 bp, Artificial
  CRISPR gRNA sequence
ctgagaaggaaatggaattt

SEQ ID NO: 686334 - DNA, 20 bp, Artificial
  CRISPR gRNA sequence
agaaggaaatggaatttctt

SEQ ID NO: 686335 - DNA, 20 bp, Artificial
  CRISPR gRNA sequence
cttatttcagaattgtcagg

SEQ ID NO: 686336 - DNA, 20 bp, Artificial
  CRISPR gRNA sequence
ttatttcagaattgtcaggc

SEQ ID NO: 686337 - DNA, 20 bp, Artificial
  CRISPR gRNA sequence
atttcagaattgtcaggctc

SEQ ID NO: 686338 - DNA, 20 bp, Artificial
  CRISPR gRNA sequence
tttcagaattgtcaggctct

SEQ ID NO: 686339 - DNA, 20 bp, Artificial
  CRISPR gRNA sequence
cagaattgtcaggctcttca

SEQ ID NO: 686340 - DNA, 20 bp, Artificial
  CRISPR gRNA sequence
agaattgtcaggctcttcaa

SEQ ID NO: 686341 - DNA, 20 bp, Artificial
  CRISPR gRNA sequence
tcaggctcttcaaggatcaa

SEQ ID NO: 686342 - DNA, 20 bp, Artificial
  CRISPR gRNA sequence
ttcaaggatcaaggtacagg

SEQ ID NO: 686343 - DNA, 20 bp, Artificial
  CRISPR gRNA sequence
caaggatcaaggtacagggc

SEQ ID NO: 686344 - DNA, 20 bp, Artificial
  CRISPR gRNA sequence
aaggatcaaggtacagggcg

SEQ ID NO: 686345 - DNA, 20 bp, Artificial
  CRISPR gRNA sequence
ttggtcattgataatgtgat

SEQ ID NO: 686346 - DNA, 20 bp, Artificial
  CRISPR gRNA sequence
tggtcattgataatgtgatg

SEQ ID NO: 686347 - DNA, 20 bp, Artificial
  CRISPR gRNA sequence
ggtcattgataatgtgatga

SEQ ID NO: 686348 - DNA, 20 bp, Artificial
  CRISPR gRNA sequence
gtcattgataatgtgatgac

SEQ ID NO: 686349 - DNA, 20 bp, Artificial
  CRISPR gRNA sequence
ataatgtgatgactgaggac

SEQ ID NO: 686350 - DNA, 20 bp, Artificial
  CRISPR gRNA sequence
aggacgcaggtgattacacc

SEQ ID NO: 686351 - DNA, 20 bp, Artificial
  CRISPR gRNA sequence
cacctgtaaatttatacaca

SEQ ID NO: 686352 - DNA, 20 bp, Artificial
  CRISPR gRNA sequence
taaatttatacacaatgaaa

SEQ ID NO: 686353 - DNA, 20 bp, Artificial
  CRISPR gRNA sequence
atacacaatgaaaatggagc

SEQ ID NO: 686354 - DNA, 20 bp, Artificial
  CRISPR gRNA sequence
tacacaatgaaaatggagcc

SEQ ID NO: 686355 - DNA, 20 bp, Artificial
  CRISPR gRNA sequence
tagtgtgacggcgaccaggt

SEQ ID NO: 686356 - DNA, 20 bp, Artificial
  CRISPR gRNA sequence
cacggtcaagggtaagctac

SEQ ID NO: 686357 - DNA, 20 bp, Artificial
  CRISPR gRNA sequence
acggtcaagggtaagctact

SEQ ID NO: 686358 - DNA, 20 bp, Artificial
  CRISPR gRNA sequence
ctgacattaatgagatagaa

SEQ ID NO: 686359 - DNA, 20 bp, Artificial
  CRISPR gRNA sequence
acattaatgagatagaatac

SEQ ID NO: 686360 - DNA, 20 bp, Artificial
  CRISPR gRNA sequence
atgagatagaatactacgtg

SEQ ID NO: 686361 - DNA, 20 bp, Artificial
  CRISPR gRNA sequence
cgtgaaagaagtcgaagtgg

SEQ ID NO: 686362 - DNA, 20 bp, Artificial
  CRISPR gRNA sequence
ctggttgggtttcttgcact

SEQ ID NO: 686363 - DNA, 20 bp, Artificial
  CRISPR gRNA sequence
tggttgggtttcttgcactt

SEQ ID NO: 686364 - DNA, 20 bp, Artificial
  CRISPR gRNA sequence
gttgggtttcttgcacttct

SEQ ID NO: 686365 - DNA, 20 bp, Artificial
  CRISPR gRNA sequence
ggtttcttgcacttctccct

SEQ ID NO: 686366 - DNA, 20 bp, Artificial
  CRISPR gRNA sequence
cttgcacttctccctcctcc

SEQ ID NO: 686367 - DNA, 20 bp, Artificial
  CRISPR gRNA sequence
ttgcacttctccctcctccc

SEQ ID NO: 686368 - DNA, 20 bp, Artificial
  CRISPR gRNA sequence
gcacttctccctcctccctt

SEQ ID NO: 686369 - DNA, 20 bp, Artificial
  CRISPR gRNA sequence
cacttctccctcctcccttt

SEQ ID NO: 686370 - DNA, 20 bp, Artificial
  CRISPR gRNA sequence
ctccctcctccctttacttc

SEQ ID NO: 686371 - DNA, 20 bp, Artificial
  CRISPR gRNA sequence
tccctcctccctttacttcc

SEQ ID NO: 686372 - DNA, 20 bp, Artificial
  CRISPR gRNA sequence
cctcctccctttacttcctc

SEQ ID NO: 686373 - DNA, 20 bp, Artificial
  CRISPR gRNA sequence
ctccctttacttcctcctgc

SEQ ID NO: 686374 - DNA, 20 bp, Artificial
  CRISPR gRNA sequence
cctttacttcctcctgctcc

SEQ ID NO: 686375 - DNA, 20 bp, Artificial
  CRISPR gRNA sequence
tacttcctcctgctccatct

SEQ ID NO: 686376 - DNA, 20 bp, Artificial
  CRISPR gRNA sequence
acttcctcctgctccatctt

SEQ ID NO: 686377 - DNA, 20 bp, Artificial
  CRISPR gRNA sequence
cttcctcctgctccatctta

SEQ ID NO: 686378 - DNA, 20 bp, Artificial
  CRISPR gRNA sequence
cctcctgctccatcttatct

SEQ ID NO: 686379 - DNA, 20 bp, Artificial
  CRISPR gRNA sequence
ctcctgctccatcttatctt

SEQ ID NO: 686380 - DNA, 20 bp, Artificial
  CRISPR gRNA sequence
ctgctccatcttatcttata

SEQ ID NO: 686381 - DNA, 20 bp, Artificial
  CRISPR gRNA sequence
ctccatcttatcttatacat

SEQ ID NO: 686382 - DNA, 20 bp, Artificial
  CRISPR gRNA sequence
catcttatcttatacattct

SEQ ID NO: 686383 - DNA, 20 bp, Artificial
  CRISPR gRNA sequence
atcttatacattctgaacta

SEQ ID NO: 686384 - DNA, 20 bp, Artificial
  CRISPR gRNA sequence
tcttatacattctgaactat

SEQ ID NO: 686385 - DNA, 20 bp, Artificial
  CRISPR gRNA sequence
atacattctgaactatgacg

SEQ ID NO: 686386 - DNA, 20 bp, Artificial
  CRISPR gRNA sequence
tacattctgaactatgacgc

SEQ ID NO: 686387 - DNA, 20 bp, Artificial
  CRISPR gRNA sequence
tgaactatgacgcaaagagg

SEQ ID NO: 686388 - DNA, 20 bp, Artificial
  CRISPR gRNA sequence
aactatgacgcaaagaggtt

SEQ ID NO: 686389 - DNA, 20 bp, Artificial
  CRISPR gRNA sequence
tgacgcaaagaggttttctg

SEQ ID NO: 686390 - DNA, 20 bp, Artificial
  CRISPR gRNA sequence
tctgaacacactatcaagat

SEQ ID NO: 686391 - DNA, 20 bp, Artificial
  CRISPR gRNA sequence
ctgaacacactatcaagatt

SEQ ID NO: 686392 - DNA, 20 bp, Artificial
  CRISPR gRNA sequence
tgaacacactatcaagattt

SEQ ID NO: 686393 - DNA, 20 bp, Artificial
  CRISPR gRNA sequence
aacacactatcaagatttaa

SEQ ID NO: 686394 - DNA, 20 bp, Artificial
  CRISPR gRNA sequence
tcaagatttaagaaatttca

SEQ ID NO: 686395 - DNA, 20 bp, Artificial
  CRISPR gRNA sequence
aagaaatttcagggggaaat

SEQ ID NO: 686396 - DNA, 20 bp, Artificial
  CRISPR gRNA sequence
agaaatttcagggggaaatt

SEQ ID NO: 686397 - DNA, 20 bp, Artificial
  CRISPR gRNA sequence
cagggggaaattacattact

SEQ ID NO: 686398 - DNA, 20 bp, Artificial
  CRISPR gRNA sequence
agggggaaattacattacta

SEQ ID NO: 686399 - DNA, 20 bp, Artificial
  CRISPR gRNA sequence
cattactaattcaaagccac

SEQ ID NO: 686400 - DNA, 20 bp, Artificial
  CRISPR gRNA sequence
ctaattcaaagccacatctg

SEQ ID NO: 686401 - DNA, 20 bp, Artificial
  CRISPR gRNA sequence
attcaaagccacatctgttc

SEQ ID NO: 686402 - DNA, 20 bp, Artificial
  CRISPR gRNA sequence
aaagccacatctgttcttta

SEQ ID NO: 686403 - DNA, 20 bp, Artificial
  CRISPR gRNA sequence
ttctttattctttttttgtg

SEQ ID NO: 686404 - DNA, 20 bp, Artificial
  CRISPR gRNA sequence
tttattctttttttgtgact

SEQ ID NO: 686405 - DNA, 20 bp, Artificial
  CRISPR gRNA sequence
tattctttttttgtgactta

SEQ ID NO: 686406 - DNA, 20 bp, Artificial
  CRISPR gRNA sequence
attctttttttgtgacttaa

SEQ ID NO: 686407 - DNA, 20 bp, Artificial
  CRISPR gRNA sequence
ttctttttttgtgacttaat

SEQ ID NO: 686408 - DNA, 20 bp, Artificial
  CRISPR gRNA sequence
tttttttgtgacttaatttt

SEQ ID NO: 686409 - DNA, 20 bp, Artificial
  CRISPR gRNA sequence
tttttgtgacttaattttcc

SEQ ID NO: 686410 - DNA, 20 bp, Artificial
  CRISPR gRNA sequence
ttttgtgacttaattttcca

SEQ ID NO: 686411 - DNA, 20 bp, Artificial
  CRISPR gRNA sequence
tttgtgacttaattttccaa

SEQ ID NO: 686412 - DNA, 20 bp, Artificial
  CRISPR gRNA sequence
ttgtgacttaattttccaaa

SEQ ID NO: 686413 - DNA, 20 bp, Artificial
  CRISPR gRNA sequence
tgtgacttaattttccaaag

SEQ ID NO: 686414 - DNA, 20 bp, Artificial
  CRISPR gRNA sequence
gtgacttaattttccaaaga

SEQ ID NO: 686415 - DNA, 20 bp, Artificial
  CRISPR gRNA sequence
tgacttaattttccaaagat

SEQ ID NO: 686416 - DNA, 20 bp, Artificial
  CRISPR gRNA sequence
aattttccaaagataaagca

SEQ ID NO: 686417 - DNA, 20 bp, Artificial
  CRISPR gRNA sequence
attttccaaagataaagcaa

SEQ ID NO: 686418 - DNA, 20 bp, Artificial
  CRISPR gRNA sequence
tccaaagataaagcaatctg

SEQ ID NO: 686419 - DNA, 20 bp, Artificial
  CRISPR gRNA sequence
ccaaagataaagcaatctga

SEQ ID NO: 686420 - DNA, 20 bp, Artificial
  CRISPR gRNA sequence
caaagataaagcaatctgaa

SEQ ID NO: 686421 - DNA, 20 bp, Artificial
  CRISPR gRNA sequence
aatgctaacttaacttactt

SEQ ID NO: 686422 - DNA, 20 bp, Artificial
  CRISPR gRNA sequence
acttaacttactttttttga

SEQ ID NO: 686423 - DNA, 20 bp, Artificial
  CRISPR gRNA sequence
aacttactttttttgaatgg

SEQ ID NO: 686424 - DNA, 20 bp, Artificial
  CRISPR gRNA sequence
acttactttttttgaatggc

SEQ ID NO: 686425 - DNA, 20 bp, Artificial
  CRISPR gRNA sequence
actttttttgaatggcaata

SEQ ID NO: 686426 - DNA, 20 bp, Artificial
  CRISPR gRNA sequence
ctttttttgaatggcaatac

SEQ ID NO: 686427 - DNA, 20 bp, Artificial
  CRISPR gRNA sequence
tttttgaatggcaatacaac

SEQ ID NO: 686428 - DNA, 20 bp, Artificial
  CRISPR gRNA sequence
ttttgaatggcaatacaact

SEQ ID NO: 686429 - DNA, 20 bp, Artificial
  CRISPR gRNA sequence
tttgaatggcaatacaacta

SEQ ID NO: 686430 - DNA, 20 bp, Artificial
  CRISPR gRNA sequence
ttgaatggcaatacaactat

SEQ ID NO: 686431 - DNA, 20 bp, Artificial
  CRISPR gRNA sequence
tgaatggcaatacaactatt

SEQ ID NO: 686432 - DNA, 20 bp, Artificial
  CRISPR gRNA sequence
gaatggcaatacaactattt

SEQ ID NO: 686433 - DNA, 20 bp, Artificial
  CRISPR gRNA sequence
aatggcaatacaactatttg

SEQ ID NO: 686434 - DNA, 20 bp, Artificial
  CRISPR gRNA sequence
tttggagagcaaaaccagct

SEQ ID NO: 686435 - DNA, 20 bp, Artificial
  CRISPR gRNA sequence
ggagagcaaaaccagctttt

SEQ ID NO: 686436 - DNA, 20 bp, Artificial
  CRISPR gRNA sequence
gagagcaaaaccagcttttt

SEQ ID NO: 686437 - DNA, 20 bp, Artificial
  CRISPR gRNA sequence
tttttttttttttctagttt

SEQ ID NO: 686438 - DNA, 20 bp, Artificial
  CRISPR gRNA sequence
ttttttttttttctagtttg

SEQ ID NO: 686439 - DNA, 20 bp, Artificial
  CRISPR gRNA sequence
tttttttttttctagtttgg

SEQ ID NO: 686440 - DNA, 20 bp, Artificial
  CRISPR gRNA sequence
ttttttttttctagtttggt

SEQ ID NO: 686441 - DNA, 20 bp, Artificial
  CRISPR gRNA sequence
tttttttttctagtttggtg

SEQ ID NO: 686442 - DNA, 20 bp, Artificial
  CRISPR gRNA sequence
ttttttttctagtttggtgt

SEQ ID NO: 686443 - DNA, 20 bp, Artificial
  CRISPR gRNA sequence
tttttttctagtttggtgtc

SEQ ID NO: 686444 - DNA, 20 bp, Artificial
  CRISPR gRNA sequence
ttttttctagtttggtgtca

SEQ ID NO: 686445 - DNA, 20 bp, Artificial
  CRISPR gRNA sequence
tttttctagtttggtgtcag

SEQ ID NO: 686446 - DNA, 20 bp, Artificial
  CRISPR gRNA sequence
ttttctagtttggtgtcaga

SEQ ID NO: 686447 - DNA, 20 bp, Artificial
  CRISPR gRNA sequence
tttctagtttggtgtcagag

SEQ ID NO: 686448 - DNA, 20 bp, Artificial
  CRISPR gRNA sequence
ttctagtttggtgtcagagt

SEQ ID NO: 686449 - DNA, 20 bp, Artificial
  CRISPR gRNA sequence
tctagtttggtgtcagagtt

SEQ ID NO: 686450 - DNA, 20 bp, Artificial
  CRISPR gRNA sequence
ctagtttggtgtcagagttt

SEQ ID NO: 686451 - DNA, 20 bp, Artificial
  CRISPR gRNA sequence
tagtttggtgtcagagtttc

SEQ ID NO: 686452 - DNA, 20 bp, Artificial
  CRISPR gRNA sequence
gtttggtgtcagagtttctg

SEQ ID NO: 686453 - DNA, 20 bp, Artificial
  CRISPR gRNA sequence
ggtgtcagagtttctgcaaa

SEQ ID NO: 686454 - DNA, 20 bp, Artificial
  CRISPR gRNA sequence
gtgtcagagtttctgcaaat

SEQ ID NO: 686455 - DNA, 20 bp, Artificial
  CRISPR gRNA sequence
ctgcaaattaaaaaagagct

SEQ ID NO: 686456 - DNA, 20 bp, Artificial
  CRISPR gRNA sequence
tgcaaattaaaaaagagctt

SEQ ID NO: 686457 - DNA, 20 bp, Artificial
  CRISPR gRNA sequence
caaattaaaaaagagcttaa

SEQ ID NO: 686458 - DNA, 20 bp, Artificial
  CRISPR gRNA sequence
aaaaagagcttaatctttag

SEQ ID NO: 686459 - DNA, 20 bp, Artificial
  CRISPR gRNA sequence
aatctttagtaatactcatt

SEQ ID NO: 686460 - DNA, 20 bp, Artificial
  CRISPR gRNA sequence
atctttagtaatactcattg

SEQ ID NO: 686461 - DNA, 20 bp, Artificial
  CRISPR gRNA sequence
tagtaatactcattggattc

SEQ ID NO: 686462 - DNA, 20 bp, Artificial
  CRISPR gRNA sequence
agtaatactcattggattca

SEQ ID NO: 686463 - DNA, 20 bp, Artificial
  CRISPR gRNA sequence
gtaatactcattggattcaa

SEQ ID NO: 686464 - DNA, 20 bp, Artificial
  CRISPR gRNA sequence
attggattcaaagtctaatg

SEQ ID NO: 686465 - DNA, 20 bp, Artificial
  CRISPR gRNA sequence
gattcaaagtctaatgagag

SEQ ID NO: 686466 - DNA, 20 bp, Artificial
  CRISPR gRNA sequence
aaagtctaatgagaggcttt

SEQ ID NO: 686467 - DNA, 20 bp, Artificial
  CRISPR gRNA sequence
atgagaggctttgtgatggt

SEQ ID NO: 686468 - DNA, 20 bp, Artificial
  CRISPR gRNA sequence
tgtgatggtatactatggtg

SEQ ID NO: 686469 - DNA, 20 bp, Artificial
  CRISPR gRNA sequence
gtgatggtatactatggtgt

SEQ ID NO: 686470 - DNA, 20 bp, Artificial
  CRISPR gRNA sequence
tgatggtatactatggtgta

SEQ ID NO: 686471 - DNA, 20 bp, Artificial
  CRISPR gRNA sequence
tggtgtacataaatgttgtc

SEQ ID NO: 686472 - DNA, 20 bp, Artificial
  CRISPR gRNA sequence
tcgagtggtttttaatcttt

SEQ ID NO: 686473 - DNA, 20 bp, Artificial
  CRISPR gRNA sequence
ttaatctttgtttgcaatac

SEQ ID NO: 686474 - DNA, 20 bp, Artificial
  CRISPR gRNA sequence
taatctttgtttgcaatact

SEQ ID NO: 686475 - DNA, 20 bp, Artificial
  CRISPR gRNA sequence
aatctttgtttgcaatactt

SEQ ID NO: 686476 - DNA, 20 bp, Artificial
  CRISPR gRNA sequence
atctttgtttgcaatacttt

SEQ ID NO: 686477 - DNA, 20 bp, Artificial
  CRISPR gRNA sequence
tgtttgcaatactttcaaca

SEQ ID NO: 686478 - DNA, 20 bp, Artificial
  CRISPR gRNA sequence
gtttgcaatactttcaacat

SEQ ID NO: 686479 - DNA, 20 bp, Artificial
  CRISPR gRNA sequence
tttgcaatactttcaacatc

SEQ ID NO: 686480 - DNA, 20 bp, Artificial
  CRISPR gRNA sequence
gcaatactttcaacatcatc

SEQ ID NO: 686481 - DNA, 20 bp, Artificial
  CRISPR gRNA sequence
caatactttcaacatcatca

SEQ ID NO: 686482 - DNA, 20 bp, Artificial
  CRISPR gRNA sequence
tcaacatcatcaatggcctt

SEQ ID NO: 686483 - DNA, 20 bp, Artificial
  CRISPR gRNA sequence
caacatcatcaatggccttg

SEQ ID NO: 686484 - DNA, 20 bp, Artificial
  CRISPR gRNA sequence
aacatcatcaatggccttga

SEQ ID NO: 686485 - DNA, 20 bp, Artificial
  CRISPR gRNA sequence
gagtaagtcacttcattcta

SEQ ID NO: 686486 - DNA, 20 bp, Artificial
  CRISPR gRNA sequence
agtaagtcacttcattctaa

SEQ ID NO: 686487 - DNA, 20 bp, Artificial
  CRISPR gRNA sequence
cattctaaaaatgtgttttc

SEQ ID NO: 686488 - DNA, 20 bp, Artificial
  CRISPR gRNA sequence
attctaaaaatgtgttttcc

SEQ ID NO: 686489 - DNA, 20 bp, Artificial
  CRISPR gRNA sequence
taaaaatgtgttttccaagt

SEQ ID NO: 686490 - DNA, 20 bp, Artificial
  CRISPR gRNA sequence
aaaatgtgttttccaagtta

SEQ ID NO: 686491 - DNA, 20 bp, Artificial
  CRISPR gRNA sequence
tccaagttattttaaatttt

SEQ ID NO: 686492 - DNA, 20 bp, Artificial
  CRISPR gRNA sequence
ccaagttattttaaatttta

SEQ ID NO: 686493 - DNA, 20 bp, Artificial
  CRISPR gRNA sequence
caagttattttaaattttat

SEQ ID NO: 686494 - DNA, 20 bp, Artificial
  CRISPR gRNA sequence
ttttaaattttataaaagct

SEQ ID NO: 686495 - DNA, 20 bp, Artificial
  CRISPR gRNA sequence
taaattttataaaagcttat

SEQ ID NO: 686496 - DNA, 20 bp, Artificial
  CRISPR gRNA sequence
aaattttataaaagcttatt

SEQ ID NO: 686497 - DNA, 20 bp, Artificial
  CRISPR gRNA sequence
aattttataaaagcttattt

SEQ ID NO: 686498 - DNA, 20 bp, Artificial
  CRISPR gRNA sequence
tataaaagcttatttaaggg

SEQ ID NO: 686499 - DNA, 20 bp, Artificial
  CRISPR gRNA sequence
ataaaagcttatttaaggga

SEQ ID NO: 686500 - DNA, 20 bp, Artificial
  CRISPR gRNA sequence
taaaagcttatttaagggaa

SEQ ID NO: 686501 - DNA, 20 bp, Artificial
  CRISPR gRNA sequence
atttaagggaaagatttcac

SEQ ID NO: 686502 - DNA, 20 bp, Artificial
  CRISPR gRNA sequence
tttaagggaaagatttcaca

SEQ ID NO: 686503 - DNA, 20 bp, Artificial
  CRISPR gRNA sequence
aagggaaagatttcacaatc

SEQ ID NO: 686504 - DNA, 20 bp, Artificial
  CRISPR gRNA sequence
agggaaagatttcacaatca

SEQ ID NO: 686505 - DNA, 20 bp, Artificial
  CRISPR gRNA sequence
cacaatcatagcttatcaat

SEQ ID NO: 686506 - DNA, 20 bp, Artificial
  CRISPR gRNA sequence
acaatcatagcttatcaatc

SEQ ID NO: 686507 - DNA, 20 bp, Artificial
  CRISPR gRNA sequence
atcaatctacaaaggattgg

SEQ ID NO: 686508 - DNA, 20 bp, Artificial
  CRISPR gRNA sequence
tcaatctacaaaggattggg

SEQ ID NO: 686509 - DNA, 20 bp, Artificial
  CRISPR gRNA sequence
caaaggattggggtctcctt

SEQ ID NO: 686510 - DNA, 20 bp, Artificial
  CRISPR gRNA sequence
gggtctccttagcacaagtc

SEQ ID NO: 686511 - DNA, 20 bp, Artificial
  CRISPR gRNA sequence
cttagcacaagtcgatctac

SEQ ID NO: 686512 - DNA, 20 bp, Artificial
  CRISPR gRNA sequence
agcacaagtcgatctacaga

SEQ ID NO: 686513 - DNA, 20 bp, Artificial
  CRISPR gRNA sequence
gcacaagtcgatctacagac

SEQ ID NO: 686514 - DNA, 20 bp, Artificial
  CRISPR gRNA sequence
cagacgtagatgtaatagcc

SEQ ID NO: 686515 - DNA, 20 bp, Artificial
  CRISPR gRNA sequence
tacgtatgacagttttttca

SEQ ID NO: 686516 - DNA, 20 bp, Artificial
  CRISPR gRNA sequence
acgtatgacagttttttcag

SEQ ID NO: 686517 - DNA, 20 bp, Artificial
  CRISPR gRNA sequence
cgtatgacagttttttcagg

SEQ ID NO: 686518 - DNA, 20 bp, Artificial
  CRISPR gRNA sequence
tttcagggcaaagcaatatt

SEQ ID NO: 686519 - DNA, 20 bp, Artificial
  CRISPR gRNA sequence
ttcagggcaaagcaatattg

SEQ ID NO: 686520 - DNA, 20 bp, Artificial
  CRISPR gRNA sequence
tcagggcaaagcaatattgg

SEQ ID NO: 686521 - DNA, 20 bp, Artificial
  CRISPR gRNA sequence
cagggcaaagcaatattgga

SEQ ID NO: 686522 - DNA, 20 bp, Artificial
  CRISPR gRNA sequence
agggcaaagcaatattggag

SEQ ID NO: 686523 - DNA, 20 bp, Artificial
  CRISPR gRNA sequence
gagacaaatttttggagttt

SEQ ID NO: 686524 - DNA, 20 bp, Artificial
  CRISPR gRNA sequence
ttggagtttttcaatactcc

SEQ ID NO: 686525 - DNA, 20 bp, Artificial
  CRISPR gRNA sequence
tggagtttttcaatactcca

SEQ ID NO: 686526 - DNA, 20 bp, Artificial
  CRISPR gRNA sequence
ggagtttttcaatactccac

SEQ ID NO: 686527 - DNA, 20 bp, Artificial
  CRISPR gRNA sequence
gagtttttcaatactccacc

SEQ ID NO: 686528 - DNA, 20 bp, Artificial
  CRISPR gRNA sequence
ttcaatactccaccgctgta

SEQ ID NO: 686529 - DNA, 20 bp, Artificial
  CRISPR gRNA sequence
tcaatactccaccgctgtaa

SEQ ID NO: 686530 - DNA, 20 bp, Artificial
  CRISPR gRNA sequence
caatactccaccgctgtaaa

SEQ ID NO: 686531 - DNA, 20 bp, Artificial
  CRISPR gRNA sequence
aatactccaccgctgtaaaa

SEQ ID NO: 686532 - DNA, 20 bp, Artificial
  CRISPR gRNA sequence
caccgctgtaaaataagcat

SEQ ID NO: 686533 - DNA, 20 bp, Artificial
  CRISPR gRNA sequence
taaaataagcatcaccagac

SEQ ID NO: 686534 - DNA, 20 bp, Artificial
  CRISPR gRNA sequence
ctatcagtgcctctttctgt

SEQ ID NO: 686535 - DNA, 20 bp, Artificial
  CRISPR gRNA sequence
tcagtgcctctttctgttta

SEQ ID NO: 686536 - DNA, 20 bp, Artificial
  CRISPR gRNA sequence
tttctgtttaatatcaaccc

SEQ ID NO: 686537 - DNA, 20 bp, Artificial
  CRISPR gRNA sequence
tctgtttaatatcaaccctt

SEQ ID NO: 686538 - DNA, 20 bp, Artificial
  CRISPR gRNA sequence
ctgtttaatatcaaccctta

SEQ ID NO: 686539 - DNA, 20 bp, Artificial
  CRISPR gRNA sequence
tgtttaatatcaacccttac

SEQ ID NO: 686540 - DNA, 20 bp, Artificial
  CRISPR gRNA sequence
tttaatatcaacccttacag

SEQ ID NO: 686541 - DNA, 20 bp, Artificial
  CRISPR gRNA sequence
aatatcaacccttacagtgg

SEQ ID NO: 686542 - DNA, 20 bp, Artificial
  CRISPR gRNA sequence
atatcaacccttacagtggt

SEQ ID NO: 686543 - DNA, 20 bp, Artificial
  CRISPR gRNA sequence
acagtggtccttaatcacac

SEQ ID NO: 686544 - DNA, 20 bp, Artificial
  CRISPR gRNA sequence
cagtggtccttaatcacact

SEQ ID NO: 686545 - DNA, 20 bp, Artificial
  CRISPR gRNA sequence
aatcacactgtcattaaata

SEQ ID NO: 686546 - DNA, 20 bp, Artificial
  CRISPR gRNA sequence
atcacactgtcattaaataa

SEQ ID NO: 686547 - DNA, 20 bp, Artificial
  CRISPR gRNA sequence
tcattaaataaatgagcatg

SEQ ID NO: 686548 - DNA, 20 bp, Artificial
  CRISPR gRNA sequence
aataaatgagcatgaaggga

SEQ ID NO: 686549 - DNA, 20 bp, Artificial
  CRISPR gRNA sequence
cagcagtgctccataagcac

SEQ ID NO: 686550 - DNA, 20 bp, Artificial
  CRISPR gRNA sequence
cataagcactgcccgtcttt

SEQ ID NO: 686551 - DNA, 20 bp, Artificial
  CRISPR gRNA sequence
cccgtctttcagccttagtg

SEQ ID NO: 686552 - DNA, 20 bp, Artificial
  CRISPR gRNA sequence
tcagccttagtggtcacagg

SEQ ID NO: 686553 - DNA, 20 bp, Artificial
  CRISPR gRNA sequence
cagccttagtggtcacagga

SEQ ID NO: 686554 - DNA, 20 bp, Artificial
  CRISPR gRNA sequence
agccttagtggtcacaggag

SEQ ID NO: 686555 - DNA, 20 bp, Artificial
  CRISPR gRNA sequence
agtggtcacaggagtcagaa

SEQ ID NO: 686556 - DNA, 20 bp, Artificial
  CRISPR gRNA sequence
gtggtcacaggagtcagaat

SEQ ID NO: 686557 - DNA, 20 bp, Artificial
  CRISPR gRNA sequence
cgtacggggaagatttcact

SEQ ID NO: 686558 - DNA, 20 bp, Artificial
  CRISPR gRNA sequence
cactgaggatgggccaccct

SEQ ID NO: 686559 - DNA, 20 bp, Artificial
  CRISPR gRNA sequence
actgaggatgggccacccta

SEQ ID NO: 686560 - DNA, 20 bp, Artificial
  CRISPR gRNA sequence
aggatgggccaccctagtgg

SEQ ID NO: 686561 - DNA, 20 bp, Artificial
  CRISPR gRNA sequence
gtggagaactgcgagcaaat

SEQ ID NO: 686562 - DNA, 20 bp, Artificial
  CRISPR gRNA sequence
cgagcaaatctgtggactca

SEQ ID NO: 686563 - DNA, 20 bp, Artificial
  CRISPR gRNA sequence
tggactcatccatttattat

SEQ ID NO: 686564 - DNA, 20 bp, Artificial
  CRISPR gRNA sequence
atccatttattattttcatg

SEQ ID NO: 686565 - DNA, 20 bp, Artificial
  CRISPR gRNA sequence
attattttcatgggtctttt

SEQ ID NO: 686566 - DNA, 20 bp, Artificial
  CRISPR gRNA sequence
ttattttcatgggtcttttg

SEQ ID NO: 686567 - DNA, 20 bp, Artificial
  CRISPR gRNA sequence
ttttcatgggtcttttgaaa

SEQ ID NO: 686568 - DNA, 20 bp, Artificial
  CRISPR gRNA sequence
tcatgggtcttttgaaatct

SEQ ID NO: 686569 - DNA, 20 bp, Artificial
  CRISPR gRNA sequence
catgggtcttttgaaatctt

SEQ ID NO: 686570 - DNA, 20 bp, Artificial
  CRISPR gRNA sequence
atgggtcttttgaaatcttc

SEQ ID NO: 686571 - DNA, 20 bp, Artificial
  CRISPR gRNA sequence
ttgaaatcttctctgtagtc

SEQ ID NO: 686572 - DNA, 20 bp, Artificial
  CRISPR gRNA sequence
tgaaatcttctctgtagtct

SEQ ID NO: 686573 - DNA, 20 bp, Artificial
  CRISPR gRNA sequence
gaaatcttctctgtagtctt

SEQ ID NO: 686574 - DNA, 20 bp, Artificial
  CRISPR gRNA sequence
aaatcttctctgtagtctta

SEQ ID NO: 686575 - DNA, 20 bp, Artificial
  CRISPR gRNA sequence
ctctgtagtcttattcttat

SEQ ID NO: 686576 - DNA, 20 bp, Artificial
  CRISPR gRNA sequence
tctgtagtcttattcttatt

SEQ ID NO: 686577 - DNA, 20 bp, Artificial
  CRISPR gRNA sequence
tgtagtcttattcttattct

SEQ ID NO: 686578 - DNA, 20 bp, Artificial
  CRISPR gRNA sequence
tagtcttattcttattctgt

SEQ ID NO: 686579 - DNA, 20 bp, Artificial
  CRISPR gRNA sequence
attcttattctgtagaagag

SEQ ID NO: 686580 - DNA, 20 bp, Artificial
  CRISPR gRNA sequence
ttcttattctgtagaagagt

SEQ ID NO: 686581 - DNA, 20 bp, Artificial
  CRISPR gRNA sequence
ttattctgtagaagagtagt

SEQ ID NO: 686582 - DNA, 20 bp, Artificial
  CRISPR gRNA sequence
attctgtagaagagtagttt

SEQ ID NO: 686583 - DNA, 20 bp, Artificial
  CRISPR gRNA sequence
ttctgtagaagagtagtttt

SEQ ID NO: 686584 - DNA, 20 bp, Artificial
  CRISPR gRNA sequence
tgtagaagagtagttttcta

SEQ ID NO: 686585 - DNA, 20 bp, Artificial
  CRISPR gRNA sequence
tagaagagtagttttctaac

SEQ ID NO: 686586 - DNA, 20 bp, Artificial
  CRISPR gRNA sequence
tctaacaactactaggtcat

SEQ ID NO: 686587 - DNA, 20 bp, Artificial
  CRISPR gRNA sequence
ctaacaactactaggtcatg

SEQ ID NO: 686588 - DNA, 20 bp, Artificial
  CRISPR gRNA sequence
taacaactactaggtcatgt

SEQ ID NO: 686589 - DNA, 20 bp, Artificial
  CRISPR gRNA sequence
acaactactaggtcatgtaa

SEQ ID NO: 686590 - DNA, 20 bp, Artificial
  CRISPR gRNA sequence
ctaggtcatgtaattagttt

SEQ ID NO: 686591 - DNA, 20 bp, Artificial
  CRISPR gRNA sequence
ggtcatgtaattagttttat

SEQ ID NO: 686592 - DNA, 20 bp, Artificial
  CRISPR gRNA sequence
gttttatgggttggatctgc

SEQ ID NO: 686593 - DNA, 20 bp, Artificial
  CRISPR gRNA sequence
tatgggttggatctgcattt

SEQ ID NO: 686594 - DNA, 20 bp, Artificial
  CRISPR gRNA sequence
atgggttggatctgcatttg

SEQ ID NO: 686595 - DNA, 20 bp, Artificial
  CRISPR gRNA sequence
tgggttggatctgcatttgt

SEQ ID NO: 686596 - DNA, 20 bp, Artificial
  CRISPR gRNA sequence
gatctgcatttgtttaagtg

SEQ ID NO: 686597 - DNA, 20 bp, Artificial
  CRISPR gRNA sequence
catttgtttaagtgatatca

SEQ ID NO: 686598 - DNA, 20 bp, Artificial
  CRISPR gRNA sequence
gtttaagtgatatcagagaa

SEQ ID NO: 686599 - DNA, 20 bp, Artificial
  CRISPR gRNA sequence
tttaagtgatatcagagaat

SEQ ID NO: 686600 - DNA, 20 bp, Artificial
  CRISPR gRNA sequence
aagtgatatcagagaataat

SEQ ID NO: 686601 - DNA, 20 bp, Artificial
  CRISPR gRNA sequence
agtgatatcagagaataatg

SEQ ID NO: 686602 - DNA, 20 bp, Artificial
  CRISPR gRNA sequence
aagagcatcataggtaataa

SEQ ID NO: 686603 - DNA, 20 bp, Artificial
  CRISPR gRNA sequence
tatttaagtgcctttctgtt

SEQ ID NO: 686604 - DNA, 20 bp, Artificial
  CRISPR gRNA sequence
atttaagtgcctttctgttt

SEQ ID NO: 686605 - DNA, 20 bp, Artificial
  CRISPR gRNA sequence
tttaagtgcctttctgtttc

SEQ ID NO: 686606 - DNA, 20 bp, Artificial
  CRISPR gRNA sequence
aagtgcctttctgtttcgtg

SEQ ID NO: 686607 - DNA, 20 bp, Artificial
  CRISPR gRNA sequence
agtgcctttctgtttcgtgt

SEQ ID NO: 686608 - DNA, 20 bp, Artificial
  CRISPR gRNA sequence
tctgtttcgtgtgtgtgtgt

SEQ ID NO: 686609 - DNA, 20 bp, Artificial
  CRISPR gRNA sequence
ctgtttcgtgtgtgtgtgtg

SEQ ID NO: 686610 - DNA, 20 bp, Artificial
  CRISPR gRNA sequence
tgtttcgtgtgtgtgtgtgt

SEQ ID NO: 686611 - DNA, 20 bp, Artificial
  CRISPR gRNA sequence
tttcgtgtgtgtgtgtgtgt

SEQ ID NO: 686612 - DNA, 20 bp, Artificial
  CRISPR gRNA sequence
cgtgtgtgtgtgtgtgtgtg

SEQ ID NO: 686613 - DNA, 20 bp, Artificial
  CRISPR gRNA sequence
gtgtgtgtgtgtgtgtgtgt

SEQ ID NO: 686614 - DNA, 20 bp, Artificial
  CRISPR gRNA sequence
gtcattatgggttattgtca

SEQ ID NO: 686615 - DNA, 20 bp, Artificial
  CRISPR gRNA sequence
tcattatgggttattgtcag

SEQ ID NO: 686616 - DNA, 20 bp, Artificial
  CRISPR gRNA sequence
tgggttattgtcagaagaac

SEQ ID NO: 686617 - DNA, 20 bp, Artificial
  CRISPR gRNA sequence
ttgtcagaagaacttgaaaa

SEQ ID NO: 686618 - DNA, 20 bp, Artificial
  CRISPR gRNA sequence
tcagaagaacttgaaaaaca

SEQ ID NO: 686619 - DNA, 20 bp, Artificial
  CRISPR gRNA sequence
gaaaaacattgctatgaaat

SEQ ID NO: 686620 - DNA, 20 bp, Artificial
  CRISPR gRNA sequence
aaaaacattgctatgaaata

SEQ ID NO: 686621 - DNA, 20 bp, Artificial
  CRISPR gRNA sequence
ctatgaaatagaatagaaac

SEQ ID NO: 686622 - DNA, 20 bp, Artificial
  CRISPR gRNA sequence
tgaaatagaatagaaacatg

SEQ ID NO: 686623 - DNA, 20 bp, Artificial
  CRISPR gRNA sequence
tatattgactagcattcaat

SEQ ID NO: 686624 - DNA, 20 bp, Artificial
  CRISPR gRNA sequence
atattgactagcattcaatg

SEQ ID NO: 686625 - DNA, 20 bp, Artificial
  CRISPR gRNA sequence
tattgactagcattcaatgc

SEQ ID NO: 686626 - DNA, 20 bp, Artificial
  CRISPR gRNA sequence
actagcattcaatgctctcc

SEQ ID NO: 686627 - DNA, 20 bp, Artificial
  CRISPR gRNA sequence
gcattcaatgctctcctaat

SEQ ID NO: 686628 - DNA, 20 bp, Artificial
  CRISPR gRNA sequence
aatgctctcctaatatttat

SEQ ID NO: 686629 - DNA, 20 bp, Artificial
  CRISPR gRNA sequence
tcctaatatttatatttctt

SEQ ID NO: 686630 - DNA, 20 bp, Artificial
  CRISPR gRNA sequence
ctaatatttatatttctttt

SEQ ID NO: 686631 - DNA, 20 bp, Artificial
  CRISPR gRNA sequence
atatttatatttctttttgt

SEQ ID NO: 686632 - DNA, 20 bp, Artificial
  CRISPR gRNA sequence
atatttctttttgtctttaa

SEQ ID NO: 686633 - DNA, 20 bp, Artificial
  CRISPR gRNA sequence
tatttctttttgtctttaag

SEQ ID NO: 686634 - DNA, 20 bp, Artificial
  CRISPR gRNA sequence
ctttttgtctttaagatgag

SEQ ID NO: 686635 - DNA, 20 bp, Artificial
  CRISPR gRNA sequence
tttttgtctttaagatgagc

SEQ ID NO: 686636 - DNA, 20 bp, Artificial
  CRISPR gRNA sequence
tttgtctttaagatgagcaa

SEQ ID NO: 686637 - DNA, 20 bp, Artificial
  CRISPR gRNA sequence
ttgtctttaagatgagcaag

SEQ ID NO: 686638 - DNA, 20 bp, Artificial
  CRISPR gRNA sequence
tgtctttaagatgagcaagg

SEQ ID NO: 686639 - DNA, 20 bp, Artificial
  CRISPR gRNA sequence
gtctttaagatgagcaaggc

SEQ ID NO: 686640 - DNA, 20 bp, Artificial
  CRISPR gRNA sequence
tctttaagatgagcaaggct

SEQ ID NO: 686641 - DNA, 20 bp, Artificial
  CRISPR gRNA sequence
taagatgagcaaggcttttc

SEQ ID NO: 686642 - DNA, 20 bp, Artificial
  CRISPR gRNA sequence
aagatgagcaaggcttttct

SEQ ID NO: 686643 - DNA, 20 bp, Artificial
  CRISPR gRNA sequence
agatgagcaaggcttttctc

SEQ ID NO: 686644 - DNA, 20 bp, Artificial
  CRISPR gRNA sequence
ttctctgtttccagtaatcg

SEQ ID NO: 686645 - DNA, 20 bp, Artificial
  CRISPR gRNA sequence
tctctgtttccagtaatcgg

SEQ ID NO: 686646 - DNA, 20 bp, Artificial
  CRISPR gRNA sequence
ctctgtttccagtaatcgga

SEQ ID NO: 686647 - DNA, 20 bp, Artificial
  CRISPR gRNA sequence
tctgtttccagtaatcggag

SEQ ID NO: 686648 - DNA, 20 bp, Artificial
  CRISPR gRNA sequence
tgtttccagtaatcggagcc

SEQ ID NO: 686649 - DNA, 20 bp, Artificial
  CRISPR gRNA sequence
tttccagtaatcggagcccc

SEQ ID NO: 686650 - DNA, 20 bp, Artificial
  CRISPR gRNA sequence
ccagtaatcggagcccctgc

SEQ ID NO: 686651 - DNA, 20 bp, Artificial
  CRISPR gRNA sequence
cagtaatcggagcccctgca

SEQ ID NO: 686652 - DNA, 20 bp, Artificial
  CRISPR gRNA sequence
cacaaaatgaaataaaggaa

SEQ ID NO: 686653 - DNA, 20 bp, Artificial
  CRISPR gRNA sequence
gtaagaaaatttatcagaat

SEQ ID NO: 686654 - DNA, 20 bp, Artificial
  CRISPR gRNA sequence
atcagaatgctgtaaatatt

SEQ ID NO: 686655 - DNA, 20 bp, Artificial
  CRISPR gRNA sequence
tcagaatgctgtaaatattg

SEQ ID NO: 686656 - DNA, 20 bp, Artificial
  CRISPR gRNA sequence
taaatattgcctggaaaaat

SEQ ID NO: 686657 - DNA, 20 bp, Artificial
  CRISPR gRNA sequence
cctggaaaaatccttccata

SEQ ID NO: 686658 - DNA, 20 bp, Artificial
  CRISPR gRNA sequence
gaaaaatccttccatatgac

SEQ ID NO: 686659 - DNA, 20 bp, Artificial
  CRISPR gRNA sequence
ccatatgacccctgttctga

SEQ ID NO: 686660 - DNA, 20 bp, Artificial
  CRISPR gRNA sequence
catatgacccctgttctgaa

SEQ ID NO: 686661 - DNA, 20 bp, Artificial
  CRISPR gRNA sequence
ttctgaattcccttagcagg

SEQ ID NO: 686662 - DNA, 20 bp, Artificial
  CRISPR gRNA sequence
tgaattcccttagcaggggt

SEQ ID NO: 686663 - DNA, 20 bp, Artificial
  CRISPR gRNA sequence
aattcccttagcaggggtca

SEQ ID NO: 686664 - DNA, 20 bp, Artificial
  CRISPR gRNA sequence
ccttagcaggggtcaggcaa

SEQ ID NO: 686665 - DNA, 20 bp, Artificial
  CRISPR gRNA sequence
agcaggggtcaggcaattag

SEQ ID NO: 686666 - DNA, 20 bp, Artificial
  CRISPR gRNA sequence
gcaggggtcaggcaattagc

SEQ ID NO: 686667 - DNA, 20 bp, Artificial
  CRISPR gRNA sequence
gcataaggaaccttgaggag

SEQ ID NO: 686668 - DNA, 20 bp, Artificial
  CRISPR gRNA sequence
gaggagtaagtgaggtgaca

SEQ ID NO: 686669 - DNA, 20 bp, Artificial
  CRISPR gRNA sequence
aggagtaagtgaggtgacat

SEQ ID NO: 686670 - DNA, 20 bp, Artificial
  CRISPR gRNA sequence
aaagcacctgccccaagcat

SEQ ID NO: 686671 - DNA, 20 bp, Artificial
  CRISPR gRNA sequence
ccccaagcatttgctaatat

SEQ ID NO: 686672 - DNA, 20 bp, Artificial
  CRISPR gRNA sequence
gctaatattgggaacaggga

SEQ ID NO: 686673 - DNA, 20 bp, Artificial
  CRISPR gRNA sequence
ctaatattgggaacagggac

SEQ ID NO: 686674 - DNA, 20 bp, Artificial
  CRISPR gRNA sequence
atattgggaacagggacaca

SEQ ID NO: 686675 - DNA, 20 bp, Artificial
  CRISPR gRNA sequence
ggaacagggacacagcaatt

SEQ ID NO: 686676 - DNA, 20 bp, Artificial
  CRISPR gRNA sequence
cagtgtttacatttgtttat

SEQ ID NO: 686677 - DNA, 20 bp, Artificial
  CRISPR gRNA sequence
acatttgtttattgtacttt

SEQ ID NO: 686678 - DNA, 20 bp, Artificial
  CRISPR gRNA sequence
catttgtttattgtactttg

SEQ ID NO: 686679 - DNA, 20 bp, Artificial
  CRISPR gRNA sequence
gtttattgtactttgtaatt

SEQ ID NO: 686680 - DNA, 20 bp, Artificial
  CRISPR gRNA sequence
tttattgtactttgtaattc

SEQ ID NO: 686681 - DNA, 20 bp, Artificial
  CRISPR gRNA sequence
attgtactttgtaattcatg

SEQ ID NO: 686682 - DNA, 20 bp, Artificial
  CRISPR gRNA sequence
ttgtactttgtaattcatga

SEQ ID NO: 686683 - DNA, 20 bp, Artificial
  CRISPR gRNA sequence
tactttgtaattcatgatgc

SEQ ID NO: 686684 - DNA, 20 bp, Artificial
  CRISPR gRNA sequence
tgtaattcatgatgctttca

SEQ ID NO: 686685 - DNA, 20 bp, Artificial
  CRISPR gRNA sequence
gtaattcatgatgctttcat

SEQ ID NO: 686686 - DNA, 20 bp, Artificial
  CRISPR gRNA sequence
taattcatgatgctttcatg

SEQ ID NO: 686687 - DNA, 20 bp, Artificial
  CRISPR gRNA sequence
atgatgctttcatgtatgca

SEQ ID NO: 686688 - DNA, 20 bp, Artificial
  CRISPR gRNA sequence
tcatgtatgcatctaatttc

SEQ ID NO: 686689 - DNA, 20 bp, Artificial
  CRISPR gRNA sequence
catgtatgcatctaatttca

SEQ ID NO: 686690 - DNA, 20 bp, Artificial
  CRISPR gRNA sequence
atgtatgcatctaatttcat

SEQ ID NO: 686691 - DNA, 20 bp, Artificial
  CRISPR gRNA sequence
atttcatcttcatctctatc

SEQ ID NO: 686692 - DNA, 20 bp, Artificial
  CRISPR gRNA sequence
catcttcatctctatcccag

SEQ ID NO: 686693 - DNA, 20 bp, Artificial
  CRISPR gRNA sequence
atcttcatctctatcccaga

SEQ ID NO: 686694 - DNA, 20 bp, Artificial
  CRISPR gRNA sequence
catctctatcccagagcttg

SEQ ID NO: 686695 - DNA, 20 bp, Artificial
  CRISPR gRNA sequence
atctctatcccagagcttgg

SEQ ID NO: 686696 - DNA, 20 bp, Artificial
  CRISPR gRNA sequence
tatcccagagcttgggatgg

SEQ ID NO: 686697 - DNA, 20 bp, Artificial
  CRISPR gRNA sequence
tcccagagcttgggatggag

SEQ ID NO: 686698 - DNA, 20 bp, Artificial
  CRISPR gRNA sequence
gggatggagacctgcagggt

SEQ ID NO: 686699 - DNA, 20 bp, Artificial
  CRISPR gRNA sequence
ggatggagacctgcagggtg

SEQ ID NO: 686700 - DNA, 20 bp, Artificial
  CRISPR gRNA sequence
cagggtgttcattctgggca

SEQ ID NO: 686701 - DNA, 20 bp, Artificial
  CRISPR gRNA sequence
attctgggcaatggtagcca

SEQ ID NO: 686702 - DNA, 20 bp, Artificial
  CRISPR gRNA sequence
tgggcaatggtagccagatc

SEQ ID NO: 686703 - DNA, 20 bp, Artificial
  CRISPR gRNA sequence
ggcaatggtagccagatccg

SEQ ID NO: 686704 - DNA, 20 bp, Artificial
  CRISPR gRNA sequence
atcttcaaagtagcttatgg

SEQ ID NO: 686705 - DNA, 20 bp, Artificial
  CRISPR gRNA sequence
tcttcaaagtagcttatgga

SEQ ID NO: 686706 - DNA, 20 bp, Artificial
  CRISPR gRNA sequence
caaagtagcttatggagaga

SEQ ID NO: 686707 - DNA, 20 bp, Artificial
  CRISPR gRNA sequence
aaagtagcttatggagagat

SEQ ID NO: 686708 - DNA, 20 bp, Artificial
  CRISPR gRNA sequence
atggagagatgaagagagtt

SEQ ID NO: 686709 - DNA, 20 bp, Artificial
  CRISPR gRNA sequence
tggagagatgaagagagttc

SEQ ID NO: 686710 - DNA, 20 bp, Artificial
  CRISPR gRNA sequence
tgtagaaagatgtggaagag

SEQ ID NO: 686711 - DNA, 20 bp, Artificial
  CRISPR gRNA sequence
tagaaagatgtggaagaggg

SEQ ID NO: 686712 - DNA, 20 bp, Artificial
  CRISPR gRNA sequence
gaaagaaactctaatttcta

SEQ ID NO: 686713 - DNA, 20 bp, Artificial
  CRISPR gRNA sequence
taatttctagtagagggcaa

SEQ ID NO: 686714 - DNA, 20 bp, Artificial
  CRISPR gRNA sequence
atttctagtagagggcaatc

SEQ ID NO: 686715 - DNA, 20 bp, Artificial
  CRISPR gRNA sequence
ctagtagagggcaatccttt

SEQ ID NO: 686716 - DNA, 20 bp, Artificial
  CRISPR gRNA sequence
tagtagagggcaatcctttt

SEQ ID NO: 686717 - DNA, 20 bp, Artificial
  CRISPR gRNA sequence
gtagagggcaatccttttac

SEQ ID NO: 686718 - DNA, 20 bp, Artificial
  CRISPR gRNA sequence
ttactagaaatcctttgtaa

SEQ ID NO: 686719 - DNA, 20 bp, Artificial
  CRISPR gRNA sequence
tactagaaatcctttgtaat

SEQ ID NO: 686720 - DNA, 20 bp, Artificial
  CRISPR gRNA sequence
actagaaatcctttgtaatg

SEQ ID NO: 686721 - DNA, 20 bp, Artificial
  CRISPR gRNA sequence
ctagaaatcctttgtaatgt

SEQ ID NO: 686722 - DNA, 20 bp, Artificial
  CRISPR gRNA sequence
gaaatcctttgtaatgtggg

SEQ ID NO: 686723 - DNA, 20 bp, Artificial
  CRISPR gRNA sequence
tgtaatgtggggttggtgaa

SEQ ID NO: 686724 - DNA, 20 bp, Artificial
  CRISPR gRNA sequence
gtaatgtggggttggtgaag

SEQ ID NO: 686725 - DNA, 20 bp, Artificial
  CRISPR gRNA sequence
taatgtggggttggtgaagg

SEQ ID NO: 686726 - DNA, 20 bp, Artificial
  CRISPR gRNA sequence
gtgaaggcagaatcattggc

SEQ ID NO: 686727 - DNA, 20 bp, Artificial
  CRISPR gRNA sequence
gccttgttagtttcccatgc

SEQ ID NO: 686728 - DNA, 20 bp, Artificial
  CRISPR gRNA sequence
gttagtttcccatgcagatg

SEQ ID NO: 686729 - DNA, 20 bp, Artificial
  CRISPR gRNA sequence
ttagtttcccatgcagatga

SEQ ID NO: 686730 - DNA, 20 bp, Artificial
  CRISPR gRNA sequence
gtttcccatgcagatgagaa

SEQ ID NO: 686731 - DNA, 20 bp, Artificial
  CRISPR gRNA sequence
cccatgcagatgagaatata

SEQ ID NO: 686732 - DNA, 20 bp, Artificial
  CRISPR gRNA sequence
ccatgcagatgagaatatag

SEQ ID NO: 686733 - DNA, 20 bp, Artificial
  CRISPR gRNA sequence
agcttcaaacccagctgggt

SEQ ID NO: 686734 - DNA, 20 bp, Artificial
  CRISPR gRNA sequence
caaacccagctgggtgaatg

SEQ ID NO: 686735 - DNA, 20 bp, Artificial
  CRISPR gRNA sequence
aaacccagctgggtgaatga

SEQ ID NO: 686736 - DNA, 20 bp, Artificial
  CRISPR gRNA sequence
ggtgaatgaaggtaatggaa

SEQ ID NO: 686737 - DNA, 20 bp, Artificial
  CRISPR gRNA sequence
gagatgagggagggaggtcc

SEQ ID NO: 686738 - DNA, 20 bp, Artificial
  CRISPR gRNA sequence
gtggggtgcatactaagtgt

SEQ ID NO: 686739 - DNA, 20 bp, Artificial
  CRISPR gRNA sequence
agtgttcagtaaggtttttt

SEQ ID NO: 686740 - DNA, 20 bp, Artificial
  CRISPR gRNA sequence
agtaaggttttttttttaca

SEQ ID NO: 686741 - DNA, 20 bp, Artificial
  CRISPR gRNA sequence
tttttttacattaaatggga

SEQ ID NO: 686742 - DNA, 20 bp, Artificial
  CRISPR gRNA sequence
ttttttacattaaatgggat

SEQ ID NO: 686743 - DNA, 20 bp, Artificial
  CRISPR gRNA sequence
tttttacattaaatgggata

SEQ ID NO: 686744 - DNA, 20 bp, Artificial
  CRISPR gRNA sequence
ttttacattaaatgggataa

SEQ ID NO: 686745 - DNA, 20 bp, Artificial
  CRISPR gRNA sequence
tttacattaaatgggataaa

SEQ ID NO: 686746 - DNA, 20 bp, Artificial
  CRISPR gRNA sequence
ttacattaaatgggataaaa

SEQ ID NO: 686747 - DNA, 20 bp, Artificial
  CRISPR gRNA sequence
tacattaaatgggataaaat

SEQ ID NO: 686748 - DNA, 20 bp, Artificial
  CRISPR gRNA sequence
acattaaatgggataaaatg

SEQ ID NO: 686749 - DNA, 20 bp, Artificial
  CRISPR gRNA sequence
cattaaatgggataaaatgc

SEQ ID NO: 686750 - DNA, 20 bp, Artificial
  CRISPR gRNA sequence
aatgggataaaatgccagtc

SEQ ID NO: 686751 - DNA, 20 bp, Artificial
  CRISPR gRNA sequence
attttattggtgaatgtcct

SEQ ID NO: 686752 - DNA, 20 bp, Artificial
  CRISPR gRNA sequence
tattggtgaatgtccttact

SEQ ID NO: 686753 - DNA, 20 bp, Artificial
  CRISPR gRNA sequence
attggtgaatgtccttactc

SEQ ID NO: 686754 - DNA, 20 bp, Artificial
  CRISPR gRNA sequence
ttggtgaatgtccttactcc

SEQ ID NO: 686755 - DNA, 20 bp, Artificial
  CRISPR gRNA sequence
gtgaatgtccttactcccct

SEQ ID NO: 686756 - DNA, 20 bp, Artificial
  CRISPR gRNA sequence
actcccctctaggaaaaaac

SEQ ID NO: 686757 - DNA, 20 bp, Artificial
  CRISPR gRNA sequence
ctcccctctaggaaaaaacg

SEQ ID NO: 686758 - DNA, 20 bp, Artificial
  CRISPR gRNA sequence
ccctctaggaaaaaacgcaa

SEQ ID NO: 686759 - DNA, 20 bp, Artificial
  CRISPR gRNA sequence
taggaaaaaacgcaaaccta

SEQ ID NO: 686760 - DNA, 20 bp, Artificial
  CRISPR gRNA sequence
ggaaaaaacgcaaacctaac

SEQ ID NO: 686761 - DNA, 20 bp, Artificial
  CRISPR gRNA sequence
acttgctctgcttgttttgg

SEQ ID NO: 686762 - DNA, 20 bp, Artificial
  CRISPR gRNA sequence
gctctgcttgttttggaaaa

SEQ ID NO: 686763 - DNA, 20 bp, Artificial
  CRISPR gRNA sequence
ctctgcttgttttggaaaag

SEQ ID NO: 686764 - DNA, 20 bp, Artificial
  CRISPR gRNA sequence
tgcttgttttggaaaaggca

SEQ ID NO: 686765 - DNA, 20 bp, Artificial
  CRISPR gRNA sequence
cttgttttggaaaaggcact

SEQ ID NO: 686766 - DNA, 20 bp, Artificial
  CRISPR gRNA sequence
gttttggaaaaggcactcag

SEQ ID NO: 686767 - DNA, 20 bp, Artificial
  CRISPR gRNA sequence
ttttggaaaaggcactcagt

SEQ ID NO: 686768 - DNA, 20 bp, Artificial
  CRISPR gRNA sequence
tggaaaaggcactcagttct

SEQ ID NO: 686769 - DNA, 20 bp, Artificial
  CRISPR gRNA sequence
ggaaaaggcactcagttctt

SEQ ID NO: 686770 - DNA, 20 bp, Artificial
  CRISPR gRNA sequence
gaaaaggcactcagttcttg

SEQ ID NO: 686771 - DNA, 20 bp, Artificial
  CRISPR gRNA sequence
agttcttggctgccgtcctg

SEQ ID NO: 686772 - DNA, 20 bp, Artificial
  CRISPR gRNA sequence
ttggctgccgtcctgtggca

SEQ ID NO: 686773 - DNA, 20 bp, Artificial
  CRISPR gRNA sequence
ggctgccgtcctgtggcagc

SEQ ID NO: 686774 - DNA, 20 bp, Artificial
  CRISPR gRNA sequence
gctgccgtcctgtggcagct

SEQ ID NO: 686775 - DNA, 20 bp, Artificial
  CRISPR gRNA sequence
ccgtcctgtggcagcttaat

SEQ ID NO: 686776 - DNA, 20 bp, Artificial
  CRISPR gRNA sequence
tggcagcttaatggaacaaa

SEQ ID NO: 686777 - DNA, 20 bp, Artificial
  CRISPR gRNA sequence
aatggaacaaaaattacaga

SEQ ID NO: 686778 - DNA, 20 bp, Artificial
  CRISPR gRNA sequence
atggaacaaaaattacagac

SEQ ID NO: 686779 - DNA, 20 bp, Artificial
  CRISPR gRNA sequence
cagactttggtgaaccaaga

SEQ ID NO: 686780 - DNA, 20 bp, Artificial
  CRISPR gRNA sequence
tggtgaaccaagaattcaac

SEQ ID NO: 686781 - DNA, 20 bp, Artificial
  CRISPR gRNA sequence
ggtgaaccaagaattcaaca

SEQ ID NO: 686782 - DNA, 20 bp, Artificial
  CRISPR gRNA sequence
gtgaaccaagaattcaacaa

SEQ ID NO: 686783 - DNA, 20 bp, Artificial
  CRISPR gRNA sequence
aacaagaggaagggcaaaat

SEQ ID NO: 686784 - DNA, 20 bp, Artificial
  CRISPR gRNA sequence
ttatattgaagagaaccatc

SEQ ID NO: 686785 - DNA, 20 bp, Artificial
  CRISPR gRNA sequence
tatattgaagagaaccatcc

SEQ ID NO: 686786 - DNA, 20 bp, Artificial
  CRISPR gRNA sequence
atattgaagagaaccatcct

SEQ ID NO: 686787 - DNA, 20 bp, Artificial
  CRISPR gRNA sequence
tattgaagagaaccatcctc

SEQ ID NO: 686788 - DNA, 20 bp, Artificial
  CRISPR gRNA sequence
aagagaaccatcctcttccc

SEQ ID NO: 686789 - DNA, 20 bp, Artificial
  CRISPR gRNA sequence
ttccccttgcacatggtttg

SEQ ID NO: 686790 - DNA, 20 bp, Artificial
  CRISPR gRNA sequence
ccccttgcacatggtttgca

SEQ ID NO: 686791 - DNA, 20 bp, Artificial
  CRISPR gRNA sequence
cccttgcacatggtttgcac

SEQ ID NO: 686792 - DNA, 20 bp, Artificial
  CRISPR gRNA sequence
gcacatggtttgcacctgca

SEQ ID NO: 686793 - DNA, 20 bp, Artificial
  CRISPR gRNA sequence
cacatggtttgcacctgcaa

SEQ ID NO: 686794 - DNA, 20 bp, Artificial
  CRISPR gRNA sequence
gcacctgcaaagtaggcatt

SEQ ID NO: 686795 - DNA, 20 bp, Artificial
  CRISPR gRNA sequence
cacctgcaaagtaggcatta

SEQ ID NO: 686796 - DNA, 20 bp, Artificial
  CRISPR gRNA sequence
caaagtaggcattaaaagta

SEQ ID NO: 686797 - DNA, 20 bp, Artificial
  CRISPR gRNA sequence
aaagtaacaggttgctttct

SEQ ID NO: 686798 - DNA, 20 bp, Artificial
  CRISPR gRNA sequence
ctttcttagtttcagcaatg

SEQ ID NO: 686799 - DNA, 20 bp, Artificial
  CRISPR gRNA sequence
tcttagtttcagcaatgggc

SEQ ID NO: 686800 - DNA, 20 bp, Artificial
  CRISPR gRNA sequence
cttagtttcagcaatgggct

SEQ ID NO: 686801 - DNA, 20 bp, Artificial
  CRISPR gRNA sequence
ttagtttcagcaatgggctg

SEQ ID NO: 686802 - DNA, 20 bp, Artificial
  CRISPR gRNA sequence
agtttcagcaatgggctggc

SEQ ID NO: 686803 - DNA, 20 bp, Artificial
  CRISPR gRNA sequence
gtttcagcaatgggctggct

SEQ ID NO: 686804 - DNA, 20 bp, Artificial
  CRISPR gRNA sequence
cagcaatgggctggcttgtc

SEQ ID NO: 686805 - DNA, 20 bp, Artificial
  CRISPR gRNA sequence
agcaatgggctggcttgtct

SEQ ID NO: 686806 - DNA, 20 bp, Artificial
  CRISPR gRNA sequence
gcttgtctagacatggtttt

SEQ ID NO: 686807 - DNA, 20 bp, Artificial
  CRISPR gRNA sequence
gtctagacatggttttaaga

SEQ ID NO: 686808 - DNA, 20 bp, Artificial
  CRISPR gRNA sequence
tctagacatggttttaagaa

SEQ ID NO: 686809 - DNA, 20 bp, Artificial
  CRISPR gRNA sequence
gacatggttttaagaatagc

SEQ ID NO: 686810 - DNA, 20 bp, Artificial
  CRISPR gRNA sequence
taagaatagctgacgtgaag

SEQ ID NO: 686811 - DNA, 20 bp, Artificial
  CRISPR gRNA sequence
aagaatagctgacgtgaagg

SEQ ID NO: 686812 - DNA, 20 bp, Artificial
  CRISPR gRNA sequence
agaatagctgacgtgaagga

SEQ ID NO: 686813 - DNA, 20 bp, Artificial
  CRISPR gRNA sequence
acgtgaaggaagaggattta

SEQ ID NO: 686814 - DNA, 20 bp, Artificial
  CRISPR gRNA sequence
attgctgcagtacgactgtc

SEQ ID NO: 686815 - DNA, 20 bp, Artificial
  CRISPR gRNA sequence
ttgctgcagtacgactgtct

SEQ ID NO: 686816 - DNA, 20 bp, Artificial
  CRISPR gRNA sequence
ctgcagtacgactgtctggc

SEQ ID NO: 686817 - DNA, 20 bp, Artificial
  CRISPR gRNA sequence
cagtacgactgtctggccct

SEQ ID NO: 686818 - DNA, 20 bp, Artificial
  CRISPR gRNA sequence
tctggccctgaatttgcatg

SEQ ID NO: 686819 - DNA, 20 bp, Artificial
  CRISPR gRNA sequence
gccctgaatttgcatggctt

SEQ ID NO: 686820 - DNA, 20 bp, Artificial
  CRISPR gRNA sequence
aatttgcatggcttgagaag

SEQ ID NO: 686821 - DNA, 20 bp, Artificial
  CRISPR gRNA sequence
gcatggcttgagaaggcaca

SEQ ID NO: 686822 - DNA, 20 bp, Artificial
  CRISPR gRNA sequence
catggcttgagaaggcacac

SEQ ID NO: 686823 - DNA, 20 bp, Artificial
  CRISPR gRNA sequence
gagaaggcacaccgtaagac

SEQ ID NO: 686824 - DNA, 20 bp, Artificial
  CRISPR gRNA sequence
agaaggcacaccgtaagact

SEQ ID NO: 686825 - DNA, 20 bp, Artificial
  CRISPR gRNA sequence
agtaggaaaaatccaagtaa

SEQ ID NO: 686826 - DNA, 20 bp, Artificial
  CRISPR gRNA sequence
ctgagactttgatcacctga

SEQ ID NO: 686827 - DNA, 20 bp, Artificial
  CRISPR gRNA sequence
tgagactttgatcacctgaa

SEQ ID NO: 686828 - DNA, 20 bp, Artificial
  CRISPR gRNA sequence
agactttgatcacctgaact

SEQ ID NO: 686829 - DNA, 20 bp, Artificial
  CRISPR gRNA sequence
tgatcacctgaactttctct

SEQ ID NO: 686830 - DNA, 20 bp, Artificial
  CRISPR gRNA sequence
gatcacctgaactttctcta

SEQ ID NO: 686831 - DNA, 20 bp, Artificial
  CRISPR gRNA sequence
atcacctgaactttctctag

SEQ ID NO: 686832 - DNA, 20 bp, Artificial
  CRISPR gRNA sequence
aactttctctagcaagtgta

SEQ ID NO: 686833 - DNA, 20 bp, Artificial
  CRISPR gRNA sequence
tctctagcaagtgtaagcag

SEQ ID NO: 686834 - DNA, 20 bp, Artificial
  CRISPR gRNA sequence
ctctagcaagtgtaagcaga

SEQ ID NO: 686835 - DNA, 20 bp, Artificial
  CRISPR gRNA sequence
tctagcaagtgtaagcagaa

SEQ ID NO: 686836 - DNA, 20 bp, Artificial
  CRISPR gRNA sequence
tagcaagtgtaagcagaatg

SEQ ID NO: 686837 - DNA, 20 bp, Artificial
  CRISPR gRNA sequence
gcaagtgtaagcagaatgga

SEQ ID NO: 686838 - DNA, 20 bp, Artificial
  CRISPR gRNA sequence
caagagatccatcaagacaa

SEQ ID NO: 686839 - DNA, 20 bp, Artificial
  CRISPR gRNA sequence
tgccataaaatgtgcttctc

SEQ ID NO: 686840 - DNA, 20 bp, Artificial
  CRISPR gRNA sequence
ctcttcttcgggatgttgtt

SEQ ID NO: 686841 - DNA, 20 bp, Artificial
  CRISPR gRNA sequence
tcttcttcgggatgttgttt

SEQ ID NO: 686842 - DNA, 20 bp, Artificial
  CRISPR gRNA sequence
ttcttcgggatgttgtttgc

SEQ ID NO: 686843 - DNA, 20 bp, Artificial
  CRISPR gRNA sequence
cttcgggatgttgtttgctg

SEQ ID NO: 686844 - DNA, 20 bp, Artificial
  CRISPR gRNA sequence
ttcgggatgttgtttgctgt

SEQ ID NO: 686845 - DNA, 20 bp, Artificial
  CRISPR gRNA sequence
cgggatgttgtttgctgtct

SEQ ID NO: 686846 - DNA, 20 bp, Artificial
  CRISPR gRNA sequence
gggatgttgtttgctgtctg

SEQ ID NO: 686847 - DNA, 20 bp, Artificial
  CRISPR gRNA sequence
tttgctgtctgatctttgta

SEQ ID NO: 686848 - DNA, 20 bp, Artificial
  CRISPR gRNA sequence
gctgtctgatctttgtagac

SEQ ID NO: 686849 - DNA, 20 bp, Artificial
  CRISPR gRNA sequence
ctgtctgatctttgtagact

SEQ ID NO: 686850 - DNA, 20 bp, Artificial
  CRISPR gRNA sequence
tctgatctttgtagactgtt

SEQ ID NO: 686851 - DNA, 20 bp, Artificial
  CRISPR gRNA sequence
atctttgtagactgttcctg

SEQ ID NO: 686852 - DNA, 20 bp, Artificial
  CRISPR gRNA sequence
tgtagactgttcctgtttgc

SEQ ID NO: 686853 - DNA, 20 bp, Artificial
  CRISPR gRNA sequence
gtagactgttcctgtttgct

SEQ ID NO: 686854 - DNA, 20 bp, Artificial
  CRISPR gRNA sequence
tagactgttcctgtttgctg

SEQ ID NO: 686855 - DNA, 20 bp, Artificial
  CRISPR gRNA sequence
ttcctgtttgctgggagctt

SEQ ID NO: 686856 - DNA, 20 bp, Artificial
  CRISPR gRNA sequence
ctgtttgctgggagcttctc

SEQ ID NO: 686857 - DNA, 20 bp, Artificial
  CRISPR gRNA sequence
tttgctgggagcttctctgc

SEQ ID NO: 686858 - DNA, 20 bp, Artificial
  CRISPR gRNA sequence
gctgggagcttctctgctgc

SEQ ID NO: 686859 - DNA, 20 bp, Artificial
  CRISPR gRNA sequence
ctgggagcttctctgctgct

SEQ ID NO: 686860 - DNA, 20 bp, Artificial
  CRISPR gRNA sequence
ggagcttctctgctgcttaa

SEQ ID NO: 686861 - DNA, 20 bp, Artificial
  CRISPR gRNA sequence
ctctgctgcttaaattgttc

SEQ ID NO: 686862 - DNA, 20 bp, Artificial
  CRISPR gRNA sequence
tctgctgcttaaattgttcg

SEQ ID NO: 686863 - DNA, 20 bp, Artificial
  CRISPR gRNA sequence
tgctgcttaaattgttcgtc

SEQ ID NO: 686864 - DNA, 20 bp, Artificial
  CRISPR gRNA sequence
ctgcttaaattgttcgtcct

SEQ ID NO: 686865 - DNA, 20 bp, Artificial
  CRISPR gRNA sequence
cttaaattgttcgtcctccc

SEQ ID NO: 686866 - DNA, 20 bp, Artificial
  CRISPR gRNA sequence
aaattgttcgtcctccccca

SEQ ID NO: 686867 - DNA, 20 bp, Artificial
  CRISPR gRNA sequence
aattgttcgtcctcccccac

SEQ ID NO: 686868 - DNA, 20 bp, Artificial
  CRISPR gRNA sequence
ttcgtcctcccccactccct

SEQ ID NO: 686869 - DNA, 20 bp, Artificial
  CRISPR gRNA sequence
gtcctcccccactccctcct

SEQ ID NO: 686870 - DNA, 20 bp, Artificial
  CRISPR gRNA sequence
ccccactccctcctatcgtt

SEQ ID NO: 686871 - DNA, 20 bp, Artificial
  CRISPR gRNA sequence
cctcctatcgttggtttgtc

SEQ ID NO: 686872 - DNA, 20 bp, Artificial
  CRISPR gRNA sequence
ctatcgttggtttgtctaga

SEQ ID NO: 686873 - DNA, 20 bp, Artificial
  CRISPR gRNA sequence
tcgttggtttgtctagaaca

SEQ ID NO: 686874 - DNA, 20 bp, Artificial
  CRISPR gRNA sequence
gtttgtctagaacactcagc

SEQ ID NO: 686875 - DNA, 20 bp, Artificial
  CRISPR gRNA sequence
gtctagaacactcagctgct

SEQ ID NO: 686876 - DNA, 20 bp, Artificial
  CRISPR gRNA sequence
tctagaacactcagctgctt

SEQ ID NO: 686877 - DNA, 20 bp, Artificial
  CRISPR gRNA sequence
gaacactcagctgcttcttt

SEQ ID NO: 686878 - DNA, 20 bp, Artificial
  CRISPR gRNA sequence
agctgcttctttggtcatcc

SEQ ID NO: 686879 - DNA, 20 bp, Artificial
  CRISPR gRNA sequence
cttctttggtcatccttgtt

SEQ ID NO: 686880 - DNA, 20 bp, Artificial
  CRISPR gRNA sequence
ctttggtcatccttgttttc

SEQ ID NO: 686881 - DNA, 20 bp, Artificial
  CRISPR gRNA sequence
tttggtcatccttgttttct

SEQ ID NO: 686882 - DNA, 20 bp, Artificial
  CRISPR gRNA sequence
tggtcatccttgttttctaa

SEQ ID NO: 686883 - DNA, 20 bp, Artificial
  CRISPR gRNA sequence
ggtcatccttgttttctaac

SEQ ID NO: 686884 - DNA, 20 bp, Artificial
  CRISPR gRNA sequence
gtcatccttgttttctaact

SEQ ID NO: 686885 - DNA, 20 bp, Artificial
  CRISPR gRNA sequence
gttttctaactttatgaact

SEQ ID NO: 686886 - DNA, 20 bp, Artificial
  CRISPR gRNA sequence
ttttctaactttatgaactc

SEQ ID NO: 686887 - DNA, 20 bp, Artificial
  CRISPR gRNA sequence
tctaactttatgaactccct

SEQ ID NO: 686888 - DNA, 20 bp, Artificial
  CRISPR gRNA sequence
ctaactttatgaactccctc

SEQ ID NO: 686889 - DNA, 20 bp, Artificial
  CRISPR gRNA sequence
taactttatgaactccctct

SEQ ID NO: 686890 - DNA, 20 bp, Artificial
  CRISPR gRNA sequence
actttatgaactccctctgt

SEQ ID NO: 686891 - DNA, 20 bp, Artificial
  CRISPR gRNA sequence
tatgaactccctctgtgtca

SEQ ID NO: 686892 - DNA, 20 bp, Artificial
  CRISPR gRNA sequence
atgaactccctctgtgtcac

SEQ ID NO: 686893 - DNA, 20 bp, Artificial
  CRISPR gRNA sequence
tgaactccctctgtgtcact

SEQ ID NO: 686894 - DNA, 20 bp, Artificial
  CRISPR gRNA sequence
cctctgtgtcactgtatgtg

SEQ ID NO: 686895 - DNA, 20 bp, Artificial
  CRISPR gRNA sequence
tgtgtcactgtatgtgaaag

SEQ ID NO: 686896 - DNA, 20 bp, Artificial
  CRISPR gRNA sequence
tgtcactgtatgtgaaagga

SEQ ID NO: 686897 - DNA, 20 bp, Artificial
  CRISPR gRNA sequence
tatgtgaaaggaaatgcacc

SEQ ID NO: 686898 - DNA, 20 bp, Artificial
  CRISPR gRNA sequence
aacgtgttcttttgtgctct

SEQ ID NO: 686899 - DNA, 20 bp, Artificial
  CRISPR gRNA sequence
ttttgtgctcttttataact

SEQ ID NO: 686900 - DNA, 20 bp, Artificial
  CRISPR gRNA sequence
ttgtgctcttttataacttg

SEQ ID NO: 686901 - DNA, 20 bp, Artificial
  CRISPR gRNA sequence
tgtgctcttttataacttgc

SEQ ID NO: 686902 - DNA, 20 bp, Artificial
  CRISPR gRNA sequence
gtgctcttttataacttgca

SEQ ID NO: 686903 - DNA, 20 bp, Artificial
  CRISPR gRNA sequence
tgctcttttataacttgcat

SEQ ID NO: 686904 - DNA, 20 bp, Artificial
  CRISPR gRNA sequence
ttttataacttgcattacat

SEQ ID NO: 686905 - DNA, 20 bp, Artificial
  CRISPR gRNA sequence
ttataacttgcattacatgt

SEQ ID NO: 686906 - DNA, 20 bp, Artificial
  CRISPR gRNA sequence
tataacttgcattacatgtt

SEQ ID NO: 686907 - DNA, 20 bp, Artificial
  CRISPR gRNA sequence
ataacttgcattacatgttg

SEQ ID NO: 686908 - DNA, 20 bp, Artificial
  CRISPR gRNA sequence
taacttgcattacatgttgt

SEQ ID NO: 686909 - DNA, 20 bp, Artificial
  CRISPR gRNA sequence
gcattacatgttgtaagcat

SEQ ID NO: 686910 - DNA, 20 bp, Artificial
  CRISPR gRNA sequence
cattacatgttgtaagcatg

SEQ ID NO: 686911 - DNA, 20 bp, Artificial
  CRISPR gRNA sequence
catgttgtaagcatggtccg

SEQ ID NO: 686912 - DNA, 20 bp, Artificial
  CRISPR gRNA sequence
taagcatggtccgttctata

SEQ ID NO: 686913 - DNA, 20 bp, Artificial
  CRISPR gRNA sequence
tatacctttttctggtcata

SEQ ID NO: 686914 - DNA, 20 bp, Artificial
  CRISPR gRNA sequence
tacctttttctggtcataat

SEQ ID NO: 686915 - DNA, 20 bp, Artificial
  CRISPR gRNA sequence
tttctggtcataatgaacac

SEQ ID NO: 686916 - DNA, 20 bp, Artificial
  CRISPR gRNA sequence
ttctggtcataatgaacact

SEQ ID NO: 686917 - DNA, 20 bp, Artificial
  CRISPR gRNA sequence
tctggtcataatgaacactc

SEQ ID NO: 686918 - DNA, 20 bp, Artificial
  CRISPR gRNA sequence
ctggtcataatgaacactca

SEQ ID NO: 686919 - DNA, 20 bp, Artificial
  CRISPR gRNA sequence
tggtcataatgaacactcat

SEQ ID NO: 686920 - DNA, 20 bp, Artificial
  CRISPR gRNA sequence
gtcataatgaacactcattt

SEQ ID NO: 686921 - DNA, 20 bp, Artificial
  CRISPR gRNA sequence
attttgttagcgagggtggt

SEQ ID NO: 686922 - DNA, 20 bp, Artificial
  CRISPR gRNA sequence
tgttagcgagggtggtaaag

SEQ ID NO: 686923 - DNA, 20 bp, Artificial
  CRISPR gRNA sequence
gttagcgagggtggtaaagt

SEQ ID NO: 686924 - DNA, 20 bp, Artificial
  CRISPR gRNA sequence
ttagcgagggtggtaaagtg

SEQ ID NO: 686925 - DNA, 20 bp, Artificial
  CRISPR gRNA sequence
gcgagggtggtaaagtgaac

SEQ ID NO: 686926 - DNA, 20 bp, Artificial
  CRISPR gRNA sequence
ctgccatttcagtgagaaaa

SEQ ID NO: 686927 - DNA, 20 bp, Artificial
  CRISPR gRNA sequence
ccatttcagtgagaaaatcc

SEQ ID NO: 686928 - DNA, 20 bp, Artificial
  CRISPR gRNA sequence
cagtgagaaaatcctaggtg

SEQ ID NO: 686929 - DNA, 20 bp, Artificial
  CRISPR gRNA sequence
agtgagaaaatcctaggtgc

SEQ ID NO: 686930 - DNA, 20 bp, Artificial
  CRISPR gRNA sequence
ggtgctactttataataaga

SEQ ID NO: 686931 - DNA, 20 bp, Artificial
  CRISPR gRNA sequence
ctttataataagacatttgt

SEQ ID NO: 686932 - DNA, 20 bp, Artificial
  CRISPR gRNA sequence
tataataagacatttgttag

SEQ ID NO: 686933 - DNA, 20 bp, Artificial
  CRISPR gRNA sequence
ataataagacatttgttagg

SEQ ID NO: 686934 - DNA, 20 bp, Artificial
  CRISPR gRNA sequence
taataagacatttgttaggc

SEQ ID NO: 686935 - DNA, 20 bp, Artificial
  CRISPR gRNA sequence
gttaggccattcttgcattg

SEQ ID NO: 686936 - DNA, 20 bp, Artificial
  CRISPR gRNA sequence
ttaggccattcttgcattga

SEQ ID NO: 686937 - DNA, 20 bp, Artificial
  CRISPR gRNA sequence
ggccattcttgcattgatat

SEQ ID NO: 686938 - DNA, 20 bp, Artificial
  CRISPR gRNA sequence
ttgcattgatataaagaaat

SEQ ID NO: 686939 - DNA, 20 bp, Artificial
  CRISPR gRNA sequence
gcattgatataaagaaatac

SEQ ID NO: 686940 - DNA, 20 bp, Artificial
  CRISPR gRNA sequence
cattgatataaagaaatacc

SEQ ID NO: 686941 - DNA, 20 bp, Artificial
  CRISPR gRNA sequence
atataaagaaatacctgaga

SEQ ID NO: 686942 - DNA, 20 bp, Artificial
  CRISPR gRNA sequence
agactgggtgatttatatga

SEQ ID NO: 686943 - DNA, 20 bp, Artificial
  CRISPR gRNA sequence
ggtgatttatatgaaaagag

SEQ ID NO: 686944 - DNA, 20 bp, Artificial
  CRISPR gRNA sequence
atatgaaaagaggtttaatt

SEQ ID NO: 686945 - DNA, 20 bp, Artificial
  CRISPR gRNA sequence
tatgaaaagaggtttaattg

SEQ ID NO: 686946 - DNA, 20 bp, Artificial
  CRISPR gRNA sequence
aattggctcacagttctgca

SEQ ID NO: 686947 - DNA, 20 bp, Artificial
  CRISPR gRNA sequence
attggctcacagttctgcag

SEQ ID NO: 686948 - DNA, 20 bp, Artificial
  CRISPR gRNA sequence
gctcacagttctgcaggctg

SEQ ID NO: 686949 - DNA, 20 bp, Artificial
  CRISPR gRNA sequence
acagttctgcaggctgtatg

SEQ ID NO: 686950 - DNA, 20 bp, Artificial
  CRISPR gRNA sequence
tgcaggctgtatgggaagca

SEQ ID NO: 686951 - DNA, 20 bp, Artificial
  CRISPR gRNA sequence
caggctgtatgggaagcatg

SEQ ID NO: 686952 - DNA, 20 bp, Artificial
  CRISPR gRNA sequence
tatgggaagcatggcggcat

SEQ ID NO: 686953 - DNA, 20 bp, Artificial
  CRISPR gRNA sequence
cttctggggacacctcagga

SEQ ID NO: 686954 - DNA, 20 bp, Artificial
  CRISPR gRNA sequence
ctggggacacctcaggagct

SEQ ID NO: 686955 - DNA, 20 bp, Artificial
  CRISPR gRNA sequence
tggggacacctcaggagctt

SEQ ID NO: 686956 - DNA, 20 bp, Artificial
  CRISPR gRNA sequence
gggacacctcaggagcttta

SEQ ID NO: 686957 - DNA, 20 bp, Artificial
  CRISPR gRNA sequence
aggagctttactcatggcag

SEQ ID NO: 686958 - DNA, 20 bp, Artificial
  CRISPR gRNA sequence
tactcatggcagaaggcaaa

SEQ ID NO: 686959 - DNA, 20 bp, Artificial
  CRISPR gRNA sequence
actcatggcagaaggcaaag

SEQ ID NO: 686960 - DNA, 20 bp, Artificial
  CRISPR gRNA sequence
ctcatggcagaaggcaaagc

SEQ ID NO: 686961 - DNA, 20 bp, Artificial
  CRISPR gRNA sequence
atggcagaaggcaaagcaaa

SEQ ID NO: 686962 - DNA, 20 bp, Artificial
  CRISPR gRNA sequence
cacacagtaaaagcaggagc

SEQ ID NO: 686963 - DNA, 20 bp, Artificial
  CRISPR gRNA sequence
acacagtaaaagcaggagcg

SEQ ID NO: 686964 - DNA, 20 bp, Artificial
  CRISPR gRNA sequence
aaacagccagatctcatgag

SEQ ID NO: 686965 - DNA, 20 bp, Artificial
  CRISPR gRNA sequence
atgagaagtcactcactatt

SEQ ID NO: 686966 - DNA, 20 bp, Artificial
  CRISPR gRNA sequence
actattgcaaggacagcatc

SEQ ID NO: 686967 - DNA, 20 bp, Artificial
  CRISPR gRNA sequence
ttgcaaggacagcatcaaag

SEQ ID NO: 686968 - DNA, 20 bp, Artificial
  CRISPR gRNA sequence
caaggacagcatcaaagaga

SEQ ID NO: 686969 - DNA, 20 bp, Artificial
  CRISPR gRNA sequence
aaccattcatgatgaactca

SEQ ID NO: 686970 - DNA, 20 bp, Artificial
  CRISPR gRNA sequence
atgatgaactcacccccatg

SEQ ID NO: 686971 - DNA, 20 bp, Artificial
  CRISPR gRNA sequence
acccccatgatccaatcacc

SEQ ID NO: 686972 - DNA, 20 bp, Artificial
  CRISPR gRNA sequence
ccaccaggctccacctcgaa

SEQ ID NO: 686973 - DNA, 20 bp, Artificial
  CRISPR gRNA sequence
cacctcgaatactggggatt

SEQ ID NO: 686974 - DNA, 20 bp, Artificial
  CRISPR gRNA sequence
gaatactggggattaccatt

SEQ ID NO: 686975 - DNA, 20 bp, Artificial
  CRISPR gRNA sequence
gggattaccattcagcatga

SEQ ID NO: 686976 - DNA, 20 bp, Artificial
  CRISPR gRNA sequence
ccattcagcatgagatttgg

SEQ ID NO: 686977 - DNA, 20 bp, Artificial
  CRISPR gRNA sequence
agcatgagatttgggcagga

SEQ ID NO: 686978 - DNA, 20 bp, Artificial
  CRISPR gRNA sequence
gggcaggaacacagacccaa

SEQ ID NO: 686979 - DNA, 20 bp, Artificial
  CRISPR gRNA sequence
ggcaggaacacagacccaaa

SEQ ID NO: 686980 - DNA, 20 bp, Artificial
  CRISPR gRNA sequence
tcattgttaaactttgtaaa

SEQ ID NO: 686981 - DNA, 20 bp, Artificial
  CRISPR gRNA sequence
ttaaactttgtaaagtattt

SEQ ID NO: 686982 - DNA, 20 bp, Artificial
  CRISPR gRNA sequence
aactttgtaaagtatttaag

SEQ ID NO: 686983 - DNA, 20 bp, Artificial
  CRISPR gRNA sequence
tgtaaagtatttaaggtaca

SEQ ID NO: 686984 - DNA, 20 bp, Artificial
  CRISPR gRNA sequence
gtaaagtatttaaggtacat

SEQ ID NO: 686985 - DNA, 20 bp, Artificial
  CRISPR gRNA sequence
taaagtatttaaggtacatg

SEQ ID NO: 686986 - DNA, 20 bp, Artificial
  CRISPR gRNA sequence
aaggtacatggaacacacgg

SEQ ID NO: 686987 - DNA, 20 bp, Artificial
  CRISPR gRNA sequence
aggtacatggaacacacggg

SEQ ID NO: 686988 - DNA, 20 bp, Artificial
  CRISPR gRNA sequence
gtagctcagcccatttcttt

SEQ ID NO: 686989 - DNA, 20 bp, Artificial
  CRISPR gRNA sequence
agcccatttctttattgcat

SEQ ID NO: 686990 - DNA, 20 bp, Artificial
  CRISPR gRNA sequence
ctttattgcatctgttattc

SEQ ID NO: 686991 - DNA, 20 bp, Artificial
  CRISPR gRNA sequence
tttattgcatctgttattca

SEQ ID NO: 686992 - DNA, 20 bp, Artificial
  CRISPR gRNA sequence
tattgcatctgttattcacc

SEQ ID NO: 686993 - DNA, 20 bp, Artificial
  CRISPR gRNA sequence
attgcatctgttattcacca

SEQ ID NO: 686994 - DNA, 20 bp, Artificial
  CRISPR gRNA sequence
ttgcatctgttattcaccat

SEQ ID NO: 686995 - DNA, 20 bp, Artificial
  CRISPR gRNA sequence
catctgttattcaccatgta

SEQ ID NO: 686996 - DNA, 20 bp, Artificial
  CRISPR gRNA sequence
ttattcaccatgtaattcag

SEQ ID NO: 686997 - DNA, 20 bp, Artificial
  CRISPR gRNA sequence
ttcaccatgtaattcaggta

SEQ ID NO: 686998 - DNA, 20 bp, Artificial
  CRISPR gRNA sequence
accatgtaattcaggtacca

SEQ ID NO: 686999 - DNA, 20 bp, Artificial
  CRISPR gRNA sequence
aggtaccacgtattccaggg

SEQ ID NO: 687000 - DNA, 20 bp, Artificial
  CRISPR gRNA sequence
cagggagcctttcttggccc

SEQ ID NO: 687001 - DNA, 20 bp, Artificial
  CRISPR gRNA sequence
tcttggccctcagtttgcag

SEQ ID NO: 687002 - DNA, 20 bp, Artificial
  CRISPR gRNA sequence
cttggccctcagtttgcagt

SEQ ID NO: 687003 - DNA, 20 bp, Artificial
  CRISPR gRNA sequence
ttggccctcagtttgcagta

SEQ ID NO: 687004 - DNA, 20 bp, Artificial
  CRISPR gRNA sequence
ggccctcagtttgcagtata

SEQ ID NO: 687005 - DNA, 20 bp, Artificial
  CRISPR gRNA sequence
gccctcagtttgcagtatac

SEQ ID NO: 687006 - DNA, 20 bp, Artificial
  CRISPR gRNA sequence
agtttgcagtatacacactt

SEQ ID NO: 687007 - DNA, 20 bp, Artificial
  CRISPR gRNA sequence
gcagtatacacactttccaa

SEQ ID NO: 687008 - DNA, 20 bp, Artificial
  CRISPR gRNA sequence
cagtatacacactttccaag

SEQ ID NO: 687009 - DNA, 20 bp, Artificial
  CRISPR gRNA sequence
tccaagtactcttgtagcat

SEQ ID NO: 687010 - DNA, 20 bp, Artificial
  CRISPR gRNA sequence
ccaagtactcttgtagcatc

SEQ ID NO: 687011 - DNA, 20 bp, Artificial
  CRISPR gRNA sequence
caagtactcttgtagcatcc

SEQ ID NO: 687012 - DNA, 20 bp, Artificial
  CRISPR gRNA sequence
ttgtagcatcctgtttgtat

SEQ ID NO: 687013 - DNA, 20 bp, Artificial
  CRISPR gRNA sequence
gtagcatcctgtttgtatca

SEQ ID NO: 687014 - DNA, 20 bp, Artificial
  CRISPR gRNA sequence
tagcatcctgtttgtatcat

SEQ ID NO: 687015 - DNA, 20 bp, Artificial
  CRISPR gRNA sequence
tttgtatcatagcactggtc

SEQ ID NO: 687016 - DNA, 20 bp, Artificial
  CRISPR gRNA sequence
gtatcatagcactggtcaca

SEQ ID NO: 687017 - DNA, 20 bp, Artificial
  CRISPR gRNA sequence
tatcatagcactggtcacat

SEQ ID NO: 687018 - DNA, 20 bp, Artificial
  CRISPR gRNA sequence
gtcacattgccttacctaaa

SEQ ID NO: 687019 - DNA, 20 bp, Artificial
  CRISPR gRNA sequence
ccttacctaaatctgtttga

SEQ ID NO: 687020 - DNA, 20 bp, Artificial
  CRISPR gRNA sequence
acctaaatctgtttgacagt

SEQ ID NO: 687021 - DNA, 20 bp, Artificial
  CRISPR gRNA sequence
cctaaatctgtttgacagtc

SEQ ID NO: 687022 - DNA, 20 bp, Artificial
  CRISPR gRNA sequence
aatctgtttgacagtctgct

SEQ ID NO: 687023 - DNA, 20 bp, Artificial
  CRISPR gRNA sequence
tttgacagtctgctcaacac

SEQ ID NO: 687024 - DNA, 20 bp, Artificial
  CRISPR gRNA sequence
gacagtctgctcaacacgac

SEQ ID NO: 687025 - DNA, 20 bp, Artificial
  CRISPR gRNA sequence
acagtctgctcaacacgact

SEQ ID NO: 687026 - DNA, 20 bp, Artificial
  CRISPR gRNA sequence
ctcaacacgactgcaagctc

SEQ ID NO: 687027 - DNA, 20 bp, Artificial
  CRISPR gRNA sequence
aacacgactgcaagctccat

SEQ ID NO: 687028 - DNA, 20 bp, Artificial
  CRISPR gRNA sequence
caagctccatgagggcaggg

SEQ ID NO: 687029 - DNA, 20 bp, Artificial
  CRISPR gRNA sequence
catgagggcagggacatcat

SEQ ID NO: 687030 - DNA, 20 bp, Artificial
  CRISPR gRNA sequence
ttccatctttgggtccttag

SEQ ID NO: 687031 - DNA, 20 bp, Artificial
  CRISPR gRNA sequence
ccatctttgggtccttagtg

SEQ ID NO: 687032 - DNA, 20 bp, Artificial
  CRISPR gRNA sequence
catctttgggtccttagtgc

SEQ ID NO: 687033 - DNA, 20 bp, Artificial
  CRISPR gRNA sequence
tgggtccttagtgcaatacc

SEQ ID NO: 687034 - DNA, 20 bp, Artificial
  CRISPR gRNA sequence
gggtccttagtgcaatacct

SEQ ID NO: 687035 - DNA, 20 bp, Artificial
  CRISPR gRNA sequence
ggtccttagtgcaatacctg

SEQ ID NO: 687036 - DNA, 20 bp, Artificial
  CRISPR gRNA sequence
agtgcaatacctggcagcta

SEQ ID NO: 687037 - DNA, 20 bp, Artificial
  CRISPR gRNA sequence
gtgcaatacctggcagctag

SEQ ID NO: 687038 - DNA, 20 bp, Artificial
  CRISPR gRNA sequence
gcagctagccagtgctcagc

SEQ ID NO: 687039 - DNA, 20 bp, Artificial
  CRISPR gRNA sequence
gccagtgctcagctaaatat

SEQ ID NO: 687040 - DNA, 20 bp, Artificial
  CRISPR gRNA sequence
agctaaatatttgttgactg

SEQ ID NO: 687041 - DNA, 20 bp, Artificial
  CRISPR gRNA sequence
aatatttgttgactgaataa

SEQ ID NO: 687042 - DNA, 20 bp, Artificial
  CRISPR gRNA sequence
gttgactgaataaatgaatg

SEQ ID NO: 687043 - DNA, 20 bp, Artificial
  CRISPR gRNA sequence
ttgactgaataaatgaatgc

SEQ ID NO: 687044 - DNA, 20 bp, Artificial
  CRISPR gRNA sequence
actgaataaatgaatgcaca

SEQ ID NO: 687045 - DNA, 20 bp, Artificial
  CRISPR gRNA sequence
aataaatgaatgcacaacca

SEQ ID NO: 687046 - DNA, 20 bp, Artificial
  CRISPR gRNA sequence
ttgataccaaatgttttttt

SEQ ID NO: 687047 - DNA, 20 bp, Artificial
  CRISPR gRNA sequence
ataccaaatgttttttttgt

SEQ ID NO: 687048 - DNA, 20 bp, Artificial
  CRISPR gRNA sequence
tttttgtgtacatttctact

SEQ ID NO: 687049 - DNA, 20 bp, Artificial
  CRISPR gRNA sequence
ttttgtgtacatttctactt

SEQ ID NO: 687050 - DNA, 20 bp, Artificial
  CRISPR gRNA sequence
tttgtgtacatttctacttc

SEQ ID NO: 687051 - DNA, 20 bp, Artificial
  CRISPR gRNA sequence
ttgtgtacatttctacttct

SEQ ID NO: 687052 - DNA, 20 bp, Artificial
  CRISPR gRNA sequence
tgtgtacatttctacttctc

SEQ ID NO: 687053 - DNA, 20 bp, Artificial
  CRISPR gRNA sequence
gtgtacatttctacttctct

SEQ ID NO: 687054 - DNA, 20 bp, Artificial
  CRISPR gRNA sequence
tgtacatttctacttctcta

SEQ ID NO: 687055 - DNA, 20 bp, Artificial
  CRISPR gRNA sequence
ctacttctctagctataagt

SEQ ID NO: 687056 - DNA, 20 bp, Artificial
  CRISPR gRNA sequence
tacttctctagctataagtc

SEQ ID NO: 687057 - DNA, 20 bp, Artificial
  CRISPR gRNA sequence
cttctctagctataagtctt

SEQ ID NO: 687058 - DNA, 20 bp, Artificial
  CRISPR gRNA sequence
ctctagctataagtcttaat

SEQ ID NO: 687059 - DNA, 20 bp, Artificial
  CRISPR gRNA sequence
tctagctataagtcttaatt

SEQ ID NO: 687060 - DNA, 20 bp, Artificial
  CRISPR gRNA sequence
tagctataagtcttaattat

SEQ ID NO: 687061 - DNA, 20 bp, Artificial
  CRISPR gRNA sequence
gctataagtcttaattatac

SEQ ID NO: 687062 - DNA, 20 bp, Artificial
  CRISPR gRNA sequence
taagtcttaattatacaaca

SEQ ID NO: 687063 - DNA, 20 bp, Artificial
  CRISPR gRNA sequence
aattatacaacaaaatacta

SEQ ID NO: 687064 - DNA, 20 bp, Artificial
  CRISPR gRNA sequence
attatacaacaaaatactat

SEQ ID NO: 687065 - DNA, 20 bp, Artificial
  CRISPR gRNA sequence
tacaacaaaatactattttt

SEQ ID NO: 687066 - DNA, 20 bp, Artificial
  CRISPR gRNA sequence
tttttatatttatgtttggt

SEQ ID NO: 687067 - DNA, 20 bp, Artificial
  CRISPR gRNA sequence
ttatatttatgtttggtaaa

SEQ ID NO: 687068 - DNA, 20 bp, Artificial
  CRISPR gRNA sequence
tatatttatgtttggtaaat

SEQ ID NO: 687069 - DNA, 20 bp, Artificial
  CRISPR gRNA sequence
atatttatgtttggtaaatt

SEQ ID NO: 687070 - DNA, 20 bp, Artificial
  CRISPR gRNA sequence
tatttatgtttggtaaattc

SEQ ID NO: 687071 - DNA, 20 bp, Artificial
  CRISPR gRNA sequence
atgtttggtaaattcaataa

SEQ ID NO: 687072 - DNA, 20 bp, Artificial
  CRISPR gRNA sequence
tgtttggtaaattcaataac

SEQ ID NO: 687073 - DNA, 20 bp, Artificial
  CRISPR gRNA sequence
ggtaaattcaataactttcc

SEQ ID NO: 687074 - DNA, 20 bp, Artificial
  CRISPR gRNA sequence
gtaaattcaataactttcct

SEQ ID NO: 687075 - DNA, 20 bp, Artificial
  CRISPR gRNA sequence
aataactttcctcatcattt

SEQ ID NO: 687076 - DNA, 20 bp, Artificial
  CRISPR gRNA sequence
tcctcatcatttggaaagtc

SEQ ID NO: 687077 - DNA, 20 bp, Artificial
  CRISPR gRNA sequence
cctcatcatttggaaagtca

SEQ ID NO: 687078 - DNA, 20 bp, Artificial
  CRISPR gRNA sequence
ctcatcatttggaaagtcaa

SEQ ID NO: 687079 - DNA, 20 bp, Artificial
  CRISPR gRNA sequence
atcatttggaaagtcaaatt

SEQ ID NO: 687080 - DNA, 20 bp, Artificial
  CRISPR gRNA sequence
ggaaagtcaaattgtttatt

SEQ ID NO: 687081 - DNA, 20 bp, Artificial
  CRISPR gRNA sequence
gaaagtcaaattgtttattg

SEQ ID NO: 687082 - DNA, 20 bp, Artificial
  CRISPR gRNA sequence
tttattgcttccctacagtt

SEQ ID NO: 687083 - DNA, 20 bp, Artificial
  CRISPR gRNA sequence
attgcttccctacagttttt

SEQ ID NO: 687084 - DNA, 20 bp, Artificial
  CRISPR gRNA sequence
ttgcttccctacagtttttt

SEQ ID NO: 687085 - DNA, 20 bp, Artificial
  CRISPR gRNA sequence
cttccctacagttttttctg

SEQ ID NO: 687086 - DNA, 20 bp, Artificial
  CRISPR gRNA sequence
ccctacagttttttctgaat

SEQ ID NO: 687087 - DNA, 20 bp, Artificial
  CRISPR gRNA sequence
cctacagttttttctgaatc

SEQ ID NO: 687088 - DNA, 20 bp, Artificial
  CRISPR gRNA sequence
cagttttttctgaatctagc

SEQ ID NO: 687089 - DNA, 20 bp, Artificial
  CRISPR gRNA sequence
tttctgaatctagcaggatt

SEQ ID NO: 687090 - DNA, 20 bp, Artificial
  CRISPR gRNA sequence
ttctgaatctagcaggattt

SEQ ID NO: 687091 - DNA, 20 bp, Artificial
  CRISPR gRNA sequence
tctgaatctagcaggatttt

SEQ ID NO: 687092 - DNA, 20 bp, Artificial
  CRISPR gRNA sequence
ctgaatctagcaggatttta

SEQ ID NO: 687093 - DNA, 20 bp, Artificial
  CRISPR gRNA sequence
tgaatctagcaggattttaa

SEQ ID NO: 687094 - DNA, 20 bp, Artificial
  CRISPR gRNA sequence
aatctagcaggattttaatg

SEQ ID NO: 687095 - DNA, 20 bp, Artificial
  CRISPR gRNA sequence
gcaggattttaatgatatca

SEQ ID NO: 687096 - DNA, 20 bp, Artificial
  CRISPR gRNA sequence
taatgatatcattataattt

SEQ ID NO: 687097 - DNA, 20 bp, Artificial
  CRISPR gRNA sequence
aatgatatcattataatttg

SEQ ID NO: 687098 - DNA, 20 bp, Artificial
  CRISPR gRNA sequence
atgatatcattataatttga

SEQ ID NO: 687099 - DNA, 20 bp, Artificial
  CRISPR gRNA sequence
taatttgacacaataaaagg

SEQ ID NO: 687100 - DNA, 20 bp, Artificial
  CRISPR gRNA sequence
gacacaataaaaggacaaca

SEQ ID NO: 687101 - DNA, 20 bp, Artificial
  CRISPR gRNA sequence
acacaataaaaggacaacat

SEQ ID NO: 687102 - DNA, 20 bp, Artificial
  CRISPR gRNA sequence
atgaatctttattgggttaa

SEQ ID NO: 687103 - DNA, 20 bp, Artificial
  CRISPR gRNA sequence
tattgggttaatttcagaca

SEQ ID NO: 687104 - DNA, 20 bp, Artificial
  CRISPR gRNA sequence
attgggttaatttcagacac

SEQ ID NO: 687105 - DNA, 20 bp, Artificial
  CRISPR gRNA sequence
ttgggttaatttcagacact

SEQ ID NO: 687106 - DNA, 20 bp, Artificial
  CRISPR gRNA sequence
ggttaatttcagacactata

SEQ ID NO: 687107 - DNA, 20 bp, Artificial
  CRISPR gRNA sequence
atttcagacactatataatc

SEQ ID NO: 687108 - DNA, 20 bp, Artificial
  CRISPR gRNA sequence
cagacactatataatctttt

SEQ ID NO: 687109 - DNA, 20 bp, Artificial
  CRISPR gRNA sequence
agacactatataatctttta

SEQ ID NO: 687110 - DNA, 20 bp, Artificial
  CRISPR gRNA sequence
tataatcttttaaaaatgta

SEQ ID NO: 687111 - DNA, 20 bp, Artificial
  CRISPR gRNA sequence
ttaaaaatgtaacattcttt

SEQ ID NO: 687112 - DNA, 20 bp, Artificial
  CRISPR gRNA sequence
taaaaatgtaacattctttt

SEQ ID NO: 687113 - DNA, 20 bp, Artificial
  CRISPR gRNA sequence
aaaaatgtaacattcttttt

SEQ ID NO: 687114 - DNA, 20 bp, Artificial
  CRISPR gRNA sequence
aaaatgtaacattctttttt

SEQ ID NO: 687115 - DNA, 20 bp, Artificial
  CRISPR gRNA sequence
ttttttatatataaataatt

SEQ ID NO: 687116 - DNA, 20 bp, Artificial
  CRISPR gRNA sequence
ttttatatataaataattgg

SEQ ID NO: 687117 - DNA, 20 bp, Artificial
  CRISPR gRNA sequence
tttatatataaataattggt

SEQ ID NO: 687118 - DNA, 20 bp, Artificial
  CRISPR gRNA sequence
ttatatataaataattggtg

SEQ ID NO: 687119 - DNA, 20 bp, Artificial
  CRISPR gRNA sequence
tatatataaataattggtgg

SEQ ID NO: 687120 - DNA, 20 bp, Artificial
  CRISPR gRNA sequence
atatataaataattggtggc

SEQ ID NO: 687121 - DNA, 20 bp, Artificial
  CRISPR gRNA sequence
tatataaataattggtggca

SEQ ID NO: 687122 - DNA, 20 bp, Artificial
  CRISPR gRNA sequence
gtggcatcacaaatagccaa

SEQ ID NO: 687123 - DNA, 20 bp, Artificial
  CRISPR gRNA sequence
cctgggtgcaggcaagaagg

SEQ ID NO: 687124 - DNA, 20 bp, Artificial
  CRISPR gRNA sequence
ctgggtgcaggcaagaaggg

SEQ ID NO: 687125 - DNA, 20 bp, Artificial
  CRISPR gRNA sequence
ggtgcaggcaagaaggggat

SEQ ID NO: 687126 - DNA, 20 bp, Artificial
  CRISPR gRNA sequence
tctacagagttttcaaaaca

SEQ ID NO: 687127 - DNA, 20 bp, Artificial
  CRISPR gRNA sequence
ctacagagttttcaaaacag

SEQ ID NO: 687128 - DNA, 20 bp, Artificial
  CRISPR gRNA sequence
tacagagttttcaaaacagt

SEQ ID NO: 687129 - DNA, 20 bp, Artificial
  CRISPR gRNA sequence
cagagttttcaaaacagtga

SEQ ID NO: 687130 - DNA, 20 bp, Artificial
  CRISPR gRNA sequence
tcaaaacagtgataaagctg

SEQ ID NO: 687131 - DNA, 20 bp, Artificial
  CRISPR gRNA sequence
caaaacagtgataaagctgt

SEQ ID NO: 687132 - DNA, 20 bp, Artificial
  CRISPR gRNA sequence
aaaacagtgataaagctgtc

SEQ ID NO: 687133 - DNA, 20 bp, Artificial
  CRISPR gRNA sequence
tctacaagtcattgtgcttt

SEQ ID NO: 687134 - DNA, 20 bp, Artificial
  CRISPR gRNA sequence
caagtcattgtgctttttat

SEQ ID NO: 687135 - DNA, 20 bp, Artificial
  CRISPR gRNA sequence
tgctttttatcatcactatg

SEQ ID NO: 687136 - DNA, 20 bp, Artificial
  CRISPR gRNA sequence
tttatcatcactatgcccag

SEQ ID NO: 687137 - DNA, 20 bp, Artificial
  CRISPR gRNA sequence
ttatcatcactatgcccaga

SEQ ID NO: 687138 - DNA, 20 bp, Artificial
  CRISPR gRNA sequence
tatcatcactatgcccagac

SEQ ID NO: 687139 - DNA, 20 bp, Artificial
  CRISPR gRNA sequence
atcatcactatgcccagaca

SEQ ID NO: 687140 - DNA, 20 bp, Artificial
  CRISPR gRNA sequence
tcatcactatgcccagacaa

SEQ ID NO: 687141 - DNA, 20 bp, Artificial
  CRISPR gRNA sequence
tgcccagacaatgtgaaaca

SEQ ID NO: 687142 - DNA, 20 bp, Artificial
  CRISPR gRNA sequence
ttcccacagaggtggactga

SEQ ID NO: 687143 - DNA, 20 bp, Artificial
  CRISPR gRNA sequence
cccacagaggtggactgatc

SEQ ID NO: 687144 - DNA, 20 bp, Artificial
  CRISPR gRNA sequence
ccacagaggtggactgatcc

SEQ ID NO: 687145 - DNA, 20 bp, Artificial
  CRISPR gRNA sequence
atccttctccccactccctt

SEQ ID NO: 687146 - DNA, 20 bp, Artificial
  CRISPR gRNA sequence
ctccccactcccttggtgtg

SEQ ID NO: 687147 - DNA, 20 bp, Artificial
  CRISPR gRNA sequence
tccccactcccttggtgtgt

SEQ ID NO: 687148 - DNA, 20 bp, Artificial
  CRISPR gRNA sequence
cccactcccttggtgtgtct

SEQ ID NO: 687149 - DNA, 20 bp, Artificial
  CRISPR gRNA sequence
ccttggtgtgtctctgaatg

SEQ ID NO: 687150 - DNA, 20 bp, Artificial
  CRISPR gRNA sequence
ggtgtgtctctgaatgcaat

SEQ ID NO: 687151 - DNA, 20 bp, Artificial
  CRISPR gRNA sequence
gtgtgtctctgaatgcaatg

SEQ ID NO: 687152 - DNA, 20 bp, Artificial
  CRISPR gRNA sequence
tgaatgcaatgttgtcttgg

SEQ ID NO: 687153 - DNA, 20 bp, Artificial
  CRISPR gRNA sequence
aatgcaatgttgtcttggaa

SEQ ID NO: 687154 - DNA, 20 bp, Artificial
  CRISPR gRNA sequence
tcttggaaaacagctttcca

SEQ ID NO: 687155 - DNA, 20 bp, Artificial
  CRISPR gRNA sequence
ggaaaacagctttccaagca

SEQ ID NO: 687156 - DNA, 20 bp, Artificial
  CRISPR gRNA sequence
gaaaacagctttccaagcat

SEQ ID NO: 687157 - DNA, 20 bp, Artificial
  CRISPR gRNA sequence
tccaagcatttcactcctga

SEQ ID NO: 687158 - DNA, 20 bp, Artificial
  CRISPR gRNA sequence
ccaagcatttcactcctgag

SEQ ID NO: 687159 - DNA, 20 bp, Artificial
  CRISPR gRNA sequence
caagcatttcactcctgagc

SEQ ID NO: 687160 - DNA, 20 bp, Artificial
  CRISPR gRNA sequence
cactcctgagcacttgccag

SEQ ID NO: 687161 - DNA, 20 bp, Artificial
  CRISPR gRNA sequence
actcctgagcacttgccagt

SEQ ID NO: 687162 - DNA, 20 bp, Artificial
  CRISPR gRNA sequence
ctgagcacttgccagtttcc

SEQ ID NO: 687163 - DNA, 20 bp, Artificial
  CRISPR gRNA sequence
agcacttgccagtttcctca

SEQ ID NO: 687164 - DNA, 20 bp, Artificial
  CRISPR gRNA sequence
gccagtttcctcacttgttc

SEQ ID NO: 687165 - DNA, 20 bp, Artificial
  CRISPR gRNA sequence
ccagtttcctcacttgttct

SEQ ID NO: 687166 - DNA, 20 bp, Artificial
  CRISPR gRNA sequence
cctcacttgttcttcacata

SEQ ID NO: 687167 - DNA, 20 bp, Artificial
  CRISPR gRNA sequence
ctcacttgttcttcacatat

SEQ ID NO: 687168 - DNA, 20 bp, Artificial
  CRISPR gRNA sequence
acttgttcttcacatatcca

SEQ ID NO: 687169 - DNA, 20 bp, Artificial
  CRISPR gRNA sequence
gttcttcacatatccaggca

SEQ ID NO: 687170 - DNA, 20 bp, Artificial
  CRISPR gRNA sequence
ttcttcacatatccaggcaa

SEQ ID NO: 687171 - DNA, 20 bp, Artificial
  CRISPR gRNA sequence
ttcacatatccaggcaaaga

SEQ ID NO: 687172 - DNA, 20 bp, Artificial
  CRISPR gRNA sequence
cacatatccaggcaaagaca

SEQ ID NO: 687173 - DNA, 20 bp, Artificial
  CRISPR gRNA sequence
acatatccaggcaaagacat

SEQ ID NO: 687174 - DNA, 20 bp, Artificial
  CRISPR gRNA sequence
tttgctatatgaagcattgt

SEQ ID NO: 687175 - DNA, 20 bp, Artificial
  CRISPR gRNA sequence
gctatatgaagcattgtatc

SEQ ID NO: 687176 - DNA, 20 bp, Artificial
  CRISPR gRNA sequence
ctatatgaagcattgtatcc

SEQ ID NO: 687177 - DNA, 20 bp, Artificial
  CRISPR gRNA sequence
tatgaagcattgtatcccgt

SEQ ID NO: 687178 - DNA, 20 bp, Artificial
  CRISPR gRNA sequence
tatcccgtataaaaggaagg

SEQ ID NO: 687179 - DNA, 20 bp, Artificial
  CRISPR gRNA sequence
ttacactcatcactcctcag

SEQ ID NO: 687180 - DNA, 20 bp, Artificial
  CRISPR gRNA sequence
tacactcatcactcctcagg

SEQ ID NO: 687181 - DNA, 20 bp, Artificial
  CRISPR gRNA sequence
acactcatcactcctcaggg

SEQ ID NO: 687182 - DNA, 20 bp, Artificial
  CRISPR gRNA sequence
cactcatcactcctcagggg

SEQ ID NO: 687183 - DNA, 20 bp, Artificial
  CRISPR gRNA sequence
atcactcctcaggggctgta

SEQ ID NO: 687184 - DNA, 20 bp, Artificial
  CRISPR gRNA sequence
ctcaggggctgtacaatcat

SEQ ID NO: 687185 - DNA, 20 bp, Artificial
  CRISPR gRNA sequence
aggggctgtacaatcatgta

SEQ ID NO: 687186 - DNA, 20 bp, Artificial
  CRISPR gRNA sequence
tacaatcatgtagaaattgt

SEQ ID NO: 687187 - DNA, 20 bp, Artificial
  CRISPR gRNA sequence
tttaatgtgcctgtcaaata

SEQ ID NO: 687188 - DNA, 20 bp, Artificial
  CRISPR gRNA sequence
aatgtgcctgtcaaatagcc

SEQ ID NO: 687189 - DNA, 20 bp, Artificial
  CRISPR gRNA sequence
atgtgcctgtcaaatagcca

SEQ ID NO: 687190 - DNA, 20 bp, Artificial
  CRISPR gRNA sequence
tcaaatagccaaagagtgtt

SEQ ID NO: 687191 - DNA, 20 bp, Artificial
  CRISPR gRNA sequence
aaccctgagttcccacccat

SEQ ID NO: 687192 - DNA, 20 bp, Artificial
  CRISPR gRNA sequence
agttcccacccatgtgtgtg

SEQ ID NO: 687193 - DNA, 20 bp, Artificial
  CRISPR gRNA sequence
ccacccatgtgtgtggtatg

SEQ ID NO: 687194 - DNA, 20 bp, Artificial
  CRISPR gRNA sequence
ggattcatccagatacacag

SEQ ID NO: 687195 - DNA, 20 bp, Artificial
  CRISPR gRNA sequence
atccagatacacagagagag

SEQ ID NO: 687196 - DNA, 20 bp, Artificial
  CRISPR gRNA sequence
tgcctgaagtgctatgtggg

SEQ ID NO: 687197 - DNA, 20 bp, Artificial
  CRISPR gRNA sequence
cctgaagtgctatgtggggt

SEQ ID NO: 687198 - DNA, 20 bp, Artificial
  CRISPR gRNA sequence
aagtgctatgtggggttttt

SEQ ID NO: 687199 - DNA, 20 bp, Artificial
  CRISPR gRNA sequence
tgtggggtttttcttgtttt

SEQ ID NO: 687200 - DNA, 20 bp, Artificial
  CRISPR gRNA sequence
ttcttgttttaattttgact

SEQ ID NO: 687201 - DNA, 20 bp, Artificial
  CRISPR gRNA sequence
tcttgttttaattttgactt

SEQ ID NO: 687202 - DNA, 20 bp, Artificial
  CRISPR gRNA sequence
cttgttttaattttgacttt

SEQ ID NO: 687203 - DNA, 20 bp, Artificial
  CRISPR gRNA sequence
ttgttttaattttgacttta

SEQ ID NO: 687204 - DNA, 20 bp, Artificial
  CRISPR gRNA sequence
gttttaattttgactttaac

SEQ ID NO: 687205 - DNA, 20 bp, Artificial
  CRISPR gRNA sequence
ttttaattttgactttaacc

SEQ ID NO: 687206 - DNA, 20 bp, Artificial
  CRISPR gRNA sequence
taattttgactttaacccct

SEQ ID NO: 687207 - DNA, 20 bp, Artificial
  CRISPR gRNA sequence
aattttgactttaacccctg

SEQ ID NO: 687208 - DNA, 20 bp, Artificial
  CRISPR gRNA sequence
attttgactttaacccctga

SEQ ID NO: 687209 - DNA, 20 bp, Artificial
  CRISPR gRNA sequence
tgactttaacccctgatttg

SEQ ID NO: 687210 - DNA, 20 bp, Artificial
  CRISPR gRNA sequence
gactttaacccctgatttgt

SEQ ID NO: 687211 - DNA, 20 bp, Artificial
  CRISPR gRNA sequence
actttaacccctgatttgta

SEQ ID NO: 687212 - DNA, 20 bp, Artificial
  CRISPR gRNA sequence
taacccctgatttgtaagtt

SEQ ID NO: 687213 - DNA, 20 bp, Artificial
  CRISPR gRNA sequence
aacccctgatttgtaagttt

SEQ ID NO: 687214 - DNA, 20 bp, Artificial
  CRISPR gRNA sequence
acccctgatttgtaagtttt

SEQ ID NO: 687215 - DNA, 20 bp, Artificial
  CRISPR gRNA sequence
atttgtaagtttttcataaa

SEQ ID NO: 687216 - DNA, 20 bp, Artificial
  CRISPR gRNA sequence
gtaagtttttcataaaataa

SEQ ID NO: 687217 - DNA, 20 bp, Artificial
  CRISPR gRNA sequence
taagtttttcataaaataaa

SEQ ID NO: 687218 - DNA, 20 bp, Artificial
  CRISPR gRNA sequence
ttcataaaataaacagaatc

SEQ ID NO: 687219 - DNA, 20 bp, Artificial
  CRISPR gRNA sequence
tcataaaataaacagaatca

SEQ ID NO: 687220 - DNA, 20 bp, Artificial
  CRISPR gRNA sequence
cataaaataaacagaatcat

SEQ ID NO: 687221 - DNA, 20 bp, Artificial
  CRISPR gRNA sequence
ataaaataaacagaatcata

SEQ ID NO: 687222 - DNA, 20 bp, Artificial
  CRISPR gRNA sequence
atgtagatggctataagtgc

SEQ ID NO: 687223 - DNA, 20 bp, Artificial
  CRISPR gRNA sequence
taagtgccgtagtgttctgt

SEQ ID NO: 687224 - DNA, 20 bp, Artificial
  CRISPR gRNA sequence
tgtgggtctctggtgtctgc

SEQ ID NO: 687225 - DNA, 20 bp, Artificial
  CRISPR gRNA sequence
tgggtctctggtgtctgcca

SEQ ID NO: 687226 - DNA, 20 bp, Artificial
  CRISPR gRNA sequence
tggtgtctgccagtgataag

SEQ ID NO: 687227 - DNA, 20 bp, Artificial
  CRISPR gRNA sequence
gtgtctgccagtgataagtg

SEQ ID NO: 687228 - DNA, 20 bp, Artificial
  CRISPR gRNA sequence
ccagtgataagtgtggcacc

SEQ ID NO: 687229 - DNA, 20 bp, Artificial
  CRISPR gRNA sequence
tggaccccatcaaggtgcta

SEQ ID NO: 687230 - DNA, 20 bp, Artificial
  CRISPR gRNA sequence
tgtgagggccatgcttgggg

SEQ ID NO: 687231 - DNA, 20 bp, Artificial
  CRISPR gRNA sequence
ggggtggtggtgggcccagt

SEQ ID NO: 687232 - DNA, 20 bp, Artificial
  CRISPR gRNA sequence
gggtggtggtgggcccagta

SEQ ID NO: 687233 - DNA, 20 bp, Artificial
  CRISPR gRNA sequence
cagccatccatccagcctgc

SEQ ID NO: 687234 - DNA, 20 bp, Artificial
  CRISPR gRNA sequence
cccactcacactgcccttgt

SEQ ID NO: 687235 - DNA, 20 bp, Artificial
  CRISPR gRNA sequence
acactgcccttgtgtactcc

SEQ ID NO: 687236 - DNA, 20 bp, Artificial
  CRISPR gRNA sequence
cccttgtgtactcctgcttt

SEQ ID NO: 687237 - DNA, 20 bp, Artificial
  CRISPR gRNA sequence
gtgtactcctgctttgctac

SEQ ID NO: 687238 - DNA, 20 bp, Artificial
  CRISPR gRNA sequence
tgtactcctgctttgctacg

SEQ ID NO: 687239 - DNA, 20 bp, Artificial
  CRISPR gRNA sequence
ctgctttgctacgttatcat

SEQ ID NO: 687240 - DNA, 20 bp, Artificial
  CRISPR gRNA sequence
ctttgctacgttatcattga

SEQ ID NO: 687241 - DNA, 20 bp, Artificial
  CRISPR gRNA sequence
tgctacgttatcattgatca

SEQ ID NO: 687242 - DNA, 20 bp, Artificial
  CRISPR gRNA sequence
gctacgttatcattgatcaa

SEQ ID NO: 687243 - DNA, 20 bp, Artificial
  CRISPR gRNA sequence
ctacgttatcattgatcaat

SEQ ID NO: 687244 - DNA, 20 bp, Artificial
  CRISPR gRNA sequence
cgttatcattgatcaatgtc

SEQ ID NO: 687245 - DNA, 20 bp, Artificial
  CRISPR gRNA sequence
tcattgatcaatgtccctgg

SEQ ID NO: 687246 - DNA, 20 bp, Artificial
  CRISPR gRNA sequence
atcaatgtccctggttacct

SEQ ID NO: 687247 - DNA, 20 bp, Artificial
  CRISPR gRNA sequence
gttacctatgtgtttgaatt

SEQ ID NO: 687248 - DNA, 20 bp, Artificial
  CRISPR gRNA sequence
cctatgtgtttgaattatct

SEQ ID NO: 687249 - DNA, 20 bp, Artificial
  CRISPR gRNA sequence
tgtgtttgaattatcttcgt

SEQ ID NO: 687250 - DNA, 20 bp, Artificial
  CRISPR gRNA sequence
gaattatcttcgtgttacag

SEQ ID NO: 687251 - DNA, 20 bp, Artificial
  CRISPR gRNA sequence
aattatcttcgtgttacagg

SEQ ID NO: 687252 - DNA, 20 bp, Artificial
  CRISPR gRNA sequence
tcttcgtgttacaggtgttt

SEQ ID NO: 687253 - DNA, 20 bp, Artificial
  CRISPR gRNA sequence
cgtgttacaggtgtttaatg

SEQ ID NO: 687254 - DNA, 20 bp, Artificial
  CRISPR gRNA sequence
gtgttacaggtgtttaatga

SEQ ID NO: 687255 - DNA, 20 bp, Artificial
  CRISPR gRNA sequence
caggtgtttaatgattttgc

SEQ ID NO: 687256 - DNA, 20 bp, Artificial
  CRISPR gRNA sequence
aatgattttgctccttctag

SEQ ID NO: 687257 - DNA, 20 bp, Artificial
  CRISPR gRNA sequence
atgattttgctccttctagc

SEQ ID NO: 687258 - DNA, 20 bp, Artificial
  CRISPR gRNA sequence
tgctccttctagcttatttg

SEQ ID NO: 687259 - DNA, 20 bp, Artificial
  CRISPR gRNA sequence
gctccttctagcttatttgt

SEQ ID NO: 687260 - DNA, 20 bp, Artificial
  CRISPR gRNA sequence
ctccttctagcttatttgta

SEQ ID NO: 687261 - DNA, 20 bp, Artificial
  CRISPR gRNA sequence
cttctagcttatttgtattt

SEQ ID NO: 687262 - DNA, 20 bp, Artificial
  CRISPR gRNA sequence
ctagcttatttgtatttcac

SEQ ID NO: 687263 - DNA, 20 bp, Artificial
  CRISPR gRNA sequence
tagcttatttgtatttcacc

SEQ ID NO: 687264 - DNA, 20 bp, Artificial
  CRISPR gRNA sequence
gcttatttgtatttcacctg

SEQ ID NO: 687265 - DNA, 20 bp, Artificial
  CRISPR gRNA sequence
atttgtatttcacctgtttt

SEQ ID NO: 687266 - DNA, 20 bp, Artificial
  CRISPR gRNA sequence
tttgtatttcacctgttttt

SEQ ID NO: 687267 - DNA, 20 bp, Artificial
  CRISPR gRNA sequence
gtatttcacctgtttttctt

SEQ ID NO: 687268 - DNA, 20 bp, Artificial
  CRISPR gRNA sequence
tatttcacctgtttttcttt

SEQ ID NO: 687269 - DNA, 20 bp, Artificial
  CRISPR gRNA sequence
cacctgtttttctttaaatc

SEQ ID NO: 687270 - DNA, 20 bp, Artificial
  CRISPR gRNA sequence
acctgtttttctttaaatca

SEQ ID NO: 687271 - DNA, 20 bp, Artificial
  CRISPR gRNA sequence
tttttctttaaatcaacatg

SEQ ID NO: 687272 - DNA, 20 bp, Artificial
  CRISPR gRNA sequence
ttctttaaatcaacatggtt

SEQ ID NO: 687273 - DNA, 20 bp, Artificial
  CRISPR gRNA sequence
tctttaaatcaacatggtta

SEQ ID NO: 687274 - DNA, 20 bp, Artificial
  CRISPR gRNA sequence
ctttaaatcaacatggttac

SEQ ID NO: 687275 - DNA, 20 bp, Artificial
  CRISPR gRNA sequence
tttaaatcaacatggttaca

SEQ ID NO: 687276 - DNA, 20 bp, Artificial
  CRISPR gRNA sequence
taaatcaacatggttacact

SEQ ID NO: 687277 - DNA, 20 bp, Artificial
  CRISPR gRNA sequence
aaatcaacatggttacactc

SEQ ID NO: 687278 - DNA, 20 bp, Artificial
  CRISPR gRNA sequence
aatcaacatggttacactct

SEQ ID NO: 687279 - DNA, 20 bp, Artificial
  CRISPR gRNA sequence
cactctgtttcagcaactgt

SEQ ID NO: 687280 - DNA, 20 bp, Artificial
  CRISPR gRNA sequence
tgtttcagcaactgtataaa

SEQ ID NO: 687281 - DNA, 20 bp, Artificial
  CRISPR gRNA sequence
tttcagcaactgtataaatt

SEQ ID NO: 687282 - DNA, 20 bp, Artificial
  CRISPR gRNA sequence
cagcaactgtataaattaaa

SEQ ID NO: 687283 - DNA, 20 bp, Artificial
  CRISPR gRNA sequence
agcaactgtataaattaaac

SEQ ID NO: 687284 - DNA, 20 bp, Artificial
  CRISPR gRNA sequence
tataaattaaacacaaatta

SEQ ID NO: 687285 - DNA, 20 bp, Artificial
  CRISPR gRNA sequence
aacacaaattattactactg

SEQ ID NO: 687286 - DNA, 20 bp, Artificial
  CRISPR gRNA sequence
ttactactgctattgagttg

SEQ ID NO: 687287 - DNA, 20 bp, Artificial
  CRISPR gRNA sequence
ctactgctattgagttgtca

SEQ ID NO: 687288 - DNA, 20 bp, Artificial
  CRISPR gRNA sequence
ctgctattgagttgtcatga

SEQ ID NO: 687289 - DNA, 20 bp, Artificial
  CRISPR gRNA sequence
ctattgagttgtcatgatga

SEQ ID NO: 687290 - DNA, 20 bp, Artificial
  CRISPR gRNA sequence
ttgagttgtcatgatgaatt

SEQ ID NO: 687291 - DNA, 20 bp, Artificial
  CRISPR gRNA sequence
agttgtcatgatgaattctt

SEQ ID NO: 687292 - DNA, 20 bp, Artificial
  CRISPR gRNA sequence
tcatgatgaattctttttta

SEQ ID NO: 687293 - DNA, 20 bp, Artificial
  CRISPR gRNA sequence
ttttttatttctgaaattat

SEQ ID NO: 687294 - DNA, 20 bp, Artificial
  CRISPR gRNA sequence
ttttatttctgaaattatag

SEQ ID NO: 687295 - DNA, 20 bp, Artificial
  CRISPR gRNA sequence
tttatttctgaaattatagc

SEQ ID NO: 687296 - DNA, 20 bp, Artificial
  CRISPR gRNA sequence
ttatttctgaaattatagca

SEQ ID NO: 687297 - DNA, 20 bp, Artificial
  CRISPR gRNA sequence
tatttctgaaattatagcat

SEQ ID NO: 687298 - DNA, 20 bp, Artificial
  CRISPR gRNA sequence
atttctgaaattatagcatt

SEQ ID NO: 687299 - DNA, 20 bp, Artificial
  CRISPR gRNA sequence
tttctgaaattatagcattt

SEQ ID NO: 687300 - DNA, 20 bp, Artificial
  CRISPR gRNA sequence
ctgaaattatagcatttctt

SEQ ID NO: 687301 - DNA, 20 bp, Artificial
  CRISPR gRNA sequence
tgaaattatagcatttcttg

SEQ ID NO: 687302 - DNA, 20 bp, Artificial
  CRISPR gRNA sequence
aaattatagcatttcttgaa

SEQ ID NO: 687303 - DNA, 20 bp, Artificial
  CRISPR gRNA sequence
tagcatttcttgaatttaag

SEQ ID NO: 687304 - DNA, 20 bp, Artificial
  CRISPR gRNA sequence
cttgaatttaagagaacaaa

SEQ ID NO: 687305 - DNA, 20 bp, Artificial
  CRISPR gRNA sequence
ttgaatttaagagaacaaaa

SEQ ID NO: 687306 - DNA, 20 bp, Artificial
  CRISPR gRNA sequence
gaatttaagagaacaaaaac

SEQ ID NO: 687307 - DNA, 20 bp, Artificial
  CRISPR gRNA sequence
aatttaagagaacaaaaact

SEQ ID NO: 687308 - DNA, 20 bp, Artificial
  CRISPR gRNA sequence
aagagaacaaaaacttgaaa

SEQ ID NO: 687309 - DNA, 20 bp, Artificial
  CRISPR gRNA sequence
agagaacaaaaacttgaaag

SEQ ID NO: 687310 - DNA, 20 bp, Artificial
  CRISPR gRNA sequence
gaaaggcctatgtctccatt

SEQ ID NO: 687311 - DNA, 20 bp, Artificial
  CRISPR gRNA sequence
aaaggcctatgtctccattt

SEQ ID NO: 687312 - DNA, 20 bp, Artificial
  CRISPR gRNA sequence
ataaaatggagacataggcc

SEQ ID NO: 687313 - DNA, 20 bp, Artificial
  CRISPR gRNA sequence
tcaagtttttgttctcttaa

SEQ ID NO: 687314 - DNA, 20 bp, Artificial
  CRISPR gRNA sequence
caagtttttgttctcttaaa

SEQ ID NO: 687315 - DNA, 20 bp, Artificial
  CRISPR gRNA sequence
aagtttttgttctcttaaat

SEQ ID NO: 687316 - DNA, 20 bp, Artificial
  CRISPR gRNA sequence
ttgttctcttaaattcaaga

SEQ ID NO: 687317 - DNA, 20 bp, Artificial
  CRISPR gRNA sequence
tgttctcttaaattcaagaa

SEQ ID NO: 687318 - DNA, 20 bp, Artificial
  CRISPR gRNA sequence
gttctcttaaattcaagaaa

SEQ ID NO: 687319 - DNA, 20 bp, Artificial
  CRISPR gRNA sequence
ttctcttaaattcaagaaat

SEQ ID NO: 687320 - DNA, 20 bp, Artificial
  CRISPR gRNA sequence
tcttaaattcaagaaatgct

SEQ ID NO: 687321 - DNA, 20 bp, Artificial
  CRISPR gRNA sequence
ttaaattcaagaaatgctat

SEQ ID NO: 687322 - DNA, 20 bp, Artificial
  CRISPR gRNA sequence
aaattcaagaaatgctataa

SEQ ID NO: 687323 - DNA, 20 bp, Artificial
  CRISPR gRNA sequence
aattcaagaaatgctataat

SEQ ID NO: 687324 - DNA, 20 bp, Artificial
  CRISPR gRNA sequence
aagaaatgctataatttcag

SEQ ID NO: 687325 - DNA, 20 bp, Artificial
  CRISPR gRNA sequence
taatttcagaaataaaaaag

SEQ ID NO: 687326 - DNA, 20 bp, Artificial
  CRISPR gRNA sequence
cagaaataaaaaagaattca

SEQ ID NO: 687327 - DNA, 20 bp, Artificial
  CRISPR gRNA sequence
agaaataaaaaagaattcat

SEQ ID NO: 687328 - DNA, 20 bp, Artificial
  CRISPR gRNA sequence
atcatgacaactcaatagca

SEQ ID NO: 687329 - DNA, 20 bp, Artificial
  CRISPR gRNA sequence
aatagcagtagtaataattt

SEQ ID NO: 687330 - DNA, 20 bp, Artificial
  CRISPR gRNA sequence
gtgtttaatttatacagttg

SEQ ID NO: 687331 - DNA, 20 bp, Artificial
  CRISPR gRNA sequence
tgtttaatttatacagttgc

SEQ ID NO: 687332 - DNA, 20 bp, Artificial
  CRISPR gRNA sequence
aatttatacagttgctgaaa

SEQ ID NO: 687333 - DNA, 20 bp, Artificial
  CRISPR gRNA sequence
atttatacagttgctgaaac

SEQ ID NO: 687334 - DNA, 20 bp, Artificial
  CRISPR gRNA sequence
atacagttgctgaaacagag

SEQ ID NO: 687335 - DNA, 20 bp, Artificial
  CRISPR gRNA sequence
tacagttgctgaaacagagt

SEQ ID NO: 687336 - DNA, 20 bp, Artificial
  CRISPR gRNA sequence
ctgaaacagagtgtaaccat

SEQ ID NO: 687337 - DNA, 20 bp, Artificial
  CRISPR gRNA sequence
aaacagagtgtaaccatgtt

SEQ ID NO: 687338 - DNA, 20 bp, Artificial
  CRISPR gRNA sequence
atttaaagaaaaacaggtga

SEQ ID NO: 687339 - DNA, 20 bp, Artificial
  CRISPR gRNA sequence
aaagaaaaacaggtgaaata

SEQ ID NO: 687340 - DNA, 20 bp, Artificial
  CRISPR gRNA sequence
aagaaaaacaggtgaaatac

SEQ ID NO: 687341 - DNA, 20 bp, Artificial
  CRISPR gRNA sequence
gaaggagcaaaatcattaaa

SEQ ID NO: 687342 - DNA, 20 bp, Artificial
  CRISPR gRNA sequence
aacacctgtaacacgaagat

SEQ ID NO: 687343 - DNA, 20 bp, Artificial
  CRISPR gRNA sequence
taacacgaagataattcaaa

SEQ ID NO: 687344 - DNA, 20 bp, Artificial
  CRISPR gRNA sequence
aaacacataggtaaccaggg

SEQ ID NO: 687345 - DNA, 20 bp, Artificial
  CRISPR gRNA sequence
atcaatgataacgtagcaaa

SEQ ID NO: 687346 - DNA, 20 bp, Artificial
  CRISPR gRNA sequence
gatggatggctgcagggtct

SEQ ID NO: 687347 - DNA, 20 bp, Artificial
  CRISPR gRNA sequence
cagggtctactgggcccacc

SEQ ID NO: 687348 - DNA, 20 bp, Artificial
  CRISPR gRNA sequence
ctgggcccaccaccacccca

SEQ ID NO: 687349 - DNA, 20 bp, Artificial
  CRISPR gRNA sequence
ggcccaccaccaccccaagc

SEQ ID NO: 687350 - DNA, 20 bp, Artificial
  CRISPR gRNA sequence
acatagcaccttgatggggt

SEQ ID NO: 687351 - DNA, 20 bp, Artificial
  CRISPR gRNA sequence
gatggggtccacagccttcc

SEQ ID NO: 687352 - DNA, 20 bp, Artificial
  CRISPR gRNA sequence
atggggtccacagccttcct

SEQ ID NO: 687353 - DNA, 20 bp, Artificial
  CRISPR gRNA sequence
cctggggtgccacacttatc

SEQ ID NO: 687354 - DNA, 20 bp, Artificial
  CRISPR gRNA sequence
ctggggtgccacacttatca

SEQ ID NO: 687355 - DNA, 20 bp, Artificial
  CRISPR gRNA sequence
gggtgccacacttatcactg

SEQ ID NO: 687356 - DNA, 20 bp, Artificial
  CRISPR gRNA sequence
atcactggcagacaccagag

SEQ ID NO: 687357 - DNA, 20 bp, Artificial
  CRISPR gRNA sequence
tcactggcagacaccagaga

SEQ ID NO: 687358 - DNA, 20 bp, Artificial
  CRISPR gRNA sequence
gcagacaccagagacccaca

SEQ ID NO: 687359 - DNA, 20 bp, Artificial
  CRISPR gRNA sequence
cggcacttatagccatctac

SEQ ID NO: 687360 - DNA, 20 bp, Artificial
  CRISPR gRNA sequence
atagccatctacatgagtta

SEQ ID NO: 687361 - DNA, 20 bp, Artificial
  CRISPR gRNA sequence
tagccatctacatgagttat

SEQ ID NO: 687362 - DNA, 20 bp, Artificial
  CRISPR gRNA sequence
catgagttatgattctgttt

SEQ ID NO: 687363 - DNA, 20 bp, Artificial
  CRISPR gRNA sequence
tgattctgtttattttatga

SEQ ID NO: 687364 - DNA, 20 bp, Artificial
  CRISPR gRNA sequence
tgtttattttatgaaaaact

SEQ ID NO: 687365 - DNA, 20 bp, Artificial
  CRISPR gRNA sequence
tttattttatgaaaaactta

SEQ ID NO: 687366 - DNA, 20 bp, Artificial
  CRISPR gRNA sequence
attttatgaaaaacttacaa

SEQ ID NO: 687367 - DNA, 20 bp, Artificial
  CRISPR gRNA sequence
ttttatgaaaaacttacaaa

SEQ ID NO: 687368 - DNA, 20 bp, Artificial
  CRISPR gRNA sequence
tatgaaaaacttacaaatca

SEQ ID NO: 687369 - DNA, 20 bp, Artificial
  CRISPR gRNA sequence
atgaaaaacttacaaatcag

SEQ ID NO: 687370 - DNA, 20 bp, Artificial
  CRISPR gRNA sequence
tgaaaaacttacaaatcagg

SEQ ID NO: 687371 - DNA, 20 bp, Artificial
  CRISPR gRNA sequence
acaaatcaggggttaaagtc

SEQ ID NO: 687372 - DNA, 20 bp, Artificial
  CRISPR gRNA sequence
caaatcaggggttaaagtca

SEQ ID NO: 687373 - DNA, 20 bp, Artificial
  CRISPR gRNA sequence
aagtcaaaattaaaacaaga

SEQ ID NO: 687374 - DNA, 20 bp, Artificial
  CRISPR gRNA sequence
aaacaagaaaaaccccacat

SEQ ID NO: 687375 - DNA, 20 bp, Artificial
  CRISPR gRNA sequence
caggcagagacctgccacga

SEQ ID NO: 687376 - DNA, 20 bp, Artificial
  CRISPR gRNA sequence
aggcagagacctgccacgat

SEQ ID NO: 687377 - DNA, 20 bp, Artificial
  CRISPR gRNA sequence
ccacgattacaccatattgg

SEQ ID NO: 687378 - DNA, 20 bp, Artificial
  CRISPR gRNA sequence
caccatattgggggcccgct

SEQ ID NO: 687379 - DNA, 20 bp, Artificial
  CRISPR gRNA sequence
ggggcccgctgtccccacac

SEQ ID NO: 687380 - DNA, 20 bp, Artificial
  CRISPR gRNA sequence
tccccacacccctatccttt

SEQ ID NO: 687381 - DNA, 20 bp, Artificial
  CRISPR gRNA sequence
tcctttctcctcctgttgtg

SEQ ID NO: 687382 - DNA, 20 bp, Artificial
  CRISPR gRNA sequence
tctcctcctgttgtgcctct

SEQ ID NO: 687383 - DNA, 20 bp, Artificial
  CRISPR gRNA sequence
ctcctcctgttgtgcctctc

SEQ ID NO: 687384 - DNA, 20 bp, Artificial
  CRISPR gRNA sequence
tcctcctgttgtgcctctct

SEQ ID NO: 687385 - DNA, 20 bp, Artificial
  CRISPR gRNA sequence
ctcctgttgtgcctctctct

SEQ ID NO: 687386 - DNA, 20 bp, Artificial
  CRISPR gRNA sequence
ctgttgtgcctctctctgtg

SEQ ID NO: 687387 - DNA, 20 bp, Artificial
  CRISPR gRNA sequence
ttgtgcctctctctgtgtat

SEQ ID NO: 687388 - DNA, 20 bp, Artificial
  CRISPR gRNA sequence
tgcctctctctgtgtatctg

SEQ ID NO: 687389 - DNA, 20 bp, Artificial
  CRISPR gRNA sequence
tctctgtgtatctggatgaa

SEQ ID NO: 687390 - DNA, 20 bp, Artificial
  CRISPR gRNA sequence
tctgtgtatctggatgaatc

SEQ ID NO: 687391 - DNA, 20 bp, Artificial
  CRISPR gRNA sequence
tgtgtatctggatgaatcct

SEQ ID NO: 687392 - DNA, 20 bp, Artificial
  CRISPR gRNA sequence
tgtatctggatgaatcctaa

SEQ ID NO: 687393 - DNA, 20 bp, Artificial
  CRISPR gRNA sequence
gatgaatcctaaccatacca

SEQ ID NO: 687394 - DNA, 20 bp, Artificial
  CRISPR gRNA sequence
accataccacacacatgggt

SEQ ID NO: 687395 - DNA, 20 bp, Artificial
  CRISPR gRNA sequence
agggtttaacactctttggc

SEQ ID NO: 687396 - DNA, 20 bp, Artificial
  CRISPR gRNA sequence
aacactctttggctatttga

SEQ ID NO: 687397 - DNA, 20 bp, Artificial
  CRISPR gRNA sequence
acactctttggctatttgac

SEQ ID NO: 687398 - DNA, 20 bp, Artificial
  CRISPR gRNA sequence
tttggctatttgacaggcac

SEQ ID NO: 687399 - DNA, 20 bp, Artificial
  CRISPR gRNA sequence
tggctatttgacaggcacat

SEQ ID NO: 687400 - DNA, 20 bp, Artificial
  CRISPR gRNA sequence
ggctatttgacaggcacatt

SEQ ID NO: 687401 - DNA, 20 bp, Artificial
  CRISPR gRNA sequence
gctatttgacaggcacatta

SEQ ID NO: 687402 - DNA, 20 bp, Artificial
  CRISPR gRNA sequence
tttgacaggcacattaaaca

SEQ ID NO: 687403 - DNA, 20 bp, Artificial
  CRISPR gRNA sequence
gacaggcacattaaacaatt

SEQ ID NO: 687404 - DNA, 20 bp, Artificial
  CRISPR gRNA sequence
acaggcacattaaacaattt

SEQ ID NO: 687405 - DNA, 20 bp, Artificial
  CRISPR gRNA sequence
aacaatttctacatgattgt

SEQ ID NO: 687406 - DNA, 20 bp, Artificial
  CRISPR gRNA sequence
ctacatgattgtacagcccc

SEQ ID NO: 687407 - DNA, 20 bp, Artificial
  CRISPR gRNA sequence
tacatgattgtacagcccct

SEQ ID NO: 687408 - DNA, 20 bp, Artificial
  CRISPR gRNA sequence
catgattgtacagcccctga

SEQ ID NO: 687409 - DNA, 20 bp, Artificial
  CRISPR gRNA sequence
tacagcccctgaggagtgat

SEQ ID NO: 687410 - DNA, 20 bp, Artificial
  CRISPR gRNA sequence
aggagtgatgagtgtaaaaa

SEQ ID NO: 687411 - DNA, 20 bp, Artificial
  CRISPR gRNA sequence
ctctctttccttccttttat

SEQ ID NO: 687412 - DNA, 20 bp, Artificial
  CRISPR gRNA sequence
tctctttccttccttttata

SEQ ID NO: 687413 - DNA, 20 bp, Artificial
  CRISPR gRNA sequence
tctttccttccttttatacg

SEQ ID NO: 687414 - DNA, 20 bp, Artificial
  CRISPR gRNA sequence
tttccttccttttatacggg

SEQ ID NO: 687415 - DNA, 20 bp, Artificial
  CRISPR gRNA sequence
tccttccttttatacgggat

SEQ ID NO: 687416 - DNA, 20 bp, Artificial
  CRISPR gRNA sequence
ccttccttttatacgggata

SEQ ID NO: 687417 - DNA, 20 bp, Artificial
  CRISPR gRNA sequence
cttccttttatacgggatac

SEQ ID NO: 687418 - DNA, 20 bp, Artificial
  CRISPR gRNA sequence
ccttttatacgggatacaat

SEQ ID NO: 687419 - DNA, 20 bp, Artificial
  CRISPR gRNA sequence
cttttatacgggatacaatg

SEQ ID NO: 687420 - DNA, 20 bp, Artificial
  CRISPR gRNA sequence
ttatacgggatacaatgctt

SEQ ID NO: 687421 - DNA, 20 bp, Artificial
  CRISPR gRNA sequence
tatacgggatacaatgcttc

SEQ ID NO: 687422 - DNA, 20 bp, Artificial
  CRISPR gRNA sequence
atacgggatacaatgcttca

SEQ ID NO: 687423 - DNA, 20 bp, Artificial
  CRISPR gRNA sequence
tacgggatacaatgcttcat

SEQ ID NO: 687424 - DNA, 20 bp, Artificial
  CRISPR gRNA sequence
catatagcaaacaggatgtc

SEQ ID NO: 687425 - DNA, 20 bp, Artificial
  CRISPR gRNA sequence
atatagcaaacaggatgtct

SEQ ID NO: 687426 - DNA, 20 bp, Artificial
  CRISPR gRNA sequence
tgcctggatatgtgaagaac

SEQ ID NO: 687427 - DNA, 20 bp, Artificial
  CRISPR gRNA sequence
gcctggatatgtgaagaaca

SEQ ID NO: 687428 - DNA, 20 bp, Artificial
  CRISPR gRNA sequence
cctggatatgtgaagaacaa

SEQ ID NO: 687429 - DNA, 20 bp, Artificial
  CRISPR gRNA sequence
gatatgtgaagaacaagtga

SEQ ID NO: 687430 - DNA, 20 bp, Artificial
  CRISPR gRNA sequence
gcaagtgctcaggagtgaaa

SEQ ID NO: 687431 - DNA, 20 bp, Artificial
  CRISPR gRNA sequence
aggagtgaaatgcttggaaa

SEQ ID NO: 687432 - DNA, 20 bp, Artificial
  CRISPR gRNA sequence
ggaaagctgttttccaagac

SEQ ID NO: 687433 - DNA, 20 bp, Artificial
  CRISPR gRNA sequence
gaaagctgttttccaagaca

SEQ ID NO: 687434 - DNA, 20 bp, Artificial
  CRISPR gRNA sequence
ttttccaagacaacattgca

SEQ ID NO: 687435 - DNA, 20 bp, Artificial
  CRISPR gRNA sequence
tccaagacaacattgcattc

SEQ ID NO: 687436 - DNA, 20 bp, Artificial
  CRISPR gRNA sequence
ccaagacaacattgcattca

SEQ ID NO: 687437 - DNA, 20 bp, Artificial
  CRISPR gRNA sequence
caagacaacattgcattcag

SEQ ID NO: 687438 - DNA, 20 bp, Artificial
  CRISPR gRNA sequence
cattcagagacacaccaagg

SEQ ID NO: 687439 - DNA, 20 bp, Artificial
  CRISPR gRNA sequence
agagacacaccaagggagtg

SEQ ID NO: 687440 - DNA, 20 bp, Artificial
  CRISPR gRNA sequence
tgtgggaagagcacttcatc

SEQ ID NO: 687441 - DNA, 20 bp, Artificial
  CRISPR gRNA sequence
tgggaagagcacttcatctc

SEQ ID NO: 687442 - DNA, 20 bp, Artificial
  CRISPR gRNA sequence
catctctgatgtttcacatt

SEQ ID NO: 687443 - DNA, 20 bp, Artificial
  CRISPR gRNA sequence
atctctgatgtttcacattg

SEQ ID NO: 687444 - DNA, 20 bp, Artificial
  CRISPR gRNA sequence
tgatgtttcacattgtctgg

SEQ ID NO: 687445 - DNA, 20 bp, Artificial
  CRISPR gRNA sequence
atgtttcacattgtctgggc

SEQ ID NO: 687446 - DNA, 20 bp, Artificial
  CRISPR gRNA sequence
cacattgtctgggcatagtg

SEQ ID NO: 687447 - DNA, 20 bp, Artificial
  CRISPR gRNA sequence
acattgtctgggcatagtga

SEQ ID NO: 687448 - DNA, 20 bp, Artificial
  CRISPR gRNA sequence
tctgggcatagtgatgataa

SEQ ID NO: 687449 - DNA, 20 bp, Artificial
  CRISPR gRNA sequence
ggcatagtgatgataaaaag

SEQ ID NO: 687450 - DNA, 20 bp, Artificial
  CRISPR gRNA sequence
gtagacagctttatcactgt

SEQ ID NO: 687451 - DNA, 20 bp, Artificial
  CRISPR gRNA sequence
tagacagctttatcactgtt

SEQ ID NO: 687452 - DNA, 20 bp, Artificial
  CRISPR gRNA sequence
tatcactgttttgaaaactc

SEQ ID NO: 687453 - DNA, 20 bp, Artificial
  CRISPR gRNA sequence
atcactgttttgaaaactct

SEQ ID NO: 687454 - DNA, 20 bp, Artificial
  CRISPR gRNA sequence
tcactgttttgaaaactctg

SEQ ID NO: 687455 - DNA, 20 bp, Artificial
  CRISPR gRNA sequence
ttttgaaaactctgtagaaa

SEQ ID NO: 687456 - DNA, 20 bp, Artificial
  CRISPR gRNA sequence
tgaaaactctgtagaaaaca

SEQ ID NO: 687457 - DNA, 20 bp, Artificial
  CRISPR gRNA sequence
gaaaactctgtagaaaacat

SEQ ID NO: 687458 - DNA, 20 bp, Artificial
  CRISPR gRNA sequence
aaaactctgtagaaaacata

SEQ ID NO: 687459 - DNA, 20 bp, Artificial
  CRISPR gRNA sequence
tgtagaaaacatatcccctt

SEQ ID NO: 687460 - DNA, 20 bp, Artificial
  CRISPR gRNA sequence
tagaaaacatatccccttct

SEQ ID NO: 687461 - DNA, 20 bp, Artificial
  CRISPR gRNA sequence
cttgcctgcacccaggaagg

SEQ ID NO: 687462 - DNA, 20 bp, Artificial
  CRISPR gRNA sequence
ttgcctgcacccaggaagga

SEQ ID NO: 687463 - DNA, 20 bp, Artificial
  CRISPR gRNA sequence
gcctgcacccaggaaggatc

SEQ ID NO: 687464 - DNA, 20 bp, Artificial
  CRISPR gRNA sequence
cctgcacccaggaaggatca

SEQ ID NO: 687465 - DNA, 20 bp, Artificial
  CRISPR gRNA sequence
cacccaggaaggatcactct

SEQ ID NO: 687466 - DNA, 20 bp, Artificial
  CRISPR gRNA sequence
tctccaccctgctttggcta

SEQ ID NO: 687467 - DNA, 20 bp, Artificial
  CRISPR gRNA sequence
tccaccctgctttggctatt

SEQ ID NO: 687468 - DNA, 20 bp, Artificial
  CRISPR gRNA sequence
caccctgctttggctatttg

SEQ ID NO: 687469 - DNA, 20 bp, Artificial
  CRISPR gRNA sequence
ctttggctatttgtgatgcc

SEQ ID NO: 687470 - DNA, 20 bp, Artificial
  CRISPR gRNA sequence
tggctatttgtgatgccacc

SEQ ID NO: 687471 - DNA, 20 bp, Artificial
  CRISPR gRNA sequence
ggctatttgtgatgccacca

SEQ ID NO: 687472 - DNA, 20 bp, Artificial
  CRISPR gRNA sequence
gctatttgtgatgccaccaa

SEQ ID NO: 687473 - DNA, 20 bp, Artificial
  CRISPR gRNA sequence
tttgtgatgccaccaattat

SEQ ID NO: 687474 - DNA, 20 bp, Artificial
  CRISPR gRNA sequence
gtgatgccaccaattattta

SEQ ID NO: 687475 - DNA, 20 bp, Artificial
  CRISPR gRNA sequence
tgatgccaccaattatttat

SEQ ID NO: 687476 - DNA, 20 bp, Artificial
  CRISPR gRNA sequence
tttatatataaaaaagaatg

SEQ ID NO: 687477 - DNA, 20 bp, Artificial
  CRISPR gRNA sequence
atatataaaaaagaatgtta

SEQ ID NO: 687478 - DNA, 20 bp, Artificial
  CRISPR gRNA sequence
tatataaaaaagaatgttac

SEQ ID NO: 687479 - DNA, 20 bp, Artificial
  CRISPR gRNA sequence
catttttaaaagattatata

SEQ ID NO: 687480 - DNA, 20 bp, Artificial
  CRISPR gRNA sequence
ttaaaagattatatagtgtc

SEQ ID NO: 687481 - DNA, 20 bp, Artificial
  CRISPR gRNA sequence
taaaagattatatagtgtct

SEQ ID NO: 687482 - DNA, 20 bp, Artificial
  CRISPR gRNA sequence
aaaagattatatagtgtctg

SEQ ID NO: 687483 - DNA, 20 bp, Artificial
  CRISPR gRNA sequence
aaagattatatagtgtctga

SEQ ID NO: 687484 - DNA, 20 bp, Artificial
  CRISPR gRNA sequence
tatagtgtctgaaattaacc

SEQ ID NO: 687485 - DNA, 20 bp, Artificial
  CRISPR gRNA sequence
aaattaacccaataaagatt

SEQ ID NO: 687486 - DNA, 20 bp, Artificial
  CRISPR gRNA sequence
acccaataaagattcatcag

SEQ ID NO: 687487 - DNA, 20 bp, Artificial
  CRISPR gRNA sequence
atcagtttcatgttgtcctt

SEQ ID NO: 687488 - DNA, 20 bp, Artificial
  CRISPR gRNA sequence
catgttgtccttttattgtg

SEQ ID NO: 687489 - DNA, 20 bp, Artificial
  CRISPR gRNA sequence
atgttgtccttttattgtgt

SEQ ID NO: 687490 - DNA, 20 bp, Artificial
  CRISPR gRNA sequence
tccttttattgtgtcaaatt

SEQ ID NO: 687491 - DNA, 20 bp, Artificial
  CRISPR gRNA sequence
ttattgtgtcaaattataat

SEQ ID NO: 687492 - DNA, 20 bp, Artificial
  CRISPR gRNA sequence
tattgtgtcaaattataatg

SEQ ID NO: 687493 - DNA, 20 bp, Artificial
  CRISPR gRNA sequence
attgtgtcaaattataatga

SEQ ID NO: 687494 - DNA, 20 bp, Artificial
  CRISPR gRNA sequence
ttgtgtcaaattataatgat

SEQ ID NO: 687495 - DNA, 20 bp, Artificial
  CRISPR gRNA sequence
tgtcaaattataatgatatc

SEQ ID NO: 687496 - DNA, 20 bp, Artificial
  CRISPR gRNA sequence
taatgatatcattaaaatcc

SEQ ID NO: 687497 - DNA, 20 bp, Artificial
  CRISPR gRNA sequence
aaatcctgctagattcagaa

SEQ ID NO: 687498 - DNA, 20 bp, Artificial
  CRISPR gRNA sequence
ctagattcagaaaaaactgt

SEQ ID NO: 687499 - DNA, 20 bp, Artificial
  CRISPR gRNA sequence
gattcagaaaaaactgtagg

SEQ ID NO: 687500 - DNA, 20 bp, Artificial
  CRISPR gRNA sequence
agaaaaaactgtagggaagc

SEQ ID NO: 687501 - DNA, 20 bp, Artificial
  CRISPR gRNA sequence
tagggaagcaataaacaatt

SEQ ID NO: 687502 - DNA, 20 bp, Artificial
  CRISPR gRNA sequence
gactttccaaatgatgagga

SEQ ID NO: 687503 - DNA, 20 bp, Artificial
  CRISPR gRNA sequence
actttccaaatgatgaggaa

SEQ ID NO: 687504 - DNA, 20 bp, Artificial
  CRISPR gRNA sequence
tccaaatgatgaggaaagtt

SEQ ID NO: 687505 - DNA, 20 bp, Artificial
  CRISPR gRNA sequence
ccaaatgatgaggaaagtta

SEQ ID NO: 687506 - DNA, 20 bp, Artificial
  CRISPR gRNA sequence
caaatgatgaggaaagttat

SEQ ID NO: 687507 - DNA, 20 bp, Artificial
  CRISPR gRNA sequence
ttgaatttaccaaacataaa

SEQ ID NO: 687508 - DNA, 20 bp, Artificial
  CRISPR gRNA sequence
aatttaccaaacataaatat

SEQ ID NO: 687509 - DNA, 20 bp, Artificial
  CRISPR gRNA sequence
accaaacataaatataaaaa

SEQ ID NO: 687510 - DNA, 20 bp, Artificial
  CRISPR gRNA sequence
ccaaacataaatataaaaat

SEQ ID NO: 687511 - DNA, 20 bp, Artificial
  CRISPR gRNA sequence
tgttgtataattaagactta

SEQ ID NO: 687512 - DNA, 20 bp, Artificial
  CRISPR gRNA sequence
gttgtataattaagacttat

SEQ ID NO: 687513 - DNA, 20 bp, Artificial
  CRISPR gRNA sequence
ttgtataattaagacttata

SEQ ID NO: 687514 - DNA, 20 bp, Artificial
  CRISPR gRNA sequence
tataattaagacttatagct

SEQ ID NO: 687515 - DNA, 20 bp, Artificial
  CRISPR gRNA sequence
agacttatagctagagaagt

SEQ ID NO: 687516 - DNA, 20 bp, Artificial
  CRISPR gRNA sequence
atagctagagaagtagaaat

SEQ ID NO: 687517 - DNA, 20 bp, Artificial
  CRISPR gRNA sequence
tagctagagaagtagaaatg

SEQ ID NO: 687518 - DNA, 20 bp, Artificial
  CRISPR gRNA sequence
gagaagtagaaatgtacaca

SEQ ID NO: 687519 - DNA, 20 bp, Artificial
  CRISPR gRNA sequence
ggtatcaataatttggttgt

SEQ ID NO: 687520 - DNA, 20 bp, Artificial
  CRISPR gRNA sequence
gtatcaataatttggttgtg

SEQ ID NO: 687521 - DNA, 20 bp, Artificial
  CRISPR gRNA sequence
ggttgtgcattcatttattc

SEQ ID NO: 687522 - DNA, 20 bp, Artificial
  CRISPR gRNA sequence
gttgtgcattcatttattca

SEQ ID NO: 687523 - DNA, 20 bp, Artificial
  CRISPR gRNA sequence
tgcattcatttattcagtca

SEQ ID NO: 687524 - DNA, 20 bp, Artificial
  CRISPR gRNA sequence
atttattcagtcaacaaata

SEQ ID NO: 687525 - DNA, 20 bp, Artificial
  CRISPR gRNA sequence
attcagtcaacaaatattta

SEQ ID NO: 687526 - DNA, 20 bp, Artificial
  CRISPR gRNA sequence
ttcagtcaacaaatatttag

SEQ ID NO: 687527 - DNA, 20 bp, Artificial
  CRISPR gRNA sequence
agtcaacaaatatttagctg

SEQ ID NO: 687528 - DNA, 20 bp, Artificial
  CRISPR gRNA sequence
agctgagcactggctagctg

SEQ ID NO: 687529 - DNA, 20 bp, Artificial
  CRISPR gRNA sequence
gctgagcactggctagctgc

SEQ ID NO: 687530 - DNA, 20 bp, Artificial
  CRISPR gRNA sequence
agcactggctagctgccagg

SEQ ID NO: 687531 - DNA, 20 bp, Artificial
  CRISPR gRNA sequence
gctagctgccaggtattgca

SEQ ID NO: 687532 - DNA, 20 bp, Artificial
  CRISPR gRNA sequence
gctgccaggtattgcactaa

SEQ ID NO: 687533 - DNA, 20 bp, Artificial
  CRISPR gRNA sequence
ccaggtattgcactaaggac

SEQ ID NO: 687534 - DNA, 20 bp, Artificial
  CRISPR gRNA sequence
cactaaggacccaaagatgg

SEQ ID NO: 687535 - DNA, 20 bp, Artificial
  CRISPR gRNA sequence
aggacccaaagatggaagag

SEQ ID NO: 687536 - DNA, 20 bp, Artificial
  CRISPR gRNA sequence
ccctcatggagcttgcagtc

SEQ ID NO: 687537 - DNA, 20 bp, Artificial
  CRISPR gRNA sequence
atggagcttgcagtcgtgtt

SEQ ID NO: 687538 - DNA, 20 bp, Artificial
  CRISPR gRNA sequence
gcagtcgtgttgagcagact

SEQ ID NO: 687539 - DNA, 20 bp, Artificial
  CRISPR gRNA sequence
cagtcgtgttgagcagactg

SEQ ID NO: 687540 - DNA, 20 bp, Artificial
  CRISPR gRNA sequence
agcagactgtcaaacagatt

SEQ ID NO: 687541 - DNA, 20 bp, Artificial
  CRISPR gRNA sequence
tcaaacagatttaggtaagg

SEQ ID NO: 687542 - DNA, 20 bp, Artificial
  CRISPR gRNA sequence
aggtaaggcaatgtgaccag

SEQ ID NO: 687543 - DNA, 20 bp, Artificial
  CRISPR gRNA sequence
ggtaaggcaatgtgaccagt

SEQ ID NO: 687544 - DNA, 20 bp, Artificial
  CRISPR gRNA sequence
tgatacaaacaggatgctac

SEQ ID NO: 687545 - DNA, 20 bp, Artificial
  CRISPR gRNA sequence
caagagtacttggaaagtgt

SEQ ID NO: 687546 - DNA, 20 bp, Artificial
  CRISPR gRNA sequence
ggaaagtgtgtatactgcaa

SEQ ID NO: 687547 - DNA, 20 bp, Artificial
  CRISPR gRNA sequence
gaaagtgtgtatactgcaaa

SEQ ID NO: 687548 - DNA, 20 bp, Artificial
  CRISPR gRNA sequence
caaactgagggccaagaaag

SEQ ID NO: 687549 - DNA, 20 bp, Artificial
  CRISPR gRNA sequence
agggccaagaaaggctccct

SEQ ID NO: 687550 - DNA, 20 bp, Artificial
  CRISPR gRNA sequence
cctggaatacgtggtacctg

SEQ ID NO: 687551 - DNA, 20 bp, Artificial
  CRISPR gRNA sequence
gaatacgtggtacctgaatt

SEQ ID NO: 687552 - DNA, 20 bp, Artificial
  CRISPR gRNA sequence
aattacatggtgaataacag

SEQ ID NO: 687553 - DNA, 20 bp, Artificial
  CRISPR gRNA sequence
catggtgaataacagatgca

SEQ ID NO: 687554 - DNA, 20 bp, Artificial
  CRISPR gRNA sequence
agctaccagacttcccgtgt

SEQ ID NO: 687555 - DNA, 20 bp, Artificial
  CRISPR gRNA sequence
ccagacttcccgtgtgttcc

SEQ ID NO: 687556 - DNA, 20 bp, Artificial
  CRISPR gRNA sequence
cccgtgtgttccatgtacct

SEQ ID NO: 687557 - DNA, 20 bp, Artificial
  CRISPR gRNA sequence
ccgtgtgttccatgtacctt

SEQ ID NO: 687558 - DNA, 20 bp, Artificial
  CRISPR gRNA sequence
catgtaccttaaatacttta

SEQ ID NO: 687559 - DNA, 20 bp, Artificial
  CRISPR gRNA sequence
aaatactttacaaagtttaa

SEQ ID NO: 687560 - DNA, 20 bp, Artificial
  CRISPR gRNA sequence
aatactttacaaagtttaac

SEQ ID NO: 687561 - DNA, 20 bp, Artificial
  CRISPR gRNA sequence
tacaaagtttaacaatgata

SEQ ID NO: 687562 - DNA, 20 bp, Artificial
  CRISPR gRNA sequence
acaaagtttaacaatgataa

SEQ ID NO: 687563 - DNA, 20 bp, Artificial
  CRISPR gRNA sequence
caaagtttaacaatgataat

SEQ ID NO: 687564 - DNA, 20 bp, Artificial
  CRISPR gRNA sequence
aacaatgataatgtgtgtgg

SEQ ID NO: 687565 - DNA, 20 bp, Artificial
  CRISPR gRNA sequence
acaatgataatgtgtgtggt

SEQ ID NO: 687566 - DNA, 20 bp, Artificial
  CRISPR gRNA sequence
gggtctgtgttcctgcccaa

SEQ ID NO: 687567 - DNA, 20 bp, Artificial
  CRISPR gRNA sequence
ggtctgtgttcctgcccaaa

SEQ ID NO: 687568 - DNA, 20 bp, Artificial
  CRISPR gRNA sequence
tgttcctgcccaaatctcat

SEQ ID NO: 687569 - DNA, 20 bp, Artificial
  CRISPR gRNA sequence
ctgcccaaatctcatgctga

SEQ ID NO: 687570 - DNA, 20 bp, Artificial
  CRISPR gRNA sequence
cccaaatctcatgctgaatg

SEQ ID NO: 687571 - DNA, 20 bp, Artificial
  CRISPR gRNA sequence
atgctgaatggtaatcccca

SEQ ID NO: 687572 - DNA, 20 bp, Artificial
  CRISPR gRNA sequence
aatggtaatccccagtattc

SEQ ID NO: 687573 - DNA, 20 bp, Artificial
  CRISPR gRNA sequence
gaggtggagcctggtgggag

SEQ ID NO: 687574 - DNA, 20 bp, Artificial
  CRISPR gRNA sequence
gtgggaggtgattggatcat

SEQ ID NO: 687575 - DNA, 20 bp, Artificial
  CRISPR gRNA sequence
gatcatgggggtgagttcat

SEQ ID NO: 687576 - DNA, 20 bp, Artificial
  CRISPR gRNA sequence
atcatgaatggtttagcacc

SEQ ID NO: 687577 - DNA, 20 bp, Artificial
  CRISPR gRNA sequence
agcaccatctctttgatgct

SEQ ID NO: 687578 - DNA, 20 bp, Artificial
  CRISPR gRNA sequence
gcaccatctctttgatgctg

SEQ ID NO: 687579 - DNA, 20 bp, Artificial
  CRISPR gRNA sequence
tttgatgctgtccttgcaat

SEQ ID NO: 687580 - DNA, 20 bp, Artificial
  CRISPR gRNA sequence
tgatgctgtccttgcaatag

SEQ ID NO: 687581 - DNA, 20 bp, Artificial
  CRISPR gRNA sequence
gatgctgtccttgcaatagt

SEQ ID NO: 687582 - DNA, 20 bp, Artificial
  CRISPR gRNA sequence
atgctgtccttgcaatagtg

SEQ ID NO: 687583 - DNA, 20 bp, Artificial
  CRISPR gRNA sequence
tccttgcaatagtgagtgac

SEQ ID NO: 687584 - DNA, 20 bp, Artificial
  CRISPR gRNA sequence
gcaatagtgagtgacttctc

SEQ ID NO: 687585 - DNA, 20 bp, Artificial
  CRISPR gRNA sequence
caatagtgagtgacttctca

SEQ ID NO: 687586 - DNA, 20 bp, Artificial
  CRISPR gRNA sequence
ctcatgagatctggctgttt

SEQ ID NO: 687587 - DNA, 20 bp, Artificial
  CRISPR gRNA sequence
tcatgagatctggctgtttc

SEQ ID NO: 687588 - DNA, 20 bp, Artificial
  CRISPR gRNA sequence
atgagatctggctgtttcag

SEQ ID NO: 687589 - DNA, 20 bp, Artificial
  CRISPR gRNA sequence
gctgtttcagtgtggcacct

SEQ ID NO: 687590 - DNA, 20 bp, Artificial
  CRISPR gRNA sequence
tttcagtgtggcacctctct

SEQ ID NO: 687591 - DNA, 20 bp, Artificial
  CRISPR gRNA sequence
cagtgtggcacctctctctc

SEQ ID NO: 687592 - DNA, 20 bp, Artificial
  CRISPR gRNA sequence
agtgtggcacctctctctcg

SEQ ID NO: 687593 - DNA, 20 bp, Artificial
  CRISPR gRNA sequence
tctctcgctcctgcttttac

SEQ ID NO: 687594 - DNA, 20 bp, Artificial
  CRISPR gRNA sequence
tctcgctcctgcttttactg

SEQ ID NO: 687595 - DNA, 20 bp, Artificial
  CRISPR gRNA sequence
tcgctcctgcttttactgtg

SEQ ID NO: 687596 - DNA, 20 bp, Artificial
  CRISPR gRNA sequence
gctcctgcttttactgtgtg

SEQ ID NO: 687597 - DNA, 20 bp, Artificial
  CRISPR gRNA sequence
ctgcttttactgtgtgaagt

SEQ ID NO: 687598 - DNA, 20 bp, Artificial
  CRISPR gRNA sequence
cttttactgtgtgaagtgcc

SEQ ID NO: 687599 - DNA, 20 bp, Artificial
  CRISPR gRNA sequence
ttactgtgtgaagtgcctgc

SEQ ID NO: 687600 - DNA, 20 bp, Artificial
  CRISPR gRNA sequence
tactgtgtgaagtgcctgcc

SEQ ID NO: 687601 - DNA, 20 bp, Artificial
  CRISPR gRNA sequence
actgtgtgaagtgcctgcct

SEQ ID NO: 687602 - DNA, 20 bp, Artificial
  CRISPR gRNA sequence
ctgtgtgaagtgcctgcctt

SEQ ID NO: 687603 - DNA, 20 bp, Artificial
  CRISPR gRNA sequence
tgtgaagtgcctgcctttgc

SEQ ID NO: 687604 - DNA, 20 bp, Artificial
  CRISPR gRNA sequence
cctttgctttgccttctgcc

SEQ ID NO: 687605 - DNA, 20 bp, Artificial
  CRISPR gRNA sequence
tgctttgccttctgccatga

SEQ ID NO: 687606 - DNA, 20 bp, Artificial
  CRISPR gRNA sequence
gctttgccttctgccatgag

SEQ ID NO: 687607 - DNA, 20 bp, Artificial
  CRISPR gRNA sequence
ctttgccttctgccatgagt

SEQ ID NO: 687608 - DNA, 20 bp, Artificial
  CRISPR gRNA sequence
tgccttctgccatgagtaaa

SEQ ID NO: 687609 - DNA, 20 bp, Artificial
  CRISPR gRNA sequence
gccttctgccatgagtaaag

SEQ ID NO: 687610 - DNA, 20 bp, Artificial
  CRISPR gRNA sequence
ccttctgccatgagtaaagc

SEQ ID NO: 687611 - DNA, 20 bp, Artificial
  CRISPR gRNA sequence
ctgccatgagtaaagctcct

SEQ ID NO: 687612 - DNA, 20 bp, Artificial
  CRISPR gRNA sequence
tgccatgagtaaagctcctg

SEQ ID NO: 687613 - DNA, 20 bp, Artificial
  CRISPR gRNA sequence
ccatgagtaaagctcctgag

SEQ ID NO: 687614 - DNA, 20 bp, Artificial
  CRISPR gRNA sequence
ctgaggtgtccccagaagca

SEQ ID NO: 687615 - DNA, 20 bp, Artificial
  CRISPR gRNA sequence
aggtgtccccagaagcagat

SEQ ID NO: 687616 - DNA, 20 bp, Artificial
  CRISPR gRNA sequence
cccatacagcctgcagaact

SEQ ID NO: 687617 - DNA, 20 bp, Artificial
  CRISPR gRNA sequence
ccatacagcctgcagaactg

SEQ ID NO: 687618 - DNA, 20 bp, Artificial
  CRISPR gRNA sequence
cagaactgtgagccaattaa

SEQ ID NO: 687619 - DNA, 20 bp, Artificial
  CRISPR gRNA sequence
tgagccaattaaacctcttt

SEQ ID NO: 687620 - DNA, 20 bp, Artificial
  CRISPR gRNA sequence
aacctcttttcatataaatc

SEQ ID NO: 687621 - DNA, 20 bp, Artificial
  CRISPR gRNA sequence
ttttcatataaatcacccag

SEQ ID NO: 687622 - DNA, 20 bp, Artificial
  CRISPR gRNA sequence
ttcatataaatcacccagtc

SEQ ID NO: 687623 - DNA, 20 bp, Artificial
  CRISPR gRNA sequence
tcatataaatcacccagtct

SEQ ID NO: 687624 - DNA, 20 bp, Artificial
  CRISPR gRNA sequence
catataaatcacccagtctc

SEQ ID NO: 687625 - DNA, 20 bp, Artificial
  CRISPR gRNA sequence
atataaatcacccagtctca

SEQ ID NO: 687626 - DNA, 20 bp, Artificial
  CRISPR gRNA sequence
aggtatttctttatatcaat

SEQ ID NO: 687627 - DNA, 20 bp, Artificial
  CRISPR gRNA sequence
ctttatatcaatgcaagaat

SEQ ID NO: 687628 - DNA, 20 bp, Artificial
  CRISPR gRNA sequence
tttatatcaatgcaagaatg

SEQ ID NO: 687629 - DNA, 20 bp, Artificial
  CRISPR gRNA sequence
tatatcaatgcaagaatggc

SEQ ID NO: 687630 - DNA, 20 bp, Artificial
  CRISPR gRNA sequence
atatcaatgcaagaatggcc

SEQ ID NO: 687631 - DNA, 20 bp, Artificial
  CRISPR gRNA sequence
tatcaatgcaagaatggcct

SEQ ID NO: 687632 - DNA, 20 bp, Artificial
  CRISPR gRNA sequence
acaaatgtcttattataaag

SEQ ID NO: 687633 - DNA, 20 bp, Artificial
  CRISPR gRNA sequence
attataaagtagcacctagg

SEQ ID NO: 687634 - DNA, 20 bp, Artificial
  CRISPR gRNA sequence
ttataaagtagcacctagga

SEQ ID NO: 687635 - DNA, 20 bp, Artificial
  CRISPR gRNA sequence
taaagtagcacctaggattt

SEQ ID NO: 687636 - DNA, 20 bp, Artificial
  CRISPR gRNA sequence
ggattttctcactgaaatgg

SEQ ID NO: 687637 - DNA, 20 bp, Artificial
  CRISPR gRNA sequence
tctcactgaaatggcagtag

SEQ ID NO: 687638 - DNA, 20 bp, Artificial
  CRISPR gRNA sequence
ctcactgaaatggcagtagt

SEQ ID NO: 687639 - DNA, 20 bp, Artificial
  CRISPR gRNA sequence
tcactgaaatggcagtagtt

SEQ ID NO: 687640 - DNA, 20 bp, Artificial
  CRISPR gRNA sequence
actgaaatggcagtagtttg

SEQ ID NO: 687641 - DNA, 20 bp, Artificial
  CRISPR gRNA sequence
aaatggcagtagtttgatac

SEQ ID NO: 687642 - DNA, 20 bp, Artificial
  CRISPR gRNA sequence
gatacttcccctttttgttc

SEQ ID NO: 687643 - DNA, 20 bp, Artificial
  CRISPR gRNA sequence
atacttcccctttttgttca

SEQ ID NO: 687644 - DNA, 20 bp, Artificial
  CRISPR gRNA sequence
cccctttttgttcactttac

SEQ ID NO: 687645 - DNA, 20 bp, Artificial
  CRISPR gRNA sequence
ccctttttgttcactttacc

SEQ ID NO: 687646 - DNA, 20 bp, Artificial
  CRISPR gRNA sequence
tttgttcactttaccaccct

SEQ ID NO: 687647 - DNA, 20 bp, Artificial
  CRISPR gRNA sequence
ttgttcactttaccaccctc

SEQ ID NO: 687648 - DNA, 20 bp, Artificial
  CRISPR gRNA sequence
tgttcactttaccaccctcg

SEQ ID NO: 687649 - DNA, 20 bp, Artificial
  CRISPR gRNA sequence
gttcactttaccaccctcgc

SEQ ID NO: 687650 - DNA, 20 bp, Artificial
  CRISPR gRNA sequence
ttcactttaccaccctcgct

SEQ ID NO: 687651 - DNA, 20 bp, Artificial
  CRISPR gRNA sequence
actttaccaccctcgctaac

SEQ ID NO: 687652 - DNA, 20 bp, Artificial
  CRISPR gRNA sequence
taccaccctcgctaacaaaa

SEQ ID NO: 687653 - DNA, 20 bp, Artificial
  CRISPR gRNA sequence
accaccctcgctaacaaaat

SEQ ID NO: 687654 - DNA, 20 bp, Artificial
  CRISPR gRNA sequence
ccaccctcgctaacaaaatg

SEQ ID NO: 687655 - DNA, 20 bp, Artificial
  CRISPR gRNA sequence
gctaacaaaatgagtgttca

SEQ ID NO: 687656 - DNA, 20 bp, Artificial
  CRISPR gRNA sequence
acaaaatgagtgttcattat

SEQ ID NO: 687657 - DNA, 20 bp, Artificial
  CRISPR gRNA sequence
attatgaccagaaaaaggta

SEQ ID NO: 687658 - DNA, 20 bp, Artificial
  CRISPR gRNA sequence
tgaccagaaaaaggtataga

SEQ ID NO: 687659 - DNA, 20 bp, Artificial
  CRISPR gRNA sequence
acaacatgtaatgcaagtta

SEQ ID NO: 687660 - DNA, 20 bp, Artificial
  CRISPR gRNA sequence
caacatgtaatgcaagttat

SEQ ID NO: 687661 - DNA, 20 bp, Artificial
  CRISPR gRNA sequence
taaaagagcacaaaagaaca

SEQ ID NO: 687662 - DNA, 20 bp, Artificial
  CRISPR gRNA sequence
agtttacggttgttggtgca

SEQ ID NO: 687663 - DNA, 20 bp, Artificial
  CRISPR gRNA sequence
acggttgttggtgcatttcc

SEQ ID NO: 687664 - DNA, 20 bp, Artificial
  CRISPR gRNA sequence
cggttgttggtgcatttcct

SEQ ID NO: 687665 - DNA, 20 bp, Artificial
  CRISPR gRNA sequence
ttggtgcatttcctttcaca

SEQ ID NO: 687666 - DNA, 20 bp, Artificial
  CRISPR gRNA sequence
gtgcatttcctttcacatac

SEQ ID NO: 687667 - DNA, 20 bp, Artificial
  CRISPR gRNA sequence
cctttcacatacagtgacac

SEQ ID NO: 687668 - DNA, 20 bp, Artificial
  CRISPR gRNA sequence
ctttcacatacagtgacaca

SEQ ID NO: 687669 - DNA, 20 bp, Artificial
  CRISPR gRNA sequence
tcacatacagtgacacagag

SEQ ID NO: 687670 - DNA, 20 bp, Artificial
  CRISPR gRNA sequence
cacatacagtgacacagagg

SEQ ID NO: 687671 - DNA, 20 bp, Artificial
  CRISPR gRNA sequence
acatacagtgacacagaggg

SEQ ID NO: 687672 - DNA, 20 bp, Artificial
  CRISPR gRNA sequence
ataaagttagaaaacaagga

SEQ ID NO: 687673 - DNA, 20 bp, Artificial
  CRISPR gRNA sequence
gaaaacaaggatgaccaaag

SEQ ID NO: 687674 - DNA, 20 bp, Artificial
  CRISPR gRNA sequence
agtgttctagacaaaccaac

SEQ ID NO: 687675 - DNA, 20 bp, Artificial
  CRISPR gRNA sequence
tagacaaaccaacgatagga

SEQ ID NO: 687676 - DNA, 20 bp, Artificial
  CRISPR gRNA sequence
gacaaaccaacgataggagg

SEQ ID NO: 687677 - DNA, 20 bp, Artificial
  CRISPR gRNA sequence
aagcagcagagaagctccca

SEQ ID NO: 687678 - DNA, 20 bp, Artificial
  CRISPR gRNA sequence
agcagcagagaagctcccag

SEQ ID NO: 687679 - DNA, 20 bp, Artificial
  CRISPR gRNA sequence
ccagcaaacaggaacagtct

SEQ ID NO: 687680 - DNA, 20 bp, Artificial
  CRISPR gRNA sequence
caaagatcagacagcaaaca

SEQ ID NO: 687681 - DNA, 20 bp, Artificial
  CRISPR gRNA sequence
tatggcacaggccattccca

SEQ ID NO: 687682 - DNA, 20 bp, Artificial
  CRISPR gRNA sequence
atggcacaggccattcccat

SEQ ID NO: 687683 - DNA, 20 bp, Artificial
  CRISPR gRNA sequence
tggcacaggccattcccatt

SEQ ID NO: 687684 - DNA, 20 bp, Artificial
  CRISPR gRNA sequence
ccattgtcttgatggatctc

SEQ ID NO: 687685 - DNA, 20 bp, Artificial
  CRISPR gRNA sequence
tcttgatggatctcttggaa

SEQ ID NO: 687686 - DNA, 20 bp, Artificial
  CRISPR gRNA sequence
gatggatctcttggaaccac

SEQ ID NO: 687687 - DNA, 20 bp, Artificial
  CRISPR gRNA sequence
atggatctcttggaaccaca

SEQ ID NO: 687688 - DNA, 20 bp, Artificial
  CRISPR gRNA sequence
ttggaaccacactccattct

SEQ ID NO: 687689 - DNA, 20 bp, Artificial
  CRISPR gRNA sequence
ggaaccacactccattctgc

SEQ ID NO: 687690 - DNA, 20 bp, Artificial
  CRISPR gRNA sequence
gaaccacactccattctgct

SEQ ID NO: 687691 - DNA, 20 bp, Artificial
  CRISPR gRNA sequence
cattctgcttacacttgcta

SEQ ID NO: 687692 - DNA, 20 bp, Artificial
  CRISPR gRNA sequence
tgcttacacttgctagagaa

SEQ ID NO: 687693 - DNA, 20 bp, Artificial
  CRISPR gRNA sequence
cttacacttgctagagaaag

SEQ ID NO: 687694 - DNA, 20 bp, Artificial
  CRISPR gRNA sequence
acacttgctagagaaagttc

SEQ ID NO: 687695 - DNA, 20 bp, Artificial
  CRISPR gRNA sequence
cacttgctagagaaagttca

SEQ ID NO: 687696 - DNA, 20 bp, Artificial
  CRISPR gRNA sequence
gctagagaaagttcaggtga

SEQ ID NO: 687697 - DNA, 20 bp, Artificial
  CRISPR gRNA sequence
ctagagaaagttcaggtgat

SEQ ID NO: 687698 - DNA, 20 bp, Artificial
  CRISPR gRNA sequence
gagaaagttcaggtgatcaa

SEQ ID NO: 687699 - DNA, 20 bp, Artificial
  CRISPR gRNA sequence
aggtgatcaaagtctcagaa

SEQ ID NO: 687700 - DNA, 20 bp, Artificial
  CRISPR gRNA sequence
agaaacactccttacttgga

SEQ ID NO: 687701 - DNA, 20 bp, Artificial
  CRISPR gRNA sequence
cttacttggatttttcctac

SEQ ID NO: 687702 - DNA, 20 bp, Artificial
  CRISPR gRNA sequence
acttggatttttcctactta

SEQ ID NO: 687703 - DNA, 20 bp, Artificial
  CRISPR gRNA sequence
cttggatttttcctacttag

SEQ ID NO: 687704 - DNA, 20 bp, Artificial
  CRISPR gRNA sequence
ggatttttcctacttagtct

SEQ ID NO: 687705 - DNA, 20 bp, Artificial
  CRISPR gRNA sequence
gatttttcctacttagtctt

SEQ ID NO: 687706 - DNA, 20 bp, Artificial
  CRISPR gRNA sequence
ttcctacttagtcttacggt

SEQ ID NO: 687707 - DNA, 20 bp, Artificial
  CRISPR gRNA sequence
tcctacttagtcttacggtg

SEQ ID NO: 687708 - DNA, 20 bp, Artificial
  CRISPR gRNA sequence
cctacttagtcttacggtgt

SEQ ID NO: 687709 - DNA, 20 bp, Artificial
  CRISPR gRNA sequence
ctacttagtcttacggtgtg

SEQ ID NO: 687710 - DNA, 20 bp, Artificial
  CRISPR gRNA sequence
cttagtcttacggtgtgcct

SEQ ID NO: 687711 - DNA, 20 bp, Artificial
  CRISPR gRNA sequence
agtcttacggtgtgccttct

SEQ ID NO: 687712 - DNA, 20 bp, Artificial
  CRISPR gRNA sequence
gtcttacggtgtgccttctc

SEQ ID NO: 687713 - DNA, 20 bp, Artificial
  CRISPR gRNA sequence
acggtgtgccttctcaagcc

SEQ ID NO: 687714 - DNA, 20 bp, Artificial
  CRISPR gRNA sequence
cggtgtgccttctcaagcca

SEQ ID NO: 687715 - DNA, 20 bp, Artificial
  CRISPR gRNA sequence
ctcaagccatgcaaattcag

SEQ ID NO: 687716 - DNA, 20 bp, Artificial
  CRISPR gRNA sequence
tcaagccatgcaaattcagg

SEQ ID NO: 687717 - DNA, 20 bp, Artificial
  CRISPR gRNA sequence
aagccatgcaaattcagggc

SEQ ID NO: 687718 - DNA, 20 bp, Artificial
  CRISPR gRNA sequence
agggccagacagtcgtactg

SEQ ID NO: 687719 - DNA, 20 bp, Artificial
  CRISPR gRNA sequence
cagcaataaatcctcttcct

SEQ ID NO: 687720 - DNA, 20 bp, Artificial
  CRISPR gRNA sequence
ttccttcacgtcagctattc

SEQ ID NO: 687721 - DNA, 20 bp, Artificial
  CRISPR gRNA sequence
ccttcacgtcagctattctt

SEQ ID NO: 687722 - DNA, 20 bp, Artificial
  CRISPR gRNA sequence
cttcacgtcagctattctta

SEQ ID NO: 687723 - DNA, 20 bp, Artificial
  CRISPR gRNA sequence
cacgtcagctattcttaaaa

SEQ ID NO: 687724 - DNA, 20 bp, Artificial
  CRISPR gRNA sequence
acgtcagctattcttaaaac

SEQ ID NO: 687725 - DNA, 20 bp, Artificial
  CRISPR gRNA sequence
ttcttaaaaccatgtctaga

SEQ ID NO: 687726 - DNA, 20 bp, Artificial
  CRISPR gRNA sequence
ttaaaaccatgtctagacaa

SEQ ID NO: 687727 - DNA, 20 bp, Artificial
  CRISPR gRNA sequence
aaaaccatgtctagacaagc

SEQ ID NO: 687728 - DNA, 20 bp, Artificial
  CRISPR gRNA sequence
aaaccatgtctagacaagcc

SEQ ID NO: 687729 - DNA, 20 bp, Artificial
  CRISPR gRNA sequence
gacaagccagcccattgctg

SEQ ID NO: 687730 - DNA, 20 bp, Artificial
  CRISPR gRNA sequence
ctgaaactaagaaagcaacc

SEQ ID NO: 687731 - DNA, 20 bp, Artificial
  CRISPR gRNA sequence
aaactaagaaagcaacctgt

SEQ ID NO: 687732 - DNA, 20 bp, Artificial
  CRISPR gRNA sequence
agaaagcaacctgttacttt

SEQ ID NO: 687733 - DNA, 20 bp, Artificial
  CRISPR gRNA sequence
ttacttttaatgcctacttt

SEQ ID NO: 687734 - DNA, 20 bp, Artificial
  CRISPR gRNA sequence
cttttaatgcctactttgca

SEQ ID NO: 687735 - DNA, 20 bp, Artificial
  CRISPR gRNA sequence
ttaatgcctactttgcaggt

SEQ ID NO: 687736 - DNA, 20 bp, Artificial
  CRISPR gRNA sequence
taatgcctactttgcaggtg

SEQ ID NO: 687737 - DNA, 20 bp, Artificial
  CRISPR gRNA sequence
aatgcctactttgcaggtgc

SEQ ID NO: 687738 - DNA, 20 bp, Artificial
  CRISPR gRNA sequence
atgcctactttgcaggtgca

SEQ ID NO: 687739 - DNA, 20 bp, Artificial
  CRISPR gRNA sequence
ctttgcaggtgcaaaccatg

SEQ ID NO: 687740 - DNA, 20 bp, Artificial
  CRISPR gRNA sequence
tgcaggtgcaaaccatgtgc

SEQ ID NO: 687741 - DNA, 20 bp, Artificial
  CRISPR gRNA sequence
gcaggtgcaaaccatgtgca

SEQ ID NO: 687742 - DNA, 20 bp, Artificial
  CRISPR gRNA sequence
caggtgcaaaccatgtgcaa

SEQ ID NO: 687743 - DNA, 20 bp, Artificial
  CRISPR gRNA sequence
tcttcaatataaaaatacct

SEQ ID NO: 687744 - DNA, 20 bp, Artificial
  CRISPR gRNA sequence
ttcaatataaaaataccttt

SEQ ID NO: 687745 - DNA, 20 bp, Artificial
  CRISPR gRNA sequence
caatataaaaatacctttga

SEQ ID NO: 687746 - DNA, 20 bp, Artificial
  CRISPR gRNA sequence
aatataaaaatacctttgat

SEQ ID NO: 687747 - DNA, 20 bp, Artificial
  CRISPR gRNA sequence
tgattttgcccttcctcttg

SEQ ID NO: 687748 - DNA, 20 bp, Artificial
  CRISPR gRNA sequence
gattttgcccttcctcttgt

SEQ ID NO: 687749 - DNA, 20 bp, Artificial
  CRISPR gRNA sequence
attttgcccttcctcttgtt

SEQ ID NO: 687750 - DNA, 20 bp, Artificial
  CRISPR gRNA sequence
tgcccttcctcttgttgaat

SEQ ID NO: 687751 - DNA, 20 bp, Artificial
  CRISPR gRNA sequence
gcccttcctcttgttgaatt

SEQ ID NO: 687752 - DNA, 20 bp, Artificial
  CRISPR gRNA sequence
cccttcctcttgttgaattc

SEQ ID NO: 687753 - DNA, 20 bp, Artificial
  CRISPR gRNA sequence
cctcttgttgaattcttggt

SEQ ID NO: 687754 - DNA, 20 bp, Artificial
  CRISPR gRNA sequence
ctcttgttgaattcttggtt

SEQ ID NO: 687755 - DNA, 20 bp, Artificial
  CRISPR gRNA sequence
ttgttgaattcttggttcac

SEQ ID NO: 687756 - DNA, 20 bp, Artificial
  CRISPR gRNA sequence
gttgaattcttggttcacca

SEQ ID NO: 687757 - DNA, 20 bp, Artificial
  CRISPR gRNA sequence
ttgaattcttggttcaccaa

SEQ ID NO: 687758 - DNA, 20 bp, Artificial
  CRISPR gRNA sequence
aattcttggttcaccaaagt

SEQ ID NO: 687759 - DNA, 20 bp, Artificial
  CRISPR gRNA sequence
ttggttcaccaaagtctgta

SEQ ID NO: 687760 - DNA, 20 bp, Artificial
  CRISPR gRNA sequence
ggttcaccaaagtctgtaat

SEQ ID NO: 687761 - DNA, 20 bp, Artificial
  CRISPR gRNA sequence
gttcaccaaagtctgtaatt

SEQ ID NO: 687762 - DNA, 20 bp, Artificial
  CRISPR gRNA sequence
accaaagtctgtaatttttg

SEQ ID NO: 687763 - DNA, 20 bp, Artificial
  CRISPR gRNA sequence
taatttttgttccattaagc

SEQ ID NO: 687764 - DNA, 20 bp, Artificial
  CRISPR gRNA sequence
ttgttccattaagctgccac

SEQ ID NO: 687765 - DNA, 20 bp, Artificial
  CRISPR gRNA sequence
tgttccattaagctgccaca

SEQ ID NO: 687766 - DNA, 20 bp, Artificial
  CRISPR gRNA sequence
gttccattaagctgccacag

SEQ ID NO: 687767 - DNA, 20 bp, Artificial
  CRISPR gRNA sequence
ttccattaagctgccacagg

SEQ ID NO: 687768 - DNA, 20 bp, Artificial
  CRISPR gRNA sequence
cattaagctgccacaggacg

SEQ ID NO: 687769 - DNA, 20 bp, Artificial
  CRISPR gRNA sequence
agctgccacaggacggcagc

SEQ ID NO: 687770 - DNA, 20 bp, Artificial
  CRISPR gRNA sequence
ccacaggacggcagccaaga

SEQ ID NO: 687771 - DNA, 20 bp, Artificial
  CRISPR gRNA sequence
agtgccttttccaaaacaag

SEQ ID NO: 687772 - DNA, 20 bp, Artificial
  CRISPR gRNA sequence
ttccaaaacaagcagagcaa

SEQ ID NO: 687773 - DNA, 20 bp, Artificial
  CRISPR gRNA sequence
tccaaaacaagcagagcaag

SEQ ID NO: 687774 - DNA, 20 bp, Artificial
  CRISPR gRNA sequence
ccaaaacaagcagagcaagt

SEQ ID NO: 687775 - DNA, 20 bp, Artificial
  CRISPR gRNA sequence
caaaacaagcagagcaagtt

SEQ ID NO: 687776 - DNA, 20 bp, Artificial
  CRISPR gRNA sequence
ggtttgcgttttttcctaga

SEQ ID NO: 687777 - DNA, 20 bp, Artificial
  CRISPR gRNA sequence
gcgttttttcctagagggga

SEQ ID NO: 687778 - DNA, 20 bp, Artificial
  CRISPR gRNA sequence
cgttttttcctagaggggag

SEQ ID NO: 687779 - DNA, 20 bp, Artificial
  CRISPR gRNA sequence
tttcctagaggggagtaagg

SEQ ID NO: 687780 - DNA, 20 bp, Artificial
  CRISPR gRNA sequence
ttcctagaggggagtaagga

SEQ ID NO: 687781 - DNA, 20 bp, Artificial
  CRISPR gRNA sequence
tcctagaggggagtaaggac

SEQ ID NO: 687782 - DNA, 20 bp, Artificial
  CRISPR gRNA sequence
cctagaggggagtaaggaca

SEQ ID NO: 687783 - DNA, 20 bp, Artificial
  CRISPR gRNA sequence
ctagaggggagtaaggacat

SEQ ID NO: 687784 - DNA, 20 bp, Artificial
  CRISPR gRNA sequence
gaggggagtaaggacattca

SEQ ID NO: 687785 - DNA, 20 bp, Artificial
  CRISPR gRNA sequence
accaataaaattaacttctg

SEQ ID NO: 687786 - DNA, 20 bp, Artificial
  CRISPR gRNA sequence
acttctgcgactggcatttt

SEQ ID NO: 687787 - DNA, 20 bp, Artificial
  CRISPR gRNA sequence
ctgcgactggcattttatcc

SEQ ID NO: 687788 - DNA, 20 bp, Artificial
  CRISPR gRNA sequence
tgcgactggcattttatccc

SEQ ID NO: 687789 - DNA, 20 bp, Artificial
  CRISPR gRNA sequence
cgactggcattttatcccat

SEQ ID NO: 687790 - DNA, 20 bp, Artificial
  CRISPR gRNA sequence
gcattttatcccatttaatg

SEQ ID NO: 687791 - DNA, 20 bp, Artificial
  CRISPR gRNA sequence
tatcccatttaatgtaaaaa

SEQ ID NO: 687792 - DNA, 20 bp, Artificial
  CRISPR gRNA sequence
atcccatttaatgtaaaaaa

SEQ ID NO: 687793 - DNA, 20 bp, Artificial
  CRISPR gRNA sequence
tcccatttaatgtaaaaaaa

SEQ ID NO: 687794 - DNA, 20 bp, Artificial
  CRISPR gRNA sequence
aatgtaaaaaaaaaacctta

SEQ ID NO: 687795 - DNA, 20 bp, Artificial
  CRISPR gRNA sequence
atgtaaaaaaaaaaccttac

SEQ ID NO: 687796 - DNA, 20 bp, Artificial
  CRISPR gRNA sequence
actgaacacttagtatgcac

SEQ ID NO: 687797 - DNA, 20 bp, Artificial
  CRISPR gRNA sequence
ctgaacacttagtatgcacc

SEQ ID NO: 687798 - DNA, 20 bp, Artificial
  CRISPR gRNA sequence
aacacttagtatgcacccca

SEQ ID NO: 687799 - DNA, 20 bp, Artificial
  CRISPR gRNA sequence
agtatgcaccccaccaggac

SEQ ID NO: 687800 - DNA, 20 bp, Artificial
  CRISPR gRNA sequence
gtatgcaccccaccaggacc

SEQ ID NO: 687801 - DNA, 20 bp, Artificial
  CRISPR gRNA sequence
cctccctcatctctagcacc

SEQ ID NO: 687802 - DNA, 20 bp, Artificial
  CRISPR gRNA sequence
cctcatctctagcaccttcc

SEQ ID NO: 687803 - DNA, 20 bp, Artificial
  CRISPR gRNA sequence
atctctagcaccttcctctt

SEQ ID NO: 687804 - DNA, 20 bp, Artificial
  CRISPR gRNA sequence
tagcaccttcctctttctat

SEQ ID NO: 687805 - DNA, 20 bp, Artificial
  CRISPR gRNA sequence
gcaccttcctctttctatgt

SEQ ID NO: 687806 - DNA, 20 bp, Artificial
  CRISPR gRNA sequence
cctctttctatgtcctctct

SEQ ID NO: 687807 - DNA, 20 bp, Artificial
  CRISPR gRNA sequence
ctctttctatgtcctctctt

SEQ ID NO: 687808 - DNA, 20 bp, Artificial
  CRISPR gRNA sequence
tttctatgtcctctcttgcc

SEQ ID NO: 687809 - DNA, 20 bp, Artificial
  CRISPR gRNA sequence
tctatgtcctctcttgcctc

SEQ ID NO: 687810 - DNA, 20 bp, Artificial
  CRISPR gRNA sequence
ctatgtcctctcttgcctcc

SEQ ID NO: 687811 - DNA, 20 bp, Artificial
  CRISPR gRNA sequence
tatgtcctctcttgcctcct

SEQ ID NO: 687812 - DNA, 20 bp, Artificial
  CRISPR gRNA sequence
tgtcctctcttgcctcctcc

SEQ ID NO: 687813 - DNA, 20 bp, Artificial
  CRISPR gRNA sequence
tcttgcctcctccctgcttc

SEQ ID NO: 687814 - DNA, 20 bp, Artificial
  CRISPR gRNA sequence
ttgcctcctccctgcttcca

SEQ ID NO: 687815 - DNA, 20 bp, Artificial
  CRISPR gRNA sequence
gcctcctccctgcttccatt

SEQ ID NO: 687816 - DNA, 20 bp, Artificial
  CRISPR gRNA sequence
cctcctccctgcttccatta

SEQ ID NO: 687817 - DNA, 20 bp, Artificial
  CRISPR gRNA sequence
ctccctgcttccattacctt

SEQ ID NO: 687818 - DNA, 20 bp, Artificial
  CRISPR gRNA sequence
cctgcttccattaccttcat

SEQ ID NO: 687819 - DNA, 20 bp, Artificial
  CRISPR gRNA sequence
cttccattaccttcattcac

SEQ ID NO: 687820 - DNA, 20 bp, Artificial
  CRISPR gRNA sequence
ccattaccttcattcaccca

SEQ ID NO: 687821 - DNA, 20 bp, Artificial
  CRISPR gRNA sequence
cattaccttcattcacccag

SEQ ID NO: 687822 - DNA, 20 bp, Artificial
  CRISPR gRNA sequence
ccttcattcacccagctggg

SEQ ID NO: 687823 - DNA, 20 bp, Artificial
  CRISPR gRNA sequence
cattcacccagctgggtttg

SEQ ID NO: 687824 - DNA, 20 bp, Artificial
  CRISPR gRNA sequence
attcacccagctgggtttga

SEQ ID NO: 687825 - DNA, 20 bp, Artificial
  CRISPR gRNA sequence
acccagctgggtttgaagct

SEQ ID NO: 687826 - DNA, 20 bp, Artificial
  CRISPR gRNA sequence
ggtttgaagctcagctccca

SEQ ID NO: 687827 - DNA, 20 bp, Artificial
  CRISPR gRNA sequence
gaagctcagctcccactata

SEQ ID NO: 687828 - DNA, 20 bp, Artificial
  CRISPR gRNA sequence
aagctcagctcccactatat

SEQ ID NO: 687829 - DNA, 20 bp, Artificial
  CRISPR gRNA sequence
agctcccactatattctcat

SEQ ID NO: 687830 - DNA, 20 bp, Artificial
  CRISPR gRNA sequence
ccactatattctcatctgca

SEQ ID NO: 687831 - DNA, 20 bp, Artificial
  CRISPR gRNA sequence
tattctcatctgcatgggaa

SEQ ID NO: 687832 - DNA, 20 bp, Artificial
  CRISPR gRNA sequence
tcatctgcatgggaaactaa

SEQ ID NO: 687833 - DNA, 20 bp, Artificial
  CRISPR gRNA sequence
atctgcatgggaaactaaca

SEQ ID NO: 687834 - DNA, 20 bp, Artificial
  CRISPR gRNA sequence
catgggaaactaacaaggcc

SEQ ID NO: 687835 - DNA, 20 bp, Artificial
  CRISPR gRNA sequence
acaaggccaatgattctgcc

SEQ ID NO: 687836 - DNA, 20 bp, Artificial
  CRISPR gRNA sequence
tgccttcaccaaccccacat

SEQ ID NO: 687837 - DNA, 20 bp, Artificial
  CRISPR gRNA sequence
ccttcaccaaccccacatta

SEQ ID NO: 687838 - DNA, 20 bp, Artificial
  CRISPR gRNA sequence
caccaaccccacattacaaa

SEQ ID NO: 687839 - DNA, 20 bp, Artificial
  CRISPR gRNA sequence
accaaccccacattacaaag

SEQ ID NO: 687840 - DNA, 20 bp, Artificial
  CRISPR gRNA sequence
caaaggatttctagtaaaag

SEQ ID NO: 687841 - DNA, 20 bp, Artificial
  CRISPR gRNA sequence
ctagtaaaaggattgccctc

SEQ ID NO: 687842 - DNA, 20 bp, Artificial
  CRISPR gRNA sequence
tagtaaaaggattgccctct

SEQ ID NO: 687843 - DNA, 20 bp, Artificial
  CRISPR gRNA sequence
gtaaaaggattgccctctac

SEQ ID NO: 687844 - DNA, 20 bp, Artificial
  CRISPR gRNA sequence
ccctctactagaaattagag

SEQ ID NO: 687845 - DNA, 20 bp, Artificial
  CRISPR gRNA sequence
tactagaaattagagtttct

SEQ ID NO: 687846 - DNA, 20 bp, Artificial
  CRISPR gRNA sequence
ctagaaattagagtttcttt

SEQ ID NO: 687847 - DNA, 20 bp, Artificial
  CRISPR gRNA sequence
gaaattagagtttctttcca

SEQ ID NO: 687848 - DNA, 20 bp, Artificial
  CRISPR gRNA sequence
gagtttctttccaactgccc

SEQ ID NO: 687849 - DNA, 20 bp, Artificial
  CRISPR gRNA sequence
ctttccaactgccctcttcc

SEQ ID NO: 687850 - DNA, 20 bp, Artificial
  CRISPR gRNA sequence
tttccaactgccctcttcca

SEQ ID NO: 687851 - DNA, 20 bp, Artificial
  CRISPR gRNA sequence
tccaactgccctcttccaca

SEQ ID NO: 687852 - DNA, 20 bp, Artificial
  CRISPR gRNA sequence
ccaactgccctcttccacat

SEQ ID NO: 687853 - DNA, 20 bp, Artificial
  CRISPR gRNA sequence
caactgccctcttccacatc

SEQ ID NO: 687854 - DNA, 20 bp, Artificial
  CRISPR gRNA sequence
ccctcttccacatctttcta

SEQ ID NO: 687855 - DNA, 20 bp, Artificial
  CRISPR gRNA sequence
ttccacatctttctacagaa

SEQ ID NO: 687856 - DNA, 20 bp, Artificial
  CRISPR gRNA sequence
ccacatctttctacagaact

SEQ ID NO: 687857 - DNA, 20 bp, Artificial
  CRISPR gRNA sequence
cacatctttctacagaactc

SEQ ID NO: 687858 - DNA, 20 bp, Artificial
  CRISPR gRNA sequence
tctacagaactctcttcatc

SEQ ID NO: 687859 - DNA, 20 bp, Artificial
  CRISPR gRNA sequence
ctacagaactctcttcatct

SEQ ID NO: 687860 - DNA, 20 bp, Artificial
  CRISPR gRNA sequence
tacagaactctcttcatctc

SEQ ID NO: 687861 - DNA, 20 bp, Artificial
  CRISPR gRNA sequence
cagaactctcttcatctctc

SEQ ID NO: 687862 - DNA, 20 bp, Artificial
  CRISPR gRNA sequence
tcttcatctctccataagct

SEQ ID NO: 687863 - DNA, 20 bp, Artificial
  CRISPR gRNA sequence
ttcatctctccataagctac

SEQ ID NO: 687864 - DNA, 20 bp, Artificial
  CRISPR gRNA sequence
catctctccataagctactt

SEQ ID NO: 687865 - DNA, 20 bp, Artificial
  CRISPR gRNA sequence
atctctccataagctacttt

SEQ ID NO: 687866 - DNA, 20 bp, Artificial
  CRISPR gRNA sequence
tccataagctactttgaaga

SEQ ID NO: 687867 - DNA, 20 bp, Artificial
  CRISPR gRNA sequence
cataagctactttgaagata

SEQ ID NO: 687868 - DNA, 20 bp, Artificial
  CRISPR gRNA sequence
ctttgaagataaacatgttt

SEQ ID NO: 687869 - DNA, 20 bp, Artificial
  CRISPR gRNA sequence
tgaagataaacatgttttac

SEQ ID NO: 687870 - DNA, 20 bp, Artificial
  CRISPR gRNA sequence
gaagataaacatgttttacc

SEQ ID NO: 687871 - DNA, 20 bp, Artificial
  CRISPR gRNA sequence
aagataaacatgttttaccg

SEQ ID NO: 687872 - DNA, 20 bp, Artificial
  CRISPR gRNA sequence
taccggatctggctaccatt

SEQ ID NO: 687873 - DNA, 20 bp, Artificial
  CRISPR gRNA sequence
accggatctggctaccattg

SEQ ID NO: 687874 - DNA, 20 bp, Artificial
  CRISPR gRNA sequence
ccggatctggctaccattgc

SEQ ID NO: 687875 - DNA, 20 bp, Artificial
  CRISPR gRNA sequence
gctaccattgcccagaatga

SEQ ID NO: 687876 - DNA, 20 bp, Artificial
  CRISPR gRNA sequence
ccattgcccagaatgaacac

SEQ ID NO: 687877 - DNA, 20 bp, Artificial
  CRISPR gRNA sequence
cccagaatgaacaccctgca

SEQ ID NO: 687878 - DNA, 20 bp, Artificial
  CRISPR gRNA sequence
caggtctccatcccaagctc

SEQ ID NO: 687879 - DNA, 20 bp, Artificial
  CRISPR gRNA sequence
catcccaagctctgggatag

SEQ ID NO: 687880 - DNA, 20 bp, Artificial
  CRISPR gRNA sequence
tgggatagagatgaagatga

SEQ ID NO: 687881 - DNA, 20 bp, Artificial
  CRISPR gRNA sequence
ggatagagatgaagatgaaa

SEQ ID NO: 687882 - DNA, 20 bp, Artificial
  CRISPR gRNA sequence
gatgcatacatgaaagcatc

SEQ ID NO: 687883 - DNA, 20 bp, Artificial
  CRISPR gRNA sequence
caaagtacaataaacaaatg

SEQ ID NO: 687884 - DNA, 20 bp, Artificial
  CRISPR gRNA sequence
caattgctgtgtccctgttc

SEQ ID NO: 687885 - DNA, 20 bp, Artificial
  CRISPR gRNA sequence
ctgtgtccctgttcccaata

SEQ ID NO: 687886 - DNA, 20 bp, Artificial
  CRISPR gRNA sequence
tgtccctgttcccaatatta

SEQ ID NO: 687887 - DNA, 20 bp, Artificial
  CRISPR gRNA sequence
ttcccaatattagcaaatgc

SEQ ID NO: 687888 - DNA, 20 bp, Artificial
  CRISPR gRNA sequence
ccaatattagcaaatgcttg

SEQ ID NO: 687889 - DNA, 20 bp, Artificial
  CRISPR gRNA sequence
gcaaatgcttggggcaggtg

SEQ ID NO: 687890 - DNA, 20 bp, Artificial
  CRISPR gRNA sequence
ggggcaggtgctttcaggga

SEQ ID NO: 687891 - DNA, 20 bp, Artificial
  CRISPR gRNA sequence
gggcaggtgctttcagggat

SEQ ID NO: 687892 - DNA, 20 bp, Artificial
  CRISPR gRNA sequence
tcagggatgtcacctcactt

SEQ ID NO: 687893 - DNA, 20 bp, Artificial
  CRISPR gRNA sequence
cagggatgtcacctcactta

SEQ ID NO: 687894 - DNA, 20 bp, Artificial
  CRISPR gRNA sequence
agggatgtcacctcacttac

SEQ ID NO: 687895 - DNA, 20 bp, Artificial
  CRISPR gRNA sequence
acttactcctcaaggttcct

SEQ ID NO: 687896 - DNA, 20 bp, Artificial
  CRISPR gRNA sequence
actcctcaaggttccttatg

SEQ ID NO: 687897 - DNA, 20 bp, Artificial
  CRISPR gRNA sequence
ctcctcaaggttccttatgc

SEQ ID NO: 687898 - DNA, 20 bp, Artificial
  CRISPR gRNA sequence
ctcaaggttccttatgctaa

SEQ ID NO: 687899 - DNA, 20 bp, Artificial
  CRISPR gRNA sequence
aaggttccttatgctaattg

SEQ ID NO: 687900 - DNA, 20 bp, Artificial
  CRISPR gRNA sequence
cttatgctaattgcctgacc

SEQ ID NO: 687901 - DNA, 20 bp, Artificial
  CRISPR gRNA sequence
atgctaattgcctgacccct

SEQ ID NO: 687902 - DNA, 20 bp, Artificial
  CRISPR gRNA sequence
tgctaattgcctgacccctg

SEQ ID NO: 687903 - DNA, 20 bp, Artificial
  CRISPR gRNA sequence
attgcctgacccctgctaag

SEQ ID NO: 687904 - DNA, 20 bp, Artificial
  CRISPR gRNA sequence
cctgacccctgctaagggaa

SEQ ID NO: 687905 - DNA, 20 bp, Artificial
  CRISPR gRNA sequence
acccctgctaagggaattca

SEQ ID NO: 687906 - DNA, 20 bp, Artificial
  CRISPR gRNA sequence
ctaagggaattcagaacagg

SEQ ID NO: 687907 - DNA, 20 bp, Artificial
  CRISPR gRNA sequence
agggaattcagaacaggggt

SEQ ID NO: 687908 - DNA, 20 bp, Artificial
  CRISPR gRNA sequence
agaacaggggtcatatggaa

SEQ ID NO: 687909 - DNA, 20 bp, Artificial
  CRISPR gRNA sequence
ttccaggcaatatttacagc

SEQ ID NO: 687910 - DNA, 20 bp, Artificial
  CRISPR gRNA sequence
tccaggcaatatttacagca

SEQ ID NO: 687911 - DNA, 20 bp, Artificial
  CRISPR gRNA sequence
ccaggcaatatttacagcat

SEQ ID NO: 687912 - DNA, 20 bp, Artificial
  CRISPR gRNA sequence
caggcaatatttacagcatt

SEQ ID NO: 687913 - DNA, 20 bp, Artificial
  CRISPR gRNA sequence
acagcattctgataaatttt

SEQ ID NO: 687914 - DNA, 20 bp, Artificial
  CRISPR gRNA sequence
cagcattctgataaattttc

SEQ ID NO: 687915 - DNA, 20 bp, Artificial
  CRISPR gRNA sequence
tgataaattttcttaccaat

SEQ ID NO: 687916 - DNA, 20 bp, Artificial
  CRISPR gRNA sequence
ataaattttcttaccaattt

SEQ ID NO: 687917 - DNA, 20 bp, Artificial
  CRISPR gRNA sequence
tcttaccaatttccacttcc

SEQ ID NO: 687918 - DNA, 20 bp, Artificial
  CRISPR gRNA sequence
cttaccaatttccacttcct

SEQ ID NO: 687919 - DNA, 20 bp, Artificial
  CRISPR gRNA sequence
ttaccaatttccacttcctt

SEQ ID NO: 687920 - DNA, 20 bp, Artificial
  CRISPR gRNA sequence
accaatttccacttccttta

SEQ ID NO: 687921 - DNA, 20 bp, Artificial
  CRISPR gRNA sequence
ccaatttccacttcctttat

SEQ ID NO: 687922 - DNA, 20 bp, Artificial
  CRISPR gRNA sequence
ccacttcctttatttcattt

SEQ ID NO: 687923 - DNA, 20 bp, Artificial
  CRISPR gRNA sequence
cacttcctttatttcatttt

SEQ ID NO: 687924 - DNA, 20 bp, Artificial
  CRISPR gRNA sequence
cctttatttcattttgtgca

SEQ ID NO: 687925 - DNA, 20 bp, Artificial
  CRISPR gRNA sequence
ctttatttcattttgtgcag

SEQ ID NO: 687926 - DNA, 20 bp, Artificial
  CRISPR gRNA sequence
tatttcattttgtgcagggg

SEQ ID NO: 687927 - DNA, 20 bp, Artificial
  CRISPR gRNA sequence
atttcattttgtgcaggggc

SEQ ID NO: 687928 - DNA, 20 bp, Artificial
  CRISPR gRNA sequence
tttcattttgtgcaggggct

SEQ ID NO: 687929 - DNA, 20 bp, Artificial
  CRISPR gRNA sequence
cattttgtgcaggggctccg

SEQ ID NO: 687930 - DNA, 20 bp, Artificial
  CRISPR gRNA sequence
attttgtgcaggggctccga

SEQ ID NO: 687931 - DNA, 20 bp, Artificial
  CRISPR gRNA sequence
tgtgcaggggctccgattac

SEQ ID NO: 687932 - DNA, 20 bp, Artificial
  CRISPR gRNA sequence
gtgcaggggctccgattact

SEQ ID NO: 687933 - DNA, 20 bp, Artificial
  CRISPR gRNA sequence
tgcaggggctccgattactg

SEQ ID NO: 687934 - DNA, 20 bp, Artificial
  CRISPR gRNA sequence
cgattactggaaacagagaa

SEQ ID NO: 687935 - DNA, 20 bp, Artificial
  CRISPR gRNA sequence
ctggaaacagagaaaagcct

SEQ ID NO: 687936 - DNA, 20 bp, Artificial
  CRISPR gRNA sequence
gaaacagagaaaagccttgc

SEQ ID NO: 687937 - DNA, 20 bp, Artificial
  CRISPR gRNA sequence
gctcatcttaaagacaaaaa

SEQ ID NO: 687938 - DNA, 20 bp, Artificial
  CRISPR gRNA sequence
ctcatcttaaagacaaaaag

SEQ ID NO: 687939 - DNA, 20 bp, Artificial
  CRISPR gRNA sequence
atcttaaagacaaaaagaaa

SEQ ID NO: 687940 - DNA, 20 bp, Artificial
  CRISPR gRNA sequence
aaagacaaaaagaaatataa

SEQ ID NO: 687941 - DNA, 20 bp, Artificial
  CRISPR gRNA sequence
aagacaaaaagaaatataaa

SEQ ID NO: 687942 - DNA, 20 bp, Artificial
  CRISPR gRNA sequence
ggagagcattgaatgctagt

SEQ ID NO: 687943 - DNA, 20 bp, Artificial
  CRISPR gRNA sequence
aatgctagtcaatataaagc

SEQ ID NO: 687944 - DNA, 20 bp, Artificial
  CRISPR gRNA sequence
gtcaatataaagcttgtatt

SEQ ID NO: 687945 - DNA, 20 bp, Artificial
  CRISPR gRNA sequence
gtattttcatgtttctattc

SEQ ID NO: 687946 - DNA, 20 bp, Artificial
  CRISPR gRNA sequence
tattttcatgtttctattct

SEQ ID NO: 687947 - DNA, 20 bp, Artificial
  CRISPR gRNA sequence
tcatgtttctattctatttc

SEQ ID NO: 687948 - DNA, 20 bp, Artificial
  CRISPR gRNA sequence
catgtttctattctatttca

SEQ ID NO: 687949 - DNA, 20 bp, Artificial
  CRISPR gRNA sequence
atgtttctattctatttcat

SEQ ID NO: 687950 - DNA, 20 bp, Artificial
  CRISPR gRNA sequence
ctattctatttcatagcaat

SEQ ID NO: 687951 - DNA, 20 bp, Artificial
  CRISPR gRNA sequence
tattctatttcatagcaatg

SEQ ID NO: 687952 - DNA, 20 bp, Artificial
  CRISPR gRNA sequence
ttctatttcatagcaatgtt

SEQ ID NO: 687953 - DNA, 20 bp, Artificial
  CRISPR gRNA sequence
tatttcatagcaatgttttt

SEQ ID NO: 687954 - DNA, 20 bp, Artificial
  CRISPR gRNA sequence
tttcatagcaatgtttttca

SEQ ID NO: 687955 - DNA, 20 bp, Artificial
  CRISPR gRNA sequence
catagcaatgtttttcaagt

SEQ ID NO: 687956 - DNA, 20 bp, Artificial
  CRISPR gRNA sequence
atagcaatgtttttcaagtt

SEQ ID NO: 687957 - DNA, 20 bp, Artificial
  CRISPR gRNA sequence
ttcaagttcttctgacaata

SEQ ID NO: 687958 - DNA, 20 bp, Artificial
  CRISPR gRNA sequence
tcaagttcttctgacaataa

SEQ ID NO: 687959 - DNA, 20 bp, Artificial
  CRISPR gRNA sequence
caagttcttctgacaataac

SEQ ID NO: 687960 - DNA, 20 bp, Artificial
  CRISPR gRNA sequence
aagttcttctgacaataacc

SEQ ID NO: 687961 - DNA, 20 bp, Artificial
  CRISPR gRNA sequence
ttctgacaataacccataat

SEQ ID NO: 687962 - DNA, 20 bp, Artificial
  CRISPR gRNA sequence
ctgacaataacccataatga

SEQ ID NO: 687963 - DNA, 20 bp, Artificial
  CRISPR gRNA sequence
tgacaataacccataatgac

SEQ ID NO: 687964 - DNA, 20 bp, Artificial
  CRISPR gRNA sequence
acaataacccataatgacaa

SEQ ID NO: 687965 - DNA, 20 bp, Artificial
  CRISPR gRNA sequence
aaataaaactttcttttatt

SEQ ID NO: 687966 - DNA, 20 bp, Artificial
  CRISPR gRNA sequence
aataaaactttcttttatta

SEQ ID NO: 687967 - DNA, 20 bp, Artificial
  CRISPR gRNA sequence
tcttttattacctatgatgc

SEQ ID NO: 687968 - DNA, 20 bp, Artificial
  CRISPR gRNA sequence
cttttattacctatgatgct

SEQ ID NO: 687969 - DNA, 20 bp, Artificial
  CRISPR gRNA sequence
ttttattacctatgatgctc

SEQ ID NO: 687970 - DNA, 20 bp, Artificial
  CRISPR gRNA sequence
ttattacctatgatgctctt

SEQ ID NO: 687971 - DNA, 20 bp, Artificial
  CRISPR gRNA sequence
tattacctatgatgctcttt

SEQ ID NO: 687972 - DNA, 20 bp, Artificial
  CRISPR gRNA sequence
attacctatgatgctcttta

SEQ ID NO: 687973 - DNA, 20 bp, Artificial
  CRISPR gRNA sequence
ttacctatgatgctctttaa

SEQ ID NO: 687974 - DNA, 20 bp, Artificial
  CRISPR gRNA sequence
cctatgatgctctttaatat

SEQ ID NO: 687975 - DNA, 20 bp, Artificial
  CRISPR gRNA sequence
tgatgctctttaatatcatt

SEQ ID NO: 687976 - DNA, 20 bp, Artificial
  CRISPR gRNA sequence
tttaatatcattattctctg

SEQ ID NO: 687977 - DNA, 20 bp, Artificial
  CRISPR gRNA sequence
taatatcattattctctgat

SEQ ID NO: 687978 - DNA, 20 bp, Artificial
  CRISPR gRNA sequence
aatatcattattctctgata

SEQ ID NO: 687979 - DNA, 20 bp, Artificial
  CRISPR gRNA sequence
atatcattattctctgatat

SEQ ID NO: 687980 - DNA, 20 bp, Artificial
  CRISPR gRNA sequence
ttctctgatatcacttaaac

SEQ ID NO: 687981 - DNA, 20 bp, Artificial
  CRISPR gRNA sequence
tctgatatcacttaaacaaa

SEQ ID NO: 687982 - DNA, 20 bp, Artificial
  CRISPR gRNA sequence
tgatatcacttaaacaaatg

SEQ ID NO: 687983 - DNA, 20 bp, Artificial
  CRISPR gRNA sequence
atatcacttaaacaaatgca

SEQ ID NO: 687984 - DNA, 20 bp, Artificial
  CRISPR gRNA sequence
aaacaaatgcagatccaacc

SEQ ID NO: 687985 - DNA, 20 bp, Artificial
  CRISPR gRNA sequence
aacaaatgcagatccaaccc

SEQ ID NO: 687986 - DNA, 20 bp, Artificial
  CRISPR gRNA sequence
attacatgacctagtagttg

SEQ ID NO: 687987 - DNA, 20 bp, Artificial
  CRISPR gRNA sequence
catgacctagtagttgttag

SEQ ID NO: 687988 - DNA, 20 bp, Artificial
  CRISPR gRNA sequence
gtagttgttagaaaactact

SEQ ID NO: 687989 - DNA, 20 bp, Artificial
  CRISPR gRNA sequence
ttagaaaactactcttctac

SEQ ID NO: 687990 - DNA, 20 bp, Artificial
  CRISPR gRNA sequence
gaaaactactcttctacaga

SEQ ID NO: 687991 - DNA, 20 bp, Artificial
  CRISPR gRNA sequence
ctcttctacagaataagaat

SEQ ID NO: 687992 - DNA, 20 bp, Artificial
  CRISPR gRNA sequence
ttctacagaataagaataag

SEQ ID NO: 687993 - DNA, 20 bp, Artificial
  CRISPR gRNA sequence
ctacagaataagaataagac

SEQ ID NO: 687994 - DNA, 20 bp, Artificial
  CRISPR gRNA sequence
tacagaataagaataagact

SEQ ID NO: 687995 - DNA, 20 bp, Artificial
  CRISPR gRNA sequence
cagaataagaataagactac

SEQ ID NO: 687996 - DNA, 20 bp, Artificial
  CRISPR gRNA sequence
cagagaagatttcaaaagac

SEQ ID NO: 687997 - DNA, 20 bp, Artificial
  CRISPR gRNA sequence
caaaagacccatgaaaataa

SEQ ID NO: 687998 - DNA, 20 bp, Artificial
  CRISPR gRNA sequence
aaaagacccatgaaaataat

SEQ ID NO: 687999 - DNA, 20 bp, Artificial
  CRISPR gRNA sequence
gctcgcagttctccactagg

SEQ ID NO: 688000 - DNA, 20 bp, Artificial
  CRISPR gRNA sequence
ctcgcagttctccactaggg

SEQ ID NO: 688001 - DNA, 20 bp, Artificial
  CRISPR gRNA sequence
gcagttctccactagggtgg

SEQ ID NO: 688002 - DNA, 20 bp, Artificial
  CRISPR gRNA sequence
tccactagggtggcccatcc

SEQ ID NO: 688003 - DNA, 20 bp, Artificial
  CRISPR gRNA sequence
cactagggtggcccatcctc

SEQ ID NO: 688004 - DNA, 20 bp, Artificial
  CRISPR gRNA sequence
gggtggcccatcctcagtga

SEQ ID NO: 688005 - DNA, 20 bp, Artificial
  CRISPR gRNA sequence
agtgaaatcttccccgtacg

SEQ ID NO: 688006 - DNA, 20 bp, Artificial
  CRISPR gRNA sequence
ccccgtacggaattctgact

SEQ ID NO: 688007 - DNA, 20 bp, Artificial
  CRISPR gRNA sequence
cccgtacggaattctgactc

SEQ ID NO: 688008 - DNA, 20 bp, Artificial
  CRISPR gRNA sequence
tgactcctgtgaccactaag

SEQ ID NO: 688009 - DNA, 20 bp, Artificial
  CRISPR gRNA sequence
actcctgtgaccactaaggc

SEQ ID NO: 688010 - DNA, 20 bp, Artificial
  CRISPR gRNA sequence
ctgtgaccactaaggctgaa

SEQ ID NO: 688011 - DNA, 20 bp, Artificial
  CRISPR gRNA sequence
tgaccactaaggctgaaaga

SEQ ID NO: 688012 - DNA, 20 bp, Artificial
  CRISPR gRNA sequence
aggctgaaagacgggcagtg

SEQ ID NO: 688013 - DNA, 20 bp, Artificial
  CRISPR gRNA sequence
aaagacgggcagtgcttatg

SEQ ID NO: 688014 - DNA, 20 bp, Artificial
  CRISPR gRNA sequence
atggagcactgctgcaatcc

SEQ ID NO: 688015 - DNA, 20 bp, Artificial
  CRISPR gRNA sequence
tggagcactgctgcaatcct

SEQ ID NO: 688016 - DNA, 20 bp, Artificial
  CRISPR gRNA sequence
ctgcaatcctccatcccttc

SEQ ID NO: 688017 - DNA, 20 bp, Artificial
  CRISPR gRNA sequence
caatcctccatcccttcatg

SEQ ID NO: 688018 - DNA, 20 bp, Artificial
  CRISPR gRNA sequence
catcccttcatgctcattta

SEQ ID NO: 688019 - DNA, 20 bp, Artificial
  CRISPR gRNA sequence
catgctcatttatttaatga

SEQ ID NO: 688020 - DNA, 20 bp, Artificial
  CRISPR gRNA sequence
atgctcatttatttaatgac

SEQ ID NO: 688021 - DNA, 20 bp, Artificial
  CRISPR gRNA sequence
atttatttaatgacagtgtg

SEQ ID NO: 688022 - DNA, 20 bp, Artificial
  CRISPR gRNA sequence
atttaatgacagtgtgatta

SEQ ID NO: 688023 - DNA, 20 bp, Artificial
  CRISPR gRNA sequence
tttaatgacagtgtgattaa

SEQ ID NO: 688024 - DNA, 20 bp, Artificial
  CRISPR gRNA sequence
aatgacagtgtgattaagga

SEQ ID NO: 688025 - DNA, 20 bp, Artificial
  CRISPR gRNA sequence
atgacagtgtgattaaggac

SEQ ID NO: 688026 - DNA, 20 bp, Artificial
  CRISPR gRNA sequence
aggaccactgtaagggttga

SEQ ID NO: 688027 - DNA, 20 bp, Artificial
  CRISPR gRNA sequence
taagggttgatattaaacag

SEQ ID NO: 688028 - DNA, 20 bp, Artificial
  CRISPR gRNA sequence
atattaaacagaaagaggca

SEQ ID NO: 688029 - DNA, 20 bp, Artificial
  CRISPR gRNA sequence
aacagaaagaggcactgata

SEQ ID NO: 688030 - DNA, 20 bp, Artificial
  CRISPR gRNA sequence
ataggaatgtggtctggtga

SEQ ID NO: 688031 - DNA, 20 bp, Artificial
  CRISPR gRNA sequence
gtgatgcttattttacagcg

SEQ ID NO: 688032 - DNA, 20 bp, Artificial
  CRISPR gRNA sequence
attttacagcggtggagtat

SEQ ID NO: 688033 - DNA, 20 bp, Artificial
  CRISPR gRNA sequence
ttttacagcggtggagtatt

SEQ ID NO: 688034 - DNA, 20 bp, Artificial
  CRISPR gRNA sequence
tacagcggtggagtattgaa

SEQ ID NO: 688035 - DNA, 20 bp, Artificial
  CRISPR gRNA sequence
acagcggtggagtattgaaa

SEQ ID NO: 688036 - DNA, 20 bp, Artificial
  CRISPR gRNA sequence
cagcggtggagtattgaaaa

SEQ ID NO: 688037 - DNA, 20 bp, Artificial
  CRISPR gRNA sequence
aaaaactccaaaaatttgtc

SEQ ID NO: 688038 - DNA, 20 bp, Artificial
  CRISPR gRNA sequence
caaaaatttgtctccaatat

SEQ ID NO: 688039 - DNA, 20 bp, Artificial
  CRISPR gRNA sequence
gtctccaatattgctttgcc

SEQ ID NO: 688040 - DNA, 20 bp, Artificial
  CRISPR gRNA sequence
tctccaatattgctttgccc

SEQ ID NO: 688041 - DNA, 20 bp, Artificial
  CRISPR gRNA sequence
caatattgctttgccctgaa

SEQ ID NO: 688042 - DNA, 20 bp, Artificial
  CRISPR gRNA sequence
ctttgccctgaaaaaactgt

SEQ ID NO: 688043 - DNA, 20 bp, Artificial
  CRISPR gRNA sequence
tgccctgaaaaaactgtcat

SEQ ID NO: 688044 - DNA, 20 bp, Artificial
  CRISPR gRNA sequence
gccctgaaaaaactgtcata

SEQ ID NO: 688045 - DNA, 20 bp, Artificial
  CRISPR gRNA sequence
ccctgaaaaaactgtcatac

SEQ ID NO: 688046 - DNA, 20 bp, Artificial
  CRISPR gRNA sequence
aaaaaactgtcatacgtaaa

SEQ ID NO: 688047 - DNA, 20 bp, Artificial
  CRISPR gRNA sequence
tcatacgtaaaggggctatt

SEQ ID NO: 688048 - DNA, 20 bp, Artificial
  CRISPR gRNA sequence
ttacatctacgtctgtagat

SEQ ID NO: 688049 - DNA, 20 bp, Artificial
  CRISPR gRNA sequence
catctacgtctgtagatcga

SEQ ID NO: 688050 - DNA, 20 bp, Artificial
  CRISPR gRNA sequence
cgtctgtagatcgacttgtg

SEQ ID NO: 688051 - DNA, 20 bp, Artificial
  CRISPR gRNA sequence
tagatcgacttgtgctaagg

SEQ ID NO: 688052 - DNA, 20 bp, Artificial
  CRISPR gRNA sequence
gtgctaaggagaccccaatc

SEQ ID NO: 688053 - DNA, 20 bp, Artificial
  CRISPR gRNA sequence
tgctaaggagaccccaatcc

SEQ ID NO: 688054 - DNA, 20 bp, Artificial
  CRISPR gRNA sequence
aggagaccccaatcctttgt

SEQ ID NO: 688055 - DNA, 20 bp, Artificial
  CRISPR gRNA sequence
tgtagattgataagctatga

SEQ ID NO: 688056 - DNA, 20 bp, Artificial
  CRISPR gRNA sequence
gtagattgataagctatgat

SEQ ID NO: 688057 - DNA, 20 bp, Artificial
  CRISPR gRNA sequence
tagattgataagctatgatt

SEQ ID NO: 688058 - DNA, 20 bp, Artificial
  CRISPR gRNA sequence
ataagctatgattgtgaaat

SEQ ID NO: 688059 - DNA, 20 bp, Artificial
  CRISPR gRNA sequence
tgattgtgaaatctttccct

SEQ ID NO: 688060 - DNA, 20 bp, Artificial
  CRISPR gRNA sequence
tgaaatctttcccttaaata

SEQ ID NO: 688061 - DNA, 20 bp, Artificial
  CRISPR gRNA sequence
tcccttaaataagcttttat

SEQ ID NO: 688062 - DNA, 20 bp, Artificial
  CRISPR gRNA sequence
cccttaaataagcttttata

SEQ ID NO: 688063 - DNA, 20 bp, Artificial
  CRISPR gRNA sequence
ccttaaataagcttttataa

SEQ ID NO: 688064 - DNA, 20 bp, Artificial
  CRISPR gRNA sequence
aaataagcttttataaaatt

SEQ ID NO: 688065 - DNA, 20 bp, Artificial
  CRISPR gRNA sequence
aataagcttttataaaattt

SEQ ID NO: 688066 - DNA, 20 bp, Artificial
  CRISPR gRNA sequence
ttataaaatttaaaataact

SEQ ID NO: 688067 - DNA, 20 bp, Artificial
  CRISPR gRNA sequence
tataaaatttaaaataactt

SEQ ID NO: 688068 - DNA, 20 bp, Artificial
  CRISPR gRNA sequence
ataaaatttaaaataacttg

SEQ ID NO: 688069 - DNA, 20 bp, Artificial
  CRISPR gRNA sequence
taaaatttaaaataacttgg

SEQ ID NO: 688070 - DNA, 20 bp, Artificial
  CRISPR gRNA sequence
aaaataacttggaaaacaca

SEQ ID NO: 688071 - DNA, 20 bp, Artificial
  CRISPR gRNA sequence
aaataacttggaaaacacat

SEQ ID NO: 688072 - DNA, 20 bp, Artificial
  CRISPR gRNA sequence
ggaaaacacatttttagaat

SEQ ID NO: 688073 - DNA, 20 bp, Artificial
  CRISPR gRNA sequence
gaaaacacatttttagaatg

SEQ ID NO: 688074 - DNA, 20 bp, Artificial
  CRISPR gRNA sequence
ttagaatgaagtgacttact

SEQ ID NO: 688075 - DNA, 20 bp, Artificial
  CRISPR gRNA sequence
tagaatgaagtgacttactc

SEQ ID NO: 688076 - DNA, 20 bp, Artificial
  CRISPR gRNA sequence
agaatgaagtgacttactca

SEQ ID NO: 688077 - DNA, 20 bp, Artificial
  CRISPR gRNA sequence
gaatgaagtgacttactcaa

SEQ ID NO: 688078 - DNA, 20 bp, Artificial
  CRISPR gRNA sequence
actcaaggccattgatgatg

SEQ ID NO: 688079 - DNA, 20 bp, Artificial
  CRISPR gRNA sequence
ctcaaggccattgatgatgt

SEQ ID NO: 688080 - DNA, 20 bp, Artificial
  CRISPR gRNA sequence
aaggccattgatgatgttga

SEQ ID NO: 688081 - DNA, 20 bp, Artificial
  CRISPR gRNA sequence
atgatgttgaaagtattgca

SEQ ID NO: 688082 - DNA, 20 bp, Artificial
  CRISPR gRNA sequence
aaagtattgcaaacaaagat

SEQ ID NO: 688083 - DNA, 20 bp, Artificial
  CRISPR gRNA sequence
caaacaaagattaaaaacca

SEQ ID NO: 688084 - DNA, 20 bp, Artificial
  CRISPR gRNA sequence
aaaaccactcgacaacattt

SEQ ID NO: 688085 - DNA, 20 bp, Artificial
  CRISPR gRNA sequence
gacaacatttatgtacacca

SEQ ID NO: 688086 - DNA, 20 bp, Artificial
  CRISPR gRNA sequence
atgtacaccatagtatacca

SEQ ID NO: 688087 - DNA, 20 bp, Artificial
  CRISPR gRNA sequence
tgtacaccatagtataccat

SEQ ID NO: 688088 - DNA, 20 bp, Artificial
  CRISPR gRNA sequence
tcattagactttgaatccaa

SEQ ID NO: 688089 - DNA, 20 bp, Artificial
  CRISPR gRNA sequence
attagactttgaatccaatg

SEQ ID NO: 688090 - DNA, 20 bp, Artificial
  CRISPR gRNA sequence
gactttgaatccaatgagta

SEQ ID NO: 688091 - DNA, 20 bp, Artificial
  CRISPR gRNA sequence
tgaatccaatgagtattact

SEQ ID NO: 688092 - DNA, 20 bp, Artificial
  CRISPR gRNA sequence
gaatccaatgagtattacta

SEQ ID NO: 688093 - DNA, 20 bp, Artificial
  CRISPR gRNA sequence
aatccaatgagtattactaa

SEQ ID NO: 688094 - DNA, 20 bp, Artificial
  CRISPR gRNA sequence
ctaaagattaagctcttttt

SEQ ID NO: 688095 - DNA, 20 bp, Artificial
  CRISPR gRNA sequence
aagattaagctcttttttaa

SEQ ID NO: 688096 - DNA, 20 bp, Artificial
  CRISPR gRNA sequence
agctcttttttaatttgcag

SEQ ID NO: 688097 - DNA, 20 bp, Artificial
  CRISPR gRNA sequence
ttttttaatttgcagaaact

SEQ ID NO: 688098 - DNA, 20 bp, Artificial
  CRISPR gRNA sequence
ttttaatttgcagaaactct

SEQ ID NO: 688099 - DNA, 20 bp, Artificial
  CRISPR gRNA sequence
tttaatttgcagaaactctg

SEQ ID NO: 688100 - DNA, 20 bp, Artificial
  CRISPR gRNA sequence
ttaatttgcagaaactctga

SEQ ID NO: 688101 - DNA, 20 bp, Artificial
  CRISPR gRNA sequence
taatttgcagaaactctgac

SEQ ID NO: 688102 - DNA, 20 bp, Artificial
  CRISPR gRNA sequence
aatttgcagaaactctgaca

SEQ ID NO: 688103 - DNA, 20 bp, Artificial
  CRISPR gRNA sequence
atttgcagaaactctgacac

SEQ ID NO: 688104 - DNA, 20 bp, Artificial
  CRISPR gRNA sequence
gcagaaactctgacaccaaa

SEQ ID NO: 688105 - DNA, 20 bp, Artificial
  CRISPR gRNA sequence
cagaaactctgacaccaaac

SEQ ID NO: 688106 - DNA, 20 bp, Artificial
  CRISPR gRNA sequence
tgacaccaaactagaaaaaa

SEQ ID NO: 688107 - DNA, 20 bp, Artificial
  CRISPR gRNA sequence
acaccaaactagaaaaaaaa

SEQ ID NO: 688108 - DNA, 20 bp, Artificial
  CRISPR gRNA sequence
gaaaaaaaaaaaaaaagctg

SEQ ID NO: 688109 - DNA, 20 bp, Artificial
  CRISPR gRNA sequence
gttttgctctccaaatagtt

SEQ ID NO: 688110 - DNA, 20 bp, Artificial
  CRISPR gRNA sequence
tgctctccaaatagttgtat

SEQ ID NO: 688111 - DNA, 20 bp, Artificial
  CRISPR gRNA sequence
gctctccaaatagttgtatt

SEQ ID NO: 688112 - DNA, 20 bp, Artificial
  CRISPR gRNA sequence
ctctccaaatagttgtattg

SEQ ID NO: 688113 - DNA, 20 bp, Artificial
  CRISPR gRNA sequence
tccaaatagttgtattgcca

SEQ ID NO: 688114 - DNA, 20 bp, Artificial
  CRISPR gRNA sequence
caaatagttgtattgccatt

SEQ ID NO: 688115 - DNA, 20 bp, Artificial
  CRISPR gRNA sequence
tattgccattcaaaaaaagt

SEQ ID NO: 688116 - DNA, 20 bp, Artificial
  CRISPR gRNA sequence
ccattcaaaaaaagtaagtt

SEQ ID NO: 688117 - DNA, 20 bp, Artificial
  CRISPR gRNA sequence
aaaaaaagtaagttaagtta

SEQ ID NO: 688118 - DNA, 20 bp, Artificial
  CRISPR gRNA sequence
agttagcattcagattgctt

SEQ ID NO: 688119 - DNA, 20 bp, Artificial
  CRISPR gRNA sequence
gcattcagattgctttatct

SEQ ID NO: 688120 - DNA, 20 bp, Artificial
  CRISPR gRNA sequence
agattgctttatctttggaa

SEQ ID NO: 688121 - DNA, 20 bp, Artificial
  CRISPR gRNA sequence
ctttatctttggaaaattaa

SEQ ID NO: 688122 - DNA, 20 bp, Artificial
  CRISPR gRNA sequence
tatctttggaaaattaagtc

SEQ ID NO: 688123 - DNA, 20 bp, Artificial
  CRISPR gRNA sequence
atctttggaaaattaagtca

SEQ ID NO: 688124 - DNA, 20 bp, Artificial
  CRISPR gRNA sequence
tctttggaaaattaagtcac

SEQ ID NO: 688125 - DNA, 20 bp, Artificial
  CRISPR gRNA sequence
tggaaaattaagtcacaaaa

SEQ ID NO: 688126 - DNA, 20 bp, Artificial
  CRISPR gRNA sequence
ggaaaattaagtcacaaaaa

SEQ ID NO: 688127 - DNA, 20 bp, Artificial
  CRISPR gRNA sequence
gaaaattaagtcacaaaaaa

SEQ ID NO: 688128 - DNA, 20 bp, Artificial
  CRISPR gRNA sequence
agtcacaaaaaaagaataaa

SEQ ID NO: 688129 - DNA, 20 bp, Artificial
  CRISPR gRNA sequence
tgaattagtaatgtaatttc

SEQ ID NO: 688130 - DNA, 20 bp, Artificial
  CRISPR gRNA sequence
gaattagtaatgtaatttcc

SEQ ID NO: 688131 - DNA, 20 bp, Artificial
  CRISPR gRNA sequence
aattagtaatgtaatttccc

SEQ ID NO: 688132 - DNA, 20 bp, Artificial
  CRISPR gRNA sequence
gtaatgtaatttccccctga

SEQ ID NO: 688133 - DNA, 20 bp, Artificial
  CRISPR gRNA sequence
ccccctgaaatttcttaaat

SEQ ID NO: 688134 - DNA, 20 bp, Artificial
  CRISPR gRNA sequence
cccctgaaatttcttaaatc

SEQ ID NO: 688135 - DNA, 20 bp, Artificial
  CRISPR gRNA sequence
aaatttcttaaatcttgata

SEQ ID NO: 688136 - DNA, 20 bp, Artificial
  CRISPR gRNA sequence
cttaaatcttgatagtgtgt

SEQ ID NO: 688137 - DNA, 20 bp, Artificial
  CRISPR gRNA sequence
ttaaatcttgatagtgtgtt

SEQ ID NO: 688138 - DNA, 20 bp, Artificial
  CRISPR gRNA sequence
aaatcttgatagtgtgttca

SEQ ID NO: 688139 - DNA, 20 bp, Artificial
  CRISPR gRNA sequence
aatcttgatagtgtgttcag

SEQ ID NO: 688140 - DNA, 20 bp, Artificial
  CRISPR gRNA sequence
gatagtgtgttcagaaaacc

SEQ ID NO: 688141 - DNA, 20 bp, Artificial
  CRISPR gRNA sequence
atagtgtgttcagaaaacct

SEQ ID NO: 688142 - DNA, 20 bp, Artificial
  CRISPR gRNA sequence
agaaaacctctttgcgtcat

SEQ ID NO: 688143 - DNA, 20 bp, Artificial
  CRISPR gRNA sequence
tttgcgtcatagttcagaat

SEQ ID NO: 688144 - DNA, 20 bp, Artificial
  CRISPR gRNA sequence
tgcgtcatagttcagaatgt

SEQ ID NO: 688145 - DNA, 20 bp, Artificial
  CRISPR gRNA sequence
gcgtcatagttcagaatgta

SEQ ID NO: 688146 - DNA, 20 bp, Artificial
  CRISPR gRNA sequence
cgtcatagttcagaatgtat

SEQ ID NO: 688147 - DNA, 20 bp, Artificial
  CRISPR gRNA sequence
agaatgtataagataagatg

SEQ ID NO: 688148 - DNA, 20 bp, Artificial
  CRISPR gRNA sequence
ttcccacttcgacttctttc

SEQ ID NO: 688149 - DNA, 20 bp, Artificial
  CRISPR gRNA sequence
ccacttcgacttctttcacg

SEQ ID NO: 688150 - DNA, 20 bp, Artificial
  CRISPR gRNA sequence
cgacttctttcacgtagtat

SEQ ID NO: 688151 - DNA, 20 bp, Artificial
  CRISPR gRNA sequence
gacttctttcacgtagtatt

SEQ ID NO: 688152 - DNA, 20 bp, Artificial
  CRISPR gRNA sequence
ctttcacgtagtattctatc

SEQ ID NO: 688153 - DNA, 20 bp, Artificial
  CRISPR gRNA sequence
tttcacgtagtattctatct

SEQ ID NO: 688154 - DNA, 20 bp, Artificial
  CRISPR gRNA sequence
tcacgtagtattctatctca

SEQ ID NO: 688155 - DNA, 20 bp, Artificial
  CRISPR gRNA sequence
cacgtagtattctatctcat

SEQ ID NO: 688156 - DNA, 20 bp, Artificial
  CRISPR gRNA sequence
acgtagtattctatctcatt

SEQ ID NO: 688157 - DNA, 20 bp, Artificial
  CRISPR gRNA sequence
tatctcattaatgtcagtag

SEQ ID NO: 688158 - DNA, 20 bp, Artificial
  CRISPR gRNA sequence
tctcattaatgtcagtagct

SEQ ID NO: 688159 - DNA, 20 bp, Artificial
  CRISPR gRNA sequence
attaatgtcagtagcttacc

SEQ ID NO: 688160 - DNA, 20 bp, Artificial
  CRISPR gRNA sequence
atgtcagtagcttacccttg

SEQ ID NO: 688161 - DNA, 20 bp, Artificial
  CRISPR gRNA sequence
acccttgaccgtgaaggacc

SEQ ID NO: 688162 - DNA, 20 bp, Artificial
  CRISPR gRNA sequence
cccttgaccgtgaaggacct

SEQ ID NO: 688163 - DNA, 20 bp, Artificial
  CRISPR gRNA sequence
gaccgtgaaggacctggtcg

SEQ ID NO: 688164 - DNA, 20 bp, Artificial
  CRISPR gRNA sequence
accgtgaaggacctggtcgc

SEQ ID NO: 688165 - DNA, 20 bp, Artificial
  CRISPR gRNA sequence
gtcgccgtcacactataatt

SEQ ID NO: 688166 - DNA, 20 bp, Artificial
  CRISPR gRNA sequence
taattggctccattttcatt

SEQ ID NO: 688167 - DNA, 20 bp, Artificial
  CRISPR gRNA sequence
gctccattttcattgtgtat

SEQ ID NO: 688168 - DNA, 20 bp, Artificial
  CRISPR gRNA sequence
cattttcattgtgtataaat

SEQ ID NO: 688169 - DNA, 20 bp, Artificial
  CRISPR gRNA sequence
tcattgtgtataaatttaca

SEQ ID NO: 688170 - DNA, 20 bp, Artificial
  CRISPR gRNA sequence
cattgtgtataaatttacag

SEQ ID NO: 688171 - DNA, 20 bp, Artificial
  CRISPR gRNA sequence
attgtgtataaatttacagg

SEQ ID NO: 688172 - DNA, 20 bp, Artificial
  CRISPR gRNA sequence
tgtataaatttacaggtgta

SEQ ID NO: 688173 - DNA, 20 bp, Artificial
  CRISPR gRNA sequence
acaggtgtaatcacctgcgt

SEQ ID NO: 688174 - DNA, 20 bp, Artificial
  CRISPR gRNA sequence
caggtgtaatcacctgcgtc

SEQ ID NO: 688175 - DNA, 20 bp, Artificial
  CRISPR gRNA sequence
cgtcctcagtcatcacatta

SEQ ID NO: 688176 - DNA, 20 bp, Artificial
  CRISPR gRNA sequence
agtcatcacattatcaatga

SEQ ID NO: 688177 - DNA, 20 bp, Artificial
  CRISPR gRNA sequence
tcaatgaccaaaaatgactt

SEQ ID NO: 688178 - DNA, 20 bp, Artificial
  CRISPR gRNA sequence
gtgcgccctgtaccttgatc

SEQ ID NO: 688179 - DNA, 20 bp, Artificial
  CRISPR gRNA sequence
tgcgccctgtaccttgatcc

SEQ ID NO: 688180 - DNA, 20 bp, Artificial
  CRISPR gRNA sequence
taccttgatccttgaagagc

SEQ ID NO: 688181 - DNA, 20 bp, Artificial
  CRISPR gRNA sequence
gatccttgaagagcctgaca

SEQ ID NO: 688182 - DNA, 20 bp, Artificial
  CRISPR gRNA sequence
atccttgaagagcctgacaa

SEQ ID NO: 688183 - DNA, 20 bp, Artificial
  CRISPR gRNA sequence
gaagagcctgacaattctga

SEQ ID NO: 688184 - DNA, 20 bp, Artificial
  CRISPR gRNA sequence
aagagcctgacaattctgaa

SEQ ID NO: 688185 - DNA, 20 bp, Artificial
  CRISPR gRNA sequence
acaattctgaaataagaaat

SEQ ID NO: 688186 - DNA, 20 bp, Artificial
  CRISPR gRNA sequence
tgaaataagaaattccattt

SEQ ID NO: 688187 - DNA, 20 bp, Artificial
  CRISPR gRNA sequence
aaataagaaattccatttcc

SEQ ID NO: 688188 - DNA, 20 bp, Artificial
  CRISPR gRNA sequence
catttccttctcagtaattc

SEQ ID NO: 688189 - DNA, 20 bp, Artificial
  CRISPR gRNA sequence
ccttctcagtaattcttcac

SEQ ID NO: 688190 - DNA, 20 bp, Artificial
  CRISPR gRNA sequence
cttctcagtaattcttcact

SEQ ID NO: 688191 - DNA, 20 bp, Artificial
  CRISPR gRNA sequence
ctcagtaattcttcactttt

SEQ ID NO: 688192 - DNA, 20 bp, Artificial
  CRISPR gRNA sequence
tcagtaattcttcactttta

SEQ ID NO: 688193 - DNA, 20 bp, Artificial
  CRISPR gRNA sequence
agtaattcttcacttttatt

SEQ ID NO: 688194 - DNA, 20 bp, Artificial
  CRISPR gRNA sequence
ttcacttttatttatttatc

SEQ ID NO: 688195 - DNA, 20 bp, Artificial
  CRISPR gRNA sequence
cacttttatttatttatctg

SEQ ID NO: 688196 - DNA, 20 bp, Artificial
  CRISPR gRNA sequence
acttttatttatttatctgt

SEQ ID NO: 688197 - DNA, 20 bp, Artificial
  CRISPR gRNA sequence
ttatttatttatctgttgac

SEQ ID NO: 688198 - DNA, 20 bp, Artificial
  CRISPR gRNA sequence
tatttatttatctgttgaca

SEQ ID NO: 688199 - DNA, 20 bp, Artificial
  CRISPR gRNA sequence
atttatttatctgttgacag

SEQ ID NO: 688200 - DNA, 20 bp, Artificial
  CRISPR gRNA sequence
tttatttatctgttgacaga

SEQ ID NO: 688201 - DNA, 20 bp, Artificial
  CRISPR gRNA sequence
atttatctgttgacagaatg

SEQ ID NO: 688202 - DNA, 20 bp, Artificial
  CRISPR gRNA sequence
tttatctgttgacagaatgt

SEQ ID NO: 688203 - DNA, 20 bp, Artificial
  CRISPR gRNA sequence
atctgttgacagaatgtttg

SEQ ID NO: 688204 - DNA, 20 bp, Artificial
  CRISPR gRNA sequence
tctgttgacagaatgtttgt

SEQ ID NO: 688205 - DNA, 20 bp, Artificial
  CRISPR gRNA sequence
ttgacagaatgtttgttgcc

SEQ ID NO: 688206 - DNA, 20 bp, Artificial
  CRISPR gRNA sequence
acagaatgtttgttgcctag

SEQ ID NO: 688207 - DNA, 20 bp, Artificial
  CRISPR gRNA sequence
gttgcctaggctggagtgag

SEQ ID NO: 688208 - DNA, 20 bp, Artificial
  CRISPR gRNA sequence
ttgcctaggctggagtgagt

SEQ ID NO: 688209 - DNA, 20 bp, Artificial
  CRISPR gRNA sequence
cctaggctggagtgagtggt

SEQ ID NO: 688210 - DNA, 20 bp, Artificial
  CRISPR gRNA sequence
ggctggagtgagtggtgcaa

SEQ ID NO: 688211 - DNA, 20 bp, Artificial
  CRISPR gRNA sequence
gagtgagtggtgcaatctgg

SEQ ID NO: 688212 - DNA, 20 bp, Artificial
  CRISPR gRNA sequence
ggctcgctgtaacctctgcc

SEQ ID NO: 688213 - DNA, 20 bp, Artificial
  CRISPR gRNA sequence
gctgtaacctctgccttcta

SEQ ID NO: 688214 - DNA, 20 bp, Artificial
  CRISPR gRNA sequence
taacctctgccttctaggtt

SEQ ID NO: 688215 - DNA, 20 bp, Artificial
  CRISPR gRNA sequence
tgccttctaggttcaagtga

SEQ ID NO: 688216 - DNA, 20 bp, Artificial
  CRISPR gRNA sequence
ccttctaggttcaagtgatt

SEQ ID NO: 688217 - DNA, 20 bp, Artificial
  CRISPR gRNA sequence
ctaggttcaagtgattttca

SEQ ID NO: 688218 - DNA, 20 bp, Artificial
  CRISPR gRNA sequence
taggttcaagtgattttcat

SEQ ID NO: 688219 - DNA, 20 bp, Artificial
  CRISPR gRNA sequence
ggttcaagtgattttcatac

SEQ ID NO: 688220 - DNA, 20 bp, Artificial
  CRISPR gRNA sequence
aagtgattttcatacctcag

SEQ ID NO: 688221 - DNA, 20 bp, Artificial
  CRISPR gRNA sequence
tcatacctcagcctcccaag

SEQ ID NO: 688222 - DNA, 20 bp, Artificial
  CRISPR gRNA sequence
catacctcagcctcccaagc

SEQ ID NO: 688223 - DNA, 20 bp, Artificial
  CRISPR gRNA sequence
atacctcagcctcccaagct

SEQ ID NO: 688224 - DNA, 20 bp, Artificial
  CRISPR gRNA sequence
agcctcccaagctgctggga

SEQ ID NO: 688225 - DNA, 20 bp, Artificial
  CRISPR gRNA sequence
ccaagctgctgggattacag

SEQ ID NO: 688226 - DNA, 20 bp, Artificial
  CRISPR gRNA sequence
ctgggattacaggtgtgtgc

SEQ ID NO: 688227 - DNA, 20 bp, Artificial
  CRISPR gRNA sequence
ggattacaggtgtgtgccac

SEQ ID NO: 688228 - DNA, 20 bp, Artificial
  CRISPR gRNA sequence
caggtgtgtgccaccacacc

SEQ ID NO: 688229 - DNA, 20 bp, Artificial
  CRISPR gRNA sequence
atttttatatttttagtaga

SEQ ID NO: 688230 - DNA, 20 bp, Artificial
  CRISPR gRNA sequence
ttatatttttagtagagatg

SEQ ID NO: 688231 - DNA, 20 bp, Artificial
  CRISPR gRNA sequence
tatatttttagtagagatgg

SEQ ID NO: 688232 - DNA, 20 bp, Artificial
  CRISPR gRNA sequence
atatttttagtagagatggg

SEQ ID NO: 688233 - DNA, 20 bp, Artificial
  CRISPR gRNA sequence
tatttttagtagagatgggg

SEQ ID NO: 688234 - DNA, 20 bp, Artificial
  CRISPR gRNA sequence
ttagtagagatggggtttcc

SEQ ID NO: 688235 - DNA, 20 bp, Artificial
  CRISPR gRNA sequence
tagtagagatggggtttcct

SEQ ID NO: 688236 - DNA, 20 bp, Artificial
  CRISPR gRNA sequence
agtagagatggggtttcctc

SEQ ID NO: 688237 - DNA, 20 bp, Artificial
  CRISPR gRNA sequence
gtagagatggggtttcctca

SEQ ID NO: 688238 - DNA, 20 bp, Artificial
  CRISPR gRNA sequence
cctcatgttggccaggctgg

SEQ ID NO: 688239 - DNA, 20 bp, Artificial
  CRISPR gRNA sequence
ctcatgttggccaggctggt

SEQ ID NO: 688240 - DNA, 20 bp, Artificial
  CRISPR gRNA sequence
atgttggccaggctggtctc

SEQ ID NO: 688241 - DNA, 20 bp, Artificial
  CRISPR gRNA sequence
gccaggctggtctcaaactc

SEQ ID NO: 688242 - DNA, 20 bp, Artificial
  CRISPR gRNA sequence
gtctcaaactcctggcctca

SEQ ID NO: 688243 - DNA, 20 bp, Artificial
  CRISPR gRNA sequence
aaactcctggcctcaagtga

SEQ ID NO: 688244 - DNA, 20 bp, Artificial
  CRISPR gRNA sequence
ctggcctcaagtgatctgcc

SEQ ID NO: 688245 - DNA, 20 bp, Artificial
  CRISPR gRNA sequence
gcctcaagtgatctgcctgc

SEQ ID NO: 688246 - DNA, 20 bp, Artificial
  CRISPR gRNA sequence
aagtgatctgcctgccttgg

SEQ ID NO: 688247 - DNA, 20 bp, Artificial
  CRISPR gRNA sequence
cctgccttggcctcccaaag

SEQ ID NO: 688248 - DNA, 20 bp, Artificial
  CRISPR gRNA sequence
ccttggcctcccaaagtgct

SEQ ID NO: 688249 - DNA, 20 bp, Artificial
  CRISPR gRNA sequence
ggcctcccaaagtgctagga

SEQ ID NO: 688250 - DNA, 20 bp, Artificial
  CRISPR gRNA sequence
gcctcccaaagtgctaggat

SEQ ID NO: 688251 - DNA, 20 bp, Artificial
  CRISPR gRNA sequence
ccaaagtgctaggattacag

SEQ ID NO: 688252 - DNA, 20 bp, Artificial
  CRISPR gRNA sequence
ggattacaggcatgagccac

SEQ ID NO: 688253 - DNA, 20 bp, Artificial
  CRISPR gRNA sequence
caggcatgagccactgtgcc

SEQ ID NO: 688254 - DNA, 20 bp, Artificial
  CRISPR gRNA sequence
tgcccggccacttgtgtcta

SEQ ID NO: 688255 - DNA, 20 bp, Artificial
  CRISPR gRNA sequence
gtgtctattttaattgtgta

SEQ ID NO: 688256 - DNA, 20 bp, Artificial
  CRISPR gRNA sequence
tgtctattttaattgtgtaa

SEQ ID NO: 688257 - DNA, 20 bp, Artificial
  CRISPR gRNA sequence
ttttaattgtgtaattttca

SEQ ID NO: 688258 - DNA, 20 bp, Artificial
  CRISPR gRNA sequence
taattgtgtaattttcatct

SEQ ID NO: 688259 - DNA, 20 bp, Artificial
  CRISPR gRNA sequence
aattgtgtaattttcatcta

SEQ ID NO: 688260 - DNA, 20 bp, Artificial
  CRISPR gRNA sequence
attgtgtaattttcatctat

SEQ ID NO: 688261 - DNA, 20 bp, Artificial
  CRISPR gRNA sequence
tgtaattttcatctatttcc

SEQ ID NO: 688262 - DNA, 20 bp, Artificial
  CRISPR gRNA sequence
tcatctatttccttccaaat

SEQ ID NO: 688263 - DNA, 20 bp, Artificial
  CRISPR gRNA sequence
catctatttccttccaaatt

SEQ ID NO: 688264 - DNA, 20 bp, Artificial
  CRISPR gRNA sequence
atctatttccttccaaattt

SEQ ID NO: 688265 - DNA, 20 bp, Artificial
  CRISPR gRNA sequence
tttccttccaaatttcttct

SEQ ID NO: 688266 - DNA, 20 bp, Artificial
  CRISPR gRNA sequence
ccttccaaatttcttcttac

SEQ ID NO: 688267 - DNA, 20 bp, Artificial
  CRISPR gRNA sequence
cttccaaatttcttcttacc

SEQ ID NO: 688268 - DNA, 20 bp, Artificial
  CRISPR gRNA sequence
ccaaatttcttcttacctta

SEQ ID NO: 688269 - DNA, 20 bp, Artificial
  CRISPR gRNA sequence
caaatttcttcttaccttaa

SEQ ID NO: 688270 - DNA, 20 bp, Artificial
  CRISPR gRNA sequence
cttcttaccttaaaccactc

SEQ ID NO: 688271 - DNA, 20 bp, Artificial
  CRISPR gRNA sequence
ttcttaccttaaaccactca

SEQ ID NO: 688272 - DNA, 20 bp, Artificial
  CRISPR gRNA sequence
cttaccttaaaccactcaag

SEQ ID NO: 688273 - DNA, 20 bp, Artificial
  CRISPR gRNA sequence
ttaccttaaaccactcaaga

SEQ ID NO: 688274 - DNA, 20 bp, Artificial
  CRISPR gRNA sequence
accttaaaccactcaagagg

SEQ ID NO: 688275 - DNA, 20 bp, Artificial
  CRISPR gRNA sequence
ccttaaaccactcaagaggt

SEQ ID NO: 688276 - DNA, 20 bp, Artificial
  CRISPR gRNA sequence
aaaccactcaagaggtgctg

SEQ ID NO: 688277 - DNA, 20 bp, Artificial
  CRISPR gRNA sequence
aaccactcaagaggtgctgt

SEQ ID NO: 688278 - DNA, 20 bp, Artificial
  CRISPR gRNA sequence
aagaggtgctgtccagttgt

SEQ ID NO: 688279 - DNA, 20 bp, Artificial
  CRISPR gRNA sequence
tccagttgtagaggtcaatg

SEQ ID NO: 688280 - DNA, 20 bp, Artificial
  CRISPR gRNA sequence
tagaggtcaatggtaggaca

SEQ ID NO: 688281 - DNA, 20 bp, Artificial
  CRISPR gRNA sequence
tggaatttttttctgatcca

SEQ ID NO: 688282 - DNA, 20 bp, Artificial
  CRISPR gRNA sequence
ggaatttttttctgatccag

SEQ ID NO: 688283 - DNA, 20 bp, Artificial
  CRISPR gRNA sequence
gaatttttttctgatccaga

SEQ ID NO: 688284 - DNA, 20 bp, Artificial
  CRISPR gRNA sequence
ttttctgatccagatactgt

SEQ ID NO: 688285 - DNA, 20 bp, Artificial
  CRISPR gRNA sequence
tttctgatccagatactgtt

SEQ ID NO: 688286 - DNA, 20 bp, Artificial
  CRISPR gRNA sequence
ttctgatccagatactgttg

SEQ ID NO: 688287 - DNA, 20 bp, Artificial
  CRISPR gRNA sequence
tctgatccagatactgttga

SEQ ID NO: 688288 - DNA, 20 bp, Artificial
  CRISPR gRNA sequence
ctgatccagatactgttgaa

SEQ ID NO: 688289 - DNA, 20 bp, Artificial
  CRISPR gRNA sequence
tgatccagatactgttgaat

SEQ ID NO: 688290 - DNA, 20 bp, Artificial
  CRISPR gRNA sequence
atccagatactgttgaatac

SEQ ID NO: 688291 - DNA, 20 bp, Artificial
  CRISPR gRNA sequence
ttgaatacatcaaataatct

SEQ ID NO: 688292 - DNA, 20 bp, Artificial
  CRISPR gRNA sequence
aatacatcaaataatctgga

SEQ ID NO: 688293 - DNA, 20 bp, Artificial
  CRISPR gRNA sequence
gaacattgcaatctgattgt

SEQ ID NO: 688294 - DNA, 20 bp, Artificial
  CRISPR gRNA sequence
caatctgattgttttttata

SEQ ID NO: 688295 - DNA, 20 bp, Artificial
  CRISPR gRNA sequence
attgttttttatatatggtg

SEQ ID NO: 688296 - DNA, 20 bp, Artificial
  CRISPR gRNA sequence
ttttttatatatggtgacat

SEQ ID NO: 688297 - DNA, 20 bp, Artificial
  CRISPR gRNA sequence
tttatatatggtgacattcg

SEQ ID NO: 688298 - DNA, 20 bp, Artificial
  CRISPR gRNA sequence
ttatatatggtgacattcgc

SEQ ID NO: 688299 - DNA, 20 bp, Artificial
  CRISPR gRNA sequence
tatatatggtgacattcgca

SEQ ID NO: 688300 - DNA, 20 bp, Artificial
  CRISPR gRNA sequence
atatatggtgacattcgcat

SEQ ID NO: 688301 - DNA, 20 bp, Artificial
  CRISPR gRNA sequence
tatatggtgacattcgcata

SEQ ID NO: 688302 - DNA, 20 bp, Artificial
  CRISPR gRNA sequence
gcatatccagtcctattgaa

SEQ ID NO: 688303 - DNA, 20 bp, Artificial
  CRISPR gRNA sequence
ttgaatgtgggactgttaaa

SEQ ID NO: 688304 - DNA, 20 bp, Artificial
  CRISPR gRNA sequence
aatgtgggactgttaaaata

SEQ ID NO: 688305 - DNA, 20 bp, Artificial
  CRISPR gRNA sequence
ttaaaataagtcagacaatt

SEQ ID NO: 688306 - DNA, 20 bp, Artificial
  CRISPR gRNA sequence
aaataagtcagacaattaaa

SEQ ID NO: 688307 - DNA, 20 bp, Artificial
  CRISPR gRNA sequence
aaagagtcacttagcattgt

SEQ ID NO: 688308 - DNA, 20 bp, Artificial
  CRISPR gRNA sequence
agcattgtgaaataacttaa

SEQ ID NO: 688309 - DNA, 20 bp, Artificial
  CRISPR gRNA sequence
gcattgtgaaataacttaat

SEQ ID NO: 688310 - DNA, 20 bp, Artificial
  CRISPR gRNA sequence
tgaaataacttaatctaaat

SEQ ID NO: 688311 - DNA, 20 bp, Artificial
  CRISPR gRNA sequence
aatctaaattcagcctttac

SEQ ID NO: 688312 - DNA, 20 bp, Artificial
  CRISPR gRNA sequence
atctaaattcagcctttact

SEQ ID NO: 688313 - DNA, 20 bp, Artificial
  CRISPR gRNA sequence
aattcagcctttacttaata

SEQ ID NO: 688314 - DNA, 20 bp, Artificial
  CRISPR gRNA sequence
agcctttacttaatattgct

SEQ ID NO: 688315 - DNA, 20 bp, Artificial
  CRISPR gRNA sequence
tacttaatattgcttttctt

SEQ ID NO: 688316 - DNA, 20 bp, Artificial
  CRISPR gRNA sequence
acttaatattgcttttcttc

SEQ ID NO: 688317 - DNA, 20 bp, Artificial
  CRISPR gRNA sequence
cttaatattgcttttcttct

SEQ ID NO: 688318 - DNA, 20 bp, Artificial
  CRISPR gRNA sequence
aatattgcttttcttcttaa

SEQ ID NO: 688319 - DNA, 20 bp, Artificial
  CRISPR gRNA sequence
atattgcttttcttcttaaa

SEQ ID NO: 688320 - DNA, 20 bp, Artificial
  CRISPR gRNA sequence
cttttcttcttaaaaaccat

SEQ ID NO: 688321 - DNA, 20 bp, Artificial
  CRISPR gRNA sequence
ttcttcttaaaaaccatcaa

SEQ ID NO: 688322 - DNA, 20 bp, Artificial
  CRISPR gRNA sequence
tcttcttaaaaaccatcaat

SEQ ID NO: 688323 - DNA, 20 bp, Artificial
  CRISPR gRNA sequence
cttcttaaaaaccatcaata

SEQ ID NO: 688324 - DNA, 20 bp, Artificial
  CRISPR gRNA sequence
ttcttaaaaaccatcaatat

SEQ ID NO: 688325 - DNA, 20 bp, Artificial
  CRISPR gRNA sequence
cttaaaaaccatcaatatac

SEQ ID NO: 688326 - DNA, 20 bp, Artificial
  CRISPR gRNA sequence
ttaaaaaccatcaatataca

SEQ ID NO: 688327 - DNA, 20 bp, Artificial
  CRISPR gRNA sequence
aaaaaccatcaatatacata

SEQ ID NO: 688328 - DNA, 20 bp, Artificial
  CRISPR gRNA sequence
aaaaccatcaatatacataa

SEQ ID NO: 688329 - DNA, 20 bp, Artificial
  CRISPR gRNA sequence
ttttattatttaaaaataaa

SEQ ID NO: 688330 - DNA, 20 bp, Artificial
  CRISPR gRNA sequence
tattatttaaaaataaacat

SEQ ID NO: 688331 - DNA, 20 bp, Artificial
  CRISPR gRNA sequence
attatttaaaaataaacatt

SEQ ID NO: 688332 - DNA, 20 bp, Artificial
  CRISPR gRNA sequence
ttatttaaaaataaacatta

SEQ ID NO: 688333 - DNA, 20 bp, Artificial
  CRISPR gRNA sequence
tttaaaaataaacattaaaa

SEQ ID NO: 688334 - DNA, 20 bp, Artificial
  CRISPR gRNA sequence
aaaaataaacattaaaatct

SEQ ID NO: 688335 - DNA, 20 bp, Artificial
  CRISPR gRNA sequence
aaaataaacattaaaatcta

SEQ ID NO: 688336 - DNA, 20 bp, Artificial
  CRISPR gRNA sequence
aaatctagagtttaaatact

SEQ ID NO: 688337 - DNA, 20 bp, Artificial
  CRISPR gRNA sequence
gagtttaaatacttttttgt

SEQ ID NO: 688338 - DNA, 20 bp, Artificial
  CRISPR gRNA sequence
aaatacttttttgttacact

SEQ ID NO: 688339 - DNA, 20 bp, Artificial
  CRISPR gRNA sequence
aatacttttttgttacactt

SEQ ID NO: 688340 - DNA, 20 bp, Artificial
  CRISPR gRNA sequence
ttttgttacacttgagctaa

SEQ ID NO: 688341 - DNA, 20 bp, Artificial
  CRISPR gRNA sequence
tttgttacacttgagctaaa

SEQ ID NO: 688342 - DNA, 20 bp, Artificial
  CRISPR gRNA sequence
ttgttacacttgagctaaaa

SEQ ID NO: 688343 - DNA, 20 bp, Artificial
  CRISPR gRNA sequence
tgttacacttgagctaaaaa

SEQ ID NO: 688344 - DNA, 20 bp, Artificial
  CRISPR gRNA sequence
gttacacttgagctaaaaac

SEQ ID NO: 688345 - DNA, 20 bp, Artificial
  CRISPR gRNA sequence
ttacacttgagctaaaaaca

SEQ ID NO: 688346 - DNA, 20 bp, Artificial
  CRISPR gRNA sequence
cacttgagctaaaaacatag

SEQ ID NO: 688347 - DNA, 20 bp, Artificial
  CRISPR gRNA sequence
gagctaaaaacatagccccc

SEQ ID NO: 688348 - DNA, 20 bp, Artificial
  CRISPR gRNA sequence
agctaaaaacatagccccca

SEQ ID NO: 688349 - DNA, 20 bp, Artificial
  CRISPR gRNA sequence
aaaacatagcccccatagta

SEQ ID NO: 688350 - DNA, 20 bp, Artificial
  CRISPR gRNA sequence
acaatgacttcttcaccatt

SEQ ID NO: 688351 - DNA, 20 bp, Artificial
  CRISPR gRNA sequence
cttcaccatttattcataca

SEQ ID NO: 688352 - DNA, 20 bp, Artificial
  CRISPR gRNA sequence
ttcaccatttattcatacac

SEQ ID NO: 688353 - DNA, 20 bp, Artificial
  CRISPR gRNA sequence
caccatttattcatacacta

SEQ ID NO: 688354 - DNA, 20 bp, Artificial
  CRISPR gRNA sequence
accatttattcatacactac

SEQ ID NO: 688355 - DNA, 20 bp, Artificial
  CRISPR gRNA sequence
attcatacactacatctgct

SEQ ID NO: 688356 - DNA, 20 bp, Artificial
  CRISPR gRNA sequence
ttcatacactacatctgctg

SEQ ID NO: 688357 - DNA, 20 bp, Artificial
  CRISPR gRNA sequence
atacactacatctgctgtaa

SEQ ID NO: 688358 - DNA, 20 bp, Artificial
  CRISPR gRNA sequence
catctgctgtaatgctgtaa

SEQ ID NO: 688359 - DNA, 20 bp, Artificial
  CRISPR gRNA sequence
ctgtaatgctgtaatcccag

SEQ ID NO: 688360 - DNA, 20 bp, Artificial
  CRISPR gRNA sequence
taatgctgtaatcccagtgt

SEQ ID NO: 688361 - DNA, 20 bp, Artificial
  CRISPR gRNA sequence
taatcccagtgtaataaaga

SEQ ID NO: 688362 - DNA, 20 bp, Artificial
  CRISPR gRNA sequence
ctatttattcagagtttact

SEQ ID NO: 688363 - DNA, 20 bp, Artificial
  CRISPR gRNA sequence
tttattcagagtttactctg

SEQ ID NO: 688364 - DNA, 20 bp, Artificial
  CRISPR gRNA sequence
attcagagtttactctgtac

SEQ ID NO: 688365 - DNA, 20 bp, Artificial
  CRISPR gRNA sequence
ttcagagtttactctgtacc

SEQ ID NO: 688366 - DNA, 20 bp, Artificial
  CRISPR gRNA sequence
agagtttactctgtaccagt

SEQ ID NO: 688367 - DNA, 20 bp, Artificial
  CRISPR gRNA sequence
actctgtaccagtgatgatg

SEQ ID NO: 688368 - DNA, 20 bp, Artificial
  CRISPR gRNA sequence
ctctgtaccagtgatgatga

SEQ ID NO: 688369 - DNA, 20 bp, Artificial
  CRISPR gRNA sequence
tgtaccagtgatgatgatga

SEQ ID NO: 688370 - DNA, 20 bp, Artificial
  CRISPR gRNA sequence
taccagtgatgatgatgagc

SEQ ID NO: 688371 - DNA, 20 bp, Artificial
  CRISPR gRNA sequence
ttcacacattaccttagttt

SEQ ID NO: 688372 - DNA, 20 bp, Artificial
  CRISPR gRNA sequence
tcacacattaccttagttta

SEQ ID NO: 688373 - DNA, 20 bp, Artificial
  CRISPR gRNA sequence
cacacattaccttagtttat

SEQ ID NO: 688374 - DNA, 20 bp, Artificial
  CRISPR gRNA sequence
acacattaccttagtttatt

SEQ ID NO: 688375 - DNA, 20 bp, Artificial
  CRISPR gRNA sequence
ccttagtttattttcacaat

SEQ ID NO: 688376 - DNA, 20 bp, Artificial
  CRISPR gRNA sequence
agtttattttcacaataatg

SEQ ID NO: 688377 - DNA, 20 bp, Artificial
  CRISPR gRNA sequence
gtttattttcacaataatgc

SEQ ID NO: 688378 - DNA, 20 bp, Artificial
  CRISPR gRNA sequence
attttcacaataatgctttg

SEQ ID NO: 688379 - DNA, 20 bp, Artificial
  CRISPR gRNA sequence
ttttcacaataatgctttga

SEQ ID NO: 688380 - DNA, 20 bp, Artificial
  CRISPR gRNA sequence
tcacaataatgctttgagat

SEQ ID NO: 688381 - DNA, 20 bp, Artificial
  CRISPR gRNA sequence
cacaataatgctttgagatg

SEQ ID NO: 688382 - DNA, 20 bp, Artificial
  CRISPR gRNA sequence
acaataatgctttgagatga

SEQ ID NO: 688383 - DNA, 20 bp, Artificial
  CRISPR gRNA sequence
tgagatgaaatatattatta

SEQ ID NO: 688384 - DNA, 20 bp, Artificial
  CRISPR gRNA sequence
gagatgaaatatattattac

SEQ ID NO: 688385 - DNA, 20 bp, Artificial
  CRISPR gRNA sequence
agatgaaatatattattaca

SEQ ID NO: 688386 - DNA, 20 bp, Artificial
  CRISPR gRNA sequence
ttacattatatgcattttac

SEQ ID NO: 688387 - DNA, 20 bp, Artificial
  CRISPR gRNA sequence
cattatatgcattttacaga

SEQ ID NO: 688388 - DNA, 20 bp, Artificial
  CRISPR gRNA sequence
tatgcattttacagagaagg

SEQ ID NO: 688389 - DNA, 20 bp, Artificial
  CRISPR gRNA sequence
tacagagaaggaaactgaag

SEQ ID NO: 688390 - DNA, 20 bp, Artificial
  CRISPR gRNA sequence
acagagaaggaaactgaagg

SEQ ID NO: 688391 - DNA, 20 bp, Artificial
  CRISPR gRNA sequence
cagagaaggaaactgaaggg

SEQ ID NO: 688392 - DNA, 20 bp, Artificial
  CRISPR gRNA sequence
aagggcagagaagtaacttg

SEQ ID NO: 688393 - DNA, 20 bp, Artificial
  CRISPR gRNA sequence
gctggcatcgcacagttaac

SEQ ID NO: 688394 - DNA, 20 bp, Artificial
  CRISPR gRNA sequence
ctggcatcgcacagttaact

SEQ ID NO: 688395 - DNA, 20 bp, Artificial
  CRISPR gRNA sequence
gcatcgcacagttaactagt

SEQ ID NO: 688396 - DNA, 20 bp, Artificial
  CRISPR gRNA sequence
actagtggcagagcatgaat

SEQ ID NO: 688397 - DNA, 20 bp, Artificial
  CRISPR gRNA sequence
gtggcagagcatgaatttga

SEQ ID NO: 688398 - DNA, 20 bp, Artificial
  CRISPR gRNA sequence
gacacttgtctagtctcaga

SEQ ID NO: 688399 - DNA, 20 bp, Artificial
  CRISPR gRNA sequence
acacttgtctagtctcagac

SEQ ID NO: 688400 - DNA, 20 bp, Artificial
  CRISPR gRNA sequence
gtctagtctcagacctaggc

SEQ ID NO: 688401 - DNA, 20 bp, Artificial
  CRISPR gRNA sequence
tctagtctcagacctaggcc

SEQ ID NO: 688402 - DNA, 20 bp, Artificial
  CRISPR gRNA sequence
gtctcagacctaggccctta

SEQ ID NO: 688403 - DNA, 20 bp, Artificial
  CRISPR gRNA sequence
agacctaggcccttaactaa

SEQ ID NO: 688404 - DNA, 20 bp, Artificial
  CRISPR gRNA sequence
ggcccttaactaatacatcc

SEQ ID NO: 688405 - DNA, 20 bp, Artificial
  CRISPR gRNA sequence
aactaatacatcctgctttt

SEQ ID NO: 688406 - DNA, 20 bp, Artificial
  CRISPR gRNA sequence
actaatacatcctgcttttt

SEQ ID NO: 688407 - DNA, 20 bp, Artificial
  CRISPR gRNA sequence
atacatcctgctttttgatt

SEQ ID NO: 688408 - DNA, 20 bp, Artificial
  CRISPR gRNA sequence
ctttttgatttaattcattt

SEQ ID NO: 688409 - DNA, 20 bp, Artificial
  CRISPR gRNA sequence
tttgatttaattcatttgac

SEQ ID NO: 688410 - DNA, 20 bp, Artificial
  CRISPR gRNA sequence
ttgatttaattcatttgaca

SEQ ID NO: 688411 - DNA, 20 bp, Artificial
  CRISPR gRNA sequence
tgatttaattcatttgacat

SEQ ID NO: 688412 - DNA, 20 bp, Artificial
  CRISPR gRNA sequence
gatttaattcatttgacatt

SEQ ID NO: 688413 - DNA, 20 bp, Artificial
  CRISPR gRNA sequence
atttaattcatttgacattt

SEQ ID NO: 688414 - DNA, 20 bp, Artificial
  CRISPR gRNA sequence
aattcatttgacattttgtg

SEQ ID NO: 688415 - DNA, 20 bp, Artificial
  CRISPR gRNA sequence
attcatttgacattttgtgt

SEQ ID NO: 688416 - DNA, 20 bp, Artificial
  CRISPR gRNA sequence
atttgacattttgtgtgtgc

SEQ ID NO: 688417 - DNA, 20 bp, Artificial
  CRISPR gRNA sequence
gacattttgtgtgtgccaaa

SEQ ID NO: 688418 - DNA, 20 bp, Artificial
  CRISPR gRNA sequence
acattttgtgtgtgccaaat

SEQ ID NO: 688419 - DNA, 20 bp, Artificial
  CRISPR gRNA sequence
tgtgtgtgccaaatacagcc

SEQ ID NO: 688420 - DNA, 20 bp, Artificial
  CRISPR gRNA sequence
gtgtgtgccaaatacagcca

SEQ ID NO: 688421 - DNA, 20 bp, Artificial
  CRISPR gRNA sequence
tgtgtgccaaatacagccac

SEQ ID NO: 688422 - DNA, 20 bp, Artificial
  CRISPR gRNA sequence
aacaatttgtgaacaaaagt

SEQ ID NO: 688423 - DNA, 20 bp, Artificial
  CRISPR gRNA sequence
acaatttgtgaacaaaagta

SEQ ID NO: 688424 - DNA, 20 bp, Artificial
  CRISPR gRNA sequence
gtgaacaaaagtaattaatt

SEQ ID NO: 688425 - DNA, 20 bp, Artificial
  CRISPR gRNA sequence
tgaacaaaagtaattaattt

SEQ ID NO: 688426 - DNA, 20 bp, Artificial
  CRISPR gRNA sequence
atttttaggcacacaatctc

SEQ ID NO: 688427 - DNA, 20 bp, Artificial
  CRISPR gRNA sequence
ttaggcacacaatctcatca

SEQ ID NO: 688428 - DNA, 20 bp, Artificial
  CRISPR gRNA sequence
taggcacacaatctcatcag

SEQ ID NO: 688429 - DNA, 20 bp, Artificial
  CRISPR gRNA sequence
aggcacacaatctcatcagc

SEQ ID NO: 688430 - DNA, 20 bp, Artificial
  CRISPR gRNA sequence
ggcacacaatctcatcagcc

SEQ ID NO: 688431 - DNA, 20 bp, Artificial
  CRISPR gRNA sequence
atcagccttctgtggcttaa

SEQ ID NO: 688432 - DNA, 20 bp, Artificial
  CRISPR gRNA sequence
ctgtggcttaacttgaaggt

SEQ ID NO: 688433 - DNA, 20 bp, Artificial
  CRISPR gRNA sequence
tgtggcttaacttgaaggtt

SEQ ID NO: 688434 - DNA, 20 bp, Artificial
  CRISPR gRNA sequence
tggcttaacttgaaggttag

SEQ ID NO: 688435 - DNA, 20 bp, Artificial
  CRISPR gRNA sequence
aacttgaaggttagaagccc

SEQ ID NO: 688436 - DNA, 20 bp, Artificial
  CRISPR gRNA sequence
acttgaaggttagaagcccc

SEQ ID NO: 688437 - DNA, 20 bp, Artificial
  CRISPR gRNA sequence
gaaggttagaagcccctttt

SEQ ID NO: 688438 - DNA, 20 bp, Artificial
  CRISPR gRNA sequence
aaggttagaagccccttttc

SEQ ID NO: 688439 - DNA, 20 bp, Artificial
  CRISPR gRNA sequence
gaagccccttttcacctact

SEQ ID NO: 688440 - DNA, 20 bp, Artificial
  CRISPR gRNA sequence
ttcacctactagaggccccc

SEQ ID NO: 688441 - DNA, 20 bp, Artificial
  CRISPR gRNA sequence
tcacctactagaggccccct

SEQ ID NO: 688442 - DNA, 20 bp, Artificial
  CRISPR gRNA sequence
cacctactagaggccccctg

SEQ ID NO: 688443 - DNA, 20 bp, Artificial
  CRISPR gRNA sequence
acctactagaggccccctga

SEQ ID NO: 688444 - DNA, 20 bp, Artificial
  CRISPR gRNA sequence
ctagaggccccctgagatgg

SEQ ID NO: 688445 - DNA, 20 bp, Artificial
  CRISPR gRNA sequence
gaggccccctgagatggaaa

SEQ ID NO: 688446 - DNA, 20 bp, Artificial
  CRISPR gRNA sequence
agatggaaaacatccagatt

SEQ ID NO: 688447 - DNA, 20 bp, Artificial
  CRISPR gRNA sequence
ctattttctgtgctagtttg

SEQ ID NO: 688448 - DNA, 20 bp, Artificial
  CRISPR gRNA sequence
ttttctgtgctagtttgttc

SEQ ID NO: 688449 - DNA, 20 bp, Artificial
  CRISPR gRNA sequence
tctgtgctagtttgttctta

SEQ ID NO: 688450 - DNA, 20 bp, Artificial
  CRISPR gRNA sequence
ctgtgctagtttgttcttaa

SEQ ID NO: 688451 - DNA, 20 bp, Artificial
  CRISPR gRNA sequence
tgtgctagtttgttcttaat

SEQ ID NO: 688452 - DNA, 20 bp, Artificial
  CRISPR gRNA sequence
tgctagtttgttcttaattc

SEQ ID NO: 688453 - DNA, 20 bp, Artificial
  CRISPR gRNA sequence
gtttgttcttaattccagcc

SEQ ID NO: 688454 - DNA, 20 bp, Artificial
  CRISPR gRNA sequence
gttcttaattccagccaaaa

SEQ ID NO: 688455 - DNA, 20 bp, Artificial
  CRISPR gRNA sequence
ttcttaattccagccaaaag

SEQ ID NO: 688456 - DNA, 20 bp, Artificial
  CRISPR gRNA sequence
ttaattccagccaaaagtaa

SEQ ID NO: 688457 - DNA, 20 bp, Artificial
  CRISPR gRNA sequence
aattccagccaaaagtaagc

SEQ ID NO: 688458 - DNA, 20 bp, Artificial
  CRISPR gRNA sequence
attccagccaaaagtaagca

SEQ ID NO: 688459 - DNA, 20 bp, Artificial
  CRISPR gRNA sequence
cagccaaaagtaagcaattg

SEQ ID NO: 688460 - DNA, 20 bp, Artificial
  CRISPR gRNA sequence
ctctcagttatcttggtcac

SEQ ID NO: 688461 - DNA, 20 bp, Artificial
  CRISPR gRNA sequence
tcagttatcttggtcactag

SEQ ID NO: 688462 - DNA, 20 bp, Artificial
  CRISPR gRNA sequence
agttatcttggtcactagga

SEQ ID NO: 688463 - DNA, 20 bp, Artificial
  CRISPR gRNA sequence
tcttggtcactaggaaagct

SEQ ID NO: 688464 - DNA, 20 bp, Artificial
  CRISPR gRNA sequence
ggtcactaggaaagctaggt

SEQ ID NO: 688465 - DNA, 20 bp, Artificial
  CRISPR gRNA sequence
gtcactaggaaagctaggtt

SEQ ID NO: 688466 - DNA, 20 bp, Artificial
  CRISPR gRNA sequence
ggaaagctaggtttttctct

SEQ ID NO: 688467 - DNA, 20 bp, Artificial
  CRISPR gRNA sequence
ggtttttctctaagtcagct

SEQ ID NO: 688468 - DNA, 20 bp, Artificial
  CRISPR gRNA sequence
ttctctaagtcagctacaaa

SEQ ID NO: 688469 - DNA, 20 bp, Artificial
  CRISPR gRNA sequence
tctctaagtcagctacaaat

SEQ ID NO: 688470 - DNA, 20 bp, Artificial
  CRISPR gRNA sequence
ctctaagtcagctacaaatc

SEQ ID NO: 688471 - DNA, 20 bp, Artificial
  CRISPR gRNA sequence
tctaagtcagctacaaatca

SEQ ID NO: 688472 - DNA, 20 bp, Artificial
  CRISPR gRNA sequence
taagtcagctacaaatcaat

SEQ ID NO: 688473 - DNA, 20 bp, Artificial
  CRISPR gRNA sequence
agtcagctacaaatcaatcc

SEQ ID NO: 688474 - DNA, 20 bp, Artificial
  CRISPR gRNA sequence
caaatcaatccctgcaactg

SEQ ID NO: 688475 - DNA, 20 bp, Artificial
  CRISPR gRNA sequence
caactgtaaatccaaatagc

SEQ ID NO: 688476 - DNA, 20 bp, Artificial
  CRISPR gRNA sequence
taaatccaaatagctcagaa

SEQ ID NO: 688477 - DNA, 20 bp, Artificial
  CRISPR gRNA sequence
agaatgagctagacctcaac

SEQ ID NO: 688478 - DNA, 20 bp, Artificial
  CRISPR gRNA sequence
gacctcaacctgatagtatt

SEQ ID NO: 688479 - DNA, 20 bp, Artificial
  CRISPR gRNA sequence
aacctgatagtattcctaga

SEQ ID NO: 688480 - DNA, 20 bp, Artificial
  CRISPR gRNA sequence
atagtattcctagaagttta

SEQ ID NO: 688481 - DNA, 20 bp, Artificial
  CRISPR gRNA sequence
ctagaagtttatccaaatca

SEQ ID NO: 688482 - DNA, 20 bp, Artificial
  CRISPR gRNA sequence
gaagtttatccaaatcactt

SEQ ID NO: 688483 - DNA, 20 bp, Artificial
  CRISPR gRNA sequence
atccaaatcacttttattca

SEQ ID NO: 688484 - DNA, 20 bp, Artificial
  CRISPR gRNA sequence
tccaaatcacttttattcaa

SEQ ID NO: 688485 - DNA, 20 bp, Artificial
  CRISPR gRNA sequence
ttattcaaatcattttataa

SEQ ID NO: 688486 - DNA, 20 bp, Artificial
  CRISPR gRNA sequence
tattcaaatcattttataaa

SEQ ID NO: 688487 - DNA, 20 bp, Artificial
  CRISPR gRNA sequence
attcaaatcattttataaat

SEQ ID NO: 688488 - DNA, 20 bp, Artificial
  CRISPR gRNA sequence
ttcaaatcattttataaatt

SEQ ID NO: 688489 - DNA, 20 bp, Artificial
  CRISPR gRNA sequence
aaatcattttataaatttaa

SEQ ID NO: 688490 - DNA, 20 bp, Artificial
  CRISPR gRNA sequence
tataaatttaactgttccag

SEQ ID NO: 688491 - DNA, 20 bp, Artificial
  CRISPR gRNA sequence
ataaatttaactgttccaga

SEQ ID NO: 688492 - DNA, 20 bp, Artificial
  CRISPR gRNA sequence
taaatttaactgttccagaa

SEQ ID NO: 688493 - DNA, 20 bp, Artificial
  CRISPR gRNA sequence
aactgttccagaaaggacta

SEQ ID NO: 688494 - DNA, 20 bp, Artificial
  CRISPR gRNA sequence
actgttccagaaaggactag

SEQ ID NO: 688495 - DNA, 20 bp, Artificial
  CRISPR gRNA sequence
ttccagaaaggactagggaa

SEQ ID NO: 688496 - DNA, 20 bp, Artificial
  CRISPR gRNA sequence
cagaaaggactagggaagga

SEQ ID NO: 688497 - DNA, 20 bp, Artificial
  CRISPR gRNA sequence
gggaaggaatgaaagcaagg

SEQ ID NO: 688498 - DNA, 20 bp, Artificial
  CRISPR gRNA sequence
aggcaatcaaccactgaaga

SEQ ID NO: 688499 - DNA, 20 bp, Artificial
  CRISPR gRNA sequence
aagaaaggggagcagggtga

SEQ ID NO: 688500 - DNA, 20 bp, Artificial
  CRISPR gRNA sequence
ctgcataataccttctgaca

SEQ ID NO: 688501 - DNA, 20 bp, Artificial
  CRISPR gRNA sequence
tgcataataccttctgacaa

SEQ ID NO: 688502 - DNA, 20 bp, Artificial
  CRISPR gRNA sequence
cataataccttctgacaata

SEQ ID NO: 688503 - DNA, 20 bp, Artificial
  CRISPR gRNA sequence
ctgacaatacaggtataaat

SEQ ID NO: 688504 - DNA, 20 bp, Artificial
  CRISPR gRNA sequence
tgacaatacaggtataaata

SEQ ID NO: 688505 - DNA, 20 bp, Artificial
  CRISPR gRNA sequence
acaatacaggtataaatacc

SEQ ID NO: 688506 - DNA, 20 bp, Artificial
  CRISPR gRNA sequence
cagctggtagaaacttcaga

SEQ ID NO: 688507 - DNA, 20 bp, Artificial
  CRISPR gRNA sequence
gtagaaacttcagaagttgg

SEQ ID NO: 688508 - DNA, 20 bp, Artificial
  CRISPR gRNA sequence
cagaagttggcctgaggcaa

SEQ ID NO: 688509 - DNA, 20 bp, Artificial
  CRISPR gRNA sequence
agaagttggcctgaggcaaa

SEQ ID NO: 688510 - DNA, 20 bp, Artificial
  CRISPR gRNA sequence
gcctgaggcaaacacacgat

SEQ ID NO: 688511 - DNA, 20 bp, Artificial
  CRISPR gRNA sequence
aggcaaacacacgatttctt

SEQ ID NO: 688512 - DNA, 20 bp, Artificial
  CRISPR gRNA sequence
ctttcctgagtgggaatact

SEQ ID NO: 688513 - DNA, 20 bp, Artificial
  CRISPR gRNA sequence
tttcctgagtgggaatactt

SEQ ID NO: 688514 - DNA, 20 bp, Artificial
  CRISPR gRNA sequence
tcctgagtgggaatactttt

SEQ ID NO: 688515 - DNA, 20 bp, Artificial
  CRISPR gRNA sequence
cctgagtgggaatacttttg

SEQ ID NO: 688516 - DNA, 20 bp, Artificial
  CRISPR gRNA sequence
ctgagtgggaatacttttgt

SEQ ID NO: 688517 - DNA, 20 bp, Artificial
  CRISPR gRNA sequence
agtgggaatacttttgtttg

SEQ ID NO: 688518 - DNA, 20 bp, Artificial
  CRISPR gRNA sequence
ttgtttgtttgtgagtaata

SEQ ID NO: 688519 - DNA, 20 bp, Artificial
  CRISPR gRNA sequence
tgtttgtttgtgagtaatac

SEQ ID NO: 688520 - DNA, 20 bp, Artificial
  CRISPR gRNA sequence
gtttgtttgtgagtaatacc

SEQ ID NO: 688521 - DNA, 20 bp, Artificial
  CRISPR gRNA sequence
tttgtttgtgagtaatacca

SEQ ID NO: 688522 - DNA, 20 bp, Artificial
  CRISPR gRNA sequence
gtttgtgagtaataccaatc

SEQ ID NO: 688523 - DNA, 20 bp, Artificial
  CRISPR gRNA sequence
tttgtgagtaataccaatcc

SEQ ID NO: 688524 - DNA, 20 bp, Artificial
  CRISPR gRNA sequence
gtgagtaataccaatccacg

SEQ ID NO: 688525 - DNA, 20 bp, Artificial
  CRISPR gRNA sequence
tgagtaataccaatccacgg

SEQ ID NO: 688526 - DNA, 20 bp, Artificial
  CRISPR gRNA sequence
ggttttccttgtctaggaca

SEQ ID NO: 688527 - DNA, 20 bp, Artificial
  CRISPR gRNA sequence
tccttgtctaggacatctta

SEQ ID NO: 688528 - DNA, 20 bp, Artificial
  CRISPR gRNA sequence
ccttgtctaggacatcttac

SEQ ID NO: 688529 - DNA, 20 bp, Artificial
  CRISPR gRNA sequence
cttgtctaggacatcttaca

SEQ ID NO: 688530 - DNA, 20 bp, Artificial
  CRISPR gRNA sequence
gtctaggacatcttacaatt

SEQ ID NO: 688531 - DNA, 20 bp, Artificial
  CRISPR gRNA sequence
tctaggacatcttacaatta

SEQ ID NO: 688532 - DNA, 20 bp, Artificial
  CRISPR gRNA sequence
ggacatcttacaattaaagc

SEQ ID NO: 688533 - DNA, 20 bp, Artificial
  CRISPR gRNA sequence
acaattaaagcctcattttc

SEQ ID NO: 688534 - DNA, 20 bp, Artificial
  CRISPR gRNA sequence
caattaaagcctcattttcc

SEQ ID NO: 688535 - DNA, 20 bp, Artificial
  CRISPR gRNA sequence
aagcctcattttccaggccc

SEQ ID NO: 688536 - DNA, 20 bp, Artificial
  CRISPR gRNA sequence
attttccaggccccatgatt

SEQ ID NO: 688537 - DNA, 20 bp, Artificial
  CRISPR gRNA sequence
tccaggccccatgattgttt

SEQ ID NO: 688538 - DNA, 20 bp, Artificial
  CRISPR gRNA sequence
ccaggccccatgattgttta

SEQ ID NO: 688539 - DNA, 20 bp, Artificial
  CRISPR gRNA sequence
caggccccatgattgtttac

SEQ ID NO: 688540 - DNA, 20 bp, Artificial
  CRISPR gRNA sequence
tttacctgcaaataaaagat

SEQ ID NO: 688541 - DNA, 20 bp, Artificial
  CRISPR gRNA sequence
acctgcaaataaaagatata

SEQ ID NO: 688542 - DNA, 20 bp, Artificial
  CRISPR gRNA sequence
cctgcaaataaaagatataa

SEQ ID NO: 688543 - DNA, 20 bp, Artificial
  CRISPR gRNA sequence
caaataaaagatataaagac

SEQ ID NO: 688544 - DNA, 20 bp, Artificial
  CRISPR gRNA sequence
aaatgatcaaatgaaaagat

SEQ ID NO: 688545 - DNA, 20 bp, Artificial
  CRISPR gRNA sequence
ttatactctcaatattttct

SEQ ID NO: 688546 - DNA, 20 bp, Artificial
  CRISPR gRNA sequence
atactctcaatattttcttc

SEQ ID NO: 688547 - DNA, 20 bp, Artificial
  CRISPR gRNA sequence
tactctcaatattttcttct

SEQ ID NO: 688548 - DNA, 20 bp, Artificial
  CRISPR gRNA sequence
tcaatattttcttctaggat

SEQ ID NO: 688549 - DNA, 20 bp, Artificial
  CRISPR gRNA sequence
aatattttcttctaggatta

SEQ ID NO: 688550 - DNA, 20 bp, Artificial
  CRISPR gRNA sequence
tcttctaggattaaatttag

SEQ ID NO: 688551 - DNA, 20 bp, Artificial
  CRISPR gRNA sequence
cttctaggattaaatttaga

SEQ ID NO: 688552 - DNA, 20 bp, Artificial
  CRISPR gRNA sequence
ttctaggattaaatttagaa

SEQ ID NO: 688553 - DNA, 20 bp, Artificial
  CRISPR gRNA sequence
ctaggattaaatttagaagc

SEQ ID NO: 688554 - DNA, 20 bp, Artificial
  CRISPR gRNA sequence
taggattaaatttagaagcc

SEQ ID NO: 688555 - DNA, 20 bp, Artificial
  CRISPR gRNA sequence
ggattaaatttagaagccgg

SEQ ID NO: 688556 - DNA, 20 bp, Artificial
  CRISPR gRNA sequence
aatttagaagccggtcatat

SEQ ID NO: 688557 - DNA, 20 bp, Artificial
  CRISPR gRNA sequence
agaagccggtcatatactgt

SEQ ID NO: 688558 - DNA, 20 bp, Artificial
  CRISPR gRNA sequence
gaagccggtcatatactgtg

SEQ ID NO: 688559 - DNA, 20 bp, Artificial
  CRISPR gRNA sequence
tgataccttgggaaagaata

SEQ ID NO: 688560 - DNA, 20 bp, Artificial
  CRISPR gRNA sequence
gggaaagaataagtaactgt

SEQ ID NO: 688561 - DNA, 20 bp, Artificial
  CRISPR gRNA sequence
ggaaagaataagtaactgtt

SEQ ID NO: 688562 - DNA, 20 bp, Artificial
  CRISPR gRNA sequence
ttaagatctcttatgaaatg

SEQ ID NO: 688563 - DNA, 20 bp, Artificial
  CRISPR gRNA sequence
agatctcttatgaaatgtta

SEQ ID NO: 688564 - DNA, 20 bp, Artificial
  CRISPR gRNA sequence
ttatgaaatgttaatgaatt

SEQ ID NO: 688565 - DNA, 20 bp, Artificial
  CRISPR gRNA sequence
atgaaatgttaatgaattaa

SEQ ID NO: 688566 - DNA, 20 bp, Artificial
  CRISPR gRNA sequence
tgaaatgttaatgaattaat

SEQ ID NO: 688567 - DNA, 20 bp, Artificial
  CRISPR gRNA sequence
atgaattaatttggagctaa

SEQ ID NO: 688568 - DNA, 20 bp, Artificial
  CRISPR gRNA sequence
atttggagctaaatccccca

SEQ ID NO: 688569 - DNA, 20 bp, Artificial
  CRISPR gRNA sequence
ggagctaaatcccccacagt

SEQ ID NO: 688570 - DNA, 20 bp, Artificial
  CRISPR gRNA sequence
gagctaaatcccccacagtt

SEQ ID NO: 688571 - DNA, 20 bp, Artificial
  CRISPR gRNA sequence
aatcccccacagttatccaa

SEQ ID NO: 688572 - DNA, 20 bp, Artificial
  CRISPR gRNA sequence
tccaatggaaaagcagcctt

SEQ ID NO: 688573 - DNA, 20 bp, Artificial
  CRISPR gRNA sequence
atctatctaaacaaactgtg

SEQ ID NO: 688574 - DNA, 20 bp, Artificial
  CRISPR gRNA sequence
tctatctaaacaaactgtgt

SEQ ID NO: 688575 - DNA, 20 bp, Artificial
  CRISPR gRNA sequence
tctaaacaaactgtgtgtca

SEQ ID NO: 688576 - DNA, 20 bp, Artificial
  CRISPR gRNA sequence
aacaaactgtgtgtcagtca

SEQ ID NO: 688577 - DNA, 20 bp, Artificial
  CRISPR gRNA sequence
tgtgtcagtcaataaacatc

SEQ ID NO: 688578 - DNA, 20 bp, Artificial
  CRISPR gRNA sequence
cccatgtgcaggcaccacat

SEQ ID NO: 688579 - DNA, 20 bp, Artificial
  CRISPR gRNA sequence
ccatgtgcaggcaccacatt

SEQ ID NO: 688580 - DNA, 20 bp, Artificial
  CRISPR gRNA sequence
aattctgctgcatttgaata

SEQ ID NO: 688581 - DNA, 20 bp, Artificial
  CRISPR gRNA sequence
tgctgcatttgaatatgcaa

SEQ ID NO: 688582 - DNA, 20 bp, Artificial
  CRISPR gRNA sequence
ctgcatttgaatatgcaaag

SEQ ID NO: 688583 - DNA, 20 bp, Artificial
  CRISPR gRNA sequence
catttgaatatgcaaagcca

SEQ ID NO: 688584 - DNA, 20 bp, Artificial
  CRISPR gRNA sequence
gaatatgcaaagccaaactg

SEQ ID NO: 688585 - DNA, 20 bp, Artificial
  CRISPR gRNA sequence
aatatgcaaagccaaactga

SEQ ID NO: 688586 - DNA, 20 bp, Artificial
  CRISPR gRNA sequence
atgatatattcattacaaag

SEQ ID NO: 688587 - DNA, 20 bp, Artificial
  CRISPR gRNA sequence
attacaaagaatttcttctg

SEQ ID NO: 688588 - DNA, 20 bp, Artificial
  CRISPR gRNA sequence
caaagaatttcttctgatag

SEQ ID NO: 688589 - DNA, 20 bp, Artificial
  CRISPR gRNA sequence
cttctgatagatttgtaatg

SEQ ID NO: 688590 - DNA, 20 bp, Artificial
  CRISPR gRNA sequence
ttctgatagatttgtaatga

SEQ ID NO: 688591 - DNA, 20 bp, Artificial
  CRISPR gRNA sequence
ctgatagatttgtaatgaaa

SEQ ID NO: 688592 - DNA, 20 bp, Artificial
  CRISPR gRNA sequence
tgatagatttgtaatgaaaa

SEQ ID NO: 688593 - DNA, 20 bp, Artificial
  CRISPR gRNA sequence
atagatttgtaatgaaaaat

SEQ ID NO: 688594 - DNA, 20 bp, Artificial
  CRISPR gRNA sequence
gtaatgaaaaatgattgtac

SEQ ID NO: 688595 - DNA, 20 bp, Artificial
  CRISPR gRNA sequence
taatgaaaaatgattgtaca

SEQ ID NO: 688596 - DNA, 20 bp, Artificial
  CRISPR gRNA sequence
tacaaaagcaatatattttt

SEQ ID NO: 688597 - DNA, 20 bp, Artificial
  CRISPR gRNA sequence
ttcagtttacaattcaactg

SEQ ID NO: 688598 - DNA, 20 bp, Artificial
  CRISPR gRNA sequence
tcagtttacaattcaactgg

SEQ ID NO: 688599 - DNA, 20 bp, Artificial
  CRISPR gRNA sequence
cagtttacaattcaactgga

SEQ ID NO: 688600 - DNA, 20 bp, Artificial
  CRISPR gRNA sequence
agtttacaattcaactggaa

SEQ ID NO: 688601 - DNA, 20 bp, Artificial
  CRISPR gRNA sequence
acaattcaactggaacaact

SEQ ID NO: 688602 - DNA, 20 bp, Artificial
  CRISPR gRNA sequence
caattcaactggaacaactg

SEQ ID NO: 688603 - DNA, 20 bp, Artificial
  CRISPR gRNA sequence
aactggaacaactggaagca

SEQ ID NO: 688604 - DNA, 20 bp, Artificial
  CRISPR gRNA sequence
gaacaactggaagcaaactg

SEQ ID NO: 688605 - DNA, 20 bp, Artificial
  CRISPR gRNA sequence
gaagcaaactgcttaaaaca

SEQ ID NO: 688606 - DNA, 20 bp, Artificial
  CRISPR gRNA sequence
cttaaaacaaggtaaatgtt

SEQ ID NO: 688607 - DNA, 20 bp, Artificial
  CRISPR gRNA sequence
aaaacaaggtaaatgttctt

SEQ ID NO: 688608 - DNA, 20 bp, Artificial
  CRISPR gRNA sequence
aaacaaggtaaatgttcttg

SEQ ID NO: 688609 - DNA, 20 bp, Artificial
  CRISPR gRNA sequence
ttgaaattatttaatttata

SEQ ID NO: 688610 - DNA, 20 bp, Artificial
  CRISPR gRNA sequence
gaaattatttaatttataaa

SEQ ID NO: 688611 - DNA, 20 bp, Artificial
  CRISPR gRNA sequence
aaattatttaatttataaaa

SEQ ID NO: 688612 - DNA, 20 bp, Artificial
  CRISPR gRNA sequence
tttaatttataaaaatttaa

SEQ ID NO: 688613 - DNA, 20 bp, Artificial
  CRISPR gRNA sequence
aatttataaaaatttaaatt

SEQ ID NO: 688614 - DNA, 20 bp, Artificial
  CRISPR gRNA sequence
atttataaaaatttaaatta

SEQ ID NO: 688615 - DNA, 20 bp, Artificial
  CRISPR gRNA sequence
ataaaaatttaaattatact

SEQ ID NO: 688616 - DNA, 20 bp, Artificial
  CRISPR gRNA sequence
taaaaatttaaattatactt

SEQ ID NO: 688617 - DNA, 20 bp, Artificial
  CRISPR gRNA sequence
aaattatacttagaaggcaa

SEQ ID NO: 688618 - DNA, 20 bp, Artificial
  CRISPR gRNA sequence
aattatacttagaaggcaat

SEQ ID NO: 688619 - DNA, 20 bp, Artificial
  CRISPR gRNA sequence
tacttagaaggcaatactta

SEQ ID NO: 688620 - DNA, 20 bp, Artificial
  CRISPR gRNA sequence
agaaggcaatacttactaaa

SEQ ID NO: 688621 - DNA, 20 bp, Artificial
  CRISPR gRNA sequence
gaaggcaatacttactaaac

SEQ ID NO: 688622 - DNA, 20 bp, Artificial
  CRISPR gRNA sequence
actaaactttgctgctgtgg

SEQ ID NO: 688623 - DNA, 20 bp, Artificial
  CRISPR gRNA sequence
ctaaactttgctgctgtgga

SEQ ID NO: 688624 - DNA, 20 bp, Artificial
  CRISPR gRNA sequence
aactttgctgctgtggaata

SEQ ID NO: 688625 - DNA, 20 bp, Artificial
  CRISPR gRNA sequence
tgctgctgtggaatacatga

SEQ ID NO: 688626 - DNA, 20 bp, Artificial
  CRISPR gRNA sequence
gctgctgtggaatacatgag

SEQ ID NO: 688627 - DNA, 20 bp, Artificial
  CRISPR gRNA sequence
ctgctgtggaatacatgaga

SEQ ID NO: 688628 - DNA, 20 bp, Artificial
  CRISPR gRNA sequence
ctgtggaatacatgagaatt

SEQ ID NO: 688629 - DNA, 20 bp, Artificial
  CRISPR gRNA sequence
tggaatacatgagaattgtg

SEQ ID NO: 688630 - DNA, 20 bp, Artificial
  CRISPR gRNA sequence
tgagaattgctaagatccaa

SEQ ID NO: 688631 - DNA, 20 bp, Artificial
  CRISPR gRNA sequence
ctaagatccaaaaccccatt

SEQ ID NO: 688632 - DNA, 20 bp, Artificial
  CRISPR gRNA sequence
agatccaaaaccccattctg

SEQ ID NO: 688633 - DNA, 20 bp, Artificial
  CRISPR gRNA sequence
tgtttatcaatcaagagcaa

SEQ ID NO: 688634 - DNA, 20 bp, Artificial
  CRISPR gRNA sequence
tttatcaatcaagagcaagt

SEQ ID NO: 688635 - DNA, 20 bp, Artificial
  CRISPR gRNA sequence
atcaatcaagagcaagtatt

SEQ ID NO: 688636 - DNA, 20 bp, Artificial
  CRISPR gRNA sequence
tcaatcaagagcaagtattg

SEQ ID NO: 688637 - DNA, 20 bp, Artificial
  CRISPR gRNA sequence
gtaactcgttgttgagatta

SEQ ID NO: 688638 - DNA, 20 bp, Artificial
  CRISPR gRNA sequence
gttgttgagattactccaga

SEQ ID NO: 688639 - DNA, 20 bp, Artificial
  CRISPR gRNA sequence
ttgagattactccagatgag

SEQ ID NO: 688640 - DNA, 20 bp, Artificial
  CRISPR gRNA sequence
agattactccagatgagtca

SEQ ID NO: 688641 - DNA, 20 bp, Artificial
  CRISPR gRNA sequence
ctccagatgagtcactggca

SEQ ID NO: 688642 - DNA, 20 bp, Artificial
  CRISPR gRNA sequence
cagatgagtcactggcatac

SEQ ID NO: 688643 - DNA, 20 bp, Artificial
  CRISPR gRNA sequence
gcatacgacagtgaaggtca

SEQ ID NO: 688644 - DNA, 20 bp, Artificial
  CRISPR gRNA sequence
gtgatactcttcaagactga

SEQ ID NO: 688645 - DNA, 20 bp, Artificial
  CRISPR gRNA sequence
ttcaagactgagttgggaag

SEQ ID NO: 688646 - DNA, 20 bp, Artificial
  CRISPR gRNA sequence
caagactgagttgggaagag

SEQ ID NO: 688647 - DNA, 20 bp, Artificial
  CRISPR gRNA sequence
aagactgagttgggaagagt

SEQ ID NO: 688648 - DNA, 20 bp, Artificial
  CRISPR gRNA sequence
agttgggaagagtagcctat

SEQ ID NO: 688649 - DNA, 20 bp, Artificial
  CRISPR gRNA sequence
ggaagagtagcctatatctc

SEQ ID NO: 688650 - DNA, 20 bp, Artificial
  CRISPR gRNA sequence
tatctcaactgaaaaataag

SEQ ID NO: 688651 - DNA, 20 bp, Artificial
  CRISPR gRNA sequence
aactgaaaaataagttagac

SEQ ID NO: 688652 - DNA, 20 bp, Artificial
  CRISPR gRNA sequence
aaaaataagttagacaaaac

SEQ ID NO: 688653 - DNA, 20 bp, Artificial
  CRISPR gRNA sequence
gacaaaaccataaacagaat

SEQ ID NO: 688654 - DNA, 20 bp, Artificial
  CRISPR gRNA sequence
ttatcagccatgatttttac

SEQ ID NO: 688655 - DNA, 20 bp, Artificial
  CRISPR gRNA sequence
tatcagccatgatttttact

SEQ ID NO: 688656 - DNA, 20 bp, Artificial
  CRISPR gRNA sequence
atcagccatgatttttactt

SEQ ID NO: 688657 - DNA, 20 bp, Artificial
  CRISPR gRNA sequence
tcagccatgatttttacttt

SEQ ID NO: 688658 - DNA, 20 bp, Artificial
  CRISPR gRNA sequence
ttactttctcagcaccaccc

SEQ ID NO: 688659 - DNA, 20 bp, Artificial
  CRISPR gRNA sequence
tactttctcagcaccaccca

SEQ ID NO: 688660 - DNA, 20 bp, Artificial
  CRISPR gRNA sequence
actttctcagcaccacccag

SEQ ID NO: 688661 - DNA, 20 bp, Artificial
  CRISPR gRNA sequence
ctttctcagcaccacccagg

SEQ ID NO: 688662 - DNA, 20 bp, Artificial
  CRISPR gRNA sequence
tctcagcaccacccaggaga

SEQ ID NO: 688663 - DNA, 20 bp, Artificial
  CRISPR gRNA sequence
ctcagcaccacccaggagaa

SEQ ID NO: 688664 - DNA, 20 bp, Artificial
  CRISPR gRNA sequence
tcagcaccacccaggagaat

SEQ ID NO: 688665 - DNA, 20 bp, Artificial
  CRISPR gRNA sequence
agcaccacccaggagaatga

SEQ ID NO: 688666 - DNA, 20 bp, Artificial
  CRISPR gRNA sequence
attaagtgcaaagagatgta

SEQ ID NO: 688667 - DNA, 20 bp, Artificial
  CRISPR gRNA sequence
ttaagtgcaaagagatgtaa

SEQ ID NO: 688668 - DNA, 20 bp, Artificial
  CRISPR gRNA sequence
agtgcaaagagatgtaacag

SEQ ID NO: 688669 - DNA, 20 bp, Artificial
  CRISPR gRNA sequence
cagatatgcaagcattgcac

SEQ ID NO: 688670 - DNA, 20 bp, Artificial
  CRISPR gRNA sequence
agatatgcaagcattgcact

SEQ ID NO: 688671 - DNA, 20 bp, Artificial
  CRISPR gRNA sequence
cacttattcctatggaagtt

SEQ ID NO: 688672 - DNA, 20 bp, Artificial
  CRISPR gRNA sequence
attcctatggaagttttggg

SEQ ID NO: 688673 - DNA, 20 bp, Artificial
  CRISPR gRNA sequence
ttcctatggaagttttgggt

SEQ ID NO: 688674 - DNA, 20 bp, Artificial
  CRISPR gRNA sequence
ctatggaagttttgggtcat

SEQ ID NO: 688675 - DNA, 20 bp, Artificial
  CRISPR gRNA sequence
tggaagttttgggtcatata

SEQ ID NO: 688676 - DNA, 20 bp, Artificial
  CRISPR gRNA sequence
tgggtcatatagctttcaca

SEQ ID NO: 688677 - DNA, 20 bp, Artificial
  CRISPR gRNA sequence
gggtcatatagctttcacaa

SEQ ID NO: 688678 - DNA, 20 bp, Artificial
  CRISPR gRNA sequence
ggtcatatagctttcacaat

SEQ ID NO: 688679 - DNA, 20 bp, Artificial
  CRISPR gRNA sequence
tcacaatgatcatgctattt

SEQ ID NO: 688680 - DNA, 20 bp, Artificial
  CRISPR gRNA sequence
cacaatgatcatgctatttc

SEQ ID NO: 688681 - DNA, 20 bp, Artificial
  CRISPR gRNA sequence
acaatgatcatgctatttca

SEQ ID NO: 688682 - DNA, 20 bp, Artificial
  CRISPR gRNA sequence
tttcacagttatcatgctac

SEQ ID NO: 688683 - DNA, 20 bp, Artificial
  CRISPR gRNA sequence
cacagttatcatgctacttc

SEQ ID NO: 688684 - DNA, 20 bp, Artificial
  CRISPR gRNA sequence
acagttatcatgctacttcg

SEQ ID NO: 688685 - DNA, 20 bp, Artificial
  CRISPR gRNA sequence
tcatgctacttcgcagttat

SEQ ID NO: 688686 - DNA, 20 bp, Artificial
  CRISPR gRNA sequence
cttcgcagttatatttcacc

SEQ ID NO: 688687 - DNA, 20 bp, Artificial
  CRISPR gRNA sequence
cgcagttatatttcaccagt

SEQ ID NO: 688688 - DNA, 20 bp, Artificial
  CRISPR gRNA sequence
gcagttatatttcaccagtc

SEQ ID NO: 688689 - DNA, 20 bp, Artificial
  CRISPR gRNA sequence
tatttcaccagtctcatgag

SEQ ID NO: 688690 - DNA, 20 bp, Artificial
  CRISPR gRNA sequence
caccagtctcatgagaatgt

SEQ ID NO: 688691 - DNA, 20 bp, Artificial
  CRISPR gRNA sequence
accagtctcatgagaatgtc

SEQ ID NO: 688692 - DNA, 20 bp, Artificial
  CRISPR gRNA sequence
atgagaatgtcctgaaagaa

SEQ ID NO: 688693 - DNA, 20 bp, Artificial
  CRISPR gRNA sequence
aaagaaactaaattaagaag

SEQ ID NO: 688694 - DNA, 20 bp, Artificial
  CRISPR gRNA sequence
aattaagaaggaaagaatat

SEQ ID NO: 688695 - DNA, 20 bp, Artificial
  CRISPR gRNA sequence
agaaggaaagaatatgagtt

SEQ ID NO: 688696 - DNA, 20 bp, Artificial
  CRISPR gRNA sequence
ctatttttgaaaaaaaaacc

SEQ ID NO: 688697 - DNA, 20 bp, Artificial
  CRISPR gRNA sequence
tatttttgaaaaaaaaacca

SEQ ID NO: 688698 - DNA, 20 bp, Artificial
  CRISPR gRNA sequence
tttttgaaaaaaaaaccata

SEQ ID NO: 688699 - DNA, 20 bp, Artificial
  CRISPR gRNA sequence
ttgaaaaaaaaaccataaaa

SEQ ID NO: 688700 - DNA, 20 bp, Artificial
  CRISPR gRNA sequence
tgaaaaaaaaaccataaaat

SEQ ID NO: 688701 - DNA, 20 bp, Artificial
  CRISPR gRNA sequence
gaaaaaaaaaccataaaatt

SEQ ID NO: 688702 - DNA, 20 bp, Artificial
  CRISPR gRNA sequence
aaaaaaaaaccataaaattc

SEQ ID NO: 688703 - DNA, 20 bp, Artificial
  CRISPR gRNA sequence
agtagactttagaaaataaa

SEQ ID NO: 688704 - DNA, 20 bp, Artificial
  CRISPR gRNA sequence
tagaaaataaaatgtatcat

SEQ ID NO: 688705 - DNA, 20 bp, Artificial
  CRISPR gRNA sequence
agaaaataaaatgtatcatg

SEQ ID NO: 688706 - DNA, 20 bp, Artificial
  CRISPR gRNA sequence
gaaaataaaatgtatcatgt

SEQ ID NO: 688707 - DNA, 20 bp, Artificial
  CRISPR gRNA sequence
gtagcagcatgctcacaaaa

SEQ ID NO: 688708 - DNA, 20 bp, Artificial
  CRISPR gRNA sequence
acaaaaataactcacaaaca

SEQ ID NO: 688709 - DNA, 20 bp, Artificial
  CRISPR gRNA sequence
acaaacagacacatgtgcaa

SEQ ID NO: 688710 - DNA, 20 bp, Artificial
  CRISPR gRNA sequence
aggagtagcaaaatcagaac

SEQ ID NO: 688711 - DNA, 20 bp, Artificial
  CRISPR gRNA sequence
gactaaagcattagccaagt

SEQ ID NO: 688712 - DNA, 20 bp, Artificial
  CRISPR gRNA sequence
aagcattagccaagtaattg

SEQ ID NO: 688713 - DNA, 20 bp, Artificial
  CRISPR gRNA sequence
gccaagtaattgtcctattc

SEQ ID NO: 688714 - DNA, 20 bp, Artificial
  CRISPR gRNA sequence
tcctattctcaaccccaaac

SEQ ID NO: 688715 - DNA, 20 bp, Artificial
  CRISPR gRNA sequence
ttctcaaccccaaaccctca

SEQ ID NO: 688716 - DNA, 20 bp, Artificial
  CRISPR gRNA sequence
tcaaccccaaaccctcaaac

SEQ ID NO: 688717 - DNA, 20 bp, Artificial
  CRISPR gRNA sequence
aaccccaaaccctcaaactt

SEQ ID NO: 688718 - DNA, 20 bp, Artificial
  CRISPR gRNA sequence
aaacttttgttcctgactca

SEQ ID NO: 688719 - DNA, 20 bp, Artificial
  CRISPR gRNA sequence
ttgttcctgactcagcttgt

SEQ ID NO: 688720 - DNA, 20 bp, Artificial
  CRISPR gRNA sequence
tgttcctgactcagcttgtt

SEQ ID NO: 688721 - DNA, 20 bp, Artificial
  CRISPR gRNA sequence
gttcctgactcagcttgttc

SEQ ID NO: 688722 - DNA, 20 bp, Artificial
  CRISPR gRNA sequence
ttcctgactcagcttgttcc

SEQ ID NO: 688723 - DNA, 20 bp, Artificial
  CRISPR gRNA sequence
ctgactcagcttgttcccag

SEQ ID NO: 688724 - DNA, 20 bp, Artificial
  CRISPR gRNA sequence
actcagcttgttcccaggag

SEQ ID NO: 688725 - DNA, 20 bp, Artificial
  CRISPR gRNA sequence
agcttgttcccaggagtcac

SEQ ID NO: 688726 - DNA, 20 bp, Artificial
  CRISPR gRNA sequence
gttcccaggagtcaccaaag

SEQ ID NO: 688727 - DNA, 20 bp, Artificial
  CRISPR gRNA sequence
ttcccaggagtcaccaaagg

SEQ ID NO: 688728 - DNA, 20 bp, Artificial
  CRISPR gRNA sequence
ccaggagtcaccaaaggctt

SEQ ID NO: 688729 - DNA, 20 bp, Artificial
  CRISPR gRNA sequence
tctaagagtagttgaaggtc

SEQ ID NO: 688730 - DNA, 20 bp, Artificial
  CRISPR gRNA sequence
ctaagagtagttgaaggtct

SEQ ID NO: 688731 - DNA, 20 bp, Artificial
  CRISPR gRNA sequence
taagagtagttgaaggtcta

SEQ ID NO: 688732 - DNA, 20 bp, Artificial
  CRISPR gRNA sequence
agagtagttgaaggtctatg

SEQ ID NO: 688733 - DNA, 20 bp, Artificial
  CRISPR gRNA sequence
aaggtctatgaataataata

SEQ ID NO: 688734 - DNA, 20 bp, Artificial
  CRISPR gRNA sequence
tgaataataataaatacatt

SEQ ID NO: 688735 - DNA, 20 bp, Artificial
  CRISPR gRNA sequence
attttttctttcagaaaaat

SEQ ID NO: 688736 - DNA, 20 bp, Artificial
  CRISPR gRNA sequence
tttctttcagaaaaataatc

SEQ ID NO: 688737 - DNA, 20 bp, Artificial
  CRISPR gRNA sequence
ttctttcagaaaaataatca

SEQ ID NO: 688738 - DNA, 20 bp, Artificial
  CRISPR gRNA sequence
tctttcagaaaaataatcat

SEQ ID NO: 688739 - DNA, 20 bp, Artificial
  CRISPR gRNA sequence
ctttcagaaaaataatcatt

SEQ ID NO: 688740 - DNA, 20 bp, Artificial
  CRISPR gRNA sequence
tttcagaaaaataatcattt

SEQ ID NO: 688741 - DNA, 20 bp, Artificial
  CRISPR gRNA sequence
tcagaaaaataatcatttac

SEQ ID NO: 688742 - DNA, 20 bp, Artificial
  CRISPR gRNA sequence
cagaaaaataatcatttact

SEQ ID NO: 688743 - DNA, 20 bp, Artificial
  CRISPR gRNA sequence
agaaaaataatcatttactt

SEQ ID NO: 688744 - DNA, 20 bp, Artificial
  CRISPR gRNA sequence
actttcttacttcttttctt

SEQ ID NO: 688745 - DNA, 20 bp, Artificial
  CRISPR gRNA sequence
ctttcttacttcttttctta

SEQ ID NO: 688746 - DNA, 20 bp, Artificial
  CRISPR gRNA sequence
tcttacttcttttcttaaaa

SEQ ID NO: 688747 - DNA, 20 bp, Artificial
  CRISPR gRNA sequence
cttacttcttttcttaaaat

SEQ ID NO: 688748 - DNA, 20 bp, Artificial
  CRISPR gRNA sequence
ttacttcttttcttaaaata

SEQ ID NO: 688749 - DNA, 20 bp, Artificial
  CRISPR gRNA sequence
acttcttttcttaaaatata

SEQ ID NO: 688750 - DNA, 20 bp, Artificial
  CRISPR gRNA sequence
cttcttttcttaaaatataa

SEQ ID NO: 688751 - DNA, 20 bp, Artificial
  CRISPR gRNA sequence
cttttcttaaaatataaggg

SEQ ID NO: 688752 - DNA, 20 bp, Artificial
  CRISPR gRNA sequence
ttttcttaaaatataagggg

SEQ ID NO: 688753 - DNA, 20 bp, Artificial
  CRISPR gRNA sequence
ttcttaaaatataaggggaa

SEQ ID NO: 688754 - DNA, 20 bp, Artificial
  CRISPR gRNA sequence
tcttaaaatataaggggaag

SEQ ID NO: 688755 - DNA, 20 bp, Artificial
  CRISPR gRNA sequence
cttaaaatataaggggaaga

SEQ ID NO: 688756 - DNA, 20 bp, Artificial
  CRISPR gRNA sequence
ttaaaatataaggggaagaa

SEQ ID NO: 688757 - DNA, 20 bp, Artificial
  CRISPR gRNA sequence
aaaatataaggggaagaata

SEQ ID NO: 688758 - DNA, 20 bp, Artificial
  CRISPR gRNA sequence
aaatataaggggaagaatag

SEQ ID NO: 688759 - DNA, 20 bp, Artificial
  CRISPR gRNA sequence
actaacataaagataaacac

SEQ ID NO: 688760 - DNA, 20 bp, Artificial
  CRISPR gRNA sequence
ctaacataaagataaacaca

SEQ ID NO: 688761 - DNA, 20 bp, Artificial
  CRISPR gRNA sequence
acataaagataaacacaatc

SEQ ID NO: 688762 - DNA, 20 bp, Artificial
  CRISPR gRNA sequence
tgaagacttttcttattaca

SEQ ID NO: 688763 - DNA, 20 bp, Artificial
  CRISPR gRNA sequence
ttcttattacaaattttaga

SEQ ID NO: 688764 - DNA, 20 bp, Artificial
  CRISPR gRNA sequence
tcttattacaaattttagat

SEQ ID NO: 688765 - DNA, 20 bp, Artificial
  CRISPR gRNA sequence
cttattacaaattttagata

SEQ ID NO: 688766 - DNA, 20 bp, Artificial
  CRISPR gRNA sequence
ttattacaaattttagataa

SEQ ID NO: 688767 - DNA, 20 bp, Artificial
  CRISPR gRNA sequence
attacaaattttagataagt

SEQ ID NO: 688768 - DNA, 20 bp, Artificial
  CRISPR gRNA sequence
ttacaaattttagataagta

SEQ ID NO: 688769 - DNA, 20 bp, Artificial
  CRISPR gRNA sequence
caaattttagataagtaatt

SEQ ID NO: 688770 - DNA, 20 bp, Artificial
  CRISPR gRNA sequence
tagataagtaattgatgctt

SEQ ID NO: 688771 - DNA, 20 bp, Artificial
  CRISPR gRNA sequence
agataagtaattgatgctta

SEQ ID NO: 688772 - DNA, 20 bp, Artificial
  CRISPR gRNA sequence
gataagtaattgatgcttac

SEQ ID NO: 688773 - DNA, 20 bp, Artificial
  CRISPR gRNA sequence
atgcttacccaaactgaaag

SEQ ID NO: 688774 - DNA, 20 bp, Artificial
  CRISPR gRNA sequence
acccaaactgaaagacagag

SEQ ID NO: 688775 - DNA, 20 bp, Artificial
  CRISPR gRNA sequence
cccaaactgaaagacagagg

SEQ ID NO: 688776 - DNA, 20 bp, Artificial
  CRISPR gRNA sequence
aaagacagaggggatgaact

SEQ ID NO: 688777 - DNA, 20 bp, Artificial
  CRISPR gRNA sequence
ggagtcagtgacggagctaa

SEQ ID NO: 688778 - DNA, 20 bp, Artificial
  CRISPR gRNA sequence
gagtcagtgacggagctaag

SEQ ID NO: 688779 - DNA, 20 bp, Artificial
  CRISPR gRNA sequence
agaatagtttccagtctttg

SEQ ID NO: 688780 - DNA, 20 bp, Artificial
  CRISPR gRNA sequence
ccagtctttgtaggtccctc

SEQ ID NO: 688781 - DNA, 20 bp, Artificial
  CRISPR gRNA sequence
cagtctttgtaggtccctcc

SEQ ID NO: 688782 - DNA, 20 bp, Artificial
  CRISPR gRNA sequence
tgtaggtccctcctcataga

SEQ ID NO: 688783 - DNA, 20 bp, Artificial
  CRISPR gRNA sequence
gtaggtccctcctcatagac

SEQ ID NO: 688784 - DNA, 20 bp, Artificial
  CRISPR gRNA sequence
taggtccctcctcatagact

SEQ ID NO: 688785 - DNA, 20 bp, Artificial
  CRISPR gRNA sequence
ctcatagactactcactctc

SEQ ID NO: 688786 - DNA, 20 bp, Artificial
  CRISPR gRNA sequence
atagactactcactctcttc

SEQ ID NO: 688787 - DNA, 20 bp, Artificial
  CRISPR gRNA sequence
ctcactctcttctattttaa

SEQ ID NO: 688788 - DNA, 20 bp, Artificial
  CRISPR gRNA sequence
actctcttctattttaaagg

SEQ ID NO: 688789 - DNA, 20 bp, Artificial
  CRISPR gRNA sequence
tcttctattttaaaggggag

SEQ ID NO: 688790 - DNA, 20 bp, Artificial
  CRISPR gRNA sequence
ttctattttaaaggggagac

SEQ ID NO: 688791 - DNA, 20 bp, Artificial
  CRISPR gRNA sequence
ctattttaaaggggagacac

SEQ ID NO: 688792 - DNA, 20 bp, Artificial
  CRISPR gRNA sequence
tattttaaaggggagacact

SEQ ID NO: 688793 - DNA, 20 bp, Artificial
  CRISPR gRNA sequence
ttttaaaggggagacactcc

SEQ ID NO: 688794 - DNA, 20 bp, Artificial
  CRISPR gRNA sequence
taaaggggagacactcctcc

SEQ ID NO: 688795 - DNA, 20 bp, Artificial
  CRISPR gRNA sequence
aaaggggagacactcctccc

SEQ ID NO: 688796 - DNA, 20 bp, Artificial
  CRISPR gRNA sequence
aaggggagacactcctccca

SEQ ID NO: 688797 - DNA, 20 bp, Artificial
  CRISPR gRNA sequence
ctcccatcctgaaatttgat

SEQ ID NO: 688798 - DNA, 20 bp, Artificial
  CRISPR gRNA sequence
ccatcctgaaatttgatttg

SEQ ID NO: 688799 - DNA, 20 bp, Artificial
  CRISPR gRNA sequence
aaatttgatttgtggccaaa

SEQ ID NO: 688800 - DNA, 20 bp, Artificial
  CRISPR gRNA sequence
gatttgtggccaaatctatg

SEQ ID NO: 688801 - DNA, 20 bp, Artificial
  CRISPR gRNA sequence
atttgtggccaaatctatga

SEQ ID NO: 688802 - DNA, 20 bp, Artificial
  CRISPR gRNA sequence
gtggccaaatctatgacttg

SEQ ID NO: 688803 - DNA, 20 bp, Artificial
  CRISPR gRNA sequence
tggccaaatctatgacttgt

SEQ ID NO: 688804 - DNA, 20 bp, Artificial
  CRISPR gRNA sequence
tgacttgttcaaaaatgctg

SEQ ID NO: 688805 - DNA, 20 bp, Artificial
  CRISPR gRNA sequence
gttcaaaaatgctggtgcat

SEQ ID NO: 688806 - DNA, 20 bp, Artificial
  CRISPR gRNA sequence
ttcaaaaatgctggtgcatc

SEQ ID NO: 688807 - DNA, 20 bp, Artificial
  CRISPR gRNA sequence
aaaaatgctggtgcatcatg

SEQ ID NO: 688808 - DNA, 20 bp, Artificial
  CRISPR gRNA sequence
gccccatttctcactcccat

SEQ ID NO: 688809 - DNA, 20 bp, Artificial
  CRISPR gRNA sequence
ccccatttctcactcccatt

SEQ ID NO: 688810 - DNA, 20 bp, Artificial
  CRISPR gRNA sequence
cccattgggcgtcgcgtttc

SEQ ID NO: 688811 - DNA, 20 bp, Artificial
  CRISPR gRNA sequence
cattgggcgtcgcgtttcta

SEQ ID NO: 688812 - DNA, 20 bp, Artificial
  CRISPR gRNA sequence
tgggcgtcgcgtttctagag

SEQ ID NO: 688813 - DNA, 20 bp, Artificial
  CRISPR gRNA sequence
gcgtttctagagaagccaat

SEQ ID NO: 688814 - DNA, 20 bp, Artificial
  CRISPR gRNA sequence
gaagccaatcagtgtcgccg

SEQ ID NO: 688815 - DNA, 20 bp, Artificial
  CRISPR gRNA sequence
atcagtgtcgccgcagttcc

SEQ ID NO: 688816 - DNA, 20 bp, Artificial
  CRISPR gRNA sequence
tcagtgtcgccgcagttccc

SEQ ID NO: 688817 - DNA, 20 bp, Artificial
  CRISPR gRNA sequence
gccgcagttcccaggttcta

SEQ ID NO: 688818 - DNA, 20 bp, Artificial
  CRISPR gRNA sequence
ctaaagtcccacgcaccccg

SEQ ID NO: 688819 - DNA, 20 bp, Artificial
  CRISPR gRNA sequence
taaagtcccacgcaccccgc

SEQ ID NO: 688820 - DNA, 20 bp, Artificial
  CRISPR gRNA sequence
cgcgggactcatatttttcc

SEQ ID NO: 688821 - DNA, 20 bp, Artificial
  CRISPR gRNA sequence
actcatatttttcccagacg

SEQ ID NO: 688822 - DNA, 20 bp, Artificial
  CRISPR gRNA sequence
tcatatttttcccagacgcg

SEQ ID NO: 688823 - DNA, 20 bp, Artificial
  CRISPR gRNA sequence
catatttttcccagacgcgg

SEQ ID NO: 688824 - DNA, 20 bp, Artificial
  CRISPR gRNA sequence
tttttcccagacgcggaggt

SEQ ID NO: 688825 - DNA, 20 bp, Artificial
  CRISPR gRNA sequence
ttttcccagacgcggaggtt

SEQ ID NO: 688826 - DNA, 20 bp, Artificial
  CRISPR gRNA sequence
tttcccagacgcggaggttg

SEQ ID NO: 688827 - DNA, 20 bp, Artificial
  CRISPR gRNA sequence
agacgcggaggttggggtca

SEQ ID NO: 688828 - DNA, 20 bp, Artificial
  CRISPR gRNA sequence
gttggggtcatggcgccccg

SEQ ID NO: 688829 - DNA, 20 bp, Artificial
  CRISPR gRNA sequence
aagcctcctcctgctgctct

SEQ ID NO: 688830 - DNA, 20 bp, Artificial
  CRISPR gRNA sequence
agcctcctcctgctgctctc

SEQ ID NO: 688831 - DNA, 20 bp, Artificial
  CRISPR gRNA sequence
gcctcctcctgctgctctca

SEQ ID NO: 688832 - DNA, 20 bp, Artificial
  CRISPR gRNA sequence
cctcctcctgctgctctcag

SEQ ID NO: 688833 - DNA, 20 bp, Artificial
  CRISPR gRNA sequence
cctgctgctctcaggggccc

SEQ ID NO: 688834 - DNA, 20 bp, Artificial
  CRISPR gRNA sequence
ccctggccctgaccgatact

SEQ ID NO: 688835 - DNA, 20 bp, Artificial
  CRISPR gRNA sequence
cctggccctgaccgatactt

SEQ ID NO: 688836 - DNA, 20 bp, Artificial
  CRISPR gRNA sequence
ggccctgaccgatacttggg

SEQ ID NO: 688837 - DNA, 20 bp, Artificial
  CRISPR gRNA sequence
gccctgaccgatacttgggc

SEQ ID NO: 688838 - DNA, 20 bp, Artificial
  CRISPR gRNA sequence
tgaccgatacttgggcgggt

SEQ ID NO: 688839 - DNA, 20 bp, Artificial
  CRISPR gRNA sequence
gatacttgggcgggtgagtg

SEQ ID NO: 688840 - DNA, 20 bp, Artificial
  CRISPR gRNA sequence
atacttgggcgggtgagtgc

SEQ ID NO: 688841 - DNA, 20 bp, Artificial
  CRISPR gRNA sequence
tacttgggcgggtgagtgcg

SEQ ID NO: 688842 - DNA, 20 bp, Artificial
  CRISPR gRNA sequence
gggcgggtgagtgcggggtc

SEQ ID NO: 688843 - DNA, 20 bp, Artificial
  CRISPR gRNA sequence
gcgggtgagtgcggggtcca

SEQ ID NO: 688844 - DNA, 20 bp, Artificial
  CRISPR gRNA sequence
gggtgagtgcggggtccaga

SEQ ID NO: 688845 - DNA, 20 bp, Artificial
  CRISPR gRNA sequence
gtgcggggtccagagagaaa

SEQ ID NO: 688846 - DNA, 20 bp, Artificial
  CRISPR gRNA sequence
ccagagagaaacggcctctg

SEQ ID NO: 688847 - DNA, 20 bp, Artificial
  CRISPR gRNA sequence
cagagagaaacggcctctgt

SEQ ID NO: 688848 - DNA, 20 bp, Artificial
  CRISPR gRNA sequence
agagagaaacggcctctgtg

SEQ ID NO: 688849 - DNA, 20 bp, Artificial
  CRISPR gRNA sequence
agagaaacggcctctgtggg

SEQ ID NO: 688850 - DNA, 20 bp, Artificial
  CRISPR gRNA sequence
gagaaacggcctctgtgggg

SEQ ID NO: 688851 - DNA, 20 bp, Artificial
  CRISPR gRNA sequence
gaaacggcctctgtggggag

SEQ ID NO: 688852 - DNA, 20 bp, Artificial
  CRISPR gRNA sequence
cggcctctgtggggaggagt

SEQ ID NO: 688853 - DNA, 20 bp, Artificial
  CRISPR gRNA sequence
ggcctctgtggggaggagtg

SEQ ID NO: 688854 - DNA, 20 bp, Artificial
  CRISPR gRNA sequence
gcctctgtggggaggagtga

SEQ ID NO: 688855 - DNA, 20 bp, Artificial
  CRISPR gRNA sequence
cctctgtggggaggagtgag

SEQ ID NO: 688856 - DNA, 20 bp, Artificial
  CRISPR gRNA sequence
ggaggagtgaggggcccgcc

SEQ ID NO: 688857 - DNA, 20 bp, Artificial
  CRISPR gRNA sequence
ggagtgaggggcccgcccgg

SEQ ID NO: 688858 - DNA, 20 bp, Artificial
  CRISPR gRNA sequence
gagtgaggggcccgcccggt

SEQ ID NO: 688859 - DNA, 20 bp, Artificial
  CRISPR gRNA sequence
agtgaggggcccgcccggtg

SEQ ID NO: 688860 - DNA, 20 bp, Artificial
  CRISPR gRNA sequence
gtgaggggcccgcccggtgg

SEQ ID NO: 688861 - DNA, 20 bp, Artificial
  CRISPR gRNA sequence
gggcccgcccggtgggggcg

SEQ ID NO: 688862 - DNA, 20 bp, Artificial
  CRISPR gRNA sequence
ggcccgcccggtgggggcgc

SEQ ID NO: 688863 - DNA, 20 bp, Artificial
  CRISPR gRNA sequence
cccggtgggggcgcaggact

SEQ ID NO: 688864 - DNA, 20 bp, Artificial
  CRISPR gRNA sequence
ccggtgggggcgcaggactc

SEQ ID NO: 688865 - DNA, 20 bp, Artificial
  CRISPR gRNA sequence
cggtgggggcgcaggactca

SEQ ID NO: 688866 - DNA, 20 bp, Artificial
  CRISPR gRNA sequence
gtgggggcgcaggactcagg

SEQ ID NO: 688867 - DNA, 20 bp, Artificial
  CRISPR gRNA sequence
aggactcagggagccgcgcc

SEQ ID NO: 688868 - DNA, 20 bp, Artificial
  CRISPR gRNA sequence
gactcagggagccgcgcccg

SEQ ID NO: 688869 - DNA, 20 bp, Artificial
  CRISPR gRNA sequence
actcagggagccgcgcccgg

SEQ ID NO: 688870 - DNA, 20 bp, Artificial
  CRISPR gRNA sequence
tcagggagccgcgcccggag

SEQ ID NO: 688871 - DNA, 20 bp, Artificial
  CRISPR gRNA sequence
cagggagccgcgcccggagg

SEQ ID NO: 688872 - DNA, 20 bp, Artificial
  CRISPR gRNA sequence
agggagccgcgcccggagga

SEQ ID NO: 688873 - DNA, 20 bp, Artificial
  CRISPR gRNA sequence
gccgcgcccggaggagggtc

SEQ ID NO: 688874 - DNA, 20 bp, Artificial
  CRISPR gRNA sequence
gcgcccggaggagggtctgg

SEQ ID NO: 688875 - DNA, 20 bp, Artificial
  CRISPR gRNA sequence
cgcccggaggagggtctggc

SEQ ID NO: 688876 - DNA, 20 bp, Artificial
  CRISPR gRNA sequence
gaggagggtctggcgggtct

SEQ ID NO: 688877 - DNA, 20 bp, Artificial
  CRISPR gRNA sequence
tctcagcccctcctcgcccc

SEQ ID NO: 688878 - DNA, 20 bp, Artificial
  CRISPR gRNA sequence
ctcagcccctcctcgccccc

SEQ ID NO: 688879 - DNA, 20 bp, Artificial
  CRISPR gRNA sequence
cccccaggctcccactcctt

SEQ ID NO: 688880 - DNA, 20 bp, Artificial
  CRISPR gRNA sequence
ccccaggctcccactccttg

SEQ ID NO: 688881 - DNA, 20 bp, Artificial
  CRISPR gRNA sequence
tcccactccttgaggtattt

SEQ ID NO: 688882 - DNA, 20 bp, Artificial
  CRISPR gRNA sequence
atttcagcaccgctgtgtcg

SEQ ID NO: 688883 - DNA, 20 bp, Artificial
  CRISPR gRNA sequence
agcaccgctgtgtcgcggcc

SEQ ID NO: 688884 - DNA, 20 bp, Artificial
  CRISPR gRNA sequence
gctgtgtcgcggcccggccg

SEQ ID NO: 688885 - DNA, 20 bp, Artificial
  CRISPR gRNA sequence
ctgtgtcgcggcccggccgc

SEQ ID NO: 688886 - DNA, 20 bp, Artificial
  CRISPR gRNA sequence
tgtgtcgcggcccggccgcg

SEQ ID NO: 688887 - DNA, 20 bp, Artificial
  CRISPR gRNA sequence
tgtcgcggcccggccgcggg

SEQ ID NO: 688888 - DNA, 20 bp, Artificial
  CRISPR gRNA sequence
ggagccccgctacatcgccg

SEQ ID NO: 688889 - DNA, 20 bp, Artificial
  CRISPR gRNA sequence
agccccgctacatcgccgtg

SEQ ID NO: 688890 - DNA, 20 bp, Artificial
  CRISPR gRNA sequence
ctacatcgccgtggagtacg

SEQ ID NO: 688891 - DNA, 20 bp, Artificial
  CRISPR gRNA sequence
tagacgacacgcaattcctg

SEQ ID NO: 688892 - DNA, 20 bp, Artificial
  CRISPR gRNA sequence
acgcaattcctgcggttcga

SEQ ID NO: 688893 - DNA, 20 bp, Artificial
  CRISPR gRNA sequence
gacagcgacgccgcgattcc

SEQ ID NO: 688894 - DNA, 20 bp, Artificial
  CRISPR gRNA sequence
acagcgacgccgcgattccg

SEQ ID NO: 688895 - DNA, 20 bp, Artificial
  CRISPR gRNA sequence
cgacgccgcgattccgagga

SEQ ID NO: 688896 - DNA, 20 bp, Artificial
  CRISPR gRNA sequence
acgccgcgattccgaggatg

SEQ ID NO: 688897 - DNA, 20 bp, Artificial
  CRISPR gRNA sequence
cgattccgaggatggagccg

SEQ ID NO: 688898 - DNA, 20 bp, Artificial
  CRISPR gRNA sequence
gattccgaggatggagccgc

SEQ ID NO: 688899 - DNA, 20 bp, Artificial
  CRISPR gRNA sequence
ttccgaggatggagccgcgg

SEQ ID NO: 688900 - DNA, 20 bp, Artificial
  CRISPR gRNA sequence
ggatggagccgcgggagccg

SEQ ID NO: 688901 - DNA, 20 bp, Artificial
  CRISPR gRNA sequence
gatggagccgcgggagccgt

SEQ ID NO: 688902 - DNA, 20 bp, Artificial
  CRISPR gRNA sequence
ggagccgcgggagccgtggg

SEQ ID NO: 688903 - DNA, 20 bp, Artificial
  CRISPR gRNA sequence
agccgcgggagccgtgggtg

SEQ ID NO: 688904 - DNA, 20 bp, Artificial
  CRISPR gRNA sequence
gcgggagccgtgggtggagc

SEQ ID NO: 688905 - DNA, 20 bp, Artificial
  CRISPR gRNA sequence
gggagccgtgggtggagcaa

SEQ ID NO: 688906 - DNA, 20 bp, Artificial
  CRISPR gRNA sequence
ggagccgtgggtggagcaag

SEQ ID NO: 688907 - DNA, 20 bp, Artificial
  CRISPR gRNA sequence
gagccgtgggtggagcaaga

SEQ ID NO: 688908 - DNA, 20 bp, Artificial
  CRISPR gRNA sequence
agccgtgggtggagcaagag

SEQ ID NO: 688909 - DNA, 20 bp, Artificial
  CRISPR gRNA sequence
gggtggagcaagaggggccg

SEQ ID NO: 688910 - DNA, 20 bp, Artificial
  CRISPR gRNA sequence
agcaagaggggccgcagtat

SEQ ID NO: 688911 - DNA, 20 bp, Artificial
  CRISPR gRNA sequence
gcaagaggggccgcagtatt

SEQ ID NO: 688912 - DNA, 20 bp, Artificial
  CRISPR gRNA sequence
aagaggggccgcagtattgg

SEQ ID NO: 688913 - DNA, 20 bp, Artificial
  CRISPR gRNA sequence
aggggccgcagtattgggag

SEQ ID NO: 688914 - DNA, 20 bp, Artificial
  CRISPR gRNA sequence
gcagtattgggagtggacca

SEQ ID NO: 688915 - DNA, 20 bp, Artificial
  CRISPR gRNA sequence
cagtattgggagtggaccac

SEQ ID NO: 688916 - DNA, 20 bp, Artificial
  CRISPR gRNA sequence
agtattgggagtggaccaca

SEQ ID NO: 688917 - DNA, 20 bp, Artificial
  CRISPR gRNA sequence
agtggaccacagggtacgcc

SEQ ID NO: 688918 - DNA, 20 bp, Artificial
  CRISPR gRNA sequence
gtggaccacagggtacgcca

SEQ ID NO: 688919 - DNA, 20 bp, Artificial
  CRISPR gRNA sequence
ggtacgccaaggccaacgca

SEQ ID NO: 688920 - DNA, 20 bp, Artificial
  CRISPR gRNA sequence
ggccaacgcacagactgacc

SEQ ID NO: 688921 - DNA, 20 bp, Artificial
  CRISPR gRNA sequence
caacgcacagactgaccgag

SEQ ID NO: 688922 - DNA, 20 bp, Artificial
  CRISPR gRNA sequence
cagactgaccgagtggccct

SEQ ID NO: 688923 - DNA, 20 bp, Artificial
  CRISPR gRNA sequence
agactgaccgagtggccctg

SEQ ID NO: 688924 - DNA, 20 bp, Artificial
  CRISPR gRNA sequence
acctgctccgccgctacaac

SEQ ID NO: 688925 - DNA, 20 bp, Artificial
  CRISPR gRNA sequence
ctgctccgccgctacaacca

SEQ ID NO: 688926 - DNA, 20 bp, Artificial
  CRISPR gRNA sequence
tccgccgctacaaccagagc

SEQ ID NO: 688927 - DNA, 20 bp, Artificial
  CRISPR gRNA sequence
ccgccgctacaaccagagcg

SEQ ID NO: 688928 - DNA, 20 bp, Artificial
  CRISPR gRNA sequence
cgctacaaccagagcgaggc

SEQ ID NO: 688929 - DNA, 20 bp, Artificial
  CRISPR gRNA sequence
acaaccagagcgaggctggt

SEQ ID NO: 688930 - DNA, 20 bp, Artificial
  CRISPR gRNA sequence
gcgaggctggtgagtgaacc

SEQ ID NO: 688931 - DNA, 20 bp, Artificial
  CRISPR gRNA sequence
ggctggtgagtgaacccggc

SEQ ID NO: 688932 - DNA, 20 bp, Artificial
  CRISPR gRNA sequence
gctggtgagtgaacccggcc

SEQ ID NO: 688933 - DNA, 20 bp, Artificial
  CRISPR gRNA sequence
ctggtgagtgaacccggccg

SEQ ID NO: 688934 - DNA, 20 bp, Artificial
  CRISPR gRNA sequence
tggtgagtgaacccggccgg

SEQ ID NO: 688935 - DNA, 20 bp, Artificial
  CRISPR gRNA sequence
agtgaacccggccgggggcg

SEQ ID NO: 688936 - DNA, 20 bp, Artificial
  CRISPR gRNA sequence
gtgaacccggccgggggcgc

SEQ ID NO: 688937 - DNA, 20 bp, Artificial
  CRISPR gRNA sequence
cgaccaccccccatccgcca

SEQ ID NO: 688938 - DNA, 20 bp, Artificial
  CRISPR gRNA sequence
cccatccgccacggaccgcc

SEQ ID NO: 688939 - DNA, 20 bp, Artificial
  CRISPR gRNA sequence
ccatccgccacggaccgccc

SEQ ID NO: 688940 - DNA, 20 bp, Artificial
  CRISPR gRNA sequence
cacggaccgcccgggtcccc

SEQ ID NO: 688941 - DNA, 20 bp, Artificial
  CRISPR gRNA sequence
cggaccgcccgggtccccca

SEQ ID NO: 688942 - DNA, 20 bp, Artificial
  CRISPR gRNA sequence
cccgggtcccccagagtctc

SEQ ID NO: 688943 - DNA, 20 bp, Artificial
  CRISPR gRNA sequence
ccggatccgaaatctacccc

SEQ ID NO: 688944 - DNA, 20 bp, Artificial
  CRISPR gRNA sequence
cggatccgaaatctaccccg

SEQ ID NO: 688945 - DNA, 20 bp, Artificial
  CRISPR gRNA sequence
atccgaaatctaccccgagg

SEQ ID NO: 688946 - DNA, 20 bp, Artificial
  CRISPR gRNA sequence
cgaaatctaccccgaggcag

SEQ ID NO: 688947 - DNA, 20 bp, Artificial
  CRISPR gRNA sequence
gaaatctaccccgaggcagc

SEQ ID NO: 688948 - DNA, 20 bp, Artificial
  CRISPR gRNA sequence
ccgaggcagcgggacccgcc

SEQ ID NO: 688949 - DNA, 20 bp, Artificial
  CRISPR gRNA sequence
acccgcccagaccctccacc

SEQ ID NO: 688950 - DNA, 20 bp, Artificial
  CRISPR gRNA sequence
cccgcccagaccctccaccc

SEQ ID NO: 688951 - DNA, 20 bp, Artificial
  CRISPR gRNA sequence
cgcccagaccctccacccgg

SEQ ID NO: 688952 - DNA, 20 bp, Artificial
  CRISPR gRNA sequence
cccagaccctccacccggga

SEQ ID NO: 688953 - DNA, 20 bp, Artificial
  CRISPR gRNA sequence
ccctccacccgggagagtcc

SEQ ID NO: 688954 - DNA, 20 bp, Artificial
  CRISPR gRNA sequence
cctccacccgggagagtccc

SEQ ID NO: 688955 - DNA, 20 bp, Artificial
  CRISPR gRNA sequence
gagtcccaggcgcctttacc

SEQ ID NO: 688956 - DNA, 20 bp, Artificial
  CRISPR gRNA sequence
agtcccaggcgcctttaccg

SEQ ID NO: 688957 - DNA, 20 bp, Artificial
  CRISPR gRNA sequence
cctttaccgaggttcatttt

SEQ ID NO: 688958 - DNA, 20 bp, Artificial
  CRISPR gRNA sequence
accgaggttcattttcagtt

SEQ ID NO: 688959 - DNA, 20 bp, Artificial
  CRISPR gRNA sequence
ccgaggttcattttcagttt

SEQ ID NO: 688960 - DNA, 20 bp, Artificial
  CRISPR gRNA sequence
agtttaggccaaaatccccg

SEQ ID NO: 688961 - DNA, 20 bp, Artificial
  CRISPR gRNA sequence
gtttaggccaaaatccccgc

SEQ ID NO: 688962 - DNA, 20 bp, Artificial
  CRISPR gRNA sequence
aggccaaaatccccgcgggt

SEQ ID NO: 688963 - DNA, 20 bp, Artificial
  CRISPR gRNA sequence
ggccaaaatccccgcgggtt

SEQ ID NO: 688964 - DNA, 20 bp, Artificial
  CRISPR gRNA sequence
caaaatccccgcgggttggg

SEQ ID NO: 688965 - DNA, 20 bp, Artificial
  CRISPR gRNA sequence
aaaatccccgcgggttgggc

SEQ ID NO: 688966 - DNA, 20 bp, Artificial
  CRISPR gRNA sequence
aaatccccgcgggttgggcg

SEQ ID NO: 688967 - DNA, 20 bp, Artificial
  CRISPR gRNA sequence
atccccgcgggttgggcggg

SEQ ID NO: 688968 - DNA, 20 bp, Artificial
  CRISPR gRNA sequence
tccccgcgggttgggcgggg

SEQ ID NO: 688969 - DNA, 20 bp, Artificial
  CRISPR gRNA sequence
ccccgcgggttgggcgggga

SEQ ID NO: 688970 - DNA, 20 bp, Artificial
  CRISPR gRNA sequence
cccgcgggttgggcggggag

SEQ ID NO: 688971 - DNA, 20 bp, Artificial
  CRISPR gRNA sequence
ccgcgggttgggcggggagg

SEQ ID NO: 688972 - DNA, 20 bp, Artificial
  CRISPR gRNA sequence
cgggttgggcggggaggggg

SEQ ID NO: 688973 - DNA, 20 bp, Artificial
  CRISPR gRNA sequence
gggttgggcggggagggggc

SEQ ID NO: 688974 - DNA, 20 bp, Artificial
  CRISPR gRNA sequence
ggttgggcggggagggggcg

SEQ ID NO: 688975 - DNA, 20 bp, Artificial
  CRISPR gRNA sequence
gggcggggagggggcggggc

SEQ ID NO: 688976 - DNA, 20 bp, Artificial
  CRISPR gRNA sequence
ggggagggggcggggctagc

SEQ ID NO: 688977 - DNA, 20 bp, Artificial
  CRISPR gRNA sequence
gggagggggcggggctagct

SEQ ID NO: 688978 - DNA, 20 bp, Artificial
  CRISPR gRNA sequence
agggggcggggctagctggg

SEQ ID NO: 688979 - DNA, 20 bp, Artificial
  CRISPR gRNA sequence
gggggcggggctagctgggc

SEQ ID NO: 688980 - DNA, 20 bp, Artificial
  CRISPR gRNA sequence
ggggcggggctagctgggcg

SEQ ID NO: 688981 - DNA, 20 bp, Artificial
  CRISPR gRNA sequence
tagctgggcggggctgactg

SEQ ID NO: 688982 - DNA, 20 bp, Artificial
  CRISPR gRNA sequence
agctgggcggggctgactgc

SEQ ID NO: 688983 - DNA, 20 bp, Artificial
  CRISPR gRNA sequence
gctgggcggggctgactgcg

SEQ ID NO: 688984 - DNA, 20 bp, Artificial
  CRISPR gRNA sequence
gcggggctgactgcggggac

SEQ ID NO: 688985 - DNA, 20 bp, Artificial
  CRISPR gRNA sequence
ggctgactgcggggaccggc

SEQ ID NO: 688986 - DNA, 20 bp, Artificial
  CRISPR gRNA sequence
gctgactgcggggaccggct

SEQ ID NO: 688987 - DNA, 20 bp, Artificial
  CRISPR gRNA sequence
ctgactgcggggaccggcta

SEQ ID NO: 688988 - DNA, 20 bp, Artificial
  CRISPR gRNA sequence
ggctagggtctcacaccctc

SEQ ID NO: 688989 - DNA, 20 bp, Artificial
  CRISPR gRNA sequence
gctagggtctcacaccctcc

SEQ ID NO: 688990 - DNA, 20 bp, Artificial
  CRISPR gRNA sequence
ctagggtctcacaccctcca

SEQ ID NO: 688991 - DNA, 20 bp, Artificial
  CRISPR gRNA sequence
cacaccctccagggaatgaa

SEQ ID NO: 688992 - DNA, 20 bp, Artificial
  CRISPR gRNA sequence
gggaatgaatggctgcgaca

SEQ ID NO: 688993 - DNA, 20 bp, Artificial
  CRISPR gRNA sequence
ggaatgaatggctgcgacat

SEQ ID NO: 688994 - DNA, 20 bp, Artificial
  CRISPR gRNA sequence
gaatgaatggctgcgacatg

SEQ ID NO: 688995 - DNA, 20 bp, Artificial
  CRISPR gRNA sequence
ggctgcgacatggggcccga

SEQ ID NO: 688996 - DNA, 20 bp, Artificial
  CRISPR gRNA sequence
cccgacggacgcctcctccg

SEQ ID NO: 688997 - DNA, 20 bp, Artificial
  CRISPR gRNA sequence
ccgacggacgcctcctccgc

SEQ ID NO: 688998 - DNA, 20 bp, Artificial
  CRISPR gRNA sequence
gcctcctccgcgggtatcac

SEQ ID NO: 688999 - DNA, 20 bp, Artificial
  CRISPR gRNA sequence
tatcaccagcacgcgtacga

SEQ ID NO: 689000 - DNA, 20 bp, Artificial
  CRISPR gRNA sequence
accagcacgcgtacgacggc

SEQ ID NO: 689001 - DNA, 20 bp, Artificial
  CRISPR gRNA sequence
ccagcacgcgtacgacggca

SEQ ID NO: 689002 - DNA, 20 bp, Artificial
  CRISPR gRNA sequence
aggattacatctccctgaac

SEQ ID NO: 689003 - DNA, 20 bp, Artificial
  CRISPR gRNA sequence
ggattacatctccctgaacg

SEQ ID NO: 689004 - DNA, 20 bp, Artificial
  CRISPR gRNA sequence
tgaacgaggacctgcgctcc

SEQ ID NO: 689005 - DNA, 20 bp, Artificial
  CRISPR gRNA sequence
ggacctgcgctcctggaccg

SEQ ID NO: 689006 - DNA, 20 bp, Artificial
  CRISPR gRNA sequence
cctgcgctcctggaccgcgg

SEQ ID NO: 689007 - DNA, 20 bp, Artificial
  CRISPR gRNA sequence
ctggaccgcggcggacaccg

SEQ ID NO: 689008 - DNA, 20 bp, Artificial
  CRISPR gRNA sequence
ccgcggcggacaccgtggct

SEQ ID NO: 689009 - DNA, 20 bp, Artificial
  CRISPR gRNA sequence
acaccgtggctcagatcacc

SEQ ID NO: 689010 - DNA, 20 bp, Artificial
  CRISPR gRNA sequence
agatcacccagcgcttctat

SEQ ID NO: 689011 - DNA, 20 bp, Artificial
  CRISPR gRNA sequence
gatcacccagcgcttctatg

SEQ ID NO: 689012 - DNA, 20 bp, Artificial
  CRISPR gRNA sequence
cacccagcgcttctatgagg

SEQ ID NO: 689013 - DNA, 20 bp, Artificial
  CRISPR gRNA sequence
cccagcgcttctatgaggca

SEQ ID NO: 689014 - DNA, 20 bp, Artificial
  CRISPR gRNA sequence
ccagcgcttctatgaggcag

SEQ ID NO: 689015 - DNA, 20 bp, Artificial
  CRISPR gRNA sequence
ctatgaggcagaggaatatg

SEQ ID NO: 689016 - DNA, 20 bp, Artificial
  CRISPR gRNA sequence
atgaggcagaggaatatgca

SEQ ID NO: 689017 - DNA, 20 bp, Artificial
  CRISPR gRNA sequence
tgaggcagaggaatatgcag

SEQ ID NO: 689018 - DNA, 20 bp, Artificial
  CRISPR gRNA sequence
aggcagaggaatatgcagag

SEQ ID NO: 689019 - DNA, 20 bp, Artificial
  CRISPR gRNA sequence
gaggaatatgcagaggagtt

SEQ ID NO: 689020 - DNA, 20 bp, Artificial
  CRISPR gRNA sequence
aggaatatgcagaggagttc

SEQ ID NO: 689021 - DNA, 20 bp, Artificial
  CRISPR gRNA sequence
agaggagttcaggacctacc

SEQ ID NO: 689022 - DNA, 20 bp, Artificial
  CRISPR gRNA sequence
aggagttcaggacctacctg

SEQ ID NO: 689023 - DNA, 20 bp, Artificial
  CRISPR gRNA sequence
ggagttcaggacctacctgg

SEQ ID NO: 689024 - DNA, 20 bp, Artificial
  CRISPR gRNA sequence
gagttcaggacctacctgga

SEQ ID NO: 689025 - DNA, 20 bp, Artificial
  CRISPR gRNA sequence
tcaggacctacctggagggc

SEQ ID NO: 689026 - DNA, 20 bp, Artificial
  CRISPR gRNA sequence
ctacctggagggcgagtgcc

SEQ ID NO: 689027 - DNA, 20 bp, Artificial
  CRISPR gRNA sequence
acctggagggcgagtgcctg

SEQ ID NO: 689028 - DNA, 20 bp, Artificial
  CRISPR gRNA sequence
gagtgcctggagttgctccg

SEQ ID NO: 689029 - DNA, 20 bp, Artificial
  CRISPR gRNA sequence
ggagttgctccgcagatact

SEQ ID NO: 689030 - DNA, 20 bp, Artificial
  CRISPR gRNA sequence
agttgctccgcagatacttg

SEQ ID NO: 689031 - DNA, 20 bp, Artificial
  CRISPR gRNA sequence
ctccgcagatacttggagaa

SEQ ID NO: 689032 - DNA, 20 bp, Artificial
  CRISPR gRNA sequence
tccgcagatacttggagaat

SEQ ID NO: 689033 - DNA, 20 bp, Artificial
  CRISPR gRNA sequence
gcagatacttggagaatggg

SEQ ID NO: 689034 - DNA, 20 bp, Artificial
  CRISPR gRNA sequence
cagatacttggagaatggga

SEQ ID NO: 689035 - DNA, 20 bp, Artificial
  CRISPR gRNA sequence
gatacttggagaatgggaag

SEQ ID NO: 689036 - DNA, 20 bp, Artificial
  CRISPR gRNA sequence
agaatgggaaggagacgcta

SEQ ID NO: 689037 - DNA, 20 bp, Artificial
  CRISPR gRNA sequence
gaaggagacgctacagcgcg

SEQ ID NO: 689038 - DNA, 20 bp, Artificial
  CRISPR gRNA sequence
aaggagacgctacagcgcgc

SEQ ID NO: 689039 - DNA, 20 bp, Artificial
  CRISPR gRNA sequence
acgctacagcgcgcaggtac

SEQ ID NO: 689040 - DNA, 20 bp, Artificial
  CRISPR gRNA sequence
cgctacagcgcgcaggtacc

SEQ ID NO: 689041 - DNA, 20 bp, Artificial
  CRISPR gRNA sequence
gctacagcgcgcaggtacca

SEQ ID NO: 689042 - DNA, 20 bp, Artificial
  CRISPR gRNA sequence
ctacagcgcgcaggtaccag

SEQ ID NO: 689043 - DNA, 20 bp, Artificial
  CRISPR gRNA sequence
cgcgcaggtaccaggggcca

SEQ ID NO: 689044 - DNA, 20 bp, Artificial
  CRISPR gRNA sequence
gcgcaggtaccaggggccat

SEQ ID NO: 689045 - DNA, 20 bp, Artificial
  CRISPR gRNA sequence
ggcgccttccctatctcctg

SEQ ID NO: 689046 - DNA, 20 bp, Artificial
  CRISPR gRNA sequence
cctatctcctgtagatctct

SEQ ID NO: 689047 - DNA, 20 bp, Artificial
  CRISPR gRNA sequence
ctatctcctgtagatctctt

SEQ ID NO: 689048 - DNA, 20 bp, Artificial
  CRISPR gRNA sequence
ctcctgtagatctcttggga

SEQ ID NO: 689049 - DNA, 20 bp, Artificial
  CRISPR gRNA sequence
ctcttgggatggcctcgcac

SEQ ID NO: 689050 - DNA, 20 bp, Artificial
  CRISPR gRNA sequence
tcttgggatggcctcgcaca

SEQ ID NO: 689051 - DNA, 20 bp, Artificial
  CRISPR gRNA sequence
gggatggcctcgcacaaggt

SEQ ID NO: 689052 - DNA, 20 bp, Artificial
  CRISPR gRNA sequence
ggatggcctcgcacaaggtt

SEQ ID NO: 689053 - DNA, 20 bp, Artificial
  CRISPR gRNA sequence
atggcctcgcacaaggttgg

SEQ ID NO: 689054 - DNA, 20 bp, Artificial
  CRISPR gRNA sequence
tggcctcgcacaaggttggg

SEQ ID NO: 689055 - DNA, 20 bp, Artificial
  CRISPR gRNA sequence
ctcgcacaaggttgggagga

SEQ ID NO: 689056 - DNA, 20 bp, Artificial
  CRISPR gRNA sequence
gcacaaggttgggaggaaag

SEQ ID NO: 689057 - DNA, 20 bp, Artificial
  CRISPR gRNA sequence
cacaaggttgggaggaaagt

SEQ ID NO: 689058 - DNA, 20 bp, Artificial
  CRISPR gRNA sequence
gaggaaagtgggcccaatgc

SEQ ID NO: 689059 - DNA, 20 bp, Artificial
  CRISPR gRNA sequence
aggaaagtgggcccaatgct

SEQ ID NO: 689060 - DNA, 20 bp, Artificial
  CRISPR gRNA sequence
ctaggatatcgccctccctc

SEQ ID NO: 689061 - DNA, 20 bp, Artificial
  CRISPR gRNA sequence
atcgccctccctctagtcct

SEQ ID NO: 689062 - DNA, 20 bp, Artificial
  CRISPR gRNA sequence
gccctccctctagtcctgag

SEQ ID NO: 689063 - DNA, 20 bp, Artificial
  CRISPR gRNA sequence
ccctccctctagtcctgagt

SEQ ID NO: 689064 - DNA, 20 bp, Artificial
  CRISPR gRNA sequence
tccctctagtcctgagtagg

SEQ ID NO: 689065 - DNA, 20 bp, Artificial
  CRISPR gRNA sequence
ctgagtaggaagaatcttcc

SEQ ID NO: 689066 - DNA, 20 bp, Artificial
  CRISPR gRNA sequence
gaagaatcttcctggctttc

SEQ ID NO: 689067 - DNA, 20 bp, Artificial
  CRISPR gRNA sequence
tcttcctggctttcgagatc

SEQ ID NO: 689068 - DNA, 20 bp, Artificial
  CRISPR gRNA sequence
tggctttcgagatccggtac

SEQ ID NO: 689069 - DNA, 20 bp, Artificial
  CRISPR gRNA sequence
gctttcgagatccggtacca

SEQ ID NO: 689070 - DNA, 20 bp, Artificial
  CRISPR gRNA sequence
tttcgagatccggtaccaga

SEQ ID NO: 689071 - DNA, 20 bp, Artificial
  CRISPR gRNA sequence
cggtaccagagagtgactgt

SEQ ID NO: 689072 - DNA, 20 bp, Artificial
  CRISPR gRNA sequence
gtaccagagagtgactgtga

SEQ ID NO: 689073 - DNA, 20 bp, Artificial
  CRISPR gRNA sequence
tgagagtccgccctgctctc

SEQ ID NO: 689074 - DNA, 20 bp, Artificial
  CRISPR gRNA sequence
gagagtccgccctgctctct

SEQ ID NO: 689075 - DNA, 20 bp, Artificial
  CRISPR gRNA sequence
ccctgctctctgggacaatt

SEQ ID NO: 689076 - DNA, 20 bp, Artificial
  CRISPR gRNA sequence
cctgctctctgggacaatta

SEQ ID NO: 689077 - DNA, 20 bp, Artificial
  CRISPR gRNA sequence
ctgctctctgggacaattaa

SEQ ID NO: 689078 - DNA, 20 bp, Artificial
  CRISPR gRNA sequence
aattaagggatgaaatctct

SEQ ID NO: 689079 - DNA, 20 bp, Artificial
  CRISPR gRNA sequence
attaagggatgaaatctctg

SEQ ID NO: 689080 - DNA, 20 bp, Artificial
  CRISPR gRNA sequence
ttaagggatgaaatctctga

SEQ ID NO: 689081 - DNA, 20 bp, Artificial
  CRISPR gRNA sequence
ggatgaaatctctgagggaa

SEQ ID NO: 689082 - DNA, 20 bp, Artificial
  CRISPR gRNA sequence
atgaaatctctgagggaatg

SEQ ID NO: 689083 - DNA, 20 bp, Artificial
  CRISPR gRNA sequence
tgaaatctctgagggaatgg

SEQ ID NO: 689084 - DNA, 20 bp, Artificial
  CRISPR gRNA sequence
gaaatctctgagggaatgga

SEQ ID NO: 689085 - DNA, 20 bp, Artificial
  CRISPR gRNA sequence
atctctgagggaatggaggg

SEQ ID NO: 689086 - DNA, 20 bp, Artificial
  CRISPR gRNA sequence
ctgagggaatggagggaaga

SEQ ID NO: 689087 - DNA, 20 bp, Artificial
  CRISPR gRNA sequence
aatggagggaagacagtccc

SEQ ID NO: 689088 - DNA, 20 bp, Artificial
  CRISPR gRNA sequence
gtccctggaataccgatccg

SEQ ID NO: 689089 - DNA, 20 bp, Artificial
  CRISPR gRNA sequence
accgatccgcggtccccttt

SEQ ID NO: 689090 - DNA, 20 bp, Artificial
  CRISPR gRNA sequence
gtcccctttgagccctccaa

SEQ ID NO: 689091 - DNA, 20 bp, Artificial
  CRISPR gRNA sequence
tttgagccctccaacagcct

SEQ ID NO: 689092 - DNA, 20 bp, Artificial
  CRISPR gRNA sequence
ttgagccctccaacagcctt

SEQ ID NO: 689093 - DNA, 20 bp, Artificial
  CRISPR gRNA sequence
ggccccgtgacttttctctc

SEQ ID NO: 689094 - DNA, 20 bp, Artificial
  CRISPR gRNA sequence
tgcctcacactcaatgtgtt

SEQ ID NO: 689095 - DNA, 20 bp, Artificial
  CRISPR gRNA sequence
gcctcacactcaatgtgttt

SEQ ID NO: 689096 - DNA, 20 bp, Artificial
  CRISPR gRNA sequence
cctcacactcaatgtgtttg

SEQ ID NO: 689097 - DNA, 20 bp, Artificial
  CRISPR gRNA sequence
tgtgtttggggctctgattc

SEQ ID NO: 689098 - DNA, 20 bp, Artificial
  CRISPR gRNA sequence
gggctctgattccagtccct

SEQ ID NO: 689099 - DNA, 20 bp, Artificial
  CRISPR gRNA sequence
ccagtccctcggcctccact

SEQ ID NO: 689100 - DNA, 20 bp, Artificial
  CRISPR gRNA sequence
cagtccctcggcctccactt

SEQ ID NO: 689101 - DNA, 20 bp, Artificial
  CRISPR gRNA sequence
ccctcggcctccacttaggt

SEQ ID NO: 689102 - DNA, 20 bp, Artificial
  CRISPR gRNA sequence
cctcggcctccacttaggtc

SEQ ID NO: 689103 - DNA, 20 bp, Artificial
  CRISPR gRNA sequence
ctcggcctccacttaggtca

SEQ ID NO: 689104 - DNA, 20 bp, Artificial
  CRISPR gRNA sequence
gcctccacttaggtcagggc

SEQ ID NO: 689105 - DNA, 20 bp, Artificial
  CRISPR gRNA sequence
tccacttaggtcagggccag

SEQ ID NO: 689106 - DNA, 20 bp, Artificial
  CRISPR gRNA sequence
agaagtccctgctccccact

SEQ ID NO: 689107 - DNA, 20 bp, Artificial
  CRISPR gRNA sequence
aagtccctgctccccactca

SEQ ID NO: 689108 - DNA, 20 bp, Artificial
  CRISPR gRNA sequence
ctcagagactcgaactttcc

SEQ ID NO: 689109 - DNA, 20 bp, Artificial
  CRISPR gRNA sequence
tcagagactcgaactttcca

SEQ ID NO: 689110 - DNA, 20 bp, Artificial
  CRISPR gRNA sequence
gactcgaactttccaaggaa

SEQ ID NO: 689111 - DNA, 20 bp, Artificial
  CRISPR gRNA sequence
actcgaactttccaaggaat

SEQ ID NO: 689112 - DNA, 20 bp, Artificial
  CRISPR gRNA sequence
tcgaactttccaaggaatag

SEQ ID NO: 689113 - DNA, 20 bp, Artificial
  CRISPR gRNA sequence
caaggaataggagattttcc

SEQ ID NO: 689114 - DNA, 20 bp, Artificial
  CRISPR gRNA sequence
aaggaataggagattttccc

SEQ ID NO: 689115 - DNA, 20 bp, Artificial
  CRISPR gRNA sequence
ttttcccaggtgtctgtgtc

SEQ ID NO: 689116 - DNA, 20 bp, Artificial
  CRISPR gRNA sequence
tttcccaggtgtctgtgtcc

SEQ ID NO: 689117 - DNA, 20 bp, Artificial
  CRISPR gRNA sequence
ccaggtgtctgtgtccaggc

SEQ ID NO: 689118 - DNA, 20 bp, Artificial
  CRISPR gRNA sequence
tctgtgtccaggctggtgtc

SEQ ID NO: 689119 - DNA, 20 bp, Artificial
  CRISPR gRNA sequence
ctgtgtccaggctggtgtct

SEQ ID NO: 689120 - DNA, 20 bp, Artificial
  CRISPR gRNA sequence
ctgtgctcccttccccaccc

SEQ ID NO: 689121 - DNA, 20 bp, Artificial
  CRISPR gRNA sequence
tgtgctcccttccccacccc

SEQ ID NO: 689122 - DNA, 20 bp, Artificial
  CRISPR gRNA sequence
ccaggtgtcctgtccattct

SEQ ID NO: 689123 - DNA, 20 bp, Artificial
  CRISPR gRNA sequence
caggtgtcctgtccattctc

SEQ ID NO: 689124 - DNA, 20 bp, Artificial
  CRISPR gRNA sequence
tgtcctgtccattctcaggt

SEQ ID NO: 689125 - DNA, 20 bp, Artificial
  CRISPR gRNA sequence
ccattctcaggttggtcaca

SEQ ID NO: 689126 - DNA, 20 bp, Artificial
  CRISPR gRNA sequence
cattctcaggttggtcacat

SEQ ID NO: 689127 - DNA, 20 bp, Artificial
  CRISPR gRNA sequence
gttggtcacatgggtgctgc

SEQ ID NO: 689128 - DNA, 20 bp, Artificial
  CRISPR gRNA sequence
ttggtcacatgggtgctgct

SEQ ID NO: 689129 - DNA, 20 bp, Artificial
  CRISPR gRNA sequence
tggtcacatgggtgctgctg

SEQ ID NO: 689130 - DNA, 20 bp, Artificial
  CRISPR gRNA sequence
gtgctgctggggtttcccat

SEQ ID NO: 689131 - DNA, 20 bp, Artificial
  CRISPR gRNA sequence
tgctgctggggtttcccatg

SEQ ID NO: 689132 - DNA, 20 bp, Artificial
  CRISPR gRNA sequence
ctgctggggtttcccatgag

SEQ ID NO: 689133 - DNA, 20 bp, Artificial
  CRISPR gRNA sequence
ggtttcccatgaggagtgca

SEQ ID NO: 689134 - DNA, 20 bp, Artificial
  CRISPR gRNA sequence
ctgaattttctgactcttct

SEQ ID NO: 689135 - DNA, 20 bp, Artificial
  CRISPR gRNA sequence
gactcttctcagatcctcca

SEQ ID NO: 689136 - DNA, 20 bp, Artificial
  CRISPR gRNA sequence
actcttctcagatcctccaa

SEQ ID NO: 689137 - DNA, 20 bp, Artificial
  CRISPR gRNA sequence
accaccccatctctgaccat

SEQ ID NO: 689138 - DNA, 20 bp, Artificial
  CRISPR gRNA sequence
ccaccccatctctgaccatg

SEQ ID NO: 689139 - DNA, 20 bp, Artificial
  CRISPR gRNA sequence
tctgaccatgaggccaccct

SEQ ID NO: 689140 - DNA, 20 bp, Artificial
  CRISPR gRNA sequence
ctgaccatgaggccaccctg

SEQ ID NO: 689141 - DNA, 20 bp, Artificial
  CRISPR gRNA sequence
atgaggccaccctgaggtgc

SEQ ID NO: 689142 - DNA, 20 bp, Artificial
  CRISPR gRNA sequence
tgaggccaccctgaggtgct

SEQ ID NO: 689143 - DNA, 20 bp, Artificial
  CRISPR gRNA sequence
caccctgaggtgctgggccc

SEQ ID NO: 689144 - DNA, 20 bp, Artificial
  CRISPR gRNA sequence
accctgaggtgctgggccct

SEQ ID NO: 689145 - DNA, 20 bp, Artificial
  CRISPR gRNA sequence
ggccctgggcttctaccctg

SEQ ID NO: 689146 - DNA, 20 bp, Artificial
  CRISPR gRNA sequence
ccctgggcttctaccctgcg

SEQ ID NO: 689147 - DNA, 20 bp, Artificial
  CRISPR gRNA sequence
ctgcggagatcacgctgacc

SEQ ID NO: 689148 - DNA, 20 bp, Artificial
  CRISPR gRNA sequence
cggagatcacgctgacctgg

SEQ ID NO: 689149 - DNA, 20 bp, Artificial
  CRISPR gRNA sequence
agatcacgctgacctggcag

SEQ ID NO: 689150 - DNA, 20 bp, Artificial
  CRISPR gRNA sequence
gatcacgctgacctggcagc

SEQ ID NO: 689151 - DNA, 20 bp, Artificial
  CRISPR gRNA sequence
acgctgacctggcagcggga

SEQ ID NO: 689152 - DNA, 20 bp, Artificial
  CRISPR gRNA sequence
cgctgacctggcagcgggat

SEQ ID NO: 689153 - DNA, 20 bp, Artificial
  CRISPR gRNA sequence
gctgacctggcagcgggatg

SEQ ID NO: 689154 - DNA, 20 bp, Artificial
  CRISPR gRNA sequence
tgacctggcagcgggatggg

SEQ ID NO: 689155 - DNA, 20 bp, Artificial
  CRISPR gRNA sequence
gacctggcagcgggatgggg

SEQ ID NO: 689156 - DNA, 20 bp, Artificial
  CRISPR gRNA sequence
ggcagcgggatggggaggaa

SEQ ID NO: 689157 - DNA, 20 bp, Artificial
  CRISPR gRNA sequence
gggatggggaggaacagacc

SEQ ID NO: 689158 - DNA, 20 bp, Artificial
  CRISPR gRNA sequence
ggatggggaggaacagaccc

SEQ ID NO: 689159 - DNA, 20 bp, Artificial
  CRISPR gRNA sequence
ggaggaacagacccaggaca

SEQ ID NO: 689160 - DNA, 20 bp, Artificial
  CRISPR gRNA sequence
aggaacagacccaggacaca

SEQ ID NO: 689161 - DNA, 20 bp, Artificial
  CRISPR gRNA sequence
gacccaggacacagagcttg

SEQ ID NO: 689162 - DNA, 20 bp, Artificial
  CRISPR gRNA sequence
cccaggacacagagcttgtg

SEQ ID NO: 689163 - DNA, 20 bp, Artificial
  CRISPR gRNA sequence
gacacagagcttgtggagac

SEQ ID NO: 689164 - DNA, 20 bp, Artificial
  CRISPR gRNA sequence
acacagagcttgtggagacc

SEQ ID NO: 689165 - DNA, 20 bp, Artificial
  CRISPR gRNA sequence
gcttgtggagaccaggcctg

SEQ ID NO: 689166 - DNA, 20 bp, Artificial
  CRISPR gRNA sequence
cttgtggagaccaggcctgc

SEQ ID NO: 689167 - DNA, 20 bp, Artificial
  CRISPR gRNA sequence
ttgtggagaccaggcctgca

SEQ ID NO: 689168 - DNA, 20 bp, Artificial
  CRISPR gRNA sequence
tgtggagaccaggcctgcag

SEQ ID NO: 689169 - DNA, 20 bp, Artificial
  CRISPR gRNA sequence
gagaccaggcctgcagggga

SEQ ID NO: 689170 - DNA, 20 bp, Artificial
  CRISPR gRNA sequence
ctgcaggggatggaaccttc

SEQ ID NO: 689171 - DNA, 20 bp, Artificial
  CRISPR gRNA sequence
caggggatggaaccttccag

SEQ ID NO: 689172 - DNA, 20 bp, Artificial
  CRISPR gRNA sequence
gggatggaaccttccagaag

SEQ ID NO: 689173 - DNA, 20 bp, Artificial
  CRISPR gRNA sequence
ggatggaaccttccagaagt

SEQ ID NO: 689174 - DNA, 20 bp, Artificial
  CRISPR gRNA sequence
cttccagaagtgggccgctg

SEQ ID NO: 689175 - DNA, 20 bp, Artificial
  CRISPR gRNA sequence
ccagaagtgggccgctgtgg

SEQ ID NO: 689176 - DNA, 20 bp, Artificial
  CRISPR gRNA sequence
gccgctgtggtggtgccttc

SEQ ID NO: 689177 - DNA, 20 bp, Artificial
  CRISPR gRNA sequence
cgctgtggtggtgccttctg

SEQ ID NO: 689178 - DNA, 20 bp, Artificial
  CRISPR gRNA sequence
ctgtggtggtgccttctgga

SEQ ID NO: 689179 - DNA, 20 bp, Artificial
  CRISPR gRNA sequence
tgtggtggtgccttctggag

SEQ ID NO: 689180 - DNA, 20 bp, Artificial
  CRISPR gRNA sequence
tggtgccttctggagaggaa

SEQ ID NO: 689181 - DNA, 20 bp, Artificial
  CRISPR gRNA sequence
gtgccttctggagaggaaca

SEQ ID NO: 689182 - DNA, 20 bp, Artificial
  CRISPR gRNA sequence
agagatacacatgccatgtg

SEQ ID NO: 689183 - DNA, 20 bp, Artificial
  CRISPR gRNA sequence
acacatgccatgtgcagcac

SEQ ID NO: 689184 - DNA, 20 bp, Artificial
  CRISPR gRNA sequence
cacatgccatgtgcagcacg

SEQ ID NO: 689185 - DNA, 20 bp, Artificial
  CRISPR gRNA sequence
acatgccatgtgcagcacga

SEQ ID NO: 689186 - DNA, 20 bp, Artificial
  CRISPR gRNA sequence
catgccatgtgcagcacgag

SEQ ID NO: 689187 - DNA, 20 bp, Artificial
  CRISPR gRNA sequence
tgcagcacgaggggctgccc

SEQ ID NO: 689188 - DNA, 20 bp, Artificial
  CRISPR gRNA sequence
ctgccccagcccctcatcct

SEQ ID NO: 689189 - DNA, 20 bp, Artificial
  CRISPR gRNA sequence
cccagcccctcatcctgaga

SEQ ID NO: 689190 - DNA, 20 bp, Artificial
  CRISPR gRNA sequence
ccagcccctcatcctgagat

SEQ ID NO: 689191 - DNA, 20 bp, Artificial
  CRISPR gRNA sequence
cagcccctcatcctgagatg

SEQ ID NO: 689192 - DNA, 20 bp, Artificial
  CRISPR gRNA sequence
ccctcatcctgagatggggt

SEQ ID NO: 689193 - DNA, 20 bp, Artificial
  CRISPR gRNA sequence
cctcatcctgagatggggta

SEQ ID NO: 689194 - DNA, 20 bp, Artificial
  CRISPR gRNA sequence
tcatcctgagatggggtaag

SEQ ID NO: 689195 - DNA, 20 bp, Artificial
  CRISPR gRNA sequence
catcctgagatggggtaagg

SEQ ID NO: 689196 - DNA, 20 bp, Artificial
  CRISPR gRNA sequence
atcctgagatggggtaagga

SEQ ID NO: 689197 - DNA, 20 bp, Artificial
  CRISPR gRNA sequence
cctgagatggggtaaggagg

SEQ ID NO: 689198 - DNA, 20 bp, Artificial
  CRISPR gRNA sequence
agatggggtaaggagggaga

SEQ ID NO: 689199 - DNA, 20 bp, Artificial
  CRISPR gRNA sequence
gatggggtaaggagggagat

SEQ ID NO: 689200 - DNA, 20 bp, Artificial
  CRISPR gRNA sequence
ggtaaggagggagatgggta

SEQ ID NO: 689201 - DNA, 20 bp, Artificial
  CRISPR gRNA sequence
taaggagggagatgggtaaa

SEQ ID NO: 689202 - DNA, 20 bp, Artificial
  CRISPR gRNA sequence
aaggagggagatgggtaaag

SEQ ID NO: 689203 - DNA, 20 bp, Artificial
  CRISPR gRNA sequence
aggagggagatgggtaaaga

SEQ ID NO: 689204 - DNA, 20 bp, Artificial
  CRISPR gRNA sequence
ggagggagatgggtaaagag

SEQ ID NO: 689205 - DNA, 20 bp, Artificial
  CRISPR gRNA sequence
agatgggtaaagaggggaac

SEQ ID NO: 689206 - DNA, 20 bp, Artificial
  CRISPR gRNA sequence
gatgggtaaagaggggaacg

SEQ ID NO: 689207 - DNA, 20 bp, Artificial
  CRISPR gRNA sequence
atgggtaaagaggggaacga

SEQ ID NO: 689208 - DNA, 20 bp, Artificial
  CRISPR gRNA sequence
tgggtaaagaggggaacgag

SEQ ID NO: 689209 - DNA, 20 bp, Artificial
  CRISPR gRNA sequence
cgaggggtcatgtcttttct

SEQ ID NO: 689210 - DNA, 20 bp, Artificial
  CRISPR gRNA sequence
gaggggtcatgtcttttctc

SEQ ID NO: 689211 - DNA, 20 bp, Artificial
  CRISPR gRNA sequence
aggggtcatgtcttttctca

SEQ ID NO: 689212 - DNA, 20 bp, Artificial
  CRISPR gRNA sequence
gtcatgtcttttctcaggga

SEQ ID NO: 689213 - DNA, 20 bp, Artificial
  CRISPR gRNA sequence
atgtcttttctcagggaaag

SEQ ID NO: 689214 - DNA, 20 bp, Artificial
  CRISPR gRNA sequence
tgtcttttctcagggaaagc

SEQ ID NO: 689215 - DNA, 20 bp, Artificial
  CRISPR gRNA sequence
tcttttctcagggaaagcag

SEQ ID NO: 689216 - DNA, 20 bp, Artificial
  CRISPR gRNA sequence
agggaaagcaggagcccttc

SEQ ID NO: 689217 - DNA, 20 bp, Artificial
  CRISPR gRNA sequence
ggaaagcaggagcccttctg

SEQ ID NO: 689218 - DNA, 20 bp, Artificial
  CRISPR gRNA sequence
ggagcccttctggagctctt

SEQ ID NO: 689219 - DNA, 20 bp, Artificial
  CRISPR gRNA sequence
gcccttctggagctcttcag

SEQ ID NO: 689220 - DNA, 20 bp, Artificial
  CRISPR gRNA sequence
cccttctggagctcttcagc

SEQ ID NO: 689221 - DNA, 20 bp, Artificial
  CRISPR gRNA sequence
ccttctggagctcttcagca

SEQ ID NO: 689222 - DNA, 20 bp, Artificial
  CRISPR gRNA sequence
ctggagctcttcagcagggt

SEQ ID NO: 689223 - DNA, 20 bp, Artificial
  CRISPR gRNA sequence
tggagctcttcagcagggtc

SEQ ID NO: 689224 - DNA, 20 bp, Artificial
  CRISPR gRNA sequence
ggagctcttcagcagggtca

SEQ ID NO: 689225 - DNA, 20 bp, Artificial
  CRISPR gRNA sequence
tcttcagcagggtcagggct

SEQ ID NO: 689226 - DNA, 20 bp, Artificial
  CRISPR gRNA sequence
cttcagcagggtcagggctg

SEQ ID NO: 689227 - DNA, 20 bp, Artificial
  CRISPR gRNA sequence
gcagggtcagggctgaggcc

SEQ ID NO: 689228 - DNA, 20 bp, Artificial
  CRISPR gRNA sequence
agggtcagggctgaggcctg

SEQ ID NO: 689229 - DNA, 20 bp, Artificial
  CRISPR gRNA sequence
cagggctgaggcctggagat

SEQ ID NO: 689230 - DNA, 20 bp, Artificial
  CRISPR gRNA sequence
agggctgaggcctggagatc

SEQ ID NO: 689231 - DNA, 20 bp, Artificial
  CRISPR gRNA sequence
gggctgaggcctggagatca

SEQ ID NO: 689232 - DNA, 20 bp, Artificial
  CRISPR gRNA sequence
ctcaccttcccttcctttcc

SEQ ID NO: 689233 - DNA, 20 bp, Artificial
  CRISPR gRNA sequence
caccttcccttcctttccca

SEQ ID NO: 689234 - DNA, 20 bp, Artificial
  CRISPR gRNA sequence
cttcccttcctttcccagag

SEQ ID NO: 689235 - DNA, 20 bp, Artificial
  CRISPR gRNA sequence
ctttcccagagcagtctccc

SEQ ID NO: 689236 - DNA, 20 bp, Artificial
  CRISPR gRNA sequence
ccagcccaccatccccatcg

SEQ ID NO: 689237 - DNA, 20 bp, Artificial
  CRISPR gRNA sequence
cagcccaccatccccatcgt

SEQ ID NO: 689238 - DNA, 20 bp, Artificial
  CRISPR gRNA sequence
cccatcgtgggcatcgttgc

SEQ ID NO: 689239 - DNA, 20 bp, Artificial
  CRISPR gRNA sequence
gttgctggccttgttgtcct

SEQ ID NO: 689240 - DNA, 20 bp, Artificial
  CRISPR gRNA sequence
tgctggccttgttgtccttg

SEQ ID NO: 689241 - DNA, 20 bp, Artificial
  CRISPR gRNA sequence
ccttgttgtccttggagctg

SEQ ID NO: 689242 - DNA, 20 bp, Artificial
  CRISPR gRNA sequence
gtccttggagctgtggtcac

SEQ ID NO: 689243 - DNA, 20 bp, Artificial
  CRISPR gRNA sequence
ccttggagctgtggtcactg

SEQ ID NO: 689244 - DNA, 20 bp, Artificial
  CRISPR gRNA sequence
agctgtggtcactggagctg

SEQ ID NO: 689245 - DNA, 20 bp, Artificial
  CRISPR gRNA sequence
ctgtggtcgctgctgtgatg

SEQ ID NO: 689246 - DNA, 20 bp, Artificial
  CRISPR gRNA sequence
gtggtcgctgctgtgatgtg

SEQ ID NO: 689247 - DNA, 20 bp, Artificial
  CRISPR gRNA sequence
tggtcgctgctgtgatgtgg

SEQ ID NO: 689248 - DNA, 20 bp, Artificial
  CRISPR gRNA sequence
tcgctgctgtgatgtggagg

SEQ ID NO: 689249 - DNA, 20 bp, Artificial
  CRISPR gRNA sequence
ctgctgtgatgtggaggaag

SEQ ID NO: 689250 - DNA, 20 bp, Artificial
  CRISPR gRNA sequence
gctgtgatgtggaggaagaa

SEQ ID NO: 689251 - DNA, 20 bp, Artificial
  CRISPR gRNA sequence
gatgtggaggaagaagagct

SEQ ID NO: 689252 - DNA, 20 bp, Artificial
  CRISPR gRNA sequence
atgtggaggaagaagagctc

SEQ ID NO: 689253 - DNA, 20 bp, Artificial
  CRISPR gRNA sequence
tggaggaagaagagctcagg

SEQ ID NO: 689254 - DNA, 20 bp, Artificial
  CRISPR gRNA sequence
ggaggaagaagagctcaggt

SEQ ID NO: 689255 - DNA, 20 bp, Artificial
  CRISPR gRNA sequence
ggaagaagagctcaggtagg

SEQ ID NO: 689256 - DNA, 20 bp, Artificial
  CRISPR gRNA sequence
gaagaagagctcaggtagga

SEQ ID NO: 689257 - DNA, 20 bp, Artificial
  CRISPR gRNA sequence
aagaagagctcaggtaggaa

SEQ ID NO: 689258 - DNA, 20 bp, Artificial
  CRISPR gRNA sequence
agaagagctcaggtaggaag

SEQ ID NO: 689259 - DNA, 20 bp, Artificial
  CRISPR gRNA sequence
gagctcaggtaggaaggggt

SEQ ID NO: 689260 - DNA, 20 bp, Artificial
  CRISPR gRNA sequence
agctcaggtaggaaggggtg

SEQ ID NO: 689261 - DNA, 20 bp, Artificial
  CRISPR gRNA sequence
ctcaggtaggaaggggtgag

SEQ ID NO: 689262 - DNA, 20 bp, Artificial
  CRISPR gRNA sequence
aggtaggaaggggtgaggag

SEQ ID NO: 689263 - DNA, 20 bp, Artificial
  CRISPR gRNA sequence
gtaggaaggggtgaggagtg

SEQ ID NO: 689264 - DNA, 20 bp, Artificial
  CRISPR gRNA sequence
aggggtgaggagtggagtct

SEQ ID NO: 689265 - DNA, 20 bp, Artificial
  CRISPR gRNA sequence
tctgagttttcttgtcccac

SEQ ID NO: 689266 - DNA, 20 bp, Artificial
  CRISPR gRNA sequence
ctgagttttcttgtcccact

SEQ ID NO: 689267 - DNA, 20 bp, Artificial
  CRISPR gRNA sequence
tgagttttcttgtcccactg

SEQ ID NO: 689268 - DNA, 20 bp, Artificial
  CRISPR gRNA sequence
gagttttcttgtcccactgg

SEQ ID NO: 689269 - DNA, 20 bp, Artificial
  CRISPR gRNA sequence
cttgtcccactgggggttgc

SEQ ID NO: 689270 - DNA, 20 bp, Artificial
  CRISPR gRNA sequence
cactgggggttgcaagcccc

SEQ ID NO: 689271 - DNA, 20 bp, Artificial
  CRISPR gRNA sequence
tgggggttgcaagccccaag

SEQ ID NO: 689272 - DNA, 20 bp, Artificial
  CRISPR gRNA sequence
gggttgcaagccccaagtag

SEQ ID NO: 689273 - DNA, 20 bp, Artificial
  CRISPR gRNA sequence
agtgtgccctgcctcattac

SEQ ID NO: 689274 - DNA, 20 bp, Artificial
  CRISPR gRNA sequence
gtgtgccctgcctcattact

SEQ ID NO: 689275 - DNA, 20 bp, Artificial
  CRISPR gRNA sequence
tgccctgcctcattactggg

SEQ ID NO: 689276 - DNA, 20 bp, Artificial
  CRISPR gRNA sequence
ggaagcaccatccacactca

SEQ ID NO: 689277 - DNA, 20 bp, Artificial
  CRISPR gRNA sequence
gaagcaccatccacactcat

SEQ ID NO: 689278 - DNA, 20 bp, Artificial
  CRISPR gRNA sequence
tccacactcatgggtctacc

SEQ ID NO: 689279 - DNA, 20 bp, Artificial
  CRISPR gRNA sequence
actcatgggtctacccagcc

SEQ ID NO: 689280 - DNA, 20 bp, Artificial
  CRISPR gRNA sequence
ctcatgggtctacccagcct

SEQ ID NO: 689281 - DNA, 20 bp, Artificial
  CRISPR gRNA sequence
ccagcctgggccctgtgtgc

SEQ ID NO: 689282 - DNA, 20 bp, Artificial
  CRISPR gRNA sequence
ccagcacctactcatttgta

SEQ ID NO: 689283 - DNA, 20 bp, Artificial
  CRISPR gRNA sequence
gtaaagctcctgtgaaaatg

SEQ ID NO: 689284 - DNA, 20 bp, Artificial
  CRISPR gRNA sequence
taaagctcctgtgaaaatga

SEQ ID NO: 689285 - DNA, 20 bp, Artificial
  CRISPR gRNA sequence
gctcctgtgaaaatgaagga

SEQ ID NO: 689286 - DNA, 20 bp, Artificial
  CRISPR gRNA sequence
attcttcacttcgatgatta

SEQ ID NO: 689287 - DNA, 20 bp, Artificial
  CRISPR gRNA sequence
cttcacttcgatgattatgg

SEQ ID NO: 689288 - DNA, 20 bp, Artificial
  CRISPR gRNA sequence
ttcgatgattatggtggtga

SEQ ID NO: 689289 - DNA, 20 bp, Artificial
  CRISPR gRNA sequence
tcgatgattatggtggtgat

SEQ ID NO: 689290 - DNA, 20 bp, Artificial
  CRISPR gRNA sequence
gtggtgatgggacctgatcc

SEQ ID NO: 689291 - DNA, 20 bp, Artificial
  CRISPR gRNA sequence
gtgatgggacctgatcccag

SEQ ID NO: 689292 - DNA, 20 bp, Artificial
  CRISPR gRNA sequence
atcccagcagtcacaaatca

SEQ ID NO: 689293 - DNA, 20 bp, Artificial
  CRISPR gRNA sequence
tcccagcagtcacaaatcac

SEQ ID NO: 689294 - DNA, 20 bp, Artificial
  CRISPR gRNA sequence
cccagcagtcacaaatcaca

SEQ ID NO: 689295 - DNA, 20 bp, Artificial
  CRISPR gRNA sequence
ccagcagtcacaaatcacag

SEQ ID NO: 689296 - DNA, 20 bp, Artificial
  CRISPR gRNA sequence
gcagtcacaaatcacagggg

SEQ ID NO: 689297 - DNA, 20 bp, Artificial
  CRISPR gRNA sequence
cagtcacaaatcacagggga

SEQ ID NO: 689298 - DNA, 20 bp, Artificial
  CRISPR gRNA sequence
gggaaggtccctgctgatga

SEQ ID NO: 689299 - DNA, 20 bp, Artificial
  CRISPR gRNA sequence
tccctgctgatgacagacct

SEQ ID NO: 689300 - DNA, 20 bp, Artificial
  CRISPR gRNA sequence
ccctgctgatgacagacctc

SEQ ID NO: 689301 - DNA, 20 bp, Artificial
  CRISPR gRNA sequence
ctgctgatgacagacctcag

SEQ ID NO: 689302 - DNA, 20 bp, Artificial
  CRISPR gRNA sequence
tgctgatgacagacctcagg

SEQ ID NO: 689303 - DNA, 20 bp, Artificial
  CRISPR gRNA sequence
gctgatgacagacctcagga

SEQ ID NO: 689304 - DNA, 20 bp, Artificial
  CRISPR gRNA sequence
gatgacagacctcaggaggg

SEQ ID NO: 689305 - DNA, 20 bp, Artificial
  CRISPR gRNA sequence
acagacctcaggagggcagt

SEQ ID NO: 689306 - DNA, 20 bp, Artificial
  CRISPR gRNA sequence
cctcaggagggcagttggtc

SEQ ID NO: 689307 - DNA, 20 bp, Artificial
  CRISPR gRNA sequence
ctcaggagggcagttggtcc

SEQ ID NO: 689308 - DNA, 20 bp, Artificial
  CRISPR gRNA sequence
catatttcttgatcctgccc

SEQ ID NO: 689309 - DNA, 20 bp, Artificial
  CRISPR gRNA sequence
ttgatcctgccctggatcta

SEQ ID NO: 689310 - DNA, 20 bp, Artificial
  CRISPR gRNA sequence
gatctacagttacacttttc

SEQ ID NO: 689311 - DNA, 20 bp, Artificial
  CRISPR gRNA sequence
cacttttctggaaacttctc

SEQ ID NO: 689312 - DNA, 20 bp, Artificial
  CRISPR gRNA sequence
acttttctggaaacttctct

SEQ ID NO: 689313 - DNA, 20 bp, Artificial
  CRISPR gRNA sequence
tggaaacttctctgggatca

SEQ ID NO: 689314 - DNA, 20 bp, Artificial
  CRISPR gRNA sequence
acttctctgggatcaaagac

SEQ ID NO: 689315 - DNA, 20 bp, Artificial
  CRISPR gRNA sequence
cttctctgggatcaaagact

SEQ ID NO: 689316 - DNA, 20 bp, Artificial
  CRISPR gRNA sequence
ttctctgggatcaaagacta

SEQ ID NO: 689317 - DNA, 20 bp, Artificial
  CRISPR gRNA sequence
tctctgggatcaaagactag

SEQ ID NO: 689318 - DNA, 20 bp, Artificial
  CRISPR gRNA sequence
caaagactaggggtttgctc

SEQ ID NO: 689319 - DNA, 20 bp, Artificial
  CRISPR gRNA sequence
aaagactaggggtttgctct

SEQ ID NO: 689320 - DNA, 20 bp, Artificial
  CRISPR gRNA sequence
gggtttgctctaggacctta

SEQ ID NO: 689321 - DNA, 20 bp, Artificial
  CRISPR gRNA sequence
ttatggccctgcctcctttc

SEQ ID NO: 689322 - DNA, 20 bp, Artificial
  CRISPR gRNA sequence
gcctcctttctggcctctca

SEQ ID NO: 689323 - DNA, 20 bp, Artificial
  CRISPR gRNA sequence
cctcctttctggcctctcac

SEQ ID NO: 689324 - DNA, 20 bp, Artificial
  CRISPR gRNA sequence
cacaggacattttcttccca

SEQ ID NO: 689325 - DNA, 20 bp, Artificial
  CRISPR gRNA sequence
ggacattttcttcccataga

SEQ ID NO: 689326 - DNA, 20 bp, Artificial
  CRISPR gRNA sequence
tttcttcccatagatagaaa

SEQ ID NO: 689327 - DNA, 20 bp, Artificial
  CRISPR gRNA sequence
tcttcccatagatagaaaca

SEQ ID NO: 689328 - DNA, 20 bp, Artificial
  CRISPR gRNA sequence
cttcccatagatagaaacag

SEQ ID NO: 689329 - DNA, 20 bp, Artificial
  CRISPR gRNA sequence
ttcccatagatagaaacaga

SEQ ID NO: 689330 - DNA, 20 bp, Artificial
  CRISPR gRNA sequence
cccatagatagaaacagagg

SEQ ID NO: 689331 - DNA, 20 bp, Artificial
  CRISPR gRNA sequence
gaaacagagggagctactct

SEQ ID NO: 689332 - DNA, 20 bp, Artificial
  CRISPR gRNA sequence
aaacagagggagctactctc

SEQ ID NO: 689333 - DNA, 20 bp, Artificial
  CRISPR gRNA sequence
agggagctactctcaggctg

SEQ ID NO: 689334 - DNA, 20 bp, Artificial
  CRISPR gRNA sequence
gggagctactctcaggctgc

SEQ ID NO: 689335 - DNA, 20 bp, Artificial
  CRISPR gRNA sequence
gctactctcaggctgcaggt

SEQ ID NO: 689336 - DNA, 20 bp, Artificial
  CRISPR gRNA sequence
ctcaggctgcaggtaagatg

SEQ ID NO: 689337 - DNA, 20 bp, Artificial
  CRISPR gRNA sequence
tcaggctgcaggtaagatga

SEQ ID NO: 689338 - DNA, 20 bp, Artificial
  CRISPR gRNA sequence
aggctgcaggtaagatgaag

SEQ ID NO: 689339 - DNA, 20 bp, Artificial
  CRISPR gRNA sequence
ggctgcaggtaagatgaagg

SEQ ID NO: 689340 - DNA, 20 bp, Artificial
  CRISPR gRNA sequence
gatgaaggaggctgatccct

SEQ ID NO: 689341 - DNA, 20 bp, Artificial
  CRISPR gRNA sequence
aggctgatccctgagattgt

SEQ ID NO: 689342 - DNA, 20 bp, Artificial
  CRISPR gRNA sequence
ggctgatccctgagattgtt

SEQ ID NO: 689343 - DNA, 20 bp, Artificial
  CRISPR gRNA sequence
ctgagattgttgggatattg

SEQ ID NO: 689344 - DNA, 20 bp, Artificial
  CRISPR gRNA sequence
gattgttgggatattgtggt

SEQ ID NO: 689345 - DNA, 20 bp, Artificial
  CRISPR gRNA sequence
attgttgggatattgtggtc

SEQ ID NO: 689346 - DNA, 20 bp, Artificial
  CRISPR gRNA sequence
tgttgggatattgtggtcag

SEQ ID NO: 689347 - DNA, 20 bp, Artificial
  CRISPR gRNA sequence
tattgtggtcaggagcctat

SEQ ID NO: 689348 - DNA, 20 bp, Artificial
  CRISPR gRNA sequence
attgtggtcaggagcctatg

SEQ ID NO: 689349 - DNA, 20 bp, Artificial
  CRISPR gRNA sequence
ttgtggtcaggagcctatga

SEQ ID NO: 689350 - DNA, 20 bp, Artificial
  CRISPR gRNA sequence
gtggtcaggagcctatgagg

SEQ ID NO: 689351 - DNA, 20 bp, Artificial
  CRISPR gRNA sequence
gagggagctcacccacccca

SEQ ID NO: 689352 - DNA, 20 bp, Artificial
  CRISPR gRNA sequence
cacccaccccacagttcctc

SEQ ID NO: 689353 - DNA, 20 bp, Artificial
  CRISPR gRNA sequence
agttcctctagccacatctg

SEQ ID NO: 689354 - DNA, 20 bp, Artificial
  CRISPR gRNA sequence
gttcctctagccacatctgt

SEQ ID NO: 689355 - DNA, 20 bp, Artificial
  CRISPR gRNA sequence
ccacatctgtgggctctgac

SEQ ID NO: 689356 - DNA, 20 bp, Artificial
  CRISPR gRNA sequence
cacatctgtgggctctgacc

SEQ ID NO: 689357 - DNA, 20 bp, Artificial
  CRISPR gRNA sequence
tgttctaccccaatcactga

SEQ ID NO: 689358 - DNA, 20 bp, Artificial
  CRISPR gRNA sequence
ccccaatcactgacagtgcc

SEQ ID NO: 689359 - DNA, 20 bp, Artificial
  CRISPR gRNA sequence
cccaatcactgacagtgccc

SEQ ID NO: 689360 - DNA, 20 bp, Artificial
  CRISPR gRNA sequence
ccaatcactgacagtgccca

SEQ ID NO: 689361 - DNA, 20 bp, Artificial
  CRISPR gRNA sequence
actgacagtgcccagggctc

SEQ ID NO: 689362 - DNA, 20 bp, Artificial
  CRISPR gRNA sequence
ctgacagtgcccagggctct

SEQ ID NO: 689363 - DNA, 20 bp, Artificial
  CRISPR gRNA sequence
tgacagtgcccagggctctg

SEQ ID NO: 689364 - DNA, 20 bp, Artificial
  CRISPR gRNA sequence
gggctctggggtgtctctca

SEQ ID NO: 689365 - DNA, 20 bp, Artificial
  CRISPR gRNA sequence
ggtgtctctcacagctaata

SEQ ID NO: 689366 - DNA, 20 bp, Artificial
  CRISPR gRNA sequence
gtgtctctcacagctaataa

SEQ ID NO: 689367 - DNA, 20 bp, Artificial
  CRISPR gRNA sequence
agctaataaaggtgacactc

SEQ ID NO: 689368 - DNA, 20 bp, Artificial
  CRISPR gRNA sequence
gctaataaaggtgacactcc

SEQ ID NO: 689369 - DNA, 20 bp, Artificial
  CRISPR gRNA sequence
ctaataaaggtgacactcca

SEQ ID NO: 689370 - DNA, 20 bp, Artificial
  CRISPR gRNA sequence
ataaaggtgacactccaggg

SEQ ID NO: 689371 - DNA, 20 bp, Artificial
  CRISPR gRNA sequence
taaaggtgacactccagggc

SEQ ID NO: 689372 - DNA, 20 bp, Artificial
  CRISPR gRNA sequence
aaaggtgacactccagggca

SEQ ID NO: 689373 - DNA, 20 bp, Artificial
  CRISPR gRNA sequence
aaggtgacactccagggcag

SEQ ID NO: 689374 - DNA, 20 bp, Artificial
  CRISPR gRNA sequence
cagggcaggggccctgatgt

SEQ ID NO: 689375 - DNA, 20 bp, Artificial
  CRISPR gRNA sequence
ggcaggggccctgatgtgag

SEQ ID NO: 689376 - DNA, 20 bp, Artificial
  CRISPR gRNA sequence
gcaggggccctgatgtgagt

SEQ ID NO: 689377 - DNA, 20 bp, Artificial
  CRISPR gRNA sequence
caggggccctgatgtgagtg

SEQ ID NO: 689378 - DNA, 20 bp, Artificial
  CRISPR gRNA sequence
ccctgatgtgagtggggtgt

SEQ ID NO: 689379 - DNA, 20 bp, Artificial
  CRISPR gRNA sequence
cctgatgtgagtggggtgtt

SEQ ID NO: 689380 - DNA, 20 bp, Artificial
  CRISPR gRNA sequence
ctgatgtgagtggggtgttg

SEQ ID NO: 689381 - DNA, 20 bp, Artificial
  CRISPR gRNA sequence
tgatgtgagtggggtgttgg

SEQ ID NO: 689382 - DNA, 20 bp, Artificial
  CRISPR gRNA sequence
gatgtgagtggggtgttggg

SEQ ID NO: 689383 - DNA, 20 bp, Artificial
  CRISPR gRNA sequence
atgtgagtggggtgttgggg

SEQ ID NO: 689384 - DNA, 20 bp, Artificial
  CRISPR gRNA sequence
agtggggtgttgggggggaa

SEQ ID NO: 689385 - DNA, 20 bp, Artificial
  CRISPR gRNA sequence
tggggtgttgggggggaaca

SEQ ID NO: 689386 - DNA, 20 bp, Artificial
  CRISPR gRNA sequence
ggggtgttgggggggaacag

SEQ ID NO: 689387 - DNA, 20 bp, Artificial
  CRISPR gRNA sequence
gggtgttgggggggaacaga

SEQ ID NO: 689388 - DNA, 20 bp, Artificial
  CRISPR gRNA sequence
ggtgttgggggggaacagag

SEQ ID NO: 689389 - DNA, 20 bp, Artificial
  CRISPR gRNA sequence
gggggggaacagaggggact

SEQ ID NO: 689390 - DNA, 20 bp, Artificial
  CRISPR gRNA sequence
aggggactcagctgtgctat

SEQ ID NO: 689391 - DNA, 20 bp, Artificial
  CRISPR gRNA sequence
ggggactcagctgtgctatt

SEQ ID NO: 689392 - DNA, 20 bp, Artificial
  CRISPR gRNA sequence
gctattgggtttctttgact

SEQ ID NO: 689393 - DNA, 20 bp, Artificial
  CRISPR gRNA sequence
ttctttgacttggatgtctt

SEQ ID NO: 689394 - DNA, 20 bp, Artificial
  CRISPR gRNA sequence
tggatgtcttgagcatgaaa

SEQ ID NO: 689395 - DNA, 20 bp, Artificial
  CRISPR gRNA sequence
ggatgtcttgagcatgaaat

SEQ ID NO: 689396 - DNA, 20 bp, Artificial
  CRISPR gRNA sequence
tgagcatgaaatgggctatt

SEQ ID NO: 689397 - DNA, 20 bp, Artificial
  CRISPR gRNA sequence
agcatgaaatgggctattta

SEQ ID NO: 689398 - DNA, 20 bp, Artificial
  CRISPR gRNA sequence
gttcatgaatattttctcta

SEQ ID NO: 689399 - DNA, 20 bp, Artificial
  CRISPR gRNA sequence
gaatattttctctatagtgt

SEQ ID NO: 689400 - DNA, 20 bp, Artificial
  CRISPR gRNA sequence
attttctctatagtgtgaga

SEQ ID NO: 689401 - DNA, 20 bp, Artificial
  CRISPR gRNA sequence
tgtgagacagcttccttgtg

SEQ ID NO: 689402 - DNA, 20 bp, Artificial
  CRISPR gRNA sequence
gtgagacagcttccttgtgt

SEQ ID NO: 689403 - DNA, 20 bp, Artificial
  CRISPR gRNA sequence
cagcttccttgtgtgggact

SEQ ID NO: 689404 - DNA, 20 bp, Artificial
  CRISPR gRNA sequence
cttccttgtgtgggactgag

SEQ ID NO: 689405 - DNA, 20 bp, Artificial
  CRISPR gRNA sequence
cttgtgtgggactgagaagc

SEQ ID NO: 689406 - DNA, 20 bp, Artificial
  CRISPR gRNA sequence
tgagaagcaagatatcaatg

SEQ ID NO: 689407 - DNA, 20 bp, Artificial
  CRISPR gRNA sequence
gaagcaagatatcaatgtag

SEQ ID NO: 689408 - DNA, 20 bp, Artificial
  CRISPR gRNA sequence
atacataaattttaaaaata

SEQ ID NO: 689409 - DNA, 20 bp, Artificial
  CRISPR gRNA sequence
aataaaaatatatcttttta

SEQ ID NO: 689410 - DNA, 20 bp, Artificial
  CRISPR gRNA sequence
aatatatctttttatagata

SEQ ID NO: 689411 - DNA, 20 bp, Artificial
  CRISPR gRNA sequence
atatatctttttatagatac

SEQ ID NO: 689412 - DNA, 20 bp, Artificial
  CRISPR gRNA sequence
tatctttttatagatacagg

SEQ ID NO: 689413 - DNA, 20 bp, Artificial
  CRISPR gRNA sequence
tacaggtagatatgttttta

SEQ ID NO: 689414 - DNA, 20 bp, Artificial
  CRISPR gRNA sequence
tgtgtgtgtgtgtgtgtgtg

SEQ ID NO: 689415 - DNA, 20 bp, Artificial
  CRISPR gRNA sequence
tgtgtgtgtgtgtgtgtgaa

SEQ ID NO: 689416 - DNA, 20 bp, Artificial
  CRISPR gRNA sequence
tgtgtgtgtgtgtgaagaga

SEQ ID NO: 689417 - DNA, 20 bp, Artificial
  CRISPR gRNA sequence
tgtgtgtgtgtgaagagaaa

SEQ ID NO: 689418 - DNA, 20 bp, Artificial
  CRISPR gRNA sequence
gtgtgaagagaaagagtgaa

SEQ ID NO: 689419 - DNA, 20 bp, Artificial
  CRISPR gRNA sequence
gtgaagagaaagagtgaata

SEQ ID NO: 689420 - DNA, 20 bp, Artificial
  CRISPR gRNA sequence
gaagagaaagagtgaataga

SEQ ID NO: 689421 - DNA, 20 bp, Artificial
  CRISPR gRNA sequence
aaagagtgaatagagagatt

SEQ ID NO: 689422 - DNA, 20 bp, Artificial
  CRISPR gRNA sequence
agagattaagattcttttaa

SEQ ID NO: 689423 - DNA, 20 bp, Artificial
  CRISPR gRNA sequence
aagattcttttaatggtgaa

SEQ ID NO: 689424 - DNA, 20 bp, Artificial
  CRISPR gRNA sequence
tgaaaagatatacatatatt

SEQ ID NO: 689425 - DNA, 20 bp, Artificial
  CRISPR gRNA sequence
gatatacatatatttggaat

SEQ ID NO: 689426 - DNA, 20 bp, Artificial
  CRISPR gRNA sequence
tacatatatttggaattagc

SEQ ID NO: 689427 - DNA, 20 bp, Artificial
  CRISPR gRNA sequence
tggaattagccagcttgact

SEQ ID NO: 689428 - DNA, 20 bp, Artificial
  CRISPR gRNA sequence
ttagccagcttgactcagtt

SEQ ID NO: 689429 - DNA, 20 bp, Artificial
  CRISPR gRNA sequence
tagccagcttgactcagttt

SEQ ID NO: 689430 - DNA, 20 bp, Artificial
  CRISPR gRNA sequence
agtttaggtgatcccaattt

SEQ ID NO: 689431 - DNA, 20 bp, Artificial
  CRISPR gRNA sequence
ttaggtgatcccaattttgg

SEQ ID NO: 689432 - DNA, 20 bp, Artificial
  CRISPR gRNA sequence
aattttggtggcaacaacca

SEQ ID NO: 689433 - DNA, 20 bp, Artificial
  CRISPR gRNA sequence
tggcaacaaccaaagcatcg

SEQ ID NO: 689434 - DNA, 20 bp, Artificial
  CRISPR gRNA sequence
aacaaccaaagcatcgtagt

SEQ ID NO: 689435 - DNA, 20 bp, Artificial
  CRISPR gRNA sequence
acaaccaaagcatcgtagtc

SEQ ID NO: 689436 - DNA, 20 bp, Artificial
  CRISPR gRNA sequence
aaccaaagcatcgtagtcag

SEQ ID NO: 689437 - DNA, 20 bp, Artificial
  CRISPR gRNA sequence
aaagcatcgtagtcaggagc

SEQ ID NO: 689438 - DNA, 20 bp, Artificial
  CRISPR gRNA sequence
atatgccttcctctctccat

SEQ ID NO: 689439 - DNA, 20 bp, Artificial
  CRISPR gRNA sequence
ctctctccatcagactgaat

SEQ ID NO: 689440 - DNA, 20 bp, Artificial
  CRISPR gRNA sequence
ctctccatcagactgaatca

SEQ ID NO: 689441 - DNA, 20 bp, Artificial
  CRISPR gRNA sequence
ctgaatcagagtgttgactt

SEQ ID NO: 689442 - DNA, 20 bp, Artificial
  CRISPR gRNA sequence
caatgtcacaaacttcttca

SEQ ID NO: 689443 - DNA, 20 bp, Artificial
  CRISPR gRNA sequence
tcttcacagcctgtttgatc

SEQ ID NO: 689444 - DNA, 20 bp, Artificial
  CRISPR gRNA sequence
ctgtttgatctggtgcttgt

SEQ ID NO: 689445 - DNA, 20 bp, Artificial
  CRISPR gRNA sequence
cttgttggctttaacatcca

SEQ ID NO: 689446 - DNA, 20 bp, Artificial
  CRISPR gRNA sequence
ttaacatccacagtgaacac

SEQ ID NO: 689447 - DNA, 20 bp, Artificial
  CRISPR gRNA sequence
acatccacagtgaacacaag

SEQ ID NO: 689448 - DNA, 20 bp, Artificial
  CRISPR gRNA sequence
catccacagtgaacacaagt

SEQ ID NO: 689449 - DNA, 20 bp, Artificial
  CRISPR gRNA sequence
gttgttttctatcttcttca

SEQ ID NO: 689450 - DNA, 20 bp, Artificial
  CRISPR gRNA sequence
tatcttcttcacagcctact

SEQ ID NO: 689451 - DNA, 20 bp, Artificial
  CRISPR gRNA sequence
cttcttcacagcctactcag

SEQ ID NO: 689452 - DNA, 20 bp, Artificial
  CRISPR gRNA sequence
ttcacagcctactcagtggt

SEQ ID NO: 689453 - DNA, 20 bp, Artificial
  CRISPR gRNA sequence
acagcctactcagtggtcag

SEQ ID NO: 689454 - DNA, 20 bp, Artificial
  CRISPR gRNA sequence
gcggaaacttgatgataaca

SEQ ID NO: 689455 - DNA, 20 bp, Artificial
  CRISPR gRNA sequence
gaaacttgatgataacatgg

SEQ ID NO: 689456 - DNA, 20 bp, Artificial
  CRISPR gRNA sequence
ttgatgataacatggtggtc

SEQ ID NO: 689457 - DNA, 20 bp, Artificial
  CRISPR gRNA sequence
gtggtcaagcttatttctcc

SEQ ID NO: 689458 - DNA, 20 bp, Artificial
  CRISPR gRNA sequence
tggtcaagcttatttctcct

SEQ ID NO: 689459 - DNA, 20 bp, Artificial
  CRISPR gRNA sequence
ggtcaagcttatttctcctg

SEQ ID NO: 689460 - DNA, 20 bp, Artificial
  CRISPR gRNA sequence
gtcaagcttatttctcctgg

SEQ ID NO: 689461 - DNA, 20 bp, Artificial
  CRISPR gRNA sequence
tctcctgggggtgctcttcc

SEQ ID NO: 689462 - DNA, 20 bp, Artificial
  CRISPR gRNA sequence
ctcctgggggtgctcttcca

SEQ ID NO: 689463 - DNA, 20 bp, Artificial
  CRISPR gRNA sequence
ggtgctcttccaaggatatt

SEQ ID NO: 689464 - DNA, 20 bp, Artificial
  CRISPR gRNA sequence
gtgctcttccaaggatattt

SEQ ID NO: 689465 - DNA, 20 bp, Artificial
  CRISPR gRNA sequence
aaggatatttgggctgcctc

SEQ ID NO: 689466 - DNA, 20 bp, Artificial
  CRISPR gRNA sequence
ggatatttgggctgcctccg

SEQ ID NO: 689467 - DNA, 20 bp, Artificial
  CRISPR gRNA sequence
ttgggctgcctccggagtca

SEQ ID NO: 689468 - DNA, 20 bp, Artificial
  CRISPR gRNA sequence
cctccggagtcacagtgtct

SEQ ID NO: 689469 - DNA, 20 bp, Artificial
  CRISPR gRNA sequence
ctccggagtcacagtgtctt

SEQ ID NO: 689470 - DNA, 20 bp, Artificial
  CRISPR gRNA sequence
gtcacagtgtcttgggccgc

SEQ ID NO: 689471 - DNA, 20 bp, Artificial
  CRISPR gRNA sequence
acagtgtcttgggccgccgg

SEQ ID NO: 689472 - DNA, 20 bp, Artificial
  CRISPR gRNA sequence
cagtgtcttgggccgccgga

SEQ ID NO: 689473 - DNA, 20 bp, Artificial
  CRISPR gRNA sequence
tgtcttgggccgccggaagg

SEQ ID NO: 689474 - DNA, 20 bp, Artificial
  CRISPR gRNA sequence
gtcttgggccgccggaaggt

SEQ ID NO: 689475 - DNA, 20 bp, Artificial
  CRISPR gRNA sequence
gccggaaggtgggtgacatg

SEQ ID NO: 689476 - DNA, 20 bp, Artificial
  CRISPR gRNA sequence
tgtggatcttgttttttttg

SEQ ID NO: 689477 - DNA, 20 bp, Artificial
  CRISPR gRNA sequence
tcttgttttttttgtggctg

SEQ ID NO: 689478 - DNA, 20 bp, Artificial
  CRISPR gRNA sequence
atctttcaacactgccttct

SEQ ID NO: 689479 - DNA, 20 bp, Artificial
  CRISPR gRNA sequence
actgccttcttggccttgca

SEQ ID NO: 689480 - DNA, 20 bp, Artificial
  CRISPR gRNA sequence
gccttgcaaagccttcgctt

SEQ ID NO: 689481 - DNA, 20 bp, Artificial
  CRISPR gRNA sequence
caaagccttcgctttggctt

SEQ ID NO: 689482 - DNA, 20 bp, Artificial
  CRISPR gRNA sequence
cttcgctttggcttcggctt

SEQ ID NO: 689483 - DNA, 20 bp, Artificial
  CRISPR gRNA sequence
ttcgctttggcttcggcttt

SEQ ID NO: 689484 - DNA, 20 bp, Artificial
  CRISPR gRNA sequence
cgctttggcttcggctttag

SEQ ID NO: 689485 - DNA, 20 bp, Artificial
  CRISPR gRNA sequence
gctttggcttcggctttagg

SEQ ID NO: 689486 - DNA, 20 bp, Artificial
  CRISPR gRNA sequence
ctttggcttcggctttagga

SEQ ID NO: 689487 - DNA, 20 bp, Artificial
  CRISPR gRNA sequence
tttggcttcggctttaggag

SEQ ID NO: 689488 - DNA, 20 bp, Artificial
  CRISPR gRNA sequence
ggcttcggctttaggagggg

SEQ ID NO: 689489 - DNA, 20 bp, Artificial
  CRISPR gRNA sequence
gcttcggctttaggaggggc

SEQ ID NO: 689490 - DNA, 20 bp, Artificial
  CRISPR gRNA sequence
ttcggctttaggaggggcag

SEQ ID NO: 689491 - DNA, 20 bp, Artificial
  CRISPR gRNA sequence
ggagcttccttcttcgttct

SEQ ID NO: 689492 - DNA, 20 bp, Artificial
  CRISPR gRNA sequence
tcttggcaccatcttatgaa

SEQ ID NO: 689493 - DNA, 20 bp, Artificial
  CRISPR gRNA sequence
cttggcaccatcttatgaaa

SEQ ID NO: 689494 - DNA, 20 bp, Artificial
  CRISPR gRNA sequence
ttggcaccatcttatgaaaa

SEQ ID NO: 689495 - DNA, 20 bp, Artificial
  CRISPR gRNA sequence
accatcttatgaaaagggtc

SEQ ID NO: 689496 - DNA, 20 bp, Artificial
  CRISPR gRNA sequence
ttatgaaaagggtccagatt

SEQ ID NO: 689497 - DNA, 20 bp, Artificial
  CRISPR gRNA sequence
ccagattaagatttttgact

SEQ ID NO: 689498 - DNA, 20 bp, Artificial
  CRISPR gRNA sequence
tttttgactgagtcattcta

SEQ ID NO: 689499 - DNA, 20 bp, Artificial
  CRISPR gRNA sequence
tgactgagtcattctaaagt

SEQ ID NO: 689500 - DNA, 20 bp, Artificial
  CRISPR gRNA sequence
gtcattctaaagtaagttgc

SEQ ID NO: 689501 - DNA, 20 bp, Artificial
  CRISPR gRNA sequence
agttgcaagacccatgatac

SEQ ID NO: 689502 - DNA, 20 bp, Artificial
  CRISPR gRNA sequence
tacttcatcacacacctcct

SEQ ID NO: 689503 - DNA, 20 bp, Artificial
  CRISPR gRNA sequence
atcacacacctcctaagaat

SEQ ID NO: 689504 - DNA, 20 bp, Artificial
  CRISPR gRNA sequence
gaaccaacattatcacacca

SEQ ID NO: 689505 - DNA, 20 bp, Artificial
  CRISPR gRNA sequence
taattccataatattattta

SEQ ID NO: 689506 - DNA, 20 bp, Artificial
  CRISPR gRNA sequence
tcaaatatctccacttcttt

SEQ ID NO: 689507 - DNA, 20 bp, Artificial
  CRISPR gRNA sequence
atttttgtacctatttttta

SEQ ID NO: 689508 - DNA, 20 bp, Artificial
  CRISPR gRNA sequence
aaatgtccactcgttgcctt

SEQ ID NO: 689509 - DNA, 20 bp, Artificial
  CRISPR gRNA sequence
tcaacccatcttttttcttt

SEQ ID NO: 689510 - DNA, 20 bp, Artificial
  CRISPR gRNA sequence
ccatcttttttcttttagaa

SEQ ID NO: 689511 - DNA, 20 bp, Artificial
  CRISPR gRNA sequence
tagaatggcattacctgttt

SEQ ID NO: 689512 - DNA, 20 bp, Artificial
  CRISPR gRNA sequence
gaatggcattacctgtttca

SEQ ID NO: 689513 - DNA, 20 bp, Artificial
  CRISPR gRNA sequence
gcattacctgtttcagagat

SEQ ID NO: 689514 - DNA, 20 bp, Artificial
  CRISPR gRNA sequence
cattacctgtttcagagatg

SEQ ID NO: 689515 - DNA, 20 bp, Artificial
  CRISPR gRNA sequence
gagatgaggccaaatacctg

SEQ ID NO: 689516 - DNA, 20 bp, Artificial
  CRISPR gRNA sequence
ccacactgaatttatcatat

SEQ ID NO: 689517 - DNA, 20 bp, Artificial
  CRISPR gRNA sequence
ctctaactgctatgcctcct

SEQ ID NO: 689518 - DNA, 20 bp, Artificial
  CRISPR gRNA sequence
tctaactgctatgcctccta

SEQ ID NO: 689519 - DNA, 20 bp, Artificial
  CRISPR gRNA sequence
atgcctcctaaggacctatg

SEQ ID NO: 689520 - DNA, 20 bp, Artificial
  CRISPR gRNA sequence
cctaaggacctatgtagctc

SEQ ID NO: 689521 - DNA, 20 bp, Artificial
  CRISPR gRNA sequence
ctaaggacctatgtagctct

SEQ ID NO: 689522 - DNA, 20 bp, Artificial
  CRISPR gRNA sequence
gtagctctgggttaaacatt

SEQ ID NO: 689523 - DNA, 20 bp, Artificial
  CRISPR gRNA sequence
gctctgggttaaacatttgg

SEQ ID NO: 689524 - DNA, 20 bp, Artificial
  CRISPR gRNA sequence
acatttggcagcaatgttta

SEQ ID NO: 689525 - DNA, 20 bp, Artificial
  CRISPR gRNA sequence
catttggcagcaatgtttac

SEQ ID NO: 689526 - DNA, 20 bp, Artificial
  CRISPR gRNA sequence
tttggcagcaatgtttacag

SEQ ID NO: 689527 - DNA, 20 bp, Artificial
  CRISPR gRNA sequence
ttggcagcaatgtttacagg

SEQ ID NO: 689528 - DNA, 20 bp, Artificial
  CRISPR gRNA sequence
ggcagcaatgtttacaggag

SEQ ID NO: 689529 - DNA, 20 bp, Artificial
  CRISPR gRNA sequence
tgaccgcacattcatcacat

SEQ ID NO: 689530 - DNA, 20 bp, Artificial
  CRISPR gRNA sequence
gaccgcacattcatcacatc

SEQ ID NO: 689531 - DNA, 20 bp, Artificial
  CRISPR gRNA sequence
ccgcacattcatcacatcag

SEQ ID NO: 689532 - DNA, 20 bp, Artificial
  CRISPR gRNA sequence
cgcacattcatcacatcagg

SEQ ID NO: 689533 - DNA, 20 bp, Artificial
  CRISPR gRNA sequence
atcacatcaggaggcacaca

SEQ ID NO: 689534 - DNA, 20 bp, Artificial
  CRISPR gRNA sequence
atcaggaggcacacaaagcc

SEQ ID NO: 689535 - DNA, 20 bp, Artificial
  CRISPR gRNA sequence
tcaggaggcacacaaagcct

SEQ ID NO: 689536 - DNA, 20 bp, Artificial
  CRISPR gRNA sequence
caggaggcacacaaagccta

SEQ ID NO: 689537 - DNA, 20 bp, Artificial
  CRISPR gRNA sequence
cacacaaagcctagggttac

SEQ ID NO: 689538 - DNA, 20 bp, Artificial
  CRISPR gRNA sequence
acacaaagcctagggttacc

SEQ ID NO: 689539 - DNA, 20 bp, Artificial
  CRISPR gRNA sequence
ggactcttactgaccccata

SEQ ID NO: 689540 - DNA, 20 bp, Artificial
  CRISPR gRNA sequence
ccaaatttatcctgacttcc

SEQ ID NO: 689541 - DNA, 20 bp, Artificial
  CRISPR gRNA sequence
aaatttatcctgacttccca

SEQ ID NO: 689542 - DNA, 20 bp, Artificial
  CRISPR gRNA sequence
atcctgacttcccagagatg

SEQ ID NO: 689543 - DNA, 20 bp, Artificial
  CRISPR gRNA sequence
ttcccagagatgcagaacca

SEQ ID NO: 689544 - DNA, 20 bp, Artificial
  CRISPR gRNA sequence
tcccagagatgcagaaccat

SEQ ID NO: 689545 - DNA, 20 bp, Artificial
  CRISPR gRNA sequence
agagatgcagaaccatgggc

SEQ ID NO: 689546 - DNA, 20 bp, Artificial
  CRISPR gRNA sequence
gagatgcagaaccatgggct

SEQ ID NO: 689547 - DNA, 20 bp, Artificial
  CRISPR gRNA sequence
agaaccatgggctgggtgtt

SEQ ID NO: 689548 - DNA, 20 bp, Artificial
  CRISPR gRNA sequence
accatgggctgggtgtttag

SEQ ID NO: 689549 - DNA, 20 bp, Artificial
  CRISPR gRNA sequence
ccatgggctgggtgtttagt

SEQ ID NO: 689550 - DNA, 20 bp, Artificial
  CRISPR gRNA sequence
gctgggtgtttagtgggtat

SEQ ID NO: 689551 - DNA, 20 bp, Artificial
  CRISPR gRNA sequence
tgggtatgagtgtgatattc

SEQ ID NO: 689552 - DNA, 20 bp, Artificial
  CRISPR gRNA sequence
tgagtgtgatattctggcaa

SEQ ID NO: 689553 - DNA, 20 bp, Artificial
  CRISPR gRNA sequence
gagtgtgatattctggcaat

SEQ ID NO: 689554 - DNA, 20 bp, Artificial
  CRISPR gRNA sequence
gtgtgatattctggcaatag

SEQ ID NO: 689555 - DNA, 20 bp, Artificial
  CRISPR gRNA sequence
tgtgatattctggcaatagg

SEQ ID NO: 689556 - DNA, 20 bp, Artificial
  CRISPR gRNA sequence
ccactctccccattcctcac

SEQ ID NO: 689557 - DNA, 20 bp, Artificial
  CRISPR gRNA sequence
tccccattcctcacgagctt

SEQ ID NO: 689558 - DNA, 20 bp, Artificial
  CRISPR gRNA sequence
gctttagttccccataccct

SEQ ID NO: 689559 - DNA, 20 bp, Artificial
  CRISPR gRNA sequence
ctttagttccccataccctg

SEQ ID NO: 689560 - DNA, 20 bp, Artificial
  CRISPR gRNA sequence
tccccataccctgaggttct

SEQ ID NO: 689561 - DNA, 20 bp, Artificial
  CRISPR gRNA sequence
taccctgaggttctgagctc

SEQ ID NO: 689562 - DNA, 20 bp, Artificial
  CRISPR gRNA sequence
agctccagaccttcaaccat

SEQ ID NO: 689563 - DNA, 20 bp, Artificial
  CRISPR gRNA sequence
gctccagaccttcaaccatc

SEQ ID NO: 689564 - DNA, 20 bp, Artificial
  CRISPR gRNA sequence
cagaccttcaaccatcaggc

SEQ ID NO: 689565 - DNA, 20 bp, Artificial
  CRISPR gRNA sequence
agaccttcaaccatcaggcc

SEQ ID NO: 689566 - DNA, 20 bp, Artificial
  CRISPR gRNA sequence
accatcaggccaggcccctc

SEQ ID NO: 689567 - DNA, 20 bp, Artificial
  CRISPR gRNA sequence
aggccaggcccctccagacc

SEQ ID NO: 689568 - DNA, 20 bp, Artificial
  CRISPR gRNA sequence
gactcccttcctgtcttctc

SEQ ID NO: 689569 - DNA, 20 bp, Artificial
  CRISPR gRNA sequence
ctctgctttgtatctacttc

SEQ ID NO: 689570 - DNA, 20 bp, Artificial
  CRISPR gRNA sequence
tctggatcactttccctcta

SEQ ID NO: 689571 - DNA, 20 bp, Artificial
  CRISPR gRNA sequence
ctggatcactttccctctac

SEQ ID NO: 689572 - DNA, 20 bp, Artificial
  CRISPR gRNA sequence
tcactttccctctacaggcc

SEQ ID NO: 689573 - DNA, 20 bp, Artificial
  CRISPR gRNA sequence
cctctacaggcccagctcct

SEQ ID NO: 689574 - DNA, 20 bp, Artificial
  CRISPR gRNA sequence
agtgtctctacctctcaaac

SEQ ID NO: 689575 - DNA, 20 bp, Artificial
  CRISPR gRNA sequence
ctcaaacaagtattctcatc

SEQ ID NO: 689576 - DNA, 20 bp, Artificial
  CRISPR gRNA sequence
tcaaacaagtattctcatcc

SEQ ID NO: 689577 - DNA, 20 bp, Artificial
  CRISPR gRNA sequence
aaacaagtattctcatccag

SEQ ID NO: 689578 - DNA, 20 bp, Artificial
  CRISPR gRNA sequence
tccaggagcaattttcccac

SEQ ID NO: 689579 - DNA, 20 bp, Artificial
  CRISPR gRNA sequence
caggagcaattttcccacca

SEQ ID NO: 689580 - DNA, 20 bp, Artificial
  CRISPR gRNA sequence
aggagcaattttcccaccag

SEQ ID NO: 689581 - DNA, 20 bp, Artificial
  CRISPR gRNA sequence
attttcccaccagaggacat

SEQ ID NO: 689582 - DNA, 20 bp, Artificial
  CRISPR gRNA sequence
cagaggacattagctatgtc

SEQ ID NO: 689583 - DNA, 20 bp, Artificial
  CRISPR gRNA sequence
aaatgttttgttgccatgac

SEQ ID NO: 689584 - DNA, 20 bp, Artificial
  CRISPR gRNA sequence
atgttttgttgccatgactg

SEQ ID NO: 689585 - DNA, 20 bp, Artificial
  CRISPR gRNA sequence
tttgttgccatgactggagt

SEQ ID NO: 689586 - DNA, 20 bp, Artificial
  CRISPR gRNA sequence
ttgttgccatgactggagtg

SEQ ID NO: 689587 - DNA, 20 bp, Artificial
  CRISPR gRNA sequence
gttgccatgactggagtgag

SEQ ID NO: 689588 - DNA, 20 bp, Artificial
  CRISPR gRNA sequence
gccatgactggagtgaggag

SEQ ID NO: 689589 - DNA, 20 bp, Artificial
  CRISPR gRNA sequence
ccatgactggagtgaggaga

SEQ ID NO: 689590 - DNA, 20 bp, Artificial
  CRISPR gRNA sequence
gagtgaggagaaggtgctac

SEQ ID NO: 689591 - DNA, 20 bp, Artificial
  CRISPR gRNA sequence
aaggtgctaccagcatcttg

SEQ ID NO: 689592 - DNA, 20 bp, Artificial
  CRISPR gRNA sequence
aggtgctaccagcatcttgt

SEQ ID NO: 689593 - DNA, 20 bp, Artificial
  CRISPR gRNA sequence
ggtgctaccagcatcttgtg

SEQ ID NO: 689594 - DNA, 20 bp, Artificial
  CRISPR gRNA sequence
agcatcttgtggggaatgac

SEQ ID NO: 689595 - DNA, 20 bp, Artificial
  CRISPR gRNA sequence
gcatcttgtggggaatgacc

SEQ ID NO: 689596 - DNA, 20 bp, Artificial
  CRISPR gRNA sequence
catcttgtggggaatgacca

SEQ ID NO: 689597 - DNA, 20 bp, Artificial
  CRISPR gRNA sequence
cagggatgctgaacatcctg

SEQ ID NO: 689598 - DNA, 20 bp, Artificial
  CRISPR gRNA sequence
ctgaacatcctgcagtgcac

SEQ ID NO: 689599 - DNA, 20 bp, Artificial
  CRISPR gRNA sequence
acatcctgcagtgcacaagt

SEQ ID NO: 689600 - DNA, 20 bp, Artificial
  CRISPR gRNA sequence
cagcccaatcacccacataa

SEQ ID NO: 689601 - DNA, 20 bp, Artificial
  CRISPR gRNA sequence
ccacataacagataattatc

SEQ ID NO: 689602 - DNA, 20 bp, Artificial
  CRISPR gRNA sequence
aattatccagccccaatacc

SEQ ID NO: 689603 - DNA, 20 bp, Artificial
  CRISPR gRNA sequence
gccccaataccaagattgcc

SEQ ID NO: 689604 - DNA, 20 bp, Artificial
  CRISPR gRNA sequence
ccccaataccaagattgcca

SEQ ID NO: 689605 - DNA, 20 bp, Artificial
  CRISPR gRNA sequence
cccaataccaagattgccaa

SEQ ID NO: 689606 - DNA, 20 bp, Artificial
  CRISPR gRNA sequence
ataccaagattgccaagggt

SEQ ID NO: 689607 - DNA, 20 bp, Artificial
  CRISPR gRNA sequence
taccaagattgccaagggta

SEQ ID NO: 689608 - DNA, 20 bp, Artificial
  CRISPR gRNA sequence
ccaagattgccaagggtaag

SEQ ID NO: 689609 - DNA, 20 bp, Artificial
  CRISPR gRNA sequence
caagattgccaagggtaagg

SEQ ID NO: 689610 - DNA, 20 bp, Artificial
  CRISPR gRNA sequence
ccaagggtaaggaggcctgc

SEQ ID NO: 689611 - DNA, 20 bp, Artificial
  CRISPR gRNA sequence
caagggtaaggaggcctgcc

SEQ ID NO: 689612 - DNA, 20 bp, Artificial
  CRISPR gRNA sequence
gccaggactttctctccctt

SEQ ID NO: 689613 - DNA, 20 bp, Artificial
  CRISPR gRNA sequence
actttctctcccttgagtac

SEQ ID NO: 689614 - DNA, 20 bp, Artificial
  CRISPR gRNA sequence
agtacaagcttccttgaact

SEQ ID NO: 689615 - DNA, 20 bp, Artificial
  CRISPR gRNA sequence
gtacaagcttccttgaactg

SEQ ID NO: 689616 - DNA, 20 bp, Artificial
  CRISPR gRNA sequence
tacaagcttccttgaactga

SEQ ID NO: 689617 - DNA, 20 bp, Artificial
  CRISPR gRNA sequence
ttgaactgagggacaccctg

SEQ ID NO: 689618 - DNA, 20 bp, Artificial
  CRISPR gRNA sequence
tgaactgagggacaccctga

SEQ ID NO: 689619 - DNA, 20 bp, Artificial
  CRISPR gRNA sequence
tgagggacaccctgaaggaa

SEQ ID NO: 689620 - DNA, 20 bp, Artificial
  CRISPR gRNA sequence
gacaccctgaaggaaaagtg

SEQ ID NO: 689621 - DNA, 20 bp, Artificial
  CRISPR gRNA sequence
ggaaaagtgtggtcccaccc

SEQ ID NO: 689622 - DNA, 20 bp, Artificial
  CRISPR gRNA sequence
ccagtcatctctcccttccc

SEQ ID NO: 689623 - DNA, 20 bp, Artificial
  CRISPR gRNA sequence
agtcatctctcccttccctg

SEQ ID NO: 689624 - DNA, 20 bp, Artificial
  CRISPR gRNA sequence
gagctccatctgtatgcctg

SEQ ID NO: 689625 - DNA, 20 bp, Artificial
  CRISPR gRNA sequence
atctgtatgcctgtagtgct

SEQ ID NO: 689626 - DNA, 20 bp, Artificial
  CRISPR gRNA sequence
tctgtatgcctgtagtgctt

SEQ ID NO: 689627 - DNA, 20 bp, Artificial
  CRISPR gRNA sequence
tagtgcttaggcctgtaacc

SEQ ID NO: 689628 - DNA, 20 bp, Artificial
  CRISPR gRNA sequence
agtgcttaggcctgtaacct

SEQ ID NO: 689629 - DNA, 20 bp, Artificial
  CRISPR gRNA sequence
gtgcttaggcctgtaacctg

SEQ ID NO: 689630 - DNA, 20 bp, Artificial
  CRISPR gRNA sequence
taggcctgtaacctggggtc

SEQ ID NO: 689631 - DNA, 20 bp, Artificial
  CRISPR gRNA sequence
aggcctgtaacctggggtcc

SEQ ID NO: 689632 - DNA, 20 bp, Artificial
  CRISPR gRNA sequence
ccaggaacccaccttcccat

SEQ ID NO: 689633 - DNA, 20 bp, Artificial
  CRISPR gRNA sequence
ccttcccatgagactgcatg

SEQ ID NO: 689634 - DNA, 20 bp, Artificial
  CRISPR gRNA sequence
tcccatgagactgcatgcag

SEQ ID NO: 689635 - DNA, 20 bp, Artificial
  CRISPR gRNA sequence
gtgcacacatgacttcatta

SEQ ID NO: 689636 - DNA, 20 bp, Artificial
  CRISPR gRNA sequence
tgcacacatgacttcattac

SEQ ID NO: 689637 - DNA, 20 bp, Artificial
  CRISPR gRNA sequence
gcacacatgacttcattaca

SEQ ID NO: 689638 - DNA, 20 bp, Artificial
  CRISPR gRNA sequence
atgacttcattacagggcat

SEQ ID NO: 689639 - DNA, 20 bp, Artificial
  CRISPR gRNA sequence
cattggatattgatattcat

SEQ ID NO: 689640 - DNA, 20 bp, Artificial
  CRISPR gRNA sequence
attggatattgatattcatc

SEQ ID NO: 689641 - DNA, 20 bp, Artificial
  CRISPR gRNA sequence
gatattgatattcatcaggt

SEQ ID NO: 689642 - DNA, 20 bp, Artificial
  CRISPR gRNA sequence
ttgatattcatcaggtcagc

SEQ ID NO: 689643 - DNA, 20 bp, Artificial
  CRISPR gRNA sequence
tgatattcatcaggtcagct

SEQ ID NO: 689644 - DNA, 20 bp, Artificial
  CRISPR gRNA sequence
gatattcatcaggtcagctg

SEQ ID NO: 689645 - DNA, 20 bp, Artificial
  CRISPR gRNA sequence
catcaggtcagctggggccc

SEQ ID NO: 689646 - DNA, 20 bp, Artificial
  CRISPR gRNA sequence
agacactactcttctgccaa

SEQ ID NO: 689647 - DNA, 20 bp, Artificial
  CRISPR gRNA sequence
gacactactcttctgccaac

SEQ ID NO: 689648 - DNA, 20 bp, Artificial
  CRISPR gRNA sequence
caggccgcaatcctctgcat

SEQ ID NO: 689649 - DNA, 20 bp, Artificial
  CRISPR gRNA sequence
ggccgcaatcctctgcatta

SEQ ID NO: 689650 - DNA, 20 bp, Artificial
  CRISPR gRNA sequence
ccgcaatcctctgcattaga

SEQ ID NO: 689651 - DNA, 20 bp, Artificial
  CRISPR gRNA sequence
gcaatcctctgcattagaga

SEQ ID NO: 689652 - DNA, 20 bp, Artificial
  CRISPR gRNA sequence
caatcctctgcattagagag

SEQ ID NO: 689653 - DNA, 20 bp, Artificial
  CRISPR gRNA sequence
aatcctctgcattagagaga

SEQ ID NO: 689654 - DNA, 20 bp, Artificial
  CRISPR gRNA sequence
tctgcattagagagagggta

SEQ ID NO: 689655 - DNA, 20 bp, Artificial
  CRISPR gRNA sequence
ttagagagagggtaaagatt

SEQ ID NO: 689656 - DNA, 20 bp, Artificial
  CRISPR gRNA sequence
tagagagagggtaaagattg

SEQ ID NO: 689657 - DNA, 20 bp, Artificial
  CRISPR gRNA sequence
agagagagggtaaagattga

SEQ ID NO: 689658 - DNA, 20 bp, Artificial
  CRISPR gRNA sequence
agagagggtaaagattgagg

SEQ ID NO: 689659 - DNA, 20 bp, Artificial
  CRISPR gRNA sequence
gagagggtaaagattgaggg

SEQ ID NO: 689660 - DNA, 20 bp, Artificial
  CRISPR gRNA sequence
ttcaaaccttctatcactgc

SEQ ID NO: 689661 - DNA, 20 bp, Artificial
  CRISPR gRNA sequence
accttctatcactgctagtg

SEQ ID NO: 689662 - DNA, 20 bp, Artificial
  CRISPR gRNA sequence
actgctagtgaagtgccaaa

SEQ ID NO: 689663 - DNA, 20 bp, Artificial
  CRISPR gRNA sequence
gctagtgaagtgccaaaaag

SEQ ID NO: 689664 - DNA, 20 bp, Artificial
  CRISPR gRNA sequence
gaagtgccaaaaagaagtgc

SEQ ID NO: 689665 - DNA, 20 bp, Artificial
  CRISPR gRNA sequence
aagtgccaaaaagaagtgca

SEQ ID NO: 689666 - DNA, 20 bp, Artificial
  CRISPR gRNA sequence
tgcaaggtcatctgcccttg

SEQ ID NO: 689667 - DNA, 20 bp, Artificial
  CRISPR gRNA sequence
gcaaggtcatctgcccttgt

SEQ ID NO: 689668 - DNA, 20 bp, Artificial
  CRISPR gRNA sequence
ctgcccttgtaggaaccaca

SEQ ID NO: 689669 - DNA, 20 bp, Artificial
  CRISPR gRNA sequence
tgcccttgtaggaaccacac

SEQ ID NO: 689670 - DNA, 20 bp, Artificial
  CRISPR gRNA sequence
ccttgtaggaaccacacagg

SEQ ID NO: 689671 - DNA, 20 bp, Artificial
  CRISPR gRNA sequence
cttgtaggaaccacacagga

SEQ ID NO: 689672 - DNA, 20 bp, Artificial
  CRISPR gRNA sequence
gtaggaaccacacaggaagg

SEQ ID NO: 689673 - DNA, 20 bp, Artificial
  CRISPR gRNA sequence
aggaaccacacaggaaggca

SEQ ID NO: 689674 - DNA, 20 bp, Artificial
  CRISPR gRNA sequence
accaatgtcaaattccatca

SEQ ID NO: 689675 - DNA, 20 bp, Artificial
  CRISPR gRNA sequence
aatattttgacaaaaaatgc

SEQ ID NO: 689676 - DNA, 20 bp, Artificial
  CRISPR gRNA sequence
aaaatgcaagtcacctttct

SEQ ID NO: 689677 - DNA, 20 bp, Artificial
  CRISPR gRNA sequence
caagtcacctttctaagtcc

SEQ ID NO: 689678 - DNA, 20 bp, Artificial
  CRISPR gRNA sequence
tcacctttctaagtcccaga

SEQ ID NO: 689679 - DNA, 20 bp, Artificial
  CRISPR gRNA sequence
cctttctaagtcccagacag

SEQ ID NO: 689680 - DNA, 20 bp, Artificial
  CRISPR gRNA sequence
agacagcagctcaaaataaa

SEQ ID NO: 689681 - DNA, 20 bp, Artificial
  CRISPR gRNA sequence
gcattaaacccctcaaatct

SEQ ID NO: 689682 - DNA, 20 bp, Artificial
  CRISPR gRNA sequence
aaacccctcaaatcttagac

SEQ ID NO: 689683 - DNA, 20 bp, Artificial
  CRISPR gRNA sequence
aacccctcaaatcttagacc

SEQ ID NO: 689684 - DNA, 20 bp, Artificial
  CRISPR gRNA sequence
tagaccaggtgaaattattg

SEQ ID NO: 689685 - DNA, 20 bp, Artificial
  CRISPR gRNA sequence
aggtgaaattattgaagctg

SEQ ID NO: 689686 - DNA, 20 bp, Artificial
  CRISPR gRNA sequence
gaaattattgaagctgcagt

SEQ ID NO: 689687 - DNA, 20 bp, Artificial
  CRISPR gRNA sequence
aaattattgaagctgcagta

SEQ ID NO: 689688 - DNA, 20 bp, Artificial
  CRISPR gRNA sequence
gaagctgcagtaaggtcttg

SEQ ID NO: 689689 - DNA, 20 bp, Artificial
  CRISPR gRNA sequence
aagctgcagtaaggtcttgt

SEQ ID NO: 689690 - DNA, 20 bp, Artificial
  CRISPR gRNA sequence
gtaaggtcttgtgggacctg

SEQ ID NO: 689691 - DNA, 20 bp, Artificial
  CRISPR gRNA sequence
ggtcttgtgggacctgcagt

SEQ ID NO: 689692 - DNA, 20 bp, Artificial
  CRISPR gRNA sequence
tcttgtgggacctgcagtta

SEQ ID NO: 689693 - DNA, 20 bp, Artificial
  CRISPR gRNA sequence
ttgtgggacctgcagttaga

SEQ ID NO: 689694 - DNA, 20 bp, Artificial
  CRISPR gRNA sequence
tgggacctgcagttagagag

SEQ ID NO: 689695 - DNA, 20 bp, Artificial
  CRISPR gRNA sequence
gggacctgcagttagagaga

SEQ ID NO: 689696 - DNA, 20 bp, Artificial
  CRISPR gRNA sequence
ggacctgcagttagagagaa

SEQ ID NO: 689697 - DNA, 20 bp, Artificial
  CRISPR gRNA sequence
agagaagggacaactcaatt

SEQ ID NO: 689698 - DNA, 20 bp, Artificial
  CRISPR gRNA sequence
gagaagggacaactcaattt

SEQ ID NO: 689699 - DNA, 20 bp, Artificial
  CRISPR gRNA sequence
gacaactcaatttgggactg

SEQ ID NO: 689700 - DNA, 20 bp, Artificial
  CRISPR gRNA sequence
aactcaatttgggactgcag

SEQ ID NO: 689701 - DNA, 20 bp, Artificial
  CRISPR gRNA sequence
cagcagaaacccctacatca

SEQ ID NO: 689702 - DNA, 20 bp, Artificial
  CRISPR gRNA sequence
agcagaaacccctacatcat

SEQ ID NO: 689703 - DNA, 20 bp, Artificial
  CRISPR gRNA sequence
gcagaaacccctacatcatg

SEQ ID NO: 689704 - DNA, 20 bp, Artificial
  CRISPR gRNA sequence
cccctacatcatggggttcc

SEQ ID NO: 689705 - DNA, 20 bp, Artificial
  CRISPR gRNA sequence
ctacatcatggggttcctgg

SEQ ID NO: 689706 - DNA, 20 bp, Artificial
  CRISPR gRNA sequence
tacatcatggggttcctgga

SEQ ID NO: 689707 - DNA, 20 bp, Artificial
  CRISPR gRNA sequence
acatcatggggttcctggaa

SEQ ID NO: 689708 - DNA, 20 bp, Artificial
  CRISPR gRNA sequence
tggaagggaccctctccctt

SEQ ID NO: 689709 - DNA, 20 bp, Artificial
  CRISPR gRNA sequence
tcccttcagcgacgcattgt

SEQ ID NO: 689710 - DNA, 20 bp, Artificial
  CRISPR gRNA sequence
cccttcagcgacgcattgtg

SEQ ID NO: 689711 - DNA, 20 bp, Artificial
  CRISPR gRNA sequence
acgcattgtgaggccatttc

SEQ ID NO: 689712 - DNA, 20 bp, Artificial
  CRISPR gRNA sequence
cgcattgtgaggccatttct

SEQ ID NO: 689713 - DNA, 20 bp, Artificial
  CRISPR gRNA sequence
tgaggccatttctaggtaaa

SEQ ID NO: 689714 - DNA, 20 bp, Artificial
  CRISPR gRNA sequence
gaggccatttctaggtaaaa

SEQ ID NO: 689715 - DNA, 20 bp, Artificial
  CRISPR gRNA sequence
gccatttctaggtaaaaagg

SEQ ID NO: 689716 - DNA, 20 bp, Artificial
  CRISPR gRNA sequence
gtaaaaaggtagaatttcct

SEQ ID NO: 689717 - DNA, 20 bp, Artificial
  CRISPR gRNA sequence
tagaatttccttggattcct

SEQ ID NO: 689718 - DNA, 20 bp, Artificial
  CRISPR gRNA sequence
agaatttccttggattcctg

SEQ ID NO: 689719 - DNA, 20 bp, Artificial
  CRISPR gRNA sequence
ctgcttattctttgacttta

SEQ ID NO: 689720 - DNA, 20 bp, Artificial
  CRISPR gRNA sequence
cttattctttgactttatag

SEQ ID NO: 689721 - DNA, 20 bp, Artificial
  CRISPR gRNA sequence
gactttatagaagccaactt

SEQ ID NO: 689722 - DNA, 20 bp, Artificial
  CRISPR gRNA sequence
atcttgcaattaattttttt

SEQ ID NO: 689723 - DNA, 20 bp, Artificial
  CRISPR gRNA sequence
aattaattttttttggctct

SEQ ID NO: 689724 - DNA, 20 bp, Artificial
  CRISPR gRNA sequence
taattttttttggctctaag

SEQ ID NO: 689725 - DNA, 20 bp, Artificial
  CRISPR gRNA sequence
attttttttggctctaagtg

SEQ ID NO: 689726 - DNA, 20 bp, Artificial
  CRISPR gRNA sequence
agaatttgaacttgtttctg

SEQ ID NO: 689727 - DNA, 20 bp, Artificial
  CRISPR gRNA sequence
aacttgtttctgaagaaaac

SEQ ID NO: 689728 - DNA, 20 bp, Artificial
  CRISPR gRNA sequence
acttgtttctgaagaaaacc

SEQ ID NO: 689729 - DNA, 20 bp, Artificial
  CRISPR gRNA sequence
cttgtttctgaagaaaacca

SEQ ID NO: 689730 - DNA, 20 bp, Artificial
  CRISPR gRNA sequence
ttgtttctgaagaaaaccag

SEQ ID NO: 689731 - DNA, 20 bp, Artificial
  CRISPR gRNA sequence
aaaccaggggctccttatgt

SEQ ID NO: 689732 - DNA, 20 bp, Artificial
  CRISPR gRNA sequence
caggggctccttatgtgagc

SEQ ID NO: 689733 - DNA, 20 bp, Artificial
  CRISPR gRNA sequence
tgagcaagcaaccctccctg

SEQ ID NO: 689734 - DNA, 20 bp, Artificial
  CRISPR gRNA sequence
cccccttatgcaataaacat

SEQ ID NO: 689735 - DNA, 20 bp, Artificial
  CRISPR gRNA sequence
caataaacataagccattgt

SEQ ID NO: 689736 - DNA, 20 bp, Artificial
  CRISPR gRNA sequence
aaacataagccattgtgagc

SEQ ID NO: 689737 - DNA, 20 bp, Artificial
  CRISPR gRNA sequence
ttgtgagccagcaaaattta

SEQ ID NO: 689738 - DNA, 20 bp, Artificial
  CRISPR gRNA sequence
gagccagcaaaatttaaagc

SEQ ID NO: 689739 - DNA, 20 bp, Artificial
  CRISPR gRNA sequence
agccagcaaaatttaaagca

SEQ ID NO: 689740 - DNA, 20 bp, Artificial
  CRISPR gRNA sequence
agcaaaatttaaagcaagga

SEQ ID NO: 689741 - DNA, 20 bp, Artificial
  CRISPR gRNA sequence
aaaatttaaagcaaggaaag

SEQ ID NO: 689742 - DNA, 20 bp, Artificial
  CRISPR gRNA sequence
aagcagtaaaccctccattt

SEQ ID NO: 689743 - DNA, 20 bp, Artificial
  CRISPR gRNA sequence
ccctccatttcagcatgttt

SEQ ID NO: 689744 - DNA, 20 bp, Artificial
  CRISPR gRNA sequence
tcagcatgtttcagcctgtc

SEQ ID NO: 689745 - DNA, 20 bp, Artificial
  CRISPR gRNA sequence
cagcctgtctagtgatgttc

SEQ ID NO: 689746 - DNA, 20 bp, Artificial
  CRISPR gRNA sequence
ttatttgattttgatttaat

SEQ ID NO: 689747 - DNA, 20 bp, Artificial
  CRISPR gRNA sequence
tcatatgtattcatttcttt

SEQ ID NO: 689748 - DNA, 20 bp, Artificial
  CRISPR gRNA sequence
catatgtattcatttctttt

SEQ ID NO: 689749 - DNA, 20 bp, Artificial
  CRISPR gRNA sequence
tcttttgggtttgtcaccaa

SEQ ID NO: 689750 - DNA, 20 bp, Artificial
  CRISPR gRNA sequence
aagcctcctccaatcacctg

SEQ ID NO: 689751 - DNA, 20 bp, Artificial
  CRISPR gRNA sequence
gcctcctccaatcacctgtg

SEQ ID NO: 689752 - DNA, 20 bp, Artificial
  CRISPR gRNA sequence
ctccaatcacctgtggagta

SEQ ID NO: 689753 - DNA, 20 bp, Artificial
  CRISPR gRNA sequence
atcacctgtggagtaaagac

SEQ ID NO: 689754 - DNA, 20 bp, Artificial
  CRISPR gRNA sequence
aagacaagtaaataaatgca

SEQ ID NO: 689755 - DNA, 20 bp, Artificial
  CRISPR gRNA sequence
tgcatggtgttcccatttat

SEQ ID NO: 689756 - DNA, 20 bp, Artificial
  CRISPR gRNA sequence
cagtgctcactgcatcttac

SEQ ID NO: 689757 - DNA, 20 bp, Artificial
  CRISPR gRNA sequence
actgcatcttacaagtgtat

SEQ ID NO: 689758 - DNA, 20 bp, Artificial
  CRISPR gRNA sequence
caagtgtatcagccccactt

SEQ ID NO: 689759 - DNA, 20 bp, Artificial
  CRISPR gRNA sequence
atcagccccacttcagctga

SEQ ID NO: 689760 - DNA, 20 bp, Artificial
  CRISPR gRNA sequence
cccacttcagctgatagtac

SEQ ID NO: 689761 - DNA, 20 bp, Artificial
  CRISPR gRNA sequence
ccacttcagctgatagtacc

SEQ ID NO: 689762 - DNA, 20 bp, Artificial
  CRISPR gRNA sequence
cacatacaaaataatgatgt

SEQ ID NO: 689763 - DNA, 20 bp, Artificial
  CRISPR gRNA sequence
atgatgttggacaaaattca

SEQ ID NO: 689764 - DNA, 20 bp, Artificial
  CRISPR gRNA sequence
aaaaattaactcaattaact

SEQ ID NO: 689765 - DNA, 20 bp, Artificial
  CRISPR gRNA sequence
ttaactcaattaactcagaa

SEQ ID NO: 689766 - DNA, 20 bp, Artificial
  CRISPR gRNA sequence
caattaactcagaatggttc

SEQ ID NO: 689767 - DNA, 20 bp, Artificial
  CRISPR gRNA sequence
aattaactcagaatggttca

SEQ ID NO: 689768 - DNA, 20 bp, Artificial
  CRISPR gRNA sequence
atggttcaaggaactcaact

SEQ ID NO: 689769 - DNA, 20 bp, Artificial
  CRISPR gRNA sequence
tggttcaaggaactcaactt

SEQ ID NO: 689770 - DNA, 20 bp, Artificial
  CRISPR gRNA sequence
gttcaaggaactcaacttag

SEQ ID NO: 689771 - DNA, 20 bp, Artificial
  CRISPR gRNA sequence
agttcaacctataaatcttt

SEQ ID NO: 689772 - DNA, 20 bp, Artificial
  CRISPR gRNA sequence
tcaacctataaatcttttag

SEQ ID NO: 689773 - DNA, 20 bp, Artificial
  CRISPR gRNA sequence
tcttttagaagaaaacattg

SEQ ID NO: 689774 - DNA, 20 bp, Artificial
  CRISPR gRNA sequence
gaaaacattgaagaaaatct

SEQ ID NO: 689775 - DNA, 20 bp, Artificial
  CRISPR gRNA sequence
aaaacattgaagaaaatctt

SEQ ID NO: 689776 - DNA, 20 bp, Artificial
  CRISPR gRNA sequence
gaagaaaatcttaggaacat

SEQ ID NO: 689777 - DNA, 20 bp, Artificial
  CRISPR gRNA sequence
aatcttaggaacattggatg

SEQ ID NO: 689778 - DNA, 20 bp, Artificial
  CRISPR gRNA sequence
aggaacattggatgtggcaa

SEQ ID NO: 689779 - DNA, 20 bp, Artificial
  CRISPR gRNA sequence
tggatgtggcaatggcttct

SEQ ID NO: 689780 - DNA, 20 bp, Artificial
  CRISPR gRNA sequence
tgtggcaatggcttcttggc

SEQ ID NO: 689781 - DNA, 20 bp, Artificial
  CRISPR gRNA sequence
gcaatggcttcttggctggt

SEQ ID NO: 689782 - DNA, 20 bp, Artificial
  CRISPR gRNA sequence
gcttcttggctggtgagcaa

SEQ ID NO: 689783 - DNA, 20 bp, Artificial
  CRISPR gRNA sequence
agcaaaagcacaaccaataa

SEQ ID NO: 689784 - DNA, 20 bp, Artificial
  CRISPR gRNA sequence
ataaaagaaaaacaataaat

SEQ ID NO: 689785 - DNA, 20 bp, Artificial
  CRISPR gRNA sequence
aaaaaccttttttatatatc

SEQ ID NO: 689786 - DNA, 20 bp, Artificial
  CRISPR gRNA sequence
aaaaccttttttatatatca

SEQ ID NO: 689787 - DNA, 20 bp, Artificial
  CRISPR gRNA sequence
aaaccttttttatatatcaa

SEQ ID NO: 689788 - DNA, 20 bp, Artificial
  CRISPR gRNA sequence
atatatcaagggacactatt

SEQ ID NO: 689789 - DNA, 20 bp, Artificial
  CRISPR gRNA sequence
atatcaagggacactattaa

SEQ ID NO: 689790 - DNA, 20 bp, Artificial
  CRISPR gRNA sequence
atcaagggacactattaaga

SEQ ID NO: 689791 - DNA, 20 bp, Artificial
  CRISPR gRNA sequence
gacactattaagagagttaa

SEQ ID NO: 689792 - DNA, 20 bp, Artificial
  CRISPR gRNA sequence
gagagttaaaagaaaatgca

SEQ ID NO: 689793 - DNA, 20 bp, Artificial
  CRISPR gRNA sequence
ttaaaagaaaatgcacagaa

SEQ ID NO: 689794 - DNA, 20 bp, Artificial
  CRISPR gRNA sequence
taaaagaaaatgcacagaat

SEQ ID NO: 689795 - DNA, 20 bp, Artificial
  CRISPR gRNA sequence
aaagaaaatgcacagaatgg

SEQ ID NO: 689796 - DNA, 20 bp, Artificial
  CRISPR gRNA sequence
aagaaaatgcacagaatggg

SEQ ID NO: 689797 - DNA, 20 bp, Artificial
  CRISPR gRNA sequence
gaatgggaggaaatatttgc

SEQ ID NO: 689798 - DNA, 20 bp, Artificial
  CRISPR gRNA sequence
tgccagttatatacctgata

SEQ ID NO: 689799 - DNA, 20 bp, Artificial
  CRISPR gRNA sequence
cctgataaagaattaatatc

SEQ ID NO: 689800 - DNA, 20 bp, Artificial
  CRISPR gRNA sequence
attaatatccagaatacata

SEQ ID NO: 689801 - DNA, 20 bp, Artificial
  CRISPR gRNA sequence
aaagaactatgacttaacaa

SEQ ID NO: 689802 - DNA, 20 bp, Artificial
  CRISPR gRNA sequence
aaacaatctcattcaaaaat

SEQ ID NO: 689803 - DNA, 20 bp, Artificial
  CRISPR gRNA sequence
aaatgagtgaacaacatgaa

SEQ ID NO: 689804 - DNA, 20 bp, Artificial
  CRISPR gRNA sequence
catgaatagacaattctcca

SEQ ID NO: 689805 - DNA, 20 bp, Artificial
  CRISPR gRNA sequence
gaatagacaattctccaaag

SEQ ID NO: 689806 - DNA, 20 bp, Artificial
  CRISPR gRNA sequence
ctccaaagaagatatacaaa

SEQ ID NO: 689807 - DNA, 20 bp, Artificial
  CRISPR gRNA sequence
tccaaagaagatatacaaat

SEQ ID NO: 689808 - DNA, 20 bp, Artificial
  CRISPR gRNA sequence
gaagatatacaaatgggcaa

SEQ ID NO: 689809 - DNA, 20 bp, Artificial
  CRISPR gRNA sequence
aagatatacaaatgggcaat

SEQ ID NO: 689810 - DNA, 20 bp, Artificial
  CRISPR gRNA sequence
gaaaatatgctgaacttcac

SEQ ID NO: 689811 - DNA, 20 bp, Artificial
  CRISPR gRNA sequence
aacttcactagtccaaatgt

SEQ ID NO: 689812 - DNA, 20 bp, Artificial
  CRISPR gRNA sequence
cactagtccaaatgttggcg

SEQ ID NO: 689813 - DNA, 20 bp, Artificial
  CRISPR gRNA sequence
tccaaatgttggcgaagatg

SEQ ID NO: 689814 - DNA, 20 bp, Artificial
  CRISPR gRNA sequence
caaatgttggcgaagatgtg

SEQ ID NO: 689815 - DNA, 20 bp, Artificial
  CRISPR gRNA sequence
atgttggcgaagatgtggag

SEQ ID NO: 689816 - DNA, 20 bp, Artificial
  CRISPR gRNA sequence
tcacaacacttgtacactgc

SEQ ID NO: 689817 - DNA, 20 bp, Artificial
  CRISPR gRNA sequence
aacacttgtacactgctggt

SEQ ID NO: 689818 - DNA, 20 bp, Artificial
  CRISPR gRNA sequence
cacttgtacactgctggtga

SEQ ID NO: 689819 - DNA, 20 bp, Artificial
  CRISPR gRNA sequence
acactgctggtgagagtgta

SEQ ID NO: 689820 - DNA, 20 bp, Artificial
  CRISPR gRNA sequence
ctgctggtgagagtgtacag

SEQ ID NO: 689821 - DNA, 20 bp, Artificial
  CRISPR gRNA sequence
ggtgagagtgtacagtggta

SEQ ID NO: 689822 - DNA, 20 bp, Artificial
  CRISPR gRNA sequence
ggtacagcgaccatgaaaaa

SEQ ID NO: 689823 - DNA, 20 bp, Artificial
  CRISPR gRNA sequence
aaacagtatgatgcttcctc

SEQ ID NO: 689824 - DNA, 20 bp, Artificial
  CRISPR gRNA sequence
agtatgatgcttcctcaaga

SEQ ID NO: 689825 - DNA, 20 bp, Artificial
  CRISPR gRNA sequence
aagtaaaaacacaatttcca

SEQ ID NO: 689826 - DNA, 20 bp, Artificial
  CRISPR gRNA sequence
agtaaaaacacaatttccat

SEQ ID NO: 689827 - DNA, 20 bp, Artificial
  CRISPR gRNA sequence
taaaaacacaatttccatag

SEQ ID NO: 689828 - DNA, 20 bp, Artificial
  CRISPR gRNA sequence
ggagccaacaattccacttt

SEQ ID NO: 689829 - DNA, 20 bp, Artificial
  CRISPR gRNA sequence
gagccaacaattccactttt

SEQ ID NO: 689830 - DNA, 20 bp, Artificial
  CRISPR gRNA sequence
acttttgggcatatacccaa

SEQ ID NO: 689831 - DNA, 20 bp, Artificial
  CRISPR gRNA sequence
catatacccaaaagaattga

SEQ ID NO: 689832 - DNA, 20 bp, Artificial
  CRISPR gRNA sequence
atacccaaaagaattgaaag

SEQ ID NO: 689833 - DNA, 20 bp, Artificial
  CRISPR gRNA sequence
tacccaaaagaattgaaagc

SEQ ID NO: 689834 - DNA, 20 bp, Artificial
  CRISPR gRNA sequence
attgaaagcaggaactcaca

SEQ ID NO: 689835 - DNA, 20 bp, Artificial
  CRISPR gRNA sequence
taattgtacactcatgctcg

SEQ ID NO: 689836 - DNA, 20 bp, Artificial
  CRISPR gRNA sequence
ttgtacactcatgctcgtag

SEQ ID NO: 689837 - DNA, 20 bp, Artificial
  CRISPR gRNA sequence
cgtagcagcactattcccaa

SEQ ID NO: 689838 - DNA, 20 bp, Artificial
  CRISPR gRNA sequence
gcactattcccaatggccaa

SEQ ID NO: 689839 - DNA, 20 bp, Artificial
  CRISPR gRNA sequence
cactattcccaatggccaaa

SEQ ID NO: 689840 - DNA, 20 bp, Artificial
  CRISPR gRNA sequence
tattcccaatggccaaaagg

SEQ ID NO: 689841 - DNA, 20 bp, Artificial
  CRISPR gRNA sequence
tcccaatggccaaaaggtgg

SEQ ID NO: 689842 - DNA, 20 bp, Artificial
  CRISPR gRNA sequence
gccaaaaggtggaagcaacc

SEQ ID NO: 689843 - DNA, 20 bp, Artificial
  CRISPR gRNA sequence
ggaagcaaccgagtgtccat

SEQ ID NO: 689844 - DNA, 20 bp, Artificial
  CRISPR gRNA sequence
aagcaaccgagtgtccatcg

SEQ ID NO: 689845 - DNA, 20 bp, Artificial
  CRISPR gRNA sequence
agcaaccgagtgtccatcgg

SEQ ID NO: 689846 - DNA, 20 bp, Artificial
  CRISPR gRNA sequence
agtgtccatcggaggatgat

SEQ ID NO: 689847 - DNA, 20 bp, Artificial
  CRISPR gRNA sequence
atgattagataaacgaccca

SEQ ID NO: 689848 - DNA, 20 bp, Artificial
  CRISPR gRNA sequence
taaacgacccatggtgcaca

SEQ ID NO: 689849 - DNA, 20 bp, Artificial
  CRISPR gRNA sequence
gacccatggtgcacatagca

SEQ ID NO: 689850 - DNA, 20 bp, Artificial
  CRISPR gRNA sequence
acatagcatggaatattatt

SEQ ID NO: 689851 - DNA, 20 bp, Artificial
  CRISPR gRNA sequence
ggaatattattcagccttaa

SEQ ID NO: 689852 - DNA, 20 bp, Artificial
  CRISPR gRNA sequence
ccttaaaagtgaatgaaatt

SEQ ID NO: 689853 - DNA, 20 bp, Artificial
  CRISPR gRNA sequence
cttaaaagtgaatgaaattc

SEQ ID NO: 689854 - DNA, 20 bp, Artificial
  CRISPR gRNA sequence
attcaggttgcatgaacctt

SEQ ID NO: 689855 - DNA, 20 bp, Artificial
  CRISPR gRNA sequence
atgaaccttgagaacactgt

SEQ ID NO: 689856 - DNA, 20 bp, Artificial
  CRISPR gRNA sequence
gagaacactgtaagtgaaat

SEQ ID NO: 689857 - DNA, 20 bp, Artificial
  CRISPR gRNA sequence
acactgtaagtgaaatgagc

SEQ ID NO: 689858 - DNA, 20 bp, Artificial
  CRISPR gRNA sequence
tgaaatgagccagaaacaaa

SEQ ID NO: 689859 - DNA, 20 bp, Artificial
  CRISPR gRNA sequence
aatatttcacttatgtgatg

SEQ ID NO: 689860 - DNA, 20 bp, Artificial
  CRISPR gRNA sequence
cttatgtgatgcagctaaaa

SEQ ID NO: 689861 - DNA, 20 bp, Artificial
  CRISPR gRNA sequence
ttatgtgatgcagctaaaat

SEQ ID NO: 689862 - DNA, 20 bp, Artificial
  CRISPR gRNA sequence
agctaaaataggcaaattca

SEQ ID NO: 689863 - DNA, 20 bp, Artificial
  CRISPR gRNA sequence
aataggcaaattcatagaaa

SEQ ID NO: 689864 - DNA, 20 bp, Artificial
  CRISPR gRNA sequence
taggcaaattcatagaaaca

SEQ ID NO: 689865 - DNA, 20 bp, Artificial
  CRISPR gRNA sequence
ggcaaattcatagaaacaga

SEQ ID NO: 689866 - DNA, 20 bp, Artificial
  CRISPR gRNA sequence
catagaaacagagagtaaaa

SEQ ID NO: 689867 - DNA, 20 bp, Artificial
  CRISPR gRNA sequence
gagagtaaaatagaatttac

SEQ ID NO: 689868 - DNA, 20 bp, Artificial
  CRISPR gRNA sequence
aatagaatttaccagaaatt

SEQ ID NO: 689869 - DNA, 20 bp, Artificial
  CRISPR gRNA sequence
atagaatttaccagaaattg

SEQ ID NO: 689870 - DNA, 20 bp, Artificial
  CRISPR gRNA sequence
tagaatttaccagaaattga

SEQ ID NO: 689871 - DNA, 20 bp, Artificial
  CRISPR gRNA sequence
aatttaccagaaattgaggg

SEQ ID NO: 689872 - DNA, 20 bp, Artificial
  CRISPR gRNA sequence
atttaccagaaattgagggt

SEQ ID NO: 689873 - DNA, 20 bp, Artificial
  CRISPR gRNA sequence
tttaccagaaattgagggta

SEQ ID NO: 689874 - DNA, 20 bp, Artificial
  CRISPR gRNA sequence
taccagaaattgagggtagg

SEQ ID NO: 689875 - DNA, 20 bp, Artificial
  CRISPR gRNA sequence
gaaattgagggtagggagaa

SEQ ID NO: 689876 - DNA, 20 bp, Artificial
  CRISPR gRNA sequence
aaattgagggtagggagaat

SEQ ID NO: 689877 - DNA, 20 bp, Artificial
  CRISPR gRNA sequence
ttgagggtagggagaatggg

SEQ ID NO: 689878 - DNA, 20 bp, Artificial
  CRISPR gRNA sequence
gtagggagaatgggcagctt

SEQ ID NO: 689879 - DNA, 20 bp, Artificial
  CRISPR gRNA sequence
aatgggcagctttggtttaa

SEQ ID NO: 689880 - DNA, 20 bp, Artificial
  CRISPR gRNA sequence
atgggcagctttggtttaat

SEQ ID NO: 689881 - DNA, 20 bp, Artificial
  CRISPR gRNA sequence
cagctttggtttaatgggtc

SEQ ID NO: 689882 - DNA, 20 bp, Artificial
  CRISPR gRNA sequence
ttaatgggtccagtttctgt

SEQ ID NO: 689883 - DNA, 20 bp, Artificial
  CRISPR gRNA sequence
taatgggtccagtttctgtt

SEQ ID NO: 689884 - DNA, 20 bp, Artificial
  CRISPR gRNA sequence
ttgggatgatgaaaatgttc

SEQ ID NO: 689885 - DNA, 20 bp, Artificial
  CRISPR gRNA sequence
aatgttctggaaatgcatat

SEQ ID NO: 689886 - DNA, 20 bp, Artificial
  CRISPR gRNA sequence
gttctggaaatgcatattgg

SEQ ID NO: 689887 - DNA, 20 bp, Artificial
  CRISPR gRNA sequence
ctggaaatgcatattggtgg

SEQ ID NO: 689888 - DNA, 20 bp, Artificial
  CRISPR gRNA sequence
acaacattgtaaatgtgctt

SEQ ID NO: 689889 - DNA, 20 bp, Artificial
  CRISPR gRNA sequence
caacattgtaaatgtgcttt

SEQ ID NO: 689890 - DNA, 20 bp, Artificial
  CRISPR gRNA sequence
caccgaattgtacactgaaa

SEQ ID NO: 689891 - DNA, 20 bp, Artificial
  CRISPR gRNA sequence
cgaattgtacactgaaaaag

SEQ ID NO: 689892 - DNA, 20 bp, Artificial
  CRISPR gRNA sequence
ttgtacactgaaaaagtggt

SEQ ID NO: 689893 - DNA, 20 bp, Artificial
  CRISPR gRNA sequence
tacactgaaaaagtggttag

SEQ ID NO: 689894 - DNA, 20 bp, Artificial
  CRISPR gRNA sequence
acactgaaaaagtggttaga

SEQ ID NO: 689895 - DNA, 20 bp, Artificial
  CRISPR gRNA sequence
tggttagaaggtaaattaca

SEQ ID NO: 689896 - DNA, 20 bp, Artificial
  CRISPR gRNA sequence
tgttttaccacaatattaac

SEQ ID NO: 689897 - DNA, 20 bp, Artificial
  CRISPR gRNA sequence
ctcctctcctgccaccaccc

SEQ ID NO: 689898 - DNA, 20 bp, Artificial
  CRISPR gRNA sequence
cctctcctgccaccacccga

SEQ ID NO: 689899 - DNA, 20 bp, Artificial
  CRISPR gRNA sequence
cacccgagagccaccctctc

SEQ ID NO: 689900 - DNA, 20 bp, Artificial
  CRISPR gRNA sequence
ccctctcaagaattgtaaac

SEQ ID NO: 689901 - DNA, 20 bp, Artificial
  CRISPR gRNA sequence
tctcaagaattgtaaaccag

SEQ ID NO: 689902 - DNA, 20 bp, Artificial
  CRISPR gRNA sequence
ctcaagaattgtaaaccaga

SEQ ID NO: 689903 - DNA, 20 bp, Artificial
  CRISPR gRNA sequence
tcaagaattgtaaaccagaa

SEQ ID NO: 689904 - DNA, 20 bp, Artificial
  CRISPR gRNA sequence
tgtaaaccagaagggctttc

SEQ ID NO: 689905 - DNA, 20 bp, Artificial
  CRISPR gRNA sequence
aaccagaagggctttccagc

SEQ ID NO: 689906 - DNA, 20 bp, Artificial
  CRISPR gRNA sequence
accagaagggctttccagct

SEQ ID NO: 689907 - DNA, 20 bp, Artificial
  CRISPR gRNA sequence
cactgtccattactcacaca

SEQ ID NO: 689908 - DNA, 20 bp, Artificial
  CRISPR gRNA sequence
actgtccattactcacacaa

SEQ ID NO: 689909 - DNA, 20 bp, Artificial
  CRISPR gRNA sequence
gtccattactcacacaaagg

SEQ ID NO: 689910 - DNA, 20 bp, Artificial
  CRISPR gRNA sequence
ccattactcacacaaaggca

SEQ ID NO: 689911 - DNA, 20 bp, Artificial
  CRISPR gRNA sequence
tactcacacaaaggcagagt

SEQ ID NO: 689912 - DNA, 20 bp, Artificial
  CRISPR gRNA sequence
tgagcctctcaaacgaaaat

SEQ ID NO: 689913 - DNA, 20 bp, Artificial
  CRISPR gRNA sequence
gagcctctcaaacgaaaatt

SEQ ID NO: 689914 - DNA, 20 bp, Artificial
  CRISPR gRNA sequence
gacatatcctatgaacacct

SEQ ID NO: 689915 - DNA, 20 bp, Artificial
  CRISPR gRNA sequence
acctcagcccttttctttcc

SEQ ID NO: 689916 - DNA, 20 bp, Artificial
  CRISPR gRNA sequence
cctcagcccttttctttcct

SEQ ID NO: 689917 - DNA, 20 bp, Artificial
  CRISPR gRNA sequence
tcctaggcacaatgaaacct

SEQ ID NO: 689918 - DNA, 20 bp, Artificial
  CRISPR gRNA sequence
agtctctcaccgtttcctac

SEQ ID NO: 689919 - DNA, 20 bp, Artificial
  CRISPR gRNA sequence
ttcctacaagcccctcatca

SEQ ID NO: 689920 - DNA, 20 bp, Artificial
  CRISPR gRNA sequence
tcctacaagcccctcatcat

SEQ ID NO: 689921 - DNA, 20 bp, Artificial
  CRISPR gRNA sequence
ccctcatcataggacccctg

SEQ ID NO: 689922 - DNA, 20 bp, Artificial
  CRISPR gRNA sequence
tggcctcatcccgccattct

SEQ ID NO: 689923 - DNA, 20 bp, Artificial
  CRISPR gRNA sequence
tcatcccgccattctcagcc

SEQ ID NO: 689924 - DNA, 20 bp, Artificial
  CRISPR gRNA sequence
tcactcatctccactcacac

SEQ ID NO: 689925 - DNA, 20 bp, Artificial
  CRISPR gRNA sequence
tcccacatgcacctgctccc

SEQ ID NO: 689926 - DNA, 20 bp, Artificial
  CRISPR gRNA sequence
cccacatgcacctgctcccc

SEQ ID NO: 689927 - DNA, 20 bp, Artificial
  CRISPR gRNA sequence
ccacatgcacctgctccccg

SEQ ID NO: 689928 - DNA, 20 bp, Artificial
  CRISPR gRNA sequence
cacatgcacctgctccccgg

SEQ ID NO: 689929 - DNA, 20 bp, Artificial
  CRISPR gRNA sequence
ctgctccccgggggtccaca

SEQ ID NO: 689930 - DNA, 20 bp, Artificial
  CRISPR gRNA sequence
gctcactcctcacaccattc

SEQ ID NO: 689931 - DNA, 20 bp, Artificial
  CRISPR gRNA sequence
gtctctgttcaaatgtccca

SEQ ID NO: 689932 - DNA, 20 bp, Artificial
  CRISPR gRNA sequence
tgttcaaatgtcccatggtc

SEQ ID NO: 689933 - DNA, 20 bp, Artificial
  CRISPR gRNA sequence
atgtcccatggtcaagttct

SEQ ID NO: 689934 - DNA, 20 bp, Artificial
  CRISPR gRNA sequence
gttctcagaaatgtcatgcc

SEQ ID NO: 689935 - DNA, 20 bp, Artificial
  CRISPR gRNA sequence
cgccactcccaccaatcttc

SEQ ID NO: 689936 - DNA, 20 bp, Artificial
  CRISPR gRNA sequence
ctcccaccaatcttctagcc

SEQ ID NO: 689937 - DNA, 20 bp, Artificial
  CRISPR gRNA sequence
tcccaccaatcttctagcct

SEQ ID NO: 689938 - DNA, 20 bp, Artificial
  CRISPR gRNA sequence
agcctaggtgtattttttat

SEQ ID NO: 689939 - DNA, 20 bp, Artificial
  CRISPR gRNA sequence
ctaggtgtattttttatcag

SEQ ID NO: 689940 - DNA, 20 bp, Artificial
  CRISPR gRNA sequence
aattatcactgatactgtga

SEQ ID NO: 689941 - DNA, 20 bp, Artificial
  CRISPR gRNA sequence
tctatttgtttattgtctgt

SEQ ID NO: 689942 - DNA, 20 bp, Artificial
  CRISPR gRNA sequence
tttattgtctgttggtgtat

SEQ ID NO: 689943 - DNA, 20 bp, Artificial
  CRISPR gRNA sequence
ttattgtctgttggtgtatc

SEQ ID NO: 689944 - DNA, 20 bp, Artificial
  CRISPR gRNA sequence
tattgtctgttggtgtatca

SEQ ID NO: 689945 - DNA, 20 bp, Artificial
  CRISPR gRNA sequence
gttggtgtatcagggttacc

SEQ ID NO: 689946 - DNA, 20 bp, Artificial
  CRISPR gRNA sequence
gtgtatcagggttaccaaga

SEQ ID NO: 689947 - DNA, 20 bp, Artificial
  CRISPR gRNA sequence
atcagggttaccaagacaga

SEQ ID NO: 689948 - DNA, 20 bp, Artificial
  CRISPR gRNA sequence
accaagacagaaagacccaa

SEQ ID NO: 689949 - DNA, 20 bp, Artificial
  CRISPR gRNA sequence
caagacagaaagacccaata

SEQ ID NO: 689950 - DNA, 20 bp, Artificial
  CRISPR gRNA sequence
gacagaaagacccaatagag

SEQ ID NO: 689951 - DNA, 20 bp, Artificial
  CRISPR gRNA sequence
gaaagacccaatagagtaga

SEQ ID NO: 689952 - DNA, 20 bp, Artificial
  CRISPR gRNA sequence
gacccaatagagtagatgga

SEQ ID NO: 689953 - DNA, 20 bp, Artificial
  CRISPR gRNA sequence
caatagagtagatggataga

SEQ ID NO: 689954 - DNA, 20 bp, Artificial
  CRISPR gRNA sequence
agagtagatggatagataga

SEQ ID NO: 689955 - DNA, 20 bp, Artificial
  CRISPR gRNA sequence
tagatggatagatagataga

SEQ ID NO: 689956 - DNA, 20 bp, Artificial
  CRISPR gRNA sequence
tggatagatagatagataga

SEQ ID NO: 689957 - DNA, 20 bp, Artificial
  CRISPR gRNA sequence
tagatagatagatagataga

SEQ ID NO: 689958 - DNA, 20 bp, Artificial
  CRISPR gRNA sequence
tagatagatagatagataga

SEQ ID NO: 689959 - DNA, 20 bp, Artificial
  CRISPR gRNA sequence
tagatagatagatagataga

SEQ ID NO: 689960 - DNA, 20 bp, Artificial
  CRISPR gRNA sequence
tagatagatagatagataga

SEQ ID NO: 689961 - DNA, 20 bp, Artificial
  CRISPR gRNA sequence
tagatagatagatagataga

SEQ ID NO: 689962 - DNA, 20 bp, Artificial
  CRISPR gRNA sequence
tagatagatagatagataga

SEQ ID NO: 689963 - DNA, 20 bp, Artificial
  CRISPR gRNA sequence
gatagatagatagatagata

SEQ ID NO: 689964 - DNA, 20 bp, Artificial
  CRISPR gRNA sequence
tagatagatagatagataga

SEQ ID NO: 689965 - DNA, 20 bp, Artificial
  CRISPR gRNA sequence
agatagatagatagagagac

SEQ ID NO: 689966 - DNA, 20 bp, Artificial
  CRISPR gRNA sequence
atagatagatagagagacaa

SEQ ID NO: 689967 - DNA, 20 bp, Artificial
  CRISPR gRNA sequence
tagatagatagagagacaag

SEQ ID NO: 689968 - DNA, 20 bp, Artificial
  CRISPR gRNA sequence
agatagatagagagacaaga

SEQ ID NO: 689969 - DNA, 20 bp, Artificial
  CRISPR gRNA sequence
gatagatagagagacaagag

SEQ ID NO: 689970 - DNA, 20 bp, Artificial
  CRISPR gRNA sequence
agagacaagaggggatttat

SEQ ID NO: 689971 - DNA, 20 bp, Artificial
  CRISPR gRNA sequence
gacaagaggggatttattag

SEQ ID NO: 689972 - DNA, 20 bp, Artificial
  CRISPR gRNA sequence
aggggatttattagtggaaa

SEQ ID NO: 689973 - DNA, 20 bp, Artificial
  CRISPR gRNA sequence
attagtggaaatggctcaca

SEQ ID NO: 689974 - DNA, 20 bp, Artificial
  CRISPR gRNA sequence
ggaaatggctcacatagtta

SEQ ID NO: 689975 - DNA, 20 bp, Artificial
  CRISPR gRNA sequence
aaatggctcacatagttatg

SEQ ID NO: 689976 - DNA, 20 bp, Artificial
  CRISPR gRNA sequence
aatggctcacatagttatgg

SEQ ID NO: 689977 - DNA, 20 bp, Artificial
  CRISPR gRNA sequence
acatagttatggaggctgat

SEQ ID NO: 689978 - DNA, 20 bp, Artificial
  CRISPR gRNA sequence
tggaggctgataagatccat

SEQ ID NO: 689979 - DNA, 20 bp, Artificial
  CRISPR gRNA sequence
gaggctgataagatccatga

SEQ ID NO: 689980 - DNA, 20 bp, Artificial
  CRISPR gRNA sequence
aggctgataagatccatgag

SEQ ID NO: 689981 - DNA, 20 bp, Artificial
  CRISPR gRNA sequence
atccatgagaggccacctgc

SEQ ID NO: 689982 - DNA, 20 bp, Artificial
  CRISPR gRNA sequence
atgagaggccacctgcaagc

SEQ ID NO: 689983 - DNA, 20 bp, Artificial
  CRISPR gRNA sequence
gagaggccacctgcaagctg

SEQ ID NO: 689984 - DNA, 20 bp, Artificial
  CRISPR gRNA sequence
cacctgcaagctggagaacc

SEQ ID NO: 689985 - DNA, 20 bp, Artificial
  CRISPR gRNA sequence
acctgcaagctggagaacca

SEQ ID NO: 689986 - DNA, 20 bp, Artificial
  CRISPR gRNA sequence
tgcaagctggagaaccaagg

SEQ ID NO: 689987 - DNA, 20 bp, Artificial
  CRISPR gRNA sequence
agctggagaaccaaggaaga

SEQ ID NO: 689988 - DNA, 20 bp, Artificial
  CRISPR gRNA sequence
tggagaaccaaggaagacag

SEQ ID NO: 689989 - DNA, 20 bp, Artificial
  CRISPR gRNA sequence
aaccaaggaagacagcagcc

SEQ ID NO: 689990 - DNA, 20 bp, Artificial
  CRISPR gRNA sequence
aggaagacagcagcctggct

SEQ ID NO: 689991 - DNA, 20 bp, Artificial
  CRISPR gRNA sequence
acagcagcctggctcagtcc

SEQ ID NO: 689992 - DNA, 20 bp, Artificial
  CRISPR gRNA sequence
cagcagcctggctcagtcca

SEQ ID NO: 689993 - DNA, 20 bp, Artificial
  CRISPR gRNA sequence
cctggctcagtccaaggcca

SEQ ID NO: 689994 - DNA, 20 bp, Artificial
  CRISPR gRNA sequence
ctggctcagtccaaggccaa

SEQ ID NO: 689995 - DNA, 20 bp, Artificial
  CRISPR gRNA sequence
cagtccaaggccaaaggcct

SEQ ID NO: 689996 - DNA, 20 bp, Artificial
  CRISPR gRNA sequence
agtccaaggccaaaggcctg

SEQ ID NO: 689997 - DNA, 20 bp, Artificial
  CRISPR gRNA sequence
gtccaaggccaaaggcctga

SEQ ID NO: 689998 - DNA, 20 bp, Artificial
  CRISPR gRNA sequence
tccaaggccaaaggcctgag

SEQ ID NO: 689999 - DNA, 20 bp, Artificial
  CRISPR gRNA sequence
aggccaaaggcctgaggggc

SEQ ID NO: 690000 - DNA, 20 bp, Artificial
  CRISPR gRNA sequence
gccaaaggcctgaggggcca

SEQ ID NO: 690001 - DNA, 20 bp, Artificial
  CRISPR gRNA sequence
ccaaaggcctgaggggccag

SEQ ID NO: 690002 - DNA, 20 bp, Artificial
  CRISPR gRNA sequence
aaaggcctgaggggccagag

SEQ ID NO: 690003 - DNA, 20 bp, Artificial
  CRISPR gRNA sequence
aaggcctgaggggccagagg

SEQ ID NO: 690004 - DNA, 20 bp, Artificial
  CRISPR gRNA sequence
ggcctgaggggccagaggag

SEQ ID NO: 690005 - DNA, 20 bp, Artificial
  CRISPR gRNA sequence
gcctgaggggccagaggagg

SEQ ID NO: 690006 - DNA, 20 bp, Artificial
  CRISPR gRNA sequence
tgaggggccagaggaggagg

SEQ ID NO: 690007 - DNA, 20 bp, Artificial
  CRISPR gRNA sequence
gaggggccagaggaggaggt

SEQ ID NO: 690008 - DNA, 20 bp, Artificial
  CRISPR gRNA sequence
ggggccagaggaggaggtgg

SEQ ID NO: 690009 - DNA, 20 bp, Artificial
  CRISPR gRNA sequence
gggccagaggaggaggtggg

SEQ ID NO: 690010 - DNA, 20 bp, Artificial
  CRISPR gRNA sequence
gaggaggaggtgggaggata

SEQ ID NO: 690011 - DNA, 20 bp, Artificial
  CRISPR gRNA sequence
aggaggaggtgggaggataa

SEQ ID NO: 690012 - DNA, 20 bp, Artificial
  CRISPR gRNA sequence
ggaggaggtgggaggataaa

SEQ ID NO: 690013 - DNA, 20 bp, Artificial
  CRISPR gRNA sequence
tgggaggataaagggttgac

SEQ ID NO: 690014 - DNA, 20 bp, Artificial
  CRISPR gRNA sequence
ggttgactggtgcaacactc

SEQ ID NO: 690015 - DNA, 20 bp, Artificial
  CRISPR gRNA sequence
ttgactggtgcaacactcaa

SEQ ID NO: 690016 - DNA, 20 bp, Artificial
  CRISPR gRNA sequence
gtgcaacactcaagagtcca

SEQ ID NO: 690017 - DNA, 20 bp, Artificial
  CRISPR gRNA sequence
agtccaaagaccatacaacc

SEQ ID NO: 690018 - DNA, 20 bp, Artificial
  CRISPR gRNA sequence
tccaaagaccatacaacctg

SEQ ID NO: 690019 - DNA, 20 bp, Artificial
  CRISPR gRNA sequence
aacctggagttctgatgtcc

SEQ ID NO: 690020 - DNA, 20 bp, Artificial
  CRISPR gRNA sequence
acctggagttctgatgtcca

SEQ ID NO: 690021 - DNA, 20 bp, Artificial
  CRISPR gRNA sequence
cctggagttctgatgtccaa

SEQ ID NO: 690022 - DNA, 20 bp, Artificial
  CRISPR gRNA sequence
ggagttctgatgtccaaggg

SEQ ID NO: 690023 - DNA, 20 bp, Artificial
  CRISPR gRNA sequence
gagttctgatgtccaagggc

SEQ ID NO: 690024 - DNA, 20 bp, Artificial
  CRISPR gRNA sequence
ctgatgtccaagggcaggaa

SEQ ID NO: 690025 - DNA, 20 bp, Artificial
  CRISPR gRNA sequence
caagggcaggaaaagtgtcc

SEQ ID NO: 690026 - DNA, 20 bp, Artificial
  CRISPR gRNA sequence
caggaaaagtgtcccagatt

SEQ ID NO: 690027 - DNA, 20 bp, Artificial
  CRISPR gRNA sequence
ggaaaagtgtcccagattga

SEQ ID NO: 690028 - DNA, 20 bp, Artificial
  CRISPR gRNA sequence
aaaagtgtcccagattgaga

SEQ ID NO: 690029 - DNA, 20 bp, Artificial
  CRISPR gRNA sequence
aagtgtcccagattgagaga

SEQ ID NO: 690030 - DNA, 20 bp, Artificial
  CRISPR gRNA sequence
gtgtcccagattgagagaga

SEQ ID NO: 690031 - DNA, 20 bp, Artificial
  CRISPR gRNA sequence
gtcccagattgagagagaga

SEQ ID NO: 690032 - DNA, 20 bp, Artificial
  CRISPR gRNA sequence
cccagattgagagagagaga

SEQ ID NO: 690033 - DNA, 20 bp, Artificial
  CRISPR gRNA sequence
cagattgagagagagagaga

SEQ ID NO: 690034 - DNA, 20 bp, Artificial
  CRISPR gRNA sequence
gattgagagagagagagaga

SEQ ID NO: 690035 - DNA, 20 bp, Artificial
  CRISPR gRNA sequence
ttctgcttttttgttctatc

SEQ ID NO: 690036 - DNA, 20 bp, Artificial
  CRISPR gRNA sequence
tctgcttttttgttctatct

SEQ ID NO: 690037 - DNA, 20 bp, Artificial
  CRISPR gRNA sequence
ttttgttctatctgggcccc

SEQ ID NO: 690038 - DNA, 20 bp, Artificial
  CRISPR gRNA sequence
tttgttctatctgggcccct

SEQ ID NO: 690039 - DNA, 20 bp, Artificial
  CRISPR gRNA sequence
tatctgggcccctaggtgat

SEQ ID NO: 690040 - DNA, 20 bp, Artificial
  CRISPR gRNA sequence
gcccctaggtgattggattg

SEQ ID NO: 690041 - DNA, 20 bp, Artificial
  CRISPR gRNA sequence
gattggattgtggctgccca

SEQ ID NO: 690042 - DNA, 20 bp, Artificial
  CRISPR gRNA sequence
ggattgtggctgcccacagc

SEQ ID NO: 690043 - DNA, 20 bp, Artificial
  CRISPR gRNA sequence
attgtggctgcccacagcga

SEQ ID NO: 690044 - DNA, 20 bp, Artificial
  CRISPR gRNA sequence
tgtggctgcccacagcgaga

SEQ ID NO: 690045 - DNA, 20 bp, Artificial
  CRISPR gRNA sequence
gtggctgcccacagcgagag

SEQ ID NO: 690046 - DNA, 20 bp, Artificial
  CRISPR gRNA sequence
gagagaggattttccccgct

SEQ ID NO: 690047 - DNA, 20 bp, Artificial
  CRISPR gRNA sequence
actcacatgccaatcccttc

SEQ ID NO: 690048 - DNA, 20 bp, Artificial
  CRISPR gRNA sequence
cccttccagaaacaccctca

SEQ ID NO: 690049 - DNA, 20 bp, Artificial
  CRISPR gRNA sequence
ccttccagaaacaccctcac

SEQ ID NO: 690050 - DNA, 20 bp, Artificial
  CRISPR gRNA sequence
aacaccctcacaggcacacc

SEQ ID NO: 690051 - DNA, 20 bp, Artificial
  CRISPR gRNA sequence
acccagaaataatgttatac

SEQ ID NO: 690052 - DNA, 20 bp, Artificial
  CRISPR gRNA sequence
ataatgttataccagctatc

SEQ ID NO: 690053 - DNA, 20 bp, Artificial
  CRISPR gRNA sequence
taatgttataccagctatct

SEQ ID NO: 690054 - DNA, 20 bp, Artificial
  CRISPR gRNA sequence
tatctaggcatcccttaatc

SEQ ID NO: 690055 - DNA, 20 bp, Artificial
  CRISPR gRNA sequence
acacctaaaattaaccatta

SEQ ID NO: 690056 - DNA, 20 bp, Artificial
  CRISPR gRNA sequence
ctaaaattaaccattacagt

SEQ ID NO: 690057 - DNA, 20 bp, Artificial
  CRISPR gRNA sequence
gaaatgtatgttctttgata

SEQ ID NO: 690058 - DNA, 20 bp, Artificial
  CRISPR gRNA sequence
aaatgtatgttctttgataa

SEQ ID NO: 690059 - DNA, 20 bp, Artificial
  CRISPR gRNA sequence
aatgtatgttctttgataaa

SEQ ID NO: 690060 - DNA, 20 bp, Artificial
  CRISPR gRNA sequence
tgttctttgataaagggatc

SEQ ID NO: 690061 - DNA, 20 bp, Artificial
  CRISPR gRNA sequence
ttgtttctcaccatcataat

SEQ ID NO: 690062 - DNA, 20 bp, Artificial
  CRISPR gRNA sequence
tcaccatcataatcagtaaa

SEQ ID NO: 690063 - DNA, 20 bp, Artificial
  CRISPR gRNA sequence
cataatcagtaaatagctct

SEQ ID NO: 690064 - DNA, 20 bp, Artificial
  CRISPR gRNA sequence
atcagtaaatagctctcagt

SEQ ID NO: 690065 - DNA, 20 bp, Artificial
  CRISPR gRNA sequence
tgttaaatgaataaatatgt

SEQ ID NO: 690066 - DNA, 20 bp, Artificial
  CRISPR gRNA sequence
taaatatgtcagtacaatca

SEQ ID NO: 690067 - DNA, 20 bp, Artificial
  CRISPR gRNA sequence
tcagtacaatcacagtatga

SEQ ID NO: 690068 - DNA, 20 bp, Artificial
  CRISPR gRNA sequence
tcacagtatgacagtataat

SEQ ID NO: 690069 - DNA, 20 bp, Artificial
  CRISPR gRNA sequence
cacagtatgacagtataata

SEQ ID NO: 690070 - DNA, 20 bp, Artificial
  CRISPR gRNA sequence
ataaggctttaaaatgttta

SEQ ID NO: 690071 - DNA, 20 bp, Artificial
  CRISPR gRNA sequence
aggctttaaaatgtttaaag

SEQ ID NO: 690072 - DNA, 20 bp, Artificial
  CRISPR gRNA sequence
ttgtttaatatttatcactt

SEQ ID NO: 690073 - DNA, 20 bp, Artificial
  CRISPR gRNA sequence
tttaatatttatcacttgag

SEQ ID NO: 690074 - DNA, 20 bp, Artificial
  CRISPR gRNA sequence
tctatgaatttatttatttt

SEQ ID NO: 690075 - DNA, 20 bp, Artificial
  CRISPR gRNA sequence
tatgaatttatttatttttg

SEQ ID NO: 690076 - DNA, 20 bp, Artificial
  CRISPR gRNA sequence
ggagacaaattctcactctg

SEQ ID NO: 690077 - DNA, 20 bp, Artificial
  CRISPR gRNA sequence
caaattctcactctgtagcc

SEQ ID NO: 690078 - DNA, 20 bp, Artificial
  CRISPR gRNA sequence
tctcactctgtagcctggtc

SEQ ID NO: 690079 - DNA, 20 bp, Artificial
  CRISPR gRNA sequence
tcactctgtagcctggtctg

SEQ ID NO: 690080 - DNA, 20 bp, Artificial
  CRISPR gRNA sequence
cactctgtagcctggtctgg

SEQ ID NO: 690081 - DNA, 20 bp, Artificial
  CRISPR gRNA sequence
actctgtagcctggtctgga

SEQ ID NO: 690082 - DNA, 20 bp, Artificial
  CRISPR gRNA sequence
ctgtagcctggtctggaggg

SEQ ID NO: 690083 - DNA, 20 bp, Artificial
  CRISPR gRNA sequence
tagcctggtctggagggcag

SEQ ID NO: 690084 - DNA, 20 bp, Artificial
  CRISPR gRNA sequence
ggagggcagtggcatgatca

SEQ ID NO: 690085 - DNA, 20 bp, Artificial
  CRISPR gRNA sequence
ggcatgatcacagctcactt

SEQ ID NO: 690086 - DNA, 20 bp, Artificial
  CRISPR gRNA sequence
tcacttcagcctcaaccttc

SEQ ID NO: 690087 - DNA, 20 bp, Artificial
  CRISPR gRNA sequence
cacttcagcctcaaccttcc

SEQ ID NO: 690088 - DNA, 20 bp, Artificial
  CRISPR gRNA sequence
aatcttcccacctcaaacac

SEQ ID NO: 690089 - DNA, 20 bp, Artificial
  CRISPR gRNA sequence
atcttcccacctcaaacact

SEQ ID NO: 690090 - DNA, 20 bp, Artificial
  CRISPR gRNA sequence
tcttcccacctcaaacactg

SEQ ID NO: 690091 - DNA, 20 bp, Artificial
  CRISPR gRNA sequence
acctcaaacactggggtacc

SEQ ID NO: 690092 - DNA, 20 bp, Artificial
  CRISPR gRNA sequence
cctcaaacactggggtacct

SEQ ID NO: 690093 - DNA, 20 bp, Artificial
  CRISPR gRNA sequence
cactggggtacctaggacta

SEQ ID NO: 690094 - DNA, 20 bp, Artificial
  CRISPR gRNA sequence
actggggtacctaggactac

SEQ ID NO: 690095 - DNA, 20 bp, Artificial
  CRISPR gRNA sequence
caggctcatgccaccatgcc

SEQ ID NO: 690096 - DNA, 20 bp, Artificial
  CRISPR gRNA sequence
ttttttttttgtattttttg

SEQ ID NO: 690097 - DNA, 20 bp, Artificial
  CRISPR gRNA sequence
ttttttttgtattttttgta

SEQ ID NO: 690098 - DNA, 20 bp, Artificial
  CRISPR gRNA sequence
ttttgtattttttgtagaga

SEQ ID NO: 690099 - DNA, 20 bp, Artificial
  CRISPR gRNA sequence
tttgtattttttgtagagac

SEQ ID NO: 690100 - DNA, 20 bp, Artificial
  CRISPR gRNA sequence
caggattttgccatgttgcc

SEQ ID NO: 690101 - DNA, 20 bp, Artificial
  CRISPR gRNA sequence
aggattttgccatgttgccc

SEQ ID NO: 690102 - DNA, 20 bp, Artificial
  CRISPR gRNA sequence
ttttgccatgttgcccaggc

SEQ ID NO: 690103 - DNA, 20 bp, Artificial
  CRISPR gRNA sequence
ccaggctggtcttgaacttc

SEQ ID NO: 690104 - DNA, 20 bp, Artificial
  CRISPR gRNA sequence
caggctggtcttgaacttct

SEQ ID NO: 690105 - DNA, 20 bp, Artificial
  CRISPR gRNA sequence
tggtcttgaacttctgggct

SEQ ID NO: 690106 - DNA, 20 bp, Artificial
  CRISPR gRNA sequence
ctcagacaatccaccctcct

SEQ ID NO: 690107 - DNA, 20 bp, Artificial
  CRISPR gRNA sequence
ccttggccttccaatgtgtt

SEQ ID NO: 690108 - DNA, 20 bp, Artificial
  CRISPR gRNA sequence
cttccaatgtgttgagatta

SEQ ID NO: 690109 - DNA, 20 bp, Artificial
  CRISPR gRNA sequence
ttccaatgtgttgagattac

SEQ ID NO: 690110 - DNA, 20 bp, Artificial
  CRISPR gRNA sequence
tgtgttgagattacaggctt

SEQ ID NO: 690111 - DNA, 20 bp, Artificial
  CRISPR gRNA sequence
gtgttgagattacaggcttg

SEQ ID NO: 690112 - DNA, 20 bp, Artificial
  CRISPR gRNA sequence
caggcttgaggcaccgcacc

SEQ ID NO: 690113 - DNA, 20 bp, Artificial
  CRISPR gRNA sequence
tgaggcaccgcacctggcct

SEQ ID NO: 690114 - DNA, 20 bp, Artificial
  CRISPR gRNA sequence
ggcaccgcacctggcctgag

SEQ ID NO: 690115 - DNA, 20 bp, Artificial
  CRISPR gRNA sequence
aatttttaaaatcccaacca

SEQ ID NO: 690116 - DNA, 20 bp, Artificial
  CRISPR gRNA sequence
atttttaaaatcccaaccat

SEQ ID NO: 690117 - DNA, 20 bp, Artificial
  CRISPR gRNA sequence
ttttaaaatcccaaccatag

SEQ ID NO: 690118 - DNA, 20 bp, Artificial
  CRISPR gRNA sequence
gtcaaaatattacctacaaa

SEQ ID NO: 690119 - DNA, 20 bp, Artificial
  CRISPR gRNA sequence
aatattacctacaaaaagat

SEQ ID NO: 690120 - DNA, 20 bp, Artificial
  CRISPR gRNA sequence
cctacaaaaagataagatga

SEQ ID NO: 690121 - DNA, 20 bp, Artificial
  CRISPR gRNA sequence
acaaaaagataagatgaaag

SEQ ID NO: 690122 - DNA, 20 bp, Artificial
  CRISPR gRNA sequence
aaagataagatgaaagcaga

SEQ ID NO: 690123 - DNA, 20 bp, Artificial
  CRISPR gRNA sequence
atgaaagcagatggatctaa

SEQ ID NO: 690124 - DNA, 20 bp, Artificial
  CRISPR gRNA sequence
cagatggatctaaaagaact

SEQ ID NO: 690125 - DNA, 20 bp, Artificial
  CRISPR gRNA sequence
gttacatcacctccttatct

SEQ ID NO: 690126 - DNA, 20 bp, Artificial
  CRISPR gRNA sequence
catcacctccttatctgaga

SEQ ID NO: 690127 - DNA, 20 bp, Artificial
  CRISPR gRNA sequence
atcacctccttatctgagat

SEQ ID NO: 690128 - DNA, 20 bp, Artificial
  CRISPR gRNA sequence
tccttatctgagatgggatg

SEQ ID NO: 690129 - DNA, 20 bp, Artificial
  CRISPR gRNA sequence
agatgggatgcagcttgtaa

SEQ ID NO: 690130 - DNA, 20 bp, Artificial
  CRISPR gRNA sequence
tttaaatttaaaaatttttt

SEQ ID NO: 690131 - DNA, 20 bp, Artificial
  CRISPR gRNA sequence
aatttaaaaatttttttaga

SEQ ID NO: 690132 - DNA, 20 bp, Artificial
  CRISPR gRNA sequence
tttaaaaatttttttagatg

SEQ ID NO: 690133 - DNA, 20 bp, Artificial
  CRISPR gRNA sequence
tggagtctcattctgtcacc

SEQ ID NO: 690134 - DNA, 20 bp, Artificial
  CRISPR gRNA sequence
ggagtctcattctgtcaccc

SEQ ID NO: 690135 - DNA, 20 bp, Artificial
  CRISPR gRNA sequence
tctcattctgtcacccaggc

SEQ ID NO: 690136 - DNA, 20 bp, Artificial
  CRISPR gRNA sequence
tcattctgtcacccaggctg

SEQ ID NO: 690137 - DNA, 20 bp, Artificial
  CRISPR gRNA sequence
ctgtcacccaggctggagta

SEQ ID NO: 690138 - DNA, 20 bp, Artificial
  CRISPR gRNA sequence
tcacccaggctggagtacag

SEQ ID NO: 690139 - DNA, 20 bp, Artificial
  CRISPR gRNA sequence
cccaggctggagtacagtgg

SEQ ID NO: 690140 - DNA, 20 bp, Artificial
  CRISPR gRNA sequence
gagtacagtggcagtgatct

SEQ ID NO: 690141 - DNA, 20 bp, Artificial
  CRISPR gRNA sequence
tcactgcaacatctgcctcc

SEQ ID NO: 690142 - DNA, 20 bp, Artificial
  CRISPR gRNA sequence
cactgcaacatctgcctcct

SEQ ID NO: 690143 - DNA, 20 bp, Artificial
  CRISPR gRNA sequence
aacatctgcctcctgggttc

SEQ ID NO: 690144 - DNA, 20 bp, Artificial
  CRISPR gRNA sequence
ctgggttcaagcaattctcc

SEQ ID NO: 690145 - DNA, 20 bp, Artificial
  CRISPR gRNA sequence
ttcaagcaattctcctggct

SEQ ID NO: 690146 - DNA, 20 bp, Artificial
  CRISPR gRNA sequence
ttctcctggctcagcatcct

SEQ ID NO: 690147 - DNA, 20 bp, Artificial
  CRISPR gRNA sequence
tcctggctcagcatcctgag

SEQ ID NO: 690148 - DNA, 20 bp, Artificial
  CRISPR gRNA sequence
ggctcagcatcctgagtagc

SEQ ID NO: 690149 - DNA, 20 bp, Artificial
  CRISPR gRNA sequence
gctcagcatcctgagtagct

SEQ ID NO: 690150 - DNA, 20 bp, Artificial
  CRISPR gRNA sequence
atcctgagtagctgggacta

SEQ ID NO: 690151 - DNA, 20 bp, Artificial
  CRISPR gRNA sequence
tcctgagtagctgggactac

SEQ ID NO: 690152 - DNA, 20 bp, Artificial
  CRISPR gRNA sequence
tgggactacaggcacatgcc

SEQ ID NO: 690153 - DNA, 20 bp, Artificial
  CRISPR gRNA sequence
caggcacatgcctagactcc

SEQ ID NO: 690154 - DNA, 20 bp, Artificial
  CRISPR gRNA sequence
ggctaattttttgtattttt

SEQ ID NO: 690155 - DNA, 20 bp, Artificial
  CRISPR gRNA sequence
attttttgtattttttagta

SEQ ID NO: 690156 - DNA, 20 bp, Artificial
  CRISPR gRNA sequence
tttgtattttttagtacaga

SEQ ID NO: 690157 - DNA, 20 bp, Artificial
  CRISPR gRNA sequence
ttgtattttttagtacagat

SEQ ID NO: 690158 - DNA, 20 bp, Artificial
  CRISPR gRNA sequence
tgtattttttagtacagatg

SEQ ID NO: 690159 - DNA, 20 bp, Artificial
  CRISPR gRNA sequence
cagatggggtttcaccatgt

SEQ ID NO: 690160 - DNA, 20 bp, Artificial
  CRISPR gRNA sequence
tggggtttcaccatgttggc

SEQ ID NO: 690161 - DNA, 20 bp, Artificial
  CRISPR gRNA sequence
tttcaccatgttggccagtc

SEQ ID NO: 690162 - DNA, 20 bp, Artificial
  CRISPR gRNA sequence
ggtctcgaattcctgacctc

SEQ ID NO: 690163 - DNA, 20 bp, Artificial
  CRISPR gRNA sequence
ctcaagtgatccacccacct

SEQ ID NO: 690164 - DNA, 20 bp, Artificial
  CRISPR gRNA sequence
ccacccacctcggcctccca

SEQ ID NO: 690165 - DNA, 20 bp, Artificial
  CRISPR gRNA sequence
acctcggcctcccaaagtgc

SEQ ID NO: 690166 - DNA, 20 bp, Artificial
  CRISPR gRNA sequence
cctcggcctcccaaagtgct

SEQ ID NO: 690167 - DNA, 20 bp, Artificial
  CRISPR gRNA sequence
ctcccaaagtgctgggatta

SEQ ID NO: 690168 - DNA, 20 bp, Artificial
  CRISPR gRNA sequence
tcccaaagtgctgggattac

SEQ ID NO: 690169 - DNA, 20 bp, Artificial
  CRISPR gRNA sequence
agtgctgggattacaggcgt

SEQ ID NO: 690170 - DNA, 20 bp, Artificial
  CRISPR gRNA sequence
acaggcgtgagccaccatgc

SEQ ID NO: 690171 - DNA, 20 bp, Artificial
  CRISPR gRNA sequence
agccaccatgccggccaaaa

SEQ ID NO: 690172 - DNA, 20 bp, Artificial
  CRISPR gRNA sequence
aaaagcatgtaaactttata

SEQ ID NO: 690173 - DNA, 20 bp, Artificial
  CRISPR gRNA sequence
aagcatgtaaactttataca

SEQ ID NO: 690174 - DNA, 20 bp, Artificial
  CRISPR gRNA sequence
tttatacagagtttacaaca

SEQ ID NO: 690175 - DNA, 20 bp, Artificial
  CRISPR gRNA sequence
tgtataataatacattcaaa

SEQ ID NO: 690176 - DNA, 20 bp, Artificial
  CRISPR gRNA sequence
acattcaaaaagcaacattc

SEQ ID NO: 690177 - DNA, 20 bp, Artificial
  CRISPR gRNA sequence
gaatgcaaccttgtacaata

SEQ ID NO: 690178 - DNA, 20 bp, Artificial
  CRISPR gRNA sequence
tacctataaaaatatataca

SEQ ID NO: 690179 - DNA, 20 bp, Artificial
  CRISPR gRNA sequence
cctataaaaatatatacata

SEQ ID NO: 690180 - DNA, 20 bp, Artificial
  CRISPR gRNA sequence
atacatagagaacaacaaaa

SEQ ID NO: 690181 - DNA, 20 bp, Artificial
  CRISPR gRNA sequence
tacatagagaacaacaaaat

SEQ ID NO: 690182 - DNA, 20 bp, Artificial
  CRISPR gRNA sequence
tagagaacaacaaaatgggc

SEQ ID NO: 690183 - DNA, 20 bp, Artificial
  CRISPR gRNA sequence
agagaacaacaaaatgggcc

SEQ ID NO: 690184 - DNA, 20 bp, Artificial
  CRISPR gRNA sequence
acaaaatgggccaggcgcct

SEQ ID NO: 690185 - DNA, 20 bp, Artificial
  CRISPR gRNA sequence
ttggctcattcctgtaatcc

SEQ ID NO: 690186 - DNA, 20 bp, Artificial
  CRISPR gRNA sequence
tcctgtaatcccagcacttt

SEQ ID NO: 690187 - DNA, 20 bp, Artificial
  CRISPR gRNA sequence
tgtaatcccagcactttgag

SEQ ID NO: 690188 - DNA, 20 bp, Artificial
  CRISPR gRNA sequence
tcccagcactttgagaagct

SEQ ID NO: 690189 - DNA, 20 bp, Artificial
  CRISPR gRNA sequence
cccagcactttgagaagctg

SEQ ID NO: 690190 - DNA, 20 bp, Artificial
  CRISPR gRNA sequence
agcactttgagaagctgagg

SEQ ID NO: 690191 - DNA, 20 bp, Artificial
  CRISPR gRNA sequence
gcactttgagaagctgaggc

SEQ ID NO: 690192 - DNA, 20 bp, Artificial
  CRISPR gRNA sequence
ctttgagaagctgaggcagg

SEQ ID NO: 690193 - DNA, 20 bp, Artificial
  CRISPR gRNA sequence
ctgaggcaggtggatcactt

SEQ ID NO: 690194 - DNA, 20 bp, Artificial
  CRISPR gRNA sequence
tgaggcaggtggatcacttg

SEQ ID NO: 690195 - DNA, 20 bp, Artificial
  CRISPR gRNA sequence
gcaggtggatcacttgaggt

SEQ ID NO: 690196 - DNA, 20 bp, Artificial
  CRISPR gRNA sequence
caggtggatcacttgaggtc

SEQ ID NO: 690197 - DNA, 20 bp, Artificial
  CRISPR gRNA sequence
ggtggatcacttgaggtcgg

SEQ ID NO: 690198 - DNA, 20 bp, Artificial
  CRISPR gRNA sequence
tcacttgaggtcgggagttc

SEQ ID NO: 690199 - DNA, 20 bp, Artificial
  CRISPR gRNA sequence
tgaggtcgggagttcgagac

SEQ ID NO: 690200 - DNA, 20 bp, Artificial
  CRISPR gRNA sequence
tcgggagttcgagaccagac

SEQ ID NO: 690201 - DNA, 20 bp, Artificial
  CRISPR gRNA sequence
cgagaccagactggccaata

SEQ ID NO: 690202 - DNA, 20 bp, Artificial
  CRISPR gRNA sequence
taaaaatacaaaaaatttgc

SEQ ID NO: 690203 - DNA, 20 bp, Artificial
  CRISPR gRNA sequence
aaaaatacaaaaaatttgct

SEQ ID NO: 690204 - DNA, 20 bp, Artificial
  CRISPR gRNA sequence
tacaaaaaatttgctgggcc

SEQ ID NO: 690205 - DNA, 20 bp, Artificial
  CRISPR gRNA sequence
aaaaaatttgctgggcctgg

SEQ ID NO: 690206 - DNA, 20 bp, Artificial
  CRISPR gRNA sequence
gtggcgcatgtgtgtaatct

SEQ ID NO: 690207 - DNA, 20 bp, Artificial
  CRISPR gRNA sequence
tgtgtgtaatctcagctact

SEQ ID NO: 690208 - DNA, 20 bp, Artificial
  CRISPR gRNA sequence
gtgtgtaatctcagctactc

SEQ ID NO: 690209 - DNA, 20 bp, Artificial
  CRISPR gRNA sequence
gtgtaatctcagctactcag

SEQ ID NO: 690210 - DNA, 20 bp, Artificial
  CRISPR gRNA sequence
tgtaatctcagctactcagg

SEQ ID NO: 690211 - DNA, 20 bp, Artificial
  CRISPR gRNA sequence
tctcagctactcaggaggct

SEQ ID NO: 690212 - DNA, 20 bp, Artificial
  CRISPR gRNA sequence
ctcagctactcaggaggctg

SEQ ID NO: 690213 - DNA, 20 bp, Artificial
  CRISPR gRNA sequence
ctactcaggaggctgaggca

SEQ ID NO: 690214 - DNA, 20 bp, Artificial
  CRISPR gRNA sequence
catggaaatcacttgaaccc

SEQ ID NO: 690215 - DNA, 20 bp, Artificial
  CRISPR gRNA sequence
tggaaatcacttgaacccga

SEQ ID NO: 690216 - DNA, 20 bp, Artificial
  CRISPR gRNA sequence
ggaaatcacttgaacccgag

SEQ ID NO: 690217 - DNA, 20 bp, Artificial
  CRISPR gRNA sequence
aatcacttgaacccgagagg

SEQ ID NO: 690218 - DNA, 20 bp, Artificial
  CRISPR gRNA sequence
tcacttgaacccgagaggcg

SEQ ID NO: 690219 - DNA, 20 bp, Artificial
  CRISPR gRNA sequence
cacttgaacccgagaggcgg

SEQ ID NO: 690220 - DNA, 20 bp, Artificial
  CRISPR gRNA sequence
aacccgagaggcggaggttg

SEQ ID NO: 690221 - DNA, 20 bp, Artificial
  CRISPR gRNA sequence
cgagaggcggaggttgcagt

SEQ ID NO: 690222 - DNA, 20 bp, Artificial
  CRISPR gRNA sequence
ggcggaggttgcagtgagct

SEQ ID NO: 690223 - DNA, 20 bp, Artificial
  CRISPR gRNA sequence
gcggaggttgcagtgagctg

SEQ ID NO: 690224 - DNA, 20 bp, Artificial
  CRISPR gRNA sequence
gaggtcgcaccactgcactc

SEQ ID NO: 690225 - DNA, 20 bp, Artificial
  CRISPR gRNA sequence
gcaccactgcactccagcct

SEQ ID NO: 690226 - DNA, 20 bp, Artificial
  CRISPR gRNA sequence
gcactccagcctcagtgaca

SEQ ID NO: 690227 - DNA, 20 bp, Artificial
  CRISPR gRNA sequence
gacaaagtgaaattgtgttt

SEQ ID NO: 690228 - DNA, 20 bp, Artificial
  CRISPR gRNA sequence
acaaaccaccaccaacaaaa

SEQ ID NO: 690229 - DNA, 20 bp, Artificial
  CRISPR gRNA sequence
accaccaacaaaatggaaat

SEQ ID NO: 690230 - DNA, 20 bp, Artificial
  CRISPR gRNA sequence
atggaaatcagcaccacgca

SEQ ID NO: 690231 - DNA, 20 bp, Artificial
  CRISPR gRNA sequence
tggaaatcagcaccacgcaa

SEQ ID NO: 690232 - DNA, 20 bp, Artificial
  CRISPR gRNA sequence
aatcagcaccacgcaaagga

SEQ ID NO: 690233 - DNA, 20 bp, Artificial
  CRISPR gRNA sequence
caccacgcaaaggacagctc

SEQ ID NO: 690234 - DNA, 20 bp, Artificial
  CRISPR gRNA sequence
accacgcaaaggacagctcc

SEQ ID NO: 690235 - DNA, 20 bp, Artificial
  CRISPR gRNA sequence
ccacgcaaaggacagctcca

SEQ ID NO: 690236 - DNA, 20 bp, Artificial
  CRISPR gRNA sequence
aggacagctccagggaccaa

SEQ ID NO: 690237 - DNA, 20 bp, Artificial
  CRISPR gRNA sequence
cagggaccaacagtcacact

SEQ ID NO: 690238 - DNA, 20 bp, Artificial
  CRISPR gRNA sequence
accaacagtcacactgagtc

SEQ ID NO: 690239 - DNA, 20 bp, Artificial
  CRISPR gRNA sequence
ccaacagtcacactgagtcc

SEQ ID NO: 690240 - DNA, 20 bp, Artificial
  CRISPR gRNA sequence
acagtcacactgagtccagg

SEQ ID NO: 690241 - DNA, 20 bp, Artificial
  CRISPR gRNA sequence
cagtcacactgagtccagga

SEQ ID NO: 690242 - DNA, 20 bp, Artificial
  CRISPR gRNA sequence
aggaaggttcaacaatacaa

SEQ ID NO: 690243 - DNA, 20 bp, Artificial
  CRISPR gRNA sequence
aaggttcaacaatacaatag

SEQ ID NO: 690244 - DNA, 20 bp, Artificial
  CRISPR gRNA sequence
acaatagcagtgatattttt

SEQ ID NO: 690245 - DNA, 20 bp, Artificial
  CRISPR gRNA sequence
caatagcagtgatatttttg

SEQ ID NO: 690246 - DNA, 20 bp, Artificial
  CRISPR gRNA sequence
aatagcagtgatatttttga

SEQ ID NO: 690247 - DNA, 20 bp, Artificial
  CRISPR gRNA sequence
atagcagtgatatttttgag

SEQ ID NO: 690248 - DNA, 20 bp, Artificial
  CRISPR gRNA sequence
agcagtgatatttttgaggg

SEQ ID NO: 690249 - DNA, 20 bp, Artificial
  CRISPR gRNA sequence
gatatttttgaggggagacc

SEQ ID NO: 690250 - DNA, 20 bp, Artificial
  CRISPR gRNA sequence
atatttttgaggggagacct

SEQ ID NO: 690251 - DNA, 20 bp, Artificial
  CRISPR gRNA sequence
tttttgaggggagacctagg

SEQ ID NO: 690252 - DNA, 20 bp, Artificial
  CRISPR gRNA sequence
ttttattttttttttaattc

SEQ ID NO: 690253 - DNA, 20 bp, Artificial
  CRISPR gRNA sequence
tattttttttttaattcaag

SEQ ID NO: 690254 - DNA, 20 bp, Artificial
  CRISPR gRNA sequence
attttttttttaattcaagt

SEQ ID NO: 690255 - DNA, 20 bp, Artificial
  CRISPR gRNA sequence
gcattgatctgtgtatttta

SEQ ID NO: 690256 - DNA, 20 bp, Artificial
  CRISPR gRNA sequence
taaagtcttctgtgatcaaa

SEQ ID NO: 690257 - DNA, 20 bp, Artificial
  CRISPR gRNA sequence
catttctaatattcaaaata

SEQ ID NO: 690258 - DNA, 20 bp, Artificial
  CRISPR gRNA sequence
tattcaaaataaagcatttg

SEQ ID NO: 690259 - DNA, 20 bp, Artificial
  CRISPR gRNA sequence
tgaagtaaaataacaatgaa

SEQ ID NO: 690260 - DNA, 20 bp, Artificial
  CRISPR gRNA sequence
agtaaaataacaatgaaaag

SEQ ID NO: 690261 - DNA, 20 bp, Artificial
  CRISPR gRNA sequence
aataacaatgaaaagtggct

SEQ ID NO: 690262 - DNA, 20 bp, Artificial
  CRISPR gRNA sequence
agtggctgagtgcacacctg

SEQ ID NO: 690263 - DNA, 20 bp, Artificial
  CRISPR gRNA sequence
tgagtgcacacctgtagtcc

SEQ ID NO: 690264 - DNA, 20 bp, Artificial
  CRISPR gRNA sequence
cacctgtagtcccagctact

SEQ ID NO: 690265 - DNA, 20 bp, Artificial
  CRISPR gRNA sequence
acctgtagtcccagctactc

SEQ ID NO: 690266 - DNA, 20 bp, Artificial
  CRISPR gRNA sequence
ctgtagtcccagctactcag

SEQ ID NO: 690267 - DNA, 20 bp, Artificial
  CRISPR gRNA sequence
tgtagtcccagctactcagg

SEQ ID NO: 690268 - DNA, 20 bp, Artificial
  CRISPR gRNA sequence
tcccagctactcaggaggct

SEQ ID NO: 690269 - DNA, 20 bp, Artificial
  CRISPR gRNA sequence
agctactcaggaggctgaga

SEQ ID NO: 690270 - DNA, 20 bp, Artificial
  CRISPR gRNA sequence
gctactcaggaggctgagat

SEQ ID NO: 690271 - DNA, 20 bp, Artificial
  CRISPR gRNA sequence
tactcaggaggctgagatgg

SEQ ID NO: 690272 - DNA, 20 bp, Artificial
  CRISPR gRNA sequence
ctgagatgggagaaccactt

SEQ ID NO: 690273 - DNA, 20 bp, Artificial
  CRISPR gRNA sequence
atgggagaaccacttgagcc

SEQ ID NO: 690274 - DNA, 20 bp, Artificial
  CRISPR gRNA sequence
tgggagaaccacttgagccc

SEQ ID NO: 690275 - DNA, 20 bp, Artificial
  CRISPR gRNA sequence
ccacttgagcccaggatttt

SEQ ID NO: 690276 - DNA, 20 bp, Artificial
  CRISPR gRNA sequence
cacttgagcccaggattttg

SEQ ID NO: 690277 - DNA, 20 bp, Artificial
  CRISPR gRNA sequence
gctattatcacacctgtgaa

SEQ ID NO: 690278 - DNA, 20 bp, Artificial
  CRISPR gRNA sequence
tgtgaatagtcacttctctc

SEQ ID NO: 690279 - DNA, 20 bp, Artificial
  CRISPR gRNA sequence
atagtcacttctctccagct

SEQ ID NO: 690280 - DNA, 20 bp, Artificial
  CRISPR gRNA sequence
tctctccagcttggacaaca

SEQ ID NO: 690281 - DNA, 20 bp, Artificial
  CRISPR gRNA sequence
tccagcttggacaacatagc

SEQ ID NO: 690282 - DNA, 20 bp, Artificial
  CRISPR gRNA sequence
caagaccccatctaaaataa

SEQ ID NO: 690283 - DNA, 20 bp, Artificial
  CRISPR gRNA sequence
tctaaaataatagtaataca

SEQ ID NO: 690284 - DNA, 20 bp, Artificial
  CRISPR gRNA sequence
aaaataatagtaatacaaag

SEQ ID NO: 690285 - DNA, 20 bp, Artificial
  CRISPR gRNA sequence
aatagtaatacaaagaagtt

SEQ ID NO: 690286 - DNA, 20 bp, Artificial
  CRISPR gRNA sequence
ttcagatctccttccaacct

SEQ ID NO: 690287 - DNA, 20 bp, Artificial
  CRISPR gRNA sequence
ctccttccaacctcagccta

SEQ ID NO: 690288 - DNA, 20 bp, Artificial
  CRISPR gRNA sequence
aatttctcatttgaaatcca

SEQ ID NO: 690289 - DNA, 20 bp, Artificial
  CRISPR gRNA sequence
atttctcatttgaaatccat

SEQ ID NO: 690290 - DNA, 20 bp, Artificial
  CRISPR gRNA sequence
tttctcatttgaaatccata

SEQ ID NO: 690291 - DNA, 20 bp, Artificial
  CRISPR gRNA sequence
ctcatttgaaatccataggg

SEQ ID NO: 690292 - DNA, 20 bp, Artificial
  CRISPR gRNA sequence
tagggcagaaatgccgatta

SEQ ID NO: 690293 - DNA, 20 bp, Artificial
  CRISPR gRNA sequence
aatgccgattatggcacctc

SEQ ID NO: 690294 - DNA, 20 bp, Artificial
  CRISPR gRNA sequence
tgccgattatggcacctcca

SEQ ID NO: 690295 - DNA, 20 bp, Artificial
  CRISPR gRNA sequence
ccgattatggcacctccaga

SEQ ID NO: 690296 - DNA, 20 bp, Artificial
  CRISPR gRNA sequence
attatggcacctccagagag

SEQ ID NO: 690297 - DNA, 20 bp, Artificial
  CRISPR gRNA sequence
ccactccatgactcatcctt

SEQ ID NO: 690298 - DNA, 20 bp, Artificial
  CRISPR gRNA sequence
catgactcatcctttggtta

SEQ ID NO: 690299 - DNA, 20 bp, Artificial
  CRISPR gRNA sequence
catcctttggttacagcatt

SEQ ID NO: 690300 - DNA, 20 bp, Artificial
  CRISPR gRNA sequence
tttggttacagcatttagct

SEQ ID NO: 690301 - DNA, 20 bp, Artificial
  CRISPR gRNA sequence
cagcatttagctgagcaatg

SEQ ID NO: 690302 - DNA, 20 bp, Artificial
  CRISPR gRNA sequence
tgagcaatgaagtcaatgct

SEQ ID NO: 690303 - DNA, 20 bp, Artificial
  CRISPR gRNA sequence
aatactgattatctcattta

SEQ ID NO: 690304 - DNA, 20 bp, Artificial
  CRISPR gRNA sequence
gtaaaattaccatcacacct

SEQ ID NO: 690305 - DNA, 20 bp, Artificial
  CRISPR gRNA sequence
aattaccatcacacctaaga

SEQ ID NO: 690306 - DNA, 20 bp, Artificial
  CRISPR gRNA sequence
accatcacacctaagacagc

SEQ ID NO: 690307 - DNA, 20 bp, Artificial
  CRISPR gRNA sequence
tcacacctaagacagcgaga

SEQ ID NO: 690308 - DNA, 20 bp, Artificial
  CRISPR gRNA sequence
agatggatttttcccttcca

SEQ ID NO: 690309 - DNA, 20 bp, Artificial
  CRISPR gRNA sequence
ccttccacagatgaaaatat

SEQ ID NO: 690310 - DNA, 20 bp, Artificial
  CRISPR gRNA sequence
agatgaaaatatgagtccct

SEQ ID NO: 690311 - DNA, 20 bp, Artificial
  CRISPR gRNA sequence
agaacataaaatcttcattt

SEQ ID NO: 690312 - DNA, 20 bp, Artificial
  CRISPR gRNA sequence
tttgagctcactgaaaatgt

SEQ ID NO: 690313 - DNA, 20 bp, Artificial
  CRISPR gRNA sequence
tcactgaaaatgttggcctt

SEQ ID NO: 690314 - DNA, 20 bp, Artificial
  CRISPR gRNA sequence
aaaatgttggccttgagaat

SEQ ID NO: 690315 - DNA, 20 bp, Artificial
  CRISPR gRNA sequence
aaatgttggccttgagaatt

SEQ ID NO: 690316 - DNA, 20 bp, Artificial
  CRISPR gRNA sequence
atgttggccttgagaattag

SEQ ID NO: 690317 - DNA, 20 bp, Artificial
  CRISPR gRNA sequence
cttgagaattaggagacact

SEQ ID NO: 690318 - DNA, 20 bp, Artificial
  CRISPR gRNA sequence
aggagacactcagtctcctg

SEQ ID NO: 690319 - DNA, 20 bp, Artificial
  CRISPR gRNA sequence
ggagacactcagtctcctgc

SEQ ID NO: 690320 - DNA, 20 bp, Artificial
  CRISPR gRNA sequence
tcagtctcctgcaggccccc

SEQ ID NO: 690321 - DNA, 20 bp, Artificial
  CRISPR gRNA sequence
cagtctcctgcaggccccct

SEQ ID NO: 690322 - DNA, 20 bp, Artificial
  CRISPR gRNA sequence
cctgcaggccccctgggcat

SEQ ID NO: 690323 - DNA, 20 bp, Artificial
  CRISPR gRNA sequence
cccctgggcatgagccacac

SEQ ID NO: 690324 - DNA, 20 bp, Artificial
  CRISPR gRNA sequence
ctgggcatgagccacaccag

SEQ ID NO: 690325 - DNA, 20 bp, Artificial
  CRISPR gRNA sequence
gggcatgagccacaccagtg

SEQ ID NO: 690326 - DNA, 20 bp, Artificial
  CRISPR gRNA sequence
ggcatgagccacaccagtgg

SEQ ID NO: 690327 - DNA, 20 bp, Artificial
  CRISPR gRNA sequence
caccagtggaggccacacaa

SEQ ID NO: 690328 - DNA, 20 bp, Artificial
  CRISPR gRNA sequence
cagtggaggccacacaacag

SEQ ID NO: 690329 - DNA, 20 bp, Artificial
  CRISPR gRNA sequence
agtggaggccacacaacagc

SEQ ID NO: 690330 - DNA, 20 bp, Artificial
  CRISPR gRNA sequence
ggaggccacacaacagcagg

SEQ ID NO: 690331 - DNA, 20 bp, Artificial
  CRISPR gRNA sequence
aggccacacaacagcaggaa

SEQ ID NO: 690332 - DNA, 20 bp, Artificial
  CRISPR gRNA sequence
caacagcaggaagagcaact

SEQ ID NO: 690333 - DNA, 20 bp, Artificial
  CRISPR gRNA sequence
ggaagagcaactgagaaccc

SEQ ID NO: 690334 - DNA, 20 bp, Artificial
  CRISPR gRNA sequence
agagcaactgagaaccctgg

SEQ ID NO: 690335 - DNA, 20 bp, Artificial
  CRISPR gRNA sequence
gagcaactgagaaccctgga

SEQ ID NO: 690336 - DNA, 20 bp, Artificial
  CRISPR gRNA sequence
ccctggaaggttcacacttg

SEQ ID NO: 690337 - DNA, 20 bp, Artificial
  CRISPR gRNA sequence
ctggaaggttcacacttgta

SEQ ID NO: 690338 - DNA, 20 bp, Artificial
  CRISPR gRNA sequence
tggaaggttcacacttgtag

SEQ ID NO: 690339 - DNA, 20 bp, Artificial
  CRISPR gRNA sequence
ggaaggttcacacttgtaga

SEQ ID NO: 690340 - DNA, 20 bp, Artificial
  CRISPR gRNA sequence
acttgtagagggtgcacatc

SEQ ID NO: 690341 - DNA, 20 bp, Artificial
  CRISPR gRNA sequence
ggtgcacatccagtgaaatg

SEQ ID NO: 690342 - DNA, 20 bp, Artificial
  CRISPR gRNA sequence
atccagtgaaatgcagttga

SEQ ID NO: 690343 - DNA, 20 bp, Artificial
  CRISPR gRNA sequence
agtgaaatgcagttgatgga

SEQ ID NO: 690344 - DNA, 20 bp, Artificial
  CRISPR gRNA sequence
gtgaaatgcagttgatggat

SEQ ID NO: 690345 - DNA, 20 bp, Artificial
  CRISPR gRNA sequence
atgcagttgatggatgggcc

SEQ ID NO: 690346 - DNA, 20 bp, Artificial
  CRISPR gRNA sequence
tgcagttgatggatgggcca

SEQ ID NO: 690347 - DNA, 20 bp, Artificial
  CRISPR gRNA sequence
gatgggccaaggtaataatc

SEQ ID NO: 690348 - DNA, 20 bp, Artificial
  CRISPR gRNA sequence
aataatccagctccttcctt

SEQ ID NO: 690349 - DNA, 20 bp, Artificial
  CRISPR gRNA sequence
atccagctccttccttcagc

SEQ ID NO: 690350 - DNA, 20 bp, Artificial
  CRISPR gRNA sequence
tccagctccttccttcagct

SEQ ID NO: 690351 - DNA, 20 bp, Artificial
  CRISPR gRNA sequence
ccagctccttccttcagctg

SEQ ID NO: 690352 - DNA, 20 bp, Artificial
  CRISPR gRNA sequence
cagctccttccttcagctgg

SEQ ID NO: 690353 - DNA, 20 bp, Artificial
  CRISPR gRNA sequence
gctccttccttcagctgggg

SEQ ID NO: 690354 - DNA, 20 bp, Artificial
  CRISPR gRNA sequence
ctccttccttcagctggggg

SEQ ID NO: 690355 - DNA, 20 bp, Artificial
  CRISPR gRNA sequence
cttccttcagctgggggagg

SEQ ID NO: 690356 - DNA, 20 bp, Artificial
  CRISPR gRNA sequence
cttcagctgggggaggcaga

SEQ ID NO: 690357 - DNA, 20 bp, Artificial
  CRISPR gRNA sequence
ttcagctgggggaggcagat

SEQ ID NO: 690358 - DNA, 20 bp, Artificial
  CRISPR gRNA sequence
gctgggggaggcagatgggt

SEQ ID NO: 690359 - DNA, 20 bp, Artificial
  CRISPR gRNA sequence
ggggaggcagatgggtgagt

SEQ ID NO: 690360 - DNA, 20 bp, Artificial
  CRISPR gRNA sequence
tgggtgagtcagctacgcat

SEQ ID NO: 690361 - DNA, 20 bp, Artificial
  CRISPR gRNA sequence
gggtgagtcagctacgcatg

SEQ ID NO: 690362 - DNA, 20 bp, Artificial
  CRISPR gRNA sequence
tcagctacgcatgaggtgta

SEQ ID NO: 690363 - DNA, 20 bp, Artificial
  CRISPR gRNA sequence
catgaggtgtatggtgttcc

SEQ ID NO: 690364 - DNA, 20 bp, Artificial
  CRISPR gRNA sequence
tgaggtgtatggtgttccta

SEQ ID NO: 690365 - DNA, 20 bp, Artificial
  CRISPR gRNA sequence
ggtgttcctagagctattgt

SEQ ID NO: 690366 - DNA, 20 bp, Artificial
  CRISPR gRNA sequence
ctctgctgtgaactccaccc

SEQ ID NO: 690367 - DNA, 20 bp, Artificial
  CRISPR gRNA sequence
tctgctgtgaactccacccc

SEQ ID NO: 690368 - DNA, 20 bp, Artificial
  CRISPR gRNA sequence
tacaaaaattatatactcac

SEQ ID NO: 690369 - DNA, 20 bp, Artificial
  CRISPR gRNA sequence
aaaattatatactcactggt

SEQ ID NO: 690370 - DNA, 20 bp, Artificial
  CRISPR gRNA sequence
attatatactcactggtaag

SEQ ID NO: 690371 - DNA, 20 bp, Artificial
  CRISPR gRNA sequence
ttatatactcactggtaagc

SEQ ID NO: 690372 - DNA, 20 bp, Artificial
  CRISPR gRNA sequence
ctggtaagcaggatcctttt

SEQ ID NO: 690373 - DNA, 20 bp, Artificial
  CRISPR gRNA sequence
tggtaagcaggatccttttt

SEQ ID NO: 690374 - DNA, 20 bp, Artificial
  CRISPR gRNA sequence
aagcaggatcctttttagga

SEQ ID NO: 690375 - DNA, 20 bp, Artificial
  CRISPR gRNA sequence
gcaaatgactttcctaacat

SEQ ID NO: 690376 - DNA, 20 bp, Artificial
  CRISPR gRNA sequence
caaatgactttcctaacata

SEQ ID NO: 690377 - DNA, 20 bp, Artificial
  CRISPR gRNA sequence
tccctccaaatgaatcatcc

SEQ ID NO: 690378 - DNA, 20 bp, Artificial
  CRISPR gRNA sequence
tccaaatgaatcatcctagt

SEQ ID NO: 690379 - DNA, 20 bp, Artificial
  CRISPR gRNA sequence
cactcccactgaaattgccc

SEQ ID NO: 690380 - DNA, 20 bp, Artificial
  CRISPR gRNA sequence
ctcccactgaaattgcccca

SEQ ID NO: 690381 - DNA, 20 bp, Artificial
  CRISPR gRNA sequence
attgccccagagttgcacgt

SEQ ID NO: 690382 - DNA, 20 bp, Artificial
  CRISPR gRNA sequence
cagagttgcacgtgagcatt

SEQ ID NO: 690383 - DNA, 20 bp, Artificial
  CRISPR gRNA sequence
gcacgtgagcatttggatcc

SEQ ID NO: 690384 - DNA, 20 bp, Artificial
  CRISPR gRNA sequence
gtgagcatttggatccaaga

SEQ ID NO: 690385 - DNA, 20 bp, Artificial
  CRISPR gRNA sequence
gcatttggatccaagacaga

SEQ ID NO: 690386 - DNA, 20 bp, Artificial
  CRISPR gRNA sequence
tccaagacagaaagtcattt

SEQ ID NO: 690387 - DNA, 20 bp, Artificial
  CRISPR gRNA sequence
ccaagacagaaagtcatttt

SEQ ID NO: 690388 - DNA, 20 bp, Artificial
  CRISPR gRNA sequence
caagacagaaagtcattttg

SEQ ID NO: 690389 - DNA, 20 bp, Artificial
  CRISPR gRNA sequence
aagacagaaagtcattttgg

SEQ ID NO: 690390 - DNA, 20 bp, Artificial
  CRISPR gRNA sequence
cagaaagtcattttgggggt

SEQ ID NO: 690391 - DNA, 20 bp, Artificial
  CRISPR gRNA sequence
agaaagtcattttgggggtt

SEQ ID NO: 690392 - DNA, 20 bp, Artificial
  CRISPR gRNA sequence
gtcattttgggggttgggtc

SEQ ID NO: 690393 - DNA, 20 bp, Artificial
  CRISPR gRNA sequence
ggggttgggtctggctgatc

SEQ ID NO: 690394 - DNA, 20 bp, Artificial
  CRISPR gRNA sequence
gggttgggtctggctgatct

SEQ ID NO: 690395 - DNA, 20 bp, Artificial
  CRISPR gRNA sequence
gttgggtctggctgatctgg

SEQ ID NO: 690396 - DNA, 20 bp, Artificial
  CRISPR gRNA sequence
gctgatctgggagtgttgtg

SEQ ID NO: 690397 - DNA, 20 bp, Artificial
  CRISPR gRNA sequence
atctgggagtgttgtgaaga

SEQ ID NO: 690398 - DNA, 20 bp, Artificial
  CRISPR gRNA sequence
tctgggagtgttgtgaagaa

SEQ ID NO: 690399 - DNA, 20 bp, Artificial
  CRISPR gRNA sequence
gaagaaaggctttctactta

SEQ ID NO: 690400 - DNA, 20 bp, Artificial
  CRISPR gRNA sequence
gaaaggctttctacttacag

SEQ ID NO: 690401 - DNA, 20 bp, Artificial
  CRISPR gRNA sequence
ctttctacttacagaagaac

SEQ ID NO: 690402 - DNA, 20 bp, Artificial
  CRISPR gRNA sequence
tttctacttacagaagaaca

SEQ ID NO: 690403 - DNA, 20 bp, Artificial
  CRISPR gRNA sequence
ttctacttacagaagaacaa

SEQ ID NO: 690404 - DNA, 20 bp, Artificial
  CRISPR gRNA sequence
acttacagaagaacaagggt

SEQ ID NO: 690405 - DNA, 20 bp, Artificial
  CRISPR gRNA sequence
gaagaacaagggtgagctct

SEQ ID NO: 690406 - DNA, 20 bp, Artificial
  CRISPR gRNA sequence
gaacaagggtgagctctgag

SEQ ID NO: 690407 - DNA, 20 bp, Artificial
  CRISPR gRNA sequence
aacaagggtgagctctgagt

SEQ ID NO: 690408 - DNA, 20 bp, Artificial
  CRISPR gRNA sequence
caagggtgagctctgagtag

SEQ ID NO: 690409 - DNA, 20 bp, Artificial
  CRISPR gRNA sequence
tgagtaggagatgacatcct

SEQ ID NO: 690410 - DNA, 20 bp, Artificial
  CRISPR gRNA sequence
gagtaggagatgacatcctg

SEQ ID NO: 690411 - DNA, 20 bp, Artificial
  CRISPR gRNA sequence
agtaggagatgacatcctga

SEQ ID NO: 690412 - DNA, 20 bp, Artificial
  CRISPR gRNA sequence
gtaggagatgacatcctgag

SEQ ID NO: 690413 - DNA, 20 bp, Artificial
  CRISPR gRNA sequence
taggagatgacatcctgagg

SEQ ID NO: 690414 - DNA, 20 bp, Artificial
  CRISPR gRNA sequence
agatgacatcctgaggggga

SEQ ID NO: 690415 - DNA, 20 bp, Artificial
  CRISPR gRNA sequence
gacatcctgagggggaaaga

SEQ ID NO: 690416 - DNA, 20 bp, Artificial
  CRISPR gRNA sequence
tcctgagggggaaagacaga

SEQ ID NO: 690417 - DNA, 20 bp, Artificial
  CRISPR gRNA sequence
cctgagggggaaagacagat

SEQ ID NO: 690418 - DNA, 20 bp, Artificial
  CRISPR gRNA sequence
gagggggaaagacagatggg

SEQ ID NO: 690419 - DNA, 20 bp, Artificial
  CRISPR gRNA sequence
agacagatgggcagatgctc

SEQ ID NO: 690420 - DNA, 20 bp, Artificial
  CRISPR gRNA sequence
ggcagatgctcaagcaaact

SEQ ID NO: 690421 - DNA, 20 bp, Artificial
  CRISPR gRNA sequence
gcagatgctcaagcaaactc

SEQ ID NO: 690422 - DNA, 20 bp, Artificial
  CRISPR gRNA sequence
agatgctcaagcaaactcag

SEQ ID NO: 690423 - DNA, 20 bp, Artificial
  CRISPR gRNA sequence
ctcaggagtttaccatataa

SEQ ID NO: 690424 - DNA, 20 bp, Artificial
  CRISPR gRNA sequence
gtttaccatataaaagattt

SEQ ID NO: 690425 - DNA, 20 bp, Artificial
  CRISPR gRNA sequence
agattttggaatctattctt

SEQ ID NO: 690426 - DNA, 20 bp, Artificial
  CRISPR gRNA sequence
ccactgtacccattgtacaa

SEQ ID NO: 690427 - DNA, 20 bp, Artificial
  CRISPR gRNA sequence
cactgtacccattgtacaat

SEQ ID NO: 690428 - DNA, 20 bp, Artificial
  CRISPR gRNA sequence
tgtacaataggtgtacaatg

SEQ ID NO: 690429 - DNA, 20 bp, Artificial
  CRISPR gRNA sequence
gtgtacaatgcagtgacaat

SEQ ID NO: 690430 - DNA, 20 bp, Artificial
  CRISPR gRNA sequence
tacaatgcagtgacaattag

SEQ ID NO: 690431 - DNA, 20 bp, Artificial
  CRISPR gRNA sequence
acaatgcagtgacaattagt

SEQ ID NO: 690432 - DNA, 20 bp, Artificial
  CRISPR gRNA sequence
agtaggttcacaatgttatg

SEQ ID NO: 690433 - DNA, 20 bp, Artificial
  CRISPR gRNA sequence
atgtagccatcatcactctc

SEQ ID NO: 690434 - DNA, 20 bp, Artificial
  CRISPR gRNA sequence
ccatcatcactctctagttc

SEQ ID NO: 690435 - DNA, 20 bp, Artificial
  CRISPR gRNA sequence
atcatcactctctagttcca

SEQ ID NO: 690436 - DNA, 20 bp, Artificial
  CRISPR gRNA sequence
tccagagtatttcatcacct

SEQ ID NO: 690437 - DNA, 20 bp, Artificial
  CRISPR gRNA sequence
ccagagtatttcatcacctc

SEQ ID NO: 690438 - DNA, 20 bp, Artificial
  CRISPR gRNA sequence
cagagtatttcatcacctca

SEQ ID NO: 690439 - DNA, 20 bp, Artificial
  CRISPR gRNA sequence
agagtatttcatcacctcag

SEQ ID NO: 690440 - DNA, 20 bp, Artificial
  CRISPR gRNA sequence
aggggaaactctgcaccatt

SEQ ID NO: 690441 - DNA, 20 bp, Artificial
  CRISPR gRNA sequence
ggaaactctgcaccattaag

SEQ ID NO: 690442 - DNA, 20 bp, Artificial
  CRISPR gRNA sequence
cctccatttcctcctgccac

SEQ ID NO: 690443 - DNA, 20 bp, Artificial
  CRISPR gRNA sequence
ccaccagaccctgtcaccac

SEQ ID NO: 690444 - DNA, 20 bp, Artificial
  CRISPR gRNA sequence
aagtctgctttctttctcta

SEQ ID NO: 690445 - DNA, 20 bp, Artificial
  CRISPR gRNA sequence
tgctttctttctctatagat

SEQ ID NO: 690446 - DNA, 20 bp, Artificial
  CRISPR gRNA sequence
ctatagattggtctcttctg

SEQ ID NO: 690447 - DNA, 20 bp, Artificial
  CRISPR gRNA sequence
tctcttctgaagatttcaca

SEQ ID NO: 690448 - DNA, 20 bp, Artificial
  CRISPR gRNA sequence
ttctgaagatttcacaaaga

SEQ ID NO: 690449 - DNA, 20 bp, Artificial
  CRISPR gRNA sequence
tctgaagatttcacaaagat

SEQ ID NO: 690450 - DNA, 20 bp, Artificial
  CRISPR gRNA sequence
atgaaatatgtatccttttg

SEQ ID NO: 690451 - DNA, 20 bp, Artificial
  CRISPR gRNA sequence
ccttcacttatcatgttttt

SEQ ID NO: 690452 - DNA, 20 bp, Artificial
  CRISPR gRNA sequence
cttatcatgtttttgagatt

SEQ ID NO: 690453 - DNA, 20 bp, Artificial
  CRISPR gRNA sequence
tttgagattcagcaatgttg

SEQ ID NO: 690454 - DNA, 20 bp, Artificial
  CRISPR gRNA sequence
agcaatgttgtagcatgtat

SEQ ID NO: 690455 - DNA, 20 bp, Artificial
  CRISPR gRNA sequence
tcagtatttcattcctttta

SEQ ID NO: 690456 - DNA, 20 bp, Artificial
  CRISPR gRNA sequence
ggctaaatcatattccattg

SEQ ID NO: 690457 - DNA, 20 bp, Artificial
  CRISPR gRNA sequence
catgttgtttattcattcat

SEQ ID NO: 690458 - DNA, 20 bp, Artificial
  CRISPR gRNA sequence
tttattcattcattagtcaa

SEQ ID NO: 690459 - DNA, 20 bp, Artificial
  CRISPR gRNA sequence
ttattcattcattagtcaat

SEQ ID NO: 690460 - DNA, 20 bp, Artificial
  CRISPR gRNA sequence
gcattttcttttaaaccaaa

SEQ ID NO: 690461 - DNA, 20 bp, Artificial
  CRISPR gRNA sequence
cattttcttttaaaccaaat

SEQ ID NO: 690462 - DNA, 20 bp, Artificial
  CRISPR gRNA sequence
taaaccaaataggaaaaaca

SEQ ID NO: 690463 - DNA, 20 bp, Artificial
  CRISPR gRNA sequence
aaaccaaataggaaaaacaa

SEQ ID NO: 690464 - DNA, 20 bp, Artificial
  CRISPR gRNA sequence
ccaaataggaaaaacaaagg

SEQ ID NO: 690465 - DNA, 20 bp, Artificial
  CRISPR gRNA sequence
aaaaatatacatgttactac

SEQ ID NO: 690466 - DNA, 20 bp, Artificial
  CRISPR gRNA sequence
catgttactactagctttta

SEQ ID NO: 690467 - DNA, 20 bp, Artificial
  CRISPR gRNA sequence
atgttactactagcttttat

SEQ ID NO: 690468 - DNA, 20 bp, Artificial
  CRISPR gRNA sequence
ttttataggactactatata

SEQ ID NO: 690469 - DNA, 20 bp, Artificial
  CRISPR gRNA sequence
aaaaatatacatattactac

SEQ ID NO: 690470 - DNA, 20 bp, Artificial
  CRISPR gRNA sequence
catattactactagctttta

SEQ ID NO: 690471 - DNA, 20 bp, Artificial
  CRISPR gRNA sequence
tatagtatgactactatata

SEQ ID NO: 690472 - DNA, 20 bp, Artificial
  CRISPR gRNA sequence
gtactatatatataatttca

SEQ ID NO: 690473 - DNA, 20 bp, Artificial
  CRISPR gRNA sequence
ctatatatataatttcatag

SEQ ID NO: 690474 - DNA, 20 bp, Artificial
  CRISPR gRNA sequence
tttcatagtagtactatata

SEQ ID NO: 690475 - DNA, 20 bp, Artificial
  CRISPR gRNA sequence
tatatatagttatatatatg

SEQ ID NO: 690476 - DNA, 20 bp, Artificial
  CRISPR gRNA sequence
tatatatgtggtactatgta

SEQ ID NO: 690477 - DNA, 20 bp, Artificial
  CRISPR gRNA sequence
tataaaatccattatttctg

SEQ ID NO: 690478 - DNA, 20 bp, Artificial
  CRISPR gRNA sequence
ataaaatccattatttctga

SEQ ID NO: 690479 - DNA, 20 bp, Artificial
  CRISPR gRNA sequence
aaaatccattatttctgaag

SEQ ID NO: 690480 - DNA, 20 bp, Artificial
  CRISPR gRNA sequence
aatccattatttctgaagga

SEQ ID NO: 690481 - DNA, 20 bp, Artificial
  CRISPR gRNA sequence
tttctgaaggagagtttttc

SEQ ID NO: 690482 - DNA, 20 bp, Artificial
  CRISPR gRNA sequence
gacacacaattcctgcatga

SEQ ID NO: 690483 - DNA, 20 bp, Artificial
  CRISPR gRNA sequence
ctctaaatttgtcaacattc

SEQ ID NO: 690484 - DNA, 20 bp, Artificial
  CRISPR gRNA sequence
ccagtgccttctgaactcta

SEQ ID NO: 690485 - DNA, 20 bp, Artificial
  CRISPR gRNA sequence
tctgaactctatggtttctg

SEQ ID NO: 690486 - DNA, 20 bp, Artificial
  CRISPR gRNA sequence
ctatggtttctgaagaaaac

SEQ ID NO: 690487 - DNA, 20 bp, Artificial
  CRISPR gRNA sequence
tatggtttctgaagaaaact

SEQ ID NO: 690488 - DNA, 20 bp, Artificial
  CRISPR gRNA sequence
aactgggctgcaatcttatt

SEQ ID NO: 690489 - DNA, 20 bp, Artificial
  CRISPR gRNA sequence
actgggctgcaatcttattg

SEQ ID NO: 690490 - DNA, 20 bp, Artificial
  CRISPR gRNA sequence
gaggatccattgaacctgaa

SEQ ID NO: 690491 - DNA, 20 bp, Artificial
  CRISPR gRNA sequence
caatatgctctgtttgtcat

SEQ ID NO: 690492 - DNA, 20 bp, Artificial
  CRISPR gRNA sequence
tgtttgtcattggcttttga

SEQ ID NO: 690493 - DNA, 20 bp, Artificial
  CRISPR gRNA sequence
gtttgtcattggcttttgac

SEQ ID NO: 690494 - DNA, 20 bp, Artificial
  CRISPR gRNA sequence
ggttgattataatgttctct

SEQ ID NO: 690495 - DNA, 20 bp, Artificial
  CRISPR gRNA sequence
attataatgttctcttggtg

SEQ ID NO: 690496 - DNA, 20 bp, Artificial
  CRISPR gRNA sequence
tttgctgcttaaaatttgtc

SEQ ID NO: 690497 - DNA, 20 bp, Artificial
  CRISPR gRNA sequence
ttaaaatttgtcaagtttgt

SEQ ID NO: 690498 - DNA, 20 bp, Artificial
  CRISPR gRNA sequence
ataatgtttttcatcaaatt

SEQ ID NO: 690499 - DNA, 20 bp, Artificial
  CRISPR gRNA sequence
atgtttttcatcaaatttgg

SEQ ID NO: 690500 - DNA, 20 bp, Artificial
  CRISPR gRNA sequence
tgtttttcatcaaatttgga

SEQ ID NO: 690501 - DNA, 20 bp, Artificial
  CRISPR gRNA sequence
ttcatcaaatttggaaggtt

SEQ ID NO: 690502 - DNA, 20 bp, Artificial
  CRISPR gRNA sequence
catcaaatttggaaggtttg

SEQ ID NO: 690503 - DNA, 20 bp, Artificial
  CRISPR gRNA sequence
gtttggagttattctttaaa

SEQ ID NO: 690504 - DNA, 20 bp, Artificial
  CRISPR gRNA sequence
tttctctctctcctttcttt

SEQ ID NO: 690505 - DNA, 20 bp, Artificial
  CRISPR gRNA sequence
ttctctctctcctttctttg

SEQ ID NO: 690506 - DNA, 20 bp, Artificial
  CRISPR gRNA sequence
cctttctttgaggactccca

SEQ ID NO: 690507 - DNA, 20 bp, Artificial
  CRISPR gRNA sequence
atgtgcttgatgttgtctca

SEQ ID NO: 690508 - DNA, 20 bp, Artificial
  CRISPR gRNA sequence
tgttgtctcacagatcttta

SEQ ID NO: 690509 - DNA, 20 bp, Artificial
  CRISPR gRNA sequence
ttttctttctgctactgaac

SEQ ID NO: 690510 - DNA, 20 bp, Artificial
  CRISPR gRNA sequence
ttctttctgctactgaacta

SEQ ID NO: 690511 - DNA, 20 bp, Artificial
  CRISPR gRNA sequence
atttcaattgtcttatcttc

SEQ ID NO: 690512 - DNA, 20 bp, Artificial
  CRISPR gRNA sequence
tgctgattctccattctgca

SEQ ID NO: 690513 - DNA, 20 bp, Artificial
  CRISPR gRNA sequence
ctgcatggtgaaatttgctc

SEQ ID NO: 690514 - DNA, 20 bp, Artificial
  CRISPR gRNA sequence
gcatggtgaaatttgctctg

SEQ ID NO: 690515 - DNA, 20 bp, Artificial
  CRISPR gRNA sequence
aatttgctctggagcccctc

SEQ ID NO: 690516 - DNA, 20 bp, Artificial
  CRISPR gRNA sequence
ctctagtgaatttttcattt

SEQ ID NO: 690517 - DNA, 20 bp, Artificial
  CRISPR gRNA sequence
atttcagttattgcactttt

SEQ ID NO: 690518 - DNA, 20 bp, Artificial
  CRISPR gRNA sequence
tcagctccaaactttttatc

SEQ ID NO: 690519 - DNA, 20 bp, Artificial
  CRISPR gRNA sequence
ttttattgatgttctctatt

SEQ ID NO: 690520 - DNA, 20 bp, Artificial
  CRISPR gRNA sequence
tttattgatgttctctattt

SEQ ID NO: 690521 - DNA, 20 bp, Artificial
  CRISPR gRNA sequence
ttattgatgttctctatttg

SEQ ID NO: 690522 - DNA, 20 bp, Artificial
  CRISPR gRNA sequence
cctgcaaccaccatcttctg

SEQ ID NO: 690523 - DNA, 20 bp, Artificial
  CRISPR gRNA sequence
tctgaagctctgcccatgtc

SEQ ID NO: 690524 - DNA, 20 bp, Artificial
  CRISPR gRNA sequence
tgaagctctgcccatgtcaa

SEQ ID NO: 690525 - DNA, 20 bp, Artificial
  CRISPR gRNA sequence
gaagctctgcccatgtcaag

SEQ ID NO: 690526 - DNA, 20 bp, Artificial
  CRISPR gRNA sequence
tacctctctcttccatcccc

SEQ ID NO: 690527 - DNA, 20 bp, Artificial
  CRISPR gRNA sequence
tttccaactttattttgctc

SEQ ID NO: 690528 - DNA, 20 bp, Artificial
  CRISPR gRNA sequence
gctcaagttcctgactgacc

SEQ ID NO: 690529 - DNA, 20 bp, Artificial
  CRISPR gRNA sequence
tgactgaccaagcaacccat

SEQ ID NO: 690530 - DNA, 20 bp, Artificial
  CRISPR gRNA sequence
ctcattcattcatgcactac

SEQ ID NO: 690531 - DNA, 20 bp, Artificial
  CRISPR gRNA sequence
tcattcattcatgcactact

SEQ ID NO: 690532 - DNA, 20 bp, Artificial
  CRISPR gRNA sequence
cattcattcatgcactactg

SEQ ID NO: 690533 - DNA, 20 bp, Artificial
  CRISPR gRNA sequence
ttcacaccctccaccttgca

SEQ ID NO: 690534 - DNA, 20 bp, Artificial
  CRISPR gRNA sequence
tcacaccctccaccttgcat

SEQ ID NO: 690535 - DNA, 20 bp, Artificial
  CRISPR gRNA sequence
ccaccttgcatgggcctttt

SEQ ID NO: 690536 - DNA, 20 bp, Artificial
  CRISPR gRNA sequence
caccttgcatgggccttttt

SEQ ID NO: 690537 - DNA, 20 bp, Artificial
  CRISPR gRNA sequence
cctttttgggttttgattcc

SEQ ID NO: 690538 - DNA, 20 bp, Artificial
  CRISPR gRNA sequence
gggttttgattcctagttcc

SEQ ID NO: 690539 - DNA, 20 bp, Artificial
  CRISPR gRNA sequence
attcctagttcctggctcaa

SEQ ID NO: 690540 - DNA, 20 bp, Artificial
  CRISPR gRNA sequence
tggctcaacagccatttcca

SEQ ID NO: 690541 - DNA, 20 bp, Artificial
  CRISPR gRNA sequence
ttccaaagctgttcttgtgt

SEQ ID NO: 690542 - DNA, 20 bp, Artificial
  CRISPR gRNA sequence
ctgttcttgtgttagctccc

SEQ ID NO: 690543 - DNA, 20 bp, Artificial
  CRISPR gRNA sequence
caagcctactgctcttgttg

SEQ ID NO: 690544 - DNA, 20 bp, Artificial
  CRISPR gRNA sequence
agattctcctcttaatgtct

SEQ ID NO: 690545 - DNA, 20 bp, Artificial
  CRISPR gRNA sequence
tcctcttaatgtctgagtca

SEQ ID NO: 690546 - DNA, 20 bp, Artificial
  CRISPR gRNA sequence
gagtcacagcatttatttca

SEQ ID NO: 690547 - DNA, 20 bp, Artificial
  CRISPR gRNA sequence
tttcatagatttttaataat

SEQ ID NO: 690548 - DNA, 20 bp, Artificial
  CRISPR gRNA sequence
tggactaattttttccaatg

SEQ ID NO: 690549 - DNA, 20 bp, Artificial
  CRISPR gRNA sequence
ttttccaatgcagcatttct

SEQ ID NO: 690550 - DNA, 20 bp, Artificial
  CRISPR gRNA sequence
tttccaatgcagcatttcta

SEQ ID NO: 690551 - DNA, 20 bp, Artificial
  CRISPR gRNA sequence
gcagcatttctaaggacttt

SEQ ID NO: 690552 - DNA, 20 bp, Artificial
  CRISPR gRNA sequence
tttctaaggactttcagtaa

SEQ ID NO: 690553 - DNA, 20 bp, Artificial
  CRISPR gRNA sequence
tctaaggactttcagtaatg

SEQ ID NO: 690554 - DNA, 20 bp, Artificial
  CRISPR gRNA sequence
cagtaatggagattctatat

SEQ ID NO: 690555 - DNA, 20 bp, Artificial
  CRISPR gRNA sequence
atggagattctatattagct

SEQ ID NO: 690556 - DNA, 20 bp, Artificial
  CRISPR gRNA sequence
ggagattctatattagctta

SEQ ID NO: 690557 - DNA, 20 bp, Artificial
  CRISPR gRNA sequence
agattctatattagcttaga

SEQ ID NO: 690558 - DNA, 20 bp, Artificial
  CRISPR gRNA sequence
agagaattgtttcaaaacat

SEQ ID NO: 690559 - DNA, 20 bp, Artificial
  CRISPR gRNA sequence
cagtaatgtatacttgaatg

SEQ ID NO: 690560 - DNA, 20 bp, Artificial
  CRISPR gRNA sequence
agtaatgtatacttgaatga

SEQ ID NO: 690561 - DNA, 20 bp, Artificial
  CRISPR gRNA sequence
tgaatgaaggacaacatgca

SEQ ID NO: 690562 - DNA, 20 bp, Artificial
  CRISPR gRNA sequence
aatgaaggacaacatgcatg

SEQ ID NO: 690563 - DNA, 20 bp, Artificial
  CRISPR gRNA sequence
aaggacaacatgcatggaga

SEQ ID NO: 690564 - DNA, 20 bp, Artificial
  CRISPR gRNA sequence
aggacaacatgcatggagaa

SEQ ID NO: 690565 - DNA, 20 bp, Artificial
  CRISPR gRNA sequence
acaacatgcatggagaaagg

SEQ ID NO: 690566 - DNA, 20 bp, Artificial
  CRISPR gRNA sequence
gagaaaggtggacaaaccat

SEQ ID NO: 690567 - DNA, 20 bp, Artificial
  CRISPR gRNA sequence
aaaggtggacaaaccataag

SEQ ID NO: 690568 - DNA, 20 bp, Artificial
  CRISPR gRNA sequence
aaggtggacaaaccataagt

SEQ ID NO: 690569 - DNA, 20 bp, Artificial
  CRISPR gRNA sequence
gacaaaccataagtgggccg

SEQ ID NO: 690570 - DNA, 20 bp, Artificial
  CRISPR gRNA sequence
gtgggccgtggattttcaca

SEQ ID NO: 690571 - DNA, 20 bp, Artificial
  CRISPR gRNA sequence
attttcacaaagtgaacact

SEQ ID NO: 690572 - DNA, 20 bp, Artificial
  CRISPR gRNA sequence
ttttcacaaagtgaacactc

SEQ ID NO: 690573 - DNA, 20 bp, Artificial
  CRISPR gRNA sequence
aaagtgaacactcaggtaaa

SEQ ID NO: 690574 - DNA, 20 bp, Artificial
  CRISPR gRNA sequence
gtgaacactcaggtaaatag

SEQ ID NO: 690575 - DNA, 20 bp, Artificial
  CRISPR gRNA sequence
aggtaaatagcagccacatc

SEQ ID NO: 690576 - DNA, 20 bp, Artificial
  CRISPR gRNA sequence
ggtaaatagcagccacatca

SEQ ID NO: 690577 - DNA, 20 bp, Artificial
  CRISPR gRNA sequence
atagcagccacatcaaggaa

SEQ ID NO: 690578 - DNA, 20 bp, Artificial
  CRISPR gRNA sequence
acatcaaggaatagcattgc

SEQ ID NO: 690579 - DNA, 20 bp, Artificial
  CRISPR gRNA sequence
ggaatagcattgccagcctc

SEQ ID NO: 690580 - DNA, 20 bp, Artificial
  CRISPR gRNA sequence
gaatagcattgccagcctcc

SEQ ID NO: 690581 - DNA, 20 bp, Artificial
  CRISPR gRNA sequence
cagcctccaggaaacaccac

SEQ ID NO: 690582 - DNA, 20 bp, Artificial
  CRISPR gRNA sequence
agcctccaggaaacaccact

SEQ ID NO: 690583 - DNA, 20 bp, Artificial
  CRISPR gRNA sequence
aaacaccactgggttctact

SEQ ID NO: 690584 - DNA, 20 bp, Artificial
  CRISPR gRNA sequence
taaatcaccctccccaaccc

SEQ ID NO: 690585 - DNA, 20 bp, Artificial
  CRISPR gRNA sequence
aatcaccctccccaacccta

SEQ ID NO: 690586 - DNA, 20 bp, Artificial
  CRISPR gRNA sequence
caccctccccaaccctagag

SEQ ID NO: 690587 - DNA, 20 bp, Artificial
  CRISPR gRNA sequence
tttcttgatttctaatatga

SEQ ID NO: 690588 - DNA, 20 bp, Artificial
  CRISPR gRNA sequence
tgatttctaatatgatagat

SEQ ID NO: 690589 - DNA, 20 bp, Artificial
  CRISPR gRNA sequence
atatgatagattagttctgt

SEQ ID NO: 690590 - DNA, 20 bp, Artificial
  CRISPR gRNA sequence
tagattagttctgtcagttc

SEQ ID NO: 690591 - DNA, 20 bp, Artificial
  CRISPR gRNA sequence
agttctgtcagttctggaca

SEQ ID NO: 690592 - DNA, 20 bp, Artificial
  CRISPR gRNA sequence
acacagtcactgccatgtcc

SEQ ID NO: 690593 - DNA, 20 bp, Artificial
  CRISPR gRNA sequence
cacagtcactgccatgtccc

SEQ ID NO: 690594 - DNA, 20 bp, Artificial
  CRISPR gRNA sequence
gtcccaggtcttgctgtgtg

SEQ ID NO: 690595 - DNA, 20 bp, Artificial
  CRISPR gRNA sequence
gtggtcactattcactcccg

SEQ ID NO: 690596 - DNA, 20 bp, Artificial
  CRISPR gRNA sequence
gtcactattcactcccgcgg

SEQ ID NO: 690597 - DNA, 20 bp, Artificial
  CRISPR gRNA sequence
ctattcactcccgcggcagt

SEQ ID NO: 690598 - DNA, 20 bp, Artificial
  CRISPR gRNA sequence
tattcactcccgcggcagtc

SEQ ID NO: 690599 - DNA, 20 bp, Artificial
  CRISPR gRNA sequence
tcccgcggcagtcaggtgct

SEQ ID NO: 690600 - DNA, 20 bp, Artificial
  CRISPR gRNA sequence
caggtgctcagctttataaa

SEQ ID NO: 690601 - DNA, 20 bp, Artificial
  CRISPR gRNA sequence
tcttgtctctccactgttga

SEQ ID NO: 690602 - DNA, 20 bp, Artificial
  CRISPR gRNA sequence
atagacatttgtgttgtatt

SEQ ID NO: 690603 - DNA, 20 bp, Artificial
  CRISPR gRNA sequence
agacatttgtgttgtattca

SEQ ID NO: 690604 - DNA, 20 bp, Artificial
  CRISPR gRNA sequence
aataatattttcatatattt

SEQ ID NO: 690605 - DNA, 20 bp, Artificial
  CRISPR gRNA sequence
acaaatgcatgcatttctat

SEQ ID NO: 690606 - DNA, 20 bp, Artificial
  CRISPR gRNA sequence
ttctattggtatataacaaa

SEQ ID NO: 690607 - DNA, 20 bp, Artificial
  CRISPR gRNA sequence
tattggtatataacaaaaag

SEQ ID NO: 690608 - DNA, 20 bp, Artificial
  CRISPR gRNA sequence
ataacaaaaagtggaattgc

SEQ ID NO: 690609 - DNA, 20 bp, Artificial
  CRISPR gRNA sequence
taacaaaaagtggaattgct

SEQ ID NO: 690610 - DNA, 20 bp, Artificial
  CRISPR gRNA sequence
aaagtggaattgctgggtca

SEQ ID NO: 690611 - DNA, 20 bp, Artificial
  CRISPR gRNA sequence
aagtggaattgctgggtcat

SEQ ID NO: 690612 - DNA, 20 bp, Artificial
  CRISPR gRNA sequence
attgctgggtcataggtgat

SEQ ID NO: 690613 - DNA, 20 bp, Artificial
  CRISPR gRNA sequence
gtcataggtgattagaaact

SEQ ID NO: 690614 - DNA, 20 bp, Artificial
  CRISPR gRNA sequence
aggtgattagaaacttggtt

SEQ ID NO: 690615 - DNA, 20 bp, Artificial
  CRISPR gRNA sequence
ggtttagtctctcaaaaaac

SEQ ID NO: 690616 - DNA, 20 bp, Artificial
  CRISPR gRNA sequence
aaaaacaagtttctactgaa

SEQ ID NO: 690617 - DNA, 20 bp, Artificial
  CRISPR gRNA sequence
gtttctactgaatagataac

SEQ ID NO: 690618 - DNA, 20 bp, Artificial
  CRISPR gRNA sequence
tctactgaatagataactgg

SEQ ID NO: 690619 - DNA, 20 bp, Artificial
  CRISPR gRNA sequence
actgaatagataactggtgg

SEQ ID NO: 690620 - DNA, 20 bp, Artificial
  CRISPR gRNA sequence
tgaatagataactggtggaa

SEQ ID NO: 690621 - DNA, 20 bp, Artificial
  CRISPR gRNA sequence
gaatagataactggtggaag

SEQ ID NO: 690622 - DNA, 20 bp, Artificial
  CRISPR gRNA sequence
aatagataactggtggaaga

SEQ ID NO: 690623 - DNA, 20 bp, Artificial
  CRISPR gRNA sequence
agagggtaaatcttttattt

SEQ ID NO: 690624 - DNA, 20 bp, Artificial
  CRISPR gRNA sequence
cttttattttagaaattatg

SEQ ID NO: 690625 - DNA, 20 bp, Artificial
  CRISPR gRNA sequence
tattttagaaattatgcagc

SEQ ID NO: 690626 - DNA, 20 bp, Artificial
  CRISPR gRNA sequence
ttatgcagctagcatatgaa

SEQ ID NO: 690627 - DNA, 20 bp, Artificial
  CRISPR gRNA sequence
tagcatatgaaaagaaatga

SEQ ID NO: 690628 - DNA, 20 bp, Artificial
  CRISPR gRNA sequence
atgaaaagaaatgaaagact

SEQ ID NO: 690629 - DNA, 20 bp, Artificial
  CRISPR gRNA sequence
tgcaatttgtaatgaattaa

SEQ ID NO: 690630 - DNA, 20 bp, Artificial
  CRISPR gRNA sequence
ttgtaatgaattaacagatt

SEQ ID NO: 690631 - DNA, 20 bp, Artificial
  CRISPR gRNA sequence
taacagatttagccactgaa

SEQ ID NO: 690632 - DNA, 20 bp, Artificial
  CRISPR gRNA sequence
atttagccactgaacagcaa

SEQ ID NO: 690633 - DNA, 20 bp, Artificial
  CRISPR gRNA sequence
tggcaattaacatcgcaaaa

SEQ ID NO: 690634 - DNA, 20 bp, Artificial
  CRISPR gRNA sequence
catcgcaaaaaagaaataac

SEQ ID NO: 690635 - DNA, 20 bp, Artificial
  CRISPR gRNA sequence
tcttgatgaaaaacatgata

SEQ ID NO: 690636 - DNA, 20 bp, Artificial
  CRISPR gRNA sequence
tatagtaccatcaatcctca

SEQ ID NO: 690637 - DNA, 20 bp, Artificial
  CRISPR gRNA sequence
aaaaaaaaaaaaaccctgaa

SEQ ID NO: 690638 - DNA, 20 bp, Artificial
  CRISPR gRNA sequence
tataacaaactaccaattta

SEQ ID NO: 690639 - DNA, 20 bp, Artificial
  CRISPR gRNA sequence
ctaccaatttacagaaaata

SEQ ID NO: 690640 - DNA, 20 bp, Artificial
  CRISPR gRNA sequence
taccaatttacagaaaatac

SEQ ID NO: 690641 - DNA, 20 bp, Artificial
  CRISPR gRNA sequence
tttacagaaaatacaggtca

SEQ ID NO: 690642 - DNA, 20 bp, Artificial
  CRISPR gRNA sequence
tacagaaaatacaggtcata

SEQ ID NO: 690643 - DNA, 20 bp, Artificial
  CRISPR gRNA sequence
agatacattaaaccacacct

SEQ ID NO: 690644 - DNA, 20 bp, Artificial
  CRISPR gRNA sequence
gatacattaaaccacacctt

SEQ ID NO: 690645 - DNA, 20 bp, Artificial
  CRISPR gRNA sequence
atacattaaaccacaccttg

SEQ ID NO: 690646 - DNA, 20 bp, Artificial
  CRISPR gRNA sequence
ggtgcaatctgcaaaatgca

SEQ ID NO: 690647 - DNA, 20 bp, Artificial
  CRISPR gRNA sequence
gtgcaatctgcaaaatgcaa

SEQ ID NO: 690648 - DNA, 20 bp, Artificial
  CRISPR gRNA sequence
aatctgcaaaatgcaaagga

SEQ ID NO: 690649 - DNA, 20 bp, Artificial
  CRISPR gRNA sequence
atctgcaaaatgcaaaggac

SEQ ID NO: 690650 - DNA, 20 bp, Artificial
  CRISPR gRNA sequence
tgcaaaggacaggaaactac

SEQ ID NO: 690651 - DNA, 20 bp, Artificial
  CRISPR gRNA sequence
taccagacaatataaatttc

SEQ ID NO: 690652 - DNA, 20 bp, Artificial
  CRISPR gRNA sequence
cagacaatataaatttcaag

SEQ ID NO: 690653 - DNA, 20 bp, Artificial
  CRISPR gRNA sequence
agacaatataaatttcaagc

SEQ ID NO: 690654 - DNA, 20 bp, Artificial
  CRISPR gRNA sequence
aaatttcaagcaggaatcta

SEQ ID NO: 690655 - DNA, 20 bp, Artificial
  CRISPR gRNA sequence
caggaatctatggaataaat

SEQ ID NO: 690656 - DNA, 20 bp, Artificial
  CRISPR gRNA sequence
aggaatctatggaataaatg

SEQ ID NO: 690657 - DNA, 20 bp, Artificial
  CRISPR gRNA sequence
aggataaaaatatactctta

SEQ ID NO: 690658 - DNA, 20 bp, Artificial
  CRISPR gRNA sequence
ggataaaaatatactcttaa

SEQ ID NO: 690659 - DNA, 20 bp, Artificial
  CRISPR gRNA sequence
gtaaaactaaactataattt

SEQ ID NO: 690660 - DNA, 20 bp, Artificial
  CRISPR gRNA sequence
taaaaatataaaattgtaca

SEQ ID NO: 690661 - DNA, 20 bp, Artificial
  CRISPR gRNA sequence
aaatataaaattgtacaaag

SEQ ID NO: 690662 - DNA, 20 bp, Artificial
  CRISPR gRNA sequence
aaaattgtacaaagaagtga

SEQ ID NO: 690663 - DNA, 20 bp, Artificial
  CRISPR gRNA sequence
caaagaagtgatggccatgt

SEQ ID NO: 690664 - DNA, 20 bp, Artificial
  CRISPR gRNA sequence
gaagtgatggccatgtaagc

SEQ ID NO: 690665 - DNA, 20 bp, Artificial
  CRISPR gRNA sequence
aagtgatggccatgtaagcc

SEQ ID NO: 690666 - DNA, 20 bp, Artificial
  CRISPR gRNA sequence
ccaggatgtgcttttatttg

SEQ ID NO: 690667 - DNA, 20 bp, Artificial
  CRISPR gRNA sequence
ggatgtgcttttatttgaag

SEQ ID NO: 690668 - DNA, 20 bp, Artificial
  CRISPR gRNA sequence
atgtgcttttatttgaagaa

SEQ ID NO: 690669 - DNA, 20 bp, Artificial
  CRISPR gRNA sequence
tgcttttatttgaagaagag

SEQ ID NO: 690670 - DNA, 20 bp, Artificial
  CRISPR gRNA sequence
cttttatttgaagaagagaa

SEQ ID NO: 690671 - DNA, 20 bp, Artificial
  CRISPR gRNA sequence
gaagagaagagtttatcatt

SEQ ID NO: 690672 - DNA, 20 bp, Artificial
  CRISPR gRNA sequence
agaagagtttatcattgagc

SEQ ID NO: 690673 - DNA, 20 bp, Artificial
  CRISPR gRNA sequence
gaagagtttatcattgagct

SEQ ID NO: 690674 - DNA, 20 bp, Artificial
  CRISPR gRNA sequence
aagagtttatcattgagctg

SEQ ID NO: 690675 - DNA, 20 bp, Artificial
  CRISPR gRNA sequence
agtttatcattgagctgggg

SEQ ID NO: 690676 - DNA, 20 bp, Artificial
  CRISPR gRNA sequence
cattgagctggggcagttga

SEQ ID NO: 690677 - DNA, 20 bp, Artificial
  CRISPR gRNA sequence
attgagctggggcagttgat

SEQ ID NO: 690678 - DNA, 20 bp, Artificial
  CRISPR gRNA sequence
ttgagctggggcagttgatg

SEQ ID NO: 690679 - DNA, 20 bp, Artificial
  CRISPR gRNA sequence
ggggcagttgatggggcttc

SEQ ID NO: 690680 - DNA, 20 bp, Artificial
  CRISPR gRNA sequence
gggcagttgatggggcttct

SEQ ID NO: 690681 - DNA, 20 bp, Artificial
  CRISPR gRNA sequence
agttgatggggcttctaggt

SEQ ID NO: 690682 - DNA, 20 bp, Artificial
  CRISPR gRNA sequence
aaacttctccctctctctga

SEQ ID NO: 690683 - DNA, 20 bp, Artificial
  CRISPR gRNA sequence
ctccctctctctgatggtta

SEQ ID NO: 690684 - DNA, 20 bp, Artificial
  CRISPR gRNA sequence
tccctctctctgatggttaa

SEQ ID NO: 690685 - DNA, 20 bp, Artificial
  CRISPR gRNA sequence
ccctctctctgatggttaaa

SEQ ID NO: 690686 - DNA, 20 bp, Artificial
  CRISPR gRNA sequence
agggtgtttacttttgatta

SEQ ID NO: 690687 - DNA, 20 bp, Artificial
  CRISPR gRNA sequence
gggtgtttacttttgattaa

SEQ ID NO: 690688 - DNA, 20 bp, Artificial
  CRISPR gRNA sequence
ggtgtttacttttgattaaa

SEQ ID NO: 690689 - DNA, 20 bp, Artificial
  CRISPR gRNA sequence
tgattaaagggcactatttt

SEQ ID NO: 690690 - DNA, 20 bp, Artificial
  CRISPR gRNA sequence
tttagatcttttatctttta

SEQ ID NO: 690691 - DNA, 20 bp, Artificial
  CRISPR gRNA sequence
tttatcttttatggtacccg

SEQ ID NO: 690692 - DNA, 20 bp, Artificial
  CRISPR gRNA sequence
ttatcttttatggtacccgt

SEQ ID NO: 690693 - DNA, 20 bp, Artificial
  CRISPR gRNA sequence
tatcttttatggtacccgtg

SEQ ID NO: 690694 - DNA, 20 bp, Artificial
  CRISPR gRNA sequence
ttatgacaaaaacactaata

SEQ ID NO: 690695 - DNA, 20 bp, Artificial
  CRISPR gRNA sequence
aacactaataaagaataaaa

SEQ ID NO: 690696 - DNA, 20 bp, Artificial
  CRISPR gRNA sequence
ataaaatagtatgtgacata

SEQ ID NO: 690697 - DNA, 20 bp, Artificial
  CRISPR gRNA sequence
tatggttcttgttctgcacc

SEQ ID NO: 690698 - DNA, 20 bp, Artificial
  CRISPR gRNA sequence
ctccttcccaccctccgctc

SEQ ID NO: 690699 - DNA, 20 bp, Artificial
  CRISPR gRNA sequence
caccctccgctccagacact

SEQ ID NO: 690700 - DNA, 20 bp, Artificial
  CRISPR gRNA sequence
cgctccagacactgagcacc

SEQ ID NO: 690701 - DNA, 20 bp, Artificial
  CRISPR gRNA sequence
cactgagcacccagaactac

SEQ ID NO: 690702 - DNA, 20 bp, Artificial
  CRISPR gRNA sequence
cccagaactactggcaaccc

SEQ ID NO: 690703 - DNA, 20 bp, Artificial
  CRISPR gRNA sequence
ccagaactactggcaacccc

SEQ ID NO: 690704 - DNA, 20 bp, Artificial
  CRISPR gRNA sequence
actggcaaccccaggatact

SEQ ID NO: 690705 - DNA, 20 bp, Artificial
  CRISPR gRNA sequence
ggcaaccccaggatacttgg

SEQ ID NO: 690706 - DNA, 20 bp, Artificial
  CRISPR gRNA sequence
gcaaccccaggatacttggc

SEQ ID NO: 690707 - DNA, 20 bp, Artificial
  CRISPR gRNA sequence
caaccccaggatacttggca

SEQ ID NO: 690708 - DNA, 20 bp, Artificial
  CRISPR gRNA sequence
tggcagggctaccttacatc

SEQ ID NO: 690709 - DNA, 20 bp, Artificial
  CRISPR gRNA sequence
ggcagggctaccttacatct

SEQ ID NO: 690710 - DNA, 20 bp, Artificial
  CRISPR gRNA sequence
cttacatctgggtgtgtgtc

SEQ ID NO: 690711 - DNA, 20 bp, Artificial
  CRISPR gRNA sequence
gtgtgtccagctcacattgc

SEQ ID NO: 690712 - DNA, 20 bp, Artificial
  CRISPR gRNA sequence
gtgtccagctcacattgcca

SEQ ID NO: 690713 - DNA, 20 bp, Artificial
  CRISPR gRNA sequence
tgtccagctcacattgccag

SEQ ID NO: 690714 - DNA, 20 bp, Artificial
  CRISPR gRNA sequence
acattgccagaggcaatgtc

SEQ ID NO: 690715 - DNA, 20 bp, Artificial
  CRISPR gRNA sequence
cattgccagaggcaatgtcc

SEQ ID NO: 690716 - DNA, 20 bp, Artificial
  CRISPR gRNA sequence
attgccagaggcaatgtcca

SEQ ID NO: 690717 - DNA, 20 bp, Artificial
  CRISPR gRNA sequence
atgtccagggtctattcttt

SEQ ID NO: 690718 - DNA, 20 bp, Artificial
  CRISPR gRNA sequence
tgtccagggtctattctttg

SEQ ID NO: 690719 - DNA, 20 bp, Artificial
  CRISPR gRNA sequence
agggtctattctttgaggcc

SEQ ID NO: 690720 - DNA, 20 bp, Artificial
  CRISPR gRNA sequence
tgaggcctagatgaacctga

SEQ ID NO: 690721 - DNA, 20 bp, Artificial
  CRISPR gRNA sequence
gaggcctagatgaacctgac

SEQ ID NO: 690722 - DNA, 20 bp, Artificial
  CRISPR gRNA sequence
tagatgaacctgacaggaca

SEQ ID NO: 690723 - DNA, 20 bp, Artificial
  CRISPR gRNA sequence
gaacctgacaggacacagct

SEQ ID NO: 690724 - DNA, 20 bp, Artificial
  CRISPR gRNA sequence
aacctgacaggacacagctg

SEQ ID NO: 690725 - DNA, 20 bp, Artificial
  CRISPR gRNA sequence
acctgacaggacacagctga

SEQ ID NO: 690726 - DNA, 20 bp, Artificial
  CRISPR gRNA sequence
acacagctgagggaaaaacc

SEQ ID NO: 690727 - DNA, 20 bp, Artificial
  CRISPR gRNA sequence
ggaaaaacctggccccactc

SEQ ID NO: 690728 - DNA, 20 bp, Artificial
  CRISPR gRNA sequence
aaaaacctggccccactctg

SEQ ID NO: 690729 - DNA, 20 bp, Artificial
  CRISPR gRNA sequence
aaaacctggccccactctgg

SEQ ID NO: 690730 - DNA, 20 bp, Artificial
  CRISPR gRNA sequence
tggccccactctggaggctc

SEQ ID NO: 690731 - DNA, 20 bp, Artificial
  CRISPR gRNA sequence
actctggaggctctggccat

SEQ ID NO: 690732 - DNA, 20 bp, Artificial
  CRISPR gRNA sequence
ggaggctctggccatcggtg

SEQ ID NO: 690733 - DNA, 20 bp, Artificial
  CRISPR gRNA sequence
aggctctggccatcggtgta

SEQ ID NO: 690734 - DNA, 20 bp, Artificial
  CRISPR gRNA sequence
ggctctggccatcggtgtag

SEQ ID NO: 690735 - DNA, 20 bp, Artificial
  CRISPR gRNA sequence
gctctggccatcggtgtaga

SEQ ID NO: 690736 - DNA, 20 bp, Artificial
  CRISPR gRNA sequence
ctctggccatcggtgtagag

SEQ ID NO: 690737 - DNA, 20 bp, Artificial
  CRISPR gRNA sequence
ggccatcggtgtagagggga

SEQ ID NO: 690738 - DNA, 20 bp, Artificial
  CRISPR gRNA sequence
gccatcggtgtagaggggac

SEQ ID NO: 690739 - DNA, 20 bp, Artificial
  CRISPR gRNA sequence
gacaggtcctcacctctcca

SEQ ID NO: 690740 - DNA, 20 bp, Artificial
  CRISPR gRNA sequence
acaggtcctcacctctccac

SEQ ID NO: 690741 - DNA, 20 bp, Artificial
  CRISPR gRNA sequence
tcctcacctctccacaggtg

SEQ ID NO: 690742 - DNA, 20 bp, Artificial
  CRISPR gRNA sequence
cctctccacaggtgcagtta

SEQ ID NO: 690743 - DNA, 20 bp, Artificial
  CRISPR gRNA sequence
tccacaggtgcagttacagt

SEQ ID NO: 690744 - DNA, 20 bp, Artificial
  CRISPR gRNA sequence
cacaggtgcagttacagtca

SEQ ID NO: 690745 - DNA, 20 bp, Artificial
  CRISPR gRNA sequence
gtcagagcctcttctctgca

SEQ ID NO: 690746 - DNA, 20 bp, Artificial
  CRISPR gRNA sequence
tcagagcctcttctctgcat

SEQ ID NO: 690747 - DNA, 20 bp, Artificial
  CRISPR gRNA sequence
agagcctcttctctgcatgg

SEQ ID NO: 690748 - DNA, 20 bp, Artificial
  CRISPR gRNA sequence
cctcttctctgcatgggagt

SEQ ID NO: 690749 - DNA, 20 bp, Artificial
  CRISPR gRNA sequence
ctcttctctgcatgggagtg

SEQ ID NO: 690750 - DNA, 20 bp, Artificial
  CRISPR gRNA sequence
ctctgcatgggagtgaggct

SEQ ID NO: 690751 - DNA, 20 bp, Artificial
  CRISPR gRNA sequence
cttggtccttcccccgaaca

SEQ ID NO: 690752 - DNA, 20 bp, Artificial
  CRISPR gRNA sequence
ttggtccttcccccgaacac

SEQ ID NO: 690753 - DNA, 20 bp, Artificial
  CRISPR gRNA sequence
tggtccttcccccgaacacg

SEQ ID NO: 690754 - DNA, 20 bp, Artificial
  CRISPR gRNA sequence
ccttcccccgaacacgggga

SEQ ID NO: 690755 - DNA, 20 bp, Artificial
  CRISPR gRNA sequence
cttcccccgaacacggggac

SEQ ID NO: 690756 - DNA, 20 bp, Artificial
  CRISPR gRNA sequence
ttcccccgaacacggggaca

SEQ ID NO: 690757 - DNA, 20 bp, Artificial
  CRISPR gRNA sequence
cacggggacagggatctctc

SEQ ID NO: 690758 - DNA, 20 bp, Artificial
  CRISPR gRNA sequence
ggggacagggatctctccag

SEQ ID NO: 690759 - DNA, 20 bp, Artificial
  CRISPR gRNA sequence
gacagggatctctccagaag

SEQ ID NO: 690760 - DNA, 20 bp, Artificial
  CRISPR gRNA sequence
cagggatctctccagaagtg

SEQ ID NO: 690761 - DNA, 20 bp, Artificial
  CRISPR gRNA sequence
acaccattcctcctctaaca

SEQ ID NO: 690762 - DNA, 20 bp, Artificial
  CRISPR gRNA sequence
ctcgtgcttgttctgcttta

SEQ ID NO: 690763 - DNA, 20 bp, Artificial
  CRISPR gRNA sequence
tcgtgcttgttctgctttac

SEQ ID NO: 690764 - DNA, 20 bp, Artificial
  CRISPR gRNA sequence
gcttgttctgctttacagga

SEQ ID NO: 690765 - DNA, 20 bp, Artificial
  CRISPR gRNA sequence
acaggaaagttgactcatac

SEQ ID NO: 690766 - DNA, 20 bp, Artificial
  CRISPR gRNA sequence
agttgactcatactggtgtc

SEQ ID NO: 690767 - DNA, 20 bp, Artificial
  CRISPR gRNA sequence
actcatactggtgtccagtg

SEQ ID NO: 690768 - DNA, 20 bp, Artificial
  CRISPR gRNA sequence
tggtgtccagtgaagaaacc

SEQ ID NO: 690769 - DNA, 20 bp, Artificial
  CRISPR gRNA sequence
ggtgtccagtgaagaaaccc

SEQ ID NO: 690770 - DNA, 20 bp, Artificial
  CRISPR gRNA sequence
gtgaagaaacccaggcgcat

SEQ ID NO: 690771 - DNA, 20 bp, Artificial
  CRISPR gRNA sequence
gaagaaacccaggcgcataa

SEQ ID NO: 690772 - DNA, 20 bp, Artificial
  CRISPR gRNA sequence
aagaaacccaggcgcataag

SEQ ID NO: 690773 - DNA, 20 bp, Artificial
  CRISPR gRNA sequence
agaaacccaggcgcataaga

SEQ ID NO: 690774 - DNA, 20 bp, Artificial
  CRISPR gRNA sequence
acccaggcgcataagaggga

SEQ ID NO: 690775 - DNA, 20 bp, Artificial
  CRISPR gRNA sequence
aggcgcataagagggacagt

SEQ ID NO: 690776 - DNA, 20 bp, Artificial
  CRISPR gRNA sequence
taagagggacagttggatct

SEQ ID NO: 690777 - DNA, 20 bp, Artificial
  CRISPR gRNA sequence
aagagggacagttggatctc

SEQ ID NO: 690778 - DNA, 20 bp, Artificial
  CRISPR gRNA sequence
tctcaggtttgtgcttgatc

SEQ ID NO: 690779 - DNA, 20 bp, Artificial
  CRISPR gRNA sequence
ggtttgtgcttgatctggaa

SEQ ID NO: 690780 - DNA, 20 bp, Artificial
  CRISPR gRNA sequence
gtttgtgcttgatctggaaa

SEQ ID NO: 690781 - DNA, 20 bp, Artificial
  CRISPR gRNA sequence
tgtgcttgatctggaaaagg

SEQ ID NO: 690782 - DNA, 20 bp, Artificial
  CRISPR gRNA sequence
tgcttgatctggaaaaggaa

SEQ ID NO: 690783 - DNA, 20 bp, Artificial
  CRISPR gRNA sequence
ttgatctggaaaaggaagag

SEQ ID NO: 690784 - DNA, 20 bp, Artificial
  CRISPR gRNA sequence
gatctggaaaaggaagagca

SEQ ID NO: 690785 - DNA, 20 bp, Artificial
  CRISPR gRNA sequence
aaaggaagagcagagaccac

SEQ ID NO: 690786 - DNA, 20 bp, Artificial
  CRISPR gRNA sequence
aaggaagagcagagaccact

SEQ ID NO: 690787 - DNA, 20 bp, Artificial
  CRISPR gRNA sequence
ggaagagcagagaccactag

SEQ ID NO: 690788 - DNA, 20 bp, Artificial
  CRISPR gRNA sequence
gaagagcagagaccactagg

SEQ ID NO: 690789 - DNA, 20 bp, Artificial
  CRISPR gRNA sequence
ggcaccactgcactgctcat

SEQ ID NO: 690790 - DNA, 20 bp, Artificial
  CRISPR gRNA sequence
cactgcactgctcatgagcc

SEQ ID NO: 690791 - DNA, 20 bp, Artificial
  CRISPR gRNA sequence
actgcactgctcatgagccc

SEQ ID NO: 690792 - DNA, 20 bp, Artificial
  CRISPR gRNA sequence
tgcactgctcatgagcccag

SEQ ID NO: 690793 - DNA, 20 bp, Artificial
  CRISPR gRNA sequence
gcactgctcatgagcccagg

SEQ ID NO: 690794 - DNA, 20 bp, Artificial
  CRISPR gRNA sequence
ctgctcatgagcccaggagg

SEQ ID NO: 690795 - DNA, 20 bp, Artificial
  CRISPR gRNA sequence
gagcccaggaggtggatgcc

SEQ ID NO: 690796 - DNA, 20 bp, Artificial
  CRISPR gRNA sequence
agcccaggaggtggatgccc

SEQ ID NO: 690797 - DNA, 20 bp, Artificial
  CRISPR gRNA sequence
aggaggtggatgcccaggct

SEQ ID NO: 690798 - DNA, 20 bp, Artificial
  CRISPR gRNA sequence
gtggatgcccaggctgagct

SEQ ID NO: 690799 - DNA, 20 bp, Artificial
  CRISPR gRNA sequence
tggatgcccaggctgagctc

SEQ ID NO: 690800 - DNA, 20 bp, Artificial
  CRISPR gRNA sequence
ggatgcccaggctgagctca

SEQ ID NO: 690801 - DNA, 20 bp, Artificial
  CRISPR gRNA sequence
tgcccaggctgagctcaggg

SEQ ID NO: 690802 - DNA, 20 bp, Artificial
  CRISPR gRNA sequence
cccaggctgagctcagggtg

SEQ ID NO: 690803 - DNA, 20 bp, Artificial
  CRISPR gRNA sequence
caggctgagctcagggtgga

SEQ ID NO: 690804 - DNA, 20 bp, Artificial
  CRISPR gRNA sequence
agatgtcattgctcatcctc

SEQ ID NO: 690805 - DNA, 20 bp, Artificial
  CRISPR gRNA sequence
gatgtcattgctcatcctcc

SEQ ID NO: 690806 - DNA, 20 bp, Artificial
  CRISPR gRNA sequence
attgctcatcctccaggttc

SEQ ID NO: 690807 - DNA, 20 bp, Artificial
  CRISPR gRNA sequence
ttgctcatcctccaggttcc

SEQ ID NO: 690808 - DNA, 20 bp, Artificial
  CRISPR gRNA sequence
caggtgaaaacccacctgcc

SEQ ID NO: 690809 - DNA, 20 bp, Artificial
  CRISPR gRNA sequence
ccagcccatctgcttctccc

SEQ ID NO: 690810 - DNA, 20 bp, Artificial
  CRISPR gRNA sequence
tctccctggttcttcaattc

SEQ ID NO: 690811 - DNA, 20 bp, Artificial
  CRISPR gRNA sequence
ctccctggttcttcaattct

SEQ ID NO: 690812 - DNA, 20 bp, Artificial
  CRISPR gRNA sequence
tccctggttcttcaattcta

SEQ ID NO: 690813 - DNA, 20 bp, Artificial
  CRISPR gRNA sequence
cctggttcttcaattctagg

SEQ ID NO: 690814 - DNA, 20 bp, Artificial
  CRISPR gRNA sequence
ctggttcttcaattctaggg

SEQ ID NO: 690815 - DNA, 20 bp, Artificial
  CRISPR gRNA sequence
ctgtcttcttctcacctccc

SEQ ID NO: 690816 - DNA, 20 bp, Artificial
  CRISPR gRNA sequence
ccggacgatgcttcttgaca

SEQ ID NO: 690817 - DNA, 20 bp, Artificial
  CRISPR gRNA sequence
cggacgatgcttcttgacac

SEQ ID NO: 690818 - DNA, 20 bp, Artificial
  CRISPR gRNA sequence
cgatgcttcttgacacagga

SEQ ID NO: 690819 - DNA, 20 bp, Artificial
  CRISPR gRNA sequence
atgcttcttgacacaggaaa

SEQ ID NO: 690820 - DNA, 20 bp, Artificial
  CRISPR gRNA sequence
tgcttcttgacacaggaaag

SEQ ID NO: 690821 - DNA, 20 bp, Artificial
  CRISPR gRNA sequence
caggaaagaggatgtgctgc

SEQ ID NO: 690822 - DNA, 20 bp, Artificial
  CRISPR gRNA sequence
aggaaagaggatgtgctgct

SEQ ID NO: 690823 - DNA, 20 bp, Artificial
  CRISPR gRNA sequence
ggaaagaggatgtgctgcta

SEQ ID NO: 690824 - DNA, 20 bp, Artificial
  CRISPR gRNA sequence
ctgctagggtcatcatgtcc

SEQ ID NO: 690825 - DNA, 20 bp, Artificial
  CRISPR gRNA sequence
gtcctggtttattgtgttgt

SEQ ID NO: 690826 - DNA, 20 bp, Artificial
  CRISPR gRNA sequence
ctggtttattgtgttgtcag

SEQ ID NO: 690827 - DNA, 20 bp, Artificial
  CRISPR gRNA sequence
ataataaaataacccataat

SEQ ID NO: 690828 - DNA, 20 bp, Artificial
  CRISPR gRNA sequence
tacaatttactcacaccatt

SEQ ID NO: 690829 - DNA, 20 bp, Artificial
  CRISPR gRNA sequence
acaatttactcacaccattg

SEQ ID NO: 690830 - DNA, 20 bp, Artificial
  CRISPR gRNA sequence
cacaccattgaggtttcctc

SEQ ID NO: 690831 - DNA, 20 bp, Artificial
  CRISPR gRNA sequence
acaccattgaggtttcctcc

SEQ ID NO: 690832 - DNA, 20 bp, Artificial
  CRISPR gRNA sequence
ttgaggtttcctccaggtgt

SEQ ID NO: 690833 - DNA, 20 bp, Artificial
  CRISPR gRNA sequence
gtttcctccaggtgtgagca

SEQ ID NO: 690834 - DNA, 20 bp, Artificial
  CRISPR gRNA sequence
tccaggtgtgagcacagctg

SEQ ID NO: 690835 - DNA, 20 bp, Artificial
  CRISPR gRNA sequence
gcagacacaccttgtcgctt

SEQ ID NO: 690836 - DNA, 20 bp, Artificial
  CRISPR gRNA sequence
acacaccttgtcgcttcagt

SEQ ID NO: 690837 - DNA, 20 bp, Artificial
  CRISPR gRNA sequence
cacaccttgtcgcttcagtc

SEQ ID NO: 690838 - DNA, 20 bp, Artificial
  CRISPR gRNA sequence
ttgtcgcttcagtcaggaca

SEQ ID NO: 690839 - DNA, 20 bp, Artificial
  CRISPR gRNA sequence
tgtcgcttcagtcaggacac

SEQ ID NO: 690840 - DNA, 20 bp, Artificial
  CRISPR gRNA sequence
gcttcagtcaggacacagga

SEQ ID NO: 690841 - DNA, 20 bp, Artificial
  CRISPR gRNA sequence
ttcagtcaggacacaggaca

SEQ ID NO: 690842 - DNA, 20 bp, Artificial
  CRISPR gRNA sequence
ggacacaggacagagtaaaa

SEQ ID NO: 690843 - DNA, 20 bp, Artificial
  CRISPR gRNA sequence
gacacaggacagagtaaaat

SEQ ID NO: 690844 - DNA, 20 bp, Artificial
  CRISPR gRNA sequence
acaggacagagtaaaatggg

SEQ ID NO: 690845 - DNA, 20 bp, Artificial
  CRISPR gRNA sequence
agtaaaatgggaagaaacca

SEQ ID NO: 690846 - DNA, 20 bp, Artificial
  CRISPR gRNA sequence
ggaagaaaccacagtcactg

SEQ ID NO: 690847 - DNA, 20 bp, Artificial
  CRISPR gRNA sequence
gaaaccacagtcactgcaga

SEQ ID NO: 690848 - DNA, 20 bp, Artificial
  CRISPR gRNA sequence
aaaccacagtcactgcagaa

SEQ ID NO: 690849 - DNA, 20 bp, Artificial
  CRISPR gRNA sequence
aaccacagtcactgcagaaa

SEQ ID NO: 690850 - DNA, 20 bp, Artificial
  CRISPR gRNA sequence
cactgcagaaagggccccca

SEQ ID NO: 690851 - DNA, 20 bp, Artificial
  CRISPR gRNA sequence
tgcagaaagggcccccatgg

SEQ ID NO: 690852 - DNA, 20 bp, Artificial
  CRISPR gRNA sequence
cagaaagggcccccatggaa

SEQ ID NO: 690853 - DNA, 20 bp, Artificial
  CRISPR gRNA sequence
agaaagggcccccatggaag

SEQ ID NO: 690854 - DNA, 20 bp, Artificial
  CRISPR gRNA sequence
gggcccccatggaagaggcc

SEQ ID NO: 690855 - DNA, 20 bp, Artificial
  CRISPR gRNA sequence
cccccatggaagaggcctgg

SEQ ID NO: 690856 - DNA, 20 bp, Artificial
  CRISPR gRNA sequence
ccccatggaagaggcctggc

SEQ ID NO: 690857 - DNA, 20 bp, Artificial
  CRISPR gRNA sequence
cccatggaagaggcctggca

SEQ ID NO: 690858 - DNA, 20 bp, Artificial
  CRISPR gRNA sequence
catggaagaggcctggcagg

SEQ ID NO: 690859 - DNA, 20 bp, Artificial
  CRISPR gRNA sequence
atggaagaggcctggcaggg

SEQ ID NO: 690860 - DNA, 20 bp, Artificial
  CRISPR gRNA sequence
aagaggcctggcagggaggc

SEQ ID NO: 690861 - DNA, 20 bp, Artificial
  CRISPR gRNA sequence
ggcagggaggccagctgccc

SEQ ID NO: 690862 - DNA, 20 bp, Artificial
  CRISPR gRNA sequence
gcagggaggccagctgcccc

SEQ ID NO: 690863 - DNA, 20 bp, Artificial
  CRISPR gRNA sequence
cagggaggccagctgcccca

SEQ ID NO: 690864 - DNA, 20 bp, Artificial
  CRISPR gRNA sequence
tgccccagggccaccatatt

SEQ ID NO: 690865 - DNA, 20 bp, Artificial
  CRISPR gRNA sequence
ccccagggccaccatattta

SEQ ID NO: 690866 - DNA, 20 bp, Artificial
  CRISPR gRNA sequence
tagagatgacttcccctttc

SEQ ID NO: 690867 - DNA, 20 bp, Artificial
  CRISPR gRNA sequence
agagatgacttcccctttct

SEQ ID NO: 690868 - DNA, 20 bp, Artificial
  CRISPR gRNA sequence
gatgacttcccctttctagg

SEQ ID NO: 690869 - DNA, 20 bp, Artificial
  CRISPR gRNA sequence
atgacttcccctttctaggc

SEQ ID NO: 690870 - DNA, 20 bp, Artificial
  CRISPR gRNA sequence
ttcccctttctaggcaggac

SEQ ID NO: 690871 - DNA, 20 bp, Artificial
  CRISPR gRNA sequence
tcccctttctaggcaggact

SEQ ID NO: 690872 - DNA, 20 bp, Artificial
  CRISPR gRNA sequence
taaaattctttttgtattca

SEQ ID NO: 690873 - DNA, 20 bp, Artificial
  CRISPR gRNA sequence
tcatagttgttctgaaattg

SEQ ID NO: 690874 - DNA, 20 bp, Artificial
  CRISPR gRNA sequence
catagttgttctgaaattgc

SEQ ID NO: 690875 - DNA, 20 bp, Artificial
  CRISPR gRNA sequence
ttctgaaattgcaggatgat

SEQ ID NO: 690876 - DNA, 20 bp, Artificial
  CRISPR gRNA sequence
aattgcaggatgatgagacc

SEQ ID NO: 690877 - DNA, 20 bp, Artificial
  CRISPR gRNA sequence
aggatgatgagacccagcac

SEQ ID NO: 690878 - DNA, 20 bp, Artificial
  CRISPR gRNA sequence
tgatgagacccagcactggt

SEQ ID NO: 690879 - DNA, 20 bp, Artificial
  CRISPR gRNA sequence
ctattaaattctgtgccaaa

SEQ ID NO: 690880 - DNA, 20 bp, Artificial
  CRISPR gRNA sequence
atatatttatctcctcttcc

SEQ ID NO: 690881 - DNA, 20 bp, Artificial
  CRISPR gRNA sequence
atatttatctcctcttcctg

SEQ ID NO: 690882 - DNA, 20 bp, Artificial
  CRISPR gRNA sequence
atttatctcctcttcctgga

SEQ ID NO: 690883 - DNA, 20 bp, Artificial
  CRISPR gRNA sequence
cctggagagaataaaaacaa

SEQ ID NO: 690884 - DNA, 20 bp, Artificial
  CRISPR gRNA sequence
atactttaaatatgtgctgt

SEQ ID NO: 690885 - DNA, 20 bp, Artificial
  CRISPR gRNA sequence
ctttaaatatgtgctgtcag

SEQ ID NO: 690886 - DNA, 20 bp, Artificial
  CRISPR gRNA sequence
taaatatgtgctgtcagaag

SEQ ID NO: 690887 - DNA, 20 bp, Artificial
  CRISPR gRNA sequence
gctgtcagaagtagctacta

SEQ ID NO: 690888 - DNA, 20 bp, Artificial
  CRISPR gRNA sequence
ctgtcagaagtagctactaa

SEQ ID NO: 690889 - DNA, 20 bp, Artificial
  CRISPR gRNA sequence
ctaaaggattaattccacca

SEQ ID NO: 690890 - DNA, 20 bp, Artificial
  CRISPR gRNA sequence
aggattaattccaccaaagt

SEQ ID NO: 690891 - DNA, 20 bp, Artificial
  CRISPR gRNA sequence
ggattaattccaccaaagtg

SEQ ID NO: 690892 - DNA, 20 bp, Artificial
  CRISPR gRNA sequence
gattaattccaccaaagtga

SEQ ID NO: 690893 - DNA, 20 bp, Artificial
  CRISPR gRNA sequence
taattccaccaaagtgaggg

SEQ ID NO: 690894 - DNA, 20 bp, Artificial
  CRISPR gRNA sequence
aattccaccaaagtgaggga

SEQ ID NO: 690895 - DNA, 20 bp, Artificial
  CRISPR gRNA sequence
aaagtgagggaaggtttgaa

SEQ ID NO: 690896 - DNA, 20 bp, Artificial
  CRISPR gRNA sequence
acattgtatacccatattca

SEQ ID NO: 690897 - DNA, 20 bp, Artificial
  CRISPR gRNA sequence
ttgtatacccatattcaaag

SEQ ID NO: 690898 - DNA, 20 bp, Artificial
  CRISPR gRNA sequence
caaagcagcattattcacga

SEQ ID NO: 690899 - DNA, 20 bp, Artificial
  CRISPR gRNA sequence
cagcattattcacgatagcc

SEQ ID NO: 690900 - DNA, 20 bp, Artificial
  CRISPR gRNA sequence
cacacaccaacacatgaatg

SEQ ID NO: 690901 - DNA, 20 bp, Artificial
  CRISPR gRNA sequence
acacatgaatgaagaaaatg

SEQ ID NO: 690902 - DNA, 20 bp, Artificial
  CRISPR gRNA sequence
aatgtggtatatatcgacaa

SEQ ID NO: 690903 - DNA, 20 bp, Artificial
  CRISPR gRNA sequence
atcgacaacggaatatcatt

SEQ ID NO: 690904 - DNA, 20 bp, Artificial
  CRISPR gRNA sequence
acggaatatcattcagcctt

SEQ ID NO: 690905 - DNA, 20 bp, Artificial
  CRISPR gRNA sequence
gaatatcattcagccttaag

SEQ ID NO: 690906 - DNA, 20 bp, Artificial
  CRISPR gRNA sequence
aatatcattcagccttaaga

SEQ ID NO: 690907 - DNA, 20 bp, Artificial
  CRISPR gRNA sequence
tcagccttaagaaggaaacc

SEQ ID NO: 690908 - DNA, 20 bp, Artificial
  CRISPR gRNA sequence
ttaagaaggaaacctggtca

SEQ ID NO: 690909 - DNA, 20 bp, Artificial
  CRISPR gRNA sequence
taagaaggaaacctggtcac

SEQ ID NO: 690910 - DNA, 20 bp, Artificial
  CRISPR gRNA sequence
aacctggtcacaggctgcaa

SEQ ID NO: 690911 - DNA, 20 bp, Artificial
  CRISPR gRNA sequence
acctggtcacaggctgcaac

SEQ ID NO: 690912 - DNA, 20 bp, Artificial
  CRISPR gRNA sequence
cctggtcacaggctgcaaca

SEQ ID NO: 690913 - DNA, 20 bp, Artificial
  CRISPR gRNA sequence
ctgcaacagggatgaacctg

SEQ ID NO: 690914 - DNA, 20 bp, Artificial
  CRISPR gRNA sequence
tgcaacagggatgaacctga

SEQ ID NO: 690915 - DNA, 20 bp, Artificial
  CRISPR gRNA sequence
tgaacctgaaggacactgct

SEQ ID NO: 690916 - DNA, 20 bp, Artificial
  CRISPR gRNA sequence
aggacactgctaagtaaaat

SEQ ID NO: 690917 - DNA, 20 bp, Artificial
  CRISPR gRNA sequence
agtaaaataagccaatcaca

SEQ ID NO: 690918 - DNA, 20 bp, Artificial
  CRISPR gRNA sequence
ctgcacatttccatttatat

SEQ ID NO: 690919 - DNA, 20 bp, Artificial
  CRISPR gRNA sequence
tgcacatttccatttatatg

SEQ ID NO: 690920 - DNA, 20 bp, Artificial
  CRISPR gRNA sequence
atatgaggtgtctaaactga

SEQ ID NO: 690921 - DNA, 20 bp, Artificial
  CRISPR gRNA sequence
tgaggtgtctaaactgaaag

SEQ ID NO: 690922 - DNA, 20 bp, Artificial
  CRISPR gRNA sequence
ctaaactgaaagtagactaa

SEQ ID NO: 690923 - DNA, 20 bp, Artificial
  CRISPR gRNA sequence
gaaagtagactaatggctgc

SEQ ID NO: 690924 - DNA, 20 bp, Artificial
  CRISPR gRNA sequence
aaagtagactaatggctgct

SEQ ID NO: 690925 - DNA, 20 bp, Artificial
  CRISPR gRNA sequence
aagtagactaatggctgcta

SEQ ID NO: 690926 - DNA, 20 bp, Artificial
  CRISPR gRNA sequence
agtagactaatggctgctag

SEQ ID NO: 690927 - DNA, 20 bp, Artificial
  CRISPR gRNA sequence
actaatggctgctaggggct

SEQ ID NO: 690928 - DNA, 20 bp, Artificial
  CRISPR gRNA sequence
atggctgctaggggctcggt

SEQ ID NO: 690929 - DNA, 20 bp, Artificial
  CRISPR gRNA sequence
tggctgctaggggctcggtg

SEQ ID NO: 690930 - DNA, 20 bp, Artificial
  CRISPR gRNA sequence
ggctgctaggggctcggtga

SEQ ID NO: 690931 - DNA, 20 bp, Artificial
  CRISPR gRNA sequence
gctgctaggggctcggtgag

SEQ ID NO: 690932 - DNA, 20 bp, Artificial
  CRISPR gRNA sequence
ctgctaggggctcggtgagg

SEQ ID NO: 690933 - DNA, 20 bp, Artificial
  CRISPR gRNA sequence
taggggctcggtgaggggga

SEQ ID NO: 690934 - DNA, 20 bp, Artificial
  CRISPR gRNA sequence
atggatgaatgtttgttcaa

SEQ ID NO: 690935 - DNA, 20 bp, Artificial
  CRISPR gRNA sequence
tggatgaatgtttgttcaat

SEQ ID NO: 690936 - DNA, 20 bp, Artificial
  CRISPR gRNA sequence
gaatgtttgttcaatgggca

SEQ ID NO: 690937 - DNA, 20 bp, Artificial
  CRISPR gRNA sequence
atgtttgttcaatgggcata

SEQ ID NO: 690938 - DNA, 20 bp, Artificial
  CRISPR gRNA sequence
gttcaatgggcatagagttt

SEQ ID NO: 690939 - DNA, 20 bp, Artificial
  CRISPR gRNA sequence
gcatagagtttcagtgttgc

SEQ ID NO: 690940 - DNA, 20 bp, Artificial
  CRISPR gRNA sequence
tttcagtgttgcaagatgaa

SEQ ID NO: 690941 - DNA, 20 bp, Artificial
  CRISPR gRNA sequence
tgttgcaagatgaaaagttc

SEQ ID NO: 690942 - DNA, 20 bp, Artificial
  CRISPR gRNA sequence
ttgcaagatgaaaagttcta

SEQ ID NO: 690943 - DNA, 20 bp, Artificial
  CRISPR gRNA sequence
gttgcacaactatgtattta

SEQ ID NO: 690944 - DNA, 20 bp, Artificial
  CRISPR gRNA sequence
tactactgtatactttaaaa

SEQ ID NO: 690945 - DNA, 20 bp, Artificial
  CRISPR gRNA sequence
ctgtatactttaaaatagtt

SEQ ID NO: 690946 - DNA, 20 bp, Artificial
  CRISPR gRNA sequence
ataccaaattttacataatg

SEQ ID NO: 690947 - DNA, 20 bp, Artificial
  CRISPR gRNA sequence
attttacataatgtagtttt

SEQ ID NO: 690948 - DNA, 20 bp, Artificial
  CRISPR gRNA sequence
cataatgtagtttttggccc

SEQ ID NO: 690949 - DNA, 20 bp, Artificial
  CRISPR gRNA sequence
ataatgtagtttttggccca

SEQ ID NO: 690950 - DNA, 20 bp, Artificial
  CRISPR gRNA sequence
gtagtttttggcccaaggaa

SEQ ID NO: 690951 - DNA, 20 bp, Artificial
  CRISPR gRNA sequence
ggcccaaggaaaagactaat

SEQ ID NO: 690952 - DNA, 20 bp, Artificial
  CRISPR gRNA sequence
aattagccctgttactaatt

SEQ ID NO: 690953 - DNA, 20 bp, Artificial
  CRISPR gRNA sequence
attagccctgttactaattt

SEQ ID NO: 690954 - DNA, 20 bp, Artificial
  CRISPR gRNA sequence
ttagccctgttactaattta

SEQ ID NO: 690955 - DNA, 20 bp, Artificial
  CRISPR gRNA sequence
ctgttactaatttagggaaa

SEQ ID NO: 690956 - DNA, 20 bp, Artificial
  CRISPR gRNA sequence
tgaattcattaaaaatatat

SEQ ID NO: 690957 - DNA, 20 bp, Artificial
  CRISPR gRNA sequence
atattagtatgcgcttacct

SEQ ID NO: 690958 - DNA, 20 bp, Artificial
  CRISPR gRNA sequence
gtatgcgcttaccttagata

SEQ ID NO: 690959 - DNA, 20 bp, Artificial
  CRISPR gRNA sequence
ccttagatacagaaaactat

SEQ ID NO: 690960 - DNA, 20 bp, Artificial
  CRISPR gRNA sequence
acagaaaactatgagacaaa

SEQ ID NO: 690961 - DNA, 20 bp, Artificial
  CRISPR gRNA sequence
agaaaactatgagacaaaaa

SEQ ID NO: 690962 - DNA, 20 bp, Artificial
  CRISPR gRNA sequence
aaaactatgagacaaaaaga

SEQ ID NO: 690963 - DNA, 20 bp, Artificial
  CRISPR gRNA sequence
aagagagatccctgctaccc

SEQ ID NO: 690964 - DNA, 20 bp, Artificial
  CRISPR gRNA sequence
cccagctatcacccatgaac

SEQ ID NO: 690965 - DNA, 20 bp, Artificial
  CRISPR gRNA sequence
ccagctatcacccatgaacc

SEQ ID NO: 690966 - DNA, 20 bp, Artificial
  CRISPR gRNA sequence
cacccatgaaccaggaaaat

SEQ ID NO: 690967 - DNA, 20 bp, Artificial
  CRISPR gRNA sequence
aaatcagcacctcctgaaac

SEQ ID NO: 690968 - DNA, 20 bp, Artificial
  CRISPR gRNA sequence
cagcacctcctgaaactaga

SEQ ID NO: 690969 - DNA, 20 bp, Artificial
  CRISPR gRNA sequence
acctcctgaaactagacaga

SEQ ID NO: 690970 - DNA, 20 bp, Artificial
  CRISPR gRNA sequence
cctcctgaaactagacagaa

SEQ ID NO: 690971 - DNA, 20 bp, Artificial
  CRISPR gRNA sequence
aaactagacagaaaggctca

SEQ ID NO: 690972 - DNA, 20 bp, Artificial
  CRISPR gRNA sequence
aactagacagaaaggctcac

SEQ ID NO: 690973 - DNA, 20 bp, Artificial
  CRISPR gRNA sequence
gacagaaaggctcacaggcc

SEQ ID NO: 690974 - DNA, 20 bp, Artificial
  CRISPR gRNA sequence
ccagccttgacatgttgaat

SEQ ID NO: 690975 - DNA, 20 bp, Artificial
  CRISPR gRNA sequence
tgttgaatcagtctgcattt

SEQ ID NO: 690976 - DNA, 20 bp, Artificial
  CRISPR gRNA sequence
gaatcagtctgcattttggc

SEQ ID NO: 690977 - DNA, 20 bp, Artificial
  CRISPR gRNA sequence
tctgcattttggctggaacc

SEQ ID NO: 690978 - DNA, 20 bp, Artificial
  CRISPR gRNA sequence
ctgcattttggctggaaccc

SEQ ID NO: 690979 - DNA, 20 bp, Artificial
  CRISPR gRNA sequence
cattttggctggaacccagg

SEQ ID NO: 690980 - DNA, 20 bp, Artificial
  CRISPR gRNA sequence
aggtggctccactgcatgta

SEQ ID NO: 690981 - DNA, 20 bp, Artificial
  CRISPR gRNA sequence
ctgcatgtaaagcaccttcc

SEQ ID NO: 690982 - DNA, 20 bp, Artificial
  CRISPR gRNA sequence
atgtaaagcaccttcccaga

SEQ ID NO: 690983 - DNA, 20 bp, Artificial
  CRISPR gRNA sequence
agcaccttcccagatagtga

SEQ ID NO: 690984 - DNA, 20 bp, Artificial
  CRISPR gRNA sequence
caccttcccagatagtgatg

SEQ ID NO: 690985 - DNA, 20 bp, Artificial
  CRISPR gRNA sequence
accttcccagatagtgatgg

SEQ ID NO: 690986 - DNA, 20 bp, Artificial
  CRISPR gRNA sequence
ccttcccagatagtgatgga

SEQ ID NO: 690987 - DNA, 20 bp, Artificial
  CRISPR gRNA sequence
ttcccagatagtgatggagg

SEQ ID NO: 690988 - DNA, 20 bp, Artificial
  CRISPR gRNA sequence
atagtgatggagggagatcc

SEQ ID NO: 690989 - DNA, 20 bp, Artificial
  CRISPR gRNA sequence
tagtgatggagggagatcct

SEQ ID NO: 690990 - DNA, 20 bp, Artificial
  CRISPR gRNA sequence
gatggagggagatcctagga

SEQ ID NO: 690991 - DNA, 20 bp, Artificial
  CRISPR gRNA sequence
aggacagtgactctgctcca

SEQ ID NO: 690992 - DNA, 20 bp, Artificial
  CRISPR gRNA sequence
ggacagtgactctgctccac

SEQ ID NO: 690993 - DNA, 20 bp, Artificial
  CRISPR gRNA sequence
gacagtgactctgctccacg

SEQ ID NO: 690994 - DNA, 20 bp, Artificial
  CRISPR gRNA sequence
cagtgactctgctccacggg

SEQ ID NO: 690995 - DNA, 20 bp, Artificial
  CRISPR gRNA sequence
tgactctgctccacggggag

SEQ ID NO: 690996 - DNA, 20 bp, Artificial
  CRISPR gRNA sequence
acggggagaagcctccaatc

SEQ ID NO: 690997 - DNA, 20 bp, Artificial
  CRISPR gRNA sequence
ggagaagcctccaatccaga

SEQ ID NO: 690998 - DNA, 20 bp, Artificial
  CRISPR gRNA sequence
gagaagcctccaatccagat

SEQ ID NO: 690999 - DNA, 20 bp, Artificial
  CRISPR gRNA sequence
gaagcctccaatccagatgg

SEQ ID NO: 691000 - DNA, 20 bp, Artificial
  CRISPR gRNA sequence
gcctccaatccagatgggag

SEQ ID NO: 691001 - DNA, 20 bp, Artificial
  CRISPR gRNA sequence
ccaatccagatgggagcagc

SEQ ID NO: 691002 - DNA, 20 bp, Artificial
  CRISPR gRNA sequence
atccagatgggagcagccag

SEQ ID NO: 691003 - DNA, 20 bp, Artificial
  CRISPR gRNA sequence
tccagatgggagcagccaga

SEQ ID NO: 691004 - DNA, 20 bp, Artificial
  CRISPR gRNA sequence
ccagatgggagcagccagaa

SEQ ID NO: 691005 - DNA, 20 bp, Artificial
  CRISPR gRNA sequence
tgggagcagccagaagggcc

SEQ ID NO: 691006 - DNA, 20 bp, Artificial
  CRISPR gRNA sequence
gggagcagccagaagggccc

SEQ ID NO: 691007 - DNA, 20 bp, Artificial
  CRISPR gRNA sequence
gagcagccagaagggcccag

SEQ ID NO: 691008 - DNA, 20 bp, Artificial
  CRISPR gRNA sequence
agcagccagaagggcccagg

SEQ ID NO: 691009 - DNA, 20 bp, Artificial
  CRISPR gRNA sequence
gcagccagaagggcccagga

SEQ ID NO: 691010 - DNA, 20 bp, Artificial
  CRISPR gRNA sequence
ggcccaggagggacatttcc

SEQ ID NO: 691011 - DNA, 20 bp, Artificial
  CRISPR gRNA sequence
ccaggagggacatttccaag

SEQ ID NO: 691012 - DNA, 20 bp, Artificial
  CRISPR gRNA sequence
ttccaagaagataaaattaa

SEQ ID NO: 691013 - DNA, 20 bp, Artificial
  CRISPR gRNA sequence
taaaattaacagaatgtcca

SEQ ID NO: 691014 - DNA, 20 bp, Artificial
  CRISPR gRNA sequence
caaagtgtccaacgtcttga

SEQ ID NO: 691015 - DNA, 20 bp, Artificial
  CRISPR gRNA sequence
tgaaagaatcatacaaacaa

SEQ ID NO: 691016 - DNA, 20 bp, Artificial
  CRISPR gRNA sequence
aaagaatcatacaaacaaaa

SEQ ID NO: 691017 - DNA, 20 bp, Artificial
  CRISPR gRNA sequence
gatatcaaacttaaattaat

SEQ ID NO: 691018 - DNA, 20 bp, Artificial
  CRISPR gRNA sequence
tatcaaacttaaattaatga

SEQ ID NO: 691019 - DNA, 20 bp, Artificial
  CRISPR gRNA sequence
aaataaacaaaaacaaatac

SEQ ID NO: 691020 - DNA, 20 bp, Artificial
  CRISPR gRNA sequence
caaatacaagtattaactcc

SEQ ID NO: 691021 - DNA, 20 bp, Artificial
  CRISPR gRNA sequence
atacaagtattaactccaag

SEQ ID NO: 691022 - DNA, 20 bp, Artificial
  CRISPR gRNA sequence
caagaagaaccaatgttgta

SEQ ID NO: 691023 - DNA, 20 bp, Artificial
  CRISPR gRNA sequence
aagaagaaccaatgttgtac

SEQ ID NO: 691024 - DNA, 20 bp, Artificial
  CRISPR gRNA sequence
aagaaccaatgttgtacagg

SEQ ID NO: 691025 - DNA, 20 bp, Artificial
  CRISPR gRNA sequence
aatgttgtacaggcagtgaa

SEQ ID NO: 691026 - DNA, 20 bp, Artificial
  CRISPR gRNA sequence
gttgtacaggcagtgaaaag

SEQ ID NO: 691027 - DNA, 20 bp, Artificial
  CRISPR gRNA sequence
acaggcagtgaaaagtagtc

SEQ ID NO: 691028 - DNA, 20 bp, Artificial
  CRISPR gRNA sequence
aagtagtccagttgacatat

SEQ ID NO: 691029 - DNA, 20 bp, Artificial
  CRISPR gRNA sequence
gtagtccagttgacatatga

SEQ ID NO: 691030 - DNA, 20 bp, Artificial
  CRISPR gRNA sequence
tagtccagttgacatatgag

SEQ ID NO: 691031 - DNA, 20 bp, Artificial
  CRISPR gRNA sequence
cagttgacatatgagaggat

SEQ ID NO: 691032 - DNA, 20 bp, Artificial
  CRISPR gRNA sequence
acatatgagaggattagtca

SEQ ID NO: 691033 - DNA, 20 bp, Artificial
  CRISPR gRNA sequence
gagaggattagtcatggtaa

SEQ ID NO: 691034 - DNA, 20 bp, Artificial
  CRISPR gRNA sequence
ttagtcatggtaaaagaaac

SEQ ID NO: 691035 - DNA, 20 bp, Artificial
  CRISPR gRNA sequence
agtcatggtaaaagaaacaa

SEQ ID NO: 691036 - DNA, 20 bp, Artificial
  CRISPR gRNA sequence
atggtaaaagaaacaagaga

SEQ ID NO: 691037 - DNA, 20 bp, Artificial
  CRISPR gRNA sequence
taatcactatataaatatac

SEQ ID NO: 691038 - DNA, 20 bp, Artificial
  CRISPR gRNA sequence
aatcactatataaatatact

SEQ ID NO: 691039 - DNA, 20 bp, Artificial
  CRISPR gRNA sequence
cactatataaatatactggg

SEQ ID NO: 691040 - DNA, 20 bp, Artificial
  CRISPR gRNA sequence
ctatataaatatactgggaa

SEQ ID NO: 691041 - DNA, 20 bp, Artificial
  CRISPR gRNA sequence
aaatatactgggaagagtga

SEQ ID NO: 691042 - DNA, 20 bp, Artificial
  CRISPR gRNA sequence
atatactgggaagagtgaaa

SEQ ID NO: 691043 - DNA, 20 bp, Artificial
  CRISPR gRNA sequence
tgggaagagtgaaagagaac

SEQ ID NO: 691044 - DNA, 20 bp, Artificial
  CRISPR gRNA sequence
accattgcgctgtgcaacaa

SEQ ID NO: 691045 - DNA, 20 bp, Artificial
  CRISPR gRNA sequence
ccattgcgctgtgcaacaat

SEQ ID NO: 691046 - DNA, 20 bp, Artificial
  CRISPR gRNA sequence
gggtgcatctgaaaaaaatc

SEQ ID NO: 691047 - DNA, 20 bp, Artificial
  CRISPR gRNA sequence
aaaatcaagcaataataata

SEQ ID NO: 691048 - DNA, 20 bp, Artificial
  CRISPR gRNA sequence
aagcaataataataaagaaa

SEQ ID NO: 691049 - DNA, 20 bp, Artificial
  CRISPR gRNA sequence
caataataataaagaaatgg

SEQ ID NO: 691050 - DNA, 20 bp, Artificial
  CRISPR gRNA sequence
aataataaagaaatggtagt

SEQ ID NO: 691051 - DNA, 20 bp, Artificial
  CRISPR gRNA sequence
taataaagaaatggtagtta

SEQ ID NO: 691052 - DNA, 20 bp, Artificial
  CRISPR gRNA sequence
agaaatggtagttagagata

SEQ ID NO: 691053 - DNA, 20 bp, Artificial
  CRISPR gRNA sequence
aatggtagttagagatacag

SEQ ID NO: 691054 - DNA, 20 bp, Artificial
  CRISPR gRNA sequence
tagttagagatacagaagta

SEQ ID NO: 691055 - DNA, 20 bp, Artificial
  CRISPR gRNA sequence
agatacagaagtaaagtcaa

SEQ ID NO: 691056 - DNA, 20 bp, Artificial
  CRISPR gRNA sequence
agaagtaaagtcaaaagaat

SEQ ID NO: 691057 - DNA, 20 bp, Artificial
  CRISPR gRNA sequence
gaatcagctaaaaaacttga

SEQ ID NO: 691058 - DNA, 20 bp, Artificial
  CRISPR gRNA sequence
tcagctaaaaaacttgaaag

SEQ ID NO: 691059 - DNA, 20 bp, Artificial
  CRISPR gRNA sequence
ctaaaaaacttgaaagtggt

SEQ ID NO: 691060 - DNA, 20 bp, Artificial
  CRISPR gRNA sequence
acttgaaagtggttggcccc

SEQ ID NO: 691061 - DNA, 20 bp, Artificial
  CRISPR gRNA sequence
gaaagtggttggcccctaga

SEQ ID NO: 691062 - DNA, 20 bp, Artificial
  CRISPR gRNA sequence
aaagtggttggcccctagaa

SEQ ID NO: 691063 - DNA, 20 bp, Artificial
  CRISPR gRNA sequence
gtggttggcccctagaaagg

SEQ ID NO: 691064 - DNA, 20 bp, Artificial
  CRISPR gRNA sequence
cccctagaaaggcagaaatt

SEQ ID NO: 691065 - DNA, 20 bp, Artificial
  CRISPR gRNA sequence
ctagaaaggcagaaattgag

SEQ ID NO: 691066 - DNA, 20 bp, Artificial
  CRISPR gRNA sequence
agaaaggcagaaattgagaa

SEQ ID NO: 691067 - DNA, 20 bp, Artificial
  CRISPR gRNA sequence
gaaaggcagaaattgagaag

SEQ ID NO: 691068 - DNA, 20 bp, Artificial
  CRISPR gRNA sequence
aggcagaaattgagaagagg

SEQ ID NO: 691069 - DNA, 20 bp, Artificial
  CRISPR gRNA sequence
gcagaaattgagaagaggca

SEQ ID NO: 691070 - DNA, 20 bp, Artificial
  CRISPR gRNA sequence
agaaattgagaagaggcaga

SEQ ID NO: 691071 - DNA, 20 bp, Artificial
  CRISPR gRNA sequence
gaaattgagaagaggcagag

SEQ ID NO: 691072 - DNA, 20 bp, Artificial
  CRISPR gRNA sequence
agaggactctcatttttctc

SEQ ID NO: 691073 - DNA, 20 bp, Artificial
  CRISPR gRNA sequence
aggactctcatttttctcaa

SEQ ID NO: 691074 - DNA, 20 bp, Artificial
  CRISPR gRNA sequence
tttgattaaaataaaaacaa

SEQ ID NO: 691075 - DNA, 20 bp, Artificial
  CRISPR gRNA sequence
taaaataaaaacaaaagctt

SEQ ID NO: 691076 - DNA, 20 bp, Artificial
  CRISPR gRNA sequence
aaaagcttcagtgaatatgc

SEQ ID NO: 691077 - DNA, 20 bp, Artificial
  CRISPR gRNA sequence
cgcattcaacaatgatattt

SEQ ID NO: 691078 - DNA, 20 bp, Artificial
  CRISPR gRNA sequence
gcattcaacaatgatattta

SEQ ID NO: 691079 - DNA, 20 bp, Artificial
  CRISPR gRNA sequence
cattcaacaatgatatttaa

SEQ ID NO: 691080 - DNA, 20 bp, Artificial
  CRISPR gRNA sequence
gaaaatacttaaacatgaaa

SEQ ID NO: 691081 - DNA, 20 bp, Artificial
  CRISPR gRNA sequence
aaaatacttaaacatgaaac

SEQ ID NO: 691082 - DNA, 20 bp, Artificial
  CRISPR gRNA sequence
tacatgcctgtttcatgttt

SEQ ID NO: 691083 - DNA, 20 bp, Artificial
  CRISPR gRNA sequence
gtttaagtattttcacattt

SEQ ID NO: 691084 - DNA, 20 bp, Artificial
  CRISPR gRNA sequence
ttaaatatcattgttgaatg

SEQ ID NO: 691085 - DNA, 20 bp, Artificial
  CRISPR gRNA sequence
ttgttgaatgcggttgtcat

SEQ ID NO: 691086 - DNA, 20 bp, Artificial
  CRISPR gRNA sequence
ataaacttgcatattcactg

SEQ ID NO: 691087 - DNA, 20 bp, Artificial
  CRISPR gRNA sequence
ttataattgtgcataattga

SEQ ID NO: 691088 - DNA, 20 bp, Artificial
  CRISPR gRNA sequence
ataattgtgcataattgaaa

SEQ ID NO: 691089 - DNA, 20 bp, Artificial
  CRISPR gRNA sequence
gaaagagtcaaatatttgtg

SEQ ID NO: 691090 - DNA, 20 bp, Artificial
  CRISPR gRNA sequence
atatttgtgcagaatctctt

SEQ ID NO: 691091 - DNA, 20 bp, Artificial
  CRISPR gRNA sequence
cagaatctcttgagaaaaat

SEQ ID NO: 691092 - DNA, 20 bp, Artificial
  CRISPR gRNA sequence
gaatctcttgagaaaaatga

SEQ ID NO: 691093 - DNA, 20 bp, Artificial
  CRISPR gRNA sequence
cttctcaatttctgcctttc

SEQ ID NO: 691094 - DNA, 20 bp, Artificial
  CRISPR gRNA sequence
ttctcaatttctgcctttct

SEQ ID NO: 691095 - DNA, 20 bp, Artificial
  CRISPR gRNA sequence
tctcaatttctgcctttcta

SEQ ID NO: 691096 - DNA, 20 bp, Artificial
  CRISPR gRNA sequence
ctcaatttctgcctttctag

SEQ ID NO: 691097 - DNA, 20 bp, Artificial
  CRISPR gRNA sequence
tctaggggccaaccactttc

SEQ ID NO: 691098 - DNA, 20 bp, Artificial
  CRISPR gRNA sequence
ccaaccactttcaagttttt

SEQ ID NO: 691099 - DNA, 20 bp, Artificial
  CRISPR gRNA sequence
tattattgcttgattttttt

SEQ ID NO: 691100 - DNA, 20 bp, Artificial
  CRISPR gRNA sequence
cagatgcacccattgttgca

SEQ ID NO: 691101 - DNA, 20 bp, Artificial
  CRISPR gRNA sequence
cccattgttgcacagcgcaa

SEQ ID NO: 691102 - DNA, 20 bp, Artificial
  CRISPR gRNA sequence
attgttgcacagcgcaatgg

SEQ ID NO: 691103 - DNA, 20 bp, Artificial
  CRISPR gRNA sequence
cagcgcaatggtggatgcaa

SEQ ID NO: 691104 - DNA, 20 bp, Artificial
  CRISPR gRNA sequence
caatggtggatgcaacagtt

SEQ ID NO: 691105 - DNA, 20 bp, Artificial
  CRISPR gRNA sequence
atggtggatgcaacagttaa

SEQ ID NO: 691106 - DNA, 20 bp, Artificial
  CRISPR gRNA sequence
ttgttctctttcactcttcc

SEQ ID NO: 691107 - DNA, 20 bp, Artificial
  CRISPR gRNA sequence
ctcttcccagtatatttata

SEQ ID NO: 691108 - DNA, 20 bp, Artificial
  CRISPR gRNA sequence
atttatatagtgattatgtt

SEQ ID NO: 691109 - DNA, 20 bp, Artificial
  CRISPR gRNA sequence
tatagtgattatgtttagtt

SEQ ID NO: 691110 - DNA, 20 bp, Artificial
  CRISPR gRNA sequence
taatcctctcatatgtcaac

SEQ ID NO: 691111 - DNA, 20 bp, Artificial
  CRISPR gRNA sequence
tttcactgcctgtacaacat

SEQ ID NO: 691112 - DNA, 20 bp, Artificial
  CRISPR gRNA sequence
tgtacaacattggttcttct

SEQ ID NO: 691113 - DNA, 20 bp, Artificial
  CRISPR gRNA sequence
tacaacattggttcttcttg

SEQ ID NO: 691114 - DNA, 20 bp, Artificial
  CRISPR gRNA sequence
ttattaactctcattaattt

SEQ ID NO: 691115 - DNA, 20 bp, Artificial
  CRISPR gRNA sequence
tttgtttgtatgattctttc

SEQ ID NO: 691116 - DNA, 20 bp, Artificial
  CRISPR gRNA sequence
gtatgattctttcaagacgt

SEQ ID NO: 691117 - DNA, 20 bp, Artificial
  CRISPR gRNA sequence
tttcaagacgttggacactt

SEQ ID NO: 691118 - DNA, 20 bp, Artificial
  CRISPR gRNA sequence
ttctgttaattttatcttct

SEQ ID NO: 691119 - DNA, 20 bp, Artificial
  CRISPR gRNA sequence
cttcttggaaatgtccctcc

SEQ ID NO: 691120 - DNA, 20 bp, Artificial
  CRISPR gRNA sequence
ttcttggaaatgtccctcct

SEQ ID NO: 691121 - DNA, 20 bp, Artificial
  CRISPR gRNA sequence
atgtccctcctgggcccttc

SEQ ID NO: 691122 - DNA, 20 bp, Artificial
  CRISPR gRNA sequence
cccttctggctgctcccatc

SEQ ID NO: 691123 - DNA, 20 bp, Artificial
  CRISPR gRNA sequence
ctggctgctcccatctggat

SEQ ID NO: 691124 - DNA, 20 bp, Artificial
  CRISPR gRNA sequence
ggctgctcccatctggattg

SEQ ID NO: 691125 - DNA, 20 bp, Artificial
  CRISPR gRNA sequence
gctgctcccatctggattgg

SEQ ID NO: 691126 - DNA, 20 bp, Artificial
  CRISPR gRNA sequence
ggattggaggcttctccccg

SEQ ID NO: 691127 - DNA, 20 bp, Artificial
  CRISPR gRNA sequence
attggaggcttctccccgtg

SEQ ID NO: 691128 - DNA, 20 bp, Artificial
  CRISPR gRNA sequence
ggaggcttctccccgtggag

SEQ ID NO: 691129 - DNA, 20 bp, Artificial
  CRISPR gRNA sequence
aggcttctccccgtggagca

SEQ ID NO: 691130 - DNA, 20 bp, Artificial
  CRISPR gRNA sequence
gtggagcagagtcactgtcc

SEQ ID NO: 691131 - DNA, 20 bp, Artificial
  CRISPR gRNA sequence
tggagcagagtcactgtcct

SEQ ID NO: 691132 - DNA, 20 bp, Artificial
  CRISPR gRNA sequence
gatctccctccatcactatc

SEQ ID NO: 691133 - DNA, 20 bp, Artificial
  CRISPR gRNA sequence
atctccctccatcactatct

SEQ ID NO: 691134 - DNA, 20 bp, Artificial
  CRISPR gRNA sequence
tccctccatcactatctggg

SEQ ID NO: 691135 - DNA, 20 bp, Artificial
  CRISPR gRNA sequence
ccctccatcactatctggga

SEQ ID NO: 691136 - DNA, 20 bp, Artificial
  CRISPR gRNA sequence
ctgggaaggtgctttacatg

SEQ ID NO: 691137 - DNA, 20 bp, Artificial
  CRISPR gRNA sequence
ggaaggtgctttacatgcag

SEQ ID NO: 691138 - DNA, 20 bp, Artificial
  CRISPR gRNA sequence
aaggtgctttacatgcagtg

SEQ ID NO: 691139 - DNA, 20 bp, Artificial
  CRISPR gRNA sequence
ttacatgcagtggagccacc

SEQ ID NO: 691140 - DNA, 20 bp, Artificial
  CRISPR gRNA sequence
tacatgcagtggagccacct

SEQ ID NO: 691141 - DNA, 20 bp, Artificial
  CRISPR gRNA sequence
cagtggagccacctgggttc

SEQ ID NO: 691142 - DNA, 20 bp, Artificial
  CRISPR gRNA sequence
cctgggttccagccaaaatg

SEQ ID NO: 691143 - DNA, 20 bp, Artificial
  CRISPR gRNA sequence
gcagactgattcaacatgtc

SEQ ID NO: 691144 - DNA, 20 bp, Artificial
  CRISPR gRNA sequence
cagactgattcaacatgtca

SEQ ID NO: 691145 - DNA, 20 bp, Artificial
  CRISPR gRNA sequence
ctgattcaacatgtcaaggc

SEQ ID NO: 691146 - DNA, 20 bp, Artificial
  CRISPR gRNA sequence
tgattcaacatgtcaaggct

SEQ ID NO: 691147 - DNA, 20 bp, Artificial
  CRISPR gRNA sequence
catgtcaaggctgggcctgt

SEQ ID NO: 691148 - DNA, 20 bp, Artificial
  CRISPR gRNA sequence
ggcctgtgagcctttctgtc

SEQ ID NO: 691149 - DNA, 20 bp, Artificial
  CRISPR gRNA sequence
tgagcctttctgtctagttt

SEQ ID NO: 691150 - DNA, 20 bp, Artificial
  CRISPR gRNA sequence
gagcctttctgtctagtttc

SEQ ID NO: 691151 - DNA, 20 bp, Artificial
  CRISPR gRNA sequence
gcctttctgtctagtttcag

SEQ ID NO: 691152 - DNA, 20 bp, Artificial
  CRISPR gRNA sequence
cctttctgtctagtttcagg

SEQ ID NO: 691153 - DNA, 20 bp, Artificial
  CRISPR gRNA sequence
tcaggaggtgctgattttcc

SEQ ID NO: 691154 - DNA, 20 bp, Artificial
  CRISPR gRNA sequence
gtgctgattttcctggttca

SEQ ID NO: 691155 - DNA, 20 bp, Artificial
  CRISPR gRNA sequence
tgctgattttcctggttcat

SEQ ID NO: 691156 - DNA, 20 bp, Artificial
  CRISPR gRNA sequence
ttttcctggttcatgggtga

SEQ ID NO: 691157 - DNA, 20 bp, Artificial
  CRISPR gRNA sequence
cctggttcatgggtgatagc

SEQ ID NO: 691158 - DNA, 20 bp, Artificial
  CRISPR gRNA sequence
ctggttcatgggtgatagct

SEQ ID NO: 691159 - DNA, 20 bp, Artificial
  CRISPR gRNA sequence
tggttcatgggtgatagctg

SEQ ID NO: 691160 - DNA, 20 bp, Artificial
  CRISPR gRNA sequence
ttcatgggtgatagctgggg

SEQ ID NO: 691161 - DNA, 20 bp, Artificial
  CRISPR gRNA sequence
atgggtgatagctggggtag

SEQ ID NO: 691162 - DNA, 20 bp, Artificial
  CRISPR gRNA sequence
tgggtgatagctggggtagc

SEQ ID NO: 691163 - DNA, 20 bp, Artificial
  CRISPR gRNA sequence
gggtgatagctggggtagca

SEQ ID NO: 691164 - DNA, 20 bp, Artificial
  CRISPR gRNA sequence
ggatctctctttttgtctca

SEQ ID NO: 691165 - DNA, 20 bp, Artificial
  CRISPR gRNA sequence
tctcatagttttctgtatct

SEQ ID NO: 691166 - DNA, 20 bp, Artificial
  CRISPR gRNA sequence
ctcatagttttctgtatcta

SEQ ID NO: 691167 - DNA, 20 bp, Artificial
  CRISPR gRNA sequence
tagttttctgtatctaaggt

SEQ ID NO: 691168 - DNA, 20 bp, Artificial
  CRISPR gRNA sequence
catgtactttttccctaaat

SEQ ID NO: 691169 - DNA, 20 bp, Artificial
  CRISPR gRNA sequence
ctttttccctaaattagtaa

SEQ ID NO: 691170 - DNA, 20 bp, Artificial
  CRISPR gRNA sequence
tttttccctaaattagtaac

SEQ ID NO: 691171 - DNA, 20 bp, Artificial
  CRISPR gRNA sequence
ttttccctaaattagtaaca

SEQ ID NO: 691172 - DNA, 20 bp, Artificial
  CRISPR gRNA sequence
aaattagtaacagggctaat

SEQ ID NO: 691173 - DNA, 20 bp, Artificial
  CRISPR gRNA sequence
gggctaattagtcttttcct

SEQ ID NO: 691174 - DNA, 20 bp, Artificial
  CRISPR gRNA sequence
ggctaattagtcttttcctt

SEQ ID NO: 691175 - DNA, 20 bp, Artificial
  CRISPR gRNA sequence
aaactacattatgtaaaatt

SEQ ID NO: 691176 - DNA, 20 bp, Artificial
  CRISPR gRNA sequence
ttggtatcttaactatttta

SEQ ID NO: 691177 - DNA, 20 bp, Artificial
  CRISPR gRNA sequence
cttaactattttaaagtata

SEQ ID NO: 691178 - DNA, 20 bp, Artificial
  CRISPR gRNA sequence
aactattttaaagtatacag

SEQ ID NO: 691179 - DNA, 20 bp, Artificial
  CRISPR gRNA sequence
ttttaaagtatacagtagta

SEQ ID NO: 691180 - DNA, 20 bp, Artificial
  CRISPR gRNA sequence
cagtattaactgtaaataca

SEQ ID NO: 691181 - DNA, 20 bp, Artificial
  CRISPR gRNA sequence
gtaaatacatagttgtgcaa

SEQ ID NO: 691182 - DNA, 20 bp, Artificial
  CRISPR gRNA sequence
atagttgtgcaacagatctc

SEQ ID NO: 691183 - DNA, 20 bp, Artificial
  CRISPR gRNA sequence
attcatccatccccctcacc

SEQ ID NO: 691184 - DNA, 20 bp, Artificial
  CRISPR gRNA sequence
catccccctcaccgagcccc

SEQ ID NO: 691185 - DNA, 20 bp, Artificial
  CRISPR gRNA sequence
ccccctcaccgagcccctag

SEQ ID NO: 691186 - DNA, 20 bp, Artificial
  CRISPR gRNA sequence
accgagcccctagcagccat

SEQ ID NO: 691187 - DNA, 20 bp, Artificial
  CRISPR gRNA sequence
agcagccattagtctacttt

SEQ ID NO: 691188 - DNA, 20 bp, Artificial
  CRISPR gRNA sequence
ccattagtctactttcagtt

SEQ ID NO: 691189 - DNA, 20 bp, Artificial
  CRISPR gRNA sequence
gtttagacacctcatataaa

SEQ ID NO: 691190 - DNA, 20 bp, Artificial
  CRISPR gRNA sequence
ctcatataaatggaaatgtg

SEQ ID NO: 691191 - DNA, 20 bp, Artificial
  CRISPR gRNA sequence
taaatggaaatgtgcagtat

SEQ ID NO: 691192 - DNA, 20 bp, Artificial
  CRISPR gRNA sequence
aaatggaaatgtgcagtatt

SEQ ID NO: 691193 - DNA, 20 bp, Artificial
  CRISPR gRNA sequence
tattgggttttctttgtgat

SEQ ID NO: 691194 - DNA, 20 bp, Artificial
  CRISPR gRNA sequence
tgtgattggcttattttact

SEQ ID NO: 691195 - DNA, 20 bp, Artificial
  CRISPR gRNA sequence
gattggcttattttacttag

SEQ ID NO: 691196 - DNA, 20 bp, Artificial
  CRISPR gRNA sequence
ttttacttagcagtgtcctt

SEQ ID NO: 691197 - DNA, 20 bp, Artificial
  CRISPR gRNA sequence
tttacttagcagtgtccttc

SEQ ID NO: 691198 - DNA, 20 bp, Artificial
  CRISPR gRNA sequence
cttcaggttcatccctgttg

SEQ ID NO: 691199 - DNA, 20 bp, Artificial
  CRISPR gRNA sequence
tccctgttgcagcctgtgac

SEQ ID NO: 691200 - DNA, 20 bp, Artificial
  CRISPR gRNA sequence
ccctgttgcagcctgtgacc

SEQ ID NO: 691201 - DNA, 20 bp, Artificial
  CRISPR gRNA sequence
tgtgaccaggtttccttctt

SEQ ID NO: 691202 - DNA, 20 bp, Artificial
  CRISPR gRNA sequence
gtgaccaggtttccttctta

SEQ ID NO: 691203 - DNA, 20 bp, Artificial
  CRISPR gRNA sequence
cattttcttcattcatgtgt

SEQ ID NO: 691204 - DNA, 20 bp, Artificial
  CRISPR gRNA sequence
tgtgttggtgtgtgttgtct

SEQ ID NO: 691205 - DNA, 20 bp, Artificial
  CRISPR gRNA sequence
gaataatgctgctttgaata

SEQ ID NO: 691206 - DNA, 20 bp, Artificial
  CRISPR gRNA sequence
aataatgctgctttgaatat

SEQ ID NO: 691207 - DNA, 20 bp, Artificial
  CRISPR gRNA sequence
tttcaaaccttccctcactt

SEQ ID NO: 691208 - DNA, 20 bp, Artificial
  CRISPR gRNA sequence
caaaccttccctcactttgg

SEQ ID NO: 691209 - DNA, 20 bp, Artificial
  CRISPR gRNA sequence
ctttggtggaattaatcctt

SEQ ID NO: 691210 - DNA, 20 bp, Artificial
  CRISPR gRNA sequence
tggtggaattaatcctttag

SEQ ID NO: 691211 - DNA, 20 bp, Artificial
  CRISPR gRNA sequence
cctttagtagctacttctga

SEQ ID NO: 691212 - DNA, 20 bp, Artificial
  CRISPR gRNA sequence
cttctgacagcacatattta

SEQ ID NO: 691213 - DNA, 20 bp, Artificial
  CRISPR gRNA sequence
atatttaaagtatgtttgta

SEQ ID NO: 691214 - DNA, 20 bp, Artificial
  CRISPR gRNA sequence
tccattgtttttattctctc

SEQ ID NO: 691215 - DNA, 20 bp, Artificial
  CRISPR gRNA sequence
ccattgtttttattctctcc

SEQ ID NO: 691216 - DNA, 20 bp, Artificial
  CRISPR gRNA sequence
ttgtttttattctctccagg

SEQ ID NO: 691217 - DNA, 20 bp, Artificial
  CRISPR gRNA sequence
gtttttattctctccaggaa

SEQ ID NO: 691218 - DNA, 20 bp, Artificial
  CRISPR gRNA sequence
tttttattctctccaggaag

SEQ ID NO: 691219 - DNA, 20 bp, Artificial
  CRISPR gRNA sequence
tttattctctccaggaagag

SEQ ID NO: 691220 - DNA, 20 bp, Artificial
  CRISPR gRNA sequence
gaagaggagataaatatatg

SEQ ID NO: 691221 - DNA, 20 bp, Artificial
  CRISPR gRNA sequence
aagaggagataaatatatga

SEQ ID NO: 691222 - DNA, 20 bp, Artificial
  CRISPR gRNA sequence
aaatatatgaaggtgctgtt

SEQ ID NO: 691223 - DNA, 20 bp, Artificial
  CRISPR gRNA sequence
tatgaaggtgctgtttggca

SEQ ID NO: 691224 - DNA, 20 bp, Artificial
  CRISPR gRNA sequence
ctgtttggcacagaatttaa

SEQ ID NO: 691225 - DNA, 20 bp, Artificial
  CRISPR gRNA sequence
tgtttggcacagaatttaat

SEQ ID NO: 691226 - DNA, 20 bp, Artificial
  CRISPR gRNA sequence
gtttggcacagaatttaata

SEQ ID NO: 691227 - DNA, 20 bp, Artificial
  CRISPR gRNA sequence
tggcacagaatttaataggg

SEQ ID NO: 691228 - DNA, 20 bp, Artificial
  CRISPR gRNA sequence
acagaatttaatagggaaga

SEQ ID NO: 691229 - DNA, 20 bp, Artificial
  CRISPR gRNA sequence
agaatttaatagggaagaaa

SEQ ID NO: 691230 - DNA, 20 bp, Artificial
  CRISPR gRNA sequence
tttaatagggaagaaagaga

SEQ ID NO: 691231 - DNA, 20 bp, Artificial
  CRISPR gRNA sequence
aaagagacagtataactcac

SEQ ID NO: 691232 - DNA, 20 bp, Artificial
  CRISPR gRNA sequence
acagtataactcaccagtgc

SEQ ID NO: 691233 - DNA, 20 bp, Artificial
  CRISPR gRNA sequence
cagtataactcaccagtgct

SEQ ID NO: 691234 - DNA, 20 bp, Artificial
  CRISPR gRNA sequence
gtctcatcatcctgcaattt

SEQ ID NO: 691235 - DNA, 20 bp, Artificial
  CRISPR gRNA sequence
agaacaactatgaatacaaa

SEQ ID NO: 691236 - DNA, 20 bp, Artificial
  CRISPR gRNA sequence
caaaaagaattttaaaatcc

SEQ ID NO: 691237 - DNA, 20 bp, Artificial
  CRISPR gRNA sequence
tttaaaatcccagtcctgcc

SEQ ID NO: 691238 - DNA, 20 bp, Artificial
  CRISPR gRNA sequence
aaatcccagtcctgcctaga

SEQ ID NO: 691239 - DNA, 20 bp, Artificial
  CRISPR gRNA sequence
aatcccagtcctgcctagaa

SEQ ID NO: 691240 - DNA, 20 bp, Artificial
  CRISPR gRNA sequence
atcccagtcctgcctagaaa

SEQ ID NO: 691241 - DNA, 20 bp, Artificial
  CRISPR gRNA sequence
tcccagtcctgcctagaaag

SEQ ID NO: 691242 - DNA, 20 bp, Artificial
  CRISPR gRNA sequence
cagtcctgcctagaaagggg

SEQ ID NO: 691243 - DNA, 20 bp, Artificial
  CRISPR gRNA sequence
ggggaagtcatctctaaata

SEQ ID NO: 691244 - DNA, 20 bp, Artificial
  CRISPR gRNA sequence
gaagtcatctctaaatatgg

SEQ ID NO: 691245 - DNA, 20 bp, Artificial
  CRISPR gRNA sequence
atctctaaatatggtggccc

SEQ ID NO: 691246 - DNA, 20 bp, Artificial
  CRISPR gRNA sequence
tctctaaatatggtggccct

SEQ ID NO: 691247 - DNA, 20 bp, Artificial
  CRISPR gRNA sequence
ctctaaatatggtggccctg

SEQ ID NO: 691248 - DNA, 20 bp, Artificial
  CRISPR gRNA sequence
taaatatggtggccctgggg

SEQ ID NO: 691249 - DNA, 20 bp, Artificial
  CRISPR gRNA sequence
tatggtggccctggggcagc

SEQ ID NO: 691250 - DNA, 20 bp, Artificial
  CRISPR gRNA sequence
ggggcagctggcctccctgc

SEQ ID NO: 691251 - DNA, 20 bp, Artificial
  CRISPR gRNA sequence
gggcagctggcctccctgcc

SEQ ID NO: 691252 - DNA, 20 bp, Artificial
  CRISPR gRNA sequence
tccctgccaggcctcttcca

SEQ ID NO: 691253 - DNA, 20 bp, Artificial
  CRISPR gRNA sequence
ccctgccaggcctcttccat

SEQ ID NO: 691254 - DNA, 20 bp, Artificial
  CRISPR gRNA sequence
cctgccaggcctcttccatg

SEQ ID NO: 691255 - DNA, 20 bp, Artificial
  CRISPR gRNA sequence
ctgccaggcctcttccatgg

SEQ ID NO: 691256 - DNA, 20 bp, Artificial
  CRISPR gRNA sequence
ttccatgggggccctttctg

SEQ ID NO: 691257 - DNA, 20 bp, Artificial
  CRISPR gRNA sequence
ggccctttctgcagtgactg

SEQ ID NO: 691258 - DNA, 20 bp, Artificial
  CRISPR gRNA sequence
tctgtcctgtgtcctgactg

SEQ ID NO: 691259 - DNA, 20 bp, Artificial
  CRISPR gRNA sequence
tgtgtcctgactgaagcgac

SEQ ID NO: 691260 - DNA, 20 bp, Artificial
  CRISPR gRNA sequence
gtgtcctgactgaagcgaca

SEQ ID NO: 691261 - DNA, 20 bp, Artificial
  CRISPR gRNA sequence
gaagcgacaaggtgtgtctg

SEQ ID NO: 691262 - DNA, 20 bp, Artificial
  CRISPR gRNA sequence
tctgcagctgtgctcacacc

SEQ ID NO: 691263 - DNA, 20 bp, Artificial
  CRISPR gRNA sequence
tgcagctgtgctcacacctg

SEQ ID NO: 691264 - DNA, 20 bp, Artificial
  CRISPR gRNA sequence
gcagctgtgctcacacctgg

SEQ ID NO: 691265 - DNA, 20 bp, Artificial
  CRISPR gRNA sequence
acacctggaggaaacctcaa

SEQ ID NO: 691266 - DNA, 20 bp, Artificial
  CRISPR gRNA sequence
ggaggaaacctcaatggtgt

SEQ ID NO: 691267 - DNA, 20 bp, Artificial
  CRISPR gRNA sequence
ttgtaaatgtttacttatta

SEQ ID NO: 691268 - DNA, 20 bp, Artificial
  CRISPR gRNA sequence
tgtaaatgtttacttattat

SEQ ID NO: 691269 - DNA, 20 bp, Artificial
  CRISPR gRNA sequence
atgggttattttattattta

SEQ ID NO: 691270 - DNA, 20 bp, Artificial
  CRISPR gRNA sequence
gggttattttattatttatg

SEQ ID NO: 691271 - DNA, 20 bp, Artificial
  CRISPR gRNA sequence
ctactgacaacacaataaac

SEQ ID NO: 691272 - DNA, 20 bp, Artificial
  CRISPR gRNA sequence
tactgacaacacaataaacc

SEQ ID NO: 691273 - DNA, 20 bp, Artificial
  CRISPR gRNA sequence
aaaccaggacatgatgaccc

SEQ ID NO: 691274 - DNA, 20 bp, Artificial
  CRISPR gRNA sequence
ccaggacatgatgaccctag

SEQ ID NO: 691275 - DNA, 20 bp, Artificial
  CRISPR gRNA sequence
cacatcctctttcctgtgtc

SEQ ID NO: 691276 - DNA, 20 bp, Artificial
  CRISPR gRNA sequence
atcctctttcctgtgtcaag

SEQ ID NO: 691277 - DNA, 20 bp, Artificial
  CRISPR gRNA sequence
ctgtgtcaagaagcatcgtc

SEQ ID NO: 691278 - DNA, 20 bp, Artificial
  CRISPR gRNA sequence
tgtgtcaagaagcatcgtcc

SEQ ID NO: 691279 - DNA, 20 bp, Artificial
  CRISPR gRNA sequence
gtgtcaagaagcatcgtccg

SEQ ID NO: 691280 - DNA, 20 bp, Artificial
  CRISPR gRNA sequence
gtcaagaagcatcgtccggg

SEQ ID NO: 691281 - DNA, 20 bp, Artificial
  CRISPR gRNA sequence
tcaagaagcatcgtccgggg

SEQ ID NO: 691282 - DNA, 20 bp, Artificial
  CRISPR gRNA sequence
gaagcatcgtccggggaggt

SEQ ID NO: 691283 - DNA, 20 bp, Artificial
  CRISPR gRNA sequence
gcatcgtccggggaggtgag

SEQ ID NO: 691284 - DNA, 20 bp, Artificial
  CRISPR gRNA sequence
tcgtccggggaggtgagaag

SEQ ID NO: 691285 - DNA, 20 bp, Artificial
  CRISPR gRNA sequence
ccggggaggtgagaagaaga

SEQ ID NO: 691286 - DNA, 20 bp, Artificial
  CRISPR gRNA sequence
gagaagaagacagtcctccc

SEQ ID NO: 691287 - DNA, 20 bp, Artificial
  CRISPR gRNA sequence
gacagtcctccctagaattg

SEQ ID NO: 691288 - DNA, 20 bp, Artificial
  CRISPR gRNA sequence
cctccctagaattgaagaac

SEQ ID NO: 691289 - DNA, 20 bp, Artificial
  CRISPR gRNA sequence
ctccctagaattgaagaacc

SEQ ID NO: 691290 - DNA, 20 bp, Artificial
  CRISPR gRNA sequence
tccctagaattgaagaacca

SEQ ID NO: 691291 - DNA, 20 bp, Artificial
  CRISPR gRNA sequence
cctagaattgaagaaccagg

SEQ ID NO: 691292 - DNA, 20 bp, Artificial
  CRISPR gRNA sequence
agaattgaagaaccagggag

SEQ ID NO: 691293 - DNA, 20 bp, Artificial
  CRISPR gRNA sequence
attgaagaaccagggagaag

SEQ ID NO: 691294 - DNA, 20 bp, Artificial
  CRISPR gRNA sequence
aagaaccagggagaagcaga

SEQ ID NO: 691295 - DNA, 20 bp, Artificial
  CRISPR gRNA sequence
agaaccagggagaagcagat

SEQ ID NO: 691296 - DNA, 20 bp, Artificial
  CRISPR gRNA sequence
ccagggagaagcagatgggc

SEQ ID NO: 691297 - DNA, 20 bp, Artificial
  CRISPR gRNA sequence
cagggagaagcagatgggct

SEQ ID NO: 691298 - DNA, 20 bp, Artificial
  CRISPR gRNA sequence
ggagaagcagatgggctggg

SEQ ID NO: 691299 - DNA, 20 bp, Artificial
  CRISPR gRNA sequence
gagaagcagatgggctgggc

SEQ ID NO: 691300 - DNA, 20 bp, Artificial
  CRISPR gRNA sequence
aagcagatgggctgggcagg

SEQ ID NO: 691301 - DNA, 20 bp, Artificial
  CRISPR gRNA sequence
agcagatgggctgggcaggt

SEQ ID NO: 691302 - DNA, 20 bp, Artificial
  CRISPR gRNA sequence
tgggcaggtgggttttcacc

SEQ ID NO: 691303 - DNA, 20 bp, Artificial
  CRISPR gRNA sequence
gtgggttttcacctggaacc

SEQ ID NO: 691304 - DNA, 20 bp, Artificial
  CRISPR gRNA sequence
gggttttcacctggaacctg

SEQ ID NO: 691305 - DNA, 20 bp, Artificial
  CRISPR gRNA sequence
ggttttcacctggaacctgg

SEQ ID NO: 691306 - DNA, 20 bp, Artificial
  CRISPR gRNA sequence
tcacctggaacctggaggat

SEQ ID NO: 691307 - DNA, 20 bp, Artificial
  CRISPR gRNA sequence
caatgacatctctccaccct

SEQ ID NO: 691308 - DNA, 20 bp, Artificial
  CRISPR gRNA sequence
acatctctccaccctgagct

SEQ ID NO: 691309 - DNA, 20 bp, Artificial
  CRISPR gRNA sequence
tctccaccctgagctcagcc

SEQ ID NO: 691310 - DNA, 20 bp, Artificial
  CRISPR gRNA sequence
ctccaccctgagctcagcct

SEQ ID NO: 691311 - DNA, 20 bp, Artificial
  CRISPR gRNA sequence
cagcctgggcatccacctcc

SEQ ID NO: 691312 - DNA, 20 bp, Artificial
  CRISPR gRNA sequence
agcctgggcatccacctcct

SEQ ID NO: 691313 - DNA, 20 bp, Artificial
  CRISPR gRNA sequence
catccacctcctgggctcat

SEQ ID NO: 691314 - DNA, 20 bp, Artificial
  CRISPR gRNA sequence
ccacctcctgggctcatgag

SEQ ID NO: 691315 - DNA, 20 bp, Artificial
  CRISPR gRNA sequence
tcctgggctcatgagcagtg

SEQ ID NO: 691316 - DNA, 20 bp, Artificial
  CRISPR gRNA sequence
tgggctcatgagcagtgcag

SEQ ID NO: 691317 - DNA, 20 bp, Artificial
  CRISPR gRNA sequence
agcagtgcagtggtgcctcc

SEQ ID NO: 691318 - DNA, 20 bp, Artificial
  CRISPR gRNA sequence
agtgcagtggtgcctcctag

SEQ ID NO: 691319 - DNA, 20 bp, Artificial
  CRISPR gRNA sequence
ggtctctgctcttccttttc

SEQ ID NO: 691320 - DNA, 20 bp, Artificial
  CRISPR gRNA sequence
tgctcttccttttccagatc

SEQ ID NO: 691321 - DNA, 20 bp, Artificial
  CRISPR gRNA sequence
tccagatcaagcacaaacct

SEQ ID NO: 691322 - DNA, 20 bp, Artificial
  CRISPR gRNA sequence
aactgtccctcttatgcgcc

SEQ ID NO: 691323 - DNA, 20 bp, Artificial
  CRISPR gRNA sequence
actgtccctcttatgcgcct

SEQ ID NO: 691324 - DNA, 20 bp, Artificial
  CRISPR gRNA sequence
atgcgcctgggtttcttcac

SEQ ID NO: 691325 - DNA, 20 bp, Artificial
  CRISPR gRNA sequence
tgggtttcttcactggacac

SEQ ID NO: 691326 - DNA, 20 bp, Artificial
  CRISPR gRNA sequence
tcttcactggacaccagtat

SEQ ID NO: 691327 - DNA, 20 bp, Artificial
  CRISPR gRNA sequence
tatgagtcaactttcctgta

SEQ ID NO: 691328 - DNA, 20 bp, Artificial
  CRISPR gRNA sequence
gagtcaactttcctgtaaag

SEQ ID NO: 691329 - DNA, 20 bp, Artificial
  CRISPR gRNA sequence
actttcctgtaaagcagaac

SEQ ID NO: 691330 - DNA, 20 bp, Artificial
  CRISPR gRNA sequence
ctgtaaagcagaacaagcac

SEQ ID NO: 691331 - DNA, 20 bp, Artificial
  CRISPR gRNA sequence
aagcagaacaagcacgagat

SEQ ID NO: 691332 - DNA, 20 bp, Artificial
  CRISPR gRNA sequence
agcacgagattggaccatgt

SEQ ID NO: 691333 - DNA, 20 bp, Artificial
  CRISPR gRNA sequence
cacgagattggaccatgtta

SEQ ID NO: 691334 - DNA, 20 bp, Artificial
  CRISPR gRNA sequence
acgagattggaccatgttag

SEQ ID NO: 691335 - DNA, 20 bp, Artificial
  CRISPR gRNA sequence
gagattggaccatgttagag

SEQ ID NO: 691336 - DNA, 20 bp, Artificial
  CRISPR gRNA sequence
agattggaccatgttagagg

SEQ ID NO: 691337 - DNA, 20 bp, Artificial
  CRISPR gRNA sequence
ggaccatgttagaggaggaa

SEQ ID NO: 691338 - DNA, 20 bp, Artificial
  CRISPR gRNA sequence
aatggtgtcatctccacttc

SEQ ID NO: 691339 - DNA, 20 bp, Artificial
  CRISPR gRNA sequence
tggtgtcatctccacttctg

SEQ ID NO: 691340 - DNA, 20 bp, Artificial
  CRISPR gRNA sequence
gtgtcatctccacttctgga

SEQ ID NO: 691341 - DNA, 20 bp, Artificial
  CRISPR gRNA sequence
gagatccctgtccccgtgtt

SEQ ID NO: 691342 - DNA, 20 bp, Artificial
  CRISPR gRNA sequence
agatccctgtccccgtgttc

SEQ ID NO: 691343 - DNA, 20 bp, Artificial
  CRISPR gRNA sequence
gatccctgtccccgtgttcg

SEQ ID NO: 691344 - DNA, 20 bp, Artificial
  CRISPR gRNA sequence
atccctgtccccgtgttcgg

SEQ ID NO: 691345 - DNA, 20 bp, Artificial
  CRISPR gRNA sequence
cctgtccccgtgttcggggg

SEQ ID NO: 691346 - DNA, 20 bp, Artificial
  CRISPR gRNA sequence
ctgtccccgtgttcggggga

SEQ ID NO: 691347 - DNA, 20 bp, Artificial
  CRISPR gRNA sequence
ccgtgttcgggggaaggacc

SEQ ID NO: 691348 - DNA, 20 bp, Artificial
  CRISPR gRNA sequence
gaccaagcctcactcccatg

SEQ ID NO: 691349 - DNA, 20 bp, Artificial
  CRISPR gRNA sequence
ccaagcctcactcccatgca

SEQ ID NO: 691350 - DNA, 20 bp, Artificial
  CRISPR gRNA sequence
agcctcactcccatgcagag

SEQ ID NO: 691351 - DNA, 20 bp, Artificial
  CRISPR gRNA sequence
cctcactcccatgcagagaa

SEQ ID NO: 691352 - DNA, 20 bp, Artificial
  CRISPR gRNA sequence
ctcactcccatgcagagaag

SEQ ID NO: 691353 - DNA, 20 bp, Artificial
  CRISPR gRNA sequence
tctgactgtaactgcacctg

SEQ ID NO: 691354 - DNA, 20 bp, Artificial
  CRISPR gRNA sequence
tgactgtaactgcacctgtg

SEQ ID NO: 691355 - DNA, 20 bp, Artificial
  CRISPR gRNA sequence
actgtaactgcacctgtgga

SEQ ID NO: 691356 - DNA, 20 bp, Artificial
  CRISPR gRNA sequence
ctgtaactgcacctgtggag

SEQ ID NO: 691357 - DNA, 20 bp, Artificial
  CRISPR gRNA sequence
aactgcacctgtggagaggt

SEQ ID NO: 691358 - DNA, 20 bp, Artificial
  CRISPR gRNA sequence
actgcacctgtggagaggtg

SEQ ID NO: 691359 - DNA, 20 bp, Artificial
  CRISPR gRNA sequence
acctgtcccctctacaccga

SEQ ID NO: 691360 - DNA, 20 bp, Artificial
  CRISPR gRNA sequence
gtcccctctacaccgatggc

SEQ ID NO: 691361 - DNA, 20 bp, Artificial
  CRISPR gRNA sequence
cccctctacaccgatggcca

SEQ ID NO: 691362 - DNA, 20 bp, Artificial
  CRISPR gRNA sequence
acaccgatggccagagcctc

SEQ ID NO: 691363 - DNA, 20 bp, Artificial
  CRISPR gRNA sequence
accgatggccagagcctcca

SEQ ID NO: 691364 - DNA, 20 bp, Artificial
  CRISPR gRNA sequence
gatggccagagcctccagag

SEQ ID NO: 691365 - DNA, 20 bp, Artificial
  CRISPR gRNA sequence
atggccagagcctccagagt

SEQ ID NO: 691366 - DNA, 20 bp, Artificial
  CRISPR gRNA sequence
tggccagagcctccagagtg

SEQ ID NO: 691367 - DNA, 20 bp, Artificial
  CRISPR gRNA sequence
cagagcctccagagtggggc

SEQ ID NO: 691368 - DNA, 20 bp, Artificial
  CRISPR gRNA sequence
agagcctccagagtggggcc

SEQ ID NO: 691369 - DNA, 20 bp, Artificial
  CRISPR gRNA sequence
gtggggccaggtttttccct

SEQ ID NO: 691370 - DNA, 20 bp, Artificial
  CRISPR gRNA sequence
ttccctcagctgtgtcctgt

SEQ ID NO: 691371 - DNA, 20 bp, Artificial
  CRISPR gRNA sequence
tccctcagctgtgtcctgtc

SEQ ID NO: 691372 - DNA, 20 bp, Artificial
  CRISPR gRNA sequence
tgtgtcctgtcaggttcatc

SEQ ID NO: 691373 - DNA, 20 bp, Artificial
  CRISPR gRNA sequence
gtgtcctgtcaggttcatct

SEQ ID NO: 691374 - DNA, 20 bp, Artificial
  CRISPR gRNA sequence
tcaggttcatctaggcctca

SEQ ID NO: 691375 - DNA, 20 bp, Artificial
  CRISPR gRNA sequence
ttcatctaggcctcaaagaa

SEQ ID NO: 691376 - DNA, 20 bp, Artificial
  CRISPR gRNA sequence
aggcctcaaagaatagaccc

SEQ ID NO: 691377 - DNA, 20 bp, Artificial
  CRISPR gRNA sequence
tagaccctggacattgcctc

SEQ ID NO: 691378 - DNA, 20 bp, Artificial
  CRISPR gRNA sequence
gacattgcctctggcaatgt

SEQ ID NO: 691379 - DNA, 20 bp, Artificial
  CRISPR gRNA sequence
ttgcctctggcaatgtgagc

SEQ ID NO: 691380 - DNA, 20 bp, Artificial
  CRISPR gRNA sequence
atgtgagctggacacacacc

SEQ ID NO: 691381 - DNA, 20 bp, Artificial
  CRISPR gRNA sequence
ctggacacacacccagatgt

SEQ ID NO: 691382 - DNA, 20 bp, Artificial
  CRISPR gRNA sequence
tggacacacacccagatgta

SEQ ID NO: 691383 - DNA, 20 bp, Artificial
  CRISPR gRNA sequence
acacacacccagatgtaagg

SEQ ID NO: 691384 - DNA, 20 bp, Artificial
  CRISPR gRNA sequence
agatgtaaggtagccctgcc

SEQ ID NO: 691385 - DNA, 20 bp, Artificial
  CRISPR gRNA sequence
ggtagccctgccaagtatcc

SEQ ID NO: 691386 - DNA, 20 bp, Artificial
  CRISPR gRNA sequence
gtagccctgccaagtatcct

SEQ ID NO: 691387 - DNA, 20 bp, Artificial
  CRISPR gRNA sequence
tagccctgccaagtatcctg

SEQ ID NO: 691388 - DNA, 20 bp, Artificial
  CRISPR gRNA sequence
gccaagtatcctggggttgc

SEQ ID NO: 691389 - DNA, 20 bp, Artificial
  CRISPR gRNA sequence
aagtatcctggggttgccag

SEQ ID NO: 691390 - DNA, 20 bp, Artificial
  CRISPR gRNA sequence
cctggggttgccagtagttc

SEQ ID NO: 691391 - DNA, 20 bp, Artificial
  CRISPR gRNA sequence
ctggggttgccagtagttct

SEQ ID NO: 691392 - DNA, 20 bp, Artificial
  CRISPR gRNA sequence
tgccagtagttctgggtgct

SEQ ID NO: 691393 - DNA, 20 bp, Artificial
  CRISPR gRNA sequence
agttctgggtgctcagtgtc

SEQ ID NO: 691394 - DNA, 20 bp, Artificial
  CRISPR gRNA sequence
ttctgggtgctcagtgtctg

SEQ ID NO: 691395 - DNA, 20 bp, Artificial
  CRISPR gRNA sequence
tgggtgctcagtgtctggag

SEQ ID NO: 691396 - DNA, 20 bp, Artificial
  CRISPR gRNA sequence
ggtgctcagtgtctggagcg

SEQ ID NO: 691397 - DNA, 20 bp, Artificial
  CRISPR gRNA sequence
gtgctcagtgtctggagcgg

SEQ ID NO: 691398 - DNA, 20 bp, Artificial
  CRISPR gRNA sequence
tgctcagtgtctggagcgga

SEQ ID NO: 691399 - DNA, 20 bp, Artificial
  CRISPR gRNA sequence
tcagtgtctggagcggaggg

SEQ ID NO: 691400 - DNA, 20 bp, Artificial
  CRISPR gRNA sequence
cagtgtctggagcggagggt

SEQ ID NO: 691401 - DNA, 20 bp, Artificial
  CRISPR gRNA sequence
tgtctggagcggagggtggg

SEQ ID NO: 691402 - DNA, 20 bp, Artificial
  CRISPR gRNA sequence
gtctggagcggagggtggga

SEQ ID NO: 691403 - DNA, 20 bp, Artificial
  CRISPR gRNA sequence
ctggagcggagggtgggaag

SEQ ID NO: 691404 - DNA, 20 bp, Artificial
  CRISPR gRNA sequence
tggagcggagggtgggaagg

SEQ ID NO: 691405 - DNA, 20 bp, Artificial
  CRISPR gRNA sequence
cggagggtgggaaggaggct

SEQ ID NO: 691406 - DNA, 20 bp, Artificial
  CRISPR gRNA sequence
ggtgggaaggaggcttggtg

SEQ ID NO: 691407 - DNA, 20 bp, Artificial
  CRISPR gRNA sequence
aaggaggcttggtgcagaac

SEQ ID NO: 691408 - DNA, 20 bp, Artificial
  CRISPR gRNA sequence
catactattttattctttat

SEQ ID NO: 691409 - DNA, 20 bp, Artificial
  CRISPR gRNA sequence
ttttgtcataaaaaacccca

SEQ ID NO: 691410 - DNA, 20 bp, Artificial
  CRISPR gRNA sequence
tttgtcataaaaaaccccac

SEQ ID NO: 691411 - DNA, 20 bp, Artificial
  CRISPR gRNA sequence
aaaccccacgggtaccataa

SEQ ID NO: 691412 - DNA, 20 bp, Artificial
  CRISPR gRNA sequence
acgggtaccataaaagataa

SEQ ID NO: 691413 - DNA, 20 bp, Artificial
  CRISPR gRNA sequence
aaagataaaagatctaaaaa

SEQ ID NO: 691414 - DNA, 20 bp, Artificial
  CRISPR gRNA sequence
aaatagtgccctttaatcaa

SEQ ID NO: 691415 - DNA, 20 bp, Artificial
  CRISPR gRNA sequence
agtaaacaccctttaaccat

SEQ ID NO: 691416 - DNA, 20 bp, Artificial
  CRISPR gRNA sequence
taaacaccctttaaccatca

SEQ ID NO: 691417 - DNA, 20 bp, Artificial
  CRISPR gRNA sequence
aacaccctttaaccatcaga

SEQ ID NO: 691418 - DNA, 20 bp, Artificial
  CRISPR gRNA sequence
caccctttaaccatcagaga

SEQ ID NO: 691419 - DNA, 20 bp, Artificial
  CRISPR gRNA sequence
accctttaaccatcagagag

SEQ ID NO: 691420 - DNA, 20 bp, Artificial
  CRISPR gRNA sequence
ccctttaaccatcagagaga

SEQ ID NO: 691421 - DNA, 20 bp, Artificial
  CRISPR gRNA sequence
ctttaaccatcagagagagg

SEQ ID NO: 691422 - DNA, 20 bp, Artificial
  CRISPR gRNA sequence
taaccatcagagagagggag

SEQ ID NO: 691423 - DNA, 20 bp, Artificial
  CRISPR gRNA sequence
atcagagagagggagaagtt

SEQ ID NO: 691424 - DNA, 20 bp, Artificial
  CRISPR gRNA sequence
agagagagggagaagtttgg

SEQ ID NO: 691425 - DNA, 20 bp, Artificial
  CRISPR gRNA sequence
gagaagtttggcagctgacc

SEQ ID NO: 691426 - DNA, 20 bp, Artificial
  CRISPR gRNA sequence
aagtttggcagctgacctag

SEQ ID NO: 691427 - DNA, 20 bp, Artificial
  CRISPR gRNA sequence
agaagccccatcaactgccc

SEQ ID NO: 691428 - DNA, 20 bp, Artificial
  CRISPR gRNA sequence
ctcttctcttcttcaaataa

SEQ ID NO: 691429 - DNA, 20 bp, Artificial
  CRISPR gRNA sequence
cttcaaataaaagcacatcc

SEQ ID NO: 691430 - DNA, 20 bp, Artificial
  CRISPR gRNA sequence
aaagcacatcctggcttaca

SEQ ID NO: 691431 - DNA, 20 bp, Artificial
  CRISPR gRNA sequence
atttttatcatctaaaatta

SEQ ID NO: 691432 - DNA, 20 bp, Artificial
  CRISPR gRNA sequence
tatcatctaaaattatagtt

SEQ ID NO: 691433 - DNA, 20 bp, Artificial
  CRISPR gRNA sequence
tatagtttagttttaccttt

SEQ ID NO: 691434 - DNA, 20 bp, Artificial
  CRISPR gRNA sequence
tagtttagttttacctttaa

SEQ ID NO: 691435 - DNA, 20 bp, Artificial
  CRISPR gRNA sequence
ttttatcctcatttattcca

SEQ ID NO: 691436 - DNA, 20 bp, Artificial
  CRISPR gRNA sequence
tgcttgaaatttatattgtc

SEQ ID NO: 691437 - DNA, 20 bp, Artificial
  CRISPR gRNA sequence
ttgaaatttatattgtctgg

SEQ ID NO: 691438 - DNA, 20 bp, Artificial
  CRISPR gRNA sequence
ttcctgtcctttgcattttg

SEQ ID NO: 691439 - DNA, 20 bp, Artificial
  CRISPR gRNA sequence
cattttgcagattgcacccc

SEQ ID NO: 691440 - DNA, 20 bp, Artificial
  CRISPR gRNA sequence
attttgcagattgcacccca

SEQ ID NO: 691441 - DNA, 20 bp, Artificial
  CRISPR gRNA sequence
gcagattgcaccccaaggtg

SEQ ID NO: 691442 - DNA, 20 bp, Artificial
  CRISPR gRNA sequence
gacctgtattttctgtaaat

SEQ ID NO: 691443 - DNA, 20 bp, Artificial
  CRISPR gRNA sequence
ctgtattttctgtaaattgg

SEQ ID NO: 691444 - DNA, 20 bp, Artificial
  CRISPR gRNA sequence
tgtaaattggtagtttgtta

SEQ ID NO: 691445 - DNA, 20 bp, Artificial
  CRISPR gRNA sequence
taaattggtagtttgttata

SEQ ID NO: 691446 - DNA, 20 bp, Artificial
  CRISPR gRNA sequence
aaattggtagtttgttatag

SEQ ID NO: 691447 - DNA, 20 bp, Artificial
  CRISPR gRNA sequence
tatagaggtttgcgtctatt

SEQ ID NO: 691448 - DNA, 20 bp, Artificial
  CRISPR gRNA sequence
atagaggtttgcgtctattc

SEQ ID NO: 691449 - DNA, 20 bp, Artificial
  CRISPR gRNA sequence
tagaggtttgcgtctattca

SEQ ID NO: 691450 - DNA, 20 bp, Artificial
  CRISPR gRNA sequence
tttttttttttttttgccat

SEQ ID NO: 691451 - DNA, 20 bp, Artificial
  CRISPR gRNA sequence
ttttttttttttttgccatg

SEQ ID NO: 691452 - DNA, 20 bp, Artificial
  CRISPR gRNA sequence
ttttttgccatgaggattga

SEQ ID NO: 691453 - DNA, 20 bp, Artificial
  CRISPR gRNA sequence
actatatcatgtttttcatc

SEQ ID NO: 691454 - DNA, 20 bp, Artificial
  CRISPR gRNA sequence
tatatcatgtttttcatcaa

SEQ ID NO: 691455 - DNA, 20 bp, Artificial
  CRISPR gRNA sequence
atatcatgtttttcatcaag

SEQ ID NO: 691456 - DNA, 20 bp, Artificial
  CRISPR gRNA sequence
tcatgtttttcatcaagagg

SEQ ID NO: 691457 - DNA, 20 bp, Artificial
  CRISPR gRNA sequence
caagaggaagaattcaatac

SEQ ID NO: 691458 - DNA, 20 bp, Artificial
  CRISPR gRNA sequence
tgttaattgccattgctgtt

SEQ ID NO: 691459 - DNA, 20 bp, Artificial
  CRISPR gRNA sequence
taattgccattgctgttcag

SEQ ID NO: 691460 - DNA, 20 bp, Artificial
  CRISPR gRNA sequence
taattcattacaaattgcaa

SEQ ID NO: 691461 - DNA, 20 bp, Artificial
  CRISPR gRNA sequence
attacaaattgcaaaagtct

SEQ ID NO: 691462 - DNA, 20 bp, Artificial
  CRISPR gRNA sequence
tttcatttcttttcatatgc

SEQ ID NO: 691463 - DNA, 20 bp, Artificial
  CRISPR gRNA sequence
ctgcataatttctaaaataa

SEQ ID NO: 691464 - DNA, 20 bp, Artificial
  CRISPR gRNA sequence
aaagatttaccctcttccac

SEQ ID NO: 691465 - DNA, 20 bp, Artificial
  CRISPR gRNA sequence
tcttccaccagttatctatt

SEQ ID NO: 691466 - DNA, 20 bp, Artificial
  CRISPR gRNA sequence
tccaccagttatctattcag

SEQ ID NO: 691467 - DNA, 20 bp, Artificial
  CRISPR gRNA sequence
tcagtagaaacttgtttttt

SEQ ID NO: 691468 - DNA, 20 bp, Artificial
  CRISPR gRNA sequence
agtagaaacttgttttttga

SEQ ID NO: 691469 - DNA, 20 bp, Artificial
  CRISPR gRNA sequence
gttttttgagagactaaacc

SEQ ID NO: 691470 - DNA, 20 bp, Artificial
  CRISPR gRNA sequence
gtttctaatcacctatgacc

SEQ ID NO: 691471 - DNA, 20 bp, Artificial
  CRISPR gRNA sequence
cactttttgttatataccaa

SEQ ID NO: 691472 - DNA, 20 bp, Artificial
  CRISPR gRNA sequence
atatatgaaaatattattta

SEQ ID NO: 691473 - DNA, 20 bp, Artificial
  CRISPR gRNA sequence
tatgaaaatattatttatag

SEQ ID NO: 691474 - DNA, 20 bp, Artificial
  CRISPR gRNA sequence
atttatagcagcacgatttg

SEQ ID NO: 691475 - DNA, 20 bp, Artificial
  CRISPR gRNA sequence
acaacacaaatgtctatcaa

SEQ ID NO: 691476 - DNA, 20 bp, Artificial
  CRISPR gRNA sequence
acacaaatgtctatcaacag

SEQ ID NO: 691477 - DNA, 20 bp, Artificial
  CRISPR gRNA sequence
acaaatgtctatcaacagtg

SEQ ID NO: 691478 - DNA, 20 bp, Artificial
  CRISPR gRNA sequence
aaatgtctatcaacagtgga

SEQ ID NO: 691479 - DNA, 20 bp, Artificial
  CRISPR gRNA sequence
tctatcaacagtggagagac

SEQ ID NO: 691480 - DNA, 20 bp, Artificial
  CRISPR gRNA sequence
atcaacagtggagagacaag

SEQ ID NO: 691481 - DNA, 20 bp, Artificial
  CRISPR gRNA sequence
agtggagagacaagaagtgt

SEQ ID NO: 691482 - DNA, 20 bp, Artificial
  CRISPR gRNA sequence
agaagtgtgagctatttata

SEQ ID NO: 691483 - DNA, 20 bp, Artificial
  CRISPR gRNA sequence
tgtgagctatttataaagct

SEQ ID NO: 691484 - DNA, 20 bp, Artificial
  CRISPR gRNA sequence
agctgagcacctgactgccg

SEQ ID NO: 691485 - DNA, 20 bp, Artificial
  CRISPR gRNA sequence
gctgagcacctgactgccgc

SEQ ID NO: 691486 - DNA, 20 bp, Artificial
  CRISPR gRNA sequence
tgagcacctgactgccgcgg

SEQ ID NO: 691487 - DNA, 20 bp, Artificial
  CRISPR gRNA sequence
ctgactgccgcgggagtgaa

SEQ ID NO: 691488 - DNA, 20 bp, Artificial
  CRISPR gRNA sequence
gagtgaatagtgaccacaca

SEQ ID NO: 691489 - DNA, 20 bp, Artificial
  CRISPR gRNA sequence
gaatagtgaccacacacagc

SEQ ID NO: 691490 - DNA, 20 bp, Artificial
  CRISPR gRNA sequence
tgaccacacacagcaagacc

SEQ ID NO: 691491 - DNA, 20 bp, Artificial
  CRISPR gRNA sequence
gaccacacacagcaagacct

SEQ ID NO: 691492 - DNA, 20 bp, Artificial
  CRISPR gRNA sequence
acacagcaagacctgggaca

SEQ ID NO: 691493 - DNA, 20 bp, Artificial
  CRISPR gRNA sequence
cagcaagacctgggacatgg

SEQ ID NO: 691494 - DNA, 20 bp, Artificial
  CRISPR gRNA sequence
gacatggcagtgactgtgtc

SEQ ID NO: 691495 - DNA, 20 bp, Artificial
  CRISPR gRNA sequence
gtgactgtgtccagaactga

SEQ ID NO: 691496 - DNA, 20 bp, Artificial
  CRISPR gRNA sequence
acagaactaatctatcatat

SEQ ID NO: 691497 - DNA, 20 bp, Artificial
  CRISPR gRNA sequence
aatctatcatattagaaatc

SEQ ID NO: 691498 - DNA, 20 bp, Artificial
  CRISPR gRNA sequence
tatcatattagaaatcaaga

SEQ ID NO: 691499 - DNA, 20 bp, Artificial
  CRISPR gRNA sequence
aatcaagaaagtgtctgctc

SEQ ID NO: 691500 - DNA, 20 bp, Artificial
  CRISPR gRNA sequence
atcaagaaagtgtctgctct

SEQ ID NO: 691501 - DNA, 20 bp, Artificial
  CRISPR gRNA sequence
tcaagaaagtgtctgctcta

SEQ ID NO: 691502 - DNA, 20 bp, Artificial
  CRISPR gRNA sequence
gaaagtgtctgctctagggt

SEQ ID NO: 691503 - DNA, 20 bp, Artificial
  CRISPR gRNA sequence
aaagtgtctgctctagggtt

SEQ ID NO: 691504 - DNA, 20 bp, Artificial
  CRISPR gRNA sequence
aagtgtctgctctagggttg

SEQ ID NO: 691505 - DNA, 20 bp, Artificial
  CRISPR gRNA sequence
gtgtctgctctagggttggg

SEQ ID NO: 691506 - DNA, 20 bp, Artificial
  CRISPR gRNA sequence
tgtctgctctagggttgggg

SEQ ID NO: 691507 - DNA, 20 bp, Artificial
  CRISPR gRNA sequence
gtctgctctagggttgggga

SEQ ID NO: 691508 - DNA, 20 bp, Artificial
  CRISPR gRNA sequence
ggggagggtgatttatgacc

SEQ ID NO: 691509 - DNA, 20 bp, Artificial
  CRISPR gRNA sequence
gagggtgatttatgaccaag

SEQ ID NO: 691510 - DNA, 20 bp, Artificial
  CRISPR gRNA sequence
atttatgaccaagtagaacc

SEQ ID NO: 691511 - DNA, 20 bp, Artificial
  CRISPR gRNA sequence
tatgaccaagtagaacccag

SEQ ID NO: 691512 - DNA, 20 bp, Artificial
  CRISPR gRNA sequence
tagaacccagtggtgtttcc

SEQ ID NO: 691513 - DNA, 20 bp, Artificial
  CRISPR gRNA sequence
gaacccagtggtgtttcctg

SEQ ID NO: 691514 - DNA, 20 bp, Artificial
  CRISPR gRNA sequence
aacccagtggtgtttcctgg

SEQ ID NO: 691515 - DNA, 20 bp, Artificial
  CRISPR gRNA sequence
cagtggtgtttcctggaggc

SEQ ID NO: 691516 - DNA, 20 bp, Artificial
  CRISPR gRNA sequence
ggcaatgctattccttgatg

SEQ ID NO: 691517 - DNA, 20 bp, Artificial
  CRISPR gRNA sequence
gatgtggctgctatttacct

SEQ ID NO: 691518 - DNA, 20 bp, Artificial
  CRISPR gRNA sequence
gttcactttgtgaaaatcca

SEQ ID NO: 691519 - DNA, 20 bp, Artificial
  CRISPR gRNA sequence
gaaaatccacggcccactta

SEQ ID NO: 691520 - DNA, 20 bp, Artificial
  CRISPR gRNA sequence
atgcatgttgtccttcattc

SEQ ID NO: 691521 - DNA, 20 bp, Artificial
  CRISPR gRNA sequence
gttttgaaacaattctctct

SEQ ID NO: 691522 - DNA, 20 bp, Artificial
  CRISPR gRNA sequence
caattctctctaagctaata

SEQ ID NO: 691523 - DNA, 20 bp, Artificial
  CRISPR gRNA sequence
tatagaatctccattactga

SEQ ID NO: 691524 - DNA, 20 bp, Artificial
  CRISPR gRNA sequence
tctccattactgaaagtcct

SEQ ID NO: 691525 - DNA, 20 bp, Artificial
  CRISPR gRNA sequence
agtccttagaaatgctgcat

SEQ ID NO: 691526 - DNA, 20 bp, Artificial
  CRISPR gRNA sequence
aatgctgcattggaaaaaat

SEQ ID NO: 691527 - DNA, 20 bp, Artificial
  CRISPR gRNA sequence
atgaaataaatgctgtgact

SEQ ID NO: 691528 - DNA, 20 bp, Artificial
  CRISPR gRNA sequence
aatgctgtgactcagacatt

SEQ ID NO: 691529 - DNA, 20 bp, Artificial
  CRISPR gRNA sequence
tgctgtgactcagacattaa

SEQ ID NO: 691530 - DNA, 20 bp, Artificial
  CRISPR gRNA sequence
gctgtgactcagacattaag

SEQ ID NO: 691531 - DNA, 20 bp, Artificial
  CRISPR gRNA sequence
tgtgactcagacattaagag

SEQ ID NO: 691532 - DNA, 20 bp, Artificial
  CRISPR gRNA sequence
ttaagaggagaatctacaac

SEQ ID NO: 691533 - DNA, 20 bp, Artificial
  CRISPR gRNA sequence
aagaggagaatctacaacaa

SEQ ID NO: 691534 - DNA, 20 bp, Artificial
  CRISPR gRNA sequence
aggagaatctacaacaagag

SEQ ID NO: 691535 - DNA, 20 bp, Artificial
  CRISPR gRNA sequence
agaatctacaacaagagcag

SEQ ID NO: 691536 - DNA, 20 bp, Artificial
  CRISPR gRNA sequence
gaatctacaacaagagcagt

SEQ ID NO: 691537 - DNA, 20 bp, Artificial
  CRISPR gRNA sequence
tacaacaagagcagtaggct

SEQ ID NO: 691538 - DNA, 20 bp, Artificial
  CRISPR gRNA sequence
acaacaagagcagtaggctt

SEQ ID NO: 691539 - DNA, 20 bp, Artificial
  CRISPR gRNA sequence
aacaagagcagtaggcttgg

SEQ ID NO: 691540 - DNA, 20 bp, Artificial
  CRISPR gRNA sequence
gtaggcttgggagctaacac

SEQ ID NO: 691541 - DNA, 20 bp, Artificial
  CRISPR gRNA sequence
cttgggagctaacacaagaa

SEQ ID NO: 691542 - DNA, 20 bp, Artificial
  CRISPR gRNA sequence
agctaacacaagaacagctt

SEQ ID NO: 691543 - DNA, 20 bp, Artificial
  CRISPR gRNA sequence
cacaagaacagctttggaaa

SEQ ID NO: 691544 - DNA, 20 bp, Artificial
  CRISPR gRNA sequence
cagctttggaaatggctgtt

SEQ ID NO: 691545 - DNA, 20 bp, Artificial
  CRISPR gRNA sequence
tttggaaatggctgttgagc

SEQ ID NO: 691546 - DNA, 20 bp, Artificial
  CRISPR gRNA sequence
ttggaaatggctgttgagcc

SEQ ID NO: 691547 - DNA, 20 bp, Artificial
  CRISPR gRNA sequence
atggctgttgagccaggaac

SEQ ID NO: 691548 - DNA, 20 bp, Artificial
  CRISPR gRNA sequence
tggctgttgagccaggaact

SEQ ID NO: 691549 - DNA, 20 bp, Artificial
  CRISPR gRNA sequence
actaggaatcaaaacccaaa

SEQ ID NO: 691550 - DNA, 20 bp, Artificial
  CRISPR gRNA sequence
ctaggaatcaaaacccaaaa

SEQ ID NO: 691551 - DNA, 20 bp, Artificial
  CRISPR gRNA sequence
aaacccaaaaaggcccatgc

SEQ ID NO: 691552 - DNA, 20 bp, Artificial
  CRISPR gRNA sequence
aacccaaaaaggcccatgca

SEQ ID NO: 691553 - DNA, 20 bp, Artificial
  CRISPR gRNA sequence
ccaaaaaggcccatgcaagg

SEQ ID NO: 691554 - DNA, 20 bp, Artificial
  CRISPR gRNA sequence
aaaaaggcccatgcaaggtg

SEQ ID NO: 691555 - DNA, 20 bp, Artificial
  CRISPR gRNA sequence
aaaaggcccatgcaaggtgg

SEQ ID NO: 691556 - DNA, 20 bp, Artificial
  CRISPR gRNA sequence
aaaggcccatgcaaggtgga

SEQ ID NO: 691557 - DNA, 20 bp, Artificial
  CRISPR gRNA sequence
gagggtgtgaaatgatgccc

SEQ ID NO: 691558 - DNA, 20 bp, Artificial
  CRISPR gRNA sequence
ggtgtgaaatgatgccccag

SEQ ID NO: 691559 - DNA, 20 bp, Artificial
  CRISPR gRNA sequence
ccagtagtgcatgaatgaat

SEQ ID NO: 691560 - DNA, 20 bp, Artificial
  CRISPR gRNA sequence
gtgcatgaatgaatgagtca

SEQ ID NO: 691561 - DNA, 20 bp, Artificial
  CRISPR gRNA sequence
tgcatgaatgaatgagtcat

SEQ ID NO: 691562 - DNA, 20 bp, Artificial
  CRISPR gRNA sequence
atgaatgaatgagtcatggg

SEQ ID NO: 691563 - DNA, 20 bp, Artificial
  CRISPR gRNA sequence
aatgaatgagtcatgggcag

SEQ ID NO: 691564 - DNA, 20 bp, Artificial
  CRISPR gRNA sequence
gagtcatgggcagtggctca

SEQ ID NO: 691565 - DNA, 20 bp, Artificial
  CRISPR gRNA sequence
agtcatgggcagtggctcat

SEQ ID NO: 691566 - DNA, 20 bp, Artificial
  CRISPR gRNA sequence
gcagtggctcatgggttgct

SEQ ID NO: 691567 - DNA, 20 bp, Artificial
  CRISPR gRNA sequence
tggctcatgggttgcttggt

SEQ ID NO: 691568 - DNA, 20 bp, Artificial
  CRISPR gRNA sequence
tcatgggttgcttggtcagt

SEQ ID NO: 691569 - DNA, 20 bp, Artificial
  CRISPR gRNA sequence
catgggttgcttggtcagtc

SEQ ID NO: 691570 - DNA, 20 bp, Artificial
  CRISPR gRNA sequence
gcttggtcagtcaggaactt

SEQ ID NO: 691571 - DNA, 20 bp, Artificial
  CRISPR gRNA sequence
tcaggaacttgagcaaaata

SEQ ID NO: 691572 - DNA, 20 bp, Artificial
  CRISPR gRNA sequence
gaacttgagcaaaataaagt

SEQ ID NO: 691573 - DNA, 20 bp, Artificial
  CRISPR gRNA sequence
gcaaaataaagttggaaaac

SEQ ID NO: 691574 - DNA, 20 bp, Artificial
  CRISPR gRNA sequence
caaaataaagttggaaaact

SEQ ID NO: 691575 - DNA, 20 bp, Artificial
  CRISPR gRNA sequence
aaaataaagttggaaaactg

SEQ ID NO: 691576 - DNA, 20 bp, Artificial
  CRISPR gRNA sequence
aaataaagttggaaaactgg

SEQ ID NO: 691577 - DNA, 20 bp, Artificial
  CRISPR gRNA sequence
aaagttggaaaactggggga

SEQ ID NO: 691578 - DNA, 20 bp, Artificial
  CRISPR gRNA sequence
gttggaaaactgggggatgg

SEQ ID NO: 691579 - DNA, 20 bp, Artificial
  CRISPR gRNA sequence
tggaaaactgggggatggaa

SEQ ID NO: 691580 - DNA, 20 bp, Artificial
  CRISPR gRNA sequence
gaaaactgggggatggaaga

SEQ ID NO: 691581 - DNA, 20 bp, Artificial
  CRISPR gRNA sequence
aaactgggggatggaagaga

SEQ ID NO: 691582 - DNA, 20 bp, Artificial
  CRISPR gRNA sequence
aactgggggatggaagagag

SEQ ID NO: 691583 - DNA, 20 bp, Artificial
  CRISPR gRNA sequence
atggaagagagaggtatgca

SEQ ID NO: 691584 - DNA, 20 bp, Artificial
  CRISPR gRNA sequence
tatgcacagacctcttgaca

SEQ ID NO: 691585 - DNA, 20 bp, Artificial
  CRISPR gRNA sequence
atgcacagacctcttgacat

SEQ ID NO: 691586 - DNA, 20 bp, Artificial
  CRISPR gRNA sequence
cacagacctcttgacatggg

SEQ ID NO: 691587 - DNA, 20 bp, Artificial
  CRISPR gRNA sequence
cagacctcttgacatgggca

SEQ ID NO: 691588 - DNA, 20 bp, Artificial
  CRISPR gRNA sequence
tcttgacatgggcagagctt

SEQ ID NO: 691589 - DNA, 20 bp, Artificial
  CRISPR gRNA sequence
tgacatgggcagagcttcag

SEQ ID NO: 691590 - DNA, 20 bp, Artificial
  CRISPR gRNA sequence
atgggcagagcttcagaaga

SEQ ID NO: 691591 - DNA, 20 bp, Artificial
  CRISPR gRNA sequence
ggcagagcttcagaagatgg

SEQ ID NO: 691592 - DNA, 20 bp, Artificial
  CRISPR gRNA sequence
gcttcagaagatggtggttg

SEQ ID NO: 691593 - DNA, 20 bp, Artificial
  CRISPR gRNA sequence
cttcagaagatggtggttgc

SEQ ID NO: 691594 - DNA, 20 bp, Artificial
  CRISPR gRNA sequence
tggttgcaggtttccccaaa

SEQ ID NO: 691595 - DNA, 20 bp, Artificial
  CRISPR gRNA sequence
gttgcaggtttccccaaata

SEQ ID NO: 691596 - DNA, 20 bp, Artificial
  CRISPR gRNA sequence
aaatagagaacatcaataaa

SEQ ID NO: 691597 - DNA, 20 bp, Artificial
  CRISPR gRNA sequence
aatagagaacatcaataaaa

SEQ ID NO: 691598 - DNA, 20 bp, Artificial
  CRISPR gRNA sequence
agagaacatcaataaaaagg

SEQ ID NO: 691599 - DNA, 20 bp, Artificial
  CRISPR gRNA sequence
aaaaaggtagaaattttaca

SEQ ID NO: 691600 - DNA, 20 bp, Artificial
  CRISPR gRNA sequence
aaaggtagaaattttacaaa

SEQ ID NO: 691601 - DNA, 20 bp, Artificial
  CRISPR gRNA sequence
tagaaattttacaaagagac

SEQ ID NO: 691602 - DNA, 20 bp, Artificial
  CRISPR gRNA sequence
ttacaaagagaccagataaa

SEQ ID NO: 691603 - DNA, 20 bp, Artificial
  CRISPR gRNA sequence
aagagaccagataaaaagtt

SEQ ID NO: 691604 - DNA, 20 bp, Artificial
  CRISPR gRNA sequence
gagaccagataaaaagtttg

SEQ ID NO: 691605 - DNA, 20 bp, Artificial
  CRISPR gRNA sequence
ataaaaagtttggagctgaa

SEQ ID NO: 691606 - DNA, 20 bp, Artificial
  CRISPR gRNA sequence
aactgaaatgaaaaattcac

SEQ ID NO: 691607 - DNA, 20 bp, Artificial
  CRISPR gRNA sequence
ctgaaatgaaaaattcacta

SEQ ID NO: 691608 - DNA, 20 bp, Artificial
  CRISPR gRNA sequence
tgaaatgaaaaattcactag

SEQ ID NO: 691609 - DNA, 20 bp, Artificial
  CRISPR gRNA sequence
gaaatgaaaaattcactaga

SEQ ID NO: 691610 - DNA, 20 bp, Artificial
  CRISPR gRNA sequence
aaatgaaaaattcactagag

SEQ ID NO: 691611 - DNA, 20 bp, Artificial
  CRISPR gRNA sequence
aaaattcactagaggggctc

SEQ ID NO: 691612 - DNA, 20 bp, Artificial
  CRISPR gRNA sequence
aattcactagaggggctcca

SEQ ID NO: 691613 - DNA, 20 bp, Artificial
  CRISPR gRNA sequence
ccagagcaaatttcaccatg

SEQ ID NO: 691614 - DNA, 20 bp, Artificial
  CRISPR gRNA sequence
gcaaatttcaccatgcagaa

SEQ ID NO: 691615 - DNA, 20 bp, Artificial
  CRISPR gRNA sequence
aaatttcaccatgcagaatg

SEQ ID NO: 691616 - DNA, 20 bp, Artificial
  CRISPR gRNA sequence
caccatgcagaatggagaat

SEQ ID NO: 691617 - DNA, 20 bp, Artificial
  CRISPR gRNA sequence
atgcagaatggagaatcagc

SEQ ID NO: 691618 - DNA, 20 bp, Artificial
  CRISPR gRNA sequence
atggagaatcagcaagcttg

SEQ ID NO: 691619 - DNA, 20 bp, Artificial
  CRISPR gRNA sequence
gaatcagcaagcttgaagat

SEQ ID NO: 691620 - DNA, 20 bp, Artificial
  CRISPR gRNA sequence
ataagacaattgaaattctc

SEQ ID NO: 691621 - DNA, 20 bp, Artificial
  CRISPR gRNA sequence
acaattgaaattctctagtt

SEQ ID NO: 691622 - DNA, 20 bp, Artificial
  CRISPR gRNA sequence
attgaaattctctagttcag

SEQ ID NO: 691623 - DNA, 20 bp, Artificial
  CRISPR gRNA sequence
gaaattctctagttcagtag

SEQ ID NO: 691624 - DNA, 20 bp, Artificial
  CRISPR gRNA sequence
ttctctagttcagtagcaga

SEQ ID NO: 691625 - DNA, 20 bp, Artificial
  CRISPR gRNA sequence
cagaaagaaaaaaaattatg

SEQ ID NO: 691626 - DNA, 20 bp, Artificial
  CRISPR gRNA sequence
aaattatgaagaaaaataaa

SEQ ID NO: 691627 - DNA, 20 bp, Artificial
  CRISPR gRNA sequence
gaaaaataaacagaacttta

SEQ ID NO: 691628 - DNA, 20 bp, Artificial
  CRISPR gRNA sequence
acagaactttaaagatctgt

SEQ ID NO: 691629 - DNA, 20 bp, Artificial
  CRISPR gRNA sequence
aagatctgtgagacaacatc

SEQ ID NO: 691630 - DNA, 20 bp, Artificial
  CRISPR gRNA sequence
aacatcaagcacatgcactt

SEQ ID NO: 691631 - DNA, 20 bp, Artificial
  CRISPR gRNA sequence
acatcaagcacatgcacttt

SEQ ID NO: 691632 - DNA, 20 bp, Artificial
  CRISPR gRNA sequence
atcaagcacatgcactttgg

SEQ ID NO: 691633 - DNA, 20 bp, Artificial
  CRISPR gRNA sequence
atgcactttgggagtcctca

SEQ ID NO: 691634 - DNA, 20 bp, Artificial
  CRISPR gRNA sequence
actttgggagtcctcaaaga

SEQ ID NO: 691635 - DNA, 20 bp, Artificial
  CRISPR gRNA sequence
ctttgggagtcctcaaagaa

SEQ ID NO: 691636 - DNA, 20 bp, Artificial
  CRISPR gRNA sequence
ttgggagtcctcaaagaaag

SEQ ID NO: 691637 - DNA, 20 bp, Artificial
  CRISPR gRNA sequence
gggagtcctcaaagaaagga

SEQ ID NO: 691638 - DNA, 20 bp, Artificial
  CRISPR gRNA sequence
gagtcctcaaagaaaggaga

SEQ ID NO: 691639 - DNA, 20 bp, Artificial
  CRISPR gRNA sequence
gtcctcaaagaaaggagaga

SEQ ID NO: 691640 - DNA, 20 bp, Artificial
  CRISPR gRNA sequence
tcaaagaaaggagagagaga

SEQ ID NO: 691641 - DNA, 20 bp, Artificial
  CRISPR gRNA sequence
caaagaaaggagagagagaa

SEQ ID NO: 691642 - DNA, 20 bp, Artificial
  CRISPR gRNA sequence
aagaaaggagagagagaaag

SEQ ID NO: 691643 - DNA, 20 bp, Artificial
  CRISPR gRNA sequence
aaaggagagagagaaaggag

SEQ ID NO: 691644 - DNA, 20 bp, Artificial
  CRISPR gRNA sequence
aggagaagaatgactattta

SEQ ID NO: 691645 - DNA, 20 bp, Artificial
  CRISPR gRNA sequence
caacaaacttgacaaatttt

SEQ ID NO: 691646 - DNA, 20 bp, Artificial
  CRISPR gRNA sequence
caaacttgacaaattttaag

SEQ ID NO: 691647 - DNA, 20 bp, Artificial
  CRISPR gRNA sequence
agcaaaaaaatttaaattta

SEQ ID NO: 691648 - DNA, 20 bp, Artificial
  CRISPR gRNA sequence
caaaaaaatttaaatttaaa

SEQ ID NO: 691649 - DNA, 20 bp, Artificial
  CRISPR gRNA sequence
aaaaaaatttaaatttaaag

SEQ ID NO: 691650 - DNA, 20 bp, Artificial
  CRISPR gRNA sequence
aatttaaagaggtccacacc

SEQ ID NO: 691651 - DNA, 20 bp, Artificial
  CRISPR gRNA sequence
tttaaagaggtccacaccaa

SEQ ID NO: 691652 - DNA, 20 bp, Artificial
  CRISPR gRNA sequence
cattataatcaacctgtcaa

SEQ ID NO: 691653 - DNA, 20 bp, Artificial
  CRISPR gRNA sequence
tgtcaaaagccaatgacaaa

SEQ ID NO: 691654 - DNA, 20 bp, Artificial
  CRISPR gRNA sequence
tcaaaagccaatgacaaaca

SEQ ID NO: 691655 - DNA, 20 bp, Artificial
  CRISPR gRNA sequence
gagcatattgaaatgaataa

SEQ ID NO: 691656 - DNA, 20 bp, Artificial
  CRISPR gRNA sequence
gcatattgaaatgaataaca

SEQ ID NO: 691657 - DNA, 20 bp, Artificial
  CRISPR gRNA sequence
tattgaaatgaataacagag

SEQ ID NO: 691658 - DNA, 20 bp, Artificial
  CRISPR gRNA sequence
attgaaatgaataacagaga

SEQ ID NO: 691659 - DNA, 20 bp, Artificial
  CRISPR gRNA sequence
ataacagagaaggaactttt

SEQ ID NO: 691660 - DNA, 20 bp, Artificial
  CRISPR gRNA sequence
taacagagaaggaacttttc

SEQ ID NO: 691661 - DNA, 20 bp, Artificial
  CRISPR gRNA sequence
aaggaacttttcaggttcaa

SEQ ID NO: 691662 - DNA, 20 bp, Artificial
  CRISPR gRNA sequence
aggttcaatggatcctcaat

SEQ ID NO: 691663 - DNA, 20 bp, Artificial
  CRISPR gRNA sequence
atggatcctcaataagattg

SEQ ID NO: 691664 - DNA, 20 bp, Artificial
  CRISPR gRNA sequence
tcctcaataagattgcagcc

SEQ ID NO: 691665 - DNA, 20 bp, Artificial
  CRISPR gRNA sequence
gattgcagcccagttttctt

SEQ ID NO: 691666 - DNA, 20 bp, Artificial
  CRISPR gRNA sequence
ccagttttcttcagaaacca

SEQ ID NO: 691667 - DNA, 20 bp, Artificial
  CRISPR gRNA sequence
agttttcttcagaaaccata

SEQ ID NO: 691668 - DNA, 20 bp, Artificial
  CRISPR gRNA sequence
tcttcagaaaccatagagtt

SEQ ID NO: 691669 - DNA, 20 bp, Artificial
  CRISPR gRNA sequence
tcagaaaccatagagttcag

SEQ ID NO: 691670 - DNA, 20 bp, Artificial
  CRISPR gRNA sequence
cagaaaccatagagttcaga

SEQ ID NO: 691671 - DNA, 20 bp, Artificial
  CRISPR gRNA sequence
ccatagagttcagaaggcac

SEQ ID NO: 691672 - DNA, 20 bp, Artificial
  CRISPR gRNA sequence
cactggaatgttgacaaatt

SEQ ID NO: 691673 - DNA, 20 bp, Artificial
  CRISPR gRNA sequence
ctggaatgttgacaaattta

SEQ ID NO: 691674 - DNA, 20 bp, Artificial
  CRISPR gRNA sequence
tggaatgttgacaaatttag

SEQ ID NO: 691675 - DNA, 20 bp, Artificial
  CRISPR gRNA sequence
atgttgacaaatttagaggt

SEQ ID NO: 691676 - DNA, 20 bp, Artificial
  CRISPR gRNA sequence
atttagaggtcagaaaaaaa

SEQ ID NO: 691677 - DNA, 20 bp, Artificial
  CRISPR gRNA sequence
gaaaaaaaaagactgtcatg

SEQ ID NO: 691678 - DNA, 20 bp, Artificial
  CRISPR gRNA sequence
aaaaaaaaagactgtcatgc

SEQ ID NO: 691679 - DNA, 20 bp, Artificial
  CRISPR gRNA sequence
tcatgcaggaattgtgtgtc

SEQ ID NO: 691680 - DNA, 20 bp, Artificial
  CRISPR gRNA sequence
tgtctggaaaaactctcctt

SEQ ID NO: 691681 - DNA, 20 bp, Artificial
  CRISPR gRNA sequence
aaactctccttcagaaataa

SEQ ID NO: 691682 - DNA, 20 bp, Artificial
  CRISPR gRNA sequence
tacatatatatgactataca

SEQ ID NO: 691683 - DNA, 20 bp, Artificial
  CRISPR gRNA sequence
cacatatatataactatata

SEQ ID NO: 691684 - DNA, 20 bp, Artificial
  CRISPR gRNA sequence
ctactatgaaattatatata

SEQ ID NO: 691685 - DNA, 20 bp, Artificial
  CRISPR gRNA sequence
tatatatatagtactatata

SEQ ID NO: 691686 - DNA, 20 bp, Artificial
  CRISPR gRNA sequence
atatatagtactatatatag

SEQ ID NO: 691687 - DNA, 20 bp, Artificial
  CRISPR gRNA sequence
atatagtagtcatactataa

SEQ ID NO: 691688 - DNA, 20 bp, Artificial
  CRISPR gRNA sequence
agtagtcatactataaaagc

SEQ ID NO: 691689 - DNA, 20 bp, Artificial
  CRISPR gRNA sequence
agtcatactataaaagctag

SEQ ID NO: 691690 - DNA, 20 bp, Artificial
  CRISPR gRNA sequence
agtagtaatatgtatatttt

SEQ ID NO: 691691 - DNA, 20 bp, Artificial
  CRISPR gRNA sequence
tgtgtgtgtgcatatatata

SEQ ID NO: 691692 - DNA, 20 bp, Artificial
  CRISPR gRNA sequence
tatatatatagtactatata

SEQ ID NO: 691693 - DNA, 20 bp, Artificial
  CRISPR gRNA sequence
atatatagtactatatatag

SEQ ID NO: 691694 - DNA, 20 bp, Artificial
  CRISPR gRNA sequence
tatatatagtagtcctataa

SEQ ID NO: 691695 - DNA, 20 bp, Artificial
  CRISPR gRNA sequence
tatagtagtcctataaaagc

SEQ ID NO: 691696 - DNA, 20 bp, Artificial
  CRISPR gRNA sequence
agtagtcctataaaagctag

SEQ ID NO: 691697 - DNA, 20 bp, Artificial
  CRISPR gRNA sequence
agtagtaacatgtatatttt

SEQ ID NO: 691698 - DNA, 20 bp, Artificial
  CRISPR gRNA sequence
cttcctttgtttttcctatt

SEQ ID NO: 691699 - DNA, 20 bp, Artificial
  CRISPR gRNA sequence
gtttttcctatttggtttaa

SEQ ID NO: 691700 - DNA, 20 bp, Artificial
  CRISPR gRNA sequence
atgaatgaataaacaacatg

SEQ ID NO: 691701 - DNA, 20 bp, Artificial
  CRISPR gRNA sequence
catgtagtgtatttctacaa

SEQ ID NO: 691702 - DNA, 20 bp, Artificial
  CRISPR gRNA sequence
ttctacaatggaatatgatt

SEQ ID NO: 691703 - DNA, 20 bp, Artificial
  CRISPR gRNA sequence
ggaatatgatttagccataa

SEQ ID NO: 691704 - DNA, 20 bp, Artificial
  CRISPR gRNA sequence
gaatatgatttagccataaa

SEQ ID NO: 691705 - DNA, 20 bp, Artificial
  CRISPR gRNA sequence
ctgaatctcaaaaacatgat

SEQ ID NO: 691706 - DNA, 20 bp, Artificial
  CRISPR gRNA sequence
tctcaaaaacatgataagtg

SEQ ID NO: 691707 - DNA, 20 bp, Artificial
  CRISPR gRNA sequence
ctcaaaaacatgataagtga

SEQ ID NO: 691708 - DNA, 20 bp, Artificial
  CRISPR gRNA sequence
acatgataagtgaaggaaat

SEQ ID NO: 691709 - DNA, 20 bp, Artificial
  CRISPR gRNA sequence
gtgaaggaaatcagccacaa

SEQ ID NO: 691710 - DNA, 20 bp, Artificial
  CRISPR gRNA sequence
tgaaggaaatcagccacaaa

SEQ ID NO: 691711 - DNA, 20 bp, Artificial
  CRISPR gRNA sequence
acccatctttgtgaaatctt

SEQ ID NO: 691712 - DNA, 20 bp, Artificial
  CRISPR gRNA sequence
catctttgtgaaatcttcag

SEQ ID NO: 691713 - DNA, 20 bp, Artificial
  CRISPR gRNA sequence
tctttgtgaaatcttcagaa

SEQ ID NO: 691714 - DNA, 20 bp, Artificial
  CRISPR gRNA sequence
cttcagaagagaccaatcta

SEQ ID NO: 691715 - DNA, 20 bp, Artificial
  CRISPR gRNA sequence
tcagaagagaccaatctata

SEQ ID NO: 691716 - DNA, 20 bp, Artificial
  CRISPR gRNA sequence
aagagaccaatctatagaga

SEQ ID NO: 691717 - DNA, 20 bp, Artificial
  CRISPR gRNA sequence
gaccaatctatagagaaaga

SEQ ID NO: 691718 - DNA, 20 bp, Artificial
  CRISPR gRNA sequence
caatctatagagaaagaaag

SEQ ID NO: 691719 - DNA, 20 bp, Artificial
  CRISPR gRNA sequence
agagaaagaaagcagacttg

SEQ ID NO: 691720 - DNA, 20 bp, Artificial
  CRISPR gRNA sequence
agaaagcagacttgtggtga

SEQ ID NO: 691721 - DNA, 20 bp, Artificial
  CRISPR gRNA sequence
gaaagcagacttgtggtgac

SEQ ID NO: 691722 - DNA, 20 bp, Artificial
  CRISPR gRNA sequence
aaagcagacttgtggtgaca

SEQ ID NO: 691723 - DNA, 20 bp, Artificial
  CRISPR gRNA sequence
agacttgtggtgacagggtc

SEQ ID NO: 691724 - DNA, 20 bp, Artificial
  CRISPR gRNA sequence
cttgtggtgacagggtctgg

SEQ ID NO: 691725 - DNA, 20 bp, Artificial
  CRISPR gRNA sequence
gtggtgacagggtctggtgg

SEQ ID NO: 691726 - DNA, 20 bp, Artificial
  CRISPR gRNA sequence
tggtgacagggtctggtggc

SEQ ID NO: 691727 - DNA, 20 bp, Artificial
  CRISPR gRNA sequence
gtgacagggtctggtggcag

SEQ ID NO: 691728 - DNA, 20 bp, Artificial
  CRISPR gRNA sequence
tgacagggtctggtggcagg

SEQ ID NO: 691729 - DNA, 20 bp, Artificial
  CRISPR gRNA sequence
ggtctggtggcaggaggaaa

SEQ ID NO: 691730 - DNA, 20 bp, Artificial
  CRISPR gRNA sequence
tctggtggcaggaggaaatg

SEQ ID NO: 691731 - DNA, 20 bp, Artificial
  CRISPR gRNA sequence
ctggtggcaggaggaaatgg

SEQ ID NO: 691732 - DNA, 20 bp, Artificial
  CRISPR gRNA sequence
tggtggcaggaggaaatgga

SEQ ID NO: 691733 - DNA, 20 bp, Artificial
  CRISPR gRNA sequence
aatggagggtgactgcttaa

SEQ ID NO: 691734 - DNA, 20 bp, Artificial
  CRISPR gRNA sequence
agggtgactgcttaatggtg

SEQ ID NO: 691735 - DNA, 20 bp, Artificial
  CRISPR gRNA sequence
ggtgactgcttaatggtgca

SEQ ID NO: 691736 - DNA, 20 bp, Artificial
  CRISPR gRNA sequence
aatggtgcagagtttcccct

SEQ ID NO: 691737 - DNA, 20 bp, Artificial
  CRISPR gRNA sequence
atggtgcagagtttcccctg

SEQ ID NO: 691738 - DNA, 20 bp, Artificial
  CRISPR gRNA sequence
cctgaggtgatgaaatactc

SEQ ID NO: 691739 - DNA, 20 bp, Artificial
  CRISPR gRNA sequence
gtgatgaaatactctggaac

SEQ ID NO: 691740 - DNA, 20 bp, Artificial
  CRISPR gRNA sequence
gatgaaatactctggaacta

SEQ ID NO: 691741 - DNA, 20 bp, Artificial
  CRISPR gRNA sequence
tgaaatactctggaactaga

SEQ ID NO: 691742 - DNA, 20 bp, Artificial
  CRISPR gRNA sequence
ctggaactagagagtgatga

SEQ ID NO: 691743 - DNA, 20 bp, Artificial
  CRISPR gRNA sequence
attgtacacctattgtacaa

SEQ ID NO: 691744 - DNA, 20 bp, Artificial
  CRISPR gRNA sequence
ttgtacacctattgtacaat

SEQ ID NO: 691745 - DNA, 20 bp, Artificial
  CRISPR gRNA sequence
cacctattgtacaatgggta

SEQ ID NO: 691746 - DNA, 20 bp, Artificial
  CRISPR gRNA sequence
ctattgtacaatgggtacag

SEQ ID NO: 691747 - DNA, 20 bp, Artificial
  CRISPR gRNA sequence
tgttcatgtatattgtatca

SEQ ID NO: 691748 - DNA, 20 bp, Artificial
  CRISPR gRNA sequence
tatattgtatcacagtaaaa

SEQ ID NO: 691749 - DNA, 20 bp, Artificial
  CRISPR gRNA sequence
tattgtatcacagtaaaaaa

SEQ ID NO: 691750 - DNA, 20 bp, Artificial
  CRISPR gRNA sequence
attgtatcacagtaaaaaag

SEQ ID NO: 691751 - DNA, 20 bp, Artificial
  CRISPR gRNA sequence
tcacagtaaaaaagaggctg

SEQ ID NO: 691752 - DNA, 20 bp, Artificial
  CRISPR gRNA sequence
gtaaaaaagaggctgaagaa

SEQ ID NO: 691753 - DNA, 20 bp, Artificial
  CRISPR gRNA sequence
agattccaaaatcttttata

SEQ ID NO: 691754 - DNA, 20 bp, Artificial
  CRISPR gRNA sequence
cttttatatggtaaactcct

SEQ ID NO: 691755 - DNA, 20 bp, Artificial
  CRISPR gRNA sequence
gtaaactcctgagtttgctt

SEQ ID NO: 691756 - DNA, 20 bp, Artificial
  CRISPR gRNA sequence
gcccatctgtctttccccct

SEQ ID NO: 691757 - DNA, 20 bp, Artificial
  CRISPR gRNA sequence
cccatctgtctttccccctc

SEQ ID NO: 691758 - DNA, 20 bp, Artificial
  CRISPR gRNA sequence
tcaggatgtcatctcctact

SEQ ID NO: 691759 - DNA, 20 bp, Artificial
  CRISPR gRNA sequence
aggatgtcatctcctactca

SEQ ID NO: 691760 - DNA, 20 bp, Artificial
  CRISPR gRNA sequence
gctcacccttgttcttctgt

SEQ ID NO: 691761 - DNA, 20 bp, Artificial
  CRISPR gRNA sequence
cacccttgttcttctgtaag

SEQ ID NO: 691762 - DNA, 20 bp, Artificial
  CRISPR gRNA sequence
cttgttcttctgtaagtaga

SEQ ID NO: 691763 - DNA, 20 bp, Artificial
  CRISPR gRNA sequence
gcctttcttcacaacactcc

SEQ ID NO: 691764 - DNA, 20 bp, Artificial
  CRISPR gRNA sequence
tcttcacaacactcccagat

SEQ ID NO: 691765 - DNA, 20 bp, Artificial
  CRISPR gRNA sequence
cacaacactcccagatcagc

SEQ ID NO: 691766 - DNA, 20 bp, Artificial
  CRISPR gRNA sequence
cccaaaatgactttctgtct

SEQ ID NO: 691767 - DNA, 20 bp, Artificial
  CRISPR gRNA sequence
caaatgctcacgtgcaactc

SEQ ID NO: 691768 - DNA, 20 bp, Artificial
  CRISPR gRNA sequence
aaatgctcacgtgcaactct

SEQ ID NO: 691769 - DNA, 20 bp, Artificial
  CRISPR gRNA sequence
aatgctcacgtgcaactctg

SEQ ID NO: 691770 - DNA, 20 bp, Artificial
  CRISPR gRNA sequence
gtgcaactctggggcaattt

SEQ ID NO: 691771 - DNA, 20 bp, Artificial
  CRISPR gRNA sequence
caactctggggcaatttcag

SEQ ID NO: 691772 - DNA, 20 bp, Artificial
  CRISPR gRNA sequence
aactctggggcaatttcagt

SEQ ID NO: 691773 - DNA, 20 bp, Artificial
  CRISPR gRNA sequence
ctctggggcaatttcagtgg

SEQ ID NO: 691774 - DNA, 20 bp, Artificial
  CRISPR gRNA sequence
gggcaatttcagtgggagtg

SEQ ID NO: 691775 - DNA, 20 bp, Artificial
  CRISPR gRNA sequence
gcaatttcagtgggagtgaa

SEQ ID NO: 691776 - DNA, 20 bp, Artificial
  CRISPR gRNA sequence
gagtgaagagattatccaac

SEQ ID NO: 691777 - DNA, 20 bp, Artificial
  CRISPR gRNA sequence
agtgaagagattatccaact

SEQ ID NO: 691778 - DNA, 20 bp, Artificial
  CRISPR gRNA sequence
tccaactaggatgattcatt

SEQ ID NO: 691779 - DNA, 20 bp, Artificial
  CRISPR gRNA sequence
caactaggatgattcatttg

SEQ ID NO: 691780 - DNA, 20 bp, Artificial
  CRISPR gRNA sequence
aactaggatgattcatttgg

SEQ ID NO: 691781 - DNA, 20 bp, Artificial
  CRISPR gRNA sequence
actaggatgattcatttgga

SEQ ID NO: 691782 - DNA, 20 bp, Artificial
  CRISPR gRNA sequence
ggaaatgtttgaccttatgt

SEQ ID NO: 691783 - DNA, 20 bp, Artificial
  CRISPR gRNA sequence
gaaatgtttgaccttatgtt

SEQ ID NO: 691784 - DNA, 20 bp, Artificial
  CRISPR gRNA sequence
tgtttgaccttatgttagga

SEQ ID NO: 691785 - DNA, 20 bp, Artificial
  CRISPR gRNA sequence
aagtcatttgctttcctaaa

SEQ ID NO: 691786 - DNA, 20 bp, Artificial
  CRISPR gRNA sequence
agtcatttgctttcctaaaa

SEQ ID NO: 691787 - DNA, 20 bp, Artificial
  CRISPR gRNA sequence
ctaaaaaggatcctgcttac

SEQ ID NO: 691788 - DNA, 20 bp, Artificial
  CRISPR gRNA sequence
aaaggatcctgcttaccagt

SEQ ID NO: 691789 - DNA, 20 bp, Artificial
  CRISPR gRNA sequence
gtatataatttttgtatgcc

SEQ ID NO: 691790 - DNA, 20 bp, Artificial
  CRISPR gRNA sequence
tatataatttttgtatgccc

SEQ ID NO: 691791 - DNA, 20 bp, Artificial
  CRISPR gRNA sequence
atataatttttgtatgcccg

SEQ ID NO: 691792 - DNA, 20 bp, Artificial
  CRISPR gRNA sequence
taatttttgtatgcccgggg

SEQ ID NO: 691793 - DNA, 20 bp, Artificial
  CRISPR gRNA sequence
atttttgtatgcccggggtg

SEQ ID NO: 691794 - DNA, 20 bp, Artificial
  CRISPR gRNA sequence
tatgcccggggtggagttca

SEQ ID NO: 691795 - DNA, 20 bp, Artificial
  CRISPR gRNA sequence
gcccggggtggagttcacag

SEQ ID NO: 691796 - DNA, 20 bp, Artificial
  CRISPR gRNA sequence
ccggggtggagttcacagca

SEQ ID NO: 691797 - DNA, 20 bp, Artificial
  CRISPR gRNA sequence
cggggtggagttcacagcag

SEQ ID NO: 691798 - DNA, 20 bp, Artificial
  CRISPR gRNA sequence
cacagcagaggaactaacaa

SEQ ID NO: 691799 - DNA, 20 bp, Artificial
  CRISPR gRNA sequence
agaggaactaacaatagctc

SEQ ID NO: 691800 - DNA, 20 bp, Artificial
  CRISPR gRNA sequence
gaggaactaacaatagctct

SEQ ID NO: 691801 - DNA, 20 bp, Artificial
  CRISPR gRNA sequence
aacaccatacacctcatgcg

SEQ ID NO: 691802 - DNA, 20 bp, Artificial
  CRISPR gRNA sequence
actcacccatctgcctcccc

SEQ ID NO: 691803 - DNA, 20 bp, Artificial
  CRISPR gRNA sequence
ccatctgcctcccccagctg

SEQ ID NO: 691804 - DNA, 20 bp, Artificial
  CRISPR gRNA sequence
catctgcctcccccagctga

SEQ ID NO: 691805 - DNA, 20 bp, Artificial
  CRISPR gRNA sequence
ctgcctcccccagctgaagg

SEQ ID NO: 691806 - DNA, 20 bp, Artificial
  CRISPR gRNA sequence
tgcctcccccagctgaagga

SEQ ID NO: 691807 - DNA, 20 bp, Artificial
  CRISPR gRNA sequence
cctcccccagctgaaggaag

SEQ ID NO: 691808 - DNA, 20 bp, Artificial
  CRISPR gRNA sequence
ccccagctgaaggaaggagc

SEQ ID NO: 691809 - DNA, 20 bp, Artificial
  CRISPR gRNA sequence
aaggagctggattattacct

SEQ ID NO: 691810 - DNA, 20 bp, Artificial
  CRISPR gRNA sequence
atccatcaactgcatttcac

SEQ ID NO: 691811 - DNA, 20 bp, Artificial
  CRISPR gRNA sequence
actggatgtgcaccctctac

SEQ ID NO: 691812 - DNA, 20 bp, Artificial
  CRISPR gRNA sequence
ctctacaagtgtgaaccttc

SEQ ID NO: 691813 - DNA, 20 bp, Artificial
  CRISPR gRNA sequence
tctacaagtgtgaaccttcc

SEQ ID NO: 691814 - DNA, 20 bp, Artificial
  CRISPR gRNA sequence
ctacaagtgtgaaccttcca

SEQ ID NO: 691815 - DNA, 20 bp, Artificial
  CRISPR gRNA sequence
tgtgaaccttccagggttct

SEQ ID NO: 691816 - DNA, 20 bp, Artificial
  CRISPR gRNA sequence
ttgctcttcctgctgttgtg

SEQ ID NO: 691817 - DNA, 20 bp, Artificial
  CRISPR gRNA sequence
tgctgttgtgtggcctccac

SEQ ID NO: 691818 - DNA, 20 bp, Artificial
  CRISPR gRNA sequence
ttgtgtggcctccactggtg

SEQ ID NO: 691819 - DNA, 20 bp, Artificial
  CRISPR gRNA sequence
ccactggtgtggctcatgcc

SEQ ID NO: 691820 - DNA, 20 bp, Artificial
  CRISPR gRNA sequence
cactggtgtggctcatgccc

SEQ ID NO: 691821 - DNA, 20 bp, Artificial
  CRISPR gRNA sequence
actggtgtggctcatgccca

SEQ ID NO: 691822 - DNA, 20 bp, Artificial
  CRISPR gRNA sequence
ctggtgtggctcatgcccag

SEQ ID NO: 691823 - DNA, 20 bp, Artificial
  CRISPR gRNA sequence
tggtgtggctcatgcccagg

SEQ ID NO: 691824 - DNA, 20 bp, Artificial
  CRISPR gRNA sequence
gctcatgcccagggggcctg

SEQ ID NO: 691825 - DNA, 20 bp, Artificial
  CRISPR gRNA sequence
ctcatgcccagggggcctgc

SEQ ID NO: 691826 - DNA, 20 bp, Artificial
  CRISPR gRNA sequence
catgcccagggggcctgcag

SEQ ID NO: 691827 - DNA, 20 bp, Artificial
  CRISPR gRNA sequence
cagggggcctgcaggagact

SEQ ID NO: 691828 - DNA, 20 bp, Artificial
  CRISPR gRNA sequence
ctgagtgtctcctaattctc

SEQ ID NO: 691829 - DNA, 20 bp, Artificial
  CRISPR gRNA sequence
tgagtgtctcctaattctca

SEQ ID NO: 691830 - DNA, 20 bp, Artificial
  CRISPR gRNA sequence
attctcaaggccaacatttt

SEQ ID NO: 691831 - DNA, 20 bp, Artificial
  CRISPR gRNA sequence
tcaaggccaacattttcagt

SEQ ID NO: 691832 - DNA, 20 bp, Artificial
  CRISPR gRNA sequence
attttcagtgagctcaaatg

SEQ ID NO: 691833 - DNA, 20 bp, Artificial
  CRISPR gRNA sequence
aaatgaagattttatgttct

SEQ ID NO: 691834 - DNA, 20 bp, Artificial
  CRISPR gRNA sequence
aatgaagattttatgttctc

SEQ ID NO: 691835 - DNA, 20 bp, Artificial
  CRISPR gRNA sequence
atgaagattttatgttctca

SEQ ID NO: 691836 - DNA, 20 bp, Artificial
  CRISPR gRNA sequence
gggactcatattttcatctg

SEQ ID NO: 691837 - DNA, 20 bp, Artificial
  CRISPR gRNA sequence
actcatattttcatctgtgg

SEQ ID NO: 691838 - DNA, 20 bp, Artificial
  CRISPR gRNA sequence
ctcatattttcatctgtgga

SEQ ID NO: 691839 - DNA, 20 bp, Artificial
  CRISPR gRNA sequence
tcatattttcatctgtggaa

SEQ ID NO: 691840 - DNA, 20 bp, Artificial
  CRISPR gRNA sequence
aaaaatccatctcgctgtct

SEQ ID NO: 691841 - DNA, 20 bp, Artificial
  CRISPR gRNA sequence
aaaatccatctcgctgtctt

SEQ ID NO: 691842 - DNA, 20 bp, Artificial
  CRISPR gRNA sequence
tctcgctgtcttaggtgtga

SEQ ID NO: 691843 - DNA, 20 bp, Artificial
  CRISPR gRNA sequence
taaatatatatatataatta

SEQ ID NO: 691844 - DNA, 20 bp, Artificial
  CRISPR gRNA sequence
gtatttttatgtctataaat

SEQ ID NO: 691845 - DNA, 20 bp, Artificial
  CRISPR gRNA sequence
atgtctataaatgagataat

SEQ ID NO: 691846 - DNA, 20 bp, Artificial
  CRISPR gRNA sequence
atcagtattttataaattga

SEQ ID NO: 691847 - DNA, 20 bp, Artificial
  CRISPR gRNA sequence
ttataaattgatggtattct

SEQ ID NO: 691848 - DNA, 20 bp, Artificial
  CRISPR gRNA sequence
ttagcattgacttcattgct

SEQ ID NO: 691849 - DNA, 20 bp, Artificial
  CRISPR gRNA sequence
tcagctaaatgctgtaacca

SEQ ID NO: 691850 - DNA, 20 bp, Artificial
  CRISPR gRNA sequence
cagctaaatgctgtaaccaa

SEQ ID NO: 691851 - DNA, 20 bp, Artificial
  CRISPR gRNA sequence
aaatgctgtaaccaaaggat

SEQ ID NO: 691852 - DNA, 20 bp, Artificial
  CRISPR gRNA sequence
tgtaaccaaaggatgagtca

SEQ ID NO: 691853 - DNA, 20 bp, Artificial
  CRISPR gRNA sequence
taaccaaaggatgagtcatg

SEQ ID NO: 691854 - DNA, 20 bp, Artificial
  CRISPR gRNA sequence
ccaaaggatgagtcatggag

SEQ ID NO: 691855 - DNA, 20 bp, Artificial
  CRISPR gRNA sequence
aaaggatgagtcatggagtg

SEQ ID NO: 691856 - DNA, 20 bp, Artificial
  CRISPR gRNA sequence
aaggatgagtcatggagtgg

SEQ ID NO: 691857 - DNA, 20 bp, Artificial
  CRISPR gRNA sequence
gatgagtcatggagtggagg

SEQ ID NO: 691858 - DNA, 20 bp, Artificial
  CRISPR gRNA sequence
aagaatatttttctactctc

SEQ ID NO: 691859 - DNA, 20 bp, Artificial
  CRISPR gRNA sequence
gaatatttttctactctctg

SEQ ID NO: 691860 - DNA, 20 bp, Artificial
  CRISPR gRNA sequence
aatatttttctactctctgg

SEQ ID NO: 691861 - DNA, 20 bp, Artificial
  CRISPR gRNA sequence
ctctctggaggtgccataat

SEQ ID NO: 691862 - DNA, 20 bp, Artificial
  CRISPR gRNA sequence
taatcggcatttctgcccta

SEQ ID NO: 691863 - DNA, 20 bp, Artificial
  CRISPR gRNA sequence
ctgccctatggatttcaaat

SEQ ID NO: 691864 - DNA, 20 bp, Artificial
  CRISPR gRNA sequence
ttcaaatgagaaatttgctt

SEQ ID NO: 691865 - DNA, 20 bp, Artificial
  CRISPR gRNA sequence
tcaaatgagaaatttgcttt

SEQ ID NO: 691866 - DNA, 20 bp, Artificial
  CRISPR gRNA sequence
tgagaaatttgctttaggct

SEQ ID NO: 691867 - DNA, 20 bp, Artificial
  CRISPR gRNA sequence
gagaaatttgctttaggctg

SEQ ID NO: 691868 - DNA, 20 bp, Artificial
  CRISPR gRNA sequence
aatttgctttaggctgaggt

SEQ ID NO: 691869 - DNA, 20 bp, Artificial
  CRISPR gRNA sequence
ttgctttaggctgaggttgg

SEQ ID NO: 691870 - DNA, 20 bp, Artificial
  CRISPR gRNA sequence
tgctttaggctgaggttgga

SEQ ID NO: 691871 - DNA, 20 bp, Artificial
  CRISPR gRNA sequence
ctttaggctgaggttggaag

SEQ ID NO: 691872 - DNA, 20 bp, Artificial
  CRISPR gRNA sequence
tctttgtattactattattt

SEQ ID NO: 691873 - DNA, 20 bp, Artificial
  CRISPR gRNA sequence
tgtattactattattttaga

SEQ ID NO: 691874 - DNA, 20 bp, Artificial
  CRISPR gRNA sequence
gtattactattattttagat

SEQ ID NO: 691875 - DNA, 20 bp, Artificial
  CRISPR gRNA sequence
tattactattattttagatg

SEQ ID NO: 691876 - DNA, 20 bp, Artificial
  CRISPR gRNA sequence
ggggtcttgctatgttgtcc

SEQ ID NO: 691877 - DNA, 20 bp, Artificial
  CRISPR gRNA sequence
tcttgctatgttgtccaagc

SEQ ID NO: 691878 - DNA, 20 bp, Artificial
  CRISPR gRNA sequence
ttgctatgttgtccaagctg

SEQ ID NO: 691879 - DNA, 20 bp, Artificial
  CRISPR gRNA sequence
gctatgttgtccaagctgga

SEQ ID NO: 691880 - DNA, 20 bp, Artificial
  CRISPR gRNA sequence
atgttgtccaagctggagag

SEQ ID NO: 691881 - DNA, 20 bp, Artificial
  CRISPR gRNA sequence
tggagagaagtgactattca

SEQ ID NO: 691882 - DNA, 20 bp, Artificial
  CRISPR gRNA sequence
ggagagaagtgactattcac

SEQ ID NO: 691883 - DNA, 20 bp, Artificial
  CRISPR gRNA sequence
actattcacaggtgtgataa

SEQ ID NO: 691884 - DNA, 20 bp, Artificial
  CRISPR gRNA sequence
ggtgtgataatagcacacga

SEQ ID NO: 691885 - DNA, 20 bp, Artificial
  CRISPR gRNA sequence
acacgacagcctcaaaatcc

SEQ ID NO: 691886 - DNA, 20 bp, Artificial
  CRISPR gRNA sequence
cacgacagcctcaaaatcct

SEQ ID NO: 691887 - DNA, 20 bp, Artificial
  CRISPR gRNA sequence
agcctcaaaatcctgggctc

SEQ ID NO: 691888 - DNA, 20 bp, Artificial
  CRISPR gRNA sequence
ctcaaaatcctgggctcaag

SEQ ID NO: 691889 - DNA, 20 bp, Artificial
  CRISPR gRNA sequence
ctcaagtggttctcccatct

SEQ ID NO: 691890 - DNA, 20 bp, Artificial
  CRISPR gRNA sequence
ttctcccatctcagcctcct

SEQ ID NO: 691891 - DNA, 20 bp, Artificial
  CRISPR gRNA sequence
tcccatctcagcctcctgag

SEQ ID NO: 691892 - DNA, 20 bp, Artificial
  CRISPR gRNA sequence
atctcagcctcctgagtagc

SEQ ID NO: 691893 - DNA, 20 bp, Artificial
  CRISPR gRNA sequence
tctcagcctcctgagtagct

SEQ ID NO: 691894 - DNA, 20 bp, Artificial
  CRISPR gRNA sequence
ctcctgagtagctgggacta

SEQ ID NO: 691895 - DNA, 20 bp, Artificial
  CRISPR gRNA sequence
tcctgagtagctgggactac

SEQ ID NO: 691896 - DNA, 20 bp, Artificial
  CRISPR gRNA sequence
tgggactacaggtgtgcact

SEQ ID NO: 691897 - DNA, 20 bp, Artificial
  CRISPR gRNA sequence
aaatgctttattttgaatat

SEQ ID NO: 691898 - DNA, 20 bp, Artificial
  CRISPR gRNA sequence
tgtgaaaatctatttgatca

SEQ ID NO: 691899 - DNA, 20 bp, Artificial
  CRISPR gRNA sequence
gaaaatctatttgatcacag

SEQ ID NO: 691900 - DNA, 20 bp, Artificial
  CRISPR gRNA sequence
acagaagactttaaaataca

SEQ ID NO: 691901 - DNA, 20 bp, Artificial
  CRISPR gRNA sequence
taaaaaaaaaataaaataca

SEQ ID NO: 691902 - DNA, 20 bp, Artificial
  CRISPR gRNA sequence
aaaaaaaataaaatacacag

SEQ ID NO: 691903 - DNA, 20 bp, Artificial
  CRISPR gRNA sequence
tacacagaagaaataccacc

SEQ ID NO: 691904 - DNA, 20 bp, Artificial
  CRISPR gRNA sequence
acacagaagaaataccacct

SEQ ID NO: 691905 - DNA, 20 bp, Artificial
  CRISPR gRNA sequence
attgtattgttgaaccttcc

SEQ ID NO: 691906 - DNA, 20 bp, Artificial
  CRISPR gRNA sequence
ttgttgaaccttcctggact

SEQ ID NO: 691907 - DNA, 20 bp, Artificial
  CRISPR gRNA sequence
cctggactcagtgtgactgt

SEQ ID NO: 691908 - DNA, 20 bp, Artificial
  CRISPR gRNA sequence
tcagtgtgactgttggtccc

SEQ ID NO: 691909 - DNA, 20 bp, Artificial
  CRISPR gRNA sequence
agtgtgactgttggtccctg

SEQ ID NO: 691910 - DNA, 20 bp, Artificial
  CRISPR gRNA sequence
ccctggagctgtcctttgcg

SEQ ID NO: 691911 - DNA, 20 bp, Artificial
  CRISPR gRNA sequence
ggtgctgatttccattttgt

SEQ ID NO: 691912 - DNA, 20 bp, Artificial
  CRISPR gRNA sequence
gctgatttccattttgttgg

SEQ ID NO: 691913 - DNA, 20 bp, Artificial
  CRISPR gRNA sequence
gatttccattttgttggtgg

SEQ ID NO: 691914 - DNA, 20 bp, Artificial
  CRISPR gRNA sequence
cacaatttcactttgtcact

SEQ ID NO: 691915 - DNA, 20 bp, Artificial
  CRISPR gRNA sequence
acaatttcactttgtcactg

SEQ ID NO: 691916 - DNA, 20 bp, Artificial
  CRISPR gRNA sequence
tttcactttgtcactgaggc

SEQ ID NO: 691917 - DNA, 20 bp, Artificial
  CRISPR gRNA sequence
tcactttgtcactgaggctg

SEQ ID NO: 691918 - DNA, 20 bp, Artificial
  CRISPR gRNA sequence
ttgtcactgaggctggagtg

SEQ ID NO: 691919 - DNA, 20 bp, Artificial
  CRISPR gRNA sequence
tcactgaggctggagtgcag

SEQ ID NO: 691920 - DNA, 20 bp, Artificial
  CRISPR gRNA sequence
ggagtgcagtggtgcgacct

SEQ ID NO: 691921 - DNA, 20 bp, Artificial
  CRISPR gRNA sequence
tcactgcaacctccgcctct

SEQ ID NO: 691922 - DNA, 20 bp, Artificial
  CRISPR gRNA sequence
cactgcaacctccgcctctc

SEQ ID NO: 691923 - DNA, 20 bp, Artificial
  CRISPR gRNA sequence
aacctccgcctctcgggttc

SEQ ID NO: 691924 - DNA, 20 bp, Artificial
  CRISPR gRNA sequence
ttcaagtgatttccatgcct

SEQ ID NO: 691925 - DNA, 20 bp, Artificial
  CRISPR gRNA sequence
tttccatgcctcagcctcct

SEQ ID NO: 691926 - DNA, 20 bp, Artificial
  CRISPR gRNA sequence
ccatgcctcagcctcctgag

SEQ ID NO: 691927 - DNA, 20 bp, Artificial
  CRISPR gRNA sequence
cctcagcctcctgagtagct

SEQ ID NO: 691928 - DNA, 20 bp, Artificial
  CRISPR gRNA sequence
agattacacacatgcgccac

SEQ ID NO: 691929 - DNA, 20 bp, Artificial
  CRISPR gRNA sequence
gattacacacatgcgccacc

SEQ ID NO: 691930 - DNA, 20 bp, Artificial
  CRISPR gRNA sequence
cacacatgcgccaccaggcc

SEQ ID NO: 691931 - DNA, 20 bp, Artificial
  CRISPR gRNA sequence
cagcaaattttttgtatttt

SEQ ID NO: 691932 - DNA, 20 bp, Artificial
  CRISPR gRNA sequence
caaattttttgtatttttag

SEQ ID NO: 691933 - DNA, 20 bp, Artificial
  CRISPR gRNA sequence
aattttttgtatttttagta

SEQ ID NO: 691934 - DNA, 20 bp, Artificial
  CRISPR gRNA sequence
ttttgtatttttagtagaga

SEQ ID NO: 691935 - DNA, 20 bp, Artificial
  CRISPR gRNA sequence
tttgtatttttagtagagac

SEQ ID NO: 691936 - DNA, 20 bp, Artificial
  CRISPR gRNA sequence
ttgtatttttagtagagaca

SEQ ID NO: 691937 - DNA, 20 bp, Artificial
  CRISPR gRNA sequence
gagacagggttttgccatat

SEQ ID NO: 691938 - DNA, 20 bp, Artificial
  CRISPR gRNA sequence
cagggttttgccatattggc

SEQ ID NO: 691939 - DNA, 20 bp, Artificial
  CRISPR gRNA sequence
ttttgccatattggccagtc

SEQ ID NO: 691940 - DNA, 20 bp, Artificial
  CRISPR gRNA sequence
ggtctcgaactcccgacctc

SEQ ID NO: 691941 - DNA, 20 bp, Artificial
  CRISPR gRNA sequence
ctcaagtgatccacctgcct

SEQ ID NO: 691942 - DNA, 20 bp, Artificial
  CRISPR gRNA sequence
ccacctgcctcagcttctca

SEQ ID NO: 691943 - DNA, 20 bp, Artificial
  CRISPR gRNA sequence
gcctcagcttctcaaagtgc

SEQ ID NO: 691944 - DNA, 20 bp, Artificial
  CRISPR gRNA sequence
cctcagcttctcaaagtgct

SEQ ID NO: 691945 - DNA, 20 bp, Artificial
  CRISPR gRNA sequence
ttctcaaagtgctgggatta

SEQ ID NO: 691946 - DNA, 20 bp, Artificial
  CRISPR gRNA sequence
tctcaaagtgctgggattac

SEQ ID NO: 691947 - DNA, 20 bp, Artificial
  CRISPR gRNA sequence
agtgctgggattacaggaat

SEQ ID NO: 691948 - DNA, 20 bp, Artificial
  CRISPR gRNA sequence
tgggattacaggaatgagcc

SEQ ID NO: 691949 - DNA, 20 bp, Artificial
  CRISPR gRNA sequence
gggattacaggaatgagcca

SEQ ID NO: 691950 - DNA, 20 bp, Artificial
  CRISPR gRNA sequence
caggaatgagccaaggcgcc

SEQ ID NO: 691951 - DNA, 20 bp, Artificial
  CRISPR gRNA sequence
tctctatgtatatattttta

SEQ ID NO: 691952 - DNA, 20 bp, Artificial
  CRISPR gRNA sequence
ctctatgtatatatttttat

SEQ ID NO: 691953 - DNA, 20 bp, Artificial
  CRISPR gRNA sequence
tataggtatctttattgtac

SEQ ID NO: 691954 - DNA, 20 bp, Artificial
  CRISPR gRNA sequence
ataggtatctttattgtaca

SEQ ID NO: 691955 - DNA, 20 bp, Artificial
  CRISPR gRNA sequence
aaggttgcattcatatgtta

SEQ ID NO: 691956 - DNA, 20 bp, Artificial
  CRISPR gRNA sequence
aggttgcattcatatgttat

SEQ ID NO: 691957 - DNA, 20 bp, Artificial
  CRISPR gRNA sequence
ttttgaatgtattattatac

SEQ ID NO: 691958 - DNA, 20 bp, Artificial
  CRISPR gRNA sequence
tgaatgtattattatacaag

SEQ ID NO: 691959 - DNA, 20 bp, Artificial
  CRISPR gRNA sequence
catgttgtaaactctgtata

SEQ ID NO: 691960 - DNA, 20 bp, Artificial
  CRISPR gRNA sequence
ataaagtttacatgcttttt

SEQ ID NO: 691961 - DNA, 20 bp, Artificial
  CRISPR gRNA sequence
agtttacatgcttttttggc

SEQ ID NO: 691962 - DNA, 20 bp, Artificial
  CRISPR gRNA sequence
acatgcttttttggccggca

SEQ ID NO: 691963 - DNA, 20 bp, Artificial
  CRISPR gRNA sequence
tgcttttttggccggcatgg

SEQ ID NO: 691964 - DNA, 20 bp, Artificial
  CRISPR gRNA sequence
gtggctcacgcctgtaatcc

SEQ ID NO: 691965 - DNA, 20 bp, Artificial
  CRISPR gRNA sequence
cgcctgtaatcccagcactt

SEQ ID NO: 691966 - DNA, 20 bp, Artificial
  CRISPR gRNA sequence
gcctgtaatcccagcacttt

SEQ ID NO: 691967 - DNA, 20 bp, Artificial
  CRISPR gRNA sequence
ctgtaatcccagcactttgg

SEQ ID NO: 691968 - DNA, 20 bp, Artificial
  CRISPR gRNA sequence
tgtaatcccagcactttggg

SEQ ID NO: 691969 - DNA, 20 bp, Artificial
  CRISPR gRNA sequence
tcccagcactttgggaggcc

SEQ ID NO: 691970 - DNA, 20 bp, Artificial
  CRISPR gRNA sequence
cccagcactttgggaggccg

SEQ ID NO: 691971 - DNA, 20 bp, Artificial
  CRISPR gRNA sequence
agcactttgggaggccgagg

SEQ ID NO: 691972 - DNA, 20 bp, Artificial
  CRISPR gRNA sequence
gcactttgggaggccgaggt

SEQ ID NO: 691973 - DNA, 20 bp, Artificial
  CRISPR gRNA sequence
ctttgggaggccgaggtggg

SEQ ID NO: 691974 - DNA, 20 bp, Artificial
  CRISPR gRNA sequence
ccgaggtgggtggatcactt

SEQ ID NO: 691975 - DNA, 20 bp, Artificial
  CRISPR gRNA sequence
cgaggtgggtggatcacttg

SEQ ID NO: 691976 - DNA, 20 bp, Artificial
  CRISPR gRNA sequence
gtgggtggatcacttgaggt

SEQ ID NO: 691977 - DNA, 20 bp, Artificial
  CRISPR gRNA sequence
tgggtggatcacttgaggtc

SEQ ID NO: 691978 - DNA, 20 bp, Artificial
  CRISPR gRNA sequence
tcacttgaggtcaggaattc

SEQ ID NO: 691979 - DNA, 20 bp, Artificial
  CRISPR gRNA sequence
tgaggtcaggaattcgagac

SEQ ID NO: 691980 - DNA, 20 bp, Artificial
  CRISPR gRNA sequence
tcaggaattcgagaccagac

SEQ ID NO: 691981 - DNA, 20 bp, Artificial
  CRISPR gRNA sequence
cgagaccagactggccaaca

SEQ ID NO: 691982 - DNA, 20 bp, Artificial
  CRISPR gRNA sequence
tactaaaaaatacaaaaaat

SEQ ID NO: 691983 - DNA, 20 bp, Artificial
  CRISPR gRNA sequence
aaaaaatacaaaaaattagc

SEQ ID NO: 691984 - DNA, 20 bp, Artificial
  CRISPR gRNA sequence
aaaaatacaaaaaattagcc

SEQ ID NO: 691985 - DNA, 20 bp, Artificial
  CRISPR gRNA sequence
aaatacaaaaaattagccag

SEQ ID NO: 691986 - DNA, 20 bp, Artificial
  CRISPR gRNA sequence
caaaaaattagccaggagtc

SEQ ID NO: 691987 - DNA, 20 bp, Artificial
  CRISPR gRNA sequence
aaaaaattagccaggagtct

SEQ ID NO: 691988 - DNA, 20 bp, Artificial
  CRISPR gRNA sequence
ggagtctaggcatgtgcctg

SEQ ID NO: 691989 - DNA, 20 bp, Artificial
  CRISPR gRNA sequence
taggcatgtgcctgtagtcc

SEQ ID NO: 691990 - DNA, 20 bp, Artificial
  CRISPR gRNA sequence
tgcctgtagtcccagctact

SEQ ID NO: 691991 - DNA, 20 bp, Artificial
  CRISPR gRNA sequence
gcctgtagtcccagctactc

SEQ ID NO: 691992 - DNA, 20 bp, Artificial
  CRISPR gRNA sequence
tcccagctactcaggatgct

SEQ ID NO: 691993 - DNA, 20 bp, Artificial
  CRISPR gRNA sequence
agctactcaggatgctgagc

SEQ ID NO: 691994 - DNA, 20 bp, Artificial
  CRISPR gRNA sequence
gctactcaggatgctgagcc

SEQ ID NO: 691995 - DNA, 20 bp, Artificial
  CRISPR gRNA sequence
tactcaggatgctgagccag

SEQ ID NO: 691996 - DNA, 20 bp, Artificial
  CRISPR gRNA sequence
ccaggagaattgcttgaacc

SEQ ID NO: 691997 - DNA, 20 bp, Artificial
  CRISPR gRNA sequence
caggagaattgcttgaaccc

SEQ ID NO: 691998 - DNA, 20 bp, Artificial
  CRISPR gRNA sequence
ggagaattgcttgaacccag

SEQ ID NO: 691999 - DNA, 20 bp, Artificial
  CRISPR gRNA sequence
gagaattgcttgaacccagg

SEQ ID NO: 692000 - DNA, 20 bp, Artificial
  CRISPR gRNA sequence
aattgcttgaacccaggagg

SEQ ID NO: 692001 - DNA, 20 bp, Artificial
  CRISPR gRNA sequence
aacccaggaggcagatgttg

SEQ ID NO: 692002 - DNA, 20 bp, Artificial
  CRISPR gRNA sequence
caggaggcagatgttgcagt

SEQ ID NO: 692003 - DNA, 20 bp, Artificial
  CRISPR gRNA sequence
ggcagatgttgcagtgagcc

SEQ ID NO: 692004 - DNA, 20 bp, Artificial
  CRISPR gRNA sequence
agatcactgccactgtactc

SEQ ID NO: 692005 - DNA, 20 bp, Artificial
  CRISPR gRNA sequence
actgccactgtactccagcc

SEQ ID NO: 692006 - DNA, 20 bp, Artificial
  CRISPR gRNA sequence
ctgccactgtactccagcct

SEQ ID NO: 692007 - DNA, 20 bp, Artificial
  CRISPR gRNA sequence
ctgtactccagcctgggtga

SEQ ID NO: 692008 - DNA, 20 bp, Artificial
  CRISPR gRNA sequence
tccagcctgggtgacagaat

SEQ ID NO: 692009 - DNA, 20 bp, Artificial
  CRISPR gRNA sequence
aaaaaatttttaaatttaaa

SEQ ID NO: 692010 - DNA, 20 bp, Artificial
  CRISPR gRNA sequence
aaaagttgacacacttttac

SEQ ID NO: 692011 - DNA, 20 bp, Artificial
  CRISPR gRNA sequence
ttacaagctgcatcccatct

SEQ ID NO: 692012 - DNA, 20 bp, Artificial
  CRISPR gRNA sequence
agctgcatcccatctcagat

SEQ ID NO: 692013 - DNA, 20 bp, Artificial
  CRISPR gRNA sequence
gctgcatcccatctcagata

SEQ ID NO: 692014 - DNA, 20 bp, Artificial
  CRISPR gRNA sequence
tgcatcccatctcagataag

SEQ ID NO: 692015 - DNA, 20 bp, Artificial
  CRISPR gRNA sequence
gcatcccatctcagataagg

SEQ ID NO: 692016 - DNA, 20 bp, Artificial
  CRISPR gRNA sequence
gataaggaggtgatgtaact

SEQ ID NO: 692017 - DNA, 20 bp, Artificial
  CRISPR gRNA sequence
gtgatgtaactgagttcttt

SEQ ID NO: 692018 - DNA, 20 bp, Artificial
  CRISPR gRNA sequence
gctttcatcttatctttttg

SEQ ID NO: 692019 - DNA, 20 bp, Artificial
  CRISPR gRNA sequence
ctttcatcttatctttttgt

SEQ ID NO: 692020 - DNA, 20 bp, Artificial
  CRISPR gRNA sequence
tttgtaggtaatattttgac

SEQ ID NO: 692021 - DNA, 20 bp, Artificial
  CRISPR gRNA sequence
gacaagcatgtttgtacata

SEQ ID NO: 692022 - DNA, 20 bp, Artificial
  CRISPR gRNA sequence
tgtacataaagattctccta

SEQ ID NO: 692023 - DNA, 20 bp, Artificial
  CRISPR gRNA sequence
cataaagattctcctatggt

SEQ ID NO: 692024 - DNA, 20 bp, Artificial
  CRISPR gRNA sequence
ataaagattctcctatggtt

SEQ ID NO: 692025 - DNA, 20 bp, Artificial
  CRISPR gRNA sequence
gttgggattttaaaaattca

SEQ ID NO: 692026 - DNA, 20 bp, Artificial
  CRISPR gRNA sequence
ttaaaaattcatagactact

SEQ ID NO: 692027 - DNA, 20 bp, Artificial
  CRISPR gRNA sequence
taaaaattcatagactactc

SEQ ID NO: 692028 - DNA, 20 bp, Artificial
  CRISPR gRNA sequence
aattcatagactactcaggc

SEQ ID NO: 692029 - DNA, 20 bp, Artificial
  CRISPR gRNA sequence
attcatagactactcaggcc

SEQ ID NO: 692030 - DNA, 20 bp, Artificial
  CRISPR gRNA sequence
tagactactcaggccaggtg

SEQ ID NO: 692031 - DNA, 20 bp, Artificial
  CRISPR gRNA sequence
caggccaggtgcggtgcctc

SEQ ID NO: 692032 - DNA, 20 bp, Artificial
  CRISPR gRNA sequence
agcctgtaatctcaacacat

SEQ ID NO: 692033 - DNA, 20 bp, Artificial
  CRISPR gRNA sequence
ctgtaatctcaacacattgg

SEQ ID NO: 692034 - DNA, 20 bp, Artificial
  CRISPR gRNA sequence
tgtaatctcaacacattgga

SEQ ID NO: 692035 - DNA, 20 bp, Artificial
  CRISPR gRNA sequence
tctcaacacattggaaggcc

SEQ ID NO: 692036 - DNA, 20 bp, Artificial
  CRISPR gRNA sequence
ctcaacacattggaaggcca

SEQ ID NO: 692037 - DNA, 20 bp, Artificial
  CRISPR gRNA sequence
caacacattggaaggccaag

SEQ ID NO: 692038 - DNA, 20 bp, Artificial
  CRISPR gRNA sequence
aacacattggaaggccaagg

SEQ ID NO: 692039 - DNA, 20 bp, Artificial
  CRISPR gRNA sequence
acacattggaaggccaagga

SEQ ID NO: 692040 - DNA, 20 bp, Artificial
  CRISPR gRNA sequence
cattggaaggccaaggaggg

SEQ ID NO: 692041 - DNA, 20 bp, Artificial
  CRISPR gRNA sequence
ccaaggagggtggattgtct

SEQ ID NO: 692042 - DNA, 20 bp, Artificial
  CRISPR gRNA sequence
gagggtggattgtctgagcc

SEQ ID NO: 692043 - DNA, 20 bp, Artificial
  CRISPR gRNA sequence
ggtggattgtctgagcccag

SEQ ID NO: 692044 - DNA, 20 bp, Artificial
  CRISPR gRNA sequence
ttgtctgagcccagaagttc

SEQ ID NO: 692045 - DNA, 20 bp, Artificial
  CRISPR gRNA sequence
tgagcccagaagttcaagac

SEQ ID NO: 692046 - DNA, 20 bp, Artificial
  CRISPR gRNA sequence
ccagaagttcaagaccagcc

SEQ ID NO: 692047 - DNA, 20 bp, Artificial
  CRISPR gRNA sequence
cagaagttcaagaccagcct

SEQ ID NO: 692048 - DNA, 20 bp, Artificial
  CRISPR gRNA sequence
caagaccagcctgggcaaca

SEQ ID NO: 692049 - DNA, 20 bp, Artificial
  CRISPR gRNA sequence
aaaaaatacaaaaaaaaaat

SEQ ID NO: 692050 - DNA, 20 bp, Artificial
  CRISPR gRNA sequence
aatacaaaaaaaaaattagc

SEQ ID NO: 692051 - DNA, 20 bp, Artificial
  CRISPR gRNA sequence
atacaaaaaaaaaattagct

SEQ ID NO: 692052 - DNA, 20 bp, Artificial
  CRISPR gRNA sequence
aaaaaaaaattagctgggca

SEQ ID NO: 692053 - DNA, 20 bp, Artificial
  CRISPR gRNA sequence
aaaaaattagctgggcatgg

SEQ ID NO: 692054 - DNA, 20 bp, Artificial
  CRISPR gRNA sequence
ttagctgggcatggtggcat

SEQ ID NO: 692055 - DNA, 20 bp, Artificial
  CRISPR gRNA sequence
ggcatggtggcatgagcctg

SEQ ID NO: 692056 - DNA, 20 bp, Artificial
  CRISPR gRNA sequence
gtggcatgagcctgtagtcc

SEQ ID NO: 692057 - DNA, 20 bp, Artificial
  CRISPR gRNA sequence
tggcatgagcctgtagtcct

SEQ ID NO: 692058 - DNA, 20 bp, Artificial
  CRISPR gRNA sequence
gcctgtagtcctaggtaccc

SEQ ID NO: 692059 - DNA, 20 bp, Artificial
  CRISPR gRNA sequence
tcctaggtaccccagtgttt

SEQ ID NO: 692060 - DNA, 20 bp, Artificial
  CRISPR gRNA sequence
cctaggtaccccagtgtttg

SEQ ID NO: 692061 - DNA, 20 bp, Artificial
  CRISPR gRNA sequence
aggtaccccagtgtttgagg

SEQ ID NO: 692062 - DNA, 20 bp, Artificial
  CRISPR gRNA sequence
ggtaccccagtgtttgaggt

SEQ ID NO: 692063 - DNA, 20 bp, Artificial
  CRISPR gRNA sequence
accccagtgtttgaggtggg

SEQ ID NO: 692064 - DNA, 20 bp, Artificial
  CRISPR gRNA sequence
ttgaggtgggaagattgttc

SEQ ID NO: 692065 - DNA, 20 bp, Artificial
  CRISPR gRNA sequence
gtgggaagattgttcgagcc

SEQ ID NO: 692066 - DNA, 20 bp, Artificial
  CRISPR gRNA sequence
ggaagattgttcgagcctgg

SEQ ID NO: 692067 - DNA, 20 bp, Artificial
  CRISPR gRNA sequence
gaagattgttcgagcctgga

SEQ ID NO: 692068 - DNA, 20 bp, Artificial
  CRISPR gRNA sequence
ttgttcgagcctggaaggtt

SEQ ID NO: 692069 - DNA, 20 bp, Artificial
  CRISPR gRNA sequence
tgttcgagcctggaaggttg

SEQ ID NO: 692070 - DNA, 20 bp, Artificial
  CRISPR gRNA sequence
agcctggaaggttgaggctg

SEQ ID NO: 692071 - DNA, 20 bp, Artificial
  CRISPR gRNA sequence
tggaaggttgaggctgaagt

SEQ ID NO: 692072 - DNA, 20 bp, Artificial
  CRISPR gRNA sequence
gtgatcatgccactgccctc

SEQ ID NO: 692073 - DNA, 20 bp, Artificial
  CRISPR gRNA sequence
catgccactgccctccagac

SEQ ID NO: 692074 - DNA, 20 bp, Artificial
  CRISPR gRNA sequence
atgccactgccctccagacc

SEQ ID NO: 692075 - DNA, 20 bp, Artificial
  CRISPR gRNA sequence
ctgccctccagaccaggcta

SEQ ID NO: 692076 - DNA, 20 bp, Artificial
  CRISPR gRNA sequence
gccctccagaccaggctaca

SEQ ID NO: 692077 - DNA, 20 bp, Artificial
  CRISPR gRNA sequence
tccagaccaggctacagagt

SEQ ID NO: 692078 - DNA, 20 bp, Artificial
  CRISPR gRNA sequence
tccaaaaataaataaattca

SEQ ID NO: 692079 - DNA, 20 bp, Artificial
  CRISPR gRNA sequence
aataaattcatagactactc

SEQ ID NO: 692080 - DNA, 20 bp, Artificial
  CRISPR gRNA sequence
tcaagtgataaatattaaac

SEQ ID NO: 692081 - DNA, 20 bp, Artificial
  CRISPR gRNA sequence
aagtgataaatattaaacaa

SEQ ID NO: 692082 - DNA, 20 bp, Artificial
  CRISPR gRNA sequence
agactgctttaaacatttta

SEQ ID NO: 692083 - DNA, 20 bp, Artificial
  CRISPR gRNA sequence
tcatttaacaaatacttact

SEQ ID NO: 692084 - DNA, 20 bp, Artificial
  CRISPR gRNA sequence
atttaacaaatacttactga

SEQ ID NO: 692085 - DNA, 20 bp, Artificial
  CRISPR gRNA sequence
gagctatttactgattatga

SEQ ID NO: 692086 - DNA, 20 bp, Artificial
  CRISPR gRNA sequence
tatttactgattatgatggt

SEQ ID NO: 692087 - DNA, 20 bp, Artificial
  CRISPR gRNA sequence
attatgatggtgagaaacaa

SEQ ID NO: 692088 - DNA, 20 bp, Artificial
  CRISPR gRNA sequence
tgatggtgagaaacaatggt

SEQ ID NO: 692089 - DNA, 20 bp, Artificial
  CRISPR gRNA sequence
gatggtgagaaacaatggta

SEQ ID NO: 692090 - DNA, 20 bp, Artificial
  CRISPR gRNA sequence
gagaaacaatggtaaggaaa

SEQ ID NO: 692091 - DNA, 20 bp, Artificial
  CRISPR gRNA sequence
acaatggtaaggaaacagac

SEQ ID NO: 692092 - DNA, 20 bp, Artificial
  CRISPR gRNA sequence
cagaccagatccctttatca

SEQ ID NO: 692093 - DNA, 20 bp, Artificial
  CRISPR gRNA sequence
ttatcaaagaacatacattt

SEQ ID NO: 692094 - DNA, 20 bp, Artificial
  CRISPR gRNA sequence
ttcagtgatactgactgtaa

SEQ ID NO: 692095 - DNA, 20 bp, Artificial
  CRISPR gRNA sequence
ctgactgtaatggttaattt

SEQ ID NO: 692096 - DNA, 20 bp, Artificial
  CRISPR gRNA sequence
tgactgtaatggttaatttt

SEQ ID NO: 692097 - DNA, 20 bp, Artificial
  CRISPR gRNA sequence
attttaggtgtcatattgac

SEQ ID NO: 692098 - DNA, 20 bp, Artificial
  CRISPR gRNA sequence
ggtgtcatattgactggatt

SEQ ID NO: 692099 - DNA, 20 bp, Artificial
  CRISPR gRNA sequence
gtgtcatattgactggatta

SEQ ID NO: 692100 - DNA, 20 bp, Artificial
  CRISPR gRNA sequence
tgtcatattgactggattaa

SEQ ID NO: 692101 - DNA, 20 bp, Artificial
  CRISPR gRNA sequence
tgactggattaagggatgcc

SEQ ID NO: 692102 - DNA, 20 bp, Artificial
  CRISPR gRNA sequence
tggattaagggatgcctaga

SEQ ID NO: 692103 - DNA, 20 bp, Artificial
  CRISPR gRNA sequence
ttaagggatgcctagatagc

SEQ ID NO: 692104 - DNA, 20 bp, Artificial
  CRISPR gRNA sequence
agctggtataacattatttc

SEQ ID NO: 692105 - DNA, 20 bp, Artificial
  CRISPR gRNA sequence
gctggtataacattatttct

SEQ ID NO: 692106 - DNA, 20 bp, Artificial
  CRISPR gRNA sequence
ttatttctgggtgtgcctgt

SEQ ID NO: 692107 - DNA, 20 bp, Artificial
  CRISPR gRNA sequence
tatttctgggtgtgcctgtg

SEQ ID NO: 692108 - DNA, 20 bp, Artificial
  CRISPR gRNA sequence
atttctgggtgtgcctgtga

SEQ ID NO: 692109 - DNA, 20 bp, Artificial
  CRISPR gRNA sequence
tgtgcctgtgagggtgtttc

SEQ ID NO: 692110 - DNA, 20 bp, Artificial
  CRISPR gRNA sequence
gcctgtgagggtgtttctgg

SEQ ID NO: 692111 - DNA, 20 bp, Artificial
  CRISPR gRNA sequence
cctgtgagggtgtttctgga

SEQ ID NO: 692112 - DNA, 20 bp, Artificial
  CRISPR gRNA sequence
ctgtgagggtgtttctggaa

SEQ ID NO: 692113 - DNA, 20 bp, Artificial
  CRISPR gRNA sequence
agggtgtttctggaagggat

SEQ ID NO: 692114 - DNA, 20 bp, Artificial
  CRISPR gRNA sequence
tctggaagggattggcatgt

SEQ ID NO: 692115 - DNA, 20 bp, Artificial
  CRISPR gRNA sequence
ggattggcatgtgagtgact

SEQ ID NO: 692116 - DNA, 20 bp, Artificial
  CRISPR gRNA sequence
ttggcatgtgagtgactgag

SEQ ID NO: 692117 - DNA, 20 bp, Artificial
  CRISPR gRNA sequence
tggcatgtgagtgactgagc

SEQ ID NO: 692118 - DNA, 20 bp, Artificial
  CRISPR gRNA sequence
ggcatgtgagtgactgagcg

SEQ ID NO: 692119 - DNA, 20 bp, Artificial
  CRISPR gRNA sequence
gggaaaatcctctctcgctg

SEQ ID NO: 692120 - DNA, 20 bp, Artificial
  CRISPR gRNA sequence
ggaaaatcctctctcgctgt

SEQ ID NO: 692121 - DNA, 20 bp, Artificial
  CRISPR gRNA sequence
aaatcctctctcgctgtggg

SEQ ID NO: 692122 - DNA, 20 bp, Artificial
  CRISPR gRNA sequence
gcagccacaatccaatcacc

SEQ ID NO: 692123 - DNA, 20 bp, Artificial
  CRISPR gRNA sequence
cagccacaatccaatcacct

SEQ ID NO: 692124 - DNA, 20 bp, Artificial
  CRISPR gRNA sequence
agccacaatccaatcaccta

SEQ ID NO: 692125 - DNA, 20 bp, Artificial
  CRISPR gRNA sequence
gccacaatccaatcacctag

SEQ ID NO: 692126 - DNA, 20 bp, Artificial
  CRISPR gRNA sequence
aatccaatcacctaggggcc

SEQ ID NO: 692127 - DNA, 20 bp, Artificial
  CRISPR gRNA sequence
caatcacctaggggcccaga

SEQ ID NO: 692128 - DNA, 20 bp, Artificial
  CRISPR gRNA sequence
ggggcccagatagaacaaaa

SEQ ID NO: 692129 - DNA, 20 bp, Artificial
  CRISPR gRNA sequence
gcccagatagaacaaaaaag

SEQ ID NO: 692130 - DNA, 20 bp, Artificial
  CRISPR gRNA sequence
agatagaacaaaaaagcaga

SEQ ID NO: 692131 - DNA, 20 bp, Artificial
  CRISPR gRNA sequence
gatagaacaaaaaagcagaa

SEQ ID NO: 692132 - DNA, 20 bp, Artificial
  CRISPR gRNA sequence
tagaacaaaaaagcagaaag

SEQ ID NO: 692133 - DNA, 20 bp, Artificial
  CRISPR gRNA sequence
tctctctctctctctcaatc

SEQ ID NO: 692134 - DNA, 20 bp, Artificial
  CRISPR gRNA sequence
ctctctctctctctcaatct

SEQ ID NO: 692135 - DNA, 20 bp, Artificial
  CRISPR gRNA sequence
tgggacacttttcctgccct

SEQ ID NO: 692136 - DNA, 20 bp, Artificial
  CRISPR gRNA sequence
cttttcctgcccttggacat

SEQ ID NO: 692137 - DNA, 20 bp, Artificial
  CRISPR gRNA sequence
gcccttggacatcagaactc

SEQ ID NO: 692138 - DNA, 20 bp, Artificial
  CRISPR gRNA sequence
cccttggacatcagaactcc

SEQ ID NO: 692139 - DNA, 20 bp, Artificial
  CRISPR gRNA sequence
catcagaactccaggttgta

SEQ ID NO: 692140 - DNA, 20 bp, Artificial
  CRISPR gRNA sequence
actccaggttgtatggtctt

SEQ ID NO: 692141 - DNA, 20 bp, Artificial
  CRISPR gRNA sequence
tgtatggtctttggactctt

SEQ ID NO: 692142 - DNA, 20 bp, Artificial
  CRISPR gRNA sequence
tggactcttgagtgttgcac

SEQ ID NO: 692143 - DNA, 20 bp, Artificial
  CRISPR gRNA sequence
tatcctcccacctcctcctc

SEQ ID NO: 692144 - DNA, 20 bp, Artificial
  CRISPR gRNA sequence
cacctcctcctctggcccct

SEQ ID NO: 692145 - DNA, 20 bp, Artificial
  CRISPR gRNA sequence
acctcctcctctggcccctc

SEQ ID NO: 692146 - DNA, 20 bp, Artificial
  CRISPR gRNA sequence
cctctggcccctcaggcctt

SEQ ID NO: 692147 - DNA, 20 bp, Artificial
  CRISPR gRNA sequence
gcccctcaggcctttggcct

SEQ ID NO: 692148 - DNA, 20 bp, Artificial
  CRISPR gRNA sequence
caggcctttggccttggact

SEQ ID NO: 692149 - DNA, 20 bp, Artificial
  CRISPR gRNA sequence
cctttggccttggactgagc

SEQ ID NO: 692150 - DNA, 20 bp, Artificial
  CRISPR gRNA sequence
ctttggccttggactgagcc

SEQ ID NO: 692151 - DNA, 20 bp, Artificial
  CRISPR gRNA sequence
agccaggctgctgtcttcct

SEQ ID NO: 692152 - DNA, 20 bp, Artificial
  CRISPR gRNA sequence
tgctgtcttccttggttctc

SEQ ID NO: 692153 - DNA, 20 bp, Artificial
  CRISPR gRNA sequence
ttccttggttctccagcttg

SEQ ID NO: 692154 - DNA, 20 bp, Artificial
  CRISPR gRNA sequence
tccttggttctccagcttgc

SEQ ID NO: 692155 - DNA, 20 bp, Artificial
  CRISPR gRNA sequence
ttggttctccagcttgcagg

SEQ ID NO: 692156 - DNA, 20 bp, Artificial
  CRISPR gRNA sequence
agcttgcaggtggcctctca

SEQ ID NO: 692157 - DNA, 20 bp, Artificial
  CRISPR gRNA sequence
tggcctctcatggatcttat

SEQ ID NO: 692158 - DNA, 20 bp, Artificial
  CRISPR gRNA sequence
atcagcctccataactatgt

SEQ ID NO: 692159 - DNA, 20 bp, Artificial
  CRISPR gRNA sequence
tatctatccatctactctat

SEQ ID NO: 692160 - DNA, 20 bp, Artificial
  CRISPR gRNA sequence
atctatccatctactctatt

SEQ ID NO: 692161 - DNA, 20 bp, Artificial
  CRISPR gRNA sequence
tctattgggtctttctgtct

SEQ ID NO: 692162 - DNA, 20 bp, Artificial
  CRISPR gRNA sequence
tggtaaccctgatacaccaa

SEQ ID NO: 692163 - DNA, 20 bp, Artificial
  CRISPR gRNA sequence
accaacagacaataaacaaa

SEQ ID NO: 692164 - DNA, 20 bp, Artificial
  CRISPR gRNA sequence
taaacaaatagaatctgtca

SEQ ID NO: 692165 - DNA, 20 bp, Artificial
  CRISPR gRNA sequence
aatagaatctgtcacagtat

SEQ ID NO: 692166 - DNA, 20 bp, Artificial
  CRISPR gRNA sequence
ccactgataaaaaatacacc

SEQ ID NO: 692167 - DNA, 20 bp, Artificial
  CRISPR gRNA sequence
cactgataaaaaatacacct

SEQ ID NO: 692168 - DNA, 20 bp, Artificial
  CRISPR gRNA sequence
gataaaaaatacacctaggc

SEQ ID NO: 692169 - DNA, 20 bp, Artificial
  CRISPR gRNA sequence
aaaaaatacacctaggctag

SEQ ID NO: 692170 - DNA, 20 bp, Artificial
  CRISPR gRNA sequence
atacacctaggctagaagat

SEQ ID NO: 692171 - DNA, 20 bp, Artificial
  CRISPR gRNA sequence
cacctaggctagaagattgg

SEQ ID NO: 692172 - DNA, 20 bp, Artificial
  CRISPR gRNA sequence
acctaggctagaagattggt

SEQ ID NO: 692173 - DNA, 20 bp, Artificial
  CRISPR gRNA sequence
ctaggctagaagattggtgg

SEQ ID NO: 692174 - DNA, 20 bp, Artificial
  CRISPR gRNA sequence
ggctagaagattggtgggag

SEQ ID NO: 692175 - DNA, 20 bp, Artificial
  CRISPR gRNA sequence
tagaagattggtgggagtgg

SEQ ID NO: 692176 - DNA, 20 bp, Artificial
  CRISPR gRNA sequence
agaagattggtgggagtggc

SEQ ID NO: 692177 - DNA, 20 bp, Artificial
  CRISPR gRNA sequence
attggtgggagtggcgggaa

SEQ ID NO: 692178 - DNA, 20 bp, Artificial
  CRISPR gRNA sequence
ggtgggagtggcgggaatgg

SEQ ID NO: 692179 - DNA, 20 bp, Artificial
  CRISPR gRNA sequence
gtgggagtggcgggaatggc

SEQ ID NO: 692180 - DNA, 20 bp, Artificial
  CRISPR gRNA sequence
tgggagtggcgggaatggca

SEQ ID NO: 692181 - DNA, 20 bp, Artificial
  CRISPR gRNA sequence
gtggcgggaatggcagggaa

SEQ ID NO: 692182 - DNA, 20 bp, Artificial
  CRISPR gRNA sequence
gaatggcagggaatagattt

SEQ ID NO: 692183 - DNA, 20 bp, Artificial
  CRISPR gRNA sequence
gcagggaatagatttcagaa

SEQ ID NO: 692184 - DNA, 20 bp, Artificial
  CRISPR gRNA sequence
cagggaatagatttcagaaa

SEQ ID NO: 692185 - DNA, 20 bp, Artificial
  CRISPR gRNA sequence
tagatttcagaaaaggtaac

SEQ ID NO: 692186 - DNA, 20 bp, Artificial
  CRISPR gRNA sequence
agatttcagaaaaggtaact

SEQ ID NO: 692187 - DNA, 20 bp, Artificial
  CRISPR gRNA sequence
taactgggcatgacatttct

SEQ ID NO: 692188 - DNA, 20 bp, Artificial
  CRISPR gRNA sequence
catttctgagaacttgacca

SEQ ID NO: 692189 - DNA, 20 bp, Artificial
  CRISPR gRNA sequence
atttctgagaacttgaccat

SEQ ID NO: 692190 - DNA, 20 bp, Artificial
  CRISPR gRNA sequence
ttgaccatgggacatttgaa

SEQ ID NO: 692191 - DNA, 20 bp, Artificial
  CRISPR gRNA sequence
gaccatgggacatttgaaca

SEQ ID NO: 692192 - DNA, 20 bp, Artificial
  CRISPR gRNA sequence
catttgaacagagactcgaa

SEQ ID NO: 692193 - DNA, 20 bp, Artificial
  CRISPR gRNA sequence
aacagagactcgaatggtgt

SEQ ID NO: 692194 - DNA, 20 bp, Artificial
  CRISPR gRNA sequence
acagagactcgaatggtgtg

SEQ ID NO: 692195 - DNA, 20 bp, Artificial
  CRISPR gRNA sequence
agagactcgaatggtgtgag

SEQ ID NO: 692196 - DNA, 20 bp, Artificial
  CRISPR gRNA sequence
actcgaatggtgtgaggagt

SEQ ID NO: 692197 - DNA, 20 bp, Artificial
  CRISPR gRNA sequence
ggtgtgaggagtgagccatg

SEQ ID NO: 692198 - DNA, 20 bp, Artificial
  CRISPR gRNA sequence
gagtgagccatgtggacccc

SEQ ID NO: 692199 - DNA, 20 bp, Artificial
  CRISPR gRNA sequence
agtgagccatgtggaccccc

SEQ ID NO: 692200 - DNA, 20 bp, Artificial
  CRISPR gRNA sequence
gtgagccatgtggacccccg

SEQ ID NO: 692201 - DNA, 20 bp, Artificial
  CRISPR gRNA sequence
gagccatgtggacccccggg

SEQ ID NO: 692202 - DNA, 20 bp, Artificial
  CRISPR gRNA sequence
ccatgtggacccccggggag

SEQ ID NO: 692203 - DNA, 20 bp, Artificial
  CRISPR gRNA sequence
catgtggacccccggggagc

SEQ ID NO: 692204 - DNA, 20 bp, Artificial
  CRISPR gRNA sequence
ccccggggagcaggtgcatg

SEQ ID NO: 692205 - DNA, 20 bp, Artificial
  CRISPR gRNA sequence
cccggggagcaggtgcatgt

SEQ ID NO: 692206 - DNA, 20 bp, Artificial
  CRISPR gRNA sequence
cggggagcaggtgcatgtgg

SEQ ID NO: 692207 - DNA, 20 bp, Artificial
  CRISPR gRNA sequence
gcaggtgcatgtgggagtca

SEQ ID NO: 692208 - DNA, 20 bp, Artificial
  CRISPR gRNA sequence
ggtgcatgtgggagtcacag

SEQ ID NO: 692209 - DNA, 20 bp, Artificial
  CRISPR gRNA sequence
gtgcatgtgggagtcacagc

SEQ ID NO: 692210 - DNA, 20 bp, Artificial
  CRISPR gRNA sequence
tgcatgtgggagtcacagca

SEQ ID NO: 692211 - DNA, 20 bp, Artificial
  CRISPR gRNA sequence
gcatgtgggagtcacagcag

SEQ ID NO: 692212 - DNA, 20 bp, Artificial
  CRISPR gRNA sequence
tgtgggagtcacagcagggg

SEQ ID NO: 692213 - DNA, 20 bp, Artificial
  CRISPR gRNA sequence
gtgggagtcacagcaggggc

SEQ ID NO: 692214 - DNA, 20 bp, Artificial
  CRISPR gRNA sequence
ggagtcacagcaggggcagg

SEQ ID NO: 692215 - DNA, 20 bp, Artificial
  CRISPR gRNA sequence
gtcacagcaggggcaggtag

SEQ ID NO: 692216 - DNA, 20 bp, Artificial
  CRISPR gRNA sequence
cacagcaggggcaggtagca

SEQ ID NO: 692217 - DNA, 20 bp, Artificial
  CRISPR gRNA sequence
gcaggggcaggtagcagaga

SEQ ID NO: 692218 - DNA, 20 bp, Artificial
  CRISPR gRNA sequence
caggggcaggtagcagagac

SEQ ID NO: 692219 - DNA, 20 bp, Artificial
  CRISPR gRNA sequence
ggcaggtagcagagacagga

SEQ ID NO: 692220 - DNA, 20 bp, Artificial
  CRISPR gRNA sequence
caggtagcagagacaggatg

SEQ ID NO: 692221 - DNA, 20 bp, Artificial
  CRISPR gRNA sequence
gtagcagagacaggatggag

SEQ ID NO: 692222 - DNA, 20 bp, Artificial
  CRISPR gRNA sequence
acaggatggagcagtgacaa

SEQ ID NO: 692223 - DNA, 20 bp, Artificial
  CRISPR gRNA sequence
caggatggagcagtgacaaa

SEQ ID NO: 692224 - DNA, 20 bp, Artificial
  CRISPR gRNA sequence
atggagcagtgacaaaaggc

SEQ ID NO: 692225 - DNA, 20 bp, Artificial
  CRISPR gRNA sequence
cagtgacaaaaggctggtgt

SEQ ID NO: 692226 - DNA, 20 bp, Artificial
  CRISPR gRNA sequence
tgacaaaaggctggtgtgag

SEQ ID NO: 692227 - DNA, 20 bp, Artificial
  CRISPR gRNA sequence
acaaaaggctggtgtgagtg

SEQ ID NO: 692228 - DNA, 20 bp, Artificial
  CRISPR gRNA sequence
aggctggtgtgagtggagat

SEQ ID NO: 692229 - DNA, 20 bp, Artificial
  CRISPR gRNA sequence
tggtgtgagtggagatgagt

SEQ ID NO: 692230 - DNA, 20 bp, Artificial
  CRISPR gRNA sequence
gtgagtggagatgagtgagc

SEQ ID NO: 692231 - DNA, 20 bp, Artificial
  CRISPR gRNA sequence
tgagtggagatgagtgagct

SEQ ID NO: 692232 - DNA, 20 bp, Artificial
  CRISPR gRNA sequence
ggagatgagtgagctgggct

SEQ ID NO: 692233 - DNA, 20 bp, Artificial
  CRISPR gRNA sequence
tgagtgagctgggctgagaa

SEQ ID NO: 692234 - DNA, 20 bp, Artificial
  CRISPR gRNA sequence
gtgagctgggctgagaatgg

SEQ ID NO: 692235 - DNA, 20 bp, Artificial
  CRISPR gRNA sequence
tgagctgggctgagaatggc

SEQ ID NO: 692236 - DNA, 20 bp, Artificial
  CRISPR gRNA sequence
tgggctgagaatggcgggat

SEQ ID NO: 692237 - DNA, 20 bp, Artificial
  CRISPR gRNA sequence
gggctgagaatggcgggatg

SEQ ID NO: 692238 - DNA, 20 bp, Artificial
  CRISPR gRNA sequence
agaatggcgggatgaggcca

SEQ ID NO: 692239 - DNA, 20 bp, Artificial
  CRISPR gRNA sequence
gaatggcgggatgaggccac

SEQ ID NO: 692240 - DNA, 20 bp, Artificial
  CRISPR gRNA sequence
aatggcgggatgaggccaca

SEQ ID NO: 692241 - DNA, 20 bp, Artificial
  CRISPR gRNA sequence
atggcgggatgaggccacag

SEQ ID NO: 692242 - DNA, 20 bp, Artificial
  CRISPR gRNA sequence
ggccacaggggtcctatgat

SEQ ID NO: 692243 - DNA, 20 bp, Artificial
  CRISPR gRNA sequence
gccacaggggtcctatgatg

SEQ ID NO: 692244 - DNA, 20 bp, Artificial
  CRISPR gRNA sequence
ccacaggggtcctatgatga

SEQ ID NO: 692245 - DNA, 20 bp, Artificial
  CRISPR gRNA sequence
cacaggggtcctatgatgag

SEQ ID NO: 692246 - DNA, 20 bp, Artificial
  CRISPR gRNA sequence
gtcctatgatgaggggcttg

SEQ ID NO: 692247 - DNA, 20 bp, Artificial
  CRISPR gRNA sequence
tcctatgatgaggggcttgt

SEQ ID NO: 692248 - DNA, 20 bp, Artificial
  CRISPR gRNA sequence
gatgaggggcttgtaggaaa

SEQ ID NO: 692249 - DNA, 20 bp, Artificial
  CRISPR gRNA sequence
aggggcttgtaggaaacggt

SEQ ID NO: 692250 - DNA, 20 bp, Artificial
  CRISPR gRNA sequence
gggcttgtaggaaacggtga

SEQ ID NO: 692251 - DNA, 20 bp, Artificial
  CRISPR gRNA sequence
gtaggaaacggtgagagact

SEQ ID NO: 692252 - DNA, 20 bp, Artificial
  CRISPR gRNA sequence
taggaaacggtgagagactg

SEQ ID NO: 692253 - DNA, 20 bp, Artificial
  CRISPR gRNA sequence
gactgaggtttcattgtgcc

SEQ ID NO: 692254 - DNA, 20 bp, Artificial
  CRISPR gRNA sequence
actgaggtttcattgtgcct

SEQ ID NO: 692255 - DNA, 20 bp, Artificial
  CRISPR gRNA sequence
aggtttcattgtgcctagga

SEQ ID NO: 692256 - DNA, 20 bp, Artificial
  CRISPR gRNA sequence
tcattgtgcctaggaaagaa

SEQ ID NO: 692257 - DNA, 20 bp, Artificial
  CRISPR gRNA sequence
cattgtgcctaggaaagaaa

SEQ ID NO: 692258 - DNA, 20 bp, Artificial
  CRISPR gRNA sequence
attgtgcctaggaaagaaaa

SEQ ID NO: 692259 - DNA, 20 bp, Artificial
  CRISPR gRNA sequence
gcctaggaaagaaaagggct

SEQ ID NO: 692260 - DNA, 20 bp, Artificial
  CRISPR gRNA sequence
cctaggaaagaaaagggctg

SEQ ID NO: 692261 - DNA, 20 bp, Artificial
  CRISPR gRNA sequence
gaaaagggctgaggtgttca

SEQ ID NO: 692262 - DNA, 20 bp, Artificial
  CRISPR gRNA sequence
aaaagggctgaggtgttcat

SEQ ID NO: 692263 - DNA, 20 bp, Artificial
  CRISPR gRNA sequence
atatgtcctaattttcgttt

SEQ ID NO: 692264 - DNA, 20 bp, Artificial
  CRISPR gRNA sequence
atgtcctaattttcgtttga

SEQ ID NO: 692265 - DNA, 20 bp, Artificial
  CRISPR gRNA sequence
tgtcctaattttcgtttgag

SEQ ID NO: 692266 - DNA, 20 bp, Artificial
  CRISPR gRNA sequence
ggctcactctgcctttgtgt

SEQ ID NO: 692267 - DNA, 20 bp, Artificial
  CRISPR gRNA sequence
ctctgcctttgtgtgagtaa

SEQ ID NO: 692268 - DNA, 20 bp, Artificial
  CRISPR gRNA sequence
gcctttgtgtgagtaatgga

SEQ ID NO: 692269 - DNA, 20 bp, Artificial
  CRISPR gRNA sequence
tttgtgtgagtaatggacag

SEQ ID NO: 692270 - DNA, 20 bp, Artificial
  CRISPR gRNA sequence
ttgtgtgagtaatggacagt

SEQ ID NO: 692271 - DNA, 20 bp, Artificial
  CRISPR gRNA sequence
gagtaatggacagtgggcat

SEQ ID NO: 692272 - DNA, 20 bp, Artificial
  CRISPR gRNA sequence
gtaatggacagtgggcatga

SEQ ID NO: 692273 - DNA, 20 bp, Artificial
  CRISPR gRNA sequence
taatggacagtgggcatgag

SEQ ID NO: 692274 - DNA, 20 bp, Artificial
  CRISPR gRNA sequence
tggacagtgggcatgagagg

SEQ ID NO: 692275 - DNA, 20 bp, Artificial
  CRISPR gRNA sequence
acagtgggcatgagaggcag

SEQ ID NO: 692276 - DNA, 20 bp, Artificial
  CRISPR gRNA sequence
cagtgggcatgagaggcagc

SEQ ID NO: 692277 - DNA, 20 bp, Artificial
  CRISPR gRNA sequence
tgggcatgagaggcagcagg

SEQ ID NO: 692278 - DNA, 20 bp, Artificial
  CRISPR gRNA sequence
atgagaggcagcaggcagcc

SEQ ID NO: 692279 - DNA, 20 bp, Artificial
  CRISPR gRNA sequence
gaggcagcaggcagcccagc

SEQ ID NO: 692280 - DNA, 20 bp, Artificial
  CRISPR gRNA sequence
cagcaggcagcccagctgga

SEQ ID NO: 692281 - DNA, 20 bp, Artificial
  CRISPR gRNA sequence
gcccagctggaaagcccttc

SEQ ID NO: 692282 - DNA, 20 bp, Artificial
  CRISPR gRNA sequence
ccttctggtttacaattctt

SEQ ID NO: 692283 - DNA, 20 bp, Artificial
  CRISPR gRNA sequence
ttctggtttacaattcttga

SEQ ID NO: 692284 - DNA, 20 bp, Artificial
  CRISPR gRNA sequence
tctggtttacaattcttgag

SEQ ID NO: 692285 - DNA, 20 bp, Artificial
  CRISPR gRNA sequence
ctggtttacaattcttgaga

SEQ ID NO: 692286 - DNA, 20 bp, Artificial
  CRISPR gRNA sequence
gtttacaattcttgagaggg

SEQ ID NO: 692287 - DNA, 20 bp, Artificial
  CRISPR gRNA sequence
attcttgagagggtggctct

SEQ ID NO: 692288 - DNA, 20 bp, Artificial
  CRISPR gRNA sequence
ttcttgagagggtggctctc

SEQ ID NO: 692289 - DNA, 20 bp, Artificial
  CRISPR gRNA sequence
ttgagagggtggctctcggg

SEQ ID NO: 692290 - DNA, 20 bp, Artificial
  CRISPR gRNA sequence
agagggtggctctcgggtgg

SEQ ID NO: 692291 - DNA, 20 bp, Artificial
  CRISPR gRNA sequence
gggtggctctcgggtggtgg

SEQ ID NO: 692292 - DNA, 20 bp, Artificial
  CRISPR gRNA sequence
ggtggctctcgggtggtggc

SEQ ID NO: 692293 - DNA, 20 bp, Artificial
  CRISPR gRNA sequence
tggctctcgggtggtggcag

SEQ ID NO: 692294 - DNA, 20 bp, Artificial
  CRISPR gRNA sequence
gctctcgggtggtggcagga

SEQ ID NO: 692295 - DNA, 20 bp, Artificial
  CRISPR gRNA sequence
ctctcgggtggtggcaggag

SEQ ID NO: 692296 - DNA, 20 bp, Artificial
  CRISPR gRNA sequence
ctcgggtggtggcaggagag

SEQ ID NO: 692297 - DNA, 20 bp, Artificial
  CRISPR gRNA sequence
ggtggcaggagaggagtgaa

SEQ ID NO: 692298 - DNA, 20 bp, Artificial
  CRISPR gRNA sequence
ggagaggagtgaaaagtgat

SEQ ID NO: 692299 - DNA, 20 bp, Artificial
  CRISPR gRNA sequence
gagtgaaaagtgattggatt

SEQ ID NO: 692300 - DNA, 20 bp, Artificial
  CRISPR gRNA sequence
tgatatacttgttaatattg

SEQ ID NO: 692301 - DNA, 20 bp, Artificial
  CRISPR gRNA sequence
ttaccttctaaccacttttt

SEQ ID NO: 692302 - DNA, 20 bp, Artificial
  CRISPR gRNA sequence
cactttttcagtgtacaatt

SEQ ID NO: 692303 - DNA, 20 bp, Artificial
  CRISPR gRNA sequence
tttttcagtgtacaattcgg

SEQ ID NO: 692304 - DNA, 20 bp, Artificial
  CRISPR gRNA sequence
gtgtacaattcggtggccta

SEQ ID NO: 692305 - DNA, 20 bp, Artificial
  CRISPR gRNA sequence
ccaccaccaatatgcatttc

SEQ ID NO: 692306 - DNA, 20 bp, Artificial
  CRISPR gRNA sequence
gaacattttcatcatcccaa

SEQ ID NO: 692307 - DNA, 20 bp, Artificial
  CRISPR gRNA sequence
ttcatcatcccaacagaaac

SEQ ID NO: 692308 - DNA, 20 bp, Artificial
  CRISPR gRNA sequence
aaactggacccattaaacca

SEQ ID NO: 692309 - DNA, 20 bp, Artificial
  CRISPR gRNA sequence
ttctccctaccctcaatttc

SEQ ID NO: 692310 - DNA, 20 bp, Artificial
  CRISPR gRNA sequence
ttctatgaatttgcctattt

SEQ ID NO: 692311 - DNA, 20 bp, Artificial
  CRISPR gRNA sequence
ctattttagctgcatcacat

SEQ ID NO: 692312 - DNA, 20 bp, Artificial
  CRISPR gRNA sequence
tatatttgtctttttgtttc

SEQ ID NO: 692313 - DNA, 20 bp, Artificial
  CRISPR gRNA sequence
tttctggctcatttcactta

SEQ ID NO: 692314 - DNA, 20 bp, Artificial
  CRISPR gRNA sequence
atttcacttacagtgttctc

SEQ ID NO: 692315 - DNA, 20 bp, Artificial
  CRISPR gRNA sequence
tttcacttacagtgttctca

SEQ ID NO: 692316 - DNA, 20 bp, Artificial
  CRISPR gRNA sequence
cctgaatttcattcactttt

SEQ ID NO: 692317 - DNA, 20 bp, Artificial
  CRISPR gRNA sequence
ctgaatttcattcactttta

SEQ ID NO: 692318 - DNA, 20 bp, Artificial
  CRISPR gRNA sequence
attccatgctatgtgcacca

SEQ ID NO: 692319 - DNA, 20 bp, Artificial
  CRISPR gRNA sequence
ttccatgctatgtgcaccat

SEQ ID NO: 692320 - DNA, 20 bp, Artificial
  CRISPR gRNA sequence
tttatctaatcatcctccga

SEQ ID NO: 692321 - DNA, 20 bp, Artificial
  CRISPR gRNA sequence
atcatcctccgatggacact

SEQ ID NO: 692322 - DNA, 20 bp, Artificial
  CRISPR gRNA sequence
actcggttgcttccaccttt

SEQ ID NO: 692323 - DNA, 20 bp, Artificial
  CRISPR gRNA sequence
tgcttccaccttttggccat

SEQ ID NO: 692324 - DNA, 20 bp, Artificial
  CRISPR gRNA sequence
gcttccaccttttggccatt

SEQ ID NO: 692325 - DNA, 20 bp, Artificial
  CRISPR gRNA sequence
caccttttggccattgggaa

SEQ ID NO: 692326 - DNA, 20 bp, Artificial
  CRISPR gRNA sequence
attgggaatagtgctgctac

SEQ ID NO: 692327 - DNA, 20 bp, Artificial
  CRISPR gRNA sequence
aatagtgctgctacgagcat

SEQ ID NO: 692328 - DNA, 20 bp, Artificial
  CRISPR gRNA sequence
gagtgtacaattatctgtgt

SEQ ID NO: 692329 - DNA, 20 bp, Artificial
  CRISPR gRNA sequence
gttcctgctttcaattcttt

SEQ ID NO: 692330 - DNA, 20 bp, Artificial
  CRISPR gRNA sequence
ttcctgctttcaattctttt

SEQ ID NO: 692331 - DNA, 20 bp, Artificial
  CRISPR gRNA sequence
tcttttgggtatatgcccaa

SEQ ID NO: 692332 - DNA, 20 bp, Artificial
  CRISPR gRNA sequence
tttgggtatatgcccaaaag

SEQ ID NO: 692333 - DNA, 20 bp, Artificial
  CRISPR gRNA sequence
atgcccaaaagtggaattgt

SEQ ID NO: 692334 - DNA, 20 bp, Artificial
  CRISPR gRNA sequence
agtggaattgttggctccta

SEQ ID NO: 692335 - DNA, 20 bp, Artificial
  CRISPR gRNA sequence
aattgtgtttttactttctt

SEQ ID NO: 692336 - DNA, 20 bp, Artificial
  CRISPR gRNA sequence
attgtgtttttactttcttg

SEQ ID NO: 692337 - DNA, 20 bp, Artificial
  CRISPR gRNA sequence
gtgtttttactttcttgagg

SEQ ID NO: 692338 - DNA, 20 bp, Artificial
  CRISPR gRNA sequence
aagcatcatactgtttttca

SEQ ID NO: 692339 - DNA, 20 bp, Artificial
  CRISPR gRNA sequence
gtaccactgtacactctcac

SEQ ID NO: 692340 - DNA, 20 bp, Artificial
  CRISPR gRNA sequence
ccactgtacactctcaccag

SEQ ID NO: 692341 - DNA, 20 bp, Artificial
  CRISPR gRNA sequence
cactctcaccagcagtgtac

SEQ ID NO: 692342 - DNA, 20 bp, Artificial
  CRISPR gRNA sequence
tccacatcttcgccaacatt

SEQ ID NO: 692343 - DNA, 20 bp, Artificial
  CRISPR gRNA sequence
atcttcgccaacatttggac

SEQ ID NO: 692344 - DNA, 20 bp, Artificial
  CRISPR gRNA sequence
cgccaacatttggactagtg

SEQ ID NO: 692345 - DNA, 20 bp, Artificial
  CRISPR gRNA sequence
acatttggactagtgaagtt

SEQ ID NO: 692346 - DNA, 20 bp, Artificial
  CRISPR gRNA sequence
gcccatttgtatatcttctt

SEQ ID NO: 692347 - DNA, 20 bp, Artificial
  CRISPR gRNA sequence
ccatttgtatatcttctttg

SEQ ID NO: 692348 - DNA, 20 bp, Artificial
  CRISPR gRNA sequence
ttgttcactcatttttgaat

SEQ ID NO: 692349 - DNA, 20 bp, Artificial
  CRISPR gRNA sequence
ttgtttgtttttctgttgtt

SEQ ID NO: 692350 - DNA, 20 bp, Artificial
  CRISPR gRNA sequence
gtttttctgttgttaagtca

SEQ ID NO: 692351 - DNA, 20 bp, Artificial
  CRISPR gRNA sequence
tcatagttctttatgtattc

SEQ ID NO: 692352 - DNA, 20 bp, Artificial
  CRISPR gRNA sequence
tctggatattaattctttat

SEQ ID NO: 692353 - DNA, 20 bp, Artificial
  CRISPR gRNA sequence
ctggatattaattctttatc

SEQ ID NO: 692354 - DNA, 20 bp, Artificial
  CRISPR gRNA sequence
ttctttatcaggtatataac

SEQ ID NO: 692355 - DNA, 20 bp, Artificial
  CRISPR gRNA sequence
ttttcttttaactctcttaa

SEQ ID NO: 692356 - DNA, 20 bp, Artificial
  CRISPR gRNA sequence
gtgtcccttgatatataaaa

SEQ ID NO: 692357 - DNA, 20 bp, Artificial
  CRISPR gRNA sequence
tgtcccttgatatataaaaa

SEQ ID NO: 692358 - DNA, 20 bp, Artificial
  CRISPR gRNA sequence
aaaaggtttttaaattttga

SEQ ID NO: 692359 - DNA, 20 bp, Artificial
  CRISPR gRNA sequence
atttattgtttttcttttat

SEQ ID NO: 692360 - DNA, 20 bp, Artificial
  CRISPR gRNA sequence
ttggttgtgcttttgctcac

SEQ ID NO: 692361 - DNA, 20 bp, Artificial
  CRISPR gRNA sequence
tgtgcttttgctcaccagcc

SEQ ID NO: 692362 - DNA, 20 bp, Artificial
  CRISPR gRNA sequence
gcttttgctcaccagccaag

SEQ ID NO: 692363 - DNA, 20 bp, Artificial
  CRISPR gRNA sequence
ttgccacatccaatgttcct

SEQ ID NO: 692364 - DNA, 20 bp, Artificial
  CRISPR gRNA sequence
tcttcaatgttttcttctaa

SEQ ID NO: 692365 - DNA, 20 bp, Artificial
  CRISPR gRNA sequence
gttttcttctaaaagattta

SEQ ID NO: 692366 - DNA, 20 bp, Artificial
  CRISPR gRNA sequence
ttttcttctaaaagatttat

SEQ ID NO: 692367 - DNA, 20 bp, Artificial
  CRISPR gRNA sequence
gatttataggttgaactcct

SEQ ID NO: 692368 - DNA, 20 bp, Artificial
  CRISPR gRNA sequence
ataggttgaactcctaagtt

SEQ ID NO: 692369 - DNA, 20 bp, Artificial
  CRISPR gRNA sequence
tgagttccttgaaccattct

SEQ ID NO: 692370 - DNA, 20 bp, Artificial
  CRISPR gRNA sequence
tgaaccattctgagttaatt

SEQ ID NO: 692371 - DNA, 20 bp, Artificial
  CRISPR gRNA sequence
attgagttaatttttgaata

SEQ ID NO: 692372 - DNA, 20 bp, Artificial
  CRISPR gRNA sequence
ttaatttttgaatatggtgt

SEQ ID NO: 692373 - DNA, 20 bp, Artificial
  CRISPR gRNA sequence
taatttttgaatatggtgta

SEQ ID NO: 692374 - DNA, 20 bp, Artificial
  CRISPR gRNA sequence
caacatcattattttgtatg

SEQ ID NO: 692375 - DNA, 20 bp, Artificial
  CRISPR gRNA sequence
aacatcattattttgtatgt

SEQ ID NO: 692376 - DNA, 20 bp, Artificial
  CRISPR gRNA sequence
ttattttgtatgtgggtatt

SEQ ID NO: 692377 - DNA, 20 bp, Artificial
  CRISPR gRNA sequence
tattttgtatgtgggtatta

SEQ ID NO: 692378 - DNA, 20 bp, Artificial
  CRISPR gRNA sequence
atgtgggtattaaggtttcc

SEQ ID NO: 692379 - DNA, 20 bp, Artificial
  CRISPR gRNA sequence
ttaaggtttcctggtactat

SEQ ID NO: 692380 - DNA, 20 bp, Artificial
  CRISPR gRNA sequence
tttcctggtactatcagctg

SEQ ID NO: 692381 - DNA, 20 bp, Artificial
  CRISPR gRNA sequence
cctggtactatcagctgaag

SEQ ID NO: 692382 - DNA, 20 bp, Artificial
  CRISPR gRNA sequence
ctggtactatcagctgaagt

SEQ ID NO: 692383 - DNA, 20 bp, Artificial
  CRISPR gRNA sequence
tggtactatcagctgaagtg

SEQ ID NO: 692384 - DNA, 20 bp, Artificial
  CRISPR gRNA sequence
agtggggctgatacacttgt

SEQ ID NO: 692385 - DNA, 20 bp, Artificial
  CRISPR gRNA sequence
gctgatacacttgtaagatg

SEQ ID NO: 692386 - DNA, 20 bp, Artificial
  CRISPR gRNA sequence
atacacttgtaagatgcagt

SEQ ID NO: 692387 - DNA, 20 bp, Artificial
  CRISPR gRNA sequence
atgcagtgagcactgataaa

SEQ ID NO: 692388 - DNA, 20 bp, Artificial
  CRISPR gRNA sequence
tgcagtgagcactgataaat

SEQ ID NO: 692389 - DNA, 20 bp, Artificial
  CRISPR gRNA sequence
atttacttgtctttactcca

SEQ ID NO: 692390 - DNA, 20 bp, Artificial
  CRISPR gRNA sequence
tttacttgtctttactccac

SEQ ID NO: 692391 - DNA, 20 bp, Artificial
  CRISPR gRNA sequence
gtctttactccacaggtgat

SEQ ID NO: 692392 - DNA, 20 bp, Artificial
  CRISPR gRNA sequence
ctttactccacaggtgattg

SEQ ID NO: 692393 - DNA, 20 bp, Artificial
  CRISPR gRNA sequence
tttactccacaggtgattgg

SEQ ID NO: 692394 - DNA, 20 bp, Artificial
  CRISPR gRNA sequence
tactccacaggtgattggag

SEQ ID NO: 692395 - DNA, 20 bp, Artificial
  CRISPR gRNA sequence
actccacaggtgattggagg

SEQ ID NO: 692396 - DNA, 20 bp, Artificial
  CRISPR gRNA sequence
aggtgattggaggaggcttt

SEQ ID NO: 692397 - DNA, 20 bp, Artificial
  CRISPR gRNA sequence
gcttttggtgacaaacccaa

SEQ ID NO: 692398 - DNA, 20 bp, Artificial
  CRISPR gRNA sequence
attataaattttaaaatgtt

SEQ ID NO: 692399 - DNA, 20 bp, Artificial
  CRISPR gRNA sequence
tataaattttaaaatgttaa

SEQ ID NO: 692400 - DNA, 20 bp, Artificial
  CRISPR gRNA sequence
aattttaaaatgttaagagt

SEQ ID NO: 692401 - DNA, 20 bp, Artificial
  CRISPR gRNA sequence
attttaaaatgttaagagtg

SEQ ID NO: 692402 - DNA, 20 bp, Artificial
  CRISPR gRNA sequence
taaaatgttaagagtgaggc

SEQ ID NO: 692403 - DNA, 20 bp, Artificial
  CRISPR gRNA sequence
tgttaagagtgaggcaagac

SEQ ID NO: 692404 - DNA, 20 bp, Artificial
  CRISPR gRNA sequence
aggcaagactagaacatcac

SEQ ID NO: 692405 - DNA, 20 bp, Artificial
  CRISPR gRNA sequence
aagactagaacatcactaga

SEQ ID NO: 692406 - DNA, 20 bp, Artificial
  CRISPR gRNA sequence
agactagaacatcactagac

SEQ ID NO: 692407 - DNA, 20 bp, Artificial
  CRISPR gRNA sequence
caggctgaaacatgctgaaa

SEQ ID NO: 692408 - DNA, 20 bp, Artificial
  CRISPR gRNA sequence
ggctgaaacatgctgaaatg

SEQ ID NO: 692409 - DNA, 20 bp, Artificial
  CRISPR gRNA sequence
gctgaaacatgctgaaatgg

SEQ ID NO: 692410 - DNA, 20 bp, Artificial
  CRISPR gRNA sequence
ctgaaacatgctgaaatgga

SEQ ID NO: 692411 - DNA, 20 bp, Artificial
  CRISPR gRNA sequence
ttccttgctttaaattttgc

SEQ ID NO: 692412 - DNA, 20 bp, Artificial
  CRISPR gRNA sequence
taaattttgctggctcacaa

SEQ ID NO: 692413 - DNA, 20 bp, Artificial
  CRISPR gRNA sequence
atggcttatgtttattgcat

SEQ ID NO: 692414 - DNA, 20 bp, Artificial
  CRISPR gRNA sequence
tggcttatgtttattgcata

SEQ ID NO: 692415 - DNA, 20 bp, Artificial
  CRISPR gRNA sequence
ggcttatgtttattgcataa

SEQ ID NO: 692416 - DNA, 20 bp, Artificial
  CRISPR gRNA sequence
gcttatgtttattgcataag

SEQ ID NO: 692417 - DNA, 20 bp, Artificial
  CRISPR gRNA sequence
cttatgtttattgcataagg

SEQ ID NO: 692418 - DNA, 20 bp, Artificial
  CRISPR gRNA sequence
tttattgcataagggggcca

SEQ ID NO: 692419 - DNA, 20 bp, Artificial
  CRISPR gRNA sequence
ttattgcataagggggccac

SEQ ID NO: 692420 - DNA, 20 bp, Artificial
  CRISPR gRNA sequence
tattgcataagggggccaca

SEQ ID NO: 692421 - DNA, 20 bp, Artificial
  CRISPR gRNA sequence
ttgcataagggggccacagg

SEQ ID NO: 692422 - DNA, 20 bp, Artificial
  CRISPR gRNA sequence
tgcataagggggccacaggg

SEQ ID NO: 692423 - DNA, 20 bp, Artificial
  CRISPR gRNA sequence
gcataagggggccacaggga

SEQ ID NO: 692424 - DNA, 20 bp, Artificial
  CRISPR gRNA sequence
ggagggttgcttgctcacat

SEQ ID NO: 692425 - DNA, 20 bp, Artificial
  CRISPR gRNA sequence
gagggttgcttgctcacata

SEQ ID NO: 692426 - DNA, 20 bp, Artificial
  CRISPR gRNA sequence
gggttgcttgctcacataag

SEQ ID NO: 692427 - DNA, 20 bp, Artificial
  CRISPR gRNA sequence
ttgctcacataaggagcccc

SEQ ID NO: 692428 - DNA, 20 bp, Artificial
  CRISPR gRNA sequence
aaggagcccctggttttctt

SEQ ID NO: 692429 - DNA, 20 bp, Artificial
  CRISPR gRNA sequence
ccctggttttcttcagaaac

SEQ ID NO: 692430 - DNA, 20 bp, Artificial
  CRISPR gRNA sequence
acaagttcaaattctccact

SEQ ID NO: 692431 - DNA, 20 bp, Artificial
  CRISPR gRNA sequence
aagttcaaattctccactta

SEQ ID NO: 692432 - DNA, 20 bp, Artificial
  CRISPR gRNA sequence
agccaaaaaaaattaattgc

SEQ ID NO: 692433 - DNA, 20 bp, Artificial
  CRISPR gRNA sequence
attgcaagatgttcaaactg

SEQ ID NO: 692434 - DNA, 20 bp, Artificial
  CRISPR gRNA sequence
caagatgttcaaactgaagt

SEQ ID NO: 692435 - DNA, 20 bp, Artificial
  CRISPR gRNA sequence
aactgaagttggcttctata

SEQ ID NO: 692436 - DNA, 20 bp, Artificial
  CRISPR gRNA sequence
agttggcttctataaagtca

SEQ ID NO: 692437 - DNA, 20 bp, Artificial
  CRISPR gRNA sequence
cttctataaagtcaaagaat

SEQ ID NO: 692438 - DNA, 20 bp, Artificial
  CRISPR gRNA sequence
ctataaagtcaaagaataag

SEQ ID NO: 692439 - DNA, 20 bp, Artificial
  CRISPR gRNA sequence
aaagtcaaagaataagcagt

SEQ ID NO: 692440 - DNA, 20 bp, Artificial
  CRISPR gRNA sequence
agtaagtgtaaaataaacct

SEQ ID NO: 692441 - DNA, 20 bp, Artificial
  CRISPR gRNA sequence
gtaagtgtaaaataaacctc

SEQ ID NO: 692442 - DNA, 20 bp, Artificial
  CRISPR gRNA sequence
aaaataaacctcaggaatcc

SEQ ID NO: 692443 - DNA, 20 bp, Artificial
  CRISPR gRNA sequence
aaataaacctcaggaatcca

SEQ ID NO: 692444 - DNA, 20 bp, Artificial
  CRISPR gRNA sequence
ggaaattctacctttttacc

SEQ ID NO: 692445 - DNA, 20 bp, Artificial
  CRISPR gRNA sequence
tctacctttttacctagaaa

SEQ ID NO: 692446 - DNA, 20 bp, Artificial
  CRISPR gRNA sequence
ggcctcacaatgcgtcgctg

SEQ ID NO: 692447 - DNA, 20 bp, Artificial
  CRISPR gRNA sequence
gcctcacaatgcgtcgctga

SEQ ID NO: 692448 - DNA, 20 bp, Artificial
  CRISPR gRNA sequence
cctcacaatgcgtcgctgaa

SEQ ID NO: 692449 - DNA, 20 bp, Artificial
  CRISPR gRNA sequence
tcacaatgcgtcgctgaagg

SEQ ID NO: 692450 - DNA, 20 bp, Artificial
  CRISPR gRNA sequence
acaatgcgtcgctgaaggga

SEQ ID NO: 692451 - DNA, 20 bp, Artificial
  CRISPR gRNA sequence
caatgcgtcgctgaagggag

SEQ ID NO: 692452 - DNA, 20 bp, Artificial
  CRISPR gRNA sequence
aatgcgtcgctgaagggaga

SEQ ID NO: 692453 - DNA, 20 bp, Artificial
  CRISPR gRNA sequence
tgaagggagagggtcccttc

SEQ ID NO: 692454 - DNA, 20 bp, Artificial
  CRISPR gRNA sequence
gaagggagagggtcccttcc

SEQ ID NO: 692455 - DNA, 20 bp, Artificial
  CRISPR gRNA sequence
cttccaggaaccccatgatg

SEQ ID NO: 692456 - DNA, 20 bp, Artificial
  CRISPR gRNA sequence
ttccaggaaccccatgatgt

SEQ ID NO: 692457 - DNA, 20 bp, Artificial
  CRISPR gRNA sequence
tccaggaaccccatgatgta

SEQ ID NO: 692458 - DNA, 20 bp, Artificial
  CRISPR gRNA sequence
ccaggaaccccatgatgtag

SEQ ID NO: 692459 - DNA, 20 bp, Artificial
  CRISPR gRNA sequence
tgatgtaggggtttctgctg

SEQ ID NO: 692460 - DNA, 20 bp, Artificial
  CRISPR gRNA sequence
ttctgctgcagtcccaaatt

SEQ ID NO: 692461 - DNA, 20 bp, Artificial
  CRISPR gRNA sequence
ttgtcccttctctctaactg

SEQ ID NO: 692462 - DNA, 20 bp, Artificial
  CRISPR gRNA sequence
tgtcccttctctctaactgc

SEQ ID NO: 692463 - DNA, 20 bp, Artificial
  CRISPR gRNA sequence
tctctaactgcaggtcccac

SEQ ID NO: 692464 - DNA, 20 bp, Artificial
  CRISPR gRNA sequence
ggtcccacaagaccttactg

SEQ ID NO: 692465 - DNA, 20 bp, Artificial
  CRISPR gRNA sequence
gcagcttcaataatttcacc

SEQ ID NO: 692466 - DNA, 20 bp, Artificial
  CRISPR gRNA sequence
tcaataatttcacctggtct

SEQ ID NO: 692467 - DNA, 20 bp, Artificial
  CRISPR gRNA sequence
tttcacctggtctaagattt

SEQ ID NO: 692468 - DNA, 20 bp, Artificial
  CRISPR gRNA sequence
ttcacctggtctaagatttg

SEQ ID NO: 692469 - DNA, 20 bp, Artificial
  CRISPR gRNA sequence
tcacctggtctaagatttga

SEQ ID NO: 692470 - DNA, 20 bp, Artificial
  CRISPR gRNA sequence
cacctggtctaagatttgag

SEQ ID NO: 692471 - DNA, 20 bp, Artificial
  CRISPR gRNA sequence
ggtttaatgctttttatttt

SEQ ID NO: 692472 - DNA, 20 bp, Artificial
  CRISPR gRNA sequence
ttttattttgagctgctgtc

SEQ ID NO: 692473 - DNA, 20 bp, Artificial
  CRISPR gRNA sequence
tttattttgagctgctgtct

SEQ ID NO: 692474 - DNA, 20 bp, Artificial
  CRISPR gRNA sequence
ttgagctgctgtctgggact

SEQ ID NO: 692475 - DNA, 20 bp, Artificial
  CRISPR gRNA sequence
gctgctgtctgggacttaga

SEQ ID NO: 692476 - DNA, 20 bp, Artificial
  CRISPR gRNA sequence
ctgctgtctgggacttagaa

SEQ ID NO: 692477 - DNA, 20 bp, Artificial
  CRISPR gRNA sequence
tcaaaatattatttctttga

SEQ ID NO: 692478 - DNA, 20 bp, Artificial
  CRISPR gRNA sequence
tctttgatggaatttgacat

SEQ ID NO: 692479 - DNA, 20 bp, Artificial
  CRISPR gRNA sequence
ttgatggaatttgacattgg

SEQ ID NO: 692480 - DNA, 20 bp, Artificial
  CRISPR gRNA sequence
ggacactctgccttcctgtg

SEQ ID NO: 692481 - DNA, 20 bp, Artificial
  CRISPR gRNA sequence
ccttcctgtgtggttcctac

SEQ ID NO: 692482 - DNA, 20 bp, Artificial
  CRISPR gRNA sequence
cttcctgtgtggttcctaca

SEQ ID NO: 692483 - DNA, 20 bp, Artificial
  CRISPR gRNA sequence
ttcctgtgtggttcctacaa

SEQ ID NO: 692484 - DNA, 20 bp, Artificial
  CRISPR gRNA sequence
ctgtgtggttcctacaaggg

SEQ ID NO: 692485 - DNA, 20 bp, Artificial
  CRISPR gRNA sequence
gatgaccttgcacttctttt

SEQ ID NO: 692486 - DNA, 20 bp, Artificial
  CRISPR gRNA sequence
acttctttttggcacttcac

SEQ ID NO: 692487 - DNA, 20 bp, Artificial
  CRISPR gRNA sequence
tctttttggcacttcactag

SEQ ID NO: 692488 - DNA, 20 bp, Artificial
  CRISPR gRNA sequence
tggcacttcactagcagtga

SEQ ID NO: 692489 - DNA, 20 bp, Artificial
  CRISPR gRNA sequence
cacttcactagcagtgatag

SEQ ID NO: 692490 - DNA, 20 bp, Artificial
  CRISPR gRNA sequence
acttcactagcagtgataga

SEQ ID NO: 692491 - DNA, 20 bp, Artificial
  CRISPR gRNA sequence
tagcagtgatagaaggtttg

SEQ ID NO: 692492 - DNA, 20 bp, Artificial
  CRISPR gRNA sequence
agtgatagaaggtttgaagt

SEQ ID NO: 692493 - DNA, 20 bp, Artificial
  CRISPR gRNA sequence
gtgatagaaggtttgaagtt

SEQ ID NO: 692494 - DNA, 20 bp, Artificial
  CRISPR gRNA sequence
tgatagaaggtttgaagtta

SEQ ID NO: 692495 - DNA, 20 bp, Artificial
  CRISPR gRNA sequence
tctttaccctctctctaatg

SEQ ID NO: 692496 - DNA, 20 bp, Artificial
  CRISPR gRNA sequence
tttaccctctctctaatgca

SEQ ID NO: 692497 - DNA, 20 bp, Artificial
  CRISPR gRNA sequence
ttaccctctctctaatgcag

SEQ ID NO: 692498 - DNA, 20 bp, Artificial
  CRISPR gRNA sequence
ctctctaatgcagaggattg

SEQ ID NO: 692499 - DNA, 20 bp, Artificial
  CRISPR gRNA sequence
tgcagaggattgcggcctgt

SEQ ID NO: 692500 - DNA, 20 bp, Artificial
  CRISPR gRNA sequence
agaggattgcggcctgttgg

SEQ ID NO: 692501 - DNA, 20 bp, Artificial
  CRISPR gRNA sequence
ggattgcggcctgttggcag

SEQ ID NO: 692502 - DNA, 20 bp, Artificial
  CRISPR gRNA sequence
attgcggcctgttggcagaa

SEQ ID NO: 692503 - DNA, 20 bp, Artificial
  CRISPR gRNA sequence
gcggcctgttggcagaagag

SEQ ID NO: 692504 - DNA, 20 bp, Artificial
  CRISPR gRNA sequence
ttggcagaagagtagtgtct

SEQ ID NO: 692505 - DNA, 20 bp, Artificial
  CRISPR gRNA sequence
tggcagaagagtagtgtctt

SEQ ID NO: 692506 - DNA, 20 bp, Artificial
  CRISPR gRNA sequence
aagagtagtgtcttgggccc

SEQ ID NO: 692507 - DNA, 20 bp, Artificial
  CRISPR gRNA sequence
atatccaatgccctgtaatg

SEQ ID NO: 692508 - DNA, 20 bp, Artificial
  CRISPR gRNA sequence
catatcatcacttctgcatg

SEQ ID NO: 692509 - DNA, 20 bp, Artificial
  CRISPR gRNA sequence
cacttctgcatgcagtctca

SEQ ID NO: 692510 - DNA, 20 bp, Artificial
  CRISPR gRNA sequence
acttctgcatgcagtctcat

SEQ ID NO: 692511 - DNA, 20 bp, Artificial
  CRISPR gRNA sequence
tctgcatgcagtctcatggg

SEQ ID NO: 692512 - DNA, 20 bp, Artificial
  CRISPR gRNA sequence
ctgcatgcagtctcatggga

SEQ ID NO: 692513 - DNA, 20 bp, Artificial
  CRISPR gRNA sequence
catgcagtctcatgggaagg

SEQ ID NO: 692514 - DNA, 20 bp, Artificial
  CRISPR gRNA sequence
atgcagtctcatgggaaggt

SEQ ID NO: 692515 - DNA, 20 bp, Artificial
  CRISPR gRNA sequence
ctcatgggaaggtgggttcc

SEQ ID NO: 692516 - DNA, 20 bp, Artificial
  CRISPR gRNA sequence
gaaggtgggttcctggaccc

SEQ ID NO: 692517 - DNA, 20 bp, Artificial
  CRISPR gRNA sequence
aaggtgggttcctggacccc

SEQ ID NO: 692518 - DNA, 20 bp, Artificial
  CRISPR gRNA sequence
ggttcctggaccccaggtta

SEQ ID NO: 692519 - DNA, 20 bp, Artificial
  CRISPR gRNA sequence
gttcctggaccccaggttac

SEQ ID NO: 692520 - DNA, 20 bp, Artificial
  CRISPR gRNA sequence
ggaccccaggttacaggcct

SEQ ID NO: 692521 - DNA, 20 bp, Artificial
  CRISPR gRNA sequence
ggttacaggcctaagcacta

SEQ ID NO: 692522 - DNA, 20 bp, Artificial
  CRISPR gRNA sequence
gttacaggcctaagcactac

SEQ ID NO: 692523 - DNA, 20 bp, Artificial
  CRISPR gRNA sequence
gcctaagcactacaggcata

SEQ ID NO: 692524 - DNA, 20 bp, Artificial
  CRISPR gRNA sequence
aagcactacaggcatacaga

SEQ ID NO: 692525 - DNA, 20 bp, Artificial
  CRISPR gRNA sequence
gcactacaggcatacagatg

SEQ ID NO: 692526 - DNA, 20 bp, Artificial
  CRISPR gRNA sequence
caggcatacagatggagctc

SEQ ID NO: 692527 - DNA, 20 bp, Artificial
  CRISPR gRNA sequence
aggcatacagatggagctcc

SEQ ID NO: 692528 - DNA, 20 bp, Artificial
  CRISPR gRNA sequence
ggcatacagatggagctcca

SEQ ID NO: 692529 - DNA, 20 bp, Artificial
  CRISPR gRNA sequence
atacagatggagctccaggg

SEQ ID NO: 692530 - DNA, 20 bp, Artificial
  CRISPR gRNA sequence
tacagatggagctccaggga

SEQ ID NO: 692531 - DNA, 20 bp, Artificial
  CRISPR gRNA sequence
acagatggagctccagggaa

SEQ ID NO: 692532 - DNA, 20 bp, Artificial
  CRISPR gRNA sequence
agatggagctccagggaagg

SEQ ID NO: 692533 - DNA, 20 bp, Artificial
  CRISPR gRNA sequence
atggagctccagggaaggga

SEQ ID NO: 692534 - DNA, 20 bp, Artificial
  CRISPR gRNA sequence
ccagggaagggagagatgac

SEQ ID NO: 692535 - DNA, 20 bp, Artificial
  CRISPR gRNA sequence
cagggaagggagagatgact

SEQ ID NO: 692536 - DNA, 20 bp, Artificial
  CRISPR gRNA sequence
agggaagggagagatgactg

SEQ ID NO: 692537 - DNA, 20 bp, Artificial
  CRISPR gRNA sequence
gaagggagagatgactgggg

SEQ ID NO: 692538 - DNA, 20 bp, Artificial
  CRISPR gRNA sequence
aagggagagatgactggggt

SEQ ID NO: 692539 - DNA, 20 bp, Artificial
  CRISPR gRNA sequence
gtgggaccacacttttcctt

SEQ ID NO: 692540 - DNA, 20 bp, Artificial
  CRISPR gRNA sequence
tgggaccacacttttccttc

SEQ ID NO: 692541 - DNA, 20 bp, Artificial
  CRISPR gRNA sequence
gggaccacacttttccttca

SEQ ID NO: 692542 - DNA, 20 bp, Artificial
  CRISPR gRNA sequence
ttttccttcagggtgtccct

SEQ ID NO: 692543 - DNA, 20 bp, Artificial
  CRISPR gRNA sequence
ttcagggtgtccctcagttc

SEQ ID NO: 692544 - DNA, 20 bp, Artificial
  CRISPR gRNA sequence
tcagggtgtccctcagttca

SEQ ID NO: 692545 - DNA, 20 bp, Artificial
  CRISPR gRNA sequence
gggtgtccctcagttcaagg

SEQ ID NO: 692546 - DNA, 20 bp, Artificial
  CRISPR gRNA sequence
gttcaaggaagcttgtactc

SEQ ID NO: 692547 - DNA, 20 bp, Artificial
  CRISPR gRNA sequence
ttcaaggaagcttgtactca

SEQ ID NO: 692548 - DNA, 20 bp, Artificial
  CRISPR gRNA sequence
tcaaggaagcttgtactcaa

SEQ ID NO: 692549 - DNA, 20 bp, Artificial
  CRISPR gRNA sequence
aaggaagcttgtactcaagg

SEQ ID NO: 692550 - DNA, 20 bp, Artificial
  CRISPR gRNA sequence
ggaagcttgtactcaaggga

SEQ ID NO: 692551 - DNA, 20 bp, Artificial
  CRISPR gRNA sequence
gcttgtactcaagggagaga

SEQ ID NO: 692552 - DNA, 20 bp, Artificial
  CRISPR gRNA sequence
actcaagggagagaaagtcc

SEQ ID NO: 692553 - DNA, 20 bp, Artificial
  CRISPR gRNA sequence
caagggagagaaagtcctgg

SEQ ID NO: 692554 - DNA, 20 bp, Artificial
  CRISPR gRNA sequence
aagggagagaaagtcctggc

SEQ ID NO: 692555 - DNA, 20 bp, Artificial
  CRISPR gRNA sequence
ctggcaggcctccttaccct

SEQ ID NO: 692556 - DNA, 20 bp, Artificial
  CRISPR gRNA sequence
ctccttacccttggcaatct

SEQ ID NO: 692557 - DNA, 20 bp, Artificial
  CRISPR gRNA sequence
acccttggcaatcttggtat

SEQ ID NO: 692558 - DNA, 20 bp, Artificial
  CRISPR gRNA sequence
cccttggcaatcttggtatt

SEQ ID NO: 692559 - DNA, 20 bp, Artificial
  CRISPR gRNA sequence
ccttggcaatcttggtattg

SEQ ID NO: 692560 - DNA, 20 bp, Artificial
  CRISPR gRNA sequence
ggcaatcttggtattggggc

SEQ ID NO: 692561 - DNA, 20 bp, Artificial
  CRISPR gRNA sequence
ctggataattatctgttatg

SEQ ID NO: 692562 - DNA, 20 bp, Artificial
  CRISPR gRNA sequence
tggataattatctgttatgt

SEQ ID NO: 692563 - DNA, 20 bp, Artificial
  CRISPR gRNA sequence
ttatctgttatgtgggtgat

SEQ ID NO: 692564 - DNA, 20 bp, Artificial
  CRISPR gRNA sequence
tatctgttatgtgggtgatt

SEQ ID NO: 692565 - DNA, 20 bp, Artificial
  CRISPR gRNA sequence
ttgggctgacttgtgcactg

SEQ ID NO: 692566 - DNA, 20 bp, Artificial
  CRISPR gRNA sequence
tgggctgacttgtgcactgc

SEQ ID NO: 692567 - DNA, 20 bp, Artificial
  CRISPR gRNA sequence
cttgtgcactgcaggatgtt

SEQ ID NO: 692568 - DNA, 20 bp, Artificial
  CRISPR gRNA sequence
tgcaggatgttcagcatccc

SEQ ID NO: 692569 - DNA, 20 bp, Artificial
  CRISPR gRNA sequence
catccctggtcattccccac

SEQ ID NO: 692570 - DNA, 20 bp, Artificial
  CRISPR gRNA sequence
ggtcattccccacaagatgc

SEQ ID NO: 692571 - DNA, 20 bp, Artificial
  CRISPR gRNA sequence
cattccccacaagatgctgg

SEQ ID NO: 692572 - DNA, 20 bp, Artificial
  CRISPR gRNA sequence
gtagcaccttctcctcactc

SEQ ID NO: 692573 - DNA, 20 bp, Artificial
  CRISPR gRNA sequence
ccttctcctcactccagtca

SEQ ID NO: 692574 - DNA, 20 bp, Artificial
  CRISPR gRNA sequence
atggcaacaaaacatttttc

SEQ ID NO: 692575 - DNA, 20 bp, Artificial
  CRISPR gRNA sequence
acaaaacatttttccagaca

SEQ ID NO: 692576 - DNA, 20 bp, Artificial
  CRISPR gRNA sequence
cagacatagctaatgtcctc

SEQ ID NO: 692577 - DNA, 20 bp, Artificial
  CRISPR gRNA sequence
acatagctaatgtcctctgg

SEQ ID NO: 692578 - DNA, 20 bp, Artificial
  CRISPR gRNA sequence
catagctaatgtcctctggt

SEQ ID NO: 692579 - DNA, 20 bp, Artificial
  CRISPR gRNA sequence
tctggtgggaaaattgctcc

SEQ ID NO: 692580 - DNA, 20 bp, Artificial
  CRISPR gRNA sequence
tgggaaaattgctcctggat

SEQ ID NO: 692581 - DNA, 20 bp, Artificial
  CRISPR gRNA sequence
ctggatgagaatacttgttt

SEQ ID NO: 692582 - DNA, 20 bp, Artificial
  CRISPR gRNA sequence
ggatgagaatacttgtttga

SEQ ID NO: 692583 - DNA, 20 bp, Artificial
  CRISPR gRNA sequence
gatgagaatacttgtttgag

SEQ ID NO: 692584 - DNA, 20 bp, Artificial
  CRISPR gRNA sequence
gagaatacttgtttgagagg

SEQ ID NO: 692585 - DNA, 20 bp, Artificial
  CRISPR gRNA sequence
gaatacttgtttgagaggta

SEQ ID NO: 692586 - DNA, 20 bp, Artificial
  CRISPR gRNA sequence
gtttgagaggtagagacact

SEQ ID NO: 692587 - DNA, 20 bp, Artificial
  CRISPR gRNA sequence
tttgagaggtagagacactc

SEQ ID NO: 692588 - DNA, 20 bp, Artificial
  CRISPR gRNA sequence
tgagaggtagagacactcag

SEQ ID NO: 692589 - DNA, 20 bp, Artificial
  CRISPR gRNA sequence
aggtagagacactcaggagc

SEQ ID NO: 692590 - DNA, 20 bp, Artificial
  CRISPR gRNA sequence
ggtagagacactcaggagct

SEQ ID NO: 692591 - DNA, 20 bp, Artificial
  CRISPR gRNA sequence
acactcaggagctgggcctg

SEQ ID NO: 692592 - DNA, 20 bp, Artificial
  CRISPR gRNA sequence
actcaggagctgggcctgta

SEQ ID NO: 692593 - DNA, 20 bp, Artificial
  CRISPR gRNA sequence
ctcaggagctgggcctgtag

SEQ ID NO: 692594 - DNA, 20 bp, Artificial
  CRISPR gRNA sequence
tcaggagctgggcctgtaga

SEQ ID NO: 692595 - DNA, 20 bp, Artificial
  CRISPR gRNA sequence
gagctgggcctgtagaggga

SEQ ID NO: 692596 - DNA, 20 bp, Artificial
  CRISPR gRNA sequence
cctgtagagggaaagtgatc

SEQ ID NO: 692597 - DNA, 20 bp, Artificial
  CRISPR gRNA sequence
gtagagggaaagtgatccag

SEQ ID NO: 692598 - DNA, 20 bp, Artificial
  CRISPR gRNA sequence
gagggaaagtgatccagaag

SEQ ID NO: 692599 - DNA, 20 bp, Artificial
  CRISPR gRNA sequence
gtgatccagaagtagataca

SEQ ID NO: 692600 - DNA, 20 bp, Artificial
  CRISPR gRNA sequence
atccagaagtagatacaaag

SEQ ID NO: 692601 - DNA, 20 bp, Artificial
  CRISPR gRNA sequence
ccagaagtagatacaaagca

SEQ ID NO: 692602 - DNA, 20 bp, Artificial
  CRISPR gRNA sequence
gaagtagatacaaagcagag

SEQ ID NO: 692603 - DNA, 20 bp, Artificial
  CRISPR gRNA sequence
aagtagatacaaagcagagt

SEQ ID NO: 692604 - DNA, 20 bp, Artificial
  CRISPR gRNA sequence
agtagatacaaagcagagtg

SEQ ID NO: 692605 - DNA, 20 bp, Artificial
  CRISPR gRNA sequence
gatacaaagcagagtggggc

SEQ ID NO: 692606 - DNA, 20 bp, Artificial
  CRISPR gRNA sequence
tacaaagcagagtggggctg

SEQ ID NO: 692607 - DNA, 20 bp, Artificial
  CRISPR gRNA sequence
aaagcagagtggggctggag

SEQ ID NO: 692608 - DNA, 20 bp, Artificial
  CRISPR gRNA sequence
cagagtggggctggagaaga

SEQ ID NO: 692609 - DNA, 20 bp, Artificial
  CRISPR gRNA sequence
agagtggggctggagaagac

SEQ ID NO: 692610 - DNA, 20 bp, Artificial
  CRISPR gRNA sequence
gtggggctggagaagacagg

SEQ ID NO: 692611 - DNA, 20 bp, Artificial
  CRISPR gRNA sequence
tggggctggagaagacagga

SEQ ID NO: 692612 - DNA, 20 bp, Artificial
  CRISPR gRNA sequence
ggggctggagaagacaggaa

SEQ ID NO: 692613 - DNA, 20 bp, Artificial
  CRISPR gRNA sequence
ggctggagaagacaggaagg

SEQ ID NO: 692614 - DNA, 20 bp, Artificial
  CRISPR gRNA sequence
gagaagacaggaagggagtc

SEQ ID NO: 692615 - DNA, 20 bp, Artificial
  CRISPR gRNA sequence
agaagacaggaagggagtct

SEQ ID NO: 692616 - DNA, 20 bp, Artificial
  CRISPR gRNA sequence
acaggaagggagtctaggtc

SEQ ID NO: 692617 - DNA, 20 bp, Artificial
  CRISPR gRNA sequence
aggaagggagtctaggtctg

SEQ ID NO: 692618 - DNA, 20 bp, Artificial
  CRISPR gRNA sequence
ggaagggagtctaggtctgg

SEQ ID NO: 692619 - DNA, 20 bp, Artificial
  CRISPR gRNA sequence
gaagggagtctaggtctgga

SEQ ID NO: 692620 - DNA, 20 bp, Artificial
  CRISPR gRNA sequence
aagggagtctaggtctggag

SEQ ID NO: 692621 - DNA, 20 bp, Artificial
  CRISPR gRNA sequence
agtctaggtctggaggggcc

SEQ ID NO: 692622 - DNA, 20 bp, Artificial
  CRISPR gRNA sequence
tctggaggggcctggcctga

SEQ ID NO: 692623 - DNA, 20 bp, Artificial
  CRISPR gRNA sequence
ggggcctggcctgatggttg

SEQ ID NO: 692624 - DNA, 20 bp, Artificial
  CRISPR gRNA sequence
gggcctggcctgatggttga

SEQ ID NO: 692625 - DNA, 20 bp, Artificial
  CRISPR gRNA sequence
tggcctgatggttgaaggtc

SEQ ID NO: 692626 - DNA, 20 bp, Artificial
  CRISPR gRNA sequence
gcctgatggttgaaggtctg

SEQ ID NO: 692627 - DNA, 20 bp, Artificial
  CRISPR gRNA sequence
atggttgaaggtctggagct

SEQ ID NO: 692628 - DNA, 20 bp, Artificial
  CRISPR gRNA sequence
aggtctggagctcagaacct

SEQ ID NO: 692629 - DNA, 20 bp, Artificial
  CRISPR gRNA sequence
ggtctggagctcagaacctc

SEQ ID NO: 692630 - DNA, 20 bp, Artificial
  CRISPR gRNA sequence
gtctggagctcagaacctca

SEQ ID NO: 692631 - DNA, 20 bp, Artificial
  CRISPR gRNA sequence
gagctcagaacctcagggta

SEQ ID NO: 692632 - DNA, 20 bp, Artificial
  CRISPR gRNA sequence
agctcagaacctcagggtat

SEQ ID NO: 692633 - DNA, 20 bp, Artificial
  CRISPR gRNA sequence
gctcagaacctcagggtatg

SEQ ID NO: 692634 - DNA, 20 bp, Artificial
  CRISPR gRNA sequence
cctcagggtatggggaacta

SEQ ID NO: 692635 - DNA, 20 bp, Artificial
  CRISPR gRNA sequence
tatggggaactaaagctcgt

SEQ ID NO: 692636 - DNA, 20 bp, Artificial
  CRISPR gRNA sequence
atggggaactaaagctcgtg

SEQ ID NO: 692637 - DNA, 20 bp, Artificial
  CRISPR gRNA sequence
gaactaaagctcgtgaggaa

SEQ ID NO: 692638 - DNA, 20 bp, Artificial
  CRISPR gRNA sequence
aactaaagctcgtgaggaat

SEQ ID NO: 692639 - DNA, 20 bp, Artificial
  CRISPR gRNA sequence
actaaagctcgtgaggaatg

SEQ ID NO: 692640 - DNA, 20 bp, Artificial
  CRISPR gRNA sequence
taaagctcgtgaggaatggg

SEQ ID NO: 692641 - DNA, 20 bp, Artificial
  CRISPR gRNA sequence
aagctcgtgaggaatgggga

SEQ ID NO: 692642 - DNA, 20 bp, Artificial
  CRISPR gRNA sequence
ctcgtgaggaatggggagag

SEQ ID NO: 692643 - DNA, 20 bp, Artificial
  CRISPR gRNA sequence
gtgaggaatggggagagtgg

SEQ ID NO: 692644 - DNA, 20 bp, Artificial
  CRISPR gRNA sequence
gtggcagaacctcctattgc

SEQ ID NO: 692645 - DNA, 20 bp, Artificial
  CRISPR gRNA sequence
actcatacccactaaacacc

SEQ ID NO: 692646 - DNA, 20 bp, Artificial
  CRISPR gRNA sequence
cccactaaacacccagccca

SEQ ID NO: 692647 - DNA, 20 bp, Artificial
  CRISPR gRNA sequence
agcccatggttctgcatctc

SEQ ID NO: 692648 - DNA, 20 bp, Artificial
  CRISPR gRNA sequence
gcccatggttctgcatctct

SEQ ID NO: 692649 - DNA, 20 bp, Artificial
  CRISPR gRNA sequence
catggttctgcatctctggg

SEQ ID NO: 692650 - DNA, 20 bp, Artificial
  CRISPR gRNA sequence
gttctgcatctctgggaagt

SEQ ID NO: 692651 - DNA, 20 bp, Artificial
  CRISPR gRNA sequence
ttctgcatctctgggaagtc

SEQ ID NO: 692652 - DNA, 20 bp, Artificial
  CRISPR gRNA sequence
ctgggaagtcaggataaatt

SEQ ID NO: 692653 - DNA, 20 bp, Artificial
  CRISPR gRNA sequence
tcaggataaatttggctgta

SEQ ID NO: 692654 - DNA, 20 bp, Artificial
  CRISPR gRNA sequence
caggataaatttggctgtat

SEQ ID NO: 692655 - DNA, 20 bp, Artificial
  CRISPR gRNA sequence
aggataaatttggctgtatg

SEQ ID NO: 692656 - DNA, 20 bp, Artificial
  CRISPR gRNA sequence
taaatttggctgtatggggt

SEQ ID NO: 692657 - DNA, 20 bp, Artificial
  CRISPR gRNA sequence
tttggctgtatggggtcagt

SEQ ID NO: 692658 - DNA, 20 bp, Artificial
  CRISPR gRNA sequence
tggctgtatggggtcagtaa

SEQ ID NO: 692659 - DNA, 20 bp, Artificial
  CRISPR gRNA sequence
tatggggtcagtaagagtcc

SEQ ID NO: 692660 - DNA, 20 bp, Artificial
  CRISPR gRNA sequence
agtaagagtcctggtaaccc

SEQ ID NO: 692661 - DNA, 20 bp, Artificial
  CRISPR gRNA sequence
gtaagagtcctggtaaccct

SEQ ID NO: 692662 - DNA, 20 bp, Artificial
  CRISPR gRNA sequence
ctcctgatgtgatgaatgtg

SEQ ID NO: 692663 - DNA, 20 bp, Artificial
  CRISPR gRNA sequence
atgtgatgaatgtgcggtca

SEQ ID NO: 692664 - DNA, 20 bp, Artificial
  CRISPR gRNA sequence
ttgctgccaaatgtttaacc

SEQ ID NO: 692665 - DNA, 20 bp, Artificial
  CRISPR gRNA sequence
gctgccaaatgtttaaccca

SEQ ID NO: 692666 - DNA, 20 bp, Artificial
  CRISPR gRNA sequence
atgtttaacccagagctaca

SEQ ID NO: 692667 - DNA, 20 bp, Artificial
  CRISPR gRNA sequence
tgtttaacccagagctacat

SEQ ID NO: 692668 - DNA, 20 bp, Artificial
  CRISPR gRNA sequence
cccagagctacataggtcct

SEQ ID NO: 692669 - DNA, 20 bp, Artificial
  CRISPR gRNA sequence
ccagagctacataggtcctt

SEQ ID NO: 692670 - DNA, 20 bp, Artificial
  CRISPR gRNA sequence
agagctacataggtccttag

SEQ ID NO: 692671 - DNA, 20 bp, Artificial
  CRISPR gRNA sequence
gagctacataggtccttagg

SEQ ID NO: 692672 - DNA, 20 bp, Artificial
  CRISPR gRNA sequence
acataggtccttaggaggca

SEQ ID NO: 692673 - DNA, 20 bp, Artificial
  CRISPR gRNA sequence
taggtccttaggaggcatag

SEQ ID NO: 692674 - DNA, 20 bp, Artificial
  CRISPR gRNA sequence
tccttaggaggcatagcagt

SEQ ID NO: 692675 - DNA, 20 bp, Artificial
  CRISPR gRNA sequence
cttaggaggcatagcagtta

SEQ ID NO: 692676 - DNA, 20 bp, Artificial
  CRISPR gRNA sequence
ttaggaggcatagcagttag

SEQ ID NO: 692677 - DNA, 20 bp, Artificial
  CRISPR gRNA sequence
gcatagcagttagaggaaaa

SEQ ID NO: 692678 - DNA, 20 bp, Artificial
  CRISPR gRNA sequence
cagttagaggaaaaaagtta

SEQ ID NO: 692679 - DNA, 20 bp, Artificial
  CRISPR gRNA sequence
agttagaggaaaaaagttaa

SEQ ID NO: 692680 - DNA, 20 bp, Artificial
  CRISPR gRNA sequence
aggaaaaaagttaaaggcat

SEQ ID NO: 692681 - DNA, 20 bp, Artificial
  CRISPR gRNA sequence
ggaaaaaagttaaaggcatc

SEQ ID NO: 692682 - DNA, 20 bp, Artificial
  CRISPR gRNA sequence
gaaaaaagttaaaggcatca

SEQ ID NO: 692683 - DNA, 20 bp, Artificial
  CRISPR gRNA sequence
aaaaaagttaaaggcatcag

SEQ ID NO: 692684 - DNA, 20 bp, Artificial
  CRISPR gRNA sequence
gggaactaatatgataaatt

SEQ ID NO: 692685 - DNA, 20 bp, Artificial
  CRISPR gRNA sequence
ctaatatgataaattcagtg

SEQ ID NO: 692686 - DNA, 20 bp, Artificial
  CRISPR gRNA sequence
aatatgataaattcagtgtg

SEQ ID NO: 692687 - DNA, 20 bp, Artificial
  CRISPR gRNA sequence
atgataaattcagtgtggag

SEQ ID NO: 692688 - DNA, 20 bp, Artificial
  CRISPR gRNA sequence
tcagtgtggagaagattcca

SEQ ID NO: 692689 - DNA, 20 bp, Artificial
  CRISPR gRNA sequence
cagtgtggagaagattccac

SEQ ID NO: 692690 - DNA, 20 bp, Artificial
  CRISPR gRNA sequence
gagaagattccacaggtatt

SEQ ID NO: 692691 - DNA, 20 bp, Artificial
  CRISPR gRNA sequence
atttggcctcatctctgaaa

SEQ ID NO: 692692 - DNA, 20 bp, Artificial
  CRISPR gRNA sequence
tttggcctcatctctgaaac

SEQ ID NO: 692693 - DNA, 20 bp, Artificial
  CRISPR gRNA sequence
aacaggtaatgccattctaa

SEQ ID NO: 692694 - DNA, 20 bp, Artificial
  CRISPR gRNA sequence
aatgccattctaaaagaaaa

SEQ ID NO: 692695 - DNA, 20 bp, Artificial
  CRISPR gRNA sequence
ccattctaaaagaaaaaaga

SEQ ID NO: 692696 - DNA, 20 bp, Artificial
  CRISPR gRNA sequence
cattctaaaagaaaaaagat

SEQ ID NO: 692697 - DNA, 20 bp, Artificial
  CRISPR gRNA sequence
aaaagatgggttgattgtta

SEQ ID NO: 692698 - DNA, 20 bp, Artificial
  CRISPR gRNA sequence
gggttgattgttatagattg

SEQ ID NO: 692699 - DNA, 20 bp, Artificial
  CRISPR gRNA sequence
ggttgattgttatagattgt

SEQ ID NO: 692700 - DNA, 20 bp, Artificial
  CRISPR gRNA sequence
ttatagattgtaggtaatta

SEQ ID NO: 692701 - DNA, 20 bp, Artificial
  CRISPR gRNA sequence
taattaaagaaacataacca

SEQ ID NO: 692702 - DNA, 20 bp, Artificial
  CRISPR gRNA sequence
aattaaagaaacataaccaa

SEQ ID NO: 692703 - DNA, 20 bp, Artificial
  CRISPR gRNA sequence
gaaacataaccaaaggcaac

SEQ ID NO: 692704 - DNA, 20 bp, Artificial
  CRISPR gRNA sequence
acataaccaaaggcaacgag

SEQ ID NO: 692705 - DNA, 20 bp, Artificial
  CRISPR gRNA sequence
aggcaacgagtggacatttt

SEQ ID NO: 692706 - DNA, 20 bp, Artificial
  CRISPR gRNA sequence
agtggacattttaagaaaac

SEQ ID NO: 692707 - DNA, 20 bp, Artificial
  CRISPR gRNA sequence
agaaaacaagctataaaaaa

SEQ ID NO: 692708 - DNA, 20 bp, Artificial
  CRISPR gRNA sequence
gaaaacaagctataaaaaat

SEQ ID NO: 692709 - DNA, 20 bp, Artificial
  CRISPR gRNA sequence
taggtacaaaaatgtactga

SEQ ID NO: 692710 - DNA, 20 bp, Artificial
  CRISPR gRNA sequence
gtacaaaaatgtactgaaag

SEQ ID NO: 692711 - DNA, 20 bp, Artificial
  CRISPR gRNA sequence
caaaaatgtactgaaagaag

SEQ ID NO: 692712 - DNA, 20 bp, Artificial
  CRISPR gRNA sequence
aaaatgtactgaaagaagtg

SEQ ID NO: 692713 - DNA, 20 bp, Artificial
  CRISPR gRNA sequence
gtggagatatttgaacataa

SEQ ID NO: 692714 - DNA, 20 bp, Artificial
  CRISPR gRNA sequence
tggagatatttgaacataaa

SEQ ID NO: 692715 - DNA, 20 bp, Artificial
  CRISPR gRNA sequence
aaggactttaaataatatta

SEQ ID NO: 692716 - DNA, 20 bp, Artificial
  CRISPR gRNA sequence
atggaattatttattttctt

SEQ ID NO: 692717 - DNA, 20 bp, Artificial
  CRISPR gRNA sequence
tttctttggtgtgataatgt

SEQ ID NO: 692718 - DNA, 20 bp, Artificial
  CRISPR gRNA sequence
ataatgttggttcttattct

SEQ ID NO: 692719 - DNA, 20 bp, Artificial
  CRISPR gRNA sequence
taatgttggttcttattctt

SEQ ID NO: 692720 - DNA, 20 bp, Artificial
  CRISPR gRNA sequence
atgttggttcttattcttag

SEQ ID NO: 692721 - DNA, 20 bp, Artificial
  CRISPR gRNA sequence
tgttggttcttattcttagg

SEQ ID NO: 692722 - DNA, 20 bp, Artificial
  CRISPR gRNA sequence
ttcttaggaggtgtgtgatg

SEQ ID NO: 692723 - DNA, 20 bp, Artificial
  CRISPR gRNA sequence
gaggtgtgtgatgaagtatt

SEQ ID NO: 692724 - DNA, 20 bp, Artificial
  CRISPR gRNA sequence
gtgtgtgatgaagtatttag

SEQ ID NO: 692725 - DNA, 20 bp, Artificial
  CRISPR gRNA sequence
tgatgaagtatttagtggtc

SEQ ID NO: 692726 - DNA, 20 bp, Artificial
  CRISPR gRNA sequence
tatttagtggtctagtatca

SEQ ID NO: 692727 - DNA, 20 bp, Artificial
  CRISPR gRNA sequence
atttagtggtctagtatcat

SEQ ID NO: 692728 - DNA, 20 bp, Artificial
  CRISPR gRNA sequence
atgggtcttgcaacttactt

SEQ ID NO: 692729 - DNA, 20 bp, Artificial
  CRISPR gRNA sequence
caacttactttagaatgact

SEQ ID NO: 692730 - DNA, 20 bp, Artificial
  CRISPR gRNA sequence
ctcagtcaaaaatcttaatc

SEQ ID NO: 692731 - DNA, 20 bp, Artificial
  CRISPR gRNA sequence
ttaatctggacccttttcat

SEQ ID NO: 692732 - DNA, 20 bp, Artificial
  CRISPR gRNA sequence
tctggacccttttcataaga

SEQ ID NO: 692733 - DNA, 20 bp, Artificial
  CRISPR gRNA sequence
ccttttcataagatggtgcc

SEQ ID NO: 692734 - DNA, 20 bp, Artificial
  CRISPR gRNA sequence
ataagatggtgccaagaacg

SEQ ID NO: 692735 - DNA, 20 bp, Artificial
  CRISPR gRNA sequence
agatggtgccaagaacgaag

SEQ ID NO: 692736 - DNA, 20 bp, Artificial
  CRISPR gRNA sequence
gatggtgccaagaacgaaga

SEQ ID NO: 692737 - DNA, 20 bp, Artificial
  CRISPR gRNA sequence
ggtgccaagaacgaagaagg

SEQ ID NO: 692738 - DNA, 20 bp, Artificial
  CRISPR gRNA sequence
ggaagctcctgcccctccta

SEQ ID NO: 692739 - DNA, 20 bp, Artificial
  CRISPR gRNA sequence
tcctgcccctcctaaagccg

SEQ ID NO: 692740 - DNA, 20 bp, Artificial
  CRISPR gRNA sequence
ccctcctaaagccgaagcca

SEQ ID NO: 692741 - DNA, 20 bp, Artificial
  CRISPR gRNA sequence
ctaaagccgaagccaaagcg

SEQ ID NO: 692742 - DNA, 20 bp, Artificial
  CRISPR gRNA sequence
taaagccgaagccaaagcga

SEQ ID NO: 692743 - DNA, 20 bp, Artificial
  CRISPR gRNA sequence
agccaaagcgaaggctttgc

SEQ ID NO: 692744 - DNA, 20 bp, Artificial
  CRISPR gRNA sequence
gccaaagcgaaggctttgca

SEQ ID NO: 692745 - DNA, 20 bp, Artificial
  CRISPR gRNA sequence
agcgaaggctttgcaaggcc

SEQ ID NO: 692746 - DNA, 20 bp, Artificial
  CRISPR gRNA sequence
gaaggctttgcaaggccaag

SEQ ID NO: 692747 - DNA, 20 bp, Artificial
  CRISPR gRNA sequence
aaggctttgcaaggccaaga

SEQ ID NO: 692748 - DNA, 20 bp, Artificial
  CRISPR gRNA sequence
gctttgcaaggccaagaagg

SEQ ID NO: 692749 - DNA, 20 bp, Artificial
  CRISPR gRNA sequence
ggccaagaaggcagtgttga

SEQ ID NO: 692750 - DNA, 20 bp, Artificial
  CRISPR gRNA sequence
gcagtgttgaaagatgtcca

SEQ ID NO: 692751 - DNA, 20 bp, Artificial
  CRISPR gRNA sequence
tccacagccacaaaaaaaac

SEQ ID NO: 692752 - DNA, 20 bp, Artificial
  CRISPR gRNA sequence
tccacatgtcacccaccttc

SEQ ID NO: 692753 - DNA, 20 bp, Artificial
  CRISPR gRNA sequence
acatgtcacccaccttccgg

SEQ ID NO: 692754 - DNA, 20 bp, Artificial
  CRISPR gRNA sequence
cacccaccttccggcggccc

SEQ ID NO: 692755 - DNA, 20 bp, Artificial
  CRISPR gRNA sequence
ggcccaagacactgtgactc

SEQ ID NO: 692756 - DNA, 20 bp, Artificial
  CRISPR gRNA sequence
cccaagacactgtgactccg

SEQ ID NO: 692757 - DNA, 20 bp, Artificial
  CRISPR gRNA sequence
ccaagacactgtgactccgg

SEQ ID NO: 692758 - DNA, 20 bp, Artificial
  CRISPR gRNA sequence
agacactgtgactccggagg

SEQ ID NO: 692759 - DNA, 20 bp, Artificial
  CRISPR gRNA sequence
ggaggcagcccaaatatcct

SEQ ID NO: 692760 - DNA, 20 bp, Artificial
  CRISPR gRNA sequence
ggcagcccaaatatccttgg

SEQ ID NO: 692761 - DNA, 20 bp, Artificial
  CRISPR gRNA sequence
cagcccaaatatccttggaa

SEQ ID NO: 692762 - DNA, 20 bp, Artificial
  CRISPR gRNA sequence
tatccttggaagagcacccc

SEQ ID NO: 692763 - DNA, 20 bp, Artificial
  CRISPR gRNA sequence
atccttggaagagcaccccc

SEQ ID NO: 692764 - DNA, 20 bp, Artificial
  CRISPR gRNA sequence
ccttggaagagcacccccag

SEQ ID NO: 692765 - DNA, 20 bp, Artificial
  CRISPR gRNA sequence
agagcacccccaggagaaat

SEQ ID NO: 692766 - DNA, 20 bp, Artificial
  CRISPR gRNA sequence
ttgaccaccatgttatcatc

SEQ ID NO: 692767 - DNA, 20 bp, Artificial
  CRISPR gRNA sequence
tcaagtttccgctgaccact

SEQ ID NO: 692768 - DNA, 20 bp, Artificial
  CRISPR gRNA sequence
agtttccgctgaccactgag

SEQ ID NO: 692769 - DNA, 20 bp, Artificial
  CRISPR gRNA sequence
gtttccgctgaccactgagt

SEQ ID NO: 692770 - DNA, 20 bp, Artificial
  CRISPR gRNA sequence
tgaccactgagtaggctgtg

SEQ ID NO: 692771 - DNA, 20 bp, Artificial
  CRISPR gRNA sequence
ccactgagtaggctgtgaag

SEQ ID NO: 692772 - DNA, 20 bp, Artificial
  CRISPR gRNA sequence
tgagtaggctgtgaagaaga

SEQ ID NO: 692773 - DNA, 20 bp, Artificial
  CRISPR gRNA sequence
gtgaagaagatagaaaacaa

SEQ ID NO: 692774 - DNA, 20 bp, Artificial
  CRISPR gRNA sequence
cagcctacttgtgttcactg

SEQ ID NO: 692775 - DNA, 20 bp, Artificial
  CRISPR gRNA sequence
tgtgttcactgtggatgtta

SEQ ID NO: 692776 - DNA, 20 bp, Artificial
  CRISPR gRNA sequence
ctgtggatgttaaagccaac

SEQ ID NO: 692777 - DNA, 20 bp, Artificial
  CRISPR gRNA sequence
atgttaaagccaacaagcac

SEQ ID NO: 692778 - DNA, 20 bp, Artificial
  CRISPR gRNA sequence
ccaacaagcaccagatcaaa

SEQ ID NO: 692779 - DNA, 20 bp, Artificial
  CRISPR gRNA sequence
caacaagcaccagatcaaac

SEQ ID NO: 692780 - DNA, 20 bp, Artificial
  CRISPR gRNA sequence
accagatcaaacaggctgtg

SEQ ID NO: 692781 - DNA, 20 bp, Artificial
  CRISPR gRNA sequence
agatcaaacaggctgtgaag

SEQ ID NO: 692782 - DNA, 20 bp, Artificial
  CRISPR gRNA sequence
agaagtttgtgacattgatg

SEQ ID NO: 692783 - DNA, 20 bp, Artificial
  CRISPR gRNA sequence
ttgtgacattgatgtggcca

SEQ ID NO: 692784 - DNA, 20 bp, Artificial
  CRISPR gRNA sequence
ccaaagtcaacactctgatt

SEQ ID NO: 692785 - DNA, 20 bp, Artificial
  CRISPR gRNA sequence
aacactctgattcagtctga

SEQ ID NO: 692786 - DNA, 20 bp, Artificial
  CRISPR gRNA sequence
cactctgattcagtctgatg

SEQ ID NO: 692787 - DNA, 20 bp, Artificial
  CRISPR gRNA sequence
ctctgattcagtctgatgga

SEQ ID NO: 692788 - DNA, 20 bp, Artificial
  CRISPR gRNA sequence
ctgattcagtctgatggaga

SEQ ID NO: 692789 - DNA, 20 bp, Artificial
  CRISPR gRNA sequence
tgattcagtctgatggagag

SEQ ID NO: 692790 - DNA, 20 bp, Artificial
  CRISPR gRNA sequence
ttcagtctgatggagagagg

SEQ ID NO: 692791 - DNA, 20 bp, Artificial
  CRISPR gRNA sequence
tcagtctgatggagagagga

SEQ ID NO: 692792 - DNA, 20 bp, Artificial
  CRISPR gRNA sequence
gaggaaggcatatgttcgac

SEQ ID NO: 692793 - DNA, 20 bp, Artificial
  CRISPR gRNA sequence
ggctcctgactacgatgctt

SEQ ID NO: 692794 - DNA, 20 bp, Artificial
  CRISPR gRNA sequence
ttggttgttgccaccaaaat

SEQ ID NO: 692795 - DNA, 20 bp, Artificial
  CRISPR gRNA sequence
tggttgttgccaccaaaatt

SEQ ID NO: 692796 - DNA, 20 bp, Artificial
  CRISPR gRNA sequence
aaattgggatcacctaaact

SEQ ID NO: 692797 - DNA, 20 bp, Artificial
  CRISPR gRNA sequence
gggatcacctaaactgagtc

SEQ ID NO: 692798 - DNA, 20 bp, Artificial
  CRISPR gRNA sequence
tcacctaaactgagtcaagc

SEQ ID NO: 692799 - DNA, 20 bp, Artificial
  CRISPR gRNA sequence
gtatatcttttcaccattaa

SEQ ID NO: 692800 - DNA, 20 bp, Artificial
  CRISPR gRNA sequence
tatctacctgtatctataaa

SEQ ID NO: 692801 - DNA, 20 bp, Artificial
  CRISPR gRNA sequence
taaaatttatgtatgttcgt

SEQ ID NO: 692802 - DNA, 20 bp, Artificial
  CRISPR gRNA sequence
aaaatttatgtatgttcgtg

SEQ ID NO: 692803 - DNA, 20 bp, Artificial
  CRISPR gRNA sequence
tatgtatgttcgtgaggcac

SEQ ID NO: 692804 - DNA, 20 bp, Artificial
  CRISPR gRNA sequence
tacattgatatcttgcttct

SEQ ID NO: 692805 - DNA, 20 bp, Artificial
  CRISPR gRNA sequence
cttgcttctcagtcccacac

SEQ ID NO: 692806 - DNA, 20 bp, Artificial
  CRISPR gRNA sequence
ttgcttctcagtcccacaca

SEQ ID NO: 692807 - DNA, 20 bp, Artificial
  CRISPR gRNA sequence
cttctcagtcccacacaagg

SEQ ID NO: 692808 - DNA, 20 bp, Artificial
  CRISPR gRNA sequence
aaggaagctgtctcacacta

SEQ ID NO: 692809 - DNA, 20 bp, Artificial
  CRISPR gRNA sequence
ggaagctgtctcacactata

SEQ ID NO: 692810 - DNA, 20 bp, Artificial
  CRISPR gRNA sequence
attcatgaacaaattcgtat

SEQ ID NO: 692811 - DNA, 20 bp, Artificial
  CRISPR gRNA sequence
gaacaaattcgtatcagtca

SEQ ID NO: 692812 - DNA, 20 bp, Artificial
  CRISPR gRNA sequence
aaattcgtatcagtcacagt

SEQ ID NO: 692813 - DNA, 20 bp, Artificial
  CRISPR gRNA sequence
attcgtatcagtcacagtga

SEQ ID NO: 692814 - DNA, 20 bp, Artificial
  CRISPR gRNA sequence
ttcgtatcagtcacagtgag

SEQ ID NO: 692815 - DNA, 20 bp, Artificial
  CRISPR gRNA sequence
gtgagaggtaacactctaaa

SEQ ID NO: 692816 - DNA, 20 bp, Artificial
  CRISPR gRNA sequence
aaatagcccatttcatgctc

SEQ ID NO: 692817 - DNA, 20 bp, Artificial
  CRISPR gRNA sequence
atttcatgctcaagacatcc

SEQ ID NO: 692818 - DNA, 20 bp, Artificial
  CRISPR gRNA sequence
tgctcaagacatccaagtca

SEQ ID NO: 692819 - DNA, 20 bp, Artificial
  CRISPR gRNA sequence
tccaagtcaaagaaacccaa

SEQ ID NO: 692820 - DNA, 20 bp, Artificial
  CRISPR gRNA sequence
gtcaaagaaacccaatagca

SEQ ID NO: 692821 - DNA, 20 bp, Artificial
  CRISPR gRNA sequence
agaaacccaatagcacagct

SEQ ID NO: 692822 - DNA, 20 bp, Artificial
  CRISPR gRNA sequence
ccccaacaccccactcacat

SEQ ID NO: 692823 - DNA, 20 bp, Artificial
  CRISPR gRNA sequence
cccaacaccccactcacatc

SEQ ID NO: 692824 - DNA, 20 bp, Artificial
  CRISPR gRNA sequence
ccaacaccccactcacatca

SEQ ID NO: 692825 - DNA, 20 bp, Artificial
  CRISPR gRNA sequence
tcacatcagggcccctgccc

SEQ ID NO: 692826 - DNA, 20 bp, Artificial
  CRISPR gRNA sequence
acatcagggcccctgccctg

SEQ ID NO: 692827 - DNA, 20 bp, Artificial
  CRISPR gRNA sequence
ccctggagtgtcacctttat

SEQ ID NO: 692828 - DNA, 20 bp, Artificial
  CRISPR gRNA sequence
gtgtcacctttattagctgt

SEQ ID NO: 692829 - DNA, 20 bp, Artificial
  CRISPR gRNA sequence
gtcacctttattagctgtga

SEQ ID NO: 692830 - DNA, 20 bp, Artificial
  CRISPR gRNA sequence
attagctgtgagagacaccc

SEQ ID NO: 692831 - DNA, 20 bp, Artificial
  CRISPR gRNA sequence
tagctgtgagagacacccca

SEQ ID NO: 692832 - DNA, 20 bp, Artificial
  CRISPR gRNA sequence
tgagagacaccccagagccc

SEQ ID NO: 692833 - DNA, 20 bp, Artificial
  CRISPR gRNA sequence
gagagacaccccagagccct

SEQ ID NO: 692834 - DNA, 20 bp, Artificial
  CRISPR gRNA sequence
cccagagccctgggcactgt

SEQ ID NO: 692835 - DNA, 20 bp, Artificial
  CRISPR gRNA sequence
ccctgggcactgtcagtgat

SEQ ID NO: 692836 - DNA, 20 bp, Artificial
  CRISPR gRNA sequence
cctgggcactgtcagtgatt

SEQ ID NO: 692837 - DNA, 20 bp, Artificial
  CRISPR gRNA sequence
ctgggcactgtcagtgattg

SEQ ID NO: 692838 - DNA, 20 bp, Artificial
  CRISPR gRNA sequence
ggcactgtcagtgattgggg

SEQ ID NO: 692839 - DNA, 20 bp, Artificial
  CRISPR gRNA sequence
tgattggggtagaacaaaaa

SEQ ID NO: 692840 - DNA, 20 bp, Artificial
  CRISPR gRNA sequence
gattggggtagaacaaaaat

SEQ ID NO: 692841 - DNA, 20 bp, Artificial
  CRISPR gRNA sequence
ggtagaacaaaaataggacc

SEQ ID NO: 692842 - DNA, 20 bp, Artificial
  CRISPR gRNA sequence
gaacaaaaataggacctggt

SEQ ID NO: 692843 - DNA, 20 bp, Artificial
  CRISPR gRNA sequence
acaaaaataggacctggtca

SEQ ID NO: 692844 - DNA, 20 bp, Artificial
  CRISPR gRNA sequence
taggacctggtcagagccca

SEQ ID NO: 692845 - DNA, 20 bp, Artificial
  CRISPR gRNA sequence
ctggtcagagcccacagatg

SEQ ID NO: 692846 - DNA, 20 bp, Artificial
  CRISPR gRNA sequence
tcagagcccacagatgtggc

SEQ ID NO: 692847 - DNA, 20 bp, Artificial
  CRISPR gRNA sequence
agagcccacagatgtggcta

SEQ ID NO: 692848 - DNA, 20 bp, Artificial
  CRISPR gRNA sequence
gagcccacagatgtggctag

SEQ ID NO: 692849 - DNA, 20 bp, Artificial
  CRISPR gRNA sequence
agatgtggctagaggaactg

SEQ ID NO: 692850 - DNA, 20 bp, Artificial
  CRISPR gRNA sequence
gatgtggctagaggaactgt

SEQ ID NO: 692851 - DNA, 20 bp, Artificial
  CRISPR gRNA sequence
atgtggctagaggaactgtg

SEQ ID NO: 692852 - DNA, 20 bp, Artificial
  CRISPR gRNA sequence
tggctagaggaactgtgggg

SEQ ID NO: 692853 - DNA, 20 bp, Artificial
  CRISPR gRNA sequence
ggctagaggaactgtggggt

SEQ ID NO: 692854 - DNA, 20 bp, Artificial
  CRISPR gRNA sequence
agaggaactgtggggtgggt

SEQ ID NO: 692855 - DNA, 20 bp, Artificial
  CRISPR gRNA sequence
ggggtgggtgagctccctca

SEQ ID NO: 692856 - DNA, 20 bp, Artificial
  CRISPR gRNA sequence
gggtgggtgagctccctcat

SEQ ID NO: 692857 - DNA, 20 bp, Artificial
  CRISPR gRNA sequence
ccacaatatcccaacaatct

SEQ ID NO: 692858 - DNA, 20 bp, Artificial
  CRISPR gRNA sequence
cacaatatcccaacaatctc

SEQ ID NO: 692859 - DNA, 20 bp, Artificial
  CRISPR gRNA sequence
acaatatcccaacaatctca

SEQ ID NO: 692860 - DNA, 20 bp, Artificial
  CRISPR gRNA sequence
atcccaacaatctcagggat

SEQ ID NO: 692861 - DNA, 20 bp, Artificial
  CRISPR gRNA sequence
agcctccttcatcttacctg

SEQ ID NO: 692862 - DNA, 20 bp, Artificial
  CRISPR gRNA sequence
cttcatcttacctgcagcct

SEQ ID NO: 692863 - DNA, 20 bp, Artificial
  CRISPR gRNA sequence
tcatcttacctgcagcctga

SEQ ID NO: 692864 - DNA, 20 bp, Artificial
  CRISPR gRNA sequence
tcttacctgcagcctgagag

SEQ ID NO: 692865 - DNA, 20 bp, Artificial
  CRISPR gRNA sequence
gctccctctgtttctatcta

SEQ ID NO: 692866 - DNA, 20 bp, Artificial
  CRISPR gRNA sequence
ctccctctgtttctatctat

SEQ ID NO: 692867 - DNA, 20 bp, Artificial
  CRISPR gRNA sequence
cctctgtttctatctatggg

SEQ ID NO: 692868 - DNA, 20 bp, Artificial
  CRISPR gRNA sequence
atgggaagaaaatgtcctgt

SEQ ID NO: 692869 - DNA, 20 bp, Artificial
  CRISPR gRNA sequence
gggaagaaaatgtcctgtga

SEQ ID NO: 692870 - DNA, 20 bp, Artificial
  CRISPR gRNA sequence
ggaagaaaatgtcctgtgag

SEQ ID NO: 692871 - DNA, 20 bp, Artificial
  CRISPR gRNA sequence
gaaaatgtcctgtgagaggc

SEQ ID NO: 692872 - DNA, 20 bp, Artificial
  CRISPR gRNA sequence
atgtcctgtgagaggccaga

SEQ ID NO: 692873 - DNA, 20 bp, Artificial
  CRISPR gRNA sequence
tgtcctgtgagaggccagaa

SEQ ID NO: 692874 - DNA, 20 bp, Artificial
  CRISPR gRNA sequence
tcctgtgagaggccagaaag

SEQ ID NO: 692875 - DNA, 20 bp, Artificial
  CRISPR gRNA sequence
cctgtgagaggccagaaagg

SEQ ID NO: 692876 - DNA, 20 bp, Artificial
  CRISPR gRNA sequence
gtgagaggccagaaaggagg

SEQ ID NO: 692877 - DNA, 20 bp, Artificial
  CRISPR gRNA sequence
tgagaggccagaaaggaggc

SEQ ID NO: 692878 - DNA, 20 bp, Artificial
  CRISPR gRNA sequence
gagaggccagaaaggaggca

SEQ ID NO: 692879 - DNA, 20 bp, Artificial
  CRISPR gRNA sequence
cagaaaggaggcagggccat

SEQ ID NO: 692880 - DNA, 20 bp, Artificial
  CRISPR gRNA sequence
agaaaggaggcagggccata

SEQ ID NO: 692881 - DNA, 20 bp, Artificial
  CRISPR gRNA sequence
gaggcagggccataaggtcc

SEQ ID NO: 692882 - DNA, 20 bp, Artificial
  CRISPR gRNA sequence
ggcagggccataaggtccta

SEQ ID NO: 692883 - DNA, 20 bp, Artificial
  CRISPR gRNA sequence
aaggtcctagagcaaacccc

SEQ ID NO: 692884 - DNA, 20 bp, Artificial
  CRISPR gRNA sequence
aaacccctagtctttgatcc

SEQ ID NO: 692885 - DNA, 20 bp, Artificial
  CRISPR gRNA sequence
acccctagtctttgatccca

SEQ ID NO: 692886 - DNA, 20 bp, Artificial
  CRISPR gRNA sequence
cctagtctttgatcccagag

SEQ ID NO: 692887 - DNA, 20 bp, Artificial
  CRISPR gRNA sequence
tttgatcccagagaagtttc

SEQ ID NO: 692888 - DNA, 20 bp, Artificial
  CRISPR gRNA sequence
tcccagagaagtttccagaa

SEQ ID NO: 692889 - DNA, 20 bp, Artificial
  CRISPR gRNA sequence
tttccagaaaagtgtaactg

SEQ ID NO: 692890 - DNA, 20 bp, Artificial
  CRISPR gRNA sequence
gaaaagtgtaactgtagatc

SEQ ID NO: 692891 - DNA, 20 bp, Artificial
  CRISPR gRNA sequence
aaaagtgtaactgtagatcc

SEQ ID NO: 692892 - DNA, 20 bp, Artificial
  CRISPR gRNA sequence
aaagtgtaactgtagatcca

SEQ ID NO: 692893 - DNA, 20 bp, Artificial
  CRISPR gRNA sequence
gtgtaactgtagatccaggg

SEQ ID NO: 692894 - DNA, 20 bp, Artificial
  CRISPR gRNA sequence
tgtaactgtagatccagggc

SEQ ID NO: 692895 - DNA, 20 bp, Artificial
  CRISPR gRNA sequence
tgtagatccagggcaggatc

SEQ ID NO: 692896 - DNA, 20 bp, Artificial
  CRISPR gRNA sequence
gggcaggatcaagaaatatg

SEQ ID NO: 692897 - DNA, 20 bp, Artificial
  CRISPR gRNA sequence
aggatcaagaaatatgaaga

SEQ ID NO: 692898 - DNA, 20 bp, Artificial
  CRISPR gRNA sequence
atcaagaaatatgaagaaag

SEQ ID NO: 692899 - DNA, 20 bp, Artificial
  CRISPR gRNA sequence
aaatatgaagaaagcagatg

SEQ ID NO: 692900 - DNA, 20 bp, Artificial
  CRISPR gRNA sequence
aatatgaagaaagcagatgt

SEQ ID NO: 692901 - DNA, 20 bp, Artificial
  CRISPR gRNA sequence
aagaaagcagatgtgggtcc

SEQ ID NO: 692902 - DNA, 20 bp, Artificial
  CRISPR gRNA sequence
cctggaccaactgccctcct

SEQ ID NO: 692903 - DNA, 20 bp, Artificial
  CRISPR gRNA sequence
ctggaccaactgccctcctg

SEQ ID NO: 692904 - DNA, 20 bp, Artificial
  CRISPR gRNA sequence
gccctcctgaggtctgtcat

SEQ ID NO: 692905 - DNA, 20 bp, Artificial
  CRISPR gRNA sequence
ctcctgaggtctgtcatcag

SEQ ID NO: 692906 - DNA, 20 bp, Artificial
  CRISPR gRNA sequence
tcctgaggtctgtcatcagc

SEQ ID NO: 692907 - DNA, 20 bp, Artificial
  CRISPR gRNA sequence
cctgaggtctgtcatcagca

SEQ ID NO: 692908 - DNA, 20 bp, Artificial
  CRISPR gRNA sequence
cccctgtgatttgtgactgc

SEQ ID NO: 692909 - DNA, 20 bp, Artificial
  CRISPR gRNA sequence
ccctgtgatttgtgactgct

SEQ ID NO: 692910 - DNA, 20 bp, Artificial
  CRISPR gRNA sequence
tgatttgtgactgctgggat

SEQ ID NO: 692911 - DNA, 20 bp, Artificial
  CRISPR gRNA sequence
gatttgtgactgctgggatc

SEQ ID NO: 692912 - DNA, 20 bp, Artificial
  CRISPR gRNA sequence
catcaccaccataatcatcg

SEQ ID NO: 692913 - DNA, 20 bp, Artificial
  CRISPR gRNA sequence
ccaccataatcatcgaagtg

SEQ ID NO: 692914 - DNA, 20 bp, Artificial
  CRISPR gRNA sequence
gaatctgtccttcattttca

SEQ ID NO: 692915 - DNA, 20 bp, Artificial
  CRISPR gRNA sequence
aatctgtccttcattttcac

SEQ ID NO: 692916 - DNA, 20 bp, Artificial
  CRISPR gRNA sequence
tctgtccttcattttcacag

SEQ ID NO: 692917 - DNA, 20 bp, Artificial
  CRISPR gRNA sequence
ttcacaggagctttacaaat

SEQ ID NO: 692918 - DNA, 20 bp, Artificial
  CRISPR gRNA sequence
acaggagctttacaaatgag

SEQ ID NO: 692919 - DNA, 20 bp, Artificial
  CRISPR gRNA sequence
caggagctttacaaatgagt

SEQ ID NO: 692920 - DNA, 20 bp, Artificial
  CRISPR gRNA sequence
ctttacaaatgagtaggtgc

SEQ ID NO: 692921 - DNA, 20 bp, Artificial
  CRISPR gRNA sequence
aatgagtaggtgctggcaca

SEQ ID NO: 692922 - DNA, 20 bp, Artificial
  CRISPR gRNA sequence
atgagtaggtgctggcacac

SEQ ID NO: 692923 - DNA, 20 bp, Artificial
  CRISPR gRNA sequence
tgagtaggtgctggcacaca

SEQ ID NO: 692924 - DNA, 20 bp, Artificial
  CRISPR gRNA sequence
aggtgctggcacacagggcc

SEQ ID NO: 692925 - DNA, 20 bp, Artificial
  CRISPR gRNA sequence
ggtgctggcacacagggccc

SEQ ID NO: 692926 - DNA, 20 bp, Artificial
  CRISPR gRNA sequence
ctggcacacagggcccaggc

SEQ ID NO: 692927 - DNA, 20 bp, Artificial
  CRISPR gRNA sequence
tggcacacagggcccaggct

SEQ ID NO: 692928 - DNA, 20 bp, Artificial
  CRISPR gRNA sequence
cacacagggcccaggctggg

SEQ ID NO: 692929 - DNA, 20 bp, Artificial
  CRISPR gRNA sequence
cccaggctgggtagacccat

SEQ ID NO: 692930 - DNA, 20 bp, Artificial
  CRISPR gRNA sequence
gctgggtagacccatgagtg

SEQ ID NO: 692931 - DNA, 20 bp, Artificial
  CRISPR gRNA sequence
ggtagacccatgagtgtgga

SEQ ID NO: 692932 - DNA, 20 bp, Artificial
  CRISPR gRNA sequence
tgagtgtggatggtgcttcc

SEQ ID NO: 692933 - DNA, 20 bp, Artificial
  CRISPR gRNA sequence
ggatggtgcttcccagtaat

SEQ ID NO: 692934 - DNA, 20 bp, Artificial
  CRISPR gRNA sequence
gatggtgcttcccagtaatg

SEQ ID NO: 692935 - DNA, 20 bp, Artificial
  CRISPR gRNA sequence
ggtgcttcccagtaatgagg

SEQ ID NO: 692936 - DNA, 20 bp, Artificial
  CRISPR gRNA sequence
gtgcttcccagtaatgaggc

SEQ ID NO: 692937 - DNA, 20 bp, Artificial
  CRISPR gRNA sequence
tgcttcccagtaatgaggca

SEQ ID NO: 692938 - DNA, 20 bp, Artificial
  CRISPR gRNA sequence
aggcagggcacacttctact

SEQ ID NO: 692939 - DNA, 20 bp, Artificial
  CRISPR gRNA sequence
ggcagggcacacttctactt

SEQ ID NO: 692940 - DNA, 20 bp, Artificial
  CRISPR gRNA sequence
gcagggcacacttctacttg

SEQ ID NO: 692941 - DNA, 20 bp, Artificial
  CRISPR gRNA sequence
tacttggggcttgcaacccc

SEQ ID NO: 692942 - DNA, 20 bp, Artificial
  CRISPR gRNA sequence
ttggggcttgcaacccccag

SEQ ID NO: 692943 - DNA, 20 bp, Artificial
  CRISPR gRNA sequence
tggggcttgcaacccccagt

SEQ ID NO: 692944 - DNA, 20 bp, Artificial
  CRISPR gRNA sequence
cttgcaacccccagtgggac

SEQ ID NO: 692945 - DNA, 20 bp, Artificial
  CRISPR gRNA sequence
cccagtgggacaagaaaact

SEQ ID NO: 692946 - DNA, 20 bp, Artificial
  CRISPR gRNA sequence
ctcctcaccccttcctacct

SEQ ID NO: 692947 - DNA, 20 bp, Artificial
  CRISPR gRNA sequence
gctcttcttcctccacatca

SEQ ID NO: 692948 - DNA, 20 bp, Artificial
  CRISPR gRNA sequence
cttcttcctccacatcacag

SEQ ID NO: 692949 - DNA, 20 bp, Artificial
  CRISPR gRNA sequence
ccacatcacagcagcgacca

SEQ ID NO: 692950 - DNA, 20 bp, Artificial
  CRISPR gRNA sequence
cacagcagcgaccacagctc

SEQ ID NO: 692951 - DNA, 20 bp, Artificial
  CRISPR gRNA sequence
gaccacagctccagtgacca

SEQ ID NO: 692952 - DNA, 20 bp, Artificial
  CRISPR gRNA sequence
gctccagtgaccacagctcc

SEQ ID NO: 692953 - DNA, 20 bp, Artificial
  CRISPR gRNA sequence
ctccagtgaccacagctcca

SEQ ID NO: 692954 - DNA, 20 bp, Artificial
  CRISPR gRNA sequence
accacagctccaaggacaac

SEQ ID NO: 692955 - DNA, 20 bp, Artificial
  CRISPR gRNA sequence
ccacagctccaaggacaaca

SEQ ID NO: 692956 - DNA, 20 bp, Artificial
  CRISPR gRNA sequence
agctccaaggacaacaaggc

SEQ ID NO: 692957 - DNA, 20 bp, Artificial
  CRISPR gRNA sequence
gccagcaacgatgcccacga

SEQ ID NO: 692958 - DNA, 20 bp, Artificial
  CRISPR gRNA sequence
ccagcaacgatgcccacgat

SEQ ID NO: 692959 - DNA, 20 bp, Artificial
  CRISPR gRNA sequence
cagcaacgatgcccacgatg

SEQ ID NO: 692960 - DNA, 20 bp, Artificial
  CRISPR gRNA sequence
aacgatgcccacgatgggga

SEQ ID NO: 692961 - DNA, 20 bp, Artificial
  CRISPR gRNA sequence
gatgcccacgatggggatgg

SEQ ID NO: 692962 - DNA, 20 bp, Artificial
  CRISPR gRNA sequence
atgcccacgatggggatggt

SEQ ID NO: 692963 - DNA, 20 bp, Artificial
  CRISPR gRNA sequence
ccacgatggggatggtgggc

SEQ ID NO: 692964 - DNA, 20 bp, Artificial
  CRISPR gRNA sequence
cacgatggggatggtgggct

SEQ ID NO: 692965 - DNA, 20 bp, Artificial
  CRISPR gRNA sequence
acgatggggatggtgggctg

SEQ ID NO: 692966 - DNA, 20 bp, Artificial
  CRISPR gRNA sequence
gatggggatggtgggctggg

SEQ ID NO: 692967 - DNA, 20 bp, Artificial
  CRISPR gRNA sequence
gtgggctggggagactgctc

SEQ ID NO: 692968 - DNA, 20 bp, Artificial
  CRISPR gRNA sequence
tgggctggggagactgctct

SEQ ID NO: 692969 - DNA, 20 bp, Artificial
  CRISPR gRNA sequence
ctggggagactgctctggga

SEQ ID NO: 692970 - DNA, 20 bp, Artificial
  CRISPR gRNA sequence
tggggagactgctctgggaa

SEQ ID NO: 692971 - DNA, 20 bp, Artificial
  CRISPR gRNA sequence
ggagactgctctgggaaagg

SEQ ID NO: 692972 - DNA, 20 bp, Artificial
  CRISPR gRNA sequence
gagactgctctgggaaagga

SEQ ID NO: 692973 - DNA, 20 bp, Artificial
  CRISPR gRNA sequence
agactgctctgggaaaggaa

SEQ ID NO: 692974 - DNA, 20 bp, Artificial
  CRISPR gRNA sequence
ctgctctgggaaaggaaggg

SEQ ID NO: 692975 - DNA, 20 bp, Artificial
  CRISPR gRNA sequence
tgctctgggaaaggaaggga

SEQ ID NO: 692976 - DNA, 20 bp, Artificial
  CRISPR gRNA sequence
ctgggaaaggaagggaaggt

SEQ ID NO: 692977 - DNA, 20 bp, Artificial
  CRISPR gRNA sequence
tgggaaaggaagggaaggtg

SEQ ID NO: 692978 - DNA, 20 bp, Artificial
  CRISPR gRNA sequence
gggaaaggaagggaaggtga

SEQ ID NO: 692979 - DNA, 20 bp, Artificial
  CRISPR gRNA sequence
ggaaaggaagggaaggtgag

SEQ ID NO: 692980 - DNA, 20 bp, Artificial
  CRISPR gRNA sequence
aggtgaggggccctgatctc

SEQ ID NO: 692981 - DNA, 20 bp, Artificial
  CRISPR gRNA sequence
ggtgaggggccctgatctcc

SEQ ID NO: 692982 - DNA, 20 bp, Artificial
  CRISPR gRNA sequence
gggccctgatctccaggcct

SEQ ID NO: 692983 - DNA, 20 bp, Artificial
  CRISPR gRNA sequence
cctcagccctgaccctgctg

SEQ ID NO: 692984 - DNA, 20 bp, Artificial
  CRISPR gRNA sequence
tcagccctgaccctgctgaa

SEQ ID NO: 692985 - DNA, 20 bp, Artificial
  CRISPR gRNA sequence
ctgaccctgctgaagagctc

SEQ ID NO: 692986 - DNA, 20 bp, Artificial
  CRISPR gRNA sequence
accctgctgaagagctccag

SEQ ID NO: 692987 - DNA, 20 bp, Artificial
  CRISPR gRNA sequence
ccctgctgaagagctccaga

SEQ ID NO: 692988 - DNA, 20 bp, Artificial
  CRISPR gRNA sequence
cctgctgaagagctccagaa

SEQ ID NO: 692989 - DNA, 20 bp, Artificial
  CRISPR gRNA sequence
gaagggctcctgctttccct

SEQ ID NO: 692990 - DNA, 20 bp, Artificial
  CRISPR gRNA sequence
gctcctgctttccctgagaa

SEQ ID NO: 692991 - DNA, 20 bp, Artificial
  CRISPR gRNA sequence
tctccctccttaccccatct

SEQ ID NO: 692992 - DNA, 20 bp, Artificial
  CRISPR gRNA sequence
ctccctccttaccccatctc

SEQ ID NO: 692993 - DNA, 20 bp, Artificial
  CRISPR gRNA sequence
tccttaccccatctcaggat

SEQ ID NO: 692994 - DNA, 20 bp, Artificial
  CRISPR gRNA sequence
ccttaccccatctcaggatg

SEQ ID NO: 692995 - DNA, 20 bp, Artificial
  CRISPR gRNA sequence
cttaccccatctcaggatga

SEQ ID NO: 692996 - DNA, 20 bp, Artificial
  CRISPR gRNA sequence
ttaccccatctcaggatgag

SEQ ID NO: 692997 - DNA, 20 bp, Artificial
  CRISPR gRNA sequence
cccatctcaggatgaggggc

SEQ ID NO: 692998 - DNA, 20 bp, Artificial
  CRISPR gRNA sequence
ccatctcaggatgaggggct

SEQ ID NO: 692999 - DNA, 20 bp, Artificial
  CRISPR gRNA sequence
catctcaggatgaggggctg

SEQ ID NO: 693000 - DNA, 20 bp, Artificial
  CRISPR gRNA sequence
ctcaggatgaggggctgggg

SEQ ID NO: 693001 - DNA, 20 bp, Artificial
  CRISPR gRNA sequence
gcagcccctcgtgctgcaca

SEQ ID NO: 693002 - DNA, 20 bp, Artificial
  CRISPR gRNA sequence
tgtgtatctctgttcctctc

SEQ ID NO: 693003 - DNA, 20 bp, Artificial
  CRISPR gRNA sequence
gtatctctgttcctctccag

SEQ ID NO: 693004 - DNA, 20 bp, Artificial
  CRISPR gRNA sequence
tatctctgttcctctccaga

SEQ ID NO: 693005 - DNA, 20 bp, Artificial
  CRISPR gRNA sequence
ctctccagaaggcaccacca

SEQ ID NO: 693006 - DNA, 20 bp, Artificial
  CRISPR gRNA sequence
tccagaaggcaccaccacag

SEQ ID NO: 693007 - DNA, 20 bp, Artificial
  CRISPR gRNA sequence
ccaccacagcggcccacttc

SEQ ID NO: 693008 - DNA, 20 bp, Artificial
  CRISPR gRNA sequence
ccacagcggcccacttctgg

SEQ ID NO: 693009 - DNA, 20 bp, Artificial
  CRISPR gRNA sequence
cacagcggcccacttctgga

SEQ ID NO: 693010 - DNA, 20 bp, Artificial
  CRISPR gRNA sequence
ctggaaggttccatcccctg

SEQ ID NO: 693011 - DNA, 20 bp, Artificial
  CRISPR gRNA sequence
tggaaggttccatcccctgc

SEQ ID NO: 693012 - DNA, 20 bp, Artificial
  CRISPR gRNA sequence
ggttccatcccctgcaggcc

SEQ ID NO: 693013 - DNA, 20 bp, Artificial
  CRISPR gRNA sequence
cctgcaggcctggtctccac

SEQ ID NO: 693014 - DNA, 20 bp, Artificial
  CRISPR gRNA sequence
tctccacaagctctgtgtcc

SEQ ID NO: 693015 - DNA, 20 bp, Artificial
  CRISPR gRNA sequence
ctccacaagctctgtgtcct

SEQ ID NO: 693016 - DNA, 20 bp, Artificial
  CRISPR gRNA sequence
gttcctccccatcccgctgc

SEQ ID NO: 693017 - DNA, 20 bp, Artificial
  CRISPR gRNA sequence
ttcctccccatcccgctgcc

SEQ ID NO: 693018 - DNA, 20 bp, Artificial
  CRISPR gRNA sequence
tccccatcccgctgccaggt

SEQ ID NO: 693019 - DNA, 20 bp, Artificial
  CRISPR gRNA sequence
ccaggtcagcgtgatctccg

SEQ ID NO: 693020 - DNA, 20 bp, Artificial
  CRISPR gRNA sequence
caggtcagcgtgatctccgc

SEQ ID NO: 693021 - DNA, 20 bp, Artificial
  CRISPR gRNA sequence
aggtcagcgtgatctccgca

SEQ ID NO: 693022 - DNA, 20 bp, Artificial
  CRISPR gRNA sequence
tcagcgtgatctccgcaggg

SEQ ID NO: 693023 - DNA, 20 bp, Artificial
  CRISPR gRNA sequence
gcgtgatctccgcagggtag

SEQ ID NO: 693024 - DNA, 20 bp, Artificial
  CRISPR gRNA sequence
atctccgcagggtagaagcc

SEQ ID NO: 693025 - DNA, 20 bp, Artificial
  CRISPR gRNA sequence
tctccgcagggtagaagccc

SEQ ID NO: 693026 - DNA, 20 bp, Artificial
  CRISPR gRNA sequence
ctccgcagggtagaagccca

SEQ ID NO: 693027 - DNA, 20 bp, Artificial
  CRISPR gRNA sequence
cagggtagaagcccagggcc

SEQ ID NO: 693028 - DNA, 20 bp, Artificial
  CRISPR gRNA sequence
aagcccagggcccagcacct

SEQ ID NO: 693029 - DNA, 20 bp, Artificial
  CRISPR gRNA sequence
agcccagggcccagcacctc

SEQ ID NO: 693030 - DNA, 20 bp, Artificial
  CRISPR gRNA sequence
gcccagggcccagcacctca

SEQ ID NO: 693031 - DNA, 20 bp, Artificial
  CRISPR gRNA sequence
cagggcccagcacctcaggg

SEQ ID NO: 693032 - DNA, 20 bp, Artificial
  CRISPR gRNA sequence
agcacctcagggtggcctca

SEQ ID NO: 693033 - DNA, 20 bp, Artificial
  CRISPR gRNA sequence
cctcagggtggcctcatggt

SEQ ID NO: 693034 - DNA, 20 bp, Artificial
  CRISPR gRNA sequence
tcagggtggcctcatggtca

SEQ ID NO: 693035 - DNA, 20 bp, Artificial
  CRISPR gRNA sequence
ggtggcctcatggtcagaga

SEQ ID NO: 693036 - DNA, 20 bp, Artificial
  CRISPR gRNA sequence
gtggcctcatggtcagagat

SEQ ID NO: 693037 - DNA, 20 bp, Artificial
  CRISPR gRNA sequence
tggcctcatggtcagagatg

SEQ ID NO: 693038 - DNA, 20 bp, Artificial
  CRISPR gRNA sequence
cctcatggtcagagatgggg

SEQ ID NO: 693039 - DNA, 20 bp, Artificial
  CRISPR gRNA sequence
catggtcagagatggggtgg

SEQ ID NO: 693040 - DNA, 20 bp, Artificial
  CRISPR gRNA sequence
atggtcagagatggggtggt

SEQ ID NO: 693041 - DNA, 20 bp, Artificial
  CRISPR gRNA sequence
tggtgggcaacgtgtgcctt

SEQ ID NO: 693042 - DNA, 20 bp, Artificial
  CRISPR gRNA sequence
gtgggcaacgtgtgcctttg

SEQ ID NO: 693043 - DNA, 20 bp, Artificial
  CRISPR gRNA sequence
tgggcaacgtgtgcctttgg

SEQ ID NO: 693044 - DNA, 20 bp, Artificial
  CRISPR gRNA sequence
cgtgtgcctttggaggatct

SEQ ID NO: 693045 - DNA, 20 bp, Artificial
  CRISPR gRNA sequence
gtgcctttggaggatctgag

SEQ ID NO: 693046 - DNA, 20 bp, Artificial
  CRISPR gRNA sequence
gcctttggaggatctgagaa

SEQ ID NO: 693047 - DNA, 20 bp, Artificial
  CRISPR gRNA sequence
ttggaggatctgagaagagt

SEQ ID NO: 693048 - DNA, 20 bp, Artificial
  CRISPR gRNA sequence
ctgagaagagtcagaaaatt

SEQ ID NO: 693049 - DNA, 20 bp, Artificial
  CRISPR gRNA sequence
tgagaagagtcagaaaattc

SEQ ID NO: 693050 - DNA, 20 bp, Artificial
  CRISPR gRNA sequence
caggcactttgcactcctca

SEQ ID NO: 693051 - DNA, 20 bp, Artificial
  CRISPR gRNA sequence
aggcactttgcactcctcat

SEQ ID NO: 693052 - DNA, 20 bp, Artificial
  CRISPR gRNA sequence
gcactcctcatgggaaaccc

SEQ ID NO: 693053 - DNA, 20 bp, Artificial
  CRISPR gRNA sequence
ctcctcatgggaaaccccag

SEQ ID NO: 693054 - DNA, 20 bp, Artificial
  CRISPR gRNA sequence
agcacccatgtgaccaacct

SEQ ID NO: 693055 - DNA, 20 bp, Artificial
  CRISPR gRNA sequence
ccatgtgaccaacctgagaa

SEQ ID NO: 693056 - DNA, 20 bp, Artificial
  CRISPR gRNA sequence
gtgaccaacctgagaatgga

SEQ ID NO: 693057 - DNA, 20 bp, Artificial
  CRISPR gRNA sequence
tgaccaacctgagaatggac

SEQ ID NO: 693058 - DNA, 20 bp, Artificial
  CRISPR gRNA sequence
ctgagaatggacaggacacc

SEQ ID NO: 693059 - DNA, 20 bp, Artificial
  CRISPR gRNA sequence
tgagaatggacaggacacct

SEQ ID NO: 693060 - DNA, 20 bp, Artificial
  CRISPR gRNA sequence
gagaatggacaggacacctg

SEQ ID NO: 693061 - DNA, 20 bp, Artificial
  CRISPR gRNA sequence
aatggacaggacacctgggg

SEQ ID NO: 693062 - DNA, 20 bp, Artificial
  CRISPR gRNA sequence
atggacaggacacctggggt

SEQ ID NO: 693063 - DNA, 20 bp, Artificial
  CRISPR gRNA sequence
tggacaggacacctggggtg

SEQ ID NO: 693064 - DNA, 20 bp, Artificial
  CRISPR gRNA sequence
acaggacacctggggtgggg

SEQ ID NO: 693065 - DNA, 20 bp, Artificial
  CRISPR gRNA sequence
caggacacctggggtgggga

SEQ ID NO: 693066 - DNA, 20 bp, Artificial
  CRISPR gRNA sequence
aggacacctggggtggggaa

SEQ ID NO: 693067 - DNA, 20 bp, Artificial
  CRISPR gRNA sequence
gacacctggggtggggaagg

SEQ ID NO: 693068 - DNA, 20 bp, Artificial
  CRISPR gRNA sequence
ctggggtggggaagggagca

SEQ ID NO: 693069 - DNA, 20 bp, Artificial
  CRISPR gRNA sequence
ggggaagggagcacagaacc

SEQ ID NO: 693070 - DNA, 20 bp, Artificial
  CRISPR gRNA sequence
ggagcacagaacccagacac

SEQ ID NO: 693071 - DNA, 20 bp, Artificial
  CRISPR gRNA sequence
acagaacccagacaccagcc

SEQ ID NO: 693072 - DNA, 20 bp, Artificial
  CRISPR gRNA sequence
cccagacaccagcctggaca

SEQ ID NO: 693073 - DNA, 20 bp, Artificial
  CRISPR gRNA sequence
ccagcctggacacagacacc

SEQ ID NO: 693074 - DNA, 20 bp, Artificial
  CRISPR gRNA sequence
cagcctggacacagacacct

SEQ ID NO: 693075 - DNA, 20 bp, Artificial
  CRISPR gRNA sequence
tgggaaaatctcctattcct

SEQ ID NO: 693076 - DNA, 20 bp, Artificial
  CRISPR gRNA sequence
aaaatctcctattccttgga

SEQ ID NO: 693077 - DNA, 20 bp, Artificial
  CRISPR gRNA sequence
tcctattccttggaaagttc

SEQ ID NO: 693078 - DNA, 20 bp, Artificial
  CRISPR gRNA sequence
cttggaaagttcgagtctct

SEQ ID NO: 693079 - DNA, 20 bp, Artificial
  CRISPR gRNA sequence
ggaaagttcgagtctctgag

SEQ ID NO: 693080 - DNA, 20 bp, Artificial
  CRISPR gRNA sequence
gaaagttcgagtctctgagt

SEQ ID NO: 693081 - DNA, 20 bp, Artificial
  CRISPR gRNA sequence
aaagttcgagtctctgagtg

SEQ ID NO: 693082 - DNA, 20 bp, Artificial
  CRISPR gRNA sequence
agttcgagtctctgagtggg

SEQ ID NO: 693083 - DNA, 20 bp, Artificial
  CRISPR gRNA sequence
tcgagtctctgagtggggag

SEQ ID NO: 693084 - DNA, 20 bp, Artificial
  CRISPR gRNA sequence
cgagtctctgagtggggagc

SEQ ID NO: 693085 - DNA, 20 bp, Artificial
  CRISPR gRNA sequence
gagtctctgagtggggagca

SEQ ID NO: 693086 - DNA, 20 bp, Artificial
  CRISPR gRNA sequence
gagtggggagcagggacttc

SEQ ID NO: 693087 - DNA, 20 bp, Artificial
  CRISPR gRNA sequence
gggacttctggccctgacct

SEQ ID NO: 693088 - DNA, 20 bp, Artificial
  CRISPR gRNA sequence
acttctggccctgacctaag

SEQ ID NO: 693089 - DNA, 20 bp, Artificial
  CRISPR gRNA sequence
ttctggccctgacctaagtg

SEQ ID NO: 693090 - DNA, 20 bp, Artificial
  CRISPR gRNA sequence
tctggccctgacctaagtgg

SEQ ID NO: 693091 - DNA, 20 bp, Artificial
  CRISPR gRNA sequence
ccctgacctaagtggaggcc

SEQ ID NO: 693092 - DNA, 20 bp, Artificial
  CRISPR gRNA sequence
cctgacctaagtggaggccg

SEQ ID NO: 693093 - DNA, 20 bp, Artificial
  CRISPR gRNA sequence
ctgacctaagtggaggccga

SEQ ID NO: 693094 - DNA, 20 bp, Artificial
  CRISPR gRNA sequence
ctaagtggaggccgagggac

SEQ ID NO: 693095 - DNA, 20 bp, Artificial
  CRISPR gRNA sequence
ggaggccgagggactggaat

SEQ ID NO: 693096 - DNA, 20 bp, Artificial
  CRISPR gRNA sequence
aggccgagggactggaatca

SEQ ID NO: 693097 - DNA, 20 bp, Artificial
  CRISPR gRNA sequence
atcagagccccaaacacatt

SEQ ID NO: 693098 - DNA, 20 bp, Artificial
  CRISPR gRNA sequence
gccccaaacacattgagtgt

SEQ ID NO: 693099 - DNA, 20 bp, Artificial
  CRISPR gRNA sequence
ccccaaacacattgagtgtg

SEQ ID NO: 693100 - DNA, 20 bp, Artificial
  CRISPR gRNA sequence
caaacacattgagtgtgagg

SEQ ID NO: 693101 - DNA, 20 bp, Artificial
  CRISPR gRNA sequence
aacacattgagtgtgaggca

SEQ ID NO: 693102 - DNA, 20 bp, Artificial
  CRISPR gRNA sequence
tgaggcagagaacaaaactt

SEQ ID NO: 693103 - DNA, 20 bp, Artificial
  CRISPR gRNA sequence
aggcagagaacaaaacttga

SEQ ID NO: 693104 - DNA, 20 bp, Artificial
  CRISPR gRNA sequence
gagaacaaaacttgagagaa

SEQ ID NO: 693105 - DNA, 20 bp, Artificial
  CRISPR gRNA sequence
aaaacttgagagaaaagtca

SEQ ID NO: 693106 - DNA, 20 bp, Artificial
  CRISPR gRNA sequence
aaacttgagagaaaagtcac

SEQ ID NO: 693107 - DNA, 20 bp, Artificial
  CRISPR gRNA sequence
aacttgagagaaaagtcacg

SEQ ID NO: 693108 - DNA, 20 bp, Artificial
  CRISPR gRNA sequence
agagaaaagtcacggggccc

SEQ ID NO: 693109 - DNA, 20 bp, Artificial
  CRISPR gRNA sequence
gagaaaagtcacggggccca

SEQ ID NO: 693110 - DNA, 20 bp, Artificial
  CRISPR gRNA sequence
gtcacggggcccaaggctgt

SEQ ID NO: 693111 - DNA, 20 bp, Artificial
  CRISPR gRNA sequence
cacggggcccaaggctgttg

SEQ ID NO: 693112 - DNA, 20 bp, Artificial
  CRISPR gRNA sequence
acggggcccaaggctgttgg

SEQ ID NO: 693113 - DNA, 20 bp, Artificial
  CRISPR gRNA sequence
cggggcccaaggctgttgga

SEQ ID NO: 693114 - DNA, 20 bp, Artificial
  CRISPR gRNA sequence
caaggctgttggagggctca

SEQ ID NO: 693115 - DNA, 20 bp, Artificial
  CRISPR gRNA sequence
aaggctgttggagggctcaa

SEQ ID NO: 693116 - DNA, 20 bp, Artificial
  CRISPR gRNA sequence
aggctgttggagggctcaaa

SEQ ID NO: 693117 - DNA, 20 bp, Artificial
  CRISPR gRNA sequence
ggctgttggagggctcaaag

SEQ ID NO: 693118 - DNA, 20 bp, Artificial
  CRISPR gRNA sequence
ggagggctcaaaggggaccg

SEQ ID NO: 693119 - DNA, 20 bp, Artificial
  CRISPR gRNA sequence
gctcaaaggggaccgcggat

SEQ ID NO: 693120 - DNA, 20 bp, Artificial
  CRISPR gRNA sequence
gggaccgcggatcggtattc

SEQ ID NO: 693121 - DNA, 20 bp, Artificial
  CRISPR gRNA sequence
ggaccgcggatcggtattcc

SEQ ID NO: 693122 - DNA, 20 bp, Artificial
  CRISPR gRNA sequence
gaccgcggatcggtattcca

SEQ ID NO: 693123 - DNA, 20 bp, Artificial
  CRISPR gRNA sequence
ctgtcttccctccattccct

SEQ ID NO: 693124 - DNA, 20 bp, Artificial
  CRISPR gRNA sequence
gtcttccctccattccctca

SEQ ID NO: 693125 - DNA, 20 bp, Artificial
  CRISPR gRNA sequence
atttcatcccttaattgtcc

SEQ ID NO: 693126 - DNA, 20 bp, Artificial
  CRISPR gRNA sequence
ttcatcccttaattgtccca

SEQ ID NO: 693127 - DNA, 20 bp, Artificial
  CRISPR gRNA sequence
catcccttaattgtcccaga

SEQ ID NO: 693128 - DNA, 20 bp, Artificial
  CRISPR gRNA sequence
cccttaattgtcccagagag

SEQ ID NO: 693129 - DNA, 20 bp, Artificial
  CRISPR gRNA sequence
ccttaattgtcccagagagc

SEQ ID NO: 693130 - DNA, 20 bp, Artificial
  CRISPR gRNA sequence
cttaattgtcccagagagca

SEQ ID NO: 693131 - DNA, 20 bp, Artificial
  CRISPR gRNA sequence
aattgtcccagagagcaggg

SEQ ID NO: 693132 - DNA, 20 bp, Artificial
  CRISPR gRNA sequence
gagagcagggcggactctca

SEQ ID NO: 693133 - DNA, 20 bp, Artificial
  CRISPR gRNA sequence
ggactctcacagtcactctc

SEQ ID NO: 693134 - DNA, 20 bp, Artificial
  CRISPR gRNA sequence
tcacagtcactctctggtac

SEQ ID NO: 693135 - DNA, 20 bp, Artificial
  CRISPR gRNA sequence
tctctggtaccggatctcga

SEQ ID NO: 693136 - DNA, 20 bp, Artificial
  CRISPR gRNA sequence
tggtaccggatctcgaaagc

SEQ ID NO: 693137 - DNA, 20 bp, Artificial
  CRISPR gRNA sequence
ggtaccggatctcgaaagcc

SEQ ID NO: 693138 - DNA, 20 bp, Artificial
  CRISPR gRNA sequence
accggatctcgaaagccagg

SEQ ID NO: 693139 - DNA, 20 bp, Artificial
  CRISPR gRNA sequence
ccaggaagattcttcctact

SEQ ID NO: 693140 - DNA, 20 bp, Artificial
  CRISPR gRNA sequence
caggaagattcttcctactc

SEQ ID NO: 693141 - DNA, 20 bp, Artificial
  CRISPR gRNA sequence
agattcttcctactcaggac

SEQ ID NO: 693142 - DNA, 20 bp, Artificial
  CRISPR gRNA sequence
attcttcctactcaggacta

SEQ ID NO: 693143 - DNA, 20 bp, Artificial
  CRISPR gRNA sequence
ttcttcctactcaggactag

SEQ ID NO: 693144 - DNA, 20 bp, Artificial
  CRISPR gRNA sequence
tcttcctactcaggactaga

SEQ ID NO: 693145 - DNA, 20 bp, Artificial
  CRISPR gRNA sequence
ttcctactcaggactagagg

SEQ ID NO: 693146 - DNA, 20 bp, Artificial
  CRISPR gRNA sequence
tcctactcaggactagaggg

SEQ ID NO: 693147 - DNA, 20 bp, Artificial
  CRISPR gRNA sequence
cctactcaggactagaggga

SEQ ID NO: 693148 - DNA, 20 bp, Artificial
  CRISPR gRNA sequence
ctagagggagggcgatatcc

SEQ ID NO: 693149 - DNA, 20 bp, Artificial
  CRISPR gRNA sequence
ggagggcgatatcctagcat

SEQ ID NO: 693150 - DNA, 20 bp, Artificial
  CRISPR gRNA sequence
gagggcgatatcctagcatt

SEQ ID NO: 693151 - DNA, 20 bp, Artificial
  CRISPR gRNA sequence
ctttcctcccaaccttgtgc

SEQ ID NO: 693152 - DNA, 20 bp, Artificial
  CRISPR gRNA sequence
tttcctcccaaccttgtgcg

SEQ ID NO: 693153 - DNA, 20 bp, Artificial
  CRISPR gRNA sequence
accttgtgcgaggccatccc

SEQ ID NO: 693154 - DNA, 20 bp, Artificial
  CRISPR gRNA sequence
cttgtgcgaggccatcccaa

SEQ ID NO: 693155 - DNA, 20 bp, Artificial
  CRISPR gRNA sequence
aggccatcccaagagatcta

SEQ ID NO: 693156 - DNA, 20 bp, Artificial
  CRISPR gRNA sequence
ggccatcccaagagatctac

SEQ ID NO: 693157 - DNA, 20 bp, Artificial
  CRISPR gRNA sequence
ccatcccaagagatctacag

SEQ ID NO: 693158 - DNA, 20 bp, Artificial
  CRISPR gRNA sequence
cccaagagatctacaggaga

SEQ ID NO: 693159 - DNA, 20 bp, Artificial
  CRISPR gRNA sequence
ccaagagatctacaggagat

SEQ ID NO: 693160 - DNA, 20 bp, Artificial
  CRISPR gRNA sequence
caagagatctacaggagata

SEQ ID NO: 693161 - DNA, 20 bp, Artificial
  CRISPR gRNA sequence
gagatctacaggagataggg

SEQ ID NO: 693162 - DNA, 20 bp, Artificial
  CRISPR gRNA sequence
agatctacaggagataggga

SEQ ID NO: 693163 - DNA, 20 bp, Artificial
  CRISPR gRNA sequence
ggagatagggaaggcgccca

SEQ ID NO: 693164 - DNA, 20 bp, Artificial
  CRISPR gRNA sequence
gggaaggcgcccatggcccc

SEQ ID NO: 693165 - DNA, 20 bp, Artificial
  CRISPR gRNA sequence
cccctggtacctgcgcgctg

SEQ ID NO: 693166 - DNA, 20 bp, Artificial
  CRISPR gRNA sequence
gcgtctccttcccattctcc

SEQ ID NO: 693167 - DNA, 20 bp, Artificial
  CRISPR gRNA sequence
tcccattctccaagtatctg

SEQ ID NO: 693168 - DNA, 20 bp, Artificial
  CRISPR gRNA sequence
ccattctccaagtatctgcg

SEQ ID NO: 693169 - DNA, 20 bp, Artificial
  CRISPR gRNA sequence
aagtatctgcggagcaactc

SEQ ID NO: 693170 - DNA, 20 bp, Artificial
  CRISPR gRNA sequence
agtatctgcggagcaactcc

SEQ ID NO: 693171 - DNA, 20 bp, Artificial
  CRISPR gRNA sequence
aactccaggcactcgccctc

SEQ ID NO: 693172 - DNA, 20 bp, Artificial
  CRISPR gRNA sequence
actccaggcactcgccctcc

SEQ ID NO: 693173 - DNA, 20 bp, Artificial
  CRISPR gRNA sequence
ccaggcactcgccctccagg

SEQ ID NO: 693174 - DNA, 20 bp, Artificial
  CRISPR gRNA sequence
caggcactcgccctccaggt

SEQ ID NO: 693175 - DNA, 20 bp, Artificial
  CRISPR gRNA sequence
ctgcatattcctctgcctca

SEQ ID NO: 693176 - DNA, 20 bp, Artificial
  CRISPR gRNA sequence
catattcctctgcctcatag

SEQ ID NO: 693177 - DNA, 20 bp, Artificial
  CRISPR gRNA sequence
cctctgcctcatagaagcgc

SEQ ID NO: 693178 - DNA, 20 bp, Artificial
  CRISPR gRNA sequence
ctctgcctcatagaagcgct

SEQ ID NO: 693179 - DNA, 20 bp, Artificial
  CRISPR gRNA sequence
atagaagcgctgggtgatct

SEQ ID NO: 693180 - DNA, 20 bp, Artificial
  CRISPR gRNA sequence
gcgctgggtgatctgagcca

SEQ ID NO: 693181 - DNA, 20 bp, Artificial
  CRISPR gRNA sequence
ctgagccacggtgtccgccg

SEQ ID NO: 693182 - DNA, 20 bp, Artificial
  CRISPR gRNA sequence
ccacggtgtccgccgcggtc

SEQ ID NO: 693183 - DNA, 20 bp, Artificial
  CRISPR gRNA sequence
cacggtgtccgccgcggtcc

SEQ ID NO: 693184 - DNA, 20 bp, Artificial
  CRISPR gRNA sequence
cggtgtccgccgcggtccag

SEQ ID NO: 693185 - DNA, 20 bp, Artificial
  CRISPR gRNA sequence
tccgccgcggtccaggagcg

SEQ ID NO: 693186 - DNA, 20 bp, Artificial
  CRISPR gRNA sequence
ccgccgcggtccaggagcgc

SEQ ID NO: 693187 - DNA, 20 bp, Artificial
  CRISPR gRNA sequence
caggagcgcaggtcctcgtt

SEQ ID NO: 693188 - DNA, 20 bp, Artificial
  CRISPR gRNA sequence
aggagcgcaggtcctcgttc

SEQ ID NO: 693189 - DNA, 20 bp, Artificial
  CRISPR gRNA sequence
ggagcgcaggtcctcgttca

SEQ ID NO: 693190 - DNA, 20 bp, Artificial
  CRISPR gRNA sequence
agcgcaggtcctcgttcagg

SEQ ID NO: 693191 - DNA, 20 bp, Artificial
  CRISPR gRNA sequence
ccttgccgtcgtacgcgtgc

SEQ ID NO: 693192 - DNA, 20 bp, Artificial
  CRISPR gRNA sequence
acgcgtgctggtgatacccg

SEQ ID NO: 693193 - DNA, 20 bp, Artificial
  CRISPR gRNA sequence
gcgtgctggtgatacccgcg

SEQ ID NO: 693194 - DNA, 20 bp, Artificial
  CRISPR gRNA sequence
cgtgctggtgatacccgcgg

SEQ ID NO: 693195 - DNA, 20 bp, Artificial
  CRISPR gRNA sequence
tgctggtgatacccgcggag

SEQ ID NO: 693196 - DNA, 20 bp, Artificial
  CRISPR gRNA sequence
gctggtgatacccgcggagg

SEQ ID NO: 693197 - DNA, 20 bp, Artificial
  CRISPR gRNA sequence
cccgcggaggaggcgtccgt

SEQ ID NO: 693198 - DNA, 20 bp, Artificial
  CRISPR gRNA sequence
ccgcggaggaggcgtccgtc

SEQ ID NO: 693199 - DNA, 20 bp, Artificial
  CRISPR gRNA sequence
gtccgtcgggccccatgtcg

SEQ ID NO: 693200 - DNA, 20 bp, Artificial
  CRISPR gRNA sequence
tgtcgcagccattcattccc

SEQ ID NO: 693201 - DNA, 20 bp, Artificial
  CRISPR gRNA sequence
tcgcagccattcattccctg

SEQ ID NO: 693202 - DNA, 20 bp, Artificial
  CRISPR gRNA sequence
cgcagccattcattccctgg

SEQ ID NO: 693203 - DNA, 20 bp, Artificial
  CRISPR gRNA sequence
gcagccattcattccctgga

SEQ ID NO: 693204 - DNA, 20 bp, Artificial
  CRISPR gRNA sequence
attcattccctggagggtgt

SEQ ID NO: 693205 - DNA, 20 bp, Artificial
  CRISPR gRNA sequence
ccctggagggtgtgagaccc

SEQ ID NO: 693206 - DNA, 20 bp, Artificial
  CRISPR gRNA sequence
ggagggtgtgagaccctagc

SEQ ID NO: 693207 - DNA, 20 bp, Artificial
  CRISPR gRNA sequence
gagaccctagccggtccccg

SEQ ID NO: 693208 - DNA, 20 bp, Artificial
  CRISPR gRNA sequence
ccctagccggtccccgcagt

SEQ ID NO: 693209 - DNA, 20 bp, Artificial
  CRISPR gRNA sequence
tccccgcagtcagccccgcc

SEQ ID NO: 693210 - DNA, 20 bp, Artificial
  CRISPR gRNA sequence
cgcagtcagccccgcccagc

SEQ ID NO: 693211 - DNA, 20 bp, Artificial
  CRISPR gRNA sequence
ccccctccccgcccaacccg

SEQ ID NO: 693212 - DNA, 20 bp, Artificial
  CRISPR gRNA sequence
cccctccccgcccaacccgc

SEQ ID NO: 693213 - DNA, 20 bp, Artificial
  CRISPR gRNA sequence
ccctccccgcccaacccgcg

SEQ ID NO: 693214 - DNA, 20 bp, Artificial
  CRISPR gRNA sequence
cgcccaacccgcggggattt

SEQ ID NO: 693215 - DNA, 20 bp, Artificial
  CRISPR gRNA sequence
cctaaactgaaaatgaacct

SEQ ID NO: 693216 - DNA, 20 bp, Artificial
  CRISPR gRNA sequence
actgaaaatgaacctcggta

SEQ ID NO: 693217 - DNA, 20 bp, Artificial
  CRISPR gRNA sequence
ctgaaaatgaacctcggtaa

SEQ ID NO: 693218 - DNA, 20 bp, Artificial
  CRISPR gRNA sequence
tgaacctcggtaaaggcgcc

SEQ ID NO: 693219 - DNA, 20 bp, Artificial
  CRISPR gRNA sequence
gaacctcggtaaaggcgcct

SEQ ID NO: 693220 - DNA, 20 bp, Artificial
  CRISPR gRNA sequence
aaaggcgcctgggactctcc

SEQ ID NO: 693221 - DNA, 20 bp, Artificial
  CRISPR gRNA sequence
aaggcgcctgggactctccc

SEQ ID NO: 693222 - DNA, 20 bp, Artificial
  CRISPR gRNA sequence
gcgcctgggactctcccggg

SEQ ID NO: 693223 - DNA, 20 bp, Artificial
  CRISPR gRNA sequence
gcctgggactctcccgggtg

SEQ ID NO: 693224 - DNA, 20 bp, Artificial
  CRISPR gRNA sequence
cctgggactctcccgggtgg

SEQ ID NO: 693225 - DNA, 20 bp, Artificial
  CRISPR gRNA sequence
ctgggactctcccgggtgga

SEQ ID NO: 693226 - DNA, 20 bp, Artificial
  CRISPR gRNA sequence
actctcccgggtggagggtc

SEQ ID NO: 693227 - DNA, 20 bp, Artificial
  CRISPR gRNA sequence
ctctcccgggtggagggtct

SEQ ID NO: 693228 - DNA, 20 bp, Artificial
  CRISPR gRNA sequence
tcccgggtggagggtctggg

SEQ ID NO: 693229 - DNA, 20 bp, Artificial
  CRISPR gRNA sequence
cccgggtggagggtctgggc

SEQ ID NO: 693230 - DNA, 20 bp, Artificial
  CRISPR gRNA sequence
ctgggcgggtcccgctgcct

SEQ ID NO: 693231 - DNA, 20 bp, Artificial
  CRISPR gRNA sequence
tgggcgggtcccgctgcctc

SEQ ID NO: 693232 - DNA, 20 bp, Artificial
  CRISPR gRNA sequence
gggcgggtcccgctgcctcg

SEQ ID NO: 693233 - DNA, 20 bp, Artificial
  CRISPR gRNA sequence
cgggtcccgctgcctcgggg

SEQ ID NO: 693234 - DNA, 20 bp, Artificial
  CRISPR gRNA sequence
cgctgcctcggggtagattt

SEQ ID NO: 693235 - DNA, 20 bp, Artificial
  CRISPR gRNA sequence
ctcggggtagatttcggatc

SEQ ID NO: 693236 - DNA, 20 bp, Artificial
  CRISPR gRNA sequence
cggggtagatttcggatccg

SEQ ID NO: 693237 - DNA, 20 bp, Artificial
  CRISPR gRNA sequence
gatttcggatccggagactc

SEQ ID NO: 693238 - DNA, 20 bp, Artificial
  CRISPR gRNA sequence
atttcggatccggagactct

SEQ ID NO: 693239 - DNA, 20 bp, Artificial
  CRISPR gRNA sequence
tttcggatccggagactctg

SEQ ID NO: 693240 - DNA, 20 bp, Artificial
  CRISPR gRNA sequence
ttcggatccggagactctgg

SEQ ID NO: 693241 - DNA, 20 bp, Artificial
  CRISPR gRNA sequence
tccggagactctgggggacc

SEQ ID NO: 693242 - DNA, 20 bp, Artificial
  CRISPR gRNA sequence
ccggagactctgggggaccc

SEQ ID NO: 693243 - DNA, 20 bp, Artificial
  CRISPR gRNA sequence
gagactctgggggacccggg

SEQ ID NO: 693244 - DNA, 20 bp, Artificial
  CRISPR gRNA sequence
tgggggacccgggcggtccg

SEQ ID NO: 693245 - DNA, 20 bp, Artificial
  CRISPR gRNA sequence
gggacccgggcggtccgtgg

SEQ ID NO: 693246 - DNA, 20 bp, Artificial
  CRISPR gRNA sequence
cccgggcggtccgtggcgga

SEQ ID NO: 693247 - DNA, 20 bp, Artificial
  CRISPR gRNA sequence
ccgggcggtccgtggcggat

SEQ ID NO: 693248 - DNA, 20 bp, Artificial
  CRISPR gRNA sequence
cgggcggtccgtggcggatg

SEQ ID NO: 693249 - DNA, 20 bp, Artificial
  CRISPR gRNA sequence
gggcggtccgtggcggatgg

SEQ ID NO: 693250 - DNA, 20 bp, Artificial
  CRISPR gRNA sequence
ggcggtccgtggcggatggg

SEQ ID NO: 693251 - DNA, 20 bp, Artificial
  CRISPR gRNA sequence
ggtccgtggcggatgggggg

SEQ ID NO: 693252 - DNA, 20 bp, Artificial
  CRISPR gRNA sequence
gtggtcgtgacctgcgcccc

SEQ ID NO: 693253 - DNA, 20 bp, Artificial
  CRISPR gRNA sequence
tcgtgacctgcgcccccggc

SEQ ID NO: 693254 - DNA, 20 bp, Artificial
  CRISPR gRNA sequence
cgtgacctgcgcccccggcc

SEQ ID NO: 693255 - DNA, 20 bp, Artificial
  CRISPR gRNA sequence
ccccggccgggttcactcac

SEQ ID NO: 693256 - DNA, 20 bp, Artificial
  CRISPR gRNA sequence
ttcactcaccagcctcgctc

SEQ ID NO: 693257 - DNA, 20 bp, Artificial
  CRISPR gRNA sequence
caccagcctcgctctggttg

SEQ ID NO: 693258 - DNA, 20 bp, Artificial
  CRISPR gRNA sequence
cagcctcgctctggttgtag

SEQ ID NO: 693259 - DNA, 20 bp, Artificial
  CRISPR gRNA sequence
cctcgctctggttgtagcgg

SEQ ID NO: 693260 - DNA, 20 bp, Artificial
  CRISPR gRNA sequence
tcgctctggttgtagcggcg

SEQ ID NO: 693261 - DNA, 20 bp, Artificial
  CRISPR gRNA sequence
ctctggttgtagcggcggag

SEQ ID NO: 693262 - DNA, 20 bp, Artificial
  CRISPR gRNA sequence
tctggttgtagcggcggagc

SEQ ID NO: 693263 - DNA, 20 bp, Artificial
  CRISPR gRNA sequence
tagcggcggagcaggttcct

SEQ ID NO: 693264 - DNA, 20 bp, Artificial
  CRISPR gRNA sequence
agcggcggagcaggttcctc

SEQ ID NO: 693265 - DNA, 20 bp, Artificial
  CRISPR gRNA sequence
gcggcggagcaggttcctca

SEQ ID NO: 693266 - DNA, 20 bp, Artificial
  CRISPR gRNA sequence
gcaggttcctcagggccact

SEQ ID NO: 693267 - DNA, 20 bp, Artificial
  CRISPR gRNA sequence
gttcctcagggccactcggt

SEQ ID NO: 693268 - DNA, 20 bp, Artificial
  CRISPR gRNA sequence
cactcggtcagtctgtgcgt

SEQ ID NO: 693269 - DNA, 20 bp, Artificial
  CRISPR gRNA sequence
gtcagtctgtgcgttggcct

SEQ ID NO: 693270 - DNA, 20 bp, Artificial
  CRISPR gRNA sequence
gttggccttggcgtaccctg

SEQ ID NO: 693271 - DNA, 20 bp, Artificial
  CRISPR gRNA sequence
gtggtccactcccaatactg

SEQ ID NO: 693272 - DNA, 20 bp, Artificial
  CRISPR gRNA sequence
ggcccctcttgctccaccca

SEQ ID NO: 693273 - DNA, 20 bp, Artificial
  CRISPR gRNA sequence
tgctccacccacggctcccg

SEQ ID NO: 693274 - DNA, 20 bp, Artificial
  CRISPR gRNA sequence
ggctcccgcggctccatcct

SEQ ID NO: 693275 - DNA, 20 bp, Artificial
  CRISPR gRNA sequence
cggctccatcctcggaatcg

SEQ ID NO: 693276 - DNA, 20 bp, Artificial
  CRISPR gRNA sequence
gcggcgtcgctgtcgaaccg

SEQ ID NO: 693277 - DNA, 20 bp, Artificial
  CRISPR gRNA sequence
cggcgtcgctgtcgaaccgc

SEQ ID NO: 693278 - DNA, 20 bp, Artificial
  CRISPR gRNA sequence
cgtgtcgtctacgtactcca

SEQ ID NO: 693279 - DNA, 20 bp, Artificial
  CRISPR gRNA sequence
ctacgtactccacggcgatg

SEQ ID NO: 693280 - DNA, 20 bp, Artificial
  CRISPR gRNA sequence
cgtactccacggcgatgtag

SEQ ID NO: 693281 - DNA, 20 bp, Artificial
  CRISPR gRNA sequence
gtactccacggcgatgtagc

SEQ ID NO: 693282 - DNA, 20 bp, Artificial
  CRISPR gRNA sequence
tactccacggcgatgtagcg

SEQ ID NO: 693283 - DNA, 20 bp, Artificial
  CRISPR gRNA sequence
cgatgtagcggggctccccg

SEQ ID NO: 693284 - DNA, 20 bp, Artificial
  CRISPR gRNA sequence
gtagcggggctccccgcggc

SEQ ID NO: 693285 - DNA, 20 bp, Artificial
  CRISPR gRNA sequence
tagcggggctccccgcggcc

SEQ ID NO: 693286 - DNA, 20 bp, Artificial
  CRISPR gRNA sequence
cccgcggccgggccgcgaca

SEQ ID NO: 693287 - DNA, 20 bp, Artificial
  CRISPR gRNA sequence
gcggccgggccgcgacacag

SEQ ID NO: 693288 - DNA, 20 bp, Artificial
  CRISPR gRNA sequence
cagcggtgctgaaatacctc

SEQ ID NO: 693289 - DNA, 20 bp, Artificial
  CRISPR gRNA sequence
agcggtgctgaaatacctca

SEQ ID NO: 693290 - DNA, 20 bp, Artificial
  CRISPR gRNA sequence
cggtgctgaaatacctcaag

SEQ ID NO: 693291 - DNA, 20 bp, Artificial
  CRISPR gRNA sequence
tgctgaaatacctcaaggag

SEQ ID NO: 693292 - DNA, 20 bp, Artificial
  CRISPR gRNA sequence
gctgaaatacctcaaggagt

SEQ ID NO: 693293 - DNA, 20 bp, Artificial
  CRISPR gRNA sequence
tgaaatacctcaaggagtgg

SEQ ID NO: 693294 - DNA, 20 bp, Artificial
  CRISPR gRNA sequence
tacctcaaggagtgggagcc

SEQ ID NO: 693295 - DNA, 20 bp, Artificial
  CRISPR gRNA sequence
acctcaaggagtgggagcct

SEQ ID NO: 693296 - DNA, 20 bp, Artificial
  CRISPR gRNA sequence
cctcaaggagtgggagcctg

SEQ ID NO: 693297 - DNA, 20 bp, Artificial
  CRISPR gRNA sequence
ctcaaggagtgggagcctgg

SEQ ID NO: 693298 - DNA, 20 bp, Artificial
  CRISPR gRNA sequence
aggagtgggagcctgggggc

SEQ ID NO: 693299 - DNA, 20 bp, Artificial
  CRISPR gRNA sequence
ggagtgggagcctgggggcg

SEQ ID NO: 693300 - DNA, 20 bp, Artificial
  CRISPR gRNA sequence
agtgggagcctgggggcgag

SEQ ID NO: 693301 - DNA, 20 bp, Artificial
  CRISPR gRNA sequence
gtgggagcctgggggcgagg

SEQ ID NO: 693302 - DNA, 20 bp, Artificial
  CRISPR gRNA sequence
tgggagcctgggggcgagga

SEQ ID NO: 693303 - DNA, 20 bp, Artificial
  CRISPR gRNA sequence
gggagcctgggggcgaggag

SEQ ID NO: 693304 - DNA, 20 bp, Artificial
  CRISPR gRNA sequence
cctgggggcgaggaggggct

SEQ ID NO: 693305 - DNA, 20 bp, Artificial
  CRISPR gRNA sequence
gaggaggggctgagacccgc

SEQ ID NO: 693306 - DNA, 20 bp, Artificial
  CRISPR gRNA sequence
agacccgccagaccctcctc

SEQ ID NO: 693307 - DNA, 20 bp, Artificial
  CRISPR gRNA sequence
gacccgccagaccctcctcc

SEQ ID NO: 693308 - DNA, 20 bp, Artificial
  CRISPR gRNA sequence
gccagaccctcctccgggcg

SEQ ID NO: 693309 - DNA, 20 bp, Artificial
  CRISPR gRNA sequence
tcctccgggcgcggctccct

SEQ ID NO: 693310 - DNA, 20 bp, Artificial
  CRISPR gRNA sequence
cctgagtcctgcgcccccac

SEQ ID NO: 693311 - DNA, 20 bp, Artificial
  CRISPR gRNA sequence
ctgagtcctgcgcccccacc

SEQ ID NO: 693312 - DNA, 20 bp, Artificial
  CRISPR gRNA sequence
agtcctgcgcccccaccggg

SEQ ID NO: 693313 - DNA, 20 bp, Artificial
  CRISPR gRNA sequence
gtcctgcgcccccaccgggc

SEQ ID NO: 693314 - DNA, 20 bp, Artificial
  CRISPR gRNA sequence
gggcccctcactcctcccca

SEQ ID NO: 693315 - DNA, 20 bp, Artificial
  CRISPR gRNA sequence
gcccctcactcctccccaca

SEQ ID NO: 693316 - DNA, 20 bp, Artificial
  CRISPR gRNA sequence
cccctcactcctccccacag

SEQ ID NO: 693317 - DNA, 20 bp, Artificial
  CRISPR gRNA sequence
ccacagaggccgtttctctc

SEQ ID NO: 693318 - DNA, 20 bp, Artificial
  CRISPR gRNA sequence
gaccccgcactcacccgccc

SEQ ID NO: 693319 - DNA, 20 bp, Artificial
  CRISPR gRNA sequence
gcactcacccgcccaagtat

SEQ ID NO: 693320 - DNA, 20 bp, Artificial
  CRISPR gRNA sequence
tcacccgcccaagtatcggt

SEQ ID NO: 693321 - DNA, 20 bp, Artificial
  CRISPR gRNA sequence
cacccgcccaagtatcggtc

SEQ ID NO: 693322 - DNA, 20 bp, Artificial
  CRISPR gRNA sequence
acccgcccaagtatcggtca

SEQ ID NO: 693323 - DNA, 20 bp, Artificial
  CRISPR gRNA sequence
gcccaagtatcggtcagggc

SEQ ID NO: 693324 - DNA, 20 bp, Artificial
  CRISPR gRNA sequence
cccaagtatcggtcagggcc

SEQ ID NO: 693325 - DNA, 20 bp, Artificial
  CRISPR gRNA sequence
ccaagtatcggtcagggcca

SEQ ID NO: 693326 - DNA, 20 bp, Artificial
  CRISPR gRNA sequence
cggtcagggccagggcccct

SEQ ID NO: 693327 - DNA, 20 bp, Artificial
  CRISPR gRNA sequence
gtcagggccagggcccctga

SEQ ID NO: 693328 - DNA, 20 bp, Artificial
  CRISPR gRNA sequence
agggccagggcccctgagag

SEQ ID NO: 693329 - DNA, 20 bp, Artificial
  CRISPR gRNA sequence
gccagggcccctgagagcag

SEQ ID NO: 693330 - DNA, 20 bp, Artificial
  CRISPR gRNA sequence
ccagggcccctgagagcagc

SEQ ID NO: 693331 - DNA, 20 bp, Artificial
  CRISPR gRNA sequence
agggcccctgagagcagcag

SEQ ID NO: 693332 - DNA, 20 bp, Artificial
  CRISPR gRNA sequence
gggcccctgagagcagcagg

SEQ ID NO: 693333 - DNA, 20 bp, Artificial
  CRISPR gRNA sequence
gcccctgagagcagcaggag

SEQ ID NO: 693334 - DNA, 20 bp, Artificial
  CRISPR gRNA sequence
cccctgagagcagcaggagg

SEQ ID NO: 693335 - DNA, 20 bp, Artificial
  CRISPR gRNA sequence
agagcagcaggaggaggctt

SEQ ID NO: 693336 - DNA, 20 bp, Artificial
  CRISPR gRNA sequence
gagcagcaggaggaggcttc

SEQ ID NO: 693337 - DNA, 20 bp, Artificial
  CRISPR gRNA sequence
agcagcaggaggaggcttcg

SEQ ID NO: 693338 - DNA, 20 bp, Artificial
  CRISPR gRNA sequence
atgaccccaacctccgcgtc

SEQ ID NO: 693339 - DNA, 20 bp, Artificial
  CRISPR gRNA sequence
tgaccccaacctccgcgtct

SEQ ID NO: 693340 - DNA, 20 bp, Artificial
  CRISPR gRNA sequence
tccgcgtctgggaaaaatat

SEQ ID NO: 693341 - DNA, 20 bp, Artificial
  CRISPR gRNA sequence
tgggaaaaatatgagtcccg

SEQ ID NO: 693342 - DNA, 20 bp, Artificial
  CRISPR gRNA sequence
gggaaaaatatgagtcccgc

SEQ ID NO: 693343 - DNA, 20 bp, Artificial
  CRISPR gRNA sequence
ggaaaaatatgagtcccgcg

SEQ ID NO: 693344 - DNA, 20 bp, Artificial
  CRISPR gRNA sequence
tatgagtcccgcggggtgcg

SEQ ID NO: 693345 - DNA, 20 bp, Artificial
  CRISPR gRNA sequence
atgagtcccgcggggtgcgt

SEQ ID NO: 693346 - DNA, 20 bp, Artificial
  CRISPR gRNA sequence
ccgcggggtgcgtgggactt

SEQ ID NO: 693347 - DNA, 20 bp, Artificial
  CRISPR gRNA sequence
gtgcgtgggactttagaacc

SEQ ID NO: 693348 - DNA, 20 bp, Artificial
  CRISPR gRNA sequence
tgcgtgggactttagaacct

SEQ ID NO: 693349 - DNA, 20 bp, Artificial
  CRISPR gRNA sequence
actttagaacctgggaactg

SEQ ID NO: 693350 - DNA, 20 bp, Artificial
  CRISPR gRNA sequence
ggaactgcggcgacactgat

SEQ ID NO: 693351 - DNA, 20 bp, Artificial
  CRISPR gRNA sequence
gcgacactgattggcttctc

SEQ ID NO: 693352 - DNA, 20 bp, Artificial
  CRISPR gRNA sequence
tctagaaacgcgacgcccaa

SEQ ID NO: 693353 - DNA, 20 bp, Artificial
  CRISPR gRNA sequence
ctagaaacgcgacgcccaat

SEQ ID NO: 693354 - DNA, 20 bp, Artificial
  CRISPR gRNA sequence
agaaacgcgacgcccaatgg

SEQ ID NO: 693355 - DNA, 20 bp, Artificial
  CRISPR gRNA sequence
acgcgacgcccaatgggagt

SEQ ID NO: 693356 - DNA, 20 bp, Artificial
  CRISPR gRNA sequence
cgcccaatgggagtgagaaa

SEQ ID NO: 693357 - DNA, 20 bp, Artificial
  CRISPR gRNA sequence
gcccaatgggagtgagaaat

SEQ ID NO: 693358 - DNA, 20 bp, Artificial
  CRISPR gRNA sequence
cccaatgggagtgagaaatg

SEQ ID NO: 693359 - DNA, 20 bp, Artificial
  CRISPR gRNA sequence
tttttcccagacgcggaggt

SEQ ID NO: 693360 - DNA, 20 bp, Artificial
  CRISPR gRNA sequence
tggccctgaccgatacttgg

SEQ ID NO: 693361 - DNA, 20 bp, Artificial
  CRISPR gRNA sequence
cctgaccgatacttgggcgg

SEQ ID NO: 693362 - DNA, 20 bp, Artificial
  CRISPR gRNA sequence
gatacttgggcgggtgagtg

SEQ ID NO: 693363 - DNA, 20 bp, Artificial
  CRISPR gRNA sequence
gagaaacggcctctgtgggg

SEQ ID NO: 693364 - DNA, 20 bp, Artificial
  CRISPR gRNA sequence
tcagggagccgcgcccggag

SEQ ID NO: 693365 - DNA, 20 bp, Artificial
  CRISPR gRNA sequence
cgcgcccggaggagggtctg

SEQ ID NO: 693366 - DNA, 20 bp, Artificial
  CRISPR gRNA sequence
ggagccccgctacatcgccg

SEQ ID NO: 693367 - DNA, 20 bp, Artificial
  CRISPR gRNA sequence
gacagcgacgccgcgattcc

SEQ ID NO: 693368 - DNA, 20 bp, Artificial
  CRISPR gRNA sequence
aggatggagccgcgggagcc

SEQ ID NO: 693369 - DNA, 20 bp, Artificial
  CRISPR gRNA sequence
gcaagaggggccgcagtatt

SEQ ID NO: 693370 - DNA, 20 bp, Artificial
  CRISPR gRNA sequence
gcagtattgggagtggacca

SEQ ID NO: 693371 - DNA, 20 bp, Artificial
  CRISPR gRNA sequence
aaggccaacgcacagactga

SEQ ID NO: 693372 - DNA, 20 bp, Artificial
  CRISPR gRNA sequence
ctacaaccagagcgaggctg

SEQ ID NO: 693373 - DNA, 20 bp, Artificial
  CRISPR gRNA sequence
ccccatccgccacggaccgc

SEQ ID NO: 693374 - DNA, 20 bp, Artificial
  CRISPR gRNA sequence
cacggaccgcccgggtcccc

SEQ ID NO: 693375 - DNA, 20 bp, Artificial
  CRISPR gRNA sequence
gcccgggtcccccagagtct

SEQ ID NO: 693376 - DNA, 20 bp, Artificial
  CRISPR gRNA sequence
cgcccagaccctccacccgg

SEQ ID NO: 693377 - DNA, 20 bp, Artificial
  CRISPR gRNA sequence
cagtttaggccaaaatcccc

SEQ ID NO: 693378 - DNA, 20 bp, Artificial
  CRISPR gRNA sequence
ggctgactgcggggaccggc

SEQ ID NO: 693379 - DNA, 20 bp, Artificial
  CRISPR gRNA sequence
ctagggtctcacaccctcca

SEQ ID NO: 693380 - DNA, 20 bp, Artificial
  CRISPR gRNA sequence
ggtctcacaccctccaggga

SEQ ID NO: 693381 - DNA, 20 bp, Artificial
  CRISPR gRNA sequence
gcccgacggacgcctcctcc

SEQ ID NO: 693382 - DNA, 20 bp, Artificial
  CRISPR gRNA sequence
accagcacgcgtacgacggc

SEQ ID NO: 693383 - DNA, 20 bp, Artificial
  CRISPR gRNA sequence
ccagcgcttctatgaggcag

SEQ ID NO: 693384 - DNA, 20 bp, Artificial
  CRISPR gRNA sequence
tgaggcagaggaatatgcag

SEQ ID NO: 693385 - DNA, 20 bp, Artificial
  CRISPR gRNA sequence
gttcaggacctacctggagg

SEQ ID NO: 693386 - DNA, 20 bp, Artificial
  CRISPR gRNA sequence
ctacctggagggcgagtgcc

SEQ ID NO: 693387 - DNA, 20 bp, Artificial
  CRISPR gRNA sequence
agttgctccgcagatacttg

SEQ ID NO: 693388 - DNA, 20 bp, Artificial
  CRISPR gRNA sequence
cctatctcctgtagatctct

SEQ ID NO: 693389 - DNA, 20 bp, Artificial
  CRISPR gRNA sequence
gaggaaagtgggcccaatgc

SEQ ID NO: 693390 - DNA, 20 bp, Artificial
  CRISPR gRNA sequence
atatcgccctccctctagtc

SEQ ID NO: 693391 - DNA, 20 bp, Artificial
  CRISPR gRNA sequence
tccctctagtcctgagtagg

SEQ ID NO: 693392 - DNA, 20 bp, Artificial
  CRISPR gRNA sequence
gctttcgagatccggtacca

SEQ ID NO: 693393 - DNA, 20 bp, Artificial
  CRISPR gRNA sequence
cggtaccagagagtgactgt

SEQ ID NO: 693394 - DNA, 20 bp, Artificial
  CRISPR gRNA sequence
cctgctctctgggacaatta

SEQ ID NO: 693395 - DNA, 20 bp, Artificial
  CRISPR gRNA sequence
ttaagggatgaaatctctga

SEQ ID NO: 693396 - DNA, 20 bp, Artificial
  CRISPR gRNA sequence
aatggagggaagacagtccc

SEQ ID NO: 693397 - DNA, 20 bp, Artificial
  CRISPR gRNA sequence
tcagagactcgaactttcca

SEQ ID NO: 693398 - DNA, 20 bp, Artificial
  CRISPR gRNA sequence
gtctgtgtccaggctggtgt

SEQ ID NO: 693399 - DNA, 20 bp, Artificial
  CRISPR gRNA sequence
tccattctcaggttggtcac

SEQ ID NO: 693400 - DNA, 20 bp, Artificial
  CRISPR gRNA sequence
gttggtcacatgggtgctgc

SEQ ID NO: 693401 - DNA, 20 bp, Artificial
  CRISPR gRNA sequence
tgctgctggggtttcccatg

SEQ ID NO: 693402 - DNA, 20 bp, Artificial
  CRISPR gRNA sequence
ccatgaggagtgcaaagtgc

SEQ ID NO: 693403 - DNA, 20 bp, Artificial
  CRISPR gRNA sequence
agatcacgctgacctggcag

SEQ ID NO: 693404 - DNA, 20 bp, Artificial
  CRISPR gRNA sequence
ttgtggagaccaggcctgca

SEQ ID NO: 693405 - DNA, 20 bp, Artificial
  CRISPR gRNA sequence
cccagcccctcatcctgaga

SEQ ID NO: 693406 - DNA, 20 bp, Artificial
  CRISPR gRNA sequence
gagatggggtaaggagggag

SEQ ID NO: 693407 - DNA, 20 bp, Artificial
  CRISPR gRNA sequence
gatgggtaaagaggggaacg

SEQ ID NO: 693408 - DNA, 20 bp, Artificial
  CRISPR gRNA sequence
gcccttctggagctcttcag

SEQ ID NO: 693409 - DNA, 20 bp, Artificial
  CRISPR gRNA sequence
gaagaagagctcaggtagga

SEQ ID NO: 693410 - DNA, 20 bp, Artificial
  CRISPR gRNA sequence
agctcaggtaggaaggggtg

SEQ ID NO: 693411 - DNA, 20 bp, Artificial
  CRISPR gRNA sequence
aggtaggaaggggtgaggag

SEQ ID NO: 693412 - DNA, 20 bp, Artificial
  CRISPR gRNA sequence
gaaggggtgaggagtggagt

SEQ ID NO: 693413 - DNA, 20 bp, Artificial
  CRISPR gRNA sequence
ctgagttttcttgtcccact

SEQ ID NO: 693414 - DNA, 20 bp, Artificial
  CRISPR gRNA sequence
gggaagcaccatccacactc

SEQ ID NO: 693415 - DNA, 20 bp, Artificial
  CRISPR gRNA sequence
tcatatttcttgatcctgcc

SEQ ID NO: 693416 - DNA, 20 bp, Artificial
  CRISPR gRNA sequence
cacttttctggaaacttctc

SEQ ID NO: 693417 - DNA, 20 bp, Artificial
  CRISPR gRNA sequence
cttctctgggatcaaagact

SEQ ID NO: 693418 - DNA, 20 bp, Artificial
  CRISPR gRNA sequence
aggctgatccctgagattgt

SEQ ID NO: 693419 - DNA, 20 bp, Artificial
  CRISPR gRNA sequence
actgacagtgcccagggctc

SEQ ID NO: 693420 - DNA, 20 bp, Artificial
  CRISPR gRNA sequence
tccagggcaggggccctgat

SEQ ID NO: 693421 - DNA, 20 bp, Artificial
  CRISPR gRNA sequence
ggcaggggccctgatgtgag

SEQ ID NO: 693422 - DNA, 20 bp, Artificial
  CRISPR gRNA sequence
gaggggactcagctgtgcta

SEQ ID NO: 693423 - DNA, 20 bp, Artificial
  CRISPR gRNA sequence
tgctattgggtttctttgac

SEQ ID NO: 693424 - DNA, 20 bp, Artificial
  CRISPR gRNA sequence
tgagcatgaaatgggctatt

SEQ ID NO: 693425 - DNA, 20 bp, Artificial
  CRISPR gRNA sequence
tacctctcactgtgactgat

SEQ ID NO: 693426 - DNA, 20 bp, Artificial
  CRISPR gRNA sequence
tgactgatacgaatttgttc

SEQ ID NO: 693427 - DNA, 20 bp, Artificial
  CRISPR gRNA sequence
gaagcaagatatcaatgtag

SEQ ID NO: 693428 - DNA, 20 bp, Artificial
  CRISPR gRNA sequence
atacataaattttaaaaata

SEQ ID NO: 693429 - DNA, 20 bp, Artificial
  CRISPR gRNA sequence
tgtgtgtgtgtgtgaagaga

SEQ ID NO: 693430 - DNA, 20 bp, Artificial
  CRISPR gRNA sequence
tgtgtgtgtgaagagaaaga

SEQ ID NO: 693431 - DNA, 20 bp, Artificial
  CRISPR gRNA sequence
tgaaaagatatacatatatt

SEQ ID NO: 693432 - DNA, 20 bp, Artificial
  CRISPR gRNA sequence
gccttcctctctccatcaga

SEQ ID NO: 693433 - DNA, 20 bp, Artificial
  CRISPR gRNA sequence
ctctctccatcagactgaat

SEQ ID NO: 693434 - DNA, 20 bp, Artificial
  CRISPR gRNA sequence
tggtcaagcttatttctcct

SEQ ID NO: 693435 - DNA, 20 bp, Artificial
  CRISPR gRNA sequence
tctcctgggggtgctcttcc

SEQ ID NO: 693436 - DNA, 20 bp, Artificial
  CRISPR gRNA sequence
aaggatatttgggctgcctc

SEQ ID NO: 693437 - DNA, 20 bp, Artificial
  CRISPR gRNA sequence
gtgtcttgggccgccggaag

SEQ ID NO: 693438 - DNA, 20 bp, Artificial
  CRISPR gRNA sequence
cgccggaaggtgggtgacat

SEQ ID NO: 693439 - DNA, 20 bp, Artificial
  CRISPR gRNA sequence
tcttggcaccatcttatgaa

SEQ ID NO: 693440 - DNA, 20 bp, Artificial
  CRISPR gRNA sequence
gtccagattaagatttttga

SEQ ID NO: 693441 - DNA, 20 bp, Artificial
  CRISPR gRNA sequence
tacttcatcacacacctcct

SEQ ID NO: 693442 - DNA, 20 bp, Artificial
  CRISPR gRNA sequence
tcaacccatcttttttcttt

SEQ ID NO: 693443 - DNA, 20 bp, Artificial
  CRISPR gRNA sequence
gagatgaggccaaatacctg

SEQ ID NO: 693444 - DNA, 20 bp, Artificial
  CRISPR gRNA sequence
cctgtggaatcttctccaca

SEQ ID NO: 693445 - DNA, 20 bp, Artificial
  CRISPR gRNA sequence
tcctaaggacctatgtagct

SEQ ID NO: 693446 - DNA, 20 bp, Artificial
  CRISPR gRNA sequence
atcaggaggcacacaaagcc

SEQ ID NO: 693447 - DNA, 20 bp, Artificial
  CRISPR gRNA sequence
cagagatgcagaaccatggg

SEQ ID NO: 693448 - DNA, 20 bp, Artificial
  CRISPR gRNA sequence
aaccatgggctgggtgttta

SEQ ID NO: 693449 - DNA, 20 bp, Artificial
  CRISPR gRNA sequence
gggctgggtgtttagtgggt

SEQ ID NO: 693450 - DNA, 20 bp, Artificial
  CRISPR gRNA sequence
actctgctttgtatctactt

SEQ ID NO: 693451 - DNA, 20 bp, Artificial
  CRISPR gRNA sequence
tccctctacaggcccagctc

SEQ ID NO: 693452 - DNA, 20 bp, Artificial
  CRISPR gRNA sequence
aaatgttttgttgccatgac

SEQ ID NO: 693453 - DNA, 20 bp, Artificial
  CRISPR gRNA sequence
ggtgctaccagcatcttgtg

SEQ ID NO: 693454 - DNA, 20 bp, Artificial
  CRISPR gRNA sequence
gcatcttgtggggaatgacc

SEQ ID NO: 693455 - DNA, 20 bp, Artificial
  CRISPR gRNA sequence
gccccaataccaagattgcc

SEQ ID NO: 693456 - DNA, 20 bp, Artificial
  CRISPR gRNA sequence
ctgccaggactttctctccc

SEQ ID NO: 693457 - DNA, 20 bp, Artificial
  CRISPR gRNA sequence
tagtgcttaggcctgtaacc

SEQ ID NO: 693458 - DNA, 20 bp, Artificial
  CRISPR gRNA sequence
catgacttcattacagggca

SEQ ID NO: 693459 - DNA, 20 bp, Artificial
  CRISPR gRNA sequence
gcaatcctctgcattagaga

SEQ ID NO: 693460 - DNA, 20 bp, Artificial
  CRISPR gRNA sequence
gtaggaaccacacaggaagg

SEQ ID NO: 693461 - DNA, 20 bp, Artificial
  CRISPR gRNA sequence
cagcagaaacccctacatca

SEQ ID NO: 693462 - DNA, 20 bp, Artificial
  CRISPR gRNA sequence
gccatttctaggtaaaaagg

SEQ ID NO: 693463 - DNA, 20 bp, Artificial
  CRISPR gRNA sequence
ggtaaaaaggtagaatttcc

SEQ ID NO: 693464 - DNA, 20 bp, Artificial
  CRISPR gRNA sequence
attttttttggctctaagtg

SEQ ID NO: 693465 - DNA, 20 bp, Artificial
  CRISPR gRNA sequence
ttatttgattttgatttaat

SEQ ID NO: 693466 - DNA, 20 bp, Artificial
  CRISPR gRNA sequence
ttcatatgtattcatttctt

SEQ ID NO: 693467 - DNA, 20 bp, Artificial
  CRISPR gRNA sequence
aagcctcctccaatcacctg

SEQ ID NO: 693468 - DNA, 20 bp, Artificial
  CRISPR gRNA sequence
aaaaattaactcaattaact

SEQ ID NO: 693469 - DNA, 20 bp, Artificial
  CRISPR gRNA sequence
tggttcaaggaactcaactt

SEQ ID NO: 693470 - DNA, 20 bp, Artificial
  CRISPR gRNA sequence
tgaagaaaatcttaggaaca

SEQ ID NO: 693471 - DNA, 20 bp, Artificial
  CRISPR gRNA sequence
atatcaagggacactattaa

SEQ ID NO: 693472 - DNA, 20 bp, Artificial
  CRISPR gRNA sequence
gagagttaaaagaaaatgca

SEQ ID NO: 693473 - DNA, 20 bp, Artificial
  CRISPR gRNA sequence
tgccagttatatacctgata

SEQ ID NO: 693474 - DNA, 20 bp, Artificial
  CRISPR gRNA sequence
cctgataaagaattaatatc

SEQ ID NO: 693475 - DNA, 20 bp, Artificial
  CRISPR gRNA sequence
acaaacaatctcattcaaaa

SEQ ID NO: 693476 - DNA, 20 bp, Artificial
  CRISPR gRNA sequence
ttcaaaaatgagtgaacaac

SEQ ID NO: 693477 - DNA, 20 bp, Artificial
  CRISPR gRNA sequence
aacacttgtacactgctggt

SEQ ID NO: 693478 - DNA, 20 bp, Artificial
  CRISPR gRNA sequence
acttttgggcatatacccaa

SEQ ID NO: 693479 - DNA, 20 bp, Artificial
  CRISPR gRNA sequence
tggccaaaaggtggaagcaa

SEQ ID NO: 693480 - DNA, 20 bp, Artificial
  CRISPR gRNA sequence
aagcaaccgagtgtccatcg

SEQ ID NO: 693481 - DNA, 20 bp, Artificial
  CRISPR gRNA sequence
gacccatggtgcacatagca

SEQ ID NO: 693482 - DNA, 20 bp, Artificial
  CRISPR gRNA sequence
aatattattcagccttaaaa

SEQ ID NO: 693483 - DNA, 20 bp, Artificial
  CRISPR gRNA sequence
taggcaaattcatagaaaca

SEQ ID NO: 693484 - DNA, 20 bp, Artificial
  CRISPR gRNA sequence
catagaaacagagagtaaaa

SEQ ID NO: 693485 - DNA, 20 bp, Artificial
  CRISPR gRNA sequence
aatagaatttaccagaaatt

SEQ ID NO: 693486 - DNA, 20 bp, Artificial
  CRISPR gRNA sequence
taccagaaattgagggtagg

SEQ ID NO: 693487 - DNA, 20 bp, Artificial
  CRISPR gRNA sequence
gaatgggcagctttggttta

SEQ ID NO: 693488 - DNA, 20 bp, Artificial
  CRISPR gRNA sequence
ttaatgggtccagtttctgt

SEQ ID NO: 693489 - DNA, 20 bp, Artificial
  CRISPR gRNA sequence
tgtaaatgtgctttaggcca

SEQ ID NO: 693490 - DNA, 20 bp, Artificial
  CRISPR gRNA sequence
cacccgagagccaccctctc

SEQ ID NO: 693491 - DNA, 20 bp, Artificial
  CRISPR gRNA sequence
gtccattactcacacaaagg

SEQ ID NO: 693492 - DNA, 20 bp, Artificial
  CRISPR gRNA sequence
cccacatgcacctgctcccc

SEQ ID NO: 693493 - DNA, 20 bp, Artificial
  CRISPR gRNA sequence
tggctcactcctcacaccat

SEQ ID NO: 693494 - DNA, 20 bp, Artificial
  CRISPR gRNA sequence
tttattgtctgttggtgtat

SEQ ID NO: 693495 - DNA, 20 bp, Artificial
  CRISPR gRNA sequence
accaagacagaaagacccaa

SEQ ID NO: 693496 - DNA, 20 bp, Artificial
  CRISPR gRNA sequence
agaaagacccaatagagtag

SEQ ID NO: 693497 - DNA, 20 bp, Artificial
  CRISPR gRNA sequence
agatagatagagagacaaga

SEQ ID NO: 693498 - DNA, 20 bp, Artificial
  CRISPR gRNA sequence
ggggccagaggaggaggtgg

SEQ ID NO: 693499 - DNA, 20 bp, Artificial
  CRISPR gRNA sequence
gaggaggaggtgggaggata

SEQ ID NO: 693500 - DNA, 20 bp, Artificial
  CRISPR gRNA sequence
ggttgactggtgcaacactc

SEQ ID NO: 693501 - DNA, 20 bp, Artificial
  CRISPR gRNA sequence
agtccaaagaccatacaacc

SEQ ID NO: 693502 - DNA, 20 bp, Artificial
  CRISPR gRNA sequence
ctatctgggcccctaggtga

SEQ ID NO: 693503 - DNA, 20 bp, Artificial
  CRISPR gRNA sequence
tgtggctgcccacagcgaga

SEQ ID NO: 693504 - DNA, 20 bp, Artificial
  CRISPR gRNA sequence
aaatgtatgttctttgataa

SEQ ID NO: 693505 - DNA, 20 bp, Artificial
  CRISPR gRNA sequence
tctcagtaagtatttgttaa

SEQ ID NO: 693506 - DNA, 20 bp, Artificial
  CRISPR gRNA sequence
tcttgtttaatatttatcac

SEQ ID NO: 693507 - DNA, 20 bp, Artificial
  CRISPR gRNA sequence
atttatcacttgagtagtct

SEQ ID NO: 693508 - DNA, 20 bp, Artificial
  CRISPR gRNA sequence
aatcttcccacctcaaacac

SEQ ID NO: 693509 - DNA, 20 bp, Artificial
  CRISPR gRNA sequence
ttttgtattttttgtagaga

SEQ ID NO: 693510 - DNA, 20 bp, Artificial
  CRISPR gRNA sequence
cttgaggcaccgcacctggc

SEQ ID NO: 693511 - DNA, 20 bp, Artificial
  CRISPR gRNA sequence
gcacctggcctgagtagtct

SEQ ID NO: 693512 - DNA, 20 bp, Artificial
  CRISPR gRNA sequence
ttttaaaatcccaaccatag

SEQ ID NO: 693513 - DNA, 20 bp, Artificial
  CRISPR gRNA sequence
aaaagataagatgaaagcag

SEQ ID NO: 693514 - DNA, 20 bp, Artificial
  CRISPR gRNA sequence
catcacctccttatctgaga

SEQ ID NO: 693515 - DNA, 20 bp, Artificial
  CRISPR gRNA sequence
aatttaaaaatttttttaga

SEQ ID NO: 693516 - DNA, 20 bp, Artificial
  CRISPR gRNA sequence
tctcattctgtcacccaggc

SEQ ID NO: 693517 - DNA, 20 bp, Artificial
  CRISPR gRNA sequence
ctcactgcaacatctgcctc

SEQ ID NO: 693518 - DNA, 20 bp, Artificial
  CRISPR gRNA sequence
aattctcctggctcagcatc

SEQ ID NO: 693519 - DNA, 20 bp, Artificial
  CRISPR gRNA sequence
tttgtattttttagtacaga

SEQ ID NO: 693520 - DNA, 20 bp, Artificial
  CRISPR gRNA sequence
ccatgttggccagtctggtc

SEQ ID NO: 693521 - DNA, 20 bp, Artificial
  CRISPR gRNA sequence
acctcggcctcccaaagtgc

SEQ ID NO: 693522 - DNA, 20 bp, Artificial
  CRISPR gRNA sequence
aaaagcatgtaaactttata

SEQ ID NO: 693523 - DNA, 20 bp, Artificial
  CRISPR gRNA sequence
ttcaagataacccataacat

SEQ ID NO: 693524 - DNA, 20 bp, Artificial
  CRISPR gRNA sequence
actttgagaagctgaggcag

SEQ ID NO: 693525 - DNA, 20 bp, Artificial
  CRISPR gRNA sequence
caggtggatcacttgaggtc

SEQ ID NO: 693526 - DNA, 20 bp, Artificial
  CRISPR gRNA sequence
tccagggaccaacagtcaca

SEQ ID NO: 693527 - DNA, 20 bp, Artificial
  CRISPR gRNA sequence
aaaataacaatgaaaagtgg

SEQ ID NO: 693528 - DNA, 20 bp, Artificial
  CRISPR gRNA sequence
atgggagaaccacttgagcc

SEQ ID NO: 693529 - DNA, 20 bp, Artificial
  CRISPR gRNA sequence
cgtgtgctattatcacacct

SEQ ID NO: 693530 - DNA, 20 bp, Artificial
  CRISPR gRNA sequence
tgccgattatggcacctcca

SEQ ID NO: 693531 - DNA, 20 bp, Artificial
  CRISPR gRNA sequence
tgagcaatgaagtcaatgct

SEQ ID NO: 693532 - DNA, 20 bp, Artificial
  CRISPR gRNA sequence
atcacacctaagacagcgag

SEQ ID NO: 693533 - DNA, 20 bp, Artificial
  CRISPR gRNA sequence
tcccttccacagatgaaaat

SEQ ID NO: 693534 - DNA, 20 bp, Artificial
  CRISPR gRNA sequence
tcactgaaaatgttggcctt

SEQ ID NO: 693535 - DNA, 20 bp, Artificial
  CRISPR gRNA sequence
ctggaaggttcacacttgta

SEQ ID NO: 693536 - DNA, 20 bp, Artificial
  CRISPR gRNA sequence
catccagtgaaatgcagttg

SEQ ID NO: 693537 - DNA, 20 bp, Artificial
  CRISPR gRNA sequence
ccttcagctgggggaggcag

SEQ ID NO: 693538 - DNA, 20 bp, Artificial
  CRISPR gRNA sequence
cagctgggggaggcagatgg

SEQ ID NO: 693539 - DNA, 20 bp, Artificial
  CRISPR gRNA sequence
attatatactcactggtaag

SEQ ID NO: 693540 - DNA, 20 bp, Artificial
  CRISPR gRNA sequence
ggtcaaacatttccctccaa

SEQ ID NO: 693541 - DNA, 20 bp, Artificial
  CRISPR gRNA sequence
ctccaaatgaatcatcctag

SEQ ID NO: 693542 - DNA, 20 bp, Artificial
  CRISPR gRNA sequence
cactcccactgaaattgccc

SEQ ID NO: 693543 - DNA, 20 bp, Artificial
  CRISPR gRNA sequence
ccagagttgcacgtgagcat

SEQ ID NO: 693544 - DNA, 20 bp, Artificial
  CRISPR gRNA sequence
ccaagacagaaagtcatttt

SEQ ID NO: 693545 - DNA, 20 bp, Artificial
  CRISPR gRNA sequence
acagaaagtcattttggggg

SEQ ID NO: 693546 - DNA, 20 bp, Artificial
  CRISPR gRNA sequence
gggttgggtctggctgatct

SEQ ID NO: 693547 - DNA, 20 bp, Artificial
  CRISPR gRNA sequence
ctttctacttacagaagaac

SEQ ID NO: 693548 - DNA, 20 bp, Artificial
  CRISPR gRNA sequence
cagaagaacaagggtgagct

SEQ ID NO: 693549 - DNA, 20 bp, Artificial
  CRISPR gRNA sequence
gcagatgctcaagcaaactc

SEQ ID NO: 693550 - DNA, 20 bp, Artificial
  CRISPR gRNA sequence
gtttaccatataaaagattt

SEQ ID NO: 693551 - DNA, 20 bp, Artificial
  CRISPR gRNA sequence
ccatcatcactctctagttc

SEQ ID NO: 693552 - DNA, 20 bp, Artificial
  CRISPR gRNA sequence
cttctgaagatttcacaaag

SEQ ID NO: 693553 - DNA, 20 bp, Artificial
  CRISPR gRNA sequence
ccaaataggaaaaacaaagg

SEQ ID NO: 693554 - DNA, 20 bp, Artificial
  CRISPR gRNA sequence
aaaatccattatttctgaag

SEQ ID NO: 693555 - DNA, 20 bp, Artificial
  CRISPR gRNA sequence
aactgggctgcaatcttatt

SEQ ID NO: 693556 - DNA, 20 bp, Artificial
  CRISPR gRNA sequence
cttaaaatttgtcaagtttg

SEQ ID NO: 693557 - DNA, 20 bp, Artificial
  CRISPR gRNA sequence
aaatttgtcaagtttgttgg

SEQ ID NO: 693558 - DNA, 20 bp, Artificial
  CRISPR gRNA sequence
ttcatcaaatttggaaggtt

SEQ ID NO: 693559 - DNA, 20 bp, Artificial
  CRISPR gRNA sequence
ttctttctgctactgaacta

SEQ ID NO: 693560 - DNA, 20 bp, Artificial
  CRISPR gRNA sequence
tttgctctggagcccctcta

SEQ ID NO: 693561 - DNA, 20 bp, Artificial
  CRISPR gRNA sequence
tccaccttgcatgggccttt

SEQ ID NO: 693562 - DNA, 20 bp, Artificial
  CRISPR gRNA sequence
gtagattctcctcttaatgt

SEQ ID NO: 693563 - DNA, 20 bp, Artificial
  CRISPR gRNA sequence
agattctatattagcttaga

SEQ ID NO: 693564 - DNA, 20 bp, Artificial
  CRISPR gRNA sequence
aaaacatcagtaatgtatac

SEQ ID NO: 693565 - DNA, 20 bp, Artificial
  CRISPR gRNA sequence
ggacaaaccataagtgggcc

SEQ ID NO: 693566 - DNA, 20 bp, Artificial
  CRISPR gRNA sequence
ggtaaatagcagccacatca

SEQ ID NO: 693567 - DNA, 20 bp, Artificial
  CRISPR gRNA sequence
ccagcctccaggaaacacca

SEQ ID NO: 693568 - DNA, 20 bp, Artificial
  CRISPR gRNA sequence
atagacatttgtgttgtatt

SEQ ID NO: 693569 - DNA, 20 bp, Artificial
  CRISPR gRNA sequence
tattggtatataacaaaaag

SEQ ID NO: 693570 - DNA, 20 bp, Artificial
  CRISPR gRNA sequence
tataacaaaaagtggaattg

SEQ ID NO: 693571 - DNA, 20 bp, Artificial
  CRISPR gRNA sequence
tctcaaaaaacaagtttcta

SEQ ID NO: 693572 - DNA, 20 bp, Artificial
  CRISPR gRNA sequence
tgaatagataactggtggaa

SEQ ID NO: 693573 - DNA, 20 bp, Artificial
  CRISPR gRNA sequence
tgagacttttgcaatttgta

SEQ ID NO: 693574 - DNA, 20 bp, Artificial
  CRISPR gRNA sequence
caaaaaagaaataactagta

SEQ ID NO: 693575 - DNA, 20 bp, Artificial
  CRISPR gRNA sequence
aaaaaaaaaaaaaaaaaacc

SEQ ID NO: 693576 - DNA, 20 bp, Artificial
  CRISPR gRNA sequence
agatacattaaaccacacct

SEQ ID NO: 693577 - DNA, 20 bp, Artificial
  CRISPR gRNA sequence
agacaatataaatttcaagc

SEQ ID NO: 693578 - DNA, 20 bp, Artificial
  CRISPR gRNA sequence
aaatttcaagcaggaatcta

SEQ ID NO: 693579 - DNA, 20 bp, Artificial
  CRISPR gRNA sequence
caggaatctatggaataaat

SEQ ID NO: 693580 - DNA, 20 bp, Artificial
  CRISPR gRNA sequence
gaagtgatggccatgtaagc

SEQ ID NO: 693581 - DNA, 20 bp, Artificial
  CRISPR gRNA sequence
tgcttttatttgaagaagag

SEQ ID NO: 693582 - DNA, 20 bp, Artificial
  CRISPR gRNA sequence
ctccctctctctgatggtta

SEQ ID NO: 693583 - DNA, 20 bp, Artificial
  CRISPR gRNA sequence
tttatcttttatggtacccg

SEQ ID NO: 693584 - DNA, 20 bp, Artificial
  CRISPR gRNA sequence
ttatgacaaaaacactaata

SEQ ID NO: 693585 - DNA, 20 bp, Artificial
  CRISPR gRNA sequence
cccagaactactggcaaccc

SEQ ID NO: 693586 - DNA, 20 bp, Artificial
  CRISPR gRNA sequence
ttggcagggctaccttacat

SEQ ID NO: 693587 - DNA, 20 bp, Artificial
  CRISPR gRNA sequence
acattgccagaggcaatgtc

SEQ ID NO: 693588 - DNA, 20 bp, Artificial
  CRISPR gRNA sequence
tcagagcctcttctctgcat

SEQ ID NO: 693589 - DNA, 20 bp, Artificial
  CRISPR gRNA sequence
cttcccccgaacacggggac

SEQ ID NO: 693590 - DNA, 20 bp, Artificial
  CRISPR gRNA sequence
caggcgcataagagggacag

SEQ ID NO: 693591 - DNA, 20 bp, Artificial
  CRISPR gRNA sequence
actgctcatgagcccaggag

SEQ ID NO: 693592 - DNA, 20 bp, Artificial
  CRISPR gRNA sequence
gtggatgcccaggctgagct

SEQ ID NO: 693593 - DNA, 20 bp, Artificial
  CRISPR gRNA sequence
atgcttcttgacacaggaaa

SEQ ID NO: 693594 - DNA, 20 bp, Artificial
  CRISPR gRNA sequence
caggaaagaggatgtgctgc

SEQ ID NO: 693595 - DNA, 20 bp, Artificial
  CRISPR gRNA sequence
ctggtttattgtgttgtcag

SEQ ID NO: 693596 - DNA, 20 bp, Artificial
  CRISPR gRNA sequence
gcttcagtcaggacacagga

SEQ ID NO: 693597 - DNA, 20 bp, Artificial
  CRISPR gRNA sequence
ttcccctttctaggcaggac

SEQ ID NO: 693598 - DNA, 20 bp, Artificial
  CRISPR gRNA sequence
tcatagttgttctgaaattg

SEQ ID NO: 693599 - DNA, 20 bp, Artificial
  CRISPR gRNA sequence
gatgatgagacccagcactg

SEQ ID NO: 693600 - DNA, 20 bp, Artificial
  CRISPR gRNA sequence
atttatctcctcttcctgga

SEQ ID NO: 693601 - DNA, 20 bp, Artificial
  CRISPR gRNA sequence
gctgtcagaagtagctacta

SEQ ID NO: 693602 - DNA, 20 bp, Artificial
  CRISPR gRNA sequence
aagacaacacacaccaacac

SEQ ID NO: 693603 - DNA, 20 bp, Artificial
  CRISPR gRNA sequence
aatgtggtatatatcgacaa

SEQ ID NO: 693604 - DNA, 20 bp, Artificial
  CRISPR gRNA sequence
acctggtcacaggctgcaac

SEQ ID NO: 693605 - DNA, 20 bp, Artificial
  CRISPR gRNA sequence
gctgctaggggctcggtgag

SEQ ID NO: 693606 - DNA, 20 bp, Artificial
  CRISPR gRNA sequence
ctaggggctcggtgaggggg

SEQ ID NO: 693607 - DNA, 20 bp, Artificial
  CRISPR gRNA sequence
gggctcggtgagggggatgg

SEQ ID NO: 693608 - DNA, 20 bp, Artificial
  CRISPR gRNA sequence
gaatgtttgttcaatgggca

SEQ ID NO: 693609 - DNA, 20 bp, Artificial
  CRISPR gRNA sequence
ctaatttagggaaaaagtac

SEQ ID NO: 693610 - DNA, 20 bp, Artificial
  CRISPR gRNA sequence
acaggcccagccttgacatg

SEQ ID NO: 693611 - DNA, 20 bp, Artificial
  CRISPR gRNA sequence
ttccaagaagataaaattaa

SEQ ID NO: 693612 - DNA, 20 bp, Artificial
  CRISPR gRNA sequence
caaagtgtccaacgtcttga

SEQ ID NO: 693613 - DNA, 20 bp, Artificial
  CRISPR gRNA sequence
gatatcaaacttaaattaat

SEQ ID NO: 693614 - DNA, 20 bp, Artificial
  CRISPR gRNA sequence
gtagtccagttgacatatga

SEQ ID NO: 693615 - DNA, 20 bp, Artificial
  CRISPR gRNA sequence
cactatataaatatactggg

SEQ ID NO: 693616 - DNA, 20 bp, Artificial
  CRISPR gRNA sequence
caccattgcgctgtgcaaca

SEQ ID NO: 693617 - DNA, 20 bp, Artificial
  CRISPR gRNA sequence
agatacagaagtaaagtcaa

SEQ ID NO: 693618 - DNA, 20 bp, Artificial
  CRISPR gRNA sequence
aaataaaaacaaaagcttca

SEQ ID NO: 693619 - DNA, 20 bp, Artificial
  CRISPR gRNA sequence
cgcattcaacaatgatattt

SEQ ID NO: 693620 - DNA, 20 bp, Artificial
  CRISPR gRNA sequence
ttaacccttaaatatcattg

SEQ ID NO: 693621 - DNA, 20 bp, Artificial
  CRISPR gRNA sequence
ttataattgtgcataattga

SEQ ID NO: 693622 - DNA, 20 bp, Artificial
  CRISPR gRNA sequence
gaaagagtcaaatatttgtg

SEQ ID NO: 693623 - DNA, 20 bp, Artificial
  CRISPR gRNA sequence
cagaatctcttgagaaaaat

SEQ ID NO: 693624 - DNA, 20 bp, Artificial
  CRISPR gRNA sequence
cattgttgcacagcgcaatg

SEQ ID NO: 693625 - DNA, 20 bp, Artificial
  CRISPR gRNA sequence
caatggtggatgcaacagtt

SEQ ID NO: 693626 - DNA, 20 bp, Artificial
  CRISPR gRNA sequence
tgtacaacattggttcttct

SEQ ID NO: 693627 - DNA, 20 bp, Artificial
  CRISPR gRNA sequence
gcccttctggctgctcccat

SEQ ID NO: 693628 - DNA, 20 bp, Artificial
  CRISPR gRNA sequence
ggaggcttctccccgtggag

SEQ ID NO: 693629 - DNA, 20 bp, Artificial
  CRISPR gRNA sequence
gtggagcagagtcactgtcc

SEQ ID NO: 693630 - DNA, 20 bp, Artificial
  CRISPR gRNA sequence
tttacatgcagtggagccac

SEQ ID NO: 693631 - DNA, 20 bp, Artificial
  CRISPR gRNA sequence
ggtgctgattttcctggttc

SEQ ID NO: 693632 - DNA, 20 bp, Artificial
  CRISPR gRNA sequence
cctggttcatgggtgatagc

SEQ ID NO: 693633 - DNA, 20 bp, Artificial
  CRISPR gRNA sequence
tgggtgatagctggggtagc

SEQ ID NO: 693634 - DNA, 20 bp, Artificial
  CRISPR gRNA sequence
cgcatactaatatattttta

SEQ ID NO: 693635 - DNA, 20 bp, Artificial
  CRISPR gRNA sequence
ataaatggaaatgtgcagta

SEQ ID NO: 693636 - DNA, 20 bp, Artificial
  CRISPR gRNA sequence
accaggtttccttcttaagg

SEQ ID NO: 693637 - DNA, 20 bp, Artificial
  CRISPR gRNA sequence
tgtgtgttgtcttggctatc

SEQ ID NO: 693638 - DNA, 20 bp, Artificial
  CRISPR gRNA sequence
ctatcgtgaataatgctgct

SEQ ID NO: 693639 - DNA, 20 bp, Artificial
  CRISPR gRNA sequence
tgaataatgctgctttgaat

SEQ ID NO: 693640 - DNA, 20 bp, Artificial
  CRISPR gRNA sequence
caaaccttccctcactttgg

SEQ ID NO: 693641 - DNA, 20 bp, Artificial
  CRISPR gRNA sequence
tatgaaggtgctgtttggca

SEQ ID NO: 693642 - DNA, 20 bp, Artificial
  CRISPR gRNA sequence
gacagtataactcaccagtg

SEQ ID NO: 693643 - DNA, 20 bp, Artificial
  CRISPR gRNA sequence
cctgcaatttcagaacaact

SEQ ID NO: 693644 - DNA, 20 bp, Artificial
  CRISPR gRNA sequence
agaacaactatgaatacaaa

SEQ ID NO: 693645 - DNA, 20 bp, Artificial
  CRISPR gRNA sequence
ctggaggaaacctcaatggt

SEQ ID NO: 693646 - DNA, 20 bp, Artificial
  CRISPR gRNA sequence
attgtaaatgtttacttatt

SEQ ID NO: 693647 - DNA, 20 bp, Artificial
  CRISPR gRNA sequence
atgggttattttattattta

SEQ ID NO: 693648 - DNA, 20 bp, Artificial
  CRISPR gRNA sequence
gagaagaagacagtcctccc

SEQ ID NO: 693649 - DNA, 20 bp, Artificial
  CRISPR gRNA sequence
gaagcagatgggctgggcag

SEQ ID NO: 693650 - DNA, 20 bp, Artificial
  CRISPR gRNA sequence
gggttttcacctggaacctg

SEQ ID NO: 693651 - DNA, 20 bp, Artificial
  CRISPR gRNA sequence
caactgtccctcttatgcgc

SEQ ID NO: 693652 - DNA, 20 bp, Artificial
  CRISPR gRNA sequence
tttcttcactggacaccagt

SEQ ID NO: 693653 - DNA, 20 bp, Artificial
  CRISPR gRNA sequence
agattggaccatgttagagg

SEQ ID NO: 693654 - DNA, 20 bp, Artificial
  CRISPR gRNA sequence
acaccgatggccagagcctc

SEQ ID NO: 693655 - DNA, 20 bp, Artificial
  CRISPR gRNA sequence
tcaggttcatctaggcctca

SEQ ID NO: 693656 - DNA, 20 bp, Artificial
  CRISPR gRNA sequence
ggtagccctgccaagtatcc

SEQ ID NO: 693657 - DNA, 20 bp, Artificial
  CRISPR gRNA sequence
tcctggggttgccagtagtt

SEQ ID NO: 693658 - DNA, 20 bp, Artificial
  CRISPR gRNA sequence
ggtgctcagtgtctggagcg

SEQ ID NO: 693659 - DNA, 20 bp, Artificial
  CRISPR gRNA sequence
tttttgtcataaaaaacccc

SEQ ID NO: 693660 - DNA, 20 bp, Artificial
  CRISPR gRNA sequence
tatagtttagttttaccttt

SEQ ID NO: 693661 - DNA, 20 bp, Artificial
  CRISPR gRNA sequence
tatagaggtttgcgtctatt

SEQ ID NO: 693662 - DNA, 20 bp, Artificial
  CRISPR gRNA sequence
tttttttttttttttgccat

SEQ ID NO: 693663 - DNA, 20 bp, Artificial
  CRISPR gRNA sequence
tcatgtttttcatcaagagg

SEQ ID NO: 693664 - DNA, 20 bp, Artificial
  CRISPR gRNA sequence
agcagcacgatttgtagact

SEQ ID NO: 693665 - DNA, 20 bp, Artificial
  CRISPR gRNA sequence
gctgagcacctgactgccgc

SEQ ID NO: 693666 - DNA, 20 bp, Artificial
  CRISPR gRNA sequence
agcacctgactgccgcggga

SEQ ID NO: 693667 - DNA, 20 bp, Artificial
  CRISPR gRNA sequence
aatcaagaaagtgtctgctc

SEQ ID NO: 693668 - DNA, 20 bp, Artificial
  CRISPR gRNA sequence
gtgtctgctctagggttggg

SEQ ID NO: 693669 - DNA, 20 bp, Artificial
  CRISPR gRNA sequence
ttgatgtggctgctatttac

SEQ ID NO: 693670 - DNA, 20 bp, Artificial
  CRISPR gRNA sequence
caattctctctaagctaata

SEQ ID NO: 693671 - DNA, 20 bp, Artificial
  CRISPR gRNA sequence
tgtgactcagacattaagag

SEQ ID NO: 693672 - DNA, 20 bp, Artificial
  CRISPR gRNA sequence
tggctgttgagccaggaact

SEQ ID NO: 693673 - DNA, 20 bp, Artificial
  CRISPR gRNA sequence
aaaaaggcccatgcaaggtg

SEQ ID NO: 693674 - DNA, 20 bp, Artificial
  CRISPR gRNA sequence
aaatgatgccccagtagtgc

SEQ ID NO: 693675 - DNA, 20 bp, Artificial
  CRISPR gRNA sequence
gatgccccagtagtgcatga

SEQ ID NO: 693676 - DNA, 20 bp, Artificial
  CRISPR gRNA sequence
ccccagtagtgcatgaatga

SEQ ID NO: 693677 - DNA, 20 bp, Artificial
  CRISPR gRNA sequence
tgagtcatgggcagtggctc

SEQ ID NO: 693678 - DNA, 20 bp, Artificial
  CRISPR gRNA sequence
aaaataaagttggaaaactg

SEQ ID NO: 693679 - DNA, 20 bp, Artificial
  CRISPR gRNA sequence
ccagagcaaatttcaccatg

SEQ ID NO: 693680 - DNA, 20 bp, Artificial
  CRISPR gRNA sequence
aaatttcaccatgcagaatg

SEQ ID NO: 693681 - DNA, 20 bp, Artificial
  CRISPR gRNA sequence
acatcaagcacatgcacttt

SEQ ID NO: 693682 - DNA, 20 bp, Artificial
  CRISPR gRNA sequence
aaaggagagagagaaaggag

SEQ ID NO: 693683 - DNA, 20 bp, Artificial
  CRISPR gRNA sequence
aggagaagaatgactattta

SEQ ID NO: 693684 - DNA, 20 bp, Artificial
  CRISPR gRNA sequence
gacaaacagagcatattgaa

SEQ ID NO: 693685 - DNA, 20 bp, Artificial
  CRISPR gRNA sequence
gaaggaacttttcaggttca

SEQ ID NO: 693686 - DNA, 20 bp, Artificial
  CRISPR gRNA sequence
ccagttttcttcagaaacca

SEQ ID NO: 693687 - DNA, 20 bp, Artificial
  CRISPR gRNA sequence
ccatagagttcagaaggcac

SEQ ID NO: 693688 - DNA, 20 bp, Artificial
  CRISPR gRNA sequence
aaaaaaaaagactgtcatgc

SEQ ID NO: 693689 - DNA, 20 bp, Artificial
  CRISPR gRNA sequence
aaaactctccttcagaaata

SEQ ID NO: 693690 - DNA, 20 bp, Artificial
  CRISPR gRNA sequence
aagaaaatgcccattgacta

SEQ ID NO: 693691 - DNA, 20 bp, Artificial
  CRISPR gRNA sequence
aaatgcccattgactaatga

SEQ ID NO: 693692 - DNA, 20 bp, Artificial
  CRISPR gRNA sequence
catgtagtgtatttctacaa

SEQ ID NO: 693693 - DNA, 20 bp, Artificial
  CRISPR gRNA sequence
gaatatgatttagccataaa

SEQ ID NO: 693694 - DNA, 20 bp, Artificial
  CRISPR gRNA sequence
tgatacatgctacaacattg

SEQ ID NO: 693695 - DNA, 20 bp, Artificial
  CRISPR gRNA sequence
gtgaaggaaatcagccacaa

SEQ ID NO: 693696 - DNA, 20 bp, Artificial
  CRISPR gRNA sequence
agaaagcagacttgtggtga

SEQ ID NO: 693697 - DNA, 20 bp, Artificial
  CRISPR gRNA sequence
tctggtggcaggaggaaatg

SEQ ID NO: 693698 - DNA, 20 bp, Artificial
  CRISPR gRNA sequence
agggtgactgcttaatggtg

SEQ ID NO: 693699 - DNA, 20 bp, Artificial
  CRISPR gRNA sequence
gatgaaatactctggaacta

SEQ ID NO: 693700 - DNA, 20 bp, Artificial
  CRISPR gRNA sequence
cattgtacacctattgtaca

SEQ ID NO: 693701 - DNA, 20 bp, Artificial
  CRISPR gRNA sequence
tcacagtaaaaaagaggctg

SEQ ID NO: 693702 - DNA, 20 bp, Artificial
  CRISPR gRNA sequence
atcttttatatggtaaactc

SEQ ID NO: 693703 - DNA, 20 bp, Artificial
  CRISPR gRNA sequence
gcccatctgtctttccccct

SEQ ID NO: 693704 - DNA, 20 bp, Artificial
  CRISPR gRNA sequence
ccccaaaatgactttctgtc

SEQ ID NO: 693705 - DNA, 20 bp, Artificial
  CRISPR gRNA sequence
aactctggggcaatttcagt

SEQ ID NO: 693706 - DNA, 20 bp, Artificial
  CRISPR gRNA sequence
gagtgaagagattatccaac

SEQ ID NO: 693707 - DNA, 20 bp, Artificial
  CRISPR gRNA sequence
aagtcatttgctttcctaaa

SEQ ID NO: 693708 - DNA, 20 bp, Artificial
  CRISPR gRNA sequence
aaaaaggatcctgcttacca

SEQ ID NO: 693709 - DNA, 20 bp, Artificial
  CRISPR gRNA sequence
gtatataatttttgtatgcc

SEQ ID NO: 693710 - DNA, 20 bp, Artificial
  CRISPR gRNA sequence
taatttttgtatgcccgggg

SEQ ID NO: 693711 - DNA, 20 bp, Artificial
  CRISPR gRNA sequence
cccccagctgaaggaaggag

SEQ ID NO: 693712 - DNA, 20 bp, Artificial
  CRISPR gRNA sequence
catccatcaactgcatttca

SEQ ID NO: 693713 - DNA, 20 bp, Artificial
  CRISPR gRNA sequence
ctctacaagtgtgaaccttc

SEQ ID NO: 693714 - DNA, 20 bp, Artificial
  CRISPR gRNA sequence
cccagggggcctgcaggaga

SEQ ID NO: 693715 - DNA, 20 bp, Artificial
  CRISPR gRNA sequence
tcagctaaatgctgtaacca

SEQ ID NO: 693716 - DNA, 20 bp, Artificial
  CRISPR gRNA sequence
ctaaatgctgtaaccaaagg

SEQ ID NO: 693717 - DNA, 20 bp, Artificial
  CRISPR gRNA sequence
tgtaaccaaaggatgagtca

SEQ ID NO: 693718 - DNA, 20 bp, Artificial
  CRISPR gRNA sequence
gatgagtcatggagtggagg

SEQ ID NO: 693719 - DNA, 20 bp, Artificial
  CRISPR gRNA sequence
ataatcggcatttctgccct

SEQ ID NO: 693720 - DNA, 20 bp, Artificial
  CRISPR gRNA sequence
tgtattactattattttaga

SEQ ID NO: 693721 - DNA, 20 bp, Artificial
  CRISPR gRNA sequence
ggttctcccatctcagcctc

SEQ ID NO: 693722 - DNA, 20 bp, Artificial
  CRISPR gRNA sequence
tttacttcaaatgctttatt

SEQ ID NO: 693723 - DNA, 20 bp, Artificial
  CRISPR gRNA sequence
atacacagatcaatgcctac

SEQ ID NO: 693724 - DNA, 20 bp, Artificial
  CRISPR gRNA sequence
tttcactttgtcactgaggc

SEQ ID NO: 693725 - DNA, 20 bp, Artificial
  CRISPR gRNA sequence
ctcactgcaacctccgcctc

SEQ ID NO: 693726 - DNA, 20 bp, Artificial
  CRISPR gRNA sequence
gatttccatgcctcagcctc

SEQ ID NO: 693727 - DNA, 20 bp, Artificial
  CRISPR gRNA sequence
ttttgtatttttagtagaga

SEQ ID NO: 693728 - DNA, 20 bp, Artificial
  CRISPR gRNA sequence
gcctcagcttctcaaagtgc

SEQ ID NO: 693729 - DNA, 20 bp, Artificial
  CRISPR gRNA sequence
tctcaaagtgctgggattac

SEQ ID NO: 693730 - DNA, 20 bp, Artificial
  CRISPR gRNA sequence
caaggttgcattcatatgtt

SEQ ID NO: 693731 - DNA, 20 bp, Artificial
  CRISPR gRNA sequence
ttcatatgttatgggttatc

SEQ ID NO: 693732 - DNA, 20 bp, Artificial
  CRISPR gRNA sequence
gttatcttgaatgttgcttt

SEQ ID NO: 693733 - DNA, 20 bp, Artificial
  CRISPR gRNA sequence
cagcactttgggaggccgag

SEQ ID NO: 693734 - DNA, 20 bp, Artificial
  CRISPR gRNA sequence
actttgggaggccgaggtgg

SEQ ID NO: 693735 - DNA, 20 bp, Artificial
  CRISPR gRNA sequence
tgggtggatcacttgaggtc

SEQ ID NO: 693736 - DNA, 20 bp, Artificial
  CRISPR gRNA sequence
aaaaatacaaaaaattagcc

SEQ ID NO: 693737 - DNA, 20 bp, Artificial
  CRISPR gRNA sequence
tgcctgtagtcccagctact

SEQ ID NO: 693738 - DNA, 20 bp, Artificial
  CRISPR gRNA sequence
tactcaggatgctgagccag

SEQ ID NO: 693739 - DNA, 20 bp, Artificial
  CRISPR gRNA sequence
cactgccactgtactccagc

SEQ ID NO: 693740 - DNA, 20 bp, Artificial
  CRISPR gRNA sequence
ctgtactccagcctgggtga

SEQ ID NO: 693741 - DNA, 20 bp, Artificial
  CRISPR gRNA sequence
cagataaggaggtgatgtaa

SEQ ID NO: 693742 - DNA, 20 bp, Artificial
  CRISPR gRNA sequence
cataaagattctcctatggt

SEQ ID NO: 693743 - DNA, 20 bp, Artificial
  CRISPR gRNA sequence
caacacattggaaggccaag

SEQ ID NO: 693744 - DNA, 20 bp, Artificial
  CRISPR gRNA sequence
acattggaaggccaaggagg

SEQ ID NO: 693745 - DNA, 20 bp, Artificial
  CRISPR gRNA sequence
ctgccctccagaccaggcta

SEQ ID NO: 693746 - DNA, 20 bp, Artificial
  CRISPR gRNA sequence
tccagaccaggctacagagt

SEQ ID NO: 693747 - DNA, 20 bp, Artificial
  CRISPR gRNA sequence
aattttaggtgtcatattga

SEQ ID NO: 693748 - DNA, 20 bp, Artificial
  CRISPR gRNA sequence
gtgtcatattgactggatta

SEQ ID NO: 693749 - DNA, 20 bp, Artificial
  CRISPR gRNA sequence
tagctggtataacattattt

SEQ ID NO: 693750 - DNA, 20 bp, Artificial
  CRISPR gRNA sequence
ttatttctgggtgtgcctgt

SEQ ID NO: 693751 - DNA, 20 bp, Artificial
  CRISPR gRNA sequence
cctgtgagggtgtttctgga

SEQ ID NO: 693752 - DNA, 20 bp, Artificial
  CRISPR gRNA sequence
tttctggaagggattggcat

SEQ ID NO: 693753 - DNA, 20 bp, Artificial
  CRISPR gRNA sequence
gatagaacaaaaaagcagaa

SEQ ID NO: 693754 - DNA, 20 bp, Artificial
  CRISPR gRNA sequence
gttgtatggtctttggactc

SEQ ID NO: 693755 - DNA, 20 bp, Artificial
  CRISPR gRNA sequence
cagcttgcaggtggcctctc

SEQ ID NO: 693756 - DNA, 20 bp, Artificial
  CRISPR gRNA sequence
ctatctatccatctactcta

SEQ ID NO: 693757 - DNA, 20 bp, Artificial
  CRISPR gRNA sequence
accaacagacaataaacaaa

SEQ ID NO: 693758 - DNA, 20 bp, Artificial
  CRISPR gRNA sequence
acctaggctagaagattggt

SEQ ID NO: 693759 - DNA, 20 bp, Artificial
  CRISPR gRNA sequence
agaagattggtgggagtggc

SEQ ID NO: 693760 - DNA, 20 bp, Artificial
  CRISPR gRNA sequence
tgggagtggcgggaatggca

SEQ ID NO: 693761 - DNA, 20 bp, Artificial
  CRISPR gRNA sequence
tgggacatttgaacagagac

SEQ ID NO: 693762 - DNA, 20 bp, Artificial
  CRISPR gRNA sequence
acagagactcgaatggtgtg

SEQ ID NO: 693763 - DNA, 20 bp, Artificial
  CRISPR gRNA sequence
cccggggagcaggtgcatgt

SEQ ID NO: 693764 - DNA, 20 bp, Artificial
  CRISPR gRNA sequence
gcaggggcaggtagcagaga

SEQ ID NO: 693765 - DNA, 20 bp, Artificial
  CRISPR gRNA sequence
agcagtgacaaaaggctggt

SEQ ID NO: 693766 - DNA, 20 bp, Artificial
  CRISPR gRNA sequence
aaaggctggtgtgagtggag

SEQ ID NO: 693767 - DNA, 20 bp, Artificial
  CRISPR gRNA sequence
ggagatgagtgagctgggct

SEQ ID NO: 693768 - DNA, 20 bp, Artificial
  CRISPR gRNA sequence
gtgagctgggctgagaatgg

SEQ ID NO: 693769 - DNA, 20 bp, Artificial
  CRISPR gRNA sequence
gaatggcgggatgaggccac

SEQ ID NO: 693770 - DNA, 20 bp, Artificial
  CRISPR gRNA sequence
gaaaagggctgaggtgttca

SEQ ID NO: 693771 - DNA, 20 bp, Artificial
  CRISPR gRNA sequence
gaggctcactctgcctttgt

SEQ ID NO: 693772 - DNA, 20 bp, Artificial
  CRISPR gRNA sequence
ttctggtttacaattcttga

SEQ ID NO: 693773 - DNA, 20 bp, Artificial
  CRISPR gRNA sequence
aattcttgagagggtggctc

SEQ ID NO: 693774 - DNA, 20 bp, Artificial
  CRISPR gRNA sequence
ctctcgggtggtggcaggag

SEQ ID NO: 693775 - DNA, 20 bp, Artificial
  CRISPR gRNA sequence
aggagaggagtgaaaagtga

SEQ ID NO: 693776 - DNA, 20 bp, Artificial
  CRISPR gRNA sequence
ctattttactctctgtttct

SEQ ID NO: 693777 - DNA, 20 bp, Artificial
  CRISPR gRNA sequence
gttctcaaggttcatgcaac

SEQ ID NO: 693778 - DNA, 20 bp, Artificial
  CRISPR gRNA sequence
aatttcattcacttttaagg

SEQ ID NO: 693779 - DNA, 20 bp, Artificial
  CRISPR gRNA sequence
tattccatgctatgtgcacc

SEQ ID NO: 693780 - DNA, 20 bp, Artificial
  CRISPR gRNA sequence
gcttccaccttttggccatt

SEQ ID NO: 693781 - DNA, 20 bp, Artificial
  CRISPR gRNA sequence
ggaatagtgctgctacgagc

SEQ ID NO: 693782 - DNA, 20 bp, Artificial
  CRISPR gRNA sequence
atgagtgtacaattatctgt

SEQ ID NO: 693783 - DNA, 20 bp, Artificial
  CRISPR gRNA sequence
agttcctgctttcaattctt

SEQ ID NO: 693784 - DNA, 20 bp, Artificial
  CRISPR gRNA sequence
tttgggtatatgcccaaaag

SEQ ID NO: 693785 - DNA, 20 bp, Artificial
  CRISPR gRNA sequence
ccatttgtatatcttctttg

SEQ ID NO: 693786 - DNA, 20 bp, Artificial
  CRISPR gRNA sequence
ttcatgttgttcactcattt

SEQ ID NO: 693787 - DNA, 20 bp, Artificial
  CRISPR gRNA sequence
gtcatagttctttatgtatt

SEQ ID NO: 693788 - DNA, 20 bp, Artificial
  CRISPR gRNA sequence
ttataggttgaactcctaag

SEQ ID NO: 693789 - DNA, 20 bp, Artificial
  CRISPR gRNA sequence
gttgagttccttgaaccatt

SEQ ID NO: 693790 - DNA, 20 bp, Artificial
  CRISPR gRNA sequence
cttgaaccattctgagttaa

SEQ ID NO: 693791 - DNA, 20 bp, Artificial
  CRISPR gRNA sequence
tgagttaattgagttaattt

SEQ ID NO: 693792 - DNA, 20 bp, Artificial
  CRISPR gRNA sequence
atatggtgtaaggtgatgct

SEQ ID NO: 693793 - DNA, 20 bp, Artificial
  CRISPR gRNA sequence
ccaacatcattattttgtat

SEQ ID NO: 693794 - DNA, 20 bp, Artificial
  CRISPR gRNA sequence
tggtgacaaacccaaaagaa

SEQ ID NO: 693795 - DNA, 20 bp, Artificial
  CRISPR gRNA sequence
cccaaaagaaatgaatacat

SEQ ID NO: 693796 - DNA, 20 bp, Artificial
  CRISPR gRNA sequence
attataaattttaaaatgtt

SEQ ID NO: 693797 - DNA, 20 bp, Artificial
  CRISPR gRNA sequence
ggctgaaacatgctgaaatg

SEQ ID NO: 693798 - DNA, 20 bp, Artificial
  CRISPR gRNA sequence
ttgcataagggggccacagg

SEQ ID NO: 693799 - DNA, 20 bp, Artificial
  CRISPR gRNA sequence
agttggcttctataaagtca

SEQ ID NO: 693800 - DNA, 20 bp, Artificial
  CRISPR gRNA sequence
gtaagtgtaaaataaacctc

SEQ ID NO: 693801 - DNA, 20 bp, Artificial
  CRISPR gRNA sequence
acaatgcgtcgctgaaggga

SEQ ID NO: 693802 - DNA, 20 bp, Artificial
  CRISPR gRNA sequence
ttccaggaaccccatgatgt

SEQ ID NO: 693803 - DNA, 20 bp, Artificial
  CRISPR gRNA sequence
gtttctgctgcagtcccaaa

SEQ ID NO: 693804 - DNA, 20 bp, Artificial
  CRISPR gRNA sequence
ttcacctggtctaagatttg

SEQ ID NO: 693805 - DNA, 20 bp, Artificial
  CRISPR gRNA sequence
tcaaaatattatttctttga

SEQ ID NO: 693806 - DNA, 20 bp, Artificial
  CRISPR gRNA sequence
tttaccctctctctaatgca

SEQ ID NO: 693807 - DNA, 20 bp, Artificial
  CRISPR gRNA sequence
ggattgcggcctgttggcag

SEQ ID NO: 693808 - DNA, 20 bp, Artificial
  CRISPR gRNA sequence
cttgggccccagctgacctg

SEQ ID NO: 693809 - DNA, 20 bp, Artificial
  CRISPR gRNA sequence
gcatgcagtctcatgggaag

SEQ ID NO: 693810 - DNA, 20 bp, Artificial
  CRISPR gRNA sequence
ccagggaagggagagatgac

SEQ ID NO: 693811 - DNA, 20 bp, Artificial
  CRISPR gRNA sequence
gtgggaccacacttttcctt

SEQ ID NO: 693812 - DNA, 20 bp, Artificial
  CRISPR gRNA sequence
tggcaatcttggtattgggg

SEQ ID NO: 693813 - DNA, 20 bp, Artificial
  CRISPR gRNA sequence
gctggataattatctgttat

SEQ ID NO: 693814 - DNA, 20 bp, Artificial
  CRISPR gRNA sequence
ttgggctgacttgtgcactg

SEQ ID NO: 693815 - DNA, 20 bp, Artificial
  CRISPR gRNA sequence
ctctggtgggaaaattgctc

SEQ ID NO: 693816 - DNA, 20 bp, Artificial
  CRISPR gRNA sequence
tgggaaaattgctcctggat

SEQ ID NO: 693817 - DNA, 20 bp, Artificial
  CRISPR gRNA sequence
atccagaagtagatacaaag

SEQ ID NO: 693818 - DNA, 20 bp, Artificial
  CRISPR gRNA sequence
ggggctggagaagacaggaa

SEQ ID NO: 693819 - DNA, 20 bp, Artificial
  CRISPR gRNA sequence
aggtctggagctcagaacct

SEQ ID NO: 693820 - DNA, 20 bp, Artificial
  CRISPR gRNA sequence
atggggaactaaagctcgtg

SEQ ID NO: 693821 - DNA, 20 bp, Artificial
  CRISPR gRNA sequence
taaagctcgtgaggaatggg

SEQ ID NO: 693822 - DNA, 20 bp, Artificial
  CRISPR gRNA sequence
gtggcagaacctcctattgc

SEQ ID NO: 693823 - DNA, 20 bp, Artificial
  CRISPR gRNA sequence
gttctgcatctctgggaagt

SEQ ID NO: 693824 - DNA, 20 bp, Artificial
  CRISPR gRNA sequence
tcaggataaatttggctgta

SEQ ID NO: 693825 - DNA, 20 bp, Artificial
  CRISPR gRNA sequence
tttggctgtatggggtcagt

SEQ ID NO: 693826 - DNA, 20 bp, Artificial
  CRISPR gRNA sequence
tttgtgtgcctcctgatgtg

SEQ ID NO: 693827 - DNA, 20 bp, Artificial
  CRISPR gRNA sequence
gccattctaaaagaaaaaag

SEQ ID NO: 693828 - DNA, 20 bp, Artificial
  CRISPR gRNA sequence
aagaaacataaccaaaggca

SEQ ID NO: 693829 - DNA, 20 bp, Artificial
  CRISPR gRNA sequence
aaggactttaaataatatta

SEQ ID NO: 693830 - DNA, 20 bp, Artificial
  CRISPR gRNA sequence
gtatttagtggtctagtatc

SEQ ID NO: 693831 - DNA, 20 bp, Artificial
  CRISPR gRNA sequence
atgggtcttgcaacttactt

SEQ ID NO: 693832 - DNA, 20 bp, Artificial
  CRISPR gRNA sequence
catcaagtttccgctgacca

SEQ ID NO: 693833 - DNA, 20 bp, Artificial
  CRISPR gRNA sequence
acagcctacttgtgttcact

SEQ ID NO: 693834 - DNA, 20 bp, Artificial
  CRISPR gRNA sequence
ttggttgttgccaccaaaat

SEQ ID NO: 693835 - DNA, 20 bp, Artificial
  CRISPR gRNA sequence
caaaattgggatcacctaaa

SEQ ID NO: 693836 - DNA, 20 bp, Artificial
  CRISPR gRNA sequence
gtatatcttttcaccattaa

SEQ ID NO: 693837 - DNA, 20 bp, Artificial
  CRISPR gRNA sequence
aaagaaacccaatagcacag

SEQ ID NO: 693838 - DNA, 20 bp, Artificial
  CRISPR gRNA sequence
tcacatcagggcccctgccc

SEQ ID NO: 693839 - DNA, 20 bp, Artificial
  CRISPR gRNA sequence
ccctgggcactgtcagtgat

SEQ ID NO: 693840 - DNA, 20 bp, Artificial
  CRISPR gRNA sequence
agatgtggctagaggaactg

SEQ ID NO: 693841 - DNA, 20 bp, Artificial
  CRISPR gRNA sequence
gtggctagaggaactgtggg

SEQ ID NO: 693842 - DNA, 20 bp, Artificial
  CRISPR gRNA sequence
cacaatatcccaacaatctc

SEQ ID NO: 693843 - DNA, 20 bp, Artificial
  CRISPR gRNA sequence
cttcatcttacctgcagcct

SEQ ID NO: 693844 - DNA, 20 bp, Artificial
  CRISPR gRNA sequence
gtgtaactgtagatccaggg

SEQ ID NO: 693845 - DNA, 20 bp, Artificial
  CRISPR gRNA sequence
gaaatatgaagaaagcagat

SEQ ID NO: 693846 - DNA, 20 bp, Artificial
  CRISPR gRNA sequence
cccctgtgatttgtgactgc

SEQ ID NO: 693847 - DNA, 20 bp, Artificial
  CRISPR gRNA sequence
ccaccataatcatcgaagtg

SEQ ID NO: 693848 - DNA, 20 bp, Artificial
  CRISPR gRNA sequence
ttttcacaggagctttacaa

SEQ ID NO: 693849 - DNA, 20 bp, Artificial
  CRISPR gRNA sequence
gctggcacacagggcccagg

SEQ ID NO: 693850 - DNA, 20 bp, Artificial
  CRISPR gRNA sequence
ggcccaggctgggtagaccc

SEQ ID NO: 693851 - DNA, 20 bp, Artificial
  CRISPR gRNA sequence
ggctgggtagacccatgagt

SEQ ID NO: 693852 - DNA, 20 bp, Artificial
  CRISPR gRNA sequence
ccagcaacgatgcccacgat

SEQ ID NO: 693853 - DNA, 20 bp, Artificial
  CRISPR gRNA sequence
tctccctccttaccccatct

SEQ ID NO: 693854 - DNA, 20 bp, Artificial
  CRISPR gRNA sequence
gtctccacaagctctgtgtc

SEQ ID NO: 693855 - DNA, 20 bp, Artificial
  CRISPR gRNA sequence
ccaggtcagcgtgatctccg

SEQ ID NO: 693856 - DNA, 20 bp, Artificial
  CRISPR gRNA sequence
aagcccagggcccagcacct

SEQ ID NO: 693857 - DNA, 20 bp, Artificial
  CRISPR gRNA sequence
ggtggcctcatggtcagaga

SEQ ID NO: 693858 - DNA, 20 bp, Artificial
  CRISPR gRNA sequence
gtgggcaacgtgtgcctttg

SEQ ID NO: 693859 - DNA, 20 bp, Artificial
  CRISPR gRNA sequence
gtgcctttggaggatctgag

SEQ ID NO: 693860 - DNA, 20 bp, Artificial
  CRISPR gRNA sequence
agcacccatgtgaccaacct

SEQ ID NO: 693861 - DNA, 20 bp, Artificial
  CRISPR gRNA sequence
ctgagaatggacaggacacc

SEQ ID NO: 693862 - DNA, 20 bp, Artificial
  CRISPR gRNA sequence
tctcctattccttggaaagt

SEQ ID NO: 693863 - DNA, 20 bp, Artificial
  CRISPR gRNA sequence
tccttggaaagttcgagtct

SEQ ID NO: 693864 - DNA, 20 bp, Artificial
  CRISPR gRNA sequence
ctaagtggaggccgagggac

SEQ ID NO: 693865 - DNA, 20 bp, Artificial
  CRISPR gRNA sequence
gaatcagagccccaaacaca

SEQ ID NO: 693866 - DNA, 20 bp, Artificial
  CRISPR gRNA sequence
tggagggctcaaaggggacc

SEQ ID NO: 693867 - DNA, 20 bp, Artificial
  CRISPR gRNA sequence
ctcacagtcactctctggta

SEQ ID NO: 693868 - DNA, 20 bp, Artificial
  CRISPR gRNA sequence
tcctctgcctcatagaagcg

SEQ ID NO: 693869 - DNA, 20 bp, Artificial
  CRISPR gRNA sequence
tcgcagccattcattccctg

SEQ ID NO: 693870 - DNA, 20 bp, Artificial
  CRISPR gRNA sequence
cccctccccgcccaacccgc

SEQ ID NO: 693871 - DNA, 20 bp, Artificial
  CRISPR gRNA sequence
taaaggcgcctgggactctc

SEQ ID NO: 693872 - DNA, 20 bp, Artificial
  CRISPR gRNA sequence
gcctgggactctcccgggtg

SEQ ID NO: 693873 - DNA, 20 bp, Artificial
  CRISPR gRNA sequence
ctcccgggtggagggtctgg

SEQ ID NO: 693874 - DNA, 20 bp, Artificial
  CRISPR gRNA sequence
ctgggcgggtcccgctgcct

SEQ ID NO: 693875 - DNA, 20 bp, Artificial
  CRISPR gRNA sequence
ccgctgcctcggggtagatt

SEQ ID NO: 693876 - DNA, 20 bp, Artificial
  CRISPR gRNA sequence
ggggacccgggcggtccgtg

SEQ ID NO: 693877 - DNA, 20 bp, Artificial
  CRISPR gRNA sequence
cgggcggtccgtggcggatg

SEQ ID NO: 693878 - DNA, 20 bp, Artificial
  CRISPR gRNA sequence
gtcgtgacctgcgcccccgg

SEQ ID NO: 693879 - DNA, 20 bp, Artificial
  CRISPR gRNA sequence
ggctcccgcggctccatcct

SEQ ID NO: 693880 - DNA, 20 bp, Artificial
  CRISPR gRNA sequence
cggcgtcgctgtcgaaccgc

SEQ ID NO: 693881 - DNA, 20 bp, Artificial
  CRISPR gRNA sequence
agcggtgctgaaatacctca

SEQ ID NO: 693882 - DNA, 20 bp, Artificial
  CRISPR gRNA sequence
cctcctccgggcgcggctcc

SEQ ID NO: 693883 - DNA, 20 bp, Artificial
  CRISPR gRNA sequence
cctccgcgtctgggaaaaat

SEQ ID NO: 693884 - DNA, 20 bp, Artificial
  CRISPR gRNA sequence
tgggaaaaatatgagtcccg

SEQ ID NO: 693885 - DNA, 20 bp, Artificial
  CRISPR gRNA sequence
ctagaaacgcgacgcccaat

SEQ ID NO: 693886 - DNA, 20 bp, Artificial
  CRISPR gRNA sequence
tttctcactcccattgggcg

SEQ ID NO: 693887 - DNA, 20 bp, Artificial
  CRISPR gRNA sequence
cctgcggttcgacagcgacg

SEQ ID NO: 693888 - DNA, 20 bp, Artificial
  CRISPR gRNA sequence
cgcctttaccgaggttcatt

SEQ ID NO: 693889 - DNA, 20 bp, Artificial
  CRISPR gRNA sequence
caccagcacgcgtacgacgg

SEQ ID NO: 693890 - DNA, 20 bp, Artificial
  CRISPR gRNA sequence
acaccgtggctcagatcacc

SEQ ID NO: 693891 - DNA, 20 bp, Artificial
  CRISPR gRNA sequence
tcctgagtaggaagaatctt

SEQ ID NO: 693892 - DNA, 20 bp, Artificial
  CRISPR gRNA sequence
tgggccccgtgacttttctc

SEQ ID NO: 693893 - DNA, 20 bp, Artificial
  CRISPR gRNA sequence
tgttctctgcctcacactca

SEQ ID NO: 693894 - DNA, 20 bp, Artificial
  CRISPR gRNA sequence
cacactcaatgtgtttgggg

SEQ ID NO: 693895 - DNA, 20 bp, Artificial
  CRISPR gRNA sequence
actcgaactttccaaggaat

SEQ ID NO: 693896 - DNA, 20 bp, Artificial
  CRISPR gRNA sequence
gttggtcacatgggtgctgc

SEQ ID NO: 693897 - DNA, 20 bp, Artificial
  CRISPR gRNA sequence
ccaccctgaggtgctgggcc

SEQ ID NO: 693898 - DNA, 20 bp, Artificial
  CRISPR gRNA sequence
ggaggaacagacccaggaca

SEQ ID NO: 693899 - DNA, 20 bp, Artificial
  CRISPR gRNA sequence
gaaggggtgaggagtggagt

SEQ ID NO: 693900 - DNA, 20 bp, Artificial
  CRISPR gRNA sequence
aagctcctgtgaaaatgaag

SEQ ID NO: 693901 - DNA, 20 bp, Artificial
  CRISPR gRNA sequence
gaaggacagattcttcactt

SEQ ID NO: 693902 - DNA, 20 bp, Artificial
  CRISPR gRNA sequence
gcagttggtccaggacccac

SEQ ID NO: 693903 - DNA, 20 bp, Artificial
  CRISPR gRNA sequence
cttctctgggatcaaagact

SEQ ID NO: 693904 - DNA, 20 bp, Artificial
  CRISPR gRNA sequence
aagatgaaggaggctgatcc

SEQ ID NO: 693905 - DNA, 20 bp, Artificial
  CRISPR gRNA sequence
gaggggactcagctgtgcta

SEQ ID NO: 693906 - DNA, 20 bp, Artificial
  CRISPR gRNA sequence
atattttctctatagtgtga

SEQ ID NO: 693907 - DNA, 20 bp, Artificial
  CRISPR gRNA sequence
ctttttatagatacaggtag

SEQ ID NO: 693908 - DNA, 20 bp, Artificial
  CRISPR gRNA sequence
gtgaagagaaagagtgaata

SEQ ID NO: 693909 - DNA, 20 bp, Artificial
  CRISPR gRNA sequence
agaaagagtgaatagagaga

SEQ ID NO: 693910 - DNA, 20 bp, Artificial
  CRISPR gRNA sequence
tatacatatatttggaatta

SEQ ID NO: 693911 - DNA, 20 bp, Artificial
  CRISPR gRNA sequence
tttggaattagccagcttga

SEQ ID NO: 693912 - DNA, 20 bp, Artificial
  CRISPR gRNA sequence
atgtcacaaacttcttcaca

SEQ ID NO: 693913 - DNA, 20 bp, Artificial
  CRISPR gRNA sequence
tcttcacagcctgtttgatc

SEQ ID NO: 693914 - DNA, 20 bp, Artificial
  CRISPR gRNA sequence
gcctgtttgatctggtgctt

SEQ ID NO: 693915 - DNA, 20 bp, Artificial
  CRISPR gRNA sequence
cacagtgaacacaagtaggc

SEQ ID NO: 693916 - DNA, 20 bp, Artificial
  CRISPR gRNA sequence
acttgatgataacatggtgg

SEQ ID NO: 693917 - DNA, 20 bp, Artificial
  CRISPR gRNA sequence
gaaggtgggtgacatgtgga

SEQ ID NO: 693918 - DNA, 20 bp, Artificial
  CRISPR gRNA sequence
ccttcttggccttgcaaagc

SEQ ID NO: 693919 - DNA, 20 bp, Artificial
  CRISPR gRNA sequence
tggccttgcaaagccttcgc

SEQ ID NO: 693920 - DNA, 20 bp, Artificial
  CRISPR gRNA sequence
tgcaaagccttcgctttggc

SEQ ID NO: 693921 - DNA, 20 bp, Artificial
  CRISPR gRNA sequence
gcttcggctttaggaggggc

SEQ ID NO: 693922 - DNA, 20 bp, Artificial
  CRISPR gRNA sequence
gcaccatcttatgaaaaggg

SEQ ID NO: 693923 - DNA, 20 bp, Artificial
  CRISPR gRNA sequence
tcttatgaaaagggtccaga

SEQ ID NO: 693924 - DNA, 20 bp, Artificial
  CRISPR gRNA sequence
acatttttgtacctattttt

SEQ ID NO: 693925 - DNA, 20 bp, Artificial
  CRISPR gRNA sequence
ttttgtacctattttttata

SEQ ID NO: 693926 - DNA, 20 bp, Artificial
  CRISPR gRNA sequence
tgtccactcgttgcctttgg

SEQ ID NO: 693927 - DNA, 20 bp, Artificial
  CRISPR gRNA sequence
ttttcttttagaatggcatt

SEQ ID NO: 693928 - DNA, 20 bp, Artificial
  CRISPR gRNA sequence
ctgggttaaacatttggcag

SEQ ID NO: 693929 - DNA, 20 bp, Artificial
  CRISPR gRNA sequence
gagatgcagaaccatgggct

SEQ ID NO: 693930 - DNA, 20 bp, Artificial
  CRISPR gRNA sequence
tgccactctccccattcctc

SEQ ID NO: 693931 - DNA, 20 bp, Artificial
  CRISPR gRNA sequence
tcctgtcttctccagcccca

SEQ ID NO: 693932 - DNA, 20 bp, Artificial
  CRISPR gRNA sequence
gacattagctatgtctggaa

SEQ ID NO: 693933 - DNA, 20 bp, Artificial
  CRISPR gRNA sequence
ataattatccagccccaata

SEQ ID NO: 693934 - DNA, 20 bp, Artificial
  CRISPR gRNA sequence
ggactttctctcccttgagt

SEQ ID NO: 693935 - DNA, 20 bp, Artificial
  CRISPR gRNA sequence
gagctccatctgtatgcctg

SEQ ID NO: 693936 - DNA, 20 bp, Artificial
  CRISPR gRNA sequence
cctctgcattagagagaggg

SEQ ID NO: 693937 - DNA, 20 bp, Artificial
  CRISPR gRNA sequence
aggtaaaaaggtagaatttc

SEQ ID NO: 693938 - DNA, 20 bp, Artificial
  CRISPR gRNA sequence
gtagaatttccttggattcc

SEQ ID NO: 693939 - DNA, 20 bp, Artificial
  CRISPR gRNA sequence
cctgaggtttattttacact

SEQ ID NO: 693940 - DNA, 20 bp, Artificial
  CRISPR gRNA sequence
ttgactttatagaagccaac

SEQ ID NO: 693941 - DNA, 20 bp, Artificial
  CRISPR gRNA sequence
gctctaagtggagaatttga

SEQ ID NO: 693942 - DNA, 20 bp, Artificial
  CRISPR gRNA sequence
gcagtaaaccctccatttca

SEQ ID NO: 693943 - DNA, 20 bp, Artificial
  CRISPR gRNA sequence
attttaaaatttataatttt

SEQ ID NO: 693944 - DNA, 20 bp, Artificial
  CRISPR gRNA sequence
aaatttataattttatttga

SEQ ID NO: 693945 - DNA, 20 bp, Artificial
  CRISPR gRNA sequence
ttcatatgtattcatttctt

SEQ ID NO: 693946 - DNA, 20 bp, Artificial
  CRISPR gRNA sequence
ttaggaacattggatgtggc

SEQ ID NO: 693947 - DNA, 20 bp, Artificial
  CRISPR gRNA sequence
agcgaccatgaaaaacagta

SEQ ID NO: 693948 - DNA, 20 bp, Artificial
  CRISPR gRNA sequence
gcaaccgagtgtccatcgga

SEQ ID NO: 693949 - DNA, 20 bp, Artificial
  CRISPR gRNA sequence
aattgagggtagggagaatg

SEQ ID NO: 693950 - DNA, 20 bp, Artificial
  CRISPR gRNA sequence
gggtagggagaatgggcagc

SEQ ID NO: 693951 - DNA, 20 bp, Artificial
  CRISPR gRNA sequence
ggcagctttggtttaatggg

SEQ ID NO: 693952 - DNA, 20 bp, Artificial
  CRISPR gRNA sequence
gtggttacacaacattgtaa

SEQ ID NO: 693953 - DNA, 20 bp, Artificial
  CRISPR gRNA sequence
gaaggtaaattacatggtat

SEQ ID NO: 693954 - DNA, 20 bp, Artificial
  CRISPR gRNA sequence
tctcaagaattgtaaaccag

SEQ ID NO: 693955 - DNA, 20 bp, Artificial
  CRISPR gRNA sequence
acaatgaaacctcagtctct

SEQ ID NO: 693956 - DNA, 20 bp, Artificial
  CRISPR gRNA sequence
gcaattatcactgatactgt

SEQ ID NO: 693957 - DNA, 20 bp, Artificial
  CRISPR gRNA sequence
ctgatactgtgacagattct

SEQ ID NO: 693958 - DNA, 20 bp, Artificial
  CRISPR gRNA sequence
tagatagatagagagacaag

SEQ ID NO: 693959 - DNA, 20 bp, Artificial
  CRISPR gRNA sequence
tccaagggcaggaaaagtgt

SEQ ID NO: 693960 - DNA, 20 bp, Artificial
  CRISPR gRNA sequence
agagagaaaatttgactcct

SEQ ID NO: 693961 - DNA, 20 bp, Artificial
  CRISPR gRNA sequence
tttgttctatctgggcccct

SEQ ID NO: 693962 - DNA, 20 bp, Artificial
  CRISPR gRNA sequence
tctatctgggcccctaggtg

SEQ ID NO: 693963 - DNA, 20 bp, Artificial
  CRISPR gRNA sequence
ttgtggctgcccacagcgag

SEQ ID NO: 693964 - DNA, 20 bp, Artificial
  CRISPR gRNA sequence
ttctttgataaagggatctg

SEQ ID NO: 693965 - DNA, 20 bp, Artificial
  CRISPR gRNA sequence
gatctggtctgtttccttac

SEQ ID NO: 693966 - DNA, 20 bp, Artificial
  CRISPR gRNA sequence
atcacagtatgacagtataa

SEQ ID NO: 693967 - DNA, 20 bp, Artificial
  CRISPR gRNA sequence
gacagtataataaggcttta

SEQ ID NO: 693968 - DNA, 20 bp, Artificial
  CRISPR gRNA sequence
ttaaaatgtttaaagcagtc

SEQ ID NO: 693969 - DNA, 20 bp, Artificial
  CRISPR gRNA sequence
tttttgtattttttgtagag

SEQ ID NO: 693970 - DNA, 20 bp, Artificial
  CRISPR gRNA sequence
ctccttggccttccaatgtg

SEQ ID NO: 693971 - DNA, 20 bp, Artificial
  CRISPR gRNA sequence
ccttccaatgtgttgagatt

SEQ ID NO: 693972 - DNA, 20 bp, Artificial
  CRISPR gRNA sequence
aggagaatctttatgtacaa

SEQ ID NO: 693973 - DNA, 20 bp, Artificial
  CRISPR gRNA sequence
cctccttatctgagatggga

SEQ ID NO: 693974 - DNA, 20 bp, Artificial
  CRISPR gRNA sequence
tttgtattttttagtacaga

SEQ ID NO: 693975 - DNA, 20 bp, Artificial
  CRISPR gRNA sequence
cacctcggcctcccaaagtg

SEQ ID NO: 693976 - DNA, 20 bp, Artificial
  CRISPR gRNA sequence
aaaagcatgtaaactttata

SEQ ID NO: 693977 - DNA, 20 bp, Artificial
  CRISPR gRNA sequence
gcctcagtgacaaagtgaaa

SEQ ID NO: 693978 - DNA, 20 bp, Artificial
  CRISPR gRNA sequence
tttaaagtcttctgtgatca

SEQ ID NO: 693979 - DNA, 20 bp, Artificial
  CRISPR gRNA sequence
gatgggagaaccacttgagc

SEQ ID NO: 693980 - DNA, 20 bp, Artificial
  CRISPR gRNA sequence
cctgtgaatagtcacttctc

SEQ ID NO: 693981 - DNA, 20 bp, Artificial
  CRISPR gRNA sequence
tgaaatccatagggcagaaa

SEQ ID NO: 693982 - DNA, 20 bp, Artificial
  CRISPR gRNA sequence
aataccatcaatttataaaa

SEQ ID NO: 693983 - DNA, 20 bp, Artificial
  CRISPR gRNA sequence
catcacacctaagacagcga

SEQ ID NO: 693984 - DNA, 20 bp, Artificial
  CRISPR gRNA sequence
gatctgggagtgttgtgaag

SEQ ID NO: 693985 - DNA, 20 bp, Artificial
  CRISPR gRNA sequence
gcagatgctcaagcaaactc

SEQ ID NO: 693986 - DNA, 20 bp, Artificial
  CRISPR gRNA sequence
aactcaggagtttaccatat

SEQ ID NO: 693987 - DNA, 20 bp, Artificial
  CRISPR gRNA sequence
accagaccctgtcaccacaa

SEQ ID NO: 693988 - DNA, 20 bp, Artificial
  CRISPR gRNA sequence
acaagtctgctttctttctc

SEQ ID NO: 693989 - DNA, 20 bp, Artificial
  CRISPR gRNA sequence
ctctatagattggtctcttc

SEQ ID NO: 693990 - DNA, 20 bp, Artificial
  CRISPR gRNA sequence
tgaaatatgtatccttttgt

SEQ ID NO: 693991 - DNA, 20 bp, Artificial
  CRISPR gRNA sequence
tggctgatttccttcactta

SEQ ID NO: 693992 - DNA, 20 bp, Artificial
  CRISPR gRNA sequence
ttccttcacttatcatgttt

SEQ ID NO: 693993 - DNA, 20 bp, Artificial
  CRISPR gRNA sequence
cattgtagaaatacactaca

SEQ ID NO: 693994 - DNA, 20 bp, Artificial
  CRISPR gRNA sequence
ccaaaaatatacatgttact

SEQ ID NO: 693995 - DNA, 20 bp, Artificial
  CRISPR gRNA sequence
ccaaaaatatacatattact

SEQ ID NO: 693996 - DNA, 20 bp, Artificial
  CRISPR gRNA sequence
aaaatccattatttctgaag

SEQ ID NO: 693997 - DNA, 20 bp, Artificial
  CRISPR gRNA sequence
ttccagtgccttctgaactc

SEQ ID NO: 693998 - DNA, 20 bp, Artificial
  CRISPR gRNA sequence
ctgttattcatttcaatatg

SEQ ID NO: 693999 - DNA, 20 bp, Artificial
  CRISPR gRNA sequence
ttcaatatgctctgtttgtc

SEQ ID NO: 694000 - DNA, 20 bp, Artificial
  CRISPR gRNA sequence
tttgtcattggcttttgaca

SEQ ID NO: 694001 - DNA, 20 bp, Artificial
  CRISPR gRNA sequence
tctttaaatttaaatttttt

SEQ ID NO: 694002 - DNA, 20 bp, Artificial
  CRISPR gRNA sequence
tttttgctgcttaaaatttg

SEQ ID NO: 694003 - DNA, 20 bp, Artificial
  CRISPR gRNA sequence
tgtcaagtttgttggatgaa

SEQ ID NO: 694004 - DNA, 20 bp, Artificial
  CRISPR gRNA sequence
aatgtttttcatcaaatttg

SEQ ID NO: 694005 - DNA, 20 bp, Artificial
  CRISPR gRNA sequence
tttgaggactcccaaagtgc

SEQ ID NO: 694006 - DNA, 20 bp, Artificial
  CRISPR gRNA sequence
tgtctcacagatctttaaag

SEQ ID NO: 694007 - DNA, 20 bp, Artificial
  CRISPR gRNA sequence
gaatttcaattgtcttatct

SEQ ID NO: 694008 - DNA, 20 bp, Artificial
  CRISPR gRNA sequence
aattgtcttatcttcaagct

SEQ ID NO: 694009 - DNA, 20 bp, Artificial
  CRISPR gRNA sequence
catacctctctcttccatcc

SEQ ID NO: 694010 - DNA, 20 bp, Artificial
  CRISPR gRNA sequence
tccaccttgcatgggccttt

SEQ ID NO: 694011 - DNA, 20 bp, Artificial
  CRISPR gRNA sequence
cttgcatgggcctttttggg

SEQ ID NO: 694012 - DNA, 20 bp, Artificial
  CRISPR gRNA sequence
cccaagcctactgctcttgt

SEQ ID NO: 694013 - DNA, 20 bp, Artificial
  CRISPR gRNA sequence
ctgagtcacagcatttattt

SEQ ID NO: 694014 - DNA, 20 bp, Artificial
  CRISPR gRNA sequence
tttctaaggactttcagtaa

SEQ ID NO: 694015 - DNA, 20 bp, Artificial
  CRISPR gRNA sequence
ttcagtaatggagattctat

SEQ ID NO: 694016 - DNA, 20 bp, Artificial
  CRISPR gRNA sequence
ttctatattagcttagagag

SEQ ID NO: 694017 - DNA, 20 bp, Artificial
  CRISPR gRNA sequence
tggacaaaccataagtgggc

SEQ ID NO: 694018 - DNA, 20 bp, Artificial
  CRISPR gRNA sequence
caaccctagagcagacactt

SEQ ID NO: 694019 - DNA, 20 bp, Artificial
  CRISPR gRNA sequence
actttcttgatttctaatat

SEQ ID NO: 694020 - DNA, 20 bp, Artificial
  CRISPR gRNA sequence
actcccgcggcagtcaggtg

SEQ ID NO: 694021 - DNA, 20 bp, Artificial
  CRISPR gRNA sequence
aagtggaattgctgggtcat

SEQ ID NO: 694022 - DNA, 20 bp, Artificial
  CRISPR gRNA sequence
gggtcataggtgattagaaa

SEQ ID NO: 694023 - DNA, 20 bp, Artificial
  CRISPR gRNA sequence
ttggtttagtctctcaaaaa

SEQ ID NO: 694024 - DNA, 20 bp, Artificial
  CRISPR gRNA sequence
tttgcaatttgtaatgaatt

SEQ ID NO: 694025 - DNA, 20 bp, Artificial
  CRISPR gRNA sequence
tgatggccatgtaagccagg

SEQ ID NO: 694026 - DNA, 20 bp, Artificial
  CRISPR gRNA sequence
tgcttttatttgaagaagag

SEQ ID NO: 694027 - DNA, 20 bp, Artificial
  CRISPR gRNA sequence
cattgagctggggcagttga

SEQ ID NO: 694028 - DNA, 20 bp, Artificial
  CRISPR gRNA sequence
ccctctctctgatggttaaa

SEQ ID NO: 694029 - DNA, 20 bp, Artificial
  CRISPR gRNA sequence
gatggttaaagggtgtttac

SEQ ID NO: 694030 - DNA, 20 bp, Artificial
  CRISPR gRNA sequence
tttatcttttatggtacccg

SEQ ID NO: 694031 - DNA, 20 bp, Artificial
  CRISPR gRNA sequence
gcctcttctctgcatgggag

SEQ ID NO: 694032 - DNA, 20 bp, Artificial
  CRISPR gRNA sequence
tcctctaacatggtccaatc

SEQ ID NO: 694033 - DNA, 20 bp, Artificial
  CRISPR gRNA sequence
atggtccaatctcgtgcttg

SEQ ID NO: 694034 - DNA, 20 bp, Artificial
  CRISPR gRNA sequence
ataagagggacagttggatc

SEQ ID NO: 694035 - DNA, 20 bp, Artificial
  CRISPR gRNA sequence
gggacagttggatctcaggt

SEQ ID NO: 694036 - DNA, 20 bp, Artificial
  CRISPR gRNA sequence
aaaacccacctgcccagccc

SEQ ID NO: 694037 - DNA, 20 bp, Artificial
  CRISPR gRNA sequence
cttcttctcacctccccgga

SEQ ID NO: 694038 - DNA, 20 bp, Artificial
  CRISPR gRNA sequence
tgctgctagggtcatcatgt

SEQ ID NO: 694039 - DNA, 20 bp, Artificial
  CRISPR gRNA sequence
ttacaatttactcacaccat

SEQ ID NO: 694040 - DNA, 20 bp, Artificial
  CRISPR gRNA sequence
gcacagctgcagacacacct

SEQ ID NO: 694041 - DNA, 20 bp, Artificial
  CRISPR gRNA sequence
cttcccctttctaggcagga

SEQ ID NO: 694042 - DNA, 20 bp, Artificial
  CRISPR gRNA sequence
tgctgtcagaagtagctact

SEQ ID NO: 694043 - DNA, 20 bp, Artificial
  CRISPR gRNA sequence
ttaattccaccaaagtgagg

SEQ ID NO: 694044 - DNA, 20 bp, Artificial
  CRISPR gRNA sequence
gctcggtgagggggatggat

SEQ ID NO: 694045 - DNA, 20 bp, Artificial
  CRISPR gRNA sequence
gaatgtttgttcaatgggca

SEQ ID NO: 694046 - DNA, 20 bp, Artificial
  CRISPR gRNA sequence
agataccaaattttacataa

SEQ ID NO: 694047 - DNA, 20 bp, Artificial
  CRISPR gRNA sequence
ttcattaaaaatatattagt

SEQ ID NO: 694048 - DNA, 20 bp, Artificial
  CRISPR gRNA sequence
agtagtccagttgacatatg

SEQ ID NO: 694049 - DNA, 20 bp, Artificial
  CRISPR gRNA sequence
agaggactctcatttttctc

SEQ ID NO: 694050 - DNA, 20 bp, Artificial
  CRISPR gRNA sequence
tcaattatgcacaattataa

SEQ ID NO: 694051 - DNA, 20 bp, Artificial
  CRISPR gRNA sequence
aatttgattaaaataaaaac

SEQ ID NO: 694052 - DNA, 20 bp, Artificial
  CRISPR gRNA sequence
acaaaagcttcagtgaatat

SEQ ID NO: 694053 - DNA, 20 bp, Artificial
  CRISPR gRNA sequence
acataaacttgcatattcac

SEQ ID NO: 694054 - DNA, 20 bp, Artificial
  CRISPR gRNA sequence
acttgcatattcactgaagc

SEQ ID NO: 694055 - DNA, 20 bp, Artificial
  CRISPR gRNA sequence
tttctaggggccaaccactt

SEQ ID NO: 694056 - DNA, 20 bp, Artificial
  CRISPR gRNA sequence
caaccactttcaagtttttt

SEQ ID NO: 694057 - DNA, 20 bp, Artificial
  CRISPR gRNA sequence
aactaccatttctttattat

SEQ ID NO: 694058 - DNA, 20 bp, Artificial
  CRISPR gRNA sequence
accatttctttattattatt

SEQ ID NO: 694059 - DNA, 20 bp, Artificial
  CRISPR gRNA sequence
ctcttcccagtatatttata

SEQ ID NO: 694060 - DNA, 20 bp, Artificial
  CRISPR gRNA sequence
ccagtatatttatatagtga

SEQ ID NO: 694061 - DNA, 20 bp, Artificial
  CRISPR gRNA sequence
ttatgtttagttcagccatc

SEQ ID NO: 694062 - DNA, 20 bp, Artificial
  CRISPR gRNA sequence
ttcttggagttaatacttgt

SEQ ID NO: 694063 - DNA, 20 bp, Artificial
  CRISPR gRNA sequence
gagttaatacttgtatttgt

SEQ ID NO: 694064 - DNA, 20 bp, Artificial
  CRISPR gRNA sequence
ttttattaactctcattaat

SEQ ID NO: 694065 - DNA, 20 bp, Artificial
  CRISPR gRNA sequence
taatttaagtttgatatctc

SEQ ID NO: 694066 - DNA, 20 bp, Artificial
  CRISPR gRNA sequence
gtttgatatctcttttgttt

SEQ ID NO: 694067 - DNA, 20 bp, Artificial
  CRISPR gRNA sequence
ggcccttctggctgctccca

SEQ ID NO: 694068 - DNA, 20 bp, Artificial
  CRISPR gRNA sequence
tggctgctcccatctggatt

SEQ ID NO: 694069 - DNA, 20 bp, Artificial
  CRISPR gRNA sequence
ccctccatcactatctggga

SEQ ID NO: 694070 - DNA, 20 bp, Artificial
  CRISPR gRNA sequence
tgggttccagccaaaatgca

SEQ ID NO: 694071 - DNA, 20 bp, Artificial
  CRISPR gRNA sequence
tgggcctgtgagcctttctg

SEQ ID NO: 694072 - DNA, 20 bp, Artificial
  CRISPR gRNA sequence
ttctgtctagtttcaggagg

SEQ ID NO: 694073 - DNA, 20 bp, Artificial
  CRISPR gRNA sequence
agggatctctctttttgtct

SEQ ID NO: 694074 - DNA, 20 bp, Artificial
  CRISPR gRNA sequence
ctagcagccattagtctact

SEQ ID NO: 694075 - DNA, 20 bp, Artificial
  CRISPR gRNA sequence
ataaatggaaatgtgcagta

SEQ ID NO: 694076 - DNA, 20 bp, Artificial
  CRISPR gRNA sequence
tgtgcagtattgggttttct

SEQ ID NO: 694077 - DNA, 20 bp, Artificial
  CRISPR gRNA sequence
agtattgggttttctttgtg

SEQ ID NO: 694078 - DNA, 20 bp, Artificial
  CRISPR gRNA sequence
atccctgttgcagcctgtga

SEQ ID NO: 694079 - DNA, 20 bp, Artificial
  CRISPR gRNA sequence
gtcttggctatcgtgaataa

SEQ ID NO: 694080 - DNA, 20 bp, Artificial
  CRISPR gRNA sequence
ctgctttgaatatgggtata

SEQ ID NO: 694081 - DNA, 20 bp, Artificial
  CRISPR gRNA sequence
tctgacagcacatatttaaa

SEQ ID NO: 694082 - DNA, 20 bp, Artificial
  CRISPR gRNA sequence
tttgtatggttcaatttttc

SEQ ID NO: 694083 - DNA, 20 bp, Artificial
  CRISPR gRNA sequence
aggagataaatatatgaagg

SEQ ID NO: 694084 - DNA, 20 bp, Artificial
  CRISPR gRNA sequence
ggggccctttctgcagtgac

SEQ ID NO: 694085 - DNA, 20 bp, Artificial
  CRISPR gRNA sequence
caatggtgtgagtaaattgt

SEQ ID NO: 694086 - DNA, 20 bp, Artificial
  CRISPR gRNA sequence
tattatttatggagtatgta

SEQ ID NO: 694087 - DNA, 20 bp, Artificial
  CRISPR gRNA sequence
gaagcagatgggctgggcag

SEQ ID NO: 694088 - DNA, 20 bp, Artificial
  CRISPR gRNA sequence
caactgtccctcttatgcgc

SEQ ID NO: 694089 - DNA, 20 bp, Artificial
  CRISPR gRNA sequence
tcctgtaaagcagaacaagc

SEQ ID NO: 694090 - DNA, 20 bp, Artificial
  CRISPR gRNA sequence
ccagagcctccagagtgggg

SEQ ID NO: 694091 - DNA, 20 bp, Artificial
  CRISPR gRNA sequence
tctggagcggagggtgggaa

SEQ ID NO: 694092 - DNA, 20 bp, Artificial
  CRISPR gRNA sequence
catactattttattctttat

SEQ ID NO: 694093 - DNA, 20 bp, Artificial
  CRISPR gRNA sequence
tttaaccatcagagagaggg

SEQ ID NO: 694094 - DNA, 20 bp, Artificial
  CRISPR gRNA sequence
ttcttcaaataaaagcacat

SEQ ID NO: 694095 - DNA, 20 bp, Artificial
  CRISPR gRNA sequence
atatttttatcatctaaaat

SEQ ID NO: 694096 - DNA, 20 bp, Artificial
  CRISPR gRNA sequence
tttatcatctaaaattatag

SEQ ID NO: 694097 - DNA, 20 bp, Artificial
  CRISPR gRNA sequence
atttttatcctcatttattc

SEQ ID NO: 694098 - DNA, 20 bp, Artificial
  CRISPR gRNA sequence
tcctcatttattccatagat

SEQ ID NO: 694099 - DNA, 20 bp, Artificial
  CRISPR gRNA sequence
gcttgaaatttatattgtct

SEQ ID NO: 694100 - DNA, 20 bp, Artificial
  CRISPR gRNA sequence
gtttcctgtcctttgcattt

SEQ ID NO: 694101 - DNA, 20 bp, Artificial
  CRISPR gRNA sequence
ttgcagattgcaccccaagg

SEQ ID NO: 694102 - DNA, 20 bp, Artificial
  CRISPR gRNA sequence
acctgtattttctgtaaatt

SEQ ID NO: 694103 - DNA, 20 bp, Artificial
  CRISPR gRNA sequence
gtaaattggtagtttgttat

SEQ ID NO: 694104 - DNA, 20 bp, Artificial
  CRISPR gRNA sequence
tatagaggtttgcgtctatt

SEQ ID NO: 694105 - DNA, 20 bp, Artificial
  CRISPR gRNA sequence
ttttttttttttttttgcca

SEQ ID NO: 694106 - DNA, 20 bp, Artificial
  CRISPR gRNA sequence
tgaggattgatggtactata

SEQ ID NO: 694107 - DNA, 20 bp, Artificial
  CRISPR gRNA sequence
agctgcataatttctaaaat

SEQ ID NO: 694108 - DNA, 20 bp, Artificial
  CRISPR gRNA sequence
cagttatctattcagtagaa

SEQ ID NO: 694109 - DNA, 20 bp, Artificial
  CRISPR gRNA sequence
ttgttttttgagagactaaa

SEQ ID NO: 694110 - DNA, 20 bp, Artificial
  CRISPR gRNA sequence
tgaaaatattatttatagca

SEQ ID NO: 694111 - DNA, 20 bp, Artificial
  CRISPR gRNA sequence
gtctgctctagggttgggga

SEQ ID NO: 694112 - DNA, 20 bp, Artificial
  CRISPR gRNA sequence
tatgaccaagtagaacccag

SEQ ID NO: 694113 - DNA, 20 bp, Artificial
  CRISPR gRNA sequence
gtgaaaatccacggcccact

SEQ ID NO: 694114 - DNA, 20 bp, Artificial
  CRISPR gRNA sequence
ttcattcaagtatacattac

SEQ ID NO: 694115 - DNA, 20 bp, Artificial
  CRISPR gRNA sequence
gagaatctacaacaagagca

SEQ ID NO: 694116 - DNA, 20 bp, Artificial
  CRISPR gRNA sequence
ggcttgggagctaacacaag

SEQ ID NO: 694117 - DNA, 20 bp, Artificial
  CRISPR gRNA sequence
gtcatgggcagtggctcatg

SEQ ID NO: 694118 - DNA, 20 bp, Artificial
  CRISPR gRNA sequence
cacagacctcttgacatggg

SEQ ID NO: 694119 - DNA, 20 bp, Artificial
  CRISPR gRNA sequence
agcttcagaagatggtggtt

SEQ ID NO: 694120 - DNA, 20 bp, Artificial
  CRISPR gRNA sequence
ttttacaaagagaccagata

SEQ ID NO: 694121 - DNA, 20 bp, Artificial
  CRISPR gRNA sequence
ccatgcagaatggagaatca

SEQ ID NO: 694122 - DNA, 20 bp, Artificial
  CRISPR gRNA sequence
tcaggttcaatggatcctca

SEQ ID NO: 694123 - DNA, 20 bp, Artificial
  CRISPR gRNA sequence
gatcctcaataagattgcag

SEQ ID NO: 694124 - DNA, 20 bp, Artificial
  CRISPR gRNA sequence
aaaaactctccttcagaaat

SEQ ID NO: 694125 - DNA, 20 bp, Artificial
  CRISPR gRNA sequence
agtagtaatatgtatatttt

SEQ ID NO: 694126 - DNA, 20 bp, Artificial
  CRISPR gRNA sequence
agtagtaacatgtatatttt

SEQ ID NO: 694127 - DNA, 20 bp, Artificial
  CRISPR gRNA sequence
tttttggtgtttaattcttc

SEQ ID NO: 694128 - DNA, 20 bp, Artificial
  CRISPR gRNA sequence
ttcttcctttgtttttccta

SEQ ID NO: 694129 - DNA, 20 bp, Artificial
  CRISPR gRNA sequence
tagtgtatttctacaatgga

SEQ ID NO: 694130 - DNA, 20 bp, Artificial
  CRISPR gRNA sequence
ggcaggaggaaatggagggt

SEQ ID NO: 694131 - DNA, 20 bp, Artificial
  CRISPR gRNA sequence
agggtgactgcttaatggtg

SEQ ID NO: 694132 - DNA, 20 bp, Artificial
  CRISPR gRNA sequence
cagtaaaaaagaggctgaag

SEQ ID NO: 694133 - DNA, 20 bp, Artificial
  CRISPR gRNA sequence
atcttttatatggtaaactc

SEQ ID NO: 694134 - DNA, 20 bp, Artificial
  CRISPR gRNA sequence
tttatatggtaaactcctga

SEQ ID NO: 694135 - DNA, 20 bp, Artificial
  CRISPR gRNA sequence
gggcaatttcagtgggagtg

SEQ ID NO: 694136 - DNA, 20 bp, Artificial
  CRISPR gRNA sequence
gtgaagagattatccaacta

SEQ ID NO: 694137 - DNA, 20 bp, Artificial
  CRISPR gRNA sequence
aggatgattcatttggaggg

SEQ ID NO: 694138 - DNA, 20 bp, Artificial
  CRISPR gRNA sequence
gaccttatgttaggaaagtc

SEQ ID NO: 694139 - DNA, 20 bp, Artificial
  CRISPR gRNA sequence
atttgctttcctaaaaagga

SEQ ID NO: 694140 - DNA, 20 bp, Artificial
  CRISPR gRNA sequence
tcccccagctgaaggaagga

SEQ ID NO: 694141 - DNA, 20 bp, Artificial
  CRISPR gRNA sequence
acattttcagtgagctcaaa

SEQ ID NO: 694142 - DNA, 20 bp, Artificial
  CRISPR gRNA sequence
cataatcggcatttctgccc

SEQ ID NO: 694143 - DNA, 20 bp, Artificial
  CRISPR gRNA sequence
ctatggatttcaaatgagaa

SEQ ID NO: 694144 - DNA, 20 bp, Artificial
  CRISPR gRNA sequence
tttcattgttattttacttc

SEQ ID NO: 694145 - DNA, 20 bp, Artificial
  CRISPR gRNA sequence
tggagctgtcctttgcgtgg

SEQ ID NO: 694146 - DNA, 20 bp, Artificial
  CRISPR gRNA sequence
ctgatttccattttgttggt

SEQ ID NO: 694147 - DNA, 20 bp, Artificial
  CRISPR gRNA sequence
tttccattttgttggtggtg

SEQ ID NO: 694148 - DNA, 20 bp, Artificial
  CRISPR gRNA sequence
ttttgttggtggtggtttgt

SEQ ID NO: 694149 - DNA, 20 bp, Artificial
  CRISPR gRNA sequence
tggtggtggtttgtttttgt

SEQ ID NO: 694150 - DNA, 20 bp, Artificial
  CRISPR gRNA sequence
tggtttgtttttgtttttgt

SEQ ID NO: 694151 - DNA, 20 bp, Artificial
  CRISPR gRNA sequence
gtttttgtttttgtttttgt

SEQ ID NO: 694152 - DNA, 20 bp, Artificial
  CRISPR gRNA sequence
aacctccgcctctcgggttc

SEQ ID NO: 694153 - DNA, 20 bp, Artificial
  CRISPR gRNA sequence
tgcctcagcctcctgagtag

SEQ ID NO: 694154 - DNA, 20 bp, Artificial
  CRISPR gRNA sequence
ttttgtatttttagtagaga

SEQ ID NO: 694155 - DNA, 20 bp, Artificial
  CRISPR gRNA sequence
acctcaagtgatccacctgc

SEQ ID NO: 694156 - DNA, 20 bp, Artificial
  CRISPR gRNA sequence
tgcctcagcttctcaaagtg

SEQ ID NO: 694157 - DNA, 20 bp, Artificial
  CRISPR gRNA sequence
atgttatgggttatcttgaa

SEQ ID NO: 694158 - DNA, 20 bp, Artificial
  CRISPR gRNA sequence
tttgaatgtattattataca

SEQ ID NO: 694159 - DNA, 20 bp, Artificial
  CRISPR gRNA sequence
tccatgttgtaaactctgta

SEQ ID NO: 694160 - DNA, 20 bp, Artificial
  CRISPR gRNA sequence
gtaaactctgtataaagttt

SEQ ID NO: 694161 - DNA, 20 bp, Artificial
  CRISPR gRNA sequence
tcaggatgctgagccaggag

SEQ ID NO: 694162 - DNA, 20 bp, Artificial
  CRISPR gRNA sequence
aactgagttcttttagatcc

SEQ ID NO: 694163 - DNA, 20 bp, Artificial
  CRISPR gRNA sequence
tgtaggtaatattttgacaa

SEQ ID NO: 694164 - DNA, 20 bp, Artificial
  CRISPR gRNA sequence
ttgacaagcatgtttgtaca

SEQ ID NO: 694165 - DNA, 20 bp, Artificial
  CRISPR gRNA sequence
acataaagattctcctatgg

SEQ ID NO: 694166 - DNA, 20 bp, Artificial
  CRISPR gRNA sequence
cacattggaaggccaaggag

SEQ ID NO: 694167 - DNA, 20 bp, Artificial
  CRISPR gRNA sequence
gcctgtagtcctaggtaccc

SEQ ID NO: 694168 - DNA, 20 bp, Artificial
  CRISPR gRNA sequence
gtaccccagtgtttgaggtg

SEQ ID NO: 694169 - DNA, 20 bp, Artificial
  CRISPR gRNA sequence
gtgataaatattaaacaaga

SEQ ID NO: 694170 - DNA, 20 bp, Artificial
  CRISPR gRNA sequence
agccttattatactgtcata

SEQ ID NO: 694171 - DNA, 20 bp, Artificial
  CRISPR gRNA sequence
aatacttactgagagctatt

SEQ ID NO: 694172 - DNA, 20 bp, Artificial
  CRISPR gRNA sequence
taattttaggtgtcatattg

SEQ ID NO: 694173 - DNA, 20 bp, Artificial
  CRISPR gRNA sequence
atttctgggtgtgcctgtga

SEQ ID NO: 694174 - DNA, 20 bp, Artificial
  CRISPR gRNA sequence
gcctgtgagggtgtttctgg

SEQ ID NO: 694175 - DNA, 20 bp, Artificial
  CRISPR gRNA sequence
gctgctgtcttccttggttc

SEQ ID NO: 694176 - DNA, 20 bp, Artificial
  CRISPR gRNA sequence
ataaaaaatacacctaggct

SEQ ID NO: 694177 - DNA, 20 bp, Artificial
  CRISPR gRNA sequence
gagtggcgggaatggcaggg

SEQ ID NO: 694178 - DNA, 20 bp, Artificial
  CRISPR gRNA sequence
gccacaggggtcctatgatg

SEQ ID NO: 694179 - DNA, 20 bp, Artificial
  CRISPR gRNA sequence
tgtaggaaacggtgagagac

SEQ ID NO: 694180 - DNA, 20 bp, Artificial
  CRISPR gRNA sequence
ttcataggatatgtcctaat

SEQ ID NO: 694181 - DNA, 20 bp, Artificial
  CRISPR gRNA sequence
cagcccagctggaaagccct

SEQ ID NO: 694182 - DNA, 20 bp, Artificial
  CRISPR gRNA sequence
ggtggcaggagaggagtgaa

SEQ ID NO: 694183 - DNA, 20 bp, Artificial
  CRISPR gRNA sequence
caggagaggagtgaaaagtg

SEQ ID NO: 694184 - DNA, 20 bp, Artificial
  CRISPR gRNA sequence
ctggtaaattctattttact

SEQ ID NO: 694185 - DNA, 20 bp, Artificial
  CRISPR gRNA sequence
gtgaaatattatatttgtct

SEQ ID NO: 694186 - DNA, 20 bp, Artificial
  CRISPR gRNA sequence
tccatgctatgtgcaccatg

SEQ ID NO: 694187 - DNA, 20 bp, Artificial
  CRISPR gRNA sequence
tcatcctccgatggacactc

SEQ ID NO: 694188 - DNA, 20 bp, Artificial
  CRISPR gRNA sequence
gtacaattatctgtgtgagt

SEQ ID NO: 694189 - DNA, 20 bp, Artificial
  CRISPR gRNA sequence
attgttggctcctatggaaa

SEQ ID NO: 694190 - DNA, 20 bp, Artificial
  CRISPR gRNA sequence
actttcttgaggaagcatca

SEQ ID NO: 694191 - DNA, 20 bp, Artificial
  CRISPR gRNA sequence
tgttgttcactcatttttga

SEQ ID NO: 694192 - DNA, 20 bp, Artificial
  CRISPR gRNA sequence
gttcactcatttttgaatga

SEQ ID NO: 694193 - DNA, 20 bp, Artificial
  CRISPR gRNA sequence
actcatttttgaatgagatt

SEQ ID NO: 694194 - DNA, 20 bp, Artificial
  CRISPR gRNA sequence
agtgtcccttgatatataaa

SEQ ID NO: 694195 - DNA, 20 bp, Artificial
  CRISPR gRNA sequence
taaattttgatagtctaatt

SEQ ID NO: 694196 - DNA, 20 bp, Artificial
  CRISPR gRNA sequence
tattgtttttcttttattgg

SEQ ID NO: 694197 - DNA, 20 bp, Artificial
  CRISPR gRNA sequence
cattgccacatccaatgttc

SEQ ID NO: 694198 - DNA, 20 bp, Artificial
  CRISPR gRNA sequence
aatgttcctaagattttctt

SEQ ID NO: 694199 - DNA, 20 bp, Artificial
  CRISPR gRNA sequence
tttcttcaatgttttcttct

SEQ ID NO: 694200 - DNA, 20 bp, Artificial
  CRISPR gRNA sequence
attattttgtatgtgggtat

SEQ ID NO: 694201 - DNA, 20 bp, Artificial
  CRISPR gRNA sequence
tttacttgtctttactccac

SEQ ID NO: 694202 - DNA, 20 bp, Artificial
  CRISPR gRNA sequence
ttactccacaggtgattgga

SEQ ID NO: 694203 - DNA, 20 bp, Artificial
  CRISPR gRNA sequence
ggctgaaacatgctgaaatg

SEQ ID NO: 694204 - DNA, 20 bp, Artificial
  CRISPR gRNA sequence
acatgctgaaatggagggtt

SEQ ID NO: 694205 - DNA, 20 bp, Artificial
  CRISPR gRNA sequence
aatggagggtttactgcttt

SEQ ID NO: 694206 - DNA, 20 bp, Artificial
  CRISPR gRNA sequence
tttaaattttgctggctcac

SEQ ID NO: 694207 - DNA, 20 bp, Artificial
  CRISPR gRNA sequence
ttttgctggctcacaatggc

SEQ ID NO: 694208 - DNA, 20 bp, Artificial
  CRISPR gRNA sequence
cataagggggccacagggag

SEQ ID NO: 694209 - DNA, 20 bp, Artificial
  CRISPR gRNA sequence
gcttgctcacataaggagcc

SEQ ID NO: 694210 - DNA, 20 bp, Artificial
  CRISPR gRNA sequence
tgcaagatgttcaaactgaa

SEQ ID NO: 694211 - DNA, 20 bp, Artificial
  CRISPR gRNA sequence
ttccaggaaccccatgatgt

SEQ ID NO: 694212 - DNA, 20 bp, Artificial
  CRISPR gRNA sequence
caggtcccacaagaccttac

SEQ ID NO: 694213 - DNA, 20 bp, Artificial
  CRISPR gRNA sequence
cttcaataatttcacctggt

SEQ ID NO: 694214 - DNA, 20 bp, Artificial
  CRISPR gRNA sequence
ttcacctggtctaagatttg

SEQ ID NO: 694215 - DNA, 20 bp, Artificial
  CRISPR gRNA sequence
ggtctaagatttgaggggtt

SEQ ID NO: 694216 - DNA, 20 bp, Artificial
  CRISPR gRNA sequence
gcacttcactagcagtgata

SEQ ID NO: 694217 - DNA, 20 bp, Artificial
  CRISPR gRNA sequence
ctttaccctctctctaatgc

SEQ ID NO: 694218 - DNA, 20 bp, Artificial
  CRISPR gRNA sequence
cagggtgtccctcagttcaa

SEQ ID NO: 694219 - DNA, 20 bp, Artificial
  CRISPR gRNA sequence
tggataattatctgttatgt

SEQ ID NO: 694220 - DNA, 20 bp, Artificial
  CRISPR gRNA sequence
aattgctcctggatgagaat

SEQ ID NO: 694221 - DNA, 20 bp, Artificial
  CRISPR gRNA sequence
cagtaagagtcctggtaacc

SEQ ID NO: 694222 - DNA, 20 bp, Artificial
  CRISPR gRNA sequence
ctcctgtaaacattgctgcc

SEQ ID NO: 694223 - DNA, 20 bp, Artificial
  CRISPR gRNA sequence
atatgataaattcagtgtgg

SEQ ID NO: 694224 - DNA, 20 bp, Artificial
  CRISPR gRNA sequence
attctaaaagaaaaaagatg

SEQ ID NO: 694225 - DNA, 20 bp, Artificial
  CRISPR gRNA sequence
aaaaaagatgggttgattgt

SEQ ID NO: 694226 - DNA, 20 bp, Artificial
  CRISPR gRNA sequence
cctaaagccgaagccaaagc

SEQ ID NO: 694227 - DNA, 20 bp, Artificial
  CRISPR gRNA sequence
gaagagcacccccaggagaa

SEQ ID NO: 694228 - DNA, 20 bp, Artificial
  CRISPR gRNA sequence
gcttgaccaccatgttatca

SEQ ID NO: 694229 - DNA, 20 bp, Artificial
  CRISPR gRNA sequence
ccagatcaaacaggctgtga

SEQ ID NO: 694230 - DNA, 20 bp, Artificial
  CRISPR gRNA sequence
tgatgtggccaaagtcaaca

SEQ ID NO: 694231 - DNA, 20 bp, Artificial
  CRISPR gRNA sequence
gttcgactggctcctgacta

SEQ ID NO: 694232 - DNA, 20 bp, Artificial
  CRISPR gRNA sequence
gcaattctgctacattgata

SEQ ID NO: 694233 - DNA, 20 bp, Artificial
  CRISPR gRNA sequence
cccagagccctgggcactgt

SEQ ID NO: 694234 - DNA, 20 bp, Artificial
  CRISPR gRNA sequence
tgcagcctgagagtagctcc

SEQ ID NO: 694235 - DNA, 20 bp, Artificial
  CRISPR gRNA sequence
cccctagtctttgatcccag

SEQ ID NO: 694236 - DNA, 20 bp, Artificial
  CRISPR gRNA sequence
tcatcagcagggaccttccc

SEQ ID NO: 694237 - DNA, 20 bp, Artificial
  CRISPR gRNA sequence
aatctgtccttcattttcac

SEQ ID NO: 694238 - DNA, 20 bp, Artificial
  CRISPR gRNA sequence
ggtagacccatgagtgtgga

SEQ ID NO: 694239 - DNA, 20 bp, Artificial
  CRISPR gRNA sequence
aggcagggcacacttctact

SEQ ID NO: 694240 - DNA, 20 bp, Artificial
  CRISPR gRNA sequence
ctgaagagctccagaagggc

SEQ ID NO: 694241 - DNA, 20 bp, Artificial
  CRISPR gRNA sequence
ctgtcttccctccattccct

SEQ ID NO: 694242 - DNA, 20 bp, Artificial
  CRISPR gRNA sequence
gtaccggatctcgaaagcca

SEQ ID NO: 694243 - DNA, 20 bp, Artificial
  CRISPR gRNA sequence
ccccctccccgcccaacccg

SEQ ID NO: 694244 - DNA, 20 bp, Artificial
  CRISPR gRNA sequence
ggcgggtcccgctgcctcgg

SEQ ID NO: 694245 - DNA, 20 bp, Artificial
  CRISPR gRNA sequence
ccctcactcctccccacaga

SEQ ID NO: 694246 - DNA, 20 bp, Artificial
  CRISPR gRNA sequence
ggcccctgagagcagcagga

SEQ ID NO: 694247 - DNA, 20 bp, Artificial
  CRISPR gRNA sequence
gaacctgggaactgcggcga

SEQ ID NO: 694248 - DNA, 20 bp, Artificial
  CRISPR gRNA sequence
tgggaactgcggcgacactg

SEQ ID NO: 694249 - DNA, 20 bp, Artificial
  CRISPR gRNA sequence
cgggtgagtgcggggtccag

SEQ ID NO: 694250 - DNA, 20 bp, Artificial
  CRISPR gRNA sequence
gagttgctccgcagatactt

SEQ ID NO: 694251 - DNA, 20 bp, Artificial
  CRISPR gRNA sequence
ctccctctagtcctgagtag

SEQ ID NO: 694252 - DNA, 20 bp, Artificial
  CRISPR gRNA sequence
aggacattttcttcccatag

SEQ ID NO: 694253 - DNA, 20 bp, Artificial
  CRISPR gRNA sequence
agaagcaagatatcaatgta

SEQ ID NO: 694254 - DNA, 20 bp, Artificial
  CRISPR gRNA sequence
catacataaattttaaaaat

SEQ ID NO: 694255 - DNA, 20 bp, Artificial
  CRISPR gRNA sequence
gtgtgtgtgtgtgtgtgtga

SEQ ID NO: 694256 - DNA, 20 bp, Artificial
  CRISPR gRNA sequence
atacttcatcacacacctcc

SEQ ID NO: 694257 - DNA, 20 bp, Artificial
  CRISPR gRNA sequence
agaaccaacattatcacacc

SEQ ID NO: 694258 - DNA, 20 bp, Artificial
  CRISPR gRNA sequence
atcaacccatcttttttctt

SEQ ID NO: 694259 - DNA, 20 bp, Artificial
  CRISPR gRNA sequence
caccaatgtcaaattccatc

SEQ ID NO: 694260 - DNA, 20 bp, Artificial
  CRISPR gRNA sequence
caactcaatttgggactgca

SEQ ID NO: 694261 - DNA, 20 bp, Artificial
  CRISPR gRNA sequence
ggccatttctaggtaaaaag

SEQ ID NO: 694262 - DNA, 20 bp, Artificial
  CRISPR gRNA sequence
aattttttttggctctaagt

SEQ ID NO: 694263 - DNA, 20 bp, Artificial
  CRISPR gRNA sequence
gagaatttgaacttgtttct

SEQ ID NO: 694264 - DNA, 20 bp, Artificial
  CRISPR gRNA sequence
tttatttgattttgatttaa

SEQ ID NO: 694265 - DNA, 20 bp, Artificial
  CRISPR gRNA sequence
caaaaattaactcaattaac

SEQ ID NO: 694266 - DNA, 20 bp, Artificial
  CRISPR gRNA sequence
ttcaacctataaatctttta

SEQ ID NO: 694267 - DNA, 20 bp, Artificial
  CRISPR gRNA sequence
atcttttagaagaaaacatt

SEQ ID NO: 694268 - DNA, 20 bp, Artificial
  CRISPR gRNA sequence
gagcaaaagcacaaccaata

SEQ ID NO: 694269 - DNA, 20 bp, Artificial
  CRISPR gRNA sequence
ggacactattaagagagtta

SEQ ID NO: 694270 - DNA, 20 bp, Artificial
  CRISPR gRNA sequence
agagagttaaaagaaaatgc

SEQ ID NO: 694271 - DNA, 20 bp, Artificial
  CRISPR gRNA sequence
ttgccagttatatacctgat

SEQ ID NO: 694272 - DNA, 20 bp, Artificial
  CRISPR gRNA sequence
acctgataaagaattaatat

SEQ ID NO: 694273 - DNA, 20 bp, Artificial
  CRISPR gRNA sequence
taaagaactatgacttaaca

SEQ ID NO: 694274 - DNA, 20 bp, Artificial
  CRISPR gRNA sequence
aaaacagtatgatgcttcct

SEQ ID NO: 694275 - DNA, 20 bp, Artificial
  CRISPR gRNA sequence
cacttttgggcatataccca

SEQ ID NO: 694276 - DNA, 20 bp, Artificial
  CRISPR gRNA sequence
aacactgtaagtgaaatgag

SEQ ID NO: 694277 - DNA, 20 bp, Artificial
  CRISPR gRNA sequence
cagctaaaataggcaaattc

SEQ ID NO: 694278 - DNA, 20 bp, Artificial
  CRISPR gRNA sequence
tcatagaaacagagagtaaa

SEQ ID NO: 694279 - DNA, 20 bp, Artificial
  CRISPR gRNA sequence
agagagtaaaatagaattta

SEQ ID NO: 694280 - DNA, 20 bp, Artificial
  CRISPR gRNA sequence
ttaccagaaattgagggtag

SEQ ID NO: 694281 - DNA, 20 bp, Artificial
  CRISPR gRNA sequence
ccacccgagagccaccctct

SEQ ID NO: 694282 - DNA, 20 bp, Artificial
  CRISPR gRNA sequence
aatgtcccatggtcaagttc

SEQ ID NO: 694283 - DNA, 20 bp, Artificial
  CRISPR gRNA sequence
ggtgtatcagggttaccaag

SEQ ID NO: 694284 - DNA, 20 bp, Artificial
  CRISPR gRNA sequence
agattgagagagagagagag

SEQ ID NO: 694285 - DNA, 20 bp, Artificial
  CRISPR gRNA sequence
cactcacatgccaatccctt

SEQ ID NO: 694286 - DNA, 20 bp, Artificial
  CRISPR gRNA sequence
aaacaccctcacaggcacac

SEQ ID NO: 694287 - DNA, 20 bp, Artificial
  CRISPR gRNA sequence
tttttaaaatcccaaccata

SEQ ID NO: 694288 - DNA, 20 bp, Artificial
  CRISPR gRNA sequence
tgacaaagtgaaattgtgtt

SEQ ID NO: 694289 - DNA, 20 bp, Artificial
  CRISPR gRNA sequence
tctcatttgaaatccatagg

SEQ ID NO: 694290 - DNA, 20 bp, Artificial
  CRISPR gRNA sequence
gattatggcacctccagaga

SEQ ID NO: 694291 - DNA, 20 bp, Artificial
  CRISPR gRNA sequence
ctgagcaatgaagtcaatgc

SEQ ID NO: 694292 - DNA, 20 bp, Artificial
  CRISPR gRNA sequence
ctcactgaaaatgttggcct

SEQ ID NO: 694293 - DNA, 20 bp, Artificial
  CRISPR gRNA sequence
cgtgagcatttggatccaag

SEQ ID NO: 694294 - DNA, 20 bp, Artificial
  CRISPR gRNA sequence
ggctgatctgggagtgttgt

SEQ ID NO: 694295 - DNA, 20 bp, Artificial
  CRISPR gRNA sequence
tggctaaatcatattccatt

SEQ ID NO: 694296 - DNA, 20 bp, Artificial
  CRISPR gRNA sequence
accaaataggaaaaacaaag

SEQ ID NO: 694297 - DNA, 20 bp, Artificial
  CRISPR gRNA sequence
ttctgaactctatggtttct

SEQ ID NO: 694298 - DNA, 20 bp, Artificial
  CRISPR gRNA sequence
tttctttctgctactgaact

SEQ ID NO: 694299 - DNA, 20 bp, Artificial
  CRISPR gRNA sequence
gagattctatattagcttag

SEQ ID NO: 694300 - DNA, 20 bp, Artificial
  CRISPR gRNA sequence
gaatgaaggacaacatgcat

SEQ ID NO: 694301 - DNA, 20 bp, Artificial
  CRISPR gRNA sequence
aattgctgggtcataggtga

SEQ ID NO: 694302 - DNA, 20 bp, Artificial
  CRISPR gRNA sequence
aagagggtaaatcttttatt

SEQ ID NO: 694303 - DNA, 20 bp, Artificial
  CRISPR gRNA sequence
attatgcagctagcatatga

SEQ ID NO: 694304 - DNA, 20 bp, Artificial
  CRISPR gRNA sequence
atggcaattaacatcgcaaa

SEQ ID NO: 694305 - DNA, 20 bp, Artificial
  CRISPR gRNA sequence
ctataacaaactaccaattt

SEQ ID NO: 694306 - DNA, 20 bp, Artificial
  CRISPR gRNA sequence
tttatgacaaaaacactaat

SEQ ID NO: 694307 - DNA, 20 bp, Artificial
  CRISPR gRNA sequence
gactcatactggtgtccagt

SEQ ID NO: 694308 - DNA, 20 bp, Artificial
  CRISPR gRNA sequence
cctggtttattgtgttgtca

SEQ ID NO: 694309 - DNA, 20 bp, Artificial
  CRISPR gRNA sequence
cacaggacagagtaaaatgg

SEQ ID NO: 694310 - DNA, 20 bp, Artificial
  CRISPR gRNA sequence
gggaagaaaccacagtcact

SEQ ID NO: 694311 - DNA, 20 bp, Artificial
  CRISPR gRNA sequence
tatttatctcctcttcctgg

SEQ ID NO: 694312 - DNA, 20 bp, Artificial
  CRISPR gRNA sequence
caaagtgagggaaggtttga

SEQ ID NO: 694313 - DNA, 20 bp, Artificial
  CRISPR gRNA sequence
acacacaccaacacatgaat

SEQ ID NO: 694314 - DNA, 20 bp, Artificial
  CRISPR gRNA sequence
aagtaaaataagccaatcac

SEQ ID NO: 694315 - DNA, 20 bp, Artificial
  CRISPR gRNA sequence
agtatgcgcttaccttagat

SEQ ID NO: 694316 - DNA, 20 bp, Artificial
  CRISPR gRNA sequence
tcagcacctcctgaaactag

SEQ ID NO: 694317 - DNA, 20 bp, Artificial
  CRISPR gRNA sequence
tttccaagaagataaaatta

SEQ ID NO: 694318 - DNA, 20 bp, Artificial
  CRISPR gRNA sequence
ccaaagtgtccaacgtcttg

SEQ ID NO: 694319 - DNA, 20 bp, Artificial
  CRISPR gRNA sequence
tgagaggattagtcatggta

SEQ ID NO: 694320 - DNA, 20 bp, Artificial
  CRISPR gRNA sequence
aaaaatcaagcaataataat

SEQ ID NO: 694321 - DNA, 20 bp, Artificial
  CRISPR gRNA sequence
gagatacagaagtaaagtca

SEQ ID NO: 694322 - DNA, 20 bp, Artificial
  CRISPR gRNA sequence
aacttgaaagtggttggccc

SEQ ID NO: 694323 - DNA, 20 bp, Artificial
  CRISPR gRNA sequence
agtggttggcccctagaaag

SEQ ID NO: 694324 - DNA, 20 bp, Artificial
  CRISPR gRNA sequence
tgaaagagtcaaatatttgt

SEQ ID NO: 694325 - DNA, 20 bp, Artificial
  CRISPR gRNA sequence
aatatttgtgcagaatctct

SEQ ID NO: 694326 - DNA, 20 bp, Artificial
  CRISPR gRNA sequence
atatgaaggtgctgtttggc

SEQ ID NO: 694327 - DNA, 20 bp, Artificial
  CRISPR gRNA sequence
ttggcacagaatttaatagg

SEQ ID NO: 694328 - DNA, 20 bp, Artificial
  CRISPR gRNA sequence
cagaacaactatgaatacaa

SEQ ID NO: 694329 - DNA, 20 bp, Artificial
  CRISPR gRNA sequence
ttttaaaatcccagtcctgc

SEQ ID NO: 694330 - DNA, 20 bp, Artificial
  CRISPR gRNA sequence
tgagaagaagacagtcctcc

SEQ ID NO: 694331 - DNA, 20 bp, Artificial
  CRISPR gRNA sequence
gtcaggttcatctaggcctc

SEQ ID NO: 694332 - DNA, 20 bp, Artificial
  CRISPR gRNA sequence
atcatgtttttcatcaagag

SEQ ID NO: 694333 - DNA, 20 bp, Artificial
  CRISPR gRNA sequence
ttccaccagttatctattca

SEQ ID NO: 694334 - DNA, 20 bp, Artificial
  CRISPR gRNA sequence
ccactttttgttatatacca

SEQ ID NO: 694335 - DNA, 20 bp, Artificial
  CRISPR gRNA sequence
gacagaactaatctatcata

SEQ ID NO: 694336 - DNA, 20 bp, Artificial
  CRISPR gRNA sequence
taatctatcatattagaaat

SEQ ID NO: 694337 - DNA, 20 bp, Artificial
  CRISPR gRNA sequence
acaattctctctaagctaat

SEQ ID NO: 694338 - DNA, 20 bp, Artificial
  CRISPR gRNA sequence
atctccattactgaaagtcc

SEQ ID NO: 694339 - DNA, 20 bp, Artificial
  CRISPR gRNA sequence
ctgtgactcagacattaaga

SEQ ID NO: 694340 - DNA, 20 bp, Artificial
  CRISPR gRNA sequence
tagagaacatcaataaaaag

SEQ ID NO: 694341 - DNA, 20 bp, Artificial
  CRISPR gRNA sequence
tccagagcaaatttcaccat

SEQ ID NO: 694342 - DNA, 20 bp, Artificial
  CRISPR gRNA sequence
caaatttcaccatgcagaat

SEQ ID NO: 694343 - DNA, 20 bp, Artificial
  CRISPR gRNA sequence
tgaaattctctagttcagta

SEQ ID NO: 694344 - DNA, 20 bp, Artificial
  CRISPR gRNA sequence
attctctagttcagtagcag

SEQ ID NO: 694345 - DNA, 20 bp, Artificial
  CRISPR gRNA sequence
gcagaaagaaaaaaaattat

SEQ ID NO: 694346 - DNA, 20 bp, Artificial
  CRISPR gRNA sequence
catgcactttgggagtcctc

SEQ ID NO: 694347 - DNA, 20 bp, Artificial
  CRISPR gRNA sequence
agtcctcaaagaaaggagag

SEQ ID NO: 694348 - DNA, 20 bp, Artificial
  CRISPR gRNA sequence
gaaaggagagagagaaagga

SEQ ID NO: 694349 - DNA, 20 bp, Artificial
  CRISPR gRNA sequence
aaggagaagaatgactattt

SEQ ID NO: 694350 - DNA, 20 bp, Artificial
  CRISPR gRNA sequence
agattgcagcccagttttct

SEQ ID NO: 694351 - DNA, 20 bp, Artificial
  CRISPR gRNA sequence
aatgttgacaaatttagagg

SEQ ID NO: 694352 - DNA, 20 bp, Artificial
  CRISPR gRNA sequence
gtgtctggaaaaactctcct

SEQ ID NO: 694353 - DNA, 20 bp, Artificial
  CRISPR gRNA sequence
tgtttttcctatttggttta

SEQ ID NO: 694354 - DNA, 20 bp, Artificial
  CRISPR gRNA sequence
ttcagaagagaccaatctat

SEQ ID NO: 694355 - DNA, 20 bp, Artificial
  CRISPR gRNA sequence
gaagagaccaatctatagag

SEQ ID NO: 694356 - DNA, 20 bp, Artificial
  CRISPR gRNA sequence
atcacagtaaaaaagaggct

SEQ ID NO: 694357 - DNA, 20 bp, Artificial
  CRISPR gRNA sequence
tcacccttgttcttctgtaa

SEQ ID NO: 694358 - DNA, 20 bp, Artificial
  CRISPR gRNA sequence
ggatgagtcatggagtggag

SEQ ID NO: 694359 - DNA, 20 bp, Artificial
  CRISPR gRNA sequence
tctgccctatggatttcaaa

SEQ ID NO: 694360 - DNA, 20 bp, Artificial
  CRISPR gRNA sequence
caaatgctttattttgaata

SEQ ID NO: 694361 - DNA, 20 bp, Artificial
  CRISPR gRNA sequence
aaaaaaaaataaaatacaca

SEQ ID NO: 694362 - DNA, 20 bp, Artificial
  CRISPR gRNA sequence
ctactcaggatgctgagcca

SEQ ID NO: 694363 - DNA, 20 bp, Artificial
  CRISPR gRNA sequence
actgtactccagcctgggtg

SEQ ID NO: 694364 - DNA, 20 bp, Artificial
  CRISPR gRNA sequence
ctccagaccaggctacagag

SEQ ID NO: 694365 - DNA, 20 bp, Artificial
  CRISPR gRNA sequence
ctatttactgattatgatgg

SEQ ID NO: 694366 - DNA, 20 bp, Artificial
  CRISPR gRNA sequence
ggcccagatagaacaaaaaa

SEQ ID NO: 694367 - DNA, 20 bp, Artificial
  CRISPR gRNA sequence
caccaacagacaataaacaa

SEQ ID NO: 694368 - DNA, 20 bp, Artificial
  CRISPR gRNA sequence
ggaatggcagggaatagatt

SEQ ID NO: 694369 - DNA, 20 bp, Artificial
  CRISPR gRNA sequence
tggagatgagtgagctgggc

SEQ ID NO: 694370 - DNA, 20 bp, Artificial
  CRISPR gRNA sequence
gaggtttcattgtgcctagg

SEQ ID NO: 694371 - DNA, 20 bp, Artificial
  CRISPR gRNA sequence
agaacattttcatcatccca

SEQ ID NO: 694372 - DNA, 20 bp, Artificial
  CRISPR gRNA sequence
cccatttgtatatcttcttt

SEQ ID NO: 694373 - DNA, 20 bp, Artificial
  CRISPR gRNA sequence
ggcttttggtgacaaaccca

SEQ ID NO: 694374 - DNA, 20 bp, Artificial
  CRISPR gRNA sequence
taaggagcccctggttttct

SEQ ID NO: 694375 - DNA, 20 bp, Artificial
  CRISPR gRNA sequence
aagttggcttctataaagtc

SEQ ID NO: 694376 - DNA, 20 bp, Artificial
  CRISPR gRNA sequence
aggaaattctacctttttac

SEQ ID NO: 694377 - DNA, 20 bp, Artificial
  CRISPR gRNA sequence
tttgagctgctgtctgggac

SEQ ID NO: 694378 - DNA, 20 bp, Artificial
  CRISPR gRNA sequence
aggaagcttgtactcaaggg

SEQ ID NO: 694379 - DNA, 20 bp, Artificial
  CRISPR gRNA sequence
gtgggaaaattgctcctgga

SEQ ID NO: 694380 - DNA, 20 bp, Artificial
  CRISPR gRNA sequence
agtggcagaacctcctattg

SEQ ID NO: 694381 - DNA, 20 bp, Artificial
  CRISPR gRNA sequence
aaacaggtaatgccattcta

SEQ ID NO: 694382 - DNA, 20 bp, Artificial
  CRISPR gRNA sequence
gttatagattgtaggtaatt

SEQ ID NO: 694383 - DNA, 20 bp, Artificial
  CRISPR gRNA sequence
aaggcaacgagtggacattt

SEQ ID NO: 694384 - DNA, 20 bp, Artificial
  CRISPR gRNA sequence
catgggtcttgcaacttact

SEQ ID NO: 694385 - DNA, 20 bp, Artificial
  CRISPR gRNA sequence
tccttggaagagcaccccca

SEQ ID NO: 694386 - DNA, 20 bp, Artificial
  CRISPR gRNA sequence
ctgagtaggctgtgaagaag

SEQ ID NO: 694387 - DNA, 20 bp, Artificial
  CRISPR gRNA sequence
tgtatatcttttcaccatta

SEQ ID NO: 694388 - DNA, 20 bp, Artificial
  CRISPR gRNA sequence
aggaagctgtctcacactat

SEQ ID NO: 694389 - DNA, 20 bp, Artificial
  CRISPR gRNA sequence
atgctcaagacatccaagtc

SEQ ID NO: 694390 - DNA, 20 bp, Artificial
  CRISPR gRNA sequence
ccctctgtttctatctatgg

SEQ ID NO: 694391 - DNA, 20 bp, Artificial
  CRISPR gRNA sequence
agaaaatgtcctgtgagagg

SEQ ID NO: 694392 - DNA, 20 bp, Artificial
  CRISPR gRNA sequence
ctttgatcccagagaagttt

SEQ ID NO: 694393 - DNA, 20 bp, Artificial
  CRISPR gRNA sequence
ctgtagatccagggcaggat

SEQ ID NO: 694394 - DNA, 20 bp, Artificial
  CRISPR gRNA sequence
agggcaggatcaagaaatat

SEQ ID NO: 694395 - DNA, 20 bp, Artificial
  CRISPR gRNA sequence
accaccataatcatcgaagt

SEQ ID NO: 694396 - DNA, 20 bp, Artificial
  CRISPR gRNA sequence
gcttgcaacccccagtggga

SEQ ID NO: 694397 - DNA, 20 bp, Artificial
  CRISPR gRNA sequence
agaagggctcctgctttccc

SEQ ID NO: 694398 - DNA, 20 bp, Artificial
  CRISPR gRNA sequence
tttggaggatctgagaagag

SEQ ID NO: 694399 - DNA, 20 bp, Artificial
  CRISPR gRNA sequence
cagcacccatgtgaccaacc

SEQ ID NO: 694400 - DNA, 20 bp, Artificial
  CRISPR gRNA sequence
gaggcagagaacaaaacttg

SEQ ID NO: 694401 - DNA, 20 bp, Artificial
  CRISPR gRNA sequence
ggcgacactgattggcttct

SEQ ID NO: 694402 - DNA, 20 bp, Artificial
  CRISPR gRNA sequence
aacgcgacgcccaatgggag

SEQ ID NO: 694403 - DNA, 20 bp, Artificial
  CRISPR gRNA sequence
aatttgaacttgtttctgaa

SEQ ID NO: 694404 - DNA, 20 bp, Artificial
  CRISPR gRNA sequence
aacctataaatcttttagaa

SEQ ID NO: 694405 - DNA, 20 bp, Artificial
  CRISPR gRNA sequence
aaaagcacaaccaataaaag

SEQ ID NO: 694406 - DNA, 20 bp, Artificial
  CRISPR gRNA sequence
aaattagactatcaaaattt

SEQ ID NO: 694407 - DNA, 20 bp, Artificial
  CRISPR gRNA sequence
gaactatgacttaacaacag

SEQ ID NO: 694408 - DNA, 20 bp, Artificial
  CRISPR gRNA sequence
acagtggtacagcgaccatg

SEQ ID NO: 694409 - DNA, 20 bp, Artificial
  CRISPR gRNA sequence
tgatgcttcctcaagaaagt

SEQ ID NO: 694410 - DNA, 20 bp, Artificial
  CRISPR gRNA sequence
tatacagagtttacaacatg

SEQ ID NO: 694411 - DNA, 20 bp, Artificial
  CRISPR gRNA sequence
gaccagactggccaatatgg

SEQ ID NO: 694412 - DNA, 20 bp, Artificial
  CRISPR gRNA sequence
tgaaattgtgtttcagaaac

SEQ ID NO: 694413 - DNA, 20 bp, Artificial
  CRISPR gRNA sequence
tgtgtttcagaaacaaaaac

SEQ ID NO: 694414 - DNA, 20 bp, Artificial
  CRISPR gRNA sequence
tcagaaacaaaaacaaaaac

SEQ ID NO: 694415 - DNA, 20 bp, Artificial
  CRISPR gRNA sequence
acaaaaacaaaaacaaaaac

SEQ ID NO: 694416 - DNA, 20 bp, Artificial
  CRISPR gRNA sequence
tttcttttaaaccaaatagg

SEQ ID NO: 694417 - DNA, 20 bp, Artificial
  CRISPR gRNA sequence
tgaactctatggtttctgaa

SEQ ID NO: 694418 - DNA, 20 bp, Artificial
  CRISPR gRNA sequence
tagcttagagagaattgttt

SEQ ID NO: 694419 - DNA, 20 bp, Artificial
  CRISPR gRNA sequence
aaacttggtttagtctctca

SEQ ID NO: 694420 - DNA, 20 bp, Artificial
  CRISPR gRNA sequence
ttgaattcttcctcttgatg

SEQ ID NO: 694421 - DNA, 20 bp, Artificial
  CRISPR gRNA sequence
atggcaaaaaaaaaaaaaaa

SEQ ID NO: 694422 - DNA, 20 bp, Artificial
  CRISPR gRNA sequence
taaaaatatactcttaaagg

SEQ ID NO: 694423 - DNA, 20 bp, Artificial
  CRISPR gRNA sequence
cccgtggggttttttatgac

SEQ ID NO: 694424 - DNA, 20 bp, Artificial
  CRISPR gRNA sequence
tgacaggacacagctgaggg

SEQ ID NO: 694425 - DNA, 20 bp, Artificial
  CRISPR gRNA sequence
tcatcctccaggttccaggt

SEQ ID NO: 694426 - DNA, 20 bp, Artificial
  CRISPR gRNA sequence
ctcctcttcctggagagaat

SEQ ID NO: 694427 - DNA, 20 bp, Artificial
  CRISPR gRNA sequence
gtgagggaaggtttgaaaag

SEQ ID NO: 694428 - DNA, 20 bp, Artificial
  CRISPR gRNA sequence
taaaataagccaatcacaaa

SEQ ID NO: 694429 - DNA, 20 bp, Artificial
  CRISPR gRNA sequence
atgcgcttaccttagataca

SEQ ID NO: 694430 - DNA, 20 bp, Artificial
  CRISPR gRNA sequence
tgagagttaataaaataaac

SEQ ID NO: 694431 - DNA, 20 bp, Artificial
  CRISPR gRNA sequence
aaagtcaaaagaatcagcta

SEQ ID NO: 694432 - DNA, 20 bp, Artificial
  CRISPR gRNA sequence
attataaatttgattaaaat

SEQ ID NO: 694433 - DNA, 20 bp, Artificial
  CRISPR gRNA sequence
attagtcttttccttgggcc

SEQ ID NO: 694434 - DNA, 20 bp, Artificial
  CRISPR gRNA sequence
ttattagtgtttttgtcata

SEQ ID NO: 694435 - DNA, 20 bp, Artificial
  CRISPR gRNA sequence
ttgagccaggaactaggaat

SEQ ID NO: 694436 - DNA, 20 bp, Artificial
  CRISPR gRNA sequence
acttgagcaaaataaagttg

SEQ ID NO: 694437 - DNA, 20 bp, Artificial
  CRISPR gRNA sequence
caaaccttccaaatttgatg

SEQ ID NO: 694438 - DNA, 20 bp, Artificial
  CRISPR gRNA sequence
tgcaggaattgtgtgtctgg

SEQ ID NO: 694439 - DNA, 20 bp, Artificial
  CRISPR gRNA sequence
ctacaacattgctgaatctc

SEQ ID NO: 694440 - DNA, 20 bp, Artificial
  CRISPR gRNA sequence
tatacttgttaatattgtgg

SEQ ID NO: 694441 - DNA, 20 bp, Artificial
  CRISPR gRNA sequence
cctcactccagtcatggcaa

SEQ ID NO: 694442 - DNA, 20 bp, Artificial
  CRISPR gRNA sequence
gcaacgagtggacattttaa

SEQ ID NO: 694443 - DNA, 20 bp, Artificial
  CRISPR gRNA sequence
aagatgtccacagccacaaa

SEQ ID NO: 694444 - DNA, 20 bp, Artificial
  CRISPR gRNA sequence
agtaggctgtgaagaagata

SEQ ID NO: 694445 - DNA, 20 bp, Artificial
  CRISPR gRNA sequence
cacatttacgtgcatgctat

SEQ ID NO: 694446 - DNA, 20 bp, Artificial
  CRISPR gRNA sequence
tgcaacccccagtgggacaa

SEQ ID NO: 694447 - DNA, 20 bp, Artificial
  CRISPR gRNA sequence
attgagtgtgaggcagagaa

SEQ ID NO: 694448 - DNA, 20 bp, Artificial
  CRISPR gRNA sequence
ctcactcccattgggcgtcg

SEQ ID NO: 694449 - DNA, 20 bp, Artificial
  CRISPR gRNA sequence
tcactcccattgggcgtcgc

SEQ ID NO: 694450 - DNA, 20 bp, Artificial
  CRISPR gRNA sequence
actcccattgggcgtcgcgt

SEQ ID NO: 694451 - DNA, 20 bp, Artificial
  CRISPR gRNA sequence
ccattgggcgtcgcgtttct

SEQ ID NO: 694452 - DNA, 20 bp, Artificial
  CRISPR gRNA sequence
ggcgtcgcgtttctagagaa

SEQ ID NO: 694453 - DNA, 20 bp, Artificial
  CRISPR gRNA sequence
ctagagaagccaatcagtgt

SEQ ID NO: 694454 - DNA, 20 bp, Artificial
  CRISPR gRNA sequence
tagagaagccaatcagtgtc

SEQ ID NO: 694455 - DNA, 20 bp, Artificial
  CRISPR gRNA sequence
gagaagccaatcagtgtcgc

SEQ ID NO: 694456 - DNA, 20 bp, Artificial
  CRISPR gRNA sequence
ccaggttctaaagtcccacg

SEQ ID NO: 694457 - DNA, 20 bp, Artificial
  CRISPR gRNA sequence
taaagtcccacgcaccccgc

SEQ ID NO: 694458 - DNA, 20 bp, Artificial
  CRISPR gRNA sequence
aagtcccacgcaccccgcgg

SEQ ID NO: 694459 - DNA, 20 bp, Artificial
  CRISPR gRNA sequence
atatttttcccagacgcgga

SEQ ID NO: 694460 - DNA, 20 bp, Artificial
  CRISPR gRNA sequence
ttcccagacgcggaggttgg

SEQ ID NO: 694461 - DNA, 20 bp, Artificial
  CRISPR gRNA sequence
tcccagacgcggaggttggg

SEQ ID NO: 694462 - DNA, 20 bp, Artificial
  CRISPR gRNA sequence
cccagacgcggaggttgggg

SEQ ID NO: 694463 - DNA, 20 bp, Artificial
  CRISPR gRNA sequence
ccagacgcggaggttggggt

SEQ ID NO: 694464 - DNA, 20 bp, Artificial
  CRISPR gRNA sequence
gggtcatggcgccccgaagc

SEQ ID NO: 694465 - DNA, 20 bp, Artificial
  CRISPR gRNA sequence
ctcctgctgctctcaggggc

SEQ ID NO: 694466 - DNA, 20 bp, Artificial
  CRISPR gRNA sequence
ctgctgctctcaggggccct

SEQ ID NO: 694467 - DNA, 20 bp, Artificial
  CRISPR gRNA sequence
ctgctctcaggggccctggc

SEQ ID NO: 694468 - DNA, 20 bp, Artificial
  CRISPR gRNA sequence
ctctcaggggccctggccct

SEQ ID NO: 694469 - DNA, 20 bp, Artificial
  CRISPR gRNA sequence
tcaggggccctggccctgac

SEQ ID NO: 694470 - DNA, 20 bp, Artificial
  CRISPR gRNA sequence
aggggccctggccctgaccg

SEQ ID NO: 694471 - DNA, 20 bp, Artificial
  CRISPR gRNA sequence
gccctgaccgatacttgggc

SEQ ID NO: 694472 - DNA, 20 bp, Artificial
  CRISPR gRNA sequence
accgatacttgggcgggtga

SEQ ID NO: 694473 - DNA, 20 bp, Artificial
  CRISPR gRNA sequence
gggcgggtgagtgcggggtc

SEQ ID NO: 694474 - DNA, 20 bp, Artificial
  CRISPR gRNA sequence
ggcgggtgagtgcggggtcc

SEQ ID NO: 694475 - DNA, 20 bp, Artificial
  CRISPR gRNA sequence
tgtggggaggagtgaggggc

SEQ ID NO: 694476 - DNA, 20 bp, Artificial
  CRISPR gRNA sequence
tggggaggagtgaggggccc

SEQ ID NO: 694477 - DNA, 20 bp, Artificial
  CRISPR gRNA sequence
agggagccgcgcccggagga

SEQ ID NO: 694478 - DNA, 20 bp, Artificial
  CRISPR gRNA sequence
gcgggtctcagcccctcctc

SEQ ID NO: 694479 - DNA, 20 bp, Artificial
  CRISPR gRNA sequence
agcccctcctcgcccccagg

SEQ ID NO: 694480 - DNA, 20 bp, Artificial
  CRISPR gRNA sequence
ctcgcccccaggctcccact

SEQ ID NO: 694481 - DNA, 20 bp, Artificial
  CRISPR gRNA sequence
gcccccaggctcccactcct

SEQ ID NO: 694482 - DNA, 20 bp, Artificial
  CRISPR gRNA sequence
ccactccttgaggtatttca

SEQ ID NO: 694483 - DNA, 20 bp, Artificial
  CRISPR gRNA sequence
cttgaggtatttcagcaccg

SEQ ID NO: 694484 - DNA, 20 bp, Artificial
  CRISPR gRNA sequence
gaggtatttcagcaccgctg

SEQ ID NO: 694485 - DNA, 20 bp, Artificial
  CRISPR gRNA sequence
aggtatttcagcaccgctgt

SEQ ID NO: 694486 - DNA, 20 bp, Artificial
  CRISPR gRNA sequence
cagcaccgctgtgtcgcggc

SEQ ID NO: 694487 - DNA, 20 bp, Artificial
  CRISPR gRNA sequence
agcaccgctgtgtcgcggcc

SEQ ID NO: 694488 - DNA, 20 bp, Artificial
  CRISPR gRNA sequence
tgtcgcggcccggccgcggg

SEQ ID NO: 694489 - DNA, 20 bp, Artificial
  CRISPR gRNA sequence
catcgccgtggagtacgtag

SEQ ID NO: 694490 - DNA, 20 bp, Artificial
  CRISPR gRNA sequence
ctgcggttcgacagcgacgc

SEQ ID NO: 694491 - DNA, 20 bp, Artificial
  CRISPR gRNA sequence
cggttcgacagcgacgccgc

SEQ ID NO: 694492 - DNA, 20 bp, Artificial
  CRISPR gRNA sequence
gacagcgacgccgcgattcc

SEQ ID NO: 694493 - DNA, 20 bp, Artificial
  CRISPR gRNA sequence
cgaggatggagccgcgggag

SEQ ID NO: 694494 - DNA, 20 bp, Artificial
  CRISPR gRNA sequence
ggagtggaccacagggtacg

SEQ ID NO: 694495 - DNA, 20 bp, Artificial
  CRISPR gRNA sequence
accgagtggccctgaggaac

SEQ ID NO: 694496 - DNA, 20 bp, Artificial
  CRISPR gRNA sequence
aggaacctgctccgccgcta

SEQ ID NO: 694497 - DNA, 20 bp, Artificial
  CRISPR gRNA sequence
ctccgccgctacaaccagag

SEQ ID NO: 694498 - DNA, 20 bp, Artificial
  CRISPR gRNA sequence
cgccgctacaaccagagcga

SEQ ID NO: 694499 - DNA, 20 bp, Artificial
  CRISPR gRNA sequence
caaccagagcgaggctggtg

SEQ ID NO: 694500 - DNA, 20 bp, Artificial
  CRISPR gRNA sequence
gtgagtgaacccggccgggg

SEQ ID NO: 694501 - DNA, 20 bp, Artificial
  CRISPR gRNA sequence
cggatccgaaatctaccccg

SEQ ID NO: 694502 - DNA, 20 bp, Artificial
  CRISPR gRNA sequence
ccccgaggcagcgggacccg

SEQ ID NO: 694503 - DNA, 20 bp, Artificial
  CRISPR gRNA sequence
cacccgggagagtcccaggc

SEQ ID NO: 694504 - DNA, 20 bp, Artificial
  CRISPR gRNA sequence
taccgaggttcattttcagt

SEQ ID NO: 694505 - DNA, 20 bp, Artificial
  CRISPR gRNA sequence
accgaggttcattttcagtt

SEQ ID NO: 694506 - DNA, 20 bp, Artificial
  CRISPR gRNA sequence
ccgaggttcattttcagttt

SEQ ID NO: 694507 - DNA, 20 bp, Artificial
  CRISPR gRNA sequence
attttcagtttaggccaaaa

SEQ ID NO: 694508 - DNA, 20 bp, Artificial
  CRISPR gRNA sequence
tcagtttaggccaaaatccc

SEQ ID NO: 694509 - DNA, 20 bp, Artificial
  CRISPR gRNA sequence
cagtttaggccaaaatcccc

SEQ ID NO: 694510 - DNA, 20 bp, Artificial
  CRISPR gRNA sequence
agtttaggccaaaatccccg

SEQ ID NO: 694511 - DNA, 20 bp, Artificial
  CRISPR gRNA sequence
aggccaaaatccccgcgggt

SEQ ID NO: 694512 - DNA, 20 bp, Artificial
  CRISPR gRNA sequence
ggccaaaatccccgcgggtt

SEQ ID NO: 694513 - DNA, 20 bp, Artificial
  CRISPR gRNA sequence
ggcggggagggggcggggct

SEQ ID NO: 694514 - DNA, 20 bp, Artificial
  CRISPR gRNA sequence
gctgggcggggctgactgcg

SEQ ID NO: 694515 - DNA, 20 bp, Artificial
  CRISPR gRNA sequence
ggcggggctgactgcgggga

SEQ ID NO: 694516 - DNA, 20 bp, Artificial
  CRISPR gRNA sequence
actgcggggaccggctaggg

SEQ ID NO: 694517 - DNA, 20 bp, Artificial
  CRISPR gRNA sequence
cggggaccggctagggtctc

SEQ ID NO: 694518 - DNA, 20 bp, Artificial
  CRISPR gRNA sequence
gggtctcacaccctccaggg

SEQ ID NO: 694519 - DNA, 20 bp, Artificial
  CRISPR gRNA sequence
acaccctccagggaatgaat

SEQ ID NO: 694520 - DNA, 20 bp, Artificial
  CRISPR gRNA sequence
cagggaatgaatggctgcga

SEQ ID NO: 694521 - DNA, 20 bp, Artificial
  CRISPR gRNA sequence
cgacatggggcccgacggac

SEQ ID NO: 694522 - DNA, 20 bp, Artificial
  CRISPR gRNA sequence
ctccgcgggtatcaccagca

SEQ ID NO: 694523 - DNA, 20 bp, Artificial
  CRISPR gRNA sequence
cgcgggtatcaccagcacgc

SEQ ID NO: 694524 - DNA, 20 bp, Artificial
  CRISPR gRNA sequence
catctccctgaacgaggacc

SEQ ID NO: 694525 - DNA, 20 bp, Artificial
  CRISPR gRNA sequence
cctgaacgaggacctgcgct

SEQ ID NO: 694526 - DNA, 20 bp, Artificial
  CRISPR gRNA sequence
aacgaggacctgcgctcctg

SEQ ID NO: 694527 - DNA, 20 bp, Artificial
  CRISPR gRNA sequence
cgctcctggaccgcggcgga

SEQ ID NO: 694528 - DNA, 20 bp, Artificial
  CRISPR gRNA sequence
ctggaccgcggcggacaccg

SEQ ID NO: 694529 - DNA, 20 bp, Artificial
  CRISPR gRNA sequence
gaccgcggcggacaccgtgg

SEQ ID NO: 694530 - DNA, 20 bp, Artificial
  CRISPR gRNA sequence
agatcacccagcgcttctat

SEQ ID NO: 694531 - DNA, 20 bp, Artificial
  CRISPR gRNA sequence
ctatgaggcagaggaatatg

SEQ ID NO: 694532 - DNA, 20 bp, Artificial
  CRISPR gRNA sequence
tatgaggcagaggaatatgc

SEQ ID NO: 694533 - DNA, 20 bp, Artificial
  CRISPR gRNA sequence
tgaggcagaggaatatgcag

SEQ ID NO: 694534 - DNA, 20 bp, Artificial
  CRISPR gRNA sequence
aggacctacctggagggcga

SEQ ID NO: 694535 - DNA, 20 bp, Artificial
  CRISPR gRNA sequence
cctggagggcgagtgcctgg

SEQ ID NO: 694536 - DNA, 20 bp, Artificial
  CRISPR gRNA sequence
gagggcgagtgcctggagtt

SEQ ID NO: 694537 - DNA, 20 bp, Artificial
  CRISPR gRNA sequence
gagttgctccgcagatactt

SEQ ID NO: 694538 - DNA, 20 bp, Artificial
  CRISPR gRNA sequence
ctccgcagatacttggagaa

SEQ ID NO: 694539 - DNA, 20 bp, Artificial
  CRISPR gRNA sequence
cgcagatacttggagaatgg

SEQ ID NO: 694540 - DNA, 20 bp, Artificial
  CRISPR gRNA sequence
ggagaatgggaaggagacgc

SEQ ID NO: 694541 - DNA, 20 bp, Artificial
  CRISPR gRNA sequence
gagaatgggaaggagacgct

SEQ ID NO: 694542 - DNA, 20 bp, Artificial
  CRISPR gRNA sequence
cagcgcgcaggtaccagggg

SEQ ID NO: 694543 - DNA, 20 bp, Artificial
  CRISPR gRNA sequence
ccctatctcctgtagatctc

SEQ ID NO: 694544 - DNA, 20 bp, Artificial
  CRISPR gRNA sequence
cctatctcctgtagatctct

SEQ ID NO: 694545 - DNA, 20 bp, Artificial
  CRISPR gRNA sequence
tctcctgtagatctcttggg

SEQ ID NO: 694546 - DNA, 20 bp, Artificial
  CRISPR gRNA sequence
ctgtagatctcttgggatgg

SEQ ID NO: 694547 - DNA, 20 bp, Artificial
  CRISPR gRNA sequence
tagatctcttgggatggcct

SEQ ID NO: 694548 - DNA, 20 bp, Artificial
  CRISPR gRNA sequence
ttgggatggcctcgcacaag

SEQ ID NO: 694549 - DNA, 20 bp, Artificial
  CRISPR gRNA sequence
gggatggcctcgcacaaggt

SEQ ID NO: 694550 - DNA, 20 bp, Artificial
  CRISPR gRNA sequence
ggatggcctcgcacaaggtt

SEQ ID NO: 694551 - DNA, 20 bp, Artificial
  CRISPR gRNA sequence
gcacaaggttgggaggaaag

SEQ ID NO: 694552 - DNA, 20 bp, Artificial
  CRISPR gRNA sequence
ggaggaaagtgggcccaatg

SEQ ID NO: 694553 - DNA, 20 bp, Artificial
  CRISPR gRNA sequence
ggatatcgccctccctctag

SEQ ID NO: 694554 - DNA, 20 bp, Artificial
  CRISPR gRNA sequence
cctctagtcctgagtaggaa

SEQ ID NO: 694555 - DNA, 20 bp, Artificial
  CRISPR gRNA sequence
tagtcctgagtaggaagaat

SEQ ID NO: 694556 - DNA, 20 bp, Artificial
  CRISPR gRNA sequence
gtcctgagtaggaagaatct

SEQ ID NO: 694557 - DNA, 20 bp, Artificial
  CRISPR gRNA sequence
agtaggaagaatcttcctgg

SEQ ID NO: 694558 - DNA, 20 bp, Artificial
  CRISPR gRNA sequence
cctggctttcgagatccggt

SEQ ID NO: 694559 - DNA, 20 bp, Artificial
  CRISPR gRNA sequence
ctggctttcgagatccggta

SEQ ID NO: 694560 - DNA, 20 bp, Artificial
  CRISPR gRNA sequence
gctttcgagatccggtacca

SEQ ID NO: 694561 - DNA, 20 bp, Artificial
  CRISPR gRNA sequence
tcgagatccggtaccagaga

SEQ ID NO: 694562 - DNA, 20 bp, Artificial
  CRISPR gRNA sequence
cgagatccggtaccagagag

SEQ ID NO: 694563 - DNA, 20 bp, Artificial
  CRISPR gRNA sequence
gagatccggtaccagagagt

SEQ ID NO: 694564 - DNA, 20 bp, Artificial
  CRISPR gRNA sequence
tgagagtccgccctgctctc

SEQ ID NO: 694565 - DNA, 20 bp, Artificial
  CRISPR gRNA sequence
ctctctgggacaattaaggg

SEQ ID NO: 694566 - DNA, 20 bp, Artificial
  CRISPR gRNA sequence
tctgggacaattaagggatg

SEQ ID NO: 694567 - DNA, 20 bp, Artificial
  CRISPR gRNA sequence
tgggacaattaagggatgaa

SEQ ID NO: 694568 - DNA, 20 bp, Artificial
  CRISPR gRNA sequence
ggacaattaagggatgaaat

SEQ ID NO: 694569 - DNA, 20 bp, Artificial
  CRISPR gRNA sequence
agggatgaaatctctgaggg

SEQ ID NO: 694570 - DNA, 20 bp, Artificial
  CRISPR gRNA sequence
tgagggaatggagggaagac

SEQ ID NO: 694571 - DNA, 20 bp, Artificial
  CRISPR gRNA sequence
agggaatggagggaagacag

SEQ ID NO: 694572 - DNA, 20 bp, Artificial
  CRISPR gRNA sequence
gaataccgatccgcggtccc

SEQ ID NO: 694573 - DNA, 20 bp, Artificial
  CRISPR gRNA sequence
tgagccctccaacagccttg

SEQ ID NO: 694574 - DNA, 20 bp, Artificial
  CRISPR gRNA sequence
gagccctccaacagccttgg

SEQ ID NO: 694575 - DNA, 20 bp, Artificial
  CRISPR gRNA sequence
agccctccaacagccttggg

SEQ ID NO: 694576 - DNA, 20 bp, Artificial
  CRISPR gRNA sequence
caacagccttgggccccgtg

SEQ ID NO: 694577 - DNA, 20 bp, Artificial
  CRISPR gRNA sequence
gggccccgtgacttttctct

SEQ ID NO: 694578 - DNA, 20 bp, Artificial
  CRISPR gRNA sequence
ggccccgtgacttttctctc

SEQ ID NO: 694579 - DNA, 20 bp, Artificial
  CRISPR gRNA sequence
ttctctcaagttttgttctc

SEQ ID NO: 694580 - DNA, 20 bp, Artificial
  CRISPR gRNA sequence
tctctcaagttttgttctct

SEQ ID NO: 694581 - DNA, 20 bp, Artificial
  CRISPR gRNA sequence
ctctcaagttttgttctctg

SEQ ID NO: 694582 - DNA, 20 bp, Artificial
  CRISPR gRNA sequence
tctcaagttttgttctctgc

SEQ ID NO: 694583 - DNA, 20 bp, Artificial
  CRISPR gRNA sequence
tcaagttttgttctctgcct

SEQ ID NO: 694584 - DNA, 20 bp, Artificial
  CRISPR gRNA sequence
aagttttgttctctgcctca

SEQ ID NO: 694585 - DNA, 20 bp, Artificial
  CRISPR gRNA sequence
tgttctctgcctcacactca

SEQ ID NO: 694586 - DNA, 20 bp, Artificial
  CRISPR gRNA sequence
gttctctgcctcacactcaa

SEQ ID NO: 694587 - DNA, 20 bp, Artificial
  CRISPR gRNA sequence
ttctctgcctcacactcaat

SEQ ID NO: 694588 - DNA, 20 bp, Artificial
  CRISPR gRNA sequence
tctgcctcacactcaatgtg

SEQ ID NO: 694589 - DNA, 20 bp, Artificial
  CRISPR gRNA sequence
tgcctcacactcaatgtgtt

SEQ ID NO: 694590 - DNA, 20 bp, Artificial
  CRISPR gRNA sequence
cctcacactcaatgtgtttg

SEQ ID NO: 694591 - DNA, 20 bp, Artificial
  CRISPR gRNA sequence
acactcaatgtgtttggggc

SEQ ID NO: 694592 - DNA, 20 bp, Artificial
  CRISPR gRNA sequence
aatgtgtttggggctctgat

SEQ ID NO: 694593 - DNA, 20 bp, Artificial
  CRISPR gRNA sequence
ggggctctgattccagtccc

SEQ ID NO: 694594 - DNA, 20 bp, Artificial
  CRISPR gRNA sequence
gggctctgattccagtccct

SEQ ID NO: 694595 - DNA, 20 bp, Artificial
  CRISPR gRNA sequence
tgattccagtccctcggcct

SEQ ID NO: 694596 - DNA, 20 bp, Artificial
  CRISPR gRNA sequence
attccagtccctcggcctcc

SEQ ID NO: 694597 - DNA, 20 bp, Artificial
  CRISPR gRNA sequence
cagtccctcggcctccactt

SEQ ID NO: 694598 - DNA, 20 bp, Artificial
  CRISPR gRNA sequence
ggcctccacttaggtcaggg

SEQ ID NO: 694599 - DNA, 20 bp, Artificial
  CRISPR gRNA sequence
cacttaggtcagggccagaa

SEQ ID NO: 694600 - DNA, 20 bp, Artificial
  CRISPR gRNA sequence
aggtcagggccagaagtccc

SEQ ID NO: 694601 - DNA, 20 bp, Artificial
  CRISPR gRNA sequence
ggtcagggccagaagtccct

SEQ ID NO: 694602 - DNA, 20 bp, Artificial
  CRISPR gRNA sequence
ctccccactcagagactcga

SEQ ID NO: 694603 - DNA, 20 bp, Artificial
  CRISPR gRNA sequence
cccactcagagactcgaact

SEQ ID NO: 694604 - DNA, 20 bp, Artificial
  CRISPR gRNA sequence
agagactcgaactttccaag

SEQ ID NO: 694605 - DNA, 20 bp, Artificial
  CRISPR gRNA sequence
gaactttccaaggaatagga

SEQ ID NO: 694606 - DNA, 20 bp, Artificial
  CRISPR gRNA sequence
tccaaggaataggagatttt

SEQ ID NO: 694607 - DNA, 20 bp, Artificial
  CRISPR gRNA sequence
ccaaggaataggagattttc

SEQ ID NO: 694608 - DNA, 20 bp, Artificial
  CRISPR gRNA sequence
caaggaataggagattttcc

SEQ ID NO: 694609 - DNA, 20 bp, Artificial
  CRISPR gRNA sequence
tcccaggtgtctgtgtccag

SEQ ID NO: 694610 - DNA, 20 bp, Artificial
  CRISPR gRNA sequence
cccaggtgtctgtgtccagg

SEQ ID NO: 694611 - DNA, 20 bp, Artificial
  CRISPR gRNA sequence
ccaggtgtctgtgtccaggc

SEQ ID NO: 694612 - DNA, 20 bp, Artificial
  CRISPR gRNA sequence
tgtccaggctggtgtctggg

SEQ ID NO: 694613 - DNA, 20 bp, Artificial
  CRISPR gRNA sequence
gtgtctgggttctgtgctcc

SEQ ID NO: 694614 - DNA, 20 bp, Artificial
  CRISPR gRNA sequence
ggttctgtgctcccttcccc

SEQ ID NO: 694615 - DNA, 20 bp, Artificial
  CRISPR gRNA sequence
tgtgctcccttccccacccc

SEQ ID NO: 694616 - DNA, 20 bp, Artificial
  CRISPR gRNA sequence
tgctcccttccccaccccag

SEQ ID NO: 694617 - DNA, 20 bp, Artificial
  CRISPR gRNA sequence
ccttccccaccccaggtgtc

SEQ ID NO: 694618 - DNA, 20 bp, Artificial
  CRISPR gRNA sequence
ccccaccccaggtgtcctgt

SEQ ID NO: 694619 - DNA, 20 bp, Artificial
  CRISPR gRNA sequence
cccaccccaggtgtcctgtc

SEQ ID NO: 694620 - DNA, 20 bp, Artificial
  CRISPR gRNA sequence
tccattctcaggttggtcac

SEQ ID NO: 694621 - DNA, 20 bp, Artificial
  CRISPR gRNA sequence
tcaggttggtcacatgggtg

SEQ ID NO: 694622 - DNA, 20 bp, Artificial
  CRISPR gRNA sequence
aggttggtcacatgggtgct

SEQ ID NO: 694623 - DNA, 20 bp, Artificial
  CRISPR gRNA sequence
gtcacatgggtgctgctggg

SEQ ID NO: 694624 - DNA, 20 bp, Artificial
  CRISPR gRNA sequence
ctggggtttcccatgaggag

SEQ ID NO: 694625 - DNA, 20 bp, Artificial
  CRISPR gRNA sequence
gggtttcccatgaggagtgc

SEQ ID NO: 694626 - DNA, 20 bp, Artificial
  CRISPR gRNA sequence
cccatgaggagtgcaaagtg

SEQ ID NO: 694627 - DNA, 20 bp, Artificial
  CRISPR gRNA sequence
ccatgaggagtgcaaagtgc

SEQ ID NO: 694628 - DNA, 20 bp, Artificial
  CRISPR gRNA sequence
aattttctgactcttctcag

SEQ ID NO: 694629 - DNA, 20 bp, Artificial
  CRISPR gRNA sequence
tctgactcttctcagatcct

SEQ ID NO: 694630 - DNA, 20 bp, Artificial
  CRISPR gRNA sequence
ctgactcttctcagatcctc

SEQ ID NO: 694631 - DNA, 20 bp, Artificial
  CRISPR gRNA sequence
tgactcttctcagatcctcc

SEQ ID NO: 694632 - DNA, 20 bp, Artificial
  CRISPR gRNA sequence
actcttctcagatcctccaa

SEQ ID NO: 694633 - DNA, 20 bp, Artificial
  CRISPR gRNA sequence
ttctcagatcctccaaaggc

SEQ ID NO: 694634 - DNA, 20 bp, Artificial
  CRISPR gRNA sequence
ctcagatcctccaaaggcac

SEQ ID NO: 694635 - DNA, 20 bp, Artificial
  CRISPR gRNA sequence
tcagatcctccaaaggcaca

SEQ ID NO: 694636 - DNA, 20 bp, Artificial
  CRISPR gRNA sequence
agatcctccaaaggcacacg

SEQ ID NO: 694637 - DNA, 20 bp, Artificial
  CRISPR gRNA sequence
caaaggcacacgttgcccac

SEQ ID NO: 694638 - DNA, 20 bp, Artificial
  CRISPR gRNA sequence
cccaccaccccatctctgac

SEQ ID NO: 694639 - DNA, 20 bp, Artificial
  CRISPR gRNA sequence
tgaccatgaggccaccctga

SEQ ID NO: 694640 - DNA, 20 bp, Artificial
  CRISPR gRNA sequence
accatgaggccaccctgagg

SEQ ID NO: 694641 - DNA, 20 bp, Artificial
  CRISPR gRNA sequence
aggtgctgggccctgggctt

SEQ ID NO: 694642 - DNA, 20 bp, Artificial
  CRISPR gRNA sequence
ggccctgggcttctaccctg

SEQ ID NO: 694643 - DNA, 20 bp, Artificial
  CRISPR gRNA sequence
ggcttctaccctgcggagat

SEQ ID NO: 694644 - DNA, 20 bp, Artificial
  CRISPR gRNA sequence
ctaccctgcggagatcacgc

SEQ ID NO: 694645 - DNA, 20 bp, Artificial
  CRISPR gRNA sequence
taccctgcggagatcacgct

SEQ ID NO: 694646 - DNA, 20 bp, Artificial
  CRISPR gRNA sequence
ccctgcggagatcacgctga

SEQ ID NO: 694647 - DNA, 20 bp, Artificial
  CRISPR gRNA sequence
cggagatcacgctgacctgg

SEQ ID NO: 694648 - DNA, 20 bp, Artificial
  CRISPR gRNA sequence
acctggcagcgggatgggga

SEQ ID NO: 694649 - DNA, 20 bp, Artificial
  CRISPR gRNA sequence
gcagcgggatggggaggaac

SEQ ID NO: 694650 - DNA, 20 bp, Artificial
  CRISPR gRNA sequence
gtggagaccaggcctgcagg

SEQ ID NO: 694651 - DNA, 20 bp, Artificial
  CRISPR gRNA sequence
tggagaccaggcctgcaggg

SEQ ID NO: 694652 - DNA, 20 bp, Artificial
  CRISPR gRNA sequence
caggggatggaaccttccag

SEQ ID NO: 694653 - DNA, 20 bp, Artificial
  CRISPR gRNA sequence
ccagaagtgggccgctgtgg

SEQ ID NO: 694654 - DNA, 20 bp, Artificial
  CRISPR gRNA sequence
cagaagtgggccgctgtggt

SEQ ID NO: 694655 - DNA, 20 bp, Artificial
  CRISPR gRNA sequence
tggtggtgccttctggagag

SEQ ID NO: 694656 - DNA, 20 bp, Artificial
  CRISPR gRNA sequence
ctggagaggaacagagatac

SEQ ID NO: 694657 - DNA, 20 bp, Artificial
  CRISPR gRNA sequence
tggagaggaacagagataca

SEQ ID NO: 694658 - DNA, 20 bp, Artificial
  CRISPR gRNA sequence
gagaggaacagagatacaca

SEQ ID NO: 694659 - DNA, 20 bp, Artificial
  CRISPR gRNA sequence
ccccagcccctcatcctgag

SEQ ID NO: 694660 - DNA, 20 bp, Artificial
  CRISPR gRNA sequence
atcctgagatggggtaagga

SEQ ID NO: 694661 - DNA, 20 bp, Artificial
  CRISPR gRNA sequence
agatggggtaaggagggaga

SEQ ID NO: 694662 - DNA, 20 bp, Artificial
  CRISPR gRNA sequence
ttctcagggaaagcaggagc

SEQ ID NO: 694663 - DNA, 20 bp, Artificial
  CRISPR gRNA sequence
tctcagggaaagcaggagcc

SEQ ID NO: 694664 - DNA, 20 bp, Artificial
  CRISPR gRNA sequence
ctcagggaaagcaggagccc

SEQ ID NO: 694665 - DNA, 20 bp, Artificial
  CRISPR gRNA sequence
tcagggaaagcaggagccct

SEQ ID NO: 694666 - DNA, 20 bp, Artificial
  CRISPR gRNA sequence
agggaaagcaggagcccttc

SEQ ID NO: 694667 - DNA, 20 bp, Artificial
  CRISPR gRNA sequence
ctggagctcttcagcagggt

SEQ ID NO: 694668 - DNA, 20 bp, Artificial
  CRISPR gRNA sequence
tggagctcttcagcagggtc

SEQ ID NO: 694669 - DNA, 20 bp, Artificial
  CRISPR gRNA sequence
gagctcttcagcagggtcag

SEQ ID NO: 694670 - DNA, 20 bp, Artificial
  CRISPR gRNA sequence
ttcagcagggtcagggctga

SEQ ID NO: 694671 - DNA, 20 bp, Artificial
  CRISPR gRNA sequence
cagcagggtcagggctgagg

SEQ ID NO: 694672 - DNA, 20 bp, Artificial
  CRISPR gRNA sequence
agcagggtcagggctgaggc

SEQ ID NO: 694673 - DNA, 20 bp, Artificial
  CRISPR gRNA sequence
aggcctggagatcagggccc

SEQ ID NO: 694674 - DNA, 20 bp, Artificial
  CRISPR gRNA sequence
gagatcagggcccctcacct

SEQ ID NO: 694675 - DNA, 20 bp, Artificial
  CRISPR gRNA sequence
accttcccttcctttcccag

SEQ ID NO: 694676 - DNA, 20 bp, Artificial
  CRISPR gRNA sequence
cccttcctttcccagagcag

SEQ ID NO: 694677 - DNA, 20 bp, Artificial
  CRISPR gRNA sequence
ccttcctttcccagagcagt

SEQ ID NO: 694678 - DNA, 20 bp, Artificial
  CRISPR gRNA sequence
cctttcccagagcagtctcc

SEQ ID NO: 694679 - DNA, 20 bp, Artificial
  CRISPR gRNA sequence
ctttcccagagcagtctccc

SEQ ID NO: 694680 - DNA, 20 bp, Artificial
  CRISPR gRNA sequence
tcccagagcagtctccccag

SEQ ID NO: 694681 - DNA, 20 bp, Artificial
  CRISPR gRNA sequence
cccagagcagtctccccagc

SEQ ID NO: 694682 - DNA, 20 bp, Artificial
  CRISPR gRNA sequence
ccagagcagtctccccagcc

SEQ ID NO: 694683 - DNA, 20 bp, Artificial
  CRISPR gRNA sequence
cccagcccaccatccccatc

SEQ ID NO: 694684 - DNA, 20 bp, Artificial
  CRISPR gRNA sequence
ctggccttgttgtccttgga

SEQ ID NO: 694685 - DNA, 20 bp, Artificial
  CRISPR gRNA sequence
gccttgttgtccttggagct

SEQ ID NO: 694686 - DNA, 20 bp, Artificial
  CRISPR gRNA sequence
gttgtccttggagctgtggt

SEQ ID NO: 694687 - DNA, 20 bp, Artificial
  CRISPR gRNA sequence
ttgtccttggagctgtggtc

SEQ ID NO: 694688 - DNA, 20 bp, Artificial
  CRISPR gRNA sequence
tccttggagctgtggtcact

SEQ ID NO: 694689 - DNA, 20 bp, Artificial
  CRISPR gRNA sequence
ggagctgtggtcactggagc

SEQ ID NO: 694690 - DNA, 20 bp, Artificial
  CRISPR gRNA sequence
gagctgtggtcactggagct

SEQ ID NO: 694691 - DNA, 20 bp, Artificial
  CRISPR gRNA sequence
tggtcactggagctgtggtc

SEQ ID NO: 694692 - DNA, 20 bp, Artificial
  CRISPR gRNA sequence
gagctgtggtcgctgctgtg

SEQ ID NO: 694693 - DNA, 20 bp, Artificial
  CRISPR gRNA sequence
tggtcgctgctgtgatgtgg

SEQ ID NO: 694694 - DNA, 20 bp, Artificial
  CRISPR gRNA sequence
ctgtgatgtggaggaagaag

SEQ ID NO: 694695 - DNA, 20 bp, Artificial
  CRISPR gRNA sequence
tgatgtggaggaagaagagc

SEQ ID NO: 694696 - DNA, 20 bp, Artificial
  CRISPR gRNA sequence
aggtaggaaggggtgaggag

SEQ ID NO: 694697 - DNA, 20 bp, Artificial
  CRISPR gRNA sequence
agttttcttgtcccactggg

SEQ ID NO: 694698 - DNA, 20 bp, Artificial
  CRISPR gRNA sequence
tcttgtcccactgggggttg

SEQ ID NO: 694699 - DNA, 20 bp, Artificial
  CRISPR gRNA sequence
cttgtcccactgggggttgc

SEQ ID NO: 694700 - DNA, 20 bp, Artificial
  CRISPR gRNA sequence
ttgtcccactgggggttgca

SEQ ID NO: 694701 - DNA, 20 bp, Artificial
  CRISPR gRNA sequence
gtcccactgggggttgcaag

SEQ ID NO: 694702 - DNA, 20 bp, Artificial
  CRISPR gRNA sequence
tcccactgggggttgcaagc

SEQ ID NO: 694703 - DNA, 20 bp, Artificial
  CRISPR gRNA sequence
ggggttgcaagccccaagta

SEQ ID NO: 694704 - DNA, 20 bp, Artificial
  CRISPR gRNA sequence
caagccccaagtagaagtgt

SEQ ID NO: 694705 - DNA, 20 bp, Artificial
  CRISPR gRNA sequence
cctcattactgggaagcacc

SEQ ID NO: 694706 - DNA, 20 bp, Artificial
  CRISPR gRNA sequence
attactgggaagcaccatcc

SEQ ID NO: 694707 - DNA, 20 bp, Artificial
  CRISPR gRNA sequence
ctgggaagcaccatccacac

SEQ ID NO: 694708 - DNA, 20 bp, Artificial
  CRISPR gRNA sequence
ggaagcaccatccacactca

SEQ ID NO: 694709 - DNA, 20 bp, Artificial
  CRISPR gRNA sequence
atgggtctacccagcctggg

SEQ ID NO: 694710 - DNA, 20 bp, Artificial
  CRISPR gRNA sequence
cccagcctgggccctgtgtg

SEQ ID NO: 694711 - DNA, 20 bp, Artificial
  CRISPR gRNA sequence
ggccctgtgtgccagcacct

SEQ ID NO: 694712 - DNA, 20 bp, Artificial
  CRISPR gRNA sequence
tgtgccagcacctactcatt

SEQ ID NO: 694713 - DNA, 20 bp, Artificial
  CRISPR gRNA sequence
ctcatttgtaaagctcctgt

SEQ ID NO: 694714 - DNA, 20 bp, Artificial
  CRISPR gRNA sequence
atttgtaaagctcctgtgaa

SEQ ID NO: 694715 - DNA, 20 bp, Artificial
  CRISPR gRNA sequence
gtaaagctcctgtgaaaatg

SEQ ID NO: 694716 - DNA, 20 bp, Artificial
  CRISPR gRNA sequence
taaagctcctgtgaaaatga

SEQ ID NO: 694717 - DNA, 20 bp, Artificial
  CRISPR gRNA sequence
ctgtgaaaatgaaggacaga

SEQ ID NO: 694718 - DNA, 20 bp, Artificial
  CRISPR gRNA sequence
tgaaaatgaaggacagattc

SEQ ID NO: 694719 - DNA, 20 bp, Artificial
  CRISPR gRNA sequence
ttcacttcgatgattatggt

SEQ ID NO: 694720 - DNA, 20 bp, Artificial
  CRISPR gRNA sequence
cacttcgatgattatggtgg

SEQ ID NO: 694721 - DNA, 20 bp, Artificial
  CRISPR gRNA sequence
acttcgatgattatggtggt

SEQ ID NO: 694722 - DNA, 20 bp, Artificial
  CRISPR gRNA sequence
cgatgattatggtggtgatg

SEQ ID NO: 694723 - DNA, 20 bp, Artificial
  CRISPR gRNA sequence
gatgattatggtggtgatgg

SEQ ID NO: 694724 - DNA, 20 bp, Artificial
  CRISPR gRNA sequence
tggtggtgatgggacctgat

SEQ ID NO: 694725 - DNA, 20 bp, Artificial
  CRISPR gRNA sequence
atcccagcagtcacaaatca

SEQ ID NO: 694726 - DNA, 20 bp, Artificial
  CRISPR gRNA sequence
ctgatgacagacctcaggag

SEQ ID NO: 694727 - DNA, 20 bp, Artificial
  CRISPR gRNA sequence
atgacagacctcaggagggc

SEQ ID NO: 694728 - DNA, 20 bp, Artificial
  CRISPR gRNA sequence
aggagggcagttggtccagg

SEQ ID NO: 694729 - DNA, 20 bp, Artificial
  CRISPR gRNA sequence
gtccaggacccacatctgct

SEQ ID NO: 694730 - DNA, 20 bp, Artificial
  CRISPR gRNA sequence
ctttcttcatatttcttgat

SEQ ID NO: 694731 - DNA, 20 bp, Artificial
  CRISPR gRNA sequence
tcttcatatttcttgatcct

SEQ ID NO: 694732 - DNA, 20 bp, Artificial
  CRISPR gRNA sequence
cttcatatttcttgatcctg

SEQ ID NO: 694733 - DNA, 20 bp, Artificial
  CRISPR gRNA sequence
ttcatatttcttgatcctgc

SEQ ID NO: 694734 - DNA, 20 bp, Artificial
  CRISPR gRNA sequence
catatttcttgatcctgccc

SEQ ID NO: 694735 - DNA, 20 bp, Artificial
  CRISPR gRNA sequence
atatttcttgatcctgccct

SEQ ID NO: 694736 - DNA, 20 bp, Artificial
  CRISPR gRNA sequence
cttgatcctgccctggatct

SEQ ID NO: 694737 - DNA, 20 bp, Artificial
  CRISPR gRNA sequence
ttgatcctgccctggatcta

SEQ ID NO: 694738 - DNA, 20 bp, Artificial
  CRISPR gRNA sequence
gatcctgccctggatctaca

SEQ ID NO: 694739 - DNA, 20 bp, Artificial
  CRISPR gRNA sequence
atcctgccctggatctacag

SEQ ID NO: 694740 - DNA, 20 bp, Artificial
  CRISPR gRNA sequence
ccctggatctacagttacac

SEQ ID NO: 694741 - DNA, 20 bp, Artificial
  CRISPR gRNA sequence
gatctacagttacacttttc

SEQ ID NO: 694742 - DNA, 20 bp, Artificial
  CRISPR gRNA sequence
cagttacacttttctggaaa

SEQ ID NO: 694743 - DNA, 20 bp, Artificial
  CRISPR gRNA sequence
cacttttctggaaacttctc

SEQ ID NO: 694744 - DNA, 20 bp, Artificial
  CRISPR gRNA sequence
ttctggaaacttctctggga

SEQ ID NO: 694745 - DNA, 20 bp, Artificial
  CRISPR gRNA sequence
tctggaaacttctctgggat

SEQ ID NO: 694746 - DNA, 20 bp, Artificial
  CRISPR gRNA sequence
ctggaaacttctctgggatc

SEQ ID NO: 694747 - DNA, 20 bp, Artificial
  CRISPR gRNA sequence
tggaaacttctctgggatca

SEQ ID NO: 694748 - DNA, 20 bp, Artificial
  CRISPR gRNA sequence
gaaacttctctgggatcaaa

SEQ ID NO: 694749 - DNA, 20 bp, Artificial
  CRISPR gRNA sequence
ctctgggatcaaagactagg

SEQ ID NO: 694750 - DNA, 20 bp, Artificial
  CRISPR gRNA sequence
tctgggatcaaagactaggg

SEQ ID NO: 694751 - DNA, 20 bp, Artificial
  CRISPR gRNA sequence
tgggatcaaagactaggggt

SEQ ID NO: 694752 - DNA, 20 bp, Artificial
  CRISPR gRNA sequence
ggatcaaagactaggggttt

SEQ ID NO: 694753 - DNA, 20 bp, Artificial
  CRISPR gRNA sequence
ggggtttgctctaggacctt

SEQ ID NO: 694754 - DNA, 20 bp, Artificial
  CRISPR gRNA sequence
gctctaggaccttatggccc

SEQ ID NO: 694755 - DNA, 20 bp, Artificial
  CRISPR gRNA sequence
ctctaggaccttatggccct

SEQ ID NO: 694756 - DNA, 20 bp, Artificial
  CRISPR gRNA sequence
taggaccttatggccctgcc

SEQ ID NO: 694757 - DNA, 20 bp, Artificial
  CRISPR gRNA sequence
ggaccttatggccctgcctc

SEQ ID NO: 694758 - DNA, 20 bp, Artificial
  CRISPR gRNA sequence
atggccctgcctcctttctg

SEQ ID NO: 694759 - DNA, 20 bp, Artificial
  CRISPR gRNA sequence
tggccctgcctcctttctgg

SEQ ID NO: 694760 - DNA, 20 bp, Artificial
  CRISPR gRNA sequence
cctcctttctggcctctcac

SEQ ID NO: 694761 - DNA, 20 bp, Artificial
  CRISPR gRNA sequence
ctttctggcctctcacagga

SEQ ID NO: 694762 - DNA, 20 bp, Artificial
  CRISPR gRNA sequence
tctggcctctcacaggacat

SEQ ID NO: 694763 - DNA, 20 bp, Artificial
  CRISPR gRNA sequence
ctggcctctcacaggacatt

SEQ ID NO: 694764 - DNA, 20 bp, Artificial
  CRISPR gRNA sequence
tggcctctcacaggacattt

SEQ ID NO: 694765 - DNA, 20 bp, Artificial
  CRISPR gRNA sequence
gcctctcacaggacattttc

SEQ ID NO: 694766 - DNA, 20 bp, Artificial
  CRISPR gRNA sequence
tcacaggacattttcttccc

SEQ ID NO: 694767 - DNA, 20 bp, Artificial
  CRISPR gRNA sequence
acaggacattttcttcccat

SEQ ID NO: 694768 - DNA, 20 bp, Artificial
  CRISPR gRNA sequence
tcttcccatagatagaaaca

SEQ ID NO: 694769 - DNA, 20 bp, Artificial
  CRISPR gRNA sequence
cttcccatagatagaaacag

SEQ ID NO: 694770 - DNA, 20 bp, Artificial
  CRISPR gRNA sequence
ttcccatagatagaaacaga

SEQ ID NO: 694771 - DNA, 20 bp, Artificial
  CRISPR gRNA sequence
cccatagatagaaacagagg

SEQ ID NO: 694772 - DNA, 20 bp, Artificial
  CRISPR gRNA sequence
ccatagatagaaacagaggg

SEQ ID NO: 694773 - DNA, 20 bp, Artificial
  CRISPR gRNA sequence
ctctcaggctgcaggtaaga

SEQ ID NO: 694774 - DNA, 20 bp, Artificial
  CRISPR gRNA sequence
tcaggctgcaggtaagatga

SEQ ID NO: 694775 - DNA, 20 bp, Artificial
  CRISPR gRNA sequence
aggctgcaggtaagatgaag

SEQ ID NO: 694776 - DNA, 20 bp, Artificial
  CRISPR gRNA sequence
caggtaagatgaaggaggct

SEQ ID NO: 694777 - DNA, 20 bp, Artificial
  CRISPR gRNA sequence
atccctgagattgttgggat

SEQ ID NO: 694778 - DNA, 20 bp, Artificial
  CRISPR gRNA sequence
agattgttgggatattgtgg

SEQ ID NO: 694779 - DNA, 20 bp, Artificial
  CRISPR gRNA sequence
ttgggatattgtggtcagga

SEQ ID NO: 694780 - DNA, 20 bp, Artificial
  CRISPR gRNA sequence
ggatattgtggtcaggagcc

SEQ ID NO: 694781 - DNA, 20 bp, Artificial
  CRISPR gRNA sequence
tggtcaggagcctatgaggg

SEQ ID NO: 694782 - DNA, 20 bp, Artificial
  CRISPR gRNA sequence
tgagggagctcacccacccc

SEQ ID NO: 694783 - DNA, 20 bp, Artificial
  CRISPR gRNA sequence
acccaccccacagttcctct

SEQ ID NO: 694784 - DNA, 20 bp, Artificial
  CRISPR gRNA sequence
ctctagccacatctgtgggc

SEQ ID NO: 694785 - DNA, 20 bp, Artificial
  CRISPR gRNA sequence
tagccacatctgtgggctct

SEQ ID NO: 694786 - DNA, 20 bp, Artificial
  CRISPR gRNA sequence
gccacatctgtgggctctga

SEQ ID NO: 694787 - DNA, 20 bp, Artificial
  CRISPR gRNA sequence
tgggctctgaccaggtccta

SEQ ID NO: 694788 - DNA, 20 bp, Artificial
  CRISPR gRNA sequence
tgaccaggtcctatttttgt

SEQ ID NO: 694789 - DNA, 20 bp, Artificial
  CRISPR gRNA sequence
accaggtcctatttttgttc

SEQ ID NO: 694790 - DNA, 20 bp, Artificial
  CRISPR gRNA sequence
tttttgttctaccccaatca

SEQ ID NO: 694791 - DNA, 20 bp, Artificial
  CRISPR gRNA sequence
ttgttctaccccaatcactg

SEQ ID NO: 694792 - DNA, 20 bp, Artificial
  CRISPR gRNA sequence
tgttctaccccaatcactga

SEQ ID NO: 694793 - DNA, 20 bp, Artificial
  CRISPR gRNA sequence
gttctaccccaatcactgac

SEQ ID NO: 694794 - DNA, 20 bp, Artificial
  CRISPR gRNA sequence
ttctaccccaatcactgaca

SEQ ID NO: 694795 - DNA, 20 bp, Artificial
  CRISPR gRNA sequence
taccccaatcactgacagtg

SEQ ID NO: 694796 - DNA, 20 bp, Artificial
  CRISPR gRNA sequence
ccccaatcactgacagtgcc

SEQ ID NO: 694797 - DNA, 20 bp, Artificial
  CRISPR gRNA sequence
acagtgcccagggctctggg

SEQ ID NO: 694798 - DNA, 20 bp, Artificial
  CRISPR gRNA sequence
tggggtgtctctcacagcta

SEQ ID NO: 694799 - DNA, 20 bp, Artificial
  CRISPR gRNA sequence
gggtgtctctcacagctaat

SEQ ID NO: 694800 - DNA, 20 bp, Artificial
  CRISPR gRNA sequence
tcacagctaataaaggtgac

SEQ ID NO: 694801 - DNA, 20 bp, Artificial
  CRISPR gRNA sequence
acagctaataaaggtgacac

SEQ ID NO: 694802 - DNA, 20 bp, Artificial
  CRISPR gRNA sequence
ataaaggtgacactccaggg

SEQ ID NO: 694803 - DNA, 20 bp, Artificial
  CRISPR gRNA sequence
cagggcaggggccctgatgt

SEQ ID NO: 694804 - DNA, 20 bp, Artificial
  CRISPR gRNA sequence
atgtgagtggggtgttgggg

SEQ ID NO: 694805 - DNA, 20 bp, Artificial
  CRISPR gRNA sequence
ggggggaacagaggggactc

SEQ ID NO: 694806 - DNA, 20 bp, Artificial
  CRISPR gRNA sequence
agctgtgctattgggtttct

SEQ ID NO: 694807 - DNA, 20 bp, Artificial
  CRISPR gRNA sequence
tgctattgggtttctttgac

SEQ ID NO: 694808 - DNA, 20 bp, Artificial
  CRISPR gRNA sequence
ttgggtttctttgacttgga

SEQ ID NO: 694809 - DNA, 20 bp, Artificial
  CRISPR gRNA sequence
ggtttctttgacttggatgt

SEQ ID NO: 694810 - DNA, 20 bp, Artificial
  CRISPR gRNA sequence
ctttgacttggatgtcttga

SEQ ID NO: 694811 - DNA, 20 bp, Artificial
  CRISPR gRNA sequence
tttgacttggatgtcttgag

SEQ ID NO: 694812 - DNA, 20 bp, Artificial
  CRISPR gRNA sequence
tgacttggatgtcttgagca

SEQ ID NO: 694813 - DNA, 20 bp, Artificial
  CRISPR gRNA sequence
gacttggatgtcttgagcat

SEQ ID NO: 694814 - DNA, 20 bp, Artificial
  CRISPR gRNA sequence
acttggatgtcttgagcatg

SEQ ID NO: 694815 - DNA, 20 bp, Artificial
  CRISPR gRNA sequence
ggatgtcttgagcatgaaat

SEQ ID NO: 694816 - DNA, 20 bp, Artificial
  CRISPR gRNA sequence
gatgtcttgagcatgaaatg

SEQ ID NO: 694817 - DNA, 20 bp, Artificial
  CRISPR gRNA sequence
gagcatgaaatgggctattt

SEQ ID NO: 694818 - DNA, 20 bp, Artificial
  CRISPR gRNA sequence
agcatgaaatgggctattta

SEQ ID NO: 694819 - DNA, 20 bp, Artificial
  CRISPR gRNA sequence
tttagagtgttacctctcac

SEQ ID NO: 694820 - DNA, 20 bp, Artificial
  CRISPR gRNA sequence
agagtgttacctctcactgt

SEQ ID NO: 694821 - DNA, 20 bp, Artificial
  CRISPR gRNA sequence
gagtgttacctctcactgtg

SEQ ID NO: 694822 - DNA, 20 bp, Artificial
  CRISPR gRNA sequence
cctctcactgtgactgatac

SEQ ID NO: 694823 - DNA, 20 bp, Artificial
  CRISPR gRNA sequence
tcactgtgactgatacgaat

SEQ ID NO: 694824 - DNA, 20 bp, Artificial
  CRISPR gRNA sequence
actgtgactgatacgaattt

SEQ ID NO: 694825 - DNA, 20 bp, Artificial
  CRISPR gRNA sequence
tgactgatacgaatttgttc

SEQ ID NO: 694826 - DNA, 20 bp, Artificial
  CRISPR gRNA sequence
atacgaatttgttcatgaat

SEQ ID NO: 694827 - DNA, 20 bp, Artificial
  CRISPR gRNA sequence
gttcatgaatattttctcta

SEQ ID NO: 694828 - DNA, 20 bp, Artificial
  CRISPR gRNA sequence
ttcatgaatattttctctat

SEQ ID NO: 694829 - DNA, 20 bp, Artificial
  CRISPR gRNA sequence
atgaatattttctctatagt

SEQ ID NO: 694830 - DNA, 20 bp, Artificial
  CRISPR gRNA sequence
tctctatagtgtgagacagc

SEQ ID NO: 694831 - DNA, 20 bp, Artificial
  CRISPR gRNA sequence
ctctatagtgtgagacagct

SEQ ID NO: 694832 - DNA, 20 bp, Artificial
  CRISPR gRNA sequence
tctatagtgtgagacagctt

SEQ ID NO: 694833 - DNA, 20 bp, Artificial
  CRISPR gRNA sequence
tatagtgtgagacagcttcc

SEQ ID NO: 694834 - DNA, 20 bp, Artificial
  CRISPR gRNA sequence
tagtgtgagacagcttcctt

SEQ ID NO: 694835 - DNA, 20 bp, Artificial
  CRISPR gRNA sequence
ccttgtgtgggactgagaag

SEQ ID NO: 694836 - DNA, 20 bp, Artificial
  CRISPR gRNA sequence
cttgtgtgggactgagaagc

SEQ ID NO: 694837 - DNA, 20 bp, Artificial
  CRISPR gRNA sequence
gtgtgggactgagaagcaag

SEQ ID NO: 694838 - DNA, 20 bp, Artificial
  CRISPR gRNA sequence
tgtgggactgagaagcaaga

SEQ ID NO: 694839 - DNA, 20 bp, Artificial
  CRISPR gRNA sequence
agaagcaagatatcaatgta

SEQ ID NO: 694840 - DNA, 20 bp, Artificial
  CRISPR gRNA sequence
cacttgtgcctcacgaacat

SEQ ID NO: 694841 - DNA, 20 bp, Artificial
  CRISPR gRNA sequence
gtgcctcacgaacatacata

SEQ ID NO: 694842 - DNA, 20 bp, Artificial
  CRISPR gRNA sequence
tgcctcacgaacatacataa

SEQ ID NO: 694843 - DNA, 20 bp, Artificial
  CRISPR gRNA sequence
acgaacatacataaatttta

SEQ ID NO: 694844 - DNA, 20 bp, Artificial
  CRISPR gRNA sequence
taaaaataaagaataaaaat

SEQ ID NO: 694845 - DNA, 20 bp, Artificial
  CRISPR gRNA sequence
aaaaataaagaataaaaata

SEQ ID NO: 694846 - DNA, 20 bp, Artificial
  CRISPR gRNA sequence
aaaataaagaataaaaatat

SEQ ID NO: 694847 - DNA, 20 bp, Artificial
  CRISPR gRNA sequence
tttatagatacaggtagata

SEQ ID NO: 694848 - DNA, 20 bp, Artificial
  CRISPR gRNA sequence
ttatagatacaggtagatat

SEQ ID NO: 694849 - DNA, 20 bp, Artificial
  CRISPR gRNA sequence
tatagatacaggtagatatg

SEQ ID NO: 694850 - DNA, 20 bp, Artificial
  CRISPR gRNA sequence
atagatacaggtagatatgt

SEQ ID NO: 694851 - DNA, 20 bp, Artificial
  CRISPR gRNA sequence
tagatacaggtagatatgtt

SEQ ID NO: 694852 - DNA, 20 bp, Artificial
  CRISPR gRNA sequence
ttatagcatgcacgtaaatg

SEQ ID NO: 694853 - DNA, 20 bp, Artificial
  CRISPR gRNA sequence
tatagcatgcacgtaaatgt

SEQ ID NO: 694854 - DNA, 20 bp, Artificial
  CRISPR gRNA sequence
atagcatgcacgtaaatgtg

SEQ ID NO: 694855 - DNA, 20 bp, Artificial
  CRISPR gRNA sequence
tagcatgcacgtaaatgtgt

SEQ ID NO: 694856 - DNA, 20 bp, Artificial
  CRISPR gRNA sequence
agattcttttaatggtgaaa

SEQ ID NO: 694857 - DNA, 20 bp, Artificial
  CRISPR gRNA sequence
ttttaatggtgaaaagatat

SEQ ID NO: 694858 - DNA, 20 bp, Artificial
  CRISPR gRNA sequence
ttaatggtgaaaagatatac

SEQ ID NO: 694859 - DNA, 20 bp, Artificial
  CRISPR gRNA sequence
taatggtgaaaagatataca

SEQ ID NO: 694860 - DNA, 20 bp, Artificial
  CRISPR gRNA sequence
aatggtgaaaagatatacat

SEQ ID NO: 694861 - DNA, 20 bp, Artificial
  CRISPR gRNA sequence
atggtgaaaagatatacata

SEQ ID NO: 694862 - DNA, 20 bp, Artificial
  CRISPR gRNA sequence
ggaattagccagcttgactc

SEQ ID NO: 694863 - DNA, 20 bp, Artificial
  CRISPR gRNA sequence
gaattagccagcttgactca

SEQ ID NO: 694864 - DNA, 20 bp, Artificial
  CRISPR gRNA sequence
gccagcttgactcagtttag

SEQ ID NO: 694865 - DNA, 20 bp, Artificial
  CRISPR gRNA sequence
gactcagtttaggtgatccc

SEQ ID NO: 694866 - DNA, 20 bp, Artificial
  CRISPR gRNA sequence
actcagtttaggtgatccca

SEQ ID NO: 694867 - DNA, 20 bp, Artificial
  CRISPR gRNA sequence
agtttaggtgatcccaattt

SEQ ID NO: 694868 - DNA, 20 bp, Artificial
  CRISPR gRNA sequence
aggtgatcccaattttggtg

SEQ ID NO: 694869 - DNA, 20 bp, Artificial
  CRISPR gRNA sequence
ggtgatcccaattttggtgg

SEQ ID NO: 694870 - DNA, 20 bp, Artificial
  CRISPR gRNA sequence
tggtggcaacaaccaaagca

SEQ ID NO: 694871 - DNA, 20 bp, Artificial
  CRISPR gRNA sequence
ggtggcaacaaccaaagcat

SEQ ID NO: 694872 - DNA, 20 bp, Artificial
  CRISPR gRNA sequence
gtggcaacaaccaaagcatc

SEQ ID NO: 694873 - DNA, 20 bp, Artificial
  CRISPR gRNA sequence
cctctctccatcagactgaa

SEQ ID NO: 694874 - DNA, 20 bp, Artificial
  CRISPR gRNA sequence
ctctctccatcagactgaat

SEQ ID NO: 694875 - DNA, 20 bp, Artificial
  CRISPR gRNA sequence
tctccatcagactgaatcag

SEQ ID NO: 694876 - DNA, 20 bp, Artificial
  CRISPR gRNA sequence
tccatcagactgaatcagag

SEQ ID NO: 694877 - DNA, 20 bp, Artificial
  CRISPR gRNA sequence
catcagactgaatcagagtg

SEQ ID NO: 694878 - DNA, 20 bp, Artificial
  CRISPR gRNA sequence
aatcagagtgttgactttgg

SEQ ID NO: 694879 - DNA, 20 bp, Artificial
  CRISPR gRNA sequence
actttggccacatcaatgtc

SEQ ID NO: 694880 - DNA, 20 bp, Artificial
  CRISPR gRNA sequence
tggccacatcaatgtcacaa

SEQ ID NO: 694881 - DNA, 20 bp, Artificial
  CRISPR gRNA sequence
ggccacatcaatgtcacaaa

SEQ ID NO: 694882 - DNA, 20 bp, Artificial
  CRISPR gRNA sequence
gccacatcaatgtcacaaac

SEQ ID NO: 694883 - DNA, 20 bp, Artificial
  CRISPR gRNA sequence
cttcacagcctgtttgatct

SEQ ID NO: 694884 - DNA, 20 bp, Artificial
  CRISPR gRNA sequence
ttcacagcctgtttgatctg

SEQ ID NO: 694885 - DNA, 20 bp, Artificial
  CRISPR gRNA sequence
cacagcctgtttgatctggt

SEQ ID NO: 694886 - DNA, 20 bp, Artificial
  CRISPR gRNA sequence
acagcctgtttgatctggtg

SEQ ID NO: 694887 - DNA, 20 bp, Artificial
  CRISPR gRNA sequence
tttgatctggtgcttgttgg

SEQ ID NO: 694888 - DNA, 20 bp, Artificial
  CRISPR gRNA sequence
gatctggtgcttgttggctt

SEQ ID NO: 694889 - DNA, 20 bp, Artificial
  CRISPR gRNA sequence
atctggtgcttgttggcttt

SEQ ID NO: 694890 - DNA, 20 bp, Artificial
  CRISPR gRNA sequence
gtgcttgttggctttaacat

SEQ ID NO: 694891 - DNA, 20 bp, Artificial
  CRISPR gRNA sequence
gttggctttaacatccacag

SEQ ID NO: 694892 - DNA, 20 bp, Artificial
  CRISPR gRNA sequence
ttggctttaacatccacagt

SEQ ID NO: 694893 - DNA, 20 bp, Artificial
  CRISPR gRNA sequence
gctttaacatccacagtgaa

SEQ ID NO: 694894 - DNA, 20 bp, Artificial
  CRISPR gRNA sequence
taacatccacagtgaacaca

SEQ ID NO: 694895 - DNA, 20 bp, Artificial
  CRISPR gRNA sequence
aacatccacagtgaacacaa

SEQ ID NO: 694896 - DNA, 20 bp, Artificial
  CRISPR gRNA sequence
acatccacagtgaacacaag

SEQ ID NO: 694897 - DNA, 20 bp, Artificial
  CRISPR gRNA sequence
ttgttttctatcttcttcac

SEQ ID NO: 694898 - DNA, 20 bp, Artificial
  CRISPR gRNA sequence
ttttctatcttcttcacagc

SEQ ID NO: 694899 - DNA, 20 bp, Artificial
  CRISPR gRNA sequence
tctatcttcttcacagccta

SEQ ID NO: 694900 - DNA, 20 bp, Artificial
  CRISPR gRNA sequence
ctatcttcttcacagcctac

SEQ ID NO: 694901 - DNA, 20 bp, Artificial
  CRISPR gRNA sequence
tatcttcttcacagcctact

SEQ ID NO: 694902 - DNA, 20 bp, Artificial
  CRISPR gRNA sequence
tcttcttcacagcctactca

SEQ ID NO: 694903 - DNA, 20 bp, Artificial
  CRISPR gRNA sequence
cttcacagcctactcagtgg

SEQ ID NO: 694904 - DNA, 20 bp, Artificial
  CRISPR gRNA sequence
ttcacagcctactcagtggt

SEQ ID NO: 694905 - DNA, 20 bp, Artificial
  CRISPR gRNA sequence
cacagcctactcagtggtca

SEQ ID NO: 694906 - DNA, 20 bp, Artificial
  CRISPR gRNA sequence
acagcctactcagtggtcag

SEQ ID NO: 694907 - DNA, 20 bp, Artificial
  CRISPR gRNA sequence
ctcagtggtcagcggaaact

SEQ ID NO: 694908 - DNA, 20 bp, Artificial
  CRISPR gRNA sequence
agtggtcagcggaaacttga

SEQ ID NO: 694909 - DNA, 20 bp, Artificial
  CRISPR gRNA sequence
gatgataacatggtggtcaa

SEQ ID NO: 694910 - DNA, 20 bp, Artificial
  CRISPR gRNA sequence
atgataacatggtggtcaag

SEQ ID NO: 694911 - DNA, 20 bp, Artificial
  CRISPR gRNA sequence
atttctcctgggggtgctct

SEQ ID NO: 694912 - DNA, 20 bp, Artificial
  CRISPR gRNA sequence
tttctcctgggggtgctctt

SEQ ID NO: 694913 - DNA, 20 bp, Artificial
  CRISPR gRNA sequence
ctcctgggggtgctcttcca

SEQ ID NO: 694914 - DNA, 20 bp, Artificial
  CRISPR gRNA sequence
tcctgggggtgctcttccaa

SEQ ID NO: 694915 - DNA, 20 bp, Artificial
  CRISPR gRNA sequence
ctgggggtgctcttccaagg

SEQ ID NO: 694916 - DNA, 20 bp, Artificial
  CRISPR gRNA sequence
ggggtgctcttccaaggata

SEQ ID NO: 694917 - DNA, 20 bp, Artificial
  CRISPR gRNA sequence
ttccaaggatatttgggctg

SEQ ID NO: 694918 - DNA, 20 bp, Artificial
  CRISPR gRNA sequence
ccaaggatatttgggctgcc

SEQ ID NO: 694919 - DNA, 20 bp, Artificial
  CRISPR gRNA sequence
caaggatatttgggctgcct

SEQ ID NO: 694920 - DNA, 20 bp, Artificial
  CRISPR gRNA sequence
gggctgcctccggagtcaca

SEQ ID NO: 694921 - DNA, 20 bp, Artificial
  CRISPR gRNA sequence
ggctgcctccggagtcacag

SEQ ID NO: 694922 - DNA, 20 bp, Artificial
  CRISPR gRNA sequence
cctccggagtcacagtgtct

SEQ ID NO: 694923 - DNA, 20 bp, Artificial
  CRISPR gRNA sequence
cggagtcacagtgtcttggg

SEQ ID NO: 694924 - DNA, 20 bp, Artificial
  CRISPR gRNA sequence
gggccgccggaaggtgggtg

SEQ ID NO: 694925 - DNA, 20 bp, Artificial
  CRISPR gRNA sequence
ggccgccggaaggtgggtga

SEQ ID NO: 694926 - DNA, 20 bp, Artificial
  CRISPR gRNA sequence
gttttttttgtggctgtgga

SEQ ID NO: 694927 - DNA, 20 bp, Artificial
  CRISPR gRNA sequence
ttttttttgtggctgtggac

SEQ ID NO: 694928 - DNA, 20 bp, Artificial
  CRISPR gRNA sequence
tttttgtggctgtggacatc

SEQ ID NO: 694929 - DNA, 20 bp, Artificial
  CRISPR gRNA sequence
ttttgtggctgtggacatct

SEQ ID NO: 694930 - DNA, 20 bp, Artificial
  CRISPR gRNA sequence
tttgtggctgtggacatctt

SEQ ID NO: 694931 - DNA, 20 bp, Artificial
  CRISPR gRNA sequence
ttgtggctgtggacatcttt

SEQ ID NO: 694932 - DNA, 20 bp, Artificial
  CRISPR gRNA sequence
tgtggctgtggacatctttc

SEQ ID NO: 694933 - DNA, 20 bp, Artificial
  CRISPR gRNA sequence
gtggctgtggacatctttca

SEQ ID NO: 694934 - DNA, 20 bp, Artificial
  CRISPR gRNA sequence
tggctgtggacatctttcaa

SEQ ID NO: 694935 - DNA, 20 bp, Artificial
  CRISPR gRNA sequence
tggacatctttcaacactgc

SEQ ID NO: 694936 - DNA, 20 bp, Artificial
  CRISPR gRNA sequence
tcaacactgccttcttggcc

SEQ ID NO: 694937 - DNA, 20 bp, Artificial
  CRISPR gRNA sequence
caacactgccttcttggcct

SEQ ID NO: 694938 - DNA, 20 bp, Artificial
  CRISPR gRNA sequence
aacactgccttcttggcctt

SEQ ID NO: 694939 - DNA, 20 bp, Artificial
  CRISPR gRNA sequence
ccttcttggccttgcaaagc

SEQ ID NO: 694940 - DNA, 20 bp, Artificial
  CRISPR gRNA sequence
cttggccttgcaaagccttc

SEQ ID NO: 694941 - DNA, 20 bp, Artificial
  CRISPR gRNA sequence
ttggccttgcaaagccttcg

SEQ ID NO: 694942 - DNA, 20 bp, Artificial
  CRISPR gRNA sequence
ggccttgcaaagccttcgct

SEQ ID NO: 694943 - DNA, 20 bp, Artificial
  CRISPR gRNA sequence
gccttgcaaagccttcgctt

SEQ ID NO: 694944 - DNA, 20 bp, Artificial
  CRISPR gRNA sequence
gcaaagccttcgctttggct

SEQ ID NO: 694945 - DNA, 20 bp, Artificial
  CRISPR gRNA sequence
caaagccttcgctttggctt

SEQ ID NO: 694946 - DNA, 20 bp, Artificial
  CRISPR gRNA sequence
cgctttggcttcggctttag

SEQ ID NO: 694947 - DNA, 20 bp, Artificial
  CRISPR gRNA sequence
gctttggcttcggctttagg

SEQ ID NO: 694948 - DNA, 20 bp, Artificial
  CRISPR gRNA sequence
tggcttcggctttaggaggg

SEQ ID NO: 694949 - DNA, 20 bp, Artificial
  CRISPR gRNA sequence
ggcttcggctttaggagggg

SEQ ID NO: 694950 - DNA, 20 bp, Artificial
  CRISPR gRNA sequence
gcttcggctttaggaggggc

SEQ ID NO: 694951 - DNA, 20 bp, Artificial
  CRISPR gRNA sequence
cggctttaggaggggcagga

SEQ ID NO: 694952 - DNA, 20 bp, Artificial
  CRISPR gRNA sequence
ggctttaggaggggcaggag

SEQ ID NO: 694953 - DNA, 20 bp, Artificial
  CRISPR gRNA sequence
taggaggggcaggagcttcc

SEQ ID NO: 694954 - DNA, 20 bp, Artificial
  CRISPR gRNA sequence
aggaggggcaggagcttcct

SEQ ID NO: 694955 - DNA, 20 bp, Artificial
  CRISPR gRNA sequence
ggaggggcaggagcttcctt

SEQ ID NO: 694956 - DNA, 20 bp, Artificial
  CRISPR gRNA sequence
ccttcttcgttcttggcacc

SEQ ID NO: 694957 - DNA, 20 bp, Artificial
  CRISPR gRNA sequence
cttcttcgttcttggcacca

SEQ ID NO: 694958 - DNA, 20 bp, Artificial
  CRISPR gRNA sequence
cttcgttcttggcaccatct

SEQ ID NO: 694959 - DNA, 20 bp, Artificial
  CRISPR gRNA sequence
ttcgttcttggcaccatctt

SEQ ID NO: 694960 - DNA, 20 bp, Artificial
  CRISPR gRNA sequence
cgttcttggcaccatcttat

SEQ ID NO: 694961 - DNA, 20 bp, Artificial
  CRISPR gRNA sequence
gttcttggcaccatcttatg

SEQ ID NO: 694962 - DNA, 20 bp, Artificial
  CRISPR gRNA sequence
ttggcaccatcttatgaaaa

SEQ ID NO: 694963 - DNA, 20 bp, Artificial
  CRISPR gRNA sequence
ggcaccatcttatgaaaagg

SEQ ID NO: 694964 - DNA, 20 bp, Artificial
  CRISPR gRNA sequence
gcaccatcttatgaaaaggg

SEQ ID NO: 694965 - DNA, 20 bp, Artificial
  CRISPR gRNA sequence
atgaaaagggtccagattaa

SEQ ID NO: 694966 - DNA, 20 bp, Artificial
  CRISPR gRNA sequence
tgaaaagggtccagattaag

SEQ ID NO: 694967 - DNA, 20 bp, Artificial
  CRISPR gRNA sequence
agatttttgactgagtcatt

SEQ ID NO: 694968 - DNA, 20 bp, Artificial
  CRISPR gRNA sequence
ttgactgagtcattctaaag

SEQ ID NO: 694969 - DNA, 20 bp, Artificial
  CRISPR gRNA sequence
tgactgagtcattctaaagt

SEQ ID NO: 694970 - DNA, 20 bp, Artificial
  CRISPR gRNA sequence
gactgagtcattctaaagta

SEQ ID NO: 694971 - DNA, 20 bp, Artificial
  CRISPR gRNA sequence
actgagtcattctaaagtaa

SEQ ID NO: 694972 - DNA, 20 bp, Artificial
  CRISPR gRNA sequence
agtcattctaaagtaagttg

SEQ ID NO: 694973 - DNA, 20 bp, Artificial
  CRISPR gRNA sequence
taaagtaagttgcaagaccc

SEQ ID NO: 694974 - DNA, 20 bp, Artificial
  CRISPR gRNA sequence
aagtaagttgcaagacccat

SEQ ID NO: 694975 - DNA, 20 bp, Artificial
  CRISPR gRNA sequence
caagacccatgatactagac

SEQ ID NO: 694976 - DNA, 20 bp, Artificial
  CRISPR gRNA sequence
gaccactaaatacttcatca

SEQ ID NO: 694977 - DNA, 20 bp, Artificial
  CRISPR gRNA sequence
aatacttcatcacacacctc

SEQ ID NO: 694978 - DNA, 20 bp, Artificial
  CRISPR gRNA sequence
catcacacacctcctaagaa

SEQ ID NO: 694979 - DNA, 20 bp, Artificial
  CRISPR gRNA sequence
atcacacacctcctaagaat

SEQ ID NO: 694980 - DNA, 20 bp, Artificial
  CRISPR gRNA sequence
ctaagaataagaaccaacat

SEQ ID NO: 694981 - DNA, 20 bp, Artificial
  CRISPR gRNA sequence
agaataagaaccaacattat

SEQ ID NO: 694982 - DNA, 20 bp, Artificial
  CRISPR gRNA sequence
tcacaccaaagaaaataaat

SEQ ID NO: 694983 - DNA, 20 bp, Artificial
  CRISPR gRNA sequence
cataatattatttaaagtcc

SEQ ID NO: 694984 - DNA, 20 bp, Artificial
  CRISPR gRNA sequence
tttaaagtccttttatgttc

SEQ ID NO: 694985 - DNA, 20 bp, Artificial
  CRISPR gRNA sequence
aaagtccttttatgttcaaa

SEQ ID NO: 694986 - DNA, 20 bp, Artificial
  CRISPR gRNA sequence
aagtccttttatgttcaaat

SEQ ID NO: 694987 - DNA, 20 bp, Artificial
  CRISPR gRNA sequence
ttatgttcaaatatctccac

SEQ ID NO: 694988 - DNA, 20 bp, Artificial
  CRISPR gRNA sequence
tatgttcaaatatctccact

SEQ ID NO: 694989 - DNA, 20 bp, Artificial
  CRISPR gRNA sequence
atgttcaaatatctccactt

SEQ ID NO: 694990 - DNA, 20 bp, Artificial
  CRISPR gRNA sequence
tgttcaaatatctccacttc

SEQ ID NO: 694991 - DNA, 20 bp, Artificial
  CRISPR gRNA sequence
aaatatctccacttctttca

SEQ ID NO: 694992 - DNA, 20 bp, Artificial
  CRISPR gRNA sequence
cacttctttcagtacatttt

SEQ ID NO: 694993 - DNA, 20 bp, Artificial
  CRISPR gRNA sequence
ctttcagtacatttttgtac

SEQ ID NO: 694994 - DNA, 20 bp, Artificial
  CRISPR gRNA sequence
tttcagtacatttttgtacc

SEQ ID NO: 694995 - DNA, 20 bp, Artificial
  CRISPR gRNA sequence
tcagtacatttttgtaccta

SEQ ID NO: 694996 - DNA, 20 bp, Artificial
  CRISPR gRNA sequence
cagtacatttttgtacctat

SEQ ID NO: 694997 - DNA, 20 bp, Artificial
  CRISPR gRNA sequence
agtacatttttgtacctatt

SEQ ID NO: 694998 - DNA, 20 bp, Artificial
  CRISPR gRNA sequence
ttgtacctattttttatagc

SEQ ID NO: 694999 - DNA, 20 bp, Artificial
  CRISPR gRNA sequence
tgtacctattttttatagct

SEQ ID NO: 695000 - DNA, 20 bp, Artificial
  CRISPR gRNA sequence
gtacctattttttatagctt

SEQ ID NO: 695001 - DNA, 20 bp, Artificial
  CRISPR gRNA sequence
tacctattttttatagcttg

SEQ ID NO: 695002 - DNA, 20 bp, Artificial
  CRISPR gRNA sequence
ttttttatagcttgttttct

SEQ ID NO: 695003 - DNA, 20 bp, Artificial
  CRISPR gRNA sequence
tttatagcttgttttcttaa

SEQ ID NO: 695004 - DNA, 20 bp, Artificial
  CRISPR gRNA sequence
ttatagcttgttttcttaaa

SEQ ID NO: 695005 - DNA, 20 bp, Artificial
  CRISPR gRNA sequence
tatagcttgttttcttaaaa

SEQ ID NO: 695006 - DNA, 20 bp, Artificial
  CRISPR gRNA sequence
atagcttgttttcttaaaat

SEQ ID NO: 695007 - DNA, 20 bp, Artificial
  CRISPR gRNA sequence
tagcttgttttcttaaaatg

SEQ ID NO: 695008 - DNA, 20 bp, Artificial
  CRISPR gRNA sequence
gttttcttaaaatgtccact

SEQ ID NO: 695009 - DNA, 20 bp, Artificial
  CRISPR gRNA sequence
ttttcttaaaatgtccactc

SEQ ID NO: 695010 - DNA, 20 bp, Artificial
  CRISPR gRNA sequence
tcttaaaatgtccactcgtt

SEQ ID NO: 695011 - DNA, 20 bp, Artificial
  CRISPR gRNA sequence
cttaaaatgtccactcgttg

SEQ ID NO: 695012 - DNA, 20 bp, Artificial
  CRISPR gRNA sequence
ttaaaatgtccactcgttgc

SEQ ID NO: 695013 - DNA, 20 bp, Artificial
  CRISPR gRNA sequence
aaaatgtccactcgttgcct

SEQ ID NO: 695014 - DNA, 20 bp, Artificial
  CRISPR gRNA sequence
aaatgtccactcgttgcctt

SEQ ID NO: 695015 - DNA, 20 bp, Artificial
  CRISPR gRNA sequence
gttgcctttggttatgtttc

SEQ ID NO: 695016 - DNA, 20 bp, Artificial
  CRISPR gRNA sequence
cctttggttatgtttcttta

SEQ ID NO: 695017 - DNA, 20 bp, Artificial
  CRISPR gRNA sequence
tggttatgtttctttaatta

SEQ ID NO: 695018 - DNA, 20 bp, Artificial
  CRISPR gRNA sequence
ggttatgtttctttaattac

SEQ ID NO: 695019 - DNA, 20 bp, Artificial
  CRISPR gRNA sequence
gttatgtttctttaattacc

SEQ ID NO: 695020 - DNA, 20 bp, Artificial
  CRISPR gRNA sequence
tgtttctttaattacctaca

SEQ ID NO: 695021 - DNA, 20 bp, Artificial
  CRISPR gRNA sequence
ctttaattacctacaatcta

SEQ ID NO: 695022 - DNA, 20 bp, Artificial
  CRISPR gRNA sequence
tttaattacctacaatctat

SEQ ID NO: 695023 - DNA, 20 bp, Artificial
  CRISPR gRNA sequence
taattacctacaatctataa

SEQ ID NO: 695024 - DNA, 20 bp, Artificial
  CRISPR gRNA sequence
aattacctacaatctataac

SEQ ID NO: 695025 - DNA, 20 bp, Artificial
  CRISPR gRNA sequence
attacctacaatctataaca

SEQ ID NO: 695026 - DNA, 20 bp, Artificial
  CRISPR gRNA sequence
cctacaatctataacaatca

SEQ ID NO: 695027 - DNA, 20 bp, Artificial
  CRISPR gRNA sequence
caatctataacaatcaaccc

SEQ ID NO: 695028 - DNA, 20 bp, Artificial
  CRISPR gRNA sequence
taacaatcaacccatctttt

SEQ ID NO: 695029 - DNA, 20 bp, Artificial
  CRISPR gRNA sequence
ttttcttttagaatggcatt

SEQ ID NO: 695030 - DNA, 20 bp, Artificial
  CRISPR gRNA sequence
tttcttttagaatggcatta

SEQ ID NO: 695031 - DNA, 20 bp, Artificial
  CRISPR gRNA sequence
ttcttttagaatggcattac

SEQ ID NO: 695032 - DNA, 20 bp, Artificial
  CRISPR gRNA sequence
tcttttagaatggcattacc

SEQ ID NO: 695033 - DNA, 20 bp, Artificial
  CRISPR gRNA sequence
cttttagaatggcattacct

SEQ ID NO: 695034 - DNA, 20 bp, Artificial
  CRISPR gRNA sequence
ttttagaatggcattacctg

SEQ ID NO: 695035 - DNA, 20 bp, Artificial
  CRISPR gRNA sequence
ttagaatggcattacctgtt

SEQ ID NO: 695036 - DNA, 20 bp, Artificial
  CRISPR gRNA sequence
tagaatggcattacctgttt

SEQ ID NO: 695037 - DNA, 20 bp, Artificial
  CRISPR gRNA sequence
agaatggcattacctgtttc

SEQ ID NO: 695038 - DNA, 20 bp, Artificial
  CRISPR gRNA sequence
gaatggcattacctgtttca

SEQ ID NO: 695039 - DNA, 20 bp, Artificial
  CRISPR gRNA sequence
cctgtttcagagatgaggcc

SEQ ID NO: 695040 - DNA, 20 bp, Artificial
  CRISPR gRNA sequence
tttcagagatgaggccaaat

SEQ ID NO: 695041 - DNA, 20 bp, Artificial
  CRISPR gRNA sequence
cagagatgaggccaaatacc

SEQ ID NO: 695042 - DNA, 20 bp, Artificial
  CRISPR gRNA sequence
agagatgaggccaaatacct

SEQ ID NO: 695043 - DNA, 20 bp, Artificial
  CRISPR gRNA sequence
tggaatcttctccacactga

SEQ ID NO: 695044 - DNA, 20 bp, Artificial
  CRISPR gRNA sequence
ctccacactgaatttatcat

SEQ ID NO: 695045 - DNA, 20 bp, Artificial
  CRISPR gRNA sequence
tccacactgaatttatcata

SEQ ID NO: 695046 - DNA, 20 bp, Artificial
  CRISPR gRNA sequence
cacactgaatttatcatatt

SEQ ID NO: 695047 - DNA, 20 bp, Artificial
  CRISPR gRNA sequence
aatttatcatattagttccc

SEQ ID NO: 695048 - DNA, 20 bp, Artificial
  CRISPR gRNA sequence
atcatattagttcccctgat

SEQ ID NO: 695049 - DNA, 20 bp, Artificial
  CRISPR gRNA sequence
tcatattagttcccctgatg

SEQ ID NO: 695050 - DNA, 20 bp, Artificial
  CRISPR gRNA sequence
gttcccctgatgcctttaac

SEQ ID NO: 695051 - DNA, 20 bp, Artificial
  CRISPR gRNA sequence
ccctgatgcctttaactttt

SEQ ID NO: 695052 - DNA, 20 bp, Artificial
  CRISPR gRNA sequence
atgcctttaacttttttcct

SEQ ID NO: 695053 - DNA, 20 bp, Artificial
  CRISPR gRNA sequence
taacttttttcctctaactg

SEQ ID NO: 695054 - DNA, 20 bp, Artificial
  CRISPR gRNA sequence
aacttttttcctctaactgc

SEQ ID NO: 695055 - DNA, 20 bp, Artificial
  CRISPR gRNA sequence
acttttttcctctaactgct

SEQ ID NO: 695056 - DNA, 20 bp, Artificial
  CRISPR gRNA sequence
ttttcctctaactgctatgc

SEQ ID NO: 695057 - DNA, 20 bp, Artificial
  CRISPR gRNA sequence
tttcctctaactgctatgcc

SEQ ID NO: 695058 - DNA, 20 bp, Artificial
  CRISPR gRNA sequence
ttcctctaactgctatgcct

SEQ ID NO: 695059 - DNA, 20 bp, Artificial
  CRISPR gRNA sequence
tcctctaactgctatgcctc

SEQ ID NO: 695060 - DNA, 20 bp, Artificial
  CRISPR gRNA sequence
cctctaactgctatgcctcc

SEQ ID NO: 695061 - DNA, 20 bp, Artificial
  CRISPR gRNA sequence
ctctaactgctatgcctcct

SEQ ID NO: 695062 - DNA, 20 bp, Artificial
  CRISPR gRNA sequence
taactgctatgcctcctaag

SEQ ID NO: 695063 - DNA, 20 bp, Artificial
  CRISPR gRNA sequence
actgctatgcctcctaagga

SEQ ID NO: 695064 - DNA, 20 bp, Artificial
  CRISPR gRNA sequence
ctatgcctcctaaggaccta

SEQ ID NO: 695065 - DNA, 20 bp, Artificial
  CRISPR gRNA sequence
tgcctcctaaggacctatgt

SEQ ID NO: 695066 - DNA, 20 bp, Artificial
  CRISPR gRNA sequence
ctaaggacctatgtagctct

SEQ ID NO: 695067 - DNA, 20 bp, Artificial
  CRISPR gRNA sequence
aggacctatgtagctctggg

SEQ ID NO: 695068 - DNA, 20 bp, Artificial
  CRISPR gRNA sequence
tgtagctctgggttaaacat

SEQ ID NO: 695069 - DNA, 20 bp, Artificial
  CRISPR gRNA sequence
tgggttaaacatttggcagc

SEQ ID NO: 695070 - DNA, 20 bp, Artificial
  CRISPR gRNA sequence
ggttaaacatttggcagcaa

SEQ ID NO: 695071 - DNA, 20 bp, Artificial
  CRISPR gRNA sequence
aacatttggcagcaatgttt

SEQ ID NO: 695072 - DNA, 20 bp, Artificial
  CRISPR gRNA sequence
ggcagcaatgtttacaggag

SEQ ID NO: 695073 - DNA, 20 bp, Artificial
  CRISPR gRNA sequence
gcagcaatgtttacaggagg

SEQ ID NO: 695074 - DNA, 20 bp, Artificial
  CRISPR gRNA sequence
acaggaggagctgtgaccgc

SEQ ID NO: 695075 - DNA, 20 bp, Artificial
  CRISPR gRNA sequence
caggaggagctgtgaccgca

SEQ ID NO: 695076 - DNA, 20 bp, Artificial
  CRISPR gRNA sequence
tgaccgcacattcatcacat

SEQ ID NO: 695077 - DNA, 20 bp, Artificial
  CRISPR gRNA sequence
atcacatcaggaggcacaca

SEQ ID NO: 695078 - DNA, 20 bp, Artificial
  CRISPR gRNA sequence
gggttaccaggactcttact

SEQ ID NO: 695079 - DNA, 20 bp, Artificial
  CRISPR gRNA sequence
ccaggactcttactgacccc

SEQ ID NO: 695080 - DNA, 20 bp, Artificial
  CRISPR gRNA sequence
ttactgaccccatacagcca

SEQ ID NO: 695081 - DNA, 20 bp, Artificial
  CRISPR gRNA sequence
actgaccccatacagccaaa

SEQ ID NO: 695082 - DNA, 20 bp, Artificial
  CRISPR gRNA sequence
ctgaccccatacagccaaat

SEQ ID NO: 695083 - DNA, 20 bp, Artificial
  CRISPR gRNA sequence
accccatacagccaaattta

SEQ ID NO: 695084 - DNA, 20 bp, Artificial
  CRISPR gRNA sequence
atcctgacttcccagagatg

SEQ ID NO: 695085 - DNA, 20 bp, Artificial
  CRISPR gRNA sequence
tcctgacttcccagagatgc

SEQ ID NO: 695086 - DNA, 20 bp, Artificial
  CRISPR gRNA sequence
acttcccagagatgcagaac

SEQ ID NO: 695087 - DNA, 20 bp, Artificial
  CRISPR gRNA sequence
cccagagatgcagaaccatg

SEQ ID NO: 695088 - DNA, 20 bp, Artificial
  CRISPR gRNA sequence
ccagagatgcagaaccatgg

SEQ ID NO: 695089 - DNA, 20 bp, Artificial
  CRISPR gRNA sequence
ggtgtttagtgggtatgagt

SEQ ID NO: 695090 - DNA, 20 bp, Artificial
  CRISPR gRNA sequence
agtgggtatgagtgtgatat

SEQ ID NO: 695091 - DNA, 20 bp, Artificial
  CRISPR gRNA sequence
gtgggtatgagtgtgatatt

SEQ ID NO: 695092 - DNA, 20 bp, Artificial
  CRISPR gRNA sequence
tggcaataggaggttctgcc

SEQ ID NO: 695093 - DNA, 20 bp, Artificial
  CRISPR gRNA sequence
gcaataggaggttctgccac

SEQ ID NO: 695094 - DNA, 20 bp, Artificial
  CRISPR gRNA sequence
tgccactctccccattcctc

SEQ ID NO: 695095 - DNA, 20 bp, Artificial
  CRISPR gRNA sequence
ccactctccccattcctcac

SEQ ID NO: 695096 - DNA, 20 bp, Artificial
  CRISPR gRNA sequence
tccccattcctcacgagctt

SEQ ID NO: 695097 - DNA, 20 bp, Artificial
  CRISPR gRNA sequence
cccattcctcacgagcttta

SEQ ID NO: 695098 - DNA, 20 bp, Artificial
  CRISPR gRNA sequence
ctcacgagctttagttcccc

SEQ ID NO: 695099 - DNA, 20 bp, Artificial
  CRISPR gRNA sequence
acgagctttagttccccata

SEQ ID NO: 695100 - DNA, 20 bp, Artificial
  CRISPR gRNA sequence
tagttccccataccctgagg

SEQ ID NO: 695101 - DNA, 20 bp, Artificial
  CRISPR gRNA sequence
agttccccataccctgaggt

SEQ ID NO: 695102 - DNA, 20 bp, Artificial
  CRISPR gRNA sequence
gttccccataccctgaggtt

SEQ ID NO: 695103 - DNA, 20 bp, Artificial
  CRISPR gRNA sequence
cccataccctgaggttctga

SEQ ID NO: 695104 - DNA, 20 bp, Artificial
  CRISPR gRNA sequence
aggttctgagctccagacct

SEQ ID NO: 695105 - DNA, 20 bp, Artificial
  CRISPR gRNA sequence
tgagctccagaccttcaacc

SEQ ID NO: 695106 - DNA, 20 bp, Artificial
  CRISPR gRNA sequence
agctccagaccttcaaccat

SEQ ID NO: 695107 - DNA, 20 bp, Artificial
  CRISPR gRNA sequence
cagaccttcaaccatcaggc

SEQ ID NO: 695108 - DNA, 20 bp, Artificial
  CRISPR gRNA sequence
caaccatcaggccaggcccc

SEQ ID NO: 695109 - DNA, 20 bp, Artificial
  CRISPR gRNA sequence
aaccatcaggccaggcccct

SEQ ID NO: 695110 - DNA, 20 bp, Artificial
  CRISPR gRNA sequence
cagacctagactcccttcct

SEQ ID NO: 695111 - DNA, 20 bp, Artificial
  CRISPR gRNA sequence
gactcccttcctgtcttctc

SEQ ID NO: 695112 - DNA, 20 bp, Artificial
  CRISPR gRNA sequence
ccttcctgtcttctccagcc

SEQ ID NO: 695113 - DNA, 20 bp, Artificial
  CRISPR gRNA sequence
cctgtcttctccagccccac

SEQ ID NO: 695114 - DNA, 20 bp, Artificial
  CRISPR gRNA sequence
ctgtcttctccagccccact

SEQ ID NO: 695115 - DNA, 20 bp, Artificial
  CRISPR gRNA sequence
tcttctccagccccactctg

SEQ ID NO: 695116 - DNA, 20 bp, Artificial
  CRISPR gRNA sequence
ctccagccccactctgcttt

SEQ ID NO: 695117 - DNA, 20 bp, Artificial
  CRISPR gRNA sequence
tccagccccactctgctttg

SEQ ID NO: 695118 - DNA, 20 bp, Artificial
  CRISPR gRNA sequence
cagccccactctgctttgta

SEQ ID NO: 695119 - DNA, 20 bp, Artificial
  CRISPR gRNA sequence
tgctttgtatctacttctgg

SEQ ID NO: 695120 - DNA, 20 bp, Artificial
  CRISPR gRNA sequence
ctttgtatctacttctggat

SEQ ID NO: 695121 - DNA, 20 bp, Artificial
  CRISPR gRNA sequence
tgtatctacttctggatcac

SEQ ID NO: 695122 - DNA, 20 bp, Artificial
  CRISPR gRNA sequence
gtatctacttctggatcact

SEQ ID NO: 695123 - DNA, 20 bp, Artificial
  CRISPR gRNA sequence
tatctacttctggatcactt

SEQ ID NO: 695124 - DNA, 20 bp, Artificial
  CRISPR gRNA sequence
cttctggatcactttccctc

SEQ ID NO: 695125 - DNA, 20 bp, Artificial
  CRISPR gRNA sequence
ctggatcactttccctctac

SEQ ID NO: 695126 - DNA, 20 bp, Artificial
  CRISPR gRNA sequence
tggatcactttccctctaca

SEQ ID NO: 695127 - DNA, 20 bp, Artificial
  CRISPR gRNA sequence
gatcactttccctctacagg

SEQ ID NO: 695128 - DNA, 20 bp, Artificial
  CRISPR gRNA sequence
tccctctacaggcccagctc

SEQ ID NO: 695129 - DNA, 20 bp, Artificial
  CRISPR gRNA sequence
ccctctacaggcccagctcc

SEQ ID NO: 695130 - DNA, 20 bp, Artificial
  CRISPR gRNA sequence
cctctacaggcccagctcct

SEQ ID NO: 695131 - DNA, 20 bp, Artificial
  CRISPR gRNA sequence
tacaggcccagctcctgagt

SEQ ID NO: 695132 - DNA, 20 bp, Artificial
  CRISPR gRNA sequence
caggcccagctcctgagtgt

SEQ ID NO: 695133 - DNA, 20 bp, Artificial
  CRISPR gRNA sequence
ctgagtgtctctacctctca

SEQ ID NO: 695134 - DNA, 20 bp, Artificial
  CRISPR gRNA sequence
agtgtctctacctctcaaac

SEQ ID NO: 695135 - DNA, 20 bp, Artificial
  CRISPR gRNA sequence
tacctctcaaacaagtattc

SEQ ID NO: 695136 - DNA, 20 bp, Artificial
  CRISPR gRNA sequence
cctctcaaacaagtattctc

SEQ ID NO: 695137 - DNA, 20 bp, Artificial
  CRISPR gRNA sequence
tcaaacaagtattctcatcc

SEQ ID NO: 695138 - DNA, 20 bp, Artificial
  CRISPR gRNA sequence
aaacaagtattctcatccag

SEQ ID NO: 695139 - DNA, 20 bp, Artificial
  CRISPR gRNA sequence
tcatccaggagcaattttcc

SEQ ID NO: 695140 - DNA, 20 bp, Artificial
  CRISPR gRNA sequence
atccaggagcaattttccca

SEQ ID NO: 695141 - DNA, 20 bp, Artificial
  CRISPR gRNA sequence
tcccaccagaggacattagc

SEQ ID NO: 695142 - DNA, 20 bp, Artificial
  CRISPR gRNA sequence
cccaccagaggacattagct

SEQ ID NO: 695143 - DNA, 20 bp, Artificial
  CRISPR gRNA sequence
ccaccagaggacattagcta

SEQ ID NO: 695144 - DNA, 20 bp, Artificial
  CRISPR gRNA sequence
gctatgtctggaaaaatgtt

SEQ ID NO: 695145 - DNA, 20 bp, Artificial
  CRISPR gRNA sequence
tgtctggaaaaatgttttgt

SEQ ID NO: 695146 - DNA, 20 bp, Artificial
  CRISPR gRNA sequence
gaaaaatgttttgttgccat

SEQ ID NO: 695147 - DNA, 20 bp, Artificial
  CRISPR gRNA sequence
tgttgccatgactggagtga

SEQ ID NO: 695148 - DNA, 20 bp, Artificial
  CRISPR gRNA sequence
gttgccatgactggagtgag

SEQ ID NO: 695149 - DNA, 20 bp, Artificial
  CRISPR gRNA sequence
ttgccatgactggagtgagg

SEQ ID NO: 695150 - DNA, 20 bp, Artificial
  CRISPR gRNA sequence
ccatgactggagtgaggaga

SEQ ID NO: 695151 - DNA, 20 bp, Artificial
  CRISPR gRNA sequence
gagtgaggagaaggtgctac

SEQ ID NO: 695152 - DNA, 20 bp, Artificial
  CRISPR gRNA sequence
ccagcatcttgtggggaatg

SEQ ID NO: 695153 - DNA, 20 bp, Artificial
  CRISPR gRNA sequence
gtggggaatgaccagggatg

SEQ ID NO: 695154 - DNA, 20 bp, Artificial
  CRISPR gRNA sequence
tggggaatgaccagggatgc

SEQ ID NO: 695155 - DNA, 20 bp, Artificial
  CRISPR gRNA sequence
aacatcctgcagtgcacaag

SEQ ID NO: 695156 - DNA, 20 bp, Artificial
  CRISPR gRNA sequence
cagtgcacaagtcagcccaa

SEQ ID NO: 695157 - DNA, 20 bp, Artificial
  CRISPR gRNA sequence
tccagccccaataccaagat

SEQ ID NO: 695158 - DNA, 20 bp, Artificial
  CRISPR gRNA sequence
ccaagggtaaggaggcctgc

SEQ ID NO: 695159 - DNA, 20 bp, Artificial
  CRISPR gRNA sequence
ccaggactttctctcccttg

SEQ ID NO: 695160 - DNA, 20 bp, Artificial
  CRISPR gRNA sequence
tctctcccttgagtacaagc

SEQ ID NO: 695161 - DNA, 20 bp, Artificial
  CRISPR gRNA sequence
ctctcccttgagtacaagct

SEQ ID NO: 695162 - DNA, 20 bp, Artificial
  CRISPR gRNA sequence
tctcccttgagtacaagctt

SEQ ID NO: 695163 - DNA, 20 bp, Artificial
  CRISPR gRNA sequence
tcccttgagtacaagcttcc

SEQ ID NO: 695164 - DNA, 20 bp, Artificial
  CRISPR gRNA sequence
ccttgagtacaagcttcctt

SEQ ID NO: 695165 - DNA, 20 bp, Artificial
  CRISPR gRNA sequence
gagtacaagcttccttgaac

SEQ ID NO: 695166 - DNA, 20 bp, Artificial
  CRISPR gRNA sequence
agtacaagcttccttgaact

SEQ ID NO: 695167 - DNA, 20 bp, Artificial
  CRISPR gRNA sequence
ccttgaactgagggacaccc

SEQ ID NO: 695168 - DNA, 20 bp, Artificial
  CRISPR gRNA sequence
cttgaactgagggacaccct

SEQ ID NO: 695169 - DNA, 20 bp, Artificial
  CRISPR gRNA sequence
gaactgagggacaccctgaa

SEQ ID NO: 695170 - DNA, 20 bp, Artificial
  CRISPR gRNA sequence
aactgagggacaccctgaag

SEQ ID NO: 695171 - DNA, 20 bp, Artificial
  CRISPR gRNA sequence
agggacaccctgaaggaaaa

SEQ ID NO: 695172 - DNA, 20 bp, Artificial
  CRISPR gRNA sequence
aaggaaaagtgtggtcccac

SEQ ID NO: 695173 - DNA, 20 bp, Artificial
  CRISPR gRNA sequence
tcccttccctggagctccat

SEQ ID NO: 695174 - DNA, 20 bp, Artificial
  CRISPR gRNA sequence
ccttccctggagctccatct

SEQ ID NO: 695175 - DNA, 20 bp, Artificial
  CRISPR gRNA sequence
ccctggagctccatctgtat

SEQ ID NO: 695176 - DNA, 20 bp, Artificial
  CRISPR gRNA sequence
cctggagctccatctgtatg

SEQ ID NO: 695177 - DNA, 20 bp, Artificial
  CRISPR gRNA sequence
gagctccatctgtatgcctg

SEQ ID NO: 695178 - DNA, 20 bp, Artificial
  CRISPR gRNA sequence
catctgtatgcctgtagtgc

SEQ ID NO: 695179 - DNA, 20 bp, Artificial
  CRISPR gRNA sequence
tatgcctgtagtgcttaggc

SEQ ID NO: 695180 - DNA, 20 bp, Artificial
  CRISPR gRNA sequence
tagtgcttaggcctgtaacc

SEQ ID NO: 695181 - DNA, 20 bp, Artificial
  CRISPR gRNA sequence
aggcctgtaacctggggtcc

SEQ ID NO: 695182 - DNA, 20 bp, Artificial
  CRISPR gRNA sequence
ggcctgtaacctggggtcca

SEQ ID NO: 695183 - DNA, 20 bp, Artificial
  CRISPR gRNA sequence
taacctggggtccaggaacc

SEQ ID NO: 695184 - DNA, 20 bp, Artificial
  CRISPR gRNA sequence
gggtccaggaacccaccttc

SEQ ID NO: 695185 - DNA, 20 bp, Artificial
  CRISPR gRNA sequence
cccatgagactgcatgcaga

SEQ ID NO: 695186 - DNA, 20 bp, Artificial
  CRISPR gRNA sequence
ccatgagactgcatgcagaa

SEQ ID NO: 695187 - DNA, 20 bp, Artificial
  CRISPR gRNA sequence
catgcagaagtgatgatatg

SEQ ID NO: 695188 - DNA, 20 bp, Artificial
  CRISPR gRNA sequence
cattacagggcattggatat

SEQ ID NO: 695189 - DNA, 20 bp, Artificial
  CRISPR gRNA sequence
attacagggcattggatatt

SEQ ID NO: 695190 - DNA, 20 bp, Artificial
  CRISPR gRNA sequence
cagggcattggatattgata

SEQ ID NO: 695191 - DNA, 20 bp, Artificial
  CRISPR gRNA sequence
gatattgatattcatcaggt

SEQ ID NO: 695192 - DNA, 20 bp, Artificial
  CRISPR gRNA sequence
atattcatcaggtcagctgg

SEQ ID NO: 695193 - DNA, 20 bp, Artificial
  CRISPR gRNA sequence
atcaggtcagctggggccca

SEQ ID NO: 695194 - DNA, 20 bp, Artificial
  CRISPR gRNA sequence
gggcccaagacactactctt

SEQ ID NO: 695195 - DNA, 20 bp, Artificial
  CRISPR gRNA sequence
ctcttctgccaacaggccgc

SEQ ID NO: 695196 - DNA, 20 bp, Artificial
  CRISPR gRNA sequence
ttctgccaacaggccgcaat

SEQ ID NO: 695197 - DNA, 20 bp, Artificial
  CRISPR gRNA sequence
ctgccaacaggccgcaatcc

SEQ ID NO: 695198 - DNA, 20 bp, Artificial
  CRISPR gRNA sequence
tgccaacaggccgcaatcct

SEQ ID NO: 695199 - DNA, 20 bp, Artificial
  CRISPR gRNA sequence
ccaacaggccgcaatcctct

SEQ ID NO: 695200 - DNA, 20 bp, Artificial
  CRISPR gRNA sequence
tgcattagagagagggtaaa

SEQ ID NO: 695201 - DNA, 20 bp, Artificial
  CRISPR gRNA sequence
cattagagagagggtaaaga

SEQ ID NO: 695202 - DNA, 20 bp, Artificial
  CRISPR gRNA sequence
gagagagggtaaagattgag

SEQ ID NO: 695203 - DNA, 20 bp, Artificial
  CRISPR gRNA sequence
agggaggccctaacttcaaa

SEQ ID NO: 695204 - DNA, 20 bp, Artificial
  CRISPR gRNA sequence
acttcaaaccttctatcact

SEQ ID NO: 695205 - DNA, 20 bp, Artificial
  CRISPR gRNA sequence
caaaccttctatcactgcta

SEQ ID NO: 695206 - DNA, 20 bp, Artificial
  CRISPR gRNA sequence
aaaccttctatcactgctag

SEQ ID NO: 695207 - DNA, 20 bp, Artificial
  CRISPR gRNA sequence
ctatcactgctagtgaagtg

SEQ ID NO: 695208 - DNA, 20 bp, Artificial
  CRISPR gRNA sequence
tatcactgctagtgaagtgc

SEQ ID NO: 695209 - DNA, 20 bp, Artificial
  CRISPR gRNA sequence
tcactgctagtgaagtgcca

SEQ ID NO: 695210 - DNA, 20 bp, Artificial
  CRISPR gRNA sequence
ctagtgaagtgccaaaaaga

SEQ ID NO: 695211 - DNA, 20 bp, Artificial
  CRISPR gRNA sequence
gtgaagtgccaaaaagaagt

SEQ ID NO: 695212 - DNA, 20 bp, Artificial
  CRISPR gRNA sequence
cccttgtaggaaccacacag

SEQ ID NO: 695213 - DNA, 20 bp, Artificial
  CRISPR gRNA sequence
gtaggaaccacacaggaagg

SEQ ID NO: 695214 - DNA, 20 bp, Artificial
  CRISPR gRNA sequence
taggaaccacacaggaaggc

SEQ ID NO: 695215 - DNA, 20 bp, Artificial
  CRISPR gRNA sequence
catcaaagaaataatatttt

SEQ ID NO: 695216 - DNA, 20 bp, Artificial
  CRISPR gRNA sequence
tgacaaaaaatgcaagtcac

SEQ ID NO: 695217 - DNA, 20 bp, Artificial
  CRISPR gRNA sequence
gacaaaaaatgcaagtcacc

SEQ ID NO: 695218 - DNA, 20 bp, Artificial
  CRISPR gRNA sequence
acaaaaaatgcaagtcacct

SEQ ID NO: 695219 - DNA, 20 bp, Artificial
  CRISPR gRNA sequence
tctaagtcccagacagcagc

SEQ ID NO: 695220 - DNA, 20 bp, Artificial
  CRISPR gRNA sequence
ctaagtcccagacagcagct

SEQ ID NO: 695221 - DNA, 20 bp, Artificial
  CRISPR gRNA sequence
taagtcccagacagcagctc

SEQ ID NO: 695222 - DNA, 20 bp, Artificial
  CRISPR gRNA sequence
agtcccagacagcagctcaa

SEQ ID NO: 695223 - DNA, 20 bp, Artificial
  CRISPR gRNA sequence
aaaataaaaagcattaaacc

SEQ ID NO: 695224 - DNA, 20 bp, Artificial
  CRISPR gRNA sequence
aacccctcaaatcttagacc

SEQ ID NO: 695225 - DNA, 20 bp, Artificial
  CRISPR gRNA sequence
aaatcttagaccaggtgaaa

SEQ ID NO: 695226 - DNA, 20 bp, Artificial
  CRISPR gRNA sequence
agaccaggtgaaattattga

SEQ ID NO: 695227 - DNA, 20 bp, Artificial
  CRISPR gRNA sequence
gaccaggtgaaattattgaa

SEQ ID NO: 695228 - DNA, 20 bp, Artificial
  CRISPR gRNA sequence
ttgaagctgcagtaaggtct

SEQ ID NO: 695229 - DNA, 20 bp, Artificial
  CRISPR gRNA sequence
aagctgcagtaaggtcttgt

SEQ ID NO: 695230 - DNA, 20 bp, Artificial
  CRISPR gRNA sequence
cagtaaggtcttgtgggacc

SEQ ID NO: 695231 - DNA, 20 bp, Artificial
  CRISPR gRNA sequence
gtgggacctgcagttagaga

SEQ ID NO: 695232 - DNA, 20 bp, Artificial
  CRISPR gRNA sequence
tgggacctgcagttagagag

SEQ ID NO: 695233 - DNA, 20 bp, Artificial
  CRISPR gRNA sequence
cagttagagagaagggacaa

SEQ ID NO: 695234 - DNA, 20 bp, Artificial
  CRISPR gRNA sequence
gagagaagggacaactcaat

SEQ ID NO: 695235 - DNA, 20 bp, Artificial
  CRISPR gRNA sequence
aatttgggactgcagcagaa

SEQ ID NO: 695236 - DNA, 20 bp, Artificial
  CRISPR gRNA sequence
gggactgcagcagaaacccc

SEQ ID NO: 695237 - DNA, 20 bp, Artificial
  CRISPR gRNA sequence
ggactgcagcagaaacccct

SEQ ID NO: 695238 - DNA, 20 bp, Artificial
  CRISPR gRNA sequence
cagcagaaacccctacatca

SEQ ID NO: 695239 - DNA, 20 bp, Artificial
  CRISPR gRNA sequence
catcatggggttcctggaag

SEQ ID NO: 695240 - DNA, 20 bp, Artificial
  CRISPR gRNA sequence
ctggaagggaccctctccct

SEQ ID NO: 695241 - DNA, 20 bp, Artificial
  CRISPR gRNA sequence
gaagggaccctctcccttca

SEQ ID NO: 695242 - DNA, 20 bp, Artificial
  CRISPR gRNA sequence
tcccttcagcgacgcattgt

SEQ ID NO: 695243 - DNA, 20 bp, Artificial
  CRISPR gRNA sequence
ccttcagcgacgcattgtga

SEQ ID NO: 695244 - DNA, 20 bp, Artificial
  CRISPR gRNA sequence
cagcgacgcattgtgaggcc

SEQ ID NO: 695245 - DNA, 20 bp, Artificial
  CRISPR gRNA sequence
agcgacgcattgtgaggcca

SEQ ID NO: 695246 - DNA, 20 bp, Artificial
  CRISPR gRNA sequence
tgaggccatttctaggtaaa

SEQ ID NO: 695247 - DNA, 20 bp, Artificial
  CRISPR gRNA sequence
ctaggtaaaaaggtagaatt

SEQ ID NO: 695248 - DNA, 20 bp, Artificial
  CRISPR gRNA sequence
taggtaaaaaggtagaattt

SEQ ID NO: 695249 - DNA, 20 bp, Artificial
  CRISPR gRNA sequence
ggtaaaaaggtagaatttcc

SEQ ID NO: 695250 - DNA, 20 bp, Artificial
  CRISPR gRNA sequence
ccttggattcctgaggttta

SEQ ID NO: 695251 - DNA, 20 bp, Artificial
  CRISPR gRNA sequence
cttggattcctgaggtttat

SEQ ID NO: 695252 - DNA, 20 bp, Artificial
  CRISPR gRNA sequence
ggattcctgaggtttatttt

SEQ ID NO: 695253 - DNA, 20 bp, Artificial
  CRISPR gRNA sequence
gattcctgaggtttatttta

SEQ ID NO: 695254 - DNA, 20 bp, Artificial
  CRISPR gRNA sequence
ctgaggtttattttacactt

SEQ ID NO: 695255 - DNA, 20 bp, Artificial
  CRISPR gRNA sequence
aggtttattttacacttact

SEQ ID NO: 695256 - DNA, 20 bp, Artificial
  CRISPR gRNA sequence
attttacacttactgcttat

SEQ ID NO: 695257 - DNA, 20 bp, Artificial
  CRISPR gRNA sequence
ttttacacttactgcttatt

SEQ ID NO: 695258 - DNA, 20 bp, Artificial
  CRISPR gRNA sequence
tacacttactgcttattctt

SEQ ID NO: 695259 - DNA, 20 bp, Artificial
  CRISPR gRNA sequence
acacttactgcttattcttt

SEQ ID NO: 695260 - DNA, 20 bp, Artificial
  CRISPR gRNA sequence
cacttactgcttattctttg

SEQ ID NO: 695261 - DNA, 20 bp, Artificial
  CRISPR gRNA sequence
actgcttattctttgacttt

SEQ ID NO: 695262 - DNA, 20 bp, Artificial
  CRISPR gRNA sequence
ctgcttattctttgacttta

SEQ ID NO: 695263 - DNA, 20 bp, Artificial
  CRISPR gRNA sequence
cttattctttgactttatag

SEQ ID NO: 695264 - DNA, 20 bp, Artificial
  CRISPR gRNA sequence
attctttgactttatagaag

SEQ ID NO: 695265 - DNA, 20 bp, Artificial
  CRISPR gRNA sequence
ttctttgactttatagaagc

SEQ ID NO: 695266 - DNA, 20 bp, Artificial
  CRISPR gRNA sequence
tttgactttatagaagccaa

SEQ ID NO: 695267 - DNA, 20 bp, Artificial
  CRISPR gRNA sequence
tgactttatagaagccaact

SEQ ID NO: 695268 - DNA, 20 bp, Artificial
  CRISPR gRNA sequence
gactttatagaagccaactt

SEQ ID NO: 695269 - DNA, 20 bp, Artificial
  CRISPR gRNA sequence
actttatagaagccaacttc

SEQ ID NO: 695270 - DNA, 20 bp, Artificial
  CRISPR gRNA sequence
tatagaagccaacttcagtt

SEQ ID NO: 695271 - DNA, 20 bp, Artificial
  CRISPR gRNA sequence
atagaagccaacttcagttt

SEQ ID NO: 695272 - DNA, 20 bp, Artificial
  CRISPR gRNA sequence
tagaagccaacttcagtttg

SEQ ID NO: 695273 - DNA, 20 bp, Artificial
  CRISPR gRNA sequence
cagtttgaacatcttgcaat

SEQ ID NO: 695274 - DNA, 20 bp, Artificial
  CRISPR gRNA sequence
agtttgaacatcttgcaatt

SEQ ID NO: 695275 - DNA, 20 bp, Artificial
  CRISPR gRNA sequence
gaacatcttgcaattaattt

SEQ ID NO: 695276 - DNA, 20 bp, Artificial
  CRISPR gRNA sequence
aacatcttgcaattaatttt

SEQ ID NO: 695277 - DNA, 20 bp, Artificial
  CRISPR gRNA sequence
gcaattaattttttttggct

SEQ ID NO: 695278 - DNA, 20 bp, Artificial
  CRISPR gRNA sequence
caattaattttttttggctc

SEQ ID NO: 695279 - DNA, 20 bp, Artificial
  CRISPR gRNA sequence
attttttttggctctaagtg

SEQ ID NO: 695280 - DNA, 20 bp, Artificial
  CRISPR gRNA sequence
tttttggctctaagtggaga

SEQ ID NO: 695281 - DNA, 20 bp, Artificial
  CRISPR gRNA sequence
ttttggctctaagtggagaa

SEQ ID NO: 695282 - DNA, 20 bp, Artificial
  CRISPR gRNA sequence
tttggctctaagtggagaat

SEQ ID NO: 695283 - DNA, 20 bp, Artificial
  CRISPR gRNA sequence
ttggctctaagtggagaatt

SEQ ID NO: 695284 - DNA, 20 bp, Artificial
  CRISPR gRNA sequence
tggctctaagtggagaattt

SEQ ID NO: 695285 - DNA, 20 bp, Artificial
  CRISPR gRNA sequence
ggctctaagtggagaatttg

SEQ ID NO: 695286 - DNA, 20 bp, Artificial
  CRISPR gRNA sequence
gctctaagtggagaatttga

SEQ ID NO: 695287 - DNA, 20 bp, Artificial
  CRISPR gRNA sequence
taagtggagaatttgaactt

SEQ ID NO: 695288 - DNA, 20 bp, Artificial
  CRISPR gRNA sequence
agtggagaatttgaacttgt

SEQ ID NO: 695289 - DNA, 20 bp, Artificial
  CRISPR gRNA sequence
gaacttgtttctgaagaaaa

SEQ ID NO: 695290 - DNA, 20 bp, Artificial
  CRISPR gRNA sequence
aacttgtttctgaagaaaac

SEQ ID NO: 695291 - DNA, 20 bp, Artificial
  CRISPR gRNA sequence
gtttctgaagaaaaccaggg

SEQ ID NO: 695292 - DNA, 20 bp, Artificial
  CRISPR gRNA sequence
tttctgaagaaaaccagggg

SEQ ID NO: 695293 - DNA, 20 bp, Artificial
  CRISPR gRNA sequence
ctgaagaaaaccaggggctc

SEQ ID NO: 695294 - DNA, 20 bp, Artificial
  CRISPR gRNA sequence
tgaagaaaaccaggggctcc

SEQ ID NO: 695295 - DNA, 20 bp, Artificial
  CRISPR gRNA sequence
aagaaaaccaggggctcctt

SEQ ID NO: 695296 - DNA, 20 bp, Artificial
  CRISPR gRNA sequence
cttatgtgagcaagcaaccc

SEQ ID NO: 695297 - DNA, 20 bp, Artificial
  CRISPR gRNA sequence
atgtgagcaagcaaccctcc

SEQ ID NO: 695298 - DNA, 20 bp, Artificial
  CRISPR gRNA sequence
tgtgagcaagcaaccctccc

SEQ ID NO: 695299 - DNA, 20 bp, Artificial
  CRISPR gRNA sequence
cctgtggcccccttatgcaa

SEQ ID NO: 695300 - DNA, 20 bp, Artificial
  CRISPR gRNA sequence
tggcccccttatgcaataaa

SEQ ID NO: 695301 - DNA, 20 bp, Artificial
  CRISPR gRNA sequence
atgcaataaacataagccat

SEQ ID NO: 695302 - DNA, 20 bp, Artificial
  CRISPR gRNA sequence
tgcaataaacataagccatt

SEQ ID NO: 695303 - DNA, 20 bp, Artificial
  CRISPR gRNA sequence
tgagccagcaaaatttaaag

SEQ ID NO: 695304 - DNA, 20 bp, Artificial
  CRISPR gRNA sequence
aaagcaaggaaagcagtaaa

SEQ ID NO: 695305 - DNA, 20 bp, Artificial
  CRISPR gRNA sequence
aagcaaggaaagcagtaaac

SEQ ID NO: 695306 - DNA, 20 bp, Artificial
  CRISPR gRNA sequence
catttcagcatgtttcagcc

SEQ ID NO: 695307 - DNA, 20 bp, Artificial
  CRISPR gRNA sequence
cagcatgtttcagcctgtct

SEQ ID NO: 695308 - DNA, 20 bp, Artificial
  CRISPR gRNA sequence
agcatgtttcagcctgtcta

SEQ ID NO: 695309 - DNA, 20 bp, Artificial
  CRISPR gRNA sequence
cagcctgtctagtgatgttc

SEQ ID NO: 695310 - DNA, 20 bp, Artificial
  CRISPR gRNA sequence
agcctgtctagtgatgttct

SEQ ID NO: 695311 - DNA, 20 bp, Artificial
  CRISPR gRNA sequence
tctagtgatgttctagtctt

SEQ ID NO: 695312 - DNA, 20 bp, Artificial
  CRISPR gRNA sequence
gtgatgttctagtcttgcct

SEQ ID NO: 695313 - DNA, 20 bp, Artificial
  CRISPR gRNA sequence
tagtcttgcctcactcttaa

SEQ ID NO: 695314 - DNA, 20 bp, Artificial
  CRISPR gRNA sequence
gtcttgcctcactcttaaca

SEQ ID NO: 695315 - DNA, 20 bp, Artificial
  CRISPR gRNA sequence
gcctcactcttaacatttta

SEQ ID NO: 695316 - DNA, 20 bp, Artificial
  CRISPR gRNA sequence
cctcactcttaacattttaa

SEQ ID NO: 695317 - DNA, 20 bp, Artificial
  CRISPR gRNA sequence
actcttaacattttaaaatt

SEQ ID NO: 695318 - DNA, 20 bp, Artificial
  CRISPR gRNA sequence
ttaacattttaaaatttata

SEQ ID NO: 695319 - DNA, 20 bp, Artificial
  CRISPR gRNA sequence
aacattttaaaatttataat

SEQ ID NO: 695320 - DNA, 20 bp, Artificial
  CRISPR gRNA sequence
acattttaaaatttataatt

SEQ ID NO: 695321 - DNA, 20 bp, Artificial
  CRISPR gRNA sequence
taaaatttataattttattt

SEQ ID NO: 695322 - DNA, 20 bp, Artificial
  CRISPR gRNA sequence
aaaatttataattttatttg

SEQ ID NO: 695323 - DNA, 20 bp, Artificial
  CRISPR gRNA sequence
aaatttataattttatttga

SEQ ID NO: 695324 - DNA, 20 bp, Artificial
  CRISPR gRNA sequence
ataattttatttgattttga

SEQ ID NO: 695325 - DNA, 20 bp, Artificial
  CRISPR gRNA sequence
taattttatttgattttgat

SEQ ID NO: 695326 - DNA, 20 bp, Artificial
  CRISPR gRNA sequence
tatttgattttgatttaata

SEQ ID NO: 695327 - DNA, 20 bp, Artificial
  CRISPR gRNA sequence
atttgattttgatttaataa

SEQ ID NO: 695328 - DNA, 20 bp, Artificial
  CRISPR gRNA sequence
tttgattttgatttaataag

SEQ ID NO: 695329 - DNA, 20 bp, Artificial
  CRISPR gRNA sequence
gattttgatttaataagaat

SEQ ID NO: 695330 - DNA, 20 bp, Artificial
  CRISPR gRNA sequence
attttgatttaataagaatt

SEQ ID NO: 695331 - DNA, 20 bp, Artificial
  CRISPR gRNA sequence
tgatttaataagaattcata

SEQ ID NO: 695332 - DNA, 20 bp, Artificial
  CRISPR gRNA sequence
gatttaataagaattcatat

SEQ ID NO: 695333 - DNA, 20 bp, Artificial
  CRISPR gRNA sequence
atttaataagaattcatatg

SEQ ID NO: 695334 - DNA, 20 bp, Artificial
  CRISPR gRNA sequence
aataagaattcatatgtatt

SEQ ID NO: 695335 - DNA, 20 bp, Artificial
  CRISPR gRNA sequence
ataagaattcatatgtattc

SEQ ID NO: 695336 - DNA, 20 bp, Artificial
  CRISPR gRNA sequence
atatgtattcatttcttttg

SEQ ID NO: 695337 - DNA, 20 bp, Artificial
  CRISPR gRNA sequence
atttcttttgggtttgtcac

SEQ ID NO: 695338 - DNA, 20 bp, Artificial
  CRISPR gRNA sequence
cttttgggtttgtcaccaaa

SEQ ID NO: 695339 - DNA, 20 bp, Artificial
  CRISPR gRNA sequence
ttttgggtttgtcaccaaaa

SEQ ID NO: 695340 - DNA, 20 bp, Artificial
  CRISPR gRNA sequence
ttgggtttgtcaccaaaagc

SEQ ID NO: 695341 - DNA, 20 bp, Artificial
  CRISPR gRNA sequence
tgggtttgtcaccaaaagcc

SEQ ID NO: 695342 - DNA, 20 bp, Artificial
  CRISPR gRNA sequence
gggtttgtcaccaaaagcct

SEQ ID NO: 695343 - DNA, 20 bp, Artificial
  CRISPR gRNA sequence
ggtttgtcaccaaaagcctc

SEQ ID NO: 695344 - DNA, 20 bp, Artificial
  CRISPR gRNA sequence
gtcaccaaaagcctcctcca

SEQ ID NO: 695345 - DNA, 20 bp, Artificial
  CRISPR gRNA sequence
tcaccaaaagcctcctccaa

SEQ ID NO: 695346 - DNA, 20 bp, Artificial
  CRISPR gRNA sequence
ctccaatcacctgtggagta

SEQ ID NO: 695347 - DNA, 20 bp, Artificial
  CRISPR gRNA sequence
caatcacctgtggagtaaag

SEQ ID NO: 695348 - DNA, 20 bp, Artificial
  CRISPR gRNA sequence
tggagtaaagacaagtaaat

SEQ ID NO: 695349 - DNA, 20 bp, Artificial
  CRISPR gRNA sequence
ccatttatcagtgctcactg

SEQ ID NO: 695350 - DNA, 20 bp, Artificial
  CRISPR gRNA sequence
atcagtgctcactgcatctt

SEQ ID NO: 695351 - DNA, 20 bp, Artificial
  CRISPR gRNA sequence
tcagtgctcactgcatctta

SEQ ID NO: 695352 - DNA, 20 bp, Artificial
  CRISPR gRNA sequence
actgcatcttacaagtgtat

SEQ ID NO: 695353 - DNA, 20 bp, Artificial
  CRISPR gRNA sequence
catcttacaagtgtatcagc

SEQ ID NO: 695354 - DNA, 20 bp, Artificial
  CRISPR gRNA sequence
acaagtgtatcagccccact

SEQ ID NO: 695355 - DNA, 20 bp, Artificial
  CRISPR gRNA sequence
caagtgtatcagccccactt

SEQ ID NO: 695356 - DNA, 20 bp, Artificial
  CRISPR gRNA sequence
cagctgatagtaccaggaaa

SEQ ID NO: 695357 - DNA, 20 bp, Artificial
  CRISPR gRNA sequence
agctgatagtaccaggaaac

SEQ ID NO: 695358 - DNA, 20 bp, Artificial
  CRISPR gRNA sequence
atagtaccaggaaaccttaa

SEQ ID NO: 695359 - DNA, 20 bp, Artificial
  CRISPR gRNA sequence
aatacccacatacaaaataa

SEQ ID NO: 695360 - DNA, 20 bp, Artificial
  CRISPR gRNA sequence
atacccacatacaaaataat

SEQ ID NO: 695361 - DNA, 20 bp, Artificial
  CRISPR gRNA sequence
gacaaaattcatagcatcac

SEQ ID NO: 695362 - DNA, 20 bp, Artificial
  CRISPR gRNA sequence
atagcatcaccttacaccat

SEQ ID NO: 695363 - DNA, 20 bp, Artificial
  CRISPR gRNA sequence
acaccatattcaaaaattaa

SEQ ID NO: 695364 - DNA, 20 bp, Artificial
  CRISPR gRNA sequence
caccatattcaaaaattaac

SEQ ID NO: 695365 - DNA, 20 bp, Artificial
  CRISPR gRNA sequence
aaaaattaactcaattaact

SEQ ID NO: 695366 - DNA, 20 bp, Artificial
  CRISPR gRNA sequence
actcaattaactcagaatgg

SEQ ID NO: 695367 - DNA, 20 bp, Artificial
  CRISPR gRNA sequence
aattaactcagaatggttca

SEQ ID NO: 695368 - DNA, 20 bp, Artificial
  CRISPR gRNA sequence
actcagaatggttcaaggaa

SEQ ID NO: 695369 - DNA, 20 bp, Artificial
  CRISPR gRNA sequence
agaatggttcaaggaactca

SEQ ID NO: 695370 - DNA, 20 bp, Artificial
  CRISPR gRNA sequence
aaggaactcaacttaggagt

SEQ ID NO: 695371 - DNA, 20 bp, Artificial
  CRISPR gRNA sequence
aacttaggagttcaacctat

SEQ ID NO: 695372 - DNA, 20 bp, Artificial
  CRISPR gRNA sequence
aggagttcaacctataaatc

SEQ ID NO: 695373 - DNA, 20 bp, Artificial
  CRISPR gRNA sequence
ggagttcaacctataaatct

SEQ ID NO: 695374 - DNA, 20 bp, Artificial
  CRISPR gRNA sequence
aacctataaatcttttagaa

SEQ ID NO: 695375 - DNA, 20 bp, Artificial
  CRISPR gRNA sequence
taaatcttttagaagaaaac

SEQ ID NO: 695376 - DNA, 20 bp, Artificial
  CRISPR gRNA sequence
ttagaagaaaacattgaaga

SEQ ID NO: 695377 - DNA, 20 bp, Artificial
  CRISPR gRNA sequence
tagaagaaaacattgaagaa

SEQ ID NO: 695378 - DNA, 20 bp, Artificial
  CRISPR gRNA sequence
agaagaaaacattgaagaaa

SEQ ID NO: 695379 - DNA, 20 bp, Artificial
  CRISPR gRNA sequence
gaagaaaacattgaagaaaa

SEQ ID NO: 695380 - DNA, 20 bp, Artificial
  CRISPR gRNA sequence
aagaaaatcttaggaacatt

SEQ ID NO: 695381 - DNA, 20 bp, Artificial
  CRISPR gRNA sequence
aggaacattggatgtggcaa

SEQ ID NO: 695382 - DNA, 20 bp, Artificial
  CRISPR gRNA sequence
ggaacattggatgtggcaat

SEQ ID NO: 695383 - DNA, 20 bp, Artificial
  CRISPR gRNA sequence
gatgtggcaatggcttcttg

SEQ ID NO: 695384 - DNA, 20 bp, Artificial
  CRISPR gRNA sequence
cttggctggtgagcaaaagc

SEQ ID NO: 695385 - DNA, 20 bp, Artificial
  CRISPR gRNA sequence
ttggctggtgagcaaaagca

SEQ ID NO: 695386 - DNA, 20 bp, Artificial
  CRISPR gRNA sequence
ggctggtgagcaaaagcaca

SEQ ID NO: 695387 - DNA, 20 bp, Artificial
  CRISPR gRNA sequence
gctggtgagcaaaagcacaa

SEQ ID NO: 695388 - DNA, 20 bp, Artificial
  CRISPR gRNA sequence
gtgagcaaaagcacaaccaa

SEQ ID NO: 695389 - DNA, 20 bp, Artificial
  CRISPR gRNA sequence
gactatcaaaatttaaaaac

SEQ ID NO: 695390 - DNA, 20 bp, Artificial
  CRISPR gRNA sequence
tcaaaatttaaaaacctttt

SEQ ID NO: 695391 - DNA, 20 bp, Artificial
  CRISPR gRNA sequence
aaaaaccttttttatatatc

SEQ ID NO: 695392 - DNA, 20 bp, Artificial
  CRISPR gRNA sequence
aaaaccttttttatatatca

SEQ ID NO: 695393 - DNA, 20 bp, Artificial
  CRISPR gRNA sequence
ttttatatatcaagggacac

SEQ ID NO: 695394 - DNA, 20 bp, Artificial
  CRISPR gRNA sequence
tttatatatcaagggacact

SEQ ID NO: 695395 - DNA, 20 bp, Artificial
  CRISPR gRNA sequence
ttatatatcaagggacacta

SEQ ID NO: 695396 - DNA, 20 bp, Artificial
  CRISPR gRNA sequence
tatatatcaagggacactat

SEQ ID NO: 695397 - DNA, 20 bp, Artificial
  CRISPR gRNA sequence
atatatcaagggacactatt

SEQ ID NO: 695398 - DNA, 20 bp, Artificial
  CRISPR gRNA sequence
tatatcaagggacactatta

SEQ ID NO: 695399 - DNA, 20 bp, Artificial
  CRISPR gRNA sequence
ttaagagagttaaaagaaaa

SEQ ID NO: 695400 - DNA, 20 bp, Artificial
  CRISPR gRNA sequence
agagagttaaaagaaaatgc

SEQ ID NO: 695401 - DNA, 20 bp, Artificial
  CRISPR gRNA sequence
aaagaaaatgcacagaatgg

SEQ ID NO: 695402 - DNA, 20 bp, Artificial
  CRISPR gRNA sequence
gccagttatatacctgataa

SEQ ID NO: 695403 - DNA, 20 bp, Artificial
  CRISPR gRNA sequence
ccagttatatacctgataaa

SEQ ID NO: 695404 - DNA, 20 bp, Artificial
  CRISPR gRNA sequence
tatacctgataaagaattaa

SEQ ID NO: 695405 - DNA, 20 bp, Artificial
  CRISPR gRNA sequence
ataaagaattaatatccaga

SEQ ID NO: 695406 - DNA, 20 bp, Artificial
  CRISPR gRNA sequence
atatccagaatacataaaga

SEQ ID NO: 695407 - DNA, 20 bp, Artificial
  CRISPR gRNA sequence
tgacttaacaacagaaaaac

SEQ ID NO: 695408 - DNA, 20 bp, Artificial
  CRISPR gRNA sequence
aacaacagaaaaacaaacaa

SEQ ID NO: 695409 - DNA, 20 bp, Artificial
  CRISPR gRNA sequence
acaacagaaaaacaaacaat

SEQ ID NO: 695410 - DNA, 20 bp, Artificial
  CRISPR gRNA sequence
attcaaaaatgagtgaacaa

SEQ ID NO: 695411 - DNA, 20 bp, Artificial
  CRISPR gRNA sequence
aaaaatgagtgaacaacatg

SEQ ID NO: 695412 - DNA, 20 bp, Artificial
  CRISPR gRNA sequence
tccaaagaagatatacaaat

SEQ ID NO: 695413 - DNA, 20 bp, Artificial
  CRISPR gRNA sequence
caaagaagatatacaaatgg

SEQ ID NO: 695414 - DNA, 20 bp, Artificial
  CRISPR gRNA sequence
aacttcactagtccaaatgt

SEQ ID NO: 695415 - DNA, 20 bp, Artificial
  CRISPR gRNA sequence
cactagtccaaatgttggcg

SEQ ID NO: 695416 - DNA, 20 bp, Artificial
  CRISPR gRNA sequence
actagtccaaatgttggcga

SEQ ID NO: 695417 - DNA, 20 bp, Artificial
  CRISPR gRNA sequence
gtccaaatgttggcgaagat

SEQ ID NO: 695418 - DNA, 20 bp, Artificial
  CRISPR gRNA sequence
gcgaagatgtggagaagtca

SEQ ID NO: 695419 - DNA, 20 bp, Artificial
  CRISPR gRNA sequence
gtacactgctggtgagagtg

SEQ ID NO: 695420 - DNA, 20 bp, Artificial
  CRISPR gRNA sequence
tacactgctggtgagagtgt

SEQ ID NO: 695421 - DNA, 20 bp, Artificial
  CRISPR gRNA sequence
ctggtgagagtgtacagtgg

SEQ ID NO: 695422 - DNA, 20 bp, Artificial
  CRISPR gRNA sequence
gtgagagtgtacagtggtac

SEQ ID NO: 695423 - DNA, 20 bp, Artificial
  CRISPR gRNA sequence
cctcaagaaagtaaaaacac

SEQ ID NO: 695424 - DNA, 20 bp, Artificial
  CRISPR gRNA sequence
ctcaagaaagtaaaaacaca

SEQ ID NO: 695425 - DNA, 20 bp, Artificial
  CRISPR gRNA sequence
aagaaagtaaaaacacaatt

SEQ ID NO: 695426 - DNA, 20 bp, Artificial
  CRISPR gRNA sequence
ccataggagccaacaattcc

SEQ ID NO: 695427 - DNA, 20 bp, Artificial
  CRISPR gRNA sequence
cataggagccaacaattcca

SEQ ID NO: 695428 - DNA, 20 bp, Artificial
  CRISPR gRNA sequence
cacttttgggcatataccca

SEQ ID NO: 695429 - DNA, 20 bp, Artificial
  CRISPR gRNA sequence
ttgggcatatacccaaaaga

SEQ ID NO: 695430 - DNA, 20 bp, Artificial
  CRISPR gRNA sequence
tgggcatatacccaaaagaa

SEQ ID NO: 695431 - DNA, 20 bp, Artificial
  CRISPR gRNA sequence
gggcatatacccaaaagaat

SEQ ID NO: 695432 - DNA, 20 bp, Artificial
  CRISPR gRNA sequence
ggcatatacccaaaagaatt

SEQ ID NO: 695433 - DNA, 20 bp, Artificial
  CRISPR gRNA sequence
aaagcaggaactcacacaga

SEQ ID NO: 695434 - DNA, 20 bp, Artificial
  CRISPR gRNA sequence
acacagataattgtacactc

SEQ ID NO: 695435 - DNA, 20 bp, Artificial
  CRISPR gRNA sequence
tacactcatgctcgtagcag

SEQ ID NO: 695436 - DNA, 20 bp, Artificial
  CRISPR gRNA sequence
atgctcgtagcagcactatt

SEQ ID NO: 695437 - DNA, 20 bp, Artificial
  CRISPR gRNA sequence
gtagcagcactattcccaat

SEQ ID NO: 695438 - DNA, 20 bp, Artificial
  CRISPR gRNA sequence
ttcccaatggccaaaaggtg

SEQ ID NO: 695439 - DNA, 20 bp, Artificial
  CRISPR gRNA sequence
ccaatggccaaaaggtggaa

SEQ ID NO: 695440 - DNA, 20 bp, Artificial
  CRISPR gRNA sequence
gataaacgacccatggtgca

SEQ ID NO: 695441 - DNA, 20 bp, Artificial
  CRISPR gRNA sequence
ttcagccttaaaagtgaatg

SEQ ID NO: 695442 - DNA, 20 bp, Artificial
  CRISPR gRNA sequence
agccttaaaagtgaatgaaa

SEQ ID NO: 695443 - DNA, 20 bp, Artificial
  CRISPR gRNA sequence
aaaagtgaatgaaattcagg

SEQ ID NO: 695444 - DNA, 20 bp, Artificial
  CRISPR gRNA sequence
aaagtgaatgaaattcaggt

SEQ ID NO: 695445 - DNA, 20 bp, Artificial
  CRISPR gRNA sequence
aggttgcatgaaccttgaga

SEQ ID NO: 695446 - DNA, 20 bp, Artificial
  CRISPR gRNA sequence
catgaaccttgagaacactg

SEQ ID NO: 695447 - DNA, 20 bp, Artificial
  CRISPR gRNA sequence
gagaacactgtaagtgaaat

SEQ ID NO: 695448 - DNA, 20 bp, Artificial
  CRISPR gRNA sequence
agaacactgtaagtgaaatg

SEQ ID NO: 695449 - DNA, 20 bp, Artificial
  CRISPR gRNA sequence
taagtgaaatgagccagaaa

SEQ ID NO: 695450 - DNA, 20 bp, Artificial
  CRISPR gRNA sequence
cacttatgtgatgcagctaa

SEQ ID NO: 695451 - DNA, 20 bp, Artificial
  CRISPR gRNA sequence
acttatgtgatgcagctaaa

SEQ ID NO: 695452 - DNA, 20 bp, Artificial
  CRISPR gRNA sequence
atgtgatgcagctaaaatag

SEQ ID NO: 695453 - DNA, 20 bp, Artificial
  CRISPR gRNA sequence
tgtgatgcagctaaaatagg

SEQ ID NO: 695454 - DNA, 20 bp, Artificial
  CRISPR gRNA sequence
aaataggcaaattcatagaa

SEQ ID NO: 695455 - DNA, 20 bp, Artificial
  CRISPR gRNA sequence
atagaaacagagagtaaaat

SEQ ID NO: 695456 - DNA, 20 bp, Artificial
  CRISPR gRNA sequence
accagaaattgagggtaggg

SEQ ID NO: 695457 - DNA, 20 bp, Artificial
  CRISPR gRNA sequence
ccagaaattgagggtaggga

SEQ ID NO: 695458 - DNA, 20 bp, Artificial
  CRISPR gRNA sequence
agggtagggagaatgggcag

SEQ ID NO: 695459 - DNA, 20 bp, Artificial
  CRISPR gRNA sequence
tggtttaatgggtccagttt

SEQ ID NO: 695460 - DNA, 20 bp, Artificial
  CRISPR gRNA sequence
ggtttaatgggtccagtttc

SEQ ID NO: 695461 - DNA, 20 bp, Artificial
  CRISPR gRNA sequence
gtttaatgggtccagtttct

SEQ ID NO: 695462 - DNA, 20 bp, Artificial
  CRISPR gRNA sequence
aatgggtccagtttctgttg

SEQ ID NO: 695463 - DNA, 20 bp, Artificial
  CRISPR gRNA sequence
atgggtccagtttctgttgg

SEQ ID NO: 695464 - DNA, 20 bp, Artificial
  CRISPR gRNA sequence
ctgttgggatgatgaaaatg

SEQ ID NO: 695465 - DNA, 20 bp, Artificial
  CRISPR gRNA sequence
tgttgggatgatgaaaatgt

SEQ ID NO: 695466 - DNA, 20 bp, Artificial
  CRISPR gRNA sequence
ttgggatgatgaaaatgttc

SEQ ID NO: 695467 - DNA, 20 bp, Artificial
  CRISPR gRNA sequence
ggatgatgaaaatgttctgg

SEQ ID NO: 695468 - DNA, 20 bp, Artificial
  CRISPR gRNA sequence
tggaaatgcatattggtggt

SEQ ID NO: 695469 - DNA, 20 bp, Artificial
  CRISPR gRNA sequence
gaaatgcatattggtggtgg

SEQ ID NO: 695470 - DNA, 20 bp, Artificial
  CRISPR gRNA sequence
gtggtggttacacaacattg

SEQ ID NO: 695471 - DNA, 20 bp, Artificial
  CRISPR gRNA sequence
cacaacattgtaaatgtgct

SEQ ID NO: 695472 - DNA, 20 bp, Artificial
  CRISPR gRNA sequence
taaatgtgctttaggccacc

SEQ ID NO: 695473 - DNA, 20 bp, Artificial
  CRISPR gRNA sequence
taggccaccgaattgtacac

SEQ ID NO: 695474 - DNA, 20 bp, Artificial
  CRISPR gRNA sequence
aggccaccgaattgtacact

SEQ ID NO: 695475 - DNA, 20 bp, Artificial
  CRISPR gRNA sequence
ggccaccgaattgtacactg

SEQ ID NO: 695476 - DNA, 20 bp, Artificial
  CRISPR gRNA sequence
tacactgaaaaagtggttag

SEQ ID NO: 695477 - DNA, 20 bp, Artificial
  CRISPR gRNA sequence
aaaaagtggttagaaggtaa

SEQ ID NO: 695478 - DNA, 20 bp, Artificial
  CRISPR gRNA sequence
gaaggtaaattacatggtat

SEQ ID NO: 695479 - DNA, 20 bp, Artificial
  CRISPR gRNA sequence
catggtatgtatgttttacc

SEQ ID NO: 695480 - DNA, 20 bp, Artificial
  CRISPR gRNA sequence
taccacaatattaacaagta

SEQ ID NO: 695481 - DNA, 20 bp, Artificial
  CRISPR gRNA sequence
accacaatattaacaagtat

SEQ ID NO: 695482 - DNA, 20 bp, Artificial
  CRISPR gRNA sequence
ccacaatattaacaagtata

SEQ ID NO: 695483 - DNA, 20 bp, Artificial
  CRISPR gRNA sequence
acaagtatatcaacactaaa

SEQ ID NO: 695484 - DNA, 20 bp, Artificial
  CRISPR gRNA sequence
aatccaatcacttttcactc

SEQ ID NO: 695485 - DNA, 20 bp, Artificial
  CRISPR gRNA sequence
ttcactcctctcctgccacc

SEQ ID NO: 695486 - DNA, 20 bp, Artificial
  CRISPR gRNA sequence
tcactcctctcctgccacca

SEQ ID NO: 695487 - DNA, 20 bp, Artificial
  CRISPR gRNA sequence
cactcctctcctgccaccac

SEQ ID NO: 695488 - DNA, 20 bp, Artificial
  CRISPR gRNA sequence
actcctctcctgccaccacc

SEQ ID NO: 695489 - DNA, 20 bp, Artificial
  CRISPR gRNA sequence
ctctcctgccaccacccgag

SEQ ID NO: 695490 - DNA, 20 bp, Artificial
  CRISPR gRNA sequence
tcctgccaccacccgagagc

SEQ ID NO: 695491 - DNA, 20 bp, Artificial
  CRISPR gRNA sequence
ctgccaccacccgagagcca

SEQ ID NO: 695492 - DNA, 20 bp, Artificial
  CRISPR gRNA sequence
ccaccacccgagagccaccc

SEQ ID NO: 695493 - DNA, 20 bp, Artificial
  CRISPR gRNA sequence
tcaagaattgtaaaccagaa

SEQ ID NO: 695494 - DNA, 20 bp, Artificial
  CRISPR gRNA sequence
aagaattgtaaaccagaagg

SEQ ID NO: 695495 - DNA, 20 bp, Artificial
  CRISPR gRNA sequence
taaaccagaagggctttcca

SEQ ID NO: 695496 - DNA, 20 bp, Artificial
  CRISPR gRNA sequence
tccagctgggctgcctgctg

SEQ ID NO: 695497 - DNA, 20 bp, Artificial
  CRISPR gRNA sequence
ccagctgggctgcctgctgc

SEQ ID NO: 695498 - DNA, 20 bp, Artificial
  CRISPR gRNA sequence
cagctgggctgcctgctgcc

SEQ ID NO: 695499 - DNA, 20 bp, Artificial
  CRISPR gRNA sequence
ggctgcctgctgcctctcat

SEQ ID NO: 695500 - DNA, 20 bp, Artificial
  CRISPR gRNA sequence
cctgctgcctctcatgccca

SEQ ID NO: 695501 - DNA, 20 bp, Artificial
  CRISPR gRNA sequence
ctgcctctcatgcccactgt

SEQ ID NO: 695502 - DNA, 20 bp, Artificial
  CRISPR gRNA sequence
cctctcatgcccactgtcca

SEQ ID NO: 695503 - DNA, 20 bp, Artificial
  CRISPR gRNA sequence
tcatgcccactgtccattac

SEQ ID NO: 695504 - DNA, 20 bp, Artificial
  CRISPR gRNA sequence
atgcccactgtccattactc

SEQ ID NO: 695505 - DNA, 20 bp, Artificial
  CRISPR gRNA sequence
tccattactcacacaaaggc

SEQ ID NO: 695506 - DNA, 20 bp, Artificial
  CRISPR gRNA sequence
ctcacacaaaggcagagtga

SEQ ID NO: 695507 - DNA, 20 bp, Artificial
  CRISPR gRNA sequence
acacaaaggcagagtgagcc

SEQ ID NO: 695508 - DNA, 20 bp, Artificial
  CRISPR gRNA sequence
tcaaacgaaaattaggacat

SEQ ID NO: 695509 - DNA, 20 bp, Artificial
  CRISPR gRNA sequence
aaacgaaaattaggacatat

SEQ ID NO: 695510 - DNA, 20 bp, Artificial
  CRISPR gRNA sequence
ggacatatcctatgaacacc

SEQ ID NO: 695511 - DNA, 20 bp, Artificial
  CRISPR gRNA sequence
tgaacacctcagcccttttc

SEQ ID NO: 695512 - DNA, 20 bp, Artificial
  CRISPR gRNA sequence
agcccttttctttcctaggc

SEQ ID NO: 695513 - DNA, 20 bp, Artificial
  CRISPR gRNA sequence
ttctttcctaggcacaatga

SEQ ID NO: 695514 - DNA, 20 bp, Artificial
  CRISPR gRNA sequence
tctttcctaggcacaatgaa

SEQ ID NO: 695515 - DNA, 20 bp, Artificial
  CRISPR gRNA sequence
ctttcctaggcacaatgaaa

SEQ ID NO: 695516 - DNA, 20 bp, Artificial
  CRISPR gRNA sequence
tttcctaggcacaatgaaac

SEQ ID NO: 695517 - DNA, 20 bp, Artificial
  CRISPR gRNA sequence
tcctaggcacaatgaaacct

SEQ ID NO: 695518 - DNA, 20 bp, Artificial
  CRISPR gRNA sequence
cctaggcacaatgaaacctc

SEQ ID NO: 695519 - DNA, 20 bp, Artificial
  CRISPR gRNA sequence
ctaggcacaatgaaacctca

SEQ ID NO: 695520 - DNA, 20 bp, Artificial
  CRISPR gRNA sequence
ggcacaatgaaacctcagtc

SEQ ID NO: 695521 - DNA, 20 bp, Artificial
  CRISPR gRNA sequence
agtctctcaccgtttcctac

SEQ ID NO: 695522 - DNA, 20 bp, Artificial
  CRISPR gRNA sequence
tcaccgtttcctacaagccc

SEQ ID NO: 695523 - DNA, 20 bp, Artificial
  CRISPR gRNA sequence
accgtttcctacaagcccct

SEQ ID NO: 695524 - DNA, 20 bp, Artificial
  CRISPR gRNA sequence
cctacaagcccctcatcata

SEQ ID NO: 695525 - DNA, 20 bp, Artificial
  CRISPR gRNA sequence
ctacaagcccctcatcatag

SEQ ID NO: 695526 - DNA, 20 bp, Artificial
  CRISPR gRNA sequence
caagcccctcatcataggac

SEQ ID NO: 695527 - DNA, 20 bp, Artificial
  CRISPR gRNA sequence
atcataggacccctgtggcc

SEQ ID NO: 695528 - DNA, 20 bp, Artificial
  CRISPR gRNA sequence
tggcctcatcccgccattct

SEQ ID NO: 695529 - DNA, 20 bp, Artificial
  CRISPR gRNA sequence
atcccgccattctcagccca

SEQ ID NO: 695530 - DNA, 20 bp, Artificial
  CRISPR gRNA sequence
tcagcccagctcactcatct

SEQ ID NO: 695531 - DNA, 20 bp, Artificial
  CRISPR gRNA sequence
agcccagctcactcatctcc

SEQ ID NO: 695532 - DNA, 20 bp, Artificial
  CRISPR gRNA sequence
actcatctccactcacacca

SEQ ID NO: 695533 - DNA, 20 bp, Artificial
  CRISPR gRNA sequence
atctccactcacaccagcct

SEQ ID NO: 695534 - DNA, 20 bp, Artificial
  CRISPR gRNA sequence
cactcacaccagccttttgt

SEQ ID NO: 695535 - DNA, 20 bp, Artificial
  CRISPR gRNA sequence
acaccagccttttgtcactg

SEQ ID NO: 695536 - DNA, 20 bp, Artificial
  CRISPR gRNA sequence
ttgtcactgctccatcctgt

SEQ ID NO: 695537 - DNA, 20 bp, Artificial
  CRISPR gRNA sequence
tgtcactgctccatcctgtc

SEQ ID NO: 695538 - DNA, 20 bp, Artificial
  CRISPR gRNA sequence
gtcactgctccatcctgtct

SEQ ID NO: 695539 - DNA, 20 bp, Artificial
  CRISPR gRNA sequence
tcactgctccatcctgtctc

SEQ ID NO: 695540 - DNA, 20 bp, Artificial
  CRISPR gRNA sequence
ctccatcctgtctctgctac

SEQ ID NO: 695541 - DNA, 20 bp, Artificial
  CRISPR gRNA sequence
catcctgtctctgctacctg

SEQ ID NO: 695542 - DNA, 20 bp, Artificial
  CRISPR gRNA sequence
tctctgctacctgcccctgc

SEQ ID NO: 695543 - DNA, 20 bp, Artificial
  CRISPR gRNA sequence
tgctacctgcccctgctgtg

SEQ ID NO: 695544 - DNA, 20 bp, Artificial
  CRISPR gRNA sequence
ctacctgcccctgctgtgac

SEQ ID NO: 695545 - DNA, 20 bp, Artificial
  CRISPR gRNA sequence
cctgcccctgctgtgactcc

SEQ ID NO: 695546 - DNA, 20 bp, Artificial
  CRISPR gRNA sequence
cccctgctgtgactcccaca

SEQ ID NO: 695547 - DNA, 20 bp, Artificial
  CRISPR gRNA sequence
ctgtgactcccacatgcacc

SEQ ID NO: 695548 - DNA, 20 bp, Artificial
  CRISPR gRNA sequence
tgactcccacatgcacctgc

SEQ ID NO: 695549 - DNA, 20 bp, Artificial
  CRISPR gRNA sequence
ccacatgcacctgctccccg

SEQ ID NO: 695550 - DNA, 20 bp, Artificial
  CRISPR gRNA sequence
ctccccgggggtccacatgg

SEQ ID NO: 695551 - DNA, 20 bp, Artificial
  CRISPR gRNA sequence
cccgggggtccacatggctc

SEQ ID NO: 695552 - DNA, 20 bp, Artificial
  CRISPR gRNA sequence
actcctcacaccattcgagt

SEQ ID NO: 695553 - DNA, 20 bp, Artificial
  CRISPR gRNA sequence
ctcacaccattcgagtctct

SEQ ID NO: 695554 - DNA, 20 bp, Artificial
  CRISPR gRNA sequence
acaccattcgagtctctgtt

SEQ ID NO: 695555 - DNA, 20 bp, Artificial
  CRISPR gRNA sequence
gagtctctgttcaaatgtcc

SEQ ID NO: 695556 - DNA, 20 bp, Artificial
  CRISPR gRNA sequence
tgttcaaatgtcccatggtc

SEQ ID NO: 695557 - DNA, 20 bp, Artificial
  CRISPR gRNA sequence
ttcaaatgtcccatggtcaa

SEQ ID NO: 695558 - DNA, 20 bp, Artificial
  CRISPR gRNA sequence
aaatgtcccatggtcaagtt

SEQ ID NO: 695559 - DNA, 20 bp, Artificial
  CRISPR gRNA sequence
tcagaaatgtcatgcccagt

SEQ ID NO: 695560 - DNA, 20 bp, Artificial
  CRISPR gRNA sequence
agaaatgtcatgcccagtta

SEQ ID NO: 695561 - DNA, 20 bp, Artificial
  CRISPR gRNA sequence
ccttttctgaaatctattcc

SEQ ID NO: 695562 - DNA, 20 bp, Artificial
  CRISPR gRNA sequence
ttctgaaatctattccctgc

SEQ ID NO: 695563 - DNA, 20 bp, Artificial
  CRISPR gRNA sequence
tctgaaatctattccctgcc

SEQ ID NO: 695564 - DNA, 20 bp, Artificial
  CRISPR gRNA sequence
ctgaaatctattccctgcca

SEQ ID NO: 695565 - DNA, 20 bp, Artificial
  CRISPR gRNA sequence
tgaaatctattccctgccat

SEQ ID NO: 695566 - DNA, 20 bp, Artificial
  CRISPR gRNA sequence
aaatctattccctgccattc

SEQ ID NO: 695567 - DNA, 20 bp, Artificial
  CRISPR gRNA sequence
ttccctgccattcccgccac

SEQ ID NO: 695568 - DNA, 20 bp, Artificial
  CRISPR gRNA sequence
cctgccattcccgccactcc

SEQ ID NO: 695569 - DNA, 20 bp, Artificial
  CRISPR gRNA sequence
ccattcccgccactcccacc

SEQ ID NO: 695570 - DNA, 20 bp, Artificial
  CRISPR gRNA sequence
ccgccactcccaccaatctt

SEQ ID NO: 695571 - DNA, 20 bp, Artificial
  CRISPR gRNA sequence
ccaccaatcttctagcctag

SEQ ID NO: 695572 - DNA, 20 bp, Artificial
  CRISPR gRNA sequence
ctagcctaggtgtatttttt

SEQ ID NO: 695573 - DNA, 20 bp, Artificial
  CRISPR gRNA sequence
tagcctaggtgtatttttta

SEQ ID NO: 695574 - DNA, 20 bp, Artificial
  CRISPR gRNA sequence
gcctaggtgtattttttatc

SEQ ID NO: 695575 - DNA, 20 bp, Artificial
  CRISPR gRNA sequence
ggtgtattttttatcagtgg

SEQ ID NO: 695576 - DNA, 20 bp, Artificial
  CRISPR gRNA sequence
tttatcagtggcaattatca

SEQ ID NO: 695577 - DNA, 20 bp, Artificial
  CRISPR gRNA sequence
ttatcagtggcaattatcac

SEQ ID NO: 695578 - DNA, 20 bp, Artificial
  CRISPR gRNA sequence
tatcagtggcaattatcact

SEQ ID NO: 695579 - DNA, 20 bp, Artificial
  CRISPR gRNA sequence
atcagtggcaattatcactg

SEQ ID NO: 695580 - DNA, 20 bp, Artificial
  CRISPR gRNA sequence
tcagtggcaattatcactga

SEQ ID NO: 695581 - DNA, 20 bp, Artificial
  CRISPR gRNA sequence
tcactgatactgtgacagat

SEQ ID NO: 695582 - DNA, 20 bp, Artificial
  CRISPR gRNA sequence
atactgtgacagattctatt

SEQ ID NO: 695583 - DNA, 20 bp, Artificial
  CRISPR gRNA sequence
tgacagattctatttgttta

SEQ ID NO: 695584 - DNA, 20 bp, Artificial
  CRISPR gRNA sequence
tatttgtttattgtctgttg

SEQ ID NO: 695585 - DNA, 20 bp, Artificial
  CRISPR gRNA sequence
tttgtttattgtctgttggt

SEQ ID NO: 695586 - DNA, 20 bp, Artificial
  CRISPR gRNA sequence
gtttattgtctgttggtgta

SEQ ID NO: 695587 - DNA, 20 bp, Artificial
  CRISPR gRNA sequence
tttattgtctgttggtgtat

SEQ ID NO: 695588 - DNA, 20 bp, Artificial
  CRISPR gRNA sequence
attgtctgttggtgtatcag

SEQ ID NO: 695589 - DNA, 20 bp, Artificial
  CRISPR gRNA sequence
ttgtctgttggtgtatcagg

SEQ ID NO: 695590 - DNA, 20 bp, Artificial
  CRISPR gRNA sequence
tctgttggtgtatcagggtt

SEQ ID NO: 695591 - DNA, 20 bp, Artificial
  CRISPR gRNA sequence
ttggtgtatcagggttacca

SEQ ID NO: 695592 - DNA, 20 bp, Artificial
  CRISPR gRNA sequence
gtgtatcagggttaccaaga

SEQ ID NO: 695593 - DNA, 20 bp, Artificial
  CRISPR gRNA sequence
ccaagacagaaagacccaat

SEQ ID NO: 695594 - DNA, 20 bp, Artificial
  CRISPR gRNA sequence
attagtggaaatggctcaca

SEQ ID NO: 695595 - DNA, 20 bp, Artificial
  CRISPR gRNA sequence
ttagtggaaatggctcacat

SEQ ID NO: 695596 - DNA, 20 bp, Artificial
  CRISPR gRNA sequence
gtggaaatggctcacatagt

SEQ ID NO: 695597 - DNA, 20 bp, Artificial
  CRISPR gRNA sequence
acatagttatggaggctgat

SEQ ID NO: 695598 - DNA, 20 bp, Artificial
  CRISPR gRNA sequence
tggaggctgataagatccat

SEQ ID NO: 695599 - DNA, 20 bp, Artificial
  CRISPR gRNA sequence
ataagatccatgagaggcca

SEQ ID NO: 695600 - DNA, 20 bp, Artificial
  CRISPR gRNA sequence
caagctggagaaccaaggaa

SEQ ID NO: 695601 - DNA, 20 bp, Artificial
  CRISPR gRNA sequence
gagaaccaaggaagacagca

SEQ ID NO: 695602 - DNA, 20 bp, Artificial
  CRISPR gRNA sequence
gctcagtccaaggccaaagg

SEQ ID NO: 695603 - DNA, 20 bp, Artificial
  CRISPR gRNA sequence
agtccaaggccaaaggcctg

SEQ ID NO: 695604 - DNA, 20 bp, Artificial
  CRISPR gRNA sequence
aggggccagaggaggaggtg

SEQ ID NO: 695605 - DNA, 20 bp, Artificial
  CRISPR gRNA sequence
actggtgcaacactcaagag

SEQ ID NO: 695606 - DNA, 20 bp, Artificial
  CRISPR gRNA sequence
gtgcaacactcaagagtcca

SEQ ID NO: 695607 - DNA, 20 bp, Artificial
  CRISPR gRNA sequence
aagagtccaaagaccataca

SEQ ID NO: 695608 - DNA, 20 bp, Artificial
  CRISPR gRNA sequence
gagttctgatgtccaagggc

SEQ ID NO: 695609 - DNA, 20 bp, Artificial
  CRISPR gRNA sequence
tgatgtccaagggcaggaaa

SEQ ID NO: 695610 - DNA, 20 bp, Artificial
  CRISPR gRNA sequence
atgtccaagggcaggaaaag

SEQ ID NO: 695611 - DNA, 20 bp, Artificial
  CRISPR gRNA sequence
agagagagagagagagagaa

SEQ ID NO: 695612 - DNA, 20 bp, Artificial
  CRISPR gRNA sequence
gactcctttctgcttttttg

SEQ ID NO: 695613 - DNA, 20 bp, Artificial
  CRISPR gRNA sequence
actcctttctgcttttttgt

SEQ ID NO: 695614 - DNA, 20 bp, Artificial
  CRISPR gRNA sequence
ctttctgcttttttgttcta

SEQ ID NO: 695615 - DNA, 20 bp, Artificial
  CRISPR gRNA sequence
tctgcttttttgttctatct

SEQ ID NO: 695616 - DNA, 20 bp, Artificial
  CRISPR gRNA sequence
ctgcttttttgttctatctg

SEQ ID NO: 695617 - DNA, 20 bp, Artificial
  CRISPR gRNA sequence
tgcttttttgttctatctgg

SEQ ID NO: 695618 - DNA, 20 bp, Artificial
  CRISPR gRNA sequence
cttttttgttctatctgggc

SEQ ID NO: 695619 - DNA, 20 bp, Artificial
  CRISPR gRNA sequence
ttttgttctatctgggcccc

SEQ ID NO: 695620 - DNA, 20 bp, Artificial
  CRISPR gRNA sequence
tttgttctatctgggcccct

SEQ ID NO: 695621 - DNA, 20 bp, Artificial
  CRISPR gRNA sequence
ttgttctatctgggccccta

SEQ ID NO: 695622 - DNA, 20 bp, Artificial
  CRISPR gRNA sequence
tgttctatctgggcccctag

SEQ ID NO: 695623 - DNA, 20 bp, Artificial
  CRISPR gRNA sequence
gttctatctgggcccctagg

SEQ ID NO: 695624 - DNA, 20 bp, Artificial
  CRISPR gRNA sequence
ttctatctgggcccctaggt

SEQ ID NO: 695625 - DNA, 20 bp, Artificial
  CRISPR gRNA sequence
tatctgggcccctaggtgat

SEQ ID NO: 695626 - DNA, 20 bp, Artificial
  CRISPR gRNA sequence
tctgggcccctaggtgattg

SEQ ID NO: 695627 - DNA, 20 bp, Artificial
  CRISPR gRNA sequence
ggcccctaggtgattggatt

SEQ ID NO: 695628 - DNA, 20 bp, Artificial
  CRISPR gRNA sequence
ggtgattggattgtggctgc

SEQ ID NO: 695629 - DNA, 20 bp, Artificial
  CRISPR gRNA sequence
gattgtggctgcccacagcg

SEQ ID NO: 695630 - DNA, 20 bp, Artificial
  CRISPR gRNA sequence
tggctgcccacagcgagaga

SEQ ID NO: 695631 - DNA, 20 bp, Artificial
  CRISPR gRNA sequence
cccacagcgagagaggattt

SEQ ID NO: 695632 - DNA, 20 bp, Artificial
  CRISPR gRNA sequence
tccccgctcagtcactcaca

SEQ ID NO: 695633 - DNA, 20 bp, Artificial
  CRISPR gRNA sequence
ccccgctcagtcactcacat

SEQ ID NO: 695634 - DNA, 20 bp, Artificial
  CRISPR gRNA sequence
cccgctcagtcactcacatg

SEQ ID NO: 695635 - DNA, 20 bp, Artificial
  CRISPR gRNA sequence
agtcactcacatgccaatcc

SEQ ID NO: 695636 - DNA, 20 bp, Artificial
  CRISPR gRNA sequence
acatgccaatcccttccaga

SEQ ID NO: 695637 - DNA, 20 bp, Artificial
  CRISPR gRNA sequence
ccagaaacaccctcacaggc

SEQ ID NO: 695638 - DNA, 20 bp, Artificial
  CRISPR gRNA sequence
cagaaacaccctcacaggca

SEQ ID NO: 695639 - DNA, 20 bp, Artificial
  CRISPR gRNA sequence
acaggcacacccagaaataa

SEQ ID NO: 695640 - DNA, 20 bp, Artificial
  CRISPR gRNA sequence
taccagctatctaggcatcc

SEQ ID NO: 695641 - DNA, 20 bp, Artificial
  CRISPR gRNA sequence
tctaggcatcccttaatcca

SEQ ID NO: 695642 - DNA, 20 bp, Artificial
  CRISPR gRNA sequence
ggcatcccttaatccagtca

SEQ ID NO: 695643 - DNA, 20 bp, Artificial
  CRISPR gRNA sequence
aatccagtcaatatgacacc

SEQ ID NO: 695644 - DNA, 20 bp, Artificial
  CRISPR gRNA sequence
atccagtcaatatgacacct

SEQ ID NO: 695645 - DNA, 20 bp, Artificial
  CRISPR gRNA sequence
aaattaaccattacagtcag

SEQ ID NO: 695646 - DNA, 20 bp, Artificial
  CRISPR gRNA sequence
accattacagtcagtatcac

SEQ ID NO: 695647 - DNA, 20 bp, Artificial
  CRISPR gRNA sequence
cagtcagtatcactgaaatg

SEQ ID NO: 695648 - DNA, 20 bp, Artificial
  CRISPR gRNA sequence
aaatgtatgttctttgataa

SEQ ID NO: 695649 - DNA, 20 bp, Artificial
  CRISPR gRNA sequence
tttgataaagggatctggtc

SEQ ID NO: 695650 - DNA, 20 bp, Artificial
  CRISPR gRNA sequence
tgataaagggatctggtctg

SEQ ID NO: 695651 - DNA, 20 bp, Artificial
  CRISPR gRNA sequence
gataaagggatctggtctgt

SEQ ID NO: 695652 - DNA, 20 bp, Artificial
  CRISPR gRNA sequence
ataaagggatctggtctgtt

SEQ ID NO: 695653 - DNA, 20 bp, Artificial
  CRISPR gRNA sequence
gtctgtttccttaccattgt

SEQ ID NO: 695654 - DNA, 20 bp, Artificial
  CRISPR gRNA sequence
tttccttaccattgtttctc

SEQ ID NO: 695655 - DNA, 20 bp, Artificial
  CRISPR gRNA sequence
ccttaccattgtttctcacc

SEQ ID NO: 695656 - DNA, 20 bp, Artificial
  CRISPR gRNA sequence
cttaccattgtttctcacca

SEQ ID NO: 695657 - DNA, 20 bp, Artificial
  CRISPR gRNA sequence
accattgtttctcaccatca

SEQ ID NO: 695658 - DNA, 20 bp, Artificial
  CRISPR gRNA sequence
ccattgtttctcaccatcat

SEQ ID NO: 695659 - DNA, 20 bp, Artificial
  CRISPR gRNA sequence
tttctcaccatcataatcag

SEQ ID NO: 695660 - DNA, 20 bp, Artificial
  CRISPR gRNA sequence
ctcaccatcataatcagtaa

SEQ ID NO: 695661 - DNA, 20 bp, Artificial
  CRISPR gRNA sequence
tcaccatcataatcagtaaa

SEQ ID NO: 695662 - DNA, 20 bp, Artificial
  CRISPR gRNA sequence
accatcataatcagtaaata

SEQ ID NO: 695663 - DNA, 20 bp, Artificial
  CRISPR gRNA sequence
tcagtaagtatttgttaaat

SEQ ID NO: 695664 - DNA, 20 bp, Artificial
  CRISPR gRNA sequence
agtaagtatttgttaaatga

SEQ ID NO: 695665 - DNA, 20 bp, Artificial
  CRISPR gRNA sequence
gttaaatgaataaatatgtc

SEQ ID NO: 695666 - DNA, 20 bp, Artificial
  CRISPR gRNA sequence
ttaaatgaataaatatgtca

SEQ ID NO: 695667 - DNA, 20 bp, Artificial
  CRISPR gRNA sequence
aatgaataaatatgtcagta

SEQ ID NO: 695668 - DNA, 20 bp, Artificial
  CRISPR gRNA sequence
taaaatgtttaaagcagtct

SEQ ID NO: 695669 - DNA, 20 bp, Artificial
  CRISPR gRNA sequence
aaaatgtttaaagcagtctc

SEQ ID NO: 695670 - DNA, 20 bp, Artificial
  CRISPR gRNA sequence
aaatgtttaaagcagtctct

SEQ ID NO: 695671 - DNA, 20 bp, Artificial
  CRISPR gRNA sequence
aaagcagtctcttgtttaat

SEQ ID NO: 695672 - DNA, 20 bp, Artificial
  CRISPR gRNA sequence
aagcagtctcttgtttaata

SEQ ID NO: 695673 - DNA, 20 bp, Artificial
  CRISPR gRNA sequence
ttgtttaatatttatcactt

SEQ ID NO: 695674 - DNA, 20 bp, Artificial
  CRISPR gRNA sequence
gtttaatatttatcacttga

SEQ ID NO: 695675 - DNA, 20 bp, Artificial
  CRISPR gRNA sequence
tttaatatttatcacttgag

SEQ ID NO: 695676 - DNA, 20 bp, Artificial
  CRISPR gRNA sequence
aatatttatcacttgagtag

SEQ ID NO: 695677 - DNA, 20 bp, Artificial
  CRISPR gRNA sequence
atatttatcacttgagtagt

SEQ ID NO: 695678 - DNA, 20 bp, Artificial
  CRISPR gRNA sequence
atcacttgagtagtctatga

SEQ ID NO: 695679 - DNA, 20 bp, Artificial
  CRISPR gRNA sequence
tcacttgagtagtctatgaa

SEQ ID NO: 695680 - DNA, 20 bp, Artificial
  CRISPR gRNA sequence
gagtagtctatgaatttatt

SEQ ID NO: 695681 - DNA, 20 bp, Artificial
  CRISPR gRNA sequence
agtagtctatgaatttattt

SEQ ID NO: 695682 - DNA, 20 bp, Artificial
  CRISPR gRNA sequence
tgaatttatttatttttgga

SEQ ID NO: 695683 - DNA, 20 bp, Artificial
  CRISPR gRNA sequence
atttatttttggagacaaat

SEQ ID NO: 695684 - DNA, 20 bp, Artificial
  CRISPR gRNA sequence
tttatttttggagacaaatt

SEQ ID NO: 695685 - DNA, 20 bp, Artificial
  CRISPR gRNA sequence
atttttggagacaaattctc

SEQ ID NO: 695686 - DNA, 20 bp, Artificial
  CRISPR gRNA sequence
tttttggagacaaattctca

SEQ ID NO: 695687 - DNA, 20 bp, Artificial
  CRISPR gRNA sequence
ttggagacaaattctcactc

SEQ ID NO: 695688 - DNA, 20 bp, Artificial
  CRISPR gRNA sequence
tggagacaaattctcactct

SEQ ID NO: 695689 - DNA, 20 bp, Artificial
  CRISPR gRNA sequence
ggagacaaattctcactctg

SEQ ID NO: 695690 - DNA, 20 bp, Artificial
  CRISPR gRNA sequence
gagacaaattctcactctgt

SEQ ID NO: 695691 - DNA, 20 bp, Artificial
  CRISPR gRNA sequence
tcactctgtagcctggtctg

SEQ ID NO: 695692 - DNA, 20 bp, Artificial
  CRISPR gRNA sequence
actctgtagcctggtctgga

SEQ ID NO: 695693 - DNA, 20 bp, Artificial
  CRISPR gRNA sequence
tgtagcctggtctggagggc

SEQ ID NO: 695694 - DNA, 20 bp, Artificial
  CRISPR gRNA sequence
tagcctggtctggagggcag

SEQ ID NO: 695695 - DNA, 20 bp, Artificial
  CRISPR gRNA sequence
gtctggagggcagtggcatg

SEQ ID NO: 695696 - DNA, 20 bp, Artificial
  CRISPR gRNA sequence
gagggcagtggcatgatcac

SEQ ID NO: 695697 - DNA, 20 bp, Artificial
  CRISPR gRNA sequence
acttcagcctcaaccttcca

SEQ ID NO: 695698 - DNA, 20 bp, Artificial
  CRISPR gRNA sequence
cagcctcaaccttccaggct

SEQ ID NO: 695699 - DNA, 20 bp, Artificial
  CRISPR gRNA sequence
agcctcaaccttccaggctc

SEQ ID NO: 695700 - DNA, 20 bp, Artificial
  CRISPR gRNA sequence
aaccttccaggctcgaacaa

SEQ ID NO: 695701 - DNA, 20 bp, Artificial
  CRISPR gRNA sequence
ccaggctcgaacaatcttcc

SEQ ID NO: 695702 - DNA, 20 bp, Artificial
  CRISPR gRNA sequence
caggctcgaacaatcttccc

SEQ ID NO: 695703 - DNA, 20 bp, Artificial
  CRISPR gRNA sequence
gaacaatcttcccacctcaa

SEQ ID NO: 695704 - DNA, 20 bp, Artificial
  CRISPR gRNA sequence
cccacctcaaacactggggt

SEQ ID NO: 695705 - DNA, 20 bp, Artificial
  CRISPR gRNA sequence
ccacctcaaacactggggta

SEQ ID NO: 695706 - DNA, 20 bp, Artificial
  CRISPR gRNA sequence
aaacactggggtacctagga

SEQ ID NO: 695707 - DNA, 20 bp, Artificial
  CRISPR gRNA sequence
gggtacctaggactacaggc

SEQ ID NO: 695708 - DNA, 20 bp, Artificial
  CRISPR gRNA sequence
ggactacaggctcatgccac

SEQ ID NO: 695709 - DNA, 20 bp, Artificial
  CRISPR gRNA sequence
caggctcatgccaccatgcc

SEQ ID NO: 695710 - DNA, 20 bp, Artificial
  CRISPR gRNA sequence
atgccaccatgcccagctaa

SEQ ID NO: 695711 - DNA, 20 bp, Artificial
  CRISPR gRNA sequence
attttttttttgtatttttt

SEQ ID NO: 695712 - DNA, 20 bp, Artificial
  CRISPR gRNA sequence
tttttttgtattttttgtag

SEQ ID NO: 695713 - DNA, 20 bp, Artificial
  CRISPR gRNA sequence
ttttttgtattttttgtaga

SEQ ID NO: 695714 - DNA, 20 bp, Artificial
  CRISPR gRNA sequence
tttttgtattttttgtagag

SEQ ID NO: 695715 - DNA, 20 bp, Artificial
  CRISPR gRNA sequence
ttttgtattttttgtagaga

SEQ ID NO: 695716 - DNA, 20 bp, Artificial
  CRISPR gRNA sequence
tttgtattttttgtagagac

SEQ ID NO: 695717 - DNA, 20 bp, Artificial
  CRISPR gRNA sequence
ttgtattttttgtagagaca

SEQ ID NO: 695718 - DNA, 20 bp, Artificial
  CRISPR gRNA sequence
tgtattttttgtagagacag

SEQ ID NO: 695719 - DNA, 20 bp, Artificial
  CRISPR gRNA sequence
gtattttttgtagagacagg

SEQ ID NO: 695720 - DNA, 20 bp, Artificial
  CRISPR gRNA sequence
tattttttgtagagacagga

SEQ ID NO: 695721 - DNA, 20 bp, Artificial
  CRISPR gRNA sequence
tttgtagagacaggattttg

SEQ ID NO: 695722 - DNA, 20 bp, Artificial
  CRISPR gRNA sequence
ttgtagagacaggattttgc

SEQ ID NO: 695723 - DNA, 20 bp, Artificial
  CRISPR gRNA sequence
tgtagagacaggattttgcc

SEQ ID NO: 695724 - DNA, 20 bp, Artificial
  CRISPR gRNA sequence
gtagagacaggattttgcca

SEQ ID NO: 695725 - DNA, 20 bp, Artificial
  CRISPR gRNA sequence
tagagacaggattttgccat

SEQ ID NO: 695726 - DNA, 20 bp, Artificial
  CRISPR gRNA sequence
tgccatgttgcccaggctgg

SEQ ID NO: 695727 - DNA, 20 bp, Artificial
  CRISPR gRNA sequence
gccatgttgcccaggctggt

SEQ ID NO: 695728 - DNA, 20 bp, Artificial
  CRISPR gRNA sequence
ccatgttgcccaggctggtc

SEQ ID NO: 695729 - DNA, 20 bp, Artificial
  CRISPR gRNA sequence
cccaggctggtcttgaactt

SEQ ID NO: 695730 - DNA, 20 bp, Artificial
  CRISPR gRNA sequence
gtcttgaacttctgggctca

SEQ ID NO: 695731 - DNA, 20 bp, Artificial
  CRISPR gRNA sequence
gaacttctgggctcagacaa

SEQ ID NO: 695732 - DNA, 20 bp, Artificial
  CRISPR gRNA sequence
aacttctgggctcagacaat

SEQ ID NO: 695733 - DNA, 20 bp, Artificial
  CRISPR gRNA sequence
ctgggctcagacaatccacc

SEQ ID NO: 695734 - DNA, 20 bp, Artificial
  CRISPR gRNA sequence
tgggctcagacaatccaccc

SEQ ID NO: 695735 - DNA, 20 bp, Artificial
  CRISPR gRNA sequence
ggctcagacaatccaccctc

SEQ ID NO: 695736 - DNA, 20 bp, Artificial
  CRISPR gRNA sequence
agacaatccaccctccttgg

SEQ ID NO: 695737 - DNA, 20 bp, Artificial
  CRISPR gRNA sequence
cttggccttccaatgtgttg

SEQ ID NO: 695738 - DNA, 20 bp, Artificial
  CRISPR gRNA sequence
ggccttccaatgtgttgaga

SEQ ID NO: 695739 - DNA, 20 bp, Artificial
  CRISPR gRNA sequence
gccttccaatgtgttgagat

SEQ ID NO: 695740 - DNA, 20 bp, Artificial
  CRISPR gRNA sequence
ccaatgtgttgagattacag

SEQ ID NO: 695741 - DNA, 20 bp, Artificial
  CRISPR gRNA sequence
caatgtgttgagattacagg

SEQ ID NO: 695742 - DNA, 20 bp, Artificial
  CRISPR gRNA sequence
agattacaggcttgaggcac

SEQ ID NO: 695743 - DNA, 20 bp, Artificial
  CRISPR gRNA sequence
caggcttgaggcaccgcacc

SEQ ID NO: 695744 - DNA, 20 bp, Artificial
  CRISPR gRNA sequence
gaggcaccgcacctggcctg

SEQ ID NO: 695745 - DNA, 20 bp, Artificial
  CRISPR gRNA sequence
aggcaccgcacctggcctga

SEQ ID NO: 695746 - DNA, 20 bp, Artificial
  CRISPR gRNA sequence
gcctgagtagtctatgaatt

SEQ ID NO: 695747 - DNA, 20 bp, Artificial
  CRISPR gRNA sequence
agtagtctatgaatttttaa

SEQ ID NO: 695748 - DNA, 20 bp, Artificial
  CRISPR gRNA sequence
tgaatttttaaaatcccaac

SEQ ID NO: 695749 - DNA, 20 bp, Artificial
  CRISPR gRNA sequence
ttaaaatcccaaccatagga

SEQ ID NO: 695750 - DNA, 20 bp, Artificial
  CRISPR gRNA sequence
taaaatcccaaccataggag

SEQ ID NO: 695751 - DNA, 20 bp, Artificial
  CRISPR gRNA sequence
aaaatcccaaccataggaga

SEQ ID NO: 695752 - DNA, 20 bp, Artificial
  CRISPR gRNA sequence
aaatcccaaccataggagaa

SEQ ID NO: 695753 - DNA, 20 bp, Artificial
  CRISPR gRNA sequence
tatgtacaaacatgcttgtc

SEQ ID NO: 695754 - DNA, 20 bp, Artificial
  CRISPR gRNA sequence
atgtacaaacatgcttgtca

SEQ ID NO: 695755 - DNA, 20 bp, Artificial
  CRISPR gRNA sequence
tgtacaaacatgcttgtcaa

SEQ ID NO: 695756 - DNA, 20 bp, Artificial
  CRISPR gRNA sequence
gtcaaaatattacctacaaa

SEQ ID NO: 695757 - DNA, 20 bp, Artificial
  CRISPR gRNA sequence
tcaaaatattacctacaaaa

SEQ ID NO: 695758 - DNA, 20 bp, Artificial
  CRISPR gRNA sequence
cctacaaaaagataagatga

SEQ ID NO: 695759 - DNA, 20 bp, Artificial
  CRISPR gRNA sequence
caaaaagataagatgaaagc

SEQ ID NO: 695760 - DNA, 20 bp, Artificial
  CRISPR gRNA sequence
aaagaactcagttacatcac

SEQ ID NO: 695761 - DNA, 20 bp, Artificial
  CRISPR gRNA sequence
agttacatcacctccttatc

SEQ ID NO: 695762 - DNA, 20 bp, Artificial
  CRISPR gRNA sequence
catcacctccttatctgaga

SEQ ID NO: 695763 - DNA, 20 bp, Artificial
  CRISPR gRNA sequence
cttatctgagatgggatgca

SEQ ID NO: 695764 - DNA, 20 bp, Artificial
  CRISPR gRNA sequence
atctgagatgggatgcagct

SEQ ID NO: 695765 - DNA, 20 bp, Artificial
  CRISPR gRNA sequence
tctgagatgggatgcagctt

SEQ ID NO: 695766 - DNA, 20 bp, Artificial
  CRISPR gRNA sequence
agatgggatgcagcttgtaa

SEQ ID NO: 695767 - DNA, 20 bp, Artificial
  CRISPR gRNA sequence
gtaaaagtgtgtcaactttt

SEQ ID NO: 695768 - DNA, 20 bp, Artificial
  CRISPR gRNA sequence
taaaagtgtgtcaacttttt

SEQ ID NO: 695769 - DNA, 20 bp, Artificial
  CRISPR gRNA sequence
tttaaatttaaaaatttttt

SEQ ID NO: 695770 - DNA, 20 bp, Artificial
  CRISPR gRNA sequence
ttaaatttaaaaattttttt

SEQ ID NO: 695771 - DNA, 20 bp, Artificial
  CRISPR gRNA sequence
taaatttaaaaattttttta

SEQ ID NO: 695772 - DNA, 20 bp, Artificial
  CRISPR gRNA sequence
aaatttaaaaatttttttag

SEQ ID NO: 695773 - DNA, 20 bp, Artificial
  CRISPR gRNA sequence
aatttaaaaatttttttaga

SEQ ID NO: 695774 - DNA, 20 bp, Artificial
  CRISPR gRNA sequence
aaaaatttttttagatggag

SEQ ID NO: 695775 - DNA, 20 bp, Artificial
  CRISPR gRNA sequence
aaaatttttttagatggagt

SEQ ID NO: 695776 - DNA, 20 bp, Artificial
  CRISPR gRNA sequence
ttttagatggagtctcattc

SEQ ID NO: 695777 - DNA, 20 bp, Artificial
  CRISPR gRNA sequence
tttagatggagtctcattct

SEQ ID NO: 695778 - DNA, 20 bp, Artificial
  CRISPR gRNA sequence
ttagatggagtctcattctg

SEQ ID NO: 695779 - DNA, 20 bp, Artificial
  CRISPR gRNA sequence
tagatggagtctcattctgt

SEQ ID NO: 695780 - DNA, 20 bp, Artificial
  CRISPR gRNA sequence
agatggagtctcattctgtc

SEQ ID NO: 695781 - DNA, 20 bp, Artificial
  CRISPR gRNA sequence
gatggagtctcattctgtca

SEQ ID NO: 695782 - DNA, 20 bp, Artificial
  CRISPR gRNA sequence
attctgtcacccaggctgga

SEQ ID NO: 695783 - DNA, 20 bp, Artificial
  CRISPR gRNA sequence
tgtcacccaggctggagtac

SEQ ID NO: 695784 - DNA, 20 bp, Artificial
  CRISPR gRNA sequence
tcacccaggctggagtacag

SEQ ID NO: 695785 - DNA, 20 bp, Artificial
  CRISPR gRNA sequence
gagtacagtggcagtgatct

SEQ ID NO: 695786 - DNA, 20 bp, Artificial
  CRISPR gRNA sequence
ggctcactgcaacatctgcc

SEQ ID NO: 695787 - DNA, 20 bp, Artificial
  CRISPR gRNA sequence
actgcaacatctgcctcctg

SEQ ID NO: 695788 - DNA, 20 bp, Artificial
  CRISPR gRNA sequence
caacatctgcctcctgggtt

SEQ ID NO: 695789 - DNA, 20 bp, Artificial
  CRISPR gRNA sequence
cctcctgggttcaagcaatt

SEQ ID NO: 695790 - DNA, 20 bp, Artificial
  CRISPR gRNA sequence
ctgggttcaagcaattctcc

SEQ ID NO: 695791 - DNA, 20 bp, Artificial
  CRISPR gRNA sequence
ggttcaagcaattctcctgg

SEQ ID NO: 695792 - DNA, 20 bp, Artificial
  CRISPR gRNA sequence
aagcaattctcctggctcag

SEQ ID NO: 695793 - DNA, 20 bp, Artificial
  CRISPR gRNA sequence
tcctggctcagcatcctgag

SEQ ID NO: 695794 - DNA, 20 bp, Artificial
  CRISPR gRNA sequence
ctggctcagcatcctgagta

SEQ ID NO: 695795 - DNA, 20 bp, Artificial
  CRISPR gRNA sequence
gctcagcatcctgagtagct

SEQ ID NO: 695796 - DNA, 20 bp, Artificial
  CRISPR gRNA sequence
agcatcctgagtagctggga

SEQ ID NO: 695797 - DNA, 20 bp, Artificial
  CRISPR gRNA sequence
agtagctgggactacaggca

SEQ ID NO: 695798 - DNA, 20 bp, Artificial
  CRISPR gRNA sequence
ggactacaggcacatgccta

SEQ ID NO: 695799 - DNA, 20 bp, Artificial
  CRISPR gRNA sequence
caggcacatgcctagactcc

SEQ ID NO: 695800 - DNA, 20 bp, Artificial
  CRISPR gRNA sequence
gactcctggctaattttttg

SEQ ID NO: 695801 - DNA, 20 bp, Artificial
  CRISPR gRNA sequence
ctggctaattttttgtattt

SEQ ID NO: 695802 - DNA, 20 bp, Artificial
  CRISPR gRNA sequence
gctaattttttgtatttttt

SEQ ID NO: 695803 - DNA, 20 bp, Artificial
  CRISPR gRNA sequence
attttttgtattttttagta

SEQ ID NO: 695804 - DNA, 20 bp, Artificial
  CRISPR gRNA sequence
tttgtattttttagtacaga

SEQ ID NO: 695805 - DNA, 20 bp, Artificial
  CRISPR gRNA sequence
ttgtattttttagtacagat

SEQ ID NO: 695806 - DNA, 20 bp, Artificial
  CRISPR gRNA sequence
tgtattttttagtacagatg

SEQ ID NO: 695807 - DNA, 20 bp, Artificial
  CRISPR gRNA sequence
gtattttttagtacagatgg

SEQ ID NO: 695808 - DNA, 20 bp, Artificial
  CRISPR gRNA sequence
tattttttagtacagatggg

SEQ ID NO: 695809 - DNA, 20 bp, Artificial
  CRISPR gRNA sequence
tttagtacagatggggtttc

SEQ ID NO: 695810 - DNA, 20 bp, Artificial
  CRISPR gRNA sequence
ttagtacagatggggtttca

SEQ ID NO: 695811 - DNA, 20 bp, Artificial
  CRISPR gRNA sequence
tagtacagatggggtttcac

SEQ ID NO: 695812 - DNA, 20 bp, Artificial
  CRISPR gRNA sequence
agtacagatggggtttcacc

SEQ ID NO: 695813 - DNA, 20 bp, Artificial
  CRISPR gRNA sequence
gtacagatggggtttcacca

SEQ ID NO: 695814 - DNA, 20 bp, Artificial
  CRISPR gRNA sequence
caccatgttggccagtctgg

SEQ ID NO: 695815 - DNA, 20 bp, Artificial
  CRISPR gRNA sequence
accatgttggccagtctggt

SEQ ID NO: 695816 - DNA, 20 bp, Artificial
  CRISPR gRNA sequence
gccagtctggtctcgaattc

SEQ ID NO: 695817 - DNA, 20 bp, Artificial
  CRISPR gRNA sequence
gtctcgaattcctgacctca

SEQ ID NO: 695818 - DNA, 20 bp, Artificial
  CRISPR gRNA sequence
gaattcctgacctcaagtga

SEQ ID NO: 695819 - DNA, 20 bp, Artificial
  CRISPR gRNA sequence
ctgacctcaagtgatccacc

SEQ ID NO: 695820 - DNA, 20 bp, Artificial
  CRISPR gRNA sequence
acctcaagtgatccacccac

SEQ ID NO: 695821 - DNA, 20 bp, Artificial
  CRISPR gRNA sequence
aagtgatccacccacctcgg

SEQ ID NO: 695822 - DNA, 20 bp, Artificial
  CRISPR gRNA sequence
ggcctcccaaagtgctggga

SEQ ID NO: 695823 - DNA, 20 bp, Artificial
  CRISPR gRNA sequence
ccaaagtgctgggattacag

SEQ ID NO: 695824 - DNA, 20 bp, Artificial
  CRISPR gRNA sequence
ggattacaggcgtgagccac

SEQ ID NO: 695825 - DNA, 20 bp, Artificial
  CRISPR gRNA sequence
caggcgtgagccaccatgcc

SEQ ID NO: 695826 - DNA, 20 bp, Artificial
  CRISPR gRNA sequence
tatacagagtttacaacatg

SEQ ID NO: 695827 - DNA, 20 bp, Artificial
  CRISPR gRNA sequence
atacagagtttacaacatgg

SEQ ID NO: 695828 - DNA, 20 bp, Artificial
  CRISPR gRNA sequence
tacagagtttacaacatgga

SEQ ID NO: 695829 - DNA, 20 bp, Artificial
  CRISPR gRNA sequence
acaacatggaaaactacttg

SEQ ID NO: 695830 - DNA, 20 bp, Artificial
  CRISPR gRNA sequence
caacatggaaaactacttgt

SEQ ID NO: 695831 - DNA, 20 bp, Artificial
  CRISPR gRNA sequence
cttgtataataatacattca

SEQ ID NO: 695832 - DNA, 20 bp, Artificial
  CRISPR gRNA sequence
gtataataatacattcaaaa

SEQ ID NO: 695833 - DNA, 20 bp, Artificial
  CRISPR gRNA sequence
tataataatacattcaaaaa

SEQ ID NO: 695834 - DNA, 20 bp, Artificial
  CRISPR gRNA sequence
aaaaagcaacattcaagata

SEQ ID NO: 695835 - DNA, 20 bp, Artificial
  CRISPR gRNA sequence
aagataacccataacatatg

SEQ ID NO: 695836 - DNA, 20 bp, Artificial
  CRISPR gRNA sequence
gtacaataaagatacctata

SEQ ID NO: 695837 - DNA, 20 bp, Artificial
  CRISPR gRNA sequence
tacaataaagatacctataa

SEQ ID NO: 695838 - DNA, 20 bp, Artificial
  CRISPR gRNA sequence
taaaaatatatacatagaga

SEQ ID NO: 695839 - DNA, 20 bp, Artificial
  CRISPR gRNA sequence
ggctcattcctgtaatccca

SEQ ID NO: 695840 - DNA, 20 bp, Artificial
  CRISPR gRNA sequence
gctcattcctgtaatcccag

SEQ ID NO: 695841 - DNA, 20 bp, Artificial
  CRISPR gRNA sequence
attcctgtaatcccagcact

SEQ ID NO: 695842 - DNA, 20 bp, Artificial
  CRISPR gRNA sequence
ctgtaatcccagcactttga

SEQ ID NO: 695843 - DNA, 20 bp, Artificial
  CRISPR gRNA sequence
taatcccagcactttgagaa

SEQ ID NO: 695844 - DNA, 20 bp, Artificial
  CRISPR gRNA sequence
tgagaagctgaggcaggtgg

SEQ ID NO: 695845 - DNA, 20 bp, Artificial
  CRISPR gRNA sequence
gagaagctgaggcaggtgga

SEQ ID NO: 695846 - DNA, 20 bp, Artificial
  CRISPR gRNA sequence
agaagctgaggcaggtggat

SEQ ID NO: 695847 - DNA, 20 bp, Artificial
  CRISPR gRNA sequence
aggcaggtggatcacttgag

SEQ ID NO: 695848 - DNA, 20 bp, Artificial
  CRISPR gRNA sequence
gaggtcgggagttcgagacc

SEQ ID NO: 695849 - DNA, 20 bp, Artificial
  CRISPR gRNA sequence
aggtcgggagttcgagacca

SEQ ID NO: 695850 - DNA, 20 bp, Artificial
  CRISPR gRNA sequence
gagaccagactggccaatat

SEQ ID NO: 695851 - DNA, 20 bp, Artificial
  CRISPR gRNA sequence
gccaatatggcaaaaccctg

SEQ ID NO: 695852 - DNA, 20 bp, Artificial
  CRISPR gRNA sequence
tctctactaaaaatacaaaa

SEQ ID NO: 695853 - DNA, 20 bp, Artificial
  CRISPR gRNA sequence
tactaaaaatacaaaaaatt

SEQ ID NO: 695854 - DNA, 20 bp, Artificial
  CRISPR gRNA sequence
ctaaaaatacaaaaaatttg

SEQ ID NO: 695855 - DNA, 20 bp, Artificial
  CRISPR gRNA sequence
aaaatacaaaaaatttgctg

SEQ ID NO: 695856 - DNA, 20 bp, Artificial
  CRISPR gRNA sequence
gctgggcctggtggcgcatg

SEQ ID NO: 695857 - DNA, 20 bp, Artificial
  CRISPR gRNA sequence
ctgggcctggtggcgcatgt

SEQ ID NO: 695858 - DNA, 20 bp, Artificial
  CRISPR gRNA sequence
ggcctggtggcgcatgtgtg

SEQ ID NO: 695859 - DNA, 20 bp, Artificial
  CRISPR gRNA sequence
gtggcgcatgtgtgtaatct

SEQ ID NO: 695860 - DNA, 20 bp, Artificial
  CRISPR gRNA sequence
agctactcaggaggctgagg

SEQ ID NO: 695861 - DNA, 20 bp, Artificial
  CRISPR gRNA sequence
ctcaggaggctgaggcatgg

SEQ ID NO: 695862 - DNA, 20 bp, Artificial
  CRISPR gRNA sequence
aggaggctgaggcatggaaa

SEQ ID NO: 695863 - DNA, 20 bp, Artificial
  CRISPR gRNA sequence
aggcatggaaatcacttgaa

SEQ ID NO: 695864 - DNA, 20 bp, Artificial
  CRISPR gRNA sequence
gaacccgagaggcggaggtt

SEQ ID NO: 695865 - DNA, 20 bp, Artificial
  CRISPR gRNA sequence
aacccgagaggcggaggttg

SEQ ID NO: 695866 - DNA, 20 bp, Artificial
  CRISPR gRNA sequence
cagtgagctgaggtcgcacc

SEQ ID NO: 695867 - DNA, 20 bp, Artificial
  CRISPR gRNA sequence
aggtcgcaccactgcactcc

SEQ ID NO: 695868 - DNA, 20 bp, Artificial
  CRISPR gRNA sequence
cactccagcctcagtgacaa

SEQ ID NO: 695869 - DNA, 20 bp, Artificial
  CRISPR gRNA sequence
cagcctcagtgacaaagtga

SEQ ID NO: 695870 - DNA, 20 bp, Artificial
  CRISPR gRNA sequence
agtgacaaagtgaaattgtg

SEQ ID NO: 695871 - DNA, 20 bp, Artificial
  CRISPR gRNA sequence
tgtttcagaaacaaaaacaa

SEQ ID NO: 695872 - DNA, 20 bp, Artificial
  CRISPR gRNA sequence
cagaaacaaaaacaaaaaca

SEQ ID NO: 695873 - DNA, 20 bp, Artificial
  CRISPR gRNA sequence
agaaacaaaaacaaaaacaa

SEQ ID NO: 695874 - DNA, 20 bp, Artificial
  CRISPR gRNA sequence
cagggaccaacagtcacact

SEQ ID NO: 695875 - DNA, 20 bp, Artificial
  CRISPR gRNA sequence
agtccaggaaggttcaacaa

SEQ ID NO: 695876 - DNA, 20 bp, Artificial
  CRISPR gRNA sequence
aacaatacaatagcagtgat

SEQ ID NO: 695877 - DNA, 20 bp, Artificial
  CRISPR gRNA sequence
ttgaggggagacctaggtgg

SEQ ID NO: 695878 - DNA, 20 bp, Artificial
  CRISPR gRNA sequence
tgaggggagacctaggtggt

SEQ ID NO: 695879 - DNA, 20 bp, Artificial
  CRISPR gRNA sequence
gaggggagacctaggtggta

SEQ ID NO: 695880 - DNA, 20 bp, Artificial
  CRISPR gRNA sequence
aggggagacctaggtggtat

SEQ ID NO: 695881 - DNA, 20 bp, Artificial
  CRISPR gRNA sequence
ggtggtatttcttctgtgta

SEQ ID NO: 695882 - DNA, 20 bp, Artificial
  CRISPR gRNA sequence
cttctgtgtattttattttt

SEQ ID NO: 695883 - DNA, 20 bp, Artificial
  CRISPR gRNA sequence
ttctgtgtattttatttttt

SEQ ID NO: 695884 - DNA, 20 bp, Artificial
  CRISPR gRNA sequence
ctgtgtattttatttttttt

SEQ ID NO: 695885 - DNA, 20 bp, Artificial
  CRISPR gRNA sequence
tgtgtattttattttttttt

SEQ ID NO: 695886 - DNA, 20 bp, Artificial
  CRISPR gRNA sequence
tgtattttatttttttttta

SEQ ID NO: 695887 - DNA, 20 bp, Artificial
  CRISPR gRNA sequence
tattttttttttaattcaag

SEQ ID NO: 695888 - DNA, 20 bp, Artificial
  CRISPR gRNA sequence
attttttttttaattcaagt

SEQ ID NO: 695889 - DNA, 20 bp, Artificial
  CRISPR gRNA sequence
ttttttttttaattcaagta

SEQ ID NO: 695890 - DNA, 20 bp, Artificial
  CRISPR gRNA sequence
tttttttaattcaagtaggc

SEQ ID NO: 695891 - DNA, 20 bp, Artificial
  CRISPR gRNA sequence
ttttttaattcaagtaggca

SEQ ID NO: 695892 - DNA, 20 bp, Artificial
  CRISPR gRNA sequence
tttttaattcaagtaggcat

SEQ ID NO: 695893 - DNA, 20 bp, Artificial
  CRISPR gRNA sequence
ttttaattcaagtaggcatt

SEQ ID NO: 695894 - DNA, 20 bp, Artificial
  CRISPR gRNA sequence
tttaattcaagtaggcattg

SEQ ID NO: 695895 - DNA, 20 bp, Artificial
  CRISPR gRNA sequence
ttaattcaagtaggcattga

SEQ ID NO: 695896 - DNA, 20 bp, Artificial
  CRISPR gRNA sequence
taattcaagtaggcattgat

SEQ ID NO: 695897 - DNA, 20 bp, Artificial
  CRISPR gRNA sequence
aattcaagtaggcattgatc

SEQ ID NO: 695898 - DNA, 20 bp, Artificial
  CRISPR gRNA sequence
attcaagtaggcattgatct

SEQ ID NO: 695899 - DNA, 20 bp, Artificial
  CRISPR gRNA sequence
aagtaggcattgatctgtgt

SEQ ID NO: 695900 - DNA, 20 bp, Artificial
  CRISPR gRNA sequence
atctgtgtattttaaagtct

SEQ ID NO: 695901 - DNA, 20 bp, Artificial
  CRISPR gRNA sequence
tgtattttaaagtcttctgt

SEQ ID NO: 695902 - DNA, 20 bp, Artificial
  CRISPR gRNA sequence
taaagtcttctgtgatcaaa

SEQ ID NO: 695903 - DNA, 20 bp, Artificial
  CRISPR gRNA sequence
aaagtcttctgtgatcaaat

SEQ ID NO: 695904 - DNA, 20 bp, Artificial
  CRISPR gRNA sequence
aagtcttctgtgatcaaata

SEQ ID NO: 695905 - DNA, 20 bp, Artificial
  CRISPR gRNA sequence
ctgtgatcaaatagattttc

SEQ ID NO: 695906 - DNA, 20 bp, Artificial
  CRISPR gRNA sequence
tgtgatcaaatagattttca

SEQ ID NO: 695907 - DNA, 20 bp, Artificial
  CRISPR gRNA sequence
tgatcaaatagattttcaca

SEQ ID NO: 695908 - DNA, 20 bp, Artificial
  CRISPR gRNA sequence
tcacatttctaatattcaaa

SEQ ID NO: 695909 - DNA, 20 bp, Artificial
  CRISPR gRNA sequence
cacatttctaatattcaaaa

SEQ ID NO: 695910 - DNA, 20 bp, Artificial
  CRISPR gRNA sequence
acatttctaatattcaaaat

SEQ ID NO: 695911 - DNA, 20 bp, Artificial
  CRISPR gRNA sequence
ctaatattcaaaataaagca

SEQ ID NO: 695912 - DNA, 20 bp, Artificial
  CRISPR gRNA sequence
taatattcaaaataaagcat

SEQ ID NO: 695913 - DNA, 20 bp, Artificial
  CRISPR gRNA sequence
atattcaaaataaagcattt

SEQ ID NO: 695914 - DNA, 20 bp, Artificial
  CRISPR gRNA sequence
aaaataaagcatttgaagta

SEQ ID NO: 695915 - DNA, 20 bp, Artificial
  CRISPR gRNA sequence
gaagtaaaataacaatgaaa

SEQ ID NO: 695916 - DNA, 20 bp, Artificial
  CRISPR gRNA sequence
aagtaaaataacaatgaaaa

SEQ ID NO: 695917 - DNA, 20 bp, Artificial
  CRISPR gRNA sequence
agtgcacacctgtagtccca

SEQ ID NO: 695918 - DNA, 20 bp, Artificial
  CRISPR gRNA sequence
tagtcccagctactcaggag

SEQ ID NO: 695919 - DNA, 20 bp, Artificial
  CRISPR gRNA sequence
ctcaggaggctgagatggga

SEQ ID NO: 695920 - DNA, 20 bp, Artificial
  CRISPR gRNA sequence
aggaggctgagatgggagaa

SEQ ID NO: 695921 - DNA, 20 bp, Artificial
  CRISPR gRNA sequence
agatgggagaaccacttgag

SEQ ID NO: 695922 - DNA, 20 bp, Artificial
  CRISPR gRNA sequence
gagcccaggattttgaggct

SEQ ID NO: 695923 - DNA, 20 bp, Artificial
  CRISPR gRNA sequence
agcccaggattttgaggctg

SEQ ID NO: 695924 - DNA, 20 bp, Artificial
  CRISPR gRNA sequence
tgaggctgtcgtgtgctatt

SEQ ID NO: 695925 - DNA, 20 bp, Artificial
  CRISPR gRNA sequence
gaggctgtcgtgtgctatta

SEQ ID NO: 695926 - DNA, 20 bp, Artificial
  CRISPR gRNA sequence
aggctgtcgtgtgctattat

SEQ ID NO: 695927 - DNA, 20 bp, Artificial
  CRISPR gRNA sequence
tcgtgtgctattatcacacc

SEQ ID NO: 695928 - DNA, 20 bp, Artificial
  CRISPR gRNA sequence
ttatcacacctgtgaatagt

SEQ ID NO: 695929 - DNA, 20 bp, Artificial
  CRISPR gRNA sequence
tcacacctgtgaatagtcac

SEQ ID NO: 695930 - DNA, 20 bp, Artificial
  CRISPR gRNA sequence
tgaatagtcacttctctcca

SEQ ID NO: 695931 - DNA, 20 bp, Artificial
  CRISPR gRNA sequence
ctctccagcttggacaacat

SEQ ID NO: 695932 - DNA, 20 bp, Artificial
  CRISPR gRNA sequence
tctccagcttggacaacata

SEQ ID NO: 695933 - DNA, 20 bp, Artificial
  CRISPR gRNA sequence
tccagcttggacaacatagc

SEQ ID NO: 695934 - DNA, 20 bp, Artificial
  CRISPR gRNA sequence
cagcttggacaacatagcaa

SEQ ID NO: 695935 - DNA, 20 bp, Artificial
  CRISPR gRNA sequence
ggacaacatagcaagacccc

SEQ ID NO: 695936 - DNA, 20 bp, Artificial
  CRISPR gRNA sequence
gacaacatagcaagacccca

SEQ ID NO: 695937 - DNA, 20 bp, Artificial
  CRISPR gRNA sequence
aaataatagtaatacaaaga

SEQ ID NO: 695938 - DNA, 20 bp, Artificial
  CRISPR gRNA sequence
agatctccttccaacctcag

SEQ ID NO: 695939 - DNA, 20 bp, Artificial
  CRISPR gRNA sequence
cttccaacctcagcctaaag

SEQ ID NO: 695940 - DNA, 20 bp, Artificial
  CRISPR gRNA sequence
ccaacctcagcctaaagcaa

SEQ ID NO: 695941 - DNA, 20 bp, Artificial
  CRISPR gRNA sequence
caacctcagcctaaagcaaa

SEQ ID NO: 695942 - DNA, 20 bp, Artificial
  CRISPR gRNA sequence
agcctaaagcaaatttctca

SEQ ID NO: 695943 - DNA, 20 bp, Artificial
  CRISPR gRNA sequence
aagcaaatttctcatttgaa

SEQ ID NO: 695944 - DNA, 20 bp, Artificial
  CRISPR gRNA sequence
ctcatttgaaatccataggg

SEQ ID NO: 695945 - DNA, 20 bp, Artificial
  CRISPR gRNA sequence
tcatttgaaatccatagggc

SEQ ID NO: 695946 - DNA, 20 bp, Artificial
  CRISPR gRNA sequence
atttgaaatccatagggcag

SEQ ID NO: 695947 - DNA, 20 bp, Artificial
  CRISPR gRNA sequence
gaaatccatagggcagaaat

SEQ ID NO: 695948 - DNA, 20 bp, Artificial
  CRISPR gRNA sequence
aaatccatagggcagaaatg

SEQ ID NO: 695949 - DNA, 20 bp, Artificial
  CRISPR gRNA sequence
tggcacctccagagagtaga

SEQ ID NO: 695950 - DNA, 20 bp, Artificial
  CRISPR gRNA sequence
cagagagtagaaaaatattc

SEQ ID NO: 695951 - DNA, 20 bp, Artificial
  CRISPR gRNA sequence
ttcctccactccatgactca

SEQ ID NO: 695952 - DNA, 20 bp, Artificial
  CRISPR gRNA sequence
cctccactccatgactcatc

SEQ ID NO: 695953 - DNA, 20 bp, Artificial
  CRISPR gRNA sequence
ctccactccatgactcatcc

SEQ ID NO: 695954 - DNA, 20 bp, Artificial
  CRISPR gRNA sequence
cactccatgactcatccttt

SEQ ID NO: 695955 - DNA, 20 bp, Artificial
  CRISPR gRNA sequence
catgactcatcctttggtta

SEQ ID NO: 695956 - DNA, 20 bp, Artificial
  CRISPR gRNA sequence
atcctttggttacagcattt

SEQ ID NO: 695957 - DNA, 20 bp, Artificial
  CRISPR gRNA sequence
tggttacagcatttagctga

SEQ ID NO: 695958 - DNA, 20 bp, Artificial
  CRISPR gRNA sequence
ggttacagcatttagctgag

SEQ ID NO: 695959 - DNA, 20 bp, Artificial
  CRISPR gRNA sequence
gttacagcatttagctgagc

SEQ ID NO: 695960 - DNA, 20 bp, Artificial
  CRISPR gRNA sequence
cagcatttagctgagcaatg

SEQ ID NO: 695961 - DNA, 20 bp, Artificial
  CRISPR gRNA sequence
agctgagcaatgaagtcaat

SEQ ID NO: 695962 - DNA, 20 bp, Artificial
  CRISPR gRNA sequence
gctgagcaatgaagtcaatg

SEQ ID NO: 695963 - DNA, 20 bp, Artificial
  CRISPR gRNA sequence
agcaatgaagtcaatgctaa

SEQ ID NO: 695964 - DNA, 20 bp, Artificial
  CRISPR gRNA sequence
agaataccatcaatttataa

SEQ ID NO: 695965 - DNA, 20 bp, Artificial
  CRISPR gRNA sequence
ataaaatactgattatctca

SEQ ID NO: 695966 - DNA, 20 bp, Artificial
  CRISPR gRNA sequence
taaaatactgattatctcat

SEQ ID NO: 695967 - DNA, 20 bp, Artificial
  CRISPR gRNA sequence
attatctcatttatagacat

SEQ ID NO: 695968 - DNA, 20 bp, Artificial
  CRISPR gRNA sequence
tctcatttatagacataaaa

SEQ ID NO: 695969 - DNA, 20 bp, Artificial
  CRISPR gRNA sequence
atttatagacataaaaatac

SEQ ID NO: 695970 - DNA, 20 bp, Artificial
  CRISPR gRNA sequence
atagacataaaaatactata

SEQ ID NO: 695971 - DNA, 20 bp, Artificial
  CRISPR gRNA sequence
tagacataaaaatactataa

SEQ ID NO: 695972 - DNA, 20 bp, Artificial
  CRISPR gRNA sequence
taattatatatatatattta

SEQ ID NO: 695973 - DNA, 20 bp, Artificial
  CRISPR gRNA sequence
tatatatatatttatgtaaa

SEQ ID NO: 695974 - DNA, 20 bp, Artificial
  CRISPR gRNA sequence
atgtaaaattaccatcacac

SEQ ID NO: 695975 - DNA, 20 bp, Artificial
  CRISPR gRNA sequence
tgtaaaattaccatcacacc

SEQ ID NO: 695976 - DNA, 20 bp, Artificial
  CRISPR gRNA sequence
ccatcacacctaagacagcg

SEQ ID NO: 695977 - DNA, 20 bp, Artificial
  CRISPR gRNA sequence
agacagcgagatggattttt

SEQ ID NO: 695978 - DNA, 20 bp, Artificial
  CRISPR gRNA sequence
ttcccttccacagatgaaaa

SEQ ID NO: 695979 - DNA, 20 bp, Artificial
  CRISPR gRNA sequence
tcccttccacagatgaaaat

SEQ ID NO: 695980 - DNA, 20 bp, Artificial
  CRISPR gRNA sequence
cccttccacagatgaaaata

SEQ ID NO: 695981 - DNA, 20 bp, Artificial
  CRISPR gRNA sequence
ccttccacagatgaaaatat

SEQ ID NO: 695982 - DNA, 20 bp, Artificial
  CRISPR gRNA sequence
ccacagatgaaaatatgagt

SEQ ID NO: 695983 - DNA, 20 bp, Artificial
  CRISPR gRNA sequence
cacagatgaaaatatgagtc

SEQ ID NO: 695984 - DNA, 20 bp, Artificial
  CRISPR gRNA sequence
agaacataaaatcttcattt

SEQ ID NO: 695985 - DNA, 20 bp, Artificial
  CRISPR gRNA sequence
catttgagctcactgaaaat

SEQ ID NO: 695986 - DNA, 20 bp, Artificial
  CRISPR gRNA sequence
atttgagctcactgaaaatg

SEQ ID NO: 695987 - DNA, 20 bp, Artificial
  CRISPR gRNA sequence
gagctcactgaaaatgttgg

SEQ ID NO: 695988 - DNA, 20 bp, Artificial
  CRISPR gRNA sequence
agctcactgaaaatgttggc

SEQ ID NO: 695989 - DNA, 20 bp, Artificial
  CRISPR gRNA sequence
actgaaaatgttggccttga

SEQ ID NO: 695990 - DNA, 20 bp, Artificial
  CRISPR gRNA sequence
aaaatgttggccttgagaat

SEQ ID NO: 695991 - DNA, 20 bp, Artificial
  CRISPR gRNA sequence
gccttgagaattaggagaca

SEQ ID NO: 695992 - DNA, 20 bp, Artificial
  CRISPR gRNA sequence
gagaattaggagacactcag

SEQ ID NO: 695993 - DNA, 20 bp, Artificial
  CRISPR gRNA sequence
agaattaggagacactcagt

SEQ ID NO: 695994 - DNA, 20 bp, Artificial
  CRISPR gRNA sequence
ggagacactcagtctcctgc

SEQ ID NO: 695995 - DNA, 20 bp, Artificial
  CRISPR gRNA sequence
agtctcctgcaggccccctg

SEQ ID NO: 695996 - DNA, 20 bp, Artificial
  CRISPR gRNA sequence
ctgcaggccccctgggcatg

SEQ ID NO: 695997 - DNA, 20 bp, Artificial
  CRISPR gRNA sequence
caggccccctgggcatgagc

SEQ ID NO: 695998 - DNA, 20 bp, Artificial
  CRISPR gRNA sequence
ggcatgagccacaccagtgg

SEQ ID NO: 695999 - DNA, 20 bp, Artificial
  CRISPR gRNA sequence
agaaccctggaaggttcaca

SEQ ID NO: 696000 - DNA, 20 bp, Artificial
  CRISPR gRNA sequence
gaaggttcacacttgtagag

SEQ ID NO: 696001 - DNA, 20 bp, Artificial
  CRISPR gRNA sequence
acacttgtagagggtgcaca

SEQ ID NO: 696002 - DNA, 20 bp, Artificial
  CRISPR gRNA sequence
gtagagggtgcacatccagt

SEQ ID NO: 696003 - DNA, 20 bp, Artificial
  CRISPR gRNA sequence
tagagggtgcacatccagtg

SEQ ID NO: 696004 - DNA, 20 bp, Artificial
  CRISPR gRNA sequence
atggatgggccaaggtaata

SEQ ID NO: 696005 - DNA, 20 bp, Artificial
  CRISPR gRNA sequence
cttccttcagctgggggagg

SEQ ID NO: 696006 - DNA, 20 bp, Artificial
  CRISPR gRNA sequence
ccttcagctgggggaggcag

SEQ ID NO: 696007 - DNA, 20 bp, Artificial
  CRISPR gRNA sequence
cttcagctgggggaggcaga

SEQ ID NO: 696008 - DNA, 20 bp, Artificial
  CRISPR gRNA sequence
cagctgggggaggcagatgg

SEQ ID NO: 696009 - DNA, 20 bp, Artificial
  CRISPR gRNA sequence
agctgggggaggcagatggg

SEQ ID NO: 696010 - DNA, 20 bp, Artificial
  CRISPR gRNA sequence
ggggaggcagatgggtgagt

SEQ ID NO: 696011 - DNA, 20 bp, Artificial
  CRISPR gRNA sequence
cgcatgaggtgtatggtgtt

SEQ ID NO: 696012 - DNA, 20 bp, Artificial
  CRISPR gRNA sequence
ctagagctattgttagttcc

SEQ ID NO: 696013 - DNA, 20 bp, Artificial
  CRISPR gRNA sequence
gagctattgttagttcctct

SEQ ID NO: 696014 - DNA, 20 bp, Artificial
  CRISPR gRNA sequence
ttgttagttcctctgctgtg

SEQ ID NO: 696015 - DNA, 20 bp, Artificial
  CRISPR gRNA sequence
ttagttcctctgctgtgaac

SEQ ID NO: 696016 - DNA, 20 bp, Artificial
  CRISPR gRNA sequence
gttcctctgctgtgaactcc

SEQ ID NO: 696017 - DNA, 20 bp, Artificial
  CRISPR gRNA sequence
ctctgctgtgaactccaccc

SEQ ID NO: 696018 - DNA, 20 bp, Artificial
  CRISPR gRNA sequence
tgctgtgaactccaccccgg

SEQ ID NO: 696019 - DNA, 20 bp, Artificial
  CRISPR gRNA sequence
ctgtgaactccaccccgggc

SEQ ID NO: 696020 - DNA, 20 bp, Artificial
  CRISPR gRNA sequence
tgaactccaccccgggcata

SEQ ID NO: 696021 - DNA, 20 bp, Artificial
  CRISPR gRNA sequence
caccccgggcatacaaaaat

SEQ ID NO: 696022 - DNA, 20 bp, Artificial
  CRISPR gRNA sequence
tatactcactggtaagcagg

SEQ ID NO: 696023 - DNA, 20 bp, Artificial
  CRISPR gRNA sequence
actggtaagcaggatccttt

SEQ ID NO: 696024 - DNA, 20 bp, Artificial
  CRISPR gRNA sequence
gtaagcaggatcctttttag

SEQ ID NO: 696025 - DNA, 20 bp, Artificial
  CRISPR gRNA sequence
tttaggaaagcaaatgactt

SEQ ID NO: 696026 - DNA, 20 bp, Artificial
  CRISPR gRNA sequence
ttaggaaagcaaatgacttt

SEQ ID NO: 696027 - DNA, 20 bp, Artificial
  CRISPR gRNA sequence
taggaaagcaaatgactttc

SEQ ID NO: 696028 - DNA, 20 bp, Artificial
  CRISPR gRNA sequence
aggaaagcaaatgactttcc

SEQ ID NO: 696029 - DNA, 20 bp, Artificial
  CRISPR gRNA sequence
ggaaagcaaatgactttcct

SEQ ID NO: 696030 - DNA, 20 bp, Artificial
  CRISPR gRNA sequence
tcctaacataaggtcaaaca

SEQ ID NO: 696031 - DNA, 20 bp, Artificial
  CRISPR gRNA sequence
cctaacataaggtcaaacat

SEQ ID NO: 696032 - DNA, 20 bp, Artificial
  CRISPR gRNA sequence
ctaacataaggtcaaacatt

SEQ ID NO: 696033 - DNA, 20 bp, Artificial
  CRISPR gRNA sequence
acataaggtcaaacatttcc

SEQ ID NO: 696034 - DNA, 20 bp, Artificial
  CRISPR gRNA sequence
ccctccaaatgaatcatcct

SEQ ID NO: 696035 - DNA, 20 bp, Artificial
  CRISPR gRNA sequence
cctccaaatgaatcatccta

SEQ ID NO: 696036 - DNA, 20 bp, Artificial
  CRISPR gRNA sequence
caaatgaatcatcctagttg

SEQ ID NO: 696037 - DNA, 20 bp, Artificial
  CRISPR gRNA sequence
gttggataatctcttcactc

SEQ ID NO: 696038 - DNA, 20 bp, Artificial
  CRISPR gRNA sequence
gataatctcttcactcccac

SEQ ID NO: 696039 - DNA, 20 bp, Artificial
  CRISPR gRNA sequence
ttcactcccactgaaattgc

SEQ ID NO: 696040 - DNA, 20 bp, Artificial
  CRISPR gRNA sequence
cactcccactgaaattgccc

SEQ ID NO: 696041 - DNA, 20 bp, Artificial
  CRISPR gRNA sequence
actcccactgaaattgcccc

SEQ ID NO: 696042 - DNA, 20 bp, Artificial
  CRISPR gRNA sequence
ccactgaaattgccccagag

SEQ ID NO: 696043 - DNA, 20 bp, Artificial
  CRISPR gRNA sequence
aaattgccccagagttgcac

SEQ ID NO: 696044 - DNA, 20 bp, Artificial
  CRISPR gRNA sequence
ccccagagttgcacgtgagc

SEQ ID NO: 696045 - DNA, 20 bp, Artificial
  CRISPR gRNA sequence
cacgtgagcatttggatcca

SEQ ID NO: 696046 - DNA, 20 bp, Artificial
  CRISPR gRNA sequence
ggatccaagacagaaagtca

SEQ ID NO: 696047 - DNA, 20 bp, Artificial
  CRISPR gRNA sequence
gatccaagacagaaagtcat

SEQ ID NO: 696048 - DNA, 20 bp, Artificial
  CRISPR gRNA sequence
tgggggttgggtctggctga

SEQ ID NO: 696049 - DNA, 20 bp, Artificial
  CRISPR gRNA sequence
gggggttgggtctggctgat

SEQ ID NO: 696050 - DNA, 20 bp, Artificial
  CRISPR gRNA sequence
ggggttgggtctggctgatc

SEQ ID NO: 696051 - DNA, 20 bp, Artificial
  CRISPR gRNA sequence
ggtctggctgatctgggagt

SEQ ID NO: 696052 - DNA, 20 bp, Artificial
  CRISPR gRNA sequence
gctgatctgggagtgttgtg

SEQ ID NO: 696053 - DNA, 20 bp, Artificial
  CRISPR gRNA sequence
atctgggagtgttgtgaaga

SEQ ID NO: 696054 - DNA, 20 bp, Artificial
  CRISPR gRNA sequence
ggagtgttgtgaagaaaggc

SEQ ID NO: 696055 - DNA, 20 bp, Artificial
  CRISPR gRNA sequence
tgaagaaaggctttctactt

SEQ ID NO: 696056 - DNA, 20 bp, Artificial
  CRISPR gRNA sequence
tctacttacagaagaacaag

SEQ ID NO: 696057 - DNA, 20 bp, Artificial
  CRISPR gRNA sequence
ctacttacagaagaacaagg

SEQ ID NO: 696058 - DNA, 20 bp, Artificial
  CRISPR gRNA sequence
tacttacagaagaacaaggg

SEQ ID NO: 696059 - DNA, 20 bp, Artificial
  CRISPR gRNA sequence
cttacagaagaacaagggtg

SEQ ID NO: 696060 - DNA, 20 bp, Artificial
  CRISPR gRNA sequence
acagaagaacaagggtgagc

SEQ ID NO: 696061 - DNA, 20 bp, Artificial
  CRISPR gRNA sequence
cagaagaacaagggtgagct

SEQ ID NO: 696062 - DNA, 20 bp, Artificial
  CRISPR gRNA sequence
tgagtaggagatgacatcct

SEQ ID NO: 696063 - DNA, 20 bp, Artificial
  CRISPR gRNA sequence
agtaggagatgacatcctga

SEQ ID NO: 696064 - DNA, 20 bp, Artificial
  CRISPR gRNA sequence
agggggaaagacagatgggc

SEQ ID NO: 696065 - DNA, 20 bp, Artificial
  CRISPR gRNA sequence
aagcaaactcaggagtttac

SEQ ID NO: 696066 - DNA, 20 bp, Artificial
  CRISPR gRNA sequence
aggagtttaccatataaaag

SEQ ID NO: 696067 - DNA, 20 bp, Artificial
  CRISPR gRNA sequence
accatataaaagattttgga

SEQ ID NO: 696068 - DNA, 20 bp, Artificial
  CRISPR gRNA sequence
ccatataaaagattttggaa

SEQ ID NO: 696069 - DNA, 20 bp, Artificial
  CRISPR gRNA sequence
tggaatctattcttcagcct

SEQ ID NO: 696070 - DNA, 20 bp, Artificial
  CRISPR gRNA sequence
ggaatctattcttcagcctc

SEQ ID NO: 696071 - DNA, 20 bp, Artificial
  CRISPR gRNA sequence
gaatctattcttcagcctct

SEQ ID NO: 696072 - DNA, 20 bp, Artificial
  CRISPR gRNA sequence
ttcttcagcctcttttttac

SEQ ID NO: 696073 - DNA, 20 bp, Artificial
  CRISPR gRNA sequence
ttcagcctcttttttactgt

SEQ ID NO: 696074 - DNA, 20 bp, Artificial
  CRISPR gRNA sequence
cagcctcttttttactgtga

SEQ ID NO: 696075 - DNA, 20 bp, Artificial
  CRISPR gRNA sequence
agcctcttttttactgtgat

SEQ ID NO: 696076 - DNA, 20 bp, Artificial
  CRISPR gRNA sequence
ttttttactgtgatacaata

SEQ ID NO: 696077 - DNA, 20 bp, Artificial
  CRISPR gRNA sequence
ttttactgtgatacaatata

SEQ ID NO: 696078 - DNA, 20 bp, Artificial
  CRISPR gRNA sequence
tttactgtgatacaatatac

SEQ ID NO: 696079 - DNA, 20 bp, Artificial
  CRISPR gRNA sequence
ttactgtgatacaatataca

SEQ ID NO: 696080 - DNA, 20 bp, Artificial
  CRISPR gRNA sequence
tactgtgatacaatatacat

SEQ ID NO: 696081 - DNA, 20 bp, Artificial
  CRISPR gRNA sequence
actgtgatacaatatacatg

SEQ ID NO: 696082 - DNA, 20 bp, Artificial
  CRISPR gRNA sequence
ctgtgatacaatatacatga

SEQ ID NO: 696083 - DNA, 20 bp, Artificial
  CRISPR gRNA sequence
tgatacaatatacatgaaca

SEQ ID NO: 696084 - DNA, 20 bp, Artificial
  CRISPR gRNA sequence
accactgtacccattgtaca

SEQ ID NO: 696085 - DNA, 20 bp, Artificial
  CRISPR gRNA sequence
ccactgtacccattgtacaa

SEQ ID NO: 696086 - DNA, 20 bp, Artificial
  CRISPR gRNA sequence
tacccattgtacaataggtg

SEQ ID NO: 696087 - DNA, 20 bp, Artificial
  CRISPR gRNA sequence
tacaataggtgtacaatgca

SEQ ID NO: 696088 - DNA, 20 bp, Artificial
  CRISPR gRNA sequence
gtaggttcacaatgttatgt

SEQ ID NO: 696089 - DNA, 20 bp, Artificial
  CRISPR gRNA sequence
acaatgttatgtagccatca

SEQ ID NO: 696090 - DNA, 20 bp, Artificial
  CRISPR gRNA sequence
tgtagccatcatcactctct

SEQ ID NO: 696091 - DNA, 20 bp, Artificial
  CRISPR gRNA sequence
tctagttccagagtatttca

SEQ ID NO: 696092 - DNA, 20 bp, Artificial
  CRISPR gRNA sequence
tagttccagagtatttcatc

SEQ ID NO: 696093 - DNA, 20 bp, Artificial
  CRISPR gRNA sequence
gttccagagtatttcatcac

SEQ ID NO: 696094 - DNA, 20 bp, Artificial
  CRISPR gRNA sequence
cagagtatttcatcacctca

SEQ ID NO: 696095 - DNA, 20 bp, Artificial
  CRISPR gRNA sequence
catcacctcaggggaaactc

SEQ ID NO: 696096 - DNA, 20 bp, Artificial
  CRISPR gRNA sequence
atcacctcaggggaaactct

SEQ ID NO: 696097 - DNA, 20 bp, Artificial
  CRISPR gRNA sequence
aggggaaactctgcaccatt

SEQ ID NO: 696098 - DNA, 20 bp, Artificial
  CRISPR gRNA sequence
tgcaccattaagcagtcacc

SEQ ID NO: 696099 - DNA, 20 bp, Artificial
  CRISPR gRNA sequence
caccattaagcagtcaccct

SEQ ID NO: 696100 - DNA, 20 bp, Artificial
  CRISPR gRNA sequence
agcagtcaccctccatttcc

SEQ ID NO: 696101 - DNA, 20 bp, Artificial
  CRISPR gRNA sequence
catttcctcctgccaccaga

SEQ ID NO: 696102 - DNA, 20 bp, Artificial
  CRISPR gRNA sequence
cctcctgccaccagaccctg

SEQ ID NO: 696103 - DNA, 20 bp, Artificial
  CRISPR gRNA sequence
ctcctgccaccagaccctgt

SEQ ID NO: 696104 - DNA, 20 bp, Artificial
  CRISPR gRNA sequence
ctgccaccagaccctgtcac

SEQ ID NO: 696105 - DNA, 20 bp, Artificial
  CRISPR gRNA sequence
ccaccagaccctgtcaccac

SEQ ID NO: 696106 - DNA, 20 bp, Artificial
  CRISPR gRNA sequence
tcaccacaagtctgctttct

SEQ ID NO: 696107 - DNA, 20 bp, Artificial
  CRISPR gRNA sequence
ctttctttctctatagattg

SEQ ID NO: 696108 - DNA, 20 bp, Artificial
  CRISPR gRNA sequence
tctttctctatagattggtc

SEQ ID NO: 696109 - DNA, 20 bp, Artificial
  CRISPR gRNA sequence
ctttctctatagattggtct

SEQ ID NO: 696110 - DNA, 20 bp, Artificial
  CRISPR gRNA sequence
tttctctatagattggtctc

SEQ ID NO: 696111 - DNA, 20 bp, Artificial
  CRISPR gRNA sequence
tctctatagattggtctctt

SEQ ID NO: 696112 - DNA, 20 bp, Artificial
  CRISPR gRNA sequence
ctctatagattggtctcttc

SEQ ID NO: 696113 - DNA, 20 bp, Artificial
  CRISPR gRNA sequence
tctatagattggtctcttct

SEQ ID NO: 696114 - DNA, 20 bp, Artificial
  CRISPR gRNA sequence
tatagattggtctcttctga

SEQ ID NO: 696115 - DNA, 20 bp, Artificial
  CRISPR gRNA sequence
tagattggtctcttctgaag

SEQ ID NO: 696116 - DNA, 20 bp, Artificial
  CRISPR gRNA sequence
gtctcttctgaagatttcac

SEQ ID NO: 696117 - DNA, 20 bp, Artificial
  CRISPR gRNA sequence
ttctgaagatttcacaaaga

SEQ ID NO: 696118 - DNA, 20 bp, Artificial
  CRISPR gRNA sequence
ctgaagatttcacaaagatg

SEQ ID NO: 696119 - DNA, 20 bp, Artificial
  CRISPR gRNA sequence
tgaagatttcacaaagatgg

SEQ ID NO: 696120 - DNA, 20 bp, Artificial
  CRISPR gRNA sequence
aagatttcacaaagatgggt

SEQ ID NO: 696121 - DNA, 20 bp, Artificial
  CRISPR gRNA sequence
cacaaagatgggttcatgaa

SEQ ID NO: 696122 - DNA, 20 bp, Artificial
  CRISPR gRNA sequence
acaaagatgggttcatgaaa

SEQ ID NO: 696123 - DNA, 20 bp, Artificial
  CRISPR gRNA sequence
atgaaatatgtatccttttg

SEQ ID NO: 696124 - DNA, 20 bp, Artificial
  CRISPR gRNA sequence
ttgtggctgatttccttcac

SEQ ID NO: 696125 - DNA, 20 bp, Artificial
  CRISPR gRNA sequence
tgtggctgatttccttcact

SEQ ID NO: 696126 - DNA, 20 bp, Artificial
  CRISPR gRNA sequence
gtggctgatttccttcactt

SEQ ID NO: 696127 - DNA, 20 bp, Artificial
  CRISPR gRNA sequence
tggctgatttccttcactta

SEQ ID NO: 696128 - DNA, 20 bp, Artificial
  CRISPR gRNA sequence
atttccttcacttatcatgt

SEQ ID NO: 696129 - DNA, 20 bp, Artificial
  CRISPR gRNA sequence
ccttcacttatcatgttttt

SEQ ID NO: 696130 - DNA, 20 bp, Artificial
  CRISPR gRNA sequence
cttcacttatcatgtttttg

SEQ ID NO: 696131 - DNA, 20 bp, Artificial
  CRISPR gRNA sequence
cacttatcatgtttttgaga

SEQ ID NO: 696132 - DNA, 20 bp, Artificial
  CRISPR gRNA sequence
acttatcatgtttttgagat

SEQ ID NO: 696133 - DNA, 20 bp, Artificial
  CRISPR gRNA sequence
atcatgtttttgagattcag

SEQ ID NO: 696134 - DNA, 20 bp, Artificial
  CRISPR gRNA sequence
tcatgtttttgagattcagc

SEQ ID NO: 696135 - DNA, 20 bp, Artificial
  CRISPR gRNA sequence
ttgagattcagcaatgttgt

SEQ ID NO: 696136 - DNA, 20 bp, Artificial
  CRISPR gRNA sequence
tgagattcagcaatgttgta

SEQ ID NO: 696137 - DNA, 20 bp, Artificial
  CRISPR gRNA sequence
gagattcagcaatgttgtag

SEQ ID NO: 696138 - DNA, 20 bp, Artificial
  CRISPR gRNA sequence
agattcagcaatgttgtagc

SEQ ID NO: 696139 - DNA, 20 bp, Artificial
  CRISPR gRNA sequence
agcaatgttgtagcatgtat

SEQ ID NO: 696140 - DNA, 20 bp, Artificial
  CRISPR gRNA sequence
tagcatgtatcagtatttca

SEQ ID NO: 696141 - DNA, 20 bp, Artificial
  CRISPR gRNA sequence
cattccttttatggctaaat

SEQ ID NO: 696142 - DNA, 20 bp, Artificial
  CRISPR gRNA sequence
attccttttatggctaaatc

SEQ ID NO: 696143 - DNA, 20 bp, Artificial
  CRISPR gRNA sequence
cttttatggctaaatcatat

SEQ ID NO: 696144 - DNA, 20 bp, Artificial
  CRISPR gRNA sequence
ttatggctaaatcatattcc

SEQ ID NO: 696145 - DNA, 20 bp, Artificial
  CRISPR gRNA sequence
tatggctaaatcatattcca

SEQ ID NO: 696146 - DNA, 20 bp, Artificial
  CRISPR gRNA sequence
atggctaaatcatattccat

SEQ ID NO: 696147 - DNA, 20 bp, Artificial
  CRISPR gRNA sequence
tggctaaatcatattccatt

SEQ ID NO: 696148 - DNA, 20 bp, Artificial
  CRISPR gRNA sequence
aatcatattccattgtagaa

SEQ ID NO: 696149 - DNA, 20 bp, Artificial
  CRISPR gRNA sequence
cattgtagaaatacactaca

SEQ ID NO: 696150 - DNA, 20 bp, Artificial
  CRISPR gRNA sequence
tagaaatacactacatgttg

SEQ ID NO: 696151 - DNA, 20 bp, Artificial
  CRISPR gRNA sequence
catgttgtttattcattcat

SEQ ID NO: 696152 - DNA, 20 bp, Artificial
  CRISPR gRNA sequence
tttattcattcattagtcaa

SEQ ID NO: 696153 - DNA, 20 bp, Artificial
  CRISPR gRNA sequence
attcattcattagtcaatgg

SEQ ID NO: 696154 - DNA, 20 bp, Artificial
  CRISPR gRNA sequence
ttcattcattagtcaatggg

SEQ ID NO: 696155 - DNA, 20 bp, Artificial
  CRISPR gRNA sequence
attcattagtcaatgggcat

SEQ ID NO: 696156 - DNA, 20 bp, Artificial
  CRISPR gRNA sequence
attagtcaatgggcattttc

SEQ ID NO: 696157 - DNA, 20 bp, Artificial
  CRISPR gRNA sequence
gtcaatgggcattttctttt

SEQ ID NO: 696158 - DNA, 20 bp, Artificial
  CRISPR gRNA sequence
tcttttaaaccaaataggaa

SEQ ID NO: 696159 - DNA, 20 bp, Artificial
  CRISPR gRNA sequence
cttttaaaccaaataggaaa

SEQ ID NO: 696160 - DNA, 20 bp, Artificial
  CRISPR gRNA sequence
ttttaaaccaaataggaaaa

SEQ ID NO: 696161 - DNA, 20 bp, Artificial
  CRISPR gRNA sequence
ttaaaccaaataggaaaaac

SEQ ID NO: 696162 - DNA, 20 bp, Artificial
  CRISPR gRNA sequence
taaaccaaataggaaaaaca

SEQ ID NO: 696163 - DNA, 20 bp, Artificial
  CRISPR gRNA sequence
aaaccaaataggaaaaacaa

SEQ ID NO: 696164 - DNA, 20 bp, Artificial
  CRISPR gRNA sequence
aaccaaataggaaaaacaaa

SEQ ID NO: 696165 - DNA, 20 bp, Artificial
  CRISPR gRNA sequence
aacaccaaaaatatacatgt

SEQ ID NO: 696166 - DNA, 20 bp, Artificial
  CRISPR gRNA sequence
ctactagcttttataggact

SEQ ID NO: 696167 - DNA, 20 bp, Artificial
  CRISPR gRNA sequence
ctagcttttataggactact

SEQ ID NO: 696168 - DNA, 20 bp, Artificial
  CRISPR gRNA sequence
gcttttataggactactata

SEQ ID NO: 696169 - DNA, 20 bp, Artificial
  CRISPR gRNA sequence
ttataggactactatatata

SEQ ID NO: 696170 - DNA, 20 bp, Artificial
  CRISPR gRNA sequence
tataggactactatatatag

SEQ ID NO: 696171 - DNA, 20 bp, Artificial
  CRISPR gRNA sequence
ataggactactatatatagt

SEQ ID NO: 696172 - DNA, 20 bp, Artificial
  CRISPR gRNA sequence
taggactactatatatagta

SEQ ID NO: 696173 - DNA, 20 bp, Artificial
  CRISPR gRNA sequence
ctatatatagtactatatat

SEQ ID NO: 696174 - DNA, 20 bp, Artificial
  CRISPR gRNA sequence
tatatagtactatatatata

SEQ ID NO: 696175 - DNA, 20 bp, Artificial
  CRISPR gRNA sequence
tatatatatgcacacacaca

SEQ ID NO: 696176 - DNA, 20 bp, Artificial
  CRISPR gRNA sequence
ctactagcttttatagtatg

SEQ ID NO: 696177 - DNA, 20 bp, Artificial
  CRISPR gRNA sequence
ctagcttttatagtatgact

SEQ ID NO: 696178 - DNA, 20 bp, Artificial
  CRISPR gRNA sequence
gcttttatagtatgactact

SEQ ID NO: 696179 - DNA, 20 bp, Artificial
  CRISPR gRNA sequence
ttatagtatgactactatat

SEQ ID NO: 696180 - DNA, 20 bp, Artificial
  CRISPR gRNA sequence
tatagtatgactactatata

SEQ ID NO: 696181 - DNA, 20 bp, Artificial
  CRISPR gRNA sequence
atagtatgactactatatat

SEQ ID NO: 696182 - DNA, 20 bp, Artificial
  CRISPR gRNA sequence
tagtatgactactatatata

SEQ ID NO: 696183 - DNA, 20 bp, Artificial
  CRISPR gRNA sequence
ctatatatagtactatatat

SEQ ID NO: 696184 - DNA, 20 bp, Artificial
  CRISPR gRNA sequence
tatatagtactatatatata

SEQ ID NO: 696185 - DNA, 20 bp, Artificial
  CRISPR gRNA sequence
tatatataatttcatagtag

SEQ ID NO: 696186 - DNA, 20 bp, Artificial
  CRISPR gRNA sequence
catagtagtactatatatag

SEQ ID NO: 696187 - DNA, 20 bp, Artificial
  CRISPR gRNA sequence
atagtagtactatatatagt

SEQ ID NO: 696188 - DNA, 20 bp, Artificial
  CRISPR gRNA sequence
tatatagttatatatatgtg

SEQ ID NO: 696189 - DNA, 20 bp, Artificial
  CRISPR gRNA sequence
tatatatgtggtactatgta

SEQ ID NO: 696190 - DNA, 20 bp, Artificial
  CRISPR gRNA sequence
tgtatagtcatatatatgta

SEQ ID NO: 696191 - DNA, 20 bp, Artificial
  CRISPR gRNA sequence
atatatatataaaatccatt

SEQ ID NO: 696192 - DNA, 20 bp, Artificial
  CRISPR gRNA sequence
tatatatataaaatccatta

SEQ ID NO: 696193 - DNA, 20 bp, Artificial
  CRISPR gRNA sequence
tttctgaaggagagtttttc

SEQ ID NO: 696194 - DNA, 20 bp, Artificial
  CRISPR gRNA sequence
ctgaaggagagtttttccag

SEQ ID NO: 696195 - DNA, 20 bp, Artificial
  CRISPR gRNA sequence
tgaaggagagtttttccaga

SEQ ID NO: 696196 - DNA, 20 bp, Artificial
  CRISPR gRNA sequence
aaggagagtttttccagaca

SEQ ID NO: 696197 - DNA, 20 bp, Artificial
  CRISPR gRNA sequence
ttccagacacacaattcctg

SEQ ID NO: 696198 - DNA, 20 bp, Artificial
  CRISPR gRNA sequence
tccagacacacaattcctgc

SEQ ID NO: 696199 - DNA, 20 bp, Artificial
  CRISPR gRNA sequence
ccagacacacaattcctgca

SEQ ID NO: 696200 - DNA, 20 bp, Artificial
  CRISPR gRNA sequence
cagacacacaattcctgcat

SEQ ID NO: 696201 - DNA, 20 bp, Artificial
  CRISPR gRNA sequence
ctgcatgacagtcttttttt

SEQ ID NO: 696202 - DNA, 20 bp, Artificial
  CRISPR gRNA sequence
catgacagtctttttttttc

SEQ ID NO: 696203 - DNA, 20 bp, Artificial
  CRISPR gRNA sequence
tttttttctgacctctaaat

SEQ ID NO: 696204 - DNA, 20 bp, Artificial
  CRISPR gRNA sequence
ttttttctgacctctaaatt

SEQ ID NO: 696205 - DNA, 20 bp, Artificial
  CRISPR gRNA sequence
tttttctgacctctaaattt

SEQ ID NO: 696206 - DNA, 20 bp, Artificial
  CRISPR gRNA sequence
ttttctgacctctaaatttg

SEQ ID NO: 696207 - DNA, 20 bp, Artificial
  CRISPR gRNA sequence
tttctgacctctaaatttgt

SEQ ID NO: 696208 - DNA, 20 bp, Artificial
  CRISPR gRNA sequence
ttctgacctctaaatttgtc

SEQ ID NO: 696209 - DNA, 20 bp, Artificial
  CRISPR gRNA sequence
tctgacctctaaatttgtca

SEQ ID NO: 696210 - DNA, 20 bp, Artificial
  CRISPR gRNA sequence
ctgacctctaaatttgtcaa

SEQ ID NO: 696211 - DNA, 20 bp, Artificial
  CRISPR gRNA sequence
tgacctctaaatttgtcaac

SEQ ID NO: 696212 - DNA, 20 bp, Artificial
  CRISPR gRNA sequence
acctctaaatttgtcaacat

SEQ ID NO: 696213 - DNA, 20 bp, Artificial
  CRISPR gRNA sequence
taaatttgtcaacattccag

SEQ ID NO: 696214 - DNA, 20 bp, Artificial
  CRISPR gRNA sequence
aatttgtcaacattccagtg

SEQ ID NO: 696215 - DNA, 20 bp, Artificial
  CRISPR gRNA sequence
gtcaacattccagtgccttc

SEQ ID NO: 696216 - DNA, 20 bp, Artificial
  CRISPR gRNA sequence
tcaacattccagtgccttct

SEQ ID NO: 696217 - DNA, 20 bp, Artificial
  CRISPR gRNA sequence
cagtgccttctgaactctat

SEQ ID NO: 696218 - DNA, 20 bp, Artificial
  CRISPR gRNA sequence
ctgaactctatggtttctga

SEQ ID NO: 696219 - DNA, 20 bp, Artificial
  CRISPR gRNA sequence
tgaactctatggtttctgaa

SEQ ID NO: 696220 - DNA, 20 bp, Artificial
  CRISPR gRNA sequence
aactctatggtttctgaaga

SEQ ID NO: 696221 - DNA, 20 bp, Artificial
  CRISPR gRNA sequence
tatggtttctgaagaaaact

SEQ ID NO: 696222 - DNA, 20 bp, Artificial
  CRISPR gRNA sequence
tggtttctgaagaaaactgg

SEQ ID NO: 696223 - DNA, 20 bp, Artificial
  CRISPR gRNA sequence
ctgaagaaaactgggctgca

SEQ ID NO: 696224 - DNA, 20 bp, Artificial
  CRISPR gRNA sequence
tgaagaaaactgggctgcaa

SEQ ID NO: 696225 - DNA, 20 bp, Artificial
  CRISPR gRNA sequence
aagaaaactgggctgcaatc

SEQ ID NO: 696226 - DNA, 20 bp, Artificial
  CRISPR gRNA sequence
ggctgcaatcttattgagga

SEQ ID NO: 696227 - DNA, 20 bp, Artificial
  CRISPR gRNA sequence
caatcttattgaggatccat

SEQ ID NO: 696228 - DNA, 20 bp, Artificial
  CRISPR gRNA sequence
attgaggatccattgaacct

SEQ ID NO: 696229 - DNA, 20 bp, Artificial
  CRISPR gRNA sequence
ttgaggatccattgaacctg

SEQ ID NO: 696230 - DNA, 20 bp, Artificial
  CRISPR gRNA sequence
aggatccattgaacctgaaa

SEQ ID NO: 696231 - DNA, 20 bp, Artificial
  CRISPR gRNA sequence
aacctgaaaagttccttctc

SEQ ID NO: 696232 - DNA, 20 bp, Artificial
  CRISPR gRNA sequence
aaaagttccttctctgttat

SEQ ID NO: 696233 - DNA, 20 bp, Artificial
  CRISPR gRNA sequence
cttctctgttattcatttca

SEQ ID NO: 696234 - DNA, 20 bp, Artificial
  CRISPR gRNA sequence
ctctgttattcatttcaata

SEQ ID NO: 696235 - DNA, 20 bp, Artificial
  CRISPR gRNA sequence
tctgttattcatttcaatat

SEQ ID NO: 696236 - DNA, 20 bp, Artificial
  CRISPR gRNA sequence
tgttattcatttcaatatgc

SEQ ID NO: 696237 - DNA, 20 bp, Artificial
  CRISPR gRNA sequence
ttattcatttcaatatgctc

SEQ ID NO: 696238 - DNA, 20 bp, Artificial
  CRISPR gRNA sequence
ttcatttcaatatgctctgt

SEQ ID NO: 696239 - DNA, 20 bp, Artificial
  CRISPR gRNA sequence
atttcaatatgctctgtttg

SEQ ID NO: 696240 - DNA, 20 bp, Artificial
  CRISPR gRNA sequence
caatatgctctgtttgtcat

SEQ ID NO: 696241 - DNA, 20 bp, Artificial
  CRISPR gRNA sequence
aatatgctctgtttgtcatt

SEQ ID NO: 696242 - DNA, 20 bp, Artificial
  CRISPR gRNA sequence
tgtttgtcattggcttttga

SEQ ID NO: 696243 - DNA, 20 bp, Artificial
  CRISPR gRNA sequence
tttgtcattggcttttgaca

SEQ ID NO: 696244 - DNA, 20 bp, Artificial
  CRISPR gRNA sequence
gtcattggcttttgacaggt

SEQ ID NO: 696245 - DNA, 20 bp, Artificial
  CRISPR gRNA sequence
tcattggcttttgacaggtt

SEQ ID NO: 696246 - DNA, 20 bp, Artificial
  CRISPR gRNA sequence
gcttttgacaggttgattat

SEQ ID NO: 696247 - DNA, 20 bp, Artificial
  CRISPR gRNA sequence
ttgacaggttgattataatg

SEQ ID NO: 696248 - DNA, 20 bp, Artificial
  CRISPR gRNA sequence
tgacaggttgattataatgt

SEQ ID NO: 696249 - DNA, 20 bp, Artificial
  CRISPR gRNA sequence
gacaggttgattataatgtt

SEQ ID NO: 696250 - DNA, 20 bp, Artificial
  CRISPR gRNA sequence
acaggttgattataatgttc

SEQ ID NO: 696251 - DNA, 20 bp, Artificial
  CRISPR gRNA sequence
attataatgttctcttggtg

SEQ ID NO: 696252 - DNA, 20 bp, Artificial
  CRISPR gRNA sequence
taatgttctcttggtgtgga

SEQ ID NO: 696253 - DNA, 20 bp, Artificial
  CRISPR gRNA sequence
tcttggtgtggacctcttta

SEQ ID NO: 696254 - DNA, 20 bp, Artificial
  CRISPR gRNA sequence
ttggtgtggacctctttaaa

SEQ ID NO: 696255 - DNA, 20 bp, Artificial
  CRISPR gRNA sequence
ggtgtggacctctttaaatt

SEQ ID NO: 696256 - DNA, 20 bp, Artificial
  CRISPR gRNA sequence
gtgtggacctctttaaattt

SEQ ID NO: 696257 - DNA, 20 bp, Artificial
  CRISPR gRNA sequence
tttaaatttaaatttttttg

SEQ ID NO: 696258 - DNA, 20 bp, Artificial
  CRISPR gRNA sequence
taaatttaaatttttttgct

SEQ ID NO: 696259 - DNA, 20 bp, Artificial
  CRISPR gRNA sequence
aaatttaaatttttttgctg

SEQ ID NO: 696260 - DNA, 20 bp, Artificial
  CRISPR gRNA sequence
aatttaaatttttttgctgc

SEQ ID NO: 696261 - DNA, 20 bp, Artificial
  CRISPR gRNA sequence
aaatttttttgctgcttaaa

SEQ ID NO: 696262 - DNA, 20 bp, Artificial
  CRISPR gRNA sequence
aatttttttgctgcttaaaa

SEQ ID NO: 696263 - DNA, 20 bp, Artificial
  CRISPR gRNA sequence
ttttgctgcttaaaatttgt

SEQ ID NO: 696264 - DNA, 20 bp, Artificial
  CRISPR gRNA sequence
tttgctgcttaaaatttgtc

SEQ ID NO: 696265 - DNA, 20 bp, Artificial
  CRISPR gRNA sequence
ttgctgcttaaaatttgtca

SEQ ID NO: 696266 - DNA, 20 bp, Artificial
  CRISPR gRNA sequence
tgctgcttaaaatttgtcaa

SEQ ID NO: 696267 - DNA, 20 bp, Artificial
  CRISPR gRNA sequence
gctgcttaaaatttgtcaag

SEQ ID NO: 696268 - DNA, 20 bp, Artificial
  CRISPR gRNA sequence
ctgcttaaaatttgtcaagt

SEQ ID NO: 696269 - DNA, 20 bp, Artificial
  CRISPR gRNA sequence
cttaaaatttgtcaagtttg

SEQ ID NO: 696270 - DNA, 20 bp, Artificial
  CRISPR gRNA sequence
aaaatttgtcaagtttgttg

SEQ ID NO: 696271 - DNA, 20 bp, Artificial
  CRISPR gRNA sequence
aaatttgtcaagtttgttgg

SEQ ID NO: 696272 - DNA, 20 bp, Artificial
  CRISPR gRNA sequence
gtcaagtttgttggatgaat

SEQ ID NO: 696273 - DNA, 20 bp, Artificial
  CRISPR gRNA sequence
tcaagtttgttggatgaata

SEQ ID NO: 696274 - DNA, 20 bp, Artificial
  CRISPR gRNA sequence
gttggatgaataatgttttt

SEQ ID NO: 696275 - DNA, 20 bp, Artificial
  CRISPR gRNA sequence
ttggatgaataatgtttttc

SEQ ID NO: 696276 - DNA, 20 bp, Artificial
  CRISPR gRNA sequence
gatgaataatgtttttcatc

SEQ ID NO: 696277 - DNA, 20 bp, Artificial
  CRISPR gRNA sequence
ttcatcaaatttggaaggtt

SEQ ID NO: 696278 - DNA, 20 bp, Artificial
  CRISPR gRNA sequence
tcatcaaatttggaaggttt

SEQ ID NO: 696279 - DNA, 20 bp, Artificial
  CRISPR gRNA sequence
catcaaatttggaaggtttg

SEQ ID NO: 696280 - DNA, 20 bp, Artificial
  CRISPR gRNA sequence
atcaaatttggaaggtttgg

SEQ ID NO: 696281 - DNA, 20 bp, Artificial
  CRISPR gRNA sequence
ggaaggtttggagttattct

SEQ ID NO: 696282 - DNA, 20 bp, Artificial
  CRISPR gRNA sequence
gaaggtttggagttattctt

SEQ ID NO: 696283 - DNA, 20 bp, Artificial
  CRISPR gRNA sequence
ggagttattctttaaatagt

SEQ ID NO: 696284 - DNA, 20 bp, Artificial
  CRISPR gRNA sequence
gagttattctttaaatagtc

SEQ ID NO: 696285 - DNA, 20 bp, Artificial
  CRISPR gRNA sequence
ttctttaaatagtcattctt

SEQ ID NO: 696286 - DNA, 20 bp, Artificial
  CRISPR gRNA sequence
tttaaatagtcattcttctc

SEQ ID NO: 696287 - DNA, 20 bp, Artificial
  CRISPR gRNA sequence
taaatagtcattcttctcct

SEQ ID NO: 696288 - DNA, 20 bp, Artificial
  CRISPR gRNA sequence
aaatagtcattcttctcctt

SEQ ID NO: 696289 - DNA, 20 bp, Artificial
  CRISPR gRNA sequence
aatagtcattcttctccttt

SEQ ID NO: 696290 - DNA, 20 bp, Artificial
  CRISPR gRNA sequence
ttctcctttctctctctcct

SEQ ID NO: 696291 - DNA, 20 bp, Artificial
  CRISPR gRNA sequence
ctcctttctctctctccttt

SEQ ID NO: 696292 - DNA, 20 bp, Artificial
  CRISPR gRNA sequence
tcctttctctctctcctttc

SEQ ID NO: 696293 - DNA, 20 bp, Artificial
  CRISPR gRNA sequence
ctttctctctctcctttctt

SEQ ID NO: 696294 - DNA, 20 bp, Artificial
  CRISPR gRNA sequence
tctctctctcctttctttga

SEQ ID NO: 696295 - DNA, 20 bp, Artificial
  CRISPR gRNA sequence
ctctctctcctttctttgag

SEQ ID NO: 696296 - DNA, 20 bp, Artificial
  CRISPR gRNA sequence
tctctctcctttctttgagg

SEQ ID NO: 696297 - DNA, 20 bp, Artificial
  CRISPR gRNA sequence
tctctcctttctttgaggac

SEQ ID NO: 696298 - DNA, 20 bp, Artificial
  CRISPR gRNA sequence
tctcctttctttgaggactc

SEQ ID NO: 696299 - DNA, 20 bp, Artificial
  CRISPR gRNA sequence
tcctttctttgaggactccc

SEQ ID NO: 696300 - DNA, 20 bp, Artificial
  CRISPR gRNA sequence
ctttctttgaggactcccaa

SEQ ID NO: 696301 - DNA, 20 bp, Artificial
  CRISPR gRNA sequence
tctttgaggactcccaaagt

SEQ ID NO: 696302 - DNA, 20 bp, Artificial
  CRISPR gRNA sequence
ctttgaggactcccaaagtg

SEQ ID NO: 696303 - DNA, 20 bp, Artificial
  CRISPR gRNA sequence
tttgaggactcccaaagtgc

SEQ ID NO: 696304 - DNA, 20 bp, Artificial
  CRISPR gRNA sequence
tgaggactcccaaagtgcat

SEQ ID NO: 696305 - DNA, 20 bp, Artificial
  CRISPR gRNA sequence
gaggactcccaaagtgcatg

SEQ ID NO: 696306 - DNA, 20 bp, Artificial
  CRISPR gRNA sequence
aggactcccaaagtgcatgt

SEQ ID NO: 696307 - DNA, 20 bp, Artificial
  CRISPR gRNA sequence
ccaaagtgcatgtgcttgat

SEQ ID NO: 696308 - DNA, 20 bp, Artificial
  CRISPR gRNA sequence
gatgttgtctcacagatctt

SEQ ID NO: 696309 - DNA, 20 bp, Artificial
  CRISPR gRNA sequence
atgttgtctcacagatcttt

SEQ ID NO: 696310 - DNA, 20 bp, Artificial
  CRISPR gRNA sequence
tctcacagatctttaaagtt

SEQ ID NO: 696311 - DNA, 20 bp, Artificial
  CRISPR gRNA sequence
acagatctttaaagttctgt

SEQ ID NO: 696312 - DNA, 20 bp, Artificial
  CRISPR gRNA sequence
taaagttctgtttatttttc

SEQ ID NO: 696313 - DNA, 20 bp, Artificial
  CRISPR gRNA sequence
aaagttctgtttatttttct

SEQ ID NO: 696314 - DNA, 20 bp, Artificial
  CRISPR gRNA sequence
aagttctgtttatttttctt

SEQ ID NO: 696315 - DNA, 20 bp, Artificial
  CRISPR gRNA sequence
tgtttatttttcttcataat

SEQ ID NO: 696316 - DNA, 20 bp, Artificial
  CRISPR gRNA sequence
tttatttttcttcataattt

SEQ ID NO: 696317 - DNA, 20 bp, Artificial
  CRISPR gRNA sequence
atttttcttcataatttttt

SEQ ID NO: 696318 - DNA, 20 bp, Artificial
  CRISPR gRNA sequence
tttttcttcataattttttt

SEQ ID NO: 696319 - DNA, 20 bp, Artificial
  CRISPR gRNA sequence
ttcttcataattttttttct

SEQ ID NO: 696320 - DNA, 20 bp, Artificial
  CRISPR gRNA sequence
tcttcataattttttttctt

SEQ ID NO: 696321 - DNA, 20 bp, Artificial
  CRISPR gRNA sequence
cttcataattttttttcttt

SEQ ID NO: 696322 - DNA, 20 bp, Artificial
  CRISPR gRNA sequence
ttcataattttttttctttc

SEQ ID NO: 696323 - DNA, 20 bp, Artificial
  CRISPR gRNA sequence
cataattttttttctttctg

SEQ ID NO: 696324 - DNA, 20 bp, Artificial
  CRISPR gRNA sequence
ataattttttttctttctgc

SEQ ID NO: 696325 - DNA, 20 bp, Artificial
  CRISPR gRNA sequence
tttttctttctgctactgaa

SEQ ID NO: 696326 - DNA, 20 bp, Artificial
  CRISPR gRNA sequence
ttttctttctgctactgaac

SEQ ID NO: 696327 - DNA, 20 bp, Artificial
  CRISPR gRNA sequence
tttctttctgctactgaact

SEQ ID NO: 696328 - DNA, 20 bp, Artificial
  CRISPR gRNA sequence
ttctttctgctactgaacta

SEQ ID NO: 696329 - DNA, 20 bp, Artificial
  CRISPR gRNA sequence
tctttctgctactgaactag

SEQ ID NO: 696330 - DNA, 20 bp, Artificial
  CRISPR gRNA sequence
ctttctgctactgaactaga

SEQ ID NO: 696331 - DNA, 20 bp, Artificial
  CRISPR gRNA sequence
tttctgctactgaactagag

SEQ ID NO: 696332 - DNA, 20 bp, Artificial
  CRISPR gRNA sequence
tctgctactgaactagagaa

SEQ ID NO: 696333 - DNA, 20 bp, Artificial
  CRISPR gRNA sequence
ctgctactgaactagagaat

SEQ ID NO: 696334 - DNA, 20 bp, Artificial
  CRISPR gRNA sequence
tgctactgaactagagaatt

SEQ ID NO: 696335 - DNA, 20 bp, Artificial
  CRISPR gRNA sequence
ctactgaactagagaatttc

SEQ ID NO: 696336 - DNA, 20 bp, Artificial
  CRISPR gRNA sequence
ctgaactagagaatttcaat

SEQ ID NO: 696337 - DNA, 20 bp, Artificial
  CRISPR gRNA sequence
aactagagaatttcaattgt

SEQ ID NO: 696338 - DNA, 20 bp, Artificial
  CRISPR gRNA sequence
gagaatttcaattgtcttat

SEQ ID NO: 696339 - DNA, 20 bp, Artificial
  CRISPR gRNA sequence
caattgtcttatcttcaagc

SEQ ID NO: 696340 - DNA, 20 bp, Artificial
  CRISPR gRNA sequence
aattgtcttatcttcaagct

SEQ ID NO: 696341 - DNA, 20 bp, Artificial
  CRISPR gRNA sequence
tcttatcttcaagcttgctg

SEQ ID NO: 696342 - DNA, 20 bp, Artificial
  CRISPR gRNA sequence
atcttcaagcttgctgattc

SEQ ID NO: 696343 - DNA, 20 bp, Artificial
  CRISPR gRNA sequence
tcttcaagcttgctgattct

SEQ ID NO: 696344 - DNA, 20 bp, Artificial
  CRISPR gRNA sequence
caagcttgctgattctccat

SEQ ID NO: 696345 - DNA, 20 bp, Artificial
  CRISPR gRNA sequence
aagcttgctgattctccatt

SEQ ID NO: 696346 - DNA, 20 bp, Artificial
  CRISPR gRNA sequence
gctgattctccattctgcat

SEQ ID NO: 696347 - DNA, 20 bp, Artificial
  CRISPR gRNA sequence
ctgattctccattctgcatg

SEQ ID NO: 696348 - DNA, 20 bp, Artificial
  CRISPR gRNA sequence
attctccattctgcatggtg

SEQ ID NO: 696349 - DNA, 20 bp, Artificial
  CRISPR gRNA sequence
tccattctgcatggtgaaat

SEQ ID NO: 696350 - DNA, 20 bp, Artificial
  CRISPR gRNA sequence
cattctgcatggtgaaattt

SEQ ID NO: 696351 - DNA, 20 bp, Artificial
  CRISPR gRNA sequence
tgcatggtgaaatttgctct

SEQ ID NO: 696352 - DNA, 20 bp, Artificial
  CRISPR gRNA sequence
catggtgaaatttgctctgg

SEQ ID NO: 696353 - DNA, 20 bp, Artificial
  CRISPR gRNA sequence
gctctggagcccctctagtg

SEQ ID NO: 696354 - DNA, 20 bp, Artificial
  CRISPR gRNA sequence
ctctggagcccctctagtga

SEQ ID NO: 696355 - DNA, 20 bp, Artificial
  CRISPR gRNA sequence
tggagcccctctagtgaatt

SEQ ID NO: 696356 - DNA, 20 bp, Artificial
  CRISPR gRNA sequence
gagcccctctagtgaatttt

SEQ ID NO: 696357 - DNA, 20 bp, Artificial
  CRISPR gRNA sequence
tagtgaatttttcatttcag

SEQ ID NO: 696358 - DNA, 20 bp, Artificial
  CRISPR gRNA sequence
gtgaatttttcatttcagtt

SEQ ID NO: 696359 - DNA, 20 bp, Artificial
  CRISPR gRNA sequence
ttcatttcagttattgcact

SEQ ID NO: 696360 - DNA, 20 bp, Artificial
  CRISPR gRNA sequence
tcatttcagttattgcactt

SEQ ID NO: 696361 - DNA, 20 bp, Artificial
  CRISPR gRNA sequence
catttcagttattgcacttt

SEQ ID NO: 696362 - DNA, 20 bp, Artificial
  CRISPR gRNA sequence
atttcagttattgcactttt

SEQ ID NO: 696363 - DNA, 20 bp, Artificial
  CRISPR gRNA sequence
cagttattgcacttttcagc

SEQ ID NO: 696364 - DNA, 20 bp, Artificial
  CRISPR gRNA sequence
agttattgcacttttcagct

SEQ ID NO: 696365 - DNA, 20 bp, Artificial
  CRISPR gRNA sequence
ttgcacttttcagctccaaa

SEQ ID NO: 696366 - DNA, 20 bp, Artificial
  CRISPR gRNA sequence
cacttttcagctccaaactt

SEQ ID NO: 696367 - DNA, 20 bp, Artificial
  CRISPR gRNA sequence
ttcagctccaaactttttat

SEQ ID NO: 696368 - DNA, 20 bp, Artificial
  CRISPR gRNA sequence
tcagctccaaactttttatc

SEQ ID NO: 696369 - DNA, 20 bp, Artificial
  CRISPR gRNA sequence
cagctccaaactttttatct

SEQ ID NO: 696370 - DNA, 20 bp, Artificial
  CRISPR gRNA sequence
agctccaaactttttatctg

SEQ ID NO: 696371 - DNA, 20 bp, Artificial
  CRISPR gRNA sequence
caaactttttatctggtctc

SEQ ID NO: 696372 - DNA, 20 bp, Artificial
  CRISPR gRNA sequence
tttatctggtctctttgtaa

SEQ ID NO: 696373 - DNA, 20 bp, Artificial
  CRISPR gRNA sequence
ttatctggtctctttgtaaa

SEQ ID NO: 696374 - DNA, 20 bp, Artificial
  CRISPR gRNA sequence
tatctggtctctttgtaaaa

SEQ ID NO: 696375 - DNA, 20 bp, Artificial
  CRISPR gRNA sequence
atctggtctctttgtaaaat

SEQ ID NO: 696376 - DNA, 20 bp, Artificial
  CRISPR gRNA sequence
tctggtctctttgtaaaatt

SEQ ID NO: 696377 - DNA, 20 bp, Artificial
  CRISPR gRNA sequence
gtctctttgtaaaatttcta

SEQ ID NO: 696378 - DNA, 20 bp, Artificial
  CRISPR gRNA sequence
tttgtaaaatttctaccttt

SEQ ID NO: 696379 - DNA, 20 bp, Artificial
  CRISPR gRNA sequence
tgtaaaatttctaccttttt

SEQ ID NO: 696380 - DNA, 20 bp, Artificial
  CRISPR gRNA sequence
gtaaaatttctaccttttta

SEQ ID NO: 696381 - DNA, 20 bp, Artificial
  CRISPR gRNA sequence
taaaatttctacctttttat

SEQ ID NO: 696382 - DNA, 20 bp, Artificial
  CRISPR gRNA sequence
ctacctttttattgatgttc

SEQ ID NO: 696383 - DNA, 20 bp, Artificial
  CRISPR gRNA sequence
tacctttttattgatgttct

SEQ ID NO: 696384 - DNA, 20 bp, Artificial
  CRISPR gRNA sequence
cctttttattgatgttctct

SEQ ID NO: 696385 - DNA, 20 bp, Artificial
  CRISPR gRNA sequence
tttattgatgttctctattt

SEQ ID NO: 696386 - DNA, 20 bp, Artificial
  CRISPR gRNA sequence
ttattgatgttctctatttg

SEQ ID NO: 696387 - DNA, 20 bp, Artificial
  CRISPR gRNA sequence
tattgatgttctctatttgg

SEQ ID NO: 696388 - DNA, 20 bp, Artificial
  CRISPR gRNA sequence
attgatgttctctatttggg

SEQ ID NO: 696389 - DNA, 20 bp, Artificial
  CRISPR gRNA sequence
ttgatgttctctatttgggg

SEQ ID NO: 696390 - DNA, 20 bp, Artificial
  CRISPR gRNA sequence
atgttctctatttggggaaa

SEQ ID NO: 696391 - DNA, 20 bp, Artificial
  CRISPR gRNA sequence
tctatttggggaaacctgca

SEQ ID NO: 696392 - DNA, 20 bp, Artificial
  CRISPR gRNA sequence
tatttggggaaacctgcaac

SEQ ID NO: 696393 - DNA, 20 bp, Artificial
  CRISPR gRNA sequence
tttggggaaacctgcaacca

SEQ ID NO: 696394 - DNA, 20 bp, Artificial
  CRISPR gRNA sequence
ggggaaacctgcaaccacca

SEQ ID NO: 696395 - DNA, 20 bp, Artificial
  CRISPR gRNA sequence
gggaaacctgcaaccaccat

SEQ ID NO: 696396 - DNA, 20 bp, Artificial
  CRISPR gRNA sequence
caaccaccatcttctgaagc

SEQ ID NO: 696397 - DNA, 20 bp, Artificial
  CRISPR gRNA sequence
ctgaagctctgcccatgtca

SEQ ID NO: 696398 - DNA, 20 bp, Artificial
  CRISPR gRNA sequence
tgaagctctgcccatgtcaa

SEQ ID NO: 696399 - DNA, 20 bp, Artificial
  CRISPR gRNA sequence
aagctctgcccatgtcaaga

SEQ ID NO: 696400 - DNA, 20 bp, Artificial
  CRISPR gRNA sequence
tgcccatgtcaagaggtctg

SEQ ID NO: 696401 - DNA, 20 bp, Artificial
  CRISPR gRNA sequence
cccatgtcaagaggtctgtg

SEQ ID NO: 696402 - DNA, 20 bp, Artificial
  CRISPR gRNA sequence
tgcatacctctctcttccat

SEQ ID NO: 696403 - DNA, 20 bp, Artificial
  CRISPR gRNA sequence
tctcttccatcccccagttt

SEQ ID NO: 696404 - DNA, 20 bp, Artificial
  CRISPR gRNA sequence
tcttccatcccccagttttc

SEQ ID NO: 696405 - DNA, 20 bp, Artificial
  CRISPR gRNA sequence
ttccatcccccagttttcca

SEQ ID NO: 696406 - DNA, 20 bp, Artificial
  CRISPR gRNA sequence
ccatcccccagttttccaac

SEQ ID NO: 696407 - DNA, 20 bp, Artificial
  CRISPR gRNA sequence
catcccccagttttccaact

SEQ ID NO: 696408 - DNA, 20 bp, Artificial
  CRISPR gRNA sequence
tccaactttattttgctcaa

SEQ ID NO: 696409 - DNA, 20 bp, Artificial
  CRISPR gRNA sequence
ccaactttattttgctcaag

SEQ ID NO: 696410 - DNA, 20 bp, Artificial
  CRISPR gRNA sequence
caactttattttgctcaagt

SEQ ID NO: 696411 - DNA, 20 bp, Artificial
  CRISPR gRNA sequence
tattttgctcaagttcctga

SEQ ID NO: 696412 - DNA, 20 bp, Artificial
  CRISPR gRNA sequence
attttgctcaagttcctgac

SEQ ID NO: 696413 - DNA, 20 bp, Artificial
  CRISPR gRNA sequence
ttttgctcaagttcctgact

SEQ ID NO: 696414 - DNA, 20 bp, Artificial
  CRISPR gRNA sequence
tgctcaagttcctgactgac

SEQ ID NO: 696415 - DNA, 20 bp, Artificial
  CRISPR gRNA sequence
gctcaagttcctgactgacc

SEQ ID NO: 696416 - DNA, 20 bp, Artificial
  CRISPR gRNA sequence
ctcaagttcctgactgacca

SEQ ID NO: 696417 - DNA, 20 bp, Artificial
  CRISPR gRNA sequence
aagttcctgactgaccaagc

SEQ ID NO: 696418 - DNA, 20 bp, Artificial
  CRISPR gRNA sequence
ctgactgaccaagcaaccca

SEQ ID NO: 696419 - DNA, 20 bp, Artificial
  CRISPR gRNA sequence
actgaccaagcaacccatga

SEQ ID NO: 696420 - DNA, 20 bp, Artificial
  CRISPR gRNA sequence
accaagcaacccatgagcca

SEQ ID NO: 696421 - DNA, 20 bp, Artificial
  CRISPR gRNA sequence
cccatgactcattcattcat

SEQ ID NO: 696422 - DNA, 20 bp, Artificial
  CRISPR gRNA sequence
attcattcatgcactactgg

SEQ ID NO: 696423 - DNA, 20 bp, Artificial
  CRISPR gRNA sequence
attcatgcactactggggca

SEQ ID NO: 696424 - DNA, 20 bp, Artificial
  CRISPR gRNA sequence
atgcactactggggcatcat

SEQ ID NO: 696425 - DNA, 20 bp, Artificial
  CRISPR gRNA sequence
ctggggcatcatttcacacc

SEQ ID NO: 696426 - DNA, 20 bp, Artificial
  CRISPR gRNA sequence
gggcatcatttcacaccctc

SEQ ID NO: 696427 - DNA, 20 bp, Artificial
  CRISPR gRNA sequence
cacaccctccaccttgcatg

SEQ ID NO: 696428 - DNA, 20 bp, Artificial
  CRISPR gRNA sequence
acaccctccaccttgcatgg

SEQ ID NO: 696429 - DNA, 20 bp, Artificial
  CRISPR gRNA sequence
caccttgcatgggccttttt

SEQ ID NO: 696430 - DNA, 20 bp, Artificial
  CRISPR gRNA sequence
gcatgggcctttttgggttt

SEQ ID NO: 696431 - DNA, 20 bp, Artificial
  CRISPR gRNA sequence
catgggcctttttgggtttt

SEQ ID NO: 696432 - DNA, 20 bp, Artificial
  CRISPR gRNA sequence
tttgggttttgattcctagt

SEQ ID NO: 696433 - DNA, 20 bp, Artificial
  CRISPR gRNA sequence
ttgggttttgattcctagtt

SEQ ID NO: 696434 - DNA, 20 bp, Artificial
  CRISPR gRNA sequence
tgggttttgattcctagttc

SEQ ID NO: 696435 - DNA, 20 bp, Artificial
  CRISPR gRNA sequence
gggttttgattcctagttcc

SEQ ID NO: 696436 - DNA, 20 bp, Artificial
  CRISPR gRNA sequence
ggttttgattcctagttcct

SEQ ID NO: 696437 - DNA, 20 bp, Artificial
  CRISPR gRNA sequence
tgattcctagttcctggctc

SEQ ID NO: 696438 - DNA, 20 bp, Artificial
  CRISPR gRNA sequence
gattcctagttcctggctca

SEQ ID NO: 696439 - DNA, 20 bp, Artificial
  CRISPR gRNA sequence
attcctagttcctggctcaa

SEQ ID NO: 696440 - DNA, 20 bp, Artificial
  CRISPR gRNA sequence
ctagttcctggctcaacagc

SEQ ID NO: 696441 - DNA, 20 bp, Artificial
  CRISPR gRNA sequence
gttcctggctcaacagccat

SEQ ID NO: 696442 - DNA, 20 bp, Artificial
  CRISPR gRNA sequence
ctggctcaacagccatttcc

SEQ ID NO: 696443 - DNA, 20 bp, Artificial
  CRISPR gRNA sequence
gctcaacagccatttccaaa

SEQ ID NO: 696444 - DNA, 20 bp, Artificial
  CRISPR gRNA sequence
aacagccatttccaaagctg

SEQ ID NO: 696445 - DNA, 20 bp, Artificial
  CRISPR gRNA sequence
ccaaagctgttcttgtgtta

SEQ ID NO: 696446 - DNA, 20 bp, Artificial
  CRISPR gRNA sequence
caaagctgttcttgtgttag

SEQ ID NO: 696447 - DNA, 20 bp, Artificial
  CRISPR gRNA sequence
ttcttgtgttagctcccaag

SEQ ID NO: 696448 - DNA, 20 bp, Artificial
  CRISPR gRNA sequence
ttgtgttagctcccaagcct

SEQ ID NO: 696449 - DNA, 20 bp, Artificial
  CRISPR gRNA sequence
gtgttagctcccaagcctac

SEQ ID NO: 696450 - DNA, 20 bp, Artificial
  CRISPR gRNA sequence
tgttagctcccaagcctact

SEQ ID NO: 696451 - DNA, 20 bp, Artificial
  CRISPR gRNA sequence
gctcccaagcctactgctct

SEQ ID NO: 696452 - DNA, 20 bp, Artificial
  CRISPR gRNA sequence
ccaagcctactgctcttgtt

SEQ ID NO: 696453 - DNA, 20 bp, Artificial
  CRISPR gRNA sequence
ctgctcttgttgtagattct

SEQ ID NO: 696454 - DNA, 20 bp, Artificial
  CRISPR gRNA sequence
ctcttgttgtagattctcct

SEQ ID NO: 696455 - DNA, 20 bp, Artificial
  CRISPR gRNA sequence
ttgttgtagattctcctctt

SEQ ID NO: 696456 - DNA, 20 bp, Artificial
  CRISPR gRNA sequence
gttgtagattctcctcttaa

SEQ ID NO: 696457 - DNA, 20 bp, Artificial
  CRISPR gRNA sequence
ttgtagattctcctcttaat

SEQ ID NO: 696458 - DNA, 20 bp, Artificial
  CRISPR gRNA sequence
tagattctcctcttaatgtc

SEQ ID NO: 696459 - DNA, 20 bp, Artificial
  CRISPR gRNA sequence
tcctcttaatgtctgagtca

SEQ ID NO: 696460 - DNA, 20 bp, Artificial
  CRISPR gRNA sequence
ctcttaatgtctgagtcaca

SEQ ID NO: 696461 - DNA, 20 bp, Artificial
  CRISPR gRNA sequence
ttaatgtctgagtcacagca

SEQ ID NO: 696462 - DNA, 20 bp, Artificial
  CRISPR gRNA sequence
aatgtctgagtcacagcatt

SEQ ID NO: 696463 - DNA, 20 bp, Artificial
  CRISPR gRNA sequence
atgtctgagtcacagcattt

SEQ ID NO: 696464 - DNA, 20 bp, Artificial
  CRISPR gRNA sequence
agtcacagcatttatttcat

SEQ ID NO: 696465 - DNA, 20 bp, Artificial
  CRISPR gRNA sequence
atttcatagatttttaataa

SEQ ID NO: 696466 - DNA, 20 bp, Artificial
  CRISPR gRNA sequence
tttcatagatttttaataat

SEQ ID NO: 696467 - DNA, 20 bp, Artificial
  CRISPR gRNA sequence
catagatttttaataattgg

SEQ ID NO: 696468 - DNA, 20 bp, Artificial
  CRISPR gRNA sequence
atagatttttaataattgga

SEQ ID NO: 696469 - DNA, 20 bp, Artificial
  CRISPR gRNA sequence
ttaataattggactaatttt

SEQ ID NO: 696470 - DNA, 20 bp, Artificial
  CRISPR gRNA sequence
taataattggactaattttt

SEQ ID NO: 696471 - DNA, 20 bp, Artificial
  CRISPR gRNA sequence
aataattggactaatttttt

SEQ ID NO: 696472 - DNA, 20 bp, Artificial
  CRISPR gRNA sequence
ataattggactaattttttc

SEQ ID NO: 696473 - DNA, 20 bp, Artificial
  CRISPR gRNA sequence
gactaattttttccaatgca

SEQ ID NO: 696474 - DNA, 20 bp, Artificial
  CRISPR gRNA sequence
attttttccaatgcagcatt

SEQ ID NO: 696475 - DNA, 20 bp, Artificial
  CRISPR gRNA sequence
tttccaatgcagcatttcta

SEQ ID NO: 696476 - DNA, 20 bp, Artificial
  CRISPR gRNA sequence
ttccaatgcagcatttctaa

SEQ ID NO: 696477 - DNA, 20 bp, Artificial
  CRISPR gRNA sequence
tccaatgcagcatttctaag

SEQ ID NO: 696478 - DNA, 20 bp, Artificial
  CRISPR gRNA sequence
ccaatgcagcatttctaagg

SEQ ID NO: 696479 - DNA, 20 bp, Artificial
  CRISPR gRNA sequence
caatgcagcatttctaagga

SEQ ID NO: 696480 - DNA, 20 bp, Artificial
  CRISPR gRNA sequence
ctaaggactttcagtaatgg

SEQ ID NO: 696481 - DNA, 20 bp, Artificial
  CRISPR gRNA sequence
taaggactttcagtaatgga

SEQ ID NO: 696482 - DNA, 20 bp, Artificial
  CRISPR gRNA sequence
aggactttcagtaatggaga

SEQ ID NO: 696483 - DNA, 20 bp, Artificial
  CRISPR gRNA sequence
tcagtaatggagattctata

SEQ ID NO: 696484 - DNA, 20 bp, Artificial
  CRISPR gRNA sequence
cagtaatggagattctatat

SEQ ID NO: 696485 - DNA, 20 bp, Artificial
  CRISPR gRNA sequence
agtaatggagattctatatt

SEQ ID NO: 696486 - DNA, 20 bp, Artificial
  CRISPR gRNA sequence
tatattagcttagagagaat

SEQ ID NO: 696487 - DNA, 20 bp, Artificial
  CRISPR gRNA sequence
tattagcttagagagaattg

SEQ ID NO: 696488 - DNA, 20 bp, Artificial
  CRISPR gRNA sequence
gcttagagagaattgtttca

SEQ ID NO: 696489 - DNA, 20 bp, Artificial
  CRISPR gRNA sequence
agagagaattgtttcaaaac

SEQ ID NO: 696490 - DNA, 20 bp, Artificial
  CRISPR gRNA sequence
gagagaattgtttcaaaaca

SEQ ID NO: 696491 - DNA, 20 bp, Artificial
  CRISPR gRNA sequence
tttcaaaacatcagtaatgt

SEQ ID NO: 696492 - DNA, 20 bp, Artificial
  CRISPR gRNA sequence
caaaacatcagtaatgtata

SEQ ID NO: 696493 - DNA, 20 bp, Artificial
  CRISPR gRNA sequence
aaaacatcagtaatgtatac

SEQ ID NO: 696494 - DNA, 20 bp, Artificial
  CRISPR gRNA sequence
gaatgaaggacaacatgcat

SEQ ID NO: 696495 - DNA, 20 bp, Artificial
  CRISPR gRNA sequence
aatgaaggacaacatgcatg

SEQ ID NO: 696496 - DNA, 20 bp, Artificial
  CRISPR gRNA sequence
tcacaaagtgaacactcagg

SEQ ID NO: 696497 - DNA, 20 bp, Artificial
  CRISPR gRNA sequence
cacaaagtgaacactcaggt

SEQ ID NO: 696498 - DNA, 20 bp, Artificial
  CRISPR gRNA sequence
acaaagtgaacactcaggta

SEQ ID NO: 696499 - DNA, 20 bp, Artificial
  CRISPR gRNA sequence
aggtaaatagcagccacatc

SEQ ID NO: 696500 - DNA, 20 bp, Artificial
  CRISPR gRNA sequence
ccagcctccaggaaacacca

SEQ ID NO: 696501 - DNA, 20 bp, Artificial
  CRISPR gRNA sequence
caggaaacaccactgggttc

SEQ ID NO: 696502 - DNA, 20 bp, Artificial
  CRISPR gRNA sequence
ggttctacttggtcataaat

SEQ ID NO: 696503 - DNA, 20 bp, Artificial
  CRISPR gRNA sequence
tacttggtcataaatcaccc

SEQ ID NO: 696504 - DNA, 20 bp, Artificial
  CRISPR gRNA sequence
cttggtcataaatcaccctc

SEQ ID NO: 696505 - DNA, 20 bp, Artificial
  CRISPR gRNA sequence
ggtcataaatcaccctcccc

SEQ ID NO: 696506 - DNA, 20 bp, Artificial
  CRISPR gRNA sequence
gtcataaatcaccctcccca

SEQ ID NO: 696507 - DNA, 20 bp, Artificial
  CRISPR gRNA sequence
cccaaccctagagcagacac

SEQ ID NO: 696508 - DNA, 20 bp, Artificial
  CRISPR gRNA sequence
gagcagacactttcttgatt

SEQ ID NO: 696509 - DNA, 20 bp, Artificial
  CRISPR gRNA sequence
tcttgatttctaatatgata

SEQ ID NO: 696510 - DNA, 20 bp, Artificial
  CRISPR gRNA sequence
cttgatttctaatatgatag

SEQ ID NO: 696511 - DNA, 20 bp, Artificial
  CRISPR gRNA sequence
ttgatttctaatatgataga

SEQ ID NO: 696512 - DNA, 20 bp, Artificial
  CRISPR gRNA sequence
gatttctaatatgatagatt

SEQ ID NO: 696513 - DNA, 20 bp, Artificial
  CRISPR gRNA sequence
atttctaatatgatagatta

SEQ ID NO: 696514 - DNA, 20 bp, Artificial
  CRISPR gRNA sequence
ctaatatgatagattagttc

SEQ ID NO: 696515 - DNA, 20 bp, Artificial
  CRISPR gRNA sequence
taatatgatagattagttct

SEQ ID NO: 696516 - DNA, 20 bp, Artificial
  CRISPR gRNA sequence
atatgatagattagttctgt

SEQ ID NO: 696517 - DNA, 20 bp, Artificial
  CRISPR gRNA sequence
gttctgtcagttctggacac

SEQ ID NO: 696518 - DNA, 20 bp, Artificial
  CRISPR gRNA sequence
tgtcagttctggacacagtc

SEQ ID NO: 696519 - DNA, 20 bp, Artificial
  CRISPR gRNA sequence
tcagttctggacacagtcac

SEQ ID NO: 696520 - DNA, 20 bp, Artificial
  CRISPR gRNA sequence
tggacacagtcactgccatg

SEQ ID NO: 696521 - DNA, 20 bp, Artificial
  CRISPR gRNA sequence
gacacagtcactgccatgtc

SEQ ID NO: 696522 - DNA, 20 bp, Artificial
  CRISPR gRNA sequence
ccatgtcccaggtcttgctg

SEQ ID NO: 696523 - DNA, 20 bp, Artificial
  CRISPR gRNA sequence
gctgtgtgtggtcactattc

SEQ ID NO: 696524 - DNA, 20 bp, Artificial
  CRISPR gRNA sequence
ctgtgtgtggtcactattca

SEQ ID NO: 696525 - DNA, 20 bp, Artificial
  CRISPR gRNA sequence
tgtgtggtcactattcactc

SEQ ID NO: 696526 - DNA, 20 bp, Artificial
  CRISPR gRNA sequence
ttcactcccgcggcagtcag

SEQ ID NO: 696527 - DNA, 20 bp, Artificial
  CRISPR gRNA sequence
actcccgcggcagtcaggtg

SEQ ID NO: 696528 - DNA, 20 bp, Artificial
  CRISPR gRNA sequence
ccgcggcagtcaggtgctca

SEQ ID NO: 696529 - DNA, 20 bp, Artificial
  CRISPR gRNA sequence
agctttataaatagctcaca

SEQ ID NO: 696530 - DNA, 20 bp, Artificial
  CRISPR gRNA sequence
tataaatagctcacacttct

SEQ ID NO: 696531 - DNA, 20 bp, Artificial
  CRISPR gRNA sequence
ataaatagctcacacttctt

SEQ ID NO: 696532 - DNA, 20 bp, Artificial
  CRISPR gRNA sequence
taaatagctcacacttcttg

SEQ ID NO: 696533 - DNA, 20 bp, Artificial
  CRISPR gRNA sequence
acacttcttgtctctccact

SEQ ID NO: 696534 - DNA, 20 bp, Artificial
  CRISPR gRNA sequence
cttgtctctccactgttgat

SEQ ID NO: 696535 - DNA, 20 bp, Artificial
  CRISPR gRNA sequence
ttgtctctccactgttgata

SEQ ID NO: 696536 - DNA, 20 bp, Artificial
  CRISPR gRNA sequence
gtctctccactgttgataga

SEQ ID NO: 696537 - DNA, 20 bp, Artificial
  CRISPR gRNA sequence
tctctccactgttgatagac

SEQ ID NO: 696538 - DNA, 20 bp, Artificial
  CRISPR gRNA sequence
tccactgttgatagacattt

SEQ ID NO: 696539 - DNA, 20 bp, Artificial
  CRISPR gRNA sequence
cactgttgatagacatttgt

SEQ ID NO: 696540 - DNA, 20 bp, Artificial
  CRISPR gRNA sequence
ttgatagacatttgtgttgt

SEQ ID NO: 696541 - DNA, 20 bp, Artificial
  CRISPR gRNA sequence
atagacatttgtgttgtatt

SEQ ID NO: 696542 - DNA, 20 bp, Artificial
  CRISPR gRNA sequence
gtgttgtattcagagtctac

SEQ ID NO: 696543 - DNA, 20 bp, Artificial
  CRISPR gRNA sequence
tgttgtattcagagtctaca

SEQ ID NO: 696544 - DNA, 20 bp, Artificial
  CRISPR gRNA sequence
tattcagagtctacaaatcg

SEQ ID NO: 696545 - DNA, 20 bp, Artificial
  CRISPR gRNA sequence
agagtctacaaatcgtgctg

SEQ ID NO: 696546 - DNA, 20 bp, Artificial
  CRISPR gRNA sequence
caaatcgtgctgctataaat

SEQ ID NO: 696547 - DNA, 20 bp, Artificial
  CRISPR gRNA sequence
ctataaataatattttcata

SEQ ID NO: 696548 - DNA, 20 bp, Artificial
  CRISPR gRNA sequence
taaataatattttcatatat

SEQ ID NO: 696549 - DNA, 20 bp, Artificial
  CRISPR gRNA sequence
tcatatattttggcacacaa

SEQ ID NO: 696550 - DNA, 20 bp, Artificial
  CRISPR gRNA sequence
catatattttggcacacaaa

SEQ ID NO: 696551 - DNA, 20 bp, Artificial
  CRISPR gRNA sequence
atatattttggcacacaaat

SEQ ID NO: 696552 - DNA, 20 bp, Artificial
  CRISPR gRNA sequence
tggcacacaaatgcatgcat

SEQ ID NO: 696553 - DNA, 20 bp, Artificial
  CRISPR gRNA sequence
ggcacacaaatgcatgcatt

SEQ ID NO: 696554 - DNA, 20 bp, Artificial
  CRISPR gRNA sequence
gcacacaaatgcatgcattt

SEQ ID NO: 696555 - DNA, 20 bp, Artificial
  CRISPR gRNA sequence
ctattggtatataacaaaaa

SEQ ID NO: 696556 - DNA, 20 bp, Artificial
  CRISPR gRNA sequence
tattggtatataacaaaaag

SEQ ID NO: 696557 - DNA, 20 bp, Artificial
  CRISPR gRNA sequence
ttggtatataacaaaaagtg

SEQ ID NO: 696558 - DNA, 20 bp, Artificial
  CRISPR gRNA sequence
gtatataacaaaaagtggaa

SEQ ID NO: 696559 - DNA, 20 bp, Artificial
  CRISPR gRNA sequence
ctgggtcataggtgattaga

SEQ ID NO: 696560 - DNA, 20 bp, Artificial
  CRISPR gRNA sequence
ggtcataggtgattagaaac

SEQ ID NO: 696561 - DNA, 20 bp, Artificial
  CRISPR gRNA sequence
gaaacttggtttagtctctc

SEQ ID NO: 696562 - DNA, 20 bp, Artificial
  CRISPR gRNA sequence
ggtttagtctctcaaaaaac

SEQ ID NO: 696563 - DNA, 20 bp, Artificial
  CRISPR gRNA sequence
gtttagtctctcaaaaaaca

SEQ ID NO: 696564 - DNA, 20 bp, Artificial
  CRISPR gRNA sequence
agtctctcaaaaaacaagtt

SEQ ID NO: 696565 - DNA, 20 bp, Artificial
  CRISPR gRNA sequence
gtctctcaaaaaacaagttt

SEQ ID NO: 696566 - DNA, 20 bp, Artificial
  CRISPR gRNA sequence
tcaaaaaacaagtttctact

SEQ ID NO: 696567 - DNA, 20 bp, Artificial
  CRISPR gRNA sequence
aaaaaacaagtttctactga

SEQ ID NO: 696568 - DNA, 20 bp, Artificial
  CRISPR gRNA sequence
ctactgaatagataactggt

SEQ ID NO: 696569 - DNA, 20 bp, Artificial
  CRISPR gRNA sequence
tactgaatagataactggtg

SEQ ID NO: 696570 - DNA, 20 bp, Artificial
  CRISPR gRNA sequence
ctgaatagataactggtgga

SEQ ID NO: 696571 - DNA, 20 bp, Artificial
  CRISPR gRNA sequence
aatagataactggtggaaga

SEQ ID NO: 696572 - DNA, 20 bp, Artificial
  CRISPR gRNA sequence
gtggaagagggtaaatcttt

SEQ ID NO: 696573 - DNA, 20 bp, Artificial
  CRISPR gRNA sequence
ttattttagaaattatgcag

SEQ ID NO: 696574 - DNA, 20 bp, Artificial
  CRISPR gRNA sequence
tattttagaaattatgcagc

SEQ ID NO: 696575 - DNA, 20 bp, Artificial
  CRISPR gRNA sequence
attttagaaattatgcagct

SEQ ID NO: 696576 - DNA, 20 bp, Artificial
  CRISPR gRNA sequence
ttttagaaattatgcagcta

SEQ ID NO: 696577 - DNA, 20 bp, Artificial
  CRISPR gRNA sequence
tagaaattatgcagctagca

SEQ ID NO: 696578 - DNA, 20 bp, Artificial
  CRISPR gRNA sequence
agaaattatgcagctagcat

SEQ ID NO: 696579 - DNA, 20 bp, Artificial
  CRISPR gRNA sequence
gaaattatgcagctagcata

SEQ ID NO: 696580 - DNA, 20 bp, Artificial
  CRISPR gRNA sequence
tgcagctagcatatgaaaag

SEQ ID NO: 696581 - DNA, 20 bp, Artificial
  CRISPR gRNA sequence
gcatatgaaaagaaatgaaa

SEQ ID NO: 696582 - DNA, 20 bp, Artificial
  CRISPR gRNA sequence
agacttttgcaatttgtaat

SEQ ID NO: 696583 - DNA, 20 bp, Artificial
  CRISPR gRNA sequence
ttgcaatttgtaatgaatta

SEQ ID NO: 696584 - DNA, 20 bp, Artificial
  CRISPR gRNA sequence
tgcaatttgtaatgaattaa

SEQ ID NO: 696585 - DNA, 20 bp, Artificial
  CRISPR gRNA sequence
gcaatttgtaatgaattaac

SEQ ID NO: 696586 - DNA, 20 bp, Artificial
  CRISPR gRNA sequence
caatttgtaatgaattaaca

SEQ ID NO: 696587 - DNA, 20 bp, Artificial
  CRISPR gRNA sequence
gtaatgaattaacagattta

SEQ ID NO: 696588 - DNA, 20 bp, Artificial
  CRISPR gRNA sequence
taatgaattaacagatttag

SEQ ID NO: 696589 - DNA, 20 bp, Artificial
  CRISPR gRNA sequence
acagatttagccactgaaca

SEQ ID NO: 696590 - DNA, 20 bp, Artificial
  CRISPR gRNA sequence
agccactgaacagcaatggc

SEQ ID NO: 696591 - DNA, 20 bp, Artificial
  CRISPR gRNA sequence
gccactgaacagcaatggca

SEQ ID NO: 696592 - DNA, 20 bp, Artificial
  CRISPR gRNA sequence
aacagcaatggcaattaaca

SEQ ID NO: 696593 - DNA, 20 bp, Artificial
  CRISPR gRNA sequence
acatcgcaaaaaagaaataa

SEQ ID NO: 696594 - DNA, 20 bp, Artificial
  CRISPR gRNA sequence
gtattgaattcttcctcttg

SEQ ID NO: 696595 - DNA, 20 bp, Artificial
  CRISPR gRNA sequence
aattcttcctcttgatgaaa

SEQ ID NO: 696596 - DNA, 20 bp, Artificial
  CRISPR gRNA sequence
ttcctcttgatgaaaaacat

SEQ ID NO: 696597 - DNA, 20 bp, Artificial
  CRISPR gRNA sequence
cctcttgatgaaaaacatga

SEQ ID NO: 696598 - DNA, 20 bp, Artificial
  CRISPR gRNA sequence
ctcttgatgaaaaacatgat

SEQ ID NO: 696599 - DNA, 20 bp, Artificial
  CRISPR gRNA sequence
ttgatgaaaaacatgatata

SEQ ID NO: 696600 - DNA, 20 bp, Artificial
  CRISPR gRNA sequence
gatgaaaaacatgatatagt

SEQ ID NO: 696601 - DNA, 20 bp, Artificial
  CRISPR gRNA sequence
atgaaaaacatgatatagta

SEQ ID NO: 696602 - DNA, 20 bp, Artificial
  CRISPR gRNA sequence
atggcaaaaaaaaaaaaaaa

SEQ ID NO: 696603 - DNA, 20 bp, Artificial
  CRISPR gRNA sequence
aatagacgcaaacctctata

SEQ ID NO: 696604 - DNA, 20 bp, Artificial
  CRISPR gRNA sequence
tataacaaactaccaattta

SEQ ID NO: 696605 - DNA, 20 bp, Artificial
  CRISPR gRNA sequence
taacaaactaccaatttaca

SEQ ID NO: 696606 - DNA, 20 bp, Artificial
  CRISPR gRNA sequence
ccaatttacagaaaatacag

SEQ ID NO: 696607 - DNA, 20 bp, Artificial
  CRISPR gRNA sequence
acagaaaatacaggtcatag

SEQ ID NO: 696608 - DNA, 20 bp, Artificial
  CRISPR gRNA sequence
cagaaaatacaggtcataga

SEQ ID NO: 696609 - DNA, 20 bp, Artificial
  CRISPR gRNA sequence
aaccacaccttggggtgcaa

SEQ ID NO: 696610 - DNA, 20 bp, Artificial
  CRISPR gRNA sequence
ggggtgcaatctgcaaaatg

SEQ ID NO: 696611 - DNA, 20 bp, Artificial
  CRISPR gRNA sequence
gggtgcaatctgcaaaatgc

SEQ ID NO: 696612 - DNA, 20 bp, Artificial
  CRISPR gRNA sequence
caaaatgcaaaggacaggaa

SEQ ID NO: 696613 - DNA, 20 bp, Artificial
  CRISPR gRNA sequence
ccagacaatataaatttcaa

SEQ ID NO: 696614 - DNA, 20 bp, Artificial
  CRISPR gRNA sequence
caagcaggaatctatggaat

SEQ ID NO: 696615 - DNA, 20 bp, Artificial
  CRISPR gRNA sequence
aagcaggaatctatggaata

SEQ ID NO: 696616 - DNA, 20 bp, Artificial
  CRISPR gRNA sequence
tggaataaatgaggataaaa

SEQ ID NO: 696617 - DNA, 20 bp, Artificial
  CRISPR gRNA sequence
ttaaaggtaaaactaaacta

SEQ ID NO: 696618 - DNA, 20 bp, Artificial
  CRISPR gRNA sequence
aaaggtaaaactaaactata

SEQ ID NO: 696619 - DNA, 20 bp, Artificial
  CRISPR gRNA sequence
aaggtaaaactaaactataa

SEQ ID NO: 696620 - DNA, 20 bp, Artificial
  CRISPR gRNA sequence
aactataattttagatgata

SEQ ID NO: 696621 - DNA, 20 bp, Artificial
  CRISPR gRNA sequence
taattttagatgataaaaat

SEQ ID NO: 696622 - DNA, 20 bp, Artificial
  CRISPR gRNA sequence
tagatgataaaaatataaaa

SEQ ID NO: 696623 - DNA, 20 bp, Artificial
  CRISPR gRNA sequence
agatgataaaaatataaaat

SEQ ID NO: 696624 - DNA, 20 bp, Artificial
  CRISPR gRNA sequence
gatgataaaaatataaaatt

SEQ ID NO: 696625 - DNA, 20 bp, Artificial
  CRISPR gRNA sequence
tacaaagaagtgatggccat

SEQ ID NO: 696626 - DNA, 20 bp, Artificial
  CRISPR gRNA sequence
ttatttgaagaagagaagag

SEQ ID NO: 696627 - DNA, 20 bp, Artificial
  CRISPR gRNA sequence
tatttgaagaagagaagagt

SEQ ID NO: 696628 - DNA, 20 bp, Artificial
  CRISPR gRNA sequence
atttgaagaagagaagagtt

SEQ ID NO: 696629 - DNA, 20 bp, Artificial
  CRISPR gRNA sequence
tttgaagaagagaagagttt

SEQ ID NO: 696630 - DNA, 20 bp, Artificial
  CRISPR gRNA sequence
gaagaagagaagagtttatc

SEQ ID NO: 696631 - DNA, 20 bp, Artificial
  CRISPR gRNA sequence
aagaagagaagagtttatca

SEQ ID NO: 696632 - DNA, 20 bp, Artificial
  CRISPR gRNA sequence
atcattgagctggggcagtt

SEQ ID NO: 696633 - DNA, 20 bp, Artificial
  CRISPR gRNA sequence
tcattgagctggggcagttg

SEQ ID NO: 696634 - DNA, 20 bp, Artificial
  CRISPR gRNA sequence
agctggggcagttgatgggg

SEQ ID NO: 696635 - DNA, 20 bp, Artificial
  CRISPR gRNA sequence
gggcagttgatggggcttct

SEQ ID NO: 696636 - DNA, 20 bp, Artificial
  CRISPR gRNA sequence
atggggcttctaggtcagct

SEQ ID NO: 696637 - DNA, 20 bp, Artificial
  CRISPR gRNA sequence
ctaggtcagctgccaaactt

SEQ ID NO: 696638 - DNA, 20 bp, Artificial
  CRISPR gRNA sequence
taggtcagctgccaaacttc

SEQ ID NO: 696639 - DNA, 20 bp, Artificial
  CRISPR gRNA sequence
ggtcagctgccaaacttctc

SEQ ID NO: 696640 - DNA, 20 bp, Artificial
  CRISPR gRNA sequence
ccaaacttctccctctctct

SEQ ID NO: 696641 - DNA, 20 bp, Artificial
  CRISPR gRNA sequence
ctccctctctctgatggtta

SEQ ID NO: 696642 - DNA, 20 bp, Artificial
  CRISPR gRNA sequence
tccctctctctgatggttaa

SEQ ID NO: 696643 - DNA, 20 bp, Artificial
  CRISPR gRNA sequence
cctctctctgatggttaaag

SEQ ID NO: 696644 - DNA, 20 bp, Artificial
  CRISPR gRNA sequence
tctctgatggttaaagggtg

SEQ ID NO: 696645 - DNA, 20 bp, Artificial
  CRISPR gRNA sequence
tctgatggttaaagggtgtt

SEQ ID NO: 696646 - DNA, 20 bp, Artificial
  CRISPR gRNA sequence
tgatggttaaagggtgttta

SEQ ID NO: 696647 - DNA, 20 bp, Artificial
  CRISPR gRNA sequence
atggttaaagggtgtttact

SEQ ID NO: 696648 - DNA, 20 bp, Artificial
  CRISPR gRNA sequence
aagggtgtttacttttgatt

SEQ ID NO: 696649 - DNA, 20 bp, Artificial
  CRISPR gRNA sequence
acttttgattaaagggcact

SEQ ID NO: 696650 - DNA, 20 bp, Artificial
  CRISPR gRNA sequence
cttttgattaaagggcacta

SEQ ID NO: 696651 - DNA, 20 bp, Artificial
  CRISPR gRNA sequence
ttgattaaagggcactattt

SEQ ID NO: 696652 - DNA, 20 bp, Artificial
  CRISPR gRNA sequence
tgattaaagggcactatttt

SEQ ID NO: 696653 - DNA, 20 bp, Artificial
  CRISPR gRNA sequence
gattaaagggcactattttt

SEQ ID NO: 696654 - DNA, 20 bp, Artificial
  CRISPR gRNA sequence
attaaagggcactattttta

SEQ ID NO: 696655 - DNA, 20 bp, Artificial
  CRISPR gRNA sequence
aagggcactatttttagatc

SEQ ID NO: 696656 - DNA, 20 bp, Artificial
  CRISPR gRNA sequence
tttttagatcttttatcttt

SEQ ID NO: 696657 - DNA, 20 bp, Artificial
  CRISPR gRNA sequence
ttagatcttttatcttttat

SEQ ID NO: 696658 - DNA, 20 bp, Artificial
  CRISPR gRNA sequence
tagatcttttatcttttatg

SEQ ID NO: 696659 - DNA, 20 bp, Artificial
  CRISPR gRNA sequence
agatcttttatcttttatgg

SEQ ID NO: 696660 - DNA, 20 bp, Artificial
  CRISPR gRNA sequence
gatcttttatcttttatggt

SEQ ID NO: 696661 - DNA, 20 bp, Artificial
  CRISPR gRNA sequence
ttatcttttatggtacccgt

SEQ ID NO: 696662 - DNA, 20 bp, Artificial
  CRISPR gRNA sequence
tatcttttatggtacccgtg

SEQ ID NO: 696663 - DNA, 20 bp, Artificial
  CRISPR gRNA sequence
atcttttatggtacccgtgg

SEQ ID NO: 696664 - DNA, 20 bp, Artificial
  CRISPR gRNA sequence
tcttttatggtacccgtggg

SEQ ID NO: 696665 - DNA, 20 bp, Artificial
  CRISPR gRNA sequence
ttatggtacccgtggggttt

SEQ ID NO: 696666 - DNA, 20 bp, Artificial
  CRISPR gRNA sequence
tatggtacccgtggggtttt

SEQ ID NO: 696667 - DNA, 20 bp, Artificial
  CRISPR gRNA sequence
atggtacccgtggggttttt

SEQ ID NO: 696668 - DNA, 20 bp, Artificial
  CRISPR gRNA sequence
tggtacccgtggggtttttt

SEQ ID NO: 696669 - DNA, 20 bp, Artificial
  CRISPR gRNA sequence
tttatgacaaaaacactaat

SEQ ID NO: 696670 - DNA, 20 bp, Artificial
  CRISPR gRNA sequence
ttatgacaaaaacactaata

SEQ ID NO: 696671 - DNA, 20 bp, Artificial
  CRISPR gRNA sequence
tatgacaaaaacactaataa

SEQ ID NO: 696672 - DNA, 20 bp, Artificial
  CRISPR gRNA sequence
atgacaaaaacactaataaa

SEQ ID NO: 696673 - DNA, 20 bp, Artificial
  CRISPR gRNA sequence
tgacaaaaacactaataaag

SEQ ID NO: 696674 - DNA, 20 bp, Artificial
  CRISPR gRNA sequence
ataaagaataaaatagtatg

SEQ ID NO: 696675 - DNA, 20 bp, Artificial
  CRISPR gRNA sequence
ttgttctgcaccaagcctcc

SEQ ID NO: 696676 - DNA, 20 bp, Artificial
  CRISPR gRNA sequence
gttctgcaccaagcctcctt

SEQ ID NO: 696677 - DNA, 20 bp, Artificial
  CRISPR gRNA sequence
ttctgcaccaagcctccttc

SEQ ID NO: 696678 - DNA, 20 bp, Artificial
  CRISPR gRNA sequence
tgcaccaagcctccttccca

SEQ ID NO: 696679 - DNA, 20 bp, Artificial
  CRISPR gRNA sequence
caccaagcctccttcccacc

SEQ ID NO: 696680 - DNA, 20 bp, Artificial
  CRISPR gRNA sequence
cttcccaccctccgctccag

SEQ ID NO: 696681 - DNA, 20 bp, Artificial
  CRISPR gRNA sequence
cccaccctccgctccagaca

SEQ ID NO: 696682 - DNA, 20 bp, Artificial
  CRISPR gRNA sequence
ccaccctccgctccagacac

SEQ ID NO: 696683 - DNA, 20 bp, Artificial
  CRISPR gRNA sequence
cgctccagacactgagcacc

SEQ ID NO: 696684 - DNA, 20 bp, Artificial
  CRISPR gRNA sequence
cagacactgagcacccagaa

SEQ ID NO: 696685 - DNA, 20 bp, Artificial
  CRISPR gRNA sequence
agcacccagaactactggca

SEQ ID NO: 696686 - DNA, 20 bp, Artificial
  CRISPR gRNA sequence
ctggcaaccccaggatactt

SEQ ID NO: 696687 - DNA, 20 bp, Artificial
  CRISPR gRNA sequence
gcaaccccaggatacttggc

SEQ ID NO: 696688 - DNA, 20 bp, Artificial
  CRISPR gRNA sequence
ggcagggctaccttacatct

SEQ ID NO: 696689 - DNA, 20 bp, Artificial
  CRISPR gRNA sequence
gcagggctaccttacatctg

SEQ ID NO: 696690 - DNA, 20 bp, Artificial
  CRISPR gRNA sequence
ccttacatctgggtgtgtgt

SEQ ID NO: 696691 - DNA, 20 bp, Artificial
  CRISPR gRNA sequence
acatctgggtgtgtgtccag

SEQ ID NO: 696692 - DNA, 20 bp, Artificial
  CRISPR gRNA sequence
catctgggtgtgtgtccagc

SEQ ID NO: 696693 - DNA, 20 bp, Artificial
  CRISPR gRNA sequence
ggtgtgtgtccagctcacat

SEQ ID NO: 696694 - DNA, 20 bp, Artificial
  CRISPR gRNA sequence
acattgccagaggcaatgtc

SEQ ID NO: 696695 - DNA, 20 bp, Artificial
  CRISPR gRNA sequence
ccagaggcaatgtccagggt

SEQ ID NO: 696696 - DNA, 20 bp, Artificial
  CRISPR gRNA sequence
ttctttgaggcctagatgaa

SEQ ID NO: 696697 - DNA, 20 bp, Artificial
  CRISPR gRNA sequence
tttgaggcctagatgaacct

SEQ ID NO: 696698 - DNA, 20 bp, Artificial
  CRISPR gRNA sequence
tgaggcctagatgaacctga

SEQ ID NO: 696699 - DNA, 20 bp, Artificial
  CRISPR gRNA sequence
gaggcctagatgaacctgac

SEQ ID NO: 696700 - DNA, 20 bp, Artificial
  CRISPR gRNA sequence
aggcctagatgaacctgaca

SEQ ID NO: 696701 - DNA, 20 bp, Artificial
  CRISPR gRNA sequence
gatgaacctgacaggacaca

SEQ ID NO: 696702 - DNA, 20 bp, Artificial
  CRISPR gRNA sequence
acaggacacagctgagggaa

SEQ ID NO: 696703 - DNA, 20 bp, Artificial
  CRISPR gRNA sequence
agggaaaaacctggccccac

SEQ ID NO: 696704 - DNA, 20 bp, Artificial
  CRISPR gRNA sequence
gccccactctggaggctctg

SEQ ID NO: 696705 - DNA, 20 bp, Artificial
  CRISPR gRNA sequence
tggaggctctggccatcggt

SEQ ID NO: 696706 - DNA, 20 bp, Artificial
  CRISPR gRNA sequence
gaggctctggccatcggtgt

SEQ ID NO: 696707 - DNA, 20 bp, Artificial
  CRISPR gRNA sequence
tggccatcggtgtagagggg

SEQ ID NO: 696708 - DNA, 20 bp, Artificial
  CRISPR gRNA sequence
gccatcggtgtagaggggac

SEQ ID NO: 696709 - DNA, 20 bp, Artificial
  CRISPR gRNA sequence
acctctccacaggtgcagtt

SEQ ID NO: 696710 - DNA, 20 bp, Artificial
  CRISPR gRNA sequence
tccacaggtgcagttacagt

SEQ ID NO: 696711 - DNA, 20 bp, Artificial
  CRISPR gRNA sequence
cacaggtgcagttacagtca

SEQ ID NO: 696712 - DNA, 20 bp, Artificial
  CRISPR gRNA sequence
cagtcagagcctcttctctg

SEQ ID NO: 696713 - DNA, 20 bp, Artificial
  CRISPR gRNA sequence
ttctctgcatgggagtgagg

SEQ ID NO: 696714 - DNA, 20 bp, Artificial
  CRISPR gRNA sequence
ctctgcatgggagtgaggct

SEQ ID NO: 696715 - DNA, 20 bp, Artificial
  CRISPR gRNA sequence
tctgcatgggagtgaggctt

SEQ ID NO: 696716 - DNA, 20 bp, Artificial
  CRISPR gRNA sequence
tgcatgggagtgaggcttgg

SEQ ID NO: 696717 - DNA, 20 bp, Artificial
  CRISPR gRNA sequence
catgggagtgaggcttggtc

SEQ ID NO: 696718 - DNA, 20 bp, Artificial
  CRISPR gRNA sequence
ggtccttcccccgaacacgg

SEQ ID NO: 696719 - DNA, 20 bp, Artificial
  CRISPR gRNA sequence
gtccttcccccgaacacggg

SEQ ID NO: 696720 - DNA, 20 bp, Artificial
  CRISPR gRNA sequence
cccccgaacacggggacagg

SEQ ID NO: 696721 - DNA, 20 bp, Artificial
  CRISPR gRNA sequence
ccccgaacacggggacaggg

SEQ ID NO: 696722 - DNA, 20 bp, Artificial
  CRISPR gRNA sequence
tccagaagtggagatgacac

SEQ ID NO: 696723 - DNA, 20 bp, Artificial
  CRISPR gRNA sequence
cagaagtggagatgacacca

SEQ ID NO: 696724 - DNA, 20 bp, Artificial
  CRISPR gRNA sequence
ctcctctaacatggtccaat

SEQ ID NO: 696725 - DNA, 20 bp, Artificial
  CRISPR gRNA sequence
ctctaacatggtccaatctc

SEQ ID NO: 696726 - DNA, 20 bp, Artificial
  CRISPR gRNA sequence
taacatggtccaatctcgtg

SEQ ID NO: 696727 - DNA, 20 bp, Artificial
  CRISPR gRNA sequence
acatggtccaatctcgtgct

SEQ ID NO: 696728 - DNA, 20 bp, Artificial
  CRISPR gRNA sequence
gtgcttgttctgctttacag

SEQ ID NO: 696729 - DNA, 20 bp, Artificial
  CRISPR gRNA sequence
gttctgctttacaggaaagt

SEQ ID NO: 696730 - DNA, 20 bp, Artificial
  CRISPR gRNA sequence
ttctgctttacaggaaagtt

SEQ ID NO: 696731 - DNA, 20 bp, Artificial
  CRISPR gRNA sequence
tgctttacaggaaagttgac

SEQ ID NO: 696732 - DNA, 20 bp, Artificial
  CRISPR gRNA sequence
ctttacaggaaagttgactc

SEQ ID NO: 696733 - DNA, 20 bp, Artificial
  CRISPR gRNA sequence
tacaggaaagttgactcata

SEQ ID NO: 696734 - DNA, 20 bp, Artificial
  CRISPR gRNA sequence
acaggaaagttgactcatac

SEQ ID NO: 696735 - DNA, 20 bp, Artificial
  CRISPR gRNA sequence
caggaaagttgactcatact

SEQ ID NO: 696736 - DNA, 20 bp, Artificial
  CRISPR gRNA sequence
actcatactggtgtccagtg

SEQ ID NO: 696737 - DNA, 20 bp, Artificial
  CRISPR gRNA sequence
atactggtgtccagtgaaga

SEQ ID NO: 696738 - DNA, 20 bp, Artificial
  CRISPR gRNA sequence
gtgtccagtgaagaaaccca

SEQ ID NO: 696739 - DNA, 20 bp, Artificial
  CRISPR gRNA sequence
gatctcaggtttgtgcttga

SEQ ID NO: 696740 - DNA, 20 bp, Artificial
  CRISPR gRNA sequence
aggtttgtgcttgatctgga

SEQ ID NO: 696741 - DNA, 20 bp, Artificial
  CRISPR gRNA sequence
gtgcttgatctggaaaagga

SEQ ID NO: 696742 - DNA, 20 bp, Artificial
  CRISPR gRNA sequence
tgcttgatctggaaaaggaa

SEQ ID NO: 696743 - DNA, 20 bp, Artificial
  CRISPR gRNA sequence
gatctggaaaaggaagagca

SEQ ID NO: 696744 - DNA, 20 bp, Artificial
  CRISPR gRNA sequence
atctggaaaaggaagagcag

SEQ ID NO: 696745 - DNA, 20 bp, Artificial
  CRISPR gRNA sequence
gaaaaggaagagcagagacc

SEQ ID NO: 696746 - DNA, 20 bp, Artificial
  CRISPR gRNA sequence
ggaggcaccactgcactgct

SEQ ID NO: 696747 - DNA, 20 bp, Artificial
  CRISPR gRNA sequence
cactgctcatgagcccagga

SEQ ID NO: 696748 - DNA, 20 bp, Artificial
  CRISPR gRNA sequence
ctcatgagcccaggaggtgg

SEQ ID NO: 696749 - DNA, 20 bp, Artificial
  CRISPR gRNA sequence
atgagcccaggaggtggatg

SEQ ID NO: 696750 - DNA, 20 bp, Artificial
  CRISPR gRNA sequence
agctcagggtggagagatgt

SEQ ID NO: 696751 - DNA, 20 bp, Artificial
  CRISPR gRNA sequence
agggtggagagatgtcattg

SEQ ID NO: 696752 - DNA, 20 bp, Artificial
  CRISPR gRNA sequence
ctcatcctccaggttccagg

SEQ ID NO: 696753 - DNA, 20 bp, Artificial
  CRISPR gRNA sequence
atcctccaggttccaggtga

SEQ ID NO: 696754 - DNA, 20 bp, Artificial
  CRISPR gRNA sequence
caggttccaggtgaaaaccc

SEQ ID NO: 696755 - DNA, 20 bp, Artificial
  CRISPR gRNA sequence
caggtgaaaacccacctgcc

SEQ ID NO: 696756 - DNA, 20 bp, Artificial
  CRISPR gRNA sequence
cccagcccatctgcttctcc

SEQ ID NO: 696757 - DNA, 20 bp, Artificial
  CRISPR gRNA sequence
cttctccctggttcttcaat

SEQ ID NO: 696758 - DNA, 20 bp, Artificial
  CRISPR gRNA sequence
ctccctggttcttcaattct

SEQ ID NO: 696759 - DNA, 20 bp, Artificial
  CRISPR gRNA sequence
tccctggttcttcaattcta

SEQ ID NO: 696760 - DNA, 20 bp, Artificial
  CRISPR gRNA sequence
cctggttcttcaattctagg

SEQ ID NO: 696761 - DNA, 20 bp, Artificial
  CRISPR gRNA sequence
gttcttcaattctagggagg

SEQ ID NO: 696762 - DNA, 20 bp, Artificial
  CRISPR gRNA sequence
ttcaattctagggaggactg

SEQ ID NO: 696763 - DNA, 20 bp, Artificial
  CRISPR gRNA sequence
caattctagggaggactgtc

SEQ ID NO: 696764 - DNA, 20 bp, Artificial
  CRISPR gRNA sequence
aattctagggaggactgtct

SEQ ID NO: 696765 - DNA, 20 bp, Artificial
  CRISPR gRNA sequence
tagggaggactgtcttcttc

SEQ ID NO: 696766 - DNA, 20 bp, Artificial
  CRISPR gRNA sequence
gggaggactgtcttcttctc

SEQ ID NO: 696767 - DNA, 20 bp, Artificial
  CRISPR gRNA sequence
tcttcttctcacctccccgg

SEQ ID NO: 696768 - DNA, 20 bp, Artificial
  CRISPR gRNA sequence
cttctcacctccccggacga

SEQ ID NO: 696769 - DNA, 20 bp, Artificial
  CRISPR gRNA sequence
ttctcacctccccggacgat

SEQ ID NO: 696770 - DNA, 20 bp, Artificial
  CRISPR gRNA sequence
ctcacctccccggacgatgc

SEQ ID NO: 696771 - DNA, 20 bp, Artificial
  CRISPR gRNA sequence
tcacctccccggacgatgct

SEQ ID NO: 696772 - DNA, 20 bp, Artificial
  CRISPR gRNA sequence
acctccccggacgatgcttc

SEQ ID NO: 696773 - DNA, 20 bp, Artificial
  CRISPR gRNA sequence
cccggacgatgcttcttgac

SEQ ID NO: 696774 - DNA, 20 bp, Artificial
  CRISPR gRNA sequence
cttgacacaggaaagaggat

SEQ ID NO: 696775 - DNA, 20 bp, Artificial
  CRISPR gRNA sequence
ttgacacaggaaagaggatg

SEQ ID NO: 696776 - DNA, 20 bp, Artificial
  CRISPR gRNA sequence
gacacaggaaagaggatgtg

SEQ ID NO: 696777 - DNA, 20 bp, Artificial
  CRISPR gRNA sequence
acacaggaaagaggatgtgc

SEQ ID NO: 696778 - DNA, 20 bp, Artificial
  CRISPR gRNA sequence
ctagggtcatcatgtcctgg

SEQ ID NO: 696779 - DNA, 20 bp, Artificial
  CRISPR gRNA sequence
gggtcatcatgtcctggttt

SEQ ID NO: 696780 - DNA, 20 bp, Artificial
  CRISPR gRNA sequence
gtttattgtgttgtcagtag

SEQ ID NO: 696781 - DNA, 20 bp, Artificial
  CRISPR gRNA sequence
attgtgttgtcagtagaatg

SEQ ID NO: 696782 - DNA, 20 bp, Artificial
  CRISPR gRNA sequence
ttgtgttgtcagtagaatga

SEQ ID NO: 696783 - DNA, 20 bp, Artificial
  CRISPR gRNA sequence
tgttgtcagtagaatgaaat

SEQ ID NO: 696784 - DNA, 20 bp, Artificial
  CRISPR gRNA sequence
tcagtagaatgaaatcaaaa

SEQ ID NO: 696785 - DNA, 20 bp, Artificial
  CRISPR gRNA sequence
cataaataataaaataaccc

SEQ ID NO: 696786 - DNA, 20 bp, Artificial
  CRISPR gRNA sequence
acaatttactcacaccattg

SEQ ID NO: 696787 - DNA, 20 bp, Artificial
  CRISPR gRNA sequence
caatttactcacaccattga

SEQ ID NO: 696788 - DNA, 20 bp, Artificial
  CRISPR gRNA sequence
actcacaccattgaggtttc

SEQ ID NO: 696789 - DNA, 20 bp, Artificial
  CRISPR gRNA sequence
ctcacaccattgaggtttcc

SEQ ID NO: 696790 - DNA, 20 bp, Artificial
  CRISPR gRNA sequence
acaccattgaggtttcctcc

SEQ ID NO: 696791 - DNA, 20 bp, Artificial
  CRISPR gRNA sequence
aggtttcctccaggtgtgag

SEQ ID NO: 696792 - DNA, 20 bp, Artificial
  CRISPR gRNA sequence
cctccaggtgtgagcacagc

SEQ ID NO: 696793 - DNA, 20 bp, Artificial
  CRISPR gRNA sequence
ctccaggtgtgagcacagct

SEQ ID NO: 696794 - DNA, 20 bp, Artificial
  CRISPR gRNA sequence
caggtgtgagcacagctgca

SEQ ID NO: 696795 - DNA, 20 bp, Artificial
  CRISPR gRNA sequence
cagacacaccttgtcgcttc

SEQ ID NO: 696796 - DNA, 20 bp, Artificial
  CRISPR gRNA sequence
gtcgcttcagtcaggacaca

SEQ ID NO: 696797 - DNA, 20 bp, Artificial
  CRISPR gRNA sequence
tcgcttcagtcaggacacag

SEQ ID NO: 696798 - DNA, 20 bp, Artificial
  CRISPR gRNA sequence
cagtcaggacacaggacaga

SEQ ID NO: 696799 - DNA, 20 bp, Artificial
  CRISPR gRNA sequence
agtcaggacacaggacagag

SEQ ID NO: 696800 - DNA, 20 bp, Artificial
  CRISPR gRNA sequence
cagaaagggcccccatggaa

SEQ ID NO: 696801 - DNA, 20 bp, Artificial
  CRISPR gRNA sequence
gcagggaggccagctgcccc

SEQ ID NO: 696802 - DNA, 20 bp, Artificial
  CRISPR gRNA sequence
ccccagggccaccatattta

SEQ ID NO: 696803 - DNA, 20 bp, Artificial
  CRISPR gRNA sequence
agagatgacttcccctttct

SEQ ID NO: 696804 - DNA, 20 bp, Artificial
  CRISPR gRNA sequence
gagatgacttcccctttcta

SEQ ID NO: 696805 - DNA, 20 bp, Artificial
  CRISPR gRNA sequence
cccctttctaggcaggactg

SEQ ID NO: 696806 - DNA, 20 bp, Artificial
  CRISPR gRNA sequence
ccctttctaggcaggactgg

SEQ ID NO: 696807 - DNA, 20 bp, Artificial
  CRISPR gRNA sequence
tctaggcaggactgggattt

SEQ ID NO: 696808 - DNA, 20 bp, Artificial
  CRISPR gRNA sequence
ctaggcaggactgggatttt

SEQ ID NO: 696809 - DNA, 20 bp, Artificial
  CRISPR gRNA sequence
taggcaggactgggatttta

SEQ ID NO: 696810 - DNA, 20 bp, Artificial
  CRISPR gRNA sequence
ggcaggactgggattttaaa

SEQ ID NO: 696811 - DNA, 20 bp, Artificial
  CRISPR gRNA sequence
ggattttaaaattctttttg

SEQ ID NO: 696812 - DNA, 20 bp, Artificial
  CRISPR gRNA sequence
taaaattctttttgtattca

SEQ ID NO: 696813 - DNA, 20 bp, Artificial
  CRISPR gRNA sequence
aaaattctttttgtattcat

SEQ ID NO: 696814 - DNA, 20 bp, Artificial
  CRISPR gRNA sequence
aaattctttttgtattcata

SEQ ID NO: 696815 - DNA, 20 bp, Artificial
  CRISPR gRNA sequence
tttttgtattcatagttgtt

SEQ ID NO: 696816 - DNA, 20 bp, Artificial
  CRISPR gRNA sequence
tttgtattcatagttgttct

SEQ ID NO: 696817 - DNA, 20 bp, Artificial
  CRISPR gRNA sequence
ttgtattcatagttgttctg

SEQ ID NO: 696818 - DNA, 20 bp, Artificial
  CRISPR gRNA sequence
tgtattcatagttgttctga

SEQ ID NO: 696819 - DNA, 20 bp, Artificial
  CRISPR gRNA sequence
gtattcatagttgttctgaa

SEQ ID NO: 696820 - DNA, 20 bp, Artificial
  CRISPR gRNA sequence
tattcatagttgttctgaaa

SEQ ID NO: 696821 - DNA, 20 bp, Artificial
  CRISPR gRNA sequence
atagttgttctgaaattgca

SEQ ID NO: 696822 - DNA, 20 bp, Artificial
  CRISPR gRNA sequence
ttctgaaattgcaggatgat

SEQ ID NO: 696823 - DNA, 20 bp, Artificial
  CRISPR gRNA sequence
tgaaattgcaggatgatgag

SEQ ID NO: 696824 - DNA, 20 bp, Artificial
  CRISPR gRNA sequence
aaattgcaggatgatgagac

SEQ ID NO: 696825 - DNA, 20 bp, Artificial
  CRISPR gRNA sequence
caggatgatgagacccagca

SEQ ID NO: 696826 - DNA, 20 bp, Artificial
  CRISPR gRNA sequence
gtgagttatactgtctcttt

SEQ ID NO: 696827 - DNA, 20 bp, Artificial
  CRISPR gRNA sequence
tactgtctctttcttcccta

SEQ ID NO: 696828 - DNA, 20 bp, Artificial
  CRISPR gRNA sequence
tctctttcttccctattaaa

SEQ ID NO: 696829 - DNA, 20 bp, Artificial
  CRISPR gRNA sequence
tttcttccctattaaattct

SEQ ID NO: 696830 - DNA, 20 bp, Artificial
  CRISPR gRNA sequence
tcttccctattaaattctgt

SEQ ID NO: 696831 - DNA, 20 bp, Artificial
  CRISPR gRNA sequence
cttccctattaaattctgtg

SEQ ID NO: 696832 - DNA, 20 bp, Artificial
  CRISPR gRNA sequence
ttccctattaaattctgtgc

SEQ ID NO: 696833 - DNA, 20 bp, Artificial
  CRISPR gRNA sequence
ccctattaaattctgtgcca

SEQ ID NO: 696834 - DNA, 20 bp, Artificial
  CRISPR gRNA sequence
cctattaaattctgtgccaa

SEQ ID NO: 696835 - DNA, 20 bp, Artificial
  CRISPR gRNA sequence
ttaaattctgtgccaaacag

SEQ ID NO: 696836 - DNA, 20 bp, Artificial
  CRISPR gRNA sequence
aattctgtgccaaacagcac

SEQ ID NO: 696837 - DNA, 20 bp, Artificial
  CRISPR gRNA sequence
tgtgccaaacagcaccttca

SEQ ID NO: 696838 - DNA, 20 bp, Artificial
  CRISPR gRNA sequence
tgccaaacagcaccttcata

SEQ ID NO: 696839 - DNA, 20 bp, Artificial
  CRISPR gRNA sequence
catatatttatctcctcttc

SEQ ID NO: 696840 - DNA, 20 bp, Artificial
  CRISPR gRNA sequence
atatatttatctcctcttcc

SEQ ID NO: 696841 - DNA, 20 bp, Artificial
  CRISPR gRNA sequence
atctcctcttcctggagaga

SEQ ID NO: 696842 - DNA, 20 bp, Artificial
  CRISPR gRNA sequence
tctcctcttcctggagagaa

SEQ ID NO: 696843 - DNA, 20 bp, Artificial
  CRISPR gRNA sequence
ctcttcctggagagaataaa

SEQ ID NO: 696844 - DNA, 20 bp, Artificial
  CRISPR gRNA sequence
ttcctggagagaataaaaac

SEQ ID NO: 696845 - DNA, 20 bp, Artificial
  CRISPR gRNA sequence
cctggagagaataaaaacaa

SEQ ID NO: 696846 - DNA, 20 bp, Artificial
  CRISPR gRNA sequence
ctggagagaataaaaacaat

SEQ ID NO: 696847 - DNA, 20 bp, Artificial
  CRISPR gRNA sequence
gagagaataaaaacaatgga

SEQ ID NO: 696848 - DNA, 20 bp, Artificial
  CRISPR gRNA sequence
aaccatacaaacatacttta

SEQ ID NO: 696849 - DNA, 20 bp, Artificial
  CRISPR gRNA sequence
taaatatgtgctgtcagaag

SEQ ID NO: 696850 - DNA, 20 bp, Artificial
  CRISPR gRNA sequence
aaatatgtgctgtcagaagt

SEQ ID NO: 696851 - DNA, 20 bp, Artificial
  CRISPR gRNA sequence
aatatgtgctgtcagaagta

SEQ ID NO: 696852 - DNA, 20 bp, Artificial
  CRISPR gRNA sequence
tcagaagtagctactaaagg

SEQ ID NO: 696853 - DNA, 20 bp, Artificial
  CRISPR gRNA sequence
ctaaaggattaattccacca

SEQ ID NO: 696854 - DNA, 20 bp, Artificial
  CRISPR gRNA sequence
aaggattaattccaccaaag

SEQ ID NO: 696855 - DNA, 20 bp, Artificial
  CRISPR gRNA sequence
attccaccaaagtgagggaa

SEQ ID NO: 696856 - DNA, 20 bp, Artificial
  CRISPR gRNA sequence
caccaaagtgagggaaggtt

SEQ ID NO: 696857 - DNA, 20 bp, Artificial
  CRISPR gRNA sequence
gaaaagaaaaacattgtata

SEQ ID NO: 696858 - DNA, 20 bp, Artificial
  CRISPR gRNA sequence
aaaagaaaaacattgtatac

SEQ ID NO: 696859 - DNA, 20 bp, Artificial
  CRISPR gRNA sequence
tatacccatattcaaagcag

SEQ ID NO: 696860 - DNA, 20 bp, Artificial
  CRISPR gRNA sequence
aaagcagcattattcacgat

SEQ ID NO: 696861 - DNA, 20 bp, Artificial
  CRISPR gRNA sequence
ttcacgatagccaagacaac

SEQ ID NO: 696862 - DNA, 20 bp, Artificial
  CRISPR gRNA sequence
acgatagccaagacaacaca

SEQ ID NO: 696863 - DNA, 20 bp, Artificial
  CRISPR gRNA sequence
agccttaagaaggaaacctg

SEQ ID NO: 696864 - DNA, 20 bp, Artificial
  CRISPR gRNA sequence
aagaaggaaacctggtcaca

SEQ ID NO: 696865 - DNA, 20 bp, Artificial
  CRISPR gRNA sequence
agaaggaaacctggtcacag

SEQ ID NO: 696866 - DNA, 20 bp, Artificial
  CRISPR gRNA sequence
gtcacaggctgcaacaggga

SEQ ID NO: 696867 - DNA, 20 bp, Artificial
  CRISPR gRNA sequence
caacagggatgaacctgaag

SEQ ID NO: 696868 - DNA, 20 bp, Artificial
  CRISPR gRNA sequence
aaggacactgctaagtaaaa

SEQ ID NO: 696869 - DNA, 20 bp, Artificial
  CRISPR gRNA sequence
ctaagtaaaataagccaatc

SEQ ID NO: 696870 - DNA, 20 bp, Artificial
  CRISPR gRNA sequence
agtaaaataagccaatcaca

SEQ ID NO: 696871 - DNA, 20 bp, Artificial
  CRISPR gRNA sequence
cacatttccatttatatgag

SEQ ID NO: 696872 - DNA, 20 bp, Artificial
  CRISPR gRNA sequence
ccatttatatgaggtgtcta

SEQ ID NO: 696873 - DNA, 20 bp, Artificial
  CRISPR gRNA sequence
catttatatgaggtgtctaa

SEQ ID NO: 696874 - DNA, 20 bp, Artificial
  CRISPR gRNA sequence
atatgaggtgtctaaactga

SEQ ID NO: 696875 - DNA, 20 bp, Artificial
  CRISPR gRNA sequence
tatgaggtgtctaaactgaa

SEQ ID NO: 696876 - DNA, 20 bp, Artificial
  CRISPR gRNA sequence
aactgaaagtagactaatgg

SEQ ID NO: 696877 - DNA, 20 bp, Artificial
  CRISPR gRNA sequence
aaagtagactaatggctgct

SEQ ID NO: 696878 - DNA, 20 bp, Artificial
  CRISPR gRNA sequence
atggctgctaggggctcggt

SEQ ID NO: 696879 - DNA, 20 bp, Artificial
  CRISPR gRNA sequence
ctaggggctcggtgaggggg

SEQ ID NO: 696880 - DNA, 20 bp, Artificial
  CRISPR gRNA sequence
ggggctcggtgagggggatg

SEQ ID NO: 696881 - DNA, 20 bp, Artificial
  CRISPR gRNA sequence
ggtgagggggatggatgaat

SEQ ID NO: 696882 - DNA, 20 bp, Artificial
  CRISPR gRNA sequence
gttcaatgggcatagagttt

SEQ ID NO: 696883 - DNA, 20 bp, Artificial
  CRISPR gRNA sequence
ttcaatgggcatagagtttc

SEQ ID NO: 696884 - DNA, 20 bp, Artificial
  CRISPR gRNA sequence
aatgggcatagagtttcagt

SEQ ID NO: 696885 - DNA, 20 bp, Artificial
  CRISPR gRNA sequence
cagtgttgcaagatgaaaag

SEQ ID NO: 696886 - DNA, 20 bp, Artificial
  CRISPR gRNA sequence
agtgttgcaagatgaaaagt

SEQ ID NO: 696887 - DNA, 20 bp, Artificial
  CRISPR gRNA sequence
caagatgaaaagttctagag

SEQ ID NO: 696888 - DNA, 20 bp, Artificial
  CRISPR gRNA sequence
tagagatctgttgcacaact

SEQ ID NO: 696889 - DNA, 20 bp, Artificial
  CRISPR gRNA sequence
gagatctgttgcacaactat

SEQ ID NO: 696890 - DNA, 20 bp, Artificial
  CRISPR gRNA sequence
ttgcacaactatgtatttac

SEQ ID NO: 696891 - DNA, 20 bp, Artificial
  CRISPR gRNA sequence
cacaactatgtatttacagt

SEQ ID NO: 696892 - DNA, 20 bp, Artificial
  CRISPR gRNA sequence
tgtatttacagttaatactg

SEQ ID NO: 696893 - DNA, 20 bp, Artificial
  CRISPR gRNA sequence
acagttaatactgtactact

SEQ ID NO: 696894 - DNA, 20 bp, Artificial
  CRISPR gRNA sequence
cagttaatactgtactactg

SEQ ID NO: 696895 - DNA, 20 bp, Artificial
  CRISPR gRNA sequence
atactgtactactgtatact

SEQ ID NO: 696896 - DNA, 20 bp, Artificial
  CRISPR gRNA sequence
tactactgtatactttaaaa

SEQ ID NO: 696897 - DNA, 20 bp, Artificial
  CRISPR gRNA sequence
ctgtatactttaaaatagtt

SEQ ID NO: 696898 - DNA, 20 bp, Artificial
  CRISPR gRNA sequence
tatactttaaaatagttaag

SEQ ID NO: 696899 - DNA, 20 bp, Artificial
  CRISPR gRNA sequence
taaaatagttaagataccaa

SEQ ID NO: 696900 - DNA, 20 bp, Artificial
  CRISPR gRNA sequence
aaaatagttaagataccaaa

SEQ ID NO: 696901 - DNA, 20 bp, Artificial
  CRISPR gRNA sequence
aaatagttaagataccaaat

SEQ ID NO: 696902 - DNA, 20 bp, Artificial
  CRISPR gRNA sequence
agataccaaattttacataa

SEQ ID NO: 696903 - DNA, 20 bp, Artificial
  CRISPR gRNA sequence
tacataatgtagtttttggc

SEQ ID NO: 696904 - DNA, 20 bp, Artificial
  CRISPR gRNA sequence
acataatgtagtttttggcc

SEQ ID NO: 696905 - DNA, 20 bp, Artificial
  CRISPR gRNA sequence
cataatgtagtttttggccc

SEQ ID NO: 696906 - DNA, 20 bp, Artificial
  CRISPR gRNA sequence
ttggcccaaggaaaagacta

SEQ ID NO: 696907 - DNA, 20 bp, Artificial
  CRISPR gRNA sequence
tggcccaaggaaaagactaa

SEQ ID NO: 696908 - DNA, 20 bp, Artificial
  CRISPR gRNA sequence
ggcccaaggaaaagactaat

SEQ ID NO: 696909 - DNA, 20 bp, Artificial
  CRISPR gRNA sequence
gcccaaggaaaagactaatt

SEQ ID NO: 696910 - DNA, 20 bp, Artificial
  CRISPR gRNA sequence
attagccctgttactaattt

SEQ ID NO: 696911 - DNA, 20 bp, Artificial
  CRISPR gRNA sequence
gccctgttactaatttaggg

SEQ ID NO: 696912 - DNA, 20 bp, Artificial
  CRISPR gRNA sequence
ttactaatttagggaaaaag

SEQ ID NO: 696913 - DNA, 20 bp, Artificial
  CRISPR gRNA sequence
ctaatttagggaaaaagtac

SEQ ID NO: 696914 - DNA, 20 bp, Artificial
  CRISPR gRNA sequence
atttagggaaaaagtacatg

SEQ ID NO: 696915 - DNA, 20 bp, Artificial
  CRISPR gRNA sequence
agggaaaaagtacatgaatt

SEQ ID NO: 696916 - DNA, 20 bp, Artificial
  CRISPR gRNA sequence
gggaaaaagtacatgaattc

SEQ ID NO: 696917 - DNA, 20 bp, Artificial
  CRISPR gRNA sequence
attaaaaatatattagtatg

SEQ ID NO: 696918 - DNA, 20 bp, Artificial
  CRISPR gRNA sequence
aaaatatattagtatgcgct

SEQ ID NO: 696919 - DNA, 20 bp, Artificial
  CRISPR gRNA sequence
gtatgcgcttaccttagata

SEQ ID NO: 696920 - DNA, 20 bp, Artificial
  CRISPR gRNA sequence
accttagatacagaaaacta

SEQ ID NO: 696921 - DNA, 20 bp, Artificial
  CRISPR gRNA sequence
ccttagatacagaaaactat

SEQ ID NO: 696922 - DNA, 20 bp, Artificial
  CRISPR gRNA sequence
agatacagaaaactatgaga

SEQ ID NO: 696923 - DNA, 20 bp, Artificial
  CRISPR gRNA sequence
gatacagaaaactatgagac

SEQ ID NO: 696924 - DNA, 20 bp, Artificial
  CRISPR gRNA sequence
tgagacaaaaagagagatcc

SEQ ID NO: 696925 - DNA, 20 bp, Artificial
  CRISPR gRNA sequence
ctaccccagctatcacccat

SEQ ID NO: 696926 - DNA, 20 bp, Artificial
  CRISPR gRNA sequence
ccccagctatcacccatgaa

SEQ ID NO: 696927 - DNA, 20 bp, Artificial
  CRISPR gRNA sequence
tcacccatgaaccaggaaaa

SEQ ID NO: 696928 - DNA, 20 bp, Artificial
  CRISPR gRNA sequence
ctgaaactagacagaaaggc

SEQ ID NO: 696929 - DNA, 20 bp, Artificial
  CRISPR gRNA sequence
aaactagacagaaaggctca

SEQ ID NO: 696930 - DNA, 20 bp, Artificial
  CRISPR gRNA sequence
gacagaaaggctcacaggcc

SEQ ID NO: 696931 - DNA, 20 bp, Artificial
  CRISPR gRNA sequence
acaggcccagccttgacatg

SEQ ID NO: 696932 - DNA, 20 bp, Artificial
  CRISPR gRNA sequence
gacatgttgaatcagtctgc

SEQ ID NO: 696933 - DNA, 20 bp, Artificial
  CRISPR gRNA sequence
acatgttgaatcagtctgca

SEQ ID NO: 696934 - DNA, 20 bp, Artificial
  CRISPR gRNA sequence
aatcagtctgcattttggct

SEQ ID NO: 696935 - DNA, 20 bp, Artificial
  CRISPR gRNA sequence
cattttggctggaacccagg

SEQ ID NO: 696936 - DNA, 20 bp, Artificial
  CRISPR gRNA sequence
tggctggaacccaggtggct

SEQ ID NO: 696937 - DNA, 20 bp, Artificial
  CRISPR gRNA sequence
ggctggaacccaggtggctc

SEQ ID NO: 696938 - DNA, 20 bp, Artificial
  CRISPR gRNA sequence
gctggaacccaggtggctcc

SEQ ID NO: 696939 - DNA, 20 bp, Artificial
  CRISPR gRNA sequence
gaacccaggtggctccactg

SEQ ID NO: 696940 - DNA, 20 bp, Artificial
  CRISPR gRNA sequence
cactgcatgtaaagcacctt

SEQ ID NO: 696941 - DNA, 20 bp, Artificial
  CRISPR gRNA sequence
catgtaaagcaccttcccag

SEQ ID NO: 696942 - DNA, 20 bp, Artificial
  CRISPR gRNA sequence
cccagatagtgatggaggga

SEQ ID NO: 696943 - DNA, 20 bp, Artificial
  CRISPR gRNA sequence
ccagatagtgatggagggag

SEQ ID NO: 696944 - DNA, 20 bp, Artificial
  CRISPR gRNA sequence
ggacagtgactctgctccac

SEQ ID NO: 696945 - DNA, 20 bp, Artificial
  CRISPR gRNA sequence
tgctccacggggagaagcct

SEQ ID NO: 696946 - DNA, 20 bp, Artificial
  CRISPR gRNA sequence
ctccacggggagaagcctcc

SEQ ID NO: 696947 - DNA, 20 bp, Artificial
  CRISPR gRNA sequence
cacggggagaagcctccaat

SEQ ID NO: 696948 - DNA, 20 bp, Artificial
  CRISPR gRNA sequence
caatccagatgggagcagcc

SEQ ID NO: 696949 - DNA, 20 bp, Artificial
  CRISPR gRNA sequence
ccaagaagataaaattaaca

SEQ ID NO: 696950 - DNA, 20 bp, Artificial
  CRISPR gRNA sequence
caagaagataaaattaacag

SEQ ID NO: 696951 - DNA, 20 bp, Artificial
  CRISPR gRNA sequence
acagaatgtccaaagtgtcc

SEQ ID NO: 696952 - DNA, 20 bp, Artificial
  CRISPR gRNA sequence
gaaagaatcatacaaacaaa

SEQ ID NO: 696953 - DNA, 20 bp, Artificial
  CRISPR gRNA sequence
aaagaatcatacaaacaaaa

SEQ ID NO: 696954 - DNA, 20 bp, Artificial
  CRISPR gRNA sequence
aaattaatgagagttaataa

SEQ ID NO: 696955 - DNA, 20 bp, Artificial
  CRISPR gRNA sequence
aattaatgagagttaataaa

SEQ ID NO: 696956 - DNA, 20 bp, Artificial
  CRISPR gRNA sequence
atgagagttaataaaataaa

SEQ ID NO: 696957 - DNA, 20 bp, Artificial
  CRISPR gRNA sequence
ataaaataaacaaaaacaaa

SEQ ID NO: 696958 - DNA, 20 bp, Artificial
  CRISPR gRNA sequence
actccaagaagaaccaatgt

SEQ ID NO: 696959 - DNA, 20 bp, Artificial
  CRISPR gRNA sequence
caagaagaaccaatgttgta

SEQ ID NO: 696960 - DNA, 20 bp, Artificial
  CRISPR gRNA sequence
tacaggcagtgaaaagtagt

SEQ ID NO: 696961 - DNA, 20 bp, Artificial
  CRISPR gRNA sequence
acatatgagaggattagtca

SEQ ID NO: 696962 - DNA, 20 bp, Artificial
  CRISPR gRNA sequence
gtcatggtaaaagaaacaag

SEQ ID NO: 696963 - DNA, 20 bp, Artificial
  CRISPR gRNA sequence
aactaaacataatcactata

SEQ ID NO: 696964 - DNA, 20 bp, Artificial
  CRISPR gRNA sequence
aacataatcactatataaat

SEQ ID NO: 696965 - DNA, 20 bp, Artificial
  CRISPR gRNA sequence
tataaatatactgggaagag

SEQ ID NO: 696966 - DNA, 20 bp, Artificial
  CRISPR gRNA sequence
ggaagagtgaaagagaacaa

SEQ ID NO: 696967 - DNA, 20 bp, Artificial
  CRISPR gRNA sequence
ttaactgttgcatccaccat

SEQ ID NO: 696968 - DNA, 20 bp, Artificial
  CRISPR gRNA sequence
aactgttgcatccaccattg

SEQ ID NO: 696969 - DNA, 20 bp, Artificial
  CRISPR gRNA sequence
actgttgcatccaccattgc

SEQ ID NO: 696970 - DNA, 20 bp, Artificial
  CRISPR gRNA sequence
ttgcatccaccattgcgctg

SEQ ID NO: 696971 - DNA, 20 bp, Artificial
  CRISPR gRNA sequence
catccaccattgcgctgtgc

SEQ ID NO: 696972 - DNA, 20 bp, Artificial
  CRISPR gRNA sequence
cgctgtgcaacaatgggtgc

SEQ ID NO: 696973 - DNA, 20 bp, Artificial
  CRISPR gRNA sequence
tgcaacaatgggtgcatctg

SEQ ID NO: 696974 - DNA, 20 bp, Artificial
  CRISPR gRNA sequence
aaaaaaatcaagcaataata

SEQ ID NO: 696975 - DNA, 20 bp, Artificial
  CRISPR gRNA sequence
gagatacagaagtaaagtca

SEQ ID NO: 696976 - DNA, 20 bp, Artificial
  CRISPR gRNA sequence
aaaaacttgaaagtggttgg

SEQ ID NO: 696977 - DNA, 20 bp, Artificial
  CRISPR gRNA sequence
gaaagtggttggcccctaga

SEQ ID NO: 696978 - DNA, 20 bp, Artificial
  CRISPR gRNA sequence
aaagtggttggcccctagaa

SEQ ID NO: 696979 - DNA, 20 bp, Artificial
  CRISPR gRNA sequence
gcccctagaaaggcagaaat

SEQ ID NO: 696980 - DNA, 20 bp, Artificial
  CRISPR gRNA sequence
gaaaggcagaaattgagaag

SEQ ID NO: 696981 - DNA, 20 bp, Artificial
  CRISPR gRNA sequence
agaagaggcagagaggactc

SEQ ID NO: 696982 - DNA, 20 bp, Artificial
  CRISPR gRNA sequence
tcatttttctcaagagattc

SEQ ID NO: 696983 - DNA, 20 bp, Artificial
  CRISPR gRNA sequence
atttttctcaagagattctg

SEQ ID NO: 696984 - DNA, 20 bp, Artificial
  CRISPR gRNA sequence
ttctcaagagattctgcaca

SEQ ID NO: 696985 - DNA, 20 bp, Artificial
  CRISPR gRNA sequence
tctcaagagattctgcacaa

SEQ ID NO: 696986 - DNA, 20 bp, Artificial
  CRISPR gRNA sequence
ctcaagagattctgcacaaa

SEQ ID NO: 696987 - DNA, 20 bp, Artificial
  CRISPR gRNA sequence
tcaagagattctgcacaaat

SEQ ID NO: 696988 - DNA, 20 bp, Artificial
  CRISPR gRNA sequence
aagagattctgcacaaatat

SEQ ID NO: 696989 - DNA, 20 bp, Artificial
  CRISPR gRNA sequence
tgcacaaatatttgactctt

SEQ ID NO: 696990 - DNA, 20 bp, Artificial
  CRISPR gRNA sequence
cacaaatatttgactctttc

SEQ ID NO: 696991 - DNA, 20 bp, Artificial
  CRISPR gRNA sequence
gactctttcaattatgcaca

SEQ ID NO: 696992 - DNA, 20 bp, Artificial
  CRISPR gRNA sequence
actctttcaattatgcacaa

SEQ ID NO: 696993 - DNA, 20 bp, Artificial
  CRISPR gRNA sequence
tttcaattatgcacaattat

SEQ ID NO: 696994 - DNA, 20 bp, Artificial
  CRISPR gRNA sequence
tcaattatgcacaattataa

SEQ ID NO: 696995 - DNA, 20 bp, Artificial
  CRISPR gRNA sequence
caattatgcacaattataaa

SEQ ID NO: 696996 - DNA, 20 bp, Artificial
  CRISPR gRNA sequence
aattatgcacaattataaat

SEQ ID NO: 696997 - DNA, 20 bp, Artificial
  CRISPR gRNA sequence
tgcacaattataaatttgat

SEQ ID NO: 696998 - DNA, 20 bp, Artificial
  CRISPR gRNA sequence
taaatttgattaaaataaaa

SEQ ID NO: 696999 - DNA, 20 bp, Artificial
  CRISPR gRNA sequence
gattaaaataaaaacaaaag

SEQ ID NO: 697000 - DNA, 20 bp, Artificial
  CRISPR gRNA sequence
attaaaataaaaacaaaagc

SEQ ID NO: 697001 - DNA, 20 bp, Artificial
  CRISPR gRNA sequence
aaataaaaacaaaagcttca

SEQ ID NO: 697002 - DNA, 20 bp, Artificial
  CRISPR gRNA sequence
cagtgaatatgcaagtttat

SEQ ID NO: 697003 - DNA, 20 bp, Artificial
  CRISPR gRNA sequence
agtgaatatgcaagtttatg

SEQ ID NO: 697004 - DNA, 20 bp, Artificial
  CRISPR gRNA sequence
atgtctaatgacaaccgcat

SEQ ID NO: 697005 - DNA, 20 bp, Artificial
  CRISPR gRNA sequence
tgtctaatgacaaccgcatt

SEQ ID NO: 697006 - DNA, 20 bp, Artificial
  CRISPR gRNA sequence
atgacaaccgcattcaacaa

SEQ ID NO: 697007 - DNA, 20 bp, Artificial
  CRISPR gRNA sequence
aacaatgatatttaagggtt

SEQ ID NO: 697008 - DNA, 20 bp, Artificial
  CRISPR gRNA sequence
aagggttaactaaaatgtga

SEQ ID NO: 697009 - DNA, 20 bp, Artificial
  CRISPR gRNA sequence
agggttaactaaaatgtgaa

SEQ ID NO: 697010 - DNA, 20 bp, Artificial
  CRISPR gRNA sequence
actaaaatgtgaaaatactt

SEQ ID NO: 697011 - DNA, 20 bp, Artificial
  CRISPR gRNA sequence
aaatgtgaaaatacttaaac

SEQ ID NO: 697012 - DNA, 20 bp, Artificial
  CRISPR gRNA sequence
aaacatgaaacaggcatgta

SEQ ID NO: 697013 - DNA, 20 bp, Artificial
  CRISPR gRNA sequence
aacatgaaacaggcatgtat

SEQ ID NO: 697014 - DNA, 20 bp, Artificial
  CRISPR gRNA sequence
atacatgcctgtttcatgtt

SEQ ID NO: 697015 - DNA, 20 bp, Artificial
  CRISPR gRNA sequence
tacatgcctgtttcatgttt

SEQ ID NO: 697016 - DNA, 20 bp, Artificial
  CRISPR gRNA sequence
tttcatgtttaagtattttc

SEQ ID NO: 697017 - DNA, 20 bp, Artificial
  CRISPR gRNA sequence
catgtttaagtattttcaca

SEQ ID NO: 697018 - DNA, 20 bp, Artificial
  CRISPR gRNA sequence
atgtttaagtattttcacat

SEQ ID NO: 697019 - DNA, 20 bp, Artificial
  CRISPR gRNA sequence
aagtattttcacattttagt

SEQ ID NO: 697020 - DNA, 20 bp, Artificial
  CRISPR gRNA sequence
agtattttcacattttagtt

SEQ ID NO: 697021 - DNA, 20 bp, Artificial
  CRISPR gRNA sequence
tcacattttagttaaccctt

SEQ ID NO: 697022 - DNA, 20 bp, Artificial
  CRISPR gRNA sequence
cacattttagttaaccctta

SEQ ID NO: 697023 - DNA, 20 bp, Artificial
  CRISPR gRNA sequence
acattttagttaacccttaa

SEQ ID NO: 697024 - DNA, 20 bp, Artificial
  CRISPR gRNA sequence
tagttaacccttaaatatca

SEQ ID NO: 697025 - DNA, 20 bp, Artificial
  CRISPR gRNA sequence
agttaacccttaaatatcat

SEQ ID NO: 697026 - DNA, 20 bp, Artificial
  CRISPR gRNA sequence
gttaacccttaaatatcatt

SEQ ID NO: 697027 - DNA, 20 bp, Artificial
  CRISPR gRNA sequence
acccttaaatatcattgttg

SEQ ID NO: 697028 - DNA, 20 bp, Artificial
  CRISPR gRNA sequence
aaatatcattgttgaatgcg

SEQ ID NO: 697029 - DNA, 20 bp, Artificial
  CRISPR gRNA sequence
aatatcattgttgaatgcgg

SEQ ID NO: 697030 - DNA, 20 bp, Artificial
  CRISPR gRNA sequence
ttgaatgcggttgtcattag

SEQ ID NO: 697031 - DNA, 20 bp, Artificial
  CRISPR gRNA sequence
aatgcggttgtcattagaca

SEQ ID NO: 697032 - DNA, 20 bp, Artificial
  CRISPR gRNA sequence
tcattagacataaacttgca

SEQ ID NO: 697033 - DNA, 20 bp, Artificial
  CRISPR gRNA sequence
gacataaacttgcatattca

SEQ ID NO: 697034 - DNA, 20 bp, Artificial
  CRISPR gRNA sequence
gcatattcactgaagctttt

SEQ ID NO: 697035 - DNA, 20 bp, Artificial
  CRISPR gRNA sequence
catattcactgaagcttttg

SEQ ID NO: 697036 - DNA, 20 bp, Artificial
  CRISPR gRNA sequence
actgaagcttttgtttttat

SEQ ID NO: 697037 - DNA, 20 bp, Artificial
  CRISPR gRNA sequence
aagcttttgtttttatttta

SEQ ID NO: 697038 - DNA, 20 bp, Artificial
  CRISPR gRNA sequence
ttgtttttattttaatcaaa

SEQ ID NO: 697039 - DNA, 20 bp, Artificial
  CRISPR gRNA sequence
tgtttttattttaatcaaat

SEQ ID NO: 697040 - DNA, 20 bp, Artificial
  CRISPR gRNA sequence
gtttttattttaatcaaatt

SEQ ID NO: 697041 - DNA, 20 bp, Artificial
  CRISPR gRNA sequence
tttttattttaatcaaattt

SEQ ID NO: 697042 - DNA, 20 bp, Artificial
  CRISPR gRNA sequence
ttattttaatcaaatttata

SEQ ID NO: 697043 - DNA, 20 bp, Artificial
  CRISPR gRNA sequence
tattttaatcaaatttataa

SEQ ID NO: 697044 - DNA, 20 bp, Artificial
  CRISPR gRNA sequence
attttaatcaaatttataat

SEQ ID NO: 697045 - DNA, 20 bp, Artificial
  CRISPR gRNA sequence
ttttaatcaaatttataatt

SEQ ID NO: 697046 - DNA, 20 bp, Artificial
  CRISPR gRNA sequence
taatcaaatttataattgtg

SEQ ID NO: 697047 - DNA, 20 bp, Artificial
  CRISPR gRNA sequence
aatcaaatttataattgtgc

SEQ ID NO: 697048 - DNA, 20 bp, Artificial
  CRISPR gRNA sequence
atcaaatttataattgtgca

SEQ ID NO: 697049 - DNA, 20 bp, Artificial
  CRISPR gRNA sequence
ataattgtgcataattgaaa

SEQ ID NO: 697050 - DNA, 20 bp, Artificial
  CRISPR gRNA sequence
taattgtgcataattgaaag

SEQ ID NO: 697051 - DNA, 20 bp, Artificial
  CRISPR gRNA sequence
tgcataattgaaagagtcaa

SEQ ID NO: 697052 - DNA, 20 bp, Artificial
  CRISPR gRNA sequence
aaagagtcaaatatttgtgc

SEQ ID NO: 697053 - DNA, 20 bp, Artificial
  CRISPR gRNA sequence
gtgcagaatctcttgagaaa

SEQ ID NO: 697054 - DNA, 20 bp, Artificial
  CRISPR gRNA sequence
tgcagaatctcttgagaaaa

SEQ ID NO: 697055 - DNA, 20 bp, Artificial
  CRISPR gRNA sequence
ttgagaaaaatgagagtcct

SEQ ID NO: 697056 - DNA, 20 bp, Artificial
  CRISPR gRNA sequence
gagaaaaatgagagtcctct

SEQ ID NO: 697057 - DNA, 20 bp, Artificial
  CRISPR gRNA sequence
agaaaaatgagagtcctctc

SEQ ID NO: 697058 - DNA, 20 bp, Artificial
  CRISPR gRNA sequence
tctgcctcttctcaatttct

SEQ ID NO: 697059 - DNA, 20 bp, Artificial
  CRISPR gRNA sequence
tgcctcttctcaatttctgc

SEQ ID NO: 697060 - DNA, 20 bp, Artificial
  CRISPR gRNA sequence
cctcttctcaatttctgcct

SEQ ID NO: 697061 - DNA, 20 bp, Artificial
  CRISPR gRNA sequence
ttctcaatttctgcctttct

SEQ ID NO: 697062 - DNA, 20 bp, Artificial
  CRISPR gRNA sequence
ctcaatttctgcctttctag

SEQ ID NO: 697063 - DNA, 20 bp, Artificial
  CRISPR gRNA sequence
tcaatttctgcctttctagg

SEQ ID NO: 697064 - DNA, 20 bp, Artificial
  CRISPR gRNA sequence
aatttctgcctttctagggg

SEQ ID NO: 697065 - DNA, 20 bp, Artificial
  CRISPR gRNA sequence
ctgcctttctaggggccaac

SEQ ID NO: 697066 - DNA, 20 bp, Artificial
  CRISPR gRNA sequence
tgcctttctaggggccaacc

SEQ ID NO: 697067 - DNA, 20 bp, Artificial
  CRISPR gRNA sequence
cctttctaggggccaaccac

SEQ ID NO: 697068 - DNA, 20 bp, Artificial
  CRISPR gRNA sequence
tctaggggccaaccactttc

SEQ ID NO: 697069 - DNA, 20 bp, Artificial
  CRISPR gRNA sequence
ctaggggccaaccactttca

SEQ ID NO: 697070 - DNA, 20 bp, Artificial
  CRISPR gRNA sequence
taggggccaaccactttcaa

SEQ ID NO: 697071 - DNA, 20 bp, Artificial
  CRISPR gRNA sequence
ggggccaaccactttcaagt

SEQ ID NO: 697072 - DNA, 20 bp, Artificial
  CRISPR gRNA sequence
tcaagttttttagctgattc

SEQ ID NO: 697073 - DNA, 20 bp, Artificial
  CRISPR gRNA sequence
caagttttttagctgattct

SEQ ID NO: 697074 - DNA, 20 bp, Artificial
  CRISPR gRNA sequence
aagttttttagctgattctt

SEQ ID NO: 697075 - DNA, 20 bp, Artificial
  CRISPR gRNA sequence
tttagctgattcttttgact

SEQ ID NO: 697076 - DNA, 20 bp, Artificial
  CRISPR gRNA sequence
ttagctgattcttttgactt

SEQ ID NO: 697077 - DNA, 20 bp, Artificial
  CRISPR gRNA sequence
tagctgattcttttgacttt

SEQ ID NO: 697078 - DNA, 20 bp, Artificial
  CRISPR gRNA sequence
agctgattcttttgacttta

SEQ ID NO: 697079 - DNA, 20 bp, Artificial
  CRISPR gRNA sequence
gctgattcttttgactttac

SEQ ID NO: 697080 - DNA, 20 bp, Artificial
  CRISPR gRNA sequence
attcttttgactttacttct

SEQ ID NO: 697081 - DNA, 20 bp, Artificial
  CRISPR gRNA sequence
ttttgactttacttctgtat

SEQ ID NO: 697082 - DNA, 20 bp, Artificial
  CRISPR gRNA sequence
ttgactttacttctgtatct

SEQ ID NO: 697083 - DNA, 20 bp, Artificial
  CRISPR gRNA sequence
tgactttacttctgtatctc

SEQ ID NO: 697084 - DNA, 20 bp, Artificial
  CRISPR gRNA sequence
gactttacttctgtatctct

SEQ ID NO: 697085 - DNA, 20 bp, Artificial
  CRISPR gRNA sequence
actttacttctgtatctcta

SEQ ID NO: 697086 - DNA, 20 bp, Artificial
  CRISPR gRNA sequence
tacttctgtatctctaacta

SEQ ID NO: 697087 - DNA, 20 bp, Artificial
  CRISPR gRNA sequence
acttctgtatctctaactac

SEQ ID NO: 697088 - DNA, 20 bp, Artificial
  CRISPR gRNA sequence
cttctgtatctctaactacc

SEQ ID NO: 697089 - DNA, 20 bp, Artificial
  CRISPR gRNA sequence
ctgtatctctaactaccatt

SEQ ID NO: 697090 - DNA, 20 bp, Artificial
  CRISPR gRNA sequence
tgtatctctaactaccattt

SEQ ID NO: 697091 - DNA, 20 bp, Artificial
  CRISPR gRNA sequence
tatctctaactaccatttct

SEQ ID NO: 697092 - DNA, 20 bp, Artificial
  CRISPR gRNA sequence
taactaccatttctttatta

SEQ ID NO: 697093 - DNA, 20 bp, Artificial
  CRISPR gRNA sequence
actaccatttctttattatt

SEQ ID NO: 697094 - DNA, 20 bp, Artificial
  CRISPR gRNA sequence
ccatttctttattattattg

SEQ ID NO: 697095 - DNA, 20 bp, Artificial
  CRISPR gRNA sequence
ctttattattattgcttgat

SEQ ID NO: 697096 - DNA, 20 bp, Artificial
  CRISPR gRNA sequence
tttattattattgcttgatt

SEQ ID NO: 697097 - DNA, 20 bp, Artificial
  CRISPR gRNA sequence
tattattattgcttgatttt

SEQ ID NO: 697098 - DNA, 20 bp, Artificial
  CRISPR gRNA sequence
attattattgcttgattttt

SEQ ID NO: 697099 - DNA, 20 bp, Artificial
  CRISPR gRNA sequence
ttattattgcttgatttttt

SEQ ID NO: 697100 - DNA, 20 bp, Artificial
  CRISPR gRNA sequence
ttattgcttgatttttttca

SEQ ID NO: 697101 - DNA, 20 bp, Artificial
  CRISPR gRNA sequence
ttgcttgatttttttcagat

SEQ ID NO: 697102 - DNA, 20 bp, Artificial
  CRISPR gRNA sequence
cttgatttttttcagatgca

SEQ ID NO: 697103 - DNA, 20 bp, Artificial
  CRISPR gRNA sequence
gatttttttcagatgcaccc

SEQ ID NO: 697104 - DNA, 20 bp, Artificial
  CRISPR gRNA sequence
atttttttcagatgcaccca

SEQ ID NO: 697105 - DNA, 20 bp, Artificial
  CRISPR gRNA sequence
ttttcagatgcacccattgt

SEQ ID NO: 697106 - DNA, 20 bp, Artificial
  CRISPR gRNA sequence
tttcagatgcacccattgtt

SEQ ID NO: 697107 - DNA, 20 bp, Artificial
  CRISPR gRNA sequence
ttcagatgcacccattgttg

SEQ ID NO: 697108 - DNA, 20 bp, Artificial
  CRISPR gRNA sequence
tcagatgcacccattgttgc

SEQ ID NO: 697109 - DNA, 20 bp, Artificial
  CRISPR gRNA sequence
cagatgcacccattgttgca

SEQ ID NO: 697110 - DNA, 20 bp, Artificial
  CRISPR gRNA sequence
agatgcacccattgttgcac

SEQ ID NO: 697111 - DNA, 20 bp, Artificial
  CRISPR gRNA sequence
ttgcacagcgcaatggtgga

SEQ ID NO: 697112 - DNA, 20 bp, Artificial
  CRISPR gRNA sequence
cacagcgcaatggtggatgc

SEQ ID NO: 697113 - DNA, 20 bp, Artificial
  CRISPR gRNA sequence
agagtacttgttctctttca

SEQ ID NO: 697114 - DNA, 20 bp, Artificial
  CRISPR gRNA sequence
gttctctttcactcttccca

SEQ ID NO: 697115 - DNA, 20 bp, Artificial
  CRISPR gRNA sequence
ttctctttcactcttcccag

SEQ ID NO: 697116 - DNA, 20 bp, Artificial
  CRISPR gRNA sequence
tctttcactcttcccagtat

SEQ ID NO: 697117 - DNA, 20 bp, Artificial
  CRISPR gRNA sequence
tttcactcttcccagtatat

SEQ ID NO: 697118 - DNA, 20 bp, Artificial
  CRISPR gRNA sequence
tcactcttcccagtatattt

SEQ ID NO: 697119 - DNA, 20 bp, Artificial
  CRISPR gRNA sequence
cactcttcccagtatattta

SEQ ID NO: 697120 - DNA, 20 bp, Artificial
  CRISPR gRNA sequence
actcttcccagtatatttat

SEQ ID NO: 697121 - DNA, 20 bp, Artificial
  CRISPR gRNA sequence
ttcccagtatatttatatag

SEQ ID NO: 697122 - DNA, 20 bp, Artificial
  CRISPR gRNA sequence
cccagtatatttatatagtg

SEQ ID NO: 697123 - DNA, 20 bp, Artificial
  CRISPR gRNA sequence
ccagtatatttatatagtga

SEQ ID NO: 697124 - DNA, 20 bp, Artificial
  CRISPR gRNA sequence
atatagtgattatgtttagt

SEQ ID NO: 697125 - DNA, 20 bp, Artificial
  CRISPR gRNA sequence
tatagtgattatgtttagtt

SEQ ID NO: 697126 - DNA, 20 bp, Artificial
  CRISPR gRNA sequence
tgtttagttcagccatctct

SEQ ID NO: 697127 - DNA, 20 bp, Artificial
  CRISPR gRNA sequence
agttcagccatctcttgttt

SEQ ID NO: 697128 - DNA, 20 bp, Artificial
  CRISPR gRNA sequence
gttcagccatctcttgtttc

SEQ ID NO: 697129 - DNA, 20 bp, Artificial
  CRISPR gRNA sequence
agccatctcttgtttctttt

SEQ ID NO: 697130 - DNA, 20 bp, Artificial
  CRISPR gRNA sequence
ttgtttcttttaccatgact

SEQ ID NO: 697131 - DNA, 20 bp, Artificial
  CRISPR gRNA sequence
gtttcttttaccatgactaa

SEQ ID NO: 697132 - DNA, 20 bp, Artificial
  CRISPR gRNA sequence
tttcttttaccatgactaat

SEQ ID NO: 697133 - DNA, 20 bp, Artificial
  CRISPR gRNA sequence
cttttaccatgactaatcct

SEQ ID NO: 697134 - DNA, 20 bp, Artificial
  CRISPR gRNA sequence
ttttaccatgactaatcctc

SEQ ID NO: 697135 - DNA, 20 bp, Artificial
  CRISPR gRNA sequence
ttaccatgactaatcctctc

SEQ ID NO: 697136 - DNA, 20 bp, Artificial
  CRISPR gRNA sequence
taccatgactaatcctctca

SEQ ID NO: 697137 - DNA, 20 bp, Artificial
  CRISPR gRNA sequence
accatgactaatcctctcat

SEQ ID NO: 697138 - DNA, 20 bp, Artificial
  CRISPR gRNA sequence
ccatgactaatcctctcata

SEQ ID NO: 697139 - DNA, 20 bp, Artificial
  CRISPR gRNA sequence
atcctctcatatgtcaactg

SEQ ID NO: 697140 - DNA, 20 bp, Artificial
  CRISPR gRNA sequence
tcatatgtcaactggactac

SEQ ID NO: 697141 - DNA, 20 bp, Artificial
  CRISPR gRNA sequence
atatgtcaactggactactt

SEQ ID NO: 697142 - DNA, 20 bp, Artificial
  CRISPR gRNA sequence
gactacttttcactgcctgt

SEQ ID NO: 697143 - DNA, 20 bp, Artificial
  CRISPR gRNA sequence
cttttcactgcctgtacaac

SEQ ID NO: 697144 - DNA, 20 bp, Artificial
  CRISPR gRNA sequence
ttcactgcctgtacaacatt

SEQ ID NO: 697145 - DNA, 20 bp, Artificial
  CRISPR gRNA sequence
tcactgcctgtacaacattg

SEQ ID NO: 697146 - DNA, 20 bp, Artificial
  CRISPR gRNA sequence
cactgcctgtacaacattgg

SEQ ID NO: 697147 - DNA, 20 bp, Artificial
  CRISPR gRNA sequence
actgcctgtacaacattggt

SEQ ID NO: 697148 - DNA, 20 bp, Artificial
  CRISPR gRNA sequence
cctgtacaacattggttctt

SEQ ID NO: 697149 - DNA, 20 bp, Artificial
  CRISPR gRNA sequence
tacaacattggttcttcttg

SEQ ID NO: 697150 - DNA, 20 bp, Artificial
  CRISPR gRNA sequence
gttcttcttggagttaatac

SEQ ID NO: 697151 - DNA, 20 bp, Artificial
  CRISPR gRNA sequence
ttcttggagttaatacttgt

SEQ ID NO: 697152 - DNA, 20 bp, Artificial
  CRISPR gRNA sequence
cttggagttaatacttgtat

SEQ ID NO: 697153 - DNA, 20 bp, Artificial
  CRISPR gRNA sequence
ttggagttaatacttgtatt

SEQ ID NO: 697154 - DNA, 20 bp, Artificial
  CRISPR gRNA sequence
ggagttaatacttgtatttg

SEQ ID NO: 697155 - DNA, 20 bp, Artificial
  CRISPR gRNA sequence
gagttaatacttgtatttgt

SEQ ID NO: 697156 - DNA, 20 bp, Artificial
  CRISPR gRNA sequence
atacttgtatttgtttttgt

SEQ ID NO: 697157 - DNA, 20 bp, Artificial
  CRISPR gRNA sequence
gtatttgtttttgtttattt

SEQ ID NO: 697158 - DNA, 20 bp, Artificial
  CRISPR gRNA sequence
tatttgtttttgtttatttt

SEQ ID NO: 697159 - DNA, 20 bp, Artificial
  CRISPR gRNA sequence
gtttttgtttattttattaa

SEQ ID NO: 697160 - DNA, 20 bp, Artificial
  CRISPR gRNA sequence
tttttgtttattttattaac

SEQ ID NO: 697161 - DNA, 20 bp, Artificial
  CRISPR gRNA sequence
ttgtttattttattaactct

SEQ ID NO: 697162 - DNA, 20 bp, Artificial
  CRISPR gRNA sequence
tgtttattttattaactctc

SEQ ID NO: 697163 - DNA, 20 bp, Artificial
  CRISPR gRNA sequence
gtttattttattaactctca

SEQ ID NO: 697164 - DNA, 20 bp, Artificial
  CRISPR gRNA sequence
tttattttattaactctcat

SEQ ID NO: 697165 - DNA, 20 bp, Artificial
  CRISPR gRNA sequence
attttattaactctcattaa

SEQ ID NO: 697166 - DNA, 20 bp, Artificial
  CRISPR gRNA sequence
ttttattaactctcattaat

SEQ ID NO: 697167 - DNA, 20 bp, Artificial
  CRISPR gRNA sequence
tattaactctcattaattta

SEQ ID NO: 697168 - DNA, 20 bp, Artificial
  CRISPR gRNA sequence
attaactctcattaatttaa

SEQ ID NO: 697169 - DNA, 20 bp, Artificial
  CRISPR gRNA sequence
ttaactctcattaatttaag

SEQ ID NO: 697170 - DNA, 20 bp, Artificial
  CRISPR gRNA sequence
actctcattaatttaagttt

SEQ ID NO: 697171 - DNA, 20 bp, Artificial
  CRISPR gRNA sequence
tcattaatttaagtttgata

SEQ ID NO: 697172 - DNA, 20 bp, Artificial
  CRISPR gRNA sequence
attaatttaagtttgatatc

SEQ ID NO: 697173 - DNA, 20 bp, Artificial
  CRISPR gRNA sequence
atttaagtttgatatctctt

SEQ ID NO: 697174 - DNA, 20 bp, Artificial
  CRISPR gRNA sequence
aagtttgatatctcttttgt

SEQ ID NO: 697175 - DNA, 20 bp, Artificial
  CRISPR gRNA sequence
agtttgatatctcttttgtt

SEQ ID NO: 697176 - DNA, 20 bp, Artificial
  CRISPR gRNA sequence
gatatctcttttgtttgtat

SEQ ID NO: 697177 - DNA, 20 bp, Artificial
  CRISPR gRNA sequence
atatctcttttgtttgtatg

SEQ ID NO: 697178 - DNA, 20 bp, Artificial
  CRISPR gRNA sequence
ttttgtttgtatgattcttt

SEQ ID NO: 697179 - DNA, 20 bp, Artificial
  CRISPR gRNA sequence
ttgtttgtatgattctttca

SEQ ID NO: 697180 - DNA, 20 bp, Artificial
  CRISPR gRNA sequence
tgtttgtatgattctttcaa

SEQ ID NO: 697181 - DNA, 20 bp, Artificial
  CRISPR gRNA sequence
gtttgtatgattctttcaag

SEQ ID NO: 697182 - DNA, 20 bp, Artificial
  CRISPR gRNA sequence
tttgtatgattctttcaaga

SEQ ID NO: 697183 - DNA, 20 bp, Artificial
  CRISPR gRNA sequence
gtatgattctttcaagacgt

SEQ ID NO: 697184 - DNA, 20 bp, Artificial
  CRISPR gRNA sequence
tatgattctttcaagacgtt

SEQ ID NO: 697185 - DNA, 20 bp, Artificial
  CRISPR gRNA sequence
tttcaagacgttggacactt

SEQ ID NO: 697186 - DNA, 20 bp, Artificial
  CRISPR gRNA sequence
tcaagacgttggacactttg

SEQ ID NO: 697187 - DNA, 20 bp, Artificial
  CRISPR gRNA sequence
caagacgttggacactttgg

SEQ ID NO: 697188 - DNA, 20 bp, Artificial
  CRISPR gRNA sequence
aagacgttggacactttgga

SEQ ID NO: 697189 - DNA, 20 bp, Artificial
  CRISPR gRNA sequence
gacactttggacattctgtt

SEQ ID NO: 697190 - DNA, 20 bp, Artificial
  CRISPR gRNA sequence
tggacattctgttaatttta

SEQ ID NO: 697191 - DNA, 20 bp, Artificial
  CRISPR gRNA sequence
ggacattctgttaattttat

SEQ ID NO: 697192 - DNA, 20 bp, Artificial
  CRISPR gRNA sequence
gacattctgttaattttatc

SEQ ID NO: 697193 - DNA, 20 bp, Artificial
  CRISPR gRNA sequence
tgttaattttatcttcttgg

SEQ ID NO: 697194 - DNA, 20 bp, Artificial
  CRISPR gRNA sequence
ttaattttatcttcttggaa

SEQ ID NO: 697195 - DNA, 20 bp, Artificial
  CRISPR gRNA sequence
attttatcttcttggaaatg

SEQ ID NO: 697196 - DNA, 20 bp, Artificial
  CRISPR gRNA sequence
tatcttcttggaaatgtccc

SEQ ID NO: 697197 - DNA, 20 bp, Artificial
  CRISPR gRNA sequence
atcttcttggaaatgtccct

SEQ ID NO: 697198 - DNA, 20 bp, Artificial
  CRISPR gRNA sequence
tcttcttggaaatgtccctc

SEQ ID NO: 697199 - DNA, 20 bp, Artificial
  CRISPR gRNA sequence
cttggaaatgtccctcctgg

SEQ ID NO: 697200 - DNA, 20 bp, Artificial
  CRISPR gRNA sequence
ttggaaatgtccctcctggg

SEQ ID NO: 697201 - DNA, 20 bp, Artificial
  CRISPR gRNA sequence
ggaaatgtccctcctgggcc

SEQ ID NO: 697202 - DNA, 20 bp, Artificial
  CRISPR gRNA sequence
gaaatgtccctcctgggccc

SEQ ID NO: 697203 - DNA, 20 bp, Artificial
  CRISPR gRNA sequence
ctgggcccttctggctgctc

SEQ ID NO: 697204 - DNA, 20 bp, Artificial
  CRISPR gRNA sequence
ggcccttctggctgctccca

SEQ ID NO: 697205 - DNA, 20 bp, Artificial
  CRISPR gRNA sequence
ctggctgctcccatctggat

SEQ ID NO: 697206 - DNA, 20 bp, Artificial
  CRISPR gRNA sequence
tggctgctcccatctggatt

SEQ ID NO: 697207 - DNA, 20 bp, Artificial
  CRISPR gRNA sequence
gctgctcccatctggattgg

SEQ ID NO: 697208 - DNA, 20 bp, Artificial
  CRISPR gRNA sequence
ctcccatctggattggaggc

SEQ ID NO: 697209 - DNA, 20 bp, Artificial
  CRISPR gRNA sequence
ccatctggattggaggcttc

SEQ ID NO: 697210 - DNA, 20 bp, Artificial
  CRISPR gRNA sequence
gattggaggcttctccccgt

SEQ ID NO: 697211 - DNA, 20 bp, Artificial
  CRISPR gRNA sequence
gaggcttctccccgtggagc

SEQ ID NO: 697212 - DNA, 20 bp, Artificial
  CRISPR gRNA sequence
ctccccgtggagcagagtca

SEQ ID NO: 697213 - DNA, 20 bp, Artificial
  CRISPR gRNA sequence
tccccgtggagcagagtcac

SEQ ID NO: 697214 - DNA, 20 bp, Artificial
  CRISPR gRNA sequence
cccgtggagcagagtcactg

SEQ ID NO: 697215 - DNA, 20 bp, Artificial
  CRISPR gRNA sequence
tcctaggatctccctccatc

SEQ ID NO: 697216 - DNA, 20 bp, Artificial
  CRISPR gRNA sequence
ggatctccctccatcactat

SEQ ID NO: 697217 - DNA, 20 bp, Artificial
  CRISPR gRNA sequence
cctccatcactatctgggaa

SEQ ID NO: 697218 - DNA, 20 bp, Artificial
  CRISPR gRNA sequence
catcactatctgggaaggtg

SEQ ID NO: 697219 - DNA, 20 bp, Artificial
  CRISPR gRNA sequence
tctgggaaggtgctttacat

SEQ ID NO: 697220 - DNA, 20 bp, Artificial
  CRISPR gRNA sequence
ggaaggtgctttacatgcag

SEQ ID NO: 697221 - DNA, 20 bp, Artificial
  CRISPR gRNA sequence
tacatgcagtggagccacct

SEQ ID NO: 697222 - DNA, 20 bp, Artificial
  CRISPR gRNA sequence
acatgcagtggagccacctg

SEQ ID NO: 697223 - DNA, 20 bp, Artificial
  CRISPR gRNA sequence
catgcagtggagccacctgg

SEQ ID NO: 697224 - DNA, 20 bp, Artificial
  CRISPR gRNA sequence
ggttccagccaaaatgcaga

SEQ ID NO: 697225 - DNA, 20 bp, Artificial
  CRISPR gRNA sequence
cagccaaaatgcagactgat

SEQ ID NO: 697226 - DNA, 20 bp, Artificial
  CRISPR gRNA sequence
attcaacatgtcaaggctgg

SEQ ID NO: 697227 - DNA, 20 bp, Artificial
  CRISPR gRNA sequence
aacatgtcaaggctgggcct

SEQ ID NO: 697228 - DNA, 20 bp, Artificial
  CRISPR gRNA sequence
ggcctgtgagcctttctgtc

SEQ ID NO: 697229 - DNA, 20 bp, Artificial
  CRISPR gRNA sequence
tgagcctttctgtctagttt

SEQ ID NO: 697230 - DNA, 20 bp, Artificial
  CRISPR gRNA sequence
tctgtctagtttcaggaggt

SEQ ID NO: 697231 - DNA, 20 bp, Artificial
  CRISPR gRNA sequence
ctgtctagtttcaggaggtg

SEQ ID NO: 697232 - DNA, 20 bp, Artificial
  CRISPR gRNA sequence
tgtctagtttcaggaggtgc

SEQ ID NO: 697233 - DNA, 20 bp, Artificial
  CRISPR gRNA sequence
tctagtttcaggaggtgctg

SEQ ID NO: 697234 - DNA, 20 bp, Artificial
  CRISPR gRNA sequence
gtttcaggaggtgctgattt

SEQ ID NO: 697235 - DNA, 20 bp, Artificial
  CRISPR gRNA sequence
caggaggtgctgattttcct

SEQ ID NO: 697236 - DNA, 20 bp, Artificial
  CRISPR gRNA sequence
aggaggtgctgattttcctg

SEQ ID NO: 697237 - DNA, 20 bp, Artificial
  CRISPR gRNA sequence
attttcctggttcatgggtg

SEQ ID NO: 697238 - DNA, 20 bp, Artificial
  CRISPR gRNA sequence
tcctggttcatgggtgatag

SEQ ID NO: 697239 - DNA, 20 bp, Artificial
  CRISPR gRNA sequence
cctggttcatgggtgatagc

SEQ ID NO: 697240 - DNA, 20 bp, Artificial
  CRISPR gRNA sequence
ctggttcatgggtgatagct

SEQ ID NO: 697241 - DNA, 20 bp, Artificial
  CRISPR gRNA sequence
gttcatgggtgatagctggg

SEQ ID NO: 697242 - DNA, 20 bp, Artificial
  CRISPR gRNA sequence
atgggtgatagctggggtag

SEQ ID NO: 697243 - DNA, 20 bp, Artificial
  CRISPR gRNA sequence
gggtagcagggatctctctt

SEQ ID NO: 697244 - DNA, 20 bp, Artificial
  CRISPR gRNA sequence
tctttttgtctcatagtttt

SEQ ID NO: 697245 - DNA, 20 bp, Artificial
  CRISPR gRNA sequence
tttttgtctcatagttttct

SEQ ID NO: 697246 - DNA, 20 bp, Artificial
  CRISPR gRNA sequence
tttgtctcatagttttctgt

SEQ ID NO: 697247 - DNA, 20 bp, Artificial
  CRISPR gRNA sequence
ttgtctcatagttttctgta

SEQ ID NO: 697248 - DNA, 20 bp, Artificial
  CRISPR gRNA sequence
tgtctcatagttttctgtat

SEQ ID NO: 697249 - DNA, 20 bp, Artificial
  CRISPR gRNA sequence
gtctcatagttttctgtatc

SEQ ID NO: 697250 - DNA, 20 bp, Artificial
  CRISPR gRNA sequence
tctcatagttttctgtatct

SEQ ID NO: 697251 - DNA, 20 bp, Artificial
  CRISPR gRNA sequence
atagttttctgtatctaagg

SEQ ID NO: 697252 - DNA, 20 bp, Artificial
  CRISPR gRNA sequence
tctgtatctaaggtaagcgc

SEQ ID NO: 697253 - DNA, 20 bp, Artificial
  CRISPR gRNA sequence
ctgtatctaaggtaagcgca

SEQ ID NO: 697254 - DNA, 20 bp, Artificial
  CRISPR gRNA sequence
tgtatctaaggtaagcgcat

SEQ ID NO: 697255 - DNA, 20 bp, Artificial
  CRISPR gRNA sequence
tatctaaggtaagcgcatac

SEQ ID NO: 697256 - DNA, 20 bp, Artificial
  CRISPR gRNA sequence
aggtaagcgcatactaatat

SEQ ID NO: 697257 - DNA, 20 bp, Artificial
  CRISPR gRNA sequence
atatatttttaatgaattca

SEQ ID NO: 697258 - DNA, 20 bp, Artificial
  CRISPR gRNA sequence
ttaatgaattcatgtacttt

SEQ ID NO: 697259 - DNA, 20 bp, Artificial
  CRISPR gRNA sequence
taatgaattcatgtactttt

SEQ ID NO: 697260 - DNA, 20 bp, Artificial
  CRISPR gRNA sequence
aatgaattcatgtacttttt

SEQ ID NO: 697261 - DNA, 20 bp, Artificial
  CRISPR gRNA sequence
atgaattcatgtactttttc

SEQ ID NO: 697262 - DNA, 20 bp, Artificial
  CRISPR gRNA sequence
atgtactttttccctaaatt

SEQ ID NO: 697263 - DNA, 20 bp, Artificial
  CRISPR gRNA sequence
tttccctaaattagtaacag

SEQ ID NO: 697264 - DNA, 20 bp, Artificial
  CRISPR gRNA sequence
ttccctaaattagtaacagg

SEQ ID NO: 697265 - DNA, 20 bp, Artificial
  CRISPR gRNA sequence
tccctaaattagtaacaggg

SEQ ID NO: 697266 - DNA, 20 bp, Artificial
  CRISPR gRNA sequence
ccctaaattagtaacagggc

SEQ ID NO: 697267 - DNA, 20 bp, Artificial
  CRISPR gRNA sequence
cctaaattagtaacagggct

SEQ ID NO: 697268 - DNA, 20 bp, Artificial
  CRISPR gRNA sequence
aattagtaacagggctaatt

SEQ ID NO: 697269 - DNA, 20 bp, Artificial
  CRISPR gRNA sequence
gtaacagggctaattagtct

SEQ ID NO: 697270 - DNA, 20 bp, Artificial
  CRISPR gRNA sequence
attagtcttttccttgggcc

SEQ ID NO: 697271 - DNA, 20 bp, Artificial
  CRISPR gRNA sequence
gtcttttccttgggccaaaa

SEQ ID NO: 697272 - DNA, 20 bp, Artificial
  CRISPR gRNA sequence
ttccttgggccaaaaactac

SEQ ID NO: 697273 - DNA, 20 bp, Artificial
  CRISPR gRNA sequence
tccttgggccaaaaactaca

SEQ ID NO: 697274 - DNA, 20 bp, Artificial
  CRISPR gRNA sequence
ccttgggccaaaaactacat

SEQ ID NO: 697275 - DNA, 20 bp, Artificial
  CRISPR gRNA sequence
cttgggccaaaaactacatt

SEQ ID NO: 697276 - DNA, 20 bp, Artificial
  CRISPR gRNA sequence
gggccaaaaactacattatg

SEQ ID NO: 697277 - DNA, 20 bp, Artificial
  CRISPR gRNA sequence
ggccaaaaactacattatgt

SEQ ID NO: 697278 - DNA, 20 bp, Artificial
  CRISPR gRNA sequence
cattatgtaaaatttggtat

SEQ ID NO: 697279 - DNA, 20 bp, Artificial
  CRISPR gRNA sequence
tgtaaaatttggtatcttaa

SEQ ID NO: 697280 - DNA, 20 bp, Artificial
  CRISPR gRNA sequence
ggtatcttaactattttaaa

SEQ ID NO: 697281 - DNA, 20 bp, Artificial
  CRISPR gRNA sequence
gtatcttaactattttaaag

SEQ ID NO: 697282 - DNA, 20 bp, Artificial
  CRISPR gRNA sequence
aactattttaaagtatacag

SEQ ID NO: 697283 - DNA, 20 bp, Artificial
  CRISPR gRNA sequence
actattttaaagtatacagt

SEQ ID NO: 697284 - DNA, 20 bp, Artificial
  CRISPR gRNA sequence
ttttaaagtatacagtagta

SEQ ID NO: 697285 - DNA, 20 bp, Artificial
  CRISPR gRNA sequence
taaagtatacagtagtacag

SEQ ID NO: 697286 - DNA, 20 bp, Artificial
  CRISPR gRNA sequence
aaagtatacagtagtacagt

SEQ ID NO: 697287 - DNA, 20 bp, Artificial
  CRISPR gRNA sequence
aagtatacagtagtacagta

SEQ ID NO: 697288 - DNA, 20 bp, Artificial
  CRISPR gRNA sequence
actgtaaatacatagttgtg

SEQ ID NO: 697289 - DNA, 20 bp, Artificial
  CRISPR gRNA sequence
taaatacatagttgtgcaac

SEQ ID NO: 697290 - DNA, 20 bp, Artificial
  CRISPR gRNA sequence
tgcaacagatctctagaact

SEQ ID NO: 697291 - DNA, 20 bp, Artificial
  CRISPR gRNA sequence
tagaacttttcatcttgcaa

SEQ ID NO: 697292 - DNA, 20 bp, Artificial
  CRISPR gRNA sequence
gaacttttcatcttgcaaca

SEQ ID NO: 697293 - DNA, 20 bp, Artificial
  CRISPR gRNA sequence
ttcatcttgcaacactgaaa

SEQ ID NO: 697294 - DNA, 20 bp, Artificial
  CRISPR gRNA sequence
tcatcttgcaacactgaaac

SEQ ID NO: 697295 - DNA, 20 bp, Artificial
  CRISPR gRNA sequence
catcttgcaacactgaaact

SEQ ID NO: 697296 - DNA, 20 bp, Artificial
  CRISPR gRNA sequence
atcttgcaacactgaaactc

SEQ ID NO: 697297 - DNA, 20 bp, Artificial
  CRISPR gRNA sequence
gcaacactgaaactctatgc

SEQ ID NO: 697298 - DNA, 20 bp, Artificial
  CRISPR gRNA sequence
caacactgaaactctatgcc

SEQ ID NO: 697299 - DNA, 20 bp, Artificial
  CRISPR gRNA sequence
aaactctatgcccattgaac

SEQ ID NO: 697300 - DNA, 20 bp, Artificial
  CRISPR gRNA sequence
tatgcccattgaacaaacat

SEQ ID NO: 697301 - DNA, 20 bp, Artificial
  CRISPR gRNA sequence
tgcccattgaacaaacattc

SEQ ID NO: 697302 - DNA, 20 bp, Artificial
  CRISPR gRNA sequence
aacaaacattcatccatccc

SEQ ID NO: 697303 - DNA, 20 bp, Artificial
  CRISPR gRNA sequence
atccatccccctcaccgagc

SEQ ID NO: 697304 - DNA, 20 bp, Artificial
  CRISPR gRNA sequence
accgagcccctagcagccat

SEQ ID NO: 697305 - DNA, 20 bp, Artificial
  CRISPR gRNA sequence
gcagccattagtctactttc

SEQ ID NO: 697306 - DNA, 20 bp, Artificial
  CRISPR gRNA sequence
gtctactttcagtttagaca

SEQ ID NO: 697307 - DNA, 20 bp, Artificial
  CRISPR gRNA sequence
ctttcagtttagacacctca

SEQ ID NO: 697308 - DNA, 20 bp, Artificial
  CRISPR gRNA sequence
tcagtttagacacctcatat

SEQ ID NO: 697309 - DNA, 20 bp, Artificial
  CRISPR gRNA sequence
cagtttagacacctcatata

SEQ ID NO: 697310 - DNA, 20 bp, Artificial
  CRISPR gRNA sequence
agtttagacacctcatataa

SEQ ID NO: 697311 - DNA, 20 bp, Artificial
  CRISPR gRNA sequence
agacacctcatataaatgga

SEQ ID NO: 697312 - DNA, 20 bp, Artificial
  CRISPR gRNA sequence
gacacctcatataaatggaa

SEQ ID NO: 697313 - DNA, 20 bp, Artificial
  CRISPR gRNA sequence
atataaatggaaatgtgcag

SEQ ID NO: 697314 - DNA, 20 bp, Artificial
  CRISPR gRNA sequence
ggttttctttgtgattggct

SEQ ID NO: 697315 - DNA, 20 bp, Artificial
  CRISPR gRNA sequence
tctttgtgattggcttattt

SEQ ID NO: 697316 - DNA, 20 bp, Artificial
  CRISPR gRNA sequence
ctttgtgattggcttatttt

SEQ ID NO: 697317 - DNA, 20 bp, Artificial
  CRISPR gRNA sequence
tttgtgattggcttatttta

SEQ ID NO: 697318 - DNA, 20 bp, Artificial
  CRISPR gRNA sequence
tgtgattggcttattttact

SEQ ID NO: 697319 - DNA, 20 bp, Artificial
  CRISPR gRNA sequence
gtgattggcttattttactt

SEQ ID NO: 697320 - DNA, 20 bp, Artificial
  CRISPR gRNA sequence
tgattggcttattttactta

SEQ ID NO: 697321 - DNA, 20 bp, Artificial
  CRISPR gRNA sequence
gcttattttacttagcagtg

SEQ ID NO: 697322 - DNA, 20 bp, Artificial
  CRISPR gRNA sequence
attttacttagcagtgtcct

SEQ ID NO: 697323 - DNA, 20 bp, Artificial
  CRISPR gRNA sequence
ttttacttagcagtgtcctt

SEQ ID NO: 697324 - DNA, 20 bp, Artificial
  CRISPR gRNA sequence
tacttagcagtgtccttcag

SEQ ID NO: 697325 - DNA, 20 bp, Artificial
  CRISPR gRNA sequence
acttagcagtgtccttcagg

SEQ ID NO: 697326 - DNA, 20 bp, Artificial
  CRISPR gRNA sequence
cttagcagtgtccttcaggt

SEQ ID NO: 697327 - DNA, 20 bp, Artificial
  CRISPR gRNA sequence
agcagtgtccttcaggttca

SEQ ID NO: 697328 - DNA, 20 bp, Artificial
  CRISPR gRNA sequence
gcagtgtccttcaggttcat

SEQ ID NO: 697329 - DNA, 20 bp, Artificial
  CRISPR gRNA sequence
caggttcatccctgttgcag

SEQ ID NO: 697330 - DNA, 20 bp, Artificial
  CRISPR gRNA sequence
aggttcatccctgttgcagc

SEQ ID NO: 697331 - DNA, 20 bp, Artificial
  CRISPR gRNA sequence
atccctgttgcagcctgtga

SEQ ID NO: 697332 - DNA, 20 bp, Artificial
  CRISPR gRNA sequence
ttgcagcctgtgaccaggtt

SEQ ID NO: 697333 - DNA, 20 bp, Artificial
  CRISPR gRNA sequence
cagcctgtgaccaggtttcc

SEQ ID NO: 697334 - DNA, 20 bp, Artificial
  CRISPR gRNA sequence
tgaccaggtttccttcttaa

SEQ ID NO: 697335 - DNA, 20 bp, Artificial
  CRISPR gRNA sequence
ccttcttaaggctgaatgat

SEQ ID NO: 697336 - DNA, 20 bp, Artificial
  CRISPR gRNA sequence
cttcttaaggctgaatgata

SEQ ID NO: 697337 - DNA, 20 bp, Artificial
  CRISPR gRNA sequence
cttaaggctgaatgatattc

SEQ ID NO: 697338 - DNA, 20 bp, Artificial
  CRISPR gRNA sequence
ttaaggctgaatgatattcc

SEQ ID NO: 697339 - DNA, 20 bp, Artificial
  CRISPR gRNA sequence
aaggctgaatgatattccgt

SEQ ID NO: 697340 - DNA, 20 bp, Artificial
  CRISPR gRNA sequence
aggctgaatgatattccgtt

SEQ ID NO: 697341 - DNA, 20 bp, Artificial
  CRISPR gRNA sequence
aatgatattccgttgtcgat

SEQ ID NO: 697342 - DNA, 20 bp, Artificial
  CRISPR gRNA sequence
cgttgtcgatatataccaca

SEQ ID NO: 697343 - DNA, 20 bp, Artificial
  CRISPR gRNA sequence
tcgatatataccacattttc

SEQ ID NO: 697344 - DNA, 20 bp, Artificial
  CRISPR gRNA sequence
tcttcattcatgtgttggtg

SEQ ID NO: 697345 - DNA, 20 bp, Artificial
  CRISPR gRNA sequence
cttcattcatgtgttggtgt

SEQ ID NO: 697346 - DNA, 20 bp, Artificial
  CRISPR gRNA sequence
ttcattcatgtgttggtgtg

SEQ ID NO: 697347 - DNA, 20 bp, Artificial
  CRISPR gRNA sequence
cattcatgtgttggtgtgtg

SEQ ID NO: 697348 - DNA, 20 bp, Artificial
  CRISPR gRNA sequence
attcatgtgttggtgtgtgt

SEQ ID NO: 697349 - DNA, 20 bp, Artificial
  CRISPR gRNA sequence
atgtgttggtgtgtgttgtc

SEQ ID NO: 697350 - DNA, 20 bp, Artificial
  CRISPR gRNA sequence
gtgtgtgttgtcttggctat

SEQ ID NO: 697351 - DNA, 20 bp, Artificial
  CRISPR gRNA sequence
tcttggctatcgtgaataat

SEQ ID NO: 697352 - DNA, 20 bp, Artificial
  CRISPR gRNA sequence
ggctatcgtgaataatgctg

SEQ ID NO: 697353 - DNA, 20 bp, Artificial
  CRISPR gRNA sequence
gctatcgtgaataatgctgc

SEQ ID NO: 697354 - DNA, 20 bp, Artificial
  CRISPR gRNA sequence
tcgtgaataatgctgctttg

SEQ ID NO: 697355 - DNA, 20 bp, Artificial
  CRISPR gRNA sequence
ctttgaatatgggtatacaa

SEQ ID NO: 697356 - DNA, 20 bp, Artificial
  CRISPR gRNA sequence
tgaatatgggtatacaatgt

SEQ ID NO: 697357 - DNA, 20 bp, Artificial
  CRISPR gRNA sequence
gaatatgggtatacaatgtt

SEQ ID NO: 697358 - DNA, 20 bp, Artificial
  CRISPR gRNA sequence
aatatgggtatacaatgttt

SEQ ID NO: 697359 - DNA, 20 bp, Artificial
  CRISPR gRNA sequence
ttcttttcaaaccttccctc

SEQ ID NO: 697360 - DNA, 20 bp, Artificial
  CRISPR gRNA sequence
tcttttcaaaccttccctca

SEQ ID NO: 697361 - DNA, 20 bp, Artificial
  CRISPR gRNA sequence
cttttcaaaccttccctcac

SEQ ID NO: 697362 - DNA, 20 bp, Artificial
  CRISPR gRNA sequence
ttttcaaaccttccctcact

SEQ ID NO: 697363 - DNA, 20 bp, Artificial
  CRISPR gRNA sequence
ttcaaaccttccctcacttt

SEQ ID NO: 697364 - DNA, 20 bp, Artificial
  CRISPR gRNA sequence
tcaaaccttccctcactttg

SEQ ID NO: 697365 - DNA, 20 bp, Artificial
  CRISPR gRNA sequence
caaaccttccctcactttgg

SEQ ID NO: 697366 - DNA, 20 bp, Artificial
  CRISPR gRNA sequence
aaaccttccctcactttggt

SEQ ID NO: 697367 - DNA, 20 bp, Artificial
  CRISPR gRNA sequence
ccctcactttggtggaatta

SEQ ID NO: 697368 - DNA, 20 bp, Artificial
  CRISPR gRNA sequence
cctcactttggtggaattaa

SEQ ID NO: 697369 - DNA, 20 bp, Artificial
  CRISPR gRNA sequence
actttggtggaattaatcct

SEQ ID NO: 697370 - DNA, 20 bp, Artificial
  CRISPR gRNA sequence
tggtggaattaatcctttag

SEQ ID NO: 697371 - DNA, 20 bp, Artificial
  CRISPR gRNA sequence
ggtggaattaatcctttagt

SEQ ID NO: 697372 - DNA, 20 bp, Artificial
  CRISPR gRNA sequence
gtggaattaatcctttagta

SEQ ID NO: 697373 - DNA, 20 bp, Artificial
  CRISPR gRNA sequence
atcctttagtagctacttct

SEQ ID NO: 697374 - DNA, 20 bp, Artificial
  CRISPR gRNA sequence
tagtagctacttctgacagc

SEQ ID NO: 697375 - DNA, 20 bp, Artificial
  CRISPR gRNA sequence
agtagctacttctgacagca

SEQ ID NO: 697376 - DNA, 20 bp, Artificial
  CRISPR gRNA sequence
gtagctacttctgacagcac

SEQ ID NO: 697377 - DNA, 20 bp, Artificial
  CRISPR gRNA sequence
cttctgacagcacatattta

SEQ ID NO: 697378 - DNA, 20 bp, Artificial
  CRISPR gRNA sequence
ctgacagcacatatttaaag

SEQ ID NO: 697379 - DNA, 20 bp, Artificial
  CRISPR gRNA sequence
tgacagcacatatttaaagt

SEQ ID NO: 697380 - DNA, 20 bp, Artificial
  CRISPR gRNA sequence
acagcacatatttaaagtat

SEQ ID NO: 697381 - DNA, 20 bp, Artificial
  CRISPR gRNA sequence
aaagtatgtttgtatggttc

SEQ ID NO: 697382 - DNA, 20 bp, Artificial
  CRISPR gRNA sequence
aagtatgtttgtatggttca

SEQ ID NO: 697383 - DNA, 20 bp, Artificial
  CRISPR gRNA sequence
gtatggttcaatttttccat

SEQ ID NO: 697384 - DNA, 20 bp, Artificial
  CRISPR gRNA sequence
tatggttcaatttttccatt

SEQ ID NO: 697385 - DNA, 20 bp, Artificial
  CRISPR gRNA sequence
aatttttccattgtttttat

SEQ ID NO: 697386 - DNA, 20 bp, Artificial
  CRISPR gRNA sequence
ttccattgtttttattctct

SEQ ID NO: 697387 - DNA, 20 bp, Artificial
  CRISPR gRNA sequence
tccattgtttttattctctc

SEQ ID NO: 697388 - DNA, 20 bp, Artificial
  CRISPR gRNA sequence
ccattgtttttattctctcc

SEQ ID NO: 697389 - DNA, 20 bp, Artificial
  CRISPR gRNA sequence
cattgtttttattctctcca

SEQ ID NO: 697390 - DNA, 20 bp, Artificial
  CRISPR gRNA sequence
tttttattctctccaggaag

SEQ ID NO: 697391 - DNA, 20 bp, Artificial
  CRISPR gRNA sequence
ttattctctccaggaagagg

SEQ ID NO: 697392 - DNA, 20 bp, Artificial
  CRISPR gRNA sequence
tattctctccaggaagagga

SEQ ID NO: 697393 - DNA, 20 bp, Artificial
  CRISPR gRNA sequence
attctctccaggaagaggag

SEQ ID NO: 697394 - DNA, 20 bp, Artificial
  CRISPR gRNA sequence
ttctctccaggaagaggaga

SEQ ID NO: 697395 - DNA, 20 bp, Artificial
  CRISPR gRNA sequence
tctccaggaagaggagataa

SEQ ID NO: 697396 - DNA, 20 bp, Artificial
  CRISPR gRNA sequence
tccaggaagaggagataaat

SEQ ID NO: 697397 - DNA, 20 bp, Artificial
  CRISPR gRNA sequence
caggaagaggagataaatat

SEQ ID NO: 697398 - DNA, 20 bp, Artificial
  CRISPR gRNA sequence
tttggcacagaatttaatag

SEQ ID NO: 697399 - DNA, 20 bp, Artificial
  CRISPR gRNA sequence
ggcacagaatttaataggga

SEQ ID NO: 697400 - DNA, 20 bp, Artificial
  CRISPR gRNA sequence
gcacagaatttaatagggaa

SEQ ID NO: 697401 - DNA, 20 bp, Artificial
  CRISPR gRNA sequence
aatagggaagaaagagacag

SEQ ID NO: 697402 - DNA, 20 bp, Artificial
  CRISPR gRNA sequence
atagggaagaaagagacagt

SEQ ID NO: 697403 - DNA, 20 bp, Artificial
  CRISPR gRNA sequence
accagtgctgggtctcatca

SEQ ID NO: 697404 - DNA, 20 bp, Artificial
  CRISPR gRNA sequence
ggtctcatcatcctgcaatt

SEQ ID NO: 697405 - DNA, 20 bp, Artificial
  CRISPR gRNA sequence
atcatcctgcaatttcagaa

SEQ ID NO: 697406 - DNA, 20 bp, Artificial
  CRISPR gRNA sequence
caatttcagaacaactatga

SEQ ID NO: 697407 - DNA, 20 bp, Artificial
  CRISPR gRNA sequence
cagaacaactatgaatacaa

SEQ ID NO: 697408 - DNA, 20 bp, Artificial
  CRISPR gRNA sequence
agaacaactatgaatacaaa

SEQ ID NO: 697409 - DNA, 20 bp, Artificial
  CRISPR gRNA sequence
tgaatacaaaaagaatttta

SEQ ID NO: 697410 - DNA, 20 bp, Artificial
  CRISPR gRNA sequence
taaaatcccagtcctgccta

SEQ ID NO: 697411 - DNA, 20 bp, Artificial
  CRISPR gRNA sequence
aaaatcccagtcctgcctag

SEQ ID NO: 697412 - DNA, 20 bp, Artificial
  CRISPR gRNA sequence
aaatcccagtcctgcctaga

SEQ ID NO: 697413 - DNA, 20 bp, Artificial
  CRISPR gRNA sequence
cctagaaaggggaagtcatc

SEQ ID NO: 697414 - DNA, 20 bp, Artificial
  CRISPR gRNA sequence
gaaaggggaagtcatctcta

SEQ ID NO: 697415 - DNA, 20 bp, Artificial
  CRISPR gRNA sequence
taaatatggtggccctgggg

SEQ ID NO: 697416 - DNA, 20 bp, Artificial
  CRISPR gRNA sequence
aatatggtggccctggggca

SEQ ID NO: 697417 - DNA, 20 bp, Artificial
  CRISPR gRNA sequence
gggcagctggcctccctgcc

SEQ ID NO: 697418 - DNA, 20 bp, Artificial
  CRISPR gRNA sequence
gcctccctgccaggcctctt

SEQ ID NO: 697419 - DNA, 20 bp, Artificial
  CRISPR gRNA sequence
cctgccaggcctcttccatg

SEQ ID NO: 697420 - DNA, 20 bp, Artificial
  CRISPR gRNA sequence
ccaggcctcttccatggggg

SEQ ID NO: 697421 - DNA, 20 bp, Artificial
  CRISPR gRNA sequence
ttccatgggggccctttctg

SEQ ID NO: 697422 - DNA, 20 bp, Artificial
  CRISPR gRNA sequence
ccatgggggccctttctgca

SEQ ID NO: 697423 - DNA, 20 bp, Artificial
  CRISPR gRNA sequence
catgggggccctttctgcag

SEQ ID NO: 697424 - DNA, 20 bp, Artificial
  CRISPR gRNA sequence
tctgcagtgactgtggtttc

SEQ ID NO: 697425 - DNA, 20 bp, Artificial
  CRISPR gRNA sequence
ctgcagtgactgtggtttct

SEQ ID NO: 697426 - DNA, 20 bp, Artificial
  CRISPR gRNA sequence
tgcagtgactgtggtttctt

SEQ ID NO: 697427 - DNA, 20 bp, Artificial
  CRISPR gRNA sequence
cagtgactgtggtttcttcc

SEQ ID NO: 697428 - DNA, 20 bp, Artificial
  CRISPR gRNA sequence
tggtttcttcccattttact

SEQ ID NO: 697429 - DNA, 20 bp, Artificial
  CRISPR gRNA sequence
cttcccattttactctgtcc

SEQ ID NO: 697430 - DNA, 20 bp, Artificial
  CRISPR gRNA sequence
ttcccattttactctgtcct

SEQ ID NO: 697431 - DNA, 20 bp, Artificial
  CRISPR gRNA sequence
cccattttactctgtcctgt

SEQ ID NO: 697432 - DNA, 20 bp, Artificial
  CRISPR gRNA sequence
ccattttactctgtcctgtg

SEQ ID NO: 697433 - DNA, 20 bp, Artificial
  CRISPR gRNA sequence
tactctgtcctgtgtcctga

SEQ ID NO: 697434 - DNA, 20 bp, Artificial
  CRISPR gRNA sequence
actctgtcctgtgtcctgac

SEQ ID NO: 697435 - DNA, 20 bp, Artificial
  CRISPR gRNA sequence
ctctgtcctgtgtcctgact

SEQ ID NO: 697436 - DNA, 20 bp, Artificial
  CRISPR gRNA sequence
tgtcctgtgtcctgactgaa

SEQ ID NO: 697437 - DNA, 20 bp, Artificial
  CRISPR gRNA sequence
tcctgtgtcctgactgaagc

SEQ ID NO: 697438 - DNA, 20 bp, Artificial
  CRISPR gRNA sequence
tgtcctgactgaagcgacaa

SEQ ID NO: 697439 - DNA, 20 bp, Artificial
  CRISPR gRNA sequence
actgaagcgacaaggtgtgt

SEQ ID NO: 697440 - DNA, 20 bp, Artificial
  CRISPR gRNA sequence
aagcgacaaggtgtgtctgc

SEQ ID NO: 697441 - DNA, 20 bp, Artificial
  CRISPR gRNA sequence
cagctgtgctcacacctgga

SEQ ID NO: 697442 - DNA, 20 bp, Artificial
  CRISPR gRNA sequence
tgctcacacctggaggaaac

SEQ ID NO: 697443 - DNA, 20 bp, Artificial
  CRISPR gRNA sequence
acacctggaggaaacctcaa

SEQ ID NO: 697444 - DNA, 20 bp, Artificial
  CRISPR gRNA sequence
gaggaaacctcaatggtgtg

SEQ ID NO: 697445 - DNA, 20 bp, Artificial
  CRISPR gRNA sequence
aatggtgtgagtaaattgta

SEQ ID NO: 697446 - DNA, 20 bp, Artificial
  CRISPR gRNA sequence
taaatgtttacttattatgg

SEQ ID NO: 697447 - DNA, 20 bp, Artificial
  CRISPR gRNA sequence
acttattatgggttatttta

SEQ ID NO: 697448 - DNA, 20 bp, Artificial
  CRISPR gRNA sequence
cttattatgggttattttat

SEQ ID NO: 697449 - DNA, 20 bp, Artificial
  CRISPR gRNA sequence
attatgggttattttattat

SEQ ID NO: 697450 - DNA, 20 bp, Artificial
  CRISPR gRNA sequence
ttatgggttattttattatt

SEQ ID NO: 697451 - DNA, 20 bp, Artificial
  CRISPR gRNA sequence
tgggttattttattatttat

SEQ ID NO: 697452 - DNA, 20 bp, Artificial
  CRISPR gRNA sequence
ttttattatttatggagtat

SEQ ID NO: 697453 - DNA, 20 bp, Artificial
  CRISPR gRNA sequence
tattatttatggagtatgta

SEQ ID NO: 697454 - DNA, 20 bp, Artificial
  CRISPR gRNA sequence
attatttatggagtatgtat

SEQ ID NO: 697455 - DNA, 20 bp, Artificial
  CRISPR gRNA sequence
ttatttatggagtatgtatt

SEQ ID NO: 697456 - DNA, 20 bp, Artificial
  CRISPR gRNA sequence
tttatggagtatgtattttg

SEQ ID NO: 697457 - DNA, 20 bp, Artificial
  CRISPR gRNA sequence
atggagtatgtattttgatt

SEQ ID NO: 697458 - DNA, 20 bp, Artificial
  CRISPR gRNA sequence
tggagtatgtattttgattt

SEQ ID NO: 697459 - DNA, 20 bp, Artificial
  CRISPR gRNA sequence
tgatttcattctactgacaa

SEQ ID NO: 697460 - DNA, 20 bp, Artificial
  CRISPR gRNA sequence
gatttcattctactgacaac

SEQ ID NO: 697461 - DNA, 20 bp, Artificial
  CRISPR gRNA sequence
atttcattctactgacaaca

SEQ ID NO: 697462 - DNA, 20 bp, Artificial
  CRISPR gRNA sequence
cattctactgacaacacaat

SEQ ID NO: 697463 - DNA, 20 bp, Artificial
  CRISPR gRNA sequence
attctactgacaacacaata

SEQ ID NO: 697464 - DNA, 20 bp, Artificial
  CRISPR gRNA sequence
tactgacaacacaataaacc

SEQ ID NO: 697465 - DNA, 20 bp, Artificial
  CRISPR gRNA sequence
ctgacaacacaataaaccag

SEQ ID NO: 697466 - DNA, 20 bp, Artificial
  CRISPR gRNA sequence
acaacacaataaaccaggac

SEQ ID NO: 697467 - DNA, 20 bp, Artificial
  CRISPR gRNA sequence
gcagcacatcctctttcctg

SEQ ID NO: 697468 - DNA, 20 bp, Artificial
  CRISPR gRNA sequence
tttcctgtgtcaagaagcat

SEQ ID NO: 697469 - DNA, 20 bp, Artificial
  CRISPR gRNA sequence
tcctgtgtcaagaagcatcg

SEQ ID NO: 697470 - DNA, 20 bp, Artificial
  CRISPR gRNA sequence
cctgtgtcaagaagcatcgt

SEQ ID NO: 697471 - DNA, 20 bp, Artificial
  CRISPR gRNA sequence
ctgtgtcaagaagcatcgtc

SEQ ID NO: 697472 - DNA, 20 bp, Artificial
  CRISPR gRNA sequence
tgtcaagaagcatcgtccgg

SEQ ID NO: 697473 - DNA, 20 bp, Artificial
  CRISPR gRNA sequence
cctagaattgaagaaccagg

SEQ ID NO: 697474 - DNA, 20 bp, Artificial
  CRISPR gRNA sequence
gaattgaagaaccagggaga

SEQ ID NO: 697475 - DNA, 20 bp, Artificial
  CRISPR gRNA sequence
aagaaccagggagaagcaga

SEQ ID NO: 697476 - DNA, 20 bp, Artificial
  CRISPR gRNA sequence
ggcaggtgggttttcacctg

SEQ ID NO: 697477 - DNA, 20 bp, Artificial
  CRISPR gRNA sequence
tcacctggaacctggaggat

SEQ ID NO: 697478 - DNA, 20 bp, Artificial
  CRISPR gRNA sequence
cacctggaacctggaggatg

SEQ ID NO: 697479 - DNA, 20 bp, Artificial
  CRISPR gRNA sequence
acctggaacctggaggatga

SEQ ID NO: 697480 - DNA, 20 bp, Artificial
  CRISPR gRNA sequence
gaacctggaggatgagcaat

SEQ ID NO: 697481 - DNA, 20 bp, Artificial
  CRISPR gRNA sequence
gaggatgagcaatgacatct

SEQ ID NO: 697482 - DNA, 20 bp, Artificial
  CRISPR gRNA sequence
tccaccctgagctcagcctg

SEQ ID NO: 697483 - DNA, 20 bp, Artificial
  CRISPR gRNA sequence
caccctgagctcagcctggg

SEQ ID NO: 697484 - DNA, 20 bp, Artificial
  CRISPR gRNA sequence
agctcagcctgggcatccac

SEQ ID NO: 697485 - DNA, 20 bp, Artificial
  CRISPR gRNA sequence
agcctgggcatccacctcct

SEQ ID NO: 697486 - DNA, 20 bp, Artificial
  CRISPR gRNA sequence
ggcatccacctcctgggctc

SEQ ID NO: 697487 - DNA, 20 bp, Artificial
  CRISPR gRNA sequence
ctgggctcatgagcagtgca

SEQ ID NO: 697488 - DNA, 20 bp, Artificial
  CRISPR gRNA sequence
ggctcatgagcagtgcagtg

SEQ ID NO: 697489 - DNA, 20 bp, Artificial
  CRISPR gRNA sequence
atgagcagtgcagtggtgcc

SEQ ID NO: 697490 - DNA, 20 bp, Artificial
  CRISPR gRNA sequence
ctagtggtctctgctcttcc

SEQ ID NO: 697491 - DNA, 20 bp, Artificial
  CRISPR gRNA sequence
gtggtctctgctcttccttt

SEQ ID NO: 697492 - DNA, 20 bp, Artificial
  CRISPR gRNA sequence
tgctcttccttttccagatc

SEQ ID NO: 697493 - DNA, 20 bp, Artificial
  CRISPR gRNA sequence
ctcttccttttccagatcaa

SEQ ID NO: 697494 - DNA, 20 bp, Artificial
  CRISPR gRNA sequence
ttccttttccagatcaagca

SEQ ID NO: 697495 - DNA, 20 bp, Artificial
  CRISPR gRNA sequence
ccttttccagatcaagcaca

SEQ ID NO: 697496 - DNA, 20 bp, Artificial
  CRISPR gRNA sequence
cttttccagatcaagcacaa

SEQ ID NO: 697497 - DNA, 20 bp, Artificial
  CRISPR gRNA sequence
ttccagatcaagcacaaacc

SEQ ID NO: 697498 - DNA, 20 bp, Artificial
  CRISPR gRNA sequence
tccagatcaagcacaaacct

SEQ ID NO: 697499 - DNA, 20 bp, Artificial
  CRISPR gRNA sequence
ccagatcaagcacaaacctg

SEQ ID NO: 697500 - DNA, 20 bp, Artificial
  CRISPR gRNA sequence
cagatcaagcacaaacctga

SEQ ID NO: 697501 - DNA, 20 bp, Artificial
  CRISPR gRNA sequence
agatccaactgtccctctta

SEQ ID NO: 697502 - DNA, 20 bp, Artificial
  CRISPR gRNA sequence
tccctcttatgcgcctgggt

SEQ ID NO: 697503 - DNA, 20 bp, Artificial
  CRISPR gRNA sequence
ttatgcgcctgggtttcttc

SEQ ID NO: 697504 - DNA, 20 bp, Artificial
  CRISPR gRNA sequence
atgcgcctgggtttcttcac

SEQ ID NO: 697505 - DNA, 20 bp, Artificial
  CRISPR gRNA sequence
tgcgcctgggtttcttcact

SEQ ID NO: 697506 - DNA, 20 bp, Artificial
  CRISPR gRNA sequence
ggtttcttcactggacacca

SEQ ID NO: 697507 - DNA, 20 bp, Artificial
  CRISPR gRNA sequence
cttcactggacaccagtatg

SEQ ID NO: 697508 - DNA, 20 bp, Artificial
  CRISPR gRNA sequence
ttcactggacaccagtatga

SEQ ID NO: 697509 - DNA, 20 bp, Artificial
  CRISPR gRNA sequence
cactggacaccagtatgagt

SEQ ID NO: 697510 - DNA, 20 bp, Artificial
  CRISPR gRNA sequence
actggacaccagtatgagtc

SEQ ID NO: 697511 - DNA, 20 bp, Artificial
  CRISPR gRNA sequence
gacaccagtatgagtcaact

SEQ ID NO: 697512 - DNA, 20 bp, Artificial
  CRISPR gRNA sequence
tcctgtaaagcagaacaagc

SEQ ID NO: 697513 - DNA, 20 bp, Artificial
  CRISPR gRNA sequence
cctgtaaagcagaacaagca

SEQ ID NO: 697514 - DNA, 20 bp, Artificial
  CRISPR gRNA sequence
ctgtaaagcagaacaagcac

SEQ ID NO: 697515 - DNA, 20 bp, Artificial
  CRISPR gRNA sequence
taaagcagaacaagcacgag

SEQ ID NO: 697516 - DNA, 20 bp, Artificial
  CRISPR gRNA sequence
gaccatgttagaggaggaat

SEQ ID NO: 697517 - DNA, 20 bp, Artificial
  CRISPR gRNA sequence
gaggaggaatggtgtcatct

SEQ ID NO: 697518 - DNA, 20 bp, Artificial
  CRISPR gRNA sequence
cacttctggagagatccctg

SEQ ID NO: 697519 - DNA, 20 bp, Artificial
  CRISPR gRNA sequence
ctggagagatccctgtcccc

SEQ ID NO: 697520 - DNA, 20 bp, Artificial
  CRISPR gRNA sequence
tggagagatccctgtccccg

SEQ ID NO: 697521 - DNA, 20 bp, Artificial
  CRISPR gRNA sequence
gagagatccctgtccccgtg

SEQ ID NO: 697522 - DNA, 20 bp, Artificial
  CRISPR gRNA sequence
tccccgtgttcgggggaagg

SEQ ID NO: 697523 - DNA, 20 bp, Artificial
  CRISPR gRNA sequence
gggggaaggaccaagcctca

SEQ ID NO: 697524 - DNA, 20 bp, Artificial
  CRISPR gRNA sequence
actcccatgcagagaagagg

SEQ ID NO: 697525 - DNA, 20 bp, Artificial
  CRISPR gRNA sequence
ccatgcagagaagaggctct

SEQ ID NO: 697526 - DNA, 20 bp, Artificial
  CRISPR gRNA sequence
tgactgtaactgcacctgtg

SEQ ID NO: 697527 - DNA, 20 bp, Artificial
  CRISPR gRNA sequence
actgtaactgcacctgtgga

SEQ ID NO: 697528 - DNA, 20 bp, Artificial
  CRISPR gRNA sequence
taactgcacctgtggagagg

SEQ ID NO: 697529 - DNA, 20 bp, Artificial
  CRISPR gRNA sequence
cacctgtggagaggtgagga

SEQ ID NO: 697530 - DNA, 20 bp, Artificial
  CRISPR gRNA sequence
tggagaggtgaggacctgtc

SEQ ID NO: 697531 - DNA, 20 bp, Artificial
  CRISPR gRNA sequence
tcccctctacaccgatggcc

SEQ ID NO: 697532 - DNA, 20 bp, Artificial
  CRISPR gRNA sequence
tacaccgatggccagagcct

SEQ ID NO: 697533 - DNA, 20 bp, Artificial
  CRISPR gRNA sequence
caccgatggccagagcctcc

SEQ ID NO: 697534 - DNA, 20 bp, Artificial
  CRISPR gRNA sequence
cagagtggggccaggttttt

SEQ ID NO: 697535 - DNA, 20 bp, Artificial
  CRISPR gRNA sequence
ttccctcagctgtgtcctgt

SEQ ID NO: 697536 - DNA, 20 bp, Artificial
  CRISPR gRNA sequence
tccctcagctgtgtcctgtc

SEQ ID NO: 697537 - DNA, 20 bp, Artificial
  CRISPR gRNA sequence
ccctcagctgtgtcctgtca

SEQ ID NO: 697538 - DNA, 20 bp, Artificial
  CRISPR gRNA sequence
cctcagctgtgtcctgtcag

SEQ ID NO: 697539 - DNA, 20 bp, Artificial
  CRISPR gRNA sequence
agctgtgtcctgtcaggttc

SEQ ID NO: 697540 - DNA, 20 bp, Artificial
  CRISPR gRNA sequence
tgtcctgtcaggttcatcta

SEQ ID NO: 697541 - DNA, 20 bp, Artificial
  CRISPR gRNA sequence
tcaggttcatctaggcctca

SEQ ID NO: 697542 - DNA, 20 bp, Artificial
  CRISPR gRNA sequence
atctaggcctcaaagaatag

SEQ ID NO: 697543 - DNA, 20 bp, Artificial
  CRISPR gRNA sequence
ggcctcaaagaatagaccct

SEQ ID NO: 697544 - DNA, 20 bp, Artificial
  CRISPR gRNA sequence
aaagaatagaccctggacat

SEQ ID NO: 697545 - DNA, 20 bp, Artificial
  CRISPR gRNA sequence
gacattgcctctggcaatgt

SEQ ID NO: 697546 - DNA, 20 bp, Artificial
  CRISPR gRNA sequence
cctctggcaatgtgagctgg

SEQ ID NO: 697547 - DNA, 20 bp, Artificial
  CRISPR gRNA sequence
tggcaatgtgagctggacac

SEQ ID NO: 697548 - DNA, 20 bp, Artificial
  CRISPR gRNA sequence
gcaatgtgagctggacacac

SEQ ID NO: 697549 - DNA, 20 bp, Artificial
  CRISPR gRNA sequence
gacacacacccagatgtaag

SEQ ID NO: 697550 - DNA, 20 bp, Artificial
  CRISPR gRNA sequence
ccaagtatcctggggttgcc

SEQ ID NO: 697551 - DNA, 20 bp, Artificial
  CRISPR gRNA sequence
gggttgccagtagttctggg

SEQ ID NO: 697552 - DNA, 20 bp, Artificial
  CRISPR gRNA sequence
ccagtagttctgggtgctca

SEQ ID NO: 697553 - DNA, 20 bp, Artificial
  CRISPR gRNA sequence
tgggtgctcagtgtctggag

SEQ ID NO: 697554 - DNA, 20 bp, Artificial
  CRISPR gRNA sequence
ggtgctcagtgtctggagcg

SEQ ID NO: 697555 - DNA, 20 bp, Artificial
  CRISPR gRNA sequence
agtgtctggagcggagggtg

SEQ ID NO: 697556 - DNA, 20 bp, Artificial
  CRISPR gRNA sequence
gagcggagggtgggaaggag

SEQ ID NO: 697557 - DNA, 20 bp, Artificial
  CRISPR gRNA sequence
ggtgcagaacaagaaccata

SEQ ID NO: 697558 - DNA, 20 bp, Artificial
  CRISPR gRNA sequence
gtgcagaacaagaaccatat

SEQ ID NO: 697559 - DNA, 20 bp, Artificial
  CRISPR gRNA sequence
ttttattctttattagtgtt

SEQ ID NO: 697560 - DNA, 20 bp, Artificial
  CRISPR gRNA sequence
tattctttattagtgttttt

SEQ ID NO: 697561 - DNA, 20 bp, Artificial
  CRISPR gRNA sequence
attctttattagtgtttttg

SEQ ID NO: 697562 - DNA, 20 bp, Artificial
  CRISPR gRNA sequence
ttctttattagtgtttttgt

SEQ ID NO: 697563 - DNA, 20 bp, Artificial
  CRISPR gRNA sequence
tttattagtgtttttgtcat

SEQ ID NO: 697564 - DNA, 20 bp, Artificial
  CRISPR gRNA sequence
tattagtgtttttgtcataa

SEQ ID NO: 697565 - DNA, 20 bp, Artificial
  CRISPR gRNA sequence
attagtgtttttgtcataaa

SEQ ID NO: 697566 - DNA, 20 bp, Artificial
  CRISPR gRNA sequence
ttagtgtttttgtcataaaa

SEQ ID NO: 697567 - DNA, 20 bp, Artificial
  CRISPR gRNA sequence
gtgtttttgtcataaaaaac

SEQ ID NO: 697568 - DNA, 20 bp, Artificial
  CRISPR gRNA sequence
ttgtcataaaaaaccccacg

SEQ ID NO: 697569 - DNA, 20 bp, Artificial
  CRISPR gRNA sequence
tgtcataaaaaaccccacgg

SEQ ID NO: 697570 - DNA, 20 bp, Artificial
  CRISPR gRNA sequence
gtcataaaaaaccccacggg

SEQ ID NO: 697571 - DNA, 20 bp, Artificial
  CRISPR gRNA sequence
tcataaaaaaccccacgggt

SEQ ID NO: 697572 - DNA, 20 bp, Artificial
  CRISPR gRNA sequence
aaaatagtgccctttaatca

SEQ ID NO: 697573 - DNA, 20 bp, Artificial
  CRISPR gRNA sequence
taatcaaaagtaaacaccct

SEQ ID NO: 697574 - DNA, 20 bp, Artificial
  CRISPR gRNA sequence
aatcaaaagtaaacaccctt

SEQ ID NO: 697575 - DNA, 20 bp, Artificial
  CRISPR gRNA sequence
atcaaaagtaaacacccttt

SEQ ID NO: 697576 - DNA, 20 bp, Artificial
  CRISPR gRNA sequence
taaccatcagagagagggag

SEQ ID NO: 697577 - DNA, 20 bp, Artificial
  CRISPR gRNA sequence
aaccatcagagagagggaga

SEQ ID NO: 697578 - DNA, 20 bp, Artificial
  CRISPR gRNA sequence
accatcagagagagggagaa

SEQ ID NO: 697579 - DNA, 20 bp, Artificial
  CRISPR gRNA sequence
ggcagctgacctagaagccc

SEQ ID NO: 697580 - DNA, 20 bp, Artificial
  CRISPR gRNA sequence
gcagctgacctagaagcccc

SEQ ID NO: 697581 - DNA, 20 bp, Artificial
  CRISPR gRNA sequence
acctagaagccccatcaact

SEQ ID NO: 697582 - DNA, 20 bp, Artificial
  CRISPR gRNA sequence
gaagccccatcaactgcccc

SEQ ID NO: 697583 - DNA, 20 bp, Artificial
  CRISPR gRNA sequence
ccccagctcaatgataaact

SEQ ID NO: 697584 - DNA, 20 bp, Artificial
  CRISPR gRNA sequence
aatgataaactcttctcttc

SEQ ID NO: 697585 - DNA, 20 bp, Artificial
  CRISPR gRNA sequence
ttctcttcttcaaataaaag

SEQ ID NO: 697586 - DNA, 20 bp, Artificial
  CRISPR gRNA sequence
ctcttcttcaaataaaagca

SEQ ID NO: 697587 - DNA, 20 bp, Artificial
  CRISPR gRNA sequence
tcttcttcaaataaaagcac

SEQ ID NO: 697588 - DNA, 20 bp, Artificial
  CRISPR gRNA sequence
ttcttcaaataaaagcacat

SEQ ID NO: 697589 - DNA, 20 bp, Artificial
  CRISPR gRNA sequence
cttcaaataaaagcacatcc

SEQ ID NO: 697590 - DNA, 20 bp, Artificial
  CRISPR gRNA sequence
ttcaaataaaagcacatcct

SEQ ID NO: 697591 - DNA, 20 bp, Artificial
  CRISPR gRNA sequence
caaataaaagcacatcctgg

SEQ ID NO: 697592 - DNA, 20 bp, Artificial
  CRISPR gRNA sequence
aaataaaagcacatcctggc

SEQ ID NO: 697593 - DNA, 20 bp, Artificial
  CRISPR gRNA sequence
gcttacatggccatcacttc

SEQ ID NO: 697594 - DNA, 20 bp, Artificial
  CRISPR gRNA sequence
acatggccatcacttctttg

SEQ ID NO: 697595 - DNA, 20 bp, Artificial
  CRISPR gRNA sequence
catggccatcacttctttgt

SEQ ID NO: 697596 - DNA, 20 bp, Artificial
  CRISPR gRNA sequence
ctttgtacaattttatattt

SEQ ID NO: 697597 - DNA, 20 bp, Artificial
  CRISPR gRNA sequence
tttgtacaattttatatttt

SEQ ID NO: 697598 - DNA, 20 bp, Artificial
  CRISPR gRNA sequence
tgtacaattttatattttta

SEQ ID NO: 697599 - DNA, 20 bp, Artificial
  CRISPR gRNA sequence
gtacaattttatatttttat

SEQ ID NO: 697600 - DNA, 20 bp, Artificial
  CRISPR gRNA sequence
tacaattttatatttttatc

SEQ ID NO: 697601 - DNA, 20 bp, Artificial
  CRISPR gRNA sequence
tatatttttatcatctaaaa

SEQ ID NO: 697602 - DNA, 20 bp, Artificial
  CRISPR gRNA sequence
atatttttatcatctaaaat

SEQ ID NO: 697603 - DNA, 20 bp, Artificial
  CRISPR gRNA sequence
tatttttatcatctaaaatt

SEQ ID NO: 697604 - DNA, 20 bp, Artificial
  CRISPR gRNA sequence
ttatcatctaaaattatagt

SEQ ID NO: 697605 - DNA, 20 bp, Artificial
  CRISPR gRNA sequence
tatcatctaaaattatagtt

SEQ ID NO: 697606 - DNA, 20 bp, Artificial
  CRISPR gRNA sequence
atcatctaaaattatagttt

SEQ ID NO: 697607 - DNA, 20 bp, Artificial
  CRISPR gRNA sequence
tcatctaaaattatagttta

SEQ ID NO: 697608 - DNA, 20 bp, Artificial
  CRISPR gRNA sequence
aaattatagtttagttttac

SEQ ID NO: 697609 - DNA, 20 bp, Artificial
  CRISPR gRNA sequence
tagtttagttttacctttaa

SEQ ID NO: 697610 - DNA, 20 bp, Artificial
  CRISPR gRNA sequence
agttttacctttaagagtat

SEQ ID NO: 697611 - DNA, 20 bp, Artificial
  CRISPR gRNA sequence
gttttacctttaagagtata

SEQ ID NO: 697612 - DNA, 20 bp, Artificial
  CRISPR gRNA sequence
tacctttaagagtatatttt

SEQ ID NO: 697613 - DNA, 20 bp, Artificial
  CRISPR gRNA sequence
acctttaagagtatattttt

SEQ ID NO: 697614 - DNA, 20 bp, Artificial
  CRISPR gRNA sequence
cctttaagagtatattttta

SEQ ID NO: 697615 - DNA, 20 bp, Artificial
  CRISPR gRNA sequence
taagagtatatttttatcct

SEQ ID NO: 697616 - DNA, 20 bp, Artificial
  CRISPR gRNA sequence
aagagtatatttttatcctc

SEQ ID NO: 697617 - DNA, 20 bp, Artificial
  CRISPR gRNA sequence
agagtatatttttatcctca

SEQ ID NO: 697618 - DNA, 20 bp, Artificial
  CRISPR gRNA sequence
ttatcctcatttattccata

SEQ ID NO: 697619 - DNA, 20 bp, Artificial
  CRISPR gRNA sequence
tatcctcatttattccatag

SEQ ID NO: 697620 - DNA, 20 bp, Artificial
  CRISPR gRNA sequence
atcctcatttattccataga

SEQ ID NO: 697621 - DNA, 20 bp, Artificial
  CRISPR gRNA sequence
tcctcatttattccatagat

SEQ ID NO: 697622 - DNA, 20 bp, Artificial
  CRISPR gRNA sequence
atttattccatagattcctg

SEQ ID NO: 697623 - DNA, 20 bp, Artificial
  CRISPR gRNA sequence
attccatagattcctgcttg

SEQ ID NO: 697624 - DNA, 20 bp, Artificial
  CRISPR gRNA sequence
ttccatagattcctgcttga

SEQ ID NO: 697625 - DNA, 20 bp, Artificial
  CRISPR gRNA sequence
catagattcctgcttgaaat

SEQ ID NO: 697626 - DNA, 20 bp, Artificial
  CRISPR gRNA sequence
ctgcttgaaatttatattgt

SEQ ID NO: 697627 - DNA, 20 bp, Artificial
  CRISPR gRNA sequence
cttgaaatttatattgtctg

SEQ ID NO: 697628 - DNA, 20 bp, Artificial
  CRISPR gRNA sequence
gaaatttatattgtctggta

SEQ ID NO: 697629 - DNA, 20 bp, Artificial
  CRISPR gRNA sequence
aaatttatattgtctggtag

SEQ ID NO: 697630 - DNA, 20 bp, Artificial
  CRISPR gRNA sequence
atattgtctggtagtttcct

SEQ ID NO: 697631 - DNA, 20 bp, Artificial
  CRISPR gRNA sequence
tattgtctggtagtttcctg

SEQ ID NO: 697632 - DNA, 20 bp, Artificial
  CRISPR gRNA sequence
tctggtagtttcctgtcctt

SEQ ID NO: 697633 - DNA, 20 bp, Artificial
  CRISPR gRNA sequence
gtagtttcctgtcctttgca

SEQ ID NO: 697634 - DNA, 20 bp, Artificial
  CRISPR gRNA sequence
cctgtcctttgcattttgca

SEQ ID NO: 697635 - DNA, 20 bp, Artificial
  CRISPR gRNA sequence
ctgtcctttgcattttgcag

SEQ ID NO: 697636 - DNA, 20 bp, Artificial
  CRISPR gRNA sequence
tcctttgcattttgcagatt

SEQ ID NO: 697637 - DNA, 20 bp, Artificial
  CRISPR gRNA sequence
tgcattttgcagattgcacc

SEQ ID NO: 697638 - DNA, 20 bp, Artificial
  CRISPR gRNA sequence
gcattttgcagattgcaccc

SEQ ID NO: 697639 - DNA, 20 bp, Artificial
  CRISPR gRNA sequence
cattttgcagattgcacccc

SEQ ID NO: 697640 - DNA, 20 bp, Artificial
  CRISPR gRNA sequence
tgcagattgcaccccaaggt

SEQ ID NO: 697641 - DNA, 20 bp, Artificial
  CRISPR gRNA sequence
gcagattgcaccccaaggtg

SEQ ID NO: 697642 - DNA, 20 bp, Artificial
  CRISPR gRNA sequence
cagattgcaccccaaggtgt

SEQ ID NO: 697643 - DNA, 20 bp, Artificial
  CRISPR gRNA sequence
caccccaaggtgtggtttaa

SEQ ID NO: 697644 - DNA, 20 bp, Artificial
  CRISPR gRNA sequence
aatgtatctctatgacctgt

SEQ ID NO: 697645 - DNA, 20 bp, Artificial
  CRISPR gRNA sequence
atgtatctctatgacctgta

SEQ ID NO: 697646 - DNA, 20 bp, Artificial
  CRISPR gRNA sequence
tatgacctgtattttctgta

SEQ ID NO: 697647 - DNA, 20 bp, Artificial
  CRISPR gRNA sequence
tgacctgtattttctgtaaa

SEQ ID NO: 697648 - DNA, 20 bp, Artificial
  CRISPR gRNA sequence
tattttctgtaaattggtag

SEQ ID NO: 697649 - DNA, 20 bp, Artificial
  CRISPR gRNA sequence
tctgtaaattggtagtttgt

SEQ ID NO: 697650 - DNA, 20 bp, Artificial
  CRISPR gRNA sequence
ctgtaaattggtagtttgtt

SEQ ID NO: 697651 - DNA, 20 bp, Artificial
  CRISPR gRNA sequence
tgtaaattggtagtttgtta

SEQ ID NO: 697652 - DNA, 20 bp, Artificial
  CRISPR gRNA sequence
taaattggtagtttgttata

SEQ ID NO: 697653 - DNA, 20 bp, Artificial
  CRISPR gRNA sequence
gtagtttgttatagaggttt

SEQ ID NO: 697654 - DNA, 20 bp, Artificial
  CRISPR gRNA sequence
gttatagaggtttgcgtcta

SEQ ID NO: 697655 - DNA, 20 bp, Artificial
  CRISPR gRNA sequence
ttatagaggtttgcgtctat

SEQ ID NO: 697656 - DNA, 20 bp, Artificial
  CRISPR gRNA sequence
tagaggtttgcgtctattca

SEQ ID NO: 697657 - DNA, 20 bp, Artificial
  CRISPR gRNA sequence
gcgtctattcagggtttttt

SEQ ID NO: 697658 - DNA, 20 bp, Artificial
  CRISPR gRNA sequence
cgtctattcagggttttttt

SEQ ID NO: 697659 - DNA, 20 bp, Artificial
  CRISPR gRNA sequence
ttcagggttttttttttttt

SEQ ID NO: 697660 - DNA, 20 bp, Artificial
  CRISPR gRNA sequence
agggtttttttttttttttt

SEQ ID NO: 697661 - DNA, 20 bp, Artificial
  CRISPR gRNA sequence
tttttttttttttttttgcc

SEQ ID NO: 697662 - DNA, 20 bp, Artificial
  CRISPR gRNA sequence
ttttttttttttttttgcca

SEQ ID NO: 697663 - DNA, 20 bp, Artificial
  CRISPR gRNA sequence
tttttttttttttttgccat

SEQ ID NO: 697664 - DNA, 20 bp, Artificial
  CRISPR gRNA sequence
ttttttttttttttgccatg

SEQ ID NO: 697665 - DNA, 20 bp, Artificial
  CRISPR gRNA sequence
tttttttttttttgccatga

SEQ ID NO: 697666 - DNA, 20 bp, Artificial
  CRISPR gRNA sequence
ttttttttttttgccatgag

SEQ ID NO: 697667 - DNA, 20 bp, Artificial
  CRISPR gRNA sequence
tttttttttttgccatgagg

SEQ ID NO: 697668 - DNA, 20 bp, Artificial
  CRISPR gRNA sequence
ttttttttttgccatgagga

SEQ ID NO: 697669 - DNA, 20 bp, Artificial
  CRISPR gRNA sequence
tttttttttgccatgaggat

SEQ ID NO: 697670 - DNA, 20 bp, Artificial
  CRISPR gRNA sequence
ttttttttgccatgaggatt

SEQ ID NO: 697671 - DNA, 20 bp, Artificial
  CRISPR gRNA sequence
tttttttgccatgaggattg

SEQ ID NO: 697672 - DNA, 20 bp, Artificial
  CRISPR gRNA sequence
ttttttgccatgaggattga

SEQ ID NO: 697673 - DNA, 20 bp, Artificial
  CRISPR gRNA sequence
tttttgccatgaggattgat

SEQ ID NO: 697674 - DNA, 20 bp, Artificial
  CRISPR gRNA sequence
ttttgccatgaggattgatg

SEQ ID NO: 697675 - DNA, 20 bp, Artificial
  CRISPR gRNA sequence
tttgccatgaggattgatgg

SEQ ID NO: 697676 - DNA, 20 bp, Artificial
  CRISPR gRNA sequence
ttgccatgaggattgatggt

SEQ ID NO: 697677 - DNA, 20 bp, Artificial
  CRISPR gRNA sequence
tgccatgaggattgatggta

SEQ ID NO: 697678 - DNA, 20 bp, Artificial
  CRISPR gRNA sequence
gccatgaggattgatggtac

SEQ ID NO: 697679 - DNA, 20 bp, Artificial
  CRISPR gRNA sequence
ccatgaggattgatggtact

SEQ ID NO: 697680 - DNA, 20 bp, Artificial
  CRISPR gRNA sequence
atggtactatatcatgtttt

SEQ ID NO: 697681 - DNA, 20 bp, Artificial
  CRISPR gRNA sequence
tatcatgtttttcatcaaga

SEQ ID NO: 697682 - DNA, 20 bp, Artificial
  CRISPR gRNA sequence
ttcatcaagaggaagaattc

SEQ ID NO: 697683 - DNA, 20 bp, Artificial
  CRISPR gRNA sequence
tcatcaagaggaagaattca

SEQ ID NO: 697684 - DNA, 20 bp, Artificial
  CRISPR gRNA sequence
catcaagaggaagaattcaa

SEQ ID NO: 697685 - DNA, 20 bp, Artificial
  CRISPR gRNA sequence
atcaagaggaagaattcaat

SEQ ID NO: 697686 - DNA, 20 bp, Artificial
  CRISPR gRNA sequence
aatactagttatttcttttt

SEQ ID NO: 697687 - DNA, 20 bp, Artificial
  CRISPR gRNA sequence
gttatttcttttttgcgatg

SEQ ID NO: 697688 - DNA, 20 bp, Artificial
  CRISPR gRNA sequence
tttcttttttgcgatgttaa

SEQ ID NO: 697689 - DNA, 20 bp, Artificial
  CRISPR gRNA sequence
cttttttgcgatgttaattg

SEQ ID NO: 697690 - DNA, 20 bp, Artificial
  CRISPR gRNA sequence
ttttttgcgatgttaattgc

SEQ ID NO: 697691 - DNA, 20 bp, Artificial
  CRISPR gRNA sequence
ttttgcgatgttaattgcca

SEQ ID NO: 697692 - DNA, 20 bp, Artificial
  CRISPR gRNA sequence
tttgcgatgttaattgccat

SEQ ID NO: 697693 - DNA, 20 bp, Artificial
  CRISPR gRNA sequence
ttgcgatgttaattgccatt

SEQ ID NO: 697694 - DNA, 20 bp, Artificial
  CRISPR gRNA sequence
tgcgatgttaattgccattg

SEQ ID NO: 697695 - DNA, 20 bp, Artificial
  CRISPR gRNA sequence
gcgatgttaattgccattgc

SEQ ID NO: 697696 - DNA, 20 bp, Artificial
  CRISPR gRNA sequence
cgatgttaattgccattgct

SEQ ID NO: 697697 - DNA, 20 bp, Artificial
  CRISPR gRNA sequence
attgccattgctgttcagtg

SEQ ID NO: 697698 - DNA, 20 bp, Artificial
  CRISPR gRNA sequence
ccattgctgttcagtggcta

SEQ ID NO: 697699 - DNA, 20 bp, Artificial
  CRISPR gRNA sequence
ctgttcagtggctaaatctg

SEQ ID NO: 697700 - DNA, 20 bp, Artificial
  CRISPR gRNA sequence
ttcagtggctaaatctgtta

SEQ ID NO: 697701 - DNA, 20 bp, Artificial
  CRISPR gRNA sequence
agtggctaaatctgttaatt

SEQ ID NO: 697702 - DNA, 20 bp, Artificial
  CRISPR gRNA sequence
aatctgttaattcattacaa

SEQ ID NO: 697703 - DNA, 20 bp, Artificial
  CRISPR gRNA sequence
ttaattcattacaaattgca

SEQ ID NO: 697704 - DNA, 20 bp, Artificial
  CRISPR gRNA sequence
attcattacaaattgcaaaa

SEQ ID NO: 697705 - DNA, 20 bp, Artificial
  CRISPR gRNA sequence
attacaaattgcaaaagtct

SEQ ID NO: 697706 - DNA, 20 bp, Artificial
  CRISPR gRNA sequence
caaattgcaaaagtctcagt

SEQ ID NO: 697707 - DNA, 20 bp, Artificial
  CRISPR gRNA sequence
caaaagtctcagtctttcat

SEQ ID NO: 697708 - DNA, 20 bp, Artificial
  CRISPR gRNA sequence
agtctttcatttcttttcat

SEQ ID NO: 697709 - DNA, 20 bp, Artificial
  CRISPR gRNA sequence
tcatttcttttcatatgcta

SEQ ID NO: 697710 - DNA, 20 bp, Artificial
  CRISPR gRNA sequence
catttcttttcatatgctag

SEQ ID NO: 697711 - DNA, 20 bp, Artificial
  CRISPR gRNA sequence
atttcttttcatatgctagc

SEQ ID NO: 697712 - DNA, 20 bp, Artificial
  CRISPR gRNA sequence
cttttcatatgctagctgca

SEQ ID NO: 697713 - DNA, 20 bp, Artificial
  CRISPR gRNA sequence
ttttcatatgctagctgcat

SEQ ID NO: 697714 - DNA, 20 bp, Artificial
  CRISPR gRNA sequence
ttcatatgctagctgcataa

SEQ ID NO: 697715 - DNA, 20 bp, Artificial
  CRISPR gRNA sequence
tcatatgctagctgcataat

SEQ ID NO: 697716 - DNA, 20 bp, Artificial
  CRISPR gRNA sequence
catatgctagctgcataatt

SEQ ID NO: 697717 - DNA, 20 bp, Artificial
  CRISPR gRNA sequence
atatgctagctgcataattt

SEQ ID NO: 697718 - DNA, 20 bp, Artificial
  CRISPR gRNA sequence
gctgcataatttctaaaata

SEQ ID NO: 697719 - DNA, 20 bp, Artificial
  CRISPR gRNA sequence
cataatttctaaaataaaag

SEQ ID NO: 697720 - DNA, 20 bp, Artificial
  CRISPR gRNA sequence
ctaaaataaaagatttaccc

SEQ ID NO: 697721 - DNA, 20 bp, Artificial
  CRISPR gRNA sequence
taaaataaaagatttaccct

SEQ ID NO: 697722 - DNA, 20 bp, Artificial
  CRISPR gRNA sequence
aaataaaagatttaccctct

SEQ ID NO: 697723 - DNA, 20 bp, Artificial
  CRISPR gRNA sequence
accctcttccaccagttatc

SEQ ID NO: 697724 - DNA, 20 bp, Artificial
  CRISPR gRNA sequence
ccctcttccaccagttatct

SEQ ID NO: 697725 - DNA, 20 bp, Artificial
  CRISPR gRNA sequence
ttccaccagttatctattca

SEQ ID NO: 697726 - DNA, 20 bp, Artificial
  CRISPR gRNA sequence
ccaccagttatctattcagt

SEQ ID NO: 697727 - DNA, 20 bp, Artificial
  CRISPR gRNA sequence
caccagttatctattcagta

SEQ ID NO: 697728 - DNA, 20 bp, Artificial
  CRISPR gRNA sequence
tctattcagtagaaacttgt

SEQ ID NO: 697729 - DNA, 20 bp, Artificial
  CRISPR gRNA sequence
ttcagtagaaacttgttttt

SEQ ID NO: 697730 - DNA, 20 bp, Artificial
  CRISPR gRNA sequence
agtagaaacttgttttttga

SEQ ID NO: 697731 - DNA, 20 bp, Artificial
  CRISPR gRNA sequence
gttttttgagagactaaacc

SEQ ID NO: 697732 - DNA, 20 bp, Artificial
  CRISPR gRNA sequence
ttttttgagagactaaacca

SEQ ID NO: 697733 - DNA, 20 bp, Artificial
  CRISPR gRNA sequence
tttgagagactaaaccaagt

SEQ ID NO: 697734 - DNA, 20 bp, Artificial
  CRISPR gRNA sequence
ttgagagactaaaccaagtt

SEQ ID NO: 697735 - DNA, 20 bp, Artificial
  CRISPR gRNA sequence
tgagagactaaaccaagttt

SEQ ID NO: 697736 - DNA, 20 bp, Artificial
  CRISPR gRNA sequence
gagagactaaaccaagtttc

SEQ ID NO: 697737 - DNA, 20 bp, Artificial
  CRISPR gRNA sequence
agagactaaaccaagtttct

SEQ ID NO: 697738 - DNA, 20 bp, Artificial
  CRISPR gRNA sequence
aaccaagtttctaatcacct

SEQ ID NO: 697739 - DNA, 20 bp, Artificial
  CRISPR gRNA sequence
ctaatcacctatgacccagc

SEQ ID NO: 697740 - DNA, 20 bp, Artificial
  CRISPR gRNA sequence
taatcacctatgacccagca

SEQ ID NO: 697741 - DNA, 20 bp, Artificial
  CRISPR gRNA sequence
atcacctatgacccagcaat

SEQ ID NO: 697742 - DNA, 20 bp, Artificial
  CRISPR gRNA sequence
tgacccagcaattccacttt

SEQ ID NO: 697743 - DNA, 20 bp, Artificial
  CRISPR gRNA sequence
cactttttgttatataccaa

SEQ ID NO: 697744 - DNA, 20 bp, Artificial
  CRISPR gRNA sequence
tttgttatataccaatagaa

SEQ ID NO: 697745 - DNA, 20 bp, Artificial
  CRISPR gRNA sequence
ttgttatataccaatagaaa

SEQ ID NO: 697746 - DNA, 20 bp, Artificial
  CRISPR gRNA sequence
tgttatataccaatagaaat

SEQ ID NO: 697747 - DNA, 20 bp, Artificial
  CRISPR gRNA sequence
gttatataccaatagaaatg

SEQ ID NO: 697748 - DNA, 20 bp, Artificial
  CRISPR gRNA sequence
ttatataccaatagaaatgc

SEQ ID NO: 697749 - DNA, 20 bp, Artificial
  CRISPR gRNA sequence
tataccaatagaaatgcatg

SEQ ID NO: 697750 - DNA, 20 bp, Artificial
  CRISPR gRNA sequence
gtgtgccaaaatatatgaaa

SEQ ID NO: 697751 - DNA, 20 bp, Artificial
  CRISPR gRNA sequence
tgtgccaaaatatatgaaaa

SEQ ID NO: 697752 - DNA, 20 bp, Artificial
  CRISPR gRNA sequence
tttatagcagcacgatttgt

SEQ ID NO: 697753 - DNA, 20 bp, Artificial
  CRISPR gRNA sequence
atagcagcacgatttgtaga

SEQ ID NO: 697754 - DNA, 20 bp, Artificial
  CRISPR gRNA sequence
tagcagcacgatttgtagac

SEQ ID NO: 697755 - DNA, 20 bp, Artificial
  CRISPR gRNA sequence
gtagactctgaatacaacac

SEQ ID NO: 697756 - DNA, 20 bp, Artificial
  CRISPR gRNA sequence
tagactctgaatacaacaca

SEQ ID NO: 697757 - DNA, 20 bp, Artificial
  CRISPR gRNA sequence
tgaatacaacacaaatgtct

SEQ ID NO: 697758 - DNA, 20 bp, Artificial
  CRISPR gRNA sequence
aatacaacacaaatgtctat

SEQ ID NO: 697759 - DNA, 20 bp, Artificial
  CRISPR gRNA sequence
tcaacagtggagagacaaga

SEQ ID NO: 697760 - DNA, 20 bp, Artificial
  CRISPR gRNA sequence
tttataaagctgagcacctg

SEQ ID NO: 697761 - DNA, 20 bp, Artificial
  CRISPR gRNA sequence
ataaagctgagcacctgact

SEQ ID NO: 697762 - DNA, 20 bp, Artificial
  CRISPR gRNA sequence
taaagctgagcacctgactg

SEQ ID NO: 697763 - DNA, 20 bp, Artificial
  CRISPR gRNA sequence
agcacctgactgccgcggga

SEQ ID NO: 697764 - DNA, 20 bp, Artificial
  CRISPR gRNA sequence
actgccgcgggagtgaatag

SEQ ID NO: 697765 - DNA, 20 bp, Artificial
  CRISPR gRNA sequence
ccgcgggagtgaatagtgac

SEQ ID NO: 697766 - DNA, 20 bp, Artificial
  CRISPR gRNA sequence
ggacatggcagtgactgtgt

SEQ ID NO: 697767 - DNA, 20 bp, Artificial
  CRISPR gRNA sequence
tgtccagaactgacagaact

SEQ ID NO: 697768 - DNA, 20 bp, Artificial
  CRISPR gRNA sequence
acagaactaatctatcatat

SEQ ID NO: 697769 - DNA, 20 bp, Artificial
  CRISPR gRNA sequence
atctatcatattagaaatca

SEQ ID NO: 697770 - DNA, 20 bp, Artificial
  CRISPR gRNA sequence
tcatattagaaatcaagaaa

SEQ ID NO: 697771 - DNA, 20 bp, Artificial
  CRISPR gRNA sequence
gaaatcaagaaagtgtctgc

SEQ ID NO: 697772 - DNA, 20 bp, Artificial
  CRISPR gRNA sequence
ctctagggttggggagggtg

SEQ ID NO: 697773 - DNA, 20 bp, Artificial
  CRISPR gRNA sequence
tagggttggggagggtgatt

SEQ ID NO: 697774 - DNA, 20 bp, Artificial
  CRISPR gRNA sequence
gggttggggagggtgattta

SEQ ID NO: 697775 - DNA, 20 bp, Artificial
  CRISPR gRNA sequence
gggagggtgatttatgacca

SEQ ID NO: 697776 - DNA, 20 bp, Artificial
  CRISPR gRNA sequence
atgaccaagtagaacccagt

SEQ ID NO: 697777 - DNA, 20 bp, Artificial
  CRISPR gRNA sequence
tgaccaagtagaacccagtg

SEQ ID NO: 697778 - DNA, 20 bp, Artificial
  CRISPR gRNA sequence
cctggaggctggcaatgcta

SEQ ID NO: 697779 - DNA, 20 bp, Artificial
  CRISPR gRNA sequence
ctggaggctggcaatgctat

SEQ ID NO: 697780 - DNA, 20 bp, Artificial
  CRISPR gRNA sequence
gaggctggcaatgctattcc

SEQ ID NO: 697781 - DNA, 20 bp, Artificial
  CRISPR gRNA sequence
gcaatgctattccttgatgt

SEQ ID NO: 697782 - DNA, 20 bp, Artificial
  CRISPR gRNA sequence
ttccttgatgtggctgctat

SEQ ID NO: 697783 - DNA, 20 bp, Artificial
  CRISPR gRNA sequence
cttgatgtggctgctattta

SEQ ID NO: 697784 - DNA, 20 bp, Artificial
  CRISPR gRNA sequence
gatgtggctgctatttacct

SEQ ID NO: 697785 - DNA, 20 bp, Artificial
  CRISPR gRNA sequence
atgtggctgctatttacctg

SEQ ID NO: 697786 - DNA, 20 bp, Artificial
  CRISPR gRNA sequence
ctatttacctgagtgttcac

SEQ ID NO: 697787 - DNA, 20 bp, Artificial
  CRISPR gRNA sequence
tttacctgagtgttcacttt

SEQ ID NO: 697788 - DNA, 20 bp, Artificial
  CRISPR gRNA sequence
acctgagtgttcactttgtg

SEQ ID NO: 697789 - DNA, 20 bp, Artificial
  CRISPR gRNA sequence
cctgagtgttcactttgtga

SEQ ID NO: 697790 - DNA, 20 bp, Artificial
  CRISPR gRNA sequence
agtgttcactttgtgaaaat

SEQ ID NO: 697791 - DNA, 20 bp, Artificial
  CRISPR gRNA sequence
actttgtgaaaatccacggc

SEQ ID NO: 697792 - DNA, 20 bp, Artificial
  CRISPR gRNA sequence
tgtgaaaatccacggcccac

SEQ ID NO: 697793 - DNA, 20 bp, Artificial
  CRISPR gRNA sequence
gtgaaaatccacggcccact

SEQ ID NO: 697794 - DNA, 20 bp, Artificial
  CRISPR gRNA sequence
tgaaaatccacggcccactt

SEQ ID NO: 697795 - DNA, 20 bp, Artificial
  CRISPR gRNA sequence
atggtttgtccacctttctc

SEQ ID NO: 697796 - DNA, 20 bp, Artificial
  CRISPR gRNA sequence
tggtttgtccacctttctcc

SEQ ID NO: 697797 - DNA, 20 bp, Artificial
  CRISPR gRNA sequence
gtccacctttctccatgcat

SEQ ID NO: 697798 - DNA, 20 bp, Artificial
  CRISPR gRNA sequence
tccacctttctccatgcatg

SEQ ID NO: 697799 - DNA, 20 bp, Artificial
  CRISPR gRNA sequence
tctccatgcatgttgtcctt

SEQ ID NO: 697800 - DNA, 20 bp, Artificial
  CRISPR gRNA sequence
ctccatgcatgttgtccttc

SEQ ID NO: 697801 - DNA, 20 bp, Artificial
  CRISPR gRNA sequence
tccatgcatgttgtccttca

SEQ ID NO: 697802 - DNA, 20 bp, Artificial
  CRISPR gRNA sequence
catgcatgttgtccttcatt

SEQ ID NO: 697803 - DNA, 20 bp, Artificial
  CRISPR gRNA sequence
tccttcattcaagtatacat

SEQ ID NO: 697804 - DNA, 20 bp, Artificial
  CRISPR gRNA sequence
cattcaagtatacattactg

SEQ ID NO: 697805 - DNA, 20 bp, Artificial
  CRISPR gRNA sequence
attcaagtatacattactga

SEQ ID NO: 697806 - DNA, 20 bp, Artificial
  CRISPR gRNA sequence
aagtatacattactgatgtt

SEQ ID NO: 697807 - DNA, 20 bp, Artificial
  CRISPR gRNA sequence
ctgatgttttgaaacaattc

SEQ ID NO: 697808 - DNA, 20 bp, Artificial
  CRISPR gRNA sequence
atgttttgaaacaattctct

SEQ ID NO: 697809 - DNA, 20 bp, Artificial
  CRISPR gRNA sequence
tgaaacaattctctctaagc

SEQ ID NO: 697810 - DNA, 20 bp, Artificial
  CRISPR gRNA sequence
gaaacaattctctctaagct

SEQ ID NO: 697811 - DNA, 20 bp, Artificial
  CRISPR gRNA sequence
aaacaattctctctaagcta

SEQ ID NO: 697812 - DNA, 20 bp, Artificial
  CRISPR gRNA sequence
tctctaagctaatatagaat

SEQ ID NO: 697813 - DNA, 20 bp, Artificial
  CRISPR gRNA sequence
tctaagctaatatagaatct

SEQ ID NO: 697814 - DNA, 20 bp, Artificial
  CRISPR gRNA sequence
taagctaatatagaatctcc

SEQ ID NO: 697815 - DNA, 20 bp, Artificial
  CRISPR gRNA sequence
agctaatatagaatctccat

SEQ ID NO: 697816 - DNA, 20 bp, Artificial
  CRISPR gRNA sequence
atatagaatctccattactg

SEQ ID NO: 697817 - DNA, 20 bp, Artificial
  CRISPR gRNA sequence
cattactgaaagtccttaga

SEQ ID NO: 697818 - DNA, 20 bp, Artificial
  CRISPR gRNA sequence
ctgaaagtccttagaaatgc

SEQ ID NO: 697819 - DNA, 20 bp, Artificial
  CRISPR gRNA sequence
aaagtccttagaaatgctgc

SEQ ID NO: 697820 - DNA, 20 bp, Artificial
  CRISPR gRNA sequence
agaaatgctgcattggaaaa

SEQ ID NO: 697821 - DNA, 20 bp, Artificial
  CRISPR gRNA sequence
gaaatgctgcattggaaaaa

SEQ ID NO: 697822 - DNA, 20 bp, Artificial
  CRISPR gRNA sequence
cattggaaaaaattagtcca

SEQ ID NO: 697823 - DNA, 20 bp, Artificial
  CRISPR gRNA sequence
gaaaaaattagtccaattat

SEQ ID NO: 697824 - DNA, 20 bp, Artificial
  CRISPR gRNA sequence
gtccaattattaaaaatcta

SEQ ID NO: 697825 - DNA, 20 bp, Artificial
  CRISPR gRNA sequence
ttaaaaatctatgaaataaa

SEQ ID NO: 697826 - DNA, 20 bp, Artificial
  CRISPR gRNA sequence
aaaatctatgaaataaatgc

SEQ ID NO: 697827 - DNA, 20 bp, Artificial
  CRISPR gRNA sequence
tgaaataaatgctgtgactc

SEQ ID NO: 697828 - DNA, 20 bp, Artificial
  CRISPR gRNA sequence
tgactcagacattaagagga

SEQ ID NO: 697829 - DNA, 20 bp, Artificial
  CRISPR gRNA sequence
agacattaagaggagaatct

SEQ ID NO: 697830 - DNA, 20 bp, Artificial
  CRISPR gRNA sequence
agaggagaatctacaacaag

SEQ ID NO: 697831 - DNA, 20 bp, Artificial
  CRISPR gRNA sequence
caacaagagcagtaggcttg

SEQ ID NO: 697832 - DNA, 20 bp, Artificial
  CRISPR gRNA sequence
gggagctaacacaagaacag

SEQ ID NO: 697833 - DNA, 20 bp, Artificial
  CRISPR gRNA sequence
ggagctaacacaagaacagc

SEQ ID NO: 697834 - DNA, 20 bp, Artificial
  CRISPR gRNA sequence
acacaagaacagctttggaa

SEQ ID NO: 697835 - DNA, 20 bp, Artificial
  CRISPR gRNA sequence
tggaaatggctgttgagcca

SEQ ID NO: 697836 - DNA, 20 bp, Artificial
  CRISPR gRNA sequence
ggaaatggctgttgagccag

SEQ ID NO: 697837 - DNA, 20 bp, Artificial
  CRISPR gRNA sequence
gaaatggctgttgagccagg

SEQ ID NO: 697838 - DNA, 20 bp, Artificial
  CRISPR gRNA sequence
ttgagccaggaactaggaat

SEQ ID NO: 697839 - DNA, 20 bp, Artificial
  CRISPR gRNA sequence
agccaggaactaggaatcaa

SEQ ID NO: 697840 - DNA, 20 bp, Artificial
  CRISPR gRNA sequence
ggaatcaaaacccaaaaagg

SEQ ID NO: 697841 - DNA, 20 bp, Artificial
  CRISPR gRNA sequence
atgggttgcttggtcagtca

SEQ ID NO: 697842 - DNA, 20 bp, Artificial
  CRISPR gRNA sequence
cttggtcagtcaggaacttg

SEQ ID NO: 697843 - DNA, 20 bp, Artificial
  CRISPR gRNA sequence
ggtcagtcaggaacttgagc

SEQ ID NO: 697844 - DNA, 20 bp, Artificial
  CRISPR gRNA sequence
gtcagtcaggaacttgagca

SEQ ID NO: 697845 - DNA, 20 bp, Artificial
  CRISPR gRNA sequence
gagcaaaataaagttggaaa

SEQ ID NO: 697846 - DNA, 20 bp, Artificial
  CRISPR gRNA sequence
agcaaaataaagttggaaaa

SEQ ID NO: 697847 - DNA, 20 bp, Artificial
  CRISPR gRNA sequence
gaaaactgggggatggaaga

SEQ ID NO: 697848 - DNA, 20 bp, Artificial
  CRISPR gRNA sequence
ggggatggaagagagaggta

SEQ ID NO: 697849 - DNA, 20 bp, Artificial
  CRISPR gRNA sequence
ttgacatgggcagagcttca

SEQ ID NO: 697850 - DNA, 20 bp, Artificial
  CRISPR gRNA sequence
gacatgggcagagcttcaga

SEQ ID NO: 697851 - DNA, 20 bp, Artificial
  CRISPR gRNA sequence
acatgggcagagcttcagaa

SEQ ID NO: 697852 - DNA, 20 bp, Artificial
  CRISPR gRNA sequence
cagaagatggtggttgcagg

SEQ ID NO: 697853 - DNA, 20 bp, Artificial
  CRISPR gRNA sequence
agaagatggtggttgcaggt

SEQ ID NO: 697854 - DNA, 20 bp, Artificial
  CRISPR gRNA sequence
caggtttccccaaatagaga

SEQ ID NO: 697855 - DNA, 20 bp, Artificial
  CRISPR gRNA sequence
ccccaaatagagaacatcaa

SEQ ID NO: 697856 - DNA, 20 bp, Artificial
  CRISPR gRNA sequence
cccaaatagagaacatcaat

SEQ ID NO: 697857 - DNA, 20 bp, Artificial
  CRISPR gRNA sequence
tacaaagagaccagataaaa

SEQ ID NO: 697858 - DNA, 20 bp, Artificial
  CRISPR gRNA sequence
acaaagagaccagataaaaa

SEQ ID NO: 697859 - DNA, 20 bp, Artificial
  CRISPR gRNA sequence
caaagagaccagataaaaag

SEQ ID NO: 697860 - DNA, 20 bp, Artificial
  CRISPR gRNA sequence
ggagctgaaaagtgcaataa

SEQ ID NO: 697861 - DNA, 20 bp, Artificial
  CRISPR gRNA sequence
gagctgaaaagtgcaataac

SEQ ID NO: 697862 - DNA, 20 bp, Artificial
  CRISPR gRNA sequence
aaaagtgcaataactgaaat

SEQ ID NO: 697863 - DNA, 20 bp, Artificial
  CRISPR gRNA sequence
aaatgaaaaattcactagag

SEQ ID NO: 697864 - DNA, 20 bp, Artificial
  CRISPR gRNA sequence
actagaggggctccagagca

SEQ ID NO: 697865 - DNA, 20 bp, Artificial
  CRISPR gRNA sequence
gaggggctccagagcaaatt

SEQ ID NO: 697866 - DNA, 20 bp, Artificial
  CRISPR gRNA sequence
cagagcaaatttcaccatgc

SEQ ID NO: 697867 - DNA, 20 bp, Artificial
  CRISPR gRNA sequence
caccatgcagaatggagaat

SEQ ID NO: 697868 - DNA, 20 bp, Artificial
  CRISPR gRNA sequence
accatgcagaatggagaatc

SEQ ID NO: 697869 - DNA, 20 bp, Artificial
  CRISPR gRNA sequence
gaagataagacaattgaaat

SEQ ID NO: 697870 - DNA, 20 bp, Artificial
  CRISPR gRNA sequence
aagataagacaattgaaatt

SEQ ID NO: 697871 - DNA, 20 bp, Artificial
  CRISPR gRNA sequence
aaattctctagttcagtagc

SEQ ID NO: 697872 - DNA, 20 bp, Artificial
  CRISPR gRNA sequence
tctagttcagtagcagaaag

SEQ ID NO: 697873 - DNA, 20 bp, Artificial
  CRISPR gRNA sequence
tagttcagtagcagaaagaa

SEQ ID NO: 697874 - DNA, 20 bp, Artificial
  CRISPR gRNA sequence
gttcagtagcagaaagaaaa

SEQ ID NO: 697875 - DNA, 20 bp, Artificial
  CRISPR gRNA sequence
agtagcagaaagaaaaaaaa

SEQ ID NO: 697876 - DNA, 20 bp, Artificial
  CRISPR gRNA sequence
tgaagaaaaataaacagaac

SEQ ID NO: 697877 - DNA, 20 bp, Artificial
  CRISPR gRNA sequence
taaagatctgtgagacaaca

SEQ ID NO: 697878 - DNA, 20 bp, Artificial
  CRISPR gRNA sequence
aaagatctgtgagacaacat

SEQ ID NO: 697879 - DNA, 20 bp, Artificial
  CRISPR gRNA sequence
aagatctgtgagacaacatc

SEQ ID NO: 697880 - DNA, 20 bp, Artificial
  CRISPR gRNA sequence
tgagacaacatcaagcacat

SEQ ID NO: 697881 - DNA, 20 bp, Artificial
  CRISPR gRNA sequence
tgggagtcctcaaagaaagg

SEQ ID NO: 697882 - DNA, 20 bp, Artificial
  CRISPR gRNA sequence
gggagtcctcaaagaaagga

SEQ ID NO: 697883 - DNA, 20 bp, Artificial
  CRISPR gRNA sequence
ggagtcctcaaagaaaggag

SEQ ID NO: 697884 - DNA, 20 bp, Artificial
  CRISPR gRNA sequence
aaagaaaggagagagagaaa

SEQ ID NO: 697885 - DNA, 20 bp, Artificial
  CRISPR gRNA sequence
tttaaagaataactccaaac

SEQ ID NO: 697886 - DNA, 20 bp, Artificial
  CRISPR gRNA sequence
aaagaataactccaaacctt

SEQ ID NO: 697887 - DNA, 20 bp, Artificial
  CRISPR gRNA sequence
aagaataactccaaaccttc

SEQ ID NO: 697888 - DNA, 20 bp, Artificial
  CRISPR gRNA sequence
caaaccttccaaatttgatg

SEQ ID NO: 697889 - DNA, 20 bp, Artificial
  CRISPR gRNA sequence
ccaaatttgatgaaaaacat

SEQ ID NO: 697890 - DNA, 20 bp, Artificial
  CRISPR gRNA sequence
caaatttgatgaaaaacatt

SEQ ID NO: 697891 - DNA, 20 bp, Artificial
  CRISPR gRNA sequence
gatgaaaaacattattcatc

SEQ ID NO: 697892 - DNA, 20 bp, Artificial
  CRISPR gRNA sequence
atgaaaaacattattcatcc

SEQ ID NO: 697893 - DNA, 20 bp, Artificial
  CRISPR gRNA sequence
ttcatccaacaaacttgaca

SEQ ID NO: 697894 - DNA, 20 bp, Artificial
  CRISPR gRNA sequence
atccaacaaacttgacaaat

SEQ ID NO: 697895 - DNA, 20 bp, Artificial
  CRISPR gRNA sequence
gacaaattttaagcagcaaa

SEQ ID NO: 697896 - DNA, 20 bp, Artificial
  CRISPR gRNA sequence
acaaattttaagcagcaaaa

SEQ ID NO: 697897 - DNA, 20 bp, Artificial
  CRISPR gRNA sequence
taagcagcaaaaaaatttaa

SEQ ID NO: 697898 - DNA, 20 bp, Artificial
  CRISPR gRNA sequence
aagcagcaaaaaaatttaaa

SEQ ID NO: 697899 - DNA, 20 bp, Artificial
  CRISPR gRNA sequence
agcagcaaaaaaatttaaat

SEQ ID NO: 697900 - DNA, 20 bp, Artificial
  CRISPR gRNA sequence
aaatttaaagaggtccacac

SEQ ID NO: 697901 - DNA, 20 bp, Artificial
  CRISPR gRNA sequence
aatttaaagaggtccacacc

SEQ ID NO: 697902 - DNA, 20 bp, Artificial
  CRISPR gRNA sequence
aaagaggtccacaccaagag

SEQ ID NO: 697903 - DNA, 20 bp, Artificial
  CRISPR gRNA sequence
aagaggtccacaccaagaga

SEQ ID NO: 697904 - DNA, 20 bp, Artificial
  CRISPR gRNA sequence
taatcaacctgtcaaaagcc

SEQ ID NO: 697905 - DNA, 20 bp, Artificial
  CRISPR gRNA sequence
tcaaaagccaatgacaaaca

SEQ ID NO: 697906 - DNA, 20 bp, Artificial
  CRISPR gRNA sequence
aaatgaataacagagaagga

SEQ ID NO: 697907 - DNA, 20 bp, Artificial
  CRISPR gRNA sequence
ttcaggttcaatggatcctc

SEQ ID NO: 697908 - DNA, 20 bp, Artificial
  CRISPR gRNA sequence
tcaggttcaatggatcctca

SEQ ID NO: 697909 - DNA, 20 bp, Artificial
  CRISPR gRNA sequence
caggttcaatggatcctcaa

SEQ ID NO: 697910 - DNA, 20 bp, Artificial
  CRISPR gRNA sequence
aggttcaatggatcctcaat

SEQ ID NO: 697911 - DNA, 20 bp, Artificial
  CRISPR gRNA sequence
aatggatcctcaataagatt

SEQ ID NO: 697912 - DNA, 20 bp, Artificial
  CRISPR gRNA sequence
aataagattgcagcccagtt

SEQ ID NO: 697913 - DNA, 20 bp, Artificial
  CRISPR gRNA sequence
cagcccagttttcttcagaa

SEQ ID NO: 697914 - DNA, 20 bp, Artificial
  CRISPR gRNA sequence
tcttcagaaaccatagagtt

SEQ ID NO: 697915 - DNA, 20 bp, Artificial
  CRISPR gRNA sequence
cttcagaaaccatagagttc

SEQ ID NO: 697916 - DNA, 20 bp, Artificial
  CRISPR gRNA sequence
ttcagaaaccatagagttca

SEQ ID NO: 697917 - DNA, 20 bp, Artificial
  CRISPR gRNA sequence
cagaaaccatagagttcaga

SEQ ID NO: 697918 - DNA, 20 bp, Artificial
  CRISPR gRNA sequence
agaaaccatagagttcagaa

SEQ ID NO: 697919 - DNA, 20 bp, Artificial
  CRISPR gRNA sequence
agaaggcactggaatgttga

SEQ ID NO: 697920 - DNA, 20 bp, Artificial
  CRISPR gRNA sequence
gaatgttgacaaatttagag

SEQ ID NO: 697921 - DNA, 20 bp, Artificial
  CRISPR gRNA sequence
acaaatttagaggtcagaaa

SEQ ID NO: 697922 - DNA, 20 bp, Artificial
  CRISPR gRNA sequence
agaggtcagaaaaaaaaaga

SEQ ID NO: 697923 - DNA, 20 bp, Artificial
  CRISPR gRNA sequence
gaggtcagaaaaaaaaagac

SEQ ID NO: 697924 - DNA, 20 bp, Artificial
  CRISPR gRNA sequence
tcatgcaggaattgtgtgtc

SEQ ID NO: 697925 - DNA, 20 bp, Artificial
  CRISPR gRNA sequence
tgtgtctggaaaaactctcc

SEQ ID NO: 697926 - DNA, 20 bp, Artificial
  CRISPR gRNA sequence
gaaaaactctccttcagaaa

SEQ ID NO: 697927 - DNA, 20 bp, Artificial
  CRISPR gRNA sequence
tccttcagaaataatggatt

SEQ ID NO: 697928 - DNA, 20 bp, Artificial
  CRISPR gRNA sequence
cttcagaaataatggatttt

SEQ ID NO: 697929 - DNA, 20 bp, Artificial
  CRISPR gRNA sequence
cagaaataatggattttata

SEQ ID NO: 697930 - DNA, 20 bp, Artificial
  CRISPR gRNA sequence
agaaataatggattttatat

SEQ ID NO: 697931 - DNA, 20 bp, Artificial
  CRISPR gRNA sequence
tatatatatataaatatata

SEQ ID NO: 697932 - DNA, 20 bp, Artificial
  CRISPR gRNA sequence
atatatatataaatatatat

SEQ ID NO: 697933 - DNA, 20 bp, Artificial
  CRISPR gRNA sequence
tatatatataaatatatata

SEQ ID NO: 697934 - DNA, 20 bp, Artificial
  CRISPR gRNA sequence
tacatagtaccacatatata

SEQ ID NO: 697935 - DNA, 20 bp, Artificial
  CRISPR gRNA sequence
tatatagtactactatgaaa

SEQ ID NO: 697936 - DNA, 20 bp, Artificial
  CRISPR gRNA sequence
ctatgaaattatatatatag

SEQ ID NO: 697937 - DNA, 20 bp, Artificial
  CRISPR gRNA sequence
tgaaattatatatatagtac

SEQ ID NO: 697938 - DNA, 20 bp, Artificial
  CRISPR gRNA sequence
tatatatagtactatatata

SEQ ID NO: 697939 - DNA, 20 bp, Artificial
  CRISPR gRNA sequence
tatatagtagtcatactata

SEQ ID NO: 697940 - DNA, 20 bp, Artificial
  CRISPR gRNA sequence
taaaagctagtagtaatatg

SEQ ID NO: 697941 - DNA, 20 bp, Artificial
  CRISPR gRNA sequence
gtagtaatatgtatattttt

SEQ ID NO: 697942 - DNA, 20 bp, Artificial
  CRISPR gRNA sequence
ttggtgtttatatgtgtgtg

SEQ ID NO: 697943 - DNA, 20 bp, Artificial
  CRISPR gRNA sequence
tggtgtttatatgtgtgtgt

SEQ ID NO: 697944 - DNA, 20 bp, Artificial
  CRISPR gRNA sequence
ggtgtttatatgtgtgtgtg

SEQ ID NO: 697945 - DNA, 20 bp, Artificial
  CRISPR gRNA sequence
gtgtttatatgtgtgtgtgt

SEQ ID NO: 697946 - DNA, 20 bp, Artificial
  CRISPR gRNA sequence
atatgtgtgtgtgtgtgtgt

SEQ ID NO: 697947 - DNA, 20 bp, Artificial
  CRISPR gRNA sequence
tatgtgtgtgtgtgtgtgtg

SEQ ID NO: 697948 - DNA, 20 bp, Artificial
  CRISPR gRNA sequence
tatatagtagtcctataaaa

SEQ ID NO: 697949 - DNA, 20 bp, Artificial
  CRISPR gRNA sequence
taaaagctagtagtaacatg

SEQ ID NO: 697950 - DNA, 20 bp, Artificial
  CRISPR gRNA sequence
gtagtaacatgtatattttt

SEQ ID NO: 697951 - DNA, 20 bp, Artificial
  CRISPR gRNA sequence
ttggtgtttaattcttcctt

SEQ ID NO: 697952 - DNA, 20 bp, Artificial
  CRISPR gRNA sequence
tggtgtttaattcttccttt

SEQ ID NO: 697953 - DNA, 20 bp, Artificial
  CRISPR gRNA sequence
ggtgtttaattcttcctttg

SEQ ID NO: 697954 - DNA, 20 bp, Artificial
  CRISPR gRNA sequence
gtgtttaattcttcctttgt

SEQ ID NO: 697955 - DNA, 20 bp, Artificial
  CRISPR gRNA sequence
aattcttcctttgtttttcc

SEQ ID NO: 697956 - DNA, 20 bp, Artificial
  CRISPR gRNA sequence
attcttcctttgtttttcct

SEQ ID NO: 697957 - DNA, 20 bp, Artificial
  CRISPR gRNA sequence
ttcctttgtttttcctattt

SEQ ID NO: 697958 - DNA, 20 bp, Artificial
  CRISPR gRNA sequence
cctttgtttttcctatttgg

SEQ ID NO: 697959 - DNA, 20 bp, Artificial
  CRISPR gRNA sequence
ctttgtttttcctatttggt

SEQ ID NO: 697960 - DNA, 20 bp, Artificial
  CRISPR gRNA sequence
tgtttttcctatttggttta

SEQ ID NO: 697961 - DNA, 20 bp, Artificial
  CRISPR gRNA sequence
gtttttcctatttggtttaa

SEQ ID NO: 697962 - DNA, 20 bp, Artificial
  CRISPR gRNA sequence
tttttcctatttggtttaaa

SEQ ID NO: 697963 - DNA, 20 bp, Artificial
  CRISPR gRNA sequence
ttcctatttggtttaaaaga

SEQ ID NO: 697964 - DNA, 20 bp, Artificial
  CRISPR gRNA sequence
tcctatttggtttaaaagaa

SEQ ID NO: 697965 - DNA, 20 bp, Artificial
  CRISPR gRNA sequence
cctatttggtttaaaagaaa

SEQ ID NO: 697966 - DNA, 20 bp, Artificial
  CRISPR gRNA sequence
ctatttggtttaaaagaaaa

SEQ ID NO: 697967 - DNA, 20 bp, Artificial
  CRISPR gRNA sequence
tttggtttaaaagaaaatgc

SEQ ID NO: 697968 - DNA, 20 bp, Artificial
  CRISPR gRNA sequence
ggtttaaaagaaaatgccca

SEQ ID NO: 697969 - DNA, 20 bp, Artificial
  CRISPR gRNA sequence
gtttaaaagaaaatgcccat

SEQ ID NO: 697970 - DNA, 20 bp, Artificial
  CRISPR gRNA sequence
aaaagaaaatgcccattgac

SEQ ID NO: 697971 - DNA, 20 bp, Artificial
  CRISPR gRNA sequence
aaagaaaatgcccattgact

SEQ ID NO: 697972 - DNA, 20 bp, Artificial
  CRISPR gRNA sequence
actaatgaatgaataaacaa

SEQ ID NO: 697973 - DNA, 20 bp, Artificial
  CRISPR gRNA sequence
atgaatgaataaacaacatg

SEQ ID NO: 697974 - DNA, 20 bp, Artificial
  CRISPR gRNA sequence
ctacaatggaatatgattta

SEQ ID NO: 697975 - DNA, 20 bp, Artificial
  CRISPR gRNA sequence
tacaatggaatatgatttag

SEQ ID NO: 697976 - DNA, 20 bp, Artificial
  CRISPR gRNA sequence
caatggaatatgatttagcc

SEQ ID NO: 697977 - DNA, 20 bp, Artificial
  CRISPR gRNA sequence
agccataaaaggaatgaaat

SEQ ID NO: 697978 - DNA, 20 bp, Artificial
  CRISPR gRNA sequence
gccataaaaggaatgaaata

SEQ ID NO: 697979 - DNA, 20 bp, Artificial
  CRISPR gRNA sequence
atacatgctacaacattgct

SEQ ID NO: 697980 - DNA, 20 bp, Artificial
  CRISPR gRNA sequence
caacattgctgaatctcaaa

SEQ ID NO: 697981 - DNA, 20 bp, Artificial
  CRISPR gRNA sequence
ctgaatctcaaaaacatgat

SEQ ID NO: 697982 - DNA, 20 bp, Artificial
  CRISPR gRNA sequence
aatctcaaaaacatgataag

SEQ ID NO: 697983 - DNA, 20 bp, Artificial
  CRISPR gRNA sequence
aaaaacatgataagtgaagg

SEQ ID NO: 697984 - DNA, 20 bp, Artificial
  CRISPR gRNA sequence
catgaacccatctttgtgaa

SEQ ID NO: 697985 - DNA, 20 bp, Artificial
  CRISPR gRNA sequence
atgaacccatctttgtgaaa

SEQ ID NO: 697986 - DNA, 20 bp, Artificial
  CRISPR gRNA sequence
tgtgaaatcttcagaagaga

SEQ ID NO: 697987 - DNA, 20 bp, Artificial
  CRISPR gRNA sequence
gtgaaatcttcagaagagac

SEQ ID NO: 697988 - DNA, 20 bp, Artificial
  CRISPR gRNA sequence
tgaaatcttcagaagagacc

SEQ ID NO: 697989 - DNA, 20 bp, Artificial
  CRISPR gRNA sequence
cagaagagaccaatctatag

SEQ ID NO: 697990 - DNA, 20 bp, Artificial
  CRISPR gRNA sequence
agaagagaccaatctataga

SEQ ID NO: 697991 - DNA, 20 bp, Artificial
  CRISPR gRNA sequence
tagagaaagaaagcagactt

SEQ ID NO: 697992 - DNA, 20 bp, Artificial
  CRISPR gRNA sequence
gtggtgacagggtctggtgg

SEQ ID NO: 697993 - DNA, 20 bp, Artificial
  CRISPR gRNA sequence
tggtgacagggtctggtggc

SEQ ID NO: 697994 - DNA, 20 bp, Artificial
  CRISPR gRNA sequence
gtggcaggaggaaatggagg

SEQ ID NO: 697995 - DNA, 20 bp, Artificial
  CRISPR gRNA sequence
cttaatggtgcagagtttcc

SEQ ID NO: 697996 - DNA, 20 bp, Artificial
  CRISPR gRNA sequence
aatggtgcagagtttcccct

SEQ ID NO: 697997 - DNA, 20 bp, Artificial
  CRISPR gRNA sequence
atggtgcagagtttcccctg

SEQ ID NO: 697998 - DNA, 20 bp, Artificial
  CRISPR gRNA sequence
cccctgaggtgatgaaatac

SEQ ID NO: 697999 - DNA, 20 bp, Artificial
  CRISPR gRNA sequence
ccctgaggtgatgaaatact

SEQ ID NO: 698000 - DNA, 20 bp, Artificial
  CRISPR gRNA sequence
aggtgatgaaatactctgga

SEQ ID NO: 698001 - DNA, 20 bp, Artificial
  CRISPR gRNA sequence
tggaactagagagtgatgat

SEQ ID NO: 698002 - DNA, 20 bp, Artificial
  CRISPR gRNA sequence
gaactagagagtgatgatgg

SEQ ID NO: 698003 - DNA, 20 bp, Artificial
  CRISPR gRNA sequence
gagagtgatgatggctacat

SEQ ID NO: 698004 - DNA, 20 bp, Artificial
  CRISPR gRNA sequence
cataacattgtgaacctact

SEQ ID NO: 698005 - DNA, 20 bp, Artificial
  CRISPR gRNA sequence
tgaacctactaattgtcact

SEQ ID NO: 698006 - DNA, 20 bp, Artificial
  CRISPR gRNA sequence
ctaattgtcactgcattgta

SEQ ID NO: 698007 - DNA, 20 bp, Artificial
  CRISPR gRNA sequence
attgtcactgcattgtacac

SEQ ID NO: 698008 - DNA, 20 bp, Artificial
  CRISPR gRNA sequence
tcactgcattgtacacctat

SEQ ID NO: 698009 - DNA, 20 bp, Artificial
  CRISPR gRNA sequence
cattgtacacctattgtaca

SEQ ID NO: 698010 - DNA, 20 bp, Artificial
  CRISPR gRNA sequence
tacacctattgtacaatggg

SEQ ID NO: 698011 - DNA, 20 bp, Artificial
  CRISPR gRNA sequence
ttgtacaatgggtacagtgg

SEQ ID NO: 698012 - DNA, 20 bp, Artificial
  CRISPR gRNA sequence
tacaatgggtacagtggtaa

SEQ ID NO: 698013 - DNA, 20 bp, Artificial
  CRISPR gRNA sequence
tgtgttcatgtatattgtat

SEQ ID NO: 698014 - DNA, 20 bp, Artificial
  CRISPR gRNA sequence
gtgttcatgtatattgtatc

SEQ ID NO: 698015 - DNA, 20 bp, Artificial
  CRISPR gRNA sequence
tgttcatgtatattgtatca

SEQ ID NO: 698016 - DNA, 20 bp, Artificial
  CRISPR gRNA sequence
atgtatattgtatcacagta

SEQ ID NO: 698017 - DNA, 20 bp, Artificial
  CRISPR gRNA sequence
tatcacagtaaaaaagaggc

SEQ ID NO: 698018 - DNA, 20 bp, Artificial
  CRISPR gRNA sequence
aagaatagattccaaaatct

SEQ ID NO: 698019 - DNA, 20 bp, Artificial
  CRISPR gRNA sequence
caaaatcttttatatggtaa

SEQ ID NO: 698020 - DNA, 20 bp, Artificial
  CRISPR gRNA sequence
ttatatggtaaactcctgag

SEQ ID NO: 698021 - DNA, 20 bp, Artificial
  CRISPR gRNA sequence
tatatggtaaactcctgagt

SEQ ID NO: 698022 - DNA, 20 bp, Artificial
  CRISPR gRNA sequence
atatggtaaactcctgagtt

SEQ ID NO: 698023 - DNA, 20 bp, Artificial
  CRISPR gRNA sequence
tatggtaaactcctgagttt

SEQ ID NO: 698024 - DNA, 20 bp, Artificial
  CRISPR gRNA sequence
ctgagtttgcttgagcatct

SEQ ID NO: 698025 - DNA, 20 bp, Artificial
  CRISPR gRNA sequence
agtttgcttgagcatctgcc

SEQ ID NO: 698026 - DNA, 20 bp, Artificial
  CRISPR gRNA sequence
gcttgagcatctgcccatct

SEQ ID NO: 698027 - DNA, 20 bp, Artificial
  CRISPR gRNA sequence
cttgagcatctgcccatctg

SEQ ID NO: 698028 - DNA, 20 bp, Artificial
  CRISPR gRNA sequence
gagcatctgcccatctgtct

SEQ ID NO: 698029 - DNA, 20 bp, Artificial
  CRISPR gRNA sequence
agcatctgcccatctgtctt

SEQ ID NO: 698030 - DNA, 20 bp, Artificial
  CRISPR gRNA sequence
cccatctgtctttccccctc

SEQ ID NO: 698031 - DNA, 20 bp, Artificial
  CRISPR gRNA sequence
tctttccccctcaggatgtc

SEQ ID NO: 698032 - DNA, 20 bp, Artificial
  CRISPR gRNA sequence
tccccctcaggatgtcatct

SEQ ID NO: 698033 - DNA, 20 bp, Artificial
  CRISPR gRNA sequence
ccccctcaggatgtcatctc

SEQ ID NO: 698034 - DNA, 20 bp, Artificial
  CRISPR gRNA sequence
cccctcaggatgtcatctcc

SEQ ID NO: 698035 - DNA, 20 bp, Artificial
  CRISPR gRNA sequence
aggatgtcatctcctactca

SEQ ID NO: 698036 - DNA, 20 bp, Artificial
  CRISPR gRNA sequence
ctactcagagctcacccttg

SEQ ID NO: 698037 - DNA, 20 bp, Artificial
  CRISPR gRNA sequence
ctcagagctcacccttgttc

SEQ ID NO: 698038 - DNA, 20 bp, Artificial
  CRISPR gRNA sequence
agagctcacccttgttcttc

SEQ ID NO: 698039 - DNA, 20 bp, Artificial
  CRISPR gRNA sequence
acccttgttcttctgtaagt

SEQ ID NO: 698040 - DNA, 20 bp, Artificial
  CRISPR gRNA sequence
gttcttctgtaagtagaaag

SEQ ID NO: 698041 - DNA, 20 bp, Artificial
  CRISPR gRNA sequence
ttcttctgtaagtagaaagc

SEQ ID NO: 698042 - DNA, 20 bp, Artificial
  CRISPR gRNA sequence
ttctgtaagtagaaagcctt

SEQ ID NO: 698043 - DNA, 20 bp, Artificial
  CRISPR gRNA sequence
ctgtaagtagaaagcctttc

SEQ ID NO: 698044 - DNA, 20 bp, Artificial
  CRISPR gRNA sequence
tgtaagtagaaagcctttct

SEQ ID NO: 698045 - DNA, 20 bp, Artificial
  CRISPR gRNA sequence
taagtagaaagcctttcttc

SEQ ID NO: 698046 - DNA, 20 bp, Artificial
  CRISPR gRNA sequence
tcttcacaacactcccagat

SEQ ID NO: 698047 - DNA, 20 bp, Artificial
  CRISPR gRNA sequence
cttcacaacactcccagatc

SEQ ID NO: 698048 - DNA, 20 bp, Artificial
  CRISPR gRNA sequence
ttcacaacactcccagatca

SEQ ID NO: 698049 - DNA, 20 bp, Artificial
  CRISPR gRNA sequence
cacaacactcccagatcagc

SEQ ID NO: 698050 - DNA, 20 bp, Artificial
  CRISPR gRNA sequence
acaacactcccagatcagcc

SEQ ID NO: 698051 - DNA, 20 bp, Artificial
  CRISPR gRNA sequence
ccagatcagccagacccaac

SEQ ID NO: 698052 - DNA, 20 bp, Artificial
  CRISPR gRNA sequence
tctgtcttggatccaaatgc

SEQ ID NO: 698053 - DNA, 20 bp, Artificial
  CRISPR gRNA sequence
ctgtcttggatccaaatgct

SEQ ID NO: 698054 - DNA, 20 bp, Artificial
  CRISPR gRNA sequence
tgtcttggatccaaatgctc

SEQ ID NO: 698055 - DNA, 20 bp, Artificial
  CRISPR gRNA sequence
tcttggatccaaatgctcac

SEQ ID NO: 698056 - DNA, 20 bp, Artificial
  CRISPR gRNA sequence
ggatccaaatgctcacgtgc

SEQ ID NO: 698057 - DNA, 20 bp, Artificial
  CRISPR gRNA sequence
gatccaaatgctcacgtgca

SEQ ID NO: 698058 - DNA, 20 bp, Artificial
  CRISPR gRNA sequence
acgtgcaactctggggcaat

SEQ ID NO: 698059 - DNA, 20 bp, Artificial
  CRISPR gRNA sequence
tggggcaatttcagtgggag

SEQ ID NO: 698060 - DNA, 20 bp, Artificial
  CRISPR gRNA sequence
gggcaatttcagtgggagtg

SEQ ID NO: 698061 - DNA, 20 bp, Artificial
  CRISPR gRNA sequence
cagtgggagtgaagagatta

SEQ ID NO: 698062 - DNA, 20 bp, Artificial
  CRISPR gRNA sequence
agtgggagtgaagagattat

SEQ ID NO: 698063 - DNA, 20 bp, Artificial
  CRISPR gRNA sequence
tccaactaggatgattcatt

SEQ ID NO: 698064 - DNA, 20 bp, Artificial
  CRISPR gRNA sequence
ggatgattcatttggaggga

SEQ ID NO: 698065 - DNA, 20 bp, Artificial
  CRISPR gRNA sequence
atttggagggaaatgtttga

SEQ ID NO: 698066 - DNA, 20 bp, Artificial
  CRISPR gRNA sequence
ggagggaaatgtttgacctt

SEQ ID NO: 698067 - DNA, 20 bp, Artificial
  CRISPR gRNA sequence
gagggaaatgtttgacctta

SEQ ID NO: 698068 - DNA, 20 bp, Artificial
  CRISPR gRNA sequence
gaccttatgttaggaaagtc

SEQ ID NO: 698069 - DNA, 20 bp, Artificial
  CRISPR gRNA sequence
accttatgttaggaaagtca

SEQ ID NO: 698070 - DNA, 20 bp, Artificial
  CRISPR gRNA sequence
atgttaggaaagtcatttgc

SEQ ID NO: 698071 - DNA, 20 bp, Artificial
  CRISPR gRNA sequence
tgttaggaaagtcatttgct

SEQ ID NO: 698072 - DNA, 20 bp, Artificial
  CRISPR gRNA sequence
ggaaagtcatttgctttcct

SEQ ID NO: 698073 - DNA, 20 bp, Artificial
  CRISPR gRNA sequence
gctttcctaaaaaggatcct

SEQ ID NO: 698074 - DNA, 20 bp, Artificial
  CRISPR gRNA sequence
ctttcctaaaaaggatcctg

SEQ ID NO: 698075 - DNA, 20 bp, Artificial
  CRISPR gRNA sequence
tcctaaaaaggatcctgctt

SEQ ID NO: 698076 - DNA, 20 bp, Artificial
  CRISPR gRNA sequence
cctaaaaaggatcctgctta

SEQ ID NO: 698077 - DNA, 20 bp, Artificial
  CRISPR gRNA sequence
ctaaaaaggatcctgcttac

SEQ ID NO: 698078 - DNA, 20 bp, Artificial
  CRISPR gRNA sequence
aaaaggatcctgcttaccag

SEQ ID NO: 698079 - DNA, 20 bp, Artificial
  CRISPR gRNA sequence
cttaccagtgagtatataat

SEQ ID NO: 698080 - DNA, 20 bp, Artificial
  CRISPR gRNA sequence
accagtgagtatataatttt

SEQ ID NO: 698081 - DNA, 20 bp, Artificial
  CRISPR gRNA sequence
ccagtgagtatataattttt

SEQ ID NO: 698082 - DNA, 20 bp, Artificial
  CRISPR gRNA sequence
ttgtatgcccggggtggagt

SEQ ID NO: 698083 - DNA, 20 bp, Artificial
  CRISPR gRNA sequence
tgtatgcccggggtggagtt

SEQ ID NO: 698084 - DNA, 20 bp, Artificial
  CRISPR gRNA sequence
gtatgcccggggtggagttc

SEQ ID NO: 698085 - DNA, 20 bp, Artificial
  CRISPR gRNA sequence
tatgcccggggtggagttca

SEQ ID NO: 698086 - DNA, 20 bp, Artificial
  CRISPR gRNA sequence
acagcagaggaactaacaat

SEQ ID NO: 698087 - DNA, 20 bp, Artificial
  CRISPR gRNA sequence
acaatagctctaggaacacc

SEQ ID NO: 698088 - DNA, 20 bp, Artificial
  CRISPR gRNA sequence
taggaacaccatacacctca

SEQ ID NO: 698089 - DNA, 20 bp, Artificial
  CRISPR gRNA sequence
ggaacaccatacacctcatg

SEQ ID NO: 698090 - DNA, 20 bp, Artificial
  CRISPR gRNA sequence
atgcgtagctgactcaccca

SEQ ID NO: 698091 - DNA, 20 bp, Artificial
  CRISPR gRNA sequence
actcacccatctgcctcccc

SEQ ID NO: 698092 - DNA, 20 bp, Artificial
  CRISPR gRNA sequence
acccatctgcctcccccagc

SEQ ID NO: 698093 - DNA, 20 bp, Artificial
  CRISPR gRNA sequence
cctcccccagctgaaggaag

SEQ ID NO: 698094 - DNA, 20 bp, Artificial
  CRISPR gRNA sequence
ccccagctgaaggaaggagc

SEQ ID NO: 698095 - DNA, 20 bp, Artificial
  CRISPR gRNA sequence
aaggaaggagctggattatt

SEQ ID NO: 698096 - DNA, 20 bp, Artificial
  CRISPR gRNA sequence
gattattaccttggcccatc

SEQ ID NO: 698097 - DNA, 20 bp, Artificial
  CRISPR gRNA sequence
ttaccttggcccatccatca

SEQ ID NO: 698098 - DNA, 20 bp, Artificial
  CRISPR gRNA sequence
ccttggcccatccatcaact

SEQ ID NO: 698099 - DNA, 20 bp, Artificial
  CRISPR gRNA sequence
ggcccatccatcaactgcat

SEQ ID NO: 698100 - DNA, 20 bp, Artificial
  CRISPR gRNA sequence
gcccatccatcaactgcatt

SEQ ID NO: 698101 - DNA, 20 bp, Artificial
  CRISPR gRNA sequence
catttcactggatgtgcacc

SEQ ID NO: 698102 - DNA, 20 bp, Artificial
  CRISPR gRNA sequence
cactggatgtgcaccctcta

SEQ ID NO: 698103 - DNA, 20 bp, Artificial
  CRISPR gRNA sequence
actggatgtgcaccctctac

SEQ ID NO: 698104 - DNA, 20 bp, Artificial
  CRISPR gRNA sequence
gatgtgcaccctctacaagt

SEQ ID NO: 698105 - DNA, 20 bp, Artificial
  CRISPR gRNA sequence
tacaagtgtgaaccttccag

SEQ ID NO: 698106 - DNA, 20 bp, Artificial
  CRISPR gRNA sequence
caagtgtgaaccttccaggg

SEQ ID NO: 698107 - DNA, 20 bp, Artificial
  CRISPR gRNA sequence
ccagggttctcagttgctct

SEQ ID NO: 698108 - DNA, 20 bp, Artificial
  CRISPR gRNA sequence
cagggttctcagttgctctt

SEQ ID NO: 698109 - DNA, 20 bp, Artificial
  CRISPR gRNA sequence
tcagttgctcttcctgctgt

SEQ ID NO: 698110 - DNA, 20 bp, Artificial
  CRISPR gRNA sequence
agttgctcttcctgctgttg

SEQ ID NO: 698111 - DNA, 20 bp, Artificial
  CRISPR gRNA sequence
ctcttcctgctgttgtgtgg

SEQ ID NO: 698112 - DNA, 20 bp, Artificial
  CRISPR gRNA sequence
ttcctgctgttgtgtggcct

SEQ ID NO: 698113 - DNA, 20 bp, Artificial
  CRISPR gRNA sequence
cctgctgttgtgtggcctcc

SEQ ID NO: 698114 - DNA, 20 bp, Artificial
  CRISPR gRNA sequence
ctgctgttgtgtggcctcca

SEQ ID NO: 698115 - DNA, 20 bp, Artificial
  CRISPR gRNA sequence
ctgttgtgtggcctccactg

SEQ ID NO: 698116 - DNA, 20 bp, Artificial
  CRISPR gRNA sequence
ttgtgtggcctccactggtg

SEQ ID NO: 698117 - DNA, 20 bp, Artificial
  CRISPR gRNA sequence
tgtggcctccactggtgtgg

SEQ ID NO: 698118 - DNA, 20 bp, Artificial
  CRISPR gRNA sequence
cactggtgtggctcatgccc

SEQ ID NO: 698119 - DNA, 20 bp, Artificial
  CRISPR gRNA sequence
gtgtggctcatgcccagggg

SEQ ID NO: 698120 - DNA, 20 bp, Artificial
  CRISPR gRNA sequence
atgcccagggggcctgcagg

SEQ ID NO: 698121 - DNA, 20 bp, Artificial
  CRISPR gRNA sequence
caggagactgagtgtctcct

SEQ ID NO: 698122 - DNA, 20 bp, Artificial
  CRISPR gRNA sequence
agtgtctcctaattctcaag

SEQ ID NO: 698123 - DNA, 20 bp, Artificial
  CRISPR gRNA sequence
ctaattctcaaggccaacat

SEQ ID NO: 698124 - DNA, 20 bp, Artificial
  CRISPR gRNA sequence
attctcaaggccaacatttt

SEQ ID NO: 698125 - DNA, 20 bp, Artificial
  CRISPR gRNA sequence
tcaaggccaacattttcagt

SEQ ID NO: 698126 - DNA, 20 bp, Artificial
  CRISPR gRNA sequence
aaggccaacattttcagtga

SEQ ID NO: 698127 - DNA, 20 bp, Artificial
  CRISPR gRNA sequence
tcagtgagctcaaatgaaga

SEQ ID NO: 698128 - DNA, 20 bp, Artificial
  CRISPR gRNA sequence
cagtgagctcaaatgaagat

SEQ ID NO: 698129 - DNA, 20 bp, Artificial
  CRISPR gRNA sequence
agtgagctcaaatgaagatt

SEQ ID NO: 698130 - DNA, 20 bp, Artificial
  CRISPR gRNA sequence
aaatgaagattttatgttct

SEQ ID NO: 698131 - DNA, 20 bp, Artificial
  CRISPR gRNA sequence
tatgttctcagggactcata

SEQ ID NO: 698132 - DNA, 20 bp, Artificial
  CRISPR gRNA sequence
atgttctcagggactcatat

SEQ ID NO: 698133 - DNA, 20 bp, Artificial
  CRISPR gRNA sequence
tgttctcagggactcatatt

SEQ ID NO: 698134 - DNA, 20 bp, Artificial
  CRISPR gRNA sequence
tcagggactcatattttcat

SEQ ID NO: 698135 - DNA, 20 bp, Artificial
  CRISPR gRNA sequence
agggactcatattttcatct

SEQ ID NO: 698136 - DNA, 20 bp, Artificial
  CRISPR gRNA sequence
atattttcatctgtggaagg

SEQ ID NO: 698137 - DNA, 20 bp, Artificial
  CRISPR gRNA sequence
tcatctgtggaagggaaaaa

SEQ ID NO: 698138 - DNA, 20 bp, Artificial
  CRISPR gRNA sequence
catctgtggaagggaaaaat

SEQ ID NO: 698139 - DNA, 20 bp, Artificial
  CRISPR gRNA sequence
atctgtggaagggaaaaatc

SEQ ID NO: 698140 - DNA, 20 bp, Artificial
  CRISPR gRNA sequence
tggaagggaaaaatccatct

SEQ ID NO: 698141 - DNA, 20 bp, Artificial
  CRISPR gRNA sequence
gctgtcttaggtgtgatggt

SEQ ID NO: 698142 - DNA, 20 bp, Artificial
  CRISPR gRNA sequence
tcttaggtgtgatggtaatt

SEQ ID NO: 698143 - DNA, 20 bp, Artificial
  CRISPR gRNA sequence
aggtgtgatggtaattttac

SEQ ID NO: 698144 - DNA, 20 bp, Artificial
  CRISPR gRNA sequence
ggtgtgatggtaattttaca

SEQ ID NO: 698145 - DNA, 20 bp, Artificial
  CRISPR gRNA sequence
tacataaatatatatatata

SEQ ID NO: 698146 - DNA, 20 bp, Artificial
  CRISPR gRNA sequence
acataaatatatatatataa

SEQ ID NO: 698147 - DNA, 20 bp, Artificial
  CRISPR gRNA sequence
cataaatatatatatataat

SEQ ID NO: 698148 - DNA, 20 bp, Artificial
  CRISPR gRNA sequence
tagtatttttatgtctataa

SEQ ID NO: 698149 - DNA, 20 bp, Artificial
  CRISPR gRNA sequence
ttatgtctataaatgagata

SEQ ID NO: 698150 - DNA, 20 bp, Artificial
  CRISPR gRNA sequence
tatgtctataaatgagataa

SEQ ID NO: 698151 - DNA, 20 bp, Artificial
  CRISPR gRNA sequence
atgtctataaatgagataat

SEQ ID NO: 698152 - DNA, 20 bp, Artificial
  CRISPR gRNA sequence
tgtctataaatgagataatc

SEQ ID NO: 698153 - DNA, 20 bp, Artificial
  CRISPR gRNA sequence
taaatgagataatcagtatt

SEQ ID NO: 698154 - DNA, 20 bp, Artificial
  CRISPR gRNA sequence
tataaattgatggtattctt

SEQ ID NO: 698155 - DNA, 20 bp, Artificial
  CRISPR gRNA sequence
ataaattgatggtattctta

SEQ ID NO: 698156 - DNA, 20 bp, Artificial
  CRISPR gRNA sequence
taaattgatggtattcttag

SEQ ID NO: 698157 - DNA, 20 bp, Artificial
  CRISPR gRNA sequence
atggtattcttagcattgac

SEQ ID NO: 698158 - DNA, 20 bp, Artificial
  CRISPR gRNA sequence
ttagcattgacttcattgct

SEQ ID NO: 698159 - DNA, 20 bp, Artificial
  CRISPR gRNA sequence
agcattgacttcattgctca

SEQ ID NO: 698160 - DNA, 20 bp, Artificial
  CRISPR gRNA sequence
gcattgacttcattgctcag

SEQ ID NO: 698161 - DNA, 20 bp, Artificial
  CRISPR gRNA sequence
acttcattgctcagctaaat

SEQ ID NO: 698162 - DNA, 20 bp, Artificial
  CRISPR gRNA sequence
cattgctcagctaaatgctg

SEQ ID NO: 698163 - DNA, 20 bp, Artificial
  CRISPR gRNA sequence
attgctcagctaaatgctgt

SEQ ID NO: 698164 - DNA, 20 bp, Artificial
  CRISPR gRNA sequence
ctcagctaaatgctgtaacc

SEQ ID NO: 698165 - DNA, 20 bp, Artificial
  CRISPR gRNA sequence
agctaaatgctgtaaccaaa

SEQ ID NO: 698166 - DNA, 20 bp, Artificial
  CRISPR gRNA sequence
aatgctgtaaccaaaggatg

SEQ ID NO: 698167 - DNA, 20 bp, Artificial
  CRISPR gRNA sequence
taaccaaaggatgagtcatg

SEQ ID NO: 698168 - DNA, 20 bp, Artificial
  CRISPR gRNA sequence
ttctactctctggaggtgcc

SEQ ID NO: 698169 - DNA, 20 bp, Artificial
  CRISPR gRNA sequence
tctactctctggaggtgcca

SEQ ID NO: 698170 - DNA, 20 bp, Artificial
  CRISPR gRNA sequence
ctactctctggaggtgccat

SEQ ID NO: 698171 - DNA, 20 bp, Artificial
  CRISPR gRNA sequence
tactctctggaggtgccata

SEQ ID NO: 698172 - DNA, 20 bp, Artificial
  CRISPR gRNA sequence
ctctctggaggtgccataat

SEQ ID NO: 698173 - DNA, 20 bp, Artificial
  CRISPR gRNA sequence
tctggaggtgccataatcgg

SEQ ID NO: 698174 - DNA, 20 bp, Artificial
  CRISPR gRNA sequence
tggaggtgccataatcggca

SEQ ID NO: 698175 - DNA, 20 bp, Artificial
  CRISPR gRNA sequence
gaggtgccataatcggcatt

SEQ ID NO: 698176 - DNA, 20 bp, Artificial
  CRISPR gRNA sequence
ctgccctatggatttcaaat

SEQ ID NO: 698177 - DNA, 20 bp, Artificial
  CRISPR gRNA sequence
tgccctatggatttcaaatg

SEQ ID NO: 698178 - DNA, 20 bp, Artificial
  CRISPR gRNA sequence
ccctatggatttcaaatgag

SEQ ID NO: 698179 - DNA, 20 bp, Artificial
  CRISPR gRNA sequence
tggatttcaaatgagaaatt

SEQ ID NO: 698180 - DNA, 20 bp, Artificial
  CRISPR gRNA sequence
caaatgagaaatttgcttta

SEQ ID NO: 698181 - DNA, 20 bp, Artificial
  CRISPR gRNA sequence
aaatgagaaatttgctttag

SEQ ID NO: 698182 - DNA, 20 bp, Artificial
  CRISPR gRNA sequence
gctttaggctgaggttggaa

SEQ ID NO: 698183 - DNA, 20 bp, Artificial
  CRISPR gRNA sequence
ctttaggctgaggttggaag

SEQ ID NO: 698184 - DNA, 20 bp, Artificial
  CRISPR gRNA sequence
taggctgaggttggaaggag

SEQ ID NO: 698185 - DNA, 20 bp, Artificial
  CRISPR gRNA sequence
aggctgaggttggaaggaga

SEQ ID NO: 698186 - DNA, 20 bp, Artificial
  CRISPR gRNA sequence
ggctgaggttggaaggagat

SEQ ID NO: 698187 - DNA, 20 bp, Artificial
  CRISPR gRNA sequence
aggttggaaggagatctgaa

SEQ ID NO: 698188 - DNA, 20 bp, Artificial
  CRISPR gRNA sequence
gaaggagatctgaacttctt

SEQ ID NO: 698189 - DNA, 20 bp, Artificial
  CRISPR gRNA sequence
aacttctttgtattactatt

SEQ ID NO: 698190 - DNA, 20 bp, Artificial
  CRISPR gRNA sequence
ctttgtattactattatttt

SEQ ID NO: 698191 - DNA, 20 bp, Artificial
  CRISPR gRNA sequence
tttgtattactattatttta

SEQ ID NO: 698192 - DNA, 20 bp, Artificial
  CRISPR gRNA sequence
tgtattactattattttaga

SEQ ID NO: 698193 - DNA, 20 bp, Artificial
  CRISPR gRNA sequence
gtattactattattttagat

SEQ ID NO: 698194 - DNA, 20 bp, Artificial
  CRISPR gRNA sequence
tattactattattttagatg

SEQ ID NO: 698195 - DNA, 20 bp, Artificial
  CRISPR gRNA sequence
ctattattttagatggggtc

SEQ ID NO: 698196 - DNA, 20 bp, Artificial
  CRISPR gRNA sequence
ttattttagatggggtcttg

SEQ ID NO: 698197 - DNA, 20 bp, Artificial
  CRISPR gRNA sequence
ttttagatggggtcttgcta

SEQ ID NO: 698198 - DNA, 20 bp, Artificial
  CRISPR gRNA sequence
tagatggggtcttgctatgt

SEQ ID NO: 698199 - DNA, 20 bp, Artificial
  CRISPR gRNA sequence
agatggggtcttgctatgtt

SEQ ID NO: 698200 - DNA, 20 bp, Artificial
  CRISPR gRNA sequence
gatggggtcttgctatgttg

SEQ ID NO: 698201 - DNA, 20 bp, Artificial
  CRISPR gRNA sequence
gctatgttgtccaagctgga

SEQ ID NO: 698202 - DNA, 20 bp, Artificial
  CRISPR gRNA sequence
ctatgttgtccaagctggag

SEQ ID NO: 698203 - DNA, 20 bp, Artificial
  CRISPR gRNA sequence
tgttgtccaagctggagaga

SEQ ID NO: 698204 - DNA, 20 bp, Artificial
  CRISPR gRNA sequence
tccaagctggagagaagtga

SEQ ID NO: 698205 - DNA, 20 bp, Artificial
  CRISPR gRNA sequence
gagagaagtgactattcaca

SEQ ID NO: 698206 - DNA, 20 bp, Artificial
  CRISPR gRNA sequence
ttcacaggtgtgataatagc

SEQ ID NO: 698207 - DNA, 20 bp, Artificial
  CRISPR gRNA sequence
acaggtgtgataatagcaca

SEQ ID NO: 698208 - DNA, 20 bp, Artificial
  CRISPR gRNA sequence
aaaatcctgggctcaagtgg

SEQ ID NO: 698209 - DNA, 20 bp, Artificial
  CRISPR gRNA sequence
ggctcaagtggttctcccat

SEQ ID NO: 698210 - DNA, 20 bp, Artificial
  CRISPR gRNA sequence
aagtggttctcccatctcag

SEQ ID NO: 698211 - DNA, 20 bp, Artificial
  CRISPR gRNA sequence
tcccatctcagcctcctgag

SEQ ID NO: 698212 - DNA, 20 bp, Artificial
  CRISPR gRNA sequence
ccatctcagcctcctgagta

SEQ ID NO: 698213 - DNA, 20 bp, Artificial
  CRISPR gRNA sequence
agcctcctgagtagctggga

SEQ ID NO: 698214 - DNA, 20 bp, Artificial
  CRISPR gRNA sequence
ctgagtagctgggactacag

SEQ ID NO: 698215 - DNA, 20 bp, Artificial
  CRISPR gRNA sequence
agtagctgggactacaggtg

SEQ ID NO: 698216 - DNA, 20 bp, Artificial
  CRISPR gRNA sequence
ggactacaggtgtgcactca

SEQ ID NO: 698217 - DNA, 20 bp, Artificial
  CRISPR gRNA sequence
caggtgtgcactcagccact

SEQ ID NO: 698218 - DNA, 20 bp, Artificial
  CRISPR gRNA sequence
agccacttttcattgttatt

SEQ ID NO: 698219 - DNA, 20 bp, Artificial
  CRISPR gRNA sequence
ttcattgttattttacttca

SEQ ID NO: 698220 - DNA, 20 bp, Artificial
  CRISPR gRNA sequence
tcattgttattttacttcaa

SEQ ID NO: 698221 - DNA, 20 bp, Artificial
  CRISPR gRNA sequence
cattgttattttacttcaaa

SEQ ID NO: 698222 - DNA, 20 bp, Artificial
  CRISPR gRNA sequence
attgttattttacttcaaat

SEQ ID NO: 698223 - DNA, 20 bp, Artificial
  CRISPR gRNA sequence
ttattttacttcaaatgctt

SEQ ID NO: 698224 - DNA, 20 bp, Artificial
  CRISPR gRNA sequence
ttttacttcaaatgctttat

SEQ ID NO: 698225 - DNA, 20 bp, Artificial
  CRISPR gRNA sequence
tacttcaaatgctttatttt

SEQ ID NO: 698226 - DNA, 20 bp, Artificial
  CRISPR gRNA sequence
acttcaaatgctttattttg

SEQ ID NO: 698227 - DNA, 20 bp, Artificial
  CRISPR gRNA sequence
cttcaaatgctttattttga

SEQ ID NO: 698228 - DNA, 20 bp, Artificial
  CRISPR gRNA sequence
caaatgctttattttgaata

SEQ ID NO: 698229 - DNA, 20 bp, Artificial
  CRISPR gRNA sequence
aaatgctttattttgaatat

SEQ ID NO: 698230 - DNA, 20 bp, Artificial
  CRISPR gRNA sequence
tattttgaatattagaaatg

SEQ ID NO: 698231 - DNA, 20 bp, Artificial
  CRISPR gRNA sequence
attttgaatattagaaatgt

SEQ ID NO: 698232 - DNA, 20 bp, Artificial
  CRISPR gRNA sequence
ttttgaatattagaaatgtg

SEQ ID NO: 698233 - DNA, 20 bp, Artificial
  CRISPR gRNA sequence
tgaatattagaaatgtgaaa

SEQ ID NO: 698234 - DNA, 20 bp, Artificial
  CRISPR gRNA sequence
gaatattagaaatgtgaaaa

SEQ ID NO: 698235 - DNA, 20 bp, Artificial
  CRISPR gRNA sequence
aatattagaaatgtgaaaat

SEQ ID NO: 698236 - DNA, 20 bp, Artificial
  CRISPR gRNA sequence
gaaatgtgaaaatctatttg

SEQ ID NO: 698237 - DNA, 20 bp, Artificial
  CRISPR gRNA sequence
tttgatcacagaagacttta

SEQ ID NO: 698238 - DNA, 20 bp, Artificial
  CRISPR gRNA sequence
gatcacagaagactttaaaa

SEQ ID NO: 698239 - DNA, 20 bp, Artificial
  CRISPR gRNA sequence
atcacagaagactttaaaat

SEQ ID NO: 698240 - DNA, 20 bp, Artificial
  CRISPR gRNA sequence
taaaatacacagatcaatgc

SEQ ID NO: 698241 - DNA, 20 bp, Artificial
  CRISPR gRNA sequence
aaaatacacagatcaatgcc

SEQ ID NO: 698242 - DNA, 20 bp, Artificial
  CRISPR gRNA sequence
aaatacacagatcaatgcct

SEQ ID NO: 698243 - DNA, 20 bp, Artificial
  CRISPR gRNA sequence
cttgaattaaaaaaaaaata

SEQ ID NO: 698244 - DNA, 20 bp, Artificial
  CRISPR gRNA sequence
gaattaaaaaaaaaataaaa

SEQ ID NO: 698245 - DNA, 20 bp, Artificial
  CRISPR gRNA sequence
aattaaaaaaaaaataaaat

SEQ ID NO: 698246 - DNA, 20 bp, Artificial
  CRISPR gRNA sequence
aaaaaaaaataaaatacaca

SEQ ID NO: 698247 - DNA, 20 bp, Artificial
  CRISPR gRNA sequence
ggtctcccctcaaaaatatc

SEQ ID NO: 698248 - DNA, 20 bp, Artificial
  CRISPR gRNA sequence
ccctcaaaaatatcactgct

SEQ ID NO: 698249 - DNA, 20 bp, Artificial
  CRISPR gRNA sequence
aaaaatatcactgctattgt

SEQ ID NO: 698250 - DNA, 20 bp, Artificial
  CRISPR gRNA sequence
ctattgtattgttgaacctt

SEQ ID NO: 698251 - DNA, 20 bp, Artificial
  CRISPR gRNA sequence
ttgtattgttgaaccttcct

SEQ ID NO: 698252 - DNA, 20 bp, Artificial
  CRISPR gRNA sequence
tattgttgaaccttcctgga

SEQ ID NO: 698253 - DNA, 20 bp, Artificial
  CRISPR gRNA sequence
ttgaaccttcctggactcag

SEQ ID NO: 698254 - DNA, 20 bp, Artificial
  CRISPR gRNA sequence
aaccttcctggactcagtgt

SEQ ID NO: 698255 - DNA, 20 bp, Artificial
  CRISPR gRNA sequence
cctggactcagtgtgactgt

SEQ ID NO: 698256 - DNA, 20 bp, Artificial
  CRISPR gRNA sequence
ctggactcagtgtgactgtt

SEQ ID NO: 698257 - DNA, 20 bp, Artificial
  CRISPR gRNA sequence
gactcagtgtgactgttggt

SEQ ID NO: 698258 - DNA, 20 bp, Artificial
  CRISPR gRNA sequence
agtgtgactgttggtccctg

SEQ ID NO: 698259 - DNA, 20 bp, Artificial
  CRISPR gRNA sequence
ttggtccctggagctgtcct

SEQ ID NO: 698260 - DNA, 20 bp, Artificial
  CRISPR gRNA sequence
gtccctggagctgtcctttg

SEQ ID NO: 698261 - DNA, 20 bp, Artificial
  CRISPR gRNA sequence
gagctgtcctttgcgtggtg

SEQ ID NO: 698262 - DNA, 20 bp, Artificial
  CRISPR gRNA sequence
tcctttgcgtggtgctgatt

SEQ ID NO: 698263 - DNA, 20 bp, Artificial
  CRISPR gRNA sequence
tgcgtggtgctgatttccat

SEQ ID NO: 698264 - DNA, 20 bp, Artificial
  CRISPR gRNA sequence
gcgtggtgctgatttccatt

SEQ ID NO: 698265 - DNA, 20 bp, Artificial
  CRISPR gRNA sequence
cgtggtgctgatttccattt

SEQ ID NO: 698266 - DNA, 20 bp, Artificial
  CRISPR gRNA sequence
atttccattttgttggtggt

SEQ ID NO: 698267 - DNA, 20 bp, Artificial
  CRISPR gRNA sequence
ccattttgttggtggtggtt

SEQ ID NO: 698268 - DNA, 20 bp, Artificial
  CRISPR gRNA sequence
cattttgttggtggtggttt

SEQ ID NO: 698269 - DNA, 20 bp, Artificial
  CRISPR gRNA sequence
tgttggtggtggtttgtttt

SEQ ID NO: 698270 - DNA, 20 bp, Artificial
  CRISPR gRNA sequence
gttggtggtggtttgttttt

SEQ ID NO: 698271 - DNA, 20 bp, Artificial
  CRISPR gRNA sequence
ttggtggtggtttgtttttg

SEQ ID NO: 698272 - DNA, 20 bp, Artificial
  CRISPR gRNA sequence
gtggtggtttgtttttgttt

SEQ ID NO: 698273 - DNA, 20 bp, Artificial
  CRISPR gRNA sequence
gtttttgtttttgtttttgt

SEQ ID NO: 698274 - DNA, 20 bp, Artificial
  CRISPR gRNA sequence
tttttgtttttgtttttgtt

SEQ ID NO: 698275 - DNA, 20 bp, Artificial
  CRISPR gRNA sequence
ttgtttttgtttttgttttt

SEQ ID NO: 698276 - DNA, 20 bp, Artificial
  CRISPR gRNA sequence
tgtttttgtttttgtttttg

SEQ ID NO: 698277 - DNA, 20 bp, Artificial
  CRISPR gRNA sequence
gtttttgtttttgtttttgt

SEQ ID NO: 698278 - DNA, 20 bp, Artificial
  CRISPR gRNA sequence
tttttgtttttgtttttgtt

SEQ ID NO: 698279 - DNA, 20 bp, Artificial
  CRISPR gRNA sequence
ttgtttttgtttttgtttct

SEQ ID NO: 698280 - DNA, 20 bp, Artificial
  CRISPR gRNA sequence
tgtttttgtttttgtttctg

SEQ ID NO: 698281 - DNA, 20 bp, Artificial
  CRISPR gRNA sequence
gtttttgtttttgtttctga

SEQ ID NO: 698282 - DNA, 20 bp, Artificial
  CRISPR gRNA sequence
tttttgtttttgtttctgaa

SEQ ID NO: 698283 - DNA, 20 bp, Artificial
  CRISPR gRNA sequence
ttgtttttgtttctgaaaca

SEQ ID NO: 698284 - DNA, 20 bp, Artificial
  CRISPR gRNA sequence
tgtttttgtttctgaaacac

SEQ ID NO: 698285 - DNA, 20 bp, Artificial
  CRISPR gRNA sequence
gtttttgtttctgaaacaca

SEQ ID NO: 698286 - DNA, 20 bp, Artificial
  CRISPR gRNA sequence
tttttgtttctgaaacacaa

SEQ ID NO: 698287 - DNA, 20 bp, Artificial
  CRISPR gRNA sequence
ttgtttctgaaacacaattt

SEQ ID NO: 698288 - DNA, 20 bp, Artificial
  CRISPR gRNA sequence
tgtttctgaaacacaatttc

SEQ ID NO: 698289 - DNA, 20 bp, Artificial
  CRISPR gRNA sequence
gtttctgaaacacaatttca

SEQ ID NO: 698290 - DNA, 20 bp, Artificial
  CRISPR gRNA sequence
tttctgaaacacaatttcac

SEQ ID NO: 698291 - DNA, 20 bp, Artificial
  CRISPR gRNA sequence
ctgaaacacaatttcacttt

SEQ ID NO: 698292 - DNA, 20 bp, Artificial
  CRISPR gRNA sequence
tgaaacacaatttcactttg

SEQ ID NO: 698293 - DNA, 20 bp, Artificial
  CRISPR gRNA sequence
aaacacaatttcactttgtc

SEQ ID NO: 698294 - DNA, 20 bp, Artificial
  CRISPR gRNA sequence
cactttgtcactgaggctgg

SEQ ID NO: 698295 - DNA, 20 bp, Artificial
  CRISPR gRNA sequence
actttgtcactgaggctgga

SEQ ID NO: 698296 - DNA, 20 bp, Artificial
  CRISPR gRNA sequence
tgtcactgaggctggagtgc

SEQ ID NO: 698297 - DNA, 20 bp, Artificial
  CRISPR gRNA sequence
gtcactgaggctggagtgca

SEQ ID NO: 698298 - DNA, 20 bp, Artificial
  CRISPR gRNA sequence
tcactgaggctggagtgcag

SEQ ID NO: 698299 - DNA, 20 bp, Artificial
  CRISPR gRNA sequence
aggctggagtgcagtggtgc

SEQ ID NO: 698300 - DNA, 20 bp, Artificial
  CRISPR gRNA sequence
gagtgcagtggtgcgacctc

SEQ ID NO: 698301 - DNA, 20 bp, Artificial
  CRISPR gRNA sequence
agctcactgcaacctccgcc

SEQ ID NO: 698302 - DNA, 20 bp, Artificial
  CRISPR gRNA sequence
actgcaacctccgcctctcg

SEQ ID NO: 698303 - DNA, 20 bp, Artificial
  CRISPR gRNA sequence
caacctccgcctctcgggtt

SEQ ID NO: 698304 - DNA, 20 bp, Artificial
  CRISPR gRNA sequence
cgcctctcgggttcaagtga

SEQ ID NO: 698305 - DNA, 20 bp, Artificial
  CRISPR gRNA sequence
tcgggttcaagtgatttcca

SEQ ID NO: 698306 - DNA, 20 bp, Artificial
  CRISPR gRNA sequence
gggttcaagtgatttccatg

SEQ ID NO: 698307 - DNA, 20 bp, Artificial
  CRISPR gRNA sequence
aagtgatttccatgcctcag

SEQ ID NO: 698308 - DNA, 20 bp, Artificial
  CRISPR gRNA sequence
ccatgcctcagcctcctgag

SEQ ID NO: 698309 - DNA, 20 bp, Artificial
  CRISPR gRNA sequence
catgcctcagcctcctgagt

SEQ ID NO: 698310 - DNA, 20 bp, Artificial
  CRISPR gRNA sequence
agcctcctgagtagctgaga

SEQ ID NO: 698311 - DNA, 20 bp, Artificial
  CRISPR gRNA sequence
ctgagtagctgagattacac

SEQ ID NO: 698312 - DNA, 20 bp, Artificial
  CRISPR gRNA sequence
agtagctgagattacacaca

SEQ ID NO: 698313 - DNA, 20 bp, Artificial
  CRISPR gRNA sequence
agattacacacatgcgccac

SEQ ID NO: 698314 - DNA, 20 bp, Artificial
  CRISPR gRNA sequence
cacacatgcgccaccaggcc

SEQ ID NO: 698315 - DNA, 20 bp, Artificial
  CRISPR gRNA sequence
tttgtatttttagtagagac

SEQ ID NO: 698316 - DNA, 20 bp, Artificial
  CRISPR gRNA sequence
ttgtatttttagtagagaca

SEQ ID NO: 698317 - DNA, 20 bp, Artificial
  CRISPR gRNA sequence
tgtatttttagtagagacag

SEQ ID NO: 698318 - DNA, 20 bp, Artificial
  CRISPR gRNA sequence
gtatttttagtagagacagg

SEQ ID NO: 698319 - DNA, 20 bp, Artificial
  CRISPR gRNA sequence
tatttttagtagagacaggg

SEQ ID NO: 698320 - DNA, 20 bp, Artificial
  CRISPR gRNA sequence
ttagtagagacagggttttg

SEQ ID NO: 698321 - DNA, 20 bp, Artificial
  CRISPR gRNA sequence
tagtagagacagggttttgc

SEQ ID NO: 698322 - DNA, 20 bp, Artificial
  CRISPR gRNA sequence
agtagagacagggttttgcc

SEQ ID NO: 698323 - DNA, 20 bp, Artificial
  CRISPR gRNA sequence
gtagagacagggttttgcca

SEQ ID NO: 698324 - DNA, 20 bp, Artificial
  CRISPR gRNA sequence
tgccatattggccagtctgg

SEQ ID NO: 698325 - DNA, 20 bp, Artificial
  CRISPR gRNA sequence
gccatattggccagtctggt

SEQ ID NO: 698326 - DNA, 20 bp, Artificial
  CRISPR gRNA sequence
ccatattggccagtctggtc

SEQ ID NO: 698327 - DNA, 20 bp, Artificial
  CRISPR gRNA sequence
gccagtctggtctcgaactc

SEQ ID NO: 698328 - DNA, 20 bp, Artificial
  CRISPR gRNA sequence
gtctcgaactcccgacctca

SEQ ID NO: 698329 - DNA, 20 bp, Artificial
  CRISPR gRNA sequence
gaactcccgacctcaagtga

SEQ ID NO: 698330 - DNA, 20 bp, Artificial
  CRISPR gRNA sequence
ccgacctcaagtgatccacc

SEQ ID NO: 698331 - DNA, 20 bp, Artificial
  CRISPR gRNA sequence
aagtgatccacctgcctcag

SEQ ID NO: 698332 - DNA, 20 bp, Artificial
  CRISPR gRNA sequence
cctcagcttctcaaagtgct

SEQ ID NO: 698333 - DNA, 20 bp, Artificial
  CRISPR gRNA sequence
agcttctcaaagtgctggga

SEQ ID NO: 698334 - DNA, 20 bp, Artificial
  CRISPR gRNA sequence
ctcaaagtgctgggattaca

SEQ ID NO: 698335 - DNA, 20 bp, Artificial
  CRISPR gRNA sequence
tcaaagtgctgggattacag

SEQ ID NO: 698336 - DNA, 20 bp, Artificial
  CRISPR gRNA sequence
aaagtgctgggattacagga

SEQ ID NO: 698337 - DNA, 20 bp, Artificial
  CRISPR gRNA sequence
ggattacaggaatgagccaa

SEQ ID NO: 698338 - DNA, 20 bp, Artificial
  CRISPR gRNA sequence
caggaatgagccaaggcgcc

SEQ ID NO: 698339 - DNA, 20 bp, Artificial
  CRISPR gRNA sequence
gcccattttgttgttctcta

SEQ ID NO: 698340 - DNA, 20 bp, Artificial
  CRISPR gRNA sequence
tgttgttctctatgtatata

SEQ ID NO: 698341 - DNA, 20 bp, Artificial
  CRISPR gRNA sequence
gttgttctctatgtatatat

SEQ ID NO: 698342 - DNA, 20 bp, Artificial
  CRISPR gRNA sequence
ttgttctctatgtatatatt

SEQ ID NO: 698343 - DNA, 20 bp, Artificial
  CRISPR gRNA sequence
ttctctatgtatatattttt

SEQ ID NO: 698344 - DNA, 20 bp, Artificial
  CRISPR gRNA sequence
tctatgtatatatttttata

SEQ ID NO: 698345 - DNA, 20 bp, Artificial
  CRISPR gRNA sequence
tatgtatatatttttatagg

SEQ ID NO: 698346 - DNA, 20 bp, Artificial
  CRISPR gRNA sequence
tgtatatatttttataggta

SEQ ID NO: 698347 - DNA, 20 bp, Artificial
  CRISPR gRNA sequence
ttataggtatctttattgta

SEQ ID NO: 698348 - DNA, 20 bp, Artificial
  CRISPR gRNA sequence
tataggtatctttattgtac

SEQ ID NO: 698349 - DNA, 20 bp, Artificial
  CRISPR gRNA sequence
ataggtatctttattgtaca

SEQ ID NO: 698350 - DNA, 20 bp, Artificial
  CRISPR gRNA sequence
taggtatctttattgtacaa

SEQ ID NO: 698351 - DNA, 20 bp, Artificial
  CRISPR gRNA sequence
tattgtacaaggttgcattc

SEQ ID NO: 698352 - DNA, 20 bp, Artificial
  CRISPR gRNA sequence
attgtacaaggttgcattca

SEQ ID NO: 698353 - DNA, 20 bp, Artificial
  CRISPR gRNA sequence
ttgtacaaggttgcattcat

SEQ ID NO: 698354 - DNA, 20 bp, Artificial
  CRISPR gRNA sequence
tacaaggttgcattcatatg

SEQ ID NO: 698355 - DNA, 20 bp, Artificial
  CRISPR gRNA sequence
cattcatatgttatgggtta

SEQ ID NO: 698356 - DNA, 20 bp, Artificial
  CRISPR gRNA sequence
atatgttatgggttatcttg

SEQ ID NO: 698357 - DNA, 20 bp, Artificial
  CRISPR gRNA sequence
tgggttatcttgaatgttgc

SEQ ID NO: 698358 - DNA, 20 bp, Artificial
  CRISPR gRNA sequence
tcttgaatgttgctttttga

SEQ ID NO: 698359 - DNA, 20 bp, Artificial
  CRISPR gRNA sequence
gaatgttgctttttgaatgt

SEQ ID NO: 698360 - DNA, 20 bp, Artificial
  CRISPR gRNA sequence
aatgttgctttttgaatgta

SEQ ID NO: 698361 - DNA, 20 bp, Artificial
  CRISPR gRNA sequence
ctttttgaatgtattattat

SEQ ID NO: 698362 - DNA, 20 bp, Artificial
  CRISPR gRNA sequence
tttgaatgtattattataca

SEQ ID NO: 698363 - DNA, 20 bp, Artificial
  CRISPR gRNA sequence
ttgaatgtattattatacaa

SEQ ID NO: 698364 - DNA, 20 bp, Artificial
  CRISPR gRNA sequence
tgaatgtattattatacaag

SEQ ID NO: 698365 - DNA, 20 bp, Artificial
  CRISPR gRNA sequence
gaatgtattattatacaagt

SEQ ID NO: 698366 - DNA, 20 bp, Artificial
  CRISPR gRNA sequence
aatgtattattatacaagta

SEQ ID NO: 698367 - DNA, 20 bp, Artificial
  CRISPR gRNA sequence
ttatacaagtagttttccat

SEQ ID NO: 698368 - DNA, 20 bp, Artificial
  CRISPR gRNA sequence
tacaagtagttttccatgtt

SEQ ID NO: 698369 - DNA, 20 bp, Artificial
  CRISPR gRNA sequence
tccatgttgtaaactctgta

SEQ ID NO: 698370 - DNA, 20 bp, Artificial
  CRISPR gRNA sequence
ccatgttgtaaactctgtat

SEQ ID NO: 698371 - DNA, 20 bp, Artificial
  CRISPR gRNA sequence
catgttgtaaactctgtata

SEQ ID NO: 698372 - DNA, 20 bp, Artificial
  CRISPR gRNA sequence
taaactctgtataaagttta

SEQ ID NO: 698373 - DNA, 20 bp, Artificial
  CRISPR gRNA sequence
tgtataaagtttacatgctt

SEQ ID NO: 698374 - DNA, 20 bp, Artificial
  CRISPR gRNA sequence
tataaagtttacatgctttt

SEQ ID NO: 698375 - DNA, 20 bp, Artificial
  CRISPR gRNA sequence
acatgcttttttggccggca

SEQ ID NO: 698376 - DNA, 20 bp, Artificial
  CRISPR gRNA sequence
catgcttttttggccggcat

SEQ ID NO: 698377 - DNA, 20 bp, Artificial
  CRISPR gRNA sequence
ttttggccggcatggtggct

SEQ ID NO: 698378 - DNA, 20 bp, Artificial
  CRISPR gRNA sequence
tttggccggcatggtggctc

SEQ ID NO: 698379 - DNA, 20 bp, Artificial
  CRISPR gRNA sequence
ttggccggcatggtggctca

SEQ ID NO: 698380 - DNA, 20 bp, Artificial
  CRISPR gRNA sequence
tggccggcatggtggctcac

SEQ ID NO: 698381 - DNA, 20 bp, Artificial
  CRISPR gRNA sequence
ggccggcatggtggctcacg

SEQ ID NO: 698382 - DNA, 20 bp, Artificial
  CRISPR gRNA sequence
gccggcatggtggctcacgc

SEQ ID NO: 698383 - DNA, 20 bp, Artificial
  CRISPR gRNA sequence
acgcctgtaatcccagcact

SEQ ID NO: 698384 - DNA, 20 bp, Artificial
  CRISPR gRNA sequence
taatcccagcactttgggag

SEQ ID NO: 698385 - DNA, 20 bp, Artificial
  CRISPR gRNA sequence
tgggaggccgaggtgggtgg

SEQ ID NO: 698386 - DNA, 20 bp, Artificial
  CRISPR gRNA sequence
gggaggccgaggtgggtgga

SEQ ID NO: 698387 - DNA, 20 bp, Artificial
  CRISPR gRNA sequence
ggaggccgaggtgggtggat

SEQ ID NO: 698388 - DNA, 20 bp, Artificial
  CRISPR gRNA sequence
gaggtcaggaattcgagacc

SEQ ID NO: 698389 - DNA, 20 bp, Artificial
  CRISPR gRNA sequence
aggtcaggaattcgagacca

SEQ ID NO: 698390 - DNA, 20 bp, Artificial
  CRISPR gRNA sequence
gagaccagactggccaacat

SEQ ID NO: 698391 - DNA, 20 bp, Artificial
  CRISPR gRNA sequence
gccaacatggtgaaacccca

SEQ ID NO: 698392 - DNA, 20 bp, Artificial
  CRISPR gRNA sequence
tactaaaaaatacaaaaaat

SEQ ID NO: 698393 - DNA, 20 bp, Artificial
  CRISPR gRNA sequence
aaaaatacaaaaaattagcc

SEQ ID NO: 698394 - DNA, 20 bp, Artificial
  CRISPR gRNA sequence
gccaggagtctaggcatgtg

SEQ ID NO: 698395 - DNA, 20 bp, Artificial
  CRISPR gRNA sequence
ggcatgtgcctgtagtccca

SEQ ID NO: 698396 - DNA, 20 bp, Artificial
  CRISPR gRNA sequence
tagtcccagctactcaggat

SEQ ID NO: 698397 - DNA, 20 bp, Artificial
  CRISPR gRNA sequence
ctcaggatgctgagccagga

SEQ ID NO: 698398 - DNA, 20 bp, Artificial
  CRISPR gRNA sequence
aggatgctgagccaggagaa

SEQ ID NO: 698399 - DNA, 20 bp, Artificial
  CRISPR gRNA sequence
agccaggagaattgcttgaa

SEQ ID NO: 698400 - DNA, 20 bp, Artificial
  CRISPR gRNA sequence
cttgaacccaggaggcagat

SEQ ID NO: 698401 - DNA, 20 bp, Artificial
  CRISPR gRNA sequence
gaacccaggaggcagatgtt

SEQ ID NO: 698402 - DNA, 20 bp, Artificial
  CRISPR gRNA sequence
aacccaggaggcagatgttg

SEQ ID NO: 698403 - DNA, 20 bp, Artificial
  CRISPR gRNA sequence
cagtgagccgagatcactgc

SEQ ID NO: 698404 - DNA, 20 bp, Artificial
  CRISPR gRNA sequence
ccactgtactccagcctggg

SEQ ID NO: 698405 - DNA, 20 bp, Artificial
  CRISPR gRNA sequence
tactccagcctgggtgacag

SEQ ID NO: 698406 - DNA, 20 bp, Artificial
  CRISPR gRNA sequence
cagcctgggtgacagaatga

SEQ ID NO: 698407 - DNA, 20 bp, Artificial
  CRISPR gRNA sequence
ggtgacagaatgagactcca

SEQ ID NO: 698408 - DNA, 20 bp, Artificial
  CRISPR gRNA sequence
catctaaaaaaatttttaaa

SEQ ID NO: 698409 - DNA, 20 bp, Artificial
  CRISPR gRNA sequence
aaaaaatttttaaatttaaa

SEQ ID NO: 698410 - DNA, 20 bp, Artificial
  CRISPR gRNA sequence
ttaaatttaaaaagttgaca

SEQ ID NO: 698411 - DNA, 20 bp, Artificial
  CRISPR gRNA sequence
taaatttaaaaagttgacac

SEQ ID NO: 698412 - DNA, 20 bp, Artificial
  CRISPR gRNA sequence
aaatttaaaaagttgacaca

SEQ ID NO: 698413 - DNA, 20 bp, Artificial
  CRISPR gRNA sequence
aatttaaaaagttgacacac

SEQ ID NO: 698414 - DNA, 20 bp, Artificial
  CRISPR gRNA sequence
aaaaagttgacacactttta

SEQ ID NO: 698415 - DNA, 20 bp, Artificial
  CRISPR gRNA sequence
aaaagttgacacacttttac

SEQ ID NO: 698416 - DNA, 20 bp, Artificial
  CRISPR gRNA sequence
acacacttttacaagctgca

SEQ ID NO: 698417 - DNA, 20 bp, Artificial
  CRISPR gRNA sequence
ttacaagctgcatcccatct

SEQ ID NO: 698418 - DNA, 20 bp, Artificial
  CRISPR gRNA sequence
tacaagctgcatcccatctc

SEQ ID NO: 698419 - DNA, 20 bp, Artificial
  CRISPR gRNA sequence
acaagctgcatcccatctca

SEQ ID NO: 698420 - DNA, 20 bp, Artificial
  CRISPR gRNA sequence
caagctgcatcccatctcag

SEQ ID NO: 698421 - DNA, 20 bp, Artificial
  CRISPR gRNA sequence
catcccatctcagataagga

SEQ ID NO: 698422 - DNA, 20 bp, Artificial
  CRISPR gRNA sequence
agataaggaggtgatgtaac

SEQ ID NO: 698423 - DNA, 20 bp, Artificial
  CRISPR gRNA sequence
agttcttttagatccatctg

SEQ ID NO: 698424 - DNA, 20 bp, Artificial
  CRISPR gRNA sequence
ttttagatccatctgctttc

SEQ ID NO: 698425 - DNA, 20 bp, Artificial
  CRISPR gRNA sequence
ttagatccatctgctttcat

SEQ ID NO: 698426 - DNA, 20 bp, Artificial
  CRISPR gRNA sequence
tagatccatctgctttcatc

SEQ ID NO: 698427 - DNA, 20 bp, Artificial
  CRISPR gRNA sequence
agatccatctgctttcatct

SEQ ID NO: 698428 - DNA, 20 bp, Artificial
  CRISPR gRNA sequence
gatccatctgctttcatctt

SEQ ID NO: 698429 - DNA, 20 bp, Artificial
  CRISPR gRNA sequence
ctttcatcttatctttttgt

SEQ ID NO: 698430 - DNA, 20 bp, Artificial
  CRISPR gRNA sequence
tcatcttatctttttgtagg

SEQ ID NO: 698431 - DNA, 20 bp, Artificial
  CRISPR gRNA sequence
catcttatctttttgtaggt

SEQ ID NO: 698432 - DNA, 20 bp, Artificial
  CRISPR gRNA sequence
atcttatctttttgtaggta

SEQ ID NO: 698433 - DNA, 20 bp, Artificial
  CRISPR gRNA sequence
atctttttgtaggtaatatt

SEQ ID NO: 698434 - DNA, 20 bp, Artificial
  CRISPR gRNA sequence
tctttttgtaggtaatattt

SEQ ID NO: 698435 - DNA, 20 bp, Artificial
  CRISPR gRNA sequence
tttgtaggtaatattttgac

SEQ ID NO: 698436 - DNA, 20 bp, Artificial
  CRISPR gRNA sequence
ttgtaggtaatattttgaca

SEQ ID NO: 698437 - DNA, 20 bp, Artificial
  CRISPR gRNA sequence
tgtaggtaatattttgacaa

SEQ ID NO: 698438 - DNA, 20 bp, Artificial
  CRISPR gRNA sequence
gtaggtaatattttgacaag

SEQ ID NO: 698439 - DNA, 20 bp, Artificial
  CRISPR gRNA sequence
taggtaatattttgacaagc

SEQ ID NO: 698440 - DNA, 20 bp, Artificial
  CRISPR gRNA sequence
tgacaagcatgtttgtacat

SEQ ID NO: 698441 - DNA, 20 bp, Artificial
  CRISPR gRNA sequence
gacaagcatgtttgtacata

SEQ ID NO: 698442 - DNA, 20 bp, Artificial
  CRISPR gRNA sequence
acaagcatgtttgtacataa

SEQ ID NO: 698443 - DNA, 20 bp, Artificial
  CRISPR gRNA sequence
gtacataaagattctcctat

SEQ ID NO: 698444 - DNA, 20 bp, Artificial
  CRISPR gRNA sequence
tacataaagattctcctatg

SEQ ID NO: 698445 - DNA, 20 bp, Artificial
  CRISPR gRNA sequence
tcctatggttgggattttaa

SEQ ID NO: 698446 - DNA, 20 bp, Artificial
  CRISPR gRNA sequence
ctatggttgggattttaaaa

SEQ ID NO: 698447 - DNA, 20 bp, Artificial
  CRISPR gRNA sequence
tggttgggattttaaaaatt

SEQ ID NO: 698448 - DNA, 20 bp, Artificial
  CRISPR gRNA sequence
ggattttaaaaattcataga

SEQ ID NO: 698449 - DNA, 20 bp, Artificial
  CRISPR gRNA sequence
taaaaattcatagactactc

SEQ ID NO: 698450 - DNA, 20 bp, Artificial
  CRISPR gRNA sequence
aaaaattcatagactactca

SEQ ID NO: 698451 - DNA, 20 bp, Artificial
  CRISPR gRNA sequence
aaaattcatagactactcag

SEQ ID NO: 698452 - DNA, 20 bp, Artificial
  CRISPR gRNA sequence
atagactactcaggccaggt

SEQ ID NO: 698453 - DNA, 20 bp, Artificial
  CRISPR gRNA sequence
ctcaggccaggtgcggtgcc

SEQ ID NO: 698454 - DNA, 20 bp, Artificial
  CRISPR gRNA sequence
aggccaggtgcggtgcctca

SEQ ID NO: 698455 - DNA, 20 bp, Artificial
  CRISPR gRNA sequence
aagcctgtaatctcaacaca

SEQ ID NO: 698456 - DNA, 20 bp, Artificial
  CRISPR gRNA sequence
taatctcaacacattggaag

SEQ ID NO: 698457 - DNA, 20 bp, Artificial
  CRISPR gRNA sequence
aacacattggaaggccaagg

SEQ ID NO: 698458 - DNA, 20 bp, Artificial
  CRISPR gRNA sequence
gaaggccaaggagggtggat

SEQ ID NO: 698459 - DNA, 20 bp, Artificial
  CRISPR gRNA sequence
tctgagcccagaagttcaag

SEQ ID NO: 698460 - DNA, 20 bp, Artificial
  CRISPR gRNA sequence
agcccagaagttcaagacca

SEQ ID NO: 698461 - DNA, 20 bp, Artificial
  CRISPR gRNA sequence
aagaccagcctgggcaacat

SEQ ID NO: 698462 - DNA, 20 bp, Artificial
  CRISPR gRNA sequence
ggcaacatggcaaaatcctg

SEQ ID NO: 698463 - DNA, 20 bp, Artificial
  CRISPR gRNA sequence
tctctacaaaaaatacaaaa

SEQ ID NO: 698464 - DNA, 20 bp, Artificial
  CRISPR gRNA sequence
tacaaaaaatacaaaaaaaa

SEQ ID NO: 698465 - DNA, 20 bp, Artificial
  CRISPR gRNA sequence
caaaaaatacaaaaaaaaaa

SEQ ID NO: 698466 - DNA, 20 bp, Artificial
  CRISPR gRNA sequence
gctgggcatggtggcatgag

SEQ ID NO: 698467 - DNA, 20 bp, Artificial
  CRISPR gRNA sequence
ggcatggtggcatgagcctg

SEQ ID NO: 698468 - DNA, 20 bp, Artificial
  CRISPR gRNA sequence
tagtcctaggtaccccagtg

SEQ ID NO: 698469 - DNA, 20 bp, Artificial
  CRISPR gRNA sequence
ggtaccccagtgtttgaggt

SEQ ID NO: 698470 - DNA, 20 bp, Artificial
  CRISPR gRNA sequence
gaggtgggaagattgttcga

SEQ ID NO: 698471 - DNA, 20 bp, Artificial
  CRISPR gRNA sequence
aggtgggaagattgttcgag

SEQ ID NO: 698472 - DNA, 20 bp, Artificial
  CRISPR gRNA sequence
ttcgagcctggaaggttgag

SEQ ID NO: 698473 - DNA, 20 bp, Artificial
  CRISPR gRNA sequence
gagcctggaaggttgaggct

SEQ ID NO: 698474 - DNA, 20 bp, Artificial
  CRISPR gRNA sequence
gaaggttgaggctgaagtga

SEQ ID NO: 698475 - DNA, 20 bp, Artificial
  CRISPR gRNA sequence
aggctgaagtgagctgtgat

SEQ ID NO: 698476 - DNA, 20 bp, Artificial
  CRISPR gRNA sequence
aagtgagctgtgatcatgcc

SEQ ID NO: 698477 - DNA, 20 bp, Artificial
  CRISPR gRNA sequence
tgatcatgccactgccctcc

SEQ ID NO: 698478 - DNA, 20 bp, Artificial
  CRISPR gRNA sequence
ccctccagaccaggctacag

SEQ ID NO: 698479 - DNA, 20 bp, Artificial
  CRISPR gRNA sequence
cagaccaggctacagagtga

SEQ ID NO: 698480 - DNA, 20 bp, Artificial
  CRISPR gRNA sequence
cagagtgagaatttgtctcc

SEQ ID NO: 698481 - DNA, 20 bp, Artificial
  CRISPR gRNA sequence
gtctccaaaaataaataaat

SEQ ID NO: 698482 - DNA, 20 bp, Artificial
  CRISPR gRNA sequence
tctccaaaaataaataaatt

SEQ ID NO: 698483 - DNA, 20 bp, Artificial
  CRISPR gRNA sequence
caaaaataaataaattcata

SEQ ID NO: 698484 - DNA, 20 bp, Artificial
  CRISPR gRNA sequence
atagactactcaagtgataa

SEQ ID NO: 698485 - DNA, 20 bp, Artificial
  CRISPR gRNA sequence
ctcaagtgataaatattaaa

SEQ ID NO: 698486 - DNA, 20 bp, Artificial
  CRISPR gRNA sequence
aagtgataaatattaaacaa

SEQ ID NO: 698487 - DNA, 20 bp, Artificial
  CRISPR gRNA sequence
aacaagagactgctttaaac

SEQ ID NO: 698488 - DNA, 20 bp, Artificial
  CRISPR gRNA sequence
ctttaaacattttaaagcct

SEQ ID NO: 698489 - DNA, 20 bp, Artificial
  CRISPR gRNA sequence
taaacattttaaagccttat

SEQ ID NO: 698490 - DNA, 20 bp, Artificial
  CRISPR gRNA sequence
aaacattttaaagccttatt

SEQ ID NO: 698491 - DNA, 20 bp, Artificial
  CRISPR gRNA sequence
aacattttaaagccttatta

SEQ ID NO: 698492 - DNA, 20 bp, Artificial
  CRISPR gRNA sequence
taaagccttattatactgtc

SEQ ID NO: 698493 - DNA, 20 bp, Artificial
  CRISPR gRNA sequence
aaagccttattatactgtca

SEQ ID NO: 698494 - DNA, 20 bp, Artificial
  CRISPR gRNA sequence
aagccttattatactgtcat

SEQ ID NO: 698495 - DNA, 20 bp, Artificial
  CRISPR gRNA sequence
attatactgtcatactgtga

SEQ ID NO: 698496 - DNA, 20 bp, Artificial
  CRISPR gRNA sequence
ttatactgtcatactgtgat

SEQ ID NO: 698497 - DNA, 20 bp, Artificial
  CRISPR gRNA sequence
tactgtcatactgtgattgt

SEQ ID NO: 698498 - DNA, 20 bp, Artificial
  CRISPR gRNA sequence
tcatactgtgattgtactga

SEQ ID NO: 698499 - DNA, 20 bp, Artificial
  CRISPR gRNA sequence
tgattgtactgacatattta

SEQ ID NO: 698500 - DNA, 20 bp, Artificial
  CRISPR gRNA sequence
tactgacatatttattcatt

SEQ ID NO: 698501 - DNA, 20 bp, Artificial
  CRISPR gRNA sequence
acatatttattcatttaaca

SEQ ID NO: 698502 - DNA, 20 bp, Artificial
  CRISPR gRNA sequence
attcatttaacaaatactta

SEQ ID NO: 698503 - DNA, 20 bp, Artificial
  CRISPR gRNA sequence
ttcatttaacaaatacttac

SEQ ID NO: 698504 - DNA, 20 bp, Artificial
  CRISPR gRNA sequence
atttaacaaatacttactga

SEQ ID NO: 698505 - DNA, 20 bp, Artificial
  CRISPR gRNA sequence
aacaaatacttactgagagc

SEQ ID NO: 698506 - DNA, 20 bp, Artificial
  CRISPR gRNA sequence
acaaatacttactgagagct

SEQ ID NO: 698507 - DNA, 20 bp, Artificial
  CRISPR gRNA sequence
actgagagctatttactgat

SEQ ID NO: 698508 - DNA, 20 bp, Artificial
  CRISPR gRNA sequence
ctgagagctatttactgatt

SEQ ID NO: 698509 - DNA, 20 bp, Artificial
  CRISPR gRNA sequence
agagctatttactgattatg

SEQ ID NO: 698510 - DNA, 20 bp, Artificial
  CRISPR gRNA sequence
tttactgattatgatggtga

SEQ ID NO: 698511 - DNA, 20 bp, Artificial
  CRISPR gRNA sequence
actgattatgatggtgagaa

SEQ ID NO: 698512 - DNA, 20 bp, Artificial
  CRISPR gRNA sequence
ctgattatgatggtgagaaa

SEQ ID NO: 698513 - DNA, 20 bp, Artificial
  CRISPR gRNA sequence
attatgatggtgagaaacaa

SEQ ID NO: 698514 - DNA, 20 bp, Artificial
  CRISPR gRNA sequence
tgatggtgagaaacaatggt

SEQ ID NO: 698515 - DNA, 20 bp, Artificial
  CRISPR gRNA sequence
tatcaaagaacatacatttc

SEQ ID NO: 698516 - DNA, 20 bp, Artificial
  CRISPR gRNA sequence
atcaaagaacatacatttca

SEQ ID NO: 698517 - DNA, 20 bp, Artificial
  CRISPR gRNA sequence
tcaaagaacatacatttcag

SEQ ID NO: 698518 - DNA, 20 bp, Artificial
  CRISPR gRNA sequence
cagtgatactgactgtaatg

SEQ ID NO: 698519 - DNA, 20 bp, Artificial
  CRISPR gRNA sequence
agtgatactgactgtaatgg

SEQ ID NO: 698520 - DNA, 20 bp, Artificial
  CRISPR gRNA sequence
actgtaatggttaattttag

SEQ ID NO: 698521 - DNA, 20 bp, Artificial
  CRISPR gRNA sequence
taatggttaattttaggtgt

SEQ ID NO: 698522 - DNA, 20 bp, Artificial
  CRISPR gRNA sequence
attttaggtgtcatattgac

SEQ ID NO: 698523 - DNA, 20 bp, Artificial
  CRISPR gRNA sequence
taggtgtcatattgactgga

SEQ ID NO: 698524 - DNA, 20 bp, Artificial
  CRISPR gRNA sequence
aggtgtcatattgactggat

SEQ ID NO: 698525 - DNA, 20 bp, Artificial
  CRISPR gRNA sequence
ggtgtcatattgactggatt

SEQ ID NO: 698526 - DNA, 20 bp, Artificial
  CRISPR gRNA sequence
actggattaagggatgccta

SEQ ID NO: 698527 - DNA, 20 bp, Artificial
  CRISPR gRNA sequence
gattaagggatgcctagata

SEQ ID NO: 698528 - DNA, 20 bp, Artificial
  CRISPR gRNA sequence
agggatgcctagatagctgg

SEQ ID NO: 698529 - DNA, 20 bp, Artificial
  CRISPR gRNA sequence
gatagctggtataacattat

SEQ ID NO: 698530 - DNA, 20 bp, Artificial
  CRISPR gRNA sequence
gtataacattatttctgggt

SEQ ID NO: 698531 - DNA, 20 bp, Artificial
  CRISPR gRNA sequence
tttctgggtgtgcctgtgag

SEQ ID NO: 698532 - DNA, 20 bp, Artificial
  CRISPR gRNA sequence
ctgggtgtgcctgtgagggt

SEQ ID NO: 698533 - DNA, 20 bp, Artificial
  CRISPR gRNA sequence
tgggtgtgcctgtgagggtg

SEQ ID NO: 698534 - DNA, 20 bp, Artificial
  CRISPR gRNA sequence
ggtgtgcctgtgagggtgtt

SEQ ID NO: 698535 - DNA, 20 bp, Artificial
  CRISPR gRNA sequence
tgagggtgtttctggaaggg

SEQ ID NO: 698536 - DNA, 20 bp, Artificial
  CRISPR gRNA sequence
ctggaagggattggcatgtg

SEQ ID NO: 698537 - DNA, 20 bp, Artificial
  CRISPR gRNA sequence
tggaagggattggcatgtga

SEQ ID NO: 698538 - DNA, 20 bp, Artificial
  CRISPR gRNA sequence
gaagggattggcatgtgagt

SEQ ID NO: 698539 - DNA, 20 bp, Artificial
  CRISPR gRNA sequence
gcatgtgagtgactgagcgg

SEQ ID NO: 698540 - DNA, 20 bp, Artificial
  CRISPR gRNA sequence
agcggggaaaatcctctctc

SEQ ID NO: 698541 - DNA, 20 bp, Artificial
  CRISPR gRNA sequence
tctcgctgtgggcagccaca

SEQ ID NO: 698542 - DNA, 20 bp, Artificial
  CRISPR gRNA sequence
tcgctgtgggcagccacaat

SEQ ID NO: 698543 - DNA, 20 bp, Artificial
  CRISPR gRNA sequence
gctgtgggcagccacaatcc

SEQ ID NO: 698544 - DNA, 20 bp, Artificial
  CRISPR gRNA sequence
tgggcagccacaatccaatc

SEQ ID NO: 698545 - DNA, 20 bp, Artificial
  CRISPR gRNA sequence
ggggcccagatagaacaaaa

SEQ ID NO: 698546 - DNA, 20 bp, Artificial
  CRISPR gRNA sequence
tctctctctctctctctctc

SEQ ID NO: 698547 - DNA, 20 bp, Artificial
  CRISPR gRNA sequence
ctctctctctctctctctca

SEQ ID NO: 698548 - DNA, 20 bp, Artificial
  CRISPR gRNA sequence
tctctctctctctctctcaa

SEQ ID NO: 698549 - DNA, 20 bp, Artificial
  CRISPR gRNA sequence
tctctctctctctctcaatc

SEQ ID NO: 698550 - DNA, 20 bp, Artificial
  CRISPR gRNA sequence
tctctctctctctcaatctg

SEQ ID NO: 698551 - DNA, 20 bp, Artificial
  CRISPR gRNA sequence
tctctctctctcaatctggg

SEQ ID NO: 698552 - DNA, 20 bp, Artificial
  CRISPR gRNA sequence
tctctctctcaatctgggac

SEQ ID NO: 698553 - DNA, 20 bp, Artificial
  CRISPR gRNA sequence
tctctctcaatctgggacac

SEQ ID NO: 698554 - DNA, 20 bp, Artificial
  CRISPR gRNA sequence
tctctcaatctgggacactt

SEQ ID NO: 698555 - DNA, 20 bp, Artificial
  CRISPR gRNA sequence
tctcaatctgggacactttt

SEQ ID NO: 698556 - DNA, 20 bp, Artificial
  CRISPR gRNA sequence
tcaatctgggacacttttcc

SEQ ID NO: 698557 - DNA, 20 bp, Artificial
  CRISPR gRNA sequence
aatctgggacacttttcctg

SEQ ID NO: 698558 - DNA, 20 bp, Artificial
  CRISPR gRNA sequence
ggacacttttcctgcccttg

SEQ ID NO: 698559 - DNA, 20 bp, Artificial
  CRISPR gRNA sequence
ttcctgcccttggacatcag

SEQ ID NO: 698560 - DNA, 20 bp, Artificial
  CRISPR gRNA sequence
tcctgcccttggacatcaga

SEQ ID NO: 698561 - DNA, 20 bp, Artificial
  CRISPR gRNA sequence
cctgcccttggacatcagaa

SEQ ID NO: 698562 - DNA, 20 bp, Artificial
  CRISPR gRNA sequence
ctgcccttggacatcagaac

SEQ ID NO: 698563 - DNA, 20 bp, Artificial
  CRISPR gRNA sequence
cccttggacatcagaactcc

SEQ ID NO: 698564 - DNA, 20 bp, Artificial
  CRISPR gRNA sequence
ggacatcagaactccaggtt

SEQ ID NO: 698565 - DNA, 20 bp, Artificial
  CRISPR gRNA sequence
gacatcagaactccaggttg

SEQ ID NO: 698566 - DNA, 20 bp, Artificial
  CRISPR gRNA sequence
caggttgtatggtctttgga

SEQ ID NO: 698567 - DNA, 20 bp, Artificial
  CRISPR gRNA sequence
tatggtctttggactcttga

SEQ ID NO: 698568 - DNA, 20 bp, Artificial
  CRISPR gRNA sequence
tggactcttgagtgttgcac

SEQ ID NO: 698569 - DNA, 20 bp, Artificial
  CRISPR gRNA sequence
ggactcttgagtgttgcacc

SEQ ID NO: 698570 - DNA, 20 bp, Artificial
  CRISPR gRNA sequence
gactcttgagtgttgcacca

SEQ ID NO: 698571 - DNA, 20 bp, Artificial
  CRISPR gRNA sequence
ttgagtgttgcaccagtcaa

SEQ ID NO: 698572 - DNA, 20 bp, Artificial
  CRISPR gRNA sequence
gagtgttgcaccagtcaacc

SEQ ID NO: 698573 - DNA, 20 bp, Artificial
  CRISPR gRNA sequence
agtgttgcaccagtcaaccc

SEQ ID NO: 698574 - DNA, 20 bp, Artificial
  CRISPR gRNA sequence
caccagtcaaccctttatcc

SEQ ID NO: 698575 - DNA, 20 bp, Artificial
  CRISPR gRNA sequence
tatcctcccacctcctcctc

SEQ ID NO: 698576 - DNA, 20 bp, Artificial
  CRISPR gRNA sequence
atcctcccacctcctcctct

SEQ ID NO: 698577 - DNA, 20 bp, Artificial
  CRISPR gRNA sequence
tcctcccacctcctcctctg

SEQ ID NO: 698578 - DNA, 20 bp, Artificial
  CRISPR gRNA sequence
ccacctcctcctctggcccc

SEQ ID NO: 698579 - DNA, 20 bp, Artificial
  CRISPR gRNA sequence
ctcctctggcccctcaggcc

SEQ ID NO: 698580 - DNA, 20 bp, Artificial
  CRISPR gRNA sequence
ctctggcccctcaggccttt

SEQ ID NO: 698581 - DNA, 20 bp, Artificial
  CRISPR gRNA sequence
tggcccctcaggcctttggc

SEQ ID NO: 698582 - DNA, 20 bp, Artificial
  CRISPR gRNA sequence
gcccctcaggcctttggcct

SEQ ID NO: 698583 - DNA, 20 bp, Artificial
  CRISPR gRNA sequence
aggcctttggccttggactg

SEQ ID NO: 698584 - DNA, 20 bp, Artificial
  CRISPR gRNA sequence
tggccttggactgagccagg

SEQ ID NO: 698585 - DNA, 20 bp, Artificial
  CRISPR gRNA sequence
ggccttggactgagccaggc

SEQ ID NO: 698586 - DNA, 20 bp, Artificial
  CRISPR gRNA sequence
gccttggactgagccaggct

SEQ ID NO: 698587 - DNA, 20 bp, Artificial
  CRISPR gRNA sequence
ggactgagccaggctgctgt

SEQ ID NO: 698588 - DNA, 20 bp, Artificial
  CRISPR gRNA sequence
gactgagccaggctgctgtc

SEQ ID NO: 698589 - DNA, 20 bp, Artificial
  CRISPR gRNA sequence
agccaggctgctgtcttcct

SEQ ID NO: 698590 - DNA, 20 bp, Artificial
  CRISPR gRNA sequence
ctgtcttccttggttctcca

SEQ ID NO: 698591 - DNA, 20 bp, Artificial
  CRISPR gRNA sequence
tcttccttggttctccagct

SEQ ID NO: 698592 - DNA, 20 bp, Artificial
  CRISPR gRNA sequence
ccttggttctccagcttgca

SEQ ID NO: 698593 - DNA, 20 bp, Artificial
  CRISPR gRNA sequence
cttggttctccagcttgcag

SEQ ID NO: 698594 - DNA, 20 bp, Artificial
  CRISPR gRNA sequence
ggttctccagcttgcaggtg

SEQ ID NO: 698595 - DNA, 20 bp, Artificial
  CRISPR gRNA sequence
gttctccagcttgcaggtgg

SEQ ID NO: 698596 - DNA, 20 bp, Artificial
  CRISPR gRNA sequence
tccagcttgcaggtggcctc

SEQ ID NO: 698597 - DNA, 20 bp, Artificial
  CRISPR gRNA sequence
cagcttgcaggtggcctctc

SEQ ID NO: 698598 - DNA, 20 bp, Artificial
  CRISPR gRNA sequence
gcaggtggcctctcatggat

SEQ ID NO: 698599 - DNA, 20 bp, Artificial
  CRISPR gRNA sequence
caggtggcctctcatggatc

SEQ ID NO: 698600 - DNA, 20 bp, Artificial
  CRISPR gRNA sequence
tcatggatcttatcagcctc

SEQ ID NO: 698601 - DNA, 20 bp, Artificial
  CRISPR gRNA sequence
atggatcttatcagcctcca

SEQ ID NO: 698602 - DNA, 20 bp, Artificial
  CRISPR gRNA sequence
atcagcctccataactatgt

SEQ ID NO: 698603 - DNA, 20 bp, Artificial
  CRISPR gRNA sequence
tcagcctccataactatgtg

SEQ ID NO: 698604 - DNA, 20 bp, Artificial
  CRISPR gRNA sequence
cataactatgtgagccattt

SEQ ID NO: 698605 - DNA, 20 bp, Artificial
  CRISPR gRNA sequence
tgtgagccatttccactaat

SEQ ID NO: 698606 - DNA, 20 bp, Artificial
  CRISPR gRNA sequence
ccactaataaatcccctctt

SEQ ID NO: 698607 - DNA, 20 bp, Artificial
  CRISPR gRNA sequence
cactaataaatcccctcttg

SEQ ID NO: 698608 - DNA, 20 bp, Artificial
  CRISPR gRNA sequence
ataaatcccctcttgtctct

SEQ ID NO: 698609 - DNA, 20 bp, Artificial
  CRISPR gRNA sequence
ttgtctctctatctatctat

SEQ ID NO: 698610 - DNA, 20 bp, Artificial
  CRISPR gRNA sequence
gtctctctatctatctatct

SEQ ID NO: 698611 - DNA, 20 bp, Artificial
  CRISPR gRNA sequence
tctctctatctatctatcta

SEQ ID NO: 698612 - DNA, 20 bp, Artificial
  CRISPR gRNA sequence
tctatctatctatctatcta

SEQ ID NO: 698613 - DNA, 20 bp, Artificial
  CRISPR gRNA sequence
tatctatctatctatctatc

SEQ ID NO: 698614 - DNA, 20 bp, Artificial
  CRISPR gRNA sequence
tctatctatctatctatcta

SEQ ID NO: 698615 - DNA, 20 bp, Artificial
  CRISPR gRNA sequence
tctatctatctatctatcta

SEQ ID NO: 698616 - DNA, 20 bp, Artificial
  CRISPR gRNA sequence
tctatctatctatctatcta

SEQ ID NO: 698617 - DNA, 20 bp, Artificial
  CRISPR gRNA sequence
tctatctatctatctatcta

SEQ ID NO: 698618 - DNA, 20 bp, Artificial
  CRISPR gRNA sequence
tctatctatctatctatcta

SEQ ID NO: 698619 - DNA, 20 bp, Artificial
  CRISPR gRNA sequence
tctatctatctatctatcta

SEQ ID NO: 698620 - DNA, 20 bp, Artificial
  CRISPR gRNA sequence
tctatctatctatctatcca

SEQ ID NO: 698621 - DNA, 20 bp, Artificial
  CRISPR gRNA sequence
tctatctatctatccatcta

SEQ ID NO: 698622 - DNA, 20 bp, Artificial
  CRISPR gRNA sequence
tctatctatccatctactct

SEQ ID NO: 698623 - DNA, 20 bp, Artificial
  CRISPR gRNA sequence
tctatccatctactctattg

SEQ ID NO: 698624 - DNA, 20 bp, Artificial
  CRISPR gRNA sequence
tccatctactctattgggtc

SEQ ID NO: 698625 - DNA, 20 bp, Artificial
  CRISPR gRNA sequence
ctctattgggtctttctgtc

SEQ ID NO: 698626 - DNA, 20 bp, Artificial
  CRISPR gRNA sequence
tattgggtctttctgtcttg

SEQ ID NO: 698627 - DNA, 20 bp, Artificial
  CRISPR gRNA sequence
ttgggtctttctgtcttggt

SEQ ID NO: 698628 - DNA, 20 bp, Artificial
  CRISPR gRNA sequence
ggtctttctgtcttggtaac

SEQ ID NO: 698629 - DNA, 20 bp, Artificial
  CRISPR gRNA sequence
tctgtcttggtaaccctgat

SEQ ID NO: 698630 - DNA, 20 bp, Artificial
  CRISPR gRNA sequence
ctgtcttggtaaccctgata

SEQ ID NO: 698631 - DNA, 20 bp, Artificial
  CRISPR gRNA sequence
tgtcttggtaaccctgatac

SEQ ID NO: 698632 - DNA, 20 bp, Artificial
  CRISPR gRNA sequence
tcttggtaaccctgatacac

SEQ ID NO: 698633 - DNA, 20 bp, Artificial
  CRISPR gRNA sequence
ggtaaccctgatacaccaac

SEQ ID NO: 698634 - DNA, 20 bp, Artificial
  CRISPR gRNA sequence
gtaaccctgatacaccaaca

SEQ ID NO: 698635 - DNA, 20 bp, Artificial
  CRISPR gRNA sequence
atacaccaacagacaataaa

SEQ ID NO: 698636 - DNA, 20 bp, Artificial
  CRISPR gRNA sequence
tcacagtatcagtgataatt

SEQ ID NO: 698637 - DNA, 20 bp, Artificial
  CRISPR gRNA sequence
ccactgataaaaaatacacc

SEQ ID NO: 698638 - DNA, 20 bp, Artificial
  CRISPR gRNA sequence
ataaaaaatacacctaggct

SEQ ID NO: 698639 - DNA, 20 bp, Artificial
  CRISPR gRNA sequence
ggctagaagattggtgggag

SEQ ID NO: 698640 - DNA, 20 bp, Artificial
  CRISPR gRNA sequence
gaagattggtgggagtggcg

SEQ ID NO: 698641 - DNA, 20 bp, Artificial
  CRISPR gRNA sequence
gtgggagtggcgggaatggc

SEQ ID NO: 698642 - DNA, 20 bp, Artificial
  CRISPR gRNA sequence
cagaaaaggtaactgggcat

SEQ ID NO: 698643 - DNA, 20 bp, Artificial
  CRISPR gRNA sequence
agaaaaggtaactgggcatg

SEQ ID NO: 698644 - DNA, 20 bp, Artificial
  CRISPR gRNA sequence
ggcatgacatttctgagaac

SEQ ID NO: 698645 - DNA, 20 bp, Artificial
  CRISPR gRNA sequence
ctgagaacttgaccatggga

SEQ ID NO: 698646 - DNA, 20 bp, Artificial
  CRISPR gRNA sequence
tgagaacttgaccatgggac

SEQ ID NO: 698647 - DNA, 20 bp, Artificial
  CRISPR gRNA sequence
agaacttgaccatgggacat

SEQ ID NO: 698648 - DNA, 20 bp, Artificial
  CRISPR gRNA sequence
gaccatgggacatttgaaca

SEQ ID NO: 698649 - DNA, 20 bp, Artificial
  CRISPR gRNA sequence
accatgggacatttgaacag

SEQ ID NO: 698650 - DNA, 20 bp, Artificial
  CRISPR gRNA sequence
gaacagagactcgaatggtg

SEQ ID NO: 698651 - DNA, 20 bp, Artificial
  CRISPR gRNA sequence
aacagagactcgaatggtgt

SEQ ID NO: 698652 - DNA, 20 bp, Artificial
  CRISPR gRNA sequence
gaatggtgtgaggagtgagc

SEQ ID NO: 698653 - DNA, 20 bp, Artificial
  CRISPR gRNA sequence
gtgtgagtggagatgagtga

SEQ ID NO: 698654 - DNA, 20 bp, Artificial
  CRISPR gRNA sequence
ggctgagaatggcgggatga

SEQ ID NO: 698655 - DNA, 20 bp, Artificial
  CRISPR gRNA sequence
agaatggcgggatgaggcca

SEQ ID NO: 698656 - DNA, 20 bp, Artificial
  CRISPR gRNA sequence
tgatgaggggcttgtaggaa

SEQ ID NO: 698657 - DNA, 20 bp, Artificial
  CRISPR gRNA sequence
gtaggaaacggtgagagact

SEQ ID NO: 698658 - DNA, 20 bp, Artificial
  CRISPR gRNA sequence
taggaaacggtgagagactg

SEQ ID NO: 698659 - DNA, 20 bp, Artificial
  CRISPR gRNA sequence
aggtttcattgtgcctagga

SEQ ID NO: 698660 - DNA, 20 bp, Artificial
  CRISPR gRNA sequence
cattgtgcctaggaaagaaa

SEQ ID NO: 698661 - DNA, 20 bp, Artificial
  CRISPR gRNA sequence
attgtgcctaggaaagaaaa

SEQ ID NO: 698662 - DNA, 20 bp, Artificial
  CRISPR gRNA sequence
tgcctaggaaagaaaagggc

SEQ ID NO: 698663 - DNA, 20 bp, Artificial
  CRISPR gRNA sequence
ggaaagaaaagggctgaggt

SEQ ID NO: 698664 - DNA, 20 bp, Artificial
  CRISPR gRNA sequence
aggtgttcataggatatgtc

SEQ ID NO: 698665 - DNA, 20 bp, Artificial
  CRISPR gRNA sequence
ataggatatgtcctaatttt

SEQ ID NO: 698666 - DNA, 20 bp, Artificial
  CRISPR gRNA sequence
attttcgtttgagaggctca

SEQ ID NO: 698667 - DNA, 20 bp, Artificial
  CRISPR gRNA sequence
tcgtttgagaggctcactct

SEQ ID NO: 698668 - DNA, 20 bp, Artificial
  CRISPR gRNA sequence
cgtttgagaggctcactctg

SEQ ID NO: 698669 - DNA, 20 bp, Artificial
  CRISPR gRNA sequence
gtttgagaggctcactctgc

SEQ ID NO: 698670 - DNA, 20 bp, Artificial
  CRISPR gRNA sequence
gagaggctcactctgccttt

SEQ ID NO: 698671 - DNA, 20 bp, Artificial
  CRISPR gRNA sequence
agaggctcactctgcctttg

SEQ ID NO: 698672 - DNA, 20 bp, Artificial
  CRISPR gRNA sequence
actctgcctttgtgtgagta

SEQ ID NO: 698673 - DNA, 20 bp, Artificial
  CRISPR gRNA sequence
tgcctttgtgtgagtaatgg

SEQ ID NO: 698674 - DNA, 20 bp, Artificial
  CRISPR gRNA sequence
cctttgtgtgagtaatggac

SEQ ID NO: 698675 - DNA, 20 bp, Artificial
  CRISPR gRNA sequence
tgtgtgagtaatggacagtg

SEQ ID NO: 698676 - DNA, 20 bp, Artificial
  CRISPR gRNA sequence
gtgtgagtaatggacagtgg

SEQ ID NO: 698677 - DNA, 20 bp, Artificial
  CRISPR gRNA sequence
tgtgagtaatggacagtggg

SEQ ID NO: 698678 - DNA, 20 bp, Artificial
  CRISPR gRNA sequence
gaaagcccttctggtttaca

SEQ ID NO: 698679 - DNA, 20 bp, Artificial
  CRISPR gRNA sequence
ctggtttacaattcttgaga

SEQ ID NO: 698680 - DNA, 20 bp, Artificial
  CRISPR gRNA sequence
tggtttacaattcttgagag

SEQ ID NO: 698681 - DNA, 20 bp, Artificial
  CRISPR gRNA sequence
gtttacaattcttgagaggg

SEQ ID NO: 698682 - DNA, 20 bp, Artificial
  CRISPR gRNA sequence
acaattcttgagagggtggc

SEQ ID NO: 698683 - DNA, 20 bp, Artificial
  CRISPR gRNA sequence
caattcttgagagggtggct

SEQ ID NO: 698684 - DNA, 20 bp, Artificial
  CRISPR gRNA sequence
ttgagagggtggctctcggg

SEQ ID NO: 698685 - DNA, 20 bp, Artificial
  CRISPR gRNA sequence
gagagggtggctctcgggtg

SEQ ID NO: 698686 - DNA, 20 bp, Artificial
  CRISPR gRNA sequence
agagggtggctctcgggtgg

SEQ ID NO: 698687 - DNA, 20 bp, Artificial
  CRISPR gRNA sequence
tcgggtggtggcaggagagg

SEQ ID NO: 698688 - DNA, 20 bp, Artificial
  CRISPR gRNA sequence
gggtggtggcaggagaggag

SEQ ID NO: 698689 - DNA, 20 bp, Artificial
  CRISPR gRNA sequence
gatttagtgttgatatactt

SEQ ID NO: 698690 - DNA, 20 bp, Artificial
  CRISPR gRNA sequence
agtgttgatatacttgttaa

SEQ ID NO: 698691 - DNA, 20 bp, Artificial
  CRISPR gRNA sequence
gtgttgatatacttgttaat

SEQ ID NO: 698692 - DNA, 20 bp, Artificial
  CRISPR gRNA sequence
atatacttgttaatattgtg

SEQ ID NO: 698693 - DNA, 20 bp, Artificial
  CRISPR gRNA sequence
gttaatattgtggtaaaaca

SEQ ID NO: 698694 - DNA, 20 bp, Artificial
  CRISPR gRNA sequence
ttaatattgtggtaaaacat

SEQ ID NO: 698695 - DNA, 20 bp, Artificial
  CRISPR gRNA sequence
atattgtggtaaaacataca

SEQ ID NO: 698696 - DNA, 20 bp, Artificial
  CRISPR gRNA sequence
tggtaaaacatacataccat

SEQ ID NO: 698697 - DNA, 20 bp, Artificial
  CRISPR gRNA sequence
accttctaaccactttttca

SEQ ID NO: 698698 - DNA, 20 bp, Artificial
  CRISPR gRNA sequence
ccttctaaccactttttcag

SEQ ID NO: 698699 - DNA, 20 bp, Artificial
  CRISPR gRNA sequence
ctaaccactttttcagtgta

SEQ ID NO: 698700 - DNA, 20 bp, Artificial
  CRISPR gRNA sequence
taaccactttttcagtgtac

SEQ ID NO: 698701 - DNA, 20 bp, Artificial
  CRISPR gRNA sequence
accactttttcagtgtacaa

SEQ ID NO: 698702 - DNA, 20 bp, Artificial
  CRISPR gRNA sequence
tttcagtgtacaattcggtg

SEQ ID NO: 698703 - DNA, 20 bp, Artificial
  CRISPR gRNA sequence
ttcagtgtacaattcggtgg

SEQ ID NO: 698704 - DNA, 20 bp, Artificial
  CRISPR gRNA sequence
tcagtgtacaattcggtggc

SEQ ID NO: 698705 - DNA, 20 bp, Artificial
  CRISPR gRNA sequence
cagtgtacaattcggtggcc

SEQ ID NO: 698706 - DNA, 20 bp, Artificial
  CRISPR gRNA sequence
agtgtacaattcggtggcct

SEQ ID NO: 698707 - DNA, 20 bp, Artificial
  CRISPR gRNA sequence
ggtggcctaaagcacattta

SEQ ID NO: 698708 - DNA, 20 bp, Artificial
  CRISPR gRNA sequence
aagcacatttacaatgttgt

SEQ ID NO: 698709 - DNA, 20 bp, Artificial
  CRISPR gRNA sequence
acaatgttgtgtaaccacca

SEQ ID NO: 698710 - DNA, 20 bp, Artificial
  CRISPR gRNA sequence
caatgttgtgtaaccaccac

SEQ ID NO: 698711 - DNA, 20 bp, Artificial
  CRISPR gRNA sequence
tgtaaccaccaccaatatgc

SEQ ID NO: 698712 - DNA, 20 bp, Artificial
  CRISPR gRNA sequence
ccagaacattttcatcatcc

SEQ ID NO: 698713 - DNA, 20 bp, Artificial
  CRISPR gRNA sequence
cagaacattttcatcatccc

SEQ ID NO: 698714 - DNA, 20 bp, Artificial
  CRISPR gRNA sequence
tcatcatcccaacagaaact

SEQ ID NO: 698715 - DNA, 20 bp, Artificial
  CRISPR gRNA sequence
catcatcccaacagaaactg

SEQ ID NO: 698716 - DNA, 20 bp, Artificial
  CRISPR gRNA sequence
atcatcccaacagaaactgg

SEQ ID NO: 698717 - DNA, 20 bp, Artificial
  CRISPR gRNA sequence
gacccattaaaccaaagctg

SEQ ID NO: 698718 - DNA, 20 bp, Artificial
  CRISPR gRNA sequence
aaccaaagctgcccattctc

SEQ ID NO: 698719 - DNA, 20 bp, Artificial
  CRISPR gRNA sequence
cccattctccctaccctcaa

SEQ ID NO: 698720 - DNA, 20 bp, Artificial
  CRISPR gRNA sequence
tccctaccctcaatttctgg

SEQ ID NO: 698721 - DNA, 20 bp, Artificial
  CRISPR gRNA sequence
cctaccctcaatttctggta

SEQ ID NO: 698722 - DNA, 20 bp, Artificial
  CRISPR gRNA sequence
ccctcaatttctggtaaatt

SEQ ID NO: 698723 - DNA, 20 bp, Artificial
  CRISPR gRNA sequence
aatttctggtaaattctatt

SEQ ID NO: 698724 - DNA, 20 bp, Artificial
  CRISPR gRNA sequence
ctggtaaattctattttact

SEQ ID NO: 698725 - DNA, 20 bp, Artificial
  CRISPR gRNA sequence
tggtaaattctattttactc

SEQ ID NO: 698726 - DNA, 20 bp, Artificial
  CRISPR gRNA sequence
gtaaattctattttactctc

SEQ ID NO: 698727 - DNA, 20 bp, Artificial
  CRISPR gRNA sequence
tattttactctctgtttcta

SEQ ID NO: 698728 - DNA, 20 bp, Artificial
  CRISPR gRNA sequence
ttttactctctgtttctatg

SEQ ID NO: 698729 - DNA, 20 bp, Artificial
  CRISPR gRNA sequence
tactctctgtttctatgaat

SEQ ID NO: 698730 - DNA, 20 bp, Artificial
  CRISPR gRNA sequence
actctctgtttctatgaatt

SEQ ID NO: 698731 - DNA, 20 bp, Artificial
  CRISPR gRNA sequence
ctctctgtttctatgaattt

SEQ ID NO: 698732 - DNA, 20 bp, Artificial
  CRISPR gRNA sequence
tctgtttctatgaatttgcc

SEQ ID NO: 698733 - DNA, 20 bp, Artificial
  CRISPR gRNA sequence
tgtttctatgaatttgccta

SEQ ID NO: 698734 - DNA, 20 bp, Artificial
  CRISPR gRNA sequence
tttctatgaatttgcctatt

SEQ ID NO: 698735 - DNA, 20 bp, Artificial
  CRISPR gRNA sequence
ctatgaatttgcctatttta

SEQ ID NO: 698736 - DNA, 20 bp, Artificial
  CRISPR gRNA sequence
tatgaatttgcctattttag

SEQ ID NO: 698737 - DNA, 20 bp, Artificial
  CRISPR gRNA sequence
tgaatttgcctattttagct

SEQ ID NO: 698738 - DNA, 20 bp, Artificial
  CRISPR gRNA sequence
gcctattttagctgcatcac

SEQ ID NO: 698739 - DNA, 20 bp, Artificial
  CRISPR gRNA sequence
cctattttagctgcatcaca

SEQ ID NO: 698740 - DNA, 20 bp, Artificial
  CRISPR gRNA sequence
ttttagctgcatcacataag

SEQ ID NO: 698741 - DNA, 20 bp, Artificial
  CRISPR gRNA sequence
tagctgcatcacataagtga

SEQ ID NO: 698742 - DNA, 20 bp, Artificial
  CRISPR gRNA sequence
agctgcatcacataagtgaa

SEQ ID NO: 698743 - DNA, 20 bp, Artificial
  CRISPR gRNA sequence
gctgcatcacataagtgaaa

SEQ ID NO: 698744 - DNA, 20 bp, Artificial
  CRISPR gRNA sequence
catcacataagtgaaatatt

SEQ ID NO: 698745 - DNA, 20 bp, Artificial
  CRISPR gRNA sequence
tatttgtctttttgtttctg

SEQ ID NO: 698746 - DNA, 20 bp, Artificial
  CRISPR gRNA sequence
gtctttttgtttctggctca

SEQ ID NO: 698747 - DNA, 20 bp, Artificial
  CRISPR gRNA sequence
tctttttgtttctggctcat

SEQ ID NO: 698748 - DNA, 20 bp, Artificial
  CRISPR gRNA sequence
tttgtttctggctcatttca

SEQ ID NO: 698749 - DNA, 20 bp, Artificial
  CRISPR gRNA sequence
ttgtttctggctcatttcac

SEQ ID NO: 698750 - DNA, 20 bp, Artificial
  CRISPR gRNA sequence
tgtttctggctcatttcact

SEQ ID NO: 698751 - DNA, 20 bp, Artificial
  CRISPR gRNA sequence
gtttctggctcatttcactt

SEQ ID NO: 698752 - DNA, 20 bp, Artificial
  CRISPR gRNA sequence
tttctggctcatttcactta

SEQ ID NO: 698753 - DNA, 20 bp, Artificial
  CRISPR gRNA sequence
ctggctcatttcacttacag

SEQ ID NO: 698754 - DNA, 20 bp, Artificial
  CRISPR gRNA sequence
tggctcatttcacttacagt

SEQ ID NO: 698755 - DNA, 20 bp, Artificial
  CRISPR gRNA sequence
gctcatttcacttacagtgt

SEQ ID NO: 698756 - DNA, 20 bp, Artificial
  CRISPR gRNA sequence
atttcacttacagtgttctc

SEQ ID NO: 698757 - DNA, 20 bp, Artificial
  CRISPR gRNA sequence
cacttacagtgttctcaagg

SEQ ID NO: 698758 - DNA, 20 bp, Artificial
  CRISPR gRNA sequence
acttacagtgttctcaaggt

SEQ ID NO: 698759 - DNA, 20 bp, Artificial
  CRISPR gRNA sequence
acagtgttctcaaggttcat

SEQ ID NO: 698760 - DNA, 20 bp, Artificial
  CRISPR gRNA sequence
cagtgttctcaaggttcatg

SEQ ID NO: 698761 - DNA, 20 bp, Artificial
  CRISPR gRNA sequence
tcaaggttcatgcaacctga

SEQ ID NO: 698762 - DNA, 20 bp, Artificial
  CRISPR gRNA sequence
aaggttcatgcaacctgaat

SEQ ID NO: 698763 - DNA, 20 bp, Artificial
  CRISPR gRNA sequence
atgcaacctgaatttcattc

SEQ ID NO: 698764 - DNA, 20 bp, Artificial
  CRISPR gRNA sequence
aatttcattcacttttaagg

SEQ ID NO: 698765 - DNA, 20 bp, Artificial
  CRISPR gRNA sequence
cattcacttttaaggctgaa

SEQ ID NO: 698766 - DNA, 20 bp, Artificial
  CRISPR gRNA sequence
attcacttttaaggctgaat

SEQ ID NO: 698767 - DNA, 20 bp, Artificial
  CRISPR gRNA sequence
acttttaaggctgaataata

SEQ ID NO: 698768 - DNA, 20 bp, Artificial
  CRISPR gRNA sequence
ttaaggctgaataatattcc

SEQ ID NO: 698769 - DNA, 20 bp, Artificial
  CRISPR gRNA sequence
taaggctgaataatattcca

SEQ ID NO: 698770 - DNA, 20 bp, Artificial
  CRISPR gRNA sequence
aaggctgaataatattccat

SEQ ID NO: 698771 - DNA, 20 bp, Artificial
  CRISPR gRNA sequence
aggctgaataatattccatg

SEQ ID NO: 698772 - DNA, 20 bp, Artificial
  CRISPR gRNA sequence
aataatattccatgctatgt

SEQ ID NO: 698773 - DNA, 20 bp, Artificial
  CRISPR gRNA sequence
catgctatgtgcaccatggg

SEQ ID NO: 698774 - DNA, 20 bp, Artificial
  CRISPR gRNA sequence
tgtgcaccatgggtcgttta

SEQ ID NO: 698775 - DNA, 20 bp, Artificial
  CRISPR gRNA sequence
atctaatcatcctccgatgg

SEQ ID NO: 698776 - DNA, 20 bp, Artificial
  CRISPR gRNA sequence
tctaatcatcctccgatgga

SEQ ID NO: 698777 - DNA, 20 bp, Artificial
  CRISPR gRNA sequence
atcatcctccgatggacact

SEQ ID NO: 698778 - DNA, 20 bp, Artificial
  CRISPR gRNA sequence
cgatggacactcggttgctt

SEQ ID NO: 698779 - DNA, 20 bp, Artificial
  CRISPR gRNA sequence
ggttgcttccaccttttggc

SEQ ID NO: 698780 - DNA, 20 bp, Artificial
  CRISPR gRNA sequence
cttccaccttttggccattg

SEQ ID NO: 698781 - DNA, 20 bp, Artificial
  CRISPR gRNA sequence
ccaccttttggccattggga

SEQ ID NO: 698782 - DNA, 20 bp, Artificial
  CRISPR gRNA sequence
caccttttggccattgggaa

SEQ ID NO: 698783 - DNA, 20 bp, Artificial
  CRISPR gRNA sequence
ttggccattgggaatagtgc

SEQ ID NO: 698784 - DNA, 20 bp, Artificial
  CRISPR gRNA sequence
tggccattgggaatagtgct

SEQ ID NO: 698785 - DNA, 20 bp, Artificial
  CRISPR gRNA sequence
ggccattgggaatagtgctg

SEQ ID NO: 698786 - DNA, 20 bp, Artificial
  CRISPR gRNA sequence
gccattgggaatagtgctgc

SEQ ID NO: 698787 - DNA, 20 bp, Artificial
  CRISPR gRNA sequence
ggaatagtgctgctacgagc

SEQ ID NO: 698788 - DNA, 20 bp, Artificial
  CRISPR gRNA sequence
ctacgagcatgagtgtacaa

SEQ ID NO: 698789 - DNA, 20 bp, Artificial
  CRISPR gRNA sequence
cgagcatgagtgtacaatta

SEQ ID NO: 698790 - DNA, 20 bp, Artificial
  CRISPR gRNA sequence
tctgtgtgagttcctgcttt

SEQ ID NO: 698791 - DNA, 20 bp, Artificial
  CRISPR gRNA sequence
tgtgagttcctgctttcaat

SEQ ID NO: 698792 - DNA, 20 bp, Artificial
  CRISPR gRNA sequence
ctgctttcaattcttttggg

SEQ ID NO: 698793 - DNA, 20 bp, Artificial
  CRISPR gRNA sequence
ctttcaattcttttgggtat

SEQ ID NO: 698794 - DNA, 20 bp, Artificial
  CRISPR gRNA sequence
tcaattcttttgggtatatg

SEQ ID NO: 698795 - DNA, 20 bp, Artificial
  CRISPR gRNA sequence
caattcttttgggtatatgc

SEQ ID NO: 698796 - DNA, 20 bp, Artificial
  CRISPR gRNA sequence
aattcttttgggtatatgcc

SEQ ID NO: 698797 - DNA, 20 bp, Artificial
  CRISPR gRNA sequence
ttttgggtatatgcccaaaa

SEQ ID NO: 698798 - DNA, 20 bp, Artificial
  CRISPR gRNA sequence
ttgggtatatgcccaaaagt

SEQ ID NO: 698799 - DNA, 20 bp, Artificial
  CRISPR gRNA sequence
tgggtatatgcccaaaagtg

SEQ ID NO: 698800 - DNA, 20 bp, Artificial
  CRISPR gRNA sequence
gggtatatgcccaaaagtgg

SEQ ID NO: 698801 - DNA, 20 bp, Artificial
  CRISPR gRNA sequence
ggtatatgcccaaaagtgga

SEQ ID NO: 698802 - DNA, 20 bp, Artificial
  CRISPR gRNA sequence
ttggctcctatggaaattgt

SEQ ID NO: 698803 - DNA, 20 bp, Artificial
  CRISPR gRNA sequence
gctcctatggaaattgtgtt

SEQ ID NO: 698804 - DNA, 20 bp, Artificial
  CRISPR gRNA sequence
ctatggaaattgtgttttta

SEQ ID NO: 698805 - DNA, 20 bp, Artificial
  CRISPR gRNA sequence
tggaaattgtgtttttactt

SEQ ID NO: 698806 - DNA, 20 bp, Artificial
  CRISPR gRNA sequence
tgtttttactttcttgagga

SEQ ID NO: 698807 - DNA, 20 bp, Artificial
  CRISPR gRNA sequence
ttactttcttgaggaagcat

SEQ ID NO: 698808 - DNA, 20 bp, Artificial
  CRISPR gRNA sequence
tactttcttgaggaagcatc

SEQ ID NO: 698809 - DNA, 20 bp, Artificial
  CRISPR gRNA sequence
actttcttgaggaagcatca

SEQ ID NO: 698810 - DNA, 20 bp, Artificial
  CRISPR gRNA sequence
ctttcttgaggaagcatcat

SEQ ID NO: 698811 - DNA, 20 bp, Artificial
  CRISPR gRNA sequence
tcttgaggaagcatcatact

SEQ ID NO: 698812 - DNA, 20 bp, Artificial
  CRISPR gRNA sequence
cttgaggaagcatcatactg

SEQ ID NO: 698813 - DNA, 20 bp, Artificial
  CRISPR gRNA sequence
ttgaggaagcatcatactgt

SEQ ID NO: 698814 - DNA, 20 bp, Artificial
  CRISPR gRNA sequence
gaggaagcatcatactgttt

SEQ ID NO: 698815 - DNA, 20 bp, Artificial
  CRISPR gRNA sequence
aggaagcatcatactgtttt

SEQ ID NO: 698816 - DNA, 20 bp, Artificial
  CRISPR gRNA sequence
tttttcatggtcgctgtacc

SEQ ID NO: 698817 - DNA, 20 bp, Artificial
  CRISPR gRNA sequence
ttcatggtcgctgtaccact

SEQ ID NO: 698818 - DNA, 20 bp, Artificial
  CRISPR gRNA sequence
tcatggtcgctgtaccactg

SEQ ID NO: 698819 - DNA, 20 bp, Artificial
  CRISPR gRNA sequence
catggtcgctgtaccactgt

SEQ ID NO: 698820 - DNA, 20 bp, Artificial
  CRISPR gRNA sequence
atggtcgctgtaccactgta

SEQ ID NO: 698821 - DNA, 20 bp, Artificial
  CRISPR gRNA sequence
taccactgtacactctcacc

SEQ ID NO: 698822 - DNA, 20 bp, Artificial
  CRISPR gRNA sequence
tacactctcaccagcagtgt

SEQ ID NO: 698823 - DNA, 20 bp, Artificial
  CRISPR gRNA sequence
tcaccagcagtgtacaagtg

SEQ ID NO: 698824 - DNA, 20 bp, Artificial
  CRISPR gRNA sequence
accagcagtgtacaagtgtt

SEQ ID NO: 698825 - DNA, 20 bp, Artificial
  CRISPR gRNA sequence
tgacttctccacatcttcgc

SEQ ID NO: 698826 - DNA, 20 bp, Artificial
  CRISPR gRNA sequence
ctccacatcttcgccaacat

SEQ ID NO: 698827 - DNA, 20 bp, Artificial
  CRISPR gRNA sequence
tccacatcttcgccaacatt

SEQ ID NO: 698828 - DNA, 20 bp, Artificial
  CRISPR gRNA sequence
cacatcttcgccaacatttg

SEQ ID NO: 698829 - DNA, 20 bp, Artificial
  CRISPR gRNA sequence
cgccaacatttggactagtg

SEQ ID NO: 698830 - DNA, 20 bp, Artificial
  CRISPR gRNA sequence
gccaacatttggactagtga

SEQ ID NO: 698831 - DNA, 20 bp, Artificial
  CRISPR gRNA sequence
ggactagtgaagttcagcat

SEQ ID NO: 698832 - DNA, 20 bp, Artificial
  CRISPR gRNA sequence
gactagtgaagttcagcata

SEQ ID NO: 698833 - DNA, 20 bp, Artificial
  CRISPR gRNA sequence
gtgaagttcagcatattttc

SEQ ID NO: 698834 - DNA, 20 bp, Artificial
  CRISPR gRNA sequence
agcatattttcatgtgccta

SEQ ID NO: 698835 - DNA, 20 bp, Artificial
  CRISPR gRNA sequence
tcatgtgcctattgcccatt

SEQ ID NO: 698836 - DNA, 20 bp, Artificial
  CRISPR gRNA sequence
catgtgcctattgcccattt

SEQ ID NO: 698837 - DNA, 20 bp, Artificial
  CRISPR gRNA sequence
atgtgcctattgcccatttg

SEQ ID NO: 698838 - DNA, 20 bp, Artificial
  CRISPR gRNA sequence
ttgcccatttgtatatcttc

SEQ ID NO: 698839 - DNA, 20 bp, Artificial
  CRISPR gRNA sequence
cccatttgtatatcttcttt

SEQ ID NO: 698840 - DNA, 20 bp, Artificial
  CRISPR gRNA sequence
gtatatcttctttggagaat

SEQ ID NO: 698841 - DNA, 20 bp, Artificial
  CRISPR gRNA sequence
tatatcttctttggagaatt

SEQ ID NO: 698842 - DNA, 20 bp, Artificial
  CRISPR gRNA sequence
ctttggagaattgtctattc

SEQ ID NO: 698843 - DNA, 20 bp, Artificial
  CRISPR gRNA sequence
tttggagaattgtctattca

SEQ ID NO: 698844 - DNA, 20 bp, Artificial
  CRISPR gRNA sequence
tggagaattgtctattcatg

SEQ ID NO: 698845 - DNA, 20 bp, Artificial
  CRISPR gRNA sequence
ggagaattgtctattcatgt

SEQ ID NO: 698846 - DNA, 20 bp, Artificial
  CRISPR gRNA sequence
gagaattgtctattcatgtt

SEQ ID NO: 698847 - DNA, 20 bp, Artificial
  CRISPR gRNA sequence
tctattcatgttgttcactc

SEQ ID NO: 698848 - DNA, 20 bp, Artificial
  CRISPR gRNA sequence
ttcatgttgttcactcattt

SEQ ID NO: 698849 - DNA, 20 bp, Artificial
  CRISPR gRNA sequence
atgttgttcactcatttttg

SEQ ID NO: 698850 - DNA, 20 bp, Artificial
  CRISPR gRNA sequence
ttcactcatttttgaatgag

SEQ ID NO: 698851 - DNA, 20 bp, Artificial
  CRISPR gRNA sequence
actcatttttgaatgagatt

SEQ ID NO: 698852 - DNA, 20 bp, Artificial
  CRISPR gRNA sequence
atttttgaatgagattgttt

SEQ ID NO: 698853 - DNA, 20 bp, Artificial
  CRISPR gRNA sequence
ttgaatgagattgtttgttt

SEQ ID NO: 698854 - DNA, 20 bp, Artificial
  CRISPR gRNA sequence
tgaatgagattgtttgtttt

SEQ ID NO: 698855 - DNA, 20 bp, Artificial
  CRISPR gRNA sequence
gaatgagattgtttgttttt

SEQ ID NO: 698856 - DNA, 20 bp, Artificial
  CRISPR gRNA sequence
aatgagattgtttgtttttc

SEQ ID NO: 698857 - DNA, 20 bp, Artificial
  CRISPR gRNA sequence
tttgtttttctgttgttaag

SEQ ID NO: 698858 - DNA, 20 bp, Artificial
  CRISPR gRNA sequence
gtttttctgttgttaagtca

SEQ ID NO: 698859 - DNA, 20 bp, Artificial
  CRISPR gRNA sequence
tttttctgttgttaagtcat

SEQ ID NO: 698860 - DNA, 20 bp, Artificial
  CRISPR gRNA sequence
ttctgttgttaagtcatagt

SEQ ID NO: 698861 - DNA, 20 bp, Artificial
  CRISPR gRNA sequence
tctgttgttaagtcatagtt

SEQ ID NO: 698862 - DNA, 20 bp, Artificial
  CRISPR gRNA sequence
ctgttgttaagtcatagttc

SEQ ID NO: 698863 - DNA, 20 bp, Artificial
  CRISPR gRNA sequence
tgttgttaagtcatagttct

SEQ ID NO: 698864 - DNA, 20 bp, Artificial
  CRISPR gRNA sequence
ttgttaagtcatagttcttt

SEQ ID NO: 698865 - DNA, 20 bp, Artificial
  CRISPR gRNA sequence
ttaagtcatagttctttatg

SEQ ID NO: 698866 - DNA, 20 bp, Artificial
  CRISPR gRNA sequence
agtcatagttctttatgtat

SEQ ID NO: 698867 - DNA, 20 bp, Artificial
  CRISPR gRNA sequence
tttatgtattctggatatta

SEQ ID NO: 698868 - DNA, 20 bp, Artificial
  CRISPR gRNA sequence
tatgtattctggatattaat

SEQ ID NO: 698869 - DNA, 20 bp, Artificial
  CRISPR gRNA sequence
atgtattctggatattaatt

SEQ ID NO: 698870 - DNA, 20 bp, Artificial
  CRISPR gRNA sequence
tgtattctggatattaattc

SEQ ID NO: 698871 - DNA, 20 bp, Artificial
  CRISPR gRNA sequence
tggatattaattctttatca

SEQ ID NO: 698872 - DNA, 20 bp, Artificial
  CRISPR gRNA sequence
gatattaattctttatcagg

SEQ ID NO: 698873 - DNA, 20 bp, Artificial
  CRISPR gRNA sequence
attctttatcaggtatataa

SEQ ID NO: 698874 - DNA, 20 bp, Artificial
  CRISPR gRNA sequence
tttatcaggtatataactgg

SEQ ID NO: 698875 - DNA, 20 bp, Artificial
  CRISPR gRNA sequence
tatcaggtatataactggca

SEQ ID NO: 698876 - DNA, 20 bp, Artificial
  CRISPR gRNA sequence
atcaggtatataactggcaa

SEQ ID NO: 698877 - DNA, 20 bp, Artificial
  CRISPR gRNA sequence
tcaggtatataactggcaaa

SEQ ID NO: 698878 - DNA, 20 bp, Artificial
  CRISPR gRNA sequence
gcaaatatttcctcccattc

SEQ ID NO: 698879 - DNA, 20 bp, Artificial
  CRISPR gRNA sequence
cctcccattctgtgcatttt

SEQ ID NO: 698880 - DNA, 20 bp, Artificial
  CRISPR gRNA sequence
ctcccattctgtgcattttc

SEQ ID NO: 698881 - DNA, 20 bp, Artificial
  CRISPR gRNA sequence
ccattctgtgcattttcttt

SEQ ID NO: 698882 - DNA, 20 bp, Artificial
  CRISPR gRNA sequence
tgtgcattttcttttaactc

SEQ ID NO: 698883 - DNA, 20 bp, Artificial
  CRISPR gRNA sequence
tgcattttcttttaactctc

SEQ ID NO: 698884 - DNA, 20 bp, Artificial
  CRISPR gRNA sequence
tcttttaactctcttaatag

SEQ ID NO: 698885 - DNA, 20 bp, Artificial
  CRISPR gRNA sequence
cttttaactctcttaatagt

SEQ ID NO: 698886 - DNA, 20 bp, Artificial
  CRISPR gRNA sequence
ttttaactctcttaatagtg

SEQ ID NO: 698887 - DNA, 20 bp, Artificial
  CRISPR gRNA sequence
ttaactctcttaatagtgtc

SEQ ID NO: 698888 - DNA, 20 bp, Artificial
  CRISPR gRNA sequence
taactctcttaatagtgtcc

SEQ ID NO: 698889 - DNA, 20 bp, Artificial
  CRISPR gRNA sequence
aactctcttaatagtgtccc

SEQ ID NO: 698890 - DNA, 20 bp, Artificial
  CRISPR gRNA sequence
actctcttaatagtgtccct

SEQ ID NO: 698891 - DNA, 20 bp, Artificial
  CRISPR gRNA sequence
tcttaatagtgtcccttgat

SEQ ID NO: 698892 - DNA, 20 bp, Artificial
  CRISPR gRNA sequence
ttaatagtgtcccttgatat

SEQ ID NO: 698893 - DNA, 20 bp, Artificial
  CRISPR gRNA sequence
aatagtgtcccttgatatat

SEQ ID NO: 698894 - DNA, 20 bp, Artificial
  CRISPR gRNA sequence
atagtgtcccttgatatata

SEQ ID NO: 698895 - DNA, 20 bp, Artificial
  CRISPR gRNA sequence
gatatataaaaaaggttttt

SEQ ID NO: 698896 - DNA, 20 bp, Artificial
  CRISPR gRNA sequence
atatataaaaaaggttttta

SEQ ID NO: 698897 - DNA, 20 bp, Artificial
  CRISPR gRNA sequence
ttaaattttgatagtctaat

SEQ ID NO: 698898 - DNA, 20 bp, Artificial
  CRISPR gRNA sequence
taaattttgatagtctaatt

SEQ ID NO: 698899 - DNA, 20 bp, Artificial
  CRISPR gRNA sequence
aaattttgatagtctaattt

SEQ ID NO: 698900 - DNA, 20 bp, Artificial
  CRISPR gRNA sequence
aattttgatagtctaattta

SEQ ID NO: 698901 - DNA, 20 bp, Artificial
  CRISPR gRNA sequence
tgatagtctaatttattgtt

SEQ ID NO: 698902 - DNA, 20 bp, Artificial
  CRISPR gRNA sequence
gatagtctaatttattgttt

SEQ ID NO: 698903 - DNA, 20 bp, Artificial
  CRISPR gRNA sequence
atagtctaatttattgtttt

SEQ ID NO: 698904 - DNA, 20 bp, Artificial
  CRISPR gRNA sequence
atttattgtttttcttttat

SEQ ID NO: 698905 - DNA, 20 bp, Artificial
  CRISPR gRNA sequence
attgtttttcttttattggt

SEQ ID NO: 698906 - DNA, 20 bp, Artificial
  CRISPR gRNA sequence
ttgtttttcttttattggtt

SEQ ID NO: 698907 - DNA, 20 bp, Artificial
  CRISPR gRNA sequence
tttttcttttattggttgtg

SEQ ID NO: 698908 - DNA, 20 bp, Artificial
  CRISPR gRNA sequence
ttcttttattggttgtgctt

SEQ ID NO: 698909 - DNA, 20 bp, Artificial
  CRISPR gRNA sequence
tcttttattggttgtgcttt

SEQ ID NO: 698910 - DNA, 20 bp, Artificial
  CRISPR gRNA sequence
cttttattggttgtgctttt

SEQ ID NO: 698911 - DNA, 20 bp, Artificial
  CRISPR gRNA sequence
ttttattggttgtgcttttg

SEQ ID NO: 698912 - DNA, 20 bp, Artificial
  CRISPR gRNA sequence
ttattggttgtgcttttgct

SEQ ID NO: 698913 - DNA, 20 bp, Artificial
  CRISPR gRNA sequence
tattggttgtgcttttgctc

SEQ ID NO: 698914 - DNA, 20 bp, Artificial
  CRISPR gRNA sequence
attggttgtgcttttgctca

SEQ ID NO: 698915 - DNA, 20 bp, Artificial
  CRISPR gRNA sequence
ttggttgtgcttttgctcac

SEQ ID NO: 698916 - DNA, 20 bp, Artificial
  CRISPR gRNA sequence
gttgtgcttttgctcaccag

SEQ ID NO: 698917 - DNA, 20 bp, Artificial
  CRISPR gRNA sequence
tgcttttgctcaccagccaa

SEQ ID NO: 698918 - DNA, 20 bp, Artificial
  CRISPR gRNA sequence
ttgctcaccagccaagaagc

SEQ ID NO: 698919 - DNA, 20 bp, Artificial
  CRISPR gRNA sequence
tgctcaccagccaagaagcc

SEQ ID NO: 698920 - DNA, 20 bp, Artificial
  CRISPR gRNA sequence
gctcaccagccaagaagcca

SEQ ID NO: 698921 - DNA, 20 bp, Artificial
  CRISPR gRNA sequence
ctcaccagccaagaagccat

SEQ ID NO: 698922 - DNA, 20 bp, Artificial
  CRISPR gRNA sequence
accagccaagaagccattgc

SEQ ID NO: 698923 - DNA, 20 bp, Artificial
  CRISPR gRNA sequence
ccacatccaatgttcctaag

SEQ ID NO: 698924 - DNA, 20 bp, Artificial
  CRISPR gRNA sequence
ctaagattttcttcaatgtt

SEQ ID NO: 698925 - DNA, 20 bp, Artificial
  CRISPR gRNA sequence
agattttcttcaatgttttc

SEQ ID NO: 698926 - DNA, 20 bp, Artificial
  CRISPR gRNA sequence
tcttcaatgttttcttctaa

SEQ ID NO: 698927 - DNA, 20 bp, Artificial
  CRISPR gRNA sequence
cttcaatgttttcttctaaa

SEQ ID NO: 698928 - DNA, 20 bp, Artificial
  CRISPR gRNA sequence
ttcaatgttttcttctaaaa

SEQ ID NO: 698929 - DNA, 20 bp, Artificial
  CRISPR gRNA sequence
caatgttttcttctaaaaga

SEQ ID NO: 698930 - DNA, 20 bp, Artificial
  CRISPR gRNA sequence
aatgttttcttctaaaagat

SEQ ID NO: 698931 - DNA, 20 bp, Artificial
  CRISPR gRNA sequence
tcttctaaaagatttatagg

SEQ ID NO: 698932 - DNA, 20 bp, Artificial
  CRISPR gRNA sequence
cttctaaaagatttataggt

SEQ ID NO: 698933 - DNA, 20 bp, Artificial
  CRISPR gRNA sequence
ttctaaaagatttataggtt

SEQ ID NO: 698934 - DNA, 20 bp, Artificial
  CRISPR gRNA sequence
ctaaaagatttataggttga

SEQ ID NO: 698935 - DNA, 20 bp, Artificial
  CRISPR gRNA sequence
taaaagatttataggttgaa

SEQ ID NO: 698936 - DNA, 20 bp, Artificial
  CRISPR gRNA sequence
aaagatttataggttgaact

SEQ ID NO: 698937 - DNA, 20 bp, Artificial
  CRISPR gRNA sequence
ataggttgaactcctaagtt

SEQ ID NO: 698938 - DNA, 20 bp, Artificial
  CRISPR gRNA sequence
taggttgaactcctaagttg

SEQ ID NO: 698939 - DNA, 20 bp, Artificial
  CRISPR gRNA sequence
aactcctaagttgagttcct

SEQ ID NO: 698940 - DNA, 20 bp, Artificial
  CRISPR gRNA sequence
ctaagttgagttccttgaac

SEQ ID NO: 698941 - DNA, 20 bp, Artificial
  CRISPR gRNA sequence
agttgagttccttgaaccat

SEQ ID NO: 698942 - DNA, 20 bp, Artificial
  CRISPR gRNA sequence
agttccttgaaccattctga

SEQ ID NO: 698943 - DNA, 20 bp, Artificial
  CRISPR gRNA sequence
cttgaaccattctgagttaa

SEQ ID NO: 698944 - DNA, 20 bp, Artificial
  CRISPR gRNA sequence
gaaccattctgagttaattg

SEQ ID NO: 698945 - DNA, 20 bp, Artificial
  CRISPR gRNA sequence
aaccattctgagttaattga

SEQ ID NO: 698946 - DNA, 20 bp, Artificial
  CRISPR gRNA sequence
tgagttaattgagttaattt

SEQ ID NO: 698947 - DNA, 20 bp, Artificial
  CRISPR gRNA sequence
agttaattgagttaattttt

SEQ ID NO: 698948 - DNA, 20 bp, Artificial
  CRISPR gRNA sequence
attgagttaatttttgaata

SEQ ID NO: 698949 - DNA, 20 bp, Artificial
  CRISPR gRNA sequence
agttaatttttgaatatggt

SEQ ID NO: 698950 - DNA, 20 bp, Artificial
  CRISPR gRNA sequence
atttttgaatatggtgtaag

SEQ ID NO: 698951 - DNA, 20 bp, Artificial
  CRISPR gRNA sequence
ttgaatatggtgtaaggtga

SEQ ID NO: 698952 - DNA, 20 bp, Artificial
  CRISPR gRNA sequence
tgaatatggtgtaaggtgat

SEQ ID NO: 698953 - DNA, 20 bp, Artificial
  CRISPR gRNA sequence
gaatatggtgtaaggtgatg

SEQ ID NO: 698954 - DNA, 20 bp, Artificial
  CRISPR gRNA sequence
aatatggtgtaaggtgatgc

SEQ ID NO: 698955 - DNA, 20 bp, Artificial
  CRISPR gRNA sequence
tgaattttgtccaacatcat

SEQ ID NO: 698956 - DNA, 20 bp, Artificial
  CRISPR gRNA sequence
tgtccaacatcattattttg

SEQ ID NO: 698957 - DNA, 20 bp, Artificial
  CRISPR gRNA sequence
gtccaacatcattattttgt

SEQ ID NO: 698958 - DNA, 20 bp, Artificial
  CRISPR gRNA sequence
tccaacatcattattttgta

SEQ ID NO: 698959 - DNA, 20 bp, Artificial
  CRISPR gRNA sequence
ttttgtatgtgggtattaag

SEQ ID NO: 698960 - DNA, 20 bp, Artificial
  CRISPR gRNA sequence
tgtatgtgggtattaaggtt

SEQ ID NO: 698961 - DNA, 20 bp, Artificial
  CRISPR gRNA sequence
gtatgtgggtattaaggttt

SEQ ID NO: 698962 - DNA, 20 bp, Artificial
  CRISPR gRNA sequence
tatgtgggtattaaggtttc

SEQ ID NO: 698963 - DNA, 20 bp, Artificial
  CRISPR gRNA sequence
aggtttcctggtactatcag

SEQ ID NO: 698964 - DNA, 20 bp, Artificial
  CRISPR gRNA sequence
cctggtactatcagctgaag

SEQ ID NO: 698965 - DNA, 20 bp, Artificial
  CRISPR gRNA sequence
ctggtactatcagctgaagt

SEQ ID NO: 698966 - DNA, 20 bp, Artificial
  CRISPR gRNA sequence
gtactatcagctgaagtggg

SEQ ID NO: 698967 - DNA, 20 bp, Artificial
  CRISPR gRNA sequence
tcagctgaagtggggctgat

SEQ ID NO: 698968 - DNA, 20 bp, Artificial
  CRISPR gRNA sequence
aagtggggctgatacacttg

SEQ ID NO: 698969 - DNA, 20 bp, Artificial
  CRISPR gRNA sequence
atacacttgtaagatgcagt

SEQ ID NO: 698970 - DNA, 20 bp, Artificial
  CRISPR gRNA sequence
gtaagatgcagtgagcactg

SEQ ID NO: 698971 - DNA, 20 bp, Artificial
  CRISPR gRNA sequence
taagatgcagtgagcactga

SEQ ID NO: 698972 - DNA, 20 bp, Artificial
  CRISPR gRNA sequence
ataaatgggaacaccatgca

SEQ ID NO: 698973 - DNA, 20 bp, Artificial
  CRISPR gRNA sequence
atttacttgtctttactcca

SEQ ID NO: 698974 - DNA, 20 bp, Artificial
  CRISPR gRNA sequence
tttacttgtctttactccac

SEQ ID NO: 698975 - DNA, 20 bp, Artificial
  CRISPR gRNA sequence
acttgtctttactccacagg

SEQ ID NO: 698976 - DNA, 20 bp, Artificial
  CRISPR gRNA sequence
cttgtctttactccacaggt

SEQ ID NO: 698977 - DNA, 20 bp, Artificial
  CRISPR gRNA sequence
gtctttactccacaggtgat

SEQ ID NO: 698978 - DNA, 20 bp, Artificial
  CRISPR gRNA sequence
tctttactccacaggtgatt

SEQ ID NO: 698979 - DNA, 20 bp, Artificial
  CRISPR gRNA sequence
tactccacaggtgattggag

SEQ ID NO: 698980 - DNA, 20 bp, Artificial
  CRISPR gRNA sequence
actccacaggtgattggagg

SEQ ID NO: 698981 - DNA, 20 bp, Artificial
  CRISPR gRNA sequence
ctccacaggtgattggagga

SEQ ID NO: 698982 - DNA, 20 bp, Artificial
  CRISPR gRNA sequence
cacaggtgattggaggaggc

SEQ ID NO: 698983 - DNA, 20 bp, Artificial
  CRISPR gRNA sequence
gaggaggcttttggtgacaa

SEQ ID NO: 698984 - DNA, 20 bp, Artificial
  CRISPR gRNA sequence
ttggtgacaaacccaaaaga

SEQ ID NO: 698985 - DNA, 20 bp, Artificial
  CRISPR gRNA sequence
tggtgacaaacccaaaagaa

SEQ ID NO: 698986 - DNA, 20 bp, Artificial
  CRISPR gRNA sequence
ggtgacaaacccaaaagaaa

SEQ ID NO: 698987 - DNA, 20 bp, Artificial
  CRISPR gRNA sequence
gtgacaaacccaaaagaaat

SEQ ID NO: 698988 - DNA, 20 bp, Artificial
  CRISPR gRNA sequence
ttattaaatcaaaatcaaat

SEQ ID NO: 698989 - DNA, 20 bp, Artificial
  CRISPR gRNA sequence
attaaatcaaaatcaaataa

SEQ ID NO: 698990 - DNA, 20 bp, Artificial
  CRISPR gRNA sequence
ttaaatcaaaatcaaataaa

SEQ ID NO: 698991 - DNA, 20 bp, Artificial
  CRISPR gRNA sequence
aatcaaaatcaaataaaatt

SEQ ID NO: 698992 - DNA, 20 bp, Artificial
  CRISPR gRNA sequence
taaattttaaaatgttaaga

SEQ ID NO: 698993 - DNA, 20 bp, Artificial
  CRISPR gRNA sequence
taaaatgttaagagtgaggc

SEQ ID NO: 698994 - DNA, 20 bp, Artificial
  CRISPR gRNA sequence
aaaatgttaagagtgaggca

SEQ ID NO: 698995 - DNA, 20 bp, Artificial
  CRISPR gRNA sequence
aaatgttaagagtgaggcaa

SEQ ID NO: 698996 - DNA, 20 bp, Artificial
  CRISPR gRNA sequence
agagtgaggcaagactagaa

SEQ ID NO: 698997 - DNA, 20 bp, Artificial
  CRISPR gRNA sequence
gaacatcactagacaggctg

SEQ ID NO: 698998 - DNA, 20 bp, Artificial
  CRISPR gRNA sequence
gacaggctgaaacatgctga

SEQ ID NO: 698999 - DNA, 20 bp, Artificial
  CRISPR gRNA sequence
aaacatgctgaaatggaggg

SEQ ID NO: 699000 - DNA, 20 bp, Artificial
  CRISPR gRNA sequence
aaatggagggtttactgctt

SEQ ID NO: 699001 - DNA, 20 bp, Artificial
  CRISPR gRNA sequence
actgctttccttgctttaaa

SEQ ID NO: 699002 - DNA, 20 bp, Artificial
  CRISPR gRNA sequence
ctgctttccttgctttaaat

SEQ ID NO: 699003 - DNA, 20 bp, Artificial
  CRISPR gRNA sequence
ctttccttgctttaaatttt

SEQ ID NO: 699004 - DNA, 20 bp, Artificial
  CRISPR gRNA sequence
tccttgctttaaattttgct

SEQ ID NO: 699005 - DNA, 20 bp, Artificial
  CRISPR gRNA sequence
ccttgctttaaattttgctg

SEQ ID NO: 699006 - DNA, 20 bp, Artificial
  CRISPR gRNA sequence
cttgctttaaattttgctgg

SEQ ID NO: 699007 - DNA, 20 bp, Artificial
  CRISPR gRNA sequence
gctttaaattttgctggctc

SEQ ID NO: 699008 - DNA, 20 bp, Artificial
  CRISPR gRNA sequence
ctttaaattttgctggctca

SEQ ID NO: 699009 - DNA, 20 bp, Artificial
  CRISPR gRNA sequence
taaattttgctggctcacaa

SEQ ID NO: 699010 - DNA, 20 bp, Artificial
  CRISPR gRNA sequence
aaattttgctggctcacaat

SEQ ID NO: 699011 - DNA, 20 bp, Artificial
  CRISPR gRNA sequence
aattttgctggctcacaatg

SEQ ID NO: 699012 - DNA, 20 bp, Artificial
  CRISPR gRNA sequence
tgctggctcacaatggctta

SEQ ID NO: 699013 - DNA, 20 bp, Artificial
  CRISPR gRNA sequence
gctggctcacaatggcttat

SEQ ID NO: 699014 - DNA, 20 bp, Artificial
  CRISPR gRNA sequence
ctggctcacaatggcttatg

SEQ ID NO: 699015 - DNA, 20 bp, Artificial
  CRISPR gRNA sequence
gctcacaatggcttatgttt

SEQ ID NO: 699016 - DNA, 20 bp, Artificial
  CRISPR gRNA sequence
acaatggcttatgtttattg

SEQ ID NO: 699017 - DNA, 20 bp, Artificial
  CRISPR gRNA sequence
atgtttattgcataaggggg

SEQ ID NO: 699018 - DNA, 20 bp, Artificial
  CRISPR gRNA sequence
tgtttattgcataagggggc

SEQ ID NO: 699019 - DNA, 20 bp, Artificial
  CRISPR gRNA sequence
attgcataagggggccacag

SEQ ID NO: 699020 - DNA, 20 bp, Artificial
  CRISPR gRNA sequence
ttgcataagggggccacagg

SEQ ID NO: 699021 - DNA, 20 bp, Artificial
  CRISPR gRNA sequence
cataagggggccacagggag

SEQ ID NO: 699022 - DNA, 20 bp, Artificial
  CRISPR gRNA sequence
cttgctcacataaggagccc

SEQ ID NO: 699023 - DNA, 20 bp, Artificial
  CRISPR gRNA sequence
gctcacataaggagcccctg

SEQ ID NO: 699024 - DNA, 20 bp, Artificial
  CRISPR gRNA sequence
ctcacataaggagcccctgg

SEQ ID NO: 699025 - DNA, 20 bp, Artificial
  CRISPR gRNA sequence
acataaggagcccctggttt

SEQ ID NO: 699026 - DNA, 20 bp, Artificial
  CRISPR gRNA sequence
gttttcttcagaaacaagtt

SEQ ID NO: 699027 - DNA, 20 bp, Artificial
  CRISPR gRNA sequence
tcttcagaaacaagttcaaa

SEQ ID NO: 699028 - DNA, 20 bp, Artificial
  CRISPR gRNA sequence
cttcagaaacaagttcaaat

SEQ ID NO: 699029 - DNA, 20 bp, Artificial
  CRISPR gRNA sequence
ttcagaaacaagttcaaatt

SEQ ID NO: 699030 - DNA, 20 bp, Artificial
  CRISPR gRNA sequence
cagaaacaagttcaaattct

SEQ ID NO: 699031 - DNA, 20 bp, Artificial
  CRISPR gRNA sequence
agaaacaagttcaaattctc

SEQ ID NO: 699032 - DNA, 20 bp, Artificial
  CRISPR gRNA sequence
aaattctccacttagagcca

SEQ ID NO: 699033 - DNA, 20 bp, Artificial
  CRISPR gRNA sequence
tccacttagagccaaaaaaa

SEQ ID NO: 699034 - DNA, 20 bp, Artificial
  CRISPR gRNA sequence
cacttagagccaaaaaaaat

SEQ ID NO: 699035 - DNA, 20 bp, Artificial
  CRISPR gRNA sequence
agagccaaaaaaaattaatt

SEQ ID NO: 699036 - DNA, 20 bp, Artificial
  CRISPR gRNA sequence
gagccaaaaaaaattaattg

SEQ ID NO: 699037 - DNA, 20 bp, Artificial
  CRISPR gRNA sequence
attgcaagatgttcaaactg

SEQ ID NO: 699038 - DNA, 20 bp, Artificial
  CRISPR gRNA sequence
caagatgttcaaactgaagt

SEQ ID NO: 699039 - DNA, 20 bp, Artificial
  CRISPR gRNA sequence
aaactgaagttggcttctat

SEQ ID NO: 699040 - DNA, 20 bp, Artificial
  CRISPR gRNA sequence
aagttggcttctataaagtc

SEQ ID NO: 699041 - DNA, 20 bp, Artificial
  CRISPR gRNA sequence
gcttctataaagtcaaagaa

SEQ ID NO: 699042 - DNA, 20 bp, Artificial
  CRISPR gRNA sequence
ctataaagtcaaagaataag

SEQ ID NO: 699043 - DNA, 20 bp, Artificial
  CRISPR gRNA sequence
tataaagtcaaagaataagc

SEQ ID NO: 699044 - DNA, 20 bp, Artificial
  CRISPR gRNA sequence
taaagtcaaagaataagcag

SEQ ID NO: 699045 - DNA, 20 bp, Artificial
  CRISPR gRNA sequence
aggaatccaaggaaattcta

SEQ ID NO: 699046 - DNA, 20 bp, Artificial
  CRISPR gRNA sequence
tacctttttacctagaaatg

SEQ ID NO: 699047 - DNA, 20 bp, Artificial
  CRISPR gRNA sequence
cctttttacctagaaatggc

SEQ ID NO: 699048 - DNA, 20 bp, Artificial
  CRISPR gRNA sequence
tttacctagaaatggcctca

SEQ ID NO: 699049 - DNA, 20 bp, Artificial
  CRISPR gRNA sequence
ttacctagaaatggcctcac

SEQ ID NO: 699050 - DNA, 20 bp, Artificial
  CRISPR gRNA sequence
tacctagaaatggcctcaca

SEQ ID NO: 699051 - DNA, 20 bp, Artificial
  CRISPR gRNA sequence
acctagaaatggcctcacaa

SEQ ID NO: 699052 - DNA, 20 bp, Artificial
  CRISPR gRNA sequence
cctagaaatggcctcacaat

SEQ ID NO: 699053 - DNA, 20 bp, Artificial
  CRISPR gRNA sequence
gaaatggcctcacaatgcgt

SEQ ID NO: 699054 - DNA, 20 bp, Artificial
  CRISPR gRNA sequence
acaatgcgtcgctgaaggga

SEQ ID NO: 699055 - DNA, 20 bp, Artificial
  CRISPR gRNA sequence
aagggagagggtcccttcca

SEQ ID NO: 699056 - DNA, 20 bp, Artificial
  CRISPR gRNA sequence
ccaggaaccccatgatgtag

SEQ ID NO: 699057 - DNA, 20 bp, Artificial
  CRISPR gRNA sequence
caggaaccccatgatgtagg

SEQ ID NO: 699058 - DNA, 20 bp, Artificial
  CRISPR gRNA sequence
ctgctgcagtcccaaattga

SEQ ID NO: 699059 - DNA, 20 bp, Artificial
  CRISPR gRNA sequence
tgctgcagtcccaaattgag

SEQ ID NO: 699060 - DNA, 20 bp, Artificial
  CRISPR gRNA sequence
ctgcagtcccaaattgagtt

SEQ ID NO: 699061 - DNA, 20 bp, Artificial
  CRISPR gRNA sequence
cagtcccaaattgagttgtc

SEQ ID NO: 699062 - DNA, 20 bp, Artificial
  CRISPR gRNA sequence
agttgtcccttctctctaac

SEQ ID NO: 699063 - DNA, 20 bp, Artificial
  CRISPR gRNA sequence
tcccttctctctaactgcag

SEQ ID NO: 699064 - DNA, 20 bp, Artificial
  CRISPR gRNA sequence
ctctctaactgcaggtccca

SEQ ID NO: 699065 - DNA, 20 bp, Artificial
  CRISPR gRNA sequence
tctctaactgcaggtcccac

SEQ ID NO: 699066 - DNA, 20 bp, Artificial
  CRISPR gRNA sequence
tctaactgcaggtcccacaa

SEQ ID NO: 699067 - DNA, 20 bp, Artificial
  CRISPR gRNA sequence
taactgcaggtcccacaaga

SEQ ID NO: 699068 - DNA, 20 bp, Artificial
  CRISPR gRNA sequence
actgcaggtcccacaagacc

SEQ ID NO: 699069 - DNA, 20 bp, Artificial
  CRISPR gRNA sequence
caggtcccacaagaccttac

SEQ ID NO: 699070 - DNA, 20 bp, Artificial
  CRISPR gRNA sequence
actgcagcttcaataatttc

SEQ ID NO: 699071 - DNA, 20 bp, Artificial
  CRISPR gRNA sequence
ctgcagcttcaataatttca

SEQ ID NO: 699072 - DNA, 20 bp, Artificial
  CRISPR gRNA sequence
cagcttcaataatttcacct

SEQ ID NO: 699073 - DNA, 20 bp, Artificial
  CRISPR gRNA sequence
caataatttcacctggtcta

SEQ ID NO: 699074 - DNA, 20 bp, Artificial
  CRISPR gRNA sequence
aataatttcacctggtctaa

SEQ ID NO: 699075 - DNA, 20 bp, Artificial
  CRISPR gRNA sequence
cacctggtctaagatttgag

SEQ ID NO: 699076 - DNA, 20 bp, Artificial
  CRISPR gRNA sequence
acctggtctaagatttgagg

SEQ ID NO: 699077 - DNA, 20 bp, Artificial
  CRISPR gRNA sequence
gtctaagatttgaggggttt

SEQ ID NO: 699078 - DNA, 20 bp, Artificial
  CRISPR gRNA sequence
agatttgaggggtttaatgc

SEQ ID NO: 699079 - DNA, 20 bp, Artificial
  CRISPR gRNA sequence
gaggggtttaatgcttttta

SEQ ID NO: 699080 - DNA, 20 bp, Artificial
  CRISPR gRNA sequence
aggggtttaatgctttttat

SEQ ID NO: 699081 - DNA, 20 bp, Artificial
  CRISPR gRNA sequence
aatgctttttattttgagct

SEQ ID NO: 699082 - DNA, 20 bp, Artificial
  CRISPR gRNA sequence
atgctttttattttgagctg

SEQ ID NO: 699083 - DNA, 20 bp, Artificial
  CRISPR gRNA sequence
tttattttgagctgctgtct

SEQ ID NO: 699084 - DNA, 20 bp, Artificial
  CRISPR gRNA sequence
ttattttgagctgctgtctg

SEQ ID NO: 699085 - DNA, 20 bp, Artificial
  CRISPR gRNA sequence
tattttgagctgctgtctgg

SEQ ID NO: 699086 - DNA, 20 bp, Artificial
  CRISPR gRNA sequence
attttgagctgctgtctggg

SEQ ID NO: 699087 - DNA, 20 bp, Artificial
  CRISPR gRNA sequence
ttttgagctgctgtctggga

SEQ ID NO: 699088 - DNA, 20 bp, Artificial
  CRISPR gRNA sequence
tgagctgctgtctgggactt

SEQ ID NO: 699089 - DNA, 20 bp, Artificial
  CRISPR gRNA sequence
gagctgctgtctgggactta

SEQ ID NO: 699090 - DNA, 20 bp, Artificial
  CRISPR gRNA sequence
agctgctgtctgggacttag

SEQ ID NO: 699091 - DNA, 20 bp, Artificial
  CRISPR gRNA sequence
ctgtctgggacttagaaagg

SEQ ID NO: 699092 - DNA, 20 bp, Artificial
  CRISPR gRNA sequence
tctgggacttagaaaggtga

SEQ ID NO: 699093 - DNA, 20 bp, Artificial
  CRISPR gRNA sequence
ggacttagaaaggtgacttg

SEQ ID NO: 699094 - DNA, 20 bp, Artificial
  CRISPR gRNA sequence
agaaaggtgacttgcatttt

SEQ ID NO: 699095 - DNA, 20 bp, Artificial
  CRISPR gRNA sequence
gaaaggtgacttgcattttt

SEQ ID NO: 699096 - DNA, 20 bp, Artificial
  CRISPR gRNA sequence
gcattttttgtcaaaatatt

SEQ ID NO: 699097 - DNA, 20 bp, Artificial
  CRISPR gRNA sequence
cattttttgtcaaaatatta

SEQ ID NO: 699098 - DNA, 20 bp, Artificial
  CRISPR gRNA sequence
tttgtcaaaatattatttct

SEQ ID NO: 699099 - DNA, 20 bp, Artificial
  CRISPR gRNA sequence
ttgtcaaaatattatttctt

SEQ ID NO: 699100 - DNA, 20 bp, Artificial
  CRISPR gRNA sequence
tgtcaaaatattatttcttt

SEQ ID NO: 699101 - DNA, 20 bp, Artificial
  CRISPR gRNA sequence
gtcaaaatattatttctttg

SEQ ID NO: 699102 - DNA, 20 bp, Artificial
  CRISPR gRNA sequence
tcaaaatattatttctttga

SEQ ID NO: 699103 - DNA, 20 bp, Artificial
  CRISPR gRNA sequence
tttctttgatggaatttgac

SEQ ID NO: 699104 - DNA, 20 bp, Artificial
  CRISPR gRNA sequence
ctttgatggaatttgacatt

SEQ ID NO: 699105 - DNA, 20 bp, Artificial
  CRISPR gRNA sequence
tttgatggaatttgacattg

SEQ ID NO: 699106 - DNA, 20 bp, Artificial
  CRISPR gRNA sequence
tgatggaatttgacattggt

SEQ ID NO: 699107 - DNA, 20 bp, Artificial
  CRISPR gRNA sequence
gatggaatttgacattggtg

SEQ ID NO: 699108 - DNA, 20 bp, Artificial
  CRISPR gRNA sequence
atggaatttgacattggtgg

SEQ ID NO: 699109 - DNA, 20 bp, Artificial
  CRISPR gRNA sequence
gacattggtggacactctgc

SEQ ID NO: 699110 - DNA, 20 bp, Artificial
  CRISPR gRNA sequence
acattggtggacactctgcc

SEQ ID NO: 699111 - DNA, 20 bp, Artificial
  CRISPR gRNA sequence
gtggacactctgccttcctg

SEQ ID NO: 699112 - DNA, 20 bp, Artificial
  CRISPR gRNA sequence
tgccttcctgtgtggttcct

SEQ ID NO: 699113 - DNA, 20 bp, Artificial
  CRISPR gRNA sequence
ccttcctgtgtggttcctac

SEQ ID NO: 699114 - DNA, 20 bp, Artificial
  CRISPR gRNA sequence
cctgtgtggttcctacaagg

SEQ ID NO: 699115 - DNA, 20 bp, Artificial
  CRISPR gRNA sequence
ctgtgtggttcctacaaggg

SEQ ID NO: 699116 - DNA, 20 bp, Artificial
  CRISPR gRNA sequence
tgtggttcctacaagggcag

SEQ ID NO: 699117 - DNA, 20 bp, Artificial
  CRISPR gRNA sequence
ctacaagggcagatgacctt

SEQ ID NO: 699118 - DNA, 20 bp, Artificial
  CRISPR gRNA sequence
caagggcagatgaccttgca

SEQ ID NO: 699119 - DNA, 20 bp, Artificial
  CRISPR gRNA sequence
gcacttctttttggcacttc

SEQ ID NO: 699120 - DNA, 20 bp, Artificial
  CRISPR gRNA sequence
cacttctttttggcacttca

SEQ ID NO: 699121 - DNA, 20 bp, Artificial
  CRISPR gRNA sequence
ctttttggcacttcactagc

SEQ ID NO: 699122 - DNA, 20 bp, Artificial
  CRISPR gRNA sequence
tttttggcacttcactagca

SEQ ID NO: 699123 - DNA, 20 bp, Artificial
  CRISPR gRNA sequence
tttggcacttcactagcagt

SEQ ID NO: 699124 - DNA, 20 bp, Artificial
  CRISPR gRNA sequence
ttggcacttcactagcagtg

SEQ ID NO: 699125 - DNA, 20 bp, Artificial
  CRISPR gRNA sequence
tggcacttcactagcagtga

SEQ ID NO: 699126 - DNA, 20 bp, Artificial
  CRISPR gRNA sequence
ggcacttcactagcagtgat

SEQ ID NO: 699127 - DNA, 20 bp, Artificial
  CRISPR gRNA sequence
gcacttcactagcagtgata

SEQ ID NO: 699128 - DNA, 20 bp, Artificial
  CRISPR gRNA sequence
cactagcagtgatagaaggt

SEQ ID NO: 699129 - DNA, 20 bp, Artificial
  CRISPR gRNA sequence
actagcagtgatagaaggtt

SEQ ID NO: 699130 - DNA, 20 bp, Artificial
  CRISPR gRNA sequence
gcagtgatagaaggtttgaa

SEQ ID NO: 699131 - DNA, 20 bp, Artificial
  CRISPR gRNA sequence
gaagttagggcctccctcaa

SEQ ID NO: 699132 - DNA, 20 bp, Artificial
  CRISPR gRNA sequence
aagttagggcctccctcaat

SEQ ID NO: 699133 - DNA, 20 bp, Artificial
  CRISPR gRNA sequence
gggcctccctcaatctttac

SEQ ID NO: 699134 - DNA, 20 bp, Artificial
  CRISPR gRNA sequence
cctcaatctttaccctctct

SEQ ID NO: 699135 - DNA, 20 bp, Artificial
  CRISPR gRNA sequence
aatctttaccctctctctaa

SEQ ID NO: 699136 - DNA, 20 bp, Artificial
  CRISPR gRNA sequence
taccctctctctaatgcaga

SEQ ID NO: 699137 - DNA, 20 bp, Artificial
  CRISPR gRNA sequence
accctctctctaatgcagag

SEQ ID NO: 699138 - DNA, 20 bp, Artificial
  CRISPR gRNA sequence
ccctctctctaatgcagagg

SEQ ID NO: 699139 - DNA, 20 bp, Artificial
  CRISPR gRNA sequence
tctctaatgcagaggattgc

SEQ ID NO: 699140 - DNA, 20 bp, Artificial
  CRISPR gRNA sequence
tctaatgcagaggattgcgg

SEQ ID NO: 699141 - DNA, 20 bp, Artificial
  CRISPR gRNA sequence
taatgcagaggattgcggcc

SEQ ID NO: 699142 - DNA, 20 bp, Artificial
  CRISPR gRNA sequence
atgcagaggattgcggcctg

SEQ ID NO: 699143 - DNA, 20 bp, Artificial
  CRISPR gRNA sequence
cggcctgttggcagaagagt

SEQ ID NO: 699144 - DNA, 20 bp, Artificial
  CRISPR gRNA sequence
ttggcagaagagtagtgtct

SEQ ID NO: 699145 - DNA, 20 bp, Artificial
  CRISPR gRNA sequence
gcagaagagtagtgtcttgg

SEQ ID NO: 699146 - DNA, 20 bp, Artificial
  CRISPR gRNA sequence
gggccccagctgacctgatg

SEQ ID NO: 699147 - DNA, 20 bp, Artificial
  CRISPR gRNA sequence
ggccccagctgacctgatga

SEQ ID NO: 699148 - DNA, 20 bp, Artificial
  CRISPR gRNA sequence
acctgatgaatatcaatatc

SEQ ID NO: 699149 - DNA, 20 bp, Artificial
  CRISPR gRNA sequence
atgaatatcaatatccaatg

SEQ ID NO: 699150 - DNA, 20 bp, Artificial
  CRISPR gRNA sequence
taatgaagtcatgtgtgcac

SEQ ID NO: 699151 - DNA, 20 bp, Artificial
  CRISPR gRNA sequence
ctgcatgcagtctcatggga

SEQ ID NO: 699152 - DNA, 20 bp, Artificial
  CRISPR gRNA sequence
tgcatgcagtctcatgggaa

SEQ ID NO: 699153 - DNA, 20 bp, Artificial
  CRISPR gRNA sequence
catgcagtctcatgggaagg

SEQ ID NO: 699154 - DNA, 20 bp, Artificial
  CRISPR gRNA sequence
atgggaaggtgggttcctgg

SEQ ID NO: 699155 - DNA, 20 bp, Artificial
  CRISPR gRNA sequence
ctggaccccaggttacaggc

SEQ ID NO: 699156 - DNA, 20 bp, Artificial
  CRISPR gRNA sequence
gaccccaggttacaggccta

SEQ ID NO: 699157 - DNA, 20 bp, Artificial
  CRISPR gRNA sequence
caggcctaagcactacaggc

SEQ ID NO: 699158 - DNA, 20 bp, Artificial
  CRISPR gRNA sequence
agcactacaggcatacagat

SEQ ID NO: 699159 - DNA, 20 bp, Artificial
  CRISPR gRNA sequence
caggcatacagatggagctc

SEQ ID NO: 699160 - DNA, 20 bp, Artificial
  CRISPR gRNA sequence
cagggaagggagagatgact

SEQ ID NO: 699161 - DNA, 20 bp, Artificial
  CRISPR gRNA sequence
gggtgggaccacacttttcc

SEQ ID NO: 699162 - DNA, 20 bp, Artificial
  CRISPR gRNA sequence
ttccttcagggtgtccctca

SEQ ID NO: 699163 - DNA, 20 bp, Artificial
  CRISPR gRNA sequence
tccttcagggtgtccctcag

SEQ ID NO: 699164 - DNA, 20 bp, Artificial
  CRISPR gRNA sequence
ccttcagggtgtccctcagt

SEQ ID NO: 699165 - DNA, 20 bp, Artificial
  CRISPR gRNA sequence
cttcagggtgtccctcagtt

SEQ ID NO: 699166 - DNA, 20 bp, Artificial
  CRISPR gRNA sequence
cagggtgtccctcagttcaa

SEQ ID NO: 699167 - DNA, 20 bp, Artificial
  CRISPR gRNA sequence
agggtgtccctcagttcaag

SEQ ID NO: 699168 - DNA, 20 bp, Artificial
  CRISPR gRNA sequence
agttcaaggaagcttgtact

SEQ ID NO: 699169 - DNA, 20 bp, Artificial
  CRISPR gRNA sequence
aaggaagcttgtactcaagg

SEQ ID NO: 699170 - DNA, 20 bp, Artificial
  CRISPR gRNA sequence
gtactcaagggagagaaagt

SEQ ID NO: 699171 - DNA, 20 bp, Artificial
  CRISPR gRNA sequence
tactcaagggagagaaagtc

SEQ ID NO: 699172 - DNA, 20 bp, Artificial
  CRISPR gRNA sequence
aagggagagaaagtcctggc

SEQ ID NO: 699173 - DNA, 20 bp, Artificial
  CRISPR gRNA sequence
gcaggcctccttacccttgg

SEQ ID NO: 699174 - DNA, 20 bp, Artificial
  CRISPR gRNA sequence
cttacccttggcaatcttgg

SEQ ID NO: 699175 - DNA, 20 bp, Artificial
  CRISPR gRNA sequence
acccttggcaatcttggtat

SEQ ID NO: 699176 - DNA, 20 bp, Artificial
  CRISPR gRNA sequence
cccttggcaatcttggtatt

SEQ ID NO: 699177 - DNA, 20 bp, Artificial
  CRISPR gRNA sequence
ggcaatcttggtattggggc

SEQ ID NO: 699178 - DNA, 20 bp, Artificial
  CRISPR gRNA sequence
gcaatcttggtattggggct

SEQ ID NO: 699179 - DNA, 20 bp, Artificial
  CRISPR gRNA sequence
ggtattggggctggataatt

SEQ ID NO: 699180 - DNA, 20 bp, Artificial
  CRISPR gRNA sequence
gtattggggctggataatta

SEQ ID NO: 699181 - DNA, 20 bp, Artificial
  CRISPR gRNA sequence
gggctggataattatctgtt

SEQ ID NO: 699182 - DNA, 20 bp, Artificial
  CRISPR gRNA sequence
gataattatctgttatgtgg

SEQ ID NO: 699183 - DNA, 20 bp, Artificial
  CRISPR gRNA sequence
tctgttatgtgggtgattgg

SEQ ID NO: 699184 - DNA, 20 bp, Artificial
  CRISPR gRNA sequence
ttatgtgggtgattgggctg

SEQ ID NO: 699185 - DNA, 20 bp, Artificial
  CRISPR gRNA sequence
tgtgggtgattgggctgact

SEQ ID NO: 699186 - DNA, 20 bp, Artificial
  CRISPR gRNA sequence
ggctgacttgtgcactgcag

SEQ ID NO: 699187 - DNA, 20 bp, Artificial
  CRISPR gRNA sequence
acttgtgcactgcaggatgt

SEQ ID NO: 699188 - DNA, 20 bp, Artificial
  CRISPR gRNA sequence
gtgcactgcaggatgttcag

SEQ ID NO: 699189 - DNA, 20 bp, Artificial
  CRISPR gRNA sequence
tgcactgcaggatgttcagc

SEQ ID NO: 699190 - DNA, 20 bp, Artificial
  CRISPR gRNA sequence
caggatgttcagcatccctg

SEQ ID NO: 699191 - DNA, 20 bp, Artificial
  CRISPR gRNA sequence
agcatccctggtcattcccc

SEQ ID NO: 699192 - DNA, 20 bp, Artificial
  CRISPR gRNA sequence
gtcattccccacaagatgct

SEQ ID NO: 699193 - DNA, 20 bp, Artificial
  CRISPR gRNA sequence
cccacaagatgctggtagca

SEQ ID NO: 699194 - DNA, 20 bp, Artificial
  CRISPR gRNA sequence
gtagcaccttctcctcactc

SEQ ID NO: 699195 - DNA, 20 bp, Artificial
  CRISPR gRNA sequence
ctcctcactccagtcatggc

SEQ ID NO: 699196 - DNA, 20 bp, Artificial
  CRISPR gRNA sequence
tcctcactccagtcatggca

SEQ ID NO: 699197 - DNA, 20 bp, Artificial
  CRISPR gRNA sequence
ctcactccagtcatggcaac

SEQ ID NO: 699198 - DNA, 20 bp, Artificial
  CRISPR gRNA sequence
actccagtcatggcaacaaa

SEQ ID NO: 699199 - DNA, 20 bp, Artificial
  CRISPR gRNA sequence
cagtcatggcaacaaaacat

SEQ ID NO: 699200 - DNA, 20 bp, Artificial
  CRISPR gRNA sequence
ttccagacatagctaatgtc

SEQ ID NO: 699201 - DNA, 20 bp, Artificial
  CRISPR gRNA sequence
tccagacatagctaatgtcc

SEQ ID NO: 699202 - DNA, 20 bp, Artificial
  CRISPR gRNA sequence
ccagacatagctaatgtcct

SEQ ID NO: 699203 - DNA, 20 bp, Artificial
  CRISPR gRNA sequence
cagacatagctaatgtcctc

SEQ ID NO: 699204 - DNA, 20 bp, Artificial
  CRISPR gRNA sequence
atgtcctctggtgggaaaat

SEQ ID NO: 699205 - DNA, 20 bp, Artificial
  CRISPR gRNA sequence
tggtgggaaaattgctcctg

SEQ ID NO: 699206 - DNA, 20 bp, Artificial
  CRISPR gRNA sequence
gtgggaaaattgctcctgga

SEQ ID NO: 699207 - DNA, 20 bp, Artificial
  CRISPR gRNA sequence
ctcctggatgagaatacttg

SEQ ID NO: 699208 - DNA, 20 bp, Artificial
  CRISPR gRNA sequence
ctggatgagaatacttgttt

SEQ ID NO: 699209 - DNA, 20 bp, Artificial
  CRISPR gRNA sequence
gatgagaatacttgtttgag

SEQ ID NO: 699210 - DNA, 20 bp, Artificial
  CRISPR gRNA sequence
gtttgagaggtagagacact

SEQ ID NO: 699211 - DNA, 20 bp, Artificial
  CRISPR gRNA sequence
tttgagaggtagagacactc

SEQ ID NO: 699212 - DNA, 20 bp, Artificial
  CRISPR gRNA sequence
gagaggtagagacactcagg

SEQ ID NO: 699213 - DNA, 20 bp, Artificial
  CRISPR gRNA sequence
agaggtagagacactcagga

SEQ ID NO: 699214 - DNA, 20 bp, Artificial
  CRISPR gRNA sequence
aggagctgggcctgtagagg

SEQ ID NO: 699215 - DNA, 20 bp, Artificial
  CRISPR gRNA sequence
ggcctgtagagggaaagtga

SEQ ID NO: 699216 - DNA, 20 bp, Artificial
  CRISPR gRNA sequence
tagagggaaagtgatccaga

SEQ ID NO: 699217 - DNA, 20 bp, Artificial
  CRISPR gRNA sequence
gagaagacaggaagggagtc

SEQ ID NO: 699218 - DNA, 20 bp, Artificial
  CRISPR gRNA sequence
ggtctggaggggcctggcct

SEQ ID NO: 699219 - DNA, 20 bp, Artificial
  CRISPR gRNA sequence
gaggggcctggcctgatggt

SEQ ID NO: 699220 - DNA, 20 bp, Artificial
  CRISPR gRNA sequence
gcctgatggttgaaggtctg

SEQ ID NO: 699221 - DNA, 20 bp, Artificial
  CRISPR gRNA sequence
atggttgaaggtctggagct

SEQ ID NO: 699222 - DNA, 20 bp, Artificial
  CRISPR gRNA sequence
aaggtctggagctcagaacc

SEQ ID NO: 699223 - DNA, 20 bp, Artificial
  CRISPR gRNA sequence
gagctcagaacctcagggta

SEQ ID NO: 699224 - DNA, 20 bp, Artificial
  CRISPR gRNA sequence
agaacctcagggtatgggga

SEQ ID NO: 699225 - DNA, 20 bp, Artificial
  CRISPR gRNA sequence
agggtatggggaactaaagc

SEQ ID NO: 699226 - DNA, 20 bp, Artificial
  CRISPR gRNA sequence
aagctcgtgaggaatgggga

SEQ ID NO: 699227 - DNA, 20 bp, Artificial
  CRISPR gRNA sequence
gtgaggaatggggagagtgg

SEQ ID NO: 699228 - DNA, 20 bp, Artificial
  CRISPR gRNA sequence
ctattgccagaatatcacac

SEQ ID NO: 699229 - DNA, 20 bp, Artificial
  CRISPR gRNA sequence
ttgccagaatatcacactca

SEQ ID NO: 699230 - DNA, 20 bp, Artificial
  CRISPR gRNA sequence
ccagaatatcacactcatac

SEQ ID NO: 699231 - DNA, 20 bp, Artificial
  CRISPR gRNA sequence
atacccactaaacacccagc

SEQ ID NO: 699232 - DNA, 20 bp, Artificial
  CRISPR gRNA sequence
aacacccagcccatggttct

SEQ ID NO: 699233 - DNA, 20 bp, Artificial
  CRISPR gRNA sequence
tgcatctctgggaagtcagg

SEQ ID NO: 699234 - DNA, 20 bp, Artificial
  CRISPR gRNA sequence
catctctgggaagtcaggat

SEQ ID NO: 699235 - DNA, 20 bp, Artificial
  CRISPR gRNA sequence
tgggaagtcaggataaattt

SEQ ID NO: 699236 - DNA, 20 bp, Artificial
  CRISPR gRNA sequence
ggaagtcaggataaatttgg

SEQ ID NO: 699237 - DNA, 20 bp, Artificial
  CRISPR gRNA sequence
ggctgtatggggtcagtaag

SEQ ID NO: 699238 - DNA, 20 bp, Artificial
  CRISPR gRNA sequence
gctgtatggggtcagtaaga

SEQ ID NO: 699239 - DNA, 20 bp, Artificial
  CRISPR gRNA sequence
tatggggtcagtaagagtcc

SEQ ID NO: 699240 - DNA, 20 bp, Artificial
  CRISPR gRNA sequence
gtaaccctaggctttgtgtg

SEQ ID NO: 699241 - DNA, 20 bp, Artificial
  CRISPR gRNA sequence
ggctttgtgtgcctcctgat

SEQ ID NO: 699242 - DNA, 20 bp, Artificial
  CRISPR gRNA sequence
tgtgtgcctcctgatgtgat

SEQ ID NO: 699243 - DNA, 20 bp, Artificial
  CRISPR gRNA sequence
gtgtgcctcctgatgtgatg

SEQ ID NO: 699244 - DNA, 20 bp, Artificial
  CRISPR gRNA sequence
tgtgcctcctgatgtgatga

SEQ ID NO: 699245 - DNA, 20 bp, Artificial
  CRISPR gRNA sequence
ctgatgtgatgaatgtgcgg

SEQ ID NO: 699246 - DNA, 20 bp, Artificial
  CRISPR gRNA sequence
atgtgatgaatgtgcggtca

SEQ ID NO: 699247 - DNA, 20 bp, Artificial
  CRISPR gRNA sequence
ctcctgtaaacattgctgcc

SEQ ID NO: 699248 - DNA, 20 bp, Artificial
  CRISPR gRNA sequence
ctgtaaacattgctgccaaa

SEQ ID NO: 699249 - DNA, 20 bp, Artificial
  CRISPR gRNA sequence
taaacattgctgccaaatgt

SEQ ID NO: 699250 - DNA, 20 bp, Artificial
  CRISPR gRNA sequence
ctgccaaatgtttaacccag

SEQ ID NO: 699251 - DNA, 20 bp, Artificial
  CRISPR gRNA sequence
ccaaatgtttaacccagagc

SEQ ID NO: 699252 - DNA, 20 bp, Artificial
  CRISPR gRNA sequence
aacccagagctacataggtc

SEQ ID NO: 699253 - DNA, 20 bp, Artificial
  CRISPR gRNA sequence
acccagagctacataggtcc

SEQ ID NO: 699254 - DNA, 20 bp, Artificial
  CRISPR gRNA sequence
cataggtccttaggaggcat

SEQ ID NO: 699255 - DNA, 20 bp, Artificial
  CRISPR gRNA sequence
aggaggcatagcagttagag

SEQ ID NO: 699256 - DNA, 20 bp, Artificial
  CRISPR gRNA sequence
ggaggcatagcagttagagg

SEQ ID NO: 699257 - DNA, 20 bp, Artificial
  CRISPR gRNA sequence
gaggaaaaaagttaaaggca

SEQ ID NO: 699258 - DNA, 20 bp, Artificial
  CRISPR gRNA sequence
aaggcatcaggggaactaat

SEQ ID NO: 699259 - DNA, 20 bp, Artificial
  CRISPR gRNA sequence
atatgataaattcagtgtgg

SEQ ID NO: 699260 - DNA, 20 bp, Artificial
  CRISPR gRNA sequence
agtgtggagaagattccaca

SEQ ID NO: 699261 - DNA, 20 bp, Artificial
  CRISPR gRNA sequence
cacaggtatttggcctcatc

SEQ ID NO: 699262 - DNA, 20 bp, Artificial
  CRISPR gRNA sequence
ggcctcatctctgaaacagg

SEQ ID NO: 699263 - DNA, 20 bp, Artificial
  CRISPR gRNA sequence
gcctcatctctgaaacaggt

SEQ ID NO: 699264 - DNA, 20 bp, Artificial
  CRISPR gRNA sequence
atctctgaaacaggtaatgc

SEQ ID NO: 699265 - DNA, 20 bp, Artificial
  CRISPR gRNA sequence
tgaaacaggtaatgccattc

SEQ ID NO: 699266 - DNA, 20 bp, Artificial
  CRISPR gRNA sequence
aaacaggtaatgccattcta

SEQ ID NO: 699267 - DNA, 20 bp, Artificial
  CRISPR gRNA sequence
taaaagaaaaaagatgggtt

SEQ ID NO: 699268 - DNA, 20 bp, Artificial
  CRISPR gRNA sequence
aaagaaaaaagatgggttga

SEQ ID NO: 699269 - DNA, 20 bp, Artificial
  CRISPR gRNA sequence
attgttatagattgtaggta

SEQ ID NO: 699270 - DNA, 20 bp, Artificial
  CRISPR gRNA sequence
ttatagattgtaggtaatta

SEQ ID NO: 699271 - DNA, 20 bp, Artificial
  CRISPR gRNA sequence
tagattgtaggtaattaaag

SEQ ID NO: 699272 - DNA, 20 bp, Artificial
  CRISPR gRNA sequence
taggtaattaaagaaacata

SEQ ID NO: 699273 - DNA, 20 bp, Artificial
  CRISPR gRNA sequence
aagaaacataaccaaaggca

SEQ ID NO: 699274 - DNA, 20 bp, Artificial
  CRISPR gRNA sequence
taagaaaacaagctataaaa

SEQ ID NO: 699275 - DNA, 20 bp, Artificial
  CRISPR gRNA sequence
aagaaaacaagctataaaaa

SEQ ID NO: 699276 - DNA, 20 bp, Artificial
  CRISPR gRNA sequence
agaaaacaagctataaaaaa

SEQ ID NO: 699277 - DNA, 20 bp, Artificial
  CRISPR gRNA sequence
taaaaaataggtacaaaaat

SEQ ID NO: 699278 - DNA, 20 bp, Artificial
  CRISPR gRNA sequence
aaagaagtggagatatttga

SEQ ID NO: 699279 - DNA, 20 bp, Artificial
  CRISPR gRNA sequence
gaacataaaaggactttaaa

SEQ ID NO: 699280 - DNA, 20 bp, Artificial
  CRISPR gRNA sequence
aacataaaaggactttaaat

SEQ ID NO: 699281 - DNA, 20 bp, Artificial
  CRISPR gRNA sequence
taaataatattatggaatta

SEQ ID NO: 699282 - DNA, 20 bp, Artificial
  CRISPR gRNA sequence
aaataatattatggaattat

SEQ ID NO: 699283 - DNA, 20 bp, Artificial
  CRISPR gRNA sequence
aataatattatggaattatt

SEQ ID NO: 699284 - DNA, 20 bp, Artificial
  CRISPR gRNA sequence
tggaattatttattttcttt

SEQ ID NO: 699285 - DNA, 20 bp, Artificial
  CRISPR gRNA sequence
tttattttctttggtgtgat

SEQ ID NO: 699286 - DNA, 20 bp, Artificial
  CRISPR gRNA sequence
attttctttggtgtgataat

SEQ ID NO: 699287 - DNA, 20 bp, Artificial
  CRISPR gRNA sequence
ttttctttggtgtgataatg

SEQ ID NO: 699288 - DNA, 20 bp, Artificial
  CRISPR gRNA sequence
tctttggtgtgataatgttg

SEQ ID NO: 699289 - DNA, 20 bp, Artificial
  CRISPR gRNA sequence
ctttggtgtgataatgttgg

SEQ ID NO: 699290 - DNA, 20 bp, Artificial
  CRISPR gRNA sequence
tttggtgtgataatgttggt

SEQ ID NO: 699291 - DNA, 20 bp, Artificial
  CRISPR gRNA sequence
tggtgtgataatgttggttc

SEQ ID NO: 699292 - DNA, 20 bp, Artificial
  CRISPR gRNA sequence
ggtgtgataatgttggttct

SEQ ID NO: 699293 - DNA, 20 bp, Artificial
  CRISPR gRNA sequence
gtgtgataatgttggttctt

SEQ ID NO: 699294 - DNA, 20 bp, Artificial
  CRISPR gRNA sequence
gttcttattcttaggaggtg

SEQ ID NO: 699295 - DNA, 20 bp, Artificial
  CRISPR gRNA sequence
ttattcttaggaggtgtgtg

SEQ ID NO: 699296 - DNA, 20 bp, Artificial
  CRISPR gRNA sequence
attcttaggaggtgtgtgat

SEQ ID NO: 699297 - DNA, 20 bp, Artificial
  CRISPR gRNA sequence
ttcttaggaggtgtgtgatg

SEQ ID NO: 699298 - DNA, 20 bp, Artificial
  CRISPR gRNA sequence
ttaggaggtgtgtgatgaag

SEQ ID NO: 699299 - DNA, 20 bp, Artificial
  CRISPR gRNA sequence
aggaggtgtgtgatgaagta

SEQ ID NO: 699300 - DNA, 20 bp, Artificial
  CRISPR gRNA sequence
ggaggtgtgtgatgaagtat

SEQ ID NO: 699301 - DNA, 20 bp, Artificial
  CRISPR gRNA sequence
agtggtctagtatcatgggt

SEQ ID NO: 699302 - DNA, 20 bp, Artificial
  CRISPR gRNA sequence
gtggtctagtatcatgggtc

SEQ ID NO: 699303 - DNA, 20 bp, Artificial
  CRISPR gRNA sequence
gtatcatgggtcttgcaact

SEQ ID NO: 699304 - DNA, 20 bp, Artificial
  CRISPR gRNA sequence
gcaacttactttagaatgac

SEQ ID NO: 699305 - DNA, 20 bp, Artificial
  CRISPR gRNA sequence
caacttactttagaatgact

SEQ ID NO: 699306 - DNA, 20 bp, Artificial
  CRISPR gRNA sequence
actttagaatgactcagtca

SEQ ID NO: 699307 - DNA, 20 bp, Artificial
  CRISPR gRNA sequence
ctttagaatgactcagtcaa

SEQ ID NO: 699308 - DNA, 20 bp, Artificial
  CRISPR gRNA sequence
tagaatgactcagtcaaaaa

SEQ ID NO: 699309 - DNA, 20 bp, Artificial
  CRISPR gRNA sequence
agaatgactcagtcaaaaat

SEQ ID NO: 699310 - DNA, 20 bp, Artificial
  CRISPR gRNA sequence
gaatgactcagtcaaaaatc

SEQ ID NO: 699311 - DNA, 20 bp, Artificial
  CRISPR gRNA sequence
agtcaaaaatcttaatctgg

SEQ ID NO: 699312 - DNA, 20 bp, Artificial
  CRISPR gRNA sequence
aatctggacccttttcataa

SEQ ID NO: 699313 - DNA, 20 bp, Artificial
  CRISPR gRNA sequence
atctggacccttttcataag

SEQ ID NO: 699314 - DNA, 20 bp, Artificial
  CRISPR gRNA sequence
gacccttttcataagatggt

SEQ ID NO: 699315 - DNA, 20 bp, Artificial
  CRISPR gRNA sequence
ttcataagatggtgccaaga

SEQ ID NO: 699316 - DNA, 20 bp, Artificial
  CRISPR gRNA sequence
tcataagatggtgccaagaa

SEQ ID NO: 699317 - DNA, 20 bp, Artificial
  CRISPR gRNA sequence
cataagatggtgccaagaac

SEQ ID NO: 699318 - DNA, 20 bp, Artificial
  CRISPR gRNA sequence
ataagatggtgccaagaacg

SEQ ID NO: 699319 - DNA, 20 bp, Artificial
  CRISPR gRNA sequence
ctgcccctcctaaagccgaa

SEQ ID NO: 699320 - DNA, 20 bp, Artificial
  CRISPR gRNA sequence
cccctcctaaagccgaagcc

SEQ ID NO: 699321 - DNA, 20 bp, Artificial
  CRISPR gRNA sequence
ctaaagccgaagccaaagcg

SEQ ID NO: 699322 - DNA, 20 bp, Artificial
  CRISPR gRNA sequence
aagccgaagccaaagcgaag

SEQ ID NO: 699323 - DNA, 20 bp, Artificial
  CRISPR gRNA sequence
tgcaaggccaagaaggcagt

SEQ ID NO: 699324 - DNA, 20 bp, Artificial
  CRISPR gRNA sequence
gcaaggccaagaaggcagtg

SEQ ID NO: 699325 - DNA, 20 bp, Artificial
  CRISPR gRNA sequence
caaggccaagaaggcagtgt

SEQ ID NO: 699326 - DNA, 20 bp, Artificial
  CRISPR gRNA sequence
aaagatgtccacagccacaa

SEQ ID NO: 699327 - DNA, 20 bp, Artificial
  CRISPR gRNA sequence
ccggcggcccaagacactgt

SEQ ID NO: 699328 - DNA, 20 bp, Artificial
  CRISPR gRNA sequence
cggcggcccaagacactgtg

SEQ ID NO: 699329 - DNA, 20 bp, Artificial
  CRISPR gRNA sequence
tgactccggaggcagcccaa

SEQ ID NO: 699330 - DNA, 20 bp, Artificial
  CRISPR gRNA sequence
cggaggcagcccaaatatcc

SEQ ID NO: 699331 - DNA, 20 bp, Artificial
  CRISPR gRNA sequence
ggaagagcacccccaggaga

SEQ ID NO: 699332 - DNA, 20 bp, Artificial
  CRISPR gRNA sequence
gaagagcacccccaggagaa

SEQ ID NO: 699333 - DNA, 20 bp, Artificial
  CRISPR gRNA sequence
gaccaccatgttatcatcaa

SEQ ID NO: 699334 - DNA, 20 bp, Artificial
  CRISPR gRNA sequence
accaccatgttatcatcaag

SEQ ID NO: 699335 - DNA, 20 bp, Artificial
  CRISPR gRNA sequence
tcatcaagtttccgctgacc

SEQ ID NO: 699336 - DNA, 20 bp, Artificial
  CRISPR gRNA sequence
ccgctgaccactgagtaggc

SEQ ID NO: 699337 - DNA, 20 bp, Artificial
  CRISPR gRNA sequence
cgctgaccactgagtaggct

SEQ ID NO: 699338 - DNA, 20 bp, Artificial
  CRISPR gRNA sequence
accactgagtaggctgtgaa

SEQ ID NO: 699339 - DNA, 20 bp, Artificial
  CRISPR gRNA sequence
agtaggctgtgaagaagata

SEQ ID NO: 699340 - DNA, 20 bp, Artificial
  CRISPR gRNA sequence
tgaagaagatagaaaacaac

SEQ ID NO: 699341 - DNA, 20 bp, Artificial
  CRISPR gRNA sequence
cttgtgttcactgtggatgt

SEQ ID NO: 699342 - DNA, 20 bp, Artificial
  CRISPR gRNA sequence
gtgttcactgtggatgttaa

SEQ ID NO: 699343 - DNA, 20 bp, Artificial
  CRISPR gRNA sequence
tgttcactgtggatgttaaa

SEQ ID NO: 699344 - DNA, 20 bp, Artificial
  CRISPR gRNA sequence
actgtggatgttaaagccaa

SEQ ID NO: 699345 - DNA, 20 bp, Artificial
  CRISPR gRNA sequence
tggatgttaaagccaacaag

SEQ ID NO: 699346 - DNA, 20 bp, Artificial
  CRISPR gRNA sequence
aagccaacaagcaccagatc

SEQ ID NO: 699347 - DNA, 20 bp, Artificial
  CRISPR gRNA sequence
tgaagaagtttgtgacattg

SEQ ID NO: 699348 - DNA, 20 bp, Artificial
  CRISPR gRNA sequence
gtgacattgatgtggccaaa

SEQ ID NO: 699349 - DNA, 20 bp, Artificial
  CRISPR gRNA sequence
tgacattgatgtggccaaag

SEQ ID NO: 699350 - DNA, 20 bp, Artificial
  CRISPR gRNA sequence
atgtggccaaagtcaacact

SEQ ID NO: 699351 - DNA, 20 bp, Artificial
  CRISPR gRNA sequence
tgattcagtctgatggagag

SEQ ID NO: 699352 - DNA, 20 bp, Artificial
  CRISPR gRNA sequence
attcagtctgatggagagag

SEQ ID NO: 699353 - DNA, 20 bp, Artificial
  CRISPR gRNA sequence
agtctgatggagagaggaag

SEQ ID NO: 699354 - DNA, 20 bp, Artificial
  CRISPR gRNA sequence
atggagagaggaaggcatat

SEQ ID NO: 699355 - DNA, 20 bp, Artificial
  CRISPR gRNA sequence
gactggctcctgactacgat

SEQ ID NO: 699356 - DNA, 20 bp, Artificial
  CRISPR gRNA sequence
gctcctgactacgatgcttt

SEQ ID NO: 699357 - DNA, 20 bp, Artificial
  CRISPR gRNA sequence
ctgactacgatgctttggtt

SEQ ID NO: 699358 - DNA, 20 bp, Artificial
  CRISPR gRNA sequence
actacgatgctttggttgtt

SEQ ID NO: 699359 - DNA, 20 bp, Artificial
  CRISPR gRNA sequence
cgatgctttggttgttgcca

SEQ ID NO: 699360 - DNA, 20 bp, Artificial
  CRISPR gRNA sequence
tggttgttgccaccaaaatt

SEQ ID NO: 699361 - DNA, 20 bp, Artificial
  CRISPR gRNA sequence
ggttgttgccaccaaaattg

SEQ ID NO: 699362 - DNA, 20 bp, Artificial
  CRISPR gRNA sequence
gttgttgccaccaaaattgg

SEQ ID NO: 699363 - DNA, 20 bp, Artificial
  CRISPR gRNA sequence
ttgccaccaaaattgggatc

SEQ ID NO: 699364 - DNA, 20 bp, Artificial
  CRISPR gRNA sequence
ccaccaaaattgggatcacc

SEQ ID NO: 699365 - DNA, 20 bp, Artificial
  CRISPR gRNA sequence
ggatcacctaaactgagtca

SEQ ID NO: 699366 - DNA, 20 bp, Artificial
  CRISPR gRNA sequence
aactgagtcaagctggctaa

SEQ ID NO: 699367 - DNA, 20 bp, Artificial
  CRISPR gRNA sequence
agtcaagctggctaattcca

SEQ ID NO: 699368 - DNA, 20 bp, Artificial
  CRISPR gRNA sequence
gctaattccaaatatatgta

SEQ ID NO: 699369 - DNA, 20 bp, Artificial
  CRISPR gRNA sequence
attccaaatatatgtatatc

SEQ ID NO: 699370 - DNA, 20 bp, Artificial
  CRISPR gRNA sequence
caaatatatgtatatctttt

SEQ ID NO: 699371 - DNA, 20 bp, Artificial
  CRISPR gRNA sequence
ttcaccattaaaagaatctt

SEQ ID NO: 699372 - DNA, 20 bp, Artificial
  CRISPR gRNA sequence
tcaccattaaaagaatctta

SEQ ID NO: 699373 - DNA, 20 bp, Artificial
  CRISPR gRNA sequence
caccattaaaagaatcttaa

SEQ ID NO: 699374 - DNA, 20 bp, Artificial
  CRISPR gRNA sequence
accattaaaagaatcttaat

SEQ ID NO: 699375 - DNA, 20 bp, Artificial
  CRISPR gRNA sequence
aaagaatcttaatctctcta

SEQ ID NO: 699376 - DNA, 20 bp, Artificial
  CRISPR gRNA sequence
aatctctctattcactcttt

SEQ ID NO: 699377 - DNA, 20 bp, Artificial
  CRISPR gRNA sequence
atctctctattcactctttc

SEQ ID NO: 699378 - DNA, 20 bp, Artificial
  CRISPR gRNA sequence
tctattcactctttctcttc

SEQ ID NO: 699379 - DNA, 20 bp, Artificial
  CRISPR gRNA sequence
tattcactctttctcttcac

SEQ ID NO: 699380 - DNA, 20 bp, Artificial
  CRISPR gRNA sequence
ttcactctttctcttcacac

SEQ ID NO: 699381 - DNA, 20 bp, Artificial
  CRISPR gRNA sequence
actctttctcttcacacaca

SEQ ID NO: 699382 - DNA, 20 bp, Artificial
  CRISPR gRNA sequence
tttctcttcacacacacaca

SEQ ID NO: 699383 - DNA, 20 bp, Artificial
  CRISPR gRNA sequence
tctcttcacacacacacaca

SEQ ID NO: 699384 - DNA, 20 bp, Artificial
  CRISPR gRNA sequence
ctcttcacacacacacacac

SEQ ID NO: 699385 - DNA, 20 bp, Artificial
  CRISPR gRNA sequence
tcttcacacacacacacaca

SEQ ID NO: 699386 - DNA, 20 bp, Artificial
  CRISPR gRNA sequence
ttcacacacacacacacaca

SEQ ID NO: 699387 - DNA, 20 bp, Artificial
  CRISPR gRNA sequence
cacacacacacacacacaca

SEQ ID NO: 699388 - DNA, 20 bp, Artificial
  CRISPR gRNA sequence
acacacacacacacacacac

SEQ ID NO: 699389 - DNA, 20 bp, Artificial
  CRISPR gRNA sequence
acgtgcatgctataaaaaca

SEQ ID NO: 699390 - DNA, 20 bp, Artificial
  CRISPR gRNA sequence
cgtgcatgctataaaaacat

SEQ ID NO: 699391 - DNA, 20 bp, Artificial
  CRISPR gRNA sequence
taaaaacatatctacctgta

SEQ ID NO: 699392 - DNA, 20 bp, Artificial
  CRISPR gRNA sequence
cctgtatctataaaaagata

SEQ ID NO: 699393 - DNA, 20 bp, Artificial
  CRISPR gRNA sequence
tatctataaaaagatatatt

SEQ ID NO: 699394 - DNA, 20 bp, Artificial
  CRISPR gRNA sequence
taaaaagatatatttttatt

SEQ ID NO: 699395 - DNA, 20 bp, Artificial
  CRISPR gRNA sequence
ttattctttatttttaaaat

SEQ ID NO: 699396 - DNA, 20 bp, Artificial
  CRISPR gRNA sequence
tattctttatttttaaaatt

SEQ ID NO: 699397 - DNA, 20 bp, Artificial
  CRISPR gRNA sequence
attctttatttttaaaattt

SEQ ID NO: 699398 - DNA, 20 bp, Artificial
  CRISPR gRNA sequence
ttctttatttttaaaattta

SEQ ID NO: 699399 - DNA, 20 bp, Artificial
  CRISPR gRNA sequence
tttatttttaaaatttatgt

SEQ ID NO: 699400 - DNA, 20 bp, Artificial
  CRISPR gRNA sequence
tatttttaaaatttatgtat

SEQ ID NO: 699401 - DNA, 20 bp, Artificial
  CRISPR gRNA sequence
atttttaaaatttatgtatg

SEQ ID NO: 699402 - DNA, 20 bp, Artificial
  CRISPR gRNA sequence
tttttaaaatttatgtatgt

SEQ ID NO: 699403 - DNA, 20 bp, Artificial
  CRISPR gRNA sequence
ttaaaatttatgtatgttcg

SEQ ID NO: 699404 - DNA, 20 bp, Artificial
  CRISPR gRNA sequence
taaaatttatgtatgttcgt

SEQ ID NO: 699405 - DNA, 20 bp, Artificial
  CRISPR gRNA sequence
aaaatttatgtatgttcgtg

SEQ ID NO: 699406 - DNA, 20 bp, Artificial
  CRISPR gRNA sequence
aaatttatgtatgttcgtga

SEQ ID NO: 699407 - DNA, 20 bp, Artificial
  CRISPR gRNA sequence
atgtatgttcgtgaggcaca

SEQ ID NO: 699408 - DNA, 20 bp, Artificial
  CRISPR gRNA sequence
tgtatgttcgtgaggcacaa

SEQ ID NO: 699409 - DNA, 20 bp, Artificial
  CRISPR gRNA sequence
gtgaggcacaagtgcaattc

SEQ ID NO: 699410 - DNA, 20 bp, Artificial
  CRISPR gRNA sequence
tgctacattgatatcttgct

SEQ ID NO: 699411 - DNA, 20 bp, Artificial
  CRISPR gRNA sequence
ctacattgatatcttgcttc

SEQ ID NO: 699412 - DNA, 20 bp, Artificial
  CRISPR gRNA sequence
cattgatatcttgcttctca

SEQ ID NO: 699413 - DNA, 20 bp, Artificial
  CRISPR gRNA sequence
atatcttgcttctcagtccc

SEQ ID NO: 699414 - DNA, 20 bp, Artificial
  CRISPR gRNA sequence
gcttctcagtcccacacaag

SEQ ID NO: 699415 - DNA, 20 bp, Artificial
  CRISPR gRNA sequence
cttctcagtcccacacaagg

SEQ ID NO: 699416 - DNA, 20 bp, Artificial
  CRISPR gRNA sequence
ctcagtcccacacaaggaag

SEQ ID NO: 699417 - DNA, 20 bp, Artificial
  CRISPR gRNA sequence
tcagtcccacacaaggaagc

SEQ ID NO: 699418 - DNA, 20 bp, Artificial
  CRISPR gRNA sequence
agtcccacacaaggaagctg

SEQ ID NO: 699419 - DNA, 20 bp, Artificial
  CRISPR gRNA sequence
tctcacactatagagaaaat

SEQ ID NO: 699420 - DNA, 20 bp, Artificial
  CRISPR gRNA sequence
acactatagagaaaatattc

SEQ ID NO: 699421 - DNA, 20 bp, Artificial
  CRISPR gRNA sequence
tagagaaaatattcatgaac

SEQ ID NO: 699422 - DNA, 20 bp, Artificial
  CRISPR gRNA sequence
atgaacaaattcgtatcagt

SEQ ID NO: 699423 - DNA, 20 bp, Artificial
  CRISPR gRNA sequence
gtatcagtcacagtgagagg

SEQ ID NO: 699424 - DNA, 20 bp, Artificial
  CRISPR gRNA sequence
taaatagcccatttcatgct

SEQ ID NO: 699425 - DNA, 20 bp, Artificial
  CRISPR gRNA sequence
aatagcccatttcatgctca

SEQ ID NO: 699426 - DNA, 20 bp, Artificial
  CRISPR gRNA sequence
catgctcaagacatccaagt

SEQ ID NO: 699427 - DNA, 20 bp, Artificial
  CRISPR gRNA sequence
atgctcaagacatccaagtc

SEQ ID NO: 699428 - DNA, 20 bp, Artificial
  CRISPR gRNA sequence
aagacatccaagtcaaagaa

SEQ ID NO: 699429 - DNA, 20 bp, Artificial
  CRISPR gRNA sequence
agtcccctctgttccccccc

SEQ ID NO: 699430 - DNA, 20 bp, Artificial
  CRISPR gRNA sequence
tgttcccccccaacacccca

SEQ ID NO: 699431 - DNA, 20 bp, Artificial
  CRISPR gRNA sequence
ttcccccccaacaccccact

SEQ ID NO: 699432 - DNA, 20 bp, Artificial
  CRISPR gRNA sequence
ccccccaacaccccactcac

SEQ ID NO: 699433 - DNA, 20 bp, Artificial
  CRISPR gRNA sequence
acatcagggcccctgccctg

SEQ ID NO: 699434 - DNA, 20 bp, Artificial
  CRISPR gRNA sequence
ccctggagtgtcacctttat

SEQ ID NO: 699435 - DNA, 20 bp, Artificial
  CRISPR gRNA sequence
gagtgtcacctttattagct

SEQ ID NO: 699436 - DNA, 20 bp, Artificial
  CRISPR gRNA sequence
tattagctgtgagagacacc

SEQ ID NO: 699437 - DNA, 20 bp, Artificial
  CRISPR gRNA sequence
attagctgtgagagacaccc

SEQ ID NO: 699438 - DNA, 20 bp, Artificial
  CRISPR gRNA sequence
ttagctgtgagagacacccc

SEQ ID NO: 699439 - DNA, 20 bp, Artificial
  CRISPR gRNA sequence
gctgtgagagacaccccaga

SEQ ID NO: 699440 - DNA, 20 bp, Artificial
  CRISPR gRNA sequence
tgagagacaccccagagccc

SEQ ID NO: 699441 - DNA, 20 bp, Artificial
  CRISPR gRNA sequence
ggcactgtcagtgattgggg

SEQ ID NO: 699442 - DNA, 20 bp, Artificial
  CRISPR gRNA sequence
tcagtgattggggtagaaca

SEQ ID NO: 699443 - DNA, 20 bp, Artificial
  CRISPR gRNA sequence
gggtagaacaaaaataggac

SEQ ID NO: 699444 - DNA, 20 bp, Artificial
  CRISPR gRNA sequence
gtcagagcccacagatgtgg

SEQ ID NO: 699445 - DNA, 20 bp, Artificial
  CRISPR gRNA sequence
gaggaactgtggggtgggtg

SEQ ID NO: 699446 - DNA, 20 bp, Artificial
  CRISPR gRNA sequence
tggggtgggtgagctccctc

SEQ ID NO: 699447 - DNA, 20 bp, Artificial
  CRISPR gRNA sequence
cctcataggctcctgaccac

SEQ ID NO: 699448 - DNA, 20 bp, Artificial
  CRISPR gRNA sequence
ataggctcctgaccacaata

SEQ ID NO: 699449 - DNA, 20 bp, Artificial
  CRISPR gRNA sequence
ctgaccacaatatcccaaca

SEQ ID NO: 699450 - DNA, 20 bp, Artificial
  CRISPR gRNA sequence
accacaatatcccaacaatc

SEQ ID NO: 699451 - DNA, 20 bp, Artificial
  CRISPR gRNA sequence
agggatcagcctccttcatc

SEQ ID NO: 699452 - DNA, 20 bp, Artificial
  CRISPR gRNA sequence
cttcatcttacctgcagcct

SEQ ID NO: 699453 - DNA, 20 bp, Artificial
  CRISPR gRNA sequence
catcttacctgcagcctgag

SEQ ID NO: 699454 - DNA, 20 bp, Artificial
  CRISPR gRNA sequence
atcttacctgcagcctgaga

SEQ ID NO: 699455 - DNA, 20 bp, Artificial
  CRISPR gRNA sequence
acctgcagcctgagagtagc

SEQ ID NO: 699456 - DNA, 20 bp, Artificial
  CRISPR gRNA sequence
cctgcagcctgagagtagct

SEQ ID NO: 699457 - DNA, 20 bp, Artificial
  CRISPR gRNA sequence
cagcctgagagtagctccct

SEQ ID NO: 699458 - DNA, 20 bp, Artificial
  CRISPR gRNA sequence
agagtagctccctctgtttc

SEQ ID NO: 699459 - DNA, 20 bp, Artificial
  CRISPR gRNA sequence
cctctgtttctatctatggg

SEQ ID NO: 699460 - DNA, 20 bp, Artificial
  CRISPR gRNA sequence
tgtttctatctatgggaaga

SEQ ID NO: 699461 - DNA, 20 bp, Artificial
  CRISPR gRNA sequence
tttctatctatgggaagaaa

SEQ ID NO: 699462 - DNA, 20 bp, Artificial
  CRISPR gRNA sequence
ctatctatgggaagaaaatg

SEQ ID NO: 699463 - DNA, 20 bp, Artificial
  CRISPR gRNA sequence
tatctatgggaagaaaatgt

SEQ ID NO: 699464 - DNA, 20 bp, Artificial
  CRISPR gRNA sequence
tctatgggaagaaaatgtcc

SEQ ID NO: 699465 - DNA, 20 bp, Artificial
  CRISPR gRNA sequence
tgggaagaaaatgtcctgtg

SEQ ID NO: 699466 - DNA, 20 bp, Artificial
  CRISPR gRNA sequence
tgagaggccagaaaggaggc

SEQ ID NO: 699467 - DNA, 20 bp, Artificial
  CRISPR gRNA sequence
gagcaaacccctagtctttg

SEQ ID NO: 699468 - DNA, 20 bp, Artificial
  CRISPR gRNA sequence
gtctttgatcccagagaagt

SEQ ID NO: 699469 - DNA, 20 bp, Artificial
  CRISPR gRNA sequence
tgatcccagagaagtttcca

SEQ ID NO: 699470 - DNA, 20 bp, Artificial
  CRISPR gRNA sequence
gatcccagagaagtttccag

SEQ ID NO: 699471 - DNA, 20 bp, Artificial
  CRISPR gRNA sequence
atcccagagaagtttccaga

SEQ ID NO: 699472 - DNA, 20 bp, Artificial
  CRISPR gRNA sequence
ccagaaaagtgtaactgtag

SEQ ID NO: 699473 - DNA, 20 bp, Artificial
  CRISPR gRNA sequence
cagaaaagtgtaactgtaga

SEQ ID NO: 699474 - DNA, 20 bp, Artificial
  CRISPR gRNA sequence
tagatccagggcaggatcaa

SEQ ID NO: 699475 - DNA, 20 bp, Artificial
  CRISPR gRNA sequence
gaccaactgccctcctgagg

SEQ ID NO: 699476 - DNA, 20 bp, Artificial
  CRISPR gRNA sequence
ccctcctgaggtctgtcatc

SEQ ID NO: 699477 - DNA, 20 bp, Artificial
  CRISPR gRNA sequence
ctgaggtctgtcatcagcag

SEQ ID NO: 699478 - DNA, 20 bp, Artificial
  CRISPR gRNA sequence
aggtctgtcatcagcaggga

SEQ ID NO: 699479 - DNA, 20 bp, Artificial
  CRISPR gRNA sequence
tcatcagcagggaccttccc

SEQ ID NO: 699480 - DNA, 20 bp, Artificial
  CRISPR gRNA sequence
cccctgtgatttgtgactgc

SEQ ID NO: 699481 - DNA, 20 bp, Artificial
  CRISPR gRNA sequence
ccctgtgatttgtgactgct

SEQ ID NO: 699482 - DNA, 20 bp, Artificial
  CRISPR gRNA sequence
tgatttgtgactgctgggat

SEQ ID NO: 699483 - DNA, 20 bp, Artificial
  CRISPR gRNA sequence
gtgactgctgggatcaggtc

SEQ ID NO: 699484 - DNA, 20 bp, Artificial
  CRISPR gRNA sequence
tgactgctgggatcaggtcc

SEQ ID NO: 699485 - DNA, 20 bp, Artificial
  CRISPR gRNA sequence
ctgggatcaggtcccatcac

SEQ ID NO: 699486 - DNA, 20 bp, Artificial
  CRISPR gRNA sequence
ggatcaggtcccatcaccac

SEQ ID NO: 699487 - DNA, 20 bp, Artificial
  CRISPR gRNA sequence
tccttcattttcacaggagc

SEQ ID NO: 699488 - DNA, 20 bp, Artificial
  CRISPR gRNA sequence
cattttcacaggagctttac

SEQ ID NO: 699489 - DNA, 20 bp, Artificial
  CRISPR gRNA sequence
attttcacaggagctttaca

SEQ ID NO: 699490 - DNA, 20 bp, Artificial
  CRISPR gRNA sequence
tcacaggagctttacaaatg

SEQ ID NO: 699491 - DNA, 20 bp, Artificial
  CRISPR gRNA sequence
cacaggagctttacaaatga

SEQ ID NO: 699492 - DNA, 20 bp, Artificial
  CRISPR gRNA sequence
acaggagctttacaaatgag

SEQ ID NO: 699493 - DNA, 20 bp, Artificial
  CRISPR gRNA sequence
tacaaatgagtaggtgctgg

SEQ ID NO: 699494 - DNA, 20 bp, Artificial
  CRISPR gRNA sequence
acaaatgagtaggtgctggc

SEQ ID NO: 699495 - DNA, 20 bp, Artificial
  CRISPR gRNA sequence
caaatgagtaggtgctggca

SEQ ID NO: 699496 - DNA, 20 bp, Artificial
  CRISPR gRNA sequence
gcacacagggcccaggctgg

SEQ ID NO: 699497 - DNA, 20 bp, Artificial
  CRISPR gRNA sequence
ggtagacccatgagtgtgga

SEQ ID NO: 699498 - DNA, 20 bp, Artificial
  CRISPR gRNA sequence
cccagtaatgaggcagggca

SEQ ID NO: 699499 - DNA, 20 bp, Artificial
  CRISPR gRNA sequence
ccagtaatgaggcagggcac

SEQ ID NO: 699500 - DNA, 20 bp, Artificial
  CRISPR gRNA sequence
ctacttggggcttgcaaccc

SEQ ID NO: 699501 - DNA, 20 bp, Artificial
  CRISPR gRNA sequence
tacttggggcttgcaacccc

SEQ ID NO: 699502 - DNA, 20 bp, Artificial
  CRISPR gRNA sequence
cttggggcttgcaaccccca

SEQ ID NO: 699503 - DNA, 20 bp, Artificial
  CRISPR gRNA sequence
ggggcttgcaacccccagtg

SEQ ID NO: 699504 - DNA, 20 bp, Artificial
  CRISPR gRNA sequence
gggcttgcaacccccagtgg

SEQ ID NO: 699505 - DNA, 20 bp, Artificial
  CRISPR gRNA sequence
gcaacccccagtgggacaag

SEQ ID NO: 699506 - DNA, 20 bp, Artificial
  CRISPR gRNA sequence
caacccccagtgggacaaga

SEQ ID NO: 699507 - DNA, 20 bp, Artificial
  CRISPR gRNA sequence
agactccactcctcacccct

SEQ ID NO: 699508 - DNA, 20 bp, Artificial
  CRISPR gRNA sequence
cactcctcaccccttcctac

SEQ ID NO: 699509 - DNA, 20 bp, Artificial
  CRISPR gRNA sequence
ctcaccccttcctacctgag

SEQ ID NO: 699510 - DNA, 20 bp, Artificial
  CRISPR gRNA sequence
accccttcctacctgagctc

SEQ ID NO: 699511 - DNA, 20 bp, Artificial
  CRISPR gRNA sequence
cctacctgagctcttcttcc

SEQ ID NO: 699512 - DNA, 20 bp, Artificial
  CRISPR gRNA sequence
ctacctgagctcttcttcct

SEQ ID NO: 699513 - DNA, 20 bp, Artificial
  CRISPR gRNA sequence
cctgagctcttcttcctcca

SEQ ID NO: 699514 - DNA, 20 bp, Artificial
  CRISPR gRNA sequence
agctcttcttcctccacatc

SEQ ID NO: 699515 - DNA, 20 bp, Artificial
  CRISPR gRNA sequence
ttcttcctccacatcacagc

SEQ ID NO: 699516 - DNA, 20 bp, Artificial
  CRISPR gRNA sequence
cttcctccacatcacagcag

SEQ ID NO: 699517 - DNA, 20 bp, Artificial
  CRISPR gRNA sequence
ttcctccacatcacagcagc

SEQ ID NO: 699518 - DNA, 20 bp, Artificial
  CRISPR gRNA sequence
cctccacatcacagcagcga

SEQ ID NO: 699519 - DNA, 20 bp, Artificial
  CRISPR gRNA sequence
ctccacatcacagcagcgac

SEQ ID NO: 699520 - DNA, 20 bp, Artificial
  CRISPR gRNA sequence
cacatcacagcagcgaccac

SEQ ID NO: 699521 - DNA, 20 bp, Artificial
  CRISPR gRNA sequence
cagtgaccacagctccaagg

SEQ ID NO: 699522 - DNA, 20 bp, Artificial
  CRISPR gRNA sequence
caaggacaacaaggccagca

SEQ ID NO: 699523 - DNA, 20 bp, Artificial
  CRISPR gRNA sequence
gggagactgctctgggaaag

SEQ ID NO: 699524 - DNA, 20 bp, Artificial
  CRISPR gRNA sequence
ctctgggaaaggaagggaag

SEQ ID NO: 699525 - DNA, 20 bp, Artificial
  CRISPR gRNA sequence
tgggaaaggaagggaaggtg

SEQ ID NO: 699526 - DNA, 20 bp, Artificial
  CRISPR gRNA sequence
ggaaaggaagggaaggtgag

SEQ ID NO: 699527 - DNA, 20 bp, Artificial
  CRISPR gRNA sequence
atctccaggcctcagccctg

SEQ ID NO: 699528 - DNA, 20 bp, Artificial
  CRISPR gRNA sequence
caggcctcagccctgaccct

SEQ ID NO: 699529 - DNA, 20 bp, Artificial
  CRISPR gRNA sequence
agccctgaccctgctgaaga

SEQ ID NO: 699530 - DNA, 20 bp, Artificial
  CRISPR gRNA sequence
accctgctgaagagctccag

SEQ ID NO: 699531 - DNA, 20 bp, Artificial
  CRISPR gRNA sequence
ctgaagagctccagaagggc

SEQ ID NO: 699532 - DNA, 20 bp, Artificial
  CRISPR gRNA sequence
aagagctccagaagggctcc

SEQ ID NO: 699533 - DNA, 20 bp, Artificial
  CRISPR gRNA sequence
cagaagggctcctgctttcc

SEQ ID NO: 699534 - DNA, 20 bp, Artificial
  CRISPR gRNA sequence
ctgctttccctgagaaaaga

SEQ ID NO: 699535 - DNA, 20 bp, Artificial
  CRISPR gRNA sequence
ctttccctgagaaaagacat

SEQ ID NO: 699536 - DNA, 20 bp, Artificial
  CRISPR gRNA sequence
tccctgagaaaagacatgac

SEQ ID NO: 699537 - DNA, 20 bp, Artificial
  CRISPR gRNA sequence
ccctgagaaaagacatgacc

SEQ ID NO: 699538 - DNA, 20 bp, Artificial
  CRISPR gRNA sequence
cctgagaaaagacatgaccc

SEQ ID NO: 699539 - DNA, 20 bp, Artificial
  CRISPR gRNA sequence
agaaaagacatgacccctcg

SEQ ID NO: 699540 - DNA, 20 bp, Artificial
  CRISPR gRNA sequence
gttcccctctttacccatct

SEQ ID NO: 699541 - DNA, 20 bp, Artificial
  CRISPR gRNA sequence
ccctctttacccatctccct

SEQ ID NO: 699542 - DNA, 20 bp, Artificial
  CRISPR gRNA sequence
tttacccatctccctcctta

SEQ ID NO: 699543 - DNA, 20 bp, Artificial
  CRISPR gRNA sequence
tacccatctccctccttacc

SEQ ID NO: 699544 - DNA, 20 bp, Artificial
  CRISPR gRNA sequence
acccatctccctccttaccc

SEQ ID NO: 699545 - DNA, 20 bp, Artificial
  CRISPR gRNA sequence
cccatctccctccttacccc

SEQ ID NO: 699546 - DNA, 20 bp, Artificial
  CRISPR gRNA sequence
cctccttaccccatctcagg

SEQ ID NO: 699547 - DNA, 20 bp, Artificial
  CRISPR gRNA sequence
cttaccccatctcaggatga

SEQ ID NO: 699548 - DNA, 20 bp, Artificial
  CRISPR gRNA sequence
accccatctcaggatgaggg

SEQ ID NO: 699549 - DNA, 20 bp, Artificial
  CRISPR gRNA sequence
ccccatctcaggatgagggg

SEQ ID NO: 699550 - DNA, 20 bp, Artificial
  CRISPR gRNA sequence
aggatgaggggctggggcag

SEQ ID NO: 699551 - DNA, 20 bp, Artificial
  CRISPR gRNA sequence
gggcagcccctcgtgctgca

SEQ ID NO: 699552 - DNA, 20 bp, Artificial
  CRISPR gRNA sequence
gtgctgcacatggcatgtgt

SEQ ID NO: 699553 - DNA, 20 bp, Artificial
  CRISPR gRNA sequence
cacatggcatgtgtatctct

SEQ ID NO: 699554 - DNA, 20 bp, Artificial
  CRISPR gRNA sequence
tgttcctctccagaaggcac

SEQ ID NO: 699555 - DNA, 20 bp, Artificial
  CRISPR gRNA sequence
ttcctctccagaaggcacca

SEQ ID NO: 699556 - DNA, 20 bp, Artificial
  CRISPR gRNA sequence
ctctccagaaggcaccacca

SEQ ID NO: 699557 - DNA, 20 bp, Artificial
  CRISPR gRNA sequence
tccagaaggcaccaccacag

SEQ ID NO: 699558 - DNA, 20 bp, Artificial
  CRISPR gRNA sequence
cagaaggcaccaccacagcg

SEQ ID NO: 699559 - DNA, 20 bp, Artificial
  CRISPR gRNA sequence
ctggaaggttccatcccctg

SEQ ID NO: 699560 - DNA, 20 bp, Artificial
  CRISPR gRNA sequence
tggaaggttccatcccctgc

SEQ ID NO: 699561 - DNA, 20 bp, Artificial
  CRISPR gRNA sequence
gaaggttccatcccctgcag

SEQ ID NO: 699562 - DNA, 20 bp, Artificial
  CRISPR gRNA sequence
catcccctgcaggcctggtc

SEQ ID NO: 699563 - DNA, 20 bp, Artificial
  CRISPR gRNA sequence
caggcctggtctccacaagc

SEQ ID NO: 699564 - DNA, 20 bp, Artificial
  CRISPR gRNA sequence
gtctccacaagctctgtgtc

SEQ ID NO: 699565 - DNA, 20 bp, Artificial
  CRISPR gRNA sequence
cacaagctctgtgtcctggg

SEQ ID NO: 699566 - DNA, 20 bp, Artificial
  CRISPR gRNA sequence
tgtgtcctgggtctgttcct

SEQ ID NO: 699567 - DNA, 20 bp, Artificial
  CRISPR gRNA sequence
tgtcctgggtctgttcctcc

SEQ ID NO: 699568 - DNA, 20 bp, Artificial
  CRISPR gRNA sequence
ggtctgttcctccccatccc

SEQ ID NO: 699569 - DNA, 20 bp, Artificial
  CRISPR gRNA sequence
ttcctccccatcccgctgcc

SEQ ID NO: 699570 - DNA, 20 bp, Artificial
  CRISPR gRNA sequence
ctccccatcccgctgccagg

SEQ ID NO: 699571 - DNA, 20 bp, Artificial
  CRISPR gRNA sequence
cccatcccgctgccaggtca

SEQ ID NO: 699572 - DNA, 20 bp, Artificial
  CRISPR gRNA sequence
ccaggtcagcgtgatctccg

SEQ ID NO: 699573 - DNA, 20 bp, Artificial
  CRISPR gRNA sequence
cgcagggtagaagcccaggg

SEQ ID NO: 699574 - DNA, 20 bp, Artificial
  CRISPR gRNA sequence
agggtggcctcatggtcaga

SEQ ID NO: 699575 - DNA, 20 bp, Artificial
  CRISPR gRNA sequence
atggtcagagatggggtggt

SEQ ID NO: 699576 - DNA, 20 bp, Artificial
  CRISPR gRNA sequence
tggaggatctgagaagagtc

SEQ ID NO: 699577 - DNA, 20 bp, Artificial
  CRISPR gRNA sequence
ggaggatctgagaagagtca

SEQ ID NO: 699578 - DNA, 20 bp, Artificial
  CRISPR gRNA sequence
gaggatctgagaagagtcag

SEQ ID NO: 699579 - DNA, 20 bp, Artificial
  CRISPR gRNA sequence
agaagagtcagaaaattcag

SEQ ID NO: 699580 - DNA, 20 bp, Artificial
  CRISPR gRNA sequence
aggcactttgcactcctcat

SEQ ID NO: 699581 - DNA, 20 bp, Artificial
  CRISPR gRNA sequence
tgcactcctcatgggaaacc

SEQ ID NO: 699582 - DNA, 20 bp, Artificial
  CRISPR gRNA sequence
gcactcctcatgggaaaccc

SEQ ID NO: 699583 - DNA, 20 bp, Artificial
  CRISPR gRNA sequence
cactcctcatgggaaacccc

SEQ ID NO: 699584 - DNA, 20 bp, Artificial
  CRISPR gRNA sequence
ctcatgggaaaccccagcag

SEQ ID NO: 699585 - DNA, 20 bp, Artificial
  CRISPR gRNA sequence
atgggaaaccccagcagcac

SEQ ID NO: 699586 - DNA, 20 bp, Artificial
  CRISPR gRNA sequence
agaatggacaggacacctgg

SEQ ID NO: 699587 - DNA, 20 bp, Artificial
  CRISPR gRNA sequence
gggtggggaagggagcacag

SEQ ID NO: 699588 - DNA, 20 bp, Artificial
  CRISPR gRNA sequence
gacacagacacctgggaaaa

SEQ ID NO: 699589 - DNA, 20 bp, Artificial
  CRISPR gRNA sequence
ggaaaatctcctattccttg

SEQ ID NO: 699590 - DNA, 20 bp, Artificial
  CRISPR gRNA sequence
ctattccttggaaagttcga

SEQ ID NO: 699591 - DNA, 20 bp, Artificial
  CRISPR gRNA sequence
ttccttggaaagttcgagtc

SEQ ID NO: 699592 - DNA, 20 bp, Artificial
  CRISPR gRNA sequence
cttggaaagttcgagtctct

SEQ ID NO: 699593 - DNA, 20 bp, Artificial
  CRISPR gRNA sequence
ggaaagttcgagtctctgag

SEQ ID NO: 699594 - DNA, 20 bp, Artificial
  CRISPR gRNA sequence
gaaagttcgagtctctgagt

SEQ ID NO: 699595 - DNA, 20 bp, Artificial
  CRISPR gRNA sequence
gagtctctgagtggggagca

SEQ ID NO: 699596 - DNA, 20 bp, Artificial
  CRISPR gRNA sequence
tgagtggggagcagggactt

SEQ ID NO: 699597 - DNA, 20 bp, Artificial
  CRISPR gRNA sequence
agtggggagcagggacttct

SEQ ID NO: 699598 - DNA, 20 bp, Artificial
  CRISPR gRNA sequence
ctggccctgacctaagtgga

SEQ ID NO: 699599 - DNA, 20 bp, Artificial
  CRISPR gRNA sequence
tggccctgacctaagtggag

SEQ ID NO: 699600 - DNA, 20 bp, Artificial
  CRISPR gRNA sequence
gccctgacctaagtggaggc

SEQ ID NO: 699601 - DNA, 20 bp, Artificial
  CRISPR gRNA sequence
acctaagtggaggccgaggg

SEQ ID NO: 699602 - DNA, 20 bp, Artificial
  CRISPR gRNA sequence
agtggaggccgagggactgg

SEQ ID NO: 699603 - DNA, 20 bp, Artificial
  CRISPR gRNA sequence
gaatcagagccccaaacaca

SEQ ID NO: 699604 - DNA, 20 bp, Artificial
  CRISPR gRNA sequence
agtgtgaggcagagaacaaa

SEQ ID NO: 699605 - DNA, 20 bp, Artificial
  CRISPR gRNA sequence
gagagaaaagtcacggggcc

SEQ ID NO: 699606 - DNA, 20 bp, Artificial
  CRISPR gRNA sequence
agagaaaagtcacggggccc

SEQ ID NO: 699607 - DNA, 20 bp, Artificial
  CRISPR gRNA sequence
ttggagggctcaaaggggac

SEQ ID NO: 699608 - DNA, 20 bp, Artificial
  CRISPR gRNA sequence
gagggctcaaaggggaccgc

SEQ ID NO: 699609 - DNA, 20 bp, Artificial
  CRISPR gRNA sequence
aaaggggaccgcggatcggt

SEQ ID NO: 699610 - DNA, 20 bp, Artificial
  CRISPR gRNA sequence
cagggactgtcttccctcca

SEQ ID NO: 699611 - DNA, 20 bp, Artificial
  CRISPR gRNA sequence
tcttccctccattccctcag

SEQ ID NO: 699612 - DNA, 20 bp, Artificial
  CRISPR gRNA sequence
ccctccattccctcagagat

SEQ ID NO: 699613 - DNA, 20 bp, Artificial
  CRISPR gRNA sequence
cctccattccctcagagatt

SEQ ID NO: 699614 - DNA, 20 bp, Artificial
  CRISPR gRNA sequence
cattccctcagagatttcat

SEQ ID NO: 699615 - DNA, 20 bp, Artificial
  CRISPR gRNA sequence
cctcagagatttcatccctt

SEQ ID NO: 699616 - DNA, 20 bp, Artificial
  CRISPR gRNA sequence
agagatttcatcccttaatt

SEQ ID NO: 699617 - DNA, 20 bp, Artificial
  CRISPR gRNA sequence
catcccttaattgtcccaga

SEQ ID NO: 699618 - DNA, 20 bp, Artificial
  CRISPR gRNA sequence
atcccttaattgtcccagag

SEQ ID NO: 699619 - DNA, 20 bp, Artificial
  CRISPR gRNA sequence
aattgtcccagagagcaggg

SEQ ID NO: 699620 - DNA, 20 bp, Artificial
  CRISPR gRNA sequence
attgtcccagagagcagggc

SEQ ID NO: 699621 - DNA, 20 bp, Artificial
  CRISPR gRNA sequence
tcccagagagcagggcggac

SEQ ID NO: 699622 - DNA, 20 bp, Artificial
  CRISPR gRNA sequence
tcacagtcactctctggtac

SEQ ID NO: 699623 - DNA, 20 bp, Artificial
  CRISPR gRNA sequence
acagtcactctctggtaccg

SEQ ID NO: 699624 - DNA, 20 bp, Artificial
  CRISPR gRNA sequence
tctggtaccggatctcgaaa

SEQ ID NO: 699625 - DNA, 20 bp, Artificial
  CRISPR gRNA sequence
tggtaccggatctcgaaagc

SEQ ID NO: 699626 - DNA, 20 bp, Artificial
  CRISPR gRNA sequence
gtaccggatctcgaaagcca

SEQ ID NO: 699627 - DNA, 20 bp, Artificial
  CRISPR gRNA sequence
gaaagccaggaagattcttc

SEQ ID NO: 699628 - DNA, 20 bp, Artificial
  CRISPR gRNA sequence
ttcctactcaggactagagg

SEQ ID NO: 699629 - DNA, 20 bp, Artificial
  CRISPR gRNA sequence
cctactcaggactagaggga

SEQ ID NO: 699630 - DNA, 20 bp, Artificial
  CRISPR gRNA sequence
ctactcaggactagagggag

SEQ ID NO: 699631 - DNA, 20 bp, Artificial
  CRISPR gRNA sequence
ctcaggactagagggagggc

SEQ ID NO: 699632 - DNA, 20 bp, Artificial
  CRISPR gRNA sequence
aggactagagggagggcgat

SEQ ID NO: 699633 - DNA, 20 bp, Artificial
  CRISPR gRNA sequence
gagggagggcgatatcctag

SEQ ID NO: 699634 - DNA, 20 bp, Artificial
  CRISPR gRNA sequence
gcattgggcccactttcctc

SEQ ID NO: 699635 - DNA, 20 bp, Artificial
  CRISPR gRNA sequence
ggcccactttcctcccaacc

SEQ ID NO: 699636 - DNA, 20 bp, Artificial
  CRISPR gRNA sequence
tcctcccaaccttgtgcgag

SEQ ID NO: 699637 - DNA, 20 bp, Artificial
  CRISPR gRNA sequence
cctcccaaccttgtgcgagg

SEQ ID NO: 699638 - DNA, 20 bp, Artificial
  CRISPR gRNA sequence
ctcccaaccttgtgcgaggc

SEQ ID NO: 699639 - DNA, 20 bp, Artificial
  CRISPR gRNA sequence
ccaaccttgtgcgaggccat

SEQ ID NO: 699640 - DNA, 20 bp, Artificial
  CRISPR gRNA sequence
gtgcgaggccatcccaagag

SEQ ID NO: 699641 - DNA, 20 bp, Artificial
  CRISPR gRNA sequence
tgcgaggccatcccaagaga

SEQ ID NO: 699642 - DNA, 20 bp, Artificial
  CRISPR gRNA sequence
caggagatagggaaggcgcc

SEQ ID NO: 699643 - DNA, 20 bp, Artificial
  CRISPR gRNA sequence
gtacctgcgcgctgtagcgt

SEQ ID NO: 699644 - DNA, 20 bp, Artificial
  CRISPR gRNA sequence
cgcgctgtagcgtctccttc

SEQ ID NO: 699645 - DNA, 20 bp, Artificial
  CRISPR gRNA sequence
tagcgtctccttcccattct

SEQ ID NO: 699646 - DNA, 20 bp, Artificial
  CRISPR gRNA sequence
cttcccattctccaagtatc

SEQ ID NO: 699647 - DNA, 20 bp, Artificial
  CRISPR gRNA sequence
cccattctccaagtatctgc

SEQ ID NO: 699648 - DNA, 20 bp, Artificial
  CRISPR gRNA sequence
ccattctccaagtatctgcg

SEQ ID NO: 699649 - DNA, 20 bp, Artificial
  CRISPR gRNA sequence
tccaagtatctgcggagcaa

SEQ ID NO: 699650 - DNA, 20 bp, Artificial
  CRISPR gRNA sequence
caagtatctgcggagcaact

SEQ ID NO: 699651 - DNA, 20 bp, Artificial
  CRISPR gRNA sequence
cggagcaactccaggcactc

SEQ ID NO: 699652 - DNA, 20 bp, Artificial
  CRISPR gRNA sequence
caggcactcgccctccaggt

SEQ ID NO: 699653 - DNA, 20 bp, Artificial
  CRISPR gRNA sequence
gccctccaggtaggtcctga

SEQ ID NO: 699654 - DNA, 20 bp, Artificial
  CRISPR gRNA sequence
caggtaggtcctgaactcct

SEQ ID NO: 699655 - DNA, 20 bp, Artificial
  CRISPR gRNA sequence
aactcctctgcatattcctc

SEQ ID NO: 699656 - DNA, 20 bp, Artificial
  CRISPR gRNA sequence
ctctgcatattcctctgcct

SEQ ID NO: 699657 - DNA, 20 bp, Artificial
  CRISPR gRNA sequence
tgcatattcctctgcctcat

SEQ ID NO: 699658 - DNA, 20 bp, Artificial
  CRISPR gRNA sequence
catattcctctgcctcatag

SEQ ID NO: 699659 - DNA, 20 bp, Artificial
  CRISPR gRNA sequence
ctctgcctcatagaagcgct

SEQ ID NO: 699660 - DNA, 20 bp, Artificial
  CRISPR gRNA sequence
tgcctcatagaagcgctggg

SEQ ID NO: 699661 - DNA, 20 bp, Artificial
  CRISPR gRNA sequence
cctcatagaagcgctgggtg

SEQ ID NO: 699662 - DNA, 20 bp, Artificial
  CRISPR gRNA sequence
atagaagcgctgggtgatct

SEQ ID NO: 699663 - DNA, 20 bp, Artificial
  CRISPR gRNA sequence
ggtgatctgagccacggtgt

SEQ ID NO: 699664 - DNA, 20 bp, Artificial
  CRISPR gRNA sequence
agccacggtgtccgccgcgg

SEQ ID NO: 699665 - DNA, 20 bp, Artificial
  CRISPR gRNA sequence
gttcagggagatgtaatcct

SEQ ID NO: 699666 - DNA, 20 bp, Artificial
  CRISPR gRNA sequence
agggagatgtaatccttgcc

SEQ ID NO: 699667 - DNA, 20 bp, Artificial
  CRISPR gRNA sequence
gccgtcgtacgcgtgctggt

SEQ ID NO: 699668 - DNA, 20 bp, Artificial
  CRISPR gRNA sequence
ccgtcgtacgcgtgctggtg

SEQ ID NO: 699669 - DNA, 20 bp, Artificial
  CRISPR gRNA sequence
gtgatacccgcggaggaggc

SEQ ID NO: 699670 - DNA, 20 bp, Artificial
  CRISPR gRNA sequence
attccctggagggtgtgaga

SEQ ID NO: 699671 - DNA, 20 bp, Artificial
  CRISPR gRNA sequence
cctggagggtgtgagaccct

SEQ ID NO: 699672 - DNA, 20 bp, Artificial
  CRISPR gRNA sequence
gagggtgtgagaccctagcc

SEQ ID NO: 699673 - DNA, 20 bp, Artificial
  CRISPR gRNA sequence
gccggtccccgcagtcagcc

SEQ ID NO: 699674 - DNA, 20 bp, Artificial
  CRISPR gRNA sequence
gccccgccccctccccgccc

SEQ ID NO: 699675 - DNA, 20 bp, Artificial
  CRISPR gRNA sequence
cccgcccaacccgcggggat

SEQ ID NO: 699676 - DNA, 20 bp, Artificial
  CRISPR gRNA sequence
tggcctaaactgaaaatgaa

SEQ ID NO: 699677 - DNA, 20 bp, Artificial
  CRISPR gRNA sequence
ggcctaaactgaaaatgaac

SEQ ID NO: 699678 - DNA, 20 bp, Artificial
  CRISPR gRNA sequence
gcctaaactgaaaatgaacc

SEQ ID NO: 699679 - DNA, 20 bp, Artificial
  CRISPR gRNA sequence
aactgaaaatgaacctcggt

SEQ ID NO: 699680 - DNA, 20 bp, Artificial
  CRISPR gRNA sequence
aaaatgaacctcggtaaagg

SEQ ID NO: 699681 - DNA, 20 bp, Artificial
  CRISPR gRNA sequence
ggtaaaggcgcctgggactc

SEQ ID NO: 699682 - DNA, 20 bp, Artificial
  CRISPR gRNA sequence
ggactctcccgggtggaggg

SEQ ID NO: 699683 - DNA, 20 bp, Artificial
  CRISPR gRNA sequence
tcccgggtggagggtctggg

SEQ ID NO: 699684 - DNA, 20 bp, Artificial
  CRISPR gRNA sequence
ccgggtggagggtctgggcg

SEQ ID NO: 699685 - DNA, 20 bp, Artificial
  CRISPR gRNA sequence
ggcgggtcccgctgcctcgg

SEQ ID NO: 699686 - DNA, 20 bp, Artificial
  CRISPR gRNA sequence
cctcggggtagatttcggat

SEQ ID NO: 699687 - DNA, 20 bp, Artificial
  CRISPR gRNA sequence
ggggtagatttcggatccgg

SEQ ID NO: 699688 - DNA, 20 bp, Artificial
  CRISPR gRNA sequence
cggatccggagactctgggg

SEQ ID NO: 699689 - DNA, 20 bp, Artificial
  CRISPR gRNA sequence
ggatccggagactctggggg

SEQ ID NO: 699690 - DNA, 20 bp, Artificial
  CRISPR gRNA sequence
tgggggacccgggcggtccg

SEQ ID NO: 699691 - DNA, 20 bp, Artificial
  CRISPR gRNA sequence
ggggacccgggcggtccgtg

SEQ ID NO: 699692 - DNA, 20 bp, Artificial
  CRISPR gRNA sequence
cgcccccggccgggttcact

SEQ ID NO: 699693 - DNA, 20 bp, Artificial
  CRISPR gRNA sequence
actcaccagcctcgctctgg

SEQ ID NO: 699694 - DNA, 20 bp, Artificial
  CRISPR gRNA sequence
accagcctcgctctggttgt

SEQ ID NO: 699695 - DNA, 20 bp, Artificial
  CRISPR gRNA sequence
gctctggttgtagcggcgga

SEQ ID NO: 699696 - DNA, 20 bp, Artificial
  CRISPR gRNA sequence
tggttgtagcggcggagcag

SEQ ID NO: 699697 - DNA, 20 bp, Artificial
  CRISPR gRNA sequence
gttgtagcggcggagcaggt

SEQ ID NO: 699698 - DNA, 20 bp, Artificial
  CRISPR gRNA sequence
tagcggcggagcaggttcct

SEQ ID NO: 699699 - DNA, 20 bp, Artificial
  CRISPR gRNA sequence
ctcagggccactcggtcagt

SEQ ID NO: 699700 - DNA, 20 bp, Artificial
  CRISPR gRNA sequence
agggccactcggtcagtctg

SEQ ID NO: 699701 - DNA, 20 bp, Artificial
  CRISPR gRNA sequence
ggtcagtctgtgcgttggcc

SEQ ID NO: 699702 - DNA, 20 bp, Artificial
  CRISPR gRNA sequence
tgcgttggccttggcgtacc

SEQ ID NO: 699703 - DNA, 20 bp, Artificial
  CRISPR gRNA sequence
gccttggcgtaccctgtggt

SEQ ID NO: 699704 - DNA, 20 bp, Artificial
  CRISPR gRNA sequence
ggcgtaccctgtggtccact

SEQ ID NO: 699705 - DNA, 20 bp, Artificial
  CRISPR gRNA sequence
gcgtaccctgtggtccactc

SEQ ID NO: 699706 - DNA, 20 bp, Artificial
  CRISPR gRNA sequence
tggtccactcccaatactgc

SEQ ID NO: 699707 - DNA, 20 bp, Artificial
  CRISPR gRNA sequence
ccaatactgcggcccctctt

SEQ ID NO: 699708 - DNA, 20 bp, Artificial
  CRISPR gRNA sequence
cggcccctcttgctccaccc

SEQ ID NO: 699709 - DNA, 20 bp, Artificial
  CRISPR gRNA sequence
ttgctccacccacggctccc

SEQ ID NO: 699710 - DNA, 20 bp, Artificial
  CRISPR gRNA sequence
gctccacccacggctcccgc

SEQ ID NO: 699711 - DNA, 20 bp, Artificial
  CRISPR gRNA sequence
ctccacccacggctcccgcg

SEQ ID NO: 699712 - DNA, 20 bp, Artificial
  CRISPR gRNA sequence
cacccacggctcccgcggct

SEQ ID NO: 699713 - DNA, 20 bp, Artificial
  CRISPR gRNA sequence
ccgcggctccatcctcggaa

SEQ ID NO: 699714 - DNA, 20 bp, Artificial
  CRISPR gRNA sequence
catcctcggaatcgcggcgt

SEQ ID NO: 699715 - DNA, 20 bp, Artificial
  CRISPR gRNA sequence
ggaatcgcggcgtcgctgtc

SEQ ID NO: 699716 - DNA, 20 bp, Artificial
  CRISPR gRNA sequence
tcgaaccgcaggaattgcgt

SEQ ID NO: 699717 - DNA, 20 bp, Artificial
  CRISPR gRNA sequence
cgtgtcgtctacgtactcca

SEQ ID NO: 699718 - DNA, 20 bp, Artificial
  CRISPR gRNA sequence
cgtactccacggcgatgtag

SEQ ID NO: 699719 - DNA, 20 bp, Artificial
  CRISPR gRNA sequence
cacggcgatgtagcggggct

SEQ ID NO: 699720 - DNA, 20 bp, Artificial
  CRISPR gRNA sequence
cccgcggccgggccgcgaca

SEQ ID NO: 699721 - DNA, 20 bp, Artificial
  CRISPR gRNA sequence
aaatacctcaaggagtggga

SEQ ID NO: 699722 - DNA, 20 bp, Artificial
  CRISPR gRNA sequence
aaggagtgggagcctggggg

SEQ ID NO: 699723 - DNA, 20 bp, Artificial
  CRISPR gRNA sequence
ggggcgaggaggggctgaga

SEQ ID NO: 699724 - DNA, 20 bp, Artificial
  CRISPR gRNA sequence
agacccgccagaccctcctc

SEQ ID NO: 699725 - DNA, 20 bp, Artificial
  CRISPR gRNA sequence
ctccgggcgcggctccctga

SEQ ID NO: 699726 - DNA, 20 bp, Artificial
  CRISPR gRNA sequence
cgggcgcggctccctgagtc

SEQ ID NO: 699727 - DNA, 20 bp, Artificial
  CRISPR gRNA sequence
cctgagtcctgcgcccccac

SEQ ID NO: 699728 - DNA, 20 bp, Artificial
  CRISPR gRNA sequence
agtcctgcgcccccaccggg

SEQ ID NO: 699729 - DNA, 20 bp, Artificial
  CRISPR gRNA sequence
cgcccccaccgggcgggccc

SEQ ID NO: 699730 - DNA, 20 bp, Artificial
  CRISPR gRNA sequence
actcctccccacagaggccg

SEQ ID NO: 699731 - DNA, 20 bp, Artificial
  CRISPR gRNA sequence
ctccccacagaggccgtttc

SEQ ID NO: 699732 - DNA, 20 bp, Artificial
  CRISPR gRNA sequence
cccacagaggccgtttctct

SEQ ID NO: 699733 - DNA, 20 bp, Artificial
  CRISPR gRNA sequence
ctctctggaccccgcactca

SEQ ID NO: 699734 - DNA, 20 bp, Artificial
  CRISPR gRNA sequence
tctctggaccccgcactcac

SEQ ID NO: 699735 - DNA, 20 bp, Artificial
  CRISPR gRNA sequence
tctggaccccgcactcaccc

SEQ ID NO: 699736 - DNA, 20 bp, Artificial
  CRISPR gRNA sequence
tggaccccgcactcacccgc

SEQ ID NO: 699737 - DNA, 20 bp, Artificial
  CRISPR gRNA sequence
gaccccgcactcacccgccc

SEQ ID NO: 699738 - DNA, 20 bp, Artificial
  CRISPR gRNA sequence
acccgcccaagtatcggtca

SEQ ID NO: 699739 - DNA, 20 bp, Artificial
  CRISPR gRNA sequence
agagcagcaggaggaggctt

SEQ ID NO: 699740 - DNA, 20 bp, Artificial
  CRISPR gRNA sequence
cggggcgccatgaccccaac

SEQ ID NO: 699741 - DNA, 20 bp, Artificial
  CRISPR gRNA sequence
ggggcgccatgaccccaacc

SEQ ID NO: 699742 - DNA, 20 bp, Artificial
  CRISPR gRNA sequence
cgcgtctgggaaaaatatga

SEQ ID NO: 699743 - DNA, 20 bp, Artificial
  CRISPR gRNA sequence
ggaaaaatatgagtcccgcg

SEQ ID NO: 699744 - DNA, 20 bp, Artificial
  CRISPR gRNA sequence
tagaacctgggaactgcggc

SEQ ID NO: 699745 - DNA, 20 bp, Artificial
  CRISPR gRNA sequence
agaacctgggaactgcggcg

SEQ ID NO: 699746 - DNA, 20 bp, Artificial
  CRISPR gRNA sequence
gaacctgggaactgcggcga

SEQ ID NO: 699747 - DNA, 20 bp, Artificial
  CRISPR gRNA sequence
ggaactgcggcgacactgat

SEQ ID NO: 699748 - DNA, 20 bp, Artificial
  CRISPR gRNA sequence
cggcgacactgattggcttc

SEQ ID NO: 699749 - DNA, 20 bp, Artificial
  CRISPR gRNA sequence
attggcttctctagaaacgc

SEQ ID NO: 699750 - DNA, 20 bp, Artificial
  CRISPR gRNA sequence
gcttctctagaaacgcgacg

SEQ ID NO: 699751 - DNA, 20 bp, Artificial
  CRISPR gRNA sequence
ctctagaaacgcgacgccca

SEQ ID NO: 699752 - DNA, 20 bp, Artificial
  CRISPR gRNA sequence
tctagaaacgcgacgcccaa

SEQ ID NO: 699753 - DNA, 20 bp, Artificial
  CRISPR gRNA sequence
tagaaacgcgacgcccaatg

SEQ ID NO: 699754 - DNA, 20 bp, Artificial
  CRISPR gRNA sequence
gaaacgcgacgcccaatggg

SEQ ID NO: 699755 - DNA, 20 bp, Artificial
  CRISPR gRNA sequence
tcctgagccaattatattga

SEQ ID NO: 699756 - DNA, 20 bp, Artificial
  CRISPR gRNA sequence
cctgagccaattatattgat

SEQ ID NO: 699757 - DNA, 20 bp, Artificial
  CRISPR gRNA sequence
gagccaattatattgatggg

SEQ ID NO: 699758 - DNA, 20 bp, Artificial
  CRISPR gRNA sequence
ccaattatattgatgggaag

SEQ ID NO: 699759 - DNA, 20 bp, Artificial
  CRISPR gRNA sequence
atgggaagaagtattctgat

SEQ ID NO: 699760 - DNA, 20 bp, Artificial
  CRISPR gRNA sequence
agtattctgattggcctgct

SEQ ID NO: 699761 - DNA, 20 bp, Artificial
  CRISPR gRNA sequence
gtattctgattggcctgctt

SEQ ID NO: 699762 - DNA, 20 bp, Artificial
  CRISPR gRNA sequence
cttgggtcatgtgctcatcc

SEQ ID NO: 699763 - DNA, 20 bp, Artificial
  CRISPR gRNA sequence
gggtcatgtgctcatcctgg

SEQ ID NO: 699764 - DNA, 20 bp, Artificial
  CRISPR gRNA sequence
catgtgctcatcctggaagc

SEQ ID NO: 699765 - DNA, 20 bp, Artificial
  CRISPR gRNA sequence
atgtgctcatcctggaagca

SEQ ID NO: 699766 - DNA, 20 bp, Artificial
  CRISPR gRNA sequence
tgctcatcctggaagcaagg

SEQ ID NO: 699767 - DNA, 20 bp, Artificial
  CRISPR gRNA sequence
gctcatcctggaagcaaggt

SEQ ID NO: 699768 - DNA, 20 bp, Artificial
  CRISPR gRNA sequence
catcctggaagcaaggtagg

SEQ ID NO: 699769 - DNA, 20 bp, Artificial
  CRISPR gRNA sequence
gcaaggtaggcagcgattgc

SEQ ID NO: 699770 - DNA, 20 bp, Artificial
  CRISPR gRNA sequence
caaggtaggcagcgattgct

SEQ ID NO: 699771 - DNA, 20 bp, Artificial
  CRISPR gRNA sequence
tgacttgtttatctcgaaat

SEQ ID NO: 699772 - DNA, 20 bp, Artificial
  CRISPR gRNA sequence
gacttgtttatctcgaaatc

SEQ ID NO: 699773 - DNA, 20 bp, Artificial
  CRISPR gRNA sequence
tgtttatctcgaaatcaggc

SEQ ID NO: 699774 - DNA, 20 bp, Artificial
  CRISPR gRNA sequence
atctcgaaatcaggctggat

SEQ ID NO: 699775 - DNA, 20 bp, Artificial
  CRISPR gRNA sequence
tctcgaaatcaggctggatt

SEQ ID NO: 699776 - DNA, 20 bp, Artificial
  CRISPR gRNA sequence
ctcgaaatcaggctggatta

SEQ ID NO: 699777 - DNA, 20 bp, Artificial
  CRISPR gRNA sequence
atcaggctggattagggtct

SEQ ID NO: 699778 - DNA, 20 bp, Artificial
  CRISPR gRNA sequence
aggctggattagggtcttag

SEQ ID NO: 699779 - DNA, 20 bp, Artificial
  CRISPR gRNA sequence
ctggattagggtcttagtgg

SEQ ID NO: 699780 - DNA, 20 bp, Artificial
  CRISPR gRNA sequence
tggattagggtcttagtggc

SEQ ID NO: 699781 - DNA, 20 bp, Artificial
  CRISPR gRNA sequence
gattagggtcttagtggcag

SEQ ID NO: 699782 - DNA, 20 bp, Artificial
  CRISPR gRNA sequence
ggcaggagtgtccaatcttt

SEQ ID NO: 699783 - DNA, 20 bp, Artificial
  CRISPR gRNA sequence
gtccaatctttcggcttccc

SEQ ID NO: 699784 - DNA, 20 bp, Artificial
  CRISPR gRNA sequence
tccaatctttcggcttccct

SEQ ID NO: 699785 - DNA, 20 bp, Artificial
  CRISPR gRNA sequence
tcggcttccctgggccacat

SEQ ID NO: 699786 - DNA, 20 bp, Artificial
  CRISPR gRNA sequence
gcttccctgggccacattgg

SEQ ID NO: 699787 - DNA, 20 bp, Artificial
  CRISPR gRNA sequence
tccctgggccacattggaag

SEQ ID NO: 699788 - DNA, 20 bp, Artificial
  CRISPR gRNA sequence
ctgggccacattggaagaag

SEQ ID NO: 699789 - DNA, 20 bp, Artificial
  CRISPR gRNA sequence
cacattggaagaagaagtgt

SEQ ID NO: 699790 - DNA, 20 bp, Artificial
  CRISPR gRNA sequence
tggaagaagaagtgttagtg

SEQ ID NO: 699791 - DNA, 20 bp, Artificial
  CRISPR gRNA sequence
aagaagaagtgttagtgtgg

SEQ ID NO: 699792 - DNA, 20 bp, Artificial
  CRISPR gRNA sequence
aagaagtgttagtgtggaag

SEQ ID NO: 699793 - DNA, 20 bp, Artificial
  CRISPR gRNA sequence
tagtgtggaagaagtgaatt

SEQ ID NO: 699794 - DNA, 20 bp, Artificial
  CRISPR gRNA sequence
agtgaatttagtctaacact

SEQ ID NO: 699795 - DNA, 20 bp, Artificial
  CRISPR gRNA sequence
gtgaatttagtctaacacta

SEQ ID NO: 699796 - DNA, 20 bp, Artificial
  CRISPR gRNA sequence
atttagtctaacactaagga

SEQ ID NO: 699797 - DNA, 20 bp, Artificial
  CRISPR gRNA sequence
taacactaaggatagtgttt

SEQ ID NO: 699798 - DNA, 20 bp, Artificial
  CRISPR gRNA sequence
aaggatagtgttttagctta

SEQ ID NO: 699799 - DNA, 20 bp, Artificial
  CRISPR gRNA sequence
tgttttagcttatagctgat

SEQ ID NO: 699800 - DNA, 20 bp, Artificial
  CRISPR gRNA sequence
cgcaaatctcataatgtttt

SEQ ID NO: 699801 - DNA, 20 bp, Artificial
  CRISPR gRNA sequence
aatctcataatgttttaaga

SEQ ID NO: 699802 - DNA, 20 bp, Artificial
  CRISPR gRNA sequence
aatgttttaagaaagtttat

SEQ ID NO: 699803 - DNA, 20 bp, Artificial
  CRISPR gRNA sequence
gaaagtttatgagtttgcgt

SEQ ID NO: 699804 - DNA, 20 bp, Artificial
  CRISPR gRNA sequence
aaagtttatgagtttgcgtt

SEQ ID NO: 699805 - DNA, 20 bp, Artificial
  CRISPR gRNA sequence
agtttgcgttgggcctcatt

SEQ ID NO: 699806 - DNA, 20 bp, Artificial
  CRISPR gRNA sequence
tttgcgttgggcctcattca

SEQ ID NO: 699807 - DNA, 20 bp, Artificial
  CRISPR gRNA sequence
ggcctcattcagagctgtcc

SEQ ID NO: 699808 - DNA, 20 bp, Artificial
  CRISPR gRNA sequence
gcctcattcagagctgtcct

SEQ ID NO: 699809 - DNA, 20 bp, Artificial
  CRISPR gRNA sequence
gagctgtcctgggccgaatg

SEQ ID NO: 699810 - DNA, 20 bp, Artificial
  CRISPR gRNA sequence
tgtcctgggccgaatgcggc

SEQ ID NO: 699811 - DNA, 20 bp, Artificial
  CRISPR gRNA sequence
gggccgaatgcggctagtcg

SEQ ID NO: 699812 - DNA, 20 bp, Artificial
  CRISPR gRNA sequence
ggccgaatgcggctagtcgt

SEQ ID NO: 699813 - DNA, 20 bp, Artificial
  CRISPR gRNA sequence
gaatgcggctagtcgtgggt

SEQ ID NO: 699814 - DNA, 20 bp, Artificial
  CRISPR gRNA sequence
cggctagtcgtgggttggac

SEQ ID NO: 699815 - DNA, 20 bp, Artificial
  CRISPR gRNA sequence
agtcgtgggttggacaagct

SEQ ID NO: 699816 - DNA, 20 bp, Artificial
  CRISPR gRNA sequence
tgggttggacaagcttggtc

SEQ ID NO: 699817 - DNA, 20 bp, Artificial
  CRISPR gRNA sequence
aagcttggtctagactttca

SEQ ID NO: 699818 - DNA, 20 bp, Artificial
  CRISPR gRNA sequence
gtctagactttcatggtcta

SEQ ID NO: 699819 - DNA, 20 bp, Artificial
  CRISPR gRNA sequence
actttcatggtctaaagtta

SEQ ID NO: 699820 - DNA, 20 bp, Artificial
  CRISPR gRNA sequence
tatggctctcctaattcctg

SEQ ID NO: 699821 - DNA, 20 bp, Artificial
  CRISPR gRNA sequence
gctctcctaattcctgcagt

SEQ ID NO: 699822 - DNA, 20 bp, Artificial
  CRISPR gRNA sequence
cctaattcctgcagtgagat

SEQ ID NO: 699823 - DNA, 20 bp, Artificial
  CRISPR gRNA sequence
gcagtgagataagacccctg

SEQ ID NO: 699824 - DNA, 20 bp, Artificial
  CRISPR gRNA sequence
agtgagataagacccctgca

SEQ ID NO: 699825 - DNA, 20 bp, Artificial
  CRISPR gRNA sequence
ctgcagagaatgatgacaac

SEQ ID NO: 699826 - DNA, 20 bp, Artificial
  CRISPR gRNA sequence
gatgacaaccggtgctcata

SEQ ID NO: 699827 - DNA, 20 bp, Artificial
  CRISPR gRNA sequence
ggtgctcatatagtgcttgt

SEQ ID NO: 699828 - DNA, 20 bp, Artificial
  CRISPR gRNA sequence
gtgctcatatagtgcttgtt

SEQ ID NO: 699829 - DNA, 20 bp, Artificial
  CRISPR gRNA sequence
atatagtgcttgttgggtgc

SEQ ID NO: 699830 - DNA, 20 bp, Artificial
  CRISPR gRNA sequence
tatagtgcttgttgggtgcc

SEQ ID NO: 699831 - DNA, 20 bp, Artificial
  CRISPR gRNA sequence
atagtgcttgttgggtgcca

SEQ ID NO: 699832 - DNA, 20 bp, Artificial
  CRISPR gRNA sequence
ttgggtgccagggactgctg

SEQ ID NO: 699833 - DNA, 20 bp, Artificial
  CRISPR gRNA sequence
tttatacatatttatcttca

SEQ ID NO: 699834 - DNA, 20 bp, Artificial
  CRISPR gRNA sequence
atttatcttcacagtccatt

SEQ ID NO: 699835 - DNA, 20 bp, Artificial
  CRISPR gRNA sequence
acagtccattcagtcctttc

SEQ ID NO: 699836 - DNA, 20 bp, Artificial
  CRISPR gRNA sequence
ttcagtcctttcaagaacac

SEQ ID NO: 699837 - DNA, 20 bp, Artificial
  CRISPR gRNA sequence
tcagtcctttcaagaacact

SEQ ID NO: 699838 - DNA, 20 bp, Artificial
  CRISPR gRNA sequence
agtcctttcaagaacactag

SEQ ID NO: 699839 - DNA, 20 bp, Artificial
  CRISPR gRNA sequence
gtcctttcaagaacactagg

SEQ ID NO: 699840 - DNA, 20 bp, Artificial
  CRISPR gRNA sequence
ctttcaagaacactaggagg

SEQ ID NO: 699841 - DNA, 20 bp, Artificial
  CRISPR gRNA sequence
tttcaagaacactaggaggt

SEQ ID NO: 699842 - DNA, 20 bp, Artificial
  CRISPR gRNA sequence
gggtcctattactaacttaa

SEQ ID NO: 699843 - DNA, 20 bp, Artificial
  CRISPR gRNA sequence
cacacacacacacacacaaa

SEQ ID NO: 699844 - DNA, 20 bp, Artificial
  CRISPR gRNA sequence
cacacacaaatagtgctgac

SEQ ID NO: 699845 - DNA, 20 bp, Artificial
  CRISPR gRNA sequence
acacacaaatagtgctgaca

SEQ ID NO: 699846 - DNA, 20 bp, Artificial
  CRISPR gRNA sequence
caaggtcattatcacgcaat

SEQ ID NO: 699847 - DNA, 20 bp, Artificial
  CRISPR gRNA sequence
attatcacgcaattggcaaa

SEQ ID NO: 699848 - DNA, 20 bp, Artificial
  CRISPR gRNA sequence
atcacgcaattggcaaatgg

SEQ ID NO: 699849 - DNA, 20 bp, Artificial
  CRISPR gRNA sequence
caattggcaaatggcagccc

SEQ ID NO: 699850 - DNA, 20 bp, Artificial
  CRISPR gRNA sequence
aaatggcagccctagaatcc

SEQ ID NO: 699851 - DNA, 20 bp, Artificial
  CRISPR gRNA sequence
aatggcagccctagaatccc

SEQ ID NO: 699852 - DNA, 20 bp, Artificial
  CRISPR gRNA sequence
cagccctagaatcccaggcc

SEQ ID NO: 699853 - DNA, 20 bp, Artificial
  CRISPR gRNA sequence
tgttgcttttccttgcctgc

SEQ ID NO: 699854 - DNA, 20 bp, Artificial
  CRISPR gRNA sequence
gttgcttttccttgcctgct

SEQ ID NO: 699855 - DNA, 20 bp, Artificial
  CRISPR gRNA sequence
ttgcttttccttgcctgcta

SEQ ID NO: 699856 - DNA, 20 bp, Artificial
  CRISPR gRNA sequence
tgcttttccttgcctgctag

SEQ ID NO: 699857 - DNA, 20 bp, Artificial
  CRISPR gRNA sequence
ccttgcctgctaggggacct

SEQ ID NO: 699858 - DNA, 20 bp, Artificial
  CRISPR gRNA sequence
cttgcctgctaggggacctt

SEQ ID NO: 699859 - DNA, 20 bp, Artificial
  CRISPR gRNA sequence
cctgctaggggaccttaggc

SEQ ID NO: 699860 - DNA, 20 bp, Artificial
  CRISPR gRNA sequence
ctgctaggggaccttaggcg

SEQ ID NO: 699861 - DNA, 20 bp, Artificial
  CRISPR gRNA sequence
tgctaggggaccttaggcga

SEQ ID NO: 699862 - DNA, 20 bp, Artificial
  CRISPR gRNA sequence
taggcgagggttgcccctcc

SEQ ID NO: 699863 - DNA, 20 bp, Artificial
  CRISPR gRNA sequence
aggcgagggttgcccctcct

SEQ ID NO: 699864 - DNA, 20 bp, Artificial
  CRISPR gRNA sequence
gggttgcccctcctgggtgt

SEQ ID NO: 699865 - DNA, 20 bp, Artificial
  CRISPR gRNA sequence
agtgcttccatccataacac

SEQ ID NO: 699866 - DNA, 20 bp, Artificial
  CRISPR gRNA sequence
tccatccataacacaagaat

SEQ ID NO: 699867 - DNA, 20 bp, Artificial
  CRISPR gRNA sequence
taacacaagaattggactga

SEQ ID NO: 699868 - DNA, 20 bp, Artificial
  CRISPR gRNA sequence
agaattggactgacagtttt

SEQ ID NO: 699869 - DNA, 20 bp, Artificial
  CRISPR gRNA sequence
gaattggactgacagttttc

SEQ ID NO: 699870 - DNA, 20 bp, Artificial
  CRISPR gRNA sequence
aattggactgacagttttcg

SEQ ID NO: 699871 - DNA, 20 bp, Artificial
  CRISPR gRNA sequence
attggactgacagttttcgg

SEQ ID NO: 699872 - DNA, 20 bp, Artificial
  CRISPR gRNA sequence
gactgacagttttcgggggt

SEQ ID NO: 699873 - DNA, 20 bp, Artificial
  CRISPR gRNA sequence
ctgacagttttcgggggttg

SEQ ID NO: 699874 - DNA, 20 bp, Artificial
  CRISPR gRNA sequence
tgacagttttcgggggttgg

SEQ ID NO: 699875 - DNA, 20 bp, Artificial
  CRISPR gRNA sequence
cagttttcgggggttggagg

SEQ ID NO: 699876 - DNA, 20 bp, Artificial
  CRISPR gRNA sequence
gttttcgggggttggaggtg

SEQ ID NO: 699877 - DNA, 20 bp, Artificial
  CRISPR gRNA sequence
tcgggggttggaggtggagc

SEQ ID NO: 699878 - DNA, 20 bp, Artificial
  CRISPR gRNA sequence
cgggggttggaggtggagct

SEQ ID NO: 699879 - DNA, 20 bp, Artificial
  CRISPR gRNA sequence
ggggttggaggtggagctgg

SEQ ID NO: 699880 - DNA, 20 bp, Artificial
  CRISPR gRNA sequence
gggttggaggtggagctggg

SEQ ID NO: 699881 - DNA, 20 bp, Artificial
  CRISPR gRNA sequence
ggttggaggtggagctggga

SEQ ID NO: 699882 - DNA, 20 bp, Artificial
  CRISPR gRNA sequence
gttggaggtggagctgggag

SEQ ID NO: 699883 - DNA, 20 bp, Artificial
  CRISPR gRNA sequence
ggtggagctgggaggggcgt

SEQ ID NO: 699884 - DNA, 20 bp, Artificial
  CRISPR gRNA sequence
gtggagctgggaggggcgtc

SEQ ID NO: 699885 - DNA, 20 bp, Artificial
  CRISPR gRNA sequence
tggagctgggaggggcgtca

SEQ ID NO: 699886 - DNA, 20 bp, Artificial
  CRISPR gRNA sequence
ctgggaggggcgtcagggat

SEQ ID NO: 699887 - DNA, 20 bp, Artificial
  CRISPR gRNA sequence
gggaggggcgtcagggatga

SEQ ID NO: 699888 - DNA, 20 bp, Artificial
  CRISPR gRNA sequence
ggaggggcgtcagggatgag

SEQ ID NO: 699889 - DNA, 20 bp, Artificial
  CRISPR gRNA sequence
ggcgtcagggatgagaggtg

SEQ ID NO: 699890 - DNA, 20 bp, Artificial
  CRISPR gRNA sequence
gcgtcagggatgagaggtgt

SEQ ID NO: 699891 - DNA, 20 bp, Artificial
  CRISPR gRNA sequence
cgtcagggatgagaggtgtg

SEQ ID NO: 699892 - DNA, 20 bp, Artificial
  CRISPR gRNA sequence
ggatgagaggtgtggggcat

SEQ ID NO: 699893 - DNA, 20 bp, Artificial
  CRISPR gRNA sequence
gatgagaggtgtggggcatt

SEQ ID NO: 699894 - DNA, 20 bp, Artificial
  CRISPR gRNA sequence
ggtgtggggcattgggtcat

SEQ ID NO: 699895 - DNA, 20 bp, Artificial
  CRISPR gRNA sequence
gtgtggggcattgggtcata

SEQ ID NO: 699896 - DNA, 20 bp, Artificial
  CRISPR gRNA sequence
tgggtcataaggcctttgct

SEQ ID NO: 699897 - DNA, 20 bp, Artificial
  CRISPR gRNA sequence
tcataaggcctttgctaagt

SEQ ID NO: 699898 - DNA, 20 bp, Artificial
  CRISPR gRNA sequence
aggcctttgctaagtcagcc

SEQ ID NO: 699899 - DNA, 20 bp, Artificial
  CRISPR gRNA sequence
tttgctaagtcagcctggct

SEQ ID NO: 699900 - DNA, 20 bp, Artificial
  CRISPR gRNA sequence
tgctaagtcagcctggcttg

SEQ ID NO: 699901 - DNA, 20 bp, Artificial
  CRISPR gRNA sequence
agcttctctgtttcttttcc

SEQ ID NO: 699902 - DNA, 20 bp, Artificial
  CRISPR gRNA sequence
gcttctctgtttcttttccc

SEQ ID NO: 699903 - DNA, 20 bp, Artificial
  CRISPR gRNA sequence
cttctctgtttcttttccca

SEQ ID NO: 699904 - DNA, 20 bp, Artificial
  CRISPR gRNA sequence
tcccagggctgttcccgaca

SEQ ID NO: 699905 - DNA, 20 bp, Artificial
  CRISPR gRNA sequence
cagggctgttcccgacacag

SEQ ID NO: 699906 - DNA, 20 bp, Artificial
  CRISPR gRNA sequence
tcccgacacagcagtgccca

SEQ ID NO: 699907 - DNA, 20 bp, Artificial
  CRISPR gRNA sequence
ccgacacagcagtgcccaca

SEQ ID NO: 699908 - DNA, 20 bp, Artificial
  CRISPR gRNA sequence
cgacacagcagtgcccacag

SEQ ID NO: 699909 - DNA, 20 bp, Artificial
  CRISPR gRNA sequence
ccacagaggcctactgactg

SEQ ID NO: 699910 - DNA, 20 bp, Artificial
  CRISPR gRNA sequence
cacagaggcctactgactgc

SEQ ID NO: 699911 - DNA, 20 bp, Artificial
  CRISPR gRNA sequence
agaggcctactgactgcagg

SEQ ID NO: 699912 - DNA, 20 bp, Artificial
  CRISPR gRNA sequence
ggcctactgactgcaggaag

SEQ ID NO: 699913 - DNA, 20 bp, Artificial
  CRISPR gRNA sequence
ctgactgcaggaagcagtgt

SEQ ID NO: 699914 - DNA, 20 bp, Artificial
  CRISPR gRNA sequence
gtgtgagcctgactactacc

SEQ ID NO: 699915 - DNA, 20 bp, Artificial
  CRISPR gRNA sequence
agcctgactactacctggat

SEQ ID NO: 699916 - DNA, 20 bp, Artificial
  CRISPR gRNA sequence
gcctgactactacctggatg

SEQ ID NO: 699917 - DNA, 20 bp, Artificial
  CRISPR gRNA sequence
ggatgaggccgaccgctgta

SEQ ID NO: 699918 - DNA, 20 bp, Artificial
  CRISPR gRNA sequence
agcctgcgtgacttgttctc

SEQ ID NO: 699919 - DNA, 20 bp, Artificial
  CRISPR gRNA sequence
gcctgcgtgacttgttctcg

SEQ ID NO: 699920 - DNA, 20 bp, Artificial
  CRISPR gRNA sequence
gcgtgacttgttctcgaggt

SEQ ID NO: 699921 - DNA, 20 bp, Artificial
  CRISPR gRNA sequence
cgtgacttgttctcgaggta

SEQ ID NO: 699922 - DNA, 20 bp, Artificial
  CRISPR gRNA sequence
gtgacttgttctcgaggtaa

SEQ ID NO: 699923 - DNA, 20 bp, Artificial
  CRISPR gRNA sequence
taagggccttgttctctctc

SEQ ID NO: 699924 - DNA, 20 bp, Artificial
  CRISPR gRNA sequence
aagggccttgttctctctcc

SEQ ID NO: 699925 - DNA, 20 bp, Artificial
  CRISPR gRNA sequence
agggccttgttctctctcca

SEQ ID NO: 699926 - DNA, 20 bp, Artificial
  CRISPR gRNA sequence
ctctctccagggcctccttc

SEQ ID NO: 699927 - DNA, 20 bp, Artificial
  CRISPR gRNA sequence
tctctccagggcctccttct

SEQ ID NO: 699928 - DNA, 20 bp, Artificial
  CRISPR gRNA sequence
ctctccagggcctccttcta

SEQ ID NO: 699929 - DNA, 20 bp, Artificial
  CRISPR gRNA sequence
ctccagggcctccttctagg

SEQ ID NO: 699930 - DNA, 20 bp, Artificial
  CRISPR gRNA sequence
ggcctccttctagggagcat

SEQ ID NO: 699931 - DNA, 20 bp, Artificial
  CRISPR gRNA sequence
gcctccttctagggagcatg

SEQ ID NO: 699932 - DNA, 20 bp, Artificial
  CRISPR gRNA sequence
cctccttctagggagcatga

SEQ ID NO: 699933 - DNA, 20 bp, Artificial
  CRISPR gRNA sequence
ctccttctagggagcatgag

SEQ ID NO: 699934 - DNA, 20 bp, Artificial
  CRISPR gRNA sequence
tagggagcatgaggggtcct

SEQ ID NO: 699935 - DNA, 20 bp, Artificial
  CRISPR gRNA sequence
gggagcatgaggggtcctca

SEQ ID NO: 699936 - DNA, 20 bp, Artificial
  CRISPR gRNA sequence
ggagcatgaggggtcctcag

SEQ ID NO: 699937 - DNA, 20 bp, Artificial
  CRISPR gRNA sequence
agcatgaggggtcctcagag

SEQ ID NO: 699938 - DNA, 20 bp, Artificial
  CRISPR gRNA sequence
catgaggggtcctcagagga

SEQ ID NO: 699939 - DNA, 20 bp, Artificial
  CRISPR gRNA sequence
atgaggggtcctcagaggag

SEQ ID NO: 699940 - DNA, 20 bp, Artificial
  CRISPR gRNA sequence
gggtcctcagaggagaggtg

SEQ ID NO: 699941 - DNA, 20 bp, Artificial
  CRISPR gRNA sequence
cagaggagaggtgaagaatc

SEQ ID NO: 699942 - DNA, 20 bp, Artificial
  CRISPR gRNA sequence
aggagaggtgaagaatctgg

SEQ ID NO: 699943 - DNA, 20 bp, Artificial
  CRISPR gRNA sequence
ggagaggtgaagaatctgga

SEQ ID NO: 699944 - DNA, 20 bp, Artificial
  CRISPR gRNA sequence
gaggtgaagaatctggaagg

SEQ ID NO: 699945 - DNA, 20 bp, Artificial
  CRISPR gRNA sequence
ggtgaagaatctggaaggtg

SEQ ID NO: 699946 - DNA, 20 bp, Artificial
  CRISPR gRNA sequence
tgaagaatctggaaggtgga

SEQ ID NO: 699947 - DNA, 20 bp, Artificial
  CRISPR gRNA sequence
tgttctctgaattgtcctcc

SEQ ID NO: 699948 - DNA, 20 bp, Artificial
  CRISPR gRNA sequence
gaattgtcctcctggtgcct

SEQ ID NO: 699949 - DNA, 20 bp, Artificial
  CRISPR gRNA sequence
ctgcatttgtgatttgatat

SEQ ID NO: 699950 - DNA, 20 bp, Artificial
  CRISPR gRNA sequence
cttttgcatccatactttca

SEQ ID NO: 699951 - DNA, 20 bp, Artificial
  CRISPR gRNA sequence
tttgcatccatactttcaca

SEQ ID NO: 699952 - DNA, 20 bp, Artificial
  CRISPR gRNA sequence
gagacttaacatgtttcctg

SEQ ID NO: 699953 - DNA, 20 bp, Artificial
  CRISPR gRNA sequence
agacttaacatgtttcctga

SEQ ID NO: 699954 - DNA, 20 bp, Artificial
  CRISPR gRNA sequence
acttaacatgtttcctgaag

SEQ ID NO: 699955 - DNA, 20 bp, Artificial
  CRISPR gRNA sequence
ttaacatgtttcctgaagga

SEQ ID NO: 699956 - DNA, 20 bp, Artificial
  CRISPR gRNA sequence
taacatgtttcctgaaggag

SEQ ID NO: 699957 - DNA, 20 bp, Artificial
  CRISPR gRNA sequence
gagaggactcacattttttt

SEQ ID NO: 699958 - DNA, 20 bp, Artificial
  CRISPR gRNA sequence
tttgagtttaatcctcacca

SEQ ID NO: 699959 - DNA, 20 bp, Artificial
  CRISPR gRNA sequence
tttaatcctcaccacagccc

SEQ ID NO: 699960 - DNA, 20 bp, Artificial
  CRISPR gRNA sequence
ttaatcctcaccacagccct

SEQ ID NO: 699961 - DNA, 20 bp, Artificial
  CRISPR gRNA sequence
taatcctcaccacagcccta

SEQ ID NO: 699962 - DNA, 20 bp, Artificial
  CRISPR gRNA sequence
aatcctcaccacagccctag

SEQ ID NO: 699963 - DNA, 20 bp, Artificial
  CRISPR gRNA sequence
tcctcaccacagccctaggg

SEQ ID NO: 699964 - DNA, 20 bp, Artificial
  CRISPR gRNA sequence
cctcaccacagccctagggg

SEQ ID NO: 699965 - DNA, 20 bp, Artificial
  CRISPR gRNA sequence
gcttatccttactttacaat

SEQ ID NO: 699966 - DNA, 20 bp, Artificial
  CRISPR gRNA sequence
cttatccttactttacaatg

SEQ ID NO: 699967 - DNA, 20 bp, Artificial
  CRISPR gRNA sequence
tactttacaatgaggaattt

SEQ ID NO: 699968 - DNA, 20 bp, Artificial
  CRISPR gRNA sequence
actttacaatgaggaatttg

SEQ ID NO: 699969 - DNA, 20 bp, Artificial
  CRISPR gRNA sequence
tacaatgaggaatttgagga

SEQ ID NO: 699970 - DNA, 20 bp, Artificial
  CRISPR gRNA sequence
acaatgaggaatttgaggat

SEQ ID NO: 699971 - DNA, 20 bp, Artificial
  CRISPR gRNA sequence
caatgaggaatttgaggata

SEQ ID NO: 699972 - DNA, 20 bp, Artificial
  CRISPR gRNA sequence
atgaggaatttgaggatagg

SEQ ID NO: 699973 - DNA, 20 bp, Artificial
  CRISPR gRNA sequence
tgaggaatttgaggataggg

SEQ ID NO: 699974 - DNA, 20 bp, Artificial
  CRISPR gRNA sequence
aatttgaggatagggaggtt

SEQ ID NO: 699975 - DNA, 20 bp, Artificial
  CRISPR gRNA sequence
atttgaggatagggaggtta

SEQ ID NO: 699976 - DNA, 20 bp, Artificial
  CRISPR gRNA sequence
tttgaggatagggaggttaa

SEQ ID NO: 699977 - DNA, 20 bp, Artificial
  CRISPR gRNA sequence
ggaggttaagggcctttcca

SEQ ID NO: 699978 - DNA, 20 bp, Artificial
  CRISPR gRNA sequence
tttccaaagttacaaaactc

SEQ ID NO: 699979 - DNA, 20 bp, Artificial
  CRISPR gRNA sequence
caaagttacaaaactctggt

SEQ ID NO: 699980 - DNA, 20 bp, Artificial
  CRISPR gRNA sequence
agttacaaaactctggtaag

SEQ ID NO: 699981 - DNA, 20 bp, Artificial
  CRISPR gRNA sequence
tacaaaactctggtaagtgg

SEQ ID NO: 699982 - DNA, 20 bp, Artificial
  CRISPR gRNA sequence
actctggtaagtggcagaac

SEQ ID NO: 699983 - DNA, 20 bp, Artificial
  CRISPR gRNA sequence
tctggtaagtggcagaactg

SEQ ID NO: 699984 - DNA, 20 bp, Artificial
  CRISPR gRNA sequence
aagtggcagaactggagttt

SEQ ID NO: 699985 - DNA, 20 bp, Artificial
  CRISPR gRNA sequence
cagaactggagtttgagttg

SEQ ID NO: 699986 - DNA, 20 bp, Artificial
  CRISPR gRNA sequence
ttgagttgtggcctgacacc

SEQ ID NO: 699987 - DNA, 20 bp, Artificial
  CRISPR gRNA sequence
gagttgtggcctgacaccaa

SEQ ID NO: 699988 - DNA, 20 bp, Artificial
  CRISPR gRNA sequence
aagagctgtgttcttttcct

SEQ ID NO: 699989 - DNA, 20 bp, Artificial
  CRISPR gRNA sequence
gtgttcttttcctaagatca

SEQ ID NO: 699990 - DNA, 20 bp, Artificial
  CRISPR gRNA sequence
tgttcttttcctaagatcac

SEQ ID NO: 699991 - DNA, 20 bp, Artificial
  CRISPR gRNA sequence
tcctaagatcacaggacttc

SEQ ID NO: 699992 - DNA, 20 bp, Artificial
  CRISPR gRNA sequence
cctaagatcacaggacttcc

SEQ ID NO: 699993 - DNA, 20 bp, Artificial
  CRISPR gRNA sequence
gacttccaggaaaactgttt

SEQ ID NO: 699994 - DNA, 20 bp, Artificial
  CRISPR gRNA sequence
tcagtatgaccttttattgt

SEQ ID NO: 699995 - DNA, 20 bp, Artificial
  CRISPR gRNA sequence
ttattgttagtctcttatta

SEQ ID NO: 699996 - DNA, 20 bp, Artificial
  CRISPR gRNA sequence
tgttagtctcttattatggt

SEQ ID NO: 699997 - DNA, 20 bp, Artificial
  CRISPR gRNA sequence
ttagtctcttattatggtta

SEQ ID NO: 699998 - DNA, 20 bp, Artificial
  CRISPR gRNA sequence
cttattatggttagagaatg

SEQ ID NO: 699999 - DNA, 20 bp, Artificial
  CRISPR gRNA sequence
aatgcagtctgtgtgctatc

SEQ ID NO: 700000 - DNA, 20 bp, Artificial
  CRISPR gRNA sequence
atctagtgtttatttttgtg

SEQ ID NO: 700001 - DNA, 20 bp, Artificial
  CRISPR gRNA sequence
tatttttgtgtggatttttt

SEQ ID NO: 700002 - DNA, 20 bp, Artificial
  CRISPR gRNA sequence
atttttgtgtggattttttt

SEQ ID NO: 700003 - DNA, 20 bp, Artificial
  CRISPR gRNA sequence
tttttgtgtggatttttttg

SEQ ID NO: 700004 - DNA, 20 bp, Artificial
  CRISPR gRNA sequence
ttttgtgtggatttttttgg

SEQ ID NO: 700005 - DNA, 20 bp, Artificial
  CRISPR gRNA sequence
tttgtgtggatttttttggg

SEQ ID NO: 700006 - DNA, 20 bp, Artificial
  CRISPR gRNA sequence
gtgtggatttttttgggggg

SEQ ID NO: 700007 - DNA, 20 bp, Artificial
  CRISPR gRNA sequence
tgtggatttttttggggggt

SEQ ID NO: 700008 - DNA, 20 bp, Artificial
  CRISPR gRNA sequence
gtggatttttttggggggta

SEQ ID NO: 700009 - DNA, 20 bp, Artificial
  CRISPR gRNA sequence
gatttttttggggggtaggg

SEQ ID NO: 700010 - DNA, 20 bp, Artificial
  CRISPR gRNA sequence
atttttttggggggtagggt

SEQ ID NO: 700011 - DNA, 20 bp, Artificial
  CRISPR gRNA sequence
tttttttggggggtagggtg

SEQ ID NO: 700012 - DNA, 20 bp, Artificial
  CRISPR gRNA sequence
ttttttggggggtagggtgg

SEQ ID NO: 700013 - DNA, 20 bp, Artificial
  CRISPR gRNA sequence
tagggtgggggaaatttgtt

SEQ ID NO: 700014 - DNA, 20 bp, Artificial
  CRISPR gRNA sequence
aatttgttgagatctttttg

SEQ ID NO: 700015 - DNA, 20 bp, Artificial
  CRISPR gRNA sequence
aataaatgatcatgtatttt

SEQ ID NO: 700016 - DNA, 20 bp, Artificial
  CRISPR gRNA sequence
taaatgatcatgtattttca

SEQ ID NO: 700017 - DNA, 20 bp, Artificial
  CRISPR gRNA sequence
tcatgtattttcagagtgtt

SEQ ID NO: 700018 - DNA, 20 bp, Artificial
  CRISPR gRNA sequence
ttttcagagtgttcagtgta

SEQ ID NO: 700019 - DNA, 20 bp, Artificial
  CRISPR gRNA sequence
tttcagagtgttcagtgtat

SEQ ID NO: 700020 - DNA, 20 bp, Artificial
  CRISPR gRNA sequence
tattctgtttgttgcgtata

SEQ ID NO: 700021 - DNA, 20 bp, Artificial
  CRISPR gRNA sequence
aagttctctacatatctatt

SEQ ID NO: 700022 - DNA, 20 bp, Artificial
  CRISPR gRNA sequence
ctctacatatctattaagtt

SEQ ID NO: 700023 - DNA, 20 bp, Artificial
  CRISPR gRNA sequence
cttttatcacctttatttct

SEQ ID NO: 700024 - DNA, 20 bp, Artificial
  CRISPR gRNA sequence
tttatcacctttatttctga

SEQ ID NO: 700025 - DNA, 20 bp, Artificial
  CRISPR gRNA sequence
tgtgttaaaatcttatctcc

SEQ ID NO: 700026 - DNA, 20 bp, Artificial
  CRISPR gRNA sequence
cagtatacttgttcatctat

SEQ ID NO: 700027 - DNA, 20 bp, Artificial
  CRISPR gRNA sequence
tttttgcttcatatatgtca

SEQ ID NO: 700028 - DNA, 20 bp, Artificial
  CRISPR gRNA sequence
atatgtcaaagctatgttat

SEQ ID NO: 700029 - DNA, 20 bp, Artificial
  CRISPR gRNA sequence
tatgtcaaagctatgttatt

SEQ ID NO: 700030 - DNA, 20 bp, Artificial
  CRISPR gRNA sequence
tcatgaatgttatgtttttt

SEQ ID NO: 700031 - DNA, 20 bp, Artificial
  CRISPR gRNA sequence
tgaatgttatgtttttttgg

SEQ ID NO: 700032 - DNA, 20 bp, Artificial
  CRISPR gRNA sequence
gaatgttatgtttttttggt

SEQ ID NO: 700033 - DNA, 20 bp, Artificial
  CRISPR gRNA sequence
gttatgtttttttggtgggt

SEQ ID NO: 700034 - DNA, 20 bp, Artificial
  CRISPR gRNA sequence
ttatgtttttttggtgggtt

SEQ ID NO: 700035 - DNA, 20 bp, Artificial
  CRISPR gRNA sequence
cccttaatttcacatttgtt

SEQ ID NO: 700036 - DNA, 20 bp, Artificial
  CRISPR gRNA sequence
ttaatattgctattccttcc

SEQ ID NO: 700037 - DNA, 20 bp, Artificial
  CRISPR gRNA sequence
atattgctattccttcctgg

SEQ ID NO: 700038 - DNA, 20 bp, Artificial
  CRISPR gRNA sequence
ttgctattccttcctggaag

SEQ ID NO: 700039 - DNA, 20 bp, Artificial
  CRISPR gRNA sequence
ctattccttcctggaagaag

SEQ ID NO: 700040 - DNA, 20 bp, Artificial
  CRISPR gRNA sequence
ccttcctggaagaagtagca

SEQ ID NO: 700041 - DNA, 20 bp, Artificial
  CRISPR gRNA sequence
cttcctggaagaagtagcaa

SEQ ID NO: 700042 - DNA, 20 bp, Artificial
  CRISPR gRNA sequence
aagaagtagcaaaggttaaa

SEQ ID NO: 700043 - DNA, 20 bp, Artificial
  CRISPR gRNA sequence
agtagcaaaggttaaaaaga

SEQ ID NO: 700044 - DNA, 20 bp, Artificial
  CRISPR gRNA sequence
caaaggttaaaaagaaagaa

SEQ ID NO: 700045 - DNA, 20 bp, Artificial
  CRISPR gRNA sequence
catttcttctttctttttat

SEQ ID NO: 700046 - DNA, 20 bp, Artificial
  CRISPR gRNA sequence
tctttttattagcatttatc

SEQ ID NO: 700047 - DNA, 20 bp, Artificial
  CRISPR gRNA sequence
gtgtatctttgaatttctaa

SEQ ID NO: 700048 - DNA, 20 bp, Artificial
  CRISPR gRNA sequence
acatttattatttaaaattc

SEQ ID NO: 700049 - DNA, 20 bp, Artificial
  CRISPR gRNA sequence
tttaaaattcaagcaataca

SEQ ID NO: 700050 - DNA, 20 bp, Artificial
  CRISPR gRNA sequence
taaaattcaagcaatacaaa

SEQ ID NO: 700051 - DNA, 20 bp, Artificial
  CRISPR gRNA sequence
tcaagcaatacaaagagtgt

SEQ ID NO: 700052 - DNA, 20 bp, Artificial
  CRISPR gRNA sequence
caagcaatacaaagagtgta

SEQ ID NO: 700053 - DNA, 20 bp, Artificial
  CRISPR gRNA sequence
gcaatacaaagagtgtaagg

SEQ ID NO: 700054 - DNA, 20 bp, Artificial
  CRISPR gRNA sequence
aaaacaaacattgccctccc

SEQ ID NO: 700055 - DNA, 20 bp, Artificial
  CRISPR gRNA sequence
cctccccagccctccatcta

SEQ ID NO: 700056 - DNA, 20 bp, Artificial
  CRISPR gRNA sequence
tagataactactattatcat

SEQ ID NO: 700057 - DNA, 20 bp, Artificial
  CRISPR gRNA sequence
taactactattatcattaga

SEQ ID NO: 700058 - DNA, 20 bp, Artificial
  CRISPR gRNA sequence
cgcctctacctctctgtata

SEQ ID NO: 700059 - DNA, 20 bp, Artificial
  CRISPR gRNA sequence
tctacctctctgtataaaga

SEQ ID NO: 700060 - DNA, 20 bp, Artificial
  CRISPR gRNA sequence
ctacctctctgtataaagat

SEQ ID NO: 700061 - DNA, 20 bp, Artificial
  CRISPR gRNA sequence
cctctctgtataaagatggg

SEQ ID NO: 700062 - DNA, 20 bp, Artificial
  CRISPR gRNA sequence
ctctctgtataaagatgggt

SEQ ID NO: 700063 - DNA, 20 bp, Artificial
  CRISPR gRNA sequence
ctgtataaagatgggtaggt

SEQ ID NO: 700064 - DNA, 20 bp, Artificial
  CRISPR gRNA sequence
aagatgggtaggttagtaac

SEQ ID NO: 700065 - DNA, 20 bp, Artificial
  CRISPR gRNA sequence
tgggtaggttagtaaccaga

SEQ ID NO: 700066 - DNA, 20 bp, Artificial
  CRISPR gRNA sequence
acagcctgtacacacttaca

SEQ ID NO: 700067 - DNA, 20 bp, Artificial
  CRISPR gRNA sequence
gcctgtacacacttacaaag

SEQ ID NO: 700068 - DNA, 20 bp, Artificial
  CRISPR gRNA sequence
cctgtacacacttacaaaga

SEQ ID NO: 700069 - DNA, 20 bp, Artificial
  CRISPR gRNA sequence
acttacaaagaaggaatttt

SEQ ID NO: 700070 - DNA, 20 bp, Artificial
  CRISPR gRNA sequence
ttacaaagaaggaattttaa

SEQ ID NO: 700071 - DNA, 20 bp, Artificial
  CRISPR gRNA sequence
aagaaggaattttaagagaa

SEQ ID NO: 700072 - DNA, 20 bp, Artificial
  CRISPR gRNA sequence
agagaatggcaacatattta

SEQ ID NO: 700073 - DNA, 20 bp, Artificial
  CRISPR gRNA sequence
aaaatgataatatttaattt

SEQ ID NO: 700074 - DNA, 20 bp, Artificial
  CRISPR gRNA sequence
taatatttaattttagtcaa

SEQ ID NO: 700075 - DNA, 20 bp, Artificial
  CRISPR gRNA sequence
ttaattttagtcaaaagtat

SEQ ID NO: 700076 - DNA, 20 bp, Artificial
  CRISPR gRNA sequence
ttagtcaaaagtatcagaaa

SEQ ID NO: 700077 - DNA, 20 bp, Artificial
  CRISPR gRNA sequence
tcaaaagtatcagaaaaaga

SEQ ID NO: 700078 - DNA, 20 bp, Artificial
  CRISPR gRNA sequence
agtatcagaaaaagaaagcg

SEQ ID NO: 700079 - DNA, 20 bp, Artificial
  CRISPR gRNA sequence
aaaaagaaagcgaagtgaaa

SEQ ID NO: 700080 - DNA, 20 bp, Artificial
  CRISPR gRNA sequence
aagaaagcgaagtgaaacag

SEQ ID NO: 700081 - DNA, 20 bp, Artificial
  CRISPR gRNA sequence
aacagaagaatgccaaacct

SEQ ID NO: 700082 - DNA, 20 bp, Artificial
  CRISPR gRNA sequence
gaagaatgccaaacctcagt

SEQ ID NO: 700083 - DNA, 20 bp, Artificial
  CRISPR gRNA sequence
cagtcagattaatgtatctt

SEQ ID NO: 700084 - DNA, 20 bp, Artificial
  CRISPR gRNA sequence
gattaatgtatcttcagcaa

SEQ ID NO: 700085 - DNA, 20 bp, Artificial
  CRISPR gRNA sequence
aaaaaaaaccctctaaaatt

SEQ ID NO: 700086 - DNA, 20 bp, Artificial
  CRISPR gRNA sequence
aaaaccctctaaaattaaga

SEQ ID NO: 700087 - DNA, 20 bp, Artificial
  CRISPR gRNA sequence
aaaccctctaaaattaagaa

SEQ ID NO: 700088 - DNA, 20 bp, Artificial
  CRISPR gRNA sequence
accctctaaaattaagaaag

SEQ ID NO: 700089 - DNA, 20 bp, Artificial
  CRISPR gRNA sequence
ccctctaaaattaagaaagg

SEQ ID NO: 700090 - DNA, 20 bp, Artificial
  CRISPR gRNA sequence
agaaaggaggttatgaaaat

SEQ ID NO: 700091 - DNA, 20 bp, Artificial
  CRISPR gRNA sequence
aggaggttatgaaaatcagt

SEQ ID NO: 700092 - DNA, 20 bp, Artificial
  CRISPR gRNA sequence
aggttatgaaaatcagtaag

SEQ ID NO: 700093 - DNA, 20 bp, Artificial
  CRISPR gRNA sequence
taagtggttaataatcattt

SEQ ID NO: 700094 - DNA, 20 bp, Artificial
  CRISPR gRNA sequence
tcagaatctactatctcttg

SEQ ID NO: 700095 - DNA, 20 bp, Artificial
  CRISPR gRNA sequence
atctactatctcttgcagta

SEQ ID NO: 700096 - DNA, 20 bp, Artificial
  CRISPR gRNA sequence
tctactatctcttgcagtaa

SEQ ID NO: 700097 - DNA, 20 bp, Artificial
  CRISPR gRNA sequence
cagtaaaggcaaaatctgct

SEQ ID NO: 700098 - DNA, 20 bp, Artificial
  CRISPR gRNA sequence
aggcaaaatctgcttagttt

SEQ ID NO: 700099 - DNA, 20 bp, Artificial
  CRISPR gRNA sequence
aatctgcttagtttgagttt

SEQ ID NO: 700100 - DNA, 20 bp, Artificial
  CRISPR gRNA sequence
tgcttagtttgagttttgga

SEQ ID NO: 700101 - DNA, 20 bp, Artificial
  CRISPR gRNA sequence
ttagtttgagttttggacag

SEQ ID NO: 700102 - DNA, 20 bp, Artificial
  CRISPR gRNA sequence
agtttgagttttggacagta

SEQ ID NO: 700103 - DNA, 20 bp, Artificial
  CRISPR gRNA sequence
gagttttggacagtagagaa

SEQ ID NO: 700104 - DNA, 20 bp, Artificial
  CRISPR gRNA sequence
tagattgactccctgtaatg

SEQ ID NO: 700105 - DNA, 20 bp, Artificial
  CRISPR gRNA sequence
actccctgtaatgaagaaca

SEQ ID NO: 700106 - DNA, 20 bp, Artificial
  CRISPR gRNA sequence
atattctcatctgcaaccat

SEQ ID NO: 700107 - DNA, 20 bp, Artificial
  CRISPR gRNA sequence
atctgcaaccataagtccct

SEQ ID NO: 700108 - DNA, 20 bp, Artificial
  CRISPR gRNA sequence
ccataagtcccttggcatgt

SEQ ID NO: 700109 - DNA, 20 bp, Artificial
  CRISPR gRNA sequence
cattttttattattcatgat

SEQ ID NO: 700110 - DNA, 20 bp, Artificial
  CRISPR gRNA sequence
ttattcatgatgagtttatt

SEQ ID NO: 700111 - DNA, 20 bp, Artificial
  CRISPR gRNA sequence
catgatgagtttatttggca

SEQ ID NO: 700112 - DNA, 20 bp, Artificial
  CRISPR gRNA sequence
ggcacagcttctctgttcct

SEQ ID NO: 700113 - DNA, 20 bp, Artificial
  CRISPR gRNA sequence
ttcactttgattcatcattt

SEQ ID NO: 700114 - DNA, 20 bp, Artificial
  CRISPR gRNA sequence
tgattcatcatttgagtgat

SEQ ID NO: 700115 - DNA, 20 bp, Artificial
  CRISPR gRNA sequence
gagtgattggattacactgt

SEQ ID NO: 700116 - DNA, 20 bp, Artificial
  CRISPR gRNA sequence
agtgattggattacactgtc

SEQ ID NO: 700117 - DNA, 20 bp, Artificial
  CRISPR gRNA sequence
gattggattacactgtcagg

SEQ ID NO: 700118 - DNA, 20 bp, Artificial
  CRISPR gRNA sequence
cactgtcaggtggatttttc

SEQ ID NO: 700119 - DNA, 20 bp, Artificial
  CRISPR gRNA sequence
tgtcaggtggatttttcaag

SEQ ID NO: 700120 - DNA, 20 bp, Artificial
  CRISPR gRNA sequence
gtcaggtggatttttcaaga

SEQ ID NO: 700121 - DNA, 20 bp, Artificial
  CRISPR gRNA sequence
tcaggtggatttttcaagaa

SEQ ID NO: 700122 - DNA, 20 bp, Artificial
  CRISPR gRNA sequence
ttctctgttatttcatgttt

SEQ ID NO: 700123 - DNA, 20 bp, Artificial
  CRISPR gRNA sequence
tctctgttatttcatgtttg

SEQ ID NO: 700124 - DNA, 20 bp, Artificial
  CRISPR gRNA sequence
gttttcttttttttcttttt

SEQ ID NO: 700125 - DNA, 20 bp, Artificial
  CRISPR gRNA sequence
tcttttttttctttttgaga

SEQ ID NO: 700126 - DNA, 20 bp, Artificial
  CRISPR gRNA sequence
ttttttttctttttgagaca

SEQ ID NO: 700127 - DNA, 20 bp, Artificial
  CRISPR gRNA sequence
cagagtctgactctgtcgcc

SEQ ID NO: 700128 - DNA, 20 bp, Artificial
  CRISPR gRNA sequence
agagtctgactctgtcgccc

SEQ ID NO: 700129 - DNA, 20 bp, Artificial
  CRISPR gRNA sequence
tctgactctgtcgcccaggc

SEQ ID NO: 700130 - DNA, 20 bp, Artificial
  CRISPR gRNA sequence
tgactctgtcgcccaggctg

SEQ ID NO: 700131 - DNA, 20 bp, Artificial
  CRISPR gRNA sequence
ctgtcgcccaggctggagtg

SEQ ID NO: 700132 - DNA, 20 bp, Artificial
  CRISPR gRNA sequence
tcgcccaggctggagtgcag

SEQ ID NO: 700133 - DNA, 20 bp, Artificial
  CRISPR gRNA sequence
ggagtgcagtggtgcaatct

SEQ ID NO: 700134 - DNA, 20 bp, Artificial
  CRISPR gRNA sequence
tcactacaacctctacctcc

SEQ ID NO: 700135 - DNA, 20 bp, Artificial
  CRISPR gRNA sequence
aacctctacctcctggattc

SEQ ID NO: 700136 - DNA, 20 bp, Artificial
  CRISPR gRNA sequence
gagcgattctcctgcctcct

SEQ ID NO: 700137 - DNA, 20 bp, Artificial
  CRISPR gRNA sequence
cgattctcctgcctcctgag

SEQ ID NO: 700138 - DNA, 20 bp, Artificial
  CRISPR gRNA sequence
ctcctgcctcctgagtagct

SEQ ID NO: 700139 - DNA, 20 bp, Artificial
  CRISPR gRNA sequence
ctcctgagtagctgagatta

SEQ ID NO: 700140 - DNA, 20 bp, Artificial
  CRISPR gRNA sequence
tcctgagtagctgagattac

SEQ ID NO: 700141 - DNA, 20 bp, Artificial
  CRISPR gRNA sequence
cctgagtagctgagattaca

SEQ ID NO: 700142 - DNA, 20 bp, Artificial
  CRISPR gRNA sequence
cagggatgcaccaccacgcc

SEQ ID NO: 700143 - DNA, 20 bp, Artificial
  CRISPR gRNA sequence
ctggctaatttttgtatttt

SEQ ID NO: 700144 - DNA, 20 bp, Artificial
  CRISPR gRNA sequence
gctaatttttgtatttttag

SEQ ID NO: 700145 - DNA, 20 bp, Artificial
  CRISPR gRNA sequence
taatttttgtatttttagaa

SEQ ID NO: 700146 - DNA, 20 bp, Artificial
  CRISPR gRNA sequence
ttttgtatttttagaagaga

SEQ ID NO: 700147 - DNA, 20 bp, Artificial
  CRISPR gRNA sequence
tttgtatttttagaagagat

SEQ ID NO: 700148 - DNA, 20 bp, Artificial
  CRISPR gRNA sequence
ttgtatttttagaagagatg

SEQ ID NO: 700149 - DNA, 20 bp, Artificial
  CRISPR gRNA sequence
tggggtttcatcatgttgcc

SEQ ID NO: 700150 - DNA, 20 bp, Artificial
  CRISPR gRNA sequence
ggggtttcatcatgttgccc

SEQ ID NO: 700151 - DNA, 20 bp, Artificial
  CRISPR gRNA sequence
tttcatcatgttgcccaggc

SEQ ID NO: 700152 - DNA, 20 bp, Artificial
  CRISPR gRNA sequence
ggtctcaaactcctgacctc

SEQ ID NO: 700153 - DNA, 20 bp, Artificial
  CRISPR gRNA sequence
actcctgacctcaagtgatc

SEQ ID NO: 700154 - DNA, 20 bp, Artificial
  CRISPR gRNA sequence
ctcaagtgatccagccgcct

SEQ ID NO: 700155 - DNA, 20 bp, Artificial
  CRISPR gRNA sequence
ccagccgccttggcctccta

SEQ ID NO: 700156 - DNA, 20 bp, Artificial
  CRISPR gRNA sequence
gccttggcctcctaaagtgt

SEQ ID NO: 700157 - DNA, 20 bp, Artificial
  CRISPR gRNA sequence
ccttggcctcctaaagtgtt

SEQ ID NO: 700158 - DNA, 20 bp, Artificial
  CRISPR gRNA sequence
ctcctaaagtgttgggatta

SEQ ID NO: 700159 - DNA, 20 bp, Artificial
  CRISPR gRNA sequence
tcctaaagtgttgggattac

SEQ ID NO: 700160 - DNA, 20 bp, Artificial
  CRISPR gRNA sequence
agtgttgggattacaggtgt

SEQ ID NO: 700161 - DNA, 20 bp, Artificial
  CRISPR gRNA sequence
caggtgtgagtcaccattcc

SEQ ID NO: 700162 - DNA, 20 bp, Artificial
  CRISPR gRNA sequence
atttcttatctttaaatttt

SEQ ID NO: 700163 - DNA, 20 bp, Artificial
  CRISPR gRNA sequence
cttatctttaaattttaaga

SEQ ID NO: 700164 - DNA, 20 bp, Artificial
  CRISPR gRNA sequence
ttatctttaaattttaagac

SEQ ID NO: 700165 - DNA, 20 bp, Artificial
  CRISPR gRNA sequence
tatctttaaattttaagaca

SEQ ID NO: 700166 - DNA, 20 bp, Artificial
  CRISPR gRNA sequence
cagggtctcactttgttgtc

SEQ ID NO: 700167 - DNA, 20 bp, Artificial
  CRISPR gRNA sequence
agggtctcactttgttgtcc

SEQ ID NO: 700168 - DNA, 20 bp, Artificial
  CRISPR gRNA sequence
tctcactttgttgtccaggc

SEQ ID NO: 700169 - DNA, 20 bp, Artificial
  CRISPR gRNA sequence
tccaggctggccttaaactc

SEQ ID NO: 700170 - DNA, 20 bp, Artificial
  CRISPR gRNA sequence
ccaggctggccttaaactcc

SEQ ID NO: 700171 - DNA, 20 bp, Artificial
  CRISPR gRNA sequence
caggctggccttaaactcca

SEQ ID NO: 700172 - DNA, 20 bp, Artificial
  CRISPR gRNA sequence
ggccttaaactccagggctt

SEQ ID NO: 700173 - DNA, 20 bp, Artificial
  CRISPR gRNA sequence
cttaagtgttcctcctgcct

SEQ ID NO: 700174 - DNA, 20 bp, Artificial
  CRISPR gRNA sequence
tcctcctgcctcagcctccc

SEQ ID NO: 700175 - DNA, 20 bp, Artificial
  CRISPR gRNA sequence
tcctgcctcagcctcccgag

SEQ ID NO: 700176 - DNA, 20 bp, Artificial
  CRISPR gRNA sequence
gcctcagcctcccgagtagc

SEQ ID NO: 700177 - DNA, 20 bp, Artificial
  CRISPR gRNA sequence
cctcagcctcccgagtagct

SEQ ID NO: 700178 - DNA, 20 bp, Artificial
  CRISPR gRNA sequence
ctcagcctcccgagtagctg

SEQ ID NO: 700179 - DNA, 20 bp, Artificial
  CRISPR gRNA sequence
caatttttttgtgtgtctct

SEQ ID NO: 700180 - DNA, 20 bp, Artificial
  CRISPR gRNA sequence
aatttttttgtgtgtctctg

SEQ ID NO: 700181 - DNA, 20 bp, Artificial
  CRISPR gRNA sequence
gtctctgaggatataaatta

SEQ ID NO: 700182 - DNA, 20 bp, Artificial
  CRISPR gRNA sequence
agtcatgtattgcttattga

SEQ ID NO: 700183 - DNA, 20 bp, Artificial
  CRISPR gRNA sequence
gtcatgtattgcttattgac

SEQ ID NO: 700184 - DNA, 20 bp, Artificial
  CRISPR gRNA sequence
cattctgacaaacgtgtcat

SEQ ID NO: 700185 - DNA, 20 bp, Artificial
  CRISPR gRNA sequence
attctgacaaacgtgtcatt

SEQ ID NO: 700186 - DNA, 20 bp, Artificial
  CRISPR gRNA sequence
aggcaattttgtcgttgtgc

SEQ ID NO: 700187 - DNA, 20 bp, Artificial
  CRISPR gRNA sequence
ttgtcgttgtgcaagcatcc

SEQ ID NO: 700188 - DNA, 20 bp, Artificial
  CRISPR gRNA sequence
gttgtgcaagcatcctagat

SEQ ID NO: 700189 - DNA, 20 bp, Artificial
  CRISPR gRNA sequence
ttacacacacctacatgatg

SEQ ID NO: 700190 - DNA, 20 bp, Artificial
  CRISPR gRNA sequence
gatgtagcctactgcacacc

SEQ ID NO: 700191 - DNA, 20 bp, Artificial
  CRISPR gRNA sequence
atgtagcctactgcacacct

SEQ ID NO: 700192 - DNA, 20 bp, Artificial
  CRISPR gRNA sequence
tactgcacacctaggttcta

SEQ ID NO: 700193 - DNA, 20 bp, Artificial
  CRISPR gRNA sequence
tgcacacctaggttctatgg

SEQ ID NO: 700194 - DNA, 20 bp, Artificial
  CRISPR gRNA sequence
tggcagatccttttgctcct

SEQ ID NO: 700195 - DNA, 20 bp, Artificial
  CRISPR gRNA sequence
tcctaagctacaactctgca

SEQ ID NO: 700196 - DNA, 20 bp, Artificial
  CRISPR gRNA sequence
tgtgactgtcctgaatactg

SEQ ID NO: 700197 - DNA, 20 bp, Artificial
  CRISPR gRNA sequence
gtgactgtcctgaatactgt

SEQ ID NO: 700198 - DNA, 20 bp, Artificial
  CRISPR gRNA sequence
actgtcctgaatactgtagg

SEQ ID NO: 700199 - DNA, 20 bp, Artificial
  CRISPR gRNA sequence
aggcagctgtgacacaatgt

SEQ ID NO: 700200 - DNA, 20 bp, Artificial
  CRISPR gRNA sequence
agtatttgtgtatctaaaca

SEQ ID NO: 700201 - DNA, 20 bp, Artificial
  CRISPR gRNA sequence
ttgtgtatctaaacatagaa

SEQ ID NO: 700202 - DNA, 20 bp, Artificial
  CRISPR gRNA sequence
tgtgtatctaaacatagaaa

SEQ ID NO: 700203 - DNA, 20 bp, Artificial
  CRISPR gRNA sequence
ggtgcaataaaaatacgaca

SEQ ID NO: 700204 - DNA, 20 bp, Artificial
  CRISPR gRNA sequence
gtgcaataaaaatacgacat

SEQ ID NO: 700205 - DNA, 20 bp, Artificial
  CRISPR gRNA sequence
aataaaaatacgacataggc

SEQ ID NO: 700206 - DNA, 20 bp, Artificial
  CRISPR gRNA sequence
ataaaaatacgacataggcc

SEQ ID NO: 700207 - DNA, 20 bp, Artificial
  CRISPR gRNA sequence
aatacgacataggccgggca

SEQ ID NO: 700208 - DNA, 20 bp, Artificial
  CRISPR gRNA sequence
gtgactcacacctgtaatgc

SEQ ID NO: 700209 - DNA, 20 bp, Artificial
  CRISPR gRNA sequence
cacctgtaatgccagcactt

SEQ ID NO: 700210 - DNA, 20 bp, Artificial
  CRISPR gRNA sequence
acctgtaatgccagcacttt

SEQ ID NO: 700211 - DNA, 20 bp, Artificial
  CRISPR gRNA sequence
ctgtaatgccagcactttgg

SEQ ID NO: 700212 - DNA, 20 bp, Artificial
  CRISPR gRNA sequence
tgtaatgccagcactttggg

SEQ ID NO: 700213 - DNA, 20 bp, Artificial
  CRISPR gRNA sequence
tgccagcactttgggaggcc

SEQ ID NO: 700214 - DNA, 20 bp, Artificial
  CRISPR gRNA sequence
gccagcactttgggaggccg

SEQ ID NO: 700215 - DNA, 20 bp, Artificial
  CRISPR gRNA sequence
cagcactttgggaggccgag

SEQ ID NO: 700216 - DNA, 20 bp, Artificial
  CRISPR gRNA sequence
agcactttgggaggccgagg

SEQ ID NO: 700217 - DNA, 20 bp, Artificial
  CRISPR gRNA sequence
gcactttgggaggccgagga

SEQ ID NO: 700218 - DNA, 20 bp, Artificial
  CRISPR gRNA sequence
ctttgggaggccgaggaggg

SEQ ID NO: 700219 - DNA, 20 bp, Artificial
  CRISPR gRNA sequence
ccgaggagggtggattacct

SEQ ID NO: 700220 - DNA, 20 bp, Artificial
  CRISPR gRNA sequence
cgaggagggtggattacctg

SEQ ID NO: 700221 - DNA, 20 bp, Artificial
  CRISPR gRNA sequence
gagggtggattacctgaggt

SEQ ID NO: 700222 - DNA, 20 bp, Artificial
  CRISPR gRNA sequence
agggtggattacctgaggtc

SEQ ID NO: 700223 - DNA, 20 bp, Artificial
  CRISPR gRNA sequence
ggtggattacctgaggtcag

SEQ ID NO: 700224 - DNA, 20 bp, Artificial
  CRISPR gRNA sequence
ttacctgaggtcaggagttc

SEQ ID NO: 700225 - DNA, 20 bp, Artificial
  CRISPR gRNA sequence
tgaggtcaggagttcgagac

SEQ ID NO: 700226 - DNA, 20 bp, Artificial
  CRISPR gRNA sequence
tcaggagttcgagaccagcc

SEQ ID NO: 700227 - DNA, 20 bp, Artificial
  CRISPR gRNA sequence
cgagaccagcctggctaaca

SEQ ID NO: 700228 - DNA, 20 bp, Artificial
  CRISPR gRNA sequence
tctactaaaaatacaaaaat

SEQ ID NO: 700229 - DNA, 20 bp, Artificial
  CRISPR gRNA sequence
ctaaaaatacaaaaattagc

SEQ ID NO: 700230 - DNA, 20 bp, Artificial
  CRISPR gRNA sequence
taaaaatacaaaaattagct

SEQ ID NO: 700231 - DNA, 20 bp, Artificial
  CRISPR gRNA sequence
atacaaaaattagctgggcg

SEQ ID NO: 700232 - DNA, 20 bp, Artificial
  CRISPR gRNA sequence
caaaaattagctgggcgtgg

SEQ ID NO: 700233 - DNA, 20 bp, Artificial
  CRISPR gRNA sequence
ggcgtggtggcacgtgtctg

SEQ ID NO: 700234 - DNA, 20 bp, Artificial
  CRISPR gRNA sequence
gtggcacgtgtctgtagtcc

SEQ ID NO: 700235 - DNA, 20 bp, Artificial
  CRISPR gRNA sequence
gtctgtagtcccagctactc

SEQ ID NO: 700236 - DNA, 20 bp, Artificial
  CRISPR gRNA sequence
ctgtagtcccagctactcaa

SEQ ID NO: 700237 - DNA, 20 bp, Artificial
  CRISPR gRNA sequence
tgtagtcccagctactcaag

SEQ ID NO: 700238 - DNA, 20 bp, Artificial
  CRISPR gRNA sequence
cccagctactcaagaggctg

SEQ ID NO: 700239 - DNA, 20 bp, Artificial
  CRISPR gRNA sequence
agctactcaagaggctgaag

SEQ ID NO: 700240 - DNA, 20 bp, Artificial
  CRISPR gRNA sequence
tactcaagaggctgaagcag

SEQ ID NO: 700241 - DNA, 20 bp, Artificial
  CRISPR gRNA sequence
gcagaagaattgcttgaacc

SEQ ID NO: 700242 - DNA, 20 bp, Artificial
  CRISPR gRNA sequence
cagaagaattgcttgaacct

SEQ ID NO: 700243 - DNA, 20 bp, Artificial
  CRISPR gRNA sequence
gaagaattgcttgaacctgg

SEQ ID NO: 700244 - DNA, 20 bp, Artificial
  CRISPR gRNA sequence
aagaattgcttgaacctggg

SEQ ID NO: 700245 - DNA, 20 bp, Artificial
  CRISPR gRNA sequence
aattgcttgaacctgggagg

SEQ ID NO: 700246 - DNA, 20 bp, Artificial
  CRISPR gRNA sequence
ttgcttgaacctgggaggcg

SEQ ID NO: 700247 - DNA, 20 bp, Artificial
  CRISPR gRNA sequence
tgcttgaacctgggaggcgg

SEQ ID NO: 700248 - DNA, 20 bp, Artificial
  CRISPR gRNA sequence
aacctgggaggcggaggttg

SEQ ID NO: 700249 - DNA, 20 bp, Artificial
  CRISPR gRNA sequence
ggcggaggttgcagtgcgcc

SEQ ID NO: 700250 - DNA, 20 bp, Artificial
  CRISPR gRNA sequence
gagatcatgccactgcactc

SEQ ID NO: 700251 - DNA, 20 bp, Artificial
  CRISPR gRNA sequence
catgccactgcactccagcc

SEQ ID NO: 700252 - DNA, 20 bp, Artificial
  CRISPR gRNA sequence
atgccactgcactccagcct

SEQ ID NO: 700253 - DNA, 20 bp, Artificial
  CRISPR gRNA sequence
ctgcactccagcctgggtga

SEQ ID NO: 700254 - DNA, 20 bp, Artificial
  CRISPR gRNA sequence
gcactccagcctgggtgata

SEQ ID NO: 700255 - DNA, 20 bp, Artificial
  CRISPR gRNA sequence
tccagcctgggtgatagagt

SEQ ID NO: 700256 - DNA, 20 bp, Artificial
  CRISPR gRNA sequence
aaaaaaaaaatatgatatga

SEQ ID NO: 700257 - DNA, 20 bp, Artificial
  CRISPR gRNA sequence
gatatgaaagataaaaaaaa

SEQ ID NO: 700258 - DNA, 20 bp, Artificial
  CRISPR gRNA sequence
aaaaaaatggcacacttgta

SEQ ID NO: 700259 - DNA, 20 bp, Artificial
  CRISPR gRNA sequence
aaaaaatggcacacttgtac

SEQ ID NO: 700260 - DNA, 20 bp, Artificial
  CRISPR gRNA sequence
aaaaatggcacacttgtaca

SEQ ID NO: 700261 - DNA, 20 bp, Artificial
  CRISPR gRNA sequence
tacagggcacttaccgtgaa

SEQ ID NO: 700262 - DNA, 20 bp, Artificial
  CRISPR gRNA sequence
cagggcacttaccgtgaatg

SEQ ID NO: 700263 - DNA, 20 bp, Artificial
  CRISPR gRNA sequence
cttaccgtgaatggagcttg

SEQ ID NO: 700264 - DNA, 20 bp, Artificial
  CRISPR gRNA sequence
ttaccgtgaatggagcttgc

SEQ ID NO: 700265 - DNA, 20 bp, Artificial
  CRISPR gRNA sequence
aatggagcttgcaggacacg

SEQ ID NO: 700266 - DNA, 20 bp, Artificial
  CRISPR gRNA sequence
tgcaggacacgaagttgttc

SEQ ID NO: 700267 - DNA, 20 bp, Artificial
  CRISPR gRNA sequence
gcaggacacgaagttgttct

SEQ ID NO: 700268 - DNA, 20 bp, Artificial
  CRISPR gRNA sequence
gacacgaagttgttctgggt

SEQ ID NO: 700269 - DNA, 20 bp, Artificial
  CRISPR gRNA sequence
gttgttctgggtgagtcaat

SEQ ID NO: 700270 - DNA, 20 bp, Artificial
  CRISPR gRNA sequence
ttctgggtgagtcaatgagt

SEQ ID NO: 700271 - DNA, 20 bp, Artificial
  CRISPR gRNA sequence
tgggtgagtcaatgagtaag

SEQ ID NO: 700272 - DNA, 20 bp, Artificial
  CRISPR gRNA sequence
gtgagtcaatgagtaagtgg

SEQ ID NO: 700273 - DNA, 20 bp, Artificial
  CRISPR gRNA sequence
tgagtcaatgagtaagtggt

SEQ ID NO: 700274 - DNA, 20 bp, Artificial
  CRISPR gRNA sequence
tcaatgagtaagtggtgggt

SEQ ID NO: 700275 - DNA, 20 bp, Artificial
  CRISPR gRNA sequence
gtaagtggtgggtgagtgcg

SEQ ID NO: 700276 - DNA, 20 bp, Artificial
  CRISPR gRNA sequence
taagtggtgggtgagtgcga

SEQ ID NO: 700277 - DNA, 20 bp, Artificial
  CRISPR gRNA sequence
ggtgggtgagtgcgaaggcc

SEQ ID NO: 700278 - DNA, 20 bp, Artificial
  CRISPR gRNA sequence
gtgggtgagtgcgaaggcct

SEQ ID NO: 700279 - DNA, 20 bp, Artificial
  CRISPR gRNA sequence
tgggtgagtgcgaaggcctg

SEQ ID NO: 700280 - DNA, 20 bp, Artificial
  CRISPR gRNA sequence
ggcattactatgcactactg

SEQ ID NO: 700281 - DNA, 20 bp, Artificial
  CRISPR gRNA sequence
ctttatcaacactgtacact

SEQ ID NO: 700282 - DNA, 20 bp, Artificial
  CRISPR gRNA sequence
tttatcaacactgtacactt

SEQ ID NO: 700283 - DNA, 20 bp, Artificial
  CRISPR gRNA sequence
ttaggctatactaaatttat

SEQ ID NO: 700284 - DNA, 20 bp, Artificial
  CRISPR gRNA sequence
actttaactttttaaacttt

SEQ ID NO: 700285 - DNA, 20 bp, Artificial
  CRISPR gRNA sequence
ggctcttttgtaataacact

SEQ ID NO: 700286 - DNA, 20 bp, Artificial
  CRISPR gRNA sequence
ttgtaataacacttagctta

SEQ ID NO: 700287 - DNA, 20 bp, Artificial
  CRISPR gRNA sequence
taaagcacaaacacatcgta

SEQ ID NO: 700288 - DNA, 20 bp, Artificial
  CRISPR gRNA sequence
gtacaaaaatattttcttta

SEQ ID NO: 700289 - DNA, 20 bp, Artificial
  CRISPR gRNA sequence
ttttaacatttttaaattaa

SEQ ID NO: 700290 - DNA, 20 bp, Artificial
  CRISPR gRNA sequence
acatttttaaattaaaagct

SEQ ID NO: 700291 - DNA, 20 bp, Artificial
  CRISPR gRNA sequence
cgcaaacacctacattatcc

SEQ ID NO: 700292 - DNA, 20 bp, Artificial
  CRISPR gRNA sequence
gcaaacacctacattatccg

SEQ ID NO: 700293 - DNA, 20 bp, Artificial
  CRISPR gRNA sequence
tacattatccgaggcctaca

SEQ ID NO: 700294 - DNA, 20 bp, Artificial
  CRISPR gRNA sequence
cattatccgaggcctacaca

SEQ ID NO: 700295 - DNA, 20 bp, Artificial
  CRISPR gRNA sequence
atccgaggcctacacagagt

SEQ ID NO: 700296 - DNA, 20 bp, Artificial
  CRISPR gRNA sequence
tccgaggcctacacagagtc

SEQ ID NO: 700297 - DNA, 20 bp, Artificial
  CRISPR gRNA sequence
ctacacagagtcaggatcat

SEQ ID NO: 700298 - DNA, 20 bp, Artificial
  CRISPR gRNA sequence
tcctccaaatcttgtcccat

SEQ ID NO: 700299 - DNA, 20 bp, Artificial
  CRISPR gRNA sequence
tccaaatcttgtcccattgg

SEQ ID NO: 700300 - DNA, 20 bp, Artificial
  CRISPR gRNA sequence
cttgtcccattggcagcgtg

SEQ ID NO: 700301 - DNA, 20 bp, Artificial
  CRISPR gRNA sequence
gtgactcacacctgtaatcc

SEQ ID NO: 700302 - DNA, 20 bp, Artificial
  CRISPR gRNA sequence
cacctgtaatcccagcactt

SEQ ID NO: 700303 - DNA, 20 bp, Artificial
  CRISPR gRNA sequence
acctgtaatcccagcacttt

SEQ ID NO: 700304 - DNA, 20 bp, Artificial
  CRISPR gRNA sequence
tgtaatcccagcactttggg

SEQ ID NO: 700305 - DNA, 20 bp, Artificial
  CRISPR gRNA sequence
tcccagcactttgggaagcc

SEQ ID NO: 700306 - DNA, 20 bp, Artificial
  CRISPR gRNA sequence
cccagcactttgggaagccg

SEQ ID NO: 700307 - DNA, 20 bp, Artificial
  CRISPR gRNA sequence
agcactttgggaagccgagg

SEQ ID NO: 700308 - DNA, 20 bp, Artificial
  CRISPR gRNA sequence
gcactttgggaagccgaggt

SEQ ID NO: 700309 - DNA, 20 bp, Artificial
  CRISPR gRNA sequence
ctttgggaagccgaggtggg

SEQ ID NO: 700310 - DNA, 20 bp, Artificial
  CRISPR gRNA sequence
ccgaggtgggcagatcactt

SEQ ID NO: 700311 - DNA, 20 bp, Artificial
  CRISPR gRNA sequence
cgaggtgggcagatcacttg

SEQ ID NO: 700312 - DNA, 20 bp, Artificial
  CRISPR gRNA sequence
tgggcagatcacttgaggtc

SEQ ID NO: 700313 - DNA, 20 bp, Artificial
  CRISPR gRNA sequence
ggcagatcacttgaggtcaa

SEQ ID NO: 700314 - DNA, 20 bp, Artificial
  CRISPR gRNA sequence
tcacttgaggtcaagagttc

SEQ ID NO: 700315 - DNA, 20 bp, Artificial
  CRISPR gRNA sequence
tgaggtcaagagttcaagac

SEQ ID NO: 700316 - DNA, 20 bp, Artificial
  CRISPR gRNA sequence
tcaagagttcaagaccagct

SEQ ID NO: 700317 - DNA, 20 bp, Artificial
  CRISPR gRNA sequence
caagaccagcttggccaaca

SEQ ID NO: 700318 - DNA, 20 bp, Artificial
  CRISPR gRNA sequence
tctactaaaaatataaaaat

SEQ ID NO: 700319 - DNA, 20 bp, Artificial
  CRISPR gRNA sequence
ctaaaaatataaaaattagc

SEQ ID NO: 700320 - DNA, 20 bp, Artificial
  CRISPR gRNA sequence
taaaaatataaaaattagcc

SEQ ID NO: 700321 - DNA, 20 bp, Artificial
  CRISPR gRNA sequence
taaaaattagccgggcacgt

SEQ ID NO: 700322 - DNA, 20 bp, Artificial
  CRISPR gRNA sequence
ttggcatgcgcctgtaatcc

SEQ ID NO: 700323 - DNA, 20 bp, Artificial
  CRISPR gRNA sequence
cgcctgtaatcccagctact

SEQ ID NO: 700324 - DNA, 20 bp, Artificial
  CRISPR gRNA sequence
gcctgtaatcccagctactc

SEQ ID NO: 700325 - DNA, 20 bp, Artificial
  CRISPR gRNA sequence
tgtaatcccagctactcagg

SEQ ID NO: 700326 - DNA, 20 bp, Artificial
  CRISPR gRNA sequence
tcccagctactcaggtggct

SEQ ID NO: 700327 - DNA, 20 bp, Artificial
  CRISPR gRNA sequence
cccagctactcaggtggctg

SEQ ID NO: 700328 - DNA, 20 bp, Artificial
  CRISPR gRNA sequence
agctactcaggtggctgagg

SEQ ID NO: 700329 - DNA, 20 bp, Artificial
  CRISPR gRNA sequence
gctactcaggtggctgaggc

SEQ ID NO: 700330 - DNA, 20 bp, Artificial
  CRISPR gRNA sequence
tactcaggtggctgaggcag

SEQ ID NO: 700331 - DNA, 20 bp, Artificial
  CRISPR gRNA sequence
gcaggagaattgcttgaacc

SEQ ID NO: 700332 - DNA, 20 bp, Artificial
  CRISPR gRNA sequence
caggagaattgcttgaaccc

SEQ ID NO: 700333 - DNA, 20 bp, Artificial
  CRISPR gRNA sequence
ggagaattgcttgaacccgg

SEQ ID NO: 700334 - DNA, 20 bp, Artificial
  CRISPR gRNA sequence
gagaattgcttgaacccggg

SEQ ID NO: 700335 - DNA, 20 bp, Artificial
  CRISPR gRNA sequence
aattgcttgaacccgggagg

SEQ ID NO: 700336 - DNA, 20 bp, Artificial
  CRISPR gRNA sequence
ttgcttgaacccgggaggcg

SEQ ID NO: 700337 - DNA, 20 bp, Artificial
  CRISPR gRNA sequence
tgcttgaacccgggaggcgg

SEQ ID NO: 700338 - DNA, 20 bp, Artificial
  CRISPR gRNA sequence
aacccgggaggcggaggttg

SEQ ID NO: 700339 - DNA, 20 bp, Artificial
  CRISPR gRNA sequence
cgggaggcggaggttgcagt

SEQ ID NO: 700340 - DNA, 20 bp, Artificial
  CRISPR gRNA sequence
ggcggaggttgcagtgagct

SEQ ID NO: 700341 - DNA, 20 bp, Artificial
  CRISPR gRNA sequence
gagattgtgctactgcactc

SEQ ID NO: 700342 - DNA, 20 bp, Artificial
  CRISPR gRNA sequence
tgtgctactgcactccagcc

SEQ ID NO: 700343 - DNA, 20 bp, Artificial
  CRISPR gRNA sequence
gtgctactgcactccagcct

SEQ ID NO: 700344 - DNA, 20 bp, Artificial
  CRISPR gRNA sequence
ctgcactccagcctgggtga

SEQ ID NO: 700345 - DNA, 20 bp, Artificial
  CRISPR gRNA sequence
tccagcctgggtgacagaat

SEQ ID NO: 700346 - DNA, 20 bp, Artificial
  CRISPR gRNA sequence
tgtctcaaaaaaaaaaaaaa

SEQ ID NO: 700347 - DNA, 20 bp, Artificial
  CRISPR gRNA sequence
aaaaaagaatcctgtcccat

SEQ ID NO: 700348 - DNA, 20 bp, Artificial
  CRISPR gRNA sequence
aaagaatcctgtcccattgg

SEQ ID NO: 700349 - DNA, 20 bp, Artificial
  CRISPR gRNA sequence
aagaatcctgtcccattgga

SEQ ID NO: 700350 - DNA, 20 bp, Artificial
  CRISPR gRNA sequence
ctgtcccattggaaggtctt

SEQ ID NO: 700351 - DNA, 20 bp, Artificial
  CRISPR gRNA sequence
tgtcccattggaaggtcttc

SEQ ID NO: 700352 - DNA, 20 bp, Artificial
  CRISPR gRNA sequence
tcccattggaaggtcttcag

SEQ ID NO: 700353 - DNA, 20 bp, Artificial
  CRISPR gRNA sequence
cattggaaggtcttcaggag

SEQ ID NO: 700354 - DNA, 20 bp, Artificial
  CRISPR gRNA sequence
ggaaggtcttcaggagcggt

SEQ ID NO: 700355 - DNA, 20 bp, Artificial
  CRISPR gRNA sequence
gaaggtcttcaggagcggta

SEQ ID NO: 700356 - DNA, 20 bp, Artificial
  CRISPR gRNA sequence
gagcggtaaggtaacatgca

SEQ ID NO: 700357 - DNA, 20 bp, Artificial
  CRISPR gRNA sequence
gcggtaaggtaacatgcatg

SEQ ID NO: 700358 - DNA, 20 bp, Artificial
  CRISPR gRNA sequence
atgataacaatgccttcttc

SEQ ID NO: 700359 - DNA, 20 bp, Artificial
  CRISPR gRNA sequence
tgccttcttctggatacctg

SEQ ID NO: 700360 - DNA, 20 bp, Artificial
  CRISPR gRNA sequence
cttcttctggatacctgcag

SEQ ID NO: 700361 - DNA, 20 bp, Artificial
  CRISPR gRNA sequence
ttcttctggatacctgcaga

SEQ ID NO: 700362 - DNA, 20 bp, Artificial
  CRISPR gRNA sequence
acctgcagaaggacctacct

SEQ ID NO: 700363 - DNA, 20 bp, Artificial
  CRISPR gRNA sequence
cctgcagaaggacctacctg

SEQ ID NO: 700364 - DNA, 20 bp, Artificial
  CRISPR gRNA sequence
acctacctgaggctgtatta

SEQ ID NO: 700365 - DNA, 20 bp, Artificial
  CRISPR gRNA sequence
cagttaacttttgttttaat

SEQ ID NO: 700366 - DNA, 20 bp, Artificial
  CRISPR gRNA sequence
ttaacttttgttttaataag

SEQ ID NO: 700367 - DNA, 20 bp, Artificial
  CRISPR gRNA sequence
taacttttgttttaataagt

SEQ ID NO: 700368 - DNA, 20 bp, Artificial
  CRISPR gRNA sequence
acttttgttttaataagtag

SEQ ID NO: 700369 - DNA, 20 bp, Artificial
  CRISPR gRNA sequence
gtacactctaaaataatgat

SEQ ID NO: 700370 - DNA, 20 bp, Artificial
  CRISPR gRNA sequence
tacactctaaaataatgata

SEQ ID NO: 700371 - DNA, 20 bp, Artificial
  CRISPR gRNA sequence
ctctaaaataatgataaggc

SEQ ID NO: 700372 - DNA, 20 bp, Artificial
  CRISPR gRNA sequence
aaataatgataaggccggct

SEQ ID NO: 700373 - DNA, 20 bp, Artificial
  CRISPR gRNA sequence
taatgataaggccggcttgg

SEQ ID NO: 700374 - DNA, 20 bp, Artificial
  CRISPR gRNA sequence
ggcttggtggctgatgcctg

SEQ ID NO: 700375 - DNA, 20 bp, Artificial
  CRISPR gRNA sequence
gtggctgatgcctgcagtct

SEQ ID NO: 700376 - DNA, 20 bp, Artificial
  CRISPR gRNA sequence
atgcctgcagtctcagcact

SEQ ID NO: 700377 - DNA, 20 bp, Artificial
  CRISPR gRNA sequence
tgcctgcagtctcagcactt

SEQ ID NO: 700378 - DNA, 20 bp, Artificial
  CRISPR gRNA sequence
gcctgcagtctcagcactta

SEQ ID NO: 700379 - DNA, 20 bp, Artificial
  CRISPR gRNA sequence
ctgcagtctcagcacttagg

SEQ ID NO: 700380 - DNA, 20 bp, Artificial
  CRISPR gRNA sequence
tgcagtctcagcacttaggg

SEQ ID NO: 700381 - DNA, 20 bp, Artificial
  CRISPR gRNA sequence
gtctcagcacttagggaggc

SEQ ID NO: 700382 - DNA, 20 bp, Artificial
  CRISPR gRNA sequence
tctcagcacttagggaggcc

SEQ ID NO: 700383 - DNA, 20 bp, Artificial
  CRISPR gRNA sequence
agcacttagggaggccaggc

SEQ ID NO: 700384 - DNA, 20 bp, Artificial
  CRISPR gRNA sequence
gcacttagggaggccaggct

SEQ ID NO: 700385 - DNA, 20 bp, Artificial
  CRISPR gRNA sequence
acttagggaggccaggctgg

SEQ ID NO: 700386 - DNA, 20 bp, Artificial
  CRISPR gRNA sequence
ccaggctgggagaatcactt

SEQ ID NO: 700387 - DNA, 20 bp, Artificial
  CRISPR gRNA sequence
caggctgggagaatcacttg

SEQ ID NO: 700388 - DNA, 20 bp, Artificial
  CRISPR gRNA sequence
ctgggagaatcacttgaggc

SEQ ID NO: 700389 - DNA, 20 bp, Artificial
  CRISPR gRNA sequence
tgggagaatcacttgaggcc

SEQ ID NO: 700390 - DNA, 20 bp, Artificial
  CRISPR gRNA sequence
ggagaatcacttgaggccag

SEQ ID NO: 700391 - DNA, 20 bp, Artificial
  CRISPR gRNA sequence
tcacttgaggccaggagttt

SEQ ID NO: 700392 - DNA, 20 bp, Artificial
  CRISPR gRNA sequence
tgaggccaggagtttgagac

SEQ ID NO: 700393 - DNA, 20 bp, Artificial
  CRISPR gRNA sequence
ccaggagtttgagaccagcc

SEQ ID NO: 700394 - DNA, 20 bp, Artificial
  CRISPR gRNA sequence
caggagtttgagaccagcct

SEQ ID NO: 700395 - DNA, 20 bp, Artificial
  CRISPR gRNA sequence
tgagaccagcctgggcaaca

SEQ ID NO: 700396 - DNA, 20 bp, Artificial
  CRISPR gRNA sequence
accagcctgggcaacacagt

SEQ ID NO: 700397 - DNA, 20 bp, Artificial
  CRISPR gRNA sequence
tgagatccccatctctacac

SEQ ID NO: 700398 - DNA, 20 bp, Artificial
  CRISPR gRNA sequence
ctacacaagataaaatacat

SEQ ID NO: 700399 - DNA, 20 bp, Artificial
  CRISPR gRNA sequence
acaagataaaatacattagc

SEQ ID NO: 700400 - DNA, 20 bp, Artificial
  CRISPR gRNA sequence
caagataaaatacattagct

SEQ ID NO: 700401 - DNA, 20 bp, Artificial
  CRISPR gRNA sequence
taaaatacattagctgggtg

SEQ ID NO: 700402 - DNA, 20 bp, Artificial
  CRISPR gRNA sequence
aatacattagctgggtgtgg

SEQ ID NO: 700403 - DNA, 20 bp, Artificial
  CRISPR gRNA sequence
ggtgtggtggcatgcgcctg

SEQ ID NO: 700404 - DNA, 20 bp, Artificial
  CRISPR gRNA sequence
gtggcatgcgcctgtagtcc

SEQ ID NO: 700405 - DNA, 20 bp, Artificial
  CRISPR gRNA sequence
cgcctgtagtcccagctact

SEQ ID NO: 700406 - DNA, 20 bp, Artificial
  CRISPR gRNA sequence
gcctgtagtcccagctactc

SEQ ID NO: 700407 - DNA, 20 bp, Artificial
  CRISPR gRNA sequence
ctgtagtcccagctactcag

SEQ ID NO: 700408 - DNA, 20 bp, Artificial
  CRISPR gRNA sequence
tgtagtcccagctactcagg

SEQ ID NO: 700409 - DNA, 20 bp, Artificial
  CRISPR gRNA sequence
tcccagctactcaggaggct

SEQ ID NO: 700410 - DNA, 20 bp, Artificial
  CRISPR gRNA sequence
cccagctactcaggaggctg

SEQ ID NO: 700411 - DNA, 20 bp, Artificial
  CRISPR gRNA sequence
agctactcaggaggctgagg

SEQ ID NO: 700412 - DNA, 20 bp, Artificial
  CRISPR gRNA sequence
gctactcaggaggctgaggt

SEQ ID NO: 700413 - DNA, 20 bp, Artificial
  CRISPR gRNA sequence
tactcaggaggctgaggtgg

SEQ ID NO: 700414 - DNA, 20 bp, Artificial
  CRISPR gRNA sequence
actcaggaggctgaggtggg

SEQ ID NO: 700415 - DNA, 20 bp, Artificial
  CRISPR gRNA sequence
aggaggctgaggtgggagga

SEQ ID NO: 700416 - DNA, 20 bp, Artificial
  CRISPR gRNA sequence
ctgaggtgggaggatggctt

SEQ ID NO: 700417 - DNA, 20 bp, Artificial
  CRISPR gRNA sequence
gtgggaggatggcttgagcc

SEQ ID NO: 700418 - DNA, 20 bp, Artificial
  CRISPR gRNA sequence
tgggaggatggcttgagccc

SEQ ID NO: 700419 - DNA, 20 bp, Artificial
  CRISPR gRNA sequence
gaggatggcttgagcccagg

SEQ ID NO: 700420 - DNA, 20 bp, Artificial
  CRISPR gRNA sequence
tggcttgagcccaggaagtt

SEQ ID NO: 700421 - DNA, 20 bp, Artificial
  CRISPR gRNA sequence
ggcttgagcccaggaagttg

SEQ ID NO: 700422 - DNA, 20 bp, Artificial
  CRISPR gRNA sequence
agcccaggaagttgaggtta

SEQ ID NO: 700423 - DNA, 20 bp, Artificial
  CRISPR gRNA sequence
caggaagttgaggttacagt

SEQ ID NO: 700424 - DNA, 20 bp, Artificial
  CRISPR gRNA sequence
gtgatcatgccactgcactc

SEQ ID NO: 700425 - DNA, 20 bp, Artificial
  CRISPR gRNA sequence
catgccactgcactccagcc

SEQ ID NO: 700426 - DNA, 20 bp, Artificial
  CRISPR gRNA sequence
atgccactgcactccagcct

SEQ ID NO: 700427 - DNA, 20 bp, Artificial
  CRISPR gRNA sequence
ctgcactccagcctgggcaa

SEQ ID NO: 700428 - DNA, 20 bp, Artificial
  CRISPR gRNA sequence
gcactccagcctgggcaaca

SEQ ID NO: 700429 - DNA, 20 bp, Artificial
  CRISPR gRNA sequence
tccagcctgggcaacagagc

SEQ ID NO: 700430 - DNA, 20 bp, Artificial
  CRISPR gRNA sequence
caaaaaaaaaaaatgataaa

SEQ ID NO: 700431 - DNA, 20 bp, Artificial
  CRISPR gRNA sequence
aaaaaaaatgataaaaagta

SEQ ID NO: 700432 - DNA, 20 bp, Artificial
  CRISPR gRNA sequence
aaatgataaaaagtatagta

SEQ ID NO: 700433 - DNA, 20 bp, Artificial
  CRISPR gRNA sequence
gataaaaagtatagtacagt

SEQ ID NO: 700434 - DNA, 20 bp, Artificial
  CRISPR gRNA sequence
agtacagtaagtacgtaaac

SEQ ID NO: 700435 - DNA, 20 bp, Artificial
  CRISPR gRNA sequence
aagtacgtaaaccagcaata

SEQ ID NO: 700436 - DNA, 20 bp, Artificial
  CRISPR gRNA sequence
agctttctatgatcattatc

SEQ ID NO: 700437 - DNA, 20 bp, Artificial
  CRISPR gRNA sequence
ccataattgcatgtgctatg

SEQ ID NO: 700438 - DNA, 20 bp, Artificial
  CRISPR gRNA sequence
atgcagcacttttatacaac

SEQ ID NO: 700439 - DNA, 20 bp, Artificial
  CRISPR gRNA sequence
cagcacttttatacaactgg

SEQ ID NO: 700440 - DNA, 20 bp, Artificial
  CRISPR gRNA sequence
agcacttttatacaactggc

SEQ ID NO: 700441 - DNA, 20 bp, Artificial
  CRISPR gRNA sequence
gcacttttatacaactggca

SEQ ID NO: 700442 - DNA, 20 bp, Artificial
  CRISPR gRNA sequence
cttttatacaactggcaggg

SEQ ID NO: 700443 - DNA, 20 bp, Artificial
  CRISPR gRNA sequence
ttatacaactggcagggcag

SEQ ID NO: 700444 - DNA, 20 bp, Artificial
  CRISPR gRNA sequence
tatacaactggcagggcagt

SEQ ID NO: 700445 - DNA, 20 bp, Artificial
  CRISPR gRNA sequence
taccaacatctccacaaaca

SEQ ID NO: 700446 - DNA, 20 bp, Artificial
  CRISPR gRNA sequence
accaacatctccacaaacat

SEQ ID NO: 700447 - DNA, 20 bp, Artificial
  CRISPR gRNA sequence
caacatctccacaaacatgg

SEQ ID NO: 700448 - DNA, 20 bp, Artificial
  CRISPR gRNA sequence
cacgtgctacgacattgccg

SEQ ID NO: 700449 - DNA, 20 bp, Artificial
  CRISPR gRNA sequence
tgccgtggctatgacatcac

SEQ ID NO: 700450 - DNA, 20 bp, Artificial
  CRISPR gRNA sequence
gccgtggctatgacatcact

SEQ ID NO: 700451 - DNA, 20 bp, Artificial
  CRISPR gRNA sequence
gctatgacatcactaggcaa

SEQ ID NO: 700452 - DNA, 20 bp, Artificial
  CRISPR gRNA sequence
ctatgacatcactaggcaat

SEQ ID NO: 700453 - DNA, 20 bp, Artificial
  CRISPR gRNA sequence
actaggcaataggaattttt

SEQ ID NO: 700454 - DNA, 20 bp, Artificial
  CRISPR gRNA sequence
ttttattgttttttttgttt

SEQ ID NO: 700455 - DNA, 20 bp, Artificial
  CRISPR gRNA sequence
attgttttttttgtttgaga

SEQ ID NO: 700456 - DNA, 20 bp, Artificial
  CRISPR gRNA sequence
tgttttttttgtttgagatg

SEQ ID NO: 700457 - DNA, 20 bp, Artificial
  CRISPR gRNA sequence
tggagtcctgctctgttgcc

SEQ ID NO: 700458 - DNA, 20 bp, Artificial
  CRISPR gRNA sequence
ggagtcctgctctgttgccc

SEQ ID NO: 700459 - DNA, 20 bp, Artificial
  CRISPR gRNA sequence
tcctgctctgttgcccaggc

SEQ ID NO: 700460 - DNA, 20 bp, Artificial
  CRISPR gRNA sequence
ctgctctgttgcccaggctg

SEQ ID NO: 700461 - DNA, 20 bp, Artificial
  CRISPR gRNA sequence
ttgcccaggctggagtgcaa

SEQ ID NO: 700462 - DNA, 20 bp, Artificial
  CRISPR gRNA sequence
ggagtgcaatggcgcaatct

SEQ ID NO: 700463 - DNA, 20 bp, Artificial
  CRISPR gRNA sequence
aatctcggctcactgcaacc

SEQ ID NO: 700464 - DNA, 20 bp, Artificial
  CRISPR gRNA sequence
atctcggctcactgcaacct

SEQ ID NO: 700465 - DNA, 20 bp, Artificial
  CRISPR gRNA sequence
gctcactgcaacctgggttc

SEQ ID NO: 700466 - DNA, 20 bp, Artificial
  CRISPR gRNA sequence
ttcaagcgattctcctgtct

SEQ ID NO: 700467 - DNA, 20 bp, Artificial
  CRISPR gRNA sequence
ttctcctgtcttagcctctc

SEQ ID NO: 700468 - DNA, 20 bp, Artificial
  CRISPR gRNA sequence
tcctgtcttagcctctcaag

SEQ ID NO: 700469 - DNA, 20 bp, Artificial
  CRISPR gRNA sequence
gtcttagcctctcaagtagc

SEQ ID NO: 700470 - DNA, 20 bp, Artificial
  CRISPR gRNA sequence
tcttagcctctcaagtagct

SEQ ID NO: 700471 - DNA, 20 bp, Artificial
  CRISPR gRNA sequence
ctctcaagtagctgggatta

SEQ ID NO: 700472 - DNA, 20 bp, Artificial
  CRISPR gRNA sequence
tctcaagtagctgggattac

SEQ ID NO: 700473 - DNA, 20 bp, Artificial
  CRISPR gRNA sequence
caggcatgcgccaccatgcc

SEQ ID NO: 700474 - DNA, 20 bp, Artificial
  CRISPR gRNA sequence
gctaatttttgtattttttt

SEQ ID NO: 700475 - DNA, 20 bp, Artificial
  CRISPR gRNA sequence
ctaatttttgtatttttttt

SEQ ID NO: 700476 - DNA, 20 bp, Artificial
  CRISPR gRNA sequence
aatttttgtattttttttag

SEQ ID NO: 700477 - DNA, 20 bp, Artificial
  CRISPR gRNA sequence
tttttgtattttttttagga

SEQ ID NO: 700478 - DNA, 20 bp, Artificial
  CRISPR gRNA sequence
ttttgtattttttttaggag

SEQ ID NO: 700479 - DNA, 20 bp, Artificial
  CRISPR gRNA sequence
tgtattttttttaggagagg

SEQ ID NO: 700480 - DNA, 20 bp, Artificial
  CRISPR gRNA sequence
gtattttttttaggagaggc

SEQ ID NO: 700481 - DNA, 20 bp, Artificial
  CRISPR gRNA sequence
gaggcgggatttcaccatgt

SEQ ID NO: 700482 - DNA, 20 bp, Artificial
  CRISPR gRNA sequence
cgggatttcaccatgttggc

SEQ ID NO: 700483 - DNA, 20 bp, Artificial
  CRISPR gRNA sequence
gggatttcaccatgttggcc

SEQ ID NO: 700484 - DNA, 20 bp, Artificial
  CRISPR gRNA sequence
tttcaccatgttggccaggc

SEQ ID NO: 700485 - DNA, 20 bp, Artificial
  CRISPR gRNA sequence
tggttttgaactcctgacct

SEQ ID NO: 700486 - DNA, 20 bp, Artificial
  CRISPR gRNA sequence
ggttttgaactcctgacctc

SEQ ID NO: 700487 - DNA, 20 bp, Artificial
  CRISPR gRNA sequence
ctcaggttatccgccctcct

SEQ ID NO: 700488 - DNA, 20 bp, Artificial
  CRISPR gRNA sequence
ccgccctcctcggcctccca

SEQ ID NO: 700489 - DNA, 20 bp, Artificial
  CRISPR gRNA sequence
tcctcggcctcccaaagtgc

SEQ ID NO: 700490 - DNA, 20 bp, Artificial
  CRISPR gRNA sequence
cctcggcctcccaaagtgct

SEQ ID NO: 700491 - DNA, 20 bp, Artificial
  CRISPR gRNA sequence
ctcccaaagtgctgggatta

SEQ ID NO: 700492 - DNA, 20 bp, Artificial
  CRISPR gRNA sequence
tcccaaagtgctgggattac

SEQ ID NO: 700493 - DNA, 20 bp, Artificial
  CRISPR gRNA sequence
agtgctgggattacaggcgt

SEQ ID NO: 700494 - DNA, 20 bp, Artificial
  CRISPR gRNA sequence
caggcgtgagccaccgcgcc

SEQ ID NO: 700495 - DNA, 20 bp, Artificial
  CRISPR gRNA sequence
cggcttccattatgatcttg

SEQ ID NO: 700496 - DNA, 20 bp, Artificial
  CRISPR gRNA sequence
ggcttccattatgatcttgt

SEQ ID NO: 700497 - DNA, 20 bp, Artificial
  CRISPR gRNA sequence
ttgactgaaatgttgctctg

SEQ ID NO: 700498 - DNA, 20 bp, Artificial
  CRISPR gRNA sequence
atgttgctctgtggtgcgtg

SEQ ID NO: 700499 - DNA, 20 bp, Artificial
  CRISPR gRNA sequence
tgttgctctgtggtgcgtga

SEQ ID NO: 700500 - DNA, 20 bp, Artificial
  CRISPR gRNA sequence
tccctcttttctgcctcctt

SEQ ID NO: 700501 - DNA, 20 bp, Artificial
  CRISPR gRNA sequence
ttttctgcctccttgagtgt

SEQ ID NO: 700502 - DNA, 20 bp, Artificial
  CRISPR gRNA sequence
gtgttagtgctctttgcatt

SEQ ID NO: 700503 - DNA, 20 bp, Artificial
  CRISPR gRNA sequence
gttagtgctctttgcattca

SEQ ID NO: 700504 - DNA, 20 bp, Artificial
  CRISPR gRNA sequence
cattcagagctcctcttcct

SEQ ID NO: 700505 - DNA, 20 bp, Artificial
  CRISPR gRNA sequence
gagctcctcttccttggcgc

SEQ ID NO: 700506 - DNA, 20 bp, Artificial
  CRISPR gRNA sequence
gctggttttcctctgatgtt

SEQ ID NO: 700507 - DNA, 20 bp, Artificial
  CRISPR gRNA sequence
ctctgatgtttggcgacttc

SEQ ID NO: 700508 - DNA, 20 bp, Artificial
  CRISPR gRNA sequence
cacatcatatctcatgatgc

SEQ ID NO: 700509 - DNA, 20 bp, Artificial
  CRISPR gRNA sequence
atcatatctcatgatgccgg

SEQ ID NO: 700510 - DNA, 20 bp, Artificial
  CRISPR gRNA sequence
tgatgccggtggtctgcgaa

SEQ ID NO: 700511 - DNA, 20 bp, Artificial
  CRISPR gRNA sequence
gatgccggtggtctgcgaat

SEQ ID NO: 700512 - DNA, 20 bp, Artificial
  CRISPR gRNA sequence
atgccggtggtctgcgaatg

SEQ ID NO: 700513 - DNA, 20 bp, Artificial
  CRISPR gRNA sequence
ggcttctgaaacccacctct

SEQ ID NO: 700514 - DNA, 20 bp, Artificial
  CRISPR gRNA sequence
gcttctgaaacccacctctg

SEQ ID NO: 700515 - DNA, 20 bp, Artificial
  CRISPR gRNA sequence
cttctgaaacccacctctga

SEQ ID NO: 700516 - DNA, 20 bp, Artificial
  CRISPR gRNA sequence
aaacccacctctgagggcaa

SEQ ID NO: 700517 - DNA, 20 bp, Artificial
  CRISPR gRNA sequence
aacccacctctgagggcaat

SEQ ID NO: 700518 - DNA, 20 bp, Artificial
  CRISPR gRNA sequence
acccacctctgagggcaatg

SEQ ID NO: 700519 - DNA, 20 bp, Artificial
  CRISPR gRNA sequence
cctctgagggcaatggggct

SEQ ID NO: 700520 - DNA, 20 bp, Artificial
  CRISPR gRNA sequence
ctctgagggcaatggggctc

SEQ ID NO: 700521 - DNA, 20 bp, Artificial
  CRISPR gRNA sequence
tgagggcaatggggctcagg

SEQ ID NO: 700522 - DNA, 20 bp, Artificial
  CRISPR gRNA sequence
gagggcaatggggctcaggt

SEQ ID NO: 700523 - DNA, 20 bp, Artificial
  CRISPR gRNA sequence
agggcaatggggctcaggtg

SEQ ID NO: 700524 - DNA, 20 bp, Artificial
  CRISPR gRNA sequence
gggctcaggtggggctgcaa

SEQ ID NO: 700525 - DNA, 20 bp, Artificial
  CRISPR gRNA sequence
gggctgcaacagtctctttg

SEQ ID NO: 700526 - DNA, 20 bp, Artificial
  CRISPR gRNA sequence
ggctgcaacagtctctttgc

SEQ ID NO: 700527 - DNA, 20 bp, Artificial
  CRISPR gRNA sequence
tgcaacagtctctttgcggg

SEQ ID NO: 700528 - DNA, 20 bp, Artificial
  CRISPR gRNA sequence
tctctttgcgggaagacgcg

SEQ ID NO: 700529 - DNA, 20 bp, Artificial
  CRISPR gRNA sequence
gcgggaagacgcgtggcctc

SEQ ID NO: 700530 - DNA, 20 bp, Artificial
  CRISPR gRNA sequence
acgcgtggcctctggctctg

SEQ ID NO: 700531 - DNA, 20 bp, Artificial
  CRISPR gRNA sequence
ggcctctggctctgtggcat

SEQ ID NO: 700532 - DNA, 20 bp, Artificial
  CRISPR gRNA sequence
ggctctgtggcatgagtgat

SEQ ID NO: 700533 - DNA, 20 bp, Artificial
  CRISPR gRNA sequence
gctctgtggcatgagtgatg

SEQ ID NO: 700534 - DNA, 20 bp, Artificial
  CRISPR gRNA sequence
tctgtggcatgagtgatgag

SEQ ID NO: 700535 - DNA, 20 bp, Artificial
  CRISPR gRNA sequence
atgagtgatgaggagctatc

SEQ ID NO: 700536 - DNA, 20 bp, Artificial
  CRISPR gRNA sequence
gagtgatgaggagctatcca

SEQ ID NO: 700537 - DNA, 20 bp, Artificial
  CRISPR gRNA sequence
cagagcctttcccccttctt

SEQ ID NO: 700538 - DNA, 20 bp, Artificial
  CRISPR gRNA sequence
gagcctttcccccttcttca

SEQ ID NO: 700539 - DNA, 20 bp, Artificial
  CRISPR gRNA sequence
gcctttcccccttcttcaga

SEQ ID NO: 700540 - DNA, 20 bp, Artificial
  CRISPR gRNA sequence
cttcttcagagagtccccct

SEQ ID NO: 700541 - DNA, 20 bp, Artificial
  CRISPR gRNA sequence
agtcccccttggctgcattc

SEQ ID NO: 700542 - DNA, 20 bp, Artificial
  CRISPR gRNA sequence
gtcccccttggctgcattct

SEQ ID NO: 700543 - DNA, 20 bp, Artificial
  CRISPR gRNA sequence
cttggctgcattctgggctg

SEQ ID NO: 700544 - DNA, 20 bp, Artificial
  CRISPR gRNA sequence
gtcctctgccttccgtattt

SEQ ID NO: 700545 - DNA, 20 bp, Artificial
  CRISPR gRNA sequence
tcctctgccttccgtatttc

SEQ ID NO: 700546 - DNA, 20 bp, Artificial
  CRISPR gRNA sequence
cctctgccttccgtatttcg

SEQ ID NO: 700547 - DNA, 20 bp, Artificial
  CRISPR gRNA sequence
tctgccttccgtatttcggg

SEQ ID NO: 700548 - DNA, 20 bp, Artificial
  CRISPR gRNA sequence
gtcttcgtttctgatctgcc

SEQ ID NO: 700549 - DNA, 20 bp, Artificial
  CRISPR gRNA sequence
ctgccaagcttgccccttct

SEQ ID NO: 700550 - DNA, 20 bp, Artificial
  CRISPR gRNA sequence
gcttgccccttcttggtctc

SEQ ID NO: 700551 - DNA, 20 bp, Artificial
  CRISPR gRNA sequence
cttgccccttcttggtctcc

SEQ ID NO: 700552 - DNA, 20 bp, Artificial
  CRISPR gRNA sequence
gcctgttacacattaattat

SEQ ID NO: 700553 - DNA, 20 bp, Artificial
  CRISPR gRNA sequence
acattaattattagttttac

SEQ ID NO: 700554 - DNA, 20 bp, Artificial
  CRISPR gRNA sequence
tgttttgttttgttttgttt

SEQ ID NO: 700555 - DNA, 20 bp, Artificial
  CRISPR gRNA sequence
ttgttttgttttgtttgaga

SEQ ID NO: 700556 - DNA, 20 bp, Artificial
  CRISPR gRNA sequence
gttttgttttgtttgagacg

SEQ ID NO: 700557 - DNA, 20 bp, Artificial
  CRISPR gRNA sequence
cggagtctcgctcttttgcc

SEQ ID NO: 700558 - DNA, 20 bp, Artificial
  CRISPR gRNA sequence
ggagtctcgctcttttgccc

SEQ ID NO: 700559 - DNA, 20 bp, Artificial
  CRISPR gRNA sequence
tctcgctcttttgcccaggc

SEQ ID NO: 700560 - DNA, 20 bp, Artificial
  CRISPR gRNA sequence
tcgctcttttgcccaggctg

SEQ ID NO: 700561 - DNA, 20 bp, Artificial
  CRISPR gRNA sequence
cttttgcccaggctggagtg

SEQ ID NO: 700562 - DNA, 20 bp, Artificial
  CRISPR gRNA sequence
ttgcccaggctggagtgaag

SEQ ID NO: 700563 - DNA, 20 bp, Artificial
  CRISPR gRNA sequence
tgcccaggctggagtgaagt

SEQ ID NO: 700564 - DNA, 20 bp, Artificial
  CRISPR gRNA sequence
gcccaggctggagtgaagtg

SEQ ID NO: 700565 - DNA, 20 bp, Artificial
  CRISPR gRNA sequence
tcactgcaacctccacttct

SEQ ID NO: 700566 - DNA, 20 bp, Artificial
  CRISPR gRNA sequence
cactgcaacctccacttctc

SEQ ID NO: 700567 - DNA, 20 bp, Artificial
  CRISPR gRNA sequence
aacctccacttctcgggttc

SEQ ID NO: 700568 - DNA, 20 bp, Artificial
  CRISPR gRNA sequence
ttcaagtgattttcctgtct

SEQ ID NO: 700569 - DNA, 20 bp, Artificial
  CRISPR gRNA sequence
ttttcctgtctcagcctccc

SEQ ID NO: 700570 - DNA, 20 bp, Artificial
  CRISPR gRNA sequence
tcctgtctcagcctccccag

SEQ ID NO: 700571 - DNA, 20 bp, Artificial
  CRISPR gRNA sequence
tctcagcctccccagtagct

SEQ ID NO: 700572 - DNA, 20 bp, Artificial
  CRISPR gRNA sequence
ctccccagtagcttggatta

SEQ ID NO: 700573 - DNA, 20 bp, Artificial
  CRISPR gRNA sequence
tccccagtagcttggattac

SEQ ID NO: 700574 - DNA, 20 bp, Artificial
  CRISPR gRNA sequence
caggtgtgcaccaccacacc

SEQ ID NO: 700575 - DNA, 20 bp, Artificial
  CRISPR gRNA sequence
ctggctaatttttgtatttt

SEQ ID NO: 700576 - DNA, 20 bp, Artificial
  CRISPR gRNA sequence
gctaatttttgtatttttag

SEQ ID NO: 700577 - DNA, 20 bp, Artificial
  CRISPR gRNA sequence
taatttttgtatttttagta

SEQ ID NO: 700578 - DNA, 20 bp, Artificial
  CRISPR gRNA sequence
ttttgtatttttagtagaga

SEQ ID NO: 700579 - DNA, 20 bp, Artificial
  CRISPR gRNA sequence
tttgtatttttagtagagac

SEQ ID NO: 700580 - DNA, 20 bp, Artificial
  CRISPR gRNA sequence
ttgtatttttagtagagaca

SEQ ID NO: 700581 - DNA, 20 bp, Artificial
  CRISPR gRNA sequence
gagacagggtttcactatgt

SEQ ID NO: 700582 - DNA, 20 bp, Artificial
  CRISPR gRNA sequence
cagggtttcactatgttggc

SEQ ID NO: 700583 - DNA, 20 bp, Artificial
  CRISPR gRNA sequence
agggtttcactatgttggcc

SEQ ID NO: 700584 - DNA, 20 bp, Artificial
  CRISPR gRNA sequence
tttcactatgttggccgggc

SEQ ID NO: 700585 - DNA, 20 bp, Artificial
  CRISPR gRNA sequence
tggtctcaaactcctgacct

SEQ ID NO: 700586 - DNA, 20 bp, Artificial
  CRISPR gRNA sequence
ggtctcaaactcctgacctc

SEQ ID NO: 700587 - DNA, 20 bp, Artificial
  CRISPR gRNA sequence
ctcaggtgatctgcccacct

SEQ ID NO: 700588 - DNA, 20 bp, Artificial
  CRISPR gRNA sequence
ctgcccacctcggcctccca

SEQ ID NO: 700589 - DNA, 20 bp, Artificial
  CRISPR gRNA sequence
acctcggcctcccaaagtgc

SEQ ID NO: 700590 - DNA, 20 bp, Artificial
  CRISPR gRNA sequence
cctcggcctcccaaagtgct

SEQ ID NO: 700591 - DNA, 20 bp, Artificial
  CRISPR gRNA sequence
tcccaaagtgctgggattac

SEQ ID NO: 700592 - DNA, 20 bp, Artificial
  CRISPR gRNA sequence
gtgaaccaccactccccgcc

SEQ ID NO: 700593 - DNA, 20 bp, Artificial
  CRISPR gRNA sequence
tgatttcctgcttttcctgc

SEQ ID NO: 700594 - DNA, 20 bp, Artificial
  CRISPR gRNA sequence
tttcctgcttttcctgccag

SEQ ID NO: 700595 - DNA, 20 bp, Artificial
  CRISPR gRNA sequence
attatctgtctttttgattc

SEQ ID NO: 700596 - DNA, 20 bp, Artificial
  CRISPR gRNA sequence
ctttttgattcgagtcattc

SEQ ID NO: 700597 - DNA, 20 bp, Artificial
  CRISPR gRNA sequence
tttgattcgagtcattctag

SEQ ID NO: 700598 - DNA, 20 bp, Artificial
  CRISPR gRNA sequence
gagtcattctagtggttgtg

SEQ ID NO: 700599 - DNA, 20 bp, Artificial
  CRISPR gRNA sequence
tcattctagtggttgtgaag

SEQ ID NO: 700600 - DNA, 20 bp, Artificial
  CRISPR gRNA sequence
tttgacttgcatttccctaa

SEQ ID NO: 700601 - DNA, 20 bp, Artificial
  CRISPR gRNA sequence
tgcatttccctaatggctaa

SEQ ID NO: 700602 - DNA, 20 bp, Artificial
  CRISPR gRNA sequence
ttccctaatggctaacggtg

SEQ ID NO: 700603 - DNA, 20 bp, Artificial
  CRISPR gRNA sequence
tccctaatggctaacggtgt

SEQ ID NO: 700604 - DNA, 20 bp, Artificial
  CRISPR gRNA sequence
gacatttttcatgtgtttat

SEQ ID NO: 700605 - DNA, 20 bp, Artificial
  CRISPR gRNA sequence
tttttcatgtgtttattggc

SEQ ID NO: 700606 - DNA, 20 bp, Artificial
  CRISPR gRNA sequence
ggccagctgtgtatcttctt

SEQ ID NO: 700607 - DNA, 20 bp, Artificial
  CRISPR gRNA sequence
ccagctgtgtatcttcttta

SEQ ID NO: 700608 - DNA, 20 bp, Artificial
  CRISPR gRNA sequence
ctttagagaaatgtctattc

SEQ ID NO: 700609 - DNA, 20 bp, Artificial
  CRISPR gRNA sequence
aaaaattaataaactatttc

SEQ ID NO: 700610 - DNA, 20 bp, Artificial
  CRISPR gRNA sequence
attaataaactatttctggc

SEQ ID NO: 700611 - DNA, 20 bp, Artificial
  CRISPR gRNA sequence
ttaataaactatttctggct

SEQ ID NO: 700612 - DNA, 20 bp, Artificial
  CRISPR gRNA sequence
aaactatttctggctgggtg

SEQ ID NO: 700613 - DNA, 20 bp, Artificial
  CRISPR gRNA sequence
ctatttctggctgggtgcag

SEQ ID NO: 700614 - DNA, 20 bp, Artificial
  CRISPR gRNA sequence
gtggctcacgcctgtaatct

SEQ ID NO: 700615 - DNA, 20 bp, Artificial
  CRISPR gRNA sequence
cgcctgtaatctcagcactt

SEQ ID NO: 700616 - DNA, 20 bp, Artificial
  CRISPR gRNA sequence
gcctgtaatctcagcacttt

SEQ ID NO: 700617 - DNA, 20 bp, Artificial
  CRISPR gRNA sequence
ctgtaatctcagcactttgg

SEQ ID NO: 700618 - DNA, 20 bp, Artificial
  CRISPR gRNA sequence
tgtaatctcagcactttggg

SEQ ID NO: 700619 - DNA, 20 bp, Artificial
  CRISPR gRNA sequence
tctcagcactttgggaggcc

SEQ ID NO: 700620 - DNA, 20 bp, Artificial
  CRISPR gRNA sequence
ctcagcactttgggaggccg

SEQ ID NO: 700621 - DNA, 20 bp, Artificial
  CRISPR gRNA sequence
agcactttgggaggccgagg

SEQ ID NO: 700622 - DNA, 20 bp, Artificial
  CRISPR gRNA sequence
gcactttgggaggccgaggc

SEQ ID NO: 700623 - DNA, 20 bp, Artificial
  CRISPR gRNA sequence
ctttgggaggccgaggcggg

SEQ ID NO: 700624 - DNA, 20 bp, Artificial
  CRISPR gRNA sequence
ccgaggcgggtggatcacct

SEQ ID NO: 700625 - DNA, 20 bp, Artificial
  CRISPR gRNA sequence
cgaggcgggtggatcacctg

SEQ ID NO: 700626 - DNA, 20 bp, Artificial
  CRISPR gRNA sequence
gcgggtggatcacctgaggt

SEQ ID NO: 700627 - DNA, 20 bp, Artificial
  CRISPR gRNA sequence
cgggtggatcacctgaggtc

SEQ ID NO: 700628 - DNA, 20 bp, Artificial
  CRISPR gRNA sequence
ggtggatcacctgaggtcag

SEQ ID NO: 700629 - DNA, 20 bp, Artificial
  CRISPR gRNA sequence
tcacctgaggtcaggagttt

SEQ ID NO: 700630 - DNA, 20 bp, Artificial
  CRISPR gRNA sequence
tcaggagtttgagaccatcc

SEQ ID NO: 700631 - DNA, 20 bp, Artificial
  CRISPR gRNA sequence
tgagaccatcctggccaacg

SEQ ID NO: 700632 - DNA, 20 bp, Artificial
  CRISPR gRNA sequence
tctataaaaatacaaaaaat

SEQ ID NO: 700633 - DNA, 20 bp, Artificial
  CRISPR gRNA sequence
taaaaatacaaaaaattagt

SEQ ID NO: 700634 - DNA, 20 bp, Artificial
  CRISPR gRNA sequence
aaaaatacaaaaaattagtt

SEQ ID NO: 700635 - DNA, 20 bp, Artificial
  CRISPR gRNA sequence
tacaaaaaattagttgggcg

SEQ ID NO: 700636 - DNA, 20 bp, Artificial
  CRISPR gRNA sequence
aaaaaattagttgggcgtgg

SEQ ID NO: 700637 - DNA, 20 bp, Artificial
  CRISPR gRNA sequence
gtggtgtgtgcctgtaatcc

SEQ ID NO: 700638 - DNA, 20 bp, Artificial
  CRISPR gRNA sequence
tgcctgtaatcccagctact

SEQ ID NO: 700639 - DNA, 20 bp, Artificial
  CRISPR gRNA sequence
gcctgtaatcccagctactc

SEQ ID NO: 700640 - DNA, 20 bp, Artificial
  CRISPR gRNA sequence
ctgtaatcccagctactcag

SEQ ID NO: 700641 - DNA, 20 bp, Artificial
  CRISPR gRNA sequence
tgtaatcccagctactcagg

SEQ ID NO: 700642 - DNA, 20 bp, Artificial
  CRISPR gRNA sequence
tcccagctactcaggaggct

SEQ ID NO: 700643 - DNA, 20 bp, Artificial
  CRISPR gRNA sequence
cccagctactcaggaggctg

SEQ ID NO: 700644 - DNA, 20 bp, Artificial
  CRISPR gRNA sequence
agctactcaggaggctgagg

SEQ ID NO: 700645 - DNA, 20 bp, Artificial
  CRISPR gRNA sequence
gctactcaggaggctgaggc

SEQ ID NO: 700646 - DNA, 20 bp, Artificial
  CRISPR gRNA sequence
tactcaggaggctgaggcag

SEQ ID NO: 700647 - DNA, 20 bp, Artificial
  CRISPR gRNA sequence
gcaggagaatcacttgaacc

SEQ ID NO: 700648 - DNA, 20 bp, Artificial
  CRISPR gRNA sequence
caggagaatcacttgaaccc

SEQ ID NO: 700649 - DNA, 20 bp, Artificial
  CRISPR gRNA sequence
aatcacttgaacccaggttg

SEQ ID NO: 700650 - DNA, 20 bp, Artificial
  CRISPR gRNA sequence
acttgaacccaggttgcagt

SEQ ID NO: 700651 - DNA, 20 bp, Artificial
  CRISPR gRNA sequence
aacccaggttgcagtgagcc

SEQ ID NO: 700652 - DNA, 20 bp, Artificial
  CRISPR gRNA sequence
tgcgccattgcactccaacc

SEQ ID NO: 700653 - DNA, 20 bp, Artificial
  CRISPR gRNA sequence
gcgccattgcactccaacct

SEQ ID NO: 700654 - DNA, 20 bp, Artificial
  CRISPR gRNA sequence
ttgcactccaacctgggtga

SEQ ID NO: 700655 - DNA, 20 bp, Artificial
  CRISPR gRNA sequence
gcactccaacctgggtgaca

SEQ ID NO: 700656 - DNA, 20 bp, Artificial
  CRISPR gRNA sequence
tccaacctgggtgacagagt

SEQ ID NO: 700657 - DNA, 20 bp, Artificial
  CRISPR gRNA sequence
aaaattaataaactatttct

SEQ ID NO: 700658 - DNA, 20 bp, Artificial
  CRISPR gRNA sequence
aattaataaactatttctta

SEQ ID NO: 700659 - DNA, 20 bp, Artificial
  CRISPR gRNA sequence
taataaactatttcttagag

SEQ ID NO: 700660 - DNA, 20 bp, Artificial
  CRISPR gRNA sequence
actatttcttagagcagttt

SEQ ID NO: 700661 - DNA, 20 bp, Artificial
  CRISPR gRNA sequence
ctatttcttagagcagtttt

SEQ ID NO: 700662 - DNA, 20 bp, Artificial
  CRISPR gRNA sequence
ttagagcagttttaggttta

SEQ ID NO: 700663 - DNA, 20 bp, Artificial
  CRISPR gRNA sequence
tagagcagttttaggtttac

SEQ ID NO: 700664 - DNA, 20 bp, Artificial
  CRISPR gRNA sequence
aggtttacaggaaaattgaa

SEQ ID NO: 700665 - DNA, 20 bp, Artificial
  CRISPR gRNA sequence
ggaaaattgaacagaaaata

SEQ ID NO: 700666 - DNA, 20 bp, Artificial
  CRISPR gRNA sequence
aaaattgaacagaaaataca

SEQ ID NO: 700667 - DNA, 20 bp, Artificial
  CRISPR gRNA sequence
acccccttcccaatctccca

SEQ ID NO: 700668 - DNA, 20 bp, Artificial
  CRISPR gRNA sequence
cccctattttttgtttgaaa

SEQ ID NO: 700669 - DNA, 20 bp, Artificial
  CRISPR gRNA sequence
ccctattttttgtttgaaac

SEQ ID NO: 700670 - DNA, 20 bp, Artificial
  CRISPR gRNA sequence
cctattttttgtttgaaaca

SEQ ID NO: 700671 - DNA, 20 bp, Artificial
  CRISPR gRNA sequence
cagggtatcactcttttgcc

SEQ ID NO: 700672 - DNA, 20 bp, Artificial
  CRISPR gRNA sequence
agggtatcactcttttgccc

SEQ ID NO: 700673 - DNA, 20 bp, Artificial
  CRISPR gRNA sequence
tatcactcttttgcccaggc

SEQ ID NO: 700674 - DNA, 20 bp, Artificial
  CRISPR gRNA sequence
tcactcttttgcccaggctg

SEQ ID NO: 700675 - DNA, 20 bp, Artificial
  CRISPR gRNA sequence
cttttgcccaggctggagtg

SEQ ID NO: 700676 - DNA, 20 bp, Artificial
  CRISPR gRNA sequence
ttgcccaggctggagtgcag

SEQ ID NO: 700677 - DNA, 20 bp, Artificial
  CRISPR gRNA sequence
ggagtgcagtggtgcaatca

SEQ ID NO: 700678 - DNA, 20 bp, Artificial
  CRISPR gRNA sequence
ggtgcaatcacagctcacta

SEQ ID NO: 700679 - DNA, 20 bp, Artificial
  CRISPR gRNA sequence
tcactacagcctcaacctcc

SEQ ID NO: 700680 - DNA, 20 bp, Artificial
  CRISPR gRNA sequence
cactacagcctcaacctcct

SEQ ID NO: 700681 - DNA, 20 bp, Artificial
  CRISPR gRNA sequence
agcctcaacctcctgggctc

SEQ ID NO: 700682 - DNA, 20 bp, Artificial
  CRISPR gRNA sequence
ctcaagcgatcctcccgcct

SEQ ID NO: 700683 - DNA, 20 bp, Artificial
  CRISPR gRNA sequence
tcctcccgcctcagcctccc

SEQ ID NO: 700684 - DNA, 20 bp, Artificial
  CRISPR gRNA sequence
tcccgcctcagcctcccaag

SEQ ID NO: 700685 - DNA, 20 bp, Artificial
  CRISPR gRNA sequence
gcctcagcctcccaagtagc

SEQ ID NO: 700686 - DNA, 20 bp, Artificial
  CRISPR gRNA sequence
cctcagcctcccaagtagct

SEQ ID NO: 700687 - DNA, 20 bp, Artificial
  CRISPR gRNA sequence
ctcccaagtagctgggacta

SEQ ID NO: 700688 - DNA, 20 bp, Artificial
  CRISPR gRNA sequence
tcccaagtagctgggactac

SEQ ID NO: 700689 - DNA, 20 bp, Artificial
  CRISPR gRNA sequence
caggcatgtgctaccatgcc

SEQ ID NO: 700690 - DNA, 20 bp, Artificial
  CRISPR gRNA sequence
atttttgtattttttttttg

SEQ ID NO: 700691 - DNA, 20 bp, Artificial
  CRISPR gRNA sequence
ttttgtattttttttttgta

SEQ ID NO: 700692 - DNA, 20 bp, Artificial
  CRISPR gRNA sequence
gtattttttttttgtagaga

SEQ ID NO: 700693 - DNA, 20 bp, Artificial
  CRISPR gRNA sequence
tattttttttttgtagagac

SEQ ID NO: 700694 - DNA, 20 bp, Artificial
  CRISPR gRNA sequence
accatgttgcccatgtttta

SEQ ID NO: 700695 - DNA, 20 bp, Artificial
  CRISPR gRNA sequence
catgttgcccatgttttata

SEQ ID NO: 700696 - DNA, 20 bp, Artificial
  CRISPR gRNA sequence
ttgcccatgttttatagaga

SEQ ID NO: 700697 - DNA, 20 bp, Artificial
  CRISPR gRNA sequence
tgcccatgttttatagagat

SEQ ID NO: 700698 - DNA, 20 bp, Artificial
  CRISPR gRNA sequence
atttcactatgtcgccatat

SEQ ID NO: 700699 - DNA, 20 bp, Artificial
  CRISPR gRNA sequence
tttcactatgtcgccatatg

SEQ ID NO: 700700 - DNA, 20 bp, Artificial
  CRISPR gRNA sequence
ttcactatgtcgccatatga

SEQ ID NO: 700701 - DNA, 20 bp, Artificial
  CRISPR gRNA sequence
ggcaaatgatcctcctgcct

SEQ ID NO: 700702 - DNA, 20 bp, Artificial
  CRISPR gRNA sequence
cctcctgcctcggcctccca

SEQ ID NO: 700703 - DNA, 20 bp, Artificial
  CRISPR gRNA sequence
gcctcggcctcccaaagtgc

SEQ ID NO: 700704 - DNA, 20 bp, Artificial
  CRISPR gRNA sequence
cctcggcctcccaaagtgct

SEQ ID NO: 700705 - DNA, 20 bp, Artificial
  CRISPR gRNA sequence
ctcccaaagtgctgggatta

SEQ ID NO: 700706 - DNA, 20 bp, Artificial
  CRISPR gRNA sequence
tcccaaagtgctgggattaa

SEQ ID NO: 700707 - DNA, 20 bp, Artificial
  CRISPR gRNA sequence
agtgctgggattaaaggcgt

SEQ ID NO: 700708 - DNA, 20 bp, Artificial
  CRISPR gRNA sequence
aaggcgtgagccactgcacc

SEQ ID NO: 700709 - DNA, 20 bp, Artificial
  CRISPR gRNA sequence
ctgtcacgaacaccttgcat

SEQ ID NO: 700710 - DNA, 20 bp, Artificial
  CRISPR gRNA sequence
acgaacaccttgcattagtg

SEQ ID NO: 700711 - DNA, 20 bp, Artificial
  CRISPR gRNA sequence
cattagtgtggcacaattgt

SEQ ID NO: 700712 - DNA, 20 bp, Artificial
  CRISPR gRNA sequence
tgcattattattactaactg

SEQ ID NO: 700713 - DNA, 20 bp, Artificial
  CRISPR gRNA sequence
ttattactaactgaagtcca

SEQ ID NO: 700714 - DNA, 20 bp, Artificial
  CRISPR gRNA sequence
taactgaagtccatagttta

SEQ ID NO: 700715 - DNA, 20 bp, Artificial
  CRISPR gRNA sequence
ctgaagtccatagtttacag

SEQ ID NO: 700716 - DNA, 20 bp, Artificial
  CRISPR gRNA sequence
tgaagtccatagtttacagc

SEQ ID NO: 700717 - DNA, 20 bp, Artificial
  CRISPR gRNA sequence
gaagtccatagtttacagca

SEQ ID NO: 700718 - DNA, 20 bp, Artificial
  CRISPR gRNA sequence
actctttgtgttgcccattc

SEQ ID NO: 700719 - DNA, 20 bp, Artificial
  CRISPR gRNA sequence
ctctttgtgttgcccattct

SEQ ID NO: 700720 - DNA, 20 bp, Artificial
  CRISPR gRNA sequence
tctttgtgttgcccattcta

SEQ ID NO: 700721 - DNA, 20 bp, Artificial
  CRISPR gRNA sequence
tgttgcccattctagggctt

SEQ ID NO: 700722 - DNA, 20 bp, Artificial
  CRISPR gRNA sequence
attctagggctttagacaaa

SEQ ID NO: 700723 - DNA, 20 bp, Artificial
  CRISPR gRNA sequence
ccacgtgcccaccatcaccg

SEQ ID NO: 700724 - DNA, 20 bp, Artificial
  CRISPR gRNA sequence
cccaccatcaccgtggcatc

SEQ ID NO: 700725 - DNA, 20 bp, Artificial
  CRISPR gRNA sequence
cactgccctaaatgtgtcct

SEQ ID NO: 700726 - DNA, 20 bp, Artificial
  CRISPR gRNA sequence
taaatgtgtcctgagctcgt

SEQ ID NO: 700727 - DNA, 20 bp, Artificial
  CRISPR gRNA sequence
tctccctccccctgaacctc

SEQ ID NO: 700728 - DNA, 20 bp, Artificial
  CRISPR gRNA sequence
ccctccccctgaacctctgg

SEQ ID NO: 700729 - DNA, 20 bp, Artificial
  CRISPR gRNA sequence
tgatctttttactgtctcga

SEQ ID NO: 700730 - DNA, 20 bp, Artificial
  CRISPR gRNA sequence
ctcgatagtttcatcttttc

SEQ ID NO: 700731 - DNA, 20 bp, Artificial
  CRISPR gRNA sequence
tcttttccagaaatgtcatg

SEQ ID NO: 700732 - DNA, 20 bp, Artificial
  CRISPR gRNA sequence
ttccagaaatgtcatgtagt

SEQ ID NO: 700733 - DNA, 20 bp, Artificial
  CRISPR gRNA sequence
atgtcatgtagttggaatga

SEQ ID NO: 700734 - DNA, 20 bp, Artificial
  CRISPR gRNA sequence
gtagttggaatgacagtgtg

SEQ ID NO: 700735 - DNA, 20 bp, Artificial
  CRISPR gRNA sequence
atgacagtgtgtggcctttt

SEQ ID NO: 700736 - DNA, 20 bp, Artificial
  CRISPR gRNA sequence
agtgtgtggccttttcagac

SEQ ID NO: 700737 - DNA, 20 bp, Artificial
  CRISPR gRNA sequence
tcagactggtgtctttcatt

SEQ ID NO: 700738 - DNA, 20 bp, Artificial
  CRISPR gRNA sequence
tcatttagcaatatgtatct

SEQ ID NO: 700739 - DNA, 20 bp, Artificial
  CRISPR gRNA sequence
ttttttgcattttaaaaaat

SEQ ID NO: 700740 - DNA, 20 bp, Artificial
  CRISPR gRNA sequence
tttaatttttaatccaattt

SEQ ID NO: 700741 - DNA, 20 bp, Artificial
  CRISPR gRNA sequence
aatttttaatccaattttag

SEQ ID NO: 700742 - DNA, 20 bp, Artificial
  CRISPR gRNA sequence
aatccaattttagtggtcac

SEQ ID NO: 700743 - DNA, 20 bp, Artificial
  CRISPR gRNA sequence
atccaattttagtggtcacc

SEQ ID NO: 700744 - DNA, 20 bp, Artificial
  CRISPR gRNA sequence
tccaattttagtggtcacca

SEQ ID NO: 700745 - DNA, 20 bp, Artificial
  CRISPR gRNA sequence
ccaattttagtggtcaccag

SEQ ID NO: 700746 - DNA, 20 bp, Artificial
  CRISPR gRNA sequence
caattttagtggtcaccagg

SEQ ID NO: 700747 - DNA, 20 bp, Artificial
  CRISPR gRNA sequence
ttagtggtcaccagggggtt

SEQ ID NO: 700748 - DNA, 20 bp, Artificial
  CRISPR gRNA sequence
tggtcaccagggggttgagc

SEQ ID NO: 700749 - DNA, 20 bp, Artificial
  CRISPR gRNA sequence
ggtcaccagggggttgagct

SEQ ID NO: 700750 - DNA, 20 bp, Artificial
  CRISPR gRNA sequence
tcaccagggggttgagctgg

SEQ ID NO: 700751 - DNA, 20 bp, Artificial
  CRISPR gRNA sequence
caccagggggttgagctggg

SEQ ID NO: 700752 - DNA, 20 bp, Artificial
  CRISPR gRNA sequence
cagggggttgagctgggagg

SEQ ID NO: 700753 - DNA, 20 bp, Artificial
  CRISPR gRNA sequence
gggggttgagctgggaggcg

SEQ ID NO: 700754 - DNA, 20 bp, Artificial
  CRISPR gRNA sequence
ggggttgagctgggaggcgg

SEQ ID NO: 700755 - DNA, 20 bp, Artificial
  CRISPR gRNA sequence
gggaggcggaggctgcgttg

SEQ ID NO: 700756 - DNA, 20 bp, Artificial
  CRISPR gRNA sequence
tgccctctccccctcatctc

SEQ ID NO: 700757 - DNA, 20 bp, Artificial
  CRISPR gRNA sequence
ccctctccccctcatctcaa

SEQ ID NO: 700758 - DNA, 20 bp, Artificial
  CRISPR gRNA sequence
ccctcatctcaagagctatc

SEQ ID NO: 700759 - DNA, 20 bp, Artificial
  CRISPR gRNA sequence
ctcatctcaagagctatctg

SEQ ID NO: 700760 - DNA, 20 bp, Artificial
  CRISPR gRNA sequence
catctcaagagctatctgga

SEQ ID NO: 700761 - DNA, 20 bp, Artificial
  CRISPR gRNA sequence
tgacccctgtctgtgtccct

SEQ ID NO: 700762 - DNA, 20 bp, Artificial
  CRISPR gRNA sequence
gtgtcccttagacgacctcg

SEQ ID NO: 700763 - DNA, 20 bp, Artificial
  CRISPR gRNA sequence
gtcccttagacgacctcgtg

SEQ ID NO: 700764 - DNA, 20 bp, Artificial
  CRISPR gRNA sequence
ccttagacgacctcgtggag

SEQ ID NO: 700765 - DNA, 20 bp, Artificial
  CRISPR gRNA sequence
tggagaagacgccgtgtgca

SEQ ID NO: 700766 - DNA, 20 bp, Artificial
  CRISPR gRNA sequence
cgtgtctgcgaatgtcgacc

SEQ ID NO: 700767 - DNA, 20 bp, Artificial
  CRISPR gRNA sequence
cttcttccattctgtctgtc

SEQ ID NO: 700768 - DNA, 20 bp, Artificial
  CRISPR gRNA sequence
cttccattctgtctgtccgg

SEQ ID NO: 700769 - DNA, 20 bp, Artificial
  CRISPR gRNA sequence
ttccattctgtctgtccggc

SEQ ID NO: 700770 - DNA, 20 bp, Artificial
  CRISPR gRNA sequence
tccattctgtctgtccggca

SEQ ID NO: 700771 - DNA, 20 bp, Artificial
  CRISPR gRNA sequence
gtccggcagggatgattgtc

SEQ ID NO: 700772 - DNA, 20 bp, Artificial
  CRISPR gRNA sequence
agggatgattgtcaagttcc

SEQ ID NO: 700773 - DNA, 20 bp, Artificial
  CRISPR gRNA sequence
gggatgattgtcaagttccc

SEQ ID NO: 700774 - DNA, 20 bp, Artificial
  CRISPR gRNA sequence
tgattgtcaagttcccaggt

SEQ ID NO: 700775 - DNA, 20 bp, Artificial
  CRISPR gRNA sequence
cagtgtccccacccttaact

SEQ ID NO: 700776 - DNA, 20 bp, Artificial
  CRISPR gRNA sequence
agtgtccccacccttaactc

SEQ ID NO: 700777 - DNA, 20 bp, Artificial
  CRISPR gRNA sequence
tccccacccttaactcagga

SEQ ID NO: 700778 - DNA, 20 bp, Artificial
  CRISPR gRNA sequence
cccacccttaactcaggaca

SEQ ID NO: 700779 - DNA, 20 bp, Artificial
  CRISPR gRNA sequence
gctgcaccttccgcccaccc

SEQ ID NO: 700780 - DNA, 20 bp, Artificial
  CRISPR gRNA sequence
acttccgacctcccgcttcc

SEQ ID NO: 700781 - DNA, 20 bp, Artificial
  CRISPR gRNA sequence
ttccgacctcccgcttcccg

SEQ ID NO: 700782 - DNA, 20 bp, Artificial
  CRISPR gRNA sequence
tcccgcttcccggagactgt

SEQ ID NO: 700783 - DNA, 20 bp, Artificial
  CRISPR gRNA sequence
gcttcccggagactgttgga

SEQ ID NO: 700784 - DNA, 20 bp, Artificial
  CRISPR gRNA sequence
tggacagatcatgtctcctt

SEQ ID NO: 700785 - DNA, 20 bp, Artificial
  CRISPR gRNA sequence
gatcatgtctcctttggcga

SEQ ID NO: 700786 - DNA, 20 bp, Artificial
  CRISPR gRNA sequence
atcatgtctcctttggcgat

SEQ ID NO: 700787 - DNA, 20 bp, Artificial
  CRISPR gRNA sequence
tgtctcctttggcgatgggc

SEQ ID NO: 700788 - DNA, 20 bp, Artificial
  CRISPR gRNA sequence
gtctcctttggcgatgggcc

SEQ ID NO: 700789 - DNA, 20 bp, Artificial
  CRISPR gRNA sequence
tctcctttggcgatgggcca

SEQ ID NO: 700790 - DNA, 20 bp, Artificial
  CRISPR gRNA sequence
cgatgggccagggatgtacc

SEQ ID NO: 700791 - DNA, 20 bp, Artificial
  CRISPR gRNA sequence
ccagggatgtacccagcacc

SEQ ID NO: 700792 - DNA, 20 bp, Artificial
  CRISPR gRNA sequence
ccctcccccaccttgtgttc

SEQ ID NO: 700793 - DNA, 20 bp, Artificial
  CRISPR gRNA sequence
cctcccccaccttgtgttcc

SEQ ID NO: 700794 - DNA, 20 bp, Artificial
  CRISPR gRNA sequence
cccaccttgtgttccaggtg

SEQ ID NO: 700795 - DNA, 20 bp, Artificial
  CRISPR gRNA sequence
caccttgtgttccaggtgca

SEQ ID NO: 700796 - DNA, 20 bp, Artificial
  CRISPR gRNA sequence
ccttgtgttccaggtgcaga

SEQ ID NO: 700797 - DNA, 20 bp, Artificial
  CRISPR gRNA sequence
agagagaccctgctgtcccc

SEQ ID NO: 700798 - DNA, 20 bp, Artificial
  CRISPR gRNA sequence
gaccctgctgtcccctggca

SEQ ID NO: 700799 - DNA, 20 bp, Artificial
  CRISPR gRNA sequence
gctgtcccctggcatagacc

SEQ ID NO: 700800 - DNA, 20 bp, Artificial
  CRISPR gRNA sequence
tcccctggcatagacctggc

SEQ ID NO: 700801 - DNA, 20 bp, Artificial
  CRISPR gRNA sequence
ccctggcatagacctggctg

SEQ ID NO: 700802 - DNA, 20 bp, Artificial
  CRISPR gRNA sequence
cctggcatagacctggctgg

SEQ ID NO: 700803 - DNA, 20 bp, Artificial
  CRISPR gRNA sequence
tggcatagacctggctggag

SEQ ID NO: 700804 - DNA, 20 bp, Artificial
  CRISPR gRNA sequence
ggcatagacctggctggagg

SEQ ID NO: 700805 - DNA, 20 bp, Artificial
  CRISPR gRNA sequence
ggctggaggaggtcttgctt

SEQ ID NO: 700806 - DNA, 20 bp, Artificial
  CRISPR gRNA sequence
aggaggtcttgctttggttt

SEQ ID NO: 700807 - DNA, 20 bp, Artificial
  CRISPR gRNA sequence
ggaggtcttgctttggtttg

SEQ ID NO: 700808 - DNA, 20 bp, Artificial
  CRISPR gRNA sequence
cttgctttggtttgaggctc

SEQ ID NO: 700809 - DNA, 20 bp, Artificial
  CRISPR gRNA sequence
ttgctttggtttgaggctca

SEQ ID NO: 700810 - DNA, 20 bp, Artificial
  CRISPR gRNA sequence
ctttggtttgaggctcaagg

SEQ ID NO: 700811 - DNA, 20 bp, Artificial
  CRISPR gRNA sequence
tggtttgaggctcaaggcag

SEQ ID NO: 700812 - DNA, 20 bp, Artificial
  CRISPR gRNA sequence
ttatctgatgccccataaac

SEQ ID NO: 700813 - DNA, 20 bp, Artificial
  CRISPR gRNA sequence
tctgatgccccataaacaag

SEQ ID NO: 700814 - DNA, 20 bp, Artificial
  CRISPR gRNA sequence
ctgatgccccataaacaaga

SEQ ID NO: 700815 - DNA, 20 bp, Artificial
  CRISPR gRNA sequence
tgatgccccataaacaagaa

SEQ ID NO: 700816 - DNA, 20 bp, Artificial
  CRISPR gRNA sequence
ataaacaagaagggaacctc

SEQ ID NO: 700817 - DNA, 20 bp, Artificial
  CRISPR gRNA sequence
ggaacctcaagtctctgtcc

SEQ ID NO: 700818 - DNA, 20 bp, Artificial
  CRISPR gRNA sequence
gaacctcaagtctctgtcct

SEQ ID NO: 700819 - DNA, 20 bp, Artificial
  CRISPR gRNA sequence
acctcaagtctctgtcctgg

SEQ ID NO: 700820 - DNA, 20 bp, Artificial
  CRISPR gRNA sequence
tctctgtcctgggagtttcc

SEQ ID NO: 700821 - DNA, 20 bp, Artificial
  CRISPR gRNA sequence
ctgtcctgggagtttcctag

SEQ ID NO: 700822 - DNA, 20 bp, Artificial
  CRISPR gRNA sequence
ctgggagtttcctagaagat

SEQ ID NO: 700823 - DNA, 20 bp, Artificial
  CRISPR gRNA sequence
tgggagtttcctagaagatt

SEQ ID NO: 700824 - DNA, 20 bp, Artificial
  CRISPR gRNA sequence
gggagtttcctagaagattg

SEQ ID NO: 700825 - DNA, 20 bp, Artificial
  CRISPR gRNA sequence
gtttcctagaagattggggt

SEQ ID NO: 700826 - DNA, 20 bp, Artificial
  CRISPR gRNA sequence
tggggttggcttcccccttt

SEQ ID NO: 700827 - DNA, 20 bp, Artificial
  CRISPR gRNA sequence
ggggttggcttccccctttc

SEQ ID NO: 700828 - DNA, 20 bp, Artificial
  CRISPR gRNA sequence
tggcttccccctttcaggtt

SEQ ID NO: 700829 - DNA, 20 bp, Artificial
  CRISPR gRNA sequence
ggcttccccctttcaggttc

SEQ ID NO: 700830 - DNA, 20 bp, Artificial
  CRISPR gRNA sequence
gcttccccctttcaggttca

SEQ ID NO: 700831 - DNA, 20 bp, Artificial
  CRISPR gRNA sequence
ccctttcaggttcagggcat

SEQ ID NO: 700832 - DNA, 20 bp, Artificial
  CRISPR gRNA sequence
cctttcaggttcagggcatt

SEQ ID NO: 700833 - DNA, 20 bp, Artificial
  CRISPR gRNA sequence
tttcaggttcagggcattgg

SEQ ID NO: 700834 - DNA, 20 bp, Artificial
  CRISPR gRNA sequence
aggttcagggcattgggagt

SEQ ID NO: 700835 - DNA, 20 bp, Artificial
  CRISPR gRNA sequence
gttcagggcattgggagtta

SEQ ID NO: 700836 - DNA, 20 bp, Artificial
  CRISPR gRNA sequence
ttcagggcattgggagttag

SEQ ID NO: 700837 - DNA, 20 bp, Artificial
  CRISPR gRNA sequence
cattgggagttagaggtgct

SEQ ID NO: 700838 - DNA, 20 bp, Artificial
  CRISPR gRNA sequence
ttgggagttagaggtgctga

SEQ ID NO: 700839 - DNA, 20 bp, Artificial
  CRISPR gRNA sequence
gttagaggtgctgagagatc

SEQ ID NO: 700840 - DNA, 20 bp, Artificial
  CRISPR gRNA sequence
ggtgctgagagatctggccc

SEQ ID NO: 700841 - DNA, 20 bp, Artificial
  CRISPR gRNA sequence
gtgctgagagatctggcccc

SEQ ID NO: 700842 - DNA, 20 bp, Artificial
  CRISPR gRNA sequence
agagatctggccccaggctc

SEQ ID NO: 700843 - DNA, 20 bp, Artificial
  CRISPR gRNA sequence
tggccccaggctcaagactt

SEQ ID NO: 700844 - DNA, 20 bp, Artificial
  CRISPR gRNA sequence
ggctcaagacttgagaaact

SEQ ID NO: 700845 - DNA, 20 bp, Artificial
  CRISPR gRNA sequence
gctcaagacttgagaaactt

SEQ ID NO: 700846 - DNA, 20 bp, Artificial
  CRISPR gRNA sequence
tccaacttatcgtgtgacct

SEQ ID NO: 700847 - DNA, 20 bp, Artificial
  CRISPR gRNA sequence
cttatcgtgtgacctcagac

SEQ ID NO: 700848 - DNA, 20 bp, Artificial
  CRISPR gRNA sequence
tctgacttctacttctctga

SEQ ID NO: 700849 - DNA, 20 bp, Artificial
  CRISPR gRNA sequence
ttctacttctctgatagtac

SEQ ID NO: 700850 - DNA, 20 bp, Artificial
  CRISPR gRNA sequence
tctacttctctgatagtaca

SEQ ID NO: 700851 - DNA, 20 bp, Artificial
  CRISPR gRNA sequence
tctctgatagtacaaggtgt

SEQ ID NO: 700852 - DNA, 20 bp, Artificial
  CRISPR gRNA sequence
ctctgatagtacaaggtgtc

SEQ ID NO: 700853 - DNA, 20 bp, Artificial
  CRISPR gRNA sequence
tctgatagtacaaggtgtca

SEQ ID NO: 700854 - DNA, 20 bp, Artificial
  CRISPR gRNA sequence
gtgtcagggctgcttttaac

SEQ ID NO: 700855 - DNA, 20 bp, Artificial
  CRISPR gRNA sequence
gtcagggctgcttttaacca

SEQ ID NO: 700856 - DNA, 20 bp, Artificial
  CRISPR gRNA sequence
agggctgcttttaaccagag

SEQ ID NO: 700857 - DNA, 20 bp, Artificial
  CRISPR gRNA sequence
gggctgcttttaaccagaga

SEQ ID NO: 700858 - DNA, 20 bp, Artificial
  CRISPR gRNA sequence
ggctgcttttaaccagagaa

SEQ ID NO: 700859 - DNA, 20 bp, Artificial
  CRISPR gRNA sequence
gctgcttttaaccagagaag

SEQ ID NO: 700860 - DNA, 20 bp, Artificial
  CRISPR gRNA sequence
ttttaaccagagaaggggta

SEQ ID NO: 700861 - DNA, 20 bp, Artificial
  CRISPR gRNA sequence
tttaaccagagaaggggtat

SEQ ID NO: 700862 - DNA, 20 bp, Artificial
  CRISPR gRNA sequence
cagagaaggggtatgggcca

SEQ ID NO: 700863 - DNA, 20 bp, Artificial
  CRISPR gRNA sequence
tatgggccacagaacctgtc

SEQ ID NO: 700864 - DNA, 20 bp, Artificial
  CRISPR gRNA sequence
atgggccacagaacctgtct

SEQ ID NO: 700865 - DNA, 20 bp, Artificial
  CRISPR gRNA sequence
ggccacagaacctgtctggg

SEQ ID NO: 700866 - DNA, 20 bp, Artificial
  CRISPR gRNA sequence
ccacagaacctgtctgggtg

SEQ ID NO: 700867 - DNA, 20 bp, Artificial
  CRISPR gRNA sequence
agaacctgtctgggtggagt

SEQ ID NO: 700868 - DNA, 20 bp, Artificial
  CRISPR gRNA sequence
gaacctgtctgggtggagtt

SEQ ID NO: 700869 - DNA, 20 bp, Artificial
  CRISPR gRNA sequence
gtggagttgggaccatcttc

SEQ ID NO: 700870 - DNA, 20 bp, Artificial
  CRISPR gRNA sequence
gagttgggaccatcttccag

SEQ ID NO: 700871 - DNA, 20 bp, Artificial
  CRISPR gRNA sequence
agttgggaccatcttccaga

SEQ ID NO: 700872 - DNA, 20 bp, Artificial
  CRISPR gRNA sequence
gttgggaccatcttccagaa

SEQ ID NO: 700873 - DNA, 20 bp, Artificial
  CRISPR gRNA sequence
tgggaccatcttccagaagg

SEQ ID NO: 700874 - DNA, 20 bp, Artificial
  CRISPR gRNA sequence
gggaccatcttccagaaggg

SEQ ID NO: 700875 - DNA, 20 bp, Artificial
  CRISPR gRNA sequence
atcttccagaagggaggcat

SEQ ID NO: 700876 - DNA, 20 bp, Artificial
  CRISPR gRNA sequence
tcttccagaagggaggcatg

SEQ ID NO: 700877 - DNA, 20 bp, Artificial
  CRISPR gRNA sequence
ttccagaagggaggcatgag

SEQ ID NO: 700878 - DNA, 20 bp, Artificial
  CRISPR gRNA sequence
cagaagggaggcatgaggag

SEQ ID NO: 700879 - DNA, 20 bp, Artificial
  CRISPR gRNA sequence
agaagggaggcatgaggagt

SEQ ID NO: 700880 - DNA, 20 bp, Artificial
  CRISPR gRNA sequence
agggaggcatgaggagtggg

SEQ ID NO: 700881 - DNA, 20 bp, Artificial
  CRISPR gRNA sequence
gggaggcatgaggagtgggt

SEQ ID NO: 700882 - DNA, 20 bp, Artificial
  CRISPR gRNA sequence
catgaggagtgggtgggctt

SEQ ID NO: 700883 - DNA, 20 bp, Artificial
  CRISPR gRNA sequence
tgaggagtgggtgggctttg

SEQ ID NO: 700884 - DNA, 20 bp, Artificial
  CRISPR gRNA sequence
agtgggtgggctttggagca

SEQ ID NO: 700885 - DNA, 20 bp, Artificial
  CRISPR gRNA sequence
gtgggctttggagcacagca

SEQ ID NO: 700886 - DNA, 20 bp, Artificial
  CRISPR gRNA sequence
gggctttggagcacagcaca

SEQ ID NO: 700887 - DNA, 20 bp, Artificial
  CRISPR gRNA sequence
ctttggagcacagcacagag

SEQ ID NO: 700888 - DNA, 20 bp, Artificial
  CRISPR gRNA sequence
acagcacagagtggctgccg

SEQ ID NO: 700889 - DNA, 20 bp, Artificial
  CRISPR gRNA sequence
cagagtggctgccgcagttg

SEQ ID NO: 700890 - DNA, 20 bp, Artificial
  CRISPR gRNA sequence
tgccgcagttgcagactgta

SEQ ID NO: 700891 - DNA, 20 bp, Artificial
  CRISPR gRNA sequence
ccgcagttgcagactgtatg

SEQ ID NO: 700892 - DNA, 20 bp, Artificial
  CRISPR gRNA sequence
agttgcagactgtatggagc

SEQ ID NO: 700893 - DNA, 20 bp, Artificial
  CRISPR gRNA sequence
gttgcagactgtatggagcc

SEQ ID NO: 700894 - DNA, 20 bp, Artificial
  CRISPR gRNA sequence
ttgcagactgtatggagccg

SEQ ID NO: 700895 - DNA, 20 bp, Artificial
  CRISPR gRNA sequence
gcagactgtatggagccggg

SEQ ID NO: 700896 - DNA, 20 bp, Artificial
  CRISPR gRNA sequence
actgtatggagccggggaga

SEQ ID NO: 700897 - DNA, 20 bp, Artificial
  CRISPR gRNA sequence
ctgtatggagccggggagat

SEQ ID NO: 700898 - DNA, 20 bp, Artificial
  CRISPR gRNA sequence
tggagccggggagatgggct

SEQ ID NO: 700899 - DNA, 20 bp, Artificial
  CRISPR gRNA sequence
gagccggggagatgggctca

SEQ ID NO: 700900 - DNA, 20 bp, Artificial
  CRISPR gRNA sequence
agccggggagatgggctcag

SEQ ID NO: 700901 - DNA, 20 bp, Artificial
  CRISPR gRNA sequence
cggggagatgggctcagagg

SEQ ID NO: 700902 - DNA, 20 bp, Artificial
  CRISPR gRNA sequence
ccctgtgtccactgtccact

SEQ ID NO: 700903 - DNA, 20 bp, Artificial
  CRISPR gRNA sequence
cctgtgtccactgtccactg

SEQ ID NO: 700904 - DNA, 20 bp, Artificial
  CRISPR gRNA sequence
tgtgtccactgtccactgag

SEQ ID NO: 700905 - DNA, 20 bp, Artificial
  CRISPR gRNA sequence
ccactgtccactgaggagaa

SEQ ID NO: 700906 - DNA, 20 bp, Artificial
  CRISPR gRNA sequence
ctgaggagaaaagtgccaca

SEQ ID NO: 700907 - DNA, 20 bp, Artificial
  CRISPR gRNA sequence
aaagtgccacaaagtgcctg

SEQ ID NO: 700908 - DNA, 20 bp, Artificial
  CRISPR gRNA sequence
cctgtggtccctcccccaac

SEQ ID NO: 700909 - DNA, 20 bp, Artificial
  CRISPR gRNA sequence
ctgtggtccctcccccaacc

SEQ ID NO: 700910 - DNA, 20 bp, Artificial
  CRISPR gRNA sequence
cccccaaccaggtccttctc

SEQ ID NO: 700911 - DNA, 20 bp, Artificial
  CRISPR gRNA sequence
cccaaccaggtccttctctg

SEQ ID NO: 700912 - DNA, 20 bp, Artificial
  CRISPR gRNA sequence
catgccctgttgtgcaaacc

SEQ ID NO: 700913 - DNA, 20 bp, Artificial
  CRISPR gRNA sequence
atgccctgttgtgcaaacct

SEQ ID NO: 700914 - DNA, 20 bp, Artificial
  CRISPR gRNA sequence
tgccctgttgtgcaaacctg

SEQ ID NO: 700915 - DNA, 20 bp, Artificial
  CRISPR gRNA sequence
tgttgtgcaaacctggggat

SEQ ID NO: 700916 - DNA, 20 bp, Artificial
  CRISPR gRNA sequence
tgtgcaaacctggggattgg

SEQ ID NO: 700917 - DNA, 20 bp, Artificial
  CRISPR gRNA sequence
cctcgttccctcatccttca

SEQ ID NO: 700918 - DNA, 20 bp, Artificial
  CRISPR gRNA sequence
gttccctcatccttcacagc

SEQ ID NO: 700919 - DNA, 20 bp, Artificial
  CRISPR gRNA sequence
ttcacagccagcccatcctc

SEQ ID NO: 700920 - DNA, 20 bp, Artificial
  CRISPR gRNA sequence
cagcccatcctcgagtcctg

SEQ ID NO: 700921 - DNA, 20 bp, Artificial
  CRISPR gRNA sequence
atcctcgagtcctgtagatt

SEQ ID NO: 700922 - DNA, 20 bp, Artificial
  CRISPR gRNA sequence
cccgaataccttctcttata

SEQ ID NO: 700923 - DNA, 20 bp, Artificial
  CRISPR gRNA sequence
cttctcttatacagccccca

SEQ ID NO: 700924 - DNA, 20 bp, Artificial
  CRISPR gRNA sequence
ctcttatacagcccccatgg

SEQ ID NO: 700925 - DNA, 20 bp, Artificial
  CRISPR gRNA sequence
tatacagcccccatggcaga

SEQ ID NO: 700926 - DNA, 20 bp, Artificial
  CRISPR gRNA sequence
cagcccccatggcagacagc

SEQ ID NO: 700927 - DNA, 20 bp, Artificial
  CRISPR gRNA sequence
acagccagaatgacccttgc

SEQ ID NO: 700928 - DNA, 20 bp, Artificial
  CRISPR gRNA sequence
cacacacacacacacacaca

SEQ ID NO: 700929 - DNA, 20 bp, Artificial
  CRISPR gRNA sequence
gatatatacctgaaatgctt

SEQ ID NO: 700930 - DNA, 20 bp, Artificial
  CRISPR gRNA sequence
agtatcttcctgttactcta

SEQ ID NO: 700931 - DNA, 20 bp, Artificial
  CRISPR gRNA sequence
cttcctgttactctaaagat

SEQ ID NO: 700932 - DNA, 20 bp, Artificial
  CRISPR gRNA sequence
ttcctgttactctaaagata

SEQ ID NO: 700933 - DNA, 20 bp, Artificial
  CRISPR gRNA sequence
tactctaaagataaggacac

SEQ ID NO: 700934 - DNA, 20 bp, Artificial
  CRISPR gRNA sequence
actctaaagataaggacaca

SEQ ID NO: 700935 - DNA, 20 bp, Artificial
  CRISPR gRNA sequence
taaagataaggacacaaggc

SEQ ID NO: 700936 - DNA, 20 bp, Artificial
  CRISPR gRNA sequence
aaagataaggacacaaggcc

SEQ ID NO: 700937 - DNA, 20 bp, Artificial
  CRISPR gRNA sequence
taaggacacaaggccaggtg

SEQ ID NO: 700938 - DNA, 20 bp, Artificial
  CRISPR gRNA sequence
ggacacaaggccaggtgtgg

SEQ ID NO: 700939 - DNA, 20 bp, Artificial
  CRISPR gRNA sequence
gtggcttacgcctgtaatcc

SEQ ID NO: 700940 - DNA, 20 bp, Artificial
  CRISPR gRNA sequence
cgcctgtaatcccagcactt

SEQ ID NO: 700941 - DNA, 20 bp, Artificial
  CRISPR gRNA sequence
gcctgtaatcccagcacttt

SEQ ID NO: 700942 - DNA, 20 bp, Artificial
  CRISPR gRNA sequence
ctgtaatcccagcactttgg

SEQ ID NO: 700943 - DNA, 20 bp, Artificial
  CRISPR gRNA sequence
tgtaatcccagcactttggg

SEQ ID NO: 700944 - DNA, 20 bp, Artificial
  CRISPR gRNA sequence
tcccagcactttgggaggcc

SEQ ID NO: 700945 - DNA, 20 bp, Artificial
  CRISPR gRNA sequence
cccagcactttgggaggcca

SEQ ID NO: 700946 - DNA, 20 bp, Artificial
  CRISPR gRNA sequence
agcactttgggaggccaagg

SEQ ID NO: 700947 - DNA, 20 bp, Artificial
  CRISPR gRNA sequence
gcactttgggaggccaaggc

SEQ ID NO: 700948 - DNA, 20 bp, Artificial
  CRISPR gRNA sequence
ctttgggaggccaaggcagg

SEQ ID NO: 700949 - DNA, 20 bp, Artificial
  CRISPR gRNA sequence
ccaaggcaggcagatcactt

SEQ ID NO: 700950 - DNA, 20 bp, Artificial
  CRISPR gRNA sequence
caaggcaggcagatcacttg

SEQ ID NO: 700951 - DNA, 20 bp, Artificial
  CRISPR gRNA sequence
gcaggcagatcacttgaggt

SEQ ID NO: 700952 - DNA, 20 bp, Artificial
  CRISPR gRNA sequence
caggcagatcacttgaggtc

SEQ ID NO: 700953 - DNA, 20 bp, Artificial
  CRISPR gRNA sequence
ggcagatcacttgaggtcag

SEQ ID NO: 700954 - DNA, 20 bp, Artificial
  CRISPR gRNA sequence
tcacttgaggtcaggagttc

SEQ ID NO: 700955 - DNA, 20 bp, Artificial
  CRISPR gRNA sequence
tgaggtcaggagttcaagac

SEQ ID NO: 700956 - DNA, 20 bp, Artificial
  CRISPR gRNA sequence
tcaggagttcaagaccagcc

SEQ ID NO: 700957 - DNA, 20 bp, Artificial
  CRISPR gRNA sequence
caagaccagcctggccaaca

SEQ ID NO: 700958 - DNA, 20 bp, Artificial
  CRISPR gRNA sequence
tctactaaaaatacaaaaat

SEQ ID NO: 700959 - DNA, 20 bp, Artificial
  CRISPR gRNA sequence
ctaaaaatacaaaaattagc

SEQ ID NO: 700960 - DNA, 20 bp, Artificial
  CRISPR gRNA sequence
atacaaaaattagccagccc

SEQ ID NO: 700961 - DNA, 20 bp, Artificial
  CRISPR gRNA sequence
caaaaattagccagccctgg

SEQ ID NO: 700962 - DNA, 20 bp, Artificial
  CRISPR gRNA sequence
aaattagccagccctggcag

SEQ ID NO: 700963 - DNA, 20 bp, Artificial
  CRISPR gRNA sequence
aattagccagccctggcagc

SEQ ID NO: 700964 - DNA, 20 bp, Artificial
  CRISPR gRNA sequence
gccctgtaattccatttact

SEQ ID NO: 700965 - DNA, 20 bp, Artificial
  CRISPR gRNA sequence
ccctgtaattccatttactc

SEQ ID NO: 700966 - DNA, 20 bp, Artificial
  CRISPR gRNA sequence
ctgtaattccatttactcag

SEQ ID NO: 700967 - DNA, 20 bp, Artificial
  CRISPR gRNA sequence
tgtaattccatttactcagg

SEQ ID NO: 700968 - DNA, 20 bp, Artificial
  CRISPR gRNA sequence
ttccatttactcaggaggct

SEQ ID NO: 700969 - DNA, 20 bp, Artificial
  CRISPR gRNA sequence
tccatttactcaggaggctg

SEQ ID NO: 700970 - DNA, 20 bp, Artificial
  CRISPR gRNA sequence
atttactcaggaggctgagg

SEQ ID NO: 700971 - DNA, 20 bp, Artificial
  CRISPR gRNA sequence
tttactcaggaggctgaggc

SEQ ID NO: 700972 - DNA, 20 bp, Artificial
  CRISPR gRNA sequence
tactcaggaggctgaggcag

SEQ ID NO: 700973 - DNA, 20 bp, Artificial
  CRISPR gRNA sequence
gcaggagaaccacttgaacc

SEQ ID NO: 700974 - DNA, 20 bp, Artificial
  CRISPR gRNA sequence
caggagaaccacttgaacct

SEQ ID NO: 700975 - DNA, 20 bp, Artificial
  CRISPR gRNA sequence
ggagaaccacttgaacctgg

SEQ ID NO: 700976 - DNA, 20 bp, Artificial
  CRISPR gRNA sequence
gagaaccacttgaacctggg

SEQ ID NO: 700977 - DNA, 20 bp, Artificial
  CRISPR gRNA sequence
aaccacttgaacctgggagg

SEQ ID NO: 700978 - DNA, 20 bp, Artificial
  CRISPR gRNA sequence
cacttgaacctgggaggcgg

SEQ ID NO: 700979 - DNA, 20 bp, Artificial
  CRISPR gRNA sequence
aacctgggaggcggtggttg

SEQ ID NO: 700980 - DNA, 20 bp, Artificial
  CRISPR gRNA sequence
tgggaggcggtggttgcagt

SEQ ID NO: 700981 - DNA, 20 bp, Artificial
  CRISPR gRNA sequence
ggcggtggttgcagtgagct

SEQ ID NO: 700982 - DNA, 20 bp, Artificial
  CRISPR gRNA sequence
ggttgcagtgagctgagatt

SEQ ID NO: 700983 - DNA, 20 bp, Artificial
  CRISPR gRNA sequence
gagattgagccattgcactc

SEQ ID NO: 700984 - DNA, 20 bp, Artificial
  CRISPR gRNA sequence
tgagccattgcactccagcc

SEQ ID NO: 700985 - DNA, 20 bp, Artificial
  CRISPR gRNA sequence
gagccattgcactccagcct

SEQ ID NO: 700986 - DNA, 20 bp, Artificial
  CRISPR gRNA sequence
tgcactccagcctgggtgac

SEQ ID NO: 700987 - DNA, 20 bp, Artificial
  CRISPR gRNA sequence
cactccagcctgggtgacaa

SEQ ID NO: 700988 - DNA, 20 bp, Artificial
  CRISPR gRNA sequence
ccagcctgggtgacaagagc

SEQ ID NO: 700989 - DNA, 20 bp, Artificial
  CRISPR gRNA sequence
ctcaaaaaaaaaaaaaaaaa

SEQ ID NO: 700990 - DNA, 20 bp, Artificial
  CRISPR gRNA sequence
aaaaaaaaaaaagaaaactc

SEQ ID NO: 700991 - DNA, 20 bp, Artificial
  CRISPR gRNA sequence
aaaaaaaaaaagaaaactcc

SEQ ID NO: 700992 - DNA, 20 bp, Artificial
  CRISPR gRNA sequence
aaaaaaaaaagaaaactcca

SEQ ID NO: 700993 - DNA, 20 bp, Artificial
  CRISPR gRNA sequence
aaaactccagggactcacca

SEQ ID NO: 700994 - DNA, 20 bp, Artificial
  CRISPR gRNA sequence
ggactcaccacggtgtcctt

SEQ ID NO: 700995 - DNA, 20 bp, Artificial
  CRISPR gRNA sequence
gactcaccacggtgtccttc

SEQ ID NO: 700996 - DNA, 20 bp, Artificial
  CRISPR gRNA sequence
cacggtgtccttcaggtccc

SEQ ID NO: 700997 - DNA, 20 bp, Artificial
  CRISPR gRNA sequence
acggtgtccttcaggtccca

SEQ ID NO: 700998 - DNA, 20 bp, Artificial
  CRISPR gRNA sequence
ccttcaggtcccaaggcccc

SEQ ID NO: 700999 - DNA, 20 bp, Artificial
  CRISPR gRNA sequence
gccttcttctcttcatgttt

SEQ ID NO: 701000 - DNA, 20 bp, Artificial
  CRISPR gRNA sequence
cttcttctcttcatgtttca

SEQ ID NO: 701001 - DNA, 20 bp, Artificial
  CRISPR gRNA sequence
tttattttgtacataatgtc

SEQ ID NO: 701002 - DNA, 20 bp, Artificial
  CRISPR gRNA sequence
ttattttgtacataatgtcc

SEQ ID NO: 701003 - DNA, 20 bp, Artificial
  CRISPR gRNA sequence
tattttgtacataatgtcca

SEQ ID NO: 701004 - DNA, 20 bp, Artificial
  CRISPR gRNA sequence
tacataatgtccagggcttt

SEQ ID NO: 701005 - DNA, 20 bp, Artificial
  CRISPR gRNA sequence
ataatgtccagggcttttag

SEQ ID NO: 701006 - DNA, 20 bp, Artificial
  CRISPR gRNA sequence
ccagggcttttagcggttct

SEQ ID NO: 701007 - DNA, 20 bp, Artificial
  CRISPR gRNA sequence
gggcttttagcggttcttgg

SEQ ID NO: 701008 - DNA, 20 bp, Artificial
  CRISPR gRNA sequence
ggcttttagcggttcttggc

SEQ ID NO: 701009 - DNA, 20 bp, Artificial
  CRISPR gRNA sequence
cttttagcggttcttggcgg

SEQ ID NO: 701010 - DNA, 20 bp, Artificial
  CRISPR gRNA sequence
ttttagcggttcttggcggg

SEQ ID NO: 701011 - DNA, 20 bp, Artificial
  CRISPR gRNA sequence
gcggttcttggcgggaggat

SEQ ID NO: 701012 - DNA, 20 bp, Artificial
  CRISPR gRNA sequence
cggttcttggcgggaggatg

SEQ ID NO: 701013 - DNA, 20 bp, Artificial
  CRISPR gRNA sequence
ggttcttggcgggaggatga

SEQ ID NO: 701014 - DNA, 20 bp, Artificial
  CRISPR gRNA sequence
gttcttggcgggaggatgag

SEQ ID NO: 701015 - DNA, 20 bp, Artificial
  CRISPR gRNA sequence
gatgaggggaaaacgtgtct

SEQ ID NO: 701016 - DNA, 20 bp, Artificial
  CRISPR gRNA sequence
acgtgtctaagccatcttcc

SEQ ID NO: 701017 - DNA, 20 bp, Artificial
  CRISPR gRNA sequence
ctaagccatcttcccagaat

SEQ ID NO: 701018 - DNA, 20 bp, Artificial
  CRISPR gRNA sequence
aagccatcttcccagaatca

SEQ ID NO: 701019 - DNA, 20 bp, Artificial
  CRISPR gRNA sequence
tcttcccagaatcagagtct

SEQ ID NO: 701020 - DNA, 20 bp, Artificial
  CRISPR gRNA sequence
cttcccagaatcagagtctc

SEQ ID NO: 701021 - DNA, 20 bp, Artificial
  CRISPR gRNA sequence
ctcaggatgtgatcccaaca

SEQ ID NO: 701022 - DNA, 20 bp, Artificial
  CRISPR gRNA sequence
cacagccccctcctttctcc

SEQ ID NO: 701023 - DNA, 20 bp, Artificial
  CRISPR gRNA sequence
cccctcctttctcccagctt

SEQ ID NO: 701024 - DNA, 20 bp, Artificial
  CRISPR gRNA sequence
tttctcccagcttcagctct

SEQ ID NO: 701025 - DNA, 20 bp, Artificial
  CRISPR gRNA sequence
cagcttcagctctcagcacc

SEQ ID NO: 701026 - DNA, 20 bp, Artificial
  CRISPR gRNA sequence
agcaccaagccctcactctc

SEQ ID NO: 701027 - DNA, 20 bp, Artificial
  CRISPR gRNA sequence
gcaccaagccctcactctct

SEQ ID NO: 701028 - DNA, 20 bp, Artificial
  CRISPR gRNA sequence
cacctgcgctgcccttcttc

SEQ ID NO: 701029 - DNA, 20 bp, Artificial
  CRISPR gRNA sequence
acctgcgctgcccttcttcc

SEQ ID NO: 701030 - DNA, 20 bp, Artificial
  CRISPR gRNA sequence
gcgctgcccttcttccaggt

SEQ ID NO: 701031 - DNA, 20 bp, Artificial
  CRISPR gRNA sequence
gctgcccttcttccaggttg

SEQ ID NO: 701032 - DNA, 20 bp, Artificial
  CRISPR gRNA sequence
ctgcccttcttccaggttgg

SEQ ID NO: 701033 - DNA, 20 bp, Artificial
  CRISPR gRNA sequence
gcacgtgctgttctctctgt

SEQ ID NO: 701034 - DNA, 20 bp, Artificial
  CRISPR gRNA sequence
acgtgctgttctctctgtcg

SEQ ID NO: 701035 - DNA, 20 bp, Artificial
  CRISPR gRNA sequence
cccttccctccccattcact

SEQ ID NO: 701036 - DNA, 20 bp, Artificial
  CRISPR gRNA sequence
tcacttagtcaaatcctact

SEQ ID NO: 701037 - DNA, 20 bp, Artificial
  CRISPR gRNA sequence
gtcaaatcctactcagccct

SEQ ID NO: 701038 - DNA, 20 bp, Artificial
  CRISPR gRNA sequence
gctctccaccccacttcctc

SEQ ID NO: 701039 - DNA, 20 bp, Artificial
  CRISPR gRNA sequence
tctccaccccacttcctcaa

SEQ ID NO: 701040 - DNA, 20 bp, Artificial
  CRISPR gRNA sequence
ctccaccccacttcctcaag

SEQ ID NO: 701041 - DNA, 20 bp, Artificial
  CRISPR gRNA sequence
cttcctcaagaggccttccc

SEQ ID NO: 701042 - DNA, 20 bp, Artificial
  CRISPR gRNA sequence
ggccttccctggcctctcac

SEQ ID NO: 701043 - DNA, 20 bp, Artificial
  CRISPR gRNA sequence
gccttccctggcctctcact

SEQ ID NO: 701044 - DNA, 20 bp, Artificial
  CRISPR gRNA sequence
ccttccctggcctctcacta

SEQ ID NO: 701045 - DNA, 20 bp, Artificial
  CRISPR gRNA sequence
tccctggcctctcactaggg

SEQ ID NO: 701046 - DNA, 20 bp, Artificial
  CRISPR gRNA sequence
tggcctctcactagggaagc

SEQ ID NO: 701047 - DNA, 20 bp, Artificial
  CRISPR gRNA sequence
cctctcactagggaagctgg

SEQ ID NO: 701048 - DNA, 20 bp, Artificial
  CRISPR gRNA sequence
cactgtgtcctttgcaaatg

SEQ ID NO: 701049 - DNA, 20 bp, Artificial
  CRISPR gRNA sequence
acatacctctctctgtctct

SEQ ID NO: 701050 - DNA, 20 bp, Artificial
  CRISPR gRNA sequence
tcaatgtctgtctccctccc

SEQ ID NO: 701051 - DNA, 20 bp, Artificial
  CRISPR gRNA sequence
tgtctgtctccctccctggc

SEQ ID NO: 701052 - DNA, 20 bp, Artificial
  CRISPR gRNA sequence
ctgtctccctccctggctgg

SEQ ID NO: 701053 - DNA, 20 bp, Artificial
  CRISPR gRNA sequence
tccctggctggaagcttcct

SEQ ID NO: 701054 - DNA, 20 bp, Artificial
  CRISPR gRNA sequence
ccctggctggaagcttcctg

SEQ ID NO: 701055 - DNA, 20 bp, Artificial
  CRISPR gRNA sequence
cctggctggaagcttcctga

SEQ ID NO: 701056 - DNA, 20 bp, Artificial
  CRISPR gRNA sequence
ctggaagcttcctgagggca

SEQ ID NO: 701057 - DNA, 20 bp, Artificial
  CRISPR gRNA sequence
gagggcaaagaccatgcccc

SEQ ID NO: 701058 - DNA, 20 bp, Artificial
  CRISPR gRNA sequence
cccactgcctgatcaaatgc

SEQ ID NO: 701059 - DNA, 20 bp, Artificial
  CRISPR gRNA sequence
ccactgcctgatcaaatgct

SEQ ID NO: 701060 - DNA, 20 bp, Artificial
  CRISPR gRNA sequence
gcctgatcaaatgctaggca

SEQ ID NO: 701061 - DNA, 20 bp, Artificial
  CRISPR gRNA sequence
ggcatggcacctgctcccca

SEQ ID NO: 701062 - DNA, 20 bp, Artificial
  CRISPR gRNA sequence
catggcacctgctccccata

SEQ ID NO: 701063 - DNA, 20 bp, Artificial
  CRISPR gRNA sequence
ccatagagattcattgaatt

SEQ ID NO: 701064 - DNA, 20 bp, Artificial
  CRISPR gRNA sequence
agattcattgaattaagata

SEQ ID NO: 701065 - DNA, 20 bp, Artificial
  CRISPR gRNA sequence
gattcattgaattaagatat

SEQ ID NO: 701066 - DNA, 20 bp, Artificial
  CRISPR gRNA sequence
attcattgaattaagatatg

SEQ ID NO: 701067 - DNA, 20 bp, Artificial
  CRISPR gRNA sequence
taagatatggggacacctga

SEQ ID NO: 701068 - DNA, 20 bp, Artificial
  CRISPR gRNA sequence
aagatatggggacacctgac

SEQ ID NO: 701069 - DNA, 20 bp, Artificial
  CRISPR gRNA sequence
agatatggggacacctgaca

SEQ ID NO: 701070 - DNA, 20 bp, Artificial
  CRISPR gRNA sequence
atatggggacacctgacagg

SEQ ID NO: 701071 - DNA, 20 bp, Artificial
  CRISPR gRNA sequence
gacacctgacagggagctcc

SEQ ID NO: 701072 - DNA, 20 bp, Artificial
  CRISPR gRNA sequence
cctgacagggagctccgagc

SEQ ID NO: 701073 - DNA, 20 bp, Artificial
  CRISPR gRNA sequence
gacagggagctccgagctgg

SEQ ID NO: 701074 - DNA, 20 bp, Artificial
  CRISPR gRNA sequence
acagggagctccgagctggt

SEQ ID NO: 701075 - DNA, 20 bp, Artificial
  CRISPR gRNA sequence
cagggagctccgagctggtg

SEQ ID NO: 701076 - DNA, 20 bp, Artificial
  CRISPR gRNA sequence
agggagctccgagctggtgg

SEQ ID NO: 701077 - DNA, 20 bp, Artificial
  CRISPR gRNA sequence
gggagctccgagctggtggg

SEQ ID NO: 701078 - DNA, 20 bp, Artificial
  CRISPR gRNA sequence
ggagctccgagctggtgggg

SEQ ID NO: 701079 - DNA, 20 bp, Artificial
  CRISPR gRNA sequence
gctccgagctggtggggggg

SEQ ID NO: 701080 - DNA, 20 bp, Artificial
  CRISPR gRNA sequence
tccgagctggtgggggggtg

SEQ ID NO: 701081 - DNA, 20 bp, Artificial
  CRISPR gRNA sequence
gggggggtggagttcaaatc

SEQ ID NO: 701082 - DNA, 20 bp, Artificial
  CRISPR gRNA sequence
gttcaaatctggtcaaattc

SEQ ID NO: 701083 - DNA, 20 bp, Artificial
  CRISPR gRNA sequence
ttcaaatctggtcaaattcc

SEQ ID NO: 701084 - DNA, 20 bp, Artificial
  CRISPR gRNA sequence
tcaaatctggtcaaattcca

SEQ ID NO: 701085 - DNA, 20 bp, Artificial
  CRISPR gRNA sequence
atctggtcaaattccagggt

SEQ ID NO: 701086 - DNA, 20 bp, Artificial
  CRISPR gRNA sequence
tctggtcaaattccagggtc

SEQ ID NO: 701087 - DNA, 20 bp, Artificial
  CRISPR gRNA sequence
ctggtcaaattccagggtcg

SEQ ID NO: 701088 - DNA, 20 bp, Artificial
  CRISPR gRNA sequence
tggtcaaattccagggtcgg

SEQ ID NO: 701089 - DNA, 20 bp, Artificial
  CRISPR gRNA sequence
gtcaaattccagggtcgggg

SEQ ID NO: 701090 - DNA, 20 bp, Artificial
  CRISPR gRNA sequence
caaattccagggtcggggga

SEQ ID NO: 701091 - DNA, 20 bp, Artificial
  CRISPR gRNA sequence
tcgggggagagcgctctgct

SEQ ID NO: 701092 - DNA, 20 bp, Artificial
  CRISPR gRNA sequence
cgggggagagcgctctgcta

SEQ ID NO: 701093 - DNA, 20 bp, Artificial
  CRISPR gRNA sequence
agcgctctgctaaggaatga

SEQ ID NO: 701094 - DNA, 20 bp, Artificial
  CRISPR gRNA sequence
cgctctgctaaggaatgatg

SEQ ID NO: 701095 - DNA, 20 bp, Artificial
  CRISPR gRNA sequence
gctctgctaaggaatgatgg

SEQ ID NO: 701096 - DNA, 20 bp, Artificial
  CRISPR gRNA sequence
tgatggaggcctccacccat

SEQ ID NO: 701097 - DNA, 20 bp, Artificial
  CRISPR gRNA sequence
tggaggcctccacccataag

SEQ ID NO: 701098 - DNA, 20 bp, Artificial
  CRISPR gRNA sequence
ggaggcctccacccataagc

SEQ ID NO: 701099 - DNA, 20 bp, Artificial
  CRISPR gRNA sequence
gaggcctccacccataagca

SEQ ID NO: 701100 - DNA, 20 bp, Artificial
  CRISPR gRNA sequence
aggcctccacccataagcag

SEQ ID NO: 701101 - DNA, 20 bp, Artificial
  CRISPR gRNA sequence
gcctccacccataagcaggg

SEQ ID NO: 701102 - DNA, 20 bp, Artificial
  CRISPR gRNA sequence
ctccacccataagcagggga

SEQ ID NO: 701103 - DNA, 20 bp, Artificial
  CRISPR gRNA sequence
ccataagcaggggagagtgc

SEQ ID NO: 701104 - DNA, 20 bp, Artificial
  CRISPR gRNA sequence
ataagcaggggagagtgctg

SEQ ID NO: 701105 - DNA, 20 bp, Artificial
  CRISPR gRNA sequence
agcaggggagagtgctggag

SEQ ID NO: 701106 - DNA, 20 bp, Artificial
  CRISPR gRNA sequence
gggagagtgctggagtggac

SEQ ID NO: 701107 - DNA, 20 bp, Artificial
  CRISPR gRNA sequence
ggagagtgctggagtggact

SEQ ID NO: 701108 - DNA, 20 bp, Artificial
  CRISPR gRNA sequence
gagtgctggagtggactggg

SEQ ID NO: 701109 - DNA, 20 bp, Artificial
  CRISPR gRNA sequence
tgctggagtggactgggcag

SEQ ID NO: 701110 - DNA, 20 bp, Artificial
  CRISPR gRNA sequence
tggactgggcagcagatacc

SEQ ID NO: 701111 - DNA, 20 bp, Artificial
  CRISPR gRNA sequence
ggactgggcagcagatacct

SEQ ID NO: 701112 - DNA, 20 bp, Artificial
  CRISPR gRNA sequence
cagatacctaggattttgca

SEQ ID NO: 701113 - DNA, 20 bp, Artificial
  CRISPR gRNA sequence
tttgcaaagatttgcaactg

SEQ ID NO: 701114 - DNA, 20 bp, Artificial
  CRISPR gRNA sequence
ttgcaaagatttgcaactgt

SEQ ID NO: 701115 - DNA, 20 bp, Artificial
  CRISPR gRNA sequence
tgcaaagatttgcaactgtg

SEQ ID NO: 701116 - DNA, 20 bp, Artificial
  CRISPR gRNA sequence
ggcatgttcccacccgcctc

SEQ ID NO: 701117 - DNA, 20 bp, Artificial
  CRISPR gRNA sequence
tcccacccgcctctggacct

SEQ ID NO: 701118 - DNA, 20 bp, Artificial
  CRISPR gRNA sequence
ggtctccccatctctcaaat

SEQ ID NO: 701119 - DNA, 20 bp, Artificial
  CRISPR gRNA sequence
gtctccccatctctcaaatg

SEQ ID NO: 701120 - DNA, 20 bp, Artificial
  CRISPR gRNA sequence
ctccccatctctcaaatgag

SEQ ID NO: 701121 - DNA, 20 bp, Artificial
  CRISPR gRNA sequence
tccccatctctcaaatgagg

SEQ ID NO: 701122 - DNA, 20 bp, Artificial
  CRISPR gRNA sequence
caaatgaggaggtataactg

SEQ ID NO: 701123 - DNA, 20 bp, Artificial
  CRISPR gRNA sequence
aaatgaggaggtataactga

SEQ ID NO: 701124 - DNA, 20 bp, Artificial
  CRISPR gRNA sequence
ggaggtataactgaaggcct

SEQ ID NO: 701125 - DNA, 20 bp, Artificial
  CRISPR gRNA sequence
gaggtataactgaaggcctt

SEQ ID NO: 701126 - DNA, 20 bp, Artificial
  CRISPR gRNA sequence
aggtataactgaaggccttg

SEQ ID NO: 701127 - DNA, 20 bp, Artificial
  CRISPR gRNA sequence
ggtataactgaaggccttgg

SEQ ID NO: 701128 - DNA, 20 bp, Artificial
  CRISPR gRNA sequence
gccttgggggcctctccaaa

SEQ ID NO: 701129 - DNA, 20 bp, Artificial
  CRISPR gRNA sequence
ccttgggggcctctccaaaa

SEQ ID NO: 701130 - DNA, 20 bp, Artificial
  CRISPR gRNA sequence
aaaaaggccaaacttcccaa

SEQ ID NO: 701131 - DNA, 20 bp, Artificial
  CRISPR gRNA sequence
ccaaacttcccaaaagtttc

SEQ ID NO: 701132 - DNA, 20 bp, Artificial
  CRISPR gRNA sequence
cttcccaaaagtttccagct

SEQ ID NO: 701133 - DNA, 20 bp, Artificial
  CRISPR gRNA sequence
atctttgtgaaaaacatctt

SEQ ID NO: 701134 - DNA, 20 bp, Artificial
  CRISPR gRNA sequence
tgtgaaaaacatcttgagtt

SEQ ID NO: 701135 - DNA, 20 bp, Artificial
  CRISPR gRNA sequence
catcttgagttcagttgttc

SEQ ID NO: 701136 - DNA, 20 bp, Artificial
  CRISPR gRNA sequence
tgagttcagttgttccagcc

SEQ ID NO: 701137 - DNA, 20 bp, Artificial
  CRISPR gRNA sequence
gagttcagttgttccagcca

SEQ ID NO: 701138 - DNA, 20 bp, Artificial
  CRISPR gRNA sequence
ttccagccaaggcttcctgc

SEQ ID NO: 701139 - DNA, 20 bp, Artificial
  CRISPR gRNA sequence
ccagccaaggcttcctgctg

SEQ ID NO: 701140 - DNA, 20 bp, Artificial
  CRISPR gRNA sequence
cagccaaggcttcctgctgg

SEQ ID NO: 701141 - DNA, 20 bp, Artificial
  CRISPR gRNA sequence
agccaaggcttcctgctgga

SEQ ID NO: 701142 - DNA, 20 bp, Artificial
  CRISPR gRNA sequence
ttcctgctggagggactgtc

SEQ ID NO: 701143 - DNA, 20 bp, Artificial
  CRISPR gRNA sequence
tcctgctggagggactgtct

SEQ ID NO: 701144 - DNA, 20 bp, Artificial
  CRISPR gRNA sequence
tgctggagggactgtctggg

SEQ ID NO: 701145 - DNA, 20 bp, Artificial
  CRISPR gRNA sequence
actgtctgggcagtgttcct

SEQ ID NO: 701146 - DNA, 20 bp, Artificial
  CRISPR gRNA sequence
gtgttcctgagactgccaca

SEQ ID NO: 701147 - DNA, 20 bp, Artificial
  CRISPR gRNA sequence
ttcctgagactgccacacag

SEQ ID NO: 701148 - DNA, 20 bp, Artificial
  CRISPR gRNA sequence
agactgccacacagcggcgc

SEQ ID NO: 701149 - DNA, 20 bp, Artificial
  CRISPR gRNA sequence
actgccacacagcggcgcca

SEQ ID NO: 701150 - DNA, 20 bp, Artificial
  CRISPR gRNA sequence
ctgccacacagcggcgccag

SEQ ID NO: 701151 - DNA, 20 bp, Artificial
  CRISPR gRNA sequence
aggcctccctttgctgcccc

SEQ ID NO: 701152 - DNA, 20 bp, Artificial
  CRISPR gRNA sequence
cctttgctgcccctggaccc

SEQ ID NO: 701153 - DNA, 20 bp, Artificial
  CRISPR gRNA sequence
tggaccccagctgcccaatg

SEQ ID NO: 701154 - DNA, 20 bp, Artificial
  CRISPR gRNA sequence
gctgcccaatgcagtgcccc

SEQ ID NO: 701155 - DNA, 20 bp, Artificial
  CRISPR gRNA sequence
aatgcagtgcccctggcccg

SEQ ID NO: 701156 - DNA, 20 bp, Artificial
  CRISPR gRNA sequence
tgcccctggcccgtggcacg

SEQ ID NO: 701157 - DNA, 20 bp, Artificial
  CRISPR gRNA sequence
gtggccacgcacttaaaatg

SEQ ID NO: 701158 - DNA, 20 bp, Artificial
  CRISPR gRNA sequence
ccacgcacttaaaatgcagc

SEQ ID NO: 701159 - DNA, 20 bp, Artificial
  CRISPR gRNA sequence
cacgcacttaaaatgcagct

SEQ ID NO: 701160 - DNA, 20 bp, Artificial
  CRISPR gRNA sequence
acgcacttaaaatgcagcta

SEQ ID NO: 701161 - DNA, 20 bp, Artificial
  CRISPR gRNA sequence
cgcacttaaaatgcagctag

SEQ ID NO: 701162 - DNA, 20 bp, Artificial
  CRISPR gRNA sequence
cttaaaatgcagctaggggc

SEQ ID NO: 701163 - DNA, 20 bp, Artificial
  CRISPR gRNA sequence
ttaaaatgcagctaggggcc

SEQ ID NO: 701164 - DNA, 20 bp, Artificial
  CRISPR gRNA sequence
atgcagctaggggccgggtg

SEQ ID NO: 701165 - DNA, 20 bp, Artificial
  CRISPR gRNA sequence
cagctaggggccgggtgcgg

SEQ ID NO: 701166 - DNA, 20 bp, Artificial
  CRISPR gRNA sequence
gtggctcacacctgtaattc

SEQ ID NO: 701167 - DNA, 20 bp, Artificial
  CRISPR gRNA sequence
cacctgtaattccagcattt

SEQ ID NO: 701168 - DNA, 20 bp, Artificial
  CRISPR gRNA sequence
acctgtaattccagcatttt

SEQ ID NO: 701169 - DNA, 20 bp, Artificial
  CRISPR gRNA sequence
ctgtaattccagcattttgg

SEQ ID NO: 701170 - DNA, 20 bp, Artificial
  CRISPR gRNA sequence
tgtaattccagcattttggg

SEQ ID NO: 701171 - DNA, 20 bp, Artificial
  CRISPR gRNA sequence
ttccagcattttgggaggct

SEQ ID NO: 701172 - DNA, 20 bp, Artificial
  CRISPR gRNA sequence
tccagcattttgggaggctg

SEQ ID NO: 701173 - DNA, 20 bp, Artificial
  CRISPR gRNA sequence
agcattttgggaggctgagg

SEQ ID NO: 701174 - DNA, 20 bp, Artificial
  CRISPR gRNA sequence
gcattttgggaggctgaggc

SEQ ID NO: 701175 - DNA, 20 bp, Artificial
  CRISPR gRNA sequence
ttttgggaggctgaggcagg

SEQ ID NO: 701176 - DNA, 20 bp, Artificial
  CRISPR gRNA sequence
tgaggcaggcggatcacttg

SEQ ID NO: 701177 - DNA, 20 bp, Artificial
  CRISPR gRNA sequence
gcaggcggatcacttgaagt

SEQ ID NO: 701178 - DNA, 20 bp, Artificial
  CRISPR gRNA sequence
caggcggatcacttgaagtc

SEQ ID NO: 701179 - DNA, 20 bp, Artificial
  CRISPR gRNA sequence
ggcggatcacttgaagtcag

SEQ ID NO: 701180 - DNA, 20 bp, Artificial
  CRISPR gRNA sequence
tcacttgaagtcaggagttt

SEQ ID NO: 701181 - DNA, 20 bp, Artificial
  CRISPR gRNA sequence
tgaagtcaggagtttgagac

SEQ ID NO: 701182 - DNA, 20 bp, Artificial
  CRISPR gRNA sequence
tcaggagtttgagaccagcc

SEQ ID NO: 701183 - DNA, 20 bp, Artificial
  CRISPR gRNA sequence
tgagaccagcctggccaatg

SEQ ID NO: 701184 - DNA, 20 bp, Artificial
  CRISPR gRNA sequence
cgtctctactaaaaatacaa

SEQ ID NO: 701185 - DNA, 20 bp, Artificial
  CRISPR gRNA sequence
tctactaaaaatacaaaagt

SEQ ID NO: 701186 - DNA, 20 bp, Artificial
  CRISPR gRNA sequence
ctaaaaatacaaaagttggc

SEQ ID NO: 701187 - DNA, 20 bp, Artificial
  CRISPR gRNA sequence
taaaaatacaaaagttggcc

SEQ ID NO: 701188 - DNA, 20 bp, Artificial
  CRISPR gRNA sequence
atacaaaagttggccaggtg

SEQ ID NO: 701189 - DNA, 20 bp, Artificial
  CRISPR gRNA sequence
caaaagttggccaggtgtgg

SEQ ID NO: 701190 - DNA, 20 bp, Artificial
  CRISPR gRNA sequence
aagttggccaggtgtggtgg

SEQ ID NO: 701191 - DNA, 20 bp, Artificial
  CRISPR gRNA sequence
agttggccaggtgtggtggc

SEQ ID NO: 701192 - DNA, 20 bp, Artificial
  CRISPR gRNA sequence
tgcttgaaatctcaactact

SEQ ID NO: 701193 - DNA, 20 bp, Artificial
  CRISPR gRNA sequence
gcttgaaatctcaactactt

SEQ ID NO: 701194 - DNA, 20 bp, Artificial
  CRISPR gRNA sequence
ttgaaatctcaactacttgg

SEQ ID NO: 701195 - DNA, 20 bp, Artificial
  CRISPR gRNA sequence
tgaaatctcaactacttggg

SEQ ID NO: 701196 - DNA, 20 bp, Artificial
  CRISPR gRNA sequence
tctcaactacttgggaggct

SEQ ID NO: 701197 - DNA, 20 bp, Artificial
  CRISPR gRNA sequence
ctcaactacttgggaggctg

SEQ ID NO: 701198 - DNA, 20 bp, Artificial
  CRISPR gRNA sequence
tacttgggaggctgaggcat

SEQ ID NO: 701199 - DNA, 20 bp, Artificial
  CRISPR gRNA sequence
gcatgagaattgcttgaatc

SEQ ID NO: 701200 - DNA, 20 bp, Artificial
  CRISPR gRNA sequence
catgagaattgcttgaatcc

SEQ ID NO: 701201 - DNA, 20 bp, Artificial
  CRISPR gRNA sequence
tgagaattgcttgaatccgg

SEQ ID NO: 701202 - DNA, 20 bp, Artificial
  CRISPR gRNA sequence
gagaattgcttgaatccggg

SEQ ID NO: 701203 - DNA, 20 bp, Artificial
  CRISPR gRNA sequence
aattgcttgaatccgggagg

SEQ ID NO: 701204 - DNA, 20 bp, Artificial
  CRISPR gRNA sequence
ttgcttgaatccgggaggtg

SEQ ID NO: 701205 - DNA, 20 bp, Artificial
  CRISPR gRNA sequence
tgcttgaatccgggaggtgg

SEQ ID NO: 701206 - DNA, 20 bp, Artificial
  CRISPR gRNA sequence
aatccgggaggtggaggttg

SEQ ID NO: 701207 - DNA, 20 bp, Artificial
  CRISPR gRNA sequence
cgggaggtggaggttgtagt

SEQ ID NO: 701208 - DNA, 20 bp, Artificial
  CRISPR gRNA sequence
ggtggaggttgtagtgagct

SEQ ID NO: 701209 - DNA, 20 bp, Artificial
  CRISPR gRNA sequence
tgtgccactgcactccaacc

SEQ ID NO: 701210 - DNA, 20 bp, Artificial
  CRISPR gRNA sequence
gtgccactgcactccaacct

SEQ ID NO: 701211 - DNA, 20 bp, Artificial
  CRISPR gRNA sequence
ctgcactccaacctgggcga

SEQ ID NO: 701212 - DNA, 20 bp, Artificial
  CRISPR gRNA sequence
gcactccaacctgggcgaca

SEQ ID NO: 701213 - DNA, 20 bp, Artificial
  CRISPR gRNA sequence
tccaacctgggcgacagagt

SEQ ID NO: 701214 - DNA, 20 bp, Artificial
  CRISPR gRNA sequence
gataaaaaataaaaaaaatg

SEQ ID NO: 701215 - DNA, 20 bp, Artificial
  CRISPR gRNA sequence
aatgcagatacgtctgcatt

SEQ ID NO: 701216 - DNA, 20 bp, Artificial
  CRISPR gRNA sequence
gcagatacgtctgcattgag

SEQ ID NO: 701217 - DNA, 20 bp, Artificial
  CRISPR gRNA sequence
gctgtgtgtacaatatgcac

SEQ ID NO: 701218 - DNA, 20 bp, Artificial
  CRISPR gRNA sequence
tgcactggatttcgaaaact

SEQ ID NO: 701219 - DNA, 20 bp, Artificial
  CRISPR gRNA sequence
ttcgaaaacttagtataaac

SEQ ID NO: 701220 - DNA, 20 bp, Artificial
  CRISPR gRNA sequence
atattgattgcctgcaaaca

SEQ ID NO: 701221 - DNA, 20 bp, Artificial
  CRISPR gRNA sequence
ctgcaaacatggtaatattt

SEQ ID NO: 701222 - DNA, 20 bp, Artificial
  CRISPR gRNA sequence
tggtaatattttagatatac

SEQ ID NO: 701223 - DNA, 20 bp, Artificial
  CRISPR gRNA sequence
ggtaatattttagatatact

SEQ ID NO: 701224 - DNA, 20 bp, Artificial
  CRISPR gRNA sequence
tgatttctttttacctttta

SEQ ID NO: 701225 - DNA, 20 bp, Artificial
  CRISPR gRNA sequence
tctttttaccttttaaagtg

SEQ ID NO: 701226 - DNA, 20 bp, Artificial
  CRISPR gRNA sequence
accttttaaagtgtggctcc

SEQ ID NO: 701227 - DNA, 20 bp, Artificial
  CRISPR gRNA sequence
gtgtggctcccagaatattt

SEQ ID NO: 701228 - DNA, 20 bp, Artificial
  CRISPR gRNA sequence
ggctcccagaatatttgagc

SEQ ID NO: 701229 - DNA, 20 bp, Artificial
  CRISPR gRNA sequence
tgtgactcgcatatctctgt

SEQ ID NO: 701230 - DNA, 20 bp, Artificial
  CRISPR gRNA sequence
actcgcatatctctgttgga

SEQ ID NO: 701231 - DNA, 20 bp, Artificial
  CRISPR gRNA sequence
tctgttggacagcactgttt

SEQ ID NO: 701232 - DNA, 20 bp, Artificial
  CRISPR gRNA sequence
gttggacagcactgttttag

SEQ ID NO: 701233 - DNA, 20 bp, Artificial
  CRISPR gRNA sequence
ttttagaagtgttctaatct

SEQ ID NO: 701234 - DNA, 20 bp, Artificial
  CRISPR gRNA sequence
taatctcagctgccaaaccc

SEQ ID NO: 701235 - DNA, 20 bp, Artificial
  CRISPR gRNA sequence
gccaaaccctggttaatctc

SEQ ID NO: 701236 - DNA, 20 bp, Artificial
  CRISPR gRNA sequence
ccaaaccctggttaatctct

SEQ ID NO: 701237 - DNA, 20 bp, Artificial
  CRISPR gRNA sequence
caaaccctggttaatctctg

SEQ ID NO: 701238 - DNA, 20 bp, Artificial
  CRISPR gRNA sequence
ttaatctctggggtcccctg

SEQ ID NO: 701239 - DNA, 20 bp, Artificial
  CRISPR gRNA sequence
gtcccctgtggactcaccca

SEQ ID NO: 701240 - DNA, 20 bp, Artificial
  CRISPR gRNA sequence
tcccctgtggactcacccat

SEQ ID NO: 701241 - DNA, 20 bp, Artificial
  CRISPR gRNA sequence
cccctgtggactcacccatg

SEQ ID NO: 701242 - DNA, 20 bp, Artificial
  CRISPR gRNA sequence
ctgtggactcacccatgggg

SEQ ID NO: 701243 - DNA, 20 bp, Artificial
  CRISPR gRNA sequence
tcacccatggggcagctctc

SEQ ID NO: 701244 - DNA, 20 bp, Artificial
  CRISPR gRNA sequence
cacccatggggcagctctcc

SEQ ID NO: 701245 - DNA, 20 bp, Artificial
  CRISPR gRNA sequence
acccatggggcagctctccg

SEQ ID NO: 701246 - DNA, 20 bp, Artificial
  CRISPR gRNA sequence
cggggttgttgttttttttc

SEQ ID NO: 701247 - DNA, 20 bp, Artificial
  CRISPR gRNA sequence
ttttttttccagctgtaaaa

SEQ ID NO: 701248 - DNA, 20 bp, Artificial
  CRISPR gRNA sequence
ttttccagctgtaaaataga

SEQ ID NO: 701249 - DNA, 20 bp, Artificial
  CRISPR gRNA sequence
tccagctgtaaaatagaaag

SEQ ID NO: 701250 - DNA, 20 bp, Artificial
  CRISPR gRNA sequence
tagaaagcagtttctgcctc

SEQ ID NO: 701251 - DNA, 20 bp, Artificial
  CRISPR gRNA sequence
aagcagtttctgcctccagt

SEQ ID NO: 701252 - DNA, 20 bp, Artificial
  CRISPR gRNA sequence
gtttctgcctccagtcagcc

SEQ ID NO: 701253 - DNA, 20 bp, Artificial
  CRISPR gRNA sequence
agtcagccaagccccacgct

SEQ ID NO: 701254 - DNA, 20 bp, Artificial
  CRISPR gRNA sequence
tcagccaagccccacgctaa

SEQ ID NO: 701255 - DNA, 20 bp, Artificial
  CRISPR gRNA sequence
cccacgctaagagccttcac

SEQ ID NO: 701256 - DNA, 20 bp, Artificial
  CRISPR gRNA sequence
tgaaattctcacgtctccat

SEQ ID NO: 701257 - DNA, 20 bp, Artificial
  CRISPR gRNA sequence
attctcacgtctccataaga

SEQ ID NO: 701258 - DNA, 20 bp, Artificial
  CRISPR gRNA sequence
tcacgtctccataagacaga

SEQ ID NO: 701259 - DNA, 20 bp, Artificial
  CRISPR gRNA sequence
ctccataagacagacagtat

SEQ ID NO: 701260 - DNA, 20 bp, Artificial
  CRISPR gRNA sequence
acagtattagccccattttc

SEQ ID NO: 701261 - DNA, 20 bp, Artificial
  CRISPR gRNA sequence
cagtattagccccattttcc

SEQ ID NO: 701262 - DNA, 20 bp, Artificial
  CRISPR gRNA sequence
ttagccccattttccaggtg

SEQ ID NO: 701263 - DNA, 20 bp, Artificial
  CRISPR gRNA sequence
attttccaggtgtggaaatc

SEQ ID NO: 701264 - DNA, 20 bp, Artificial
  CRISPR gRNA sequence
ttttccaggtgtggaaatcg

SEQ ID NO: 701265 - DNA, 20 bp, Artificial
  CRISPR gRNA sequence
caggtgtggaaatcgaggtc

SEQ ID NO: 701266 - DNA, 20 bp, Artificial
  CRISPR gRNA sequence
ggtgtggaaatcgaggtccg

SEQ ID NO: 701267 - DNA, 20 bp, Artificial
  CRISPR gRNA sequence
tggaaatcgaggtccggaga

SEQ ID NO: 701268 - DNA, 20 bp, Artificial
  CRISPR gRNA sequence
ggaaatcgaggtccggagat

SEQ ID NO: 701269 - DNA, 20 bp, Artificial
  CRISPR gRNA sequence
aaatcgaggtccggagatgg

SEQ ID NO: 701270 - DNA, 20 bp, Artificial
  CRISPR gRNA sequence
aatcgaggtccggagatggg

SEQ ID NO: 701271 - DNA, 20 bp, Artificial
  CRISPR gRNA sequence
gatgggaggtaaattgcccg

SEQ ID NO: 701272 - DNA, 20 bp, Artificial
  CRISPR gRNA sequence
tgggaggtaaattgcccgcg

SEQ ID NO: 701273 - DNA, 20 bp, Artificial
  CRISPR gRNA sequence
aggtaaattgcccgcggaga

SEQ ID NO: 701274 - DNA, 20 bp, Artificial
  CRISPR gRNA sequence
gtaaattgcccgcggagaca

SEQ ID NO: 701275 - DNA, 20 bp, Artificial
  CRISPR gRNA sequence
aattgcccgcggagacagag

SEQ ID NO: 701276 - DNA, 20 bp, Artificial
  CRISPR gRNA sequence
attgcccgcggagacagagc

SEQ ID NO: 701277 - DNA, 20 bp, Artificial
  CRISPR gRNA sequence
agacagagcaggaaatgtct

SEQ ID NO: 701278 - DNA, 20 bp, Artificial
  CRISPR gRNA sequence
gagcaggaaatgtctaagct

SEQ ID NO: 701279 - DNA, 20 bp, Artificial
  CRISPR gRNA sequence
agcaggaaatgtctaagctt

SEQ ID NO: 701280 - DNA, 20 bp, Artificial
  CRISPR gRNA sequence
gtcatcactccaccatgcca

SEQ ID NO: 701281 - DNA, 20 bp, Artificial
  CRISPR gRNA sequence
tccaccatgccacagaacac

SEQ ID NO: 701282 - DNA, 20 bp, Artificial
  CRISPR gRNA sequence
caccatgccacagaacacga

SEQ ID NO: 701283 - DNA, 20 bp, Artificial
  CRISPR gRNA sequence
accatgccacagaacacgag

SEQ ID NO: 701284 - DNA, 20 bp, Artificial
  CRISPR gRNA sequence
tgccacagaacacgagaggt

SEQ ID NO: 701285 - DNA, 20 bp, Artificial
  CRISPR gRNA sequence
attgctcgcgctcacctcca

SEQ ID NO: 701286 - DNA, 20 bp, Artificial
  CRISPR gRNA sequence
ctcgcgctcacctccacgga

SEQ ID NO: 701287 - DNA, 20 bp, Artificial
  CRISPR gRNA sequence
ctcacctccacggaaagctt

SEQ ID NO: 701288 - DNA, 20 bp, Artificial
  CRISPR gRNA sequence
cacctccacggaaagcttca

SEQ ID NO: 701289 - DNA, 20 bp, Artificial
  CRISPR gRNA sequence
ccacggaaagcttcagagcg

SEQ ID NO: 701290 - DNA, 20 bp, Artificial
  CRISPR gRNA sequence
agagcgaagtcccacacata

SEQ ID NO: 701291 - DNA, 20 bp, Artificial
  CRISPR gRNA sequence
gagcgaagtcccacacatac

SEQ ID NO: 701292 - DNA, 20 bp, Artificial
  CRISPR gRNA sequence
tattttttttttttttgtga

SEQ ID NO: 701293 - DNA, 20 bp, Artificial
  CRISPR gRNA sequence
ttttttttttttttgtgatg

SEQ ID NO: 701294 - DNA, 20 bp, Artificial
  CRISPR gRNA sequence
tggagcctcgatctgtcacc

SEQ ID NO: 701295 - DNA, 20 bp, Artificial
  CRISPR gRNA sequence
cctcgatctgtcacccagac

SEQ ID NO: 701296 - DNA, 20 bp, Artificial
  CRISPR gRNA sequence
tcgatctgtcacccagacta

SEQ ID NO: 701297 - DNA, 20 bp, Artificial
  CRISPR gRNA sequence
tcacccagactagagtgcaa

SEQ ID NO: 701298 - DNA, 20 bp, Artificial
  CRISPR gRNA sequence
agagtgcaatggtgtgatct

SEQ ID NO: 701299 - DNA, 20 bp, Artificial
  CRISPR gRNA sequence
tcactgcaacctctgcctcc

SEQ ID NO: 701300 - DNA, 20 bp, Artificial
  CRISPR gRNA sequence
aacctctgcctcccggattc

SEQ ID NO: 701301 - DNA, 20 bp, Artificial
  CRISPR gRNA sequence
ttcaagtgattctcctgcct

SEQ ID NO: 701302 - DNA, 20 bp, Artificial
  CRISPR gRNA sequence
ttctcctgcctcagcctcct

SEQ ID NO: 701303 - DNA, 20 bp, Artificial
  CRISPR gRNA sequence
tcctgcctcagcctcctgag

SEQ ID NO: 701304 - DNA, 20 bp, Artificial
  CRISPR gRNA sequence
gcctcagcctcctgagtagc

SEQ ID NO: 701305 - DNA, 20 bp, Artificial
  CRISPR gRNA sequence
cctcagcctcctgagtagct

SEQ ID NO: 701306 - DNA, 20 bp, Artificial
  CRISPR gRNA sequence
ctcctgagtagctgggatta

SEQ ID NO: 701307 - DNA, 20 bp, Artificial
  CRISPR gRNA sequence
tcctgagtagctgggattac

SEQ ID NO: 701308 - DNA, 20 bp, Artificial
  CRISPR gRNA sequence
caggtacctgccaccatgcc

SEQ ID NO: 701309 - DNA, 20 bp, Artificial
  CRISPR gRNA sequence
cggctaattttttgtaattt

SEQ ID NO: 701310 - DNA, 20 bp, Artificial
  CRISPR gRNA sequence
ctaattttttgtaattttag

SEQ ID NO: 701311 - DNA, 20 bp, Artificial
  CRISPR gRNA sequence
aattttttgtaattttagta

SEQ ID NO: 701312 - DNA, 20 bp, Artificial
  CRISPR gRNA sequence
ttttgtaattttagtagaga

SEQ ID NO: 701313 - DNA, 20 bp, Artificial
  CRISPR gRNA sequence
tttgtaattttagtagagat

SEQ ID NO: 701314 - DNA, 20 bp, Artificial
  CRISPR gRNA sequence
ttgtaattttagtagagatg

SEQ ID NO: 701315 - DNA, 20 bp, Artificial
  CRISPR gRNA sequence
tggggtttcactatgttgtc

SEQ ID NO: 701316 - DNA, 20 bp, Artificial
  CRISPR gRNA sequence
ggggtttcactatgttgtcc

SEQ ID NO: 701317 - DNA, 20 bp, Artificial
  CRISPR gRNA sequence
tttcactatgttgtccaggc

SEQ ID NO: 701318 - DNA, 20 bp, Artificial
  CRISPR gRNA sequence
acctcatgatccgcccacct

SEQ ID NO: 701319 - DNA, 20 bp, Artificial
  CRISPR gRNA sequence
ccgcccacctcggcctccca

SEQ ID NO: 701320 - DNA, 20 bp, Artificial
  CRISPR gRNA sequence
acctcggcctcccaaagtgt

SEQ ID NO: 701321 - DNA, 20 bp, Artificial
  CRISPR gRNA sequence
cctcggcctcccaaagtgtt

SEQ ID NO: 701322 - DNA, 20 bp, Artificial
  CRISPR gRNA sequence
ctcccaaagtgttgggatta

SEQ ID NO: 701323 - DNA, 20 bp, Artificial
  CRISPR gRNA sequence
tcccaaagtgttgggattac

SEQ ID NO: 701324 - DNA, 20 bp, Artificial
  CRISPR gRNA sequence
agtgttgggattacaggtgt

SEQ ID NO: 701325 - DNA, 20 bp, Artificial
  CRISPR gRNA sequence
caggtgtgagccaccgtgcc

SEQ ID NO: 701326 - DNA, 20 bp, Artificial
  CRISPR gRNA sequence
ccaccgtgcctggcgacata

SEQ ID NO: 701327 - DNA, 20 bp, Artificial
  CRISPR gRNA sequence
caccgtgcctggcgacatac

SEQ ID NO: 701328 - DNA, 20 bp, Artificial
  CRISPR gRNA sequence
cgacatacgggtcaccttct

SEQ ID NO: 701329 - DNA, 20 bp, Artificial
  CRISPR gRNA sequence
acgggtcaccttctaagtgt

SEQ ID NO: 701330 - DNA, 20 bp, Artificial
  CRISPR gRNA sequence
cgggtcaccttctaagtgtt

SEQ ID NO: 701331 - DNA, 20 bp, Artificial
  CRISPR gRNA sequence
tcaccttctaagtgttggga

SEQ ID NO: 701332 - DNA, 20 bp, Artificial
  CRISPR gRNA sequence
caccttctaagtgttgggat

SEQ ID NO: 701333 - DNA, 20 bp, Artificial
  CRISPR gRNA sequence
ccttctaagtgttgggatgg

SEQ ID NO: 701334 - DNA, 20 bp, Artificial
  CRISPR gRNA sequence
taagtgttgggatgggagtc

SEQ ID NO: 701335 - DNA, 20 bp, Artificial
  CRISPR gRNA sequence
tgttgggatgggagtccaga

SEQ ID NO: 701336 - DNA, 20 bp, Artificial
  CRISPR gRNA sequence
gttgggatgggagtccagat

SEQ ID NO: 701337 - DNA, 20 bp, Artificial
  CRISPR gRNA sequence
atgggagtccagatgggtgt

SEQ ID NO: 701338 - DNA, 20 bp, Artificial
  CRISPR gRNA sequence
tgggagtccagatgggtgta

SEQ ID NO: 701339 - DNA, 20 bp, Artificial
  CRISPR gRNA sequence
tccagatgggtgtaaggaca

SEQ ID NO: 701340 - DNA, 20 bp, Artificial
  CRISPR gRNA sequence
ccatatgtcatgcaatgtga

SEQ ID NO: 701341 - DNA, 20 bp, Artificial
  CRISPR gRNA sequence
catatgtcatgcaatgtgat

SEQ ID NO: 701342 - DNA, 20 bp, Artificial
  CRISPR gRNA sequence
tcttctgtttatcctgacga

SEQ ID NO: 701343 - DNA, 20 bp, Artificial
  CRISPR gRNA sequence
tgtttatcctgacgacagcc

SEQ ID NO: 701344 - DNA, 20 bp, Artificial
  CRISPR gRNA sequence
atcctgacgacagcctggtg

SEQ ID NO: 701345 - DNA, 20 bp, Artificial
  CRISPR gRNA sequence
cctgacgacagcctggtgaa

SEQ ID NO: 701346 - DNA, 20 bp, Artificial
  CRISPR gRNA sequence
tggtgaagagtgtatgatta

SEQ ID NO: 701347 - DNA, 20 bp, Artificial
  CRISPR gRNA sequence
tatgattatagtcatttgac

SEQ ID NO: 701348 - DNA, 20 bp, Artificial
  CRISPR gRNA sequence
atgattatagtcatttgact

SEQ ID NO: 701349 - DNA, 20 bp, Artificial
  CRISPR gRNA sequence
ttatagtcatttgactgggc

SEQ ID NO: 701350 - DNA, 20 bp, Artificial
  CRISPR gRNA sequence
tatagtcatttgactgggct

SEQ ID NO: 701351 - DNA, 20 bp, Artificial
  CRISPR gRNA sequence
tcatttgactgggctgggca

SEQ ID NO: 701352 - DNA, 20 bp, Artificial
  CRISPR gRNA sequence
tttgactgggctgggcacgg

SEQ ID NO: 701353 - DNA, 20 bp, Artificial
  CRISPR gRNA sequence
gcagcttatgcctgaaatcc

SEQ ID NO: 701354 - DNA, 20 bp, Artificial
  CRISPR gRNA sequence
tgcctgaaatcccagcactt

SEQ ID NO: 701355 - DNA, 20 bp, Artificial
  CRISPR gRNA sequence
gcctgaaatcccagcacttt

SEQ ID NO: 701356 - DNA, 20 bp, Artificial
  CRISPR gRNA sequence
ctgaaatcccagcactttgg

SEQ ID NO: 701357 - DNA, 20 bp, Artificial
  CRISPR gRNA sequence
tgaaatcccagcactttggg

SEQ ID NO: 701358 - DNA, 20 bp, Artificial
  CRISPR gRNA sequence
tcccagcactttgggaggct

SEQ ID NO: 701359 - DNA, 20 bp, Artificial
  CRISPR gRNA sequence
cccagcactttgggaggctg

SEQ ID NO: 701360 - DNA, 20 bp, Artificial
  CRISPR gRNA sequence
cagcactttgggaggctgag

SEQ ID NO: 701361 - DNA, 20 bp, Artificial
  CRISPR gRNA sequence
agcactttgggaggctgagg

SEQ ID NO: 701362 - DNA, 20 bp, Artificial
  CRISPR gRNA sequence
gcactttgggaggctgagga

SEQ ID NO: 701363 - DNA, 20 bp, Artificial
  CRISPR gRNA sequence
ctttgggaggctgaggaggg

SEQ ID NO: 701364 - DNA, 20 bp, Artificial
  CRISPR gRNA sequence
ctgaggagggtggatcacct

SEQ ID NO: 701365 - DNA, 20 bp, Artificial
  CRISPR gRNA sequence
tgaggagggtggatcacctg

SEQ ID NO: 701366 - DNA, 20 bp, Artificial
  CRISPR gRNA sequence
gagggtggatcacctgaggt

SEQ ID NO: 701367 - DNA, 20 bp, Artificial
  CRISPR gRNA sequence
agggtggatcacctgaggtc

SEQ ID NO: 701368 - DNA, 20 bp, Artificial
  CRISPR gRNA sequence
ggtggatcacctgaggtcag

SEQ ID NO: 701369 - DNA, 20 bp, Artificial
  CRISPR gRNA sequence
tcacctgaggtcaggagttc

SEQ ID NO: 701370 - DNA, 20 bp, Artificial
  CRISPR gRNA sequence
tgaggtcaggagttcgagac

SEQ ID NO: 701371 - DNA, 20 bp, Artificial
  CRISPR gRNA sequence
tcaggagttcgagaccagcc

SEQ ID NO: 701372 - DNA, 20 bp, Artificial
  CRISPR gRNA sequence
cgagaccagcctggccaaca

SEQ ID NO: 701373 - DNA, 20 bp, Artificial
  CRISPR gRNA sequence
accctgtctctactaaaaat

SEQ ID NO: 701374 - DNA, 20 bp, Artificial
  CRISPR gRNA sequence
tgtctctactaaaaattagc

SEQ ID NO: 701375 - DNA, 20 bp, Artificial
  CRISPR gRNA sequence
gtctctactaaaaattagcc

SEQ ID NO: 701376 - DNA, 20 bp, Artificial
  CRISPR gRNA sequence
tactaaaaattagccgggcg

SEQ ID NO: 701377 - DNA, 20 bp, Artificial
  CRISPR gRNA sequence
aaattagccgggcgtggttg

SEQ ID NO: 701378 - DNA, 20 bp, Artificial
  CRISPR gRNA sequence
aattagccgggcgtggttgc

SEQ ID NO: 701379 - DNA, 20 bp, Artificial
  CRISPR gRNA sequence
gttgcaggcacctgtaatcc

SEQ ID NO: 701380 - DNA, 20 bp, Artificial
  CRISPR gRNA sequence
cacctgtaatcccagctact

SEQ ID NO: 701381 - DNA, 20 bp, Artificial
  CRISPR gRNA sequence
acctgtaatcccagctactc

SEQ ID NO: 701382 - DNA, 20 bp, Artificial
  CRISPR gRNA sequence
ctgtaatcccagctactcag

SEQ ID NO: 701383 - DNA, 20 bp, Artificial
  CRISPR gRNA sequence
tgtaatcccagctactcagg

SEQ ID NO: 701384 - DNA, 20 bp, Artificial
  CRISPR gRNA sequence
tcccagctactcaggaggct

SEQ ID NO: 701385 - DNA, 20 bp, Artificial
  CRISPR gRNA sequence
cccagctactcaggaggctg

SEQ ID NO: 701386 - DNA, 20 bp, Artificial
  CRISPR gRNA sequence
agctactcaggaggctgagg

SEQ ID NO: 701387 - DNA, 20 bp, Artificial
  CRISPR gRNA sequence
gctactcaggaggctgaggc

SEQ ID NO: 701388 - DNA, 20 bp, Artificial
  CRISPR gRNA sequence
tactcaggaggctgaggcag

SEQ ID NO: 701389 - DNA, 20 bp, Artificial
  CRISPR gRNA sequence
gcaggagaattgcttgaacc

SEQ ID NO: 701390 - DNA, 20 bp, Artificial
  CRISPR gRNA sequence
caggagaattgcttgaacct

SEQ ID NO: 701391 - DNA, 20 bp, Artificial
  CRISPR gRNA sequence
ggagaattgcttgaacctgg

SEQ ID NO: 701392 - DNA, 20 bp, Artificial
  CRISPR gRNA sequence
gagaattgcttgaacctggg

SEQ ID NO: 701393 - DNA, 20 bp, Artificial
  CRISPR gRNA sequence
aattgcttgaacctgggagg

SEQ ID NO: 701394 - DNA, 20 bp, Artificial
  CRISPR gRNA sequence
ttgcttgaacctgggaggca

SEQ ID NO: 701395 - DNA, 20 bp, Artificial
  CRISPR gRNA sequence
tgcttgaacctgggaggcag

SEQ ID NO: 701396 - DNA, 20 bp, Artificial
  CRISPR gRNA sequence
aacctgggaggcagaggttg

SEQ ID NO: 701397 - DNA, 20 bp, Artificial
  CRISPR gRNA sequence
tgggaggcagaggttgcagt

SEQ ID NO: 701398 - DNA, 20 bp, Artificial
  CRISPR gRNA sequence
ggcagaggttgcagtgagct

SEQ ID NO: 701399 - DNA, 20 bp, Artificial
  CRISPR gRNA sequence
gagattgcatcactgcactc

SEQ ID NO: 701400 - DNA, 20 bp, Artificial
  CRISPR gRNA sequence
tgcatcactgcactccagcc

SEQ ID NO: 701401 - DNA, 20 bp, Artificial
  CRISPR gRNA sequence
gcatcactgcactccagcct

SEQ ID NO: 701402 - DNA, 20 bp, Artificial
  CRISPR gRNA sequence
ctgcactccagcctgggcga

SEQ ID NO: 701403 - DNA, 20 bp, Artificial
  CRISPR gRNA sequence
gcactccagcctgggcgaca

SEQ ID NO: 701404 - DNA, 20 bp, Artificial
  CRISPR gRNA sequence
tccagcctgggcgacagagt

SEQ ID NO: 701405 - DNA, 20 bp, Artificial
  CRISPR gRNA sequence
tctcaaataaataaataaac

SEQ ID NO: 701406 - DNA, 20 bp, Artificial
  CRISPR gRNA sequence
aaataaacaagtaaataaaa

SEQ ID NO: 701407 - DNA, 20 bp, Artificial
  CRISPR gRNA sequence
gtaaataaaatggactttcc

SEQ ID NO: 701408 - DNA, 20 bp, Artificial
  CRISPR gRNA sequence
taaaatggactttcctggca

SEQ ID NO: 701409 - DNA, 20 bp, Artificial
  CRISPR gRNA sequence
atggactttcctggcacagt

SEQ ID NO: 701410 - DNA, 20 bp, Artificial
  CRISPR gRNA sequence
tggactttcctggcacagtt

SEQ ID NO: 701411 - DNA, 20 bp, Artificial
  CRISPR gRNA sequence
ttcctggcacagttaggaca

SEQ ID NO: 701412 - DNA, 20 bp, Artificial
  CRISPR gRNA sequence
ctggcacagttaggacatag

SEQ ID NO: 701413 - DNA, 20 bp, Artificial
  CRISPR gRNA sequence
tggcacagttaggacatagc

SEQ ID NO: 701414 - DNA, 20 bp, Artificial
  CRISPR gRNA sequence
taggacatagcaggcaaact

SEQ ID NO: 701415 - DNA, 20 bp, Artificial
  CRISPR gRNA sequence
aggacatagcaggcaaactg

SEQ ID NO: 701416 - DNA, 20 bp, Artificial
  CRISPR gRNA sequence
ggacatagcaggcaaactga

SEQ ID NO: 701417 - DNA, 20 bp, Artificial
  CRISPR gRNA sequence
gacatagcaggcaaactgag

SEQ ID NO: 701418 - DNA, 20 bp, Artificial
  CRISPR gRNA sequence
gcaggcaaactgaggggcac

SEQ ID NO: 701419 - DNA, 20 bp, Artificial
  CRISPR gRNA sequence
gcaaactgaggggcactggc

SEQ ID NO: 701420 - DNA, 20 bp, Artificial
  CRISPR gRNA sequence
ttctccactctgcttctgtc

SEQ ID NO: 701421 - DNA, 20 bp, Artificial
  CRISPR gRNA sequence
tgcttctgtccagcattctt

SEQ ID NO: 701422 - DNA, 20 bp, Artificial
  CRISPR gRNA sequence
gcttctgtccagcattcttc

SEQ ID NO: 701423 - DNA, 20 bp, Artificial
  CRISPR gRNA sequence
cagcattcttcaggactcct

SEQ ID NO: 701424 - DNA, 20 bp, Artificial
  CRISPR gRNA sequence
aggactccttggattgcatg

SEQ ID NO: 701425 - DNA, 20 bp, Artificial
  CRISPR gRNA sequence
tagcaaaatccccaattttt

SEQ ID NO: 701426 - DNA, 20 bp, Artificial
  CRISPR gRNA sequence
ccccaattttttagcacatg

SEQ ID NO: 701427 - DNA, 20 bp, Artificial
  CRISPR gRNA sequence
ttttagcacatgtagcttaa

SEQ ID NO: 701428 - DNA, 20 bp, Artificial
  CRISPR gRNA sequence
gcacatgtagcttaaaagtc

SEQ ID NO: 701429 - DNA, 20 bp, Artificial
  CRISPR gRNA sequence
cacatgtagcttaaaagtct

SEQ ID NO: 701430 - DNA, 20 bp, Artificial
  CRISPR gRNA sequence
acatgtagcttaaaagtctg

SEQ ID NO: 701431 - DNA, 20 bp, Artificial
  CRISPR gRNA sequence
gtagcttaaaagtctgggga

SEQ ID NO: 701432 - DNA, 20 bp, Artificial
  CRISPR gRNA sequence
aaaagtctggggatagctct

SEQ ID NO: 701433 - DNA, 20 bp, Artificial
  CRISPR gRNA sequence
agtctggggatagctctgag

SEQ ID NO: 701434 - DNA, 20 bp, Artificial
  CRISPR gRNA sequence
gggatagctctgagaagctt

SEQ ID NO: 701435 - DNA, 20 bp, Artificial
  CRISPR gRNA sequence
ggatagctctgagaagcttc

SEQ ID NO: 701436 - DNA, 20 bp, Artificial
  CRISPR gRNA sequence
gctctgagaagcttcaggca

SEQ ID NO: 701437 - DNA, 20 bp, Artificial
  CRISPR gRNA sequence
tgagaagcttcaggcatggc

SEQ ID NO: 701438 - DNA, 20 bp, Artificial
  CRISPR gRNA sequence
gcttcaggcatggctggatc

SEQ ID NO: 701439 - DNA, 20 bp, Artificial
  CRISPR gRNA sequence
cttcaggcatggctggatcc

SEQ ID NO: 701440 - DNA, 20 bp, Artificial
  CRISPR gRNA sequence
ttcaggcatggctggatcca

SEQ ID NO: 701441 - DNA, 20 bp, Artificial
  CRISPR gRNA sequence
acctctatttccctctctgt

SEQ ID NO: 701442 - DNA, 20 bp, Artificial
  CRISPR gRNA sequence
ttccctctctgttggttcat

SEQ ID NO: 701443 - DNA, 20 bp, Artificial
  CRISPR gRNA sequence
ctctctgttggttcatcggc

SEQ ID NO: 701444 - DNA, 20 bp, Artificial
  CRISPR gRNA sequence
ttcatcggcaagatacttac

SEQ ID NO: 701445 - DNA, 20 bp, Artificial
  CRISPR gRNA sequence
atcggcaagatacttacaag

SEQ ID NO: 701446 - DNA, 20 bp, Artificial
  CRISPR gRNA sequence
tacttacaagcagctctgcc

SEQ ID NO: 701447 - DNA, 20 bp, Artificial
  CRISPR gRNA sequence
caagcagctctgcccagcgc

SEQ ID NO: 701448 - DNA, 20 bp, Artificial
  CRISPR gRNA sequence
gcagctctgcccagcgccag

SEQ ID NO: 701449 - DNA, 20 bp, Artificial
  CRISPR gRNA sequence
cagctctgcccagcgccagt

SEQ ID NO: 701450 - DNA, 20 bp, Artificial
  CRISPR gRNA sequence
ctctgcccagcgccagtggg

SEQ ID NO: 701451 - DNA, 20 bp, Artificial
  CRISPR gRNA sequence
gcccagcgccagtgggaaga

SEQ ID NO: 701452 - DNA, 20 bp, Artificial
  CRISPR gRNA sequence
aaaacctttaaatcccaaac

SEQ ID NO: 701453 - DNA, 20 bp, Artificial
  CRISPR gRNA sequence
aatctttaaattctacctca

SEQ ID NO: 701454 - DNA, 20 bp, Artificial
  CRISPR gRNA sequence
atctttaaattctacctcac

SEQ ID NO: 701455 - DNA, 20 bp, Artificial
  CRISPR gRNA sequence
taaattctacctcacaggct

SEQ ID NO: 701456 - DNA, 20 bp, Artificial
  CRISPR gRNA sequence
aaattctacctcacaggctt

SEQ ID NO: 701457 - DNA, 20 bp, Artificial
  CRISPR gRNA sequence
tcacatgtccgtccctgaac

SEQ ID NO: 701458 - DNA, 20 bp, Artificial
  CRISPR gRNA sequence
gtccctgaactggctcatcg

SEQ ID NO: 701459 - DNA, 20 bp, Artificial
  CRISPR gRNA sequence
ctgaactggctcatcgtggc

SEQ ID NO: 701460 - DNA, 20 bp, Artificial
  CRISPR gRNA sequence
gaactggctcatcgtggcca

SEQ ID NO: 701461 - DNA, 20 bp, Artificial
  CRISPR gRNA sequence
aactggctcatcgtggccag

SEQ ID NO: 701462 - DNA, 20 bp, Artificial
  CRISPR gRNA sequence
tcgtggccagaggaatgcaa

SEQ ID NO: 701463 - DNA, 20 bp, Artificial
  CRISPR gRNA sequence
gaggaatgcaacggattgat

SEQ ID NO: 701464 - DNA, 20 bp, Artificial
  CRISPR gRNA sequence
atgcaacggattgattggtc

SEQ ID NO: 701465 - DNA, 20 bp, Artificial
  CRISPR gRNA sequence
acggattgattggtccagcc

SEQ ID NO: 701466 - DNA, 20 bp, Artificial
  CRISPR gRNA sequence
attggtccagcctggtctca

SEQ ID NO: 701467 - DNA, 20 bp, Artificial
  CRISPR gRNA sequence
agcctggtctcatggccact

SEQ ID NO: 701468 - DNA, 20 bp, Artificial
  CRISPR gRNA sequence
gcctggtctcatggccactc

SEQ ID NO: 701469 - DNA, 20 bp, Artificial
  CRISPR gRNA sequence
ggtctcatggccactcggga

SEQ ID NO: 701470 - DNA, 20 bp, Artificial
  CRISPR gRNA sequence
gtctcatggccactcgggaa

SEQ ID NO: 701471 - DNA, 20 bp, Artificial
  CRISPR gRNA sequence
tctcatggccactcgggaaa

SEQ ID NO: 701472 - DNA, 20 bp, Artificial
  CRISPR gRNA sequence
ctcatggccactcgggaaag

SEQ ID NO: 701473 - DNA, 20 bp, Artificial
  CRISPR gRNA sequence
tcatggccactcgggaaagg

SEQ ID NO: 701474 - DNA, 20 bp, Artificial
  CRISPR gRNA sequence
gccactcgggaaagggggtt

SEQ ID NO: 701475 - DNA, 20 bp, Artificial
  CRISPR gRNA sequence
ctcgggaaagggggttcagt

SEQ ID NO: 701476 - DNA, 20 bp, Artificial
  CRISPR gRNA sequence
tcggtcccaacccctaacca

SEQ ID NO: 701477 - DNA, 20 bp, Artificial
  CRISPR gRNA sequence
aacccctaaccacagatgct

SEQ ID NO: 701478 - DNA, 20 bp, Artificial
  CRISPR gRNA sequence
ctaaccacagatgctgagat

SEQ ID NO: 701479 - DNA, 20 bp, Artificial
  CRISPR gRNA sequence
aaccacagatgctgagatca

SEQ ID NO: 701480 - DNA, 20 bp, Artificial
  CRISPR gRNA sequence
accacagatgctgagatcag

SEQ ID NO: 701481 - DNA, 20 bp, Artificial
  CRISPR gRNA sequence
ccacagatgctgagatcaga

SEQ ID NO: 701482 - DNA, 20 bp, Artificial
  CRISPR gRNA sequence
acagatgctgagatcagagg

SEQ ID NO: 701483 - DNA, 20 bp, Artificial
  CRISPR gRNA sequence
agatgctgagatcagaggga

SEQ ID NO: 701484 - DNA, 20 bp, Artificial
  CRISPR gRNA sequence
tcagagggagagtaattccc

SEQ ID NO: 701485 - DNA, 20 bp, Artificial
  CRISPR gRNA sequence
cagagggagagtaattcccc

SEQ ID NO: 701486 - DNA, 20 bp, Artificial
  CRISPR gRNA sequence
agagggagagtaattcccca

SEQ ID NO: 701487 - DNA, 20 bp, Artificial
  CRISPR gRNA sequence
ggagagtaattccccaggga

SEQ ID NO: 701488 - DNA, 20 bp, Artificial
  CRISPR gRNA sequence
agtaattccccagggaaaga

SEQ ID NO: 701489 - DNA, 20 bp, Artificial
  CRISPR gRNA sequence
gtaattccccagggaaagat

SEQ ID NO: 701490 - DNA, 20 bp, Artificial
  CRISPR gRNA sequence
agataggctgctttactctg

SEQ ID NO: 701491 - DNA, 20 bp, Artificial
  CRISPR gRNA sequence
gataggctgctttactctga

SEQ ID NO: 701492 - DNA, 20 bp, Artificial
  CRISPR gRNA sequence
ataggctgctttactctgaa

SEQ ID NO: 701493 - DNA, 20 bp, Artificial
  CRISPR gRNA sequence
taggctgctttactctgaag

SEQ ID NO: 701494 - DNA, 20 bp, Artificial
  CRISPR gRNA sequence
tgctttactctgaaggggaa

SEQ ID NO: 701495 - DNA, 20 bp, Artificial
  CRISPR gRNA sequence
gctttactctgaaggggaac

SEQ ID NO: 701496 - DNA, 20 bp, Artificial
  CRISPR gRNA sequence
ctctgaaggggaacgggtgc

SEQ ID NO: 701497 - DNA, 20 bp, Artificial
  CRISPR gRNA sequence
tctgaaggggaacgggtgcc

SEQ ID NO: 701498 - DNA, 20 bp, Artificial
  CRISPR gRNA sequence
gaaggggaacgggtgccagg

SEQ ID NO: 701499 - DNA, 20 bp, Artificial
  CRISPR gRNA sequence
aaggggaacgggtgccaggc

SEQ ID NO: 701500 - DNA, 20 bp, Artificial
  CRISPR gRNA sequence
tgccaggcgggtgccacctc

SEQ ID NO: 701501 - DNA, 20 bp, Artificial
  CRISPR gRNA sequence
agatgactgctgtgttttcc

SEQ ID NO: 701502 - DNA, 20 bp, Artificial
  CRISPR gRNA sequence
gatgactgctgtgttttcca

SEQ ID NO: 701503 - DNA, 20 bp, Artificial
  CRISPR gRNA sequence
atgactgctgtgttttccaa

SEQ ID NO: 701504 - DNA, 20 bp, Artificial
  CRISPR gRNA sequence
aagggccccatctccgactc

SEQ ID NO: 701505 - DNA, 20 bp, Artificial
  CRISPR gRNA sequence
ccatctccgactctggcctg

SEQ ID NO: 701506 - DNA, 20 bp, Artificial
  CRISPR gRNA sequence
tctccgactctggcctgtgg

SEQ ID NO: 701507 - DNA, 20 bp, Artificial
  CRISPR gRNA sequence
gactctggcctgtggtagtg

SEQ ID NO: 701508 - DNA, 20 bp, Artificial
  CRISPR gRNA sequence
actctggcctgtggtagtga

SEQ ID NO: 701509 - DNA, 20 bp, Artificial
  CRISPR gRNA sequence
ctctggcctgtggtagtgaa

SEQ ID NO: 701510 - DNA, 20 bp, Artificial
  CRISPR gRNA sequence
tggtagtgaagggtgtattc

SEQ ID NO: 701511 - DNA, 20 bp, Artificial
  CRISPR gRNA sequence
ggtagtgaagggtgtattcc

SEQ ID NO: 701512 - DNA, 20 bp, Artificial
  CRISPR gRNA sequence
tagtgaagggtgtattccgg

SEQ ID NO: 701513 - DNA, 20 bp, Artificial
  CRISPR gRNA sequence
gggtgtattccgggagactt

SEQ ID NO: 701514 - DNA, 20 bp, Artificial
  CRISPR gRNA sequence
ggtgtattccgggagacttt

SEQ ID NO: 701515 - DNA, 20 bp, Artificial
  CRISPR gRNA sequence
ggtccccaacactgattctg

SEQ ID NO: 701516 - DNA, 20 bp, Artificial
  CRISPR gRNA sequence
gtccccaacactgattctga

SEQ ID NO: 701517 - DNA, 20 bp, Artificial
  CRISPR gRNA sequence
aggcactgctgtcccccctg

SEQ ID NO: 701518 - DNA, 20 bp, Artificial
  CRISPR gRNA sequence
ggcactgctgtcccccctgc

SEQ ID NO: 701519 - DNA, 20 bp, Artificial
  CRISPR gRNA sequence
tgctgtcccccctgcaggca

SEQ ID NO: 701520 - DNA, 20 bp, Artificial
  CRISPR gRNA sequence
tcccccctgcaggcacggcg

SEQ ID NO: 701521 - DNA, 20 bp, Artificial
  CRISPR gRNA sequence
cccctgcaggcacggcgcag

SEQ ID NO: 701522 - DNA, 20 bp, Artificial
  CRISPR gRNA sequence
aggcacggcgcagaagaaca

SEQ ID NO: 701523 - DNA, 20 bp, Artificial
  CRISPR gRNA sequence
cgcagaagaacacggtctgt

SEQ ID NO: 701524 - DNA, 20 bp, Artificial
  CRISPR gRNA sequence
gaagaacacggtctgtgagc

SEQ ID NO: 701525 - DNA, 20 bp, Artificial
  CRISPR gRNA sequence
ggtctgtgagccggcttccc

SEQ ID NO: 701526 - DNA, 20 bp, Artificial
  CRISPR gRNA sequence
gtctgtgagccggcttcccc

SEQ ID NO: 701527 - DNA, 20 bp, Artificial
  CRISPR gRNA sequence
tctgtgagccggcttcccca

SEQ ID NO: 701528 - DNA, 20 bp, Artificial
  CRISPR gRNA sequence
ctgtgagccggcttccccag

SEQ ID NO: 701529 - DNA, 20 bp, Artificial
  CRISPR gRNA sequence
gagccggcttccccaggggt

SEQ ID NO: 701530 - DNA, 20 bp, Artificial
  CRISPR gRNA sequence
ggggtcagccctgcctgtgc

SEQ ID NO: 701531 - DNA, 20 bp, Artificial
  CRISPR gRNA sequence
cagccctgcctgtgccagcc

SEQ ID NO: 701532 - DNA, 20 bp, Artificial
  CRISPR gRNA sequence
gccctgcctgtgccagccca

SEQ ID NO: 701533 - DNA, 20 bp, Artificial
  CRISPR gRNA sequence
gtgccagcccagagaactgc

SEQ ID NO: 701534 - DNA, 20 bp, Artificial
  CRISPR gRNA sequence
tgccagcccagagaactgca

SEQ ID NO: 701535 - DNA, 20 bp, Artificial
  CRISPR gRNA sequence
gagaactgcaaggaaccctc

SEQ ID NO: 701536 - DNA, 20 bp, Artificial
  CRISPR gRNA sequence
agaactgcaaggaaccctcc

SEQ ID NO: 701537 - DNA, 20 bp, Artificial
  CRISPR gRNA sequence
gaaccctccaggtgactccc

SEQ ID NO: 701538 - DNA, 20 bp, Artificial
  CRISPR gRNA sequence
ttgcctcctcctcttccccc

SEQ ID NO: 701539 - DNA, 20 bp, Artificial
  CRISPR gRNA sequence
ctcctcctcttcccccaagc

SEQ ID NO: 701540 - DNA, 20 bp, Artificial
  CRISPR gRNA sequence
tcttcccccaagctggcttt

SEQ ID NO: 701541 - DNA, 20 bp, Artificial
  CRISPR gRNA sequence
ccccaagctggctttcagat

SEQ ID NO: 701542 - DNA, 20 bp, Artificial
  CRISPR gRNA sequence
cccaagctggctttcagatg

SEQ ID NO: 701543 - DNA, 20 bp, Artificial
  CRISPR gRNA sequence
gatgaggctgccccacccca

SEQ ID NO: 701544 - DNA, 20 bp, Artificial
  CRISPR gRNA sequence
atgaggctgccccaccccac

SEQ ID NO: 701545 - DNA, 20 bp, Artificial
  CRISPR gRNA sequence
cccaccccacaggacgccca

SEQ ID NO: 701546 - DNA, 20 bp, Artificial
  CRISPR gRNA sequence
caggacgcccatggtacaac

SEQ ID NO: 701547 - DNA, 20 bp, Artificial
  CRISPR gRNA sequence
aggacgcccatggtacaact

SEQ ID NO: 701548 - DNA, 20 bp, Artificial
  CRISPR gRNA sequence
cgcccatggtacaactgggc

SEQ ID NO: 701549 - DNA, 20 bp, Artificial
  CRISPR gRNA sequence
gcccatggtacaactgggct

SEQ ID NO: 701550 - DNA, 20 bp, Artificial
  CRISPR gRNA sequence
cccatggtacaactgggctg

SEQ ID NO: 701551 - DNA, 20 bp, Artificial
  CRISPR gRNA sequence
ccatggtacaactgggctgg

SEQ ID NO: 701552 - DNA, 20 bp, Artificial
  CRISPR gRNA sequence
tacaactgggctgggggtgt

SEQ ID NO: 701553 - DNA, 20 bp, Artificial
  CRISPR gRNA sequence
aactgggctgggggtgtaag

SEQ ID NO: 701554 - DNA, 20 bp, Artificial
  CRISPR gRNA sequence
actgggctgggggtgtaagc

SEQ ID NO: 701555 - DNA, 20 bp, Artificial
  CRISPR gRNA sequence
ctgggggtgtaagcgggatt

SEQ ID NO: 701556 - DNA, 20 bp, Artificial
  CRISPR gRNA sequence
tgtaagcgggattcagccca

SEQ ID NO: 701557 - DNA, 20 bp, Artificial
  CRISPR gRNA sequence
cgggattcagcccatggtgt

SEQ ID NO: 701558 - DNA, 20 bp, Artificial
  CRISPR gRNA sequence
agcccatggtgtcagcactt

SEQ ID NO: 701559 - DNA, 20 bp, Artificial
  CRISPR gRNA sequence
gcccatggtgtcagcacttt

SEQ ID NO: 701560 - DNA, 20 bp, Artificial
  CRISPR gRNA sequence
cccatggtgtcagcactttg

SEQ ID NO: 701561 - DNA, 20 bp, Artificial
  CRISPR gRNA sequence
ctttggggtgcctctctgcc

SEQ ID NO: 701562 - DNA, 20 bp, Artificial
  CRISPR gRNA sequence
tgcctctctgccaagcccct

SEQ ID NO: 701563 - DNA, 20 bp, Artificial
  CRISPR gRNA sequence
ccaagcccctcagatcattt

SEQ ID NO: 701564 - DNA, 20 bp, Artificial
  CRISPR gRNA sequence
caagcccctcagatcatttg

SEQ ID NO: 701565 - DNA, 20 bp, Artificial
  CRISPR gRNA sequence
cctcagatcatttgaggccc

SEQ ID NO: 701566 - DNA, 20 bp, Artificial
  CRISPR gRNA sequence
ctcagatcatttgaggccct

SEQ ID NO: 701567 - DNA, 20 bp, Artificial
  CRISPR gRNA sequence
tcagatcatttgaggcccta

SEQ ID NO: 701568 - DNA, 20 bp, Artificial
  CRISPR gRNA sequence
ttgaggccctagggtgtgcc

SEQ ID NO: 701569 - DNA, 20 bp, Artificial
  CRISPR gRNA sequence
ggtgtgcccagccctgccct

SEQ ID NO: 701570 - DNA, 20 bp, Artificial
  CRISPR gRNA sequence
ccagccctgccctgagcaca

SEQ ID NO: 701571 - DNA, 20 bp, Artificial
  CRISPR gRNA sequence
cagccctgccctgagcacat

SEQ ID NO: 701572 - DNA, 20 bp, Artificial
  CRISPR gRNA sequence
gccctgccctgagcacatgg

SEQ ID NO: 701573 - DNA, 20 bp, Artificial
  CRISPR gRNA sequence
ctgagcacatgggagaccca

SEQ ID NO: 701574 - DNA, 20 bp, Artificial
  CRISPR gRNA sequence
tgagcacatgggagacccac

SEQ ID NO: 701575 - DNA, 20 bp, Artificial
  CRISPR gRNA sequence
gagcacatgggagacccaca

SEQ ID NO: 701576 - DNA, 20 bp, Artificial
  CRISPR gRNA sequence
catgggagacccacagggct

SEQ ID NO: 701577 - DNA, 20 bp, Artificial
  CRISPR gRNA sequence
cccacagggcttagaaaaca

SEQ ID NO: 701578 - DNA, 20 bp, Artificial
  CRISPR gRNA sequence
ccacagggcttagaaaacac

SEQ ID NO: 701579 - DNA, 20 bp, Artificial
  CRISPR gRNA sequence
gaaaacacaggccttgctcc

SEQ ID NO: 701580 - DNA, 20 bp, Artificial
  CRISPR gRNA sequence
aaaacacaggccttgctccc

SEQ ID NO: 701581 - DNA, 20 bp, Artificial
  CRISPR gRNA sequence
aacacaggccttgctcccag

SEQ ID NO: 701582 - DNA, 20 bp, Artificial
  CRISPR gRNA sequence
gccttgctcccaggagctta

SEQ ID NO: 701583 - DNA, 20 bp, Artificial
  CRISPR gRNA sequence
ttgctcccaggagcttacag

SEQ ID NO: 701584 - DNA, 20 bp, Artificial
  CRISPR gRNA sequence
tgctcccaggagcttacagt

SEQ ID NO: 701585 - DNA, 20 bp, Artificial
  CRISPR gRNA sequence
ggagcttacagtgggcccgc

SEQ ID NO: 701586 - DNA, 20 bp, Artificial
  CRISPR gRNA sequence
agcttacagtgggcccgcca

SEQ ID NO: 701587 - DNA, 20 bp, Artificial
  CRISPR gRNA sequence
gcttacagtgggcccgccag

SEQ ID NO: 701588 - DNA, 20 bp, Artificial
  CRISPR gRNA sequence
tacagtgggcccgccagagg

SEQ ID NO: 701589 - DNA, 20 bp, Artificial
  CRISPR gRNA sequence
agtgggcccgccagaggcag

SEQ ID NO: 701590 - DNA, 20 bp, Artificial
  CRISPR gRNA sequence
gtgggcccgccagaggcagt

SEQ ID NO: 701591 - DNA, 20 bp, Artificial
  CRISPR gRNA sequence
cccgccagaggcagtgggcc

SEQ ID NO: 701592 - DNA, 20 bp, Artificial
  CRISPR gRNA sequence
ccgccagaggcagtgggcca

SEQ ID NO: 701593 - DNA, 20 bp, Artificial
  CRISPR gRNA sequence
cgccagaggcagtgggccaa

SEQ ID NO: 701594 - DNA, 20 bp, Artificial
  CRISPR gRNA sequence
gaggcagtgggccaagggcc

SEQ ID NO: 701595 - DNA, 20 bp, Artificial
  CRISPR gRNA sequence
aggcagtgggccaagggcct

SEQ ID NO: 701596 - DNA, 20 bp, Artificial
  CRISPR gRNA sequence
ggcctgggaccccatctctg

SEQ ID NO: 701597 - DNA, 20 bp, Artificial
  CRISPR gRNA sequence
ctgtggaaactgttactcgt

SEQ ID NO: 701598 - DNA, 20 bp, Artificial
  CRISPR gRNA sequence
gaaactgttactcgtgagca

SEQ ID NO: 701599 - DNA, 20 bp, Artificial
  CRISPR gRNA sequence
aaactgttactcgtgagcac

SEQ ID NO: 701600 - DNA, 20 bp, Artificial
  CRISPR gRNA sequence
acaggcctcccttgccccat

SEQ ID NO: 701601 - DNA, 20 bp, Artificial
  CRISPR gRNA sequence
ggcctcccttgccccattgg

SEQ ID NO: 701602 - DNA, 20 bp, Artificial
  CRISPR gRNA sequence
tgccccattggcagaattat

SEQ ID NO: 701603 - DNA, 20 bp, Artificial
  CRISPR gRNA sequence
agaattatcagtcccatctc

SEQ ID NO: 701604 - DNA, 20 bp, Artificial
  CRISPR gRNA sequence
cccatctctggcttcttccc

SEQ ID NO: 701605 - DNA, 20 bp, Artificial
  CRISPR gRNA sequence
atctctggcttcttccccag

SEQ ID NO: 701606 - DNA, 20 bp, Artificial
  CRISPR gRNA sequence
tccccagtggcaccatcccc

SEQ ID NO: 701607 - DNA, 20 bp, Artificial
  CRISPR gRNA sequence
ccccagtggcaccatccccc

SEQ ID NO: 701608 - DNA, 20 bp, Artificial
  CRISPR gRNA sequence
gtggcaccatcccccaggcc

SEQ ID NO: 701609 - DNA, 20 bp, Artificial
  CRISPR gRNA sequence
cccccaggccaagcccaccc

SEQ ID NO: 701610 - DNA, 20 bp, Artificial
  CRISPR gRNA sequence
caagcccaccccggtgtccc

SEQ ID NO: 701611 - DNA, 20 bp, Artificial
  CRISPR gRNA sequence
ccggtgtccccagcaacctc

SEQ ID NO: 701612 - DNA, 20 bp, Artificial
  CRISPR gRNA sequence
tccccagcaacctccagtgc

SEQ ID NO: 701613 - DNA, 20 bp, Artificial
  CRISPR gRNA sequence
agtgccagcaccatgcctgt

SEQ ID NO: 701614 - DNA, 20 bp, Artificial
  CRISPR gRNA sequence
tgccagcaccatgcctgtaa

SEQ ID NO: 701615 - DNA, 20 bp, Artificial
  CRISPR gRNA sequence
gccagcaccatgcctgtaag

SEQ ID NO: 701616 - DNA, 20 bp, Artificial
  CRISPR gRNA sequence
ccagcaccatgcctgtaaga

SEQ ID NO: 701617 - DNA, 20 bp, Artificial
  CRISPR gRNA sequence
cagcaccatgcctgtaagag

SEQ ID NO: 701618 - DNA, 20 bp, Artificial
  CRISPR gRNA sequence
agcaccatgcctgtaagagg

SEQ ID NO: 701619 - DNA, 20 bp, Artificial
  CRISPR gRNA sequence
gagggggcacccgcctcgcc

SEQ ID NO: 701620 - DNA, 20 bp, Artificial
  CRISPR gRNA sequence
agggggcacccgcctcgccc

SEQ ID NO: 701621 - DNA, 20 bp, Artificial
  CRISPR gRNA sequence
gggcacccgcctcgcccagg

SEQ ID NO: 701622 - DNA, 20 bp, Artificial
  CRISPR gRNA sequence
gaagctgcttctaaactgac

SEQ ID NO: 701623 - DNA, 20 bp, Artificial
  CRISPR gRNA sequence
aagctgcttctaaactgacg

SEQ ID NO: 701624 - DNA, 20 bp, Artificial
  CRISPR gRNA sequence
agctgcttctaaactgacga

SEQ ID NO: 701625 - DNA, 20 bp, Artificial
  CRISPR gRNA sequence
tcccgactctccctcctctg

SEQ ID NO: 701626 - DNA, 20 bp, Artificial
  CRISPR gRNA sequence
cccgactctccctcctctgt

SEQ ID NO: 701627 - DNA, 20 bp, Artificial
  CRISPR gRNA sequence
gactctccctcctctgtggg

SEQ ID NO: 701628 - DNA, 20 bp, Artificial
  CRISPR gRNA sequence
actctccctcctctgtggga

SEQ ID NO: 701629 - DNA, 20 bp, Artificial
  CRISPR gRNA sequence
ccctcctctgtgggaaggcc

SEQ ID NO: 701630 - DNA, 20 bp, Artificial
  CRISPR gRNA sequence
ctctgtgggaaggcctagtt

SEQ ID NO: 701631 - DNA, 20 bp, Artificial
  CRISPR gRNA sequence
gggaaggcctagttcagatc

SEQ ID NO: 701632 - DNA, 20 bp, Artificial
  CRISPR gRNA sequence
ggaaggcctagttcagatcc

SEQ ID NO: 701633 - DNA, 20 bp, Artificial
  CRISPR gRNA sequence
atccaggtaatttccccatg

SEQ ID NO: 701634 - DNA, 20 bp, Artificial
  CRISPR gRNA sequence
gtaatttccccatgaagctg

SEQ ID NO: 701635 - DNA, 20 bp, Artificial
  CRISPR gRNA sequence
taatttccccatgaagctgt

SEQ ID NO: 701636 - DNA, 20 bp, Artificial
  CRISPR gRNA sequence
gaagctgtgggtcgtctccc

SEQ ID NO: 701637 - DNA, 20 bp, Artificial
  CRISPR gRNA sequence
aagctgtgggtcgtctccct

SEQ ID NO: 701638 - DNA, 20 bp, Artificial
  CRISPR gRNA sequence
agctgtgggtcgtctccctg

SEQ ID NO: 701639 - DNA, 20 bp, Artificial
  CRISPR gRNA sequence
gtctccctggggtgctcgat

SEQ ID NO: 701640 - DNA, 20 bp, Artificial
  CRISPR gRNA sequence
tccctggggtgctcgattgg

SEQ ID NO: 701641 - DNA, 20 bp, Artificial
  CRISPR gRNA sequence
tggggtgctcgattggtgga

SEQ ID NO: 701642 - DNA, 20 bp, Artificial
  CRISPR gRNA sequence
tcgattggtggatggcccat

SEQ ID NO: 701643 - DNA, 20 bp, Artificial
  CRISPR gRNA sequence
attggtggatggcccatgag

SEQ ID NO: 701644 - DNA, 20 bp, Artificial
  CRISPR gRNA sequence
ttggtggatggcccatgagt

SEQ ID NO: 701645 - DNA, 20 bp, Artificial
  CRISPR gRNA sequence
tggtggatggcccatgagtg

SEQ ID NO: 701646 - DNA, 20 bp, Artificial
  CRISPR gRNA sequence
ggtggatggcccatgagtgg

SEQ ID NO: 701647 - DNA, 20 bp, Artificial
  CRISPR gRNA sequence
ggcccatgagtgggggtgtt

SEQ ID NO: 701648 - DNA, 20 bp, Artificial
  CRISPR gRNA sequence
cccatgagtgggggtgtttg

SEQ ID NO: 701649 - DNA, 20 bp, Artificial
  CRISPR gRNA sequence
atgagtgggggtgtttggag

SEQ ID NO: 701650 - DNA, 20 bp, Artificial
  CRISPR gRNA sequence
tgagtgggggtgtttggagc

SEQ ID NO: 701651 - DNA, 20 bp, Artificial
  CRISPR gRNA sequence
gtgggggtgtttggagcagg

SEQ ID NO: 701652 - DNA, 20 bp, Artificial
  CRISPR gRNA sequence
tgggggtgtttggagcaggc

SEQ ID NO: 701653 - DNA, 20 bp, Artificial
  CRISPR gRNA sequence
gggtgtttggagcaggcggg

SEQ ID NO: 701654 - DNA, 20 bp, Artificial
  CRISPR gRNA sequence
agcaggcgggcagtgatctg

SEQ ID NO: 701655 - DNA, 20 bp, Artificial
  CRISPR gRNA sequence
agtgatctgtggtcttttcc

SEQ ID NO: 701656 - DNA, 20 bp, Artificial
  CRISPR gRNA sequence
gatctgtggtcttttcctgg

SEQ ID NO: 701657 - DNA, 20 bp, Artificial
  CRISPR gRNA sequence
atctgtggtcttttcctggt

SEQ ID NO: 701658 - DNA, 20 bp, Artificial
  CRISPR gRNA sequence
tctgtggtcttttcctggtg

SEQ ID NO: 701659 - DNA, 20 bp, Artificial
  CRISPR gRNA sequence
tgtggtcttttcctggtggg

SEQ ID NO: 701660 - DNA, 20 bp, Artificial
  CRISPR gRNA sequence
tggtcttttcctggtgggga

SEQ ID NO: 701661 - DNA, 20 bp, Artificial
  CRISPR gRNA sequence
tcttttcctggtggggagag

SEQ ID NO: 701662 - DNA, 20 bp, Artificial
  CRISPR gRNA sequence
ttcctggtggggagagaaga

SEQ ID NO: 701663 - DNA, 20 bp, Artificial
  CRISPR gRNA sequence
ctggtggggagagaagacgg

SEQ ID NO: 701664 - DNA, 20 bp, Artificial
  CRISPR gRNA sequence
tggggagagaagacggtggt

SEQ ID NO: 701665 - DNA, 20 bp, Artificial
  CRISPR gRNA sequence
ggggagagaagacggtggta

SEQ ID NO: 701666 - DNA, 20 bp, Artificial
  CRISPR gRNA sequence
gacggtggtaaggtatgatc

SEQ ID NO: 701667 - DNA, 20 bp, Artificial
  CRISPR gRNA sequence
acggtggtaaggtatgatct

SEQ ID NO: 701668 - DNA, 20 bp, Artificial
  CRISPR gRNA sequence
cggtggtaaggtatgatcta

SEQ ID NO: 701669 - DNA, 20 bp, Artificial
  CRISPR gRNA sequence
aaggtatgatctagggctga

SEQ ID NO: 701670 - DNA, 20 bp, Artificial
  CRISPR gRNA sequence
gatctagggctgaaagcatt

SEQ ID NO: 701671 - DNA, 20 bp, Artificial
  CRISPR gRNA sequence
atctagggctgaaagcattg

SEQ ID NO: 701672 - DNA, 20 bp, Artificial
  CRISPR gRNA sequence
tctagggctgaaagcattga

SEQ ID NO: 701673 - DNA, 20 bp, Artificial
  CRISPR gRNA sequence
ctagggctgaaagcattgag

SEQ ID NO: 701674 - DNA, 20 bp, Artificial
  CRISPR gRNA sequence
gggctgaaagcattgagggg

SEQ ID NO: 701675 - DNA, 20 bp, Artificial
  CRISPR gRNA sequence
gctgaaagcattgaggggca

SEQ ID NO: 701676 - DNA, 20 bp, Artificial
  CRISPR gRNA sequence
ctgaaagcattgaggggcag

SEQ ID NO: 701677 - DNA, 20 bp, Artificial
  CRISPR gRNA sequence
aaagcattgaggggcagagg

SEQ ID NO: 701678 - DNA, 20 bp, Artificial
  CRISPR gRNA sequence
tgaggggcagaggtagacac

SEQ ID NO: 701679 - DNA, 20 bp, Artificial
  CRISPR gRNA sequence
aggggcagaggtagacacca

SEQ ID NO: 701680 - DNA, 20 bp, Artificial
  CRISPR gRNA sequence
ggggcagaggtagacaccag

SEQ ID NO: 701681 - DNA, 20 bp, Artificial
  CRISPR gRNA sequence
gggcagaggtagacaccaga

SEQ ID NO: 701682 - DNA, 20 bp, Artificial
  CRISPR gRNA sequence
cagagggctcattcatttgc

SEQ ID NO: 701683 - DNA, 20 bp, Artificial
  CRISPR gRNA sequence
agggctcattcatttgccag

SEQ ID NO: 701684 - DNA, 20 bp, Artificial
  CRISPR gRNA sequence
tcattcatttgccagcagtg

SEQ ID NO: 701685 - DNA, 20 bp, Artificial
  CRISPR gRNA sequence
attcatttgccagcagtgca

SEQ ID NO: 701686 - DNA, 20 bp, Artificial
  CRISPR gRNA sequence
ttcatttgccagcagtgcag

SEQ ID NO: 701687 - DNA, 20 bp, Artificial
  CRISPR gRNA sequence
tcatttgccagcagtgcaga

SEQ ID NO: 701688 - DNA, 20 bp, Artificial
  CRISPR gRNA sequence
gcagagggcctgccttgtgc

SEQ ID NO: 701689 - DNA, 20 bp, Artificial
  CRISPR gRNA sequence
ccctctatttccctctacgt

SEQ ID NO: 701690 - DNA, 20 bp, Artificial
  CRISPR gRNA sequence
ttccctctacgttggtttgt

SEQ ID NO: 701691 - DNA, 20 bp, Artificial
  CRISPR gRNA sequence
ccctctacgttggtttgtca

SEQ ID NO: 701692 - DNA, 20 bp, Artificial
  CRISPR gRNA sequence
cctctacgttggtttgtcag

SEQ ID NO: 701693 - DNA, 20 bp, Artificial
  CRISPR gRNA sequence
ctctacgttggtttgtcaga

SEQ ID NO: 701694 - DNA, 20 bp, Artificial
  CRISPR gRNA sequence
gttggtttgtcagagggaaa

SEQ ID NO: 701695 - DNA, 20 bp, Artificial
  CRISPR gRNA sequence
ttggtttgtcagagggaaat

SEQ ID NO: 701696 - DNA, 20 bp, Artificial
  CRISPR gRNA sequence
ctgttgtgacacttgcgact

SEQ ID NO: 701697 - DNA, 20 bp, Artificial
  CRISPR gRNA sequence
tgtgacacttgcgactcagc

SEQ ID NO: 701698 - DNA, 20 bp, Artificial
  CRISPR gRNA sequence
acacttgcgactcagctggc

SEQ ID NO: 701699 - DNA, 20 bp, Artificial
  CRISPR gRNA sequence
gtgtccatctgatgccctcc

SEQ ID NO: 701700 - DNA, 20 bp, Artificial
  CRISPR gRNA sequence
tgatgccctcctggtctcca

SEQ ID NO: 701701 - DNA, 20 bp, Artificial
  CRISPR gRNA sequence
ccctcctggtctccatggcg

SEQ ID NO: 701702 - DNA, 20 bp, Artificial
  CRISPR gRNA sequence
cctcctggtctccatggcga

SEQ ID NO: 701703 - DNA, 20 bp, Artificial
  CRISPR gRNA sequence
ctcctggtctccatggcgaa

SEQ ID NO: 701704 - DNA, 20 bp, Artificial
  CRISPR gRNA sequence
catggcgaagggtcgaccct

SEQ ID NO: 701705 - DNA, 20 bp, Artificial
  CRISPR gRNA sequence
tttttctttttctttttttt

SEQ ID NO: 701706 - DNA, 20 bp, Artificial
  CRISPR gRNA sequence
tctttttcttttttttgaga

SEQ ID NO: 701707 - DNA, 20 bp, Artificial
  CRISPR gRNA sequence
tttttcttttttttgagacg

SEQ ID NO: 701708 - DNA, 20 bp, Artificial
  CRISPR gRNA sequence
ggagtttcgctcatgttgcc

SEQ ID NO: 701709 - DNA, 20 bp, Artificial
  CRISPR gRNA sequence
gagtttcgctcatgttgccc

SEQ ID NO: 701710 - DNA, 20 bp, Artificial
  CRISPR gRNA sequence
ttcgctcatgttgcccaggc

SEQ ID NO: 701711 - DNA, 20 bp, Artificial
  CRISPR gRNA sequence
cgctcatgttgcccaggctg

SEQ ID NO: 701712 - DNA, 20 bp, Artificial
  CRISPR gRNA sequence
atgttgcccaggctggagtg

SEQ ID NO: 701713 - DNA, 20 bp, Artificial
  CRISPR gRNA sequence
ttgcccaggctggagtgcag

SEQ ID NO: 701714 - DNA, 20 bp, Artificial
  CRISPR gRNA sequence
ggagtgcagtggcgcaatct

SEQ ID NO: 701715 - DNA, 20 bp, Artificial
  CRISPR gRNA sequence
tcactgccacctccacctcc

SEQ ID NO: 701716 - DNA, 20 bp, Artificial
  CRISPR gRNA sequence
cactgccacctccacctcct

SEQ ID NO: 701717 - DNA, 20 bp, Artificial
  CRISPR gRNA sequence
cacctccacctcctgggttc

SEQ ID NO: 701718 - DNA, 20 bp, Artificial
  CRISPR gRNA sequence
ttcaagcgattctcctgcct

SEQ ID NO: 701719 - DNA, 20 bp, Artificial
  CRISPR gRNA sequence
ttctcctgcctcagcctcct

SEQ ID NO: 701720 - DNA, 20 bp, Artificial
  CRISPR gRNA sequence
tcctgcctcagcctcctgag

SEQ ID NO: 701721 - DNA, 20 bp, Artificial
  CRISPR gRNA sequence
gcctcagcctcctgagtagc

SEQ ID NO: 701722 - DNA, 20 bp, Artificial
  CRISPR gRNA sequence
cctcagcctcctgagtagct

SEQ ID NO: 701723 - DNA, 20 bp, Artificial
  CRISPR gRNA sequence
ctcctgagtagctgggatta

SEQ ID NO: 701724 - DNA, 20 bp, Artificial
  CRISPR gRNA sequence
tcctgagtagctgggattac

SEQ ID NO: 701725 - DNA, 20 bp, Artificial
  CRISPR gRNA sequence
caggtgcccaccaccacgcc

SEQ ID NO: 701726 - DNA, 20 bp, Artificial
  CRISPR gRNA sequence
cctggctaactttgtatttt

SEQ ID NO: 701727 - DNA, 20 bp, Artificial
  CRISPR gRNA sequence
ggctaactttgtatttttag

SEQ ID NO: 701728 - DNA, 20 bp, Artificial
  CRISPR gRNA sequence
ctaactttgtatttttagta

SEQ ID NO: 701729 - DNA, 20 bp, Artificial
  CRISPR gRNA sequence
ctttgtatttttagtagaga

SEQ ID NO: 701730 - DNA, 20 bp, Artificial
  CRISPR gRNA sequence
tttgtatttttagtagagat

SEQ ID NO: 701731 - DNA, 20 bp, Artificial
  CRISPR gRNA sequence
gagatgggatttcaccatgt

SEQ ID NO: 701732 - DNA, 20 bp, Artificial
  CRISPR gRNA sequence
tgggatttcaccatgttggt

SEQ ID NO: 701733 - DNA, 20 bp, Artificial
  CRISPR gRNA sequence
gggatttcaccatgttggtc

SEQ ID NO: 701734 - DNA, 20 bp, Artificial
  CRISPR gRNA sequence
tttcaccatgttggtcaggc

SEQ ID NO: 701735 - DNA, 20 bp, Artificial
  CRISPR gRNA sequence
tggtctcgaactcccgacct

SEQ ID NO: 701736 - DNA, 20 bp, Artificial
  CRISPR gRNA sequence
ggtctcgaactcccgacctc

SEQ ID NO: 701737 - DNA, 20 bp, Artificial
  CRISPR gRNA sequence
ctcaggtgatccgcccacct

SEQ ID NO: 701738 - DNA, 20 bp, Artificial
  CRISPR gRNA sequence
ccgcccacctcggcctccca

SEQ ID NO: 701739 - DNA, 20 bp, Artificial
  CRISPR gRNA sequence
acctcggcctcccaaagtgc

SEQ ID NO: 701740 - DNA, 20 bp, Artificial
  CRISPR gRNA sequence
cctcggcctcccaaagtgct

SEQ ID NO: 701741 - DNA, 20 bp, Artificial
  CRISPR gRNA sequence
tcggcctcccaaagtgctgg

SEQ ID NO: 701742 - DNA, 20 bp, Artificial
  CRISPR gRNA sequence
cggcctcccaaagtgctggg

SEQ ID NO: 701743 - DNA, 20 bp, Artificial
  CRISPR gRNA sequence
ccaaagtgctgggaggatta

SEQ ID NO: 701744 - DNA, 20 bp, Artificial
  CRISPR gRNA sequence
caaagtgctgggaggattac

SEQ ID NO: 701745 - DNA, 20 bp, Artificial
  CRISPR gRNA sequence
gctgggaggattacaggcgt

SEQ ID NO: 701746 - DNA, 20 bp, Artificial
  CRISPR gRNA sequence
gtgagccaccgcgcccaacc

SEQ ID NO: 701747 - DNA, 20 bp, Artificial
  CRISPR gRNA sequence
agtcccattttattactgaa

SEQ ID NO: 701748 - DNA, 20 bp, Artificial
  CRISPR gRNA sequence
tattactgaatagccctcca

SEQ ID NO: 701749 - DNA, 20 bp, Artificial
  CRISPR gRNA sequence
ctgaatagccctccatggcg

SEQ ID NO: 701750 - DNA, 20 bp, Artificial
  CRISPR gRNA sequence
ctccatggcgtagatatgcc

SEQ ID NO: 701751 - DNA, 20 bp, Artificial
  CRISPR gRNA sequence
tatgccgagctctgtttatc

SEQ ID NO: 701752 - DNA, 20 bp, Artificial
  CRISPR gRNA sequence
ttatccagtttttgaatatt

SEQ ID NO: 701753 - DNA, 20 bp, Artificial
  CRISPR gRNA sequence
tatccagtttttgaatattt

SEQ ID NO: 701754 - DNA, 20 bp, Artificial
  CRISPR gRNA sequence
tctgccttttgactataatg

SEQ ID NO: 701755 - DNA, 20 bp, Artificial
  CRISPR gRNA sequence
ccttttgactataatgaaga

SEQ ID NO: 701756 - DNA, 20 bp, Artificial
  CRISPR gRNA sequence
gtatgtgctttcctttctct

SEQ ID NO: 701757 - DNA, 20 bp, Artificial
  CRISPR gRNA sequence
tatgtgctttcctttctctt

SEQ ID NO: 701758 - DNA, 20 bp, Artificial
  CRISPR gRNA sequence
tgctttcctttctcttgggt

SEQ ID NO: 701759 - DNA, 20 bp, Artificial
  CRISPR gRNA sequence
ggttggttttgtaaaaaaaa

SEQ ID NO: 701760 - DNA, 20 bp, Artificial
  CRISPR gRNA sequence
ttgtaaaaaaaatggatttg

SEQ ID NO: 701761 - DNA, 20 bp, Artificial
  CRISPR gRNA sequence
tgtaaaaaaaatggatttgt

SEQ ID NO: 701762 - DNA, 20 bp, Artificial
  CRISPR gRNA sequence
tgtgggacttctaacaattt

SEQ ID NO: 701763 - DNA, 20 bp, Artificial
  CRISPR gRNA sequence
gtgggacttctaacaatttt

SEQ ID NO: 701764 - DNA, 20 bp, Artificial
  CRISPR gRNA sequence
gacttctaacaattttgggt

SEQ ID NO: 701765 - DNA, 20 bp, Artificial
  CRISPR gRNA sequence
cttctaacaattttgggttg

SEQ ID NO: 701766 - DNA, 20 bp, Artificial
  CRISPR gRNA sequence
gggttggagctcttttccta

SEQ ID NO: 701767 - DNA, 20 bp, Artificial
  CRISPR gRNA sequence
ttgtaccttctcccgctcca

SEQ ID NO: 701768 - DNA, 20 bp, Artificial
  CRISPR gRNA sequence
gtcttttgtttgtttgtttg

SEQ ID NO: 701769 - DNA, 20 bp, Artificial
  CRISPR gRNA sequence
tgtttgtggtttgttttttt

SEQ ID NO: 701770 - DNA, 20 bp, Artificial
  CRISPR gRNA sequence
gtttgtggtttgtttttttg

SEQ ID NO: 701771 - DNA, 20 bp, Artificial
  CRISPR gRNA sequence
gtggtttgtttttttgaggt

SEQ ID NO: 701772 - DNA, 20 bp, Artificial
  CRISPR gRNA sequence
gtgagtcttgctctgtcgcc

SEQ ID NO: 701773 - DNA, 20 bp, Artificial
  CRISPR gRNA sequence
tcttgctctgtcgcccagac

SEQ ID NO: 701774 - DNA, 20 bp, Artificial
  CRISPR gRNA sequence
ttgctctgtcgcccagactg

SEQ ID NO: 701775 - DNA, 20 bp, Artificial
  CRISPR gRNA sequence
ctgtcgcccagactggagtg

SEQ ID NO: 701776 - DNA, 20 bp, Artificial
  CRISPR gRNA sequence
tcgcccagactggagtgcag

SEQ ID NO: 701777 - DNA, 20 bp, Artificial
  CRISPR gRNA sequence
ggagtgcagtggcgtgatct

SEQ ID NO: 701778 - DNA, 20 bp, Artificial
  CRISPR gRNA sequence
tcactgcaacctccgcctcc

SEQ ID NO: 701779 - DNA, 20 bp, Artificial
  CRISPR gRNA sequence
cactgcaacctccgcctcct

SEQ ID NO: 701780 - DNA, 20 bp, Artificial
  CRISPR gRNA sequence
aacctccgcctcctgggttc

SEQ ID NO: 701781 - DNA, 20 bp, Artificial
  CRISPR gRNA sequence
ttcaagcaattctcctgcct

SEQ ID NO: 701782 - DNA, 20 bp, Artificial
  CRISPR gRNA sequence
ttctcctgcctcagcctccc

SEQ ID NO: 701783 - DNA, 20 bp, Artificial
  CRISPR gRNA sequence
tcctgcctcagcctcccgag

SEQ ID NO: 701784 - DNA, 20 bp, Artificial
  CRISPR gRNA sequence
gcctcagcctcccgagtagc

SEQ ID NO: 701785 - DNA, 20 bp, Artificial
  CRISPR gRNA sequence
cctcagcctcccgagtagct

SEQ ID NO: 701786 - DNA, 20 bp, Artificial
  CRISPR gRNA sequence
ctcccgagtagctgggatta

SEQ ID NO: 701787 - DNA, 20 bp, Artificial
  CRISPR gRNA sequence
tcccgagtagctgggattac

SEQ ID NO: 701788 - DNA, 20 bp, Artificial
  CRISPR gRNA sequence
caggcgcctgccaccacatt

SEQ ID NO: 701789 - DNA, 20 bp, Artificial
  CRISPR gRNA sequence
ttggctacttttcttttttt

SEQ ID NO: 701790 - DNA, 20 bp, Artificial
  CRISPR gRNA sequence
gctacttttcttttttttag

SEQ ID NO: 701791 - DNA, 20 bp, Artificial
  CRISPR gRNA sequence
tacttttcttttttttagta

SEQ ID NO: 701792 - DNA, 20 bp, Artificial
  CRISPR gRNA sequence
tttcttttttttagtagaga

SEQ ID NO: 701793 - DNA, 20 bp, Artificial
  CRISPR gRNA sequence
ttcttttttttagtagagac

SEQ ID NO: 701794 - DNA, 20 bp, Artificial
  CRISPR gRNA sequence
tcttttttttagtagagacg

SEQ ID NO: 701795 - DNA, 20 bp, Artificial
  CRISPR gRNA sequence
gagacggggtttcaccatgt

SEQ ID NO: 701796 - DNA, 20 bp, Artificial
  CRISPR gRNA sequence
cggggtttcaccatgttggc

SEQ ID NO: 701797 - DNA, 20 bp, Artificial
  CRISPR gRNA sequence
ggggtttcaccatgttggcc

SEQ ID NO: 701798 - DNA, 20 bp, Artificial
  CRISPR gRNA sequence
tttcaccatgttggccaggc

SEQ ID NO: 701799 - DNA, 20 bp, Artificial
  CRISPR gRNA sequence
ccaggctggtcacaaactcc

SEQ ID NO: 701800 - DNA, 20 bp, Artificial
  CRISPR gRNA sequence
ggtcacaaactcctggcctc

SEQ ID NO: 701801 - DNA, 20 bp, Artificial
  CRISPR gRNA sequence
ctcaagtaatccacccgcct

SEQ ID NO: 701802 - DNA, 20 bp, Artificial
  CRISPR gRNA sequence
ccacccgcctcagcctccca

SEQ ID NO: 701803 - DNA, 20 bp, Artificial
  CRISPR gRNA sequence
gcctcagcctcccaaagtgc

SEQ ID NO: 701804 - DNA, 20 bp, Artificial
  CRISPR gRNA sequence
cctcagcctcccaaagtgct

SEQ ID NO: 701805 - DNA, 20 bp, Artificial
  CRISPR gRNA sequence
ctcccaaagtgctgggatta

SEQ ID NO: 701806 - DNA, 20 bp, Artificial
  CRISPR gRNA sequence
agtgctgggattacagacgt

SEQ ID NO: 701807 - DNA, 20 bp, Artificial
  CRISPR gRNA sequence
cagacgtgagccaccgcgcc

SEQ ID NO: 701808 - DNA, 20 bp, Artificial
  CRISPR gRNA sequence
ccaccgcgcccggcccacac

SEQ ID NO: 701809 - DNA, 20 bp, Artificial
  CRISPR gRNA sequence
cggcccacaccagtctttaa

SEQ ID NO: 701810 - DNA, 20 bp, Artificial
  CRISPR gRNA sequence
gcccacaccagtctttaaaa

SEQ ID NO: 701811 - DNA, 20 bp, Artificial
  CRISPR gRNA sequence
cccacaccagtctttaaaag

SEQ ID NO: 701812 - DNA, 20 bp, Artificial
  CRISPR gRNA sequence
ccacaccagtctttaaaaga

SEQ ID NO: 701813 - DNA, 20 bp, Artificial
  CRISPR gRNA sequence
acaccagtctttaaaagagg

SEQ ID NO: 701814 - DNA, 20 bp, Artificial
  CRISPR gRNA sequence
caccagtctttaaaagaggg

SEQ ID NO: 701815 - DNA, 20 bp, Artificial
  CRISPR gRNA sequence
cagtctttaaaagagggagg

SEQ ID NO: 701816 - DNA, 20 bp, Artificial
  CRISPR gRNA sequence
agtctttaaaagagggaggc

SEQ ID NO: 701817 - DNA, 20 bp, Artificial
  CRISPR gRNA sequence
tctttaaaagagggaggcag

SEQ ID NO: 701818 - DNA, 20 bp, Artificial
  CRISPR gRNA sequence
ctttaaaagagggaggcagg

SEQ ID NO: 701819 - DNA, 20 bp, Artificial
  CRISPR gRNA sequence
agagggaggcaggaggcacc

SEQ ID NO: 701820 - DNA, 20 bp, Artificial
  CRISPR gRNA sequence
ctgcccaataccattctgaa

SEQ ID NO: 701821 - DNA, 20 bp, Artificial
  CRISPR gRNA sequence
tgcccaataccattctgaac

SEQ ID NO: 701822 - DNA, 20 bp, Artificial
  CRISPR gRNA sequence
cccaataccattctgaacag

SEQ ID NO: 701823 - DNA, 20 bp, Artificial
  CRISPR gRNA sequence
attctgaacaggagttacgc

SEQ ID NO: 701824 - DNA, 20 bp, Artificial
  CRISPR gRNA sequence
aggagttacgctagtgtgct

SEQ ID NO: 701825 - DNA, 20 bp, Artificial
  CRISPR gRNA sequence
acgctagtgtgctgagctct

SEQ ID NO: 701826 - DNA, 20 bp, Artificial
  CRISPR gRNA sequence
cgctagtgtgctgagctctc

SEQ ID NO: 701827 - DNA, 20 bp, Artificial
  CRISPR gRNA sequence
gctagtgtgctgagctctca

SEQ ID NO: 701828 - DNA, 20 bp, Artificial
  CRISPR gRNA sequence
agtgtgctgagctctcaggg

SEQ ID NO: 701829 - DNA, 20 bp, Artificial
  CRISPR gRNA sequence
tctcagggaagctgttccca

SEQ ID NO: 701830 - DNA, 20 bp, Artificial
  CRISPR gRNA sequence
gaagctgttcccaaagtttt

SEQ ID NO: 701831 - DNA, 20 bp, Artificial
  CRISPR gRNA sequence
gctgttcccaaagttttgag

SEQ ID NO: 701832 - DNA, 20 bp, Artificial
  CRISPR gRNA sequence
ctgttcccaaagttttgagc

SEQ ID NO: 701833 - DNA, 20 bp, Artificial
  CRISPR gRNA sequence
tgttcccaaagttttgagca

SEQ ID NO: 701834 - DNA, 20 bp, Artificial
  CRISPR gRNA sequence
gttcccaaagttttgagcag

SEQ ID NO: 701835 - DNA, 20 bp, Artificial
  CRISPR gRNA sequence
tcccaaagttttgagcaggg

SEQ ID NO: 701836 - DNA, 20 bp, Artificial
  CRISPR gRNA sequence
agttttgagcaggggagtga

SEQ ID NO: 701837 - DNA, 20 bp, Artificial
  CRISPR gRNA sequence
ttttgagcaggggagtgaca

SEQ ID NO: 701838 - DNA, 20 bp, Artificial
  CRISPR gRNA sequence
caggggagtgacagagccat

SEQ ID NO: 701839 - DNA, 20 bp, Artificial
  CRISPR gRNA sequence
ggagtgacagagccatgaga

SEQ ID NO: 701840 - DNA, 20 bp, Artificial
  CRISPR gRNA sequence
gagtgacagagccatgagac

SEQ ID NO: 701841 - DNA, 20 bp, Artificial
  CRISPR gRNA sequence
agtgacagagccatgagaca

SEQ ID NO: 701842 - DNA, 20 bp, Artificial
  CRISPR gRNA sequence
acagagccatgagacagggt

SEQ ID NO: 701843 - DNA, 20 bp, Artificial
  CRISPR gRNA sequence
cagagccatgagacagggtt

SEQ ID NO: 701844 - DNA, 20 bp, Artificial
  CRISPR gRNA sequence
agagccatgagacagggttg

SEQ ID NO: 701845 - DNA, 20 bp, Artificial
  CRISPR gRNA sequence
gagccatgagacagggttgg

SEQ ID NO: 701846 - DNA, 20 bp, Artificial
  CRISPR gRNA sequence
ccatgagacagggttggggg

SEQ ID NO: 701847 - DNA, 20 bp, Artificial
  CRISPR gRNA sequence
gacagggttgggggaagctg

SEQ ID NO: 701848 - DNA, 20 bp, Artificial
  CRISPR gRNA sequence
ggttgggggaagctgtggca

SEQ ID NO: 701849 - DNA, 20 bp, Artificial
  CRISPR gRNA sequence
tgggggaagctgtggcatgg

SEQ ID NO: 701850 - DNA, 20 bp, Artificial
  CRISPR gRNA sequence
aagctgtggcatggtggcct

SEQ ID NO: 701851 - DNA, 20 bp, Artificial
  CRISPR gRNA sequence
agctgtggcatggtggcctc

SEQ ID NO: 701852 - DNA, 20 bp, Artificial
  CRISPR gRNA sequence
ctgtggcatggtggcctcag

SEQ ID NO: 701853 - DNA, 20 bp, Artificial
  CRISPR gRNA sequence
tgtggcatggtggcctcagg

SEQ ID NO: 701854 - DNA, 20 bp, Artificial
  CRISPR gRNA sequence
catggtggcctcaggaggaa

SEQ ID NO: 701855 - DNA, 20 bp, Artificial
  CRISPR gRNA sequence
ggtggcctcaggaggaacag

SEQ ID NO: 701856 - DNA, 20 bp, Artificial
  CRISPR gRNA sequence
gtggcctcaggaggaacagt

SEQ ID NO: 701857 - DNA, 20 bp, Artificial
  CRISPR gRNA sequence
gcctcaggaggaacagtggg

SEQ ID NO: 701858 - DNA, 20 bp, Artificial
  CRISPR gRNA sequence
cctcaggaggaacagtgggc

SEQ ID NO: 701859 - DNA, 20 bp, Artificial
  CRISPR gRNA sequence
ctcaggaggaacagtgggca

SEQ ID NO: 701860 - DNA, 20 bp, Artificial
  CRISPR gRNA sequence
tcaggaggaacagtgggcag

SEQ ID NO: 701861 - DNA, 20 bp, Artificial
  CRISPR gRNA sequence
gaggaacagtgggcaggggc

SEQ ID NO: 701862 - DNA, 20 bp, Artificial
  CRISPR gRNA sequence
aacagtgggcaggggctggt

SEQ ID NO: 701863 - DNA, 20 bp, Artificial
  CRISPR gRNA sequence
acagtgggcaggggctggtt

SEQ ID NO: 701864 - DNA, 20 bp, Artificial
  CRISPR gRNA sequence
cagtgggcaggggctggttg

SEQ ID NO: 701865 - DNA, 20 bp, Artificial
  CRISPR gRNA sequence
agtgggcaggggctggttgg

SEQ ID NO: 701866 - DNA, 20 bp, Artificial
  CRISPR gRNA sequence
gtgggcaggggctggttggg

SEQ ID NO: 701867 - DNA, 20 bp, Artificial
  CRISPR gRNA sequence
ggggctggttggggggcaat

SEQ ID NO: 701868 - DNA, 20 bp, Artificial
  CRISPR gRNA sequence
atgagtaccctcctctcgtg

SEQ ID NO: 701869 - DNA, 20 bp, Artificial
  CRISPR gRNA sequence
cctctcgtgtggaatgcacg

SEQ ID NO: 701870 - DNA, 20 bp, Artificial
  CRISPR gRNA sequence
gcagcattcctgtcctctct

SEQ ID NO: 701871 - DNA, 20 bp, Artificial
  CRISPR gRNA sequence
ttcctgtcctctctgagcct

SEQ ID NO: 701872 - DNA, 20 bp, Artificial
  CRISPR gRNA sequence
tcctgtcctctctgagcctc

SEQ ID NO: 701873 - DNA, 20 bp, Artificial
  CRISPR gRNA sequence
agcctcaggactccctctga

SEQ ID NO: 701874 - DNA, 20 bp, Artificial
  CRISPR gRNA sequence
gcctcaggactccctctgaa

SEQ ID NO: 701875 - DNA, 20 bp, Artificial
  CRISPR gRNA sequence
caggactccctctgaaaggc

SEQ ID NO: 701876 - DNA, 20 bp, Artificial
  CRISPR gRNA sequence
tccctctgaaaggctggact

SEQ ID NO: 701877 - DNA, 20 bp, Artificial
  CRISPR gRNA sequence
ggctggactgagctgacatg

SEQ ID NO: 701878 - DNA, 20 bp, Artificial
  CRISPR gRNA sequence
ctggactgagctgacatgcg

SEQ ID NO: 701879 - DNA, 20 bp, Artificial
  CRISPR gRNA sequence
ctgagctgacatgcggagtt

SEQ ID NO: 701880 - DNA, 20 bp, Artificial
  CRISPR gRNA sequence
tgagctgacatgcggagttt

SEQ ID NO: 701881 - DNA, 20 bp, Artificial
  CRISPR gRNA sequence
agctgacatgcggagtttgg

SEQ ID NO: 701882 - DNA, 20 bp, Artificial
  CRISPR gRNA sequence
gacatgcggagtttgggagc

SEQ ID NO: 701883 - DNA, 20 bp, Artificial
  CRISPR gRNA sequence
cggagtttgggagctggcca

SEQ ID NO: 701884 - DNA, 20 bp, Artificial
  CRISPR gRNA sequence
gtttgggagctggccacggt

SEQ ID NO: 701885 - DNA, 20 bp, Artificial
  CRISPR gRNA sequence
tttgggagctggccacggtg

SEQ ID NO: 701886 - DNA, 20 bp, Artificial
  CRISPR gRNA sequence
ttgggagctggccacggtga

SEQ ID NO: 701887 - DNA, 20 bp, Artificial
  CRISPR gRNA sequence
gagctggccacggtgaggga

SEQ ID NO: 701888 - DNA, 20 bp, Artificial
  CRISPR gRNA sequence
agctggccacggtgagggat

SEQ ID NO: 701889 - DNA, 20 bp, Artificial
  CRISPR gRNA sequence
gctggccacggtgagggatg

SEQ ID NO: 701890 - DNA, 20 bp, Artificial
  CRISPR gRNA sequence
ctggccacggtgagggatgg

SEQ ID NO: 701891 - DNA, 20 bp, Artificial
  CRISPR gRNA sequence
tggccacggtgagggatggg

SEQ ID NO: 701892 - DNA, 20 bp, Artificial
  CRISPR gRNA sequence
cggtgagggatggggggctt

SEQ ID NO: 701893 - DNA, 20 bp, Artificial
  CRISPR gRNA sequence
ggtgagggatggggggcttc

SEQ ID NO: 701894 - DNA, 20 bp, Artificial
  CRISPR gRNA sequence
gtgagggatggggggcttca

SEQ ID NO: 701895 - DNA, 20 bp, Artificial
  CRISPR gRNA sequence
gggatggggggcttcagggt

SEQ ID NO: 701896 - DNA, 20 bp, Artificial
  CRISPR gRNA sequence
ggatggggggcttcagggtt

SEQ ID NO: 701897 - DNA, 20 bp, Artificial
  CRISPR gRNA sequence
tggggggcttcagggttggg

SEQ ID NO: 701898 - DNA, 20 bp, Artificial
  CRISPR gRNA sequence
ggggggcttcagggttgggt

SEQ ID NO: 701899 - DNA, 20 bp, Artificial
  CRISPR gRNA sequence
gggggcttcagggttgggtg

SEQ ID NO: 701900 - DNA, 20 bp, Artificial
  CRISPR gRNA sequence
gggcttcagggttgggtggg

SEQ ID NO: 701901 - DNA, 20 bp, Artificial
  CRISPR gRNA sequence
ttcagggttgggtggggagt

SEQ ID NO: 701902 - DNA, 20 bp, Artificial
  CRISPR gRNA sequence
tcagggttgggtggggagtg

SEQ ID NO: 701903 - DNA, 20 bp, Artificial
  CRISPR gRNA sequence
tggggagtgaggcctttgcc

SEQ ID NO: 701904 - DNA, 20 bp, Artificial
  CRISPR gRNA sequence
ggggagtgaggcctttgcca

SEQ ID NO: 701905 - DNA, 20 bp, Artificial
  CRISPR gRNA sequence
gagtgaggcctttgccaagg

SEQ ID NO: 701906 - DNA, 20 bp, Artificial
  CRISPR gRNA sequence
aggcctttgccaaggcggcc

SEQ ID NO: 701907 - DNA, 20 bp, Artificial
  CRISPR gRNA sequence
tgccaaggcggcctggcctg

SEQ ID NO: 701908 - DNA, 20 bp, Artificial
  CRISPR gRNA sequence
agcttctctgcttctttccc

SEQ ID NO: 701909 - DNA, 20 bp, Artificial
  CRISPR gRNA sequence
gcttctctgcttctttcccc

SEQ ID NO: 701910 - DNA, 20 bp, Artificial
  CRISPR gRNA sequence
ccccaggtctgtccccaaca

SEQ ID NO: 701911 - DNA, 20 bp, Artificial
  CRISPR gRNA sequence
gtccccaacacagccatgcc

SEQ ID NO: 701912 - DNA, 20 bp, Artificial
  CRISPR gRNA sequence
ccccaacacagccatgccca

SEQ ID NO: 701913 - DNA, 20 bp, Artificial
  CRISPR gRNA sequence
cccaacacagccatgcccag

SEQ ID NO: 701914 - DNA, 20 bp, Artificial
  CRISPR gRNA sequence
ccaacacagccatgcccaga

SEQ ID NO: 701915 - DNA, 20 bp, Artificial
  CRISPR gRNA sequence
caacacagccatgcccagag

SEQ ID NO: 701916 - DNA, 20 bp, Artificial
  CRISPR gRNA sequence
cagccatgcccagaggggtc

SEQ ID NO: 701917 - DNA, 20 bp, Artificial
  CRISPR gRNA sequence
ccagaggggtctggtgattg

SEQ ID NO: 701918 - DNA, 20 bp, Artificial
  CRISPR gRNA sequence
aggggtctggtgattgcaga

SEQ ID NO: 701919 - DNA, 20 bp, Artificial
  CRISPR gRNA sequence
ggtctggtgattgcagaaag

SEQ ID NO: 701920 - DNA, 20 bp, Artificial
  CRISPR gRNA sequence
gtgattgcagaaagcagtgt

SEQ ID NO: 701921 - DNA, 20 bp, Artificial
  CRISPR gRNA sequence
gtgtgagcccgactactacc

SEQ ID NO: 701922 - DNA, 20 bp, Artificial
  CRISPR gRNA sequence
agcccgactactacctggac

SEQ ID NO: 701923 - DNA, 20 bp, Artificial
  CRISPR gRNA sequence
gcccgactactacctggacg

SEQ ID NO: 701924 - DNA, 20 bp, Artificial
  CRISPR gRNA sequence
gactactacctggacgaggc

SEQ ID NO: 701925 - DNA, 20 bp, Artificial
  CRISPR gRNA sequence
ggacgaggccggccgctgca

SEQ ID NO: 701926 - DNA, 20 bp, Artificial
  CRISPR gRNA sequence
ggccgctgcacggcctgcgt

SEQ ID NO: 701927 - DNA, 20 bp, Artificial
  CRISPR gRNA sequence
ggcctgcgtgagctgttctc

SEQ ID NO: 701928 - DNA, 20 bp, Artificial
  CRISPR gRNA sequence
gcctgcgtgagctgttctcg

SEQ ID NO: 701929 - DNA, 20 bp, Artificial
  CRISPR gRNA sequence
gcgtgagctgttctcgaggt

SEQ ID NO: 701930 - DNA, 20 bp, Artificial
  CRISPR gRNA sequence
cgtgagctgttctcgaggta

SEQ ID NO: 701931 - DNA, 20 bp, Artificial
  CRISPR gRNA sequence
gtgagctgttctcgaggtaa

SEQ ID NO: 701932 - DNA, 20 bp, Artificial
  CRISPR gRNA sequence
gtaagggcctcgtccctccc

SEQ ID NO: 701933 - DNA, 20 bp, Artificial
  CRISPR gRNA sequence
taagggcctcgtccctcccc

SEQ ID NO: 701934 - DNA, 20 bp, Artificial
  CRISPR gRNA sequence
cctcgtccctccccgggcct

SEQ ID NO: 701935 - DNA, 20 bp, Artificial
  CRISPR gRNA sequence
atttttgaaccgtgaacttc

SEQ ID NO: 701936 - DNA, 20 bp, Artificial
  CRISPR gRNA sequence
actactcccccttatgtttg

SEQ ID NO: 701937 - DNA, 20 bp, Artificial
  CRISPR gRNA sequence
ctactcccccttatgtttgt

SEQ ID NO: 701938 - DNA, 20 bp, Artificial
  CRISPR gRNA sequence
ttatgtttgtgggtttttga

SEQ ID NO: 701939 - DNA, 20 bp, Artificial
  CRISPR gRNA sequence
tatgtttgtgggtttttgat

SEQ ID NO: 701940 - DNA, 20 bp, Artificial
  CRISPR gRNA sequence
atgtttgtgggtttttgatg

SEQ ID NO: 701941 - DNA, 20 bp, Artificial
  CRISPR gRNA sequence
tgtttgtgggtttttgatgg

SEQ ID NO: 701942 - DNA, 20 bp, Artificial
  CRISPR gRNA sequence
tgatgggggtcgcctctttt

SEQ ID NO: 701943 - DNA, 20 bp, Artificial
  CRISPR gRNA sequence
atgggggtcgcctcttttca

SEQ ID NO: 701944 - DNA, 20 bp, Artificial
  CRISPR gRNA sequence
tgggggtcgcctcttttcag

SEQ ID NO: 701945 - DNA, 20 bp, Artificial
  CRISPR gRNA sequence
gggggtcgcctcttttcaga

SEQ ID NO: 701946 - DNA, 20 bp, Artificial
  CRISPR gRNA sequence
tcttttcagagggcttccat

SEQ ID NO: 701947 - DNA, 20 bp, Artificial
  CRISPR gRNA sequence
attggcatattatttccttc

SEQ ID NO: 701948 - DNA, 20 bp, Artificial
  CRISPR gRNA sequence
ttggcatattatttccttcc

SEQ ID NO: 701949 - DNA, 20 bp, Artificial
  CRISPR gRNA sequence
gcatattatttccttccagg

SEQ ID NO: 701950 - DNA, 20 bp, Artificial
  CRISPR gRNA sequence
tcacccacctgttccaaact

SEQ ID NO: 701951 - DNA, 20 bp, Artificial
  CRISPR gRNA sequence
ttgtaactactctgtgattc

SEQ ID NO: 701952 - DNA, 20 bp, Artificial
  CRISPR gRNA sequence
ttgtgatcattcccctttta

SEQ ID NO: 701953 - DNA, 20 bp, Artificial
  CRISPR gRNA sequence
gtgatcattccccttttaca

SEQ ID NO: 701954 - DNA, 20 bp, Artificial
  CRISPR gRNA sequence
tgatcattccccttttacag

SEQ ID NO: 701955 - DNA, 20 bp, Artificial
  CRISPR gRNA sequence
atcattccccttttacagag

SEQ ID NO: 701956 - DNA, 20 bp, Artificial
  CRISPR gRNA sequence
tcattccccttttacagagg

SEQ ID NO: 701957 - DNA, 20 bp, Artificial
  CRISPR gRNA sequence
cccttttacagaggaggaaa

SEQ ID NO: 701958 - DNA, 20 bp, Artificial
  CRISPR gRNA sequence
cttttacagaggaggaaacg

SEQ ID NO: 701959 - DNA, 20 bp, Artificial
  CRISPR gRNA sequence
ttttacagaggaggaaacgg

SEQ ID NO: 701960 - DNA, 20 bp, Artificial
  CRISPR gRNA sequence
agaggaggaaacggaggctt

SEQ ID NO: 701961 - DNA, 20 bp, Artificial
  CRISPR gRNA sequence
gaggaggaaacggaggcttt

SEQ ID NO: 701962 - DNA, 20 bp, Artificial
  CRISPR gRNA sequence
gaggaaacggaggctttggg

SEQ ID NO: 701963 - DNA, 20 bp, Artificial
  CRISPR gRNA sequence
aaacggaggctttgggaagt

SEQ ID NO: 701964 - DNA, 20 bp, Artificial
  CRISPR gRNA sequence
aacggaggctttgggaagtc

SEQ ID NO: 701965 - DNA, 20 bp, Artificial
  CRISPR gRNA sequence
acggaggctttgggaagtca

SEQ ID NO: 701966 - DNA, 20 bp, Artificial
  CRISPR gRNA sequence
tgggaagtcagggaacttcc

SEQ ID NO: 701967 - DNA, 20 bp, Artificial
  CRISPR gRNA sequence
gggaagtcagggaacttcca

SEQ ID NO: 701968 - DNA, 20 bp, Artificial
  CRISPR gRNA sequence
ggaagtcagggaacttccaa

SEQ ID NO: 701969 - DNA, 20 bp, Artificial
  CRISPR gRNA sequence
cagggaacttccaagggctg

SEQ ID NO: 701970 - DNA, 20 bp, Artificial
  CRISPR gRNA sequence
agggaacttccaagggctgt

SEQ ID NO: 701971 - DNA, 20 bp, Artificial
  CRISPR gRNA sequence
aacttccaagggctgtgggc

SEQ ID NO: 701972 - DNA, 20 bp, Artificial
  CRISPR gRNA sequence
cttccaagggctgtgggctg

SEQ ID NO: 701973 - DNA, 20 bp, Artificial
  CRISPR gRNA sequence
tgtgggctggagtttgaacc

SEQ ID NO: 701974 - DNA, 20 bp, Artificial
  CRISPR gRNA sequence
ggctggagtttgaacccaga

SEQ ID NO: 701975 - DNA, 20 bp, Artificial
  CRISPR gRNA sequence
gctggagtttgaacccagac

SEQ ID NO: 701976 - DNA, 20 bp, Artificial
  CRISPR gRNA sequence
tgaacccagacaggtgccac

SEQ ID NO: 701977 - DNA, 20 bp, Artificial
  CRISPR gRNA sequence
gaacccagacaggtgccacc

SEQ ID NO: 701978 - DNA, 20 bp, Artificial
  CRISPR gRNA sequence
agacaggtgccaccaggttc

SEQ ID NO: 701979 - DNA, 20 bp, Artificial
  CRISPR gRNA sequence
gacaggtgccaccaggttcc

SEQ ID NO: 701980 - DNA, 20 bp, Artificial
  CRISPR gRNA sequence
actccactcgctgcccctat

SEQ ID NO: 701981 - DNA, 20 bp, Artificial
  CRISPR gRNA sequence
tattctttttttttttttcc

SEQ ID NO: 701982 - DNA, 20 bp, Artificial
  CRISPR gRNA sequence
ctttttttttttttcccaga

SEQ ID NO: 701983 - DNA, 20 bp, Artificial
  CRISPR gRNA sequence
tttttttttttttcccagac

SEQ ID NO: 701984 - DNA, 20 bp, Artificial
  CRISPR gRNA sequence
ttttttttttttcccagaca

SEQ ID NO: 701985 - DNA, 20 bp, Artificial
  CRISPR gRNA sequence
agggtctcactccttcaccc

SEQ ID NO: 701986 - DNA, 20 bp, Artificial
  CRISPR gRNA sequence
tcactccttcacccaagctg

SEQ ID NO: 701987 - DNA, 20 bp, Artificial
  CRISPR gRNA sequence
ccttcacccaagctgcagta

SEQ ID NO: 701988 - DNA, 20 bp, Artificial
  CRISPR gRNA sequence
tcacccaagctgcagtacgg

SEQ ID NO: 701989 - DNA, 20 bp, Artificial
  CRISPR gRNA sequence
cccaagctgcagtacggtgg

SEQ ID NO: 701990 - DNA, 20 bp, Artificial
  CRISPR gRNA sequence
ccaagctgcagtacggtggt

SEQ ID NO: 701991 - DNA, 20 bp, Artificial
  CRISPR gRNA sequence
gcagtacggtggtgggatca

SEQ ID NO: 701992 - DNA, 20 bp, Artificial
  CRISPR gRNA sequence
ggtgggatcatagctccctg

SEQ ID NO: 701993 - DNA, 20 bp, Artificial
  CRISPR gRNA sequence
tccctgcagctgtgacctcc

SEQ ID NO: 701994 - DNA, 20 bp, Artificial
  CRISPR gRNA sequence
ccctgcagctgtgacctccc

SEQ ID NO: 701995 - DNA, 20 bp, Artificial
  CRISPR gRNA sequence
atcacatgatccttttgcct

SEQ ID NO: 701996 - DNA, 20 bp, Artificial
  CRISPR gRNA sequence
tccttttgcctcagcctttc

SEQ ID NO: 701997 - DNA, 20 bp, Artificial
  CRISPR gRNA sequence
ttttgcctcagcctttcaag

SEQ ID NO: 701998 - DNA, 20 bp, Artificial
  CRISPR gRNA sequence
gcctcagcctttcaagtggc

SEQ ID NO: 701999 - DNA, 20 bp, Artificial
  CRISPR gRNA sequence
cctcagcctttcaagtggct

SEQ ID NO: 702000 - DNA, 20 bp, Artificial
  CRISPR gRNA sequence
ctttcaagtggctgggacta

SEQ ID NO: 702001 - DNA, 20 bp, Artificial
  CRISPR gRNA sequence
tttcaagtggctgggactat

SEQ ID NO: 702002 - DNA, 20 bp, Artificial
  CRISPR gRNA sequence
taggtgcacactaccatgcc

SEQ ID NO: 702003 - DNA, 20 bp, Artificial
  CRISPR gRNA sequence
aaaaaaaattttttttcata

SEQ ID NO: 702004 - DNA, 20 bp, Artificial
  CRISPR gRNA sequence
aaaattttttttcatacaga

SEQ ID NO: 702005 - DNA, 20 bp, Artificial
  CRISPR gRNA sequence
aaattttttttcatacagat

SEQ ID NO: 702006 - DNA, 20 bp, Artificial
  CRISPR gRNA sequence
aattttttttcatacagatg

SEQ ID NO: 702007 - DNA, 20 bp, Artificial
  CRISPR gRNA sequence
attttttttcatacagatgg

SEQ ID NO: 702008 - DNA, 20 bp, Artificial
  CRISPR gRNA sequence
gggggtctcactatgttgcc

SEQ ID NO: 702009 - DNA, 20 bp, Artificial
  CRISPR gRNA sequence
ggggtctcactatgttgccc

SEQ ID NO: 702010 - DNA, 20 bp, Artificial
  CRISPR gRNA sequence
ccaggctgctctcgaactcc

SEQ ID NO: 702011 - DNA, 20 bp, Artificial
  CRISPR gRNA sequence
ctcgaactcctggactcaaa

SEQ ID NO: 702012 - DNA, 20 bp, Artificial
  CRISPR gRNA sequence
ctcaaatggtcctcccacct

SEQ ID NO: 702013 - DNA, 20 bp, Artificial
  CRISPR gRNA sequence
accttggcttcctaaattgc

SEQ ID NO: 702014 - DNA, 20 bp, Artificial
  CRISPR gRNA sequence
ccttggcttcctaaattgct

SEQ ID NO: 702015 - DNA, 20 bp, Artificial
  CRISPR gRNA sequence
ttcctaaattgctgggatta

SEQ ID NO: 702016 - DNA, 20 bp, Artificial
  CRISPR gRNA sequence
tcctaaattgctgggattat

SEQ ID NO: 702017 - DNA, 20 bp, Artificial
  CRISPR gRNA sequence
attgctgggattataggcat

SEQ ID NO: 702018 - DNA, 20 bp, Artificial
  CRISPR gRNA sequence
taggcatgagccaccatgcc

SEQ ID NO: 702019 - DNA, 20 bp, Artificial
  CRISPR gRNA sequence
agccaccatgcccggcctgc

SEQ ID NO: 702020 - DNA, 20 bp, Artificial
  CRISPR gRNA sequence
ggcctgcgagctgttttgac

SEQ ID NO: 702021 - DNA, 20 bp, Artificial
  CRISPR gRNA sequence
tgttttgacaagcacttact

SEQ ID NO: 702022 - DNA, 20 bp, Artificial
  CRISPR gRNA sequence
acaagcacttactgagtgca

SEQ ID NO: 702023 - DNA, 20 bp, Artificial
  CRISPR gRNA sequence
acttactgagtgcacagaca

SEQ ID NO: 702024 - DNA, 20 bp, Artificial
  CRISPR gRNA sequence
tgcacagacacagcacgatg

SEQ ID NO: 702025 - DNA, 20 bp, Artificial
  CRISPR gRNA sequence
gcacagacacagcacgatgc

SEQ ID NO: 702026 - DNA, 20 bp, Artificial
  CRISPR gRNA sequence
gacacagcacgatgcaggtg

SEQ ID NO: 702027 - DNA, 20 bp, Artificial
  CRISPR gRNA sequence
acacagcacgatgcaggtgt

SEQ ID NO: 702028 - DNA, 20 bp, Artificial
  CRISPR gRNA sequence
cacagcacgatgcaggtgtg

SEQ ID NO: 702029 - DNA, 20 bp, Artificial
  CRISPR gRNA sequence
gtgtggggcttccctgtgcc

SEQ ID NO: 702030 - DNA, 20 bp, Artificial
  CRISPR gRNA sequence
cccagcccatcacaacctcc

SEQ ID NO: 702031 - DNA, 20 bp, Artificial
  CRISPR gRNA sequence
ccatcacaacctcccagcgc

SEQ ID NO: 702032 - DNA, 20 bp, Artificial
  CRISPR gRNA sequence
tcacaacctcccagcgccag

SEQ ID NO: 702033 - DNA, 20 bp, Artificial
  CRISPR gRNA sequence
cccagcgccagcagcacccc

SEQ ID NO: 702034 - DNA, 20 bp, Artificial
  CRISPR gRNA sequence
ccagcgccagcagcaccccg

SEQ ID NO: 702035 - DNA, 20 bp, Artificial
  CRISPR gRNA sequence
cagcgccagcagcaccccga

SEQ ID NO: 702036 - DNA, 20 bp, Artificial
  CRISPR gRNA sequence
agcgccagcagcaccccgag

SEQ ID NO: 702037 - DNA, 20 bp, Artificial
  CRISPR gRNA sequence
gcagcaccccgaggggcatg

SEQ ID NO: 702038 - DNA, 20 bp, Artificial
  CRISPR gRNA sequence
cagcaccccgaggggcatgt

SEQ ID NO: 702039 - DNA, 20 bp, Artificial
  CRISPR gRNA sequence
caccccgaggggcatgtggg

SEQ ID NO: 702040 - DNA, 20 bp, Artificial
  CRISPR gRNA sequence
accccgaggggcatgtgggc

SEQ ID NO: 702041 - DNA, 20 bp, Artificial
  CRISPR gRNA sequence
ccccgaggggcatgtgggca

SEQ ID NO: 702042 - DNA, 20 bp, Artificial
  CRISPR gRNA sequence
cccgaggggcatgtgggcag

SEQ ID NO: 702043 - DNA, 20 bp, Artificial
  CRISPR gRNA sequence
ccgaggggcatgtgggcagg

SEQ ID NO: 702044 - DNA, 20 bp, Artificial
  CRISPR gRNA sequence
tgtgggcagggggtgttgct

SEQ ID NO: 702045 - DNA, 20 bp, Artificial
  CRISPR gRNA sequence
gtgggcagggggtgttgctc

SEQ ID NO: 702046 - DNA, 20 bp, Artificial
  CRISPR gRNA sequence
agggggtgttgctcaggcca

SEQ ID NO: 702047 - DNA, 20 bp, Artificial
  CRISPR gRNA sequence
gggggtgttgctcaggccac

SEQ ID NO: 702048 - DNA, 20 bp, Artificial
  CRISPR gRNA sequence
ccacaggctgctgtgactgt

SEQ ID NO: 702049 - DNA, 20 bp, Artificial
  CRISPR gRNA sequence
acaggctgctgtgactgtta

SEQ ID NO: 702050 - DNA, 20 bp, Artificial
  CRISPR gRNA sequence
caggctgctgtgactgttag

SEQ ID NO: 702051 - DNA, 20 bp, Artificial
  CRISPR gRNA sequence
gctgtgactgttagaggccc

SEQ ID NO: 702052 - DNA, 20 bp, Artificial
  CRISPR gRNA sequence
ttagaggccctggctattca

SEQ ID NO: 702053 - DNA, 20 bp, Artificial
  CRISPR gRNA sequence
agaggccctggctattcacg

SEQ ID NO: 702054 - DNA, 20 bp, Artificial
  CRISPR gRNA sequence
gaggccctggctattcacgg

SEQ ID NO: 702055 - DNA, 20 bp, Artificial
  CRISPR gRNA sequence
tggctattcacggaggccac

SEQ ID NO: 702056 - DNA, 20 bp, Artificial
  CRISPR gRNA sequence
ggctattcacggaggccact

SEQ ID NO: 702057 - DNA, 20 bp, Artificial
  CRISPR gRNA sequence
tgtgtgtctgtctccttgtc

SEQ ID NO: 702058 - DNA, 20 bp, Artificial
  CRISPR gRNA sequence
tgtgtctgtctccttgtcca

SEQ ID NO: 702059 - DNA, 20 bp, Artificial
  CRISPR gRNA sequence
tccttgtccagagctgcttt

SEQ ID NO: 702060 - DNA, 20 bp, Artificial
  CRISPR gRNA sequence
ccttgtccagagctgctttt

SEQ ID NO: 702061 - DNA, 20 bp, Artificial
  CRISPR gRNA sequence
tgtccagagctgcttttggg

SEQ ID NO: 702062 - DNA, 20 bp, Artificial
  CRISPR gRNA sequence
agagctgcttttgggcagca

SEQ ID NO: 702063 - DNA, 20 bp, Artificial
  CRISPR gRNA sequence
gctgcttttgggcagcaaag

SEQ ID NO: 702064 - DNA, 20 bp, Artificial
  CRISPR gRNA sequence
tgcttttgggcagcaaagca

SEQ ID NO: 702065 - DNA, 20 bp, Artificial
  CRISPR gRNA sequence
ttgggcagcaaagcagagtg

SEQ ID NO: 702066 - DNA, 20 bp, Artificial
  CRISPR gRNA sequence
tgggcagcaaagcagagtga

SEQ ID NO: 702067 - DNA, 20 bp, Artificial
  CRISPR gRNA sequence
gggcagcaaagcagagtgaa

SEQ ID NO: 702068 - DNA, 20 bp, Artificial
  CRISPR gRNA sequence
agcaaagcagagtgaagggt

SEQ ID NO: 702069 - DNA, 20 bp, Artificial
  CRISPR gRNA sequence
gcaaagcagagtgaagggtc

SEQ ID NO: 702070 - DNA, 20 bp, Artificial
  CRISPR gRNA sequence
caaagcagagtgaagggtca

SEQ ID NO: 702071 - DNA, 20 bp, Artificial
  CRISPR gRNA sequence
aaagcagagtgaagggtcag

SEQ ID NO: 702072 - DNA, 20 bp, Artificial
  CRISPR gRNA sequence
agcagagtgaagggtcaggg

SEQ ID NO: 702073 - DNA, 20 bp, Artificial
  CRISPR gRNA sequence
gcagagtgaagggtcagggg

SEQ ID NO: 702074 - DNA, 20 bp, Artificial
  CRISPR gRNA sequence
aagggtcaggggaggccaaa

SEQ ID NO: 702075 - DNA, 20 bp, Artificial
  CRISPR gRNA sequence
ggggaggccaaaaagaacca

SEQ ID NO: 702076 - DNA, 20 bp, Artificial
  CRISPR gRNA sequence
cagacactgtttgttgtcat

SEQ ID NO: 702077 - DNA, 20 bp, Artificial
  CRISPR gRNA sequence
gacactgtttgttgtcattg

SEQ ID NO: 702078 - DNA, 20 bp, Artificial
  CRISPR gRNA sequence
acactgtttgttgtcattgg

SEQ ID NO: 702079 - DNA, 20 bp, Artificial
  CRISPR gRNA sequence
gtcattggaggtctctgtcc

SEQ ID NO: 702080 - DNA, 20 bp, Artificial
  CRISPR gRNA sequence
aggtctctgtcctagttact

SEQ ID NO: 702081 - DNA, 20 bp, Artificial
  CRISPR gRNA sequence
ggtctctgtcctagttacta

SEQ ID NO: 702082 - DNA, 20 bp, Artificial
  CRISPR gRNA sequence
tcctagttactaaggctgca

SEQ ID NO: 702083 - DNA, 20 bp, Artificial
  CRISPR gRNA sequence
caaatcattctttgtactca

SEQ ID NO: 702084 - DNA, 20 bp, Artificial
  CRISPR gRNA sequence
tttgtactcacagattctgt

SEQ ID NO: 702085 - DNA, 20 bp, Artificial
  CRISPR gRNA sequence
tactcacagattctgtgagt

SEQ ID NO: 702086 - DNA, 20 bp, Artificial
  CRISPR gRNA sequence
agattctgtgagtcagaatt

SEQ ID NO: 702087 - DNA, 20 bp, Artificial
  CRISPR gRNA sequence
tctgtgagtcagaattcaga

SEQ ID NO: 702088 - DNA, 20 bp, Artificial
  CRISPR gRNA sequence
ctgtgagtcagaattcagac

SEQ ID NO: 702089 - DNA, 20 bp, Artificial
  CRISPR gRNA sequence
tgtgagtcagaattcagaca

SEQ ID NO: 702090 - DNA, 20 bp, Artificial
  CRISPR gRNA sequence
agaattcagacagggcactg

SEQ ID NO: 702091 - DNA, 20 bp, Artificial
  CRISPR gRNA sequence
gaattcagacagggcactgc

SEQ ID NO: 702092 - DNA, 20 bp, Artificial
  CRISPR gRNA sequence
aattcagacagggcactgcg

SEQ ID NO: 702093 - DNA, 20 bp, Artificial
  CRISPR gRNA sequence
cagacagggcactgcgggga

SEQ ID NO: 702094 - DNA, 20 bp, Artificial
  CRISPR gRNA sequence
gtctctgctccacaatgtct

SEQ ID NO: 702095 - DNA, 20 bp, Artificial
  CRISPR gRNA sequence
tctctgctccacaatgtctg

SEQ ID NO: 702096 - DNA, 20 bp, Artificial
  CRISPR gRNA sequence
ctccacaatgtctgaggtct

SEQ ID NO: 702097 - DNA, 20 bp, Artificial
  CRISPR gRNA sequence
acaatgtctgaggtcttagc

SEQ ID NO: 702098 - DNA, 20 bp, Artificial
  CRISPR gRNA sequence
tgtctgaggtcttagctgga

SEQ ID NO: 702099 - DNA, 20 bp, Artificial
  CRISPR gRNA sequence
gtcttagctggaaagcccaa

SEQ ID NO: 702100 - DNA, 20 bp, Artificial
  CRISPR gRNA sequence
gctggaaagcccaaaagctg

SEQ ID NO: 702101 - DNA, 20 bp, Artificial
  CRISPR gRNA sequence
aaagcccaaaagctgcagat

SEQ ID NO: 702102 - DNA, 20 bp, Artificial
  CRISPR gRNA sequence
aagcccaaaagctgcagatc

SEQ ID NO: 702103 - DNA, 20 bp, Artificial
  CRISPR gRNA sequence
ctgcagatcaggaacttctg

SEQ ID NO: 702104 - DNA, 20 bp, Artificial
  CRISPR gRNA sequence
cttcattcattcacctgcct

SEQ ID NO: 702105 - DNA, 20 bp, Artificial
  CRISPR gRNA sequence
ttcattcattcacctgcctt

SEQ ID NO: 702106 - DNA, 20 bp, Artificial
  CRISPR gRNA sequence
tcattcattcacctgccttg

SEQ ID NO: 702107 - DNA, 20 bp, Artificial
  CRISPR gRNA sequence
acctgccttggggttgatgt

SEQ ID NO: 702108 - DNA, 20 bp, Artificial
  CRISPR gRNA sequence
ttggggttgatgttggctcc

SEQ ID NO: 702109 - DNA, 20 bp, Artificial
  CRISPR gRNA sequence
ttgatgttggctcctggctg

SEQ ID NO: 702110 - DNA, 20 bp, Artificial
  CRISPR gRNA sequence
ttggctcctggctgcagcct

SEQ ID NO: 702111 - DNA, 20 bp, Artificial
  CRISPR gRNA sequence
gccttggttcccttccatgt

SEQ ID NO: 702112 - DNA, 20 bp, Artificial
  CRISPR gRNA sequence
cggcctcttcgtgtcttacc

SEQ ID NO: 702113 - DNA, 20 bp, Artificial
  CRISPR gRNA sequence
ggcctcttcgtgtcttacct

SEQ ID NO: 702114 - DNA, 20 bp, Artificial
  CRISPR gRNA sequence
gcctcttcgtgtcttacctg

SEQ ID NO: 702115 - DNA, 20 bp, Artificial
  CRISPR gRNA sequence
tcttacctggggcttcctca

SEQ ID NO: 702116 - DNA, 20 bp, Artificial
  CRISPR gRNA sequence
cctggggcttcctcatggtc

SEQ ID NO: 702117 - DNA, 20 bp, Artificial
  CRISPR gRNA sequence
ggggcttcctcatggtctgg

SEQ ID NO: 702118 - DNA, 20 bp, Artificial
  CRISPR gRNA sequence
cttcctcatggtctggtggt

SEQ ID NO: 702119 - DNA, 20 bp, Artificial
  CRISPR gRNA sequence
ttcctcatggtctggtggtt

SEQ ID NO: 702120 - DNA, 20 bp, Artificial
  CRISPR gRNA sequence
ggtctggtggttaggttcta

SEQ ID NO: 702121 - DNA, 20 bp, Artificial
  CRISPR gRNA sequence
gtctggtggttaggttctaa

SEQ ID NO: 702122 - DNA, 20 bp, Artificial
  CRISPR gRNA sequence
gtggttaggttctaaaggcg

SEQ ID NO: 702123 - DNA, 20 bp, Artificial
  CRISPR gRNA sequence
tttttctttttttgtatttt

SEQ ID NO: 702124 - DNA, 20 bp, Artificial
  CRISPR gRNA sequence
ttctttttttgtatttttag

SEQ ID NO: 702125 - DNA, 20 bp, Artificial
  CRISPR gRNA sequence
ctttttttgtatttttagta

SEQ ID NO: 702126 - DNA, 20 bp, Artificial
  CRISPR gRNA sequence
ttttgtatttttagtagaga

SEQ ID NO: 702127 - DNA, 20 bp, Artificial
  CRISPR gRNA sequence
tttgtatttttagtagagac

SEQ ID NO: 702128 - DNA, 20 bp, Artificial
  CRISPR gRNA sequence
ttgtatttttagtagagacg

SEQ ID NO: 702129 - DNA, 20 bp, Artificial
  CRISPR gRNA sequence
gagacggggtttcaccatgt

SEQ ID NO: 702130 - DNA, 20 bp, Artificial
  CRISPR gRNA sequence
cggggtttcaccatgttggc

SEQ ID NO: 702131 - DNA, 20 bp, Artificial
  CRISPR gRNA sequence
ggggtttcaccatgttggcc

SEQ ID NO: 702132 - DNA, 20 bp, Artificial
  CRISPR gRNA sequence
tttcaccatgttggccaggc

SEQ ID NO: 702133 - DNA, 20 bp, Artificial
  CRISPR gRNA sequence
ccaggctggtcccaaactcc

SEQ ID NO: 702134 - DNA, 20 bp, Artificial
  CRISPR gRNA sequence
ggtcccaaactcctggcctc

SEQ ID NO: 702135 - DNA, 20 bp, Artificial
  CRISPR gRNA sequence
cctggcctcaagtgatccgc

SEQ ID NO: 702136 - DNA, 20 bp, Artificial
  CRISPR gRNA sequence
ctcaagtgatccgccggcct

SEQ ID NO: 702137 - DNA, 20 bp, Artificial
  CRISPR gRNA sequence
ccgccggccttggcctccca

SEQ ID NO: 702138 - DNA, 20 bp, Artificial
  CRISPR gRNA sequence
gccttggcctcccaaagtgt

SEQ ID NO: 702139 - DNA, 20 bp, Artificial
  CRISPR gRNA sequence
tcccaaagtgttggaattac

SEQ ID NO: 702140 - DNA, 20 bp, Artificial
  CRISPR gRNA sequence
agtgttggaattacaagcat

SEQ ID NO: 702141 - DNA, 20 bp, Artificial
  CRISPR gRNA sequence
caagcatgagccattgcccc

SEQ ID NO: 702142 - DNA, 20 bp, Artificial
  CRISPR gRNA sequence
gccattgcccccggccataa

SEQ ID NO: 702143 - DNA, 20 bp, Artificial
  CRISPR gRNA sequence
cccccggccataaaagtctt

SEQ ID NO: 702144 - DNA, 20 bp, Artificial
  CRISPR gRNA sequence
cccggccataaaagtcttga

SEQ ID NO: 702145 - DNA, 20 bp, Artificial
  CRISPR gRNA sequence
cggccataaaagtcttgaga

SEQ ID NO: 702146 - DNA, 20 bp, Artificial
  CRISPR gRNA sequence
gccataaaagtcttgagaga

SEQ ID NO: 702147 - DNA, 20 bp, Artificial
  CRISPR gRNA sequence
cataaaagtcttgagagaga

SEQ ID NO: 702148 - DNA, 20 bp, Artificial
  CRISPR gRNA sequence
aaagtcttgagagagagaga

SEQ ID NO: 702149 - DNA, 20 bp, Artificial
  CRISPR gRNA sequence
tcttgagagagagagacaga

SEQ ID NO: 702150 - DNA, 20 bp, Artificial
  CRISPR gRNA sequence
gagagagagagacagacaga

SEQ ID NO: 702151 - DNA, 20 bp, Artificial
  CRISPR gRNA sequence
gagagagagacagacagaaa

SEQ ID NO: 702152 - DNA, 20 bp, Artificial
  CRISPR gRNA sequence
gagagagacagacagaaaga

SEQ ID NO: 702153 - DNA, 20 bp, Artificial
  CRISPR gRNA sequence
gagagacagacagaaagaga

SEQ ID NO: 702154 - DNA, 20 bp, Artificial
  CRISPR gRNA sequence
gacagacagaaagagagagt

SEQ ID NO: 702155 - DNA, 20 bp, Artificial
  CRISPR gRNA sequence
cagacagaaagagagagtga

SEQ ID NO: 702156 - DNA, 20 bp, Artificial
  CRISPR gRNA sequence
gacagaaagagagagtgaga

SEQ ID NO: 702157 - DNA, 20 bp, Artificial
  CRISPR gRNA sequence
cagaaagagagagtgagaga

SEQ ID NO: 702158 - DNA, 20 bp, Artificial
  CRISPR gRNA sequence
aagagagagtgagagagaga

SEQ ID NO: 702159 - DNA, 20 bp, Artificial
  CRISPR gRNA sequence
gagagtgagagagagacaga

SEQ ID NO: 702160 - DNA, 20 bp, Artificial
  CRISPR gRNA sequence
gagtgagagagagacagaaa

SEQ ID NO: 702161 - DNA, 20 bp, Artificial
  CRISPR gRNA sequence
agtgagagagagacagaaag

SEQ ID NO: 702162 - DNA, 20 bp, Artificial
  CRISPR gRNA sequence
gtgagagagagacagaaaga

SEQ ID NO: 702163 - DNA, 20 bp, Artificial
  CRISPR gRNA sequence
gagagagagacagaaagagg

SEQ ID NO: 702164 - DNA, 20 bp, Artificial
  CRISPR gRNA sequence
gagagagacagaaagaggga

SEQ ID NO: 702165 - DNA, 20 bp, Artificial
  CRISPR gRNA sequence
gagacagaaagagggagaga

SEQ ID NO: 702166 - DNA, 20 bp, Artificial
  CRISPR gRNA sequence
gacagaaagagggagagaaa

SEQ ID NO: 702167 - DNA, 20 bp, Artificial
  CRISPR gRNA sequence
gaaagagggagagaaagagt

SEQ ID NO: 702168 - DNA, 20 bp, Artificial
  CRISPR gRNA sequence
aagagggagagaaagagtga

SEQ ID NO: 702169 - DNA, 20 bp, Artificial
  CRISPR gRNA sequence
gagggagagaaagagtgaga

SEQ ID NO: 702170 - DNA, 20 bp, Artificial
  CRISPR gRNA sequence
gggagagaaagagtgagaga

SEQ ID NO: 702171 - DNA, 20 bp, Artificial
  CRISPR gRNA sequence
gagaaagagtgagagagaga

SEQ ID NO: 702172 - DNA, 20 bp, Artificial
  CRISPR gRNA sequence
gaaagagtgagagagagaaa

SEQ ID NO: 702173 - DNA, 20 bp, Artificial
  CRISPR gRNA sequence
aagagtgagagagagaaaga

SEQ ID NO: 702174 - DNA, 20 bp, Artificial
  CRISPR gRNA sequence
gagtgagagagagaaagaga

SEQ ID NO: 702175 - DNA, 20 bp, Artificial
  CRISPR gRNA sequence
gagagagagaaagagagaga

SEQ ID NO: 702176 - DNA, 20 bp, Artificial
  CRISPR gRNA sequence
gagagagaaagagagagaca

SEQ ID NO: 702177 - DNA, 20 bp, Artificial
  CRISPR gRNA sequence
gagagaaagagagagacaga

SEQ ID NO: 702178 - DNA, 20 bp, Artificial
  CRISPR gRNA sequence
gaaagagagagacagagaga

SEQ ID NO: 702179 - DNA, 20 bp, Artificial
  CRISPR gRNA sequence
aagagagagacagagagaaa

SEQ ID NO: 702180 - DNA, 20 bp, Artificial
  CRISPR gRNA sequence
gagagacagagagaaagaga

SEQ ID NO: 702181 - DNA, 20 bp, Artificial
  CRISPR gRNA sequence
cagagagaaagagacagaat

SEQ ID NO: 702182 - DNA, 20 bp, Artificial
  CRISPR gRNA sequence
gagagaaagagacagaatga

SEQ ID NO: 702183 - DNA, 20 bp, Artificial
  CRISPR gRNA sequence
agagaaagagacagaatgag

SEQ ID NO: 702184 - DNA, 20 bp, Artificial
  CRISPR gRNA sequence
gagaaagagacagaatgaga

SEQ ID NO: 702185 - DNA, 20 bp, Artificial
  CRISPR gRNA sequence
gaaagagacagaatgagagg

SEQ ID NO: 702186 - DNA, 20 bp, Artificial
  CRISPR gRNA sequence
aagagacagaatgagaggga

SEQ ID NO: 702187 - DNA, 20 bp, Artificial
  CRISPR gRNA sequence
gagacagaatgagagggaga

SEQ ID NO: 702188 - DNA, 20 bp, Artificial
  CRISPR gRNA sequence
gacagaatgagagggagaga

SEQ ID NO: 702189 - DNA, 20 bp, Artificial
  CRISPR gRNA sequence
cagaatgagagggagagaga

SEQ ID NO: 702190 - DNA, 20 bp, Artificial
  CRISPR gRNA sequence
atgagagggagagagagagt

SEQ ID NO: 702191 - DNA, 20 bp, Artificial
  CRISPR gRNA sequence
gagagggagagagagagtga

SEQ ID NO: 702192 - DNA, 20 bp, Artificial
  CRISPR gRNA sequence
gagggagagagagagtgaga

SEQ ID NO: 702193 - DNA, 20 bp, Artificial
  CRISPR gRNA sequence
gggagagagagagtgagaga

SEQ ID NO: 702194 - DNA, 20 bp, Artificial
  CRISPR gRNA sequence
gagagagagtgagagagaga

SEQ ID NO: 702195 - DNA, 20 bp, Artificial
  CRISPR gRNA sequence
gagagtgagagagagacaga

SEQ ID NO: 702196 - DNA, 20 bp, Artificial
  CRISPR gRNA sequence
gagtgagagagagacagaaa

SEQ ID NO: 702197 - DNA, 20 bp, Artificial
  CRISPR gRNA sequence
agtgagagagagacagaaag

SEQ ID NO: 702198 - DNA, 20 bp, Artificial
  CRISPR gRNA sequence
gtgagagagagacagaaaga

SEQ ID NO: 702199 - DNA, 20 bp, Artificial
  CRISPR gRNA sequence
gagagagagacagaaagagg

SEQ ID NO: 702200 - DNA, 20 bp, Artificial
  CRISPR gRNA sequence
gagagagacagaaagaggga

SEQ ID NO: 702201 - DNA, 20 bp, Artificial
  CRISPR gRNA sequence
gagagacagaaagagggaga

SEQ ID NO: 702202 - DNA, 20 bp, Artificial
  CRISPR gRNA sequence
gagacagaaagagggagaga

SEQ ID NO: 702203 - DNA, 20 bp, Artificial
  CRISPR gRNA sequence
gacagaaagagggagagaga

SEQ ID NO: 702204 - DNA, 20 bp, Artificial
  CRISPR gRNA sequence
gaaagagggagagagagaga

SEQ ID NO: 702205 - DNA, 20 bp, Artificial
  CRISPR gRNA sequence
gagggagagagagagacaga

SEQ ID NO: 702206 - DNA, 20 bp, Artificial
  CRISPR gRNA sequence
gggagagagagagacagaaa

SEQ ID NO: 702207 - DNA, 20 bp, Artificial
  CRISPR gRNA sequence
gagagagagacagaaagaga

SEQ ID NO: 702208 - DNA, 20 bp, Artificial
  CRISPR gRNA sequence
gagagagacagaaagagaaa

SEQ ID NO: 702209 - DNA, 20 bp, Artificial
  CRISPR gRNA sequence
gagacagaaagagaaagaga

SEQ ID NO: 702210 - DNA, 20 bp, Artificial
  CRISPR gRNA sequence
gacagaaagagaaagagacg

SEQ ID NO: 702211 - DNA, 20 bp, Artificial
  CRISPR gRNA sequence
gaaagagaaagagacggagt

SEQ ID NO: 702212 - DNA, 20 bp, Artificial
  CRISPR gRNA sequence
gagaaagagacggagtgagc

SEQ ID NO: 702213 - DNA, 20 bp, Artificial
  CRISPR gRNA sequence
gaaagagacggagtgagcga

SEQ ID NO: 702214 - DNA, 20 bp, Artificial
  CRISPR gRNA sequence
aagagacggagtgagcgaga

SEQ ID NO: 702215 - DNA, 20 bp, Artificial
  CRISPR gRNA sequence
gagacggagtgagcgagaga

SEQ ID NO: 702216 - DNA, 20 bp, Artificial
  CRISPR gRNA sequence
gacggagtgagcgagagaga

SEQ ID NO: 702217 - DNA, 20 bp, Artificial
  CRISPR gRNA sequence
cggagtgagcgagagagaga

SEQ ID NO: 702218 - DNA, 20 bp, Artificial
  CRISPR gRNA sequence
gtgagcgagagagagagaga

SEQ ID NO: 702219 - DNA, 20 bp, Artificial
  CRISPR gRNA sequence
gcgagagagagagagacaga

SEQ ID NO: 702220 - DNA, 20 bp, Artificial
  CRISPR gRNA sequence
gagagagagagacagaaaga

SEQ ID NO: 702221 - DNA, 20 bp, Artificial
  CRISPR gRNA sequence
gagagagacagaaagacaga

SEQ ID NO: 702222 - DNA, 20 bp, Artificial
  CRISPR gRNA sequence
gagagacagaaagacagaaa

SEQ ID NO: 702223 - DNA, 20 bp, Artificial
  CRISPR gRNA sequence
gagacagaaagacagaaaga

SEQ ID NO: 702224 - DNA, 20 bp, Artificial
  CRISPR gRNA sequence
gaaagacagaaagagagact

SEQ ID NO: 702225 - DNA, 20 bp, Artificial
  CRISPR gRNA sequence
aagacagaaagagagactga

SEQ ID NO: 702226 - DNA, 20 bp, Artificial
  CRISPR gRNA sequence
cagaaagagagactgagaga

SEQ ID NO: 702227 - DNA, 20 bp, Artificial
  CRISPR gRNA sequence
gaaagagagactgagagaca

SEQ ID NO: 702228 - DNA, 20 bp, Artificial
  CRISPR gRNA sequence
aagagagactgagagacaga

SEQ ID NO: 702229 - DNA, 20 bp, Artificial
  CRISPR gRNA sequence
gagagactgagagacagaga

SEQ ID NO: 702230 - DNA, 20 bp, Artificial
  CRISPR gRNA sequence
gactgagagacagagagaga

SEQ ID NO: 702231 - DNA, 20 bp, Artificial
  CRISPR gRNA sequence
ctgagagacagagagagaca

SEQ ID NO: 702232 - DNA, 20 bp, Artificial
  CRISPR gRNA sequence
gagacagagagagacagaga

SEQ ID NO: 702233 - DNA, 20 bp, Artificial
  CRISPR gRNA sequence
gacagagagagacagagata

SEQ ID NO: 702234 - DNA, 20 bp, Artificial
  CRISPR gRNA sequence
gagacagagatagagtgtga

SEQ ID NO: 702235 - DNA, 20 bp, Artificial
  CRISPR gRNA sequence
gacagagatagagtgtgaca

SEQ ID NO: 702236 - DNA, 20 bp, Artificial
  CRISPR gRNA sequence
cagagatagagtgtgacaga

SEQ ID NO: 702237 - DNA, 20 bp, Artificial
  CRISPR gRNA sequence
gatagagtgtgacagagaga

SEQ ID NO: 702238 - DNA, 20 bp, Artificial
  CRISPR gRNA sequence
gagtgtgacagagagaaaga

SEQ ID NO: 702239 - DNA, 20 bp, Artificial
  CRISPR gRNA sequence
gtgtgacagagagaaagaca

SEQ ID NO: 702240 - DNA, 20 bp, Artificial
  CRISPR gRNA sequence
gacagagagaaagacagaga

SEQ ID NO: 702241 - DNA, 20 bp, Artificial
  CRISPR gRNA sequence
cagagagaaagacagagaaa

SEQ ID NO: 702242 - DNA, 20 bp, Artificial
  CRISPR gRNA sequence
gagagaaagacagagaaaga

SEQ ID NO: 702243 - DNA, 20 bp, Artificial
  CRISPR gRNA sequence
gagaaagacagagaaagaga

SEQ ID NO: 702244 - DNA, 20 bp, Artificial
  CRISPR gRNA sequence
gaaagacagagaaagagaga

SEQ ID NO: 702245 - DNA, 20 bp, Artificial
  CRISPR gRNA sequence
aagacagagaaagagagaga

SEQ ID NO: 702246 - DNA, 20 bp, Artificial
  CRISPR gRNA sequence
gacagagaaagagagagaga

SEQ ID NO: 702247 - DNA, 20 bp, Artificial
  CRISPR gRNA sequence
gagaaagagagagagagaga

SEQ ID NO: 702248 - DNA, 20 bp, Artificial
  CRISPR gRNA sequence
aagagagagagagagacaga

SEQ ID NO: 702249 - DNA, 20 bp, Artificial
  CRISPR gRNA sequence
gagagagagagagacagaaa

SEQ ID NO: 702250 - DNA, 20 bp, Artificial
  CRISPR gRNA sequence
gagagagagagacagaaaga

SEQ ID NO: 702251 - DNA, 20 bp, Artificial
  CRISPR gRNA sequence
gagagagagacagaaagaga

SEQ ID NO: 702252 - DNA, 20 bp, Artificial
  CRISPR gRNA sequence
gagagagacagaaagagaga

SEQ ID NO: 702253 - DNA, 20 bp, Artificial
  CRISPR gRNA sequence
gagagacagaaagagagaga

SEQ ID NO: 702254 - DNA, 20 bp, Artificial
  CRISPR gRNA sequence
gagacagaaagagagagaga

SEQ ID NO: 702255 - DNA, 20 bp, Artificial
  CRISPR gRNA sequence
cagaaagagagagagagaga

SEQ ID NO: 702256 - DNA, 20 bp, Artificial
  CRISPR gRNA sequence
aagagagagagagagacaga

SEQ ID NO: 702257 - DNA, 20 bp, Artificial
  CRISPR gRNA sequence
gagagagagagagacagaca

SEQ ID NO: 702258 - DNA, 20 bp, Artificial
  CRISPR gRNA sequence
agagagagagagacagacag

SEQ ID NO: 702259 - DNA, 20 bp, Artificial
  CRISPR gRNA sequence
gagagagagacagacagagg

SEQ ID NO: 702260 - DNA, 20 bp, Artificial
  CRISPR gRNA sequence
agagagacagacagaggcag

SEQ ID NO: 702261 - DNA, 20 bp, Artificial
  CRISPR gRNA sequence
ccacccctccttttatgacc

SEQ ID NO: 702262 - DNA, 20 bp, Artificial
  CRISPR gRNA sequence
ctccttttatgacctggcct

SEQ ID NO: 702263 - DNA, 20 bp, Artificial
  CRISPR gRNA sequence
cttttatgacctggccttgg

SEQ ID NO: 702264 - DNA, 20 bp, Artificial
  CRISPR gRNA sequence
acctggccttggaagtcaca

SEQ ID NO: 702265 - DNA, 20 bp, Artificial
  CRISPR gRNA sequence
tctaccactttctgtttgtt

SEQ ID NO: 702266 - DNA, 20 bp, Artificial
  CRISPR gRNA sequence
ctaccactttctgtttgttg

SEQ ID NO: 702267 - DNA, 20 bp, Artificial
  CRISPR gRNA sequence
ggcaaccacaaatgtcactt

SEQ ID NO: 702268 - DNA, 20 bp, Artificial
  CRISPR gRNA sequence
cacaaatgtcacttgagacc

SEQ ID NO: 702269 - DNA, 20 bp, Artificial
  CRISPR gRNA sequence
acaaatgtcacttgagacca

SEQ ID NO: 702270 - DNA, 20 bp, Artificial
  CRISPR gRNA sequence
caaatgtcacttgagaccaa

SEQ ID NO: 702271 - DNA, 20 bp, Artificial
  CRISPR gRNA sequence
atgtcacttgagaccaaggg

SEQ ID NO: 702272 - DNA, 20 bp, Artificial
  CRISPR gRNA sequence
tgtcacttgagaccaaggga

SEQ ID NO: 702273 - DNA, 20 bp, Artificial
  CRISPR gRNA sequence
tgagaccaagggaaggaaaa

SEQ ID NO: 702274 - DNA, 20 bp, Artificial
  CRISPR gRNA sequence
aaaacagttgtacttcttga

SEQ ID NO: 702275 - DNA, 20 bp, Artificial
  CRISPR gRNA sequence
aaacagttgtacttcttgac

SEQ ID NO: 702276 - DNA, 20 bp, Artificial
  CRISPR gRNA sequence
cagttgtacttcttgacagg

SEQ ID NO: 702277 - DNA, 20 bp, Artificial
  CRISPR gRNA sequence
agttgtacttcttgacaggt

SEQ ID NO: 702278 - DNA, 20 bp, Artificial
  CRISPR gRNA sequence
tgtacttcttgacaggtagg

SEQ ID NO: 702279 - DNA, 20 bp, Artificial
  CRISPR gRNA sequence
ttcttgacaggtaggtggca

SEQ ID NO: 702280 - DNA, 20 bp, Artificial
  CRISPR gRNA sequence
tcttgacaggtaggtggcaa

SEQ ID NO: 702281 - DNA, 20 bp, Artificial
  CRISPR gRNA sequence
caggtaggtggcaaaggctc

SEQ ID NO: 702282 - DNA, 20 bp, Artificial
  CRISPR gRNA sequence
gtaggtggcaaaggctctgg

SEQ ID NO: 702283 - DNA, 20 bp, Artificial
  CRISPR gRNA sequence
taggtggcaaaggctctgga

SEQ ID NO: 702284 - DNA, 20 bp, Artificial
  CRISPR gRNA sequence
aggtggcaaaggctctggaa

SEQ ID NO: 702285 - DNA, 20 bp, Artificial
  CRISPR gRNA sequence
ggcaaaggctctggaagggc

SEQ ID NO: 702286 - DNA, 20 bp, Artificial
  CRISPR gRNA sequence
gaagggccagaacatcactg

SEQ ID NO: 702287 - DNA, 20 bp, Artificial
  CRISPR gRNA sequence
acatcactgcagccatgttt

SEQ ID NO: 702288 - DNA, 20 bp, Artificial
  CRISPR gRNA sequence
catcactgcagccatgtttt

SEQ ID NO: 702289 - DNA, 20 bp, Artificial
  CRISPR gRNA sequence
atcactgcagccatgttttg

SEQ ID NO: 702290 - DNA, 20 bp, Artificial
  CRISPR gRNA sequence
agccatgttttggggaaata

SEQ ID NO: 702291 - DNA, 20 bp, Artificial
  CRISPR gRNA sequence
agtctgccacaaccaccatg

SEQ ID NO: 702292 - DNA, 20 bp, Artificial
  CRISPR gRNA sequence
acaaccaccatgtggacata

SEQ ID NO: 702293 - DNA, 20 bp, Artificial
  CRISPR gRNA sequence
aaccaccatgtggacatatg

SEQ ID NO: 702294 - DNA, 20 bp, Artificial
  CRISPR gRNA sequence
accatgtggacatatggaga

SEQ ID NO: 702295 - DNA, 20 bp, Artificial
  CRISPR gRNA sequence
catgtggacatatggagaaa

SEQ ID NO: 702296 - DNA, 20 bp, Artificial
  CRISPR gRNA sequence
atgtggacatatggagaaag

SEQ ID NO: 702297 - DNA, 20 bp, Artificial
  CRISPR gRNA sequence
acatatggagaaagaggtgt

SEQ ID NO: 702298 - DNA, 20 bp, Artificial
  CRISPR gRNA sequence
ggagaaagaggtgttggctc

SEQ ID NO: 702299 - DNA, 20 bp, Artificial
  CRISPR gRNA sequence
gagaaagaggtgttggctct

SEQ ID NO: 702300 - DNA, 20 bp, Artificial
  CRISPR gRNA sequence
agaggtgttggctctgggcc

SEQ ID NO: 702301 - DNA, 20 bp, Artificial
  CRISPR gRNA sequence
tctgggcccagtaattcctt

SEQ ID NO: 702302 - DNA, 20 bp, Artificial
  CRISPR gRNA sequence
tctcctaactgaaaccccac

SEQ ID NO: 702303 - DNA, 20 bp, Artificial
  CRISPR gRNA sequence
ctcctaactgaaaccccacg

SEQ ID NO: 702304 - DNA, 20 bp, Artificial
  CRISPR gRNA sequence
ctaactgaaaccccacgagg

SEQ ID NO: 702305 - DNA, 20 bp, Artificial
  CRISPR gRNA sequence
actgaaaccccacgaggcag

SEQ ID NO: 702306 - DNA, 20 bp, Artificial
  CRISPR gRNA sequence
tgaaaccccacgaggcagtg

SEQ ID NO: 702307 - DNA, 20 bp, Artificial
  CRISPR gRNA sequence
aaccccacgaggcagtggag

SEQ ID NO: 702308 - DNA, 20 bp, Artificial
  CRISPR gRNA sequence
gaggcagtggagtggtgtat

SEQ ID NO: 702309 - DNA, 20 bp, Artificial
  CRISPR gRNA sequence
gcagtggagtggtgtattag

SEQ ID NO: 702310 - DNA, 20 bp, Artificial
  CRISPR gRNA sequence
gagtggtgtattagtagcta

SEQ ID NO: 702311 - DNA, 20 bp, Artificial
  CRISPR gRNA sequence
agtggtgtattagtagctaa

SEQ ID NO: 702312 - DNA, 20 bp, Artificial
  CRISPR gRNA sequence
gtattagtagctaaaggcat

SEQ ID NO: 702313 - DNA, 20 bp, Artificial
  CRISPR gRNA sequence
gtagctaaaggcatgagctc

SEQ ID NO: 702314 - DNA, 20 bp, Artificial
  CRISPR gRNA sequence
aggcatgagctctagaaccc

SEQ ID NO: 702315 - DNA, 20 bp, Artificial
  CRISPR gRNA sequence
gagctctagaacccgagtgc

SEQ ID NO: 702316 - DNA, 20 bp, Artificial
  CRISPR gRNA sequence
agctctagaacccgagtgcc

SEQ ID NO: 702317 - DNA, 20 bp, Artificial
  CRISPR gRNA sequence
tagaacccgagtgccgggtt

SEQ ID NO: 702318 - DNA, 20 bp, Artificial
  CRISPR gRNA sequence
atcccgcctctcccacttga

SEQ ID NO: 702319 - DNA, 20 bp, Artificial
  CRISPR gRNA sequence
acttgatagcctataacctc

SEQ ID NO: 702320 - DNA, 20 bp, Artificial
  CRISPR gRNA sequence
tgatagcctataacctcaag

SEQ ID NO: 702321 - DNA, 20 bp, Artificial
  CRISPR gRNA sequence
gatagcctataacctcaagc

SEQ ID NO: 702322 - DNA, 20 bp, Artificial
  CRISPR gRNA sequence
ttcctaacctctctgtgcct

SEQ ID NO: 702323 - DNA, 20 bp, Artificial
  CRISPR gRNA sequence
cagtttcctctgctgcaaaa

SEQ ID NO: 702324 - DNA, 20 bp, Artificial
  CRISPR gRNA sequence
agtttcctctgctgcaaaat

SEQ ID NO: 702325 - DNA, 20 bp, Artificial
  CRISPR gRNA sequence
cctctgctgcaaaatgggca

SEQ ID NO: 702326 - DNA, 20 bp, Artificial
  CRISPR gRNA sequence
gggcatagtattatctatct

SEQ ID NO: 702327 - DNA, 20 bp, Artificial
  CRISPR gRNA sequence
gcatagtattatctatctca

SEQ ID NO: 702328 - DNA, 20 bp, Artificial
  CRISPR gRNA sequence
tctatctcagagaaccatgt

SEQ ID NO: 702329 - DNA, 20 bp, Artificial
  CRISPR gRNA sequence
gagaattgaatacatgattg

SEQ ID NO: 702330 - DNA, 20 bp, Artificial
  CRISPR gRNA sequence
agaattgaatacatgattgt

SEQ ID NO: 702331 - DNA, 20 bp, Artificial
  CRISPR gRNA sequence
tacatgattgtaggttaatc

SEQ ID NO: 702332 - DNA, 20 bp, Artificial
  CRISPR gRNA sequence
acatgattgtaggttaatct

SEQ ID NO: 702333 - DNA, 20 bp, Artificial
  CRISPR gRNA sequence
tgattgtaggttaatctggg

SEQ ID NO: 702334 - DNA, 20 bp, Artificial
  CRISPR gRNA sequence
attgtaggttaatctgggta

SEQ ID NO: 702335 - DNA, 20 bp, Artificial
  CRISPR gRNA sequence
gttaatctgggtagagtgct

SEQ ID NO: 702336 - DNA, 20 bp, Artificial
  CRISPR gRNA sequence
actactgtctcacacatact

SEQ ID NO: 702337 - DNA, 20 bp, Artificial
  CRISPR gRNA sequence
cacacatactcagttatctt

SEQ ID NO: 702338 - DNA, 20 bp, Artificial
  CRISPR gRNA sequence
cacatactcagttatcttaa

SEQ ID NO: 702339 - DNA, 20 bp, Artificial
  CRISPR gRNA sequence
agctataataataatgataa

SEQ ID NO: 702340 - DNA, 20 bp, Artificial
  CRISPR gRNA sequence
atagctgccattgtcccaaa

SEQ ID NO: 702341 - DNA, 20 bp, Artificial
  CRISPR gRNA sequence
aaatggtttcattcattgct

SEQ ID NO: 702342 - DNA, 20 bp, Artificial
  CRISPR gRNA sequence
caaattccccaaatcctgcc

SEQ ID NO: 702343 - DNA, 20 bp, Artificial
  CRISPR gRNA sequence
cctgcccagttcccttgctc

SEQ ID NO: 702344 - DNA, 20 bp, Artificial
  CRISPR gRNA sequence
tcccttgctctggatgttgt

SEQ ID NO: 702345 - DNA, 20 bp, Artificial
  CRISPR gRNA sequence
cttgctctggatgttgtaag

SEQ ID NO: 702346 - DNA, 20 bp, Artificial
  CRISPR gRNA sequence
tgctctggatgttgtaagaa

SEQ ID NO: 702347 - DNA, 20 bp, Artificial
  CRISPR gRNA sequence
tgttgtaagaagagactgtc

SEQ ID NO: 702348 - DNA, 20 bp, Artificial
  CRISPR gRNA sequence
agcccttatcattatcatgc

SEQ ID NO: 702349 - DNA, 20 bp, Artificial
  CRISPR gRNA sequence
gcccttatcattatcatgct

SEQ ID NO: 702350 - DNA, 20 bp, Artificial
  CRISPR gRNA sequence
cattatcatgctgggtctct

SEQ ID NO: 702351 - DNA, 20 bp, Artificial
  CRISPR gRNA sequence
ctctaagtatcctgctgatt

SEQ ID NO: 702352 - DNA, 20 bp, Artificial
  CRISPR gRNA sequence
ctgattgagatctaccctcg

SEQ ID NO: 702353 - DNA, 20 bp, Artificial
  CRISPR gRNA sequence
gattgagatctaccctcgcg

SEQ ID NO: 702354 - DNA, 20 bp, Artificial
  CRISPR gRNA sequence
ttgagatctaccctcgcgga

SEQ ID NO: 702355 - DNA, 20 bp, Artificial
  CRISPR gRNA sequence
tgagatctaccctcgcggag

SEQ ID NO: 702356 - DNA, 20 bp, Artificial
  CRISPR gRNA sequence
atttgcctaatctactgatg

SEQ ID NO: 702357 - DNA, 20 bp, Artificial
  CRISPR gRNA sequence
gtcgttctgtatttacctct

SEQ ID NO: 702358 - DNA, 20 bp, Artificial
  CRISPR gRNA sequence
gttctgtatttacctctaag

SEQ ID NO: 702359 - DNA, 20 bp, Artificial
  CRISPR gRNA sequence
tctgtatttacctctaagtg

SEQ ID NO: 702360 - DNA, 20 bp, Artificial
  CRISPR gRNA sequence
taaaaataatacctctaaca

SEQ ID NO: 702361 - DNA, 20 bp, Artificial
  CRISPR gRNA sequence
acatggtttttttttgcttt

SEQ ID NO: 702362 - DNA, 20 bp, Artificial
  CRISPR gRNA sequence
atggtttttttttgcttttg

SEQ ID NO: 702363 - DNA, 20 bp, Artificial
  CRISPR gRNA sequence
tggtttttttttgcttttgg

SEQ ID NO: 702364 - DNA, 20 bp, Artificial
  CRISPR gRNA sequence
tttttttttttttttttaaa

SEQ ID NO: 702365 - DNA, 20 bp, Artificial
  CRISPR gRNA sequence
tttttttttttttaaataga

SEQ ID NO: 702366 - DNA, 20 bp, Artificial
  CRISPR gRNA sequence
tttttttttttaaatagaca

SEQ ID NO: 702367 - DNA, 20 bp, Artificial
  CRISPR gRNA sequence
cagagtcttgttctgtcgcc

SEQ ID NO: 702368 - DNA, 20 bp, Artificial
  CRISPR gRNA sequence
agagtcttgttctgtcgccc

SEQ ID NO: 702369 - DNA, 20 bp, Artificial
  CRISPR gRNA sequence
tcttgttctgtcgcccaggc

SEQ ID NO: 702370 - DNA, 20 bp, Artificial
  CRISPR gRNA sequence
ttgttctgtcgcccaggctg

SEQ ID NO: 702371 - DNA, 20 bp, Artificial
  CRISPR gRNA sequence
ctgtcgcccaggctggagtg

SEQ ID NO: 702372 - DNA, 20 bp, Artificial
  CRISPR gRNA sequence
tcgcccaggctggagtgcag

SEQ ID NO: 702373 - DNA, 20 bp, Artificial
  CRISPR gRNA sequence
ggagtgcagtggcactatct

SEQ ID NO: 702374 - DNA, 20 bp, Artificial
  CRISPR gRNA sequence
tcactgcaacctctgcctcc

SEQ ID NO: 702375 - DNA, 20 bp, Artificial
  CRISPR gRNA sequence
cactgcaacctctgcctccc

SEQ ID NO: 702376 - DNA, 20 bp, Artificial
  CRISPR gRNA sequence
aacctctgcctcccaggttc

SEQ ID NO: 702377 - DNA, 20 bp, Artificial
  CRISPR gRNA sequence
ttcaagtgattctcctgcct

SEQ ID NO: 702378 - DNA, 20 bp, Artificial
  CRISPR gRNA sequence
ttctcctgcctcagcctcct

SEQ ID NO: 702379 - DNA, 20 bp, Artificial
  CRISPR gRNA sequence
tcctgcctcagcctcctgag

SEQ ID NO: 702380 - DNA, 20 bp, Artificial
  CRISPR gRNA sequence
gcctcagcctcctgagtagc

SEQ ID NO: 702381 - DNA, 20 bp, Artificial
  CRISPR gRNA sequence
cctcagcctcctgagtagct

SEQ ID NO: 702382 - DNA, 20 bp, Artificial
  CRISPR gRNA sequence
ctcctgagtagctgggatta

SEQ ID NO: 702383 - DNA, 20 bp, Artificial
  CRISPR gRNA sequence
tcctgagtagctgggattac

SEQ ID NO: 702384 - DNA, 20 bp, Artificial
  CRISPR gRNA sequence
ggattacaggcacgtgccac

SEQ ID NO: 702385 - DNA, 20 bp, Artificial
  CRISPR gRNA sequence
gattacaggcacgtgccacc

SEQ ID NO: 702386 - DNA, 20 bp, Artificial
  CRISPR gRNA sequence
caggcacgtgccaccaggca

SEQ ID NO: 702387 - DNA, 20 bp, Artificial
  CRISPR gRNA sequence
atggctaatttttgtatttt

SEQ ID NO: 702388 - DNA, 20 bp, Artificial
  CRISPR gRNA sequence
gctaatttttgtatttttag

SEQ ID NO: 702389 - DNA, 20 bp, Artificial
  CRISPR gRNA sequence
taatttttgtatttttagta

SEQ ID NO: 702390 - DNA, 20 bp, Artificial
  CRISPR gRNA sequence
ttttgtatttttagtagaga

SEQ ID NO: 702391 - DNA, 20 bp, Artificial
  CRISPR gRNA sequence
tttgtatttttagtagagac

SEQ ID NO: 702392 - DNA, 20 bp, Artificial
  CRISPR gRNA sequence
ttgtatttttagtagagacg

SEQ ID NO: 702393 - DNA, 20 bp, Artificial
  CRISPR gRNA sequence
gagacggggtttcaccatgt

SEQ ID NO: 702394 - DNA, 20 bp, Artificial
  CRISPR gRNA sequence
cggggtttcaccatgttggt

SEQ ID NO: 702395 - DNA, 20 bp, Artificial
  CRISPR gRNA sequence
ggggtttcaccatgttggtc

SEQ ID NO: 702396 - DNA, 20 bp, Artificial
  CRISPR gRNA sequence
tttcaccatgttggtcaggc

SEQ ID NO: 702397 - DNA, 20 bp, Artificial
  CRISPR gRNA sequence
accttgtgatctgcctgcct

SEQ ID NO: 702398 - DNA, 20 bp, Artificial
  CRISPR gRNA sequence
ctgcctgcctcggcctccca

SEQ ID NO: 702399 - DNA, 20 bp, Artificial
  CRISPR gRNA sequence
gcctcggcctcccaaagtgc

SEQ ID NO: 702400 - DNA, 20 bp, Artificial
  CRISPR gRNA sequence
cctcggcctcccaaagtgcc

SEQ ID NO: 702401 - DNA, 20 bp, Artificial
  CRISPR gRNA sequence
ctcccaaagtgccgggatta

SEQ ID NO: 702402 - DNA, 20 bp, Artificial
  CRISPR gRNA sequence
agtgccgggattacagtcgt

SEQ ID NO: 702403 - DNA, 20 bp, Artificial
  CRISPR gRNA sequence
cagtcgtgagccaccgtgtc

SEQ ID NO: 702404 - DNA, 20 bp, Artificial
  CRISPR gRNA sequence
ttaaaaatttcaaacatatt

SEQ ID NO: 702405 - DNA, 20 bp, Artificial
  CRISPR gRNA sequence
atttcaaacatattcagatg

SEQ ID NO: 702406 - DNA, 20 bp, Artificial
  CRISPR gRNA sequence
ttcaaacatattcagatgta

SEQ ID NO: 702407 - DNA, 20 bp, Artificial
  CRISPR gRNA sequence
aacatattcagatgtagagt

SEQ ID NO: 702408 - DNA, 20 bp, Artificial
  CRISPR gRNA sequence
tattcagatgtagagtgagt

SEQ ID NO: 702409 - DNA, 20 bp, Artificial
  CRISPR gRNA sequence
ttcagatgtagagtgagtca

SEQ ID NO: 702410 - DNA, 20 bp, Artificial
  CRISPR gRNA sequence
gatgtagagtgagtcagaga

SEQ ID NO: 702411 - DNA, 20 bp, Artificial
  CRISPR gRNA sequence
gatggctgcgtactatcacc

SEQ ID NO: 702412 - DNA, 20 bp, Artificial
  CRISPR gRNA sequence
tactatcacccagctttaaa

SEQ ID NO: 702413 - DNA, 20 bp, Artificial
  CRISPR gRNA sequence
cacccagctttaaacggtta

SEQ ID NO: 702414 - DNA, 20 bp, Artificial
  CRISPR gRNA sequence
cccagctttaaacggttatg

SEQ ID NO: 702415 - DNA, 20 bp, Artificial
  CRISPR gRNA sequence
tttaaacggttatggagtca

SEQ ID NO: 702416 - DNA, 20 bp, Artificial
  CRISPR gRNA sequence
aacggttatggagtcatggc

SEQ ID NO: 702417 - DNA, 20 bp, Artificial
  CRISPR gRNA sequence
tatggagtcatggccagtct

SEQ ID NO: 702418 - DNA, 20 bp, Artificial
  CRISPR gRNA sequence
tgcccgctcaccccgtcccc

SEQ ID NO: 702419 - DNA, 20 bp, Artificial
  CRISPR gRNA sequence
cccgctcaccccgtcccctg

SEQ ID NO: 702420 - DNA, 20 bp, Artificial
  CRISPR gRNA sequence
ccgctcaccccgtcccctgg

SEQ ID NO: 702421 - DNA, 20 bp, Artificial
  CRISPR gRNA sequence
cctggaggactttcttttaa

SEQ ID NO: 702422 - DNA, 20 bp, Artificial
  CRISPR gRNA sequence
ggactttcttttaacagctt

SEQ ID NO: 702423 - DNA, 20 bp, Artificial
  CRISPR gRNA sequence
gactttcttttaacagcttt

SEQ ID NO: 702424 - DNA, 20 bp, Artificial
  CRISPR gRNA sequence
actttcttttaacagcttta

SEQ ID NO: 702425 - DNA, 20 bp, Artificial
  CRISPR gRNA sequence
tttcttttaacagctttagg

SEQ ID NO: 702426 - DNA, 20 bp, Artificial
  CRISPR gRNA sequence
tcttttaacagctttaggga

SEQ ID NO: 702427 - DNA, 20 bp, Artificial
  CRISPR gRNA sequence
ttaacagctttagggagaga

SEQ ID NO: 702428 - DNA, 20 bp, Artificial
  CRISPR gRNA sequence
acagctttagggagagatag

SEQ ID NO: 702429 - DNA, 20 bp, Artificial
  CRISPR gRNA sequence
cagctttagggagagatagt

SEQ ID NO: 702430 - DNA, 20 bp, Artificial
  CRISPR gRNA sequence
agggagagatagtgggcata

SEQ ID NO: 702431 - DNA, 20 bp, Artificial
  CRISPR gRNA sequence
gagatagtgggcatatggta

SEQ ID NO: 702432 - DNA, 20 bp, Artificial
  CRISPR gRNA sequence
tgggcatatggtaaagtgca

SEQ ID NO: 702433 - DNA, 20 bp, Artificial
  CRISPR gRNA sequence
atggtaaagtgcatagatta

SEQ ID NO: 702434 - DNA, 20 bp, Artificial
  CRISPR gRNA sequence
tggtaaagtgcatagattaa

SEQ ID NO: 702435 - DNA, 20 bp, Artificial
  CRISPR gRNA sequence
attaaaggatgcaatctgat

SEQ ID NO: 702436 - DNA, 20 bp, Artificial
  CRISPR gRNA sequence
taagttttaacaaatgcatg

SEQ ID NO: 702437 - DNA, 20 bp, Artificial
  CRISPR gRNA sequence
tttaacaaatgcatgcagct

SEQ ID NO: 702438 - DNA, 20 bp, Artificial
  CRISPR gRNA sequence
aatgcatgcagctgagcaac

SEQ ID NO: 702439 - DNA, 20 bp, Artificial
  CRISPR gRNA sequence
aaccagccatccccctctaa

SEQ ID NO: 702440 - DNA, 20 bp, Artificial
  CRISPR gRNA sequence
tccccctctaaaagttacct

SEQ ID NO: 702441 - DNA, 20 bp, Artificial
  CRISPR gRNA sequence
ccccctctaaaagttacctc

SEQ ID NO: 702442 - DNA, 20 bp, Artificial
  CRISPR gRNA sequence
catttcccatcccctgctta

SEQ ID NO: 702443 - DNA, 20 bp, Artificial
  CRISPR gRNA sequence
tgcttatggtcaccatgcaa

SEQ ID NO: 702444 - DNA, 20 bp, Artificial
  CRISPR gRNA sequence
ttgcatgtaaatgcgacata

SEQ ID NO: 702445 - DNA, 20 bp, Artificial
  CRISPR gRNA sequence
gcctgccttctttcaccctg

SEQ ID NO: 702446 - DNA, 20 bp, Artificial
  CRISPR gRNA sequence
tcaccctgcagaattatttt

SEQ ID NO: 702447 - DNA, 20 bp, Artificial
  CRISPR gRNA sequence
cagaattattttgagcatgc

SEQ ID NO: 702448 - DNA, 20 bp, Artificial
  CRISPR gRNA sequence
agaattattttgagcatgct

SEQ ID NO: 702449 - DNA, 20 bp, Artificial
  CRISPR gRNA sequence
aattattttgagcatgctgg

SEQ ID NO: 702450 - DNA, 20 bp, Artificial
  CRISPR gRNA sequence
ttattttgagcatgctggga

SEQ ID NO: 702451 - DNA, 20 bp, Artificial
  CRISPR gRNA sequence
atgctgggagagctgctcaa

SEQ ID NO: 702452 - DNA, 20 bp, Artificial
  CRISPR gRNA sequence
gggagagctgctcaacggca

SEQ ID NO: 702453 - DNA, 20 bp, Artificial
  CRISPR gRNA sequence
gagctgctcaacggcatagt

SEQ ID NO: 702454 - DNA, 20 bp, Artificial
  CRISPR gRNA sequence
gctcaacggcatagtcagac

SEQ ID NO: 702455 - DNA, 20 bp, Artificial
  CRISPR gRNA sequence
acgagcatttattttcttgt

SEQ ID NO: 702456 - DNA, 20 bp, Artificial
  CRISPR gRNA sequence
ttttcttgttggatgaccct

SEQ ID NO: 702457 - DNA, 20 bp, Artificial
  CRISPR gRNA sequence
caactgcttctctgtcttcc

SEQ ID NO: 702458 - DNA, 20 bp, Artificial
  CRISPR gRNA sequence
aactgcttctctgtcttcct

SEQ ID NO: 702459 - DNA, 20 bp, Artificial
  CRISPR gRNA sequence
actgcttctctgtcttcctg

SEQ ID NO: 702460 - DNA, 20 bp, Artificial
  CRISPR gRNA sequence
ctgcttctctgtcttcctgg

SEQ ID NO: 702461 - DNA, 20 bp, Artificial
  CRISPR gRNA sequence
ctgtcttcctgggggctctc

SEQ ID NO: 702462 - DNA, 20 bp, Artificial
  CRISPR gRNA sequence
tgatcctcatctgtgtccct

SEQ ID NO: 702463 - DNA, 20 bp, Artificial
  CRISPR gRNA sequence
gtgtcccttagatgaccttg

SEQ ID NO: 702464 - DNA, 20 bp, Artificial
  CRISPR gRNA sequence
gtcccttagatgaccttgtg

SEQ ID NO: 702465 - DNA, 20 bp, Artificial
  CRISPR gRNA sequence
ccttagatgaccttgtggag

SEQ ID NO: 702466 - DNA, 20 bp, Artificial
  CRISPR gRNA sequence
tggagaagacgccatgtgca

SEQ ID NO: 702467 - DNA, 20 bp, Artificial
  CRISPR gRNA sequence
cgcacctgcgaatgtcgacc

SEQ ID NO: 702468 - DNA, 20 bp, Artificial
  CRISPR gRNA sequence
tggcatgatctgtgccacat

SEQ ID NO: 702469 - DNA, 20 bp, Artificial
  CRISPR gRNA sequence
tgtcccctacccaatctgtg

SEQ ID NO: 702470 - DNA, 20 bp, Artificial
  CRISPR gRNA sequence
cccctacccaatctgtgcag

SEQ ID NO: 702471 - DNA, 20 bp, Artificial
  CRISPR gRNA sequence
cctacccaatctgtgcagca

SEQ ID NO: 702472 - DNA, 20 bp, Artificial
  CRISPR gRNA sequence
cccaatctgtgcagcagaga

SEQ ID NO: 702473 - DNA, 20 bp, Artificial
  CRISPR gRNA sequence
gtgcagcagagacggtcacc

SEQ ID NO: 702474 - DNA, 20 bp, Artificial
  CRISPR gRNA sequence
cagagacggtcaccaagccc

SEQ ID NO: 702475 - DNA, 20 bp, Artificial
  CRISPR gRNA sequence
agagacggtcaccaagcccc

SEQ ID NO: 702476 - DNA, 20 bp, Artificial
  CRISPR gRNA sequence
gagacggtcaccaagcccca

SEQ ID NO: 702477 - DNA, 20 bp, Artificial
  CRISPR gRNA sequence
cggtcaccaagccccagggt

SEQ ID NO: 702478 - DNA, 20 bp, Artificial
  CRISPR gRNA sequence
tcaccaagccccagggtaag

SEQ ID NO: 702479 - DNA, 20 bp, Artificial
  CRISPR gRNA sequence
agggtaagcagttcccaccc

SEQ ID NO: 702480 - DNA, 20 bp, Artificial
  CRISPR gRNA sequence
gggtaagcagttcccacccc

SEQ ID NO: 702481 - DNA, 20 bp, Artificial
  CRISPR gRNA sequence
cccaccccaggcctcgacca

SEQ ID NO: 702482 - DNA, 20 bp, Artificial
  CRISPR gRNA sequence
ccaccccaggcctcgaccac

SEQ ID NO: 702483 - DNA, 20 bp, Artificial
  CRISPR gRNA sequence
caccccaggcctcgaccaca

SEQ ID NO: 702484 - DNA, 20 bp, Artificial
  CRISPR gRNA sequence
cccaggcctcgaccacaggg

SEQ ID NO: 702485 - DNA, 20 bp, Artificial
  CRISPR gRNA sequence
caggcctcgaccacagggtg

SEQ ID NO: 702486 - DNA, 20 bp, Artificial
  CRISPR gRNA sequence
gttgtgcctctccccaccaa

SEQ ID NO: 702487 - DNA, 20 bp, Artificial
  CRISPR gRNA sequence
tgcctctccccaccaacagc

SEQ ID NO: 702488 - DNA, 20 bp, Artificial
  CRISPR gRNA sequence
gcctctccccaccaacagcc

SEQ ID NO: 702489 - DNA, 20 bp, Artificial
  CRISPR gRNA sequence
cctctccccaccaacagcca

SEQ ID NO: 702490 - DNA, 20 bp, Artificial
  CRISPR gRNA sequence
ctctccccaccaacagccag

SEQ ID NO: 702491 - DNA, 20 bp, Artificial
  CRISPR gRNA sequence
tccccaccaacagccagggg

SEQ ID NO: 702492 - DNA, 20 bp, Artificial
  CRISPR gRNA sequence
cccaccaacagccaggggtg

SEQ ID NO: 702493 - DNA, 20 bp, Artificial
  CRISPR gRNA sequence
ccaccaacagccaggggtgg

SEQ ID NO: 702494 - DNA, 20 bp, Artificial
  CRISPR gRNA sequence
aggcaaatgacctacaccct

SEQ ID NO: 702495 - DNA, 20 bp, Artificial
  CRISPR gRNA sequence
ctacaccctcggctgttcat

SEQ ID NO: 702496 - DNA, 20 bp, Artificial
  CRISPR gRNA sequence
tacaccctcggctgttcatt

SEQ ID NO: 702497 - DNA, 20 bp, Artificial
  CRISPR gRNA sequence
ccctcggctgttcattaggt

SEQ ID NO: 702498 - DNA, 20 bp, Artificial
  CRISPR gRNA sequence
cctcggctgttcattaggtc

SEQ ID NO: 702499 - DNA, 20 bp, Artificial
  CRISPR gRNA sequence
gctgttcattaggtcaggtt

SEQ ID NO: 702500 - DNA, 20 bp, Artificial
  CRISPR gRNA sequence
ctgttcattaggtcaggttt

SEQ ID NO: 702501 - DNA, 20 bp, Artificial
  CRISPR gRNA sequence
attaggtcaggtttgggttc

SEQ ID NO: 702502 - DNA, 20 bp, Artificial
  CRISPR gRNA sequence
ttgggttctggttatccttt

SEQ ID NO: 702503 - DNA, 20 bp, Artificial
  CRISPR gRNA sequence
ggttctggttatcctttgag

SEQ ID NO: 702504 - DNA, 20 bp, Artificial
  CRISPR gRNA sequence
ctggttatcctttgagtagt

SEQ ID NO: 702505 - DNA, 20 bp, Artificial
  CRISPR gRNA sequence
atcctttgagtagtcagact

SEQ ID NO: 702506 - DNA, 20 bp, Artificial
  CRISPR gRNA sequence
gagtagtcagactcagtgaa

SEQ ID NO: 702507 - DNA, 20 bp, Artificial
  CRISPR gRNA sequence
gtgaatggaatgataaaatc

SEQ ID NO: 702508 - DNA, 20 bp, Artificial
  CRISPR gRNA sequence
ggaatgataaaatccagttt

SEQ ID NO: 702509 - DNA, 20 bp, Artificial
  CRISPR gRNA sequence
aaaatccagttttagcattt

SEQ ID NO: 702510 - DNA, 20 bp, Artificial
  CRISPR gRNA sequence
tccagttttagcattttggc

SEQ ID NO: 702511 - DNA, 20 bp, Artificial
  CRISPR gRNA sequence
cagttttagcattttggcaa

SEQ ID NO: 702512 - DNA, 20 bp, Artificial
  CRISPR gRNA sequence
aaaattcttcctgaaattat

SEQ ID NO: 702513 - DNA, 20 bp, Artificial
  CRISPR gRNA sequence
aaattcttcctgaaattatt

SEQ ID NO: 702514 - DNA, 20 bp, Artificial
  CRISPR gRNA sequence
tcttcctgaaattattgggc

SEQ ID NO: 702515 - DNA, 20 bp, Artificial
  CRISPR gRNA sequence
ggtaaaatctttatattttt

SEQ ID NO: 702516 - DNA, 20 bp, Artificial
  CRISPR gRNA sequence
aaatctttatatttttgaga

SEQ ID NO: 702517 - DNA, 20 bp, Artificial
  CRISPR gRNA sequence
atctttatatttttgagatg

SEQ ID NO: 702518 - DNA, 20 bp, Artificial
  CRISPR gRNA sequence
ggagtttcgctcatgttgcc

SEQ ID NO: 702519 - DNA, 20 bp, Artificial
  CRISPR gRNA sequence
gagtttcgctcatgttgccc

SEQ ID NO: 702520 - DNA, 20 bp, Artificial
  CRISPR gRNA sequence
ttcgctcatgttgcccaggc

SEQ ID NO: 702521 - DNA, 20 bp, Artificial
  CRISPR gRNA sequence
cgctcatgttgcccaggctg

SEQ ID NO: 702522 - DNA, 20 bp, Artificial
  CRISPR gRNA sequence
ttgcccaggctggagtacaa

SEQ ID NO: 702523 - DNA, 20 bp, Artificial
  CRISPR gRNA sequence
ggagtacaatggctcaatct

SEQ ID NO: 702524 - DNA, 20 bp, Artificial
  CRISPR gRNA sequence
tcaccgcaacctgcacctcc

SEQ ID NO: 702525 - DNA, 20 bp, Artificial
  CRISPR gRNA sequence
caccgcaacctgcacctcct

SEQ ID NO: 702526 - DNA, 20 bp, Artificial
  CRISPR gRNA sequence
aacctgcacctcctgggttc

SEQ ID NO: 702527 - DNA, 20 bp, Artificial
  CRISPR gRNA sequence
ttcaagcaattctcctgcct

SEQ ID NO: 702528 - DNA, 20 bp, Artificial
  CRISPR gRNA sequence
ttctcctgcctcagccttct

SEQ ID NO: 702529 - DNA, 20 bp, Artificial
  CRISPR gRNA sequence
tcctgcctcagccttctgag

SEQ ID NO: 702530 - DNA, 20 bp, Artificial
  CRISPR gRNA sequence
gcctcagccttctgagtagc

SEQ ID NO: 702531 - DNA, 20 bp, Artificial
  CRISPR gRNA sequence
cctcagccttctgagtagct

SEQ ID NO: 702532 - DNA, 20 bp, Artificial
  CRISPR gRNA sequence
ctcagccttctgagtagctg

SEQ ID NO: 702533 - DNA, 20 bp, Artificial
  CRISPR gRNA sequence
ttctgagtagctggggttac

SEQ ID NO: 702534 - DNA, 20 bp, Artificial
  CRISPR gRNA sequence
gttacaagcattcgccacca

SEQ ID NO: 702535 - DNA, 20 bp, Artificial
  CRISPR gRNA sequence
caagcattcgccaccacagc

SEQ ID NO: 702536 - DNA, 20 bp, Artificial
  CRISPR gRNA sequence
gccggctaatgttgtatttt

SEQ ID NO: 702537 - DNA, 20 bp, Artificial
  CRISPR gRNA sequence
ggctaatgttgtatttttag

SEQ ID NO: 702538 - DNA, 20 bp, Artificial
  CRISPR gRNA sequence
ctaatgttgtatttttagaa

SEQ ID NO: 702539 - DNA, 20 bp, Artificial
  CRISPR gRNA sequence
ttgtatttttagaagagatg

SEQ ID NO: 702540 - DNA, 20 bp, Artificial
  CRISPR gRNA sequence
gagatgcggtttctccatgt

SEQ ID NO: 702541 - DNA, 20 bp, Artificial
  CRISPR gRNA sequence
tgcggtttctccatgttggt

SEQ ID NO: 702542 - DNA, 20 bp, Artificial
  CRISPR gRNA sequence
gcggtttctccatgttggtc

SEQ ID NO: 702543 - DNA, 20 bp, Artificial
  CRISPR gRNA sequence
tttctccatgttggtcaggc

SEQ ID NO: 702544 - DNA, 20 bp, Artificial
  CRISPR gRNA sequence
tggtctcgaactcccgacct

SEQ ID NO: 702545 - DNA, 20 bp, Artificial
  CRISPR gRNA sequence
ggtctcgaactcccgacctc

SEQ ID NO: 702546 - DNA, 20 bp, Artificial
  CRISPR gRNA sequence
ctcaggtgatccacccacct

SEQ ID NO: 702547 - DNA, 20 bp, Artificial
  CRISPR gRNA sequence
ccacccaccttggcctctca

SEQ ID NO: 702548 - DNA, 20 bp, Artificial
  CRISPR gRNA sequence
accttggcctctcaaagtgc

SEQ ID NO: 702549 - DNA, 20 bp, Artificial
  CRISPR gRNA sequence
ccttggcctctcaaagtgct

SEQ ID NO: 702550 - DNA, 20 bp, Artificial
  CRISPR gRNA sequence
ctctcaaagtgctgggatta

SEQ ID NO: 702551 - DNA, 20 bp, Artificial
  CRISPR gRNA sequence
tctcaaagtgctgggattac

SEQ ID NO: 702552 - DNA, 20 bp, Artificial
  CRISPR gRNA sequence
agtgctgggattacaggcct

SEQ ID NO: 702553 - DNA, 20 bp, Artificial
  CRISPR gRNA sequence
caggcctgagccaccatgcc

SEQ ID NO: 702554 - DNA, 20 bp, Artificial
  CRISPR gRNA sequence
tgagccaccatgcccagccc

SEQ ID NO: 702555 - DNA, 20 bp, Artificial
  CRISPR gRNA sequence
gagccaccatgcccagcccc

SEQ ID NO: 702556 - DNA, 20 bp, Artificial
  CRISPR gRNA sequence
caccatgcccagccccgggc

SEQ ID NO: 702557 - DNA, 20 bp, Artificial
  CRISPR gRNA sequence
taaaatcttgacctgtttgc

SEQ ID NO: 702558 - DNA, 20 bp, Artificial
  CRISPR gRNA sequence
aaaatcttgacctgtttgca

SEQ ID NO: 702559 - DNA, 20 bp, Artificial
  CRISPR gRNA sequence
gcaaggctgttttattgact

SEQ ID NO: 702560 - DNA, 20 bp, Artificial
  CRISPR gRNA sequence
aaggctgttttattgactta

SEQ ID NO: 702561 - DNA, 20 bp, Artificial
  CRISPR gRNA sequence
ggctgttttattgacttaga

SEQ ID NO: 702562 - DNA, 20 bp, Artificial
  CRISPR gRNA sequence
gacttagagagatgaatatc

SEQ ID NO: 702563 - DNA, 20 bp, Artificial
  CRISPR gRNA sequence
agatgaatatcaagtttctg

SEQ ID NO: 702564 - DNA, 20 bp, Artificial
  CRISPR gRNA sequence
atgaatatcaagtttctgaa

SEQ ID NO: 702565 - DNA, 20 bp, Artificial
  CRISPR gRNA sequence
gtttctgaagagatttctaa

SEQ ID NO: 702566 - DNA, 20 bp, Artificial
  CRISPR gRNA sequence
tttctgaagagatttctaac

SEQ ID NO: 702567 - DNA, 20 bp, Artificial
  CRISPR gRNA sequence
tgaagagatttctaacagga

SEQ ID NO: 702568 - DNA, 20 bp, Artificial
  CRISPR gRNA sequence
gagatttctaacaggacggt

SEQ ID NO: 702569 - DNA, 20 bp, Artificial
  CRISPR gRNA sequence
aacaggacggttggctttac

SEQ ID NO: 702570 - DNA, 20 bp, Artificial
  CRISPR gRNA sequence
cggttggctttaccagtgtg

SEQ ID NO: 702571 - DNA, 20 bp, Artificial
  CRISPR gRNA sequence
ggttggctttaccagtgtgc

SEQ ID NO: 702572 - DNA, 20 bp, Artificial
  CRISPR gRNA sequence
gcaggaaactaaaaccctga

SEQ ID NO: 702573 - DNA, 20 bp, Artificial
  CRISPR gRNA sequence
gttgttgttttttgtttttt

SEQ ID NO: 702574 - DNA, 20 bp, Artificial
  CRISPR gRNA sequence
ttgttgttttttgtttttta

SEQ ID NO: 702575 - DNA, 20 bp, Artificial
  CRISPR gRNA sequence
tgttgttttttgttttttaa

SEQ ID NO: 702576 - DNA, 20 bp, Artificial
  CRISPR gRNA sequence
ttttgttttttaagggcttt

SEQ ID NO: 702577 - DNA, 20 bp, Artificial
  CRISPR gRNA sequence
ttgttttttaagggctttga

SEQ ID NO: 702578 - DNA, 20 bp, Artificial
  CRISPR gRNA sequence
gagagattttaacaaatctc

SEQ ID NO: 702579 - DNA, 20 bp, Artificial
  CRISPR gRNA sequence
agagattttaacaaatctcc

SEQ ID NO: 702580 - DNA, 20 bp, Artificial
  CRISPR gRNA sequence
gattttaacaaatctccagg

SEQ ID NO: 702581 - DNA, 20 bp, Artificial
  CRISPR gRNA sequence
aatctccaggtggtttaaaa

SEQ ID NO: 702582 - DNA, 20 bp, Artificial
  CRISPR gRNA sequence
tccaggtggtttaaaacaga

SEQ ID NO: 702583 - DNA, 20 bp, Artificial
  CRISPR gRNA sequence
aggtggtttaaaacagatgg

SEQ ID NO: 702584 - DNA, 20 bp, Artificial
  CRISPR gRNA sequence
gtggtttaaaacagatggaa

SEQ ID NO: 702585 - DNA, 20 bp, Artificial
  CRISPR gRNA sequence
gtttaaaacagatggaagag

SEQ ID NO: 702586 - DNA, 20 bp, Artificial
  CRISPR gRNA sequence
ggaagagtggtgacaaaacc

SEQ ID NO: 702587 - DNA, 20 bp, Artificial
  CRISPR gRNA sequence
gaagagtggtgacaaaacca

SEQ ID NO: 702588 - DNA, 20 bp, Artificial
  CRISPR gRNA sequence
aagagtggtgacaaaaccaa

SEQ ID NO: 702589 - DNA, 20 bp, Artificial
  CRISPR gRNA sequence
agagtggtgacaaaaccaag

SEQ ID NO: 702590 - DNA, 20 bp, Artificial
  CRISPR gRNA sequence
ggtgacaaaaccaaggggaa

SEQ ID NO: 702591 - DNA, 20 bp, Artificial
  CRISPR gRNA sequence
acaaaaccaaggggaatggc

SEQ ID NO: 702592 - DNA, 20 bp, Artificial
  CRISPR gRNA sequence
caaaaccaaggggaatggcc

SEQ ID NO: 702593 - DNA, 20 bp, Artificial
  CRISPR gRNA sequence
ccaaggggaatggccaggcg

SEQ ID NO: 702594 - DNA, 20 bp, Artificial
  CRISPR gRNA sequence
aggggaatggccaggcgtgg

SEQ ID NO: 702595 - DNA, 20 bp, Artificial
  CRISPR gRNA sequence
gtggctcacgcctgtgatcc

SEQ ID NO: 702596 - DNA, 20 bp, Artificial
  CRISPR gRNA sequence
cgcctgtgatcccagcactt

SEQ ID NO: 702597 - DNA, 20 bp, Artificial
  CRISPR gRNA sequence
gcctgtgatcccagcacttt

SEQ ID NO: 702598 - DNA, 20 bp, Artificial
  CRISPR gRNA sequence
ctgtgatcccagcactttgg

SEQ ID NO: 702599 - DNA, 20 bp, Artificial
  CRISPR gRNA sequence
tgtgatcccagcactttggg

SEQ ID NO: 702600 - DNA, 20 bp, Artificial
  CRISPR gRNA sequence
tcccagcactttgggaggct

SEQ ID NO: 702601 - DNA, 20 bp, Artificial
  CRISPR gRNA sequence
cccagcactttgggaggctg

SEQ ID NO: 702602 - DNA, 20 bp, Artificial
  CRISPR gRNA sequence
agcactttgggaggctgagg

SEQ ID NO: 702603 - DNA, 20 bp, Artificial
  CRISPR gRNA sequence
gcactttgggaggctgaggc

SEQ ID NO: 702604 - DNA, 20 bp, Artificial
  CRISPR gRNA sequence
ctttgggaggctgaggcagg

SEQ ID NO: 702605 - DNA, 20 bp, Artificial
  CRISPR gRNA sequence
ctgaggcaggtggatcactt

SEQ ID NO: 702606 - DNA, 20 bp, Artificial
  CRISPR gRNA sequence
tgaggcaggtggatcacttg

SEQ ID NO: 702607 - DNA, 20 bp, Artificial
  CRISPR gRNA sequence
gcaggtggatcacttgaggt

SEQ ID NO: 702608 - DNA, 20 bp, Artificial
  CRISPR gRNA sequence
caggtggatcacttgaggtc

SEQ ID NO: 702609 - DNA, 20 bp, Artificial
  CRISPR gRNA sequence
ggtggatcacttgaggtcag

SEQ ID NO: 702610 - DNA, 20 bp, Artificial
  CRISPR gRNA sequence
tcacttgaggtcaggagttc

SEQ ID NO: 702611 - DNA, 20 bp, Artificial
  CRISPR gRNA sequence
tgaggtcaggagttcaagac

SEQ ID NO: 702612 - DNA, 20 bp, Artificial
  CRISPR gRNA sequence
caagaccagcctgaccaaca

SEQ ID NO: 702613 - DNA, 20 bp, Artificial
  CRISPR gRNA sequence
tctactaaaaatacacaaat

SEQ ID NO: 702614 - DNA, 20 bp, Artificial
  CRISPR gRNA sequence
ctaaaaatacacaaattagc

SEQ ID NO: 702615 - DNA, 20 bp, Artificial
  CRISPR gRNA sequence
taaaaatacacaaattagct

SEQ ID NO: 702616 - DNA, 20 bp, Artificial
  CRISPR gRNA sequence
atacacaaattagctgggtg

SEQ ID NO: 702617 - DNA, 20 bp, Artificial
  CRISPR gRNA sequence
cacaaattagctgggtgtgg

SEQ ID NO: 702618 - DNA, 20 bp, Artificial
  CRISPR gRNA sequence
aaattagctgggtgtggtgg

SEQ ID NO: 702619 - DNA, 20 bp, Artificial
  CRISPR gRNA sequence
aattagctgggtgtggtggt

SEQ ID NO: 702620 - DNA, 20 bp, Artificial
  CRISPR gRNA sequence
gggtgtggtggtgggcaccg

SEQ ID NO: 702621 - DNA, 20 bp, Artificial
  CRISPR gRNA sequence
ggtggtgggcaccgtagtcc

SEQ ID NO: 702622 - DNA, 20 bp, Artificial
  CRISPR gRNA sequence
gcaccgtagtcccagctact

SEQ ID NO: 702623 - DNA, 20 bp, Artificial
  CRISPR gRNA sequence
caccgtagtcccagctactc

SEQ ID NO: 702624 - DNA, 20 bp, Artificial
  CRISPR gRNA sequence
ccgtagtcccagctactcag

SEQ ID NO: 702625 - DNA, 20 bp, Artificial
  CRISPR gRNA sequence
cgtagtcccagctactcagg

SEQ ID NO: 702626 - DNA, 20 bp, Artificial
  CRISPR gRNA sequence
tcccagctactcaggaggtt

SEQ ID NO: 702627 - DNA, 20 bp, Artificial
  CRISPR gRNA sequence
cccagctactcaggaggttg

SEQ ID NO: 702628 - DNA, 20 bp, Artificial
  CRISPR gRNA sequence
agctactcaggaggttgagg

SEQ ID NO: 702629 - DNA, 20 bp, Artificial
  CRISPR gRNA sequence
gctactcaggaggttgaggc

SEQ ID NO: 702630 - DNA, 20 bp, Artificial
  CRISPR gRNA sequence
tactcaggaggttgaggcag

SEQ ID NO: 702631 - DNA, 20 bp, Artificial
  CRISPR gRNA sequence
gcaggagaatcgcttgaacc

SEQ ID NO: 702632 - DNA, 20 bp, Artificial
  CRISPR gRNA sequence
caggagaatcgcttgaaccc

SEQ ID NO: 702633 - DNA, 20 bp, Artificial
  CRISPR gRNA sequence
ggagaatcgcttgaacccgg

SEQ ID NO: 702634 - DNA, 20 bp, Artificial
  CRISPR gRNA sequence
gagaatcgcttgaacccggg

SEQ ID NO: 702635 - DNA, 20 bp, Artificial
  CRISPR gRNA sequence
tcgcttgaacccgggaggca

SEQ ID NO: 702636 - DNA, 20 bp, Artificial
  CRISPR gRNA sequence
cgcttgaacccgggaggcat

SEQ ID NO: 702637 - DNA, 20 bp, Artificial
  CRISPR gRNA sequence
aacccgggaggcataggttg

SEQ ID NO: 702638 - DNA, 20 bp, Artificial
  CRISPR gRNA sequence
cgggaggcataggttgcagt

SEQ ID NO: 702639 - DNA, 20 bp, Artificial
  CRISPR gRNA sequence
ggcataggttgcagtgagcc

SEQ ID NO: 702640 - DNA, 20 bp, Artificial
  CRISPR gRNA sequence
gagattgcaccactgaactc

SEQ ID NO: 702641 - DNA, 20 bp, Artificial
  CRISPR gRNA sequence
tgcaccactgaactccagcc

SEQ ID NO: 702642 - DNA, 20 bp, Artificial
  CRISPR gRNA sequence
gcaccactgaactccagcct

SEQ ID NO: 702643 - DNA, 20 bp, Artificial
  CRISPR gRNA sequence
ctgaactccagcctgggcaa

SEQ ID NO: 702644 - DNA, 20 bp, Artificial
  CRISPR gRNA sequence
tgaactccagcctgggcaac

SEQ ID NO: 702645 - DNA, 20 bp, Artificial
  CRISPR gRNA sequence
gaactccagcctgggcaaca

SEQ ID NO: 702646 - DNA, 20 bp, Artificial
  CRISPR gRNA sequence
gggcgaaactctgcctaaaa

SEQ ID NO: 702647 - DNA, 20 bp, Artificial
  CRISPR gRNA sequence
cctaaaaaagaaaaaaaacc

SEQ ID NO: 702648 - DNA, 20 bp, Artificial
  CRISPR gRNA sequence
aaaaaagaaaaaaaaccaag

SEQ ID NO: 702649 - DNA, 20 bp, Artificial
  CRISPR gRNA sequence
aaaagaaaaaaaaccaagtg

SEQ ID NO: 702650 - DNA, 20 bp, Artificial
  CRISPR gRNA sequence
aaagaaaaaaaaccaagtgg

SEQ ID NO: 702651 - DNA, 20 bp, Artificial
  CRISPR gRNA sequence
aagaaaaaaaaccaagtgga

SEQ ID NO: 702652 - DNA, 20 bp, Artificial
  CRISPR gRNA sequence
aaaaaaaaccaagtggaggg

SEQ ID NO: 702653 - DNA, 20 bp, Artificial
  CRISPR gRNA sequence
aaaaaaaccaagtggaggga

SEQ ID NO: 702654 - DNA, 20 bp, Artificial
  CRISPR gRNA sequence
gtcacccaatgtgactctgt

SEQ ID NO: 702655 - DNA, 20 bp, Artificial
  CRISPR gRNA sequence
tcacccaatgtgactctgtg

SEQ ID NO: 702656 - DNA, 20 bp, Artificial
  CRISPR gRNA sequence
cacccaatgtgactctgtga

SEQ ID NO: 702657 - DNA, 20 bp, Artificial
  CRISPR gRNA sequence
tgtgactctgtgagggctgc

SEQ ID NO: 702658 - DNA, 20 bp, Artificial
  CRISPR gRNA sequence
tgactctgtgagggctgcca

SEQ ID NO: 702659 - DNA, 20 bp, Artificial
  CRISPR gRNA sequence
ctctgtgagggctgccagag

SEQ ID NO: 702660 - DNA, 20 bp, Artificial
  CRISPR gRNA sequence
gtgagggctgccagagaagt

SEQ ID NO: 702661 - DNA, 20 bp, Artificial
  CRISPR gRNA sequence
tgagggctgccagagaagtg

SEQ ID NO: 702662 - DNA, 20 bp, Artificial
  CRISPR gRNA sequence
gagggctgccagagaagtga

SEQ ID NO: 702663 - DNA, 20 bp, Artificial
  CRISPR gRNA sequence
agggctgccagagaagtgag

SEQ ID NO: 702664 - DNA, 20 bp, Artificial
  CRISPR gRNA sequence
agtgaggggtgacttgcttc

SEQ ID NO: 702665 - DNA, 20 bp, Artificial
  CRISPR gRNA sequence
gtgaggggtgacttgcttct

SEQ ID NO: 702666 - DNA, 20 bp, Artificial
  CRISPR gRNA sequence
tgacttgcttctaggacccc

SEQ ID NO: 702667 - DNA, 20 bp, Artificial
  CRISPR gRNA sequence
acttgcttctaggaccccca

SEQ ID NO: 702668 - DNA, 20 bp, Artificial
  CRISPR gRNA sequence
ttgcttctaggacccccaga

SEQ ID NO: 702669 - DNA, 20 bp, Artificial
  CRISPR gRNA sequence
tgcttctaggacccccagag

SEQ ID NO: 702670 - DNA, 20 bp, Artificial
  CRISPR gRNA sequence
taggacccccagagaggctc

SEQ ID NO: 702671 - DNA, 20 bp, Artificial
  CRISPR gRNA sequence
aggacccccagagaggctct

SEQ ID NO: 702672 - DNA, 20 bp, Artificial
  CRISPR gRNA sequence
ccccagagaggctctgggct

SEQ ID NO: 702673 - DNA, 20 bp, Artificial
  CRISPR gRNA sequence
cagagaggctctgggcttgg

SEQ ID NO: 702674 - DNA, 20 bp, Artificial
  CRISPR gRNA sequence
gagaggctctgggcttggaa

SEQ ID NO: 702675 - DNA, 20 bp, Artificial
  CRISPR gRNA sequence
agaggctctgggcttggaag

SEQ ID NO: 702676 - DNA, 20 bp, Artificial
  CRISPR gRNA sequence
ggctctgggcttggaagagg

SEQ ID NO: 702677 - DNA, 20 bp, Artificial
  CRISPR gRNA sequence
gctctgggcttggaagaggc

SEQ ID NO: 702678 - DNA, 20 bp, Artificial
  CRISPR gRNA sequence
ctgggcttggaagaggcagg

SEQ ID NO: 702679 - DNA, 20 bp, Artificial
  CRISPR gRNA sequence
ttggaagaggcaggcagatg

SEQ ID NO: 702680 - DNA, 20 bp, Artificial
  CRISPR gRNA sequence
ggaagaggcaggcagatgaa

SEQ ID NO: 702681 - DNA, 20 bp, Artificial
  CRISPR gRNA sequence
agaggcaggcagatgaagag

SEQ ID NO: 702682 - DNA, 20 bp, Artificial
  CRISPR gRNA sequence
gaggcaggcagatgaagagc

SEQ ID NO: 702683 - DNA, 20 bp, Artificial
  CRISPR gRNA sequence
ggcaggcagatgaagagcgg

SEQ ID NO: 702684 - DNA, 20 bp, Artificial
  CRISPR gRNA sequence
gcaggcagatgaagagcggg

SEQ ID NO: 702685 - DNA, 20 bp, Artificial
  CRISPR gRNA sequence
caggcagatgaagagcggga

SEQ ID NO: 702686 - DNA, 20 bp, Artificial
  CRISPR gRNA sequence
gcagatgaagagcgggaggg

SEQ ID NO: 702687 - DNA, 20 bp, Artificial
  CRISPR gRNA sequence
tgaagagcgggagggaagtt

SEQ ID NO: 702688 - DNA, 20 bp, Artificial
  CRISPR gRNA sequence
aagagcgggagggaagttga

SEQ ID NO: 702689 - DNA, 20 bp, Artificial
  CRISPR gRNA sequence
agagcgggagggaagttgag

SEQ ID NO: 702690 - DNA, 20 bp, Artificial
  CRISPR gRNA sequence
ggagggaagttgagaggtgt

SEQ ID NO: 702691 - DNA, 20 bp, Artificial
  CRISPR gRNA sequence
gagggaagttgagaggtgtg

SEQ ID NO: 702692 - DNA, 20 bp, Artificial
  CRISPR gRNA sequence
aagttgagaggtgtgaggtg

SEQ ID NO: 702693 - DNA, 20 bp, Artificial
  CRISPR gRNA sequence
ttgagaggtgtgaggtgtag

SEQ ID NO: 702694 - DNA, 20 bp, Artificial
  CRISPR gRNA sequence
aggtgtgaggtgtagtggcc

SEQ ID NO: 702695 - DNA, 20 bp, Artificial
  CRISPR gRNA sequence
ggtgtgaggtgtagtggcct

SEQ ID NO: 702696 - DNA, 20 bp, Artificial
  CRISPR gRNA sequence
aacttcaaaatgtattacaa

SEQ ID NO: 702697 - DNA, 20 bp, Artificial
  CRISPR gRNA sequence
caaaatgtattacaatggca

SEQ ID NO: 702698 - DNA, 20 bp, Artificial
  CRISPR gRNA sequence
tgtattacaatggcatggca

SEQ ID NO: 702699 - DNA, 20 bp, Artificial
  CRISPR gRNA sequence
ggcatggcatggccactgac

SEQ ID NO: 702700 - DNA, 20 bp, Artificial
  CRISPR gRNA sequence
tggccactgaccagtttgca

SEQ ID NO: 702701 - DNA, 20 bp, Artificial
  CRISPR gRNA sequence
agtttgcacagatgatgcct

SEQ ID NO: 702702 - DNA, 20 bp, Artificial
  CRISPR gRNA sequence
atgcctgagtttttaatccc

SEQ ID NO: 702703 - DNA, 20 bp, Artificial
  CRISPR gRNA sequence
ctttttttttcctctttttt

SEQ ID NO: 702704 - DNA, 20 bp, Artificial
  CRISPR gRNA sequence
ttttttttcctcttttttta

SEQ ID NO: 702705 - DNA, 20 bp, Artificial
  CRISPR gRNA sequence
ttttcctctttttttagaga

SEQ ID NO: 702706 - DNA, 20 bp, Artificial
  CRISPR gRNA sequence
ttcctctttttttagagatg

SEQ ID NO: 702707 - DNA, 20 bp, Artificial
  CRISPR gRNA sequence
tggagtctcgctgtcttgcc

SEQ ID NO: 702708 - DNA, 20 bp, Artificial
  CRISPR gRNA sequence
ggagtctcgctgtcttgccc

SEQ ID NO: 702709 - DNA, 20 bp, Artificial
  CRISPR gRNA sequence
gtcttgcccaggccgatgtg

SEQ ID NO: 702710 - DNA, 20 bp, Artificial
  CRISPR gRNA sequence
ttgcccaggccgatgtgcag

SEQ ID NO: 702711 - DNA, 20 bp, Artificial
  CRISPR gRNA sequence
gatgtgcagtggtgtaatct

SEQ ID NO: 702712 - DNA, 20 bp, Artificial
  CRISPR gRNA sequence
tcactgcaacctccgtctcc

SEQ ID NO: 702713 - DNA, 20 bp, Artificial
  CRISPR gRNA sequence
cactgcaacctccgtctccc

SEQ ID NO: 702714 - DNA, 20 bp, Artificial
  CRISPR gRNA sequence
caacctccgtctcccgggtt

SEQ ID NO: 702715 - DNA, 20 bp, Artificial
  CRISPR gRNA sequence
aacctccgtctcccgggttc

SEQ ID NO: 702716 - DNA, 20 bp, Artificial
  CRISPR gRNA sequence
ttcaggcaattctcctgcct

SEQ ID NO: 702717 - DNA, 20 bp, Artificial
  CRISPR gRNA sequence
ttctcctgcctcagcctccc

SEQ ID NO: 702718 - DNA, 20 bp, Artificial
  CRISPR gRNA sequence
tcctgcctcagcctcccgag

SEQ ID NO: 702719 - DNA, 20 bp, Artificial
  CRISPR gRNA sequence
gcctcagcctcccgagtagc

SEQ ID NO: 702720 - DNA, 20 bp, Artificial
  CRISPR gRNA sequence
cctcagcctcccgagtagct

SEQ ID NO: 702721 - DNA, 20 bp, Artificial
  CRISPR gRNA sequence
ctcccgagtagctgggatta

SEQ ID NO: 702722 - DNA, 20 bp, Artificial
  CRISPR gRNA sequence
tcccgagtagctgggattac

SEQ ID NO: 702723 - DNA, 20 bp, Artificial
  CRISPR gRNA sequence
caggtgcccgccaccacacc

SEQ ID NO: 702724 - DNA, 20 bp, Artificial
  CRISPR gRNA sequence
ccagctaattttcatatttt

SEQ ID NO: 702725 - DNA, 20 bp, Artificial
  CRISPR gRNA sequence
gctaattttcatatttttag

SEQ ID NO: 702726 - DNA, 20 bp, Artificial
  CRISPR gRNA sequence
taattttcatatttttagta

SEQ ID NO: 702727 - DNA, 20 bp, Artificial
  CRISPR gRNA sequence
tttcatatttttagtagaga

SEQ ID NO: 702728 - DNA, 20 bp, Artificial
  CRISPR gRNA sequence
ttcatatttttagtagagac

SEQ ID NO: 702729 - DNA, 20 bp, Artificial
  CRISPR gRNA sequence
tcatatttttagtagagacg

SEQ ID NO: 702730 - DNA, 20 bp, Artificial
  CRISPR gRNA sequence
gagacggggttttgccatgt

SEQ ID NO: 702731 - DNA, 20 bp, Artificial
  CRISPR gRNA sequence
cggggttttgccatgttggc

SEQ ID NO: 702732 - DNA, 20 bp, Artificial
  CRISPR gRNA sequence
ggggttttgccatgttggcc

SEQ ID NO: 702733 - DNA, 20 bp, Artificial
  CRISPR gRNA sequence
ttttgccatgttggccaggc

SEQ ID NO: 702734 - DNA, 20 bp, Artificial
  CRISPR gRNA sequence
ccatgttggccaggctggtc

SEQ ID NO: 702735 - DNA, 20 bp, Artificial
  CRISPR gRNA sequence
ggtctggaactcctgacctc

SEQ ID NO: 702736 - DNA, 20 bp, Artificial
  CRISPR gRNA sequence
ctgcccgcctccacctccca

SEQ ID NO: 702737 - DNA, 20 bp, Artificial
  CRISPR gRNA sequence
gcctccacctcccaaagtgc

SEQ ID NO: 702738 - DNA, 20 bp, Artificial
  CRISPR gRNA sequence
cctccacctcccaaagtgct

SEQ ID NO: 702739 - DNA, 20 bp, Artificial
  CRISPR gRNA sequence
ctcccaaagtgctgggatta

SEQ ID NO: 702740 - DNA, 20 bp, Artificial
  CRISPR gRNA sequence
tcccaaagtgctgggattac

SEQ ID NO: 702741 - DNA, 20 bp, Artificial
  CRISPR gRNA sequence
agtgctgggattacaggtgt

SEQ ID NO: 702742 - DNA, 20 bp, Artificial
  CRISPR gRNA sequence
caggtgtgagccaccgtgcc

SEQ ID NO: 702743 - DNA, 20 bp, Artificial
  CRISPR gRNA sequence
tggccaacaattgtcttctt

SEQ ID NO: 702744 - DNA, 20 bp, Artificial
  CRISPR gRNA sequence
caacaattgtcttcttgagt

SEQ ID NO: 702745 - DNA, 20 bp, Artificial
  CRISPR gRNA sequence
cttcttgagtcagaacattg

SEQ ID NO: 702746 - DNA, 20 bp, Artificial
  CRISPR gRNA sequence
ttcttgagtcagaacattga

SEQ ID NO: 702747 - DNA, 20 bp, Artificial
  CRISPR gRNA sequence
cagaacattgaaggaatatc

SEQ ID NO: 702748 - DNA, 20 bp, Artificial
  CRISPR gRNA sequence
agaacattgaaggaatatcc

SEQ ID NO: 702749 - DNA, 20 bp, Artificial
  CRISPR gRNA sequence
gaacattgaaggaatatccg

SEQ ID NO: 702750 - DNA, 20 bp, Artificial
  CRISPR gRNA sequence
attgaaggaatatccgggga

SEQ ID NO: 702751 - DNA, 20 bp, Artificial
  CRISPR gRNA sequence
aggaatatccggggaaagtt

SEQ ID NO: 702752 - DNA, 20 bp, Artificial
  CRISPR gRNA sequence
ggaatatccggggaaagttc

SEQ ID NO: 702753 - DNA, 20 bp, Artificial
  CRISPR gRNA sequence
ccggggaaagttcgggccac

SEQ ID NO: 702754 - DNA, 20 bp, Artificial
  CRISPR gRNA sequence
gggaaagttcgggccactag

SEQ ID NO: 702755 - DNA, 20 bp, Artificial
  CRISPR gRNA sequence
ggaaagttcgggccactagt

SEQ ID NO: 702756 - DNA, 20 bp, Artificial
  CRISPR gRNA sequence
gaaagttcgggccactagtg

SEQ ID NO: 702757 - DNA, 20 bp, Artificial
  CRISPR gRNA sequence
gtgctgtcactctgtttgta

SEQ ID NO: 702758 - DNA, 20 bp, Artificial
  CRISPR gRNA sequence
tttgtaaagccctctttact

SEQ ID NO: 702759 - DNA, 20 bp, Artificial
  CRISPR gRNA sequence
ttgtaaagccctctttactt

SEQ ID NO: 702760 - DNA, 20 bp, Artificial
  CRISPR gRNA sequence
gccctctttacttgggtatt

SEQ ID NO: 702761 - DNA, 20 bp, Artificial
  CRISPR gRNA sequence
ctctttacttgggtatttgg

SEQ ID NO: 702762 - DNA, 20 bp, Artificial
  CRISPR gRNA sequence
tttggaagtgcacctgtcaa

SEQ ID NO: 702763 - DNA, 20 bp, Artificial
  CRISPR gRNA sequence
ttggaagtgcacctgtcaac

SEQ ID NO: 702764 - DNA, 20 bp, Artificial
  CRISPR gRNA sequence
aagtgcacctgtcaacaggc

SEQ ID NO: 702765 - DNA, 20 bp, Artificial
  CRISPR gRNA sequence
cacaccccatcaccctgaaa

SEQ ID NO: 702766 - DNA, 20 bp, Artificial
  CRISPR gRNA sequence
caccccatcaccctgaaatg

SEQ ID NO: 702767 - DNA, 20 bp, Artificial
  CRISPR gRNA sequence
accccatcaccctgaaatgg

SEQ ID NO: 702768 - DNA, 20 bp, Artificial
  CRISPR gRNA sequence
caccctgaaatggaggctgc

SEQ ID NO: 702769 - DNA, 20 bp, Artificial
  CRISPR gRNA sequence
cagctcacactctccgccca

SEQ ID NO: 702770 - DNA, 20 bp, Artificial
  CRISPR gRNA sequence
agctcacactctccgcccat

SEQ ID NO: 702771 - DNA, 20 bp, Artificial
  CRISPR gRNA sequence
acactctccgcccatgggcc

SEQ ID NO: 702772 - DNA, 20 bp, Artificial
  CRISPR gRNA sequence
cactctccgcccatgggccc

SEQ ID NO: 702773 - DNA, 20 bp, Artificial
  CRISPR gRNA sequence
actctccgcccatgggccca

SEQ ID NO: 702774 - DNA, 20 bp, Artificial
  CRISPR gRNA sequence
cccatgggcccagggttccc

SEQ ID NO: 702775 - DNA, 20 bp, Artificial
  CRISPR gRNA sequence
tccctggccaacttcctact

SEQ ID NO: 702776 - DNA, 20 bp, Artificial
  CRISPR gRNA sequence
ccctggccaacttcctactc

SEQ ID NO: 702777 - DNA, 20 bp, Artificial
  CRISPR gRNA sequence
cctggccaacttcctactca

SEQ ID NO: 702778 - DNA, 20 bp, Artificial
  CRISPR gRNA sequence
ggccaacttcctactcaggg

SEQ ID NO: 702779 - DNA, 20 bp, Artificial
  CRISPR gRNA sequence
ccaacttcctactcagggaa

SEQ ID NO: 702780 - DNA, 20 bp, Artificial
  CRISPR gRNA sequence
gggaagagacccattgtgaa

SEQ ID NO: 702781 - DNA, 20 bp, Artificial
  CRISPR gRNA sequence
ggaagagacccattgtgaac

SEQ ID NO: 702782 - DNA, 20 bp, Artificial
  CRISPR gRNA sequence
gtgaacaggacatactaaca

SEQ ID NO: 702783 - DNA, 20 bp, Artificial
  CRISPR gRNA sequence
aacaggacatactaacacag

SEQ ID NO: 702784 - DNA, 20 bp, Artificial
  CRISPR gRNA sequence
aggacatactaacacagcag

SEQ ID NO: 702785 - DNA, 20 bp, Artificial
  CRISPR gRNA sequence
cagaagaaactgtccccgct

SEQ ID NO: 702786 - DNA, 20 bp, Artificial
  CRISPR gRNA sequence
aactgtccccgctcagtgac

SEQ ID NO: 702787 - DNA, 20 bp, Artificial
  CRISPR gRNA sequence
cgctcagtgactggaatatt

SEQ ID NO: 702788 - DNA, 20 bp, Artificial
  CRISPR gRNA sequence
tcagtgactggaatattcag

SEQ ID NO: 702789 - DNA, 20 bp, Artificial
  CRISPR gRNA sequence
agtgactggaatattcagta

SEQ ID NO: 702790 - DNA, 20 bp, Artificial
  CRISPR gRNA sequence
ggaatattcagtagagtcct

SEQ ID NO: 702791 - DNA, 20 bp, Artificial
  CRISPR gRNA sequence
gaatattcagtagagtcctt

SEQ ID NO: 702792 - DNA, 20 bp, Artificial
  CRISPR gRNA sequence
attttgtttgcataaatgta

SEQ ID NO: 702793 - DNA, 20 bp, Artificial
  CRISPR gRNA sequence
ttttgtttgcataaatgtat

SEQ ID NO: 702794 - DNA, 20 bp, Artificial
  CRISPR gRNA sequence
tttgtttgcataaatgtatg

SEQ ID NO: 702795 - DNA, 20 bp, Artificial
  CRISPR gRNA sequence
tgcataaatgtatggggtac

SEQ ID NO: 702796 - DNA, 20 bp, Artificial
  CRISPR gRNA sequence
gtgtaattttattacatgct

SEQ ID NO: 702797 - DNA, 20 bp, Artificial
  CRISPR gRNA sequence
attttattacatgcttagat

SEQ ID NO: 702798 - DNA, 20 bp, Artificial
  CRISPR gRNA sequence
ttttattacatgcttagatt

SEQ ID NO: 702799 - DNA, 20 bp, Artificial
  CRISPR gRNA sequence
tattacatgcttagattggg

SEQ ID NO: 702800 - DNA, 20 bp, Artificial
  CRISPR gRNA sequence
cttagattgggtggtgaact

SEQ ID NO: 702801 - DNA, 20 bp, Artificial
  CRISPR gRNA sequence
ttagattgggtggtgaactc

SEQ ID NO: 702802 - DNA, 20 bp, Artificial
  CRISPR gRNA sequence
ggtggtgaactcaggacgtt

SEQ ID NO: 702803 - DNA, 20 bp, Artificial
  CRISPR gRNA sequence
gtggtgaactcaggacgttt

SEQ ID NO: 702804 - DNA, 20 bp, Artificial
  CRISPR gRNA sequence
tggtgaactcaggacgttta

SEQ ID NO: 702805 - DNA, 20 bp, Artificial
  CRISPR gRNA sequence
tagggtatccctcacccaaa

SEQ ID NO: 702806 - DNA, 20 bp, Artificial
  CRISPR gRNA sequence
accccttaaataatttctca

SEQ ID NO: 702807 - DNA, 20 bp, Artificial
  CRISPR gRNA sequence
tcccaccccctcacccttct

SEQ ID NO: 702808 - DNA, 20 bp, Artificial
  CRISPR gRNA sequence
ttgccttttattccactctc

SEQ ID NO: 702809 - DNA, 20 bp, Artificial
  CRISPR gRNA sequence
ttccactctccagctccgtg

SEQ ID NO: 702810 - DNA, 20 bp, Artificial
  CRISPR gRNA sequence
tctccagctccgtgtggaca

SEQ ID NO: 702811 - DNA, 20 bp, Artificial
  CRISPR gRNA sequence
cacagtatttcactcccact

SEQ ID NO: 702812 - DNA, 20 bp, Artificial
  CRISPR gRNA sequence
agtatttcactcccacttag

SEQ ID NO: 702813 - DNA, 20 bp, Artificial
  CRISPR gRNA sequence
tttcactcccacttagaagt

SEQ ID NO: 702814 - DNA, 20 bp, Artificial
  CRISPR gRNA sequence
ctcccacttagaagtgagaa

SEQ ID NO: 702815 - DNA, 20 bp, Artificial
  CRISPR gRNA sequence
tcccacttagaagtgagaac

SEQ ID NO: 702816 - DNA, 20 bp, Artificial
  CRISPR gRNA sequence
cacttagaagtgagaacagg

SEQ ID NO: 702817 - DNA, 20 bp, Artificial
  CRISPR gRNA sequence
gtgtctgaatgtctgcactt

SEQ ID NO: 702818 - DNA, 20 bp, Artificial
  CRISPR gRNA sequence
aatgtctgcacttaagaata

SEQ ID NO: 702819 - DNA, 20 bp, Artificial
  CRISPR gRNA sequence
gcacttaagaatatggcctt

SEQ ID NO: 702820 - DNA, 20 bp, Artificial
  CRISPR gRNA sequence
ttccatccatgttgctgcga

SEQ ID NO: 702821 - DNA, 20 bp, Artificial
  CRISPR gRNA sequence
cttgatttctttccttatga

SEQ ID NO: 702822 - DNA, 20 bp, Artificial
  CRISPR gRNA sequence
tttctttccttatgatggct

SEQ ID NO: 702823 - DNA, 20 bp, Artificial
  CRISPR gRNA sequence
ctttccttatgatggctgag

SEQ ID NO: 702824 - DNA, 20 bp, Artificial
  CRISPR gRNA sequence
gagtagtattccattgtgta

SEQ ID NO: 702825 - DNA, 20 bp, Artificial
  CRISPR gRNA sequence
tagatgccacatttatctat

SEQ ID NO: 702826 - DNA, 20 bp, Artificial
  CRISPR gRNA sequence
atgccacatttatctattgg

SEQ ID NO: 702827 - DNA, 20 bp, Artificial
  CRISPR gRNA sequence
catttatctattggtggatg

SEQ ID NO: 702828 - DNA, 20 bp, Artificial
  CRISPR gRNA sequence
ccccccacccttttcttttt

SEQ ID NO: 702829 - DNA, 20 bp, Artificial
  CRISPR gRNA sequence
acccttttctttttgagaca

SEQ ID NO: 702830 - DNA, 20 bp, Artificial
  CRISPR gRNA sequence
caaagtctcgctctgttgcc

SEQ ID NO: 702831 - DNA, 20 bp, Artificial
  CRISPR gRNA sequence
aaagtctcgctctgttgccc

SEQ ID NO: 702832 - DNA, 20 bp, Artificial
  CRISPR gRNA sequence
tctcgctctgttgcccaggc

SEQ ID NO: 702833 - DNA, 20 bp, Artificial
  CRISPR gRNA sequence
tcgctctgttgcccaggctg

SEQ ID NO: 702834 - DNA, 20 bp, Artificial
  CRISPR gRNA sequence
ctgttgcccaggctggagtg

SEQ ID NO: 702835 - DNA, 20 bp, Artificial
  CRISPR gRNA sequence
ttgcccaggctggagtgcag

SEQ ID NO: 702836 - DNA, 20 bp, Artificial
  CRISPR gRNA sequence
caggctggagtgcagtggta

SEQ ID NO: 702837 - DNA, 20 bp, Artificial
  CRISPR gRNA sequence
ggagtgcagtggtatggtct

SEQ ID NO: 702838 - DNA, 20 bp, Artificial
  CRISPR gRNA sequence
agtggtatggtctcggctca

SEQ ID NO: 702839 - DNA, 20 bp, Artificial
  CRISPR gRNA sequence
tcacggcaacctctgcctcc

SEQ ID NO: 702840 - DNA, 20 bp, Artificial
  CRISPR gRNA sequence
cacggcaacctctgcctcct

SEQ ID NO: 702841 - DNA, 20 bp, Artificial
  CRISPR gRNA sequence
aacctctgcctcctgggttt

SEQ ID NO: 702842 - DNA, 20 bp, Artificial
  CRISPR gRNA sequence
tttgagctattcttgtgcct

SEQ ID NO: 702843 - DNA, 20 bp, Artificial
  CRISPR gRNA sequence
ttcttgtgcctcagcctccc

SEQ ID NO: 702844 - DNA, 20 bp, Artificial
  CRISPR gRNA sequence
ttgtgcctcagcctcccaag

SEQ ID NO: 702845 - DNA, 20 bp, Artificial
  CRISPR gRNA sequence
gcctcagcctcccaagtagc

SEQ ID NO: 702846 - DNA, 20 bp, Artificial
  CRISPR gRNA sequence
cctcagcctcccaagtagct

SEQ ID NO: 702847 - DNA, 20 bp, Artificial
  CRISPR gRNA sequence
ctcccaagtagctgggatta

SEQ ID NO: 702848 - DNA, 20 bp, Artificial
  CRISPR gRNA sequence
tcccaagtagctgggattac

SEQ ID NO: 702849 - DNA, 20 bp, Artificial
  CRISPR gRNA sequence
caggcgtgcaccaccacacc

SEQ ID NO: 702850 - DNA, 20 bp, Artificial
  CRISPR gRNA sequence
ccggctaatttttgtatttt

SEQ ID NO: 702851 - DNA, 20 bp, Artificial
  CRISPR gRNA sequence
gctaatttttgtatttttag

SEQ ID NO: 702852 - DNA, 20 bp, Artificial
  CRISPR gRNA sequence
taatttttgtatttttagta

SEQ ID NO: 702853 - DNA, 20 bp, Artificial
  CRISPR gRNA sequence
ttttgtatttttagtagaga

SEQ ID NO: 702854 - DNA, 20 bp, Artificial
  CRISPR gRNA sequence
tttgtatttttagtagagac

SEQ ID NO: 702855 - DNA, 20 bp, Artificial
  CRISPR gRNA sequence
ttgtatttttagtagagacg

SEQ ID NO: 702856 - DNA, 20 bp, Artificial
  CRISPR gRNA sequence
gagacggggtttcaccacat

SEQ ID NO: 702857 - DNA, 20 bp, Artificial
  CRISPR gRNA sequence
cggggtttcaccacattggt

SEQ ID NO: 702858 - DNA, 20 bp, Artificial
  CRISPR gRNA sequence
ggggtttcaccacattggtc

SEQ ID NO: 702859 - DNA, 20 bp, Artificial
  CRISPR gRNA sequence
tttcaccacattggtcaggc

SEQ ID NO: 702860 - DNA, 20 bp, Artificial
  CRISPR gRNA sequence
tggtctcgaactcctgaccc

SEQ ID NO: 702861 - DNA, 20 bp, Artificial
  CRISPR gRNA sequence
ggtctcgaactcctgacccc

SEQ ID NO: 702862 - DNA, 20 bp, Artificial
  CRISPR gRNA sequence
cccaggtgatctgcctgcct

SEQ ID NO: 702863 - DNA, 20 bp, Artificial
  CRISPR gRNA sequence
ctgcctgcctcagcctccca

SEQ ID NO: 702864 - DNA, 20 bp, Artificial
  CRISPR gRNA sequence
gcctcagcctcccaaagtgc

SEQ ID NO: 702865 - DNA, 20 bp, Artificial
  CRISPR gRNA sequence
cctcagcctcccaaagtgct

SEQ ID NO: 702866 - DNA, 20 bp, Artificial
  CRISPR gRNA sequence
ctcccaaagtgctgggatta

SEQ ID NO: 702867 - DNA, 20 bp, Artificial
  CRISPR gRNA sequence
tcccaaagtgctgggattac

SEQ ID NO: 702868 - DNA, 20 bp, Artificial
  CRISPR gRNA sequence
agtgctgggattacaggcgt

SEQ ID NO: 702869 - DNA, 20 bp, Artificial
  CRISPR gRNA sequence
caggcgtgagccaccgcacc

SEQ ID NO: 702870 - DNA, 20 bp, Artificial
  CRISPR gRNA sequence
gtgagccaccgcacccggcc

SEQ ID NO: 702871 - DNA, 20 bp, Artificial
  CRISPR gRNA sequence
cttttaaaataaatatgaat

SEQ ID NO: 702872 - DNA, 20 bp, Artificial
  CRISPR gRNA sequence
aaaataaatatgaatgagca

SEQ ID NO: 702873 - DNA, 20 bp, Artificial
  CRISPR gRNA sequence
atgaatgagcaaagatttgt

SEQ ID NO: 702874 - DNA, 20 bp, Artificial
  CRISPR gRNA sequence
caaagatttgtaagaaaaac

SEQ ID NO: 702875 - DNA, 20 bp, Artificial
  CRISPR gRNA sequence
taagaaaaaccagccctaca

SEQ ID NO: 702876 - DNA, 20 bp, Artificial
  CRISPR gRNA sequence
aagaaaaaccagccctacaa

SEQ ID NO: 702877 - DNA, 20 bp, Artificial
  CRISPR gRNA sequence
gaaaaaccagccctacaaag

SEQ ID NO: 702878 - DNA, 20 bp, Artificial
  CRISPR gRNA sequence
gccctacaaaggagaataaa

SEQ ID NO: 702879 - DNA, 20 bp, Artificial
  CRISPR gRNA sequence
agaataaaaagatacgaaac

SEQ ID NO: 702880 - DNA, 20 bp, Artificial
  CRISPR gRNA sequence
agaaattcttaccacacatg

SEQ ID NO: 702881 - DNA, 20 bp, Artificial
  CRISPR gRNA sequence
acatgaagctttgataaatc

SEQ ID NO: 702882 - DNA, 20 bp, Artificial
  CRISPR gRNA sequence
catgaagctttgataaatcc

SEQ ID NO: 702883 - DNA, 20 bp, Artificial
  CRISPR gRNA sequence
agctttgataaatccaggaa

SEQ ID NO: 702884 - DNA, 20 bp, Artificial
  CRISPR gRNA sequence
tttgataaatccaggaatag

SEQ ID NO: 702885 - DNA, 20 bp, Artificial
  CRISPR gRNA sequence
tgataaatccaggaatagaa

SEQ ID NO: 702886 - DNA, 20 bp, Artificial
  CRISPR gRNA sequence
tccaggaatagaagagtact

SEQ ID NO: 702887 - DNA, 20 bp, Artificial
  CRISPR gRNA sequence
caacattaaattcgtgtctg

SEQ ID NO: 702888 - DNA, 20 bp, Artificial
  CRISPR gRNA sequence
tgtctgcagaaaaattcacg

SEQ ID NO: 702889 - DNA, 20 bp, Artificial
  CRISPR gRNA sequence
cacgaagtcgttacatccat

SEQ ID NO: 702890 - DNA, 20 bp, Artificial
  CRISPR gRNA sequence
acgaagtcgttacatccata

SEQ ID NO: 702891 - DNA, 20 bp, Artificial
  CRISPR gRNA sequence
aagtcgttacatccataagg

SEQ ID NO: 702892 - DNA, 20 bp, Artificial
  CRISPR gRNA sequence
agtcgttacatccataaggt

SEQ ID NO: 702893 - DNA, 20 bp, Artificial
  CRISPR gRNA sequence
ttacatccataaggtgggca

SEQ ID NO: 702894 - DNA, 20 bp, Artificial
  CRISPR gRNA sequence
tgggcacagaatgctatgaa

SEQ ID NO: 702895 - DNA, 20 bp, Artificial
  CRISPR gRNA sequence
gggcacagaatgctatgaaa

SEQ ID NO: 702896 - DNA, 20 bp, Artificial
  CRISPR gRNA sequence
tgctatgaaaaggaacaata

SEQ ID NO: 702897 - DNA, 20 bp, Artificial
  CRISPR gRNA sequence
gctatgaaaaggaacaatat

SEQ ID NO: 702898 - DNA, 20 bp, Artificial
  CRISPR gRNA sequence
gaaaaggaacaatatgggat

SEQ ID NO: 702899 - DNA, 20 bp, Artificial
  CRISPR gRNA sequence
aaaggaacaatatgggatca

SEQ ID NO: 702900 - DNA, 20 bp, Artificial
  CRISPR gRNA sequence
aaggaacaatatgggatcag

SEQ ID NO: 702901 - DNA, 20 bp, Artificial
  CRISPR gRNA sequence
aggaacaatatgggatcaga

SEQ ID NO: 702902 - DNA, 20 bp, Artificial
  CRISPR gRNA sequence
acaatatgggatcagagggc

SEQ ID NO: 702903 - DNA, 20 bp, Artificial
  CRISPR gRNA sequence
atgggatcagagggcaagaa

SEQ ID NO: 702904 - DNA, 20 bp, Artificial
  CRISPR gRNA sequence
tgggatcagagggcaagaaa

SEQ ID NO: 702905 - DNA, 20 bp, Artificial
  CRISPR gRNA sequence
gagggcaagaaaaggctttt

SEQ ID NO: 702906 - DNA, 20 bp, Artificial
  CRISPR gRNA sequence
gcaagaaaaggctttttaga

SEQ ID NO: 702907 - DNA, 20 bp, Artificial
  CRISPR gRNA sequence
ttagaaagtgtgcttgtgat

SEQ ID NO: 702908 - DNA, 20 bp, Artificial
  CRISPR gRNA sequence
tgtgatcagcccatcatctc

SEQ ID NO: 702909 - DNA, 20 bp, Artificial
  CRISPR gRNA sequence
gtgatcagcccatcatctct

SEQ ID NO: 702910 - DNA, 20 bp, Artificial
  CRISPR gRNA sequence
ccctgccctgccatcaacga

SEQ ID NO: 702911 - DNA, 20 bp, Artificial
  CRISPR gRNA sequence
ggctccgcctttctcctctg

SEQ ID NO: 702912 - DNA, 20 bp, Artificial
  CRISPR gRNA sequence
gctccgcctttctcctctgt

SEQ ID NO: 702913 - DNA, 20 bp, Artificial
  CRISPR gRNA sequence
ctccgcctttctcctctgta

SEQ ID NO: 702914 - DNA, 20 bp, Artificial
  CRISPR gRNA sequence
ccgcctttctcctctgtagg

SEQ ID NO: 702915 - DNA, 20 bp, Artificial
  CRISPR gRNA sequence
tctcctctgtagggagcatg

SEQ ID NO: 702916 - DNA, 20 bp, Artificial
  CRISPR gRNA sequence
tctgtagggagcatgcagtt

SEQ ID NO: 702917 - DNA, 20 bp, Artificial
  CRISPR gRNA sequence
agcatgcagttaagccttgc

SEQ ID NO: 702918 - DNA, 20 bp, Artificial
  CRISPR gRNA sequence
atgcagttaagccttgccag

SEQ ID NO: 702919 - DNA, 20 bp, Artificial
  CRISPR gRNA sequence
gcagttaagccttgccagca

SEQ ID NO: 702920 - DNA, 20 bp, Artificial
  CRISPR gRNA sequence
cagttaagccttgccagcag

SEQ ID NO: 702921 - DNA, 20 bp, Artificial
  CRISPR gRNA sequence
agttaagccttgccagcaga

SEQ ID NO: 702922 - DNA, 20 bp, Artificial
  CRISPR gRNA sequence
gccttgccagcagagggcgc

SEQ ID NO: 702923 - DNA, 20 bp, Artificial
  CRISPR gRNA sequence
cttgccagcagagggcgcta

SEQ ID NO: 702924 - DNA, 20 bp, Artificial
  CRISPR gRNA sequence
ttgccagcagagggcgctag

SEQ ID NO: 702925 - DNA, 20 bp, Artificial
  CRISPR gRNA sequence
tgccagcagagggcgctaga

SEQ ID NO: 702926 - DNA, 20 bp, Artificial
  CRISPR gRNA sequence
agggcgctagagggccatcg

SEQ ID NO: 702927 - DNA, 20 bp, Artificial
  CRISPR gRNA sequence
gggcgctagagggccatcgc

SEQ ID NO: 702928 - DNA, 20 bp, Artificial
  CRISPR gRNA sequence
gcgctagagggccatcgcag

SEQ ID NO: 702929 - DNA, 20 bp, Artificial
  CRISPR gRNA sequence
cgctagagggccatcgcagg

SEQ ID NO: 702930 - DNA, 20 bp, Artificial
  CRISPR gRNA sequence
tagagggccatcgcaggagg

SEQ ID NO: 702931 - DNA, 20 bp, Artificial
  CRISPR gRNA sequence
agagggccatcgcaggagga

SEQ ID NO: 702932 - DNA, 20 bp, Artificial
  CRISPR gRNA sequence
agggccatcgcaggaggaag

SEQ ID NO: 702933 - DNA, 20 bp, Artificial
  CRISPR gRNA sequence
gggccatcgcaggaggaagg

SEQ ID NO: 702934 - DNA, 20 bp, Artificial
  CRISPR gRNA sequence
cgcaggaggaaggaggcttc

SEQ ID NO: 702935 - DNA, 20 bp, Artificial
  CRISPR gRNA sequence
tttgtttcttttcttttttt

SEQ ID NO: 702936 - DNA, 20 bp, Artificial
  CRISPR gRNA sequence
tttcttttctttttttgaga

SEQ ID NO: 702937 - DNA, 20 bp, Artificial
  CRISPR gRNA sequence
tcttttctttttttgagaca

SEQ ID NO: 702938 - DNA, 20 bp, Artificial
  CRISPR gRNA sequence
cagagtctcactctgtcgcc

SEQ ID NO: 702939 - DNA, 20 bp, Artificial
  CRISPR gRNA sequence
agagtctcactctgtcgccc

SEQ ID NO: 702940 - DNA, 20 bp, Artificial
  CRISPR gRNA sequence
tctcactctgtcgcccaggc

SEQ ID NO: 702941 - DNA, 20 bp, Artificial
  CRISPR gRNA sequence
tcactctgtcgcccaggctg

SEQ ID NO: 702942 - DNA, 20 bp, Artificial
  CRISPR gRNA sequence
ctgtcgcccaggctggagtg

SEQ ID NO: 702943 - DNA, 20 bp, Artificial
  CRISPR gRNA sequence
ggagtgcagtgacgcgatct

SEQ ID NO: 702944 - DNA, 20 bp, Artificial
  CRISPR gRNA sequence
ccaccacaacctccacctcc

SEQ ID NO: 702945 - DNA, 20 bp, Artificial
  CRISPR gRNA sequence
caccacaacctccacctccc

SEQ ID NO: 702946 - DNA, 20 bp, Artificial
  CRISPR gRNA sequence
aacctccacctcccgggttc

SEQ ID NO: 702947 - DNA, 20 bp, Artificial
  CRISPR gRNA sequence
ctccacctcccgggttcaag

SEQ ID NO: 702948 - DNA, 20 bp, Artificial
  CRISPR gRNA sequence
ttcaagcagttttcctgcct

SEQ ID NO: 702949 - DNA, 20 bp, Artificial
  CRISPR gRNA sequence
ttttcctgcctcagcctcct

SEQ ID NO: 702950 - DNA, 20 bp, Artificial
  CRISPR gRNA sequence
tcctgcctcagcctcctgag

SEQ ID NO: 702951 - DNA, 20 bp, Artificial
  CRISPR gRNA sequence
gcctcagcctcctgagtagc

SEQ ID NO: 702952 - DNA, 20 bp, Artificial
  CRISPR gRNA sequence
cctcagcctcctgagtagct

SEQ ID NO: 702953 - DNA, 20 bp, Artificial
  CRISPR gRNA sequence
ctcctgagtagctgggatta

SEQ ID NO: 702954 - DNA, 20 bp, Artificial
  CRISPR gRNA sequence
tcctgagtagctgggattac

SEQ ID NO: 702955 - DNA, 20 bp, Artificial
  CRISPR gRNA sequence
caggcacgcgccaccacgcc

SEQ ID NO: 702956 - DNA, 20 bp, Artificial
  CRISPR gRNA sequence
ctggctaatttttgtatttt

SEQ ID NO: 702957 - DNA, 20 bp, Artificial
  CRISPR gRNA sequence
gctaatttttgtatttttag

SEQ ID NO: 702958 - DNA, 20 bp, Artificial
  CRISPR gRNA sequence
taatttttgtatttttagta

SEQ ID NO: 702959 - DNA, 20 bp, Artificial
  CRISPR gRNA sequence
ttttgtatttttagtagaga

SEQ ID NO: 702960 - DNA, 20 bp, Artificial
  CRISPR gRNA sequence
tttgtatttttagtagagac

SEQ ID NO: 702961 - DNA, 20 bp, Artificial
  CRISPR gRNA sequence
ttgtatttttagtagagaca

SEQ ID NO: 702962 - DNA, 20 bp, Artificial
  CRISPR gRNA sequence
gagacagggtttcaccatga

SEQ ID NO: 702963 - DNA, 20 bp, Artificial
  CRISPR gRNA sequence
cagggtttcaccatgatggt

SEQ ID NO: 702964 - DNA, 20 bp, Artificial
  CRISPR gRNA sequence
agggtttcaccatgatggtc

SEQ ID NO: 702965 - DNA, 20 bp, Artificial
  CRISPR gRNA sequence
tttcaccatgatggtcaggc

SEQ ID NO: 702966 - DNA, 20 bp, Artificial
  CRISPR gRNA sequence
ctggtctcgaactcctgacc

SEQ ID NO: 702967 - DNA, 20 bp, Artificial
  CRISPR gRNA sequence
acctggtgatccgcctgcct

SEQ ID NO: 702968 - DNA, 20 bp, Artificial
  CRISPR gRNA sequence
cgcctgcctcggcctcgcaa

SEQ ID NO: 702969 - DNA, 20 bp, Artificial
  CRISPR gRNA sequence
cctcggcctcgcaaaagtgc

SEQ ID NO: 702970 - DNA, 20 bp, Artificial
  CRISPR gRNA sequence
ctcggcctcgcaaaagtgct

SEQ ID NO: 702971 - DNA, 20 bp, Artificial
  CRISPR gRNA sequence
cgcaaaagtgctgggattac

SEQ ID NO: 702972 - DNA, 20 bp, Artificial
  CRISPR gRNA sequence
agtgctgggattaccggcgt

SEQ ID NO: 702973 - DNA, 20 bp, Artificial
  CRISPR gRNA sequence
ccggcgtgagccactgcgcc

SEQ ID NO: 702974 - DNA, 20 bp, Artificial
  CRISPR gRNA sequence
ttcttcttgctcctgctgcc

SEQ ID NO: 702975 - DNA, 20 bp, Artificial
  CRISPR gRNA sequence
cttgctcctgctgcctggcc

SEQ ID NO: 702976 - DNA, 20 bp, Artificial
  CRISPR gRNA sequence
gcctggtgaccaccttgatg

SEQ ID NO: 702977 - DNA, 20 bp, Artificial
  CRISPR gRNA sequence
ttgatgtggctctcccaatg

SEQ ID NO: 702978 - DNA, 20 bp, Artificial
  CRISPR gRNA sequence
ggctctcccaatgcagacat

SEQ ID NO: 702979 - DNA, 20 bp, Artificial
  CRISPR gRNA sequence
atgcagacattggcacgtgc

SEQ ID NO: 702980 - DNA, 20 bp, Artificial
  CRISPR gRNA sequence
tgcagacattggcacgtgcc

SEQ ID NO: 702981 - DNA, 20 bp, Artificial
  CRISPR gRNA sequence
gccaggcctcatgtctgcaa

SEQ ID NO: 702982 - DNA, 20 bp, Artificial
  CRISPR gRNA sequence
tccctctgtgcatcccccac

SEQ ID NO: 702983 - DNA, 20 bp, Artificial
  CRISPR gRNA sequence
tgtgcatcccccaccagcca

SEQ ID NO: 702984 - DNA, 20 bp, Artificial
  CRISPR gRNA sequence
gtgcatcccccaccagccac

SEQ ID NO: 702985 - DNA, 20 bp, Artificial
  CRISPR gRNA sequence
ccccaccagccacaggtctt

SEQ ID NO: 702986 - DNA, 20 bp, Artificial
  CRISPR gRNA sequence
cacaggtctttggcacccca

SEQ ID NO: 702987 - DNA, 20 bp, Artificial
  CRISPR gRNA sequence
tttggcaccccaaagtgctc

SEQ ID NO: 702988 - DNA, 20 bp, Artificial
  CRISPR gRNA sequence
ttggcaccccaaagtgctcc

SEQ ID NO: 702989 - DNA, 20 bp, Artificial
  CRISPR gRNA sequence
tgctccaggcgtctccccca

SEQ ID NO: 702990 - DNA, 20 bp, Artificial
  CRISPR gRNA sequence
tccaggcgtctcccccacag

SEQ ID NO: 702991 - DNA, 20 bp, Artificial
  CRISPR gRNA sequence
aggcgtctcccccacagtgg

SEQ ID NO: 702992 - DNA, 20 bp, Artificial
  CRISPR gRNA sequence
aatttctctgtgcacctgac

SEQ ID NO: 702993 - DNA, 20 bp, Artificial
  CRISPR gRNA sequence
ttctctgtgcacctgaccag

SEQ ID NO: 702994 - DNA, 20 bp, Artificial
  CRISPR gRNA sequence
tgtgcacctgaccagaagca

SEQ ID NO: 702995 - DNA, 20 bp, Artificial
  CRISPR gRNA sequence
ctgaccagaagcatagactt

SEQ ID NO: 702996 - DNA, 20 bp, Artificial
  CRISPR gRNA sequence
tgaccagaagcatagacttc

SEQ ID NO: 702997 - DNA, 20 bp, Artificial
  CRISPR gRNA sequence
aagcatagacttcaggtcaa

SEQ ID NO: 702998 - DNA, 20 bp, Artificial
  CRISPR gRNA sequence
agcatagacttcaggtcaaa

SEQ ID NO: 702999 - DNA, 20 bp, Artificial
  CRISPR gRNA sequence
tcaggtcaaaaggacctacc

SEQ ID NO: 703000 - DNA, 20 bp, Artificial
  CRISPR gRNA sequence
aggtcaaaaggacctaccaa

SEQ ID NO: 703001 - DNA, 20 bp, Artificial
  CRISPR gRNA sequence
aaaaggacctaccaagagca

SEQ ID NO: 703002 - DNA, 20 bp, Artificial
  CRISPR gRNA sequence
aggacctaccaagagcaaag

SEQ ID NO: 703003 - DNA, 20 bp, Artificial
  CRISPR gRNA sequence
ggacctaccaagagcaaagc

SEQ ID NO: 703004 - DNA, 20 bp, Artificial
  CRISPR gRNA sequence
caagagcaaagcaggattaa

SEQ ID NO: 703005 - DNA, 20 bp, Artificial
  CRISPR gRNA sequence
attacccacgctacatgtaa

SEQ ID NO: 703006 - DNA, 20 bp, Artificial
  CRISPR gRNA sequence
ccatgattttatctacctgc

SEQ ID NO: 703007 - DNA, 20 bp, Artificial
  CRISPR gRNA sequence
tttatctacctgccggttga

SEQ ID NO: 703008 - DNA, 20 bp, Artificial
  CRISPR gRNA sequence
acctgccggttgatggcatt

SEQ ID NO: 703009 - DNA, 20 bp, Artificial
  CRISPR gRNA sequence
cctgccggttgatggcattt

SEQ ID NO: 703010 - DNA, 20 bp, Artificial
  CRISPR gRNA sequence
gatggcatttgggttgtttc

SEQ ID NO: 703011 - DNA, 20 bp, Artificial
  CRISPR gRNA sequence
catttgggttgtttccagtt

SEQ ID NO: 703012 - DNA, 20 bp, Artificial
  CRISPR gRNA sequence
atttgggttgtttccagttt

SEQ ID NO: 703013 - DNA, 20 bp, Artificial
  CRISPR gRNA sequence
tttgggttgtttccagttta

SEQ ID NO: 703014 - DNA, 20 bp, Artificial
  CRISPR gRNA sequence
agggctattatgaatgaaaa

SEQ ID NO: 703015 - DNA, 20 bp, Artificial
  CRISPR gRNA sequence
attattatttttattatttt

SEQ ID NO: 703016 - DNA, 20 bp, Artificial
  CRISPR gRNA sequence
tattatttttattattttta

SEQ ID NO: 703017 - DNA, 20 bp, Artificial
  CRISPR gRNA sequence
atttttattatttttagaga

SEQ ID NO: 703018 - DNA, 20 bp, Artificial
  CRISPR gRNA sequence
tttttattatttttagagac

SEQ ID NO: 703019 - DNA, 20 bp, Artificial
  CRISPR gRNA sequence
ttttattatttttagagaca

SEQ ID NO: 703020 - DNA, 20 bp, Artificial
  CRISPR gRNA sequence
cagggtctcactctgtgttc

SEQ ID NO: 703021 - DNA, 20 bp, Artificial
  CRISPR gRNA sequence
agggtctcactctgtgttcc

SEQ ID NO: 703022 - DNA, 20 bp, Artificial
  CRISPR gRNA sequence
tctcactctgtgttccaggc

SEQ ID NO: 703023 - DNA, 20 bp, Artificial
  CRISPR gRNA sequence
tcactctgtgttccaggctg

SEQ ID NO: 703024 - DNA, 20 bp, Artificial
  CRISPR gRNA sequence
ctgtgttccaggctggagtg

SEQ ID NO: 703025 - DNA, 20 bp, Artificial
  CRISPR gRNA sequence
tgttccaggctggagtgcag

SEQ ID NO: 703026 - DNA, 20 bp, Artificial
  CRISPR gRNA sequence
ggagtgcagtggcatgatct

SEQ ID NO: 703027 - DNA, 20 bp, Artificial
  CRISPR gRNA sequence
ggcatgatcttggctcactg

SEQ ID NO: 703028 - DNA, 20 bp, Artificial
  CRISPR gRNA sequence
tcactgcagcattgaactcc

SEQ ID NO: 703029 - DNA, 20 bp, Artificial
  CRISPR gRNA sequence
cactgcagcattgaactcct

SEQ ID NO: 703030 - DNA, 20 bp, Artificial
  CRISPR gRNA sequence
cagcattgaactcctgggct

SEQ ID NO: 703031 - DNA, 20 bp, Artificial
  CRISPR gRNA sequence
agcattgaactcctgggctc

SEQ ID NO: 703032 - DNA, 20 bp, Artificial
  CRISPR gRNA sequence
ctcgggcgatcctcccacct

SEQ ID NO: 703033 - DNA, 20 bp, Artificial
  CRISPR gRNA sequence
cctcccacctcagcctccca

SEQ ID NO: 703034 - DNA, 20 bp, Artificial
  CRISPR gRNA sequence
cctcagcctcccacagtgct

SEQ ID NO: 703035 - DNA, 20 bp, Artificial
  CRISPR gRNA sequence
tcccacagtgctgagattac

SEQ ID NO: 703036 - DNA, 20 bp, Artificial
  CRISPR gRNA sequence
agtgctgagattactggcat

SEQ ID NO: 703037 - DNA, 20 bp, Artificial
  CRISPR gRNA sequence
ctggcatgagccaccatgac

SEQ ID NO: 703038 - DNA, 20 bp, Artificial
  CRISPR gRNA sequence
tgactggccgattcttgtac

SEQ ID NO: 703039 - DNA, 20 bp, Artificial
  CRISPR gRNA sequence
ccgattcttgtacaagtctt

SEQ ID NO: 703040 - DNA, 20 bp, Artificial
  CRISPR gRNA sequence
cgattcttgtacaagtcttt

SEQ ID NO: 703041 - DNA, 20 bp, Artificial
  CRISPR gRNA sequence
ttcttgtacaagtctttggg

SEQ ID NO: 703042 - DNA, 20 bp, Artificial
  CRISPR gRNA sequence
atgtatattttcatttttca

SEQ ID NO: 703043 - DNA, 20 bp, Artificial
  CRISPR gRNA sequence
tgtatattttcatttttcat

SEQ ID NO: 703044 - DNA, 20 bp, Artificial
  CRISPR gRNA sequence
atttttcatgggtaaatacc

SEQ ID NO: 703045 - DNA, 20 bp, Artificial
  CRISPR gRNA sequence
tttttcatgggtaaatacct

SEQ ID NO: 703046 - DNA, 20 bp, Artificial
  CRISPR gRNA sequence
tttcatgggtaaatacctag

SEQ ID NO: 703047 - DNA, 20 bp, Artificial
  CRISPR gRNA sequence
ttcatgggtaaatacctagg

SEQ ID NO: 703048 - DNA, 20 bp, Artificial
  CRISPR gRNA sequence
catgggtaaatacctaggag

SEQ ID NO: 703049 - DNA, 20 bp, Artificial
  CRISPR gRNA sequence
gggtaaatacctaggaggag

SEQ ID NO: 703050 - DNA, 20 bp, Artificial
  CRISPR gRNA sequence
aaatacctaggaggagtggc

SEQ ID NO: 703051 - DNA, 20 bp, Artificial
  CRISPR gRNA sequence
aatacctaggaggagtggct

SEQ ID NO: 703052 - DNA, 20 bp, Artificial
  CRISPR gRNA sequence
gagtggctaggtcattgtgc

SEQ ID NO: 703053 - DNA, 20 bp, Artificial
  CRISPR gRNA sequence
aggtcattgtgctggtcaca

SEQ ID NO: 703054 - DNA, 20 bp, Artificial
  CRISPR gRNA sequence
cattgtgctggtcacatagt

SEQ ID NO: 703055 - DNA, 20 bp, Artificial
  CRISPR gRNA sequence
cacatagtcagaatgttttt

SEQ ID NO: 703056 - DNA, 20 bp, Artificial
  CRISPR gRNA sequence
acatagtcagaatgtttttg

SEQ ID NO: 703057 - DNA, 20 bp, Artificial
  CRISPR gRNA sequence
gtcagaatgtttttgaggac

SEQ ID NO: 703058 - DNA, 20 bp, Artificial
  CRISPR gRNA sequence
atgtttttgaggactagtca

SEQ ID NO: 703059 - DNA, 20 bp, Artificial
  CRISPR gRNA sequence
ttttgaggactagtcaaagc

SEQ ID NO: 703060 - DNA, 20 bp, Artificial
  CRISPR gRNA sequence
tagtcaaagctggatacctc

SEQ ID NO: 703061 - DNA, 20 bp, Artificial
  CRISPR gRNA sequence
caaccccttcgttttacacc

SEQ ID NO: 703062 - DNA, 20 bp, Artificial
  CRISPR gRNA sequence
accccttcgttttacaccca

SEQ ID NO: 703063 - DNA, 20 bp, Artificial
  CRISPR gRNA sequence
cccttcgttttacacccaga

SEQ ID NO: 703064 - DNA, 20 bp, Artificial
  CRISPR gRNA sequence
ttcgttttacacccagagag

SEQ ID NO: 703065 - DNA, 20 bp, Artificial
  CRISPR gRNA sequence
tttacacccagagagaagca

SEQ ID NO: 703066 - DNA, 20 bp, Artificial
  CRISPR gRNA sequence
ttacacccagagagaagcac

SEQ ID NO: 703067 - DNA, 20 bp, Artificial
  CRISPR gRNA sequence
tacacccagagagaagcaca

SEQ ID NO: 703068 - DNA, 20 bp, Artificial
  CRISPR gRNA sequence
cagagagaagcacagggccg

SEQ ID NO: 703069 - DNA, 20 bp, Artificial
  CRISPR gRNA sequence
gagaagcacagggccgaagc

SEQ ID NO: 703070 - DNA, 20 bp, Artificial
  CRISPR gRNA sequence
cacagggccgaagctagaac

SEQ ID NO: 703071 - DNA, 20 bp, Artificial
  CRISPR gRNA sequence
ccgaagctagaaccagaatg

SEQ ID NO: 703072 - DNA, 20 bp, Artificial
  CRISPR gRNA sequence
cgaagctagaaccagaatgc

SEQ ID NO: 703073 - DNA, 20 bp, Artificial
  CRISPR gRNA sequence
gaagctagaaccagaatgca

SEQ ID NO: 703074 - DNA, 20 bp, Artificial
  CRISPR gRNA sequence
aaccagaatgcagggatccc

SEQ ID NO: 703075 - DNA, 20 bp, Artificial
  CRISPR gRNA sequence
accagaatgcagggatccca

SEQ ID NO: 703076 - DNA, 20 bp, Artificial
  CRISPR gRNA sequence
ccagaatgcagggatcccaa

SEQ ID NO: 703077 - DNA, 20 bp, Artificial
  CRISPR gRNA sequence
aatgcagggatcccaagggt

SEQ ID NO: 703078 - DNA, 20 bp, Artificial
  CRISPR gRNA sequence
agggatcccaagggtcagcc

SEQ ID NO: 703079 - DNA, 20 bp, Artificial
  CRISPR gRNA sequence
ggatcccaagggtcagccca

SEQ ID NO: 703080 - DNA, 20 bp, Artificial
  CRISPR gRNA sequence
tcagcccagagtacttccac

SEQ ID NO: 703081 - DNA, 20 bp, Artificial
  CRISPR gRNA sequence
gcccagagtacttccactgg

SEQ ID NO: 703082 - DNA, 20 bp, Artificial
  CRISPR gRNA sequence
ccacccacccacctccttct

SEQ ID NO: 703083 - DNA, 20 bp, Artificial
  CRISPR gRNA sequence
ctccttcttagttctgaacc

SEQ ID NO: 703084 - DNA, 20 bp, Artificial
  CRISPR gRNA sequence
ttctgaacctagaatttacc

SEQ ID NO: 703085 - DNA, 20 bp, Artificial
  CRISPR gRNA sequence
gaatttacccagctaaatta

SEQ ID NO: 703086 - DNA, 20 bp, Artificial
  CRISPR gRNA sequence
cagctaaattacagtcactt

SEQ ID NO: 703087 - DNA, 20 bp, Artificial
  CRISPR gRNA sequence
acttcagctaaattacaatc

SEQ ID NO: 703088 - DNA, 20 bp, Artificial
  CRISPR gRNA sequence
ctaaattacaatcaagtttg

SEQ ID NO: 703089 - DNA, 20 bp, Artificial
  CRISPR gRNA sequence
taaattacaatcaagtttga

SEQ ID NO: 703090 - DNA, 20 bp, Artificial
  CRISPR gRNA sequence
attacaatcaagtttgaagg

SEQ ID NO: 703091 - DNA, 20 bp, Artificial
  CRISPR gRNA sequence
aggcagcataaaaacatttt

SEQ ID NO: 703092 - DNA, 20 bp, Artificial
  CRISPR gRNA sequence
aaaaacattttcagacataa

SEQ ID NO: 703093 - DNA, 20 bp, Artificial
  CRISPR gRNA sequence
aaaacattttcagacataaa

SEQ ID NO: 703094 - DNA, 20 bp, Artificial
  CRISPR gRNA sequence
attttcagacataaaaggtc

SEQ ID NO: 703095 - DNA, 20 bp, Artificial
  CRISPR gRNA sequence
ttcagacataaaaggtccag

SEQ ID NO: 703096 - DNA, 20 bp, Artificial
  CRISPR gRNA sequence
tcagacataaaaggtccaga

SEQ ID NO: 703097 - DNA, 20 bp, Artificial
  CRISPR gRNA sequence
tttcttcctatatcctctcc

SEQ ID NO: 703098 - DNA, 20 bp, Artificial
  CRISPR gRNA sequence
ttcttcctatatcctctcct

SEQ ID NO: 703099 - DNA, 20 bp, Artificial
  CRISPR gRNA sequence
ttcctatatcctctcctagg

SEQ ID NO: 703100 - DNA, 20 bp, Artificial
  CRISPR gRNA sequence
ctctcctaggaagatatttg

SEQ ID NO: 703101 - DNA, 20 bp, Artificial
  CRISPR gRNA sequence
agatatttgaagatgtaatt

SEQ ID NO: 703102 - DNA, 20 bp, Artificial
  CRISPR gRNA sequence
tttgaagatgtaattcagct

SEQ ID NO: 703103 - DNA, 20 bp, Artificial
  CRISPR gRNA sequence
aagatgtaattcagctaagt

SEQ ID NO: 703104 - DNA, 20 bp, Artificial
  CRISPR gRNA sequence
agatgtaattcagctaagtg

SEQ ID NO: 703105 - DNA, 20 bp, Artificial
  CRISPR gRNA sequence
gatgtaattcagctaagtga

SEQ ID NO: 703106 - DNA, 20 bp, Artificial
  CRISPR gRNA sequence
atgtaattcagctaagtgag

SEQ ID NO: 703107 - DNA, 20 bp, Artificial
  CRISPR gRNA sequence
tgtaattcagctaagtgagg

SEQ ID NO: 703108 - DNA, 20 bp, Artificial
  CRISPR gRNA sequence
agctaagtgagggggcaaaa

SEQ ID NO: 703109 - DNA, 20 bp, Artificial
  CRISPR gRNA sequence
ggggcaaaaaagaaaaacaa

SEQ ID NO: 703110 - DNA, 20 bp, Artificial
  CRISPR gRNA sequence
gggcaaaaaagaaaaacaac

SEQ ID NO: 703111 - DNA, 20 bp, Artificial
  CRISPR gRNA sequence
caaaaaagaaaaacaacagg

SEQ ID NO: 703112 - DNA, 20 bp, Artificial
  CRISPR gRNA sequence
agaaaaacaacaggaagcca

SEQ ID NO: 703113 - DNA, 20 bp, Artificial
  CRISPR gRNA sequence
caacaggaagccatggaatc

SEQ ID NO: 703114 - DNA, 20 bp, Artificial
  CRISPR gRNA sequence
acaggaagccatggaatcta

SEQ ID NO: 703115 - DNA, 20 bp, Artificial
  CRISPR gRNA sequence
aagccatggaatctagagac

SEQ ID NO: 703116 - DNA, 20 bp, Artificial
  CRISPR gRNA sequence
tagagaccagcactccatcc

SEQ ID NO: 703117 - DNA, 20 bp, Artificial
  CRISPR gRNA sequence
agaccagcactccatcctag

SEQ ID NO: 703118 - DNA, 20 bp, Artificial
  CRISPR gRNA sequence
accagcactccatcctagca

SEQ ID NO: 703119 - DNA, 20 bp, Artificial
  CRISPR gRNA sequence
gcactccatcctagcagagc

SEQ ID NO: 703120 - DNA, 20 bp, Artificial
  CRISPR gRNA sequence
cactccatcctagcagagca

SEQ ID NO: 703121 - DNA, 20 bp, Artificial
  CRISPR gRNA sequence
tccatcctagcagagcaagg

SEQ ID NO: 703122 - DNA, 20 bp, Artificial
  CRISPR gRNA sequence
ccatcctagcagagcaagga

SEQ ID NO: 703123 - DNA, 20 bp, Artificial
  CRISPR gRNA sequence
catcctagcagagcaaggaa

SEQ ID NO: 703124 - DNA, 20 bp, Artificial
  CRISPR gRNA sequence
cctagcagagcaaggaaggg

SEQ ID NO: 703125 - DNA, 20 bp, Artificial
  CRISPR gRNA sequence
agagcaaggaagggaagtcc

SEQ ID NO: 703126 - DNA, 20 bp, Artificial
  CRISPR gRNA sequence
agggaagtcccagaatgatg

SEQ ID NO: 703127 - DNA, 20 bp, Artificial
  CRISPR gRNA sequence
agtcccagaatgatgtggta

SEQ ID NO: 703128 - DNA, 20 bp, Artificial
  CRISPR gRNA sequence
cagaatgatgtggtatagac

SEQ ID NO: 703129 - DNA, 20 bp, Artificial
  CRISPR gRNA sequence
tgatgtggtatagaccagtt

SEQ ID NO: 703130 - DNA, 20 bp, Artificial
  CRISPR gRNA sequence
gtggtatagaccagttgagc

SEQ ID NO: 703131 - DNA, 20 bp, Artificial
  CRISPR gRNA sequence
atagaccagttgagccagat

SEQ ID NO: 703132 - DNA, 20 bp, Artificial
  CRISPR gRNA sequence
agaccagttgagccagatca

SEQ ID NO: 703133 - DNA, 20 bp, Artificial
  CRISPR gRNA sequence
ccagttgagccagatcagag

SEQ ID NO: 703134 - DNA, 20 bp, Artificial
  CRISPR gRNA sequence
cagttgagccagatcagagc

SEQ ID NO: 703135 - DNA, 20 bp, Artificial
  CRISPR gRNA sequence
gccagatcagagcaggaaaa

SEQ ID NO: 703136 - DNA, 20 bp, Artificial
  CRISPR gRNA sequence
agatcagagcaggaaaatgg

SEQ ID NO: 703137 - DNA, 20 bp, Artificial
  CRISPR gRNA sequence
gatcagagcaggaaaatgga

SEQ ID NO: 703138 - DNA, 20 bp, Artificial
  CRISPR gRNA sequence
cagagcaggaaaatggaagg

SEQ ID NO: 703139 - DNA, 20 bp, Artificial
  CRISPR gRNA sequence
agagcaggaaaatggaagga

SEQ ID NO: 703140 - DNA, 20 bp, Artificial
  CRISPR gRNA sequence
gaaaatggaaggaaggctcc

SEQ ID NO: 703141 - DNA, 20 bp, Artificial
  CRISPR gRNA sequence
aaaatggaaggaaggctccg

SEQ ID NO: 703142 - DNA, 20 bp, Artificial
  CRISPR gRNA sequence
atggaaggaaggctccgagg

SEQ ID NO: 703143 - DNA, 20 bp, Artificial
  CRISPR gRNA sequence
aggctccgaggaagtgttcc

SEQ ID NO: 703144 - DNA, 20 bp, Artificial
  CRISPR gRNA sequence
ggctccgaggaagtgttccc

SEQ ID NO: 703145 - DNA, 20 bp, Artificial
  CRISPR gRNA sequence
cgaggaagtgttcccaggaa

SEQ ID NO: 703146 - DNA, 20 bp, Artificial
  CRISPR gRNA sequence
ggaagtgttcccaggaatag

SEQ ID NO: 703147 - DNA, 20 bp, Artificial
  CRISPR gRNA sequence
aagtgttcccaggaatagaa

SEQ ID NO: 703148 - DNA, 20 bp, Artificial
  CRISPR gRNA sequence
gtgttcccaggaatagaaga

SEQ ID NO: 703149 - DNA, 20 bp, Artificial
  CRISPR gRNA sequence
aggaatagaagagagaattg

SEQ ID NO: 703150 - DNA, 20 bp, Artificial
  CRISPR gRNA sequence
attgtagtaaatttcatgat

SEQ ID NO: 703151 - DNA, 20 bp, Artificial
  CRISPR gRNA sequence
gtagtaaatttcatgattag

SEQ ID NO: 703152 - DNA, 20 bp, Artificial
  CRISPR gRNA sequence
agtaaatttcatgattagta

SEQ ID NO: 703153 - DNA, 20 bp, Artificial
  CRISPR gRNA sequence
tcatgattagtagagttgaa

SEQ ID NO: 703154 - DNA, 20 bp, Artificial
  CRISPR gRNA sequence
ttagtagagttgaaaagcct

SEQ ID NO: 703155 - DNA, 20 bp, Artificial
  CRISPR gRNA sequence
tagtagagttgaaaagcctg

SEQ ID NO: 703156 - DNA, 20 bp, Artificial
  CRISPR gRNA sequence
agttgaaaagcctgaggata

SEQ ID NO: 703157 - DNA, 20 bp, Artificial
  CRISPR gRNA sequence
gaaaagcctgaggatatggt

SEQ ID NO: 703158 - DNA, 20 bp, Artificial
  CRISPR gRNA sequence
aaaagcctgaggatatggtg

SEQ ID NO: 703159 - DNA, 20 bp, Artificial
  CRISPR gRNA sequence
aaagcctgaggatatggtga

SEQ ID NO: 703160 - DNA, 20 bp, Artificial
  CRISPR gRNA sequence
cacactgtccttttatcaac

SEQ ID NO: 703161 - DNA, 20 bp, Artificial
  CRISPR gRNA sequence
gtccttttatcaacaagaaa

SEQ ID NO: 703162 - DNA, 20 bp, Artificial
  CRISPR gRNA sequence
ttttatcaacaagaaaaaga

SEQ ID NO: 703163 - DNA, 20 bp, Artificial
  CRISPR gRNA sequence
tttatcaacaagaaaaagaa

SEQ ID NO: 703164 - DNA, 20 bp, Artificial
  CRISPR gRNA sequence
gaaaggcaattgaaaactcc

SEQ ID NO: 703165 - DNA, 20 bp, Artificial
  CRISPR gRNA sequence
aaaggcaattgaaaactccc

SEQ ID NO: 703166 - DNA, 20 bp, Artificial
  CRISPR gRNA sequence
caattgaaaactcccgggaa

SEQ ID NO: 703167 - DNA, 20 bp, Artificial
  CRISPR gRNA sequence
aaaactcccgggaaaagaaa

SEQ ID NO: 703168 - DNA, 20 bp, Artificial
  CRISPR gRNA sequence
cgggaaaagaaaaagatgac

SEQ ID NO: 703169 - DNA, 20 bp, Artificial
  CRISPR gRNA sequence
aaaagatgacaagaaatata

SEQ ID NO: 703170 - DNA, 20 bp, Artificial
  CRISPR gRNA sequence
aaatatacagtccaaatatg

SEQ ID NO: 703171 - DNA, 20 bp, Artificial
  CRISPR gRNA sequence
atgaaatttcacctgatttt

SEQ ID NO: 703172 - DNA, 20 bp, Artificial
  CRISPR gRNA sequence
acctgattttaagcgattgc

SEQ ID NO: 703173 - DNA, 20 bp, Artificial
  CRISPR gRNA sequence
gcgattgctggatgtacaaa

SEQ ID NO: 703174 - DNA, 20 bp, Artificial
  CRISPR gRNA sequence
gattgctggatgtacaaaaa

SEQ ID NO: 703175 - DNA, 20 bp, Artificial
  CRISPR gRNA sequence
gtacaaaaagagaatctgtt

SEQ ID NO: 703176 - DNA, 20 bp, Artificial
  CRISPR gRNA sequence
atctgtttggccttgatgct

SEQ ID NO: 703177 - DNA, 20 bp, Artificial
  CRISPR gRNA sequence
tgctgagacaattctttaaa

SEQ ID NO: 703178 - DNA, 20 bp, Artificial
  CRISPR gRNA sequence
gacaattctttaaatggccc

SEQ ID NO: 703179 - DNA, 20 bp, Artificial
  CRISPR gRNA sequence
acaattctttaaatggccca

SEQ ID NO: 703180 - DNA, 20 bp, Artificial
  CRISPR gRNA sequence
tctttaaatggcccaaggac

SEQ ID NO: 703181 - DNA, 20 bp, Artificial
  CRISPR gRNA sequence
ctttaaatggcccaaggact

SEQ ID NO: 703182 - DNA, 20 bp, Artificial
  CRISPR gRNA sequence
tggcccaaggactgggtgtt

SEQ ID NO: 703183 - DNA, 20 bp, Artificial
  CRISPR gRNA sequence
ggactgggtgtttggattta

SEQ ID NO: 703184 - DNA, 20 bp, Artificial
  CRISPR gRNA sequence
actgggtgtttggatttaaa

SEQ ID NO: 703185 - DNA, 20 bp, Artificial
  CRISPR gRNA sequence
gggtgtttggatttaaagag

SEQ ID NO: 703186 - DNA, 20 bp, Artificial
  CRISPR gRNA sequence
taaagagaagtatatccatc

SEQ ID NO: 703187 - DNA, 20 bp, Artificial
  CRISPR gRNA sequence
ctggtaaataatattttttt

SEQ ID NO: 703188 - DNA, 20 bp, Artificial
  CRISPR gRNA sequence
tattttttttagttcttaaa

SEQ ID NO: 703189 - DNA, 20 bp, Artificial
  CRISPR gRNA sequence
ttttttttagttcttaaatg

SEQ ID NO: 703190 - DNA, 20 bp, Artificial
  CRISPR gRNA sequence
tttttttagttcttaaatgg

SEQ ID NO: 703191 - DNA, 20 bp, Artificial
  CRISPR gRNA sequence
ttagttcttaaatggaggct

SEQ ID NO: 703192 - DNA, 20 bp, Artificial
  CRISPR gRNA sequence
gttcttaaatggaggctgag

SEQ ID NO: 703193 - DNA, 20 bp, Artificial
  CRISPR gRNA sequence
ttcttaaatggaggctgagt

SEQ ID NO: 703194 - DNA, 20 bp, Artificial
  CRISPR gRNA sequence
ttaaatggaggctgagtagg

SEQ ID NO: 703195 - DNA, 20 bp, Artificial
  CRISPR gRNA sequence
taaatggaggctgagtaggc

SEQ ID NO: 703196 - DNA, 20 bp, Artificial
  CRISPR gRNA sequence
caggttcttttcttctcttc

SEQ ID NO: 703197 - DNA, 20 bp, Artificial
  CRISPR gRNA sequence
gttcttttcttctcttccag

SEQ ID NO: 703198 - DNA, 20 bp, Artificial
  CRISPR gRNA sequence
ttcttttcttctcttccagt

SEQ ID NO: 703199 - DNA, 20 bp, Artificial
  CRISPR gRNA sequence
ctcttccagtaggccattac

SEQ ID NO: 703200 - DNA, 20 bp, Artificial
  CRISPR gRNA sequence
cttccagtaggccattacca

SEQ ID NO: 703201 - DNA, 20 bp, Artificial
  CRISPR gRNA sequence
taggccattaccagagaaca

SEQ ID NO: 703202 - DNA, 20 bp, Artificial
  CRISPR gRNA sequence
aggccattaccagagaacac

SEQ ID NO: 703203 - DNA, 20 bp, Artificial
  CRISPR gRNA sequence
ccattaccagagaacacagg

SEQ ID NO: 703204 - DNA, 20 bp, Artificial
  CRISPR gRNA sequence
gagaacacaggcagaccaac

SEQ ID NO: 703205 - DNA, 20 bp, Artificial
  CRISPR gRNA sequence
agaacacaggcagaccaact

SEQ ID NO: 703206 - DNA, 20 bp, Artificial
  CRISPR gRNA sequence
gaacacaggcagaccaacta

SEQ ID NO: 703207 - DNA, 20 bp, Artificial
  CRISPR gRNA sequence
aacacaggcagaccaactag

SEQ ID NO: 703208 - DNA, 20 bp, Artificial
  CRISPR gRNA sequence
caggcagaccaactaggggc

SEQ ID NO: 703209 - DNA, 20 bp, Artificial
  CRISPR gRNA sequence
tctcctcaccttcaaatcca

SEQ ID NO: 703210 - DNA, 20 bp, Artificial
  CRISPR gRNA sequence
tcctcaccttcaaatccaaa

SEQ ID NO: 703211 - DNA, 20 bp, Artificial
  CRISPR gRNA sequence
cctcaccttcaaatccaaag

SEQ ID NO: 703212 - DNA, 20 bp, Artificial
  CRISPR gRNA sequence
tcaccttcaaatccaaagag

SEQ ID NO: 703213 - DNA, 20 bp, Artificial
  CRISPR gRNA sequence
caccttcaaatccaaagagg

SEQ ID NO: 703214 - DNA, 20 bp, Artificial
  CRISPR gRNA sequence
tcaaatccaaagaggaggaa

SEQ ID NO: 703215 - DNA, 20 bp, Artificial
  CRISPR gRNA sequence
caaatccaaagaggaggaaa

SEQ ID NO: 703216 - DNA, 20 bp, Artificial
  CRISPR gRNA sequence
aaatccaaagaggaggaaaa

SEQ ID NO: 703217 - DNA, 20 bp, Artificial
  CRISPR gRNA sequence
aatccaaagaggaggaaaag

SEQ ID NO: 703218 - DNA, 20 bp, Artificial
  CRISPR gRNA sequence
tccaaagaggaggaaaaggg

SEQ ID NO: 703219 - DNA, 20 bp, Artificial
  CRISPR gRNA sequence
ccaaagaggaggaaaagggg

SEQ ID NO: 703220 - DNA, 20 bp, Artificial
  CRISPR gRNA sequence
aaaggggaggatcactgact

SEQ ID NO: 703221 - DNA, 20 bp, Artificial
  CRISPR gRNA sequence
aaggggaggatcactgactc

SEQ ID NO: 703222 - DNA, 20 bp, Artificial
  CRISPR gRNA sequence
aggggaggatcactgactca

SEQ ID NO: 703223 - DNA, 20 bp, Artificial
  CRISPR gRNA sequence
gggaggatcactgactcagg

SEQ ID NO: 703224 - DNA, 20 bp, Artificial
  CRISPR gRNA sequence
ggaggatcactgactcaggg

SEQ ID NO: 703225 - DNA, 20 bp, Artificial
  CRISPR gRNA sequence
ggatcactgactcagggagg

SEQ ID NO: 703226 - DNA, 20 bp, Artificial
  CRISPR gRNA sequence
tcactgactcagggaggaag

SEQ ID NO: 703227 - DNA, 20 bp, Artificial
  CRISPR gRNA sequence
cactgactcagggaggaaga

SEQ ID NO: 703228 - DNA, 20 bp, Artificial
  CRISPR gRNA sequence
gactcagggaggaagaagga

SEQ ID NO: 703229 - DNA, 20 bp, Artificial
  CRISPR gRNA sequence
ggaggaagaaggaaagttac

SEQ ID NO: 703230 - DNA, 20 bp, Artificial
  CRISPR gRNA sequence
gaagaaggaaagttacaagt

SEQ ID NO: 703231 - DNA, 20 bp, Artificial
  CRISPR gRNA sequence
aagaaggaaagttacaagtt

SEQ ID NO: 703232 - DNA, 20 bp, Artificial
  CRISPR gRNA sequence
ggaaagttacaagttaggta

SEQ ID NO: 703233 - DNA, 20 bp, Artificial
  CRISPR gRNA sequence
caagttaggtatagtatatt

SEQ ID NO: 703234 - DNA, 20 bp, Artificial
  CRISPR gRNA sequence
agttaggtatagtatattca

SEQ ID NO: 703235 - DNA, 20 bp, Artificial
  CRISPR gRNA sequence
ttaggtatagtatattcaga

SEQ ID NO: 703236 - DNA, 20 bp, Artificial
  CRISPR gRNA sequence
taggtatagtatattcagag

SEQ ID NO: 703237 - DNA, 20 bp, Artificial
  CRISPR gRNA sequence
aggtatagtatattcagaga

SEQ ID NO: 703238 - DNA, 20 bp, Artificial
  CRISPR gRNA sequence
ggtatagtatattcagagag

SEQ ID NO: 703239 - DNA, 20 bp, Artificial
  CRISPR gRNA sequence
agtatattcagagaggggat

SEQ ID NO: 703240 - DNA, 20 bp, Artificial
  CRISPR gRNA sequence
tatattcagagaggggatga

SEQ ID NO: 703241 - DNA, 20 bp, Artificial
  CRISPR gRNA sequence
atattcagagaggggatgag

SEQ ID NO: 703242 - DNA, 20 bp, Artificial
  CRISPR gRNA sequence
agaggggatgagaggcaccc

SEQ ID NO: 703243 - DNA, 20 bp, Artificial
  CRISPR gRNA sequence
gaggggatgagaggcaccca

SEQ ID NO: 703244 - DNA, 20 bp, Artificial
  CRISPR gRNA sequence
aggggatgagaggcacccaa

SEQ ID NO: 703245 - DNA, 20 bp, Artificial
  CRISPR gRNA sequence
gagaggcacccaagggatac

SEQ ID NO: 703246 - DNA, 20 bp, Artificial
  CRISPR gRNA sequence
agaggcacccaagggatact

SEQ ID NO: 703247 - DNA, 20 bp, Artificial
  CRISPR gRNA sequence
gttccccccttctgcacata

SEQ ID NO: 703248 - DNA, 20 bp, Artificial
  CRISPR gRNA sequence
ttccccccttctgcacatac

SEQ ID NO: 703249 - DNA, 20 bp, Artificial
  CRISPR gRNA sequence
ccccccttctgcacatacag

SEQ ID NO: 703250 - DNA, 20 bp, Artificial
  CRISPR gRNA sequence
cccccttctgcacatacagg

SEQ ID NO: 703251 - DNA, 20 bp, Artificial
  CRISPR gRNA sequence
ccccttctgcacatacagga

SEQ ID NO: 703252 - DNA, 20 bp, Artificial
  CRISPR gRNA sequence
ttctgcacatacaggaggga

SEQ ID NO: 703253 - DNA, 20 bp, Artificial
  CRISPR gRNA sequence
tgcacatacaggagggacag

SEQ ID NO: 703254 - DNA, 20 bp, Artificial
  CRISPR gRNA sequence
agggacagcagatctgtcgc

SEQ ID NO: 703255 - DNA, 20 bp, Artificial
  CRISPR gRNA sequence
gcagatctgtcgctggattt

SEQ ID NO: 703256 - DNA, 20 bp, Artificial
  CRISPR gRNA sequence
gatctgtcgctggatttcag

SEQ ID NO: 703257 - DNA, 20 bp, Artificial
  CRISPR gRNA sequence
atctgtcgctggatttcagc

SEQ ID NO: 703258 - DNA, 20 bp, Artificial
  CRISPR gRNA sequence
ctggatttcagcaggtgttt

SEQ ID NO: 703259 - DNA, 20 bp, Artificial
  CRISPR gRNA sequence
gatttcagcaggtgtttcag

SEQ ID NO: 703260 - DNA, 20 bp, Artificial
  CRISPR gRNA sequence
ttcagcaggtgtttcagcag

SEQ ID NO: 703261 - DNA, 20 bp, Artificial
  CRISPR gRNA sequence
caggtgtttcagcagcagct

SEQ ID NO: 703262 - DNA, 20 bp, Artificial
  CRISPR gRNA sequence
ttcagcagcagctgagacca

SEQ ID NO: 703263 - DNA, 20 bp, Artificial
  CRISPR gRNA sequence
tcagcagcagctgagaccat

SEQ ID NO: 703264 - DNA, 20 bp, Artificial
  CRISPR gRNA sequence
gctgagaccatgggcctgtc

SEQ ID NO: 703265 - DNA, 20 bp, Artificial
  CRISPR gRNA sequence
atgggcctgtctagttacat

SEQ ID NO: 703266 - DNA, 20 bp, Artificial
  CRISPR gRNA sequence
tgggcctgtctagttacatc

SEQ ID NO: 703267 - DNA, 20 bp, Artificial
  CRISPR gRNA sequence
ctagttacatcaggctgcct

SEQ ID NO: 703268 - DNA, 20 bp, Artificial
  CRISPR gRNA sequence
agttacatcaggctgccttg

SEQ ID NO: 703269 - DNA, 20 bp, Artificial
  CRISPR gRNA sequence
ttacatcaggctgccttgga

SEQ ID NO: 703270 - DNA, 20 bp, Artificial
  CRISPR gRNA sequence
catcaggctgccttggagag

SEQ ID NO: 703271 - DNA, 20 bp, Artificial
  CRISPR gRNA sequence
atcaggctgccttggagagc

SEQ ID NO: 703272 - DNA, 20 bp, Artificial
  CRISPR gRNA sequence
aggctgccttggagagcagg

SEQ ID NO: 703273 - DNA, 20 bp, Artificial
  CRISPR gRNA sequence
ggctgccttggagagcaggc

SEQ ID NO: 703274 - DNA, 20 bp, Artificial
  CRISPR gRNA sequence
gctgccttggagagcaggca

SEQ ID NO: 703275 - DNA, 20 bp, Artificial
  CRISPR gRNA sequence
ctgccttggagagcaggcag

SEQ ID NO: 703276 - DNA, 20 bp, Artificial
  CRISPR gRNA sequence
tgccttggagagcaggcagg

SEQ ID NO: 703277 - DNA, 20 bp, Artificial
  CRISPR gRNA sequence
tctctcctcatgatgctgac

SEQ ID NO: 703278 - DNA, 20 bp, Artificial
  CRISPR gRNA sequence
ctctcctcatgatgctgact

SEQ ID NO: 703279 - DNA, 20 bp, Artificial
  CRISPR gRNA sequence
ctcatgatgctgactgggaa

SEQ ID NO: 703280 - DNA, 20 bp, Artificial
  CRISPR gRNA sequence
atgctgactgggaatagcca

SEQ ID NO: 703281 - DNA, 20 bp, Artificial
  CRISPR gRNA sequence
ctgggaatagccacagttaa

SEQ ID NO: 703282 - DNA, 20 bp, Artificial
  CRISPR gRNA sequence
tgggaatagccacagttaat

SEQ ID NO: 703283 - DNA, 20 bp, Artificial
  CRISPR gRNA sequence
tagccacagttaatgggttt

SEQ ID NO: 703284 - DNA, 20 bp, Artificial
  CRISPR gRNA sequence
cagttaatgggtttgagcat

SEQ ID NO: 703285 - DNA, 20 bp, Artificial
  CRISPR gRNA sequence
gttaatgggtttgagcatca

SEQ ID NO: 703286 - DNA, 20 bp, Artificial
  CRISPR gRNA sequence
gggtttgagcatcagagctc

SEQ ID NO: 703287 - DNA, 20 bp, Artificial
  CRISPR gRNA sequence
tcagagctccagtccactca

SEQ ID NO: 703288 - DNA, 20 bp, Artificial
  CRISPR gRNA sequence
agctccagtccactcaaagt

SEQ ID NO: 703289 - DNA, 20 bp, Artificial
  CRISPR gRNA sequence
tgattcaaatactgattaac

SEQ ID NO: 703290 - DNA, 20 bp, Artificial
  CRISPR gRNA sequence
aatactgattaacgagcatg

SEQ ID NO: 703291 - DNA, 20 bp, Artificial
  CRISPR gRNA sequence
atactgattaacgagcatgt

SEQ ID NO: 703292 - DNA, 20 bp, Artificial
  CRISPR gRNA sequence
acatcgcatcatcttcccca

SEQ ID NO: 703293 - DNA, 20 bp, Artificial
  CRISPR gRNA sequence
atcatcttccccatagtctc

SEQ ID NO: 703294 - DNA, 20 bp, Artificial
  CRISPR gRNA sequence
tcatcttccccatagtctcc

SEQ ID NO: 703295 - DNA, 20 bp, Artificial
  CRISPR gRNA sequence
tccccatagtctccaggctc

SEQ ID NO: 703296 - DNA, 20 bp, Artificial
  CRISPR gRNA sequence
tctccaggctccagctaatt

SEQ ID NO: 703297 - DNA, 20 bp, Artificial
  CRISPR gRNA sequence
ctccaggctccagctaattc

SEQ ID NO: 703298 - DNA, 20 bp, Artificial
  CRISPR gRNA sequence
aggctccagctaattcaggt

SEQ ID NO: 703299 - DNA, 20 bp, Artificial
  CRISPR gRNA sequence
gctccagctaattcaggtaa

SEQ ID NO: 703300 - DNA, 20 bp, Artificial
  CRISPR gRNA sequence
agctaattcaggtaagagtc

SEQ ID NO: 703301 - DNA, 20 bp, Artificial
  CRISPR gRNA sequence
gagtccagtgaccttcccca

SEQ ID NO: 703302 - DNA, 20 bp, Artificial
  CRISPR gRNA sequence
gtccagtgaccttccccaaa

SEQ ID NO: 703303 - DNA, 20 bp, Artificial
  CRISPR gRNA sequence
tccagtgaccttccccaaag

SEQ ID NO: 703304 - DNA, 20 bp, Artificial
  CRISPR gRNA sequence
ccagtgaccttccccaaaga

SEQ ID NO: 703305 - DNA, 20 bp, Artificial
  CRISPR gRNA sequence
cagtgaccttccccaaagag

SEQ ID NO: 703306 - DNA, 20 bp, Artificial
  CRISPR gRNA sequence
agtgaccttccccaaagagg

SEQ ID NO: 703307 - DNA, 20 bp, Artificial
  CRISPR gRNA sequence
gtgaccttccccaaagaggg

SEQ ID NO: 703308 - DNA, 20 bp, Artificial
  CRISPR gRNA sequence
ccccaaagaggggggttcct

SEQ ID NO: 703309 - DNA, 20 bp, Artificial
  CRISPR gRNA sequence
tcctcagaaccctacaatgc

SEQ ID NO: 703310 - DNA, 20 bp, Artificial
  CRISPR gRNA sequence
tgcaagaaataaattaatcc

SEQ ID NO: 703311 - DNA, 20 bp, Artificial
  CRISPR gRNA sequence
ctttacttttttgtctattt

SEQ ID NO: 703312 - DNA, 20 bp, Artificial
  CRISPR gRNA sequence
tttacttttttgtctatttg

SEQ ID NO: 703313 - DNA, 20 bp, Artificial
  CRISPR gRNA sequence
gtctatttgaggaaaaatct

SEQ ID NO: 703314 - DNA, 20 bp, Artificial
  CRISPR gRNA sequence
ctatttgaggaaaaatctga

SEQ ID NO: 703315 - DNA, 20 bp, Artificial
  CRISPR gRNA sequence
tatttgaggaaaaatctgag

SEQ ID NO: 703316 - DNA, 20 bp, Artificial
  CRISPR gRNA sequence
gaggcgtcacgaacactttg

SEQ ID NO: 703317 - DNA, 20 bp, Artificial
  CRISPR gRNA sequence
ggcgtcacgaacactttgta

SEQ ID NO: 703318 - DNA, 20 bp, Artificial
  CRISPR gRNA sequence
gcgtcacgaacactttgtag

SEQ ID NO: 703319 - DNA, 20 bp, Artificial
  CRISPR gRNA sequence
cgtcacgaacactttgtaga

SEQ ID NO: 703320 - DNA, 20 bp, Artificial
  CRISPR gRNA sequence
gtcacgaacactttgtagag

SEQ ID NO: 703321 - DNA, 20 bp, Artificial
  CRISPR gRNA sequence
cacgaacactttgtagaggg

SEQ ID NO: 703322 - DNA, 20 bp, Artificial
  CRISPR gRNA sequence
cactttgtagaggggagatg

SEQ ID NO: 703323 - DNA, 20 bp, Artificial
  CRISPR gRNA sequence
actttgtagaggggagatgt

SEQ ID NO: 703324 - DNA, 20 bp, Artificial
  CRISPR gRNA sequence
gggagatgtgggtatgtgtg

SEQ ID NO: 703325 - DNA, 20 bp, Artificial
  CRISPR gRNA sequence
ggagatgtgggtatgtgtgt

SEQ ID NO: 703326 - DNA, 20 bp, Artificial
  CRISPR gRNA sequence
gagatgtgggtatgtgtgtg

SEQ ID NO: 703327 - DNA, 20 bp, Artificial
  CRISPR gRNA sequence
ttgctttgtaccacatcaaa

SEQ ID NO: 703328 - DNA, 20 bp, Artificial
  CRISPR gRNA sequence
tgctttgtaccacatcaaaa

SEQ ID NO: 703329 - DNA, 20 bp, Artificial
  CRISPR gRNA sequence
gctttgtaccacatcaaaaa

SEQ ID NO: 703330 - DNA, 20 bp, Artificial
  CRISPR gRNA sequence
ctttgtaccacatcaaaaag

SEQ ID NO: 703331 - DNA, 20 bp, Artificial
  CRISPR gRNA sequence
tcaaaaaggggtgcctccac

SEQ ID NO: 703332 - DNA, 20 bp, Artificial
  CRISPR gRNA sequence
caaaaaggggtgcctccacc

SEQ ID NO: 703333 - DNA, 20 bp, Artificial
  CRISPR gRNA sequence
aaaaaggggtgcctccacca

SEQ ID NO: 703334 - DNA, 20 bp, Artificial
  CRISPR gRNA sequence
gggtgcctccaccagggctc

SEQ ID NO: 703335 - DNA, 20 bp, Artificial
  CRISPR gRNA sequence
ggtgcctccaccagggctct

SEQ ID NO: 703336 - DNA, 20 bp, Artificial
  CRISPR gRNA sequence
gtgcctccaccagggctctg

SEQ ID NO: 703337 - DNA, 20 bp, Artificial
  CRISPR gRNA sequence
tgcctccaccagggctctgg

SEQ ID NO: 703338 - DNA, 20 bp, Artificial
  CRISPR gRNA sequence
ctccaccagggctctggggg

SEQ ID NO: 703339 - DNA, 20 bp, Artificial
  CRISPR gRNA sequence
ccaccagggctctgggggtg

SEQ ID NO: 703340 - DNA, 20 bp, Artificial
  CRISPR gRNA sequence
accagggctctgggggtgga

SEQ ID NO: 703341 - DNA, 20 bp, Artificial
  CRISPR gRNA sequence
ccagggctctgggggtggag

SEQ ID NO: 703342 - DNA, 20 bp, Artificial
  CRISPR gRNA sequence
gctctgggggtggagaggtg

SEQ ID NO: 703343 - DNA, 20 bp, Artificial
  CRISPR gRNA sequence
ggtggagaggtgtagtgact

SEQ ID NO: 703344 - DNA, 20 bp, Artificial
  CRISPR gRNA sequence
agcataacccacttctaatg

SEQ ID NO: 703345 - DNA, 20 bp, Artificial
  CRISPR gRNA sequence
gcataacccacttctaatgt

SEQ ID NO: 703346 - DNA, 20 bp, Artificial
  CRISPR gRNA sequence
tgggccaaattatcctgccc

SEQ ID NO: 703347 - DNA, 20 bp, Artificial
  CRISPR gRNA sequence
caaattatcctgccccagaa

SEQ ID NO: 703348 - DNA, 20 bp, Artificial
  CRISPR gRNA sequence
attatcctgccccagaaaag

SEQ ID NO: 703349 - DNA, 20 bp, Artificial
  CRISPR gRNA sequence
ttatcctgccccagaaaagc

SEQ ID NO: 703350 - DNA, 20 bp, Artificial
  CRISPR gRNA sequence
tcctgccccagaaaagcagg

SEQ ID NO: 703351 - DNA, 20 bp, Artificial
  CRISPR gRNA sequence
cagaaaagcaggaagctttg

SEQ ID NO: 703352 - DNA, 20 bp, Artificial
  CRISPR gRNA sequence
aaaagcaggaagctttgaag

SEQ ID NO: 703353 - DNA, 20 bp, Artificial
  CRISPR gRNA sequence
aaagcaggaagctttgaaga

SEQ ID NO: 703354 - DNA, 20 bp, Artificial
  CRISPR gRNA sequence
gaagctttgaagaaggtgcc

SEQ ID NO: 703355 - DNA, 20 bp, Artificial
  CRISPR gRNA sequence
tgaagaaggtgcccagtccc

SEQ ID NO: 703356 - DNA, 20 bp, Artificial
  CRISPR gRNA sequence
gaagaaggtgcccagtcccc

SEQ ID NO: 703357 - DNA, 20 bp, Artificial
  CRISPR gRNA sequence
gaaggtgcccagtccccagg

SEQ ID NO: 703358 - DNA, 20 bp, Artificial
  CRISPR gRNA sequence
aaggtgcccagtccccaggc

SEQ ID NO: 703359 - DNA, 20 bp, Artificial
  CRISPR gRNA sequence
ggtgcccagtccccaggcag

SEQ ID NO: 703360 - DNA, 20 bp, Artificial
  CRISPR gRNA sequence
gtgcccagtccccaggcagg

SEQ ID NO: 703361 - DNA, 20 bp, Artificial
  CRISPR gRNA sequence
cccagtccccaggcaggagg

SEQ ID NO: 703362 - DNA, 20 bp, Artificial
  CRISPR gRNA sequence
aggcaggaggcagtgccatc

SEQ ID NO: 703363 - DNA, 20 bp, Artificial
  CRISPR gRNA sequence
gcaggaggcagtgccatcca

SEQ ID NO: 703364 - DNA, 20 bp, Artificial
  CRISPR gRNA sequence
caggaggcagtgccatccag

SEQ ID NO: 703365 - DNA, 20 bp, Artificial
  CRISPR gRNA sequence
ggaggcagtgccatccagag

SEQ ID NO: 703366 - DNA, 20 bp, Artificial
  CRISPR gRNA sequence
aggcagtgccatccagagga

SEQ ID NO: 703367 - DNA, 20 bp, Artificial
  CRISPR gRNA sequence
ccatccagaggagagtgctc

SEQ ID NO: 703368 - DNA, 20 bp, Artificial
  CRISPR gRNA sequence
catccagaggagagtgctct

SEQ ID NO: 703369 - DNA, 20 bp, Artificial
  CRISPR gRNA sequence
cagaggagagtgctctgggc

SEQ ID NO: 703370 - DNA, 20 bp, Artificial
  CRISPR gRNA sequence
aactcgccatctctgtttcc

SEQ ID NO: 703371 - DNA, 20 bp, Artificial
  CRISPR gRNA sequence
ccatctctgtttcctggctg

SEQ ID NO: 703372 - DNA, 20 bp, Artificial
  CRISPR gRNA sequence
ctgtttcctggctgtagctc

SEQ ID NO: 703373 - DNA, 20 bp, Artificial
  CRISPR gRNA sequence
tggctgtagctccagccctg

SEQ ID NO: 703374 - DNA, 20 bp, Artificial
  CRISPR gRNA sequence
gctctctccatctgtaaaac

SEQ ID NO: 703375 - DNA, 20 bp, Artificial
  CRISPR gRNA sequence
ctctctccatctgtaaaaca

SEQ ID NO: 703376 - DNA, 20 bp, Artificial
  CRISPR gRNA sequence
tctccatctgtaaaacaagg

SEQ ID NO: 703377 - DNA, 20 bp, Artificial
  CRISPR gRNA sequence
catctgtaaaacaaggtagc

SEQ ID NO: 703378 - DNA, 20 bp, Artificial
  CRISPR gRNA sequence
atctgtaaaacaaggtagct

SEQ ID NO: 703379 - DNA, 20 bp, Artificial
  CRISPR gRNA sequence
gtaaaacaaggtagctgggt

SEQ ID NO: 703380 - DNA, 20 bp, Artificial
  CRISPR gRNA sequence
acaaggtagctgggtcagac

SEQ ID NO: 703381 - DNA, 20 bp, Artificial
  CRISPR gRNA sequence
aggtagctgggtcagaccag

SEQ ID NO: 703382 - DNA, 20 bp, Artificial
  CRISPR gRNA sequence
tagctgggtcagaccagtgg

SEQ ID NO: 703383 - DNA, 20 bp, Artificial
  CRISPR gRNA sequence
tgggtcagaccagtggtggc

SEQ ID NO: 703384 - DNA, 20 bp, Artificial
  CRISPR gRNA sequence
agtggtggccagctatgaac

SEQ ID NO: 703385 - DNA, 20 bp, Artificial
  CRISPR gRNA sequence
gccagctatgaactggcctt

SEQ ID NO: 703386 - DNA, 20 bp, Artificial
  CRISPR gRNA sequence
cagctatgaactggccttca

SEQ ID NO: 703387 - DNA, 20 bp, Artificial
  CRISPR gRNA sequence
gccttcagagacattccgtc

SEQ ID NO: 703388 - DNA, 20 bp, Artificial
  CRISPR gRNA sequence
tcagagacattccgtctggc

SEQ ID NO: 703389 - DNA, 20 bp, Artificial
  CRISPR gRNA sequence
gacattccgtctggccagca

SEQ ID NO: 703390 - DNA, 20 bp, Artificial
  CRISPR gRNA sequence
gtctggccagcatagcaatc

SEQ ID NO: 703391 - DNA, 20 bp, Artificial
  CRISPR gRNA sequence
agcaatccagccacccttcc

SEQ ID NO: 703392 - DNA, 20 bp, Artificial
  CRISPR gRNA sequence
gcaatccagccacccttcct

SEQ ID NO: 703393 - DNA, 20 bp, Artificial
  CRISPR gRNA sequence
gccacccttcctaggcactc

SEQ ID NO: 703394 - DNA, 20 bp, Artificial
  CRISPR gRNA sequence
cacccttcctaggcactcaa

SEQ ID NO: 703395 - DNA, 20 bp, Artificial
  CRISPR gRNA sequence
acccttcctaggcactcaag

SEQ ID NO: 703396 - DNA, 20 bp, Artificial
  CRISPR gRNA sequence
aatgaaattatacgttcaca

SEQ ID NO: 703397 - DNA, 20 bp, Artificial
  CRISPR gRNA sequence
tgaaattatacgttcacaca

SEQ ID NO: 703398 - DNA, 20 bp, Artificial
  CRISPR gRNA sequence
gaaattatacgttcacacag

SEQ ID NO: 703399 - DNA, 20 bp, Artificial
  CRISPR gRNA sequence
gttcacacagaggcacgcac

SEQ ID NO: 703400 - DNA, 20 bp, Artificial
  CRISPR gRNA sequence
ggcacgcacaagaatactca

SEQ ID NO: 703401 - DNA, 20 bp, Artificial
  CRISPR gRNA sequence
cacagctgccttgttcgtca

SEQ ID NO: 703402 - DNA, 20 bp, Artificial
  CRISPR gRNA sequence
ttgttcgtcatagttcaaac

SEQ ID NO: 703403 - DNA, 20 bp, Artificial
  CRISPR gRNA sequence
caacccaaatgtccatcaac

SEQ ID NO: 703404 - DNA, 20 bp, Artificial
  CRISPR gRNA sequence
aatgtccatcaactagcgaa

SEQ ID NO: 703405 - DNA, 20 bp, Artificial
  CRISPR gRNA sequence
atgtccatcaactagcgaac

SEQ ID NO: 703406 - DNA, 20 bp, Artificial
  CRISPR gRNA sequence
ctagcgaacgggtatgtaaa

SEQ ID NO: 703407 - DNA, 20 bp, Artificial
  CRISPR gRNA sequence
gcgaacgggtatgtaaacag

SEQ ID NO: 703408 - DNA, 20 bp, Artificial
  CRISPR gRNA sequence
acagtggttcatctgtacaa

SEQ ID NO: 703409 - DNA, 20 bp, Artificial
  CRISPR gRNA sequence
ctgtacaacagaacgccatt

SEQ ID NO: 703410 - DNA, 20 bp, Artificial
  CRISPR gRNA sequence
aacagaacgccatttggcaa

SEQ ID NO: 703411 - DNA, 20 bp, Artificial
  CRISPR gRNA sequence
gaacgccatttggcaacaga

SEQ ID NO: 703412 - DNA, 20 bp, Artificial
  CRISPR gRNA sequence
aacgccatttggcaacagaa

SEQ ID NO: 703413 - DNA, 20 bp, Artificial
  CRISPR gRNA sequence
tttggcaacagaaaggaatg

SEQ ID NO: 703414 - DNA, 20 bp, Artificial
  CRISPR gRNA sequence
tgaatatcaaaaacattatg

SEQ ID NO: 703415 - DNA, 20 bp, Artificial
  CRISPR gRNA sequence
aatatcaaaaacattatgca

SEQ ID NO: 703416 - DNA, 20 bp, Artificial
  CRISPR gRNA sequence
atcaaaaacattatgcagag

SEQ ID NO: 703417 - DNA, 20 bp, Artificial
  CRISPR gRNA sequence
aaaaacattatgcagagtgg

SEQ ID NO: 703418 - DNA, 20 bp, Artificial
  CRISPR gRNA sequence
aacattatgcagagtggaag

SEQ ID NO: 703419 - DNA, 20 bp, Artificial
  CRISPR gRNA sequence
ttatgcagagtggaagaagc

SEQ ID NO: 703420 - DNA, 20 bp, Artificial
  CRISPR gRNA sequence
gtggaagaagccagacccca

SEQ ID NO: 703421 - DNA, 20 bp, Artificial
  CRISPR gRNA sequence
ggaagaagccagaccccaaa

SEQ ID NO: 703422 - DNA, 20 bp, Artificial
  CRISPR gRNA sequence
attctgtcgacatgaaattc

SEQ ID NO: 703423 - DNA, 20 bp, Artificial
  CRISPR gRNA sequence
gtcgacatgaaattctggaa

SEQ ID NO: 703424 - DNA, 20 bp, Artificial
  CRISPR gRNA sequence
ggaacagatacactcctcta

SEQ ID NO: 703425 - DNA, 20 bp, Artificial
  CRISPR gRNA sequence
cactcctctatagtgacata

SEQ ID NO: 703426 - DNA, 20 bp, Artificial
  CRISPR gRNA sequence
tcctctatagtgacataaag

SEQ ID NO: 703427 - DNA, 20 bp, Artificial
  CRISPR gRNA sequence
tatagtgacataaagcagat

SEQ ID NO: 703428 - DNA, 20 bp, Artificial
  CRISPR gRNA sequence
agtgacataaagcagatcgg

SEQ ID NO: 703429 - DNA, 20 bp, Artificial
  CRISPR gRNA sequence
aaagcagatcggtggttgcc

SEQ ID NO: 703430 - DNA, 20 bp, Artificial
  CRISPR gRNA sequence
gatcggtggttgcctggatc

SEQ ID NO: 703431 - DNA, 20 bp, Artificial
  CRISPR gRNA sequence
tcggtggttgcctggatctg

SEQ ID NO: 703432 - DNA, 20 bp, Artificial
  CRISPR gRNA sequence
cggtggttgcctggatctgg

SEQ ID NO: 703433 - DNA, 20 bp, Artificial
  CRISPR gRNA sequence
tggttgcctggatctggagg

SEQ ID NO: 703434 - DNA, 20 bp, Artificial
  CRISPR gRNA sequence
ggttgcctggatctggaggt

SEQ ID NO: 703435 - DNA, 20 bp, Artificial
  CRISPR gRNA sequence
gttgcctggatctggaggtg

SEQ ID NO: 703436 - DNA, 20 bp, Artificial
  CRISPR gRNA sequence
ttgcctggatctggaggtgg

SEQ ID NO: 703437 - DNA, 20 bp, Artificial
  CRISPR gRNA sequence
cctggatctggaggtggggg

SEQ ID NO: 703438 - DNA, 20 bp, Artificial
  CRISPR gRNA sequence
tggatctggaggtgggggca

SEQ ID NO: 703439 - DNA, 20 bp, Artificial
  CRISPR gRNA sequence
tctggaggtgggggcagagt

SEQ ID NO: 703440 - DNA, 20 bp, Artificial
  CRISPR gRNA sequence
gaggtgggggcagagtgagt

SEQ ID NO: 703441 - DNA, 20 bp, Artificial
  CRISPR gRNA sequence
aggtgggggcagagtgagtg

SEQ ID NO: 703442 - DNA, 20 bp, Artificial
  CRISPR gRNA sequence
gtgggggcagagtgagtgag

SEQ ID NO: 703443 - DNA, 20 bp, Artificial
  CRISPR gRNA sequence
tgggggcagagtgagtgagg

SEQ ID NO: 703444 - DNA, 20 bp, Artificial
  CRISPR gRNA sequence
gggggcagagtgagtgagga

SEQ ID NO: 703445 - DNA, 20 bp, Artificial
  CRISPR gRNA sequence
ggggcagagtgagtgaggag

SEQ ID NO: 703446 - DNA, 20 bp, Artificial
  CRISPR gRNA sequence
gagtgagtgaggaggggcac

SEQ ID NO: 703447 - DNA, 20 bp, Artificial
  CRISPR gRNA sequence
agtgagtgaggaggggcact

SEQ ID NO: 703448 - DNA, 20 bp, Artificial
  CRISPR gRNA sequence
gtgagtgaggaggggcacta

SEQ ID NO: 703449 - DNA, 20 bp, Artificial
  CRISPR gRNA sequence
aggggcactagggaaccttc

SEQ ID NO: 703450 - DNA, 20 bp, Artificial
  CRISPR gRNA sequence
gggcactagggaaccttctg

SEQ ID NO: 703451 - DNA, 20 bp, Artificial
  CRISPR gRNA sequence
ggcactagggaaccttctgg

SEQ ID NO: 703452 - DNA, 20 bp, Artificial
  CRISPR gRNA sequence
gcactagggaaccttctgga

SEQ ID NO: 703453 - DNA, 20 bp, Artificial
  CRISPR gRNA sequence
agggaaccttctggagggat

SEQ ID NO: 703454 - DNA, 20 bp, Artificial
  CRISPR gRNA sequence
agaatgttctgtattttgat

SEQ ID NO: 703455 - DNA, 20 bp, Artificial
  CRISPR gRNA sequence
aatgttctgtattttgattg

SEQ ID NO: 703456 - DNA, 20 bp, Artificial
  CRISPR gRNA sequence
ttctgtattttgattggagt

SEQ ID NO: 703457 - DNA, 20 bp, Artificial
  CRISPR gRNA sequence
ttggagttagttacctttgt

SEQ ID NO: 703458 - DNA, 20 bp, Artificial
  CRISPR gRNA sequence
ttacctttgtcagaactcat

SEQ ID NO: 703459 - DNA, 20 bp, Artificial
  CRISPR gRNA sequence
tacctttgtcagaactcatc

SEQ ID NO: 703460 - DNA, 20 bp, Artificial
  CRISPR gRNA sequence
ctcatcaggctgtacacact

SEQ ID NO: 703461 - DNA, 20 bp, Artificial
  CRISPR gRNA sequence
tcatcaggctgtacacactt

SEQ ID NO: 703462 - DNA, 20 bp, Artificial
  CRISPR gRNA sequence
catcaggctgtacacactta

SEQ ID NO: 703463 - DNA, 20 bp, Artificial
  CRISPR gRNA sequence
ttatttttacttattaaaaa

SEQ ID NO: 703464 - DNA, 20 bp, Artificial
  CRISPR gRNA sequence
atttttacttattaaaaata

SEQ ID NO: 703465 - DNA, 20 bp, Artificial
  CRISPR gRNA sequence
ttacttattaaaaatagaga

SEQ ID NO: 703466 - DNA, 20 bp, Artificial
  CRISPR gRNA sequence
tacttattaaaaatagagac

SEQ ID NO: 703467 - DNA, 20 bp, Artificial
  CRISPR gRNA sequence
acttattaaaaatagagaca

SEQ ID NO: 703468 - DNA, 20 bp, Artificial
  CRISPR gRNA sequence
cagggtcttgctatgttgct

SEQ ID NO: 703469 - DNA, 20 bp, Artificial
  CRISPR gRNA sequence
agggtcttgctatgttgctt

SEQ ID NO: 703470 - DNA, 20 bp, Artificial
  CRISPR gRNA sequence
tcttgctatgttgcttaggc

SEQ ID NO: 703471 - DNA, 20 bp, Artificial
  CRISPR gRNA sequence
taggctggtttcgaactcct

SEQ ID NO: 703472 - DNA, 20 bp, Artificial
  CRISPR gRNA sequence
ggtttcgaactcctgagctc

SEQ ID NO: 703473 - DNA, 20 bp, Artificial
  CRISPR gRNA sequence
ctcaagtgatctgcctgctt

SEQ ID NO: 703474 - DNA, 20 bp, Artificial
  CRISPR gRNA sequence
ctgcctgcttcagcctccca

SEQ ID NO: 703475 - DNA, 20 bp, Artificial
  CRISPR gRNA sequence
gcttcagcctcccaaagtgc

SEQ ID NO: 703476 - DNA, 20 bp, Artificial
  CRISPR gRNA sequence
cttcagcctcccaaagtgct

SEQ ID NO: 703477 - DNA, 20 bp, Artificial
  CRISPR gRNA sequence
ctcccaaagtgctgggatta

SEQ ID NO: 703478 - DNA, 20 bp, Artificial
  CRISPR gRNA sequence
tcccaaagtgctgggattac

SEQ ID NO: 703479 - DNA, 20 bp, Artificial
  CRISPR gRNA sequence
caaagtgctgggattacagg

SEQ ID NO: 703480 - DNA, 20 bp, Artificial
  CRISPR gRNA sequence
aaagtgctgggattacaggc

SEQ ID NO: 703481 - DNA, 20 bp, Artificial
  CRISPR gRNA sequence
agtgctgggattacaggcgg

SEQ ID NO: 703482 - DNA, 20 bp, Artificial
  CRISPR gRNA sequence
cgggagccaccctaccctgc

SEQ ID NO: 703483 - DNA, 20 bp, Artificial
  CRISPR gRNA sequence
gggagccaccctaccctgcc

SEQ ID NO: 703484 - DNA, 20 bp, Artificial
  CRISPR gRNA sequence
ggagccaccctaccctgcca

SEQ ID NO: 703485 - DNA, 20 bp, Artificial
  CRISPR gRNA sequence
gagccaccctaccctgccag

SEQ ID NO: 703486 - DNA, 20 bp, Artificial
  CRISPR gRNA sequence
cttgtatataaatgttgcct

SEQ ID NO: 703487 - DNA, 20 bp, Artificial
  CRISPR gRNA sequence
ttgtatataaatgttgcctt

SEQ ID NO: 703488 - DNA, 20 bp, Artificial
  CRISPR gRNA sequence
atataaatgttgccttaggc

SEQ ID NO: 703489 - DNA, 20 bp, Artificial
  CRISPR gRNA sequence
tataaatgttgccttaggct

SEQ ID NO: 703490 - DNA, 20 bp, Artificial
  CRISPR gRNA sequence
atgttgccttaggctgggca

SEQ ID NO: 703491 - DNA, 20 bp, Artificial
  CRISPR gRNA sequence
ttgccttaggctgggcatgg

SEQ ID NO: 703492 - DNA, 20 bp, Artificial
  CRISPR gRNA sequence
gtggctcacgcctacgatcc

SEQ ID NO: 703493 - DNA, 20 bp, Artificial
  CRISPR gRNA sequence
cgcctacgatcccagcactt

SEQ ID NO: 703494 - DNA, 20 bp, Artificial
  CRISPR gRNA sequence
gcctacgatcccagcacttt

SEQ ID NO: 703495 - DNA, 20 bp, Artificial
  CRISPR gRNA sequence
ctacgatcccagcactttgg

SEQ ID NO: 703496 - DNA, 20 bp, Artificial
  CRISPR gRNA sequence
tacgatcccagcactttggg

SEQ ID NO: 703497 - DNA, 20 bp, Artificial
  CRISPR gRNA sequence
tcccagcactttgggaggct

SEQ ID NO: 703498 - DNA, 20 bp, Artificial
  CRISPR gRNA sequence
cccagcactttgggaggctg

SEQ ID NO: 703499 - DNA, 20 bp, Artificial
  CRISPR gRNA sequence
agcactttgggaggctgagg

SEQ ID NO: 703500 - DNA, 20 bp, Artificial
  CRISPR gRNA sequence
gcactttgggaggctgaggt

SEQ ID NO: 703501 - DNA, 20 bp, Artificial
  CRISPR gRNA sequence
ctttgggaggctgaggtggg

SEQ ID NO: 703502 - DNA, 20 bp, Artificial
  CRISPR gRNA sequence
ctgaggtgggcggatcactt

SEQ ID NO: 703503 - DNA, 20 bp, Artificial
  CRISPR gRNA sequence
tgaggtgggcggatcacttg

SEQ ID NO: 703504 - DNA, 20 bp, Artificial
  CRISPR gRNA sequence
gtgggcggatcacttgaggt

SEQ ID NO: 703505 - DNA, 20 bp, Artificial
  CRISPR gRNA sequence
tgggcggatcacttgaggtc

SEQ ID NO: 703506 - DNA, 20 bp, Artificial
  CRISPR gRNA sequence
ggcggatcacttgaggtcag

SEQ ID NO: 703507 - DNA, 20 bp, Artificial
  CRISPR gRNA sequence
tcacttgaggtcaggagttc

SEQ ID NO: 703508 - DNA, 20 bp, Artificial
  CRISPR gRNA sequence
tgaggtcaggagttcgagac

SEQ ID NO: 703509 - DNA, 20 bp, Artificial
  CRISPR gRNA sequence
tcaggagttcgagaccagcc

SEQ ID NO: 703510 - DNA, 20 bp, Artificial
  CRISPR gRNA sequence
cgagaccagcctggtcaaca

SEQ ID NO: 703511 - DNA, 20 bp, Artificial
  CRISPR gRNA sequence
tctactaaaaatacaaaaat

SEQ ID NO: 703512 - DNA, 20 bp, Artificial
  CRISPR gRNA sequence
ctaaaaatacaaaaattagc

SEQ ID NO: 703513 - DNA, 20 bp, Artificial
  CRISPR gRNA sequence
taaaaatacaaaaattagct

SEQ ID NO: 703514 - DNA, 20 bp, Artificial
  CRISPR gRNA sequence
caaaaattagctgggcatgt

SEQ ID NO: 703515 - DNA, 20 bp, Artificial
  CRISPR gRNA sequence
aaattagctgggcatgttgg

SEQ ID NO: 703516 - DNA, 20 bp, Artificial
  CRISPR gRNA sequence
aattagctgggcatgttggc

SEQ ID NO: 703517 - DNA, 20 bp, Artificial
  CRISPR gRNA sequence
ttggcaggcacctgtaatcc

SEQ ID NO: 703518 - DNA, 20 bp, Artificial
  CRISPR gRNA sequence
cacctgtaatcccagctact

SEQ ID NO: 703519 - DNA, 20 bp, Artificial
  CRISPR gRNA sequence
acctgtaatcccagctactc

SEQ ID NO: 703520 - DNA, 20 bp, Artificial
  CRISPR gRNA sequence
ctgtaatcccagctactcag

SEQ ID NO: 703521 - DNA, 20 bp, Artificial
  CRISPR gRNA sequence
tgtaatcccagctactcagg

SEQ ID NO: 703522 - DNA, 20 bp, Artificial
  CRISPR gRNA sequence
tcccagctactcaggaggct

SEQ ID NO: 703523 - DNA, 20 bp, Artificial
  CRISPR gRNA sequence
cccagctactcaggaggctg

SEQ ID NO: 703524 - DNA, 20 bp, Artificial
  CRISPR gRNA sequence
agctactcaggaggctgagg

SEQ ID NO: 703525 - DNA, 20 bp, Artificial
  CRISPR gRNA sequence
gctactcaggaggctgaggc

SEQ ID NO: 703526 - DNA, 20 bp, Artificial
  CRISPR gRNA sequence
tactcaggaggctgaggcag

SEQ ID NO: 703527 - DNA, 20 bp, Artificial
  CRISPR gRNA sequence
gcaggagaatcacttgaatc

SEQ ID NO: 703528 - DNA, 20 bp, Artificial
  CRISPR gRNA sequence
caggagaatcacttgaatcc

SEQ ID NO: 703529 - DNA, 20 bp, Artificial
  CRISPR gRNA sequence
ggagaatcacttgaatccgg

SEQ ID NO: 703530 - DNA, 20 bp, Artificial
  CRISPR gRNA sequence
gagaatcacttgaatccggg

SEQ ID NO: 703531 - DNA, 20 bp, Artificial
  CRISPR gRNA sequence
aatcacttgaatccgggagg

SEQ ID NO: 703532 - DNA, 20 bp, Artificial
  CRISPR gRNA sequence
cacttgaatccgggaggcag

SEQ ID NO: 703533 - DNA, 20 bp, Artificial
  CRISPR gRNA sequence
cgggaggcagaagttgcaat

SEQ ID NO: 703534 - DNA, 20 bp, Artificial
  CRISPR gRNA sequence
ggcagaagttgcaatgagct

SEQ ID NO: 703535 - DNA, 20 bp, Artificial
  CRISPR gRNA sequence
gagatcgtgccactgcactc

SEQ ID NO: 703536 - DNA, 20 bp, Artificial
  CRISPR gRNA sequence
cgtgccactgcactccagtc

SEQ ID NO: 703537 - DNA, 20 bp, Artificial
  CRISPR gRNA sequence
gtgccactgcactccagtct

SEQ ID NO: 703538 - DNA, 20 bp, Artificial
  CRISPR gRNA sequence
ccactgcactccagtctggg

SEQ ID NO: 703539 - DNA, 20 bp, Artificial
  CRISPR gRNA sequence
ctgcactccagtctgggcag

SEQ ID NO: 703540 - DNA, 20 bp, Artificial
  CRISPR gRNA sequence
gcactccagtctgggcagca

SEQ ID NO: 703541 - DNA, 20 bp, Artificial
  CRISPR gRNA sequence
cactccagtctgggcagcag

SEQ ID NO: 703542 - DNA, 20 bp, Artificial
  CRISPR gRNA sequence
tccagtctgggcagcagagg

SEQ ID NO: 703543 - DNA, 20 bp, Artificial
  CRISPR gRNA sequence
aaataaataattccttaata

SEQ ID NO: 703544 - DNA, 20 bp, Artificial
  CRISPR gRNA sequence
ccttaataaagttgatttaa

SEQ ID NO: 703545 - DNA, 20 bp, Artificial
  CRISPR gRNA sequence
agaaaaaaactttaaaaatt

SEQ ID NO: 703546 - DNA, 20 bp, Artificial
  CRISPR gRNA sequence
gaaaaaaactttaaaaattg

SEQ ID NO: 703547 - DNA, 20 bp, Artificial
  CRISPR gRNA sequence
ttgaggctgtatttaaacat

SEQ ID NO: 703548 - DNA, 20 bp, Artificial
  CRISPR gRNA sequence
tgaggctgtatttaaacatt

SEQ ID NO: 703549 - DNA, 20 bp, Artificial
  CRISPR gRNA sequence
atttaaacattaggcgattt

SEQ ID NO: 703550 - DNA, 20 bp, Artificial
  CRISPR gRNA sequence
cgatttcagttttctcttaa

SEQ ID NO: 703551 - DNA, 20 bp, Artificial
  CRISPR gRNA sequence
cagttttctcttaaaagcaa

SEQ ID NO: 703552 - DNA, 20 bp, Artificial
  CRISPR gRNA sequence
agttttctcttaaaagcaaa

SEQ ID NO: 703553 - DNA, 20 bp, Artificial
  CRISPR gRNA sequence
tctcttaaaagcaaaaggtc

SEQ ID NO: 703554 - DNA, 20 bp, Artificial
  CRISPR gRNA sequence
gcgtcactgtttcaccttcc

SEQ ID NO: 703555 - DNA, 20 bp, Artificial
  CRISPR gRNA sequence
cgtcactgtttcaccttcct

SEQ ID NO: 703556 - DNA, 20 bp, Artificial
  CRISPR gRNA sequence
ttcaccttcctgggtgacca

SEQ ID NO: 703557 - DNA, 20 bp, Artificial
  CRISPR gRNA sequence
tcctgggtgaccacagctgt

SEQ ID NO: 703558 - DNA, 20 bp, Artificial
  CRISPR gRNA sequence
ctgggtgaccacagctgtta

SEQ ID NO: 703559 - DNA, 20 bp, Artificial
  CRISPR gRNA sequence
tgaccacagctgttagagac

SEQ ID NO: 703560 - DNA, 20 bp, Artificial
  CRISPR gRNA sequence
ccacagctgttagagacaag

SEQ ID NO: 703561 - DNA, 20 bp, Artificial
  CRISPR gRNA sequence
cactttgttttatttatttt

SEQ ID NO: 703562 - DNA, 20 bp, Artificial
  CRISPR gRNA sequence
ttgagtctttctctgtcgcc

SEQ ID NO: 703563 - DNA, 20 bp, Artificial
  CRISPR gRNA sequence
tgagtctttctctgtcgccc

SEQ ID NO: 703564 - DNA, 20 bp, Artificial
  CRISPR gRNA sequence
tctttctctgtcgcccaggc

SEQ ID NO: 703565 - DNA, 20 bp, Artificial
  CRISPR gRNA sequence
tttctctgtcgcccaggctg

SEQ ID NO: 703566 - DNA, 20 bp, Artificial
  CRISPR gRNA sequence
ctgtcgcccaggctggagtg

SEQ ID NO: 703567 - DNA, 20 bp, Artificial
  CRISPR gRNA sequence
tcgcccaggctggagtgcag

SEQ ID NO: 703568 - DNA, 20 bp, Artificial
  CRISPR gRNA sequence
ggagtgcagtggcatgatct

SEQ ID NO: 703569 - DNA, 20 bp, Artificial
  CRISPR gRNA sequence
ggcatgatctcagctcactg

SEQ ID NO: 703570 - DNA, 20 bp, Artificial
  CRISPR gRNA sequence
tcactgcagcctccacctcc

SEQ ID NO: 703571 - DNA, 20 bp, Artificial
  CRISPR gRNA sequence
cactgcagcctccacctccc

SEQ ID NO: 703572 - DNA, 20 bp, Artificial
  CRISPR gRNA sequence
ttcaaacgattctcctgcct

SEQ ID NO: 703573 - DNA, 20 bp, Artificial
  CRISPR gRNA sequence
ttctcctgcctcagcctcct

SEQ ID NO: 703574 - DNA, 20 bp, Artificial
  CRISPR gRNA sequence
tcctgcctcagcctcctgag

SEQ ID NO: 703575 - DNA, 20 bp, Artificial
  CRISPR gRNA sequence
gcctcagcctcctgagtagc

SEQ ID NO: 703576 - DNA, 20 bp, Artificial
  CRISPR gRNA sequence
cctcagcctcctgagtagct

SEQ ID NO: 703577 - DNA, 20 bp, Artificial
  CRISPR gRNA sequence
ctcctgagtagctaggatta

SEQ ID NO: 703578 - DNA, 20 bp, Artificial
  CRISPR gRNA sequence
tcctgagtagctaggattac

SEQ ID NO: 703579 - DNA, 20 bp, Artificial
  CRISPR gRNA sequence
caggtgtgtgccatcacacc

SEQ ID NO: 703580 - DNA, 20 bp, Artificial
  CRISPR gRNA sequence
ctggctaatttttgtgtttt

SEQ ID NO: 703581 - DNA, 20 bp, Artificial
  CRISPR gRNA sequence
gctaatttttgtgtttttag

SEQ ID NO: 703582 - DNA, 20 bp, Artificial
  CRISPR gRNA sequence
taatttttgtgtttttagta

SEQ ID NO: 703583 - DNA, 20 bp, Artificial
  CRISPR gRNA sequence
ttttgtgtttttagtagaga

SEQ ID NO: 703584 - DNA, 20 bp, Artificial
  CRISPR gRNA sequence
tttgtgtttttagtagagat

SEQ ID NO: 703585 - DNA, 20 bp, Artificial
  CRISPR gRNA sequence
ttgtgtttttagtagagatg

SEQ ID NO: 703586 - DNA, 20 bp, Artificial
  CRISPR gRNA sequence
gagatggggtttcaccgtgt

SEQ ID NO: 703587 - DNA, 20 bp, Artificial
  CRISPR gRNA sequence
tggggtttcaccgtgttggt

SEQ ID NO: 703588 - DNA, 20 bp, Artificial
  CRISPR gRNA sequence
ggggtttcaccgtgttggtc

SEQ ID NO: 703589 - DNA, 20 bp, Artificial
  CRISPR gRNA sequence
tttcaccgtgttggtcaggc

SEQ ID NO: 703590 - DNA, 20 bp, Artificial
  CRISPR gRNA sequence
ggtctcgaactcctgacctc

SEQ ID NO: 703591 - DNA, 20 bp, Artificial
  CRISPR gRNA sequence
ctcgaactcctgacctcaag

SEQ ID NO: 703592 - DNA, 20 bp, Artificial
  CRISPR gRNA sequence
ctcaagtggtcctcctgcct

SEQ ID NO: 703593 - DNA, 20 bp, Artificial
  CRISPR gRNA sequence
ctcccaaaatgctgtgatta

SEQ ID NO: 703594 - DNA, 20 bp, Artificial
  CRISPR gRNA sequence
tcccaaaatgctgtgattac

SEQ ID NO: 703595 - DNA, 20 bp, Artificial
  CRISPR gRNA sequence
aatgctgtgattacaggtgt

SEQ ID NO: 703596 - DNA, 20 bp, Artificial
  CRISPR gRNA sequence
caggtgtgagccaatgtgcc

SEQ ID NO: 703597 - DNA, 20 bp, Artificial
  CRISPR gRNA sequence
tgtgagccaatgtgcctggc

SEQ ID NO: 703598 - DNA, 20 bp, Artificial
  CRISPR gRNA sequence
aaacacaaatctgactgtct

SEQ ID NO: 703599 - DNA, 20 bp, Artificial
  CRISPR gRNA sequence
tctgactgtcttagctccca

SEQ ID NO: 703600 - DNA, 20 bp, Artificial
  CRISPR gRNA sequence
ctcccacggtgttgcctcgc

SEQ ID NO: 703601 - DNA, 20 bp, Artificial
  CRISPR gRNA sequence
ccacggtgttgcctcgctgg

SEQ ID NO: 703602 - DNA, 20 bp, Artificial
  CRISPR gRNA sequence
gttgcctcgctggaagccac

SEQ ID NO: 703603 - DNA, 20 bp, Artificial
  CRISPR gRNA sequence
tggaagccaccagtccctgc

SEQ ID NO: 703604 - DNA, 20 bp, Artificial
  CRISPR gRNA sequence
cctgctggttaactctttcc

SEQ ID NO: 703605 - DNA, 20 bp, Artificial
  CRISPR gRNA sequence
tgctggttaactctttcctg

SEQ ID NO: 703606 - DNA, 20 bp, Artificial
  CRISPR gRNA sequence
taactctttcctggagacac

SEQ ID NO: 703607 - DNA, 20 bp, Artificial
  CRISPR gRNA sequence
cctggagacaccagcctcct

SEQ ID NO: 703608 - DNA, 20 bp, Artificial
  CRISPR gRNA sequence
gacaccagcctccttggcgc

SEQ ID NO: 703609 - DNA, 20 bp, Artificial
  CRISPR gRNA sequence
gcctccttggcgctggttct

SEQ ID NO: 703610 - DNA, 20 bp, Artificial
  CRISPR gRNA sequence
cagatgttacgtcccctctg

SEQ ID NO: 703611 - DNA, 20 bp, Artificial
  CRISPR gRNA sequence
ttacgtcccctctgcagata

SEQ ID NO: 703612 - DNA, 20 bp, Artificial
  CRISPR gRNA sequence
tcccctctgcagatatggct

SEQ ID NO: 703613 - DNA, 20 bp, Artificial
  CRISPR gRNA sequence
cctctgcagatatggctgag

SEQ ID NO: 703614 - DNA, 20 bp, Artificial
  CRISPR gRNA sequence
ctctgcagatatggctgaga

SEQ ID NO: 703615 - DNA, 20 bp, Artificial
  CRISPR gRNA sequence
ctgagaaggacaccaccttt

SEQ ID NO: 703616 - DNA, 20 bp, Artificial
  CRISPR gRNA sequence
tgagaaggacaccacctttg

SEQ ID NO: 703617 - DNA, 20 bp, Artificial
  CRISPR gRNA sequence
cacctttgaggcgccacccc

SEQ ID NO: 703618 - DNA, 20 bp, Artificial
  CRISPR gRNA sequence
acctttgaggcgccacccct

SEQ ID NO: 703619 - DNA, 20 bp, Artificial
  CRISPR gRNA sequence
cctttgaggcgccacccctg

SEQ ID NO: 703620 - DNA, 20 bp, Artificial
  CRISPR gRNA sequence
aggcgccacccctggggacc

SEQ ID NO: 703621 - DNA, 20 bp, Artificial
  CRISPR gRNA sequence
gccacccctggggacccagc

SEQ ID NO: 703622 - DNA, 20 bp, Artificial
  CRISPR gRNA sequence
gccggactgcaaccccaccc

SEQ ID NO: 703623 - DNA, 20 bp, Artificial
  CRISPR gRNA sequence
cggactgcaaccccacccca

SEQ ID NO: 703624 - DNA, 20 bp, Artificial
  CRISPR gRNA sequence
tgcaaccccaccccagagaa

SEQ ID NO: 703625 - DNA, 20 bp, Artificial
  CRISPR gRNA sequence
accccaccccagagaatggc

SEQ ID NO: 703626 - DNA, 20 bp, Artificial
  CRISPR gRNA sequence
ccccaccccagagaatggcg

SEQ ID NO: 703627 - DNA, 20 bp, Artificial
  CRISPR gRNA sequence
gagaatggcgaggcgcctgc

SEQ ID NO: 703628 - DNA, 20 bp, Artificial
  CRISPR gRNA sequence
agaatggcgaggcgcctgcc

SEQ ID NO: 703629 - DNA, 20 bp, Artificial
  CRISPR gRNA sequence
ccccaccccttctctctgtt

SEQ ID NO: 703630 - DNA, 20 bp, Artificial
  CRISPR gRNA sequence
ttctctctgtttggctgctg

SEQ ID NO: 703631 - DNA, 20 bp, Artificial
  CRISPR gRNA sequence
tctctctgtttggctgctgc

SEQ ID NO: 703632 - DNA, 20 bp, Artificial
  CRISPR gRNA sequence
tctctgtttggctgctgcag

SEQ ID NO: 703633 - DNA, 20 bp, Artificial
  CRISPR gRNA sequence
ctctgtttggctgctgcagg

SEQ ID NO: 703634 - DNA, 20 bp, Artificial
  CRISPR gRNA sequence
tctgtttggctgctgcagga

SEQ ID NO: 703635 - DNA, 20 bp, Artificial
  CRISPR gRNA sequence
tgtttggctgctgcaggagg

SEQ ID NO: 703636 - DNA, 20 bp, Artificial
  CRISPR gRNA sequence
ggagctgtccctgccatgcc

SEQ ID NO: 703637 - DNA, 20 bp, Artificial
  CRISPR gRNA sequence
gagctgtccctgccatgccc

SEQ ID NO: 703638 - DNA, 20 bp, Artificial
  CRISPR gRNA sequence
agctgtccctgccatgccca

SEQ ID NO: 703639 - DNA, 20 bp, Artificial
  CRISPR gRNA sequence
gctgtccctgccatgcccag

SEQ ID NO: 703640 - DNA, 20 bp, Artificial
  CRISPR gRNA sequence
tgccatgcccaggggatgcc

SEQ ID NO: 703641 - DNA, 20 bp, Artificial
  CRISPR gRNA sequence
gccatgcccaggggatgcct

SEQ ID NO: 703642 - DNA, 20 bp, Artificial
  CRISPR gRNA sequence
catgcccaggggatgcctgg

SEQ ID NO: 703643 - DNA, 20 bp, Artificial
  CRISPR gRNA sequence
atgcccaggggatgcctggg

SEQ ID NO: 703644 - DNA, 20 bp, Artificial
  CRISPR gRNA sequence
cccaggggatgcctgggagg

SEQ ID NO: 703645 - DNA, 20 bp, Artificial
  CRISPR gRNA sequence
ggggatgcctgggaggcagc

SEQ ID NO: 703646 - DNA, 20 bp, Artificial
  CRISPR gRNA sequence
gggatgcctgggaggcagct

SEQ ID NO: 703647 - DNA, 20 bp, Artificial
  CRISPR gRNA sequence
tgcctgggaggcagctgggc

SEQ ID NO: 703648 - DNA, 20 bp, Artificial
  CRISPR gRNA sequence
gcctgggaggcagctgggct

SEQ ID NO: 703649 - DNA, 20 bp, Artificial
  CRISPR gRNA sequence
cctgggaggcagctgggctg

SEQ ID NO: 703650 - DNA, 20 bp, Artificial
  CRISPR gRNA sequence
ctgggaggcagctgggctgg

SEQ ID NO: 703651 - DNA, 20 bp, Artificial
  CRISPR gRNA sequence
ggaggcagctgggctggggg

SEQ ID NO: 703652 - DNA, 20 bp, Artificial
  CRISPR gRNA sequence
aggcagctgggctgggggtg

SEQ ID NO: 703653 - DNA, 20 bp, Artificial
  CRISPR gRNA sequence
ggcagctgggctgggggtgg

SEQ ID NO: 703654 - DNA, 20 bp, Artificial
  CRISPR gRNA sequence
agctgggctgggggtggagg

SEQ ID NO: 703655 - DNA, 20 bp, Artificial
  CRISPR gRNA sequence
gctgggctgggggtggaggt

SEQ ID NO: 703656 - DNA, 20 bp, Artificial
  CRISPR gRNA sequence
ctgggctgggggtggaggtg

SEQ ID NO: 703657 - DNA, 20 bp, Artificial
  CRISPR gRNA sequence
ctgggggtggaggtggggcc

SEQ ID NO: 703658 - DNA, 20 bp, Artificial
  CRISPR gRNA sequence
tgggggtggaggtggggcct

SEQ ID NO: 703659 - DNA, 20 bp, Artificial
  CRISPR gRNA sequence
catctctttgctgacaccat

SEQ ID NO: 703660 - DNA, 20 bp, Artificial
  CRISPR gRNA sequence
tctttgctgacaccattgga

SEQ ID NO: 703661 - DNA, 20 bp, Artificial
  CRISPR gRNA sequence
tgctgacaccattggaaagc

SEQ ID NO: 703662 - DNA, 20 bp, Artificial
  CRISPR gRNA sequence
tgacaccattggaaagccag

SEQ ID NO: 703663 - DNA, 20 bp, Artificial
  CRISPR gRNA sequence
gacaccattggaaagccaga

SEQ ID NO: 703664 - DNA, 20 bp, Artificial
  CRISPR gRNA sequence
agccagaaggccttgaaacc

SEQ ID NO: 703665 - DNA, 20 bp, Artificial
  CRISPR gRNA sequence
gtccctgccctcaaaatgcc

SEQ ID NO: 703666 - DNA, 20 bp, Artificial
  CRISPR gRNA sequence
cctgccctcaaaatgcctgg

SEQ ID NO: 703667 - DNA, 20 bp, Artificial
  CRISPR gRNA sequence
tgccctcaaaatgcctggca

SEQ ID NO: 703668 - DNA, 20 bp, Artificial
  CRISPR gRNA sequence
caaaatgcctggcagagact

SEQ ID NO: 703669 - DNA, 20 bp, Artificial
  CRISPR gRNA sequence
aaaatgcctggcagagactc

SEQ ID NO: 703670 - DNA, 20 bp, Artificial
  CRISPR gRNA sequence
aaatgcctggcagagactcg

SEQ ID NO: 703671 - DNA, 20 bp, Artificial
  CRISPR gRNA sequence
tgcctggcagagactcgggg

SEQ ID NO: 703672 - DNA, 20 bp, Artificial
  CRISPR gRNA sequence
cctggcagagactcggggca

SEQ ID NO: 703673 - DNA, 20 bp, Artificial
  CRISPR gRNA sequence
ctggcagagactcggggcag

SEQ ID NO: 703674 - DNA, 20 bp, Artificial
  CRISPR gRNA sequence
gagactcggggcagaggatc

SEQ ID NO: 703675 - DNA, 20 bp, Artificial
  CRISPR gRNA sequence
agactcggggcagaggatct

SEQ ID NO: 703676 - DNA, 20 bp, Artificial
  CRISPR gRNA sequence
gactcggggcagaggatcta

SEQ ID NO: 703677 - DNA, 20 bp, Artificial
  CRISPR gRNA sequence
actcggggcagaggatctag

SEQ ID NO: 703678 - DNA, 20 bp, Artificial
  CRISPR gRNA sequence
gggcagaggatctaggggcc

SEQ ID NO: 703679 - DNA, 20 bp, Artificial
  CRISPR gRNA sequence
ggcagaggatctaggggccc

SEQ ID NO: 703680 - DNA, 20 bp, Artificial
  CRISPR gRNA sequence
ggatctaggggcccaggctc

SEQ ID NO: 703681 - DNA, 20 bp, Artificial
  CRISPR gRNA sequence
gggcccaggctctggttgcg

SEQ ID NO: 703682 - DNA, 20 bp, Artificial
  CRISPR gRNA sequence
ggctctggttgcgcagtctc

SEQ ID NO: 703683 - DNA, 20 bp, Artificial
  CRISPR gRNA sequence
ctctggttgcgcagtctcca

SEQ ID NO: 703684 - DNA, 20 bp, Artificial
  CRISPR gRNA sequence
ggttgcgcagtctccagaga

SEQ ID NO: 703685 - DNA, 20 bp, Artificial
  CRISPR gRNA sequence
gttgcgcagtctccagagaa

SEQ ID NO: 703686 - DNA, 20 bp, Artificial
  CRISPR gRNA sequence
ttgcgcagtctccagagaaa

SEQ ID NO: 703687 - DNA, 20 bp, Artificial
  CRISPR gRNA sequence
gagaaagggaattattcctg

SEQ ID NO: 703688 - DNA, 20 bp, Artificial
  CRISPR gRNA sequence
catcttcatcactcctgcct

SEQ ID NO: 703689 - DNA, 20 bp, Artificial
  CRISPR gRNA sequence
atcttcatcactcctgcctt

SEQ ID NO: 703690 - DNA, 20 bp, Artificial
  CRISPR gRNA sequence
ctgccttgggcttctccccg

SEQ ID NO: 703691 - DNA, 20 bp, Artificial
  CRISPR gRNA sequence
tgggcttctccccgcagcac

SEQ ID NO: 703692 - DNA, 20 bp, Artificial
  CRISPR gRNA sequence
cccgcagcaccagccccact

SEQ ID NO: 703693 - DNA, 20 bp, Artificial
  CRISPR gRNA sequence
cgcagcaccagccccactca

SEQ ID NO: 703694 - DNA, 20 bp, Artificial
  CRISPR gRNA sequence
cagccccactcagagcttgc

SEQ ID NO: 703695 - DNA, 20 bp, Artificial
  CRISPR gRNA sequence
ccccactcagagcttgctgg

SEQ ID NO: 703696 - DNA, 20 bp, Artificial
  CRISPR gRNA sequence
agagcttgctggtggactcc

SEQ ID NO: 703697 - DNA, 20 bp, Artificial
  CRISPR gRNA sequence
gagcttgctggtggactccc

SEQ ID NO: 703698 - DNA, 20 bp, Artificial
  CRISPR gRNA sequence
ttgctggtggactcccaggc

SEQ ID NO: 703699 - DNA, 20 bp, Artificial
  CRISPR gRNA sequence
tggtggactcccaggccagt

SEQ ID NO: 703700 - DNA, 20 bp, Artificial
  CRISPR gRNA sequence
aagacgctgcccatcccaac

SEQ ID NO: 703701 - DNA, 20 bp, Artificial
  CRISPR gRNA sequence
tcccgtcgctctctcctcca

SEQ ID NO: 703702 - DNA, 20 bp, Artificial
  CRISPR gRNA sequence
cccgtcgctctctcctccac

SEQ ID NO: 703703 - DNA, 20 bp, Artificial
  CRISPR gRNA sequence
ccgtcgctctctcctccacg

SEQ ID NO: 703704 - DNA, 20 bp, Artificial
  CRISPR gRNA sequence
tcgctctctcctccacgggg

SEQ ID NO: 703705 - DNA, 20 bp, Artificial
  CRISPR gRNA sequence
ctccacggggaagcccgttc

SEQ ID NO: 703706 - DNA, 20 bp, Artificial
  CRISPR gRNA sequence
ggggaagcccgttctggatg

SEQ ID NO: 703707 - DNA, 20 bp, Artificial
  CRISPR gRNA sequence
gggaagcccgttctggatgc

SEQ ID NO: 703708 - DNA, 20 bp, Artificial
  CRISPR gRNA sequence
cccgttctggatgcaggtaa

SEQ ID NO: 703709 - DNA, 20 bp, Artificial
  CRISPR gRNA sequence
ctggatgcaggtaatggtcc

SEQ ID NO: 703710 - DNA, 20 bp, Artificial
  CRISPR gRNA sequence
agcccactcacccctactcc

SEQ ID NO: 703711 - DNA, 20 bp, Artificial
  CRISPR gRNA sequence
ccactcacccctactcccag

SEQ ID NO: 703712 - DNA, 20 bp, Artificial
  CRISPR gRNA sequence
cactcacccctactcccagc

SEQ ID NO: 703713 - DNA, 20 bp, Artificial
  CRISPR gRNA sequence
actcacccctactcccagca

SEQ ID NO: 703714 - DNA, 20 bp, Artificial
  CRISPR gRNA sequence
ctcacccctactcccagcag

SEQ ID NO: 703715 - DNA, 20 bp, Artificial
  CRISPR gRNA sequence
tcccagcaggggcttcctcc

SEQ ID NO: 703716 - DNA, 20 bp, Artificial
  CRISPR gRNA sequence
cccagcaggggcttcctcct

SEQ ID NO: 703717 - DNA, 20 bp, Artificial
  CRISPR gRNA sequence
ccagcaggggcttcctcctg

SEQ ID NO: 703718 - DNA, 20 bp, Artificial
  CRISPR gRNA sequence
gcaggggcttcctcctgggg

SEQ ID NO: 703719 - DNA, 20 bp, Artificial
  CRISPR gRNA sequence
ggcttcctcctggggaagtg

SEQ ID NO: 703720 - DNA, 20 bp, Artificial
  CRISPR gRNA sequence
cctcctggggaagtgtggat

SEQ ID NO: 703721 - DNA, 20 bp, Artificial
  CRISPR gRNA sequence
ctcctggggaagtgtggatt

SEQ ID NO: 703722 - DNA, 20 bp, Artificial
  CRISPR gRNA sequence
tcctggggaagtgtggattg

SEQ ID NO: 703723 - DNA, 20 bp, Artificial
  CRISPR gRNA sequence
cctggggaagtgtggattgg

SEQ ID NO: 703724 - DNA, 20 bp, Artificial
  CRISPR gRNA sequence
tggggaagtgtggattgggg

SEQ ID NO: 703725 - DNA, 20 bp, Artificial
  CRISPR gRNA sequence
gaagtgtggattgggggagc

SEQ ID NO: 703726 - DNA, 20 bp, Artificial
  CRISPR gRNA sequence
aagtgtggattgggggagcc

SEQ ID NO: 703727 - DNA, 20 bp, Artificial
  CRISPR gRNA sequence
gtgtggattgggggagccag

SEQ ID NO: 703728 - DNA, 20 bp, Artificial
  CRISPR gRNA sequence
tgtggattgggggagccagg

SEQ ID NO: 703729 - DNA, 20 bp, Artificial
  CRISPR gRNA sequence
gtggattgggggagccagga

SEQ ID NO: 703730 - DNA, 20 bp, Artificial
  CRISPR gRNA sequence
ggattgggggagccaggagg

SEQ ID NO: 703731 - DNA, 20 bp, Artificial
  CRISPR gRNA sequence
aggagggagcttctcctttg

SEQ ID NO: 703732 - DNA, 20 bp, Artificial
  CRISPR gRNA sequence
ggagggagcttctcctttgt

SEQ ID NO: 703733 - DNA, 20 bp, Artificial
  CRISPR gRNA sequence
gagcttctcctttgtgggta

SEQ ID NO: 703734 - DNA, 20 bp, Artificial
  CRISPR gRNA sequence
ctcctttgtgggtatggtct

SEQ ID NO: 703735 - DNA, 20 bp, Artificial
  CRISPR gRNA sequence
ctttgtgggtatggtctgag

SEQ ID NO: 703736 - DNA, 20 bp, Artificial
  CRISPR gRNA sequence
tttgtgggtatggtctgaga

SEQ ID NO: 703737 - DNA, 20 bp, Artificial
  CRISPR gRNA sequence
ttgtgggtatggtctgagaa

SEQ ID NO: 703738 - DNA, 20 bp, Artificial
  CRISPR gRNA sequence
tgtgggtatggtctgagaag

SEQ ID NO: 703739 - DNA, 20 bp, Artificial
  CRISPR gRNA sequence
gtgggtatggtctgagaagg

SEQ ID NO: 703740 - DNA, 20 bp, Artificial
  CRISPR gRNA sequence
atggtctgagaagggggatt

SEQ ID NO: 703741 - DNA, 20 bp, Artificial
  CRISPR gRNA sequence
tggtctgagaagggggatta

SEQ ID NO: 703742 - DNA, 20 bp, Artificial
  CRISPR gRNA sequence
agggggattaaggttgaccc

SEQ ID NO: 703743 - DNA, 20 bp, Artificial
  CRISPR gRNA sequence
gggggattaaggttgacccc

SEQ ID NO: 703744 - DNA, 20 bp, Artificial
  CRISPR gRNA sequence
taaggttgaccccaggtttc

SEQ ID NO: 703745 - DNA, 20 bp, Artificial
  CRISPR gRNA sequence
ccccaggtttctggcttctt

SEQ ID NO: 703746 - DNA, 20 bp, Artificial
  CRISPR gRNA sequence
aggtttctggcttcttgagt

SEQ ID NO: 703747 - DNA, 20 bp, Artificial
  CRISPR gRNA sequence
ggcttcttgagttggtgctg

SEQ ID NO: 703748 - DNA, 20 bp, Artificial
  CRISPR gRNA sequence
ttgagttggtgctgtggctc

SEQ ID NO: 703749 - DNA, 20 bp, Artificial
  CRISPR gRNA sequence
gctgtggctctggcacttgc

SEQ ID NO: 703750 - DNA, 20 bp, Artificial
  CRISPR gRNA sequence
ctattcttttctttttgaaa

SEQ ID NO: 703751 - DNA, 20 bp, Artificial
  CRISPR gRNA sequence
aacagtctcactctgttgct

SEQ ID NO: 703752 - DNA, 20 bp, Artificial
  CRISPR gRNA sequence
acagtctcactctgttgctc

SEQ ID NO: 703753 - DNA, 20 bp, Artificial
  CRISPR gRNA sequence
tctcactctgttgctcaggc

SEQ ID NO: 703754 - DNA, 20 bp, Artificial
  CRISPR gRNA sequence
tcactctgttgctcaggctg

SEQ ID NO: 703755 - DNA, 20 bp, Artificial
  CRISPR gRNA sequence
cactctgttgctcaggctgg

SEQ ID NO: 703756 - DNA, 20 bp, Artificial
  CRISPR gRNA sequence
actctgttgctcaggctgga

SEQ ID NO: 703757 - DNA, 20 bp, Artificial
  CRISPR gRNA sequence
ctgttgctcaggctggaggg

SEQ ID NO: 703758 - DNA, 20 bp, Artificial
  CRISPR gRNA sequence
ttgctcaggctggagggcag

SEQ ID NO: 703759 - DNA, 20 bp, Artificial
  CRISPR gRNA sequence
gagggcagtggcacccatct

SEQ ID NO: 703760 - DNA, 20 bp, Artificial
  CRISPR gRNA sequence
tcactgcaacctccacctcc

SEQ ID NO: 703761 - DNA, 20 bp, Artificial
  CRISPR gRNA sequence
cactgcaacctccacctccc

SEQ ID NO: 703762 - DNA, 20 bp, Artificial
  CRISPR gRNA sequence
aacctccacctcccaggttc

SEQ ID NO: 703763 - DNA, 20 bp, Artificial
  CRISPR gRNA sequence
cctccacctcccaggttcaa

SEQ ID NO: 703764 - DNA, 20 bp, Artificial
  CRISPR gRNA sequence
ttcaagagattctcctgtct

SEQ ID NO: 703765 - DNA, 20 bp, Artificial
  CRISPR gRNA sequence
ttctcctgtctcagcctccc

SEQ ID NO: 703766 - DNA, 20 bp, Artificial
  CRISPR gRNA sequence
tcctgtctcagcctcccgag

SEQ ID NO: 703767 - DNA, 20 bp, Artificial
  CRISPR gRNA sequence
gtctcagcctcccgagtagc

SEQ ID NO: 703768 - DNA, 20 bp, Artificial
  CRISPR gRNA sequence
tctcagcctcccgagtagct

SEQ ID NO: 703769 - DNA, 20 bp, Artificial
  CRISPR gRNA sequence
ctcccgagtagctgggttta

SEQ ID NO: 703770 - DNA, 20 bp, Artificial
  CRISPR gRNA sequence
tcccgagtagctgggtttac

SEQ ID NO: 703771 - DNA, 20 bp, Artificial
  CRISPR gRNA sequence
caggcgcttgccaccacgcc

SEQ ID NO: 703772 - DNA, 20 bp, Artificial
  CRISPR gRNA sequence
ctaaatttttttttaatttt

SEQ ID NO: 703773 - DNA, 20 bp, Artificial
  CRISPR gRNA sequence
aatttttttttaatttttag

SEQ ID NO: 703774 - DNA, 20 bp, Artificial
  CRISPR gRNA sequence
tttttttttaatttttagta

SEQ ID NO: 703775 - DNA, 20 bp, Artificial
  CRISPR gRNA sequence
tttttaatttttagtagaga

SEQ ID NO: 703776 - DNA, 20 bp, Artificial
  CRISPR gRNA sequence
ttttaatttttagtagagac

SEQ ID NO: 703777 - DNA, 20 bp, Artificial
  CRISPR gRNA sequence
tttaatttttagtagagacg

SEQ ID NO: 703778 - DNA, 20 bp, Artificial
  CRISPR gRNA sequence
cggggttttgccatgttgtc

SEQ ID NO: 703779 - DNA, 20 bp, Artificial
  CRISPR gRNA sequence
ggggttttgccatgttgtcc

SEQ ID NO: 703780 - DNA, 20 bp, Artificial
  CRISPR gRNA sequence
ttttgccatgttgtccaggt

SEQ ID NO: 703781 - DNA, 20 bp, Artificial
  CRISPR gRNA sequence
tggtctcaaactcctgacct

SEQ ID NO: 703782 - DNA, 20 bp, Artificial
  CRISPR gRNA sequence
ggtctcaaactcctgacctc

SEQ ID NO: 703783 - DNA, 20 bp, Artificial
  CRISPR gRNA sequence
ctcaggtgatccacctgctt

SEQ ID NO: 703784 - DNA, 20 bp, Artificial
  CRISPR gRNA sequence
ccacctgcttcagcctccca

SEQ ID NO: 703785 - DNA, 20 bp, Artificial
  CRISPR gRNA sequence
gcttcagcctcccaaagtgc

SEQ ID NO: 703786 - DNA, 20 bp, Artificial
  CRISPR gRNA sequence
cttcagcctcccaaagtgct

SEQ ID NO: 703787 - DNA, 20 bp, Artificial
  CRISPR gRNA sequence
ctcccaaagtgctaggatta

SEQ ID NO: 703788 - DNA, 20 bp, Artificial
  CRISPR gRNA sequence
tcccaaagtgctaggattat

SEQ ID NO: 703789 - DNA, 20 bp, Artificial
  CRISPR gRNA sequence
taggtgtgaaccactgcgcc

SEQ ID NO: 703790 - DNA, 20 bp, Artificial
  CRISPR gRNA sequence
gaaccactgcgcctggctgc

SEQ ID NO: 703791 - DNA, 20 bp, Artificial
  CRISPR gRNA sequence
tgactattctttaattcttg

SEQ ID NO: 703792 - DNA, 20 bp, Artificial
  CRISPR gRNA sequence
gactattctttaattcttgt

SEQ ID NO: 703793 - DNA, 20 bp, Artificial
  CRISPR gRNA sequence
tattctttaattcttgtagg

SEQ ID NO: 703794 - DNA, 20 bp, Artificial
  CRISPR gRNA sequence
attctttaattcttgtaggc

SEQ ID NO: 703795 - DNA, 20 bp, Artificial
  CRISPR gRNA sequence
gtaggcaggaatttttttca

SEQ ID NO: 703796 - DNA, 20 bp, Artificial
  CRISPR gRNA sequence
ttttcacagcttcatcctcg

SEQ ID NO: 703797 - DNA, 20 bp, Artificial
  CRISPR gRNA sequence
cgtggcttataattgctact

SEQ ID NO: 703798 - DNA, 20 bp, Artificial
  CRISPR gRNA sequence
tataattgctactcagaaaa

SEQ ID NO: 703799 - DNA, 20 bp, Artificial
  CRISPR gRNA sequence
ataattgctactcagaaaat

SEQ ID NO: 703800 - DNA, 20 bp, Artificial
  CRISPR gRNA sequence
attgatttcatgactttgac

SEQ ID NO: 703801 - DNA, 20 bp, Artificial
  CRISPR gRNA sequence
atgactttgactagttgttc

SEQ ID NO: 703802 - DNA, 20 bp, Artificial
  CRISPR gRNA sequence
gactagttgttcgagccttt

SEQ ID NO: 703803 - DNA, 20 bp, Artificial
  CRISPR gRNA sequence
ttgttcgagcctttgagcct

SEQ ID NO: 703804 - DNA, 20 bp, Artificial
  CRISPR gRNA sequence
cagttgtctcatctatacaa

SEQ ID NO: 703805 - DNA, 20 bp, Artificial
  CRISPR gRNA sequence
tctcatctatacaatggtaa

SEQ ID NO: 703806 - DNA, 20 bp, Artificial
  CRISPR gRNA sequence
catctatacaatggtaatgg

SEQ ID NO: 703807 - DNA, 20 bp, Artificial
  CRISPR gRNA sequence
tctatacaatggtaatggca

SEQ ID NO: 703808 - DNA, 20 bp, Artificial
  CRISPR gRNA sequence
tggtaatggcagagaccgtg

SEQ ID NO: 703809 - DNA, 20 bp, Artificial
  CRISPR gRNA sequence
ggtaatggcagagaccgtgc

SEQ ID NO: 703810 - DNA, 20 bp, Artificial
  CRISPR gRNA sequence
gtaatggcagagaccgtgca

SEQ ID NO: 703811 - DNA, 20 bp, Artificial
  CRISPR gRNA sequence
cagagaccgtgcagggttat

SEQ ID NO: 703812 - DNA, 20 bp, Artificial
  CRISPR gRNA sequence
agaccgtgcagggttataag

SEQ ID NO: 703813 - DNA, 20 bp, Artificial
  CRISPR gRNA sequence
gtgcagggttataagcagtg

SEQ ID NO: 703814 - DNA, 20 bp, Artificial
  CRISPR gRNA sequence
ttataagcagtgtagcattg

SEQ ID NO: 703815 - DNA, 20 bp, Artificial
  CRISPR gRNA sequence
aagcagtgtagcattgtaga

SEQ ID NO: 703816 - DNA, 20 bp, Artificial
  CRISPR gRNA sequence
gcattgtagacggcctctgt

SEQ ID NO: 703817 - DNA, 20 bp, Artificial
  CRISPR gRNA sequence
attgtagacggcctctgtca

SEQ ID NO: 703818 - DNA, 20 bp, Artificial
  CRISPR gRNA sequence
tagacggcctctgtcagagt

SEQ ID NO: 703819 - DNA, 20 bp, Artificial
  CRISPR gRNA sequence
cctctgtcagagttagctct

SEQ ID NO: 703820 - DNA, 20 bp, Artificial
  CRISPR gRNA sequence
ctctgtcagagttagctctt

SEQ ID NO: 703821 - DNA, 20 bp, Artificial
  CRISPR gRNA sequence
gtcagagttagctcttaggc

SEQ ID NO: 703822 - DNA, 20 bp, Artificial
  CRISPR gRNA sequence
gttagctcttaggctggacg

SEQ ID NO: 703823 - DNA, 20 bp, Artificial
  CRISPR gRNA sequence
agctcttaggctggacgcgg

SEQ ID NO: 703824 - DNA, 20 bp, Artificial
  CRISPR gRNA sequence
gtggctcacgcctgtaatcc

SEQ ID NO: 703825 - DNA, 20 bp, Artificial
  CRISPR gRNA sequence
cgcctgtaatcccagcactt

SEQ ID NO: 703826 - DNA, 20 bp, Artificial
  CRISPR gRNA sequence
gcctgtaatcccagcacttt

SEQ ID NO: 703827 - DNA, 20 bp, Artificial
  CRISPR gRNA sequence
ctgtaatcccagcactttgg

SEQ ID NO: 703828 - DNA, 20 bp, Artificial
  CRISPR gRNA sequence
tgtaatcccagcactttggg

SEQ ID NO: 703829 - DNA, 20 bp, Artificial
  CRISPR gRNA sequence
tcccagcactttgggaggcc

SEQ ID NO: 703830 - DNA, 20 bp, Artificial
  CRISPR gRNA sequence
cccagcactttgggaggcca

SEQ ID NO: 703831 - DNA, 20 bp, Artificial
  CRISPR gRNA sequence
agcactttgggaggccaagg

SEQ ID NO: 703832 - DNA, 20 bp, Artificial
  CRISPR gRNA sequence
gcactttgggaggccaaggt

SEQ ID NO: 703833 - DNA, 20 bp, Artificial
  CRISPR gRNA sequence
ctttgggaggccaaggtggg

SEQ ID NO: 703834 - DNA, 20 bp, Artificial
  CRISPR gRNA sequence
ggccaaggtgggtggatcac

SEQ ID NO: 703835 - DNA, 20 bp, Artificial
  CRISPR gRNA sequence
gccaaggtgggtggatcacg

SEQ ID NO: 703836 - DNA, 20 bp, Artificial
  CRISPR gRNA sequence
aggtgggtggatcacgaggt

SEQ ID NO: 703837 - DNA, 20 bp, Artificial
  CRISPR gRNA sequence
ggtgggtggatcacgaggtc

SEQ ID NO: 703838 - DNA, 20 bp, Artificial
  CRISPR gRNA sequence
tgggtggatcacgaggtcag

SEQ ID NO: 703839 - DNA, 20 bp, Artificial
  CRISPR gRNA sequence
gatcacgaggtcaggagttt

SEQ ID NO: 703840 - DNA, 20 bp, Artificial
  CRISPR gRNA sequence
cgaggtcaggagtttgagac

SEQ ID NO: 703841 - DNA, 20 bp, Artificial
  CRISPR gRNA sequence
tcaggagtttgagaccagcc

SEQ ID NO: 703842 - DNA, 20 bp, Artificial
  CRISPR gRNA sequence
tctactaaaaatacaaaaat

SEQ ID NO: 703843 - DNA, 20 bp, Artificial
  CRISPR gRNA sequence
ctaaaaatacaaaaattagc

SEQ ID NO: 703844 - DNA, 20 bp, Artificial
  CRISPR gRNA sequence
taaaaatacaaaaattagcc

SEQ ID NO: 703845 - DNA, 20 bp, Artificial
  CRISPR gRNA sequence
atacaaaaattagccaggcg

SEQ ID NO: 703846 - DNA, 20 bp, Artificial
  CRISPR gRNA sequence
caaaaattagccaggcgtgg

SEQ ID NO: 703847 - DNA, 20 bp, Artificial
  CRISPR gRNA sequence
gtggcgcgcgcctgtaatcc

SEQ ID NO: 703848 - DNA, 20 bp, Artificial
  CRISPR gRNA sequence
cgcctgtaatcccagctact

SEQ ID NO: 703849 - DNA, 20 bp, Artificial
  CRISPR gRNA sequence
gcctgtaatcccagctactc

SEQ ID NO: 703850 - DNA, 20 bp, Artificial
  CRISPR gRNA sequence
ctgtaatcccagctactcag

SEQ ID NO: 703851 - DNA, 20 bp, Artificial
  CRISPR gRNA sequence
tgtaatcccagctactcagg

SEQ ID NO: 703852 - DNA, 20 bp, Artificial
  CRISPR gRNA sequence
tcccagctactcaggaggct

SEQ ID NO: 703853 - DNA, 20 bp, Artificial
  CRISPR gRNA sequence
cccagctactcaggaggctg

SEQ ID NO: 703854 - DNA, 20 bp, Artificial
  CRISPR gRNA sequence
agctactcaggaggctgagg

SEQ ID NO: 703855 - DNA, 20 bp, Artificial
  CRISPR gRNA sequence
gctactcaggaggctgaggc

SEQ ID NO: 703856 - DNA, 20 bp, Artificial
  CRISPR gRNA sequence
tactcaggaggctgaggcag

SEQ ID NO: 703857 - DNA, 20 bp, Artificial
  CRISPR gRNA sequence
gcaggagaatcgcttgaacc

SEQ ID NO: 703858 - DNA, 20 bp, Artificial
  CRISPR gRNA sequence
caggagaatcgcttgaaccc

SEQ ID NO: 703859 - DNA, 20 bp, Artificial
  CRISPR gRNA sequence
ggagaatcgcttgaacccgg

SEQ ID NO: 703860 - DNA, 20 bp, Artificial
  CRISPR gRNA sequence
gagaatcgcttgaacccggg

SEQ ID NO: 703861 - DNA, 20 bp, Artificial
  CRISPR gRNA sequence
aatcgcttgaacccgggagg

SEQ ID NO: 703862 - DNA, 20 bp, Artificial
  CRISPR gRNA sequence
tcgcttgaacccgggaggcg

SEQ ID NO: 703863 - DNA, 20 bp, Artificial
  CRISPR gRNA sequence
cgcttgaacccgggaggcgg

SEQ ID NO: 703864 - DNA, 20 bp, Artificial
  CRISPR gRNA sequence
acccgggaggcggaggttgc

SEQ ID NO: 703865 - DNA, 20 bp, Artificial
  CRISPR gRNA sequence
cccgggaggcggaggttgca

SEQ ID NO: 703866 - DNA, 20 bp, Artificial
  CRISPR gRNA sequence
aggcggaggttgcaaggttg

SEQ ID NO: 703867 - DNA, 20 bp, Artificial
  CRISPR gRNA sequence
ggaggttgcaaggttgcagt

SEQ ID NO: 703868 - DNA, 20 bp, Artificial
  CRISPR gRNA sequence
ttgcaaggttgcagtgagcc

SEQ ID NO: 703869 - DNA, 20 bp, Artificial
  CRISPR gRNA sequence
gagattgcaccgctgcactc

SEQ ID NO: 703870 - DNA, 20 bp, Artificial
  CRISPR gRNA sequence
gcaccgctgcactccagcct

SEQ ID NO: 703871 - DNA, 20 bp, Artificial
  CRISPR gRNA sequence
ccgctgcactccagcctgag

SEQ ID NO: 703872 - DNA, 20 bp, Artificial
  CRISPR gRNA sequence
ctgcactccagcctgagcag

SEQ ID NO: 703873 - DNA, 20 bp, Artificial
  CRISPR gRNA sequence
tccagcctgagcagcagaat

SEQ ID NO: 703874 - DNA, 20 bp, Artificial
  CRISPR gRNA sequence
ctgagcagcagaatgagaat

SEQ ID NO: 703875 - DNA, 20 bp, Artificial
  CRISPR gRNA sequence
acaaaacaaacaaaaccccc

SEQ ID NO: 703876 - DNA, 20 bp, Artificial
  CRISPR gRNA sequence
aaaacaaacaaaacccccaa

SEQ ID NO: 703877 - DNA, 20 bp, Artificial
  CRISPR gRNA sequence
caaacaaaacccccaagagt

SEQ ID NO: 703878 - DNA, 20 bp, Artificial
  CRISPR gRNA sequence
aacccccaagagttagctct

SEQ ID NO: 703879 - DNA, 20 bp, Artificial
  CRISPR gRNA sequence
acccccaagagttagctctt

SEQ ID NO: 703880 - DNA, 20 bp, Artificial
  CRISPR gRNA sequence
cccccaagagttagctctta

SEQ ID NO: 703881 - DNA, 20 bp, Artificial
  CRISPR gRNA sequence
caagagttagctcttaggga

SEQ ID NO: 703882 - DNA, 20 bp, Artificial
  CRISPR gRNA sequence
tagctcttagggaaagatgc

SEQ ID NO: 703883 - DNA, 20 bp, Artificial
  CRISPR gRNA sequence
agctcttagggaaagatgcc

SEQ ID NO: 703884 - DNA, 20 bp, Artificial
  CRISPR gRNA sequence
agatgccaggttactcattt

SEQ ID NO: 703885 - DNA, 20 bp, Artificial
  CRISPR gRNA sequence
gatgccaggttactcatttt

SEQ ID NO: 703886 - DNA, 20 bp, Artificial
  CRISPR gRNA sequence
gttactcattttaggacttg

SEQ ID NO: 703887 - DNA, 20 bp, Artificial
  CRISPR gRNA sequence
cattttaggacttgcagttc

SEQ ID NO: 703888 - DNA, 20 bp, Artificial
  CRISPR gRNA sequence
tttaggacttgcagttctag

SEQ ID NO: 703889 - DNA, 20 bp, Artificial
  CRISPR gRNA sequence
gcagttctagtggctgacac

SEQ ID NO: 703890 - DNA, 20 bp, Artificial
  CRISPR gRNA sequence
cagttctagtggctgacacg

SEQ ID NO: 703891 - DNA, 20 bp, Artificial
  CRISPR gRNA sequence
ttctagtggctgacacgagg

SEQ ID NO: 703892 - DNA, 20 bp, Artificial
  CRISPR gRNA sequence
tagtggctgacacgaggtgg

SEQ ID NO: 703893 - DNA, 20 bp, Artificial
  CRISPR gRNA sequence
tggctgacacgaggtggcag

SEQ ID NO: 703894 - DNA, 20 bp, Artificial
  CRISPR gRNA sequence
acgaggtggcagtagtgctc

SEQ ID NO: 703895 - DNA, 20 bp, Artificial
  CRISPR gRNA sequence
ggtggcagtagtgctccggc

SEQ ID NO: 703896 - DNA, 20 bp, Artificial
  CRISPR gRNA sequence
tggcagtagtgctccggcca

SEQ ID NO: 703897 - DNA, 20 bp, Artificial
  CRISPR gRNA sequence
gctccggccagagtttctga

SEQ ID NO: 703898 - DNA, 20 bp, Artificial
  CRISPR gRNA sequence
ggccagagtttctgaaagtg

SEQ ID NO: 703899 - DNA, 20 bp, Artificial
  CRISPR gRNA sequence
tctgaaagtgcggtcccgtc

SEQ ID NO: 703900 - DNA, 20 bp, Artificial
  CRISPR gRNA sequence
gaaagtgcggtcccgtctgg

SEQ ID NO: 703901 - DNA, 20 bp, Artificial
  CRISPR gRNA sequence
gcggtcccgtctggcagcat

SEQ ID NO: 703902 - DNA, 20 bp, Artificial
  CRISPR gRNA sequence
ccgtctggcagcattggcac

SEQ ID NO: 703903 - DNA, 20 bp, Artificial
  CRISPR gRNA sequence
ctggcagcattggcaccggc

SEQ ID NO: 703904 - DNA, 20 bp, Artificial
  CRISPR gRNA sequence
tggcagcattggcaccggct

SEQ ID NO: 703905 - DNA, 20 bp, Artificial
  CRISPR gRNA sequence
ggcaccggctgggaacttgt

SEQ ID NO: 703906 - DNA, 20 bp, Artificial
  CRISPR gRNA sequence
gcaccggctgggaacttgtt

SEQ ID NO: 703907 - DNA, 20 bp, Artificial
  CRISPR gRNA sequence
cggctgggaacttgttagga

SEQ ID NO: 703908 - DNA, 20 bp, Artificial
  CRISPR gRNA sequence
cttgttaggaaagcaaatta

SEQ ID NO: 703909 - DNA, 20 bp, Artificial
  CRISPR gRNA sequence
ttgttaggaaagcaaattat

SEQ ID NO: 703910 - DNA, 20 bp, Artificial
  CRISPR gRNA sequence
gcaaattatgggccccatcc

SEQ ID NO: 703911 - DNA, 20 bp, Artificial
  CRISPR gRNA sequence
tatgggccccatcccagacc

SEQ ID NO: 703912 - DNA, 20 bp, Artificial
  CRISPR gRNA sequence
tgggccccatcccagaccta

SEQ ID NO: 703913 - DNA, 20 bp, Artificial
  CRISPR gRNA sequence
ccatcccagacctagagaat

SEQ ID NO: 703914 - DNA, 20 bp, Artificial
  CRISPR gRNA sequence
atcagaaactgcactttaac

SEQ ID NO: 703915 - DNA, 20 bp, Artificial
  CRISPR gRNA sequence
ctgcactttaacaagatctc

SEQ ID NO: 703916 - DNA, 20 bp, Artificial
  CRISPR gRNA sequence
tgcactttaacaagatctcc

SEQ ID NO: 703917 - DNA, 20 bp, Artificial
  CRISPR gRNA sequence
gcactttaacaagatctcca

SEQ ID NO: 703918 - DNA, 20 bp, Artificial
  CRISPR gRNA sequence
tcatgtgcacattaacgttt

SEQ ID NO: 703919 - DNA, 20 bp, Artificial
  CRISPR gRNA sequence
tgtgcacattaacgtttgag

SEQ ID NO: 703920 - DNA, 20 bp, Artificial
  CRISPR gRNA sequence
acgtttgagaagcacttaac

SEQ ID NO: 703921 - DNA, 20 bp, Artificial
  CRISPR gRNA sequence
actttttaaacatctaaaca

SEQ ID NO: 703922 - DNA, 20 bp, Artificial
  CRISPR gRNA sequence
tctaaacatggacttcaata

SEQ ID NO: 703923 - DNA, 20 bp, Artificial
  CRISPR gRNA sequence
cttcaataaagtgcaatcac

SEQ ID NO: 703924 - DNA, 20 bp, Artificial
  CRISPR gRNA sequence
actagctctatgatctctgt

SEQ ID NO: 703925 - DNA, 20 bp, Artificial
  CRISPR gRNA sequence
atgatctctgtaagtgacaa

SEQ ID NO: 703926 - DNA, 20 bp, Artificial
  CRISPR gRNA sequence
tgatctctgtaagtgacaaa

SEQ ID NO: 703927 - DNA, 20 bp, Artificial
  CRISPR gRNA sequence
gatctctgtaagtgacaaaa

SEQ ID NO: 703928 - DNA, 20 bp, Artificial
  CRISPR gRNA sequence
agtgacaaaagggaaaaacg

SEQ ID NO: 703929 - DNA, 20 bp, Artificial
  CRISPR gRNA sequence
acaaaagggaaaaacgaagc

SEQ ID NO: 703930 - DNA, 20 bp, Artificial
  CRISPR gRNA sequence
agggaaaaacgaagcgagtt

SEQ ID NO: 703931 - DNA, 20 bp, Artificial
  CRISPR gRNA sequence
aacgaagcgagtttagtacc

SEQ ID NO: 703932 - DNA, 20 bp, Artificial
  CRISPR gRNA sequence
acgaagcgagtttagtaccg

SEQ ID NO: 703933 - DNA, 20 bp, Artificial
  CRISPR gRNA sequence
gagtttagtaccgaggtgtg

SEQ ID NO: 703934 - DNA, 20 bp, Artificial
  CRISPR gRNA sequence
tttagtaccgaggtgtgaag

SEQ ID NO: 703935 - DNA, 20 bp, Artificial
  CRISPR gRNA sequence
agtaccgaggtgtgaagaag

SEQ ID NO: 703936 - DNA, 20 bp, Artificial
  CRISPR gRNA sequence
gaggtgtgaagaagtagatc

SEQ ID NO: 703937 - DNA, 20 bp, Artificial
  CRISPR gRNA sequence
tgtgaagaagtagatctaga

SEQ ID NO: 703938 - DNA, 20 bp, Artificial
  CRISPR gRNA sequence
gtgaagaagtagatctagat

SEQ ID NO: 703939 - DNA, 20 bp, Artificial
  CRISPR gRNA sequence
tgaagaagtagatctagata

SEQ ID NO: 703940 - DNA, 20 bp, Artificial
  CRISPR gRNA sequence
gaagaagtagatctagatag

SEQ ID NO: 703941 - DNA, 20 bp, Artificial
  CRISPR gRNA sequence
agtagatctagataggggtt

SEQ ID NO: 703942 - DNA, 20 bp, Artificial
  CRISPR gRNA sequence
tagatctagataggggttaa

SEQ ID NO: 703943 - DNA, 20 bp, Artificial
  CRISPR gRNA sequence
ctagataggggttaagagcg

SEQ ID NO: 703944 - DNA, 20 bp, Artificial
  CRISPR gRNA sequence
gggttaagagcgtggccctg

SEQ ID NO: 703945 - DNA, 20 bp, Artificial
  CRISPR gRNA sequence
gcgtggccctgcagtccccc

SEQ ID NO: 703946 - DNA, 20 bp, Artificial
  CRISPR gRNA sequence
gccctgcagtccccccggcc

SEQ ID NO: 703947 - DNA, 20 bp, Artificial
  CRISPR gRNA sequence
gcagtccccccggcctggcc

SEQ ID NO: 703948 - DNA, 20 bp, Artificial
  CRISPR gRNA sequence
ccccccggcctggcctggcc

SEQ ID NO: 703949 - DNA, 20 bp, Artificial
  CRISPR gRNA sequence
cccccggcctggcctggcct

SEQ ID NO: 703950 - DNA, 20 bp, Artificial
  CRISPR gRNA sequence
cggcctggcctggcctgggc

SEQ ID NO: 703951 - DNA, 20 bp, Artificial
  CRISPR gRNA sequence
ggcctggcctggcctgggct

SEQ ID NO: 703952 - DNA, 20 bp, Artificial
  CRISPR gRNA sequence
gcctggcctggcctgggctg

SEQ ID NO: 703953 - DNA, 20 bp, Artificial
  CRISPR gRNA sequence
ggggctctgccacttactct

SEQ ID NO: 703954 - DNA, 20 bp, Artificial
  CRISPR gRNA sequence
gggctctgccacttactctc

SEQ ID NO: 703955 - DNA, 20 bp, Artificial
  CRISPR gRNA sequence
ggctctgccacttactctca

SEQ ID NO: 703956 - DNA, 20 bp, Artificial
  CRISPR gRNA sequence
acttactctcagggtgacct

SEQ ID NO: 703957 - DNA, 20 bp, Artificial
  CRISPR gRNA sequence
cttactctcagggtgacctt

SEQ ID NO: 703958 - DNA, 20 bp, Artificial
  CRISPR gRNA sequence
gcaacttaacgaactttcgt

SEQ ID NO: 703959 - DNA, 20 bp, Artificial
  CRISPR gRNA sequence
taacgaactttcgtgagcct

SEQ ID NO: 703960 - DNA, 20 bp, Artificial
  CRISPR gRNA sequence
ctcccctcatttttaaactg

SEQ ID NO: 703961 - DNA, 20 bp, Artificial
  CRISPR gRNA sequence
tcccctcatttttaaactga

SEQ ID NO: 703962 - DNA, 20 bp, Artificial
  CRISPR gRNA sequence
cctcatttttaaactgaagg

SEQ ID NO: 703963 - DNA, 20 bp, Artificial
  CRISPR gRNA sequence
ttttaaactgaaggtagtga

SEQ ID NO: 703964 - DNA, 20 bp, Artificial
  CRISPR gRNA sequence
ctgaaggtagtgacggtgcc

SEQ ID NO: 703965 - DNA, 20 bp, Artificial
  CRISPR gRNA sequence
tgaaggtagtgacggtgcct

SEQ ID NO: 703966 - DNA, 20 bp, Artificial
  CRISPR gRNA sequence
gaaggtagtgacggtgccta

SEQ ID NO: 703967 - DNA, 20 bp, Artificial
  CRISPR gRNA sequence
tagtgacggtgcctagggca

SEQ ID NO: 703968 - DNA, 20 bp, Artificial
  CRISPR gRNA sequence
agtgacggtgcctagggcat

SEQ ID NO: 703969 - DNA, 20 bp, Artificial
  CRISPR gRNA sequence
gtgacggtgcctagggcata

SEQ ID NO: 703970 - DNA, 20 bp, Artificial
  CRISPR gRNA sequence
cggtgcctagggcatagggt

SEQ ID NO: 703971 - DNA, 20 bp, Artificial
  CRISPR gRNA sequence
ggtgcctagggcatagggtt

SEQ ID NO: 703972 - DNA, 20 bp, Artificial
  CRISPR gRNA sequence
gtgcctagggcatagggttg

SEQ ID NO: 703973 - DNA, 20 bp, Artificial
  CRISPR gRNA sequence
agggttggggatcattcatt

SEQ ID NO: 703974 - DNA, 20 bp, Artificial
  CRISPR gRNA sequence
gggttggggatcattcattc

SEQ ID NO: 703975 - DNA, 20 bp, Artificial
  CRISPR gRNA sequence
ggttggggatcattcattca

SEQ ID NO: 703976 - DNA, 20 bp, Artificial
  CRISPR gRNA sequence
attcattcagggaacgcttg

SEQ ID NO: 703977 - DNA, 20 bp, Artificial
  CRISPR gRNA sequence
ttcattcagggaacgcttgt

SEQ ID NO: 703978 - DNA, 20 bp, Artificial
  CRISPR gRNA sequence
tcattcagggaacgcttgtg

SEQ ID NO: 703979 - DNA, 20 bp, Artificial
  CRISPR gRNA sequence
ttgtggggtgtgtttatgtg

SEQ ID NO: 703980 - DNA, 20 bp, Artificial
  CRISPR gRNA sequence
tggggtgtgtttatgtgcag

SEQ ID NO: 703981 - DNA, 20 bp, Artificial
  CRISPR gRNA sequence
ggggtgtgtttatgtgcagt

SEQ ID NO: 703982 - DNA, 20 bp, Artificial
  CRISPR gRNA sequence
gggtgtgtttatgtgcagtg

SEQ ID NO: 703983 - DNA, 20 bp, Artificial
  CRISPR gRNA sequence
actccatgcctgccctcatc

SEQ ID NO: 703984 - DNA, 20 bp, Artificial
  CRISPR gRNA sequence
ccatgcctgccctcatcaag

SEQ ID NO: 703985 - DNA, 20 bp, Artificial
  CRISPR gRNA sequence
catgcctgccctcatcaagc

SEQ ID NO: 703986 - DNA, 20 bp, Artificial
  CRISPR gRNA sequence
ctgccctcatcaagcaggtc

SEQ ID NO: 703987 - DNA, 20 bp, Artificial
  CRISPR gRNA sequence
gccctcatcaagcaggtcta

SEQ ID NO: 703988 - DNA, 20 bp, Artificial
  CRISPR gRNA sequence
ccctcatcaagcaggtctag

SEQ ID NO: 703989 - DNA, 20 bp, Artificial
  CRISPR gRNA sequence
cctcatcaagcaggtctaga

SEQ ID NO: 703990 - DNA, 20 bp, Artificial
  CRISPR gRNA sequence
atcaagcaggtctagagggt

SEQ ID NO: 703991 - DNA, 20 bp, Artificial
  CRISPR gRNA sequence
agcaggtctagagggttggc

SEQ ID NO: 703992 - DNA, 20 bp, Artificial
  CRISPR gRNA sequence
gcaggtctagagggttggcc

SEQ ID NO: 703993 - DNA, 20 bp, Artificial
  CRISPR gRNA sequence
aggtctagagggttggccgg

SEQ ID NO: 703994 - DNA, 20 bp, Artificial
  CRISPR gRNA sequence
ggtctagagggttggccggg

SEQ ID NO: 703995 - DNA, 20 bp, Artificial
  CRISPR gRNA sequence
gtctagagggttggccggga

SEQ ID NO: 703996 - DNA, 20 bp, Artificial
  CRISPR gRNA sequence
tctagagggttggccgggag

SEQ ID NO: 703997 - DNA, 20 bp, Artificial
  CRISPR gRNA sequence
agggttggccgggaggggac

SEQ ID NO: 703998 - DNA, 20 bp, Artificial
  CRISPR gRNA sequence
gggttggccgggaggggact

SEQ ID NO: 703999 - DNA, 20 bp, Artificial
  CRISPR gRNA sequence
tcttccttcccctcactgct

SEQ ID NO: 704000 - DNA, 20 bp, Artificial
  CRISPR gRNA sequence
ggccctccccaccctgactc

SEQ ID NO: 704001 - DNA, 20 bp, Artificial
  CRISPR gRNA sequence
caccctgactccggccacac

SEQ ID NO: 704002 - DNA, 20 bp, Artificial
  CRISPR gRNA sequence
cctgactccggccacaccag

SEQ ID NO: 704003 - DNA, 20 bp, Artificial
  CRISPR gRNA sequence
ggccacaccagcagtgctgc

SEQ ID NO: 704004 - DNA, 20 bp, Artificial
  CRISPR gRNA sequence
ccagcagtgctgccagatgc

SEQ ID NO: 704005 - DNA, 20 bp, Artificial
  CRISPR gRNA sequence
ctgccagatgccggtcacac

SEQ ID NO: 704006 - DNA, 20 bp, Artificial
  CRISPR gRNA sequence
tgccagatgccggtcacacc

SEQ ID NO: 704007 - DNA, 20 bp, Artificial
  CRISPR gRNA sequence
tcacaccgggccctcgtcca

SEQ ID NO: 704008 - DNA, 20 bp, Artificial
  CRISPR gRNA sequence
cgtccacagtccccaaattt

SEQ ID NO: 704009 - DNA, 20 bp, Artificial
  CRISPR gRNA sequence
gtccccaaattttggtctat

SEQ ID NO: 704010 - DNA, 20 bp, Artificial
  CRISPR gRNA sequence
ggacctcaattcctttgttc

SEQ ID NO: 704011 - DNA, 20 bp, Artificial
  CRISPR gRNA sequence
aattcctttgttctggctcc

SEQ ID NO: 704012 - DNA, 20 bp, Artificial
  CRISPR gRNA sequence
cgcctcaatttctcactctc

SEQ ID NO: 704013 - DNA, 20 bp, Artificial
  CRISPR gRNA sequence
aatttctcactctctagaca

SEQ ID NO: 704014 - DNA, 20 bp, Artificial
  CRISPR gRNA sequence
gacacagtttgcccttctct

SEQ ID NO: 704015 - DNA, 20 bp, Artificial
  CRISPR gRNA sequence
gcccttctctcagccttcaa

SEQ ID NO: 704016 - DNA, 20 bp, Artificial
  CRISPR gRNA sequence
ctcagccttcaatagttgat

SEQ ID NO: 704017 - DNA, 20 bp, Artificial
  CRISPR gRNA sequence
tcaatagttgatcagcttcc

SEQ ID NO: 704018 - DNA, 20 bp, Artificial
  CRISPR gRNA sequence
aatagttgatcagcttcctg

SEQ ID NO: 704019 - DNA, 20 bp, Artificial
  CRISPR gRNA sequence
gttgatcagcttcctggagc

SEQ ID NO: 704020 - DNA, 20 bp, Artificial
  CRISPR gRNA sequence
ttgatcagcttcctggagcc

SEQ ID NO: 704021 - DNA, 20 bp, Artificial
  CRISPR gRNA sequence
tcagcttcctggagccaggc

SEQ ID NO: 704022 - DNA, 20 bp, Artificial
  CRISPR gRNA sequence
cagcttcctggagccaggcg

SEQ ID NO: 704023 - DNA, 20 bp, Artificial
  CRISPR gRNA sequence
agcttcctggagccaggcga

SEQ ID NO: 704024 - DNA, 20 bp, Artificial
  CRISPR gRNA sequence
cttcctggagccaggcgagg

SEQ ID NO: 704025 - DNA, 20 bp, Artificial
  CRISPR gRNA sequence
ttcctggagccaggcgaggg

SEQ ID NO: 704026 - DNA, 20 bp, Artificial
  CRISPR gRNA sequence
tcctggagccaggcgaggga

SEQ ID NO: 704027 - DNA, 20 bp, Artificial
  CRISPR gRNA sequence
ggagccaggcgagggagggc

SEQ ID NO: 704028 - DNA, 20 bp, Artificial
  CRISPR gRNA sequence
caggcgagggagggctggat

SEQ ID NO: 704029 - DNA, 20 bp, Artificial
  CRISPR gRNA sequence
gagggagggctggatgagat

SEQ ID NO: 704030 - DNA, 20 bp, Artificial
  CRISPR gRNA sequence
gggagggctggatgagataa

SEQ ID NO: 704031 - DNA, 20 bp, Artificial
  CRISPR gRNA sequence
gctggatgagataagagcct

SEQ ID NO: 704032 - DNA, 20 bp, Artificial
  CRISPR gRNA sequence
atgagataagagccttggct

SEQ ID NO: 704033 - DNA, 20 bp, Artificial
  CRISPR gRNA sequence
gataagagccttggcttgga

SEQ ID NO: 704034 - DNA, 20 bp, Artificial
  CRISPR gRNA sequence
ataagagccttggcttggaa

SEQ ID NO: 704035 - DNA, 20 bp, Artificial
  CRISPR gRNA sequence
tggaaaggacctgttgttgt

SEQ ID NO: 704036 - DNA, 20 bp, Artificial
  CRISPR gRNA sequence
cctgttgttgttagccatga

SEQ ID NO: 704037 - DNA, 20 bp, Artificial
  CRISPR gRNA sequence
gttgttgttagccatgatgg

SEQ ID NO: 704038 - DNA, 20 bp, Artificial
  CRISPR gRNA sequence
ccatgatggaagctgtgtcc

SEQ ID NO: 704039 - DNA, 20 bp, Artificial
  CRISPR gRNA sequence
catgatggaagctgtgtccc

SEQ ID NO: 704040 - DNA, 20 bp, Artificial
  CRISPR gRNA sequence
tgatggaagctgtgtcccag

SEQ ID NO: 704041 - DNA, 20 bp, Artificial
  CRISPR gRNA sequence
tggaagctgtgtcccaggag

SEQ ID NO: 704042 - DNA, 20 bp, Artificial
  CRISPR gRNA sequence
ggaagctgtgtcccaggaga

SEQ ID NO: 704043 - DNA, 20 bp, Artificial
  CRISPR gRNA sequence
aagctgtgtcccaggagaag

SEQ ID NO: 704044 - DNA, 20 bp, Artificial
  CRISPR gRNA sequence
agctgtgtcccaggagaagg

SEQ ID NO: 704045 - DNA, 20 bp, Artificial
  CRISPR gRNA sequence
tgtgtcccaggagaaggagg

SEQ ID NO: 704046 - DNA, 20 bp, Artificial
  CRISPR gRNA sequence
aggagaaggaggaagtcgtc

SEQ ID NO: 704047 - DNA, 20 bp, Artificial
  CRISPR gRNA sequence
ggagaaggaggaagtcgtct

SEQ ID NO: 704048 - DNA, 20 bp, Artificial
  CRISPR gRNA sequence
gagaaggaggaagtcgtctg

SEQ ID NO: 704049 - DNA, 20 bp, Artificial
  CRISPR gRNA sequence
aggaggaagtcgtctggggc

SEQ ID NO: 704050 - DNA, 20 bp, Artificial
  CRISPR gRNA sequence
ggaggaagtcgtctggggct

SEQ ID NO: 704051 - DNA, 20 bp, Artificial
  CRISPR gRNA sequence
gaggaagtcgtctggggctg

SEQ ID NO: 704052 - DNA, 20 bp, Artificial
  CRISPR gRNA sequence
ggggctggggctgtcttgtg

SEQ ID NO: 704053 - DNA, 20 bp, Artificial
  CRISPR gRNA sequence
ggggctgtcttgtgtggttg

SEQ ID NO: 704054 - DNA, 20 bp, Artificial
  CRISPR gRNA sequence
ctgtcttgtgtggttgcagc

SEQ ID NO: 704055 - DNA, 20 bp, Artificial
  CRISPR gRNA sequence
tgtcttgtgtggttgcagca

SEQ ID NO: 704056 - DNA, 20 bp, Artificial
  CRISPR gRNA sequence
tgtgtggttgcagcaaggca

SEQ ID NO: 704057 - DNA, 20 bp, Artificial
  CRISPR gRNA sequence
tgtggttgcagcaaggcaaa

SEQ ID NO: 704058 - DNA, 20 bp, Artificial
  CRISPR gRNA sequence
ttgcagcaaggcaaagagtg

SEQ ID NO: 704059 - DNA, 20 bp, Artificial
  CRISPR gRNA sequence
tgcagcaaggcaaagagtgt

SEQ ID NO: 704060 - DNA, 20 bp, Artificial
  CRISPR gRNA sequence
gcagcaaggcaaagagtgtg

SEQ ID NO: 704061 - DNA, 20 bp, Artificial
  CRISPR gRNA sequence
tgtggggcgtctctgtgttc

SEQ ID NO: 704062 - DNA, 20 bp, Artificial
  CRISPR gRNA sequence
gtggggcgtctctgtgttcc

SEQ ID NO: 704063 - DNA, 20 bp, Artificial
  CRISPR gRNA sequence
tggggcgtctctgtgttcca

SEQ ID NO: 704064 - DNA, 20 bp, Artificial
  CRISPR gRNA sequence
gcgtctctgtgttccagggc

SEQ ID NO: 704065 - DNA, 20 bp, Artificial
  CRISPR gRNA sequence
ttccagggccagtgctcttc

SEQ ID NO: 704066 - DNA, 20 bp, Artificial
  CRISPR gRNA sequence
tccagggccagtgctcttct

SEQ ID NO: 704067 - DNA, 20 bp, Artificial
  CRISPR gRNA sequence
agtgctcttctgggtgatcc

SEQ ID NO: 704068 - DNA, 20 bp, Artificial
  CRISPR gRNA sequence
cttctgggtgatcctggtgt

SEQ ID NO: 704069 - DNA, 20 bp, Artificial
  CRISPR gRNA sequence
ggtgatcctggtgttggttg

SEQ ID NO: 704070 - DNA, 20 bp, Artificial
  CRISPR gRNA sequence
gatcctggtgttggttgtgg

SEQ ID NO: 704071 - DNA, 20 bp, Artificial
  CRISPR gRNA sequence
ctggtgttggttgtggtggt

SEQ ID NO: 704072 - DNA, 20 bp, Artificial
  CRISPR gRNA sequence
ttggttgtggtggtcggctc

SEQ ID NO: 704073 - DNA, 20 bp, Artificial
  CRISPR gRNA sequence
gcgccttcctcctgtgccac

SEQ ID NO: 704074 - DNA, 20 bp, Artificial
  CRISPR gRNA sequence
gccttcctcctgtgccaccg

SEQ ID NO: 704075 - DNA, 20 bp, Artificial
  CRISPR gRNA sequence
ccttcctcctgtgccaccgg

SEQ ID NO: 704076 - DNA, 20 bp, Artificial
  CRISPR gRNA sequence
cttcctcctgtgccaccgga

SEQ ID NO: 704077 - DNA, 20 bp, Artificial
  CRISPR gRNA sequence
ctgtgccaccggagggcctg

SEQ ID NO: 704078 - DNA, 20 bp, Artificial
  CRISPR gRNA sequence
tgtgccaccggagggcctgc

SEQ ID NO: 704079 - DNA, 20 bp, Artificial
  CRISPR gRNA sequence
gccaccggagggcctgcagg

SEQ ID NO: 704080 - DNA, 20 bp, Artificial
  CRISPR gRNA sequence
gggcctgcaggaagcgaatt

SEQ ID NO: 704081 - DNA, 20 bp, Artificial
  CRISPR gRNA sequence
cctgcaggaagcgaattcgg

SEQ ID NO: 704082 - DNA, 20 bp, Artificial
  CRISPR gRNA sequence
tgcaggaagcgaattcggca

SEQ ID NO: 704083 - DNA, 20 bp, Artificial
  CRISPR gRNA sequence
ggaagcgaattcggcagagt

SEQ ID NO: 704084 - DNA, 20 bp, Artificial
  CRISPR gRNA sequence
agcgaattcggcagagtaag

SEQ ID NO: 704085 - DNA, 20 bp, Artificial
  CRISPR gRNA sequence
agagtaagtggctgtgtcct

SEQ ID NO: 704086 - DNA, 20 bp, Artificial
  CRISPR gRNA sequence
gagtaagtggctgtgtcctt

SEQ ID NO: 704087 - DNA, 20 bp, Artificial
  CRISPR gRNA sequence
agtaagtggctgtgtccttg

SEQ ID NO: 704088 - DNA, 20 bp, Artificial
  CRISPR gRNA sequence
tggctgtgtccttggggcct

SEQ ID NO: 704089 - DNA, 20 bp, Artificial
  CRISPR gRNA sequence
ggctgtgtccttggggcctt

SEQ ID NO: 704090 - DNA, 20 bp, Artificial
  CRISPR gRNA sequence
gctgtgtccttggggccttg

SEQ ID NO: 704091 - DNA, 20 bp, Artificial
  CRISPR gRNA sequence
tgtgtccttggggccttggg

SEQ ID NO: 704092 - DNA, 20 bp, Artificial
  CRISPR gRNA sequence
gtgtccttggggccttgggg

SEQ ID NO: 704093 - DNA, 20 bp, Artificial
  CRISPR gRNA sequence
ccttggggccttggggagga

SEQ ID NO: 704094 - DNA, 20 bp, Artificial
  CRISPR gRNA sequence
cttggggccttggggaggac

SEQ ID NO: 704095 - DNA, 20 bp, Artificial
  CRISPR gRNA sequence
gaggacaggttgctctctgc

SEQ ID NO: 704096 - DNA, 20 bp, Artificial
  CRISPR gRNA sequence
caggttgctctctgccagcc

SEQ ID NO: 704097 - DNA, 20 bp, Artificial
  CRISPR gRNA sequence
tgctctctgccagcctggcc

SEQ ID NO: 704098 - DNA, 20 bp, Artificial
  CRISPR gRNA sequence
gctctctgccagcctggcct

SEQ ID NO: 704099 - DNA, 20 bp, Artificial
  CRISPR gRNA sequence
cctgcctgctcctgctctct

SEQ ID NO: 704100 - DNA, 20 bp, Artificial
  CRISPR gRNA sequence
ctgcctgctcctgctctctg

SEQ ID NO: 704101 - DNA, 20 bp, Artificial
  CRISPR gRNA sequence
ctctctgaggccgccacccc

SEQ ID NO: 704102 - DNA, 20 bp, Artificial
  CRISPR gRNA sequence
gccacccccagccttcctcc

SEQ ID NO: 704103 - DNA, 20 bp, Artificial
  CRISPR gRNA sequence
ccttcctcctggtgtcgttt

SEQ ID NO: 704104 - DNA, 20 bp, Artificial
  CRISPR gRNA sequence
ttcctcctggtgtcgtttca

SEQ ID NO: 704105 - DNA, 20 bp, Artificial
  CRISPR gRNA sequence
agagctccacctgtgctacc

SEQ ID NO: 704106 - DNA, 20 bp, Artificial
  CRISPR gRNA sequence
tccacctgtgctacccggtc

SEQ ID NO: 704107 - DNA, 20 bp, Artificial
  CRISPR gRNA sequence
gctacccggtccagacctcc

SEQ ID NO: 704108 - DNA, 20 bp, Artificial
  CRISPR gRNA sequence
cggtccagacctcccagccc

SEQ ID NO: 704109 - DNA, 20 bp, Artificial
  CRISPR gRNA sequence
ccagacctcccagcccaagc

SEQ ID NO: 704110 - DNA, 20 bp, Artificial
  CRISPR gRNA sequence
agacctcccagcccaagcta

SEQ ID NO: 704111 - DNA, 20 bp, Artificial
  CRISPR gRNA sequence
ccagcccaagctagagcttg

SEQ ID NO: 704112 - DNA, 20 bp, Artificial
  CRISPR gRNA sequence
cagcccaagctagagcttgt

SEQ ID NO: 704113 - DNA, 20 bp, Artificial
  CRISPR gRNA sequence
ccaagctagagcttgtgggt

SEQ ID NO: 704114 - DNA, 20 bp, Artificial
  CRISPR gRNA sequence
agagcttgtgggtgagtgtc

SEQ ID NO: 704115 - DNA, 20 bp, Artificial
  CRISPR gRNA sequence
ggtgagtgtccagccgtcca

SEQ ID NO: 704116 - DNA, 20 bp, Artificial
  CRISPR gRNA sequence
gtgagtgtccagccgtccaa

SEQ ID NO: 704117 - DNA, 20 bp, Artificial
  CRISPR gRNA sequence
tgagtgtccagccgtccaaa

SEQ ID NO: 704118 - DNA, 20 bp, Artificial
  CRISPR gRNA sequence
gagtgtccagccgtccaaag

SEQ ID NO: 704119 - DNA, 20 bp, Artificial
  CRISPR gRNA sequence
gccgtccaaaggggctgccc

SEQ ID NO: 704120 - DNA, 20 bp, Artificial
  CRISPR gRNA sequence
tccaaaggggctgcccgagc

SEQ ID NO: 704121 - DNA, 20 bp, Artificial
  CRISPR gRNA sequence
caaaggggctgcccgagcca

SEQ ID NO: 704122 - DNA, 20 bp, Artificial
  CRISPR gRNA sequence
aaaggggctgcccgagccag

SEQ ID NO: 704123 - DNA, 20 bp, Artificial
  CRISPR gRNA sequence
ctgcccgagccagaggaaca

SEQ ID NO: 704124 - DNA, 20 bp, Artificial
  CRISPR gRNA sequence
tgcccgagccagaggaacac

SEQ ID NO: 704125 - DNA, 20 bp, Artificial
  CRISPR gRNA sequence
gcccgagccagaggaacaca

SEQ ID NO: 704126 - DNA, 20 bp, Artificial
  CRISPR gRNA sequence
cgagccagaggaacacaggg

SEQ ID NO: 704127 - DNA, 20 bp, Artificial
  CRISPR gRNA sequence
agaggaacacagggcagctc

SEQ ID NO: 704128 - DNA, 20 bp, Artificial
  CRISPR gRNA sequence
gaggaacacagggcagctct

SEQ ID NO: 704129 - DNA, 20 bp, Artificial
  CRISPR gRNA sequence
acacagggcagctctgggcc

SEQ ID NO: 704130 - DNA, 20 bp, Artificial
  CRISPR gRNA sequence
cacagggcagctctgggccc

SEQ ID NO: 704131 - DNA, 20 bp, Artificial
  CRISPR gRNA sequence
acagggcagctctgggcccg

SEQ ID NO: 704132 - DNA, 20 bp, Artificial
  CRISPR gRNA sequence
gcagctctgggcccggggcg

SEQ ID NO: 704133 - DNA, 20 bp, Artificial
  CRISPR gRNA sequence
cagctctgggcccggggcgt

SEQ ID NO: 704134 - DNA, 20 bp, Artificial
  CRISPR gRNA sequence
tgggcccggggcgtgggctc

SEQ ID NO: 704135 - DNA, 20 bp, Artificial
  CRISPR gRNA sequence
ggcccggggcgtgggctcca

SEQ ID NO: 704136 - DNA, 20 bp, Artificial
  CRISPR gRNA sequence
cagagactgaacttctaccc

SEQ ID NO: 704137 - DNA, 20 bp, Artificial
  CRISPR gRNA sequence
gaacttctaccccagcctcg

SEQ ID NO: 704138 - DNA, 20 bp, Artificial
  CRISPR gRNA sequence
gcctcgaagctccctgtctg

SEQ ID NO: 704139 - DNA, 20 bp, Artificial
  CRISPR gRNA sequence
tgtcgcattctgtacatctg

SEQ ID NO: 704140 - DNA, 20 bp, Artificial
  CRISPR gRNA sequence
gtcgcattctgtacatctgt

SEQ ID NO: 704141 - DNA, 20 bp, Artificial
  CRISPR gRNA sequence
tcgcattctgtacatctgta

SEQ ID NO: 704142 - DNA, 20 bp, Artificial
  CRISPR gRNA sequence
acatctgtagggatgcaatg

SEQ ID NO: 704143 - DNA, 20 bp, Artificial
  CRISPR gRNA sequence
catctgtagggatgcaatgt

SEQ ID NO: 704144 - DNA, 20 bp, Artificial
  CRISPR gRNA sequence
tgggtgaaaactcatgcgtg

SEQ ID NO: 704145 - DNA, 20 bp, Artificial
  CRISPR gRNA sequence
ggtgaaaactcatgcgtgtg

SEQ ID NO: 704146 - DNA, 20 bp, Artificial
  CRISPR gRNA sequence
atgcgtgtggagaatgcaat

SEQ ID NO: 704147 - DNA, 20 bp, Artificial
  CRISPR gRNA sequence
tgcgtgtggagaatgcaatg

SEQ ID NO: 704148 - DNA, 20 bp, Artificial
  CRISPR gRNA sequence
gtggagaatgcaatgaggtg

SEQ ID NO: 704149 - DNA, 20 bp, Artificial
  CRISPR gRNA sequence
caatgaggtgaagactgtac

SEQ ID NO: 704150 - DNA, 20 bp, Artificial
  CRISPR gRNA sequence
aatgaggtgaagactgtact

SEQ ID NO: 704151 - DNA, 20 bp, Artificial
  CRISPR gRNA sequence
tactgggtgtgacgactgtg

SEQ ID NO: 704152 - DNA, 20 bp, Artificial
  CRISPR gRNA sequence
tgacgactgtgtggcttgcc

SEQ ID NO: 704153 - DNA, 20 bp, Artificial
  CRISPR gRNA sequence
acgactgtgtggcttgccca

SEQ ID NO: 704154 - DNA, 20 bp, Artificial
  CRISPR gRNA sequence
actgtgtggcttgcccagag

SEQ ID NO: 704155 - DNA, 20 bp, Artificial
  CRISPR gRNA sequence
ggcttgcccagagcagcacc

SEQ ID NO: 704156 - DNA, 20 bp, Artificial
  CRISPR gRNA sequence
tgcccagagcagcacctgga

SEQ ID NO: 704157 - DNA, 20 bp, Artificial
  CRISPR gRNA sequence
agcagcacctggatggatgc

SEQ ID NO: 704158 - DNA, 20 bp, Artificial
  CRISPR gRNA sequence
atgctggcatgaacgtttaa

SEQ ID NO: 704159 - DNA, 20 bp, Artificial
  CRISPR gRNA sequence
ttgtctgtcactttttcctc

SEQ ID NO: 704160 - DNA, 20 bp, Artificial
  CRISPR gRNA sequence
actttttcctccagtacccc

SEQ ID NO: 704161 - DNA, 20 bp, Artificial
  CRISPR gRNA sequence
ctttttcctccagtaccccc

SEQ ID NO: 704162 - DNA, 20 bp, Artificial
  CRISPR gRNA sequence
tttttcctccagtaccccca

SEQ ID NO: 704163 - DNA, 20 bp, Artificial
  CRISPR gRNA sequence
ttttcctccagtacccccag

SEQ ID NO: 704164 - DNA, 20 bp, Artificial
  CRISPR gRNA sequence
tttcctccagtacccccagg

SEQ ID NO: 704165 - DNA, 20 bp, Artificial
  CRISPR gRNA sequence
cccccagggggcattcctgc

SEQ ID NO: 704166 - DNA, 20 bp, Artificial
  CRISPR gRNA sequence
tctccccctcttctaccacc

SEQ ID NO: 704167 - DNA, 20 bp, Artificial
  CRISPR gRNA sequence
cccctcttctaccacctggc

SEQ ID NO: 704168 - DNA, 20 bp, Artificial
  CRISPR gRNA sequence
tcttctaccacctggcaagt

SEQ ID NO: 704169 - DNA, 20 bp, Artificial
  CRISPR gRNA sequence
taccacctggcaagtcagcc

SEQ ID NO: 704170 - DNA, 20 bp, Artificial
  CRISPR gRNA sequence
accacctggcaagtcagccc

SEQ ID NO: 704171 - DNA, 20 bp, Artificial
  CRISPR gRNA sequence
ccacctggcaagtcagccca

SEQ ID NO: 704172 - DNA, 20 bp, Artificial
  CRISPR gRNA sequence
cacctggcaagtcagcccag

SEQ ID NO: 704173 - DNA, 20 bp, Artificial
  CRISPR gRNA sequence
ctggcaagtcagcccagggg

SEQ ID NO: 704174 - DNA, 20 bp, Artificial
  CRISPR gRNA sequence
tggcaagtcagcccaggggc

SEQ ID NO: 704175 - DNA, 20 bp, Artificial
  CRISPR gRNA sequence
gcaagtcagcccaggggcag

SEQ ID NO: 704176 - DNA, 20 bp, Artificial
  CRISPR gRNA sequence
caagtcagcccaggggcagg

SEQ ID NO: 704177 - DNA, 20 bp, Artificial
  CRISPR gRNA sequence
aagtcagcccaggggcagga

SEQ ID NO: 704178 - DNA, 20 bp, Artificial
  CRISPR gRNA sequence
agtcagcccaggggcaggag

SEQ ID NO: 704179 - DNA, 20 bp, Artificial
  CRISPR gRNA sequence
agcccaggggcaggagggga

SEQ ID NO: 704180 - DNA, 20 bp, Artificial
  CRISPR gRNA sequence
gcccaggggcaggaggggaa

SEQ ID NO: 704181 - DNA, 20 bp, Artificial
  CRISPR gRNA sequence
ccaggggcaggaggggaaag

SEQ ID NO: 704182 - DNA, 20 bp, Artificial
  CRISPR gRNA sequence
caggaggggaaaggagcaca

SEQ ID NO: 704183 - DNA, 20 bp, Artificial
  CRISPR gRNA sequence
aggaggggaaaggagcacat

SEQ ID NO: 704184 - DNA, 20 bp, Artificial
  CRISPR gRNA sequence
ggaggggaaaggagcacatg

SEQ ID NO: 704185 - DNA, 20 bp, Artificial
  CRISPR gRNA sequence
gggaaaggagcacatggggc

SEQ ID NO: 704186 - DNA, 20 bp, Artificial
  CRISPR gRNA sequence
gaaaggagcacatggggcaa

SEQ ID NO: 704187 - DNA, 20 bp, Artificial
  CRISPR gRNA sequence
aaaggagcacatggggcaag

SEQ ID NO: 704188 - DNA, 20 bp, Artificial
  CRISPR gRNA sequence
aaggagcacatggggcaaga

SEQ ID NO: 704189 - DNA, 20 bp, Artificial
  CRISPR gRNA sequence
acatggggcaagagggaccc

SEQ ID NO: 704190 - DNA, 20 bp, Artificial
  CRISPR gRNA sequence
accctggttctgccacttac

SEQ ID NO: 704191 - DNA, 20 bp, Artificial
  CRISPR gRNA sequence
acttacaagctgtgtgaccc

SEQ ID NO: 704192 - DNA, 20 bp, Artificial
  CRISPR gRNA sequence
cttacaagctgtgtgaccct

SEQ ID NO: 704193 - DNA, 20 bp, Artificial
  CRISPR gRNA sequence
caagctgtgtgaccctgggt

SEQ ID NO: 704194 - DNA, 20 bp, Artificial
  CRISPR gRNA sequence
tactgaattgtcctgtgtct

SEQ ID NO: 704195 - DNA, 20 bp, Artificial
  CRISPR gRNA sequence
tgtgtctcagtttcctcatc

SEQ ID NO: 704196 - DNA, 20 bp, Artificial
  CRISPR gRNA sequence
gtttcctcatccggaaaatg

SEQ ID NO: 704197 - DNA, 20 bp, Artificial
  CRISPR gRNA sequence
cctcatccggaaaatgcaga

SEQ ID NO: 704198 - DNA, 20 bp, Artificial
  CRISPR gRNA sequence
catccggaaaatgcagatgg

SEQ ID NO: 704199 - DNA, 20 bp, Artificial
  CRISPR gRNA sequence
gcagatggtagaatctactt

SEQ ID NO: 704200 - DNA, 20 bp, Artificial
  CRISPR gRNA sequence
agatggtagaatctacttca

SEQ ID NO: 704201 - DNA, 20 bp, Artificial
  CRISPR gRNA sequence
gatggtagaatctacttcag

SEQ ID NO: 704202 - DNA, 20 bp, Artificial
  CRISPR gRNA sequence
tagaatctacttcagaggct

SEQ ID NO: 704203 - DNA, 20 bp, Artificial
  CRISPR gRNA sequence
tacttcagaggcttggcctg

SEQ ID NO: 704204 - DNA, 20 bp, Artificial
  CRISPR gRNA sequence
gcttggcctgtggattcgtc

SEQ ID NO: 704205 - DNA, 20 bp, Artificial
  CRISPR gRNA sequence
cttggcctgtggattcgtcg

SEQ ID NO: 704206 - DNA, 20 bp, Artificial
  CRISPR gRNA sequence
gcctgtggattcgtcgaggt

SEQ ID NO: 704207 - DNA, 20 bp, Artificial
  CRISPR gRNA sequence
cctgtggattcgtcgaggtc

SEQ ID NO: 704208 - DNA, 20 bp, Artificial
  CRISPR gRNA sequence
ttcgtcgaggtcgggctgtt

SEQ ID NO: 704209 - DNA, 20 bp, Artificial
  CRISPR gRNA sequence
tcgggctgttaagcgcatcg

SEQ ID NO: 704210 - DNA, 20 bp, Artificial
  CRISPR gRNA sequence
gggctgttaagcgcatcgtg

SEQ ID NO: 704211 - DNA, 20 bp, Artificial
  CRISPR gRNA sequence
gtggagtacctgcctgcaat

SEQ ID NO: 704212 - DNA, 20 bp, Artificial
  CRISPR gRNA sequence
gagtacctgcctgcaatcgg

SEQ ID NO: 704213 - DNA, 20 bp, Artificial
  CRISPR gRNA sequence
cggtggctgctgcctattga

SEQ ID NO: 704214 - DNA, 20 bp, Artificial
  CRISPR gRNA sequence
ggtggctgctgcctattgac

SEQ ID NO: 704215 - DNA, 20 bp, Artificial
  CRISPR gRNA sequence
gctgctgcctattgacaggc

SEQ ID NO: 704216 - DNA, 20 bp, Artificial
  CRISPR gRNA sequence
ttgacaggctggcctgtgcc

SEQ ID NO: 704217 - DNA, 20 bp, Artificial
  CRISPR gRNA sequence
tgacaggctggcctgtgcct

SEQ ID NO: 704218 - DNA, 20 bp, Artificial
  CRISPR gRNA sequence
gacaggctggcctgtgcctg

SEQ ID NO: 704219 - DNA, 20 bp, Artificial
  CRISPR gRNA sequence
gcctggggctttttccttcc

SEQ ID NO: 704220 - DNA, 20 bp, Artificial
  CRISPR gRNA sequence
tggggctttttccttcctgg

SEQ ID NO: 704221 - DNA, 20 bp, Artificial
  CRISPR gRNA sequence
tttttccttcctggaagctt

SEQ ID NO: 704222 - DNA, 20 bp, Artificial
  CRISPR gRNA sequence
ttttccttcctggaagcttc

SEQ ID NO: 704223 - DNA, 20 bp, Artificial
  CRISPR gRNA sequence
tggaagcttcaggccttcct

SEQ ID NO: 704224 - DNA, 20 bp, Artificial
  CRISPR gRNA sequence
cttcaggccttcctgagtcc

SEQ ID NO: 704225 - DNA, 20 bp, Artificial
  CRISPR gRNA sequence
ttcaggccttcctgagtcct

SEQ ID NO: 704226 - DNA, 20 bp, Artificial
  CRISPR gRNA sequence
ggtgcttctgaccccctccc

SEQ ID NO: 704227 - DNA, 20 bp, Artificial
  CRISPR gRNA sequence
cctgcactctgatccctgcc

SEQ ID NO: 704228 - DNA, 20 bp, Artificial
  CRISPR gRNA sequence
tctgatccctgcccagcctc

SEQ ID NO: 704229 - DNA, 20 bp, Artificial
  CRISPR gRNA sequence
ctgatccctgcccagcctct

SEQ ID NO: 704230 - DNA, 20 bp, Artificial
  CRISPR gRNA sequence
tccctgcccagcctctgggc

SEQ ID NO: 704231 - DNA, 20 bp, Artificial
  CRISPR gRNA sequence
agcctctgggccagctcttc

SEQ ID NO: 704232 - DNA, 20 bp, Artificial
  CRISPR gRNA sequence
gcctctgggccagctcttcc

SEQ ID NO: 704233 - DNA, 20 bp, Artificial
  CRISPR gRNA sequence
tctgggccagctcttccagg

SEQ ID NO: 704234 - DNA, 20 bp, Artificial
  CRISPR gRNA sequence
cagctcttccaggcagccct

SEQ ID NO: 704235 - DNA, 20 bp, Artificial
  CRISPR gRNA sequence
agctcttccaggcagccctt

SEQ ID NO: 704236 - DNA, 20 bp, Artificial
  CRISPR gRNA sequence
ctcttccaggcagcccttgg

SEQ ID NO: 704237 - DNA, 20 bp, Artificial
  CRISPR gRNA sequence
tccaggcagcccttgggagc

SEQ ID NO: 704238 - DNA, 20 bp, Artificial
  CRISPR gRNA sequence
tggaaccctcctcacctgtc

SEQ ID NO: 704239 - DNA, 20 bp, Artificial
  CRISPR gRNA sequence
ggaaccctcctcacctgtcc

SEQ ID NO: 704240 - DNA, 20 bp, Artificial
  CRISPR gRNA sequence
accctcctcacctgtccagg

SEQ ID NO: 704241 - DNA, 20 bp, Artificial
  CRISPR gRNA sequence
ccctcctcacctgtccaggc

SEQ ID NO: 704242 - DNA, 20 bp, Artificial
  CRISPR gRNA sequence
cctcctcacctgtccaggca

SEQ ID NO: 704243 - DNA, 20 bp, Artificial
  CRISPR gRNA sequence
tccaggcagggtcgtctata

SEQ ID NO: 704244 - DNA, 20 bp, Artificial
  CRISPR gRNA sequence
tctatacagcgtgtgtcttc

SEQ ID NO: 704245 - DNA, 20 bp, Artificial
  CRISPR gRNA sequence
tgtgtcttctagctctcacc

SEQ ID NO: 704246 - DNA, 20 bp, Artificial
  CRISPR gRNA sequence
gtgtcttctagctctcacct

SEQ ID NO: 704247 - DNA, 20 bp, Artificial
  CRISPR gRNA sequence
tgtcttctagctctcacctg

SEQ ID NO: 704248 - DNA, 20 bp, Artificial
  CRISPR gRNA sequence
cttctagctctcacctgggg

SEQ ID NO: 704249 - DNA, 20 bp, Artificial
  CRISPR gRNA sequence
ttctagctctcacctggggc

SEQ ID NO: 704250 - DNA, 20 bp, Artificial
  CRISPR gRNA sequence
tctagctctcacctggggca

SEQ ID NO: 704251 - DNA, 20 bp, Artificial
  CRISPR gRNA sequence
ctagctctcacctggggcag

SEQ ID NO: 704252 - DNA, 20 bp, Artificial
  CRISPR gRNA sequence
tagctctcacctggggcagg

SEQ ID NO: 704253 - DNA, 20 bp, Artificial
  CRISPR gRNA sequence
cacctggggcagggggctcc

SEQ ID NO: 704254 - DNA, 20 bp, Artificial
  CRISPR gRNA sequence
gctcccagctatcttgtgcc

SEQ ID NO: 704255 - DNA, 20 bp, Artificial
  CRISPR gRNA sequence
gccaagcaccttctctctcc

SEQ ID NO: 704256 - DNA, 20 bp, Artificial
  CRISPR gRNA sequence
ccaagcaccttctctctcct

SEQ ID NO: 704257 - DNA, 20 bp, Artificial
  CRISPR gRNA sequence
agcaccttctctctcctggg

SEQ ID NO: 704258 - DNA, 20 bp, Artificial
  CRISPR gRNA sequence
ctctcctgggcagccccttc

SEQ ID NO: 704259 - DNA, 20 bp, Artificial
  CRISPR gRNA sequence
tctcctgggcagccccttca

SEQ ID NO: 704260 - DNA, 20 bp, Artificial
  CRISPR gRNA sequence
cctgggcagccccttcaagg

SEQ ID NO: 704261 - DNA, 20 bp, Artificial
  CRISPR gRNA sequence
ctgggcagccccttcaaggc

SEQ ID NO: 704262 - DNA, 20 bp, Artificial
  CRISPR gRNA sequence
gcagccccttcaaggcaggc

SEQ ID NO: 704263 - DNA, 20 bp, Artificial
  CRISPR gRNA sequence
cagccccttcaaggcaggcc

SEQ ID NO: 704264 - DNA, 20 bp, Artificial
  CRISPR gRNA sequence
agccccttcaaggcaggcca

SEQ ID NO: 704265 - DNA, 20 bp, Artificial
  CRISPR gRNA sequence
aggcaggccagggtcttcct

SEQ ID NO: 704266 - DNA, 20 bp, Artificial
  CRISPR gRNA sequence
gggtcttcctcagcactgca

SEQ ID NO: 704267 - DNA, 20 bp, Artificial
  CRISPR gRNA sequence
ttcctcagcactgcatggca

SEQ ID NO: 704268 - DNA, 20 bp, Artificial
  CRISPR gRNA sequence
cagcactgcatggcatggat

SEQ ID NO: 704269 - DNA, 20 bp, Artificial
  CRISPR gRNA sequence
agcactgcatggcatggatt

SEQ ID NO: 704270 - DNA, 20 bp, Artificial
  CRISPR gRNA sequence
attgggtgcctgctctgtgc

SEQ ID NO: 704271 - DNA, 20 bp, Artificial
  CRISPR gRNA sequence
ttgggtgcctgctctgtgct

SEQ ID NO: 704272 - DNA, 20 bp, Artificial
  CRISPR gRNA sequence
tgctctgtgctgggctctga

SEQ ID NO: 704273 - DNA, 20 bp, Artificial
  CRISPR gRNA sequence
gctctgtgctgggctctgat

SEQ ID NO: 704274 - DNA, 20 bp, Artificial
  CRISPR gRNA sequence
ctctgtgctgggctctgatg

SEQ ID NO: 704275 - DNA, 20 bp, Artificial
  CRISPR gRNA sequence
tctgtgctgggctctgatgg

SEQ ID NO: 704276 - DNA, 20 bp, Artificial
  CRISPR gRNA sequence
ctctgatgggggaatcgtct

SEQ ID NO: 704277 - DNA, 20 bp, Artificial
  CRISPR gRNA sequence
agccttcgtttctgatttgc

SEQ ID NO: 704278 - DNA, 20 bp, Artificial
  CRISPR gRNA sequence
gccttcgtttctgatttgca

SEQ ID NO: 704279 - DNA, 20 bp, Artificial
  CRISPR gRNA sequence
ttcgtttctgatttgcaagg

SEQ ID NO: 704280 - DNA, 20 bp, Artificial
  CRISPR gRNA sequence
tcgtttctgatttgcaaggt

SEQ ID NO: 704281 - DNA, 20 bp, Artificial
  CRISPR gRNA sequence
ttgcaaggtgggctcccata

SEQ ID NO: 704282 - DNA, 20 bp, Artificial
  CRISPR gRNA sequence
tgcaaggtgggctcccatac

SEQ ID NO: 704283 - DNA, 20 bp, Artificial
  CRISPR gRNA sequence
acaggcttcctgtactcccc

SEQ ID NO: 704284 - DNA, 20 bp, Artificial
  CRISPR gRNA sequence
agtgatgacctttgttctgc

SEQ ID NO: 704285 - DNA, 20 bp, Artificial
  CRISPR gRNA sequence
gtgatgacctttgttctgca

SEQ ID NO: 704286 - DNA, 20 bp, Artificial
  CRISPR gRNA sequence
gatgacctttgttctgcaag

SEQ ID NO: 704287 - DNA, 20 bp, Artificial
  CRISPR gRNA sequence
atgacctttgttctgcaagg

SEQ ID NO: 704288 - DNA, 20 bp, Artificial
  CRISPR gRNA sequence
gacctttgttctgcaaggag

SEQ ID NO: 704289 - DNA, 20 bp, Artificial
  CRISPR gRNA sequence
acctttgttctgcaaggagg

SEQ ID NO: 704290 - DNA, 20 bp, Artificial
  CRISPR gRNA sequence
tttgttctgcaaggaggagg

SEQ ID NO: 704291 - DNA, 20 bp, Artificial
  CRISPR gRNA sequence
ttgttctgcaaggaggaggc

SEQ ID NO: 704292 - DNA, 20 bp, Artificial
  CRISPR gRNA sequence
tgttctgcaaggaggaggca

SEQ ID NO: 704293 - DNA, 20 bp, Artificial
  CRISPR gRNA sequence
tgcaaggaggaggcagggct

SEQ ID NO: 704294 - DNA, 20 bp, Artificial
  CRISPR gRNA sequence
aggaggaggcagggctcagc

SEQ ID NO: 704295 - DNA, 20 bp, Artificial
  CRISPR gRNA sequence
ggaggaggcagggctcagca

SEQ ID NO: 704296 - DNA, 20 bp, Artificial
  CRISPR gRNA sequence
ggaggcagggctcagcaagg

SEQ ID NO: 704297 - DNA, 20 bp, Artificial
  CRISPR gRNA sequence
gcagggctcagcaaggtgga

SEQ ID NO: 704298 - DNA, 20 bp, Artificial
  CRISPR gRNA sequence
ggctcagcaaggtggacggc

SEQ ID NO: 704299 - DNA, 20 bp, Artificial
  CRISPR gRNA sequence
agcaaggtggacggctggcc

SEQ ID NO: 704300 - DNA, 20 bp, Artificial
  CRISPR gRNA sequence
gcaaggtggacggctggccc

SEQ ID NO: 704301 - DNA, 20 bp, Artificial
  CRISPR gRNA sequence
caaggtggacggctggccca

SEQ ID NO: 704302 - DNA, 20 bp, Artificial
  CRISPR gRNA sequence
acggctggcccagggccaca

SEQ ID NO: 704303 - DNA, 20 bp, Artificial
  CRISPR gRNA sequence
tggcccagggccacacagcc

SEQ ID NO: 704304 - DNA, 20 bp, Artificial
  CRISPR gRNA sequence
cccagggccacacagcctgg

SEQ ID NO: 704305 - DNA, 20 bp, Artificial
  CRISPR gRNA sequence
agggccacacagcctggcag

SEQ ID NO: 704306 - DNA, 20 bp, Artificial
  CRISPR gRNA sequence
cacacagcctggcagtggca

SEQ ID NO: 704307 - DNA, 20 bp, Artificial
  CRISPR gRNA sequence
cagcctggcagtggcacagc

SEQ ID NO: 704308 - DNA, 20 bp, Artificial
  CRISPR gRNA sequence
ggcagtggcacagccagcct

SEQ ID NO: 704309 - DNA, 20 bp, Artificial
  CRISPR gRNA sequence
gcagtggcacagccagcctc

SEQ ID NO: 704310 - DNA, 20 bp, Artificial
  CRISPR gRNA sequence
gcacagccagcctcaggcac

SEQ ID NO: 704311 - DNA, 20 bp, Artificial
  CRISPR gRNA sequence
ccagcctcaggcactggtcc

SEQ ID NO: 704312 - DNA, 20 bp, Artificial
  CRISPR gRNA sequence
cagcctcaggcactggtcct

SEQ ID NO: 704313 - DNA, 20 bp, Artificial
  CRISPR gRNA sequence
agcctcaggcactggtccta

SEQ ID NO: 704314 - DNA, 20 bp, Artificial
  CRISPR gRNA sequence
gcctcaggcactggtcctag

SEQ ID NO: 704315 - DNA, 20 bp, Artificial
  CRISPR gRNA sequence
ggcactggtcctaggggttt

SEQ ID NO: 704316 - DNA, 20 bp, Artificial
  CRISPR gRNA sequence
cctaggggttttggtttgta

SEQ ID NO: 704317 - DNA, 20 bp, Artificial
  CRISPR gRNA sequence
ctaggggttttggtttgtaa

SEQ ID NO: 704318 - DNA, 20 bp, Artificial
  CRISPR gRNA sequence
taggggttttggtttgtaaa

SEQ ID NO: 704319 - DNA, 20 bp, Artificial
  CRISPR gRNA sequence
gttttggtttgtaaagggct

SEQ ID NO: 704320 - DNA, 20 bp, Artificial
  CRISPR gRNA sequence
cccctcttccttccccctgc

SEQ ID NO: 704321 - DNA, 20 bp, Artificial
  CRISPR gRNA sequence
caccatcgcaatgcctaccc

SEQ ID NO: 704322 - DNA, 20 bp, Artificial
  CRISPR gRNA sequence
ccatcgcaatgcctacccaa

SEQ ID NO: 704323 - DNA, 20 bp, Artificial
  CRISPR gRNA sequence
ctacccaagagccacgtgct

SEQ ID NO: 704324 - DNA, 20 bp, Artificial
  CRISPR gRNA sequence
aagagccacgtgctcagcct

SEQ ID NO: 704325 - DNA, 20 bp, Artificial
  CRISPR gRNA sequence
agagccacgtgctcagccta

SEQ ID NO: 704326 - DNA, 20 bp, Artificial
  CRISPR gRNA sequence
ccacgtgctcagcctaaggc

SEQ ID NO: 704327 - DNA, 20 bp, Artificial
  CRISPR gRNA sequence
cacgtgctcagcctaaggcc

SEQ ID NO: 704328 - DNA, 20 bp, Artificial
  CRISPR gRNA sequence
ctcagcctaaggccaggccc

SEQ ID NO: 704329 - DNA, 20 bp, Artificial
  CRISPR gRNA sequence
ggcccgtcccctgatctccc

SEQ ID NO: 704330 - DNA, 20 bp, Artificial
  CRISPR gRNA sequence
gcccgtcccctgatctcccc

SEQ ID NO: 704331 - DNA, 20 bp, Artificial
  CRISPR gRNA sequence
tgatctccccaggacccttg

SEQ ID NO: 704332 - DNA, 20 bp, Artificial
  CRISPR gRNA sequence
atctccccaggacccttgca

SEQ ID NO: 704333 - DNA, 20 bp, Artificial
  CRISPR gRNA sequence
tctccccaggacccttgcag

SEQ ID NO: 704334 - DNA, 20 bp, Artificial
  CRISPR gRNA sequence
cccttgcagaggcccttgca

SEQ ID NO: 704335 - DNA, 20 bp, Artificial
  CRISPR gRNA sequence
ccttgcagaggcccttgcat

SEQ ID NO: 704336 - DNA, 20 bp, Artificial
  CRISPR gRNA sequence
gcataggctgactgttgact

SEQ ID NO: 704337 - DNA, 20 bp, Artificial
  CRISPR gRNA sequence
cataggctgactgttgactt

SEQ ID NO: 704338 - DNA, 20 bp, Artificial
  CRISPR gRNA sequence
ttgacttgggcacaaaaaca

SEQ ID NO: 704339 - DNA, 20 bp, Artificial
  CRISPR gRNA sequence
gcacaaaaacacagtccact

SEQ ID NO: 704340 - DNA, 20 bp, Artificial
  CRISPR gRNA sequence
cacaaaaacacagtccactg

SEQ ID NO: 704341 - DNA, 20 bp, Artificial
  CRISPR gRNA sequence
aggcatgttttgaatttgac

SEQ ID NO: 704342 - DNA, 20 bp, Artificial
  CRISPR gRNA sequence
ttgaatttgacgagtttcac

SEQ ID NO: 704343 - DNA, 20 bp, Artificial
  CRISPR gRNA sequence
atttgacgagtttcacaagc

SEQ ID NO: 704344 - DNA, 20 bp, Artificial
  CRISPR gRNA sequence
agtttcacaagcaagcactg

SEQ ID NO: 704345 - DNA, 20 bp, Artificial
  CRISPR gRNA sequence
aagcactgtggtccctgtgc

SEQ ID NO: 704346 - DNA, 20 bp, Artificial
  CRISPR gRNA sequence
agcactgtggtccctgtgca

SEQ ID NO: 704347 - DNA, 20 bp, Artificial
  CRISPR gRNA sequence
gcactgtggtccctgtgcaa

SEQ ID NO: 704348 - DNA, 20 bp, Artificial
  CRISPR gRNA sequence
cactgtggtccctgtgcaag

SEQ ID NO: 704349 - DNA, 20 bp, Artificial
  CRISPR gRNA sequence
actgtggtccctgtgcaagg

SEQ ID NO: 704350 - DNA, 20 bp, Artificial
  CRISPR gRNA sequence
ctgtggtccctgtgcaaggg

SEQ ID NO: 704351 - DNA, 20 bp, Artificial
  CRISPR gRNA sequence
ggggggtttttgtgttttga

SEQ ID NO: 704352 - DNA, 20 bp, Artificial
  CRISPR gRNA sequence
ttttgtgttttgatagtttc

SEQ ID NO: 704353 - DNA, 20 bp, Artificial
  CRISPR gRNA sequence
agcctgtttccatgacctgt

SEQ ID NO: 704354 - DNA, 20 bp, Artificial
  CRISPR gRNA sequence
gcctgtttccatgacctgtc

SEQ ID NO: 704355 - DNA, 20 bp, Artificial
  CRISPR gRNA sequence
tttccatgacctgtcaggct

SEQ ID NO: 704356 - DNA, 20 bp, Artificial
  CRISPR gRNA sequence
gctgagtgtctcattgaaac

SEQ ID NO: 704357 - DNA, 20 bp, Artificial
  CRISPR gRNA sequence
ttgctttcttgacatttttc

SEQ ID NO: 704358 - DNA, 20 bp, Artificial
  CRISPR gRNA sequence
tcttgacatttttctagtat

SEQ ID NO: 704359 - DNA, 20 bp, Artificial
  CRISPR gRNA sequence
attagaatttccattgccgt

SEQ ID NO: 704360 - DNA, 20 bp, Artificial
  CRISPR gRNA sequence
ttttttcttcaaacctctgt

SEQ ID NO: 704361 - DNA, 20 bp, Artificial
  CRISPR gRNA sequence
ttttcttcaaacctctgtga

SEQ ID NO: 704362 - DNA, 20 bp, Artificial
  CRISPR gRNA sequence
tcttcaaacctctgtgagag

SEQ ID NO: 704363 - DNA, 20 bp, Artificial
  CRISPR gRNA sequence
ctgtgagagcagttttgtta

SEQ ID NO: 704364 - DNA, 20 bp, Artificial
  CRISPR gRNA sequence
tgagagcagttttgttacag

SEQ ID NO: 704365 - DNA, 20 bp, Artificial
  CRISPR gRNA sequence
gttttgttacagaagaaaaa

SEQ ID NO: 704366 - DNA, 20 bp, Artificial
  CRISPR gRNA sequence
tgttacagaagaaaaaaaga

SEQ ID NO: 704367 - DNA, 20 bp, Artificial
  CRISPR gRNA sequence
acagaagaaaaaaagaaaga

SEQ ID NO: 704368 - DNA, 20 bp, Artificial
  CRISPR gRNA sequence
aagaaaaaaagaaagaaaga

SEQ ID NO: 704369 - DNA, 20 bp, Artificial
  CRISPR gRNA sequence
gaaagaaaacaccttcccct

SEQ ID NO: 704370 - DNA, 20 bp, Artificial
  CRISPR gRNA sequence
agaaaacaccttcccctaag

SEQ ID NO: 704371 - DNA, 20 bp, Artificial
  CRISPR gRNA sequence
aacaccttcccctaagaagc

SEQ ID NO: 704372 - DNA, 20 bp, Artificial
  CRISPR gRNA sequence
acaccttcccctaagaagcc

SEQ ID NO: 704373 - DNA, 20 bp, Artificial
  CRISPR gRNA sequence
cctaagaagccaggtctaca

SEQ ID NO: 704374 - DNA, 20 bp, Artificial
  CRISPR gRNA sequence
agccaggtctacaaagaact

SEQ ID NO: 704375 - DNA, 20 bp, Artificial
  CRISPR gRNA sequence
tctacaaagaactgagccct

SEQ ID NO: 704376 - DNA, 20 bp, Artificial
  CRISPR gRNA sequence
aactgagccctgagactcaa

SEQ ID NO: 704377 - DNA, 20 bp, Artificial
  CRISPR gRNA sequence
tgagccctgagactcaatgg

SEQ ID NO: 704378 - DNA, 20 bp, Artificial
  CRISPR gRNA sequence
caatggtggacatcttatct

SEQ ID NO: 704379 - DNA, 20 bp, Artificial
  CRISPR gRNA sequence
aatggtggacatcttatctc

SEQ ID NO: 704380 - DNA, 20 bp, Artificial
  CRISPR gRNA sequence
tcaggtcgtttttgaccctc

SEQ ID NO: 704381 - DNA, 20 bp, Artificial
  CRISPR gRNA sequence
gtttttgaccctctagcttc

SEQ ID NO: 704382 - DNA, 20 bp, Artificial
  CRISPR gRNA sequence
tttgaccctctagcttctgg

SEQ ID NO: 704383 - DNA, 20 bp, Artificial
  CRISPR gRNA sequence
ttgaccctctagcttctggt

SEQ ID NO: 704384 - DNA, 20 bp, Artificial
  CRISPR gRNA sequence
tctagcttctggtgggacct

SEQ ID NO: 704385 - DNA, 20 bp, Artificial
  CRISPR gRNA sequence
ctagcttctggtgggacctt

SEQ ID NO: 704386 - DNA, 20 bp, Artificial
  CRISPR gRNA sequence
tagcttctggtgggaccttg

SEQ ID NO: 704387 - DNA, 20 bp, Artificial
  CRISPR gRNA sequence
tctggtgggaccttggggtc

SEQ ID NO: 704388 - DNA, 20 bp, Artificial
  CRISPR gRNA sequence
ctggtgggaccttggggtct

SEQ ID NO: 704389 - DNA, 20 bp, Artificial
  CRISPR gRNA sequence
gaccttggggtctgggttcc

SEQ ID NO: 704390 - DNA, 20 bp, Artificial
  CRISPR gRNA sequence
accttggggtctgggttccg

SEQ ID NO: 704391 - DNA, 20 bp, Artificial
  CRISPR gRNA sequence
gggtctgggttccgaggctc

SEQ ID NO: 704392 - DNA, 20 bp, Artificial
  CRISPR gRNA sequence
ctgggttccgaggctcaaga

SEQ ID NO: 704393 - DNA, 20 bp, Artificial
  CRISPR gRNA sequence
gttccgaggctcaagatgga

SEQ ID NO: 704394 - DNA, 20 bp, Artificial
  CRISPR gRNA sequence
cgaggctcaagatggacaga

SEQ ID NO: 704395 - DNA, 20 bp, Artificial
  CRISPR gRNA sequence
ctcaagatggacagaaagtg

SEQ ID NO: 704396 - DNA, 20 bp, Artificial
  CRISPR gRNA sequence
gatggacagaaagtgaagcc

SEQ ID NO: 704397 - DNA, 20 bp, Artificial
  CRISPR gRNA sequence
gacagaaagtgaagccaaga

SEQ ID NO: 704398 - DNA, 20 bp, Artificial
  CRISPR gRNA sequence
acagaaagtgaagccaagac

SEQ ID NO: 704399 - DNA, 20 bp, Artificial
  CRISPR gRNA sequence
aaagtgaagccaagacaggc

SEQ ID NO: 704400 - DNA, 20 bp, Artificial
  CRISPR gRNA sequence
agccaagacaggcaagctca

SEQ ID NO: 704401 - DNA, 20 bp, Artificial
  CRISPR gRNA sequence
ccaagacaggcaagctcaca

SEQ ID NO: 704402 - DNA, 20 bp, Artificial
  CRISPR gRNA sequence
caggcaagctcacagagcac

SEQ ID NO: 704403 - DNA, 20 bp, Artificial
  CRISPR gRNA sequence
aggcaagctcacagagcacc

SEQ ID NO: 704404 - DNA, 20 bp, Artificial
  CRISPR gRNA sequence
aagctcacagagcaccgggt

SEQ ID NO: 704405 - DNA, 20 bp, Artificial
  CRISPR gRNA sequence
cacagagcaccgggtgagaa

SEQ ID NO: 704406 - DNA, 20 bp, Artificial
  CRISPR gRNA sequence
gcaccgggtgagaatggacc

SEQ ID NO: 704407 - DNA, 20 bp, Artificial
  CRISPR gRNA sequence
cgggtgagaatggaccgagc

SEQ ID NO: 704408 - DNA, 20 bp, Artificial
  CRISPR gRNA sequence
tgagaatggaccgagctggc

SEQ ID NO: 704409 - DNA, 20 bp, Artificial
  CRISPR gRNA sequence
cggatgcccctttccctcct

SEQ ID NO: 704410 - DNA, 20 bp, Artificial
  CRISPR gRNA sequence
cccctttccctcctgagccg

SEQ ID NO: 704411 - DNA, 20 bp, Artificial
  CRISPR gRNA sequence
ccctttccctcctgagccgt

SEQ ID NO: 704412 - DNA, 20 bp, Artificial
  CRISPR gRNA sequence
tttccctcctgagccgtggg

SEQ ID NO: 704413 - DNA, 20 bp, Artificial
  CRISPR gRNA sequence
ctcctgagccgtgggtggtg

SEQ ID NO: 704414 - DNA, 20 bp, Artificial
  CRISPR gRNA sequence
tcctgagccgtgggtggtga

SEQ ID NO: 704415 - DNA, 20 bp, Artificial
  CRISPR gRNA sequence
ctgagccgtgggtggtgaag

SEQ ID NO: 704416 - DNA, 20 bp, Artificial
  CRISPR gRNA sequence
tgagccgtgggtggtgaagg

SEQ ID NO: 704417 - DNA, 20 bp, Artificial
  CRISPR gRNA sequence
gagccgtgggtggtgaagga

SEQ ID NO: 704418 - DNA, 20 bp, Artificial
  CRISPR gRNA sequence
ccgtgggtggtgaaggaggg

SEQ ID NO: 704419 - DNA, 20 bp, Artificial
  CRISPR gRNA sequence
cgtgggtggtgaaggaggga

SEQ ID NO: 704420 - DNA, 20 bp, Artificial
  CRISPR gRNA sequence
tgggtggtgaaggagggaag

SEQ ID NO: 704421 - DNA, 20 bp, Artificial
  CRISPR gRNA sequence
gtgaaggagggaaggagcac

SEQ ID NO: 704422 - DNA, 20 bp, Artificial
  CRISPR gRNA sequence
gggaaggagcactggtttat

SEQ ID NO: 704423 - DNA, 20 bp, Artificial
  CRISPR gRNA sequence
gagcactggtttattggcac

SEQ ID NO: 704424 - DNA, 20 bp, Artificial
  CRISPR gRNA sequence
gtttattggcactggtttat

SEQ ID NO: 704425 - DNA, 20 bp, Artificial
  CRISPR gRNA sequence
cgttcattcatctattcaca

SEQ ID NO: 704426 - DNA, 20 bp, Artificial
  CRISPR gRNA sequence
atctattcacatggtcttca

SEQ ID NO: 704427 - DNA, 20 bp, Artificial
  CRISPR gRNA sequence
ctattcacatggtcttcacg

SEQ ID NO: 704428 - DNA, 20 bp, Artificial
  CRISPR gRNA sequence
cacggagcacttcctccttg

SEQ ID NO: 704429 - DNA, 20 bp, Artificial
  CRISPR gRNA sequence
acggagcacttcctccttgc

SEQ ID NO: 704430 - DNA, 20 bp, Artificial
  CRISPR gRNA sequence
cctccttgcaggctctgtgc

SEQ ID NO: 704431 - DNA, 20 bp, Artificial
  CRISPR gRNA sequence
ctccttgcaggctctgtgcc

SEQ ID NO: 704432 - DNA, 20 bp, Artificial
  CRISPR gRNA sequence
tgcaggctctgtgccgggcc

SEQ ID NO: 704433 - DNA, 20 bp, Artificial
  CRISPR gRNA sequence
aggctctgtgccgggcccag

SEQ ID NO: 704434 - DNA, 20 bp, Artificial
  CRISPR gRNA sequence
gccgggcccagaagctgttc

SEQ ID NO: 704435 - DNA, 20 bp, Artificial
  CRISPR gRNA sequence
aagctgttctagctccctcc

SEQ ID NO: 704436 - DNA, 20 bp, Artificial
  CRISPR gRNA sequence
tctagctccctccaagcttt

SEQ ID NO: 704437 - DNA, 20 bp, Artificial
  CRISPR gRNA sequence
agactaattccgactgcccg

SEQ ID NO: 704438 - DNA, 20 bp, Artificial
  CRISPR gRNA sequence
actaattccgactgcccgca

SEQ ID NO: 704439 - DNA, 20 bp, Artificial
  CRISPR gRNA sequence
ctaattccgactgcccgcag

SEQ ID NO: 704440 - DNA, 20 bp, Artificial
  CRISPR gRNA sequence
ccgactgcccgcagaggcca

SEQ ID NO: 704441 - DNA, 20 bp, Artificial
  CRISPR gRNA sequence
cgactgcccgcagaggccaa

SEQ ID NO: 704442 - DNA, 20 bp, Artificial
  CRISPR gRNA sequence
ctgcccgcagaggccaaagg

SEQ ID NO: 704443 - DNA, 20 bp, Artificial
  CRISPR gRNA sequence
ccgcagaggccaaaggcaga

SEQ ID NO: 704444 - DNA, 20 bp, Artificial
  CRISPR gRNA sequence
cgcagaggccaaaggcagac

SEQ ID NO: 704445 - DNA, 20 bp, Artificial
  CRISPR gRNA sequence
cagaggccaaaggcagacgg

SEQ ID NO: 704446 - DNA, 20 bp, Artificial
  CRISPR gRNA sequence
agaggccaaaggcagacggg

SEQ ID NO: 704447 - DNA, 20 bp, Artificial
  CRISPR gRNA sequence
gaggccaaaggcagacggga

SEQ ID NO: 704448 - DNA, 20 bp, Artificial
  CRISPR gRNA sequence
aggccaaaggcagacgggag

SEQ ID NO: 704449 - DNA, 20 bp, Artificial
  CRISPR gRNA sequence
gccaaaggcagacgggaggg

SEQ ID NO: 704450 - DNA, 20 bp, Artificial
  CRISPR gRNA sequence
ggaggggagtgtgcgcccct

SEQ ID NO: 704451 - DNA, 20 bp, Artificial
  CRISPR gRNA sequence
ccccttggcctcccacatcc

SEQ ID NO: 704452 - DNA, 20 bp, Artificial
  CRISPR gRNA sequence
ggcctcccacatcccagacc

SEQ ID NO: 704453 - DNA, 20 bp, Artificial
  CRISPR gRNA sequence
gcctcccacatcccagacct

SEQ ID NO: 704454 - DNA, 20 bp, Artificial
  CRISPR gRNA sequence
cctcccacatcccagacctg

SEQ ID NO: 704455 - DNA, 20 bp, Artificial
  CRISPR gRNA sequence
cccacatcccagacctgggg

SEQ ID NO: 704456 - DNA, 20 bp, Artificial
  CRISPR gRNA sequence
cacatcccagacctggggca

SEQ ID NO: 704457 - DNA, 20 bp, Artificial
  CRISPR gRNA sequence
acatcccagacctggggcag

SEQ ID NO: 704458 - DNA, 20 bp, Artificial
  CRISPR gRNA sequence
catcccagacctggggcaga

SEQ ID NO: 704459 - DNA, 20 bp, Artificial
  CRISPR gRNA sequence
cctggggcagagggtgctct

SEQ ID NO: 704460 - DNA, 20 bp, Artificial
  CRISPR gRNA sequence
agggtgctcttggttccttt

SEQ ID NO: 704461 - DNA, 20 bp, Artificial
  CRISPR gRNA sequence
gtgctcttggttcctttgag

SEQ ID NO: 704462 - DNA, 20 bp, Artificial
  CRISPR gRNA sequence
tcttggttcctttgagcagt

SEQ ID NO: 704463 - DNA, 20 bp, Artificial
  CRISPR gRNA sequence
cctttgagcagtgagcacat

SEQ ID NO: 704464 - DNA, 20 bp, Artificial
  CRISPR gRNA sequence
ctttgagcagtgagcacatc

SEQ ID NO: 704465 - DNA, 20 bp, Artificial
  CRISPR gRNA sequence
tttgagcagtgagcacatca

SEQ ID NO: 704466 - DNA, 20 bp, Artificial
  CRISPR gRNA sequence
gtgagcacatcagggatctg

SEQ ID NO: 704467 - DNA, 20 bp, Artificial
  CRISPR gRNA sequence
tcagggatctgtggtccgtg

SEQ ID NO: 704468 - DNA, 20 bp, Artificial
  CRISPR gRNA sequence
cagggatctgtggtccgtgc

SEQ ID NO: 704469 - DNA, 20 bp, Artificial
  CRISPR gRNA sequence
gtggtccgtgcaggtgcgat

SEQ ID NO: 704470 - DNA, 20 bp, Artificial
  CRISPR gRNA sequence
ggtccgtgcaggtgcgatga

SEQ ID NO: 704471 - DNA, 20 bp, Artificial
  CRISPR gRNA sequence
gtccgtgcaggtgcgatgag

SEQ ID NO: 704472 - DNA, 20 bp, Artificial
  CRISPR gRNA sequence
gcgatgagaggcccaccaac

SEQ ID NO: 704473 - DNA, 20 bp, Artificial
  CRISPR gRNA sequence
aggcccaccaaccagccctc

SEQ ID NO: 704474 - DNA, 20 bp, Artificial
  CRISPR gRNA sequence
cccaccaaccagccctcgag

SEQ ID NO: 704475 - DNA, 20 bp, Artificial
  CRISPR gRNA sequence
gaccttcccgtgtgtgtcct

SEQ ID NO: 704476 - DNA, 20 bp, Artificial
  CRISPR gRNA sequence
cccgtgtgtgtcctcggtga

SEQ ID NO: 704477 - DNA, 20 bp, Artificial
  CRISPR gRNA sequence
ccgtgtgtgtcctcggtgac

SEQ ID NO: 704478 - DNA, 20 bp, Artificial
  CRISPR gRNA sequence
ctcggtgacaggcatttgca

SEQ ID NO: 704479 - DNA, 20 bp, Artificial
  CRISPR gRNA sequence
cgtgatctcatccactcctc

SEQ ID NO: 704480 - DNA, 20 bp, Artificial
  CRISPR gRNA sequence
gatctcatccactcctccgg

SEQ ID NO: 704481 - DNA, 20 bp, Artificial
  CRISPR gRNA sequence
ccactcctccggtggcctgt

SEQ ID NO: 704482 - DNA, 20 bp, Artificial
  CRISPR gRNA sequence
cactcctccggtggcctgtg

SEQ ID NO: 704483 - DNA, 20 bp, Artificial
  CRISPR gRNA sequence
ttactgttatccccgttgca

SEQ ID NO: 704484 - DNA, 20 bp, Artificial
  CRISPR gRNA sequence
gttatccccgttgcacagat

SEQ ID NO: 704485 - DNA, 20 bp, Artificial
  CRISPR gRNA sequence
atccccgttgcacagattag

SEQ ID NO: 704486 - DNA, 20 bp, Artificial
  CRISPR gRNA sequence
gttgcacagattagcagcct

SEQ ID NO: 704487 - DNA, 20 bp, Artificial
  CRISPR gRNA sequence
ttgcacagattagcagccta

SEQ ID NO: 704488 - DNA, 20 bp, Artificial
  CRISPR gRNA sequence
cagattagcagcctaaggca

SEQ ID NO: 704489 - DNA, 20 bp, Artificial
  CRISPR gRNA sequence
agattagcagcctaaggcac

SEQ ID NO: 704490 - DNA, 20 bp, Artificial
  CRISPR gRNA sequence
tagcagcctaaggcacagga

SEQ ID NO: 704491 - DNA, 20 bp, Artificial
  CRISPR gRNA sequence
gcctaaggcacaggatggtg

SEQ ID NO: 704492 - DNA, 20 bp, Artificial
  CRISPR gRNA sequence
gatggtgaagtaattcgttt

SEQ ID NO: 704493 - DNA, 20 bp, Artificial
  CRISPR gRNA sequence
atggtgaagtaattcgttta

SEQ ID NO: 704494 - DNA, 20 bp, Artificial
  CRISPR gRNA sequence
attcgtttaaggccacgtgc

SEQ ID NO: 704495 - DNA, 20 bp, Artificial
  CRISPR gRNA sequence
ttcgtttaaggccacgtgct

SEQ ID NO: 704496 - DNA, 20 bp, Artificial
  CRISPR gRNA sequence
tttaaggccacgtgctgggt

SEQ ID NO: 704497 - DNA, 20 bp, Artificial
  CRISPR gRNA sequence
gccacgtgctgggtgagccg

SEQ ID NO: 704498 - DNA, 20 bp, Artificial
  CRISPR gRNA sequence
ccacgtgctgggtgagccgt

SEQ ID NO: 704499 - DNA, 20 bp, Artificial
  CRISPR gRNA sequence
gtgctgggtgagccgtagga

SEQ ID NO: 704500 - DNA, 20 bp, Artificial
  CRISPR gRNA sequence
tgctgggtgagccgtaggac

SEQ ID NO: 704501 - DNA, 20 bp, Artificial
  CRISPR gRNA sequence
gctgggtgagccgtaggacg

SEQ ID NO: 704502 - DNA, 20 bp, Artificial
  CRISPR gRNA sequence
gtaggacggggattttatcg

SEQ ID NO: 704503 - DNA, 20 bp, Artificial
  CRISPR gRNA sequence
gggattttatcgtggttgtt

SEQ ID NO: 704504 - DNA, 20 bp, Artificial
  CRISPR gRNA sequence
gttgttgagatgtttgtaaa

SEQ ID NO: 704505 - DNA, 20 bp, Artificial
  CRISPR gRNA sequence
gtaaaaagatttttcaccct

SEQ ID NO: 704506 - DNA, 20 bp, Artificial
  CRISPR gRNA sequence
cccttggcaccattgacatt

SEQ ID NO: 704507 - DNA, 20 bp, Artificial
  CRISPR gRNA sequence
ccttggcaccattgacattt

SEQ ID NO: 704508 - DNA, 20 bp, Artificial
  CRISPR gRNA sequence
gcaccattgacatttgggaa

SEQ ID NO: 704509 - DNA, 20 bp, Artificial
  CRISPR gRNA sequence
cattgacatttgggaatgga

SEQ ID NO: 704510 - DNA, 20 bp, Artificial
  CRISPR gRNA sequence
gaatggatggttctttgctg

SEQ ID NO: 704511 - DNA, 20 bp, Artificial
  CRISPR gRNA sequence
atggatggttctttgctgtg

SEQ ID NO: 704512 - DNA, 20 bp, Artificial
  CRISPR gRNA sequence
tgctgtggagcgctatccta

SEQ ID NO: 704513 - DNA, 20 bp, Artificial
  CRISPR gRNA sequence
gctgtggagcgctatcctat

SEQ ID NO: 704514 - DNA, 20 bp, Artificial
  CRISPR gRNA sequence
ctatcctataggacgttgta

SEQ ID NO: 704515 - DNA, 20 bp, Artificial
  CRISPR gRNA sequence
aggacgttgtacagcccctc

SEQ ID NO: 704516 - DNA, 20 bp, Artificial
  CRISPR gRNA sequence
tgtacagcccctctagatgc

SEQ ID NO: 704517 - DNA, 20 bp, Artificial
  CRISPR gRNA sequence
tgccagtaaccttccctact

SEQ ID NO: 704518 - DNA, 20 bp, Artificial
  CRISPR gRNA sequence
gccagtaaccttccctactt

SEQ ID NO: 704519 - DNA, 20 bp, Artificial
  CRISPR gRNA sequence
gggacaaccaaaaatgtctc

SEQ ID NO: 704520 - DNA, 20 bp, Artificial
  CRISPR gRNA sequence
tgtctctagacattgccatg

SEQ ID NO: 704521 - DNA, 20 bp, Artificial
  CRISPR gRNA sequence
agacattgccatgtggcccc

SEQ ID NO: 704522 - DNA, 20 bp, Artificial
  CRISPR gRNA sequence
gacattgccatgtggcccct

SEQ ID NO: 704523 - DNA, 20 bp, Artificial
  CRISPR gRNA sequence
acattgccatgtggcccctg

SEQ ID NO: 704524 - DNA, 20 bp, Artificial
  CRISPR gRNA sequence
ggcccctggggaaaacctcc

SEQ ID NO: 704525 - DNA, 20 bp, Artificial
  CRISPR gRNA sequence
ctggggaaaacctcctggtt

SEQ ID NO: 704526 - DNA, 20 bp, Artificial
  CRISPR gRNA sequence
acctcctggttgagaaccac

SEQ ID NO: 704527 - DNA, 20 bp, Artificial
  CRISPR gRNA sequence
cttttttttttttttttttt

SEQ ID NO: 704528 - DNA, 20 bp, Artificial
  CRISPR gRNA sequence
ttttttttttttttttgaga

SEQ ID NO: 704529 - DNA, 20 bp, Artificial
  CRISPR gRNA sequence
ttttttttttttttgagaca

SEQ ID NO: 704530 - DNA, 20 bp, Artificial
  CRISPR gRNA sequence
cagagtctcgctctgtcacc

SEQ ID NO: 704531 - DNA, 20 bp, Artificial
  CRISPR gRNA sequence
agagtctcgctctgtcaccc

SEQ ID NO: 704532 - DNA, 20 bp, Artificial
  CRISPR gRNA sequence
tctcgctctgtcacccaggc

SEQ ID NO: 704533 - DNA, 20 bp, Artificial
  CRISPR gRNA sequence
tcgctctgtcacccaggctg

SEQ ID NO: 704534 - DNA, 20 bp, Artificial
  CRISPR gRNA sequence
tcacccaggctggagtgcac

SEQ ID NO: 704535 - DNA, 20 bp, Artificial
  CRISPR gRNA sequence
tggagtgcactggtgccatc

SEQ ID NO: 704536 - DNA, 20 bp, Artificial
  CRISPR gRNA sequence
ggagtgcactggtgccatct

SEQ ID NO: 704537 - DNA, 20 bp, Artificial
  CRISPR gRNA sequence
tcactgcaacctccgcctca

SEQ ID NO: 704538 - DNA, 20 bp, Artificial
  CRISPR gRNA sequence
cactgcaacctccgcctcac

SEQ ID NO: 704539 - DNA, 20 bp, Artificial
  CRISPR gRNA sequence
aacctccgcctcacgggttc

SEQ ID NO: 704540 - DNA, 20 bp, Artificial
  CRISPR gRNA sequence
ttcaagtgattctcctgcct

SEQ ID NO: 704541 - DNA, 20 bp, Artificial
  CRISPR gRNA sequence
ttctcctgcctcagcctcct

SEQ ID NO: 704542 - DNA, 20 bp, Artificial
  CRISPR gRNA sequence
tcctgcctcagcctcctgag

SEQ ID NO: 704543 - DNA, 20 bp, Artificial
  CRISPR gRNA sequence
gcctcagcctcctgagtagc

SEQ ID NO: 704544 - DNA, 20 bp, Artificial
  CRISPR gRNA sequence
cctcagcctcctgagtagct

SEQ ID NO: 704545 - DNA, 20 bp, Artificial
  CRISPR gRNA sequence
ctcctgagtagctgggatta

SEQ ID NO: 704546 - DNA, 20 bp, Artificial
  CRISPR gRNA sequence
tcctgagtagctgggattac

SEQ ID NO: 704547 - DNA, 20 bp, Artificial
  CRISPR gRNA sequence
caggctcctgccaccatgcc

SEQ ID NO: 704548 - DNA, 20 bp, Artificial
  CRISPR gRNA sequence
ccaccatgcctggctaattt

SEQ ID NO: 704549 - DNA, 20 bp, Artificial
  CRISPR gRNA sequence
ctggctaattttggtatttt

SEQ ID NO: 704550 - DNA, 20 bp, Artificial
  CRISPR gRNA sequence
gctaattttggtatttttag

SEQ ID NO: 704551 - DNA, 20 bp, Artificial
  CRISPR gRNA sequence
taattttggtatttttagta

SEQ ID NO: 704552 - DNA, 20 bp, Artificial
  CRISPR gRNA sequence
tttggtatttttagtagaga

SEQ ID NO: 704553 - DNA, 20 bp, Artificial
  CRISPR gRNA sequence
ttggtatttttagtagagac

SEQ ID NO: 704554 - DNA, 20 bp, Artificial
  CRISPR gRNA sequence
tggtatttttagtagagacg

SEQ ID NO: 704555 - DNA, 20 bp, Artificial
  CRISPR gRNA sequence
gagacggggtttcaccgtgt

SEQ ID NO: 704556 - DNA, 20 bp, Artificial
  CRISPR gRNA sequence
cggggtttcaccgtgttggc

SEQ ID NO: 704557 - DNA, 20 bp, Artificial
  CRISPR gRNA sequence
ggggtttcaccgtgttggcc

SEQ ID NO: 704558 - DNA, 20 bp, Artificial
  CRISPR gRNA sequence
tttcaccgtgttggccaggc

SEQ ID NO: 704559 - DNA, 20 bp, Artificial
  CRISPR gRNA sequence
acctcatgatccgcctgcct

SEQ ID NO: 704560 - DNA, 20 bp, Artificial
  CRISPR gRNA sequence
ccgcctgcctcggcctccca

SEQ ID NO: 704561 - DNA, 20 bp, Artificial
  CRISPR gRNA sequence
gcctcggcctcccaaagtgc

SEQ ID NO: 704562 - DNA, 20 bp, Artificial
  CRISPR gRNA sequence
cctcggcctcccaaagtgct

SEQ ID NO: 704563 - DNA, 20 bp, Artificial
  CRISPR gRNA sequence
ctcccaaagtgctgggtttg

SEQ ID NO: 704564 - DNA, 20 bp, Artificial
  CRISPR gRNA sequence
tcccaaagtgctgggtttgc

SEQ ID NO: 704565 - DNA, 20 bp, Artificial
  CRISPR gRNA sequence
agtgctgggtttgcaggcat

SEQ ID NO: 704566 - DNA, 20 bp, Artificial
  CRISPR gRNA sequence
caggcatgagccaccatgcc

SEQ ID NO: 704567 - DNA, 20 bp, Artificial
  CRISPR gRNA sequence
ttttaatccttcatttttat

SEQ ID NO: 704568 - DNA, 20 bp, Artificial
  CRISPR gRNA sequence
cttcatttttatgagcactt

SEQ ID NO: 704569 - DNA, 20 bp, Artificial
  CRISPR gRNA sequence
tgagtcattttctattattc

SEQ ID NO: 704570 - DNA, 20 bp, Artificial
  CRISPR gRNA sequence
gagtcattttctattattcc

SEQ ID NO: 704571 - DNA, 20 bp, Artificial
  CRISPR gRNA sequence
agtcattttctattattcca

SEQ ID NO: 704572 - DNA, 20 bp, Artificial
  CRISPR gRNA sequence
tcattttctattattccagg

SEQ ID NO: 704573 - DNA, 20 bp, Artificial
  CRISPR gRNA sequence
tctattattccagggagatt

SEQ ID NO: 704574 - DNA, 20 bp, Artificial
  CRISPR gRNA sequence
ctattattccagggagattt

SEQ ID NO: 704575 - DNA, 20 bp, Artificial
  CRISPR gRNA sequence
tccagggagatttaggttga

SEQ ID NO: 704576 - DNA, 20 bp, Artificial
  CRISPR gRNA sequence
attctttttttgttttgaaa

SEQ ID NO: 704577 - DNA, 20 bp, Artificial
  CRISPR gRNA sequence
ttgaaacagtttcaaactta

SEQ ID NO: 704578 - DNA, 20 bp, Artificial
  CRISPR gRNA sequence
cagtttcaaacttatagaaa

SEQ ID NO: 704579 - DNA, 20 bp, Artificial
  CRISPR gRNA sequence
caaacttatagaaatggtat

SEQ ID NO: 704580 - DNA, 20 bp, Artificial
  CRISPR gRNA sequence
atagaaatggtataagtatg

SEQ ID NO: 704581 - DNA, 20 bp, Artificial
  CRISPR gRNA sequence
cattttgacctgaaccattt

SEQ ID NO: 704582 - DNA, 20 bp, Artificial
  CRISPR gRNA sequence
ttttgacctgaaccatttga

SEQ ID NO: 704583 - DNA, 20 bp, Artificial
  CRISPR gRNA sequence
tttgagagtaactgactgac

SEQ ID NO: 704584 - DNA, 20 bp, Artificial
  CRISPR gRNA sequence
gtctctcaccccgaaaactt

SEQ ID NO: 704585 - DNA, 20 bp, Artificial
  CRISPR gRNA sequence
gaaaacttcagtgtgtgttt

SEQ ID NO: 704586 - DNA, 20 bp, Artificial
  CRISPR gRNA sequence
acttcagtgtgtgtttcaga

SEQ ID NO: 704587 - DNA, 20 bp, Artificial
  CRISPR gRNA sequence
agtgtgtgtttcagacagac

SEQ ID NO: 704588 - DNA, 20 bp, Artificial
  CRISPR gRNA sequence
gtgtgtgtttcagacagaca

SEQ ID NO: 704589 - DNA, 20 bp, Artificial
  CRISPR gRNA sequence
tgtgtgtttcagacagacaa

SEQ ID NO: 704590 - DNA, 20 bp, Artificial
  CRISPR gRNA sequence
agggtgtattttacacgatg

SEQ ID NO: 704591 - DNA, 20 bp, Artificial
  CRISPR gRNA sequence
tgtattttacacgatgtggt

SEQ ID NO: 704592 - DNA, 20 bp, Artificial
  CRISPR gRNA sequence
gtattttacacgatgtggta

SEQ ID NO: 704593 - DNA, 20 bp, Artificial
  CRISPR gRNA sequence
cacgatgtggtaaggatcgt

SEQ ID NO: 704594 - DNA, 20 bp, Artificial
  CRISPR gRNA sequence
gtggtaaggatcgtcagaat

SEQ ID NO: 704595 - DNA, 20 bp, Artificial
  CRISPR gRNA sequence
catgacccacaatgaattct

SEQ ID NO: 704596 - DNA, 20 bp, Artificial
  CRISPR gRNA sequence
atgacccacaatgaattctc

SEQ ID NO: 704597 - DNA, 20 bp, Artificial
  CRISPR gRNA sequence
tgaattctcaggccctgttg

SEQ ID NO: 704598 - DNA, 20 bp, Artificial
  CRISPR gRNA sequence
tgtcccaataatgtccttta

SEQ ID NO: 704599 - DNA, 20 bp, Artificial
  CRISPR gRNA sequence
cccaataatgtcctttatag

SEQ ID NO: 704600 - DNA, 20 bp, Artificial
  CRISPR gRNA sequence
caataatgtcctttatagca

SEQ ID NO: 704601 - DNA, 20 bp, Artificial
  CRISPR gRNA sequence
aataatgtcctttatagcag

SEQ ID NO: 704602 - DNA, 20 bp, Artificial
  CRISPR gRNA sequence
tcctttatagcagaggactc

SEQ ID NO: 704603 - DNA, 20 bp, Artificial
  CRISPR gRNA sequence
tatagcagaggactccagct

SEQ ID NO: 704604 - DNA, 20 bp, Artificial
  CRISPR gRNA sequence
atagcagaggactccagctc

SEQ ID NO: 704605 - DNA, 20 bp, Artificial
  CRISPR gRNA sequence
tagcagaggactccagctca

SEQ ID NO: 704606 - DNA, 20 bp, Artificial
  CRISPR gRNA sequence
acgtgttacatttgcttgtc

SEQ ID NO: 704607 - DNA, 20 bp, Artificial
  CRISPR gRNA sequence
atttgcttgtctggtttctc

SEQ ID NO: 704608 - DNA, 20 bp, Artificial
  CRISPR gRNA sequence
ttctcgagtctccttctgtc

SEQ ID NO: 704609 - DNA, 20 bp, Artificial
  CRISPR gRNA sequence
ttctgtccggatccgttccc

SEQ ID NO: 704610 - DNA, 20 bp, Artificial
  CRISPR gRNA sequence
tctgtccggatccgttcccc

SEQ ID NO: 704611 - DNA, 20 bp, Artificial
  CRISPR gRNA sequence
caggcgtttctttcacttac

SEQ ID NO: 704612 - DNA, 20 bp, Artificial
  CRISPR gRNA sequence
aggcgtttctttcacttact

SEQ ID NO: 704613 - DNA, 20 bp, Artificial
  CRISPR gRNA sequence
cgtttctttcacttactggg

SEQ ID NO: 704614 - DNA, 20 bp, Artificial
  CRISPR gRNA sequence
tttctttcacttactgggaa

SEQ ID NO: 704615 - DNA, 20 bp, Artificial
  CRISPR gRNA sequence
ttcacttactgggaagagcg

SEQ ID NO: 704616 - DNA, 20 bp, Artificial
  CRISPR gRNA sequence
tcacttactgggaagagcgc

SEQ ID NO: 704617 - DNA, 20 bp, Artificial
  CRISPR gRNA sequence
ttactgggaagagcgcaggc

SEQ ID NO: 704618 - DNA, 20 bp, Artificial
  CRISPR gRNA sequence
agcgcaggctggtgatttca

SEQ ID NO: 704619 - DNA, 20 bp, Artificial
  CRISPR gRNA sequence
ttcatggatgctccttgctt

SEQ ID NO: 704620 - DNA, 20 bp, Artificial
  CRISPR gRNA sequence
tcatggatgctccttgcttt

SEQ ID NO: 704621 - DNA, 20 bp, Artificial
  CRISPR gRNA sequence
ctccttgctttgggtttgtc

SEQ ID NO: 704622 - DNA, 20 bp, Artificial
  CRISPR gRNA sequence
tttgtctggtgttttctccc

SEQ ID NO: 704623 - DNA, 20 bp, Artificial
  CRISPR gRNA sequence
gtctggtgttttctcccgag

SEQ ID NO: 704624 - DNA, 20 bp, Artificial
  CRISPR gRNA sequence
tgttttctcccgagtggatt

SEQ ID NO: 704625 - DNA, 20 bp, Artificial
  CRISPR gRNA sequence
gttttctcccgagtggattc

SEQ ID NO: 704626 - DNA, 20 bp, Artificial
  CRISPR gRNA sequence
tggattcaggtcatgcatct

SEQ ID NO: 704627 - DNA, 20 bp, Artificial
  CRISPR gRNA sequence
ggattcaggtcatgcatctt

SEQ ID NO: 704628 - DNA, 20 bp, Artificial
  CRISPR gRNA sequence
tcaggtcatgcatcttgggc

SEQ ID NO: 704629 - DNA, 20 bp, Artificial
  CRISPR gRNA sequence
ggtcatgcatcttgggctgg

SEQ ID NO: 704630 - DNA, 20 bp, Artificial
  CRISPR gRNA sequence
gtcatgcatcttgggctgga

SEQ ID NO: 704631 - DNA, 20 bp, Artificial
  CRISPR gRNA sequence
catcttgggctggaaggtcc

SEQ ID NO: 704632 - DNA, 20 bp, Artificial
  CRISPR gRNA sequence
atcttgggctggaaggtccc

SEQ ID NO: 704633 - DNA, 20 bp, Artificial
  CRISPR gRNA sequence
gaaggtcccaggaatgatgc

SEQ ID NO: 704634 - DNA, 20 bp, Artificial
  CRISPR gRNA sequence
gatgctggcctcttctctct

SEQ ID NO: 704635 - DNA, 20 bp, Artificial
  CRISPR gRNA sequence
atgctggcctcttctctctc

SEQ ID NO: 704636 - DNA, 20 bp, Artificial
  CRISPR gRNA sequence
tgctggcctcttctctctca

SEQ ID NO: 704637 - DNA, 20 bp, Artificial
  CRISPR gRNA sequence
tctctctcagggcgtcctgc

SEQ ID NO: 704638 - DNA, 20 bp, Artificial
  CRISPR gRNA sequence
ctctctcagggcgtcctgcc

SEQ ID NO: 704639 - DNA, 20 bp, Artificial
  CRISPR gRNA sequence
gtttcgatgtctccctttcc

SEQ ID NO: 704640 - DNA, 20 bp, Artificial
  CRISPR gRNA sequence
ttcctggtgctgtgtacttt

SEQ ID NO: 704641 - DNA, 20 bp, Artificial
  CRISPR gRNA sequence
tgtgtactttgagcgctcga

SEQ ID NO: 704642 - DNA, 20 bp, Artificial
  CRISPR gRNA sequence
tgtactttgagcgctcgacg

SEQ ID NO: 704643 - DNA, 20 bp, Artificial
  CRISPR gRNA sequence
gtactttgagcgctcgacgg

SEQ ID NO: 704644 - DNA, 20 bp, Artificial
  CRISPR gRNA sequence
cgacggaggtgatgtcctgc

SEQ ID NO: 704645 - DNA, 20 bp, Artificial
  CRISPR gRNA sequence
gacggaggtgatgtcctgcc

SEQ ID NO: 704646 - DNA, 20 bp, Artificial
  CRISPR gRNA sequence
tgacgtctccatttgctcct

SEQ ID NO: 704647 - DNA, 20 bp, Artificial
  CRISPR gRNA sequence
tttgctcctcggtcattact

SEQ ID NO: 704648 - DNA, 20 bp, Artificial
  CRISPR gRNA sequence
ctcggtcattactaagtctt

SEQ ID NO: 704649 - DNA, 20 bp, Artificial
  CRISPR gRNA sequence
tcggtcattactaagtcttt

SEQ ID NO: 704650 - DNA, 20 bp, Artificial
  CRISPR gRNA sequence
cggtcattactaagtcttta

SEQ ID NO: 704651 - DNA, 20 bp, Artificial
  CRISPR gRNA sequence
ggtcattactaagtctttag

SEQ ID NO: 704652 - DNA, 20 bp, Artificial
  CRISPR gRNA sequence
agtctttaggggcgttactt

SEQ ID NO: 704653 - DNA, 20 bp, Artificial
  CRISPR gRNA sequence
gttacttgagactatgtcaa

SEQ ID NO: 704654 - DNA, 20 bp, Artificial
  CRISPR gRNA sequence
tatgtcaatagcccattctt

SEQ ID NO: 704655 - DNA, 20 bp, Artificial
  CRISPR gRNA sequence
gtcaatagcccattcttcag

SEQ ID NO: 704656 - DNA, 20 bp, Artificial
  CRISPR gRNA sequence
atttatttgtttattttttt

SEQ ID NO: 704657 - DNA, 20 bp, Artificial
  CRISPR gRNA sequence
atttgtttatttttttgaga

SEQ ID NO: 704658 - DNA, 20 bp, Artificial
  CRISPR gRNA sequence
tttgtttatttttttgagac

SEQ ID NO: 704659 - DNA, 20 bp, Artificial
  CRISPR gRNA sequence
ttgtttatttttttgagaca

SEQ ID NO: 704660 - DNA, 20 bp, Artificial
  CRISPR gRNA sequence
tatttttttgagacagggtc

SEQ ID NO: 704661 - DNA, 20 bp, Artificial
  CRISPR gRNA sequence
cagggtctggctctgtcacc

SEQ ID NO: 704662 - DNA, 20 bp, Artificial
  CRISPR gRNA sequence
agggtctggctctgtcaccc

SEQ ID NO: 704663 - DNA, 20 bp, Artificial
  CRISPR gRNA sequence
tctggctctgtcacccaggc

SEQ ID NO: 704664 - DNA, 20 bp, Artificial
  CRISPR gRNA sequence
tggctctgtcacccaggctg

SEQ ID NO: 704665 - DNA, 20 bp, Artificial
  CRISPR gRNA sequence
ctgtcacccaggctggagtg

SEQ ID NO: 704666 - DNA, 20 bp, Artificial
  CRISPR gRNA sequence
tcacccaggctggagtgcag

SEQ ID NO: 704667 - DNA, 20 bp, Artificial
  CRISPR gRNA sequence
ggagtgcagtagtgtgatct

SEQ ID NO: 704668 - DNA, 20 bp, Artificial
  CRISPR gRNA sequence
ttactgcaacccccgcctcc

SEQ ID NO: 704669 - DNA, 20 bp, Artificial
  CRISPR gRNA sequence
tactgcaacccccgcctcct

SEQ ID NO: 704670 - DNA, 20 bp, Artificial
  CRISPR gRNA sequence
aacccccgcctcctgggttc

SEQ ID NO: 704671 - DNA, 20 bp, Artificial
  CRISPR gRNA sequence
ttcaagcaattctcctgctt

SEQ ID NO: 704672 - DNA, 20 bp, Artificial
  CRISPR gRNA sequence
ttctcctgcttcagcctccc

SEQ ID NO: 704673 - DNA, 20 bp, Artificial
  CRISPR gRNA sequence
tcctgcttcagcctcccaag

SEQ ID NO: 704674 - DNA, 20 bp, Artificial
  CRISPR gRNA sequence
gcttcagcctcccaagtggc

SEQ ID NO: 704675 - DNA, 20 bp, Artificial
  CRISPR gRNA sequence
cttcagcctcccaagtggct

SEQ ID NO: 704676 - DNA, 20 bp, Artificial
  CRISPR gRNA sequence
ctcccaagtggctgggatta

SEQ ID NO: 704677 - DNA, 20 bp, Artificial
  CRISPR gRNA sequence
tcccaagtggctgggattac

SEQ ID NO: 704678 - DNA, 20 bp, Artificial
  CRISPR gRNA sequence
ggcgtgtgccacacaatgcc

SEQ ID NO: 704679 - DNA, 20 bp, Artificial
  CRISPR gRNA sequence
tggctcattttttgtatttt

SEQ ID NO: 704680 - DNA, 20 bp, Artificial
  CRISPR gRNA sequence
ctcattttttgtattttcag

SEQ ID NO: 704681 - DNA, 20 bp, Artificial
  CRISPR gRNA sequence
cattttttgtattttcagta

SEQ ID NO: 704682 - DNA, 20 bp, Artificial
  CRISPR gRNA sequence
ttttgtattttcagtagaga

SEQ ID NO: 704683 - DNA, 20 bp, Artificial
  CRISPR gRNA sequence
ttgtattttcagtagagaca

SEQ ID NO: 704684 - DNA, 20 bp, Artificial
  CRISPR gRNA sequence
gagacagagtttcaccatgt

SEQ ID NO: 704685 - DNA, 20 bp, Artificial
  CRISPR gRNA sequence
cagagtttcaccatgttggc

SEQ ID NO: 704686 - DNA, 20 bp, Artificial
  CRISPR gRNA sequence
agagtttcaccatgttggcc

SEQ ID NO: 704687 - DNA, 20 bp, Artificial
  CRISPR gRNA sequence
tttcaccatgttggccaggc

SEQ ID NO: 704688 - DNA, 20 bp, Artificial
  CRISPR gRNA sequence
ccaggctggtctcgaactcc

SEQ ID NO: 704689 - DNA, 20 bp, Artificial
  CRISPR gRNA sequence
ggtctcgaactcctggcctc

SEQ ID NO: 704690 - DNA, 20 bp, Artificial
  CRISPR gRNA sequence
ctcgaactcctggcctcaag

SEQ ID NO: 704691 - DNA, 20 bp, Artificial
  CRISPR gRNA sequence
ctcaagtggtcctcccgcct

SEQ ID NO: 704692 - DNA, 20 bp, Artificial
  CRISPR gRNA sequence
cctcccgcctcggcctccca

SEQ ID NO: 704693 - DNA, 20 bp, Artificial
  CRISPR gRNA sequence
cgcctcggcctcccaaagtt

SEQ ID NO: 704694 - DNA, 20 bp, Artificial
  CRISPR gRNA sequence
gcctcggcctcccaaagttc

SEQ ID NO: 704695 - DNA, 20 bp, Artificial
  CRISPR gRNA sequence
cctcggcctcccaaagttca

SEQ ID NO: 704696 - DNA, 20 bp, Artificial
  CRISPR gRNA sequence
ctcccaaagttcagggatga

SEQ ID NO: 704697 - DNA, 20 bp, Artificial
  CRISPR gRNA sequence
tcccaaagttcagggatgac

SEQ ID NO: 704698 - DNA, 20 bp, Artificial
  CRISPR gRNA sequence
agttcagggatgacaggcgt

SEQ ID NO: 704699 - DNA, 20 bp, Artificial
  CRISPR gRNA sequence
gcgtgagctgccaccgcgcc

SEQ ID NO: 704700 - DNA, 20 bp, Artificial
  CRISPR gRNA sequence
agctgccaccgcgcccagcc

SEQ ID NO: 704701 - DNA, 20 bp, Artificial
  CRISPR gRNA sequence
cttacatatttatatctgta

SEQ ID NO: 704702 - DNA, 20 bp, Artificial
  CRISPR gRNA sequence
tttatatctgtatggattca

SEQ ID NO: 704703 - DNA, 20 bp, Artificial
  CRISPR gRNA sequence
ttatatctgtatggattcat

SEQ ID NO: 704704 - DNA, 20 bp, Artificial
  CRISPR gRNA sequence
tatatctgtatggattcatg

SEQ ID NO: 704705 - DNA, 20 bp, Artificial
  CRISPR gRNA sequence
tggggccctgttctgttcaa

SEQ ID NO: 704706 - DNA, 20 bp, Artificial
  CRISPR gRNA sequence
ggggccctgttctgttcaat

SEQ ID NO: 704707 - DNA, 20 bp, Artificial
  CRISPR gRNA sequence
cttaccatcattttttattt

SEQ ID NO: 704708 - DNA, 20 bp, Artificial
  CRISPR gRNA sequence
tttttattttggtgctcaaa

SEQ ID NO: 704709 - DNA, 20 bp, Artificial
  CRISPR gRNA sequence
ttttggtgctcaaatggtcc

SEQ ID NO: 704710 - DNA, 20 bp, Artificial
  CRISPR gRNA sequence
gtgctcaaatggtcccagat

SEQ ID NO: 704711 - DNA, 20 bp, Artificial
  CRISPR gRNA sequence
tgctcaaatggtcccagatg

SEQ ID NO: 704712 - DNA, 20 bp, Artificial
  CRISPR gRNA sequence
caaatggtcccagatgaggt

SEQ ID NO: 704713 - DNA, 20 bp, Artificial
  CRISPR gRNA sequence
aaatggtcccagatgaggtc

SEQ ID NO: 704714 - DNA, 20 bp, Artificial
  CRISPR gRNA sequence
aatggtcccagatgaggtca

SEQ ID NO: 704715 - DNA, 20 bp, Artificial
  CRISPR gRNA sequence
tggtcccagatgaggtcagg

SEQ ID NO: 704716 - DNA, 20 bp, Artificial
  CRISPR gRNA sequence
gtcccagatgaggtcaggga

SEQ ID NO: 704717 - DNA, 20 bp, Artificial
  CRISPR gRNA sequence
aggtcagggagagccccttt

SEQ ID NO: 704718 - DNA, 20 bp, Artificial
  CRISPR gRNA sequence
cagggagagcccctttaagc

SEQ ID NO: 704719 - DNA, 20 bp, Artificial
  CRISPR gRNA sequence
aagctggctcttgtgtgctt

SEQ ID NO: 704720 - DNA, 20 bp, Artificial
  CRISPR gRNA sequence
gtatcctcatcctgtgcttt

SEQ ID NO: 704721 - DNA, 20 bp, Artificial
  CRISPR gRNA sequence
ttgagcacgtcccttattct

SEQ ID NO: 704722 - DNA, 20 bp, Artificial
  CRISPR gRNA sequence
cccttattctgagatgttcc

SEQ ID NO: 704723 - DNA, 20 bp, Artificial
  CRISPR gRNA sequence
taacttgtgtgctcctgccc

SEQ ID NO: 704724 - DNA, 20 bp, Artificial
  CRISPR gRNA sequence
gtgtgctcctgccccggccc

SEQ ID NO: 704725 - DNA, 20 bp, Artificial
  CRISPR gRNA sequence
tcctgccccggccctggaat

SEQ ID NO: 704726 - DNA, 20 bp, Artificial
  CRISPR gRNA sequence
ctggaatcagctgcctctcc

SEQ ID NO: 704727 - DNA, 20 bp, Artificial
  CRISPR gRNA sequence
tggaatcagctgcctctcca

SEQ ID NO: 704728 - DNA, 20 bp, Artificial
  CRISPR gRNA sequence
gaatcagctgcctctccaag

SEQ ID NO: 704729 - DNA, 20 bp, Artificial
  CRISPR gRNA sequence
agctgcctctccaaggagcc

SEQ ID NO: 704730 - DNA, 20 bp, Artificial
  CRISPR gRNA sequence
gctgcctctccaaggagccc

SEQ ID NO: 704731 - DNA, 20 bp, Artificial
  CRISPR gRNA sequence
ctgcctctccaaggagcccg

SEQ ID NO: 704732 - DNA, 20 bp, Artificial
  CRISPR gRNA sequence
ggagcccggggtttgcatct

SEQ ID NO: 704733 - DNA, 20 bp, Artificial
  CRISPR gRNA sequence
gagcccggggtttgcatctc

SEQ ID NO: 704734 - DNA, 20 bp, Artificial
  CRISPR gRNA sequence
agcccggggtttgcatctcg

SEQ ID NO: 704735 - DNA, 20 bp, Artificial
  CRISPR gRNA sequence
tctcggggtacctgttgcca

SEQ ID NO: 704736 - DNA, 20 bp, Artificial
  CRISPR gRNA sequence
gggtacctgttgccaaagcc

SEQ ID NO: 704737 - DNA, 20 bp, Artificial
  CRISPR gRNA sequence
tctgtgccaaattcccccct

SEQ ID NO: 704738 - DNA, 20 bp, Artificial
  CRISPR gRNA sequence
ctgtgccaaattcccccctt

SEQ ID NO: 704739 - DNA, 20 bp, Artificial
  CRISPR gRNA sequence
tgggcctgttctgcttccca

SEQ ID NO: 704740 - DNA, 20 bp, Artificial
  CRISPR gRNA sequence
tgttctgcttcccacagcac

SEQ ID NO: 704741 - DNA, 20 bp, Artificial
  CRISPR gRNA sequence
gttctgcttcccacagcact

SEQ ID NO: 704742 - DNA, 20 bp, Artificial
  CRISPR gRNA sequence
ttctgcttcccacagcactg

SEQ ID NO: 704743 - DNA, 20 bp, Artificial
  CRISPR gRNA sequence
cccacagcactggggaatca

SEQ ID NO: 704744 - DNA, 20 bp, Artificial
  CRISPR gRNA sequence
ccacagcactggggaatcac

SEQ ID NO: 704745 - DNA, 20 bp, Artificial
  CRISPR gRNA sequence
agcactggggaatcacaggc

SEQ ID NO: 704746 - DNA, 20 bp, Artificial
  CRISPR gRNA sequence
cactggggaatcacaggcca

SEQ ID NO: 704747 - DNA, 20 bp, Artificial
  CRISPR gRNA sequence
ctggggaatcacaggccaga

SEQ ID NO: 704748 - DNA, 20 bp, Artificial
  CRISPR gRNA sequence
tggggaatcacaggccagag

SEQ ID NO: 704749 - DNA, 20 bp, Artificial
  CRISPR gRNA sequence
ggggaatcacaggccagaga

SEQ ID NO: 704750 - DNA, 20 bp, Artificial
  CRISPR gRNA sequence
gggaatcacaggccagagag

SEQ ID NO: 704751 - DNA, 20 bp, Artificial
  CRISPR gRNA sequence
gaatcacaggccagagaggg

SEQ ID NO: 704752 - DNA, 20 bp, Artificial
  CRISPR gRNA sequence
aatcacaggccagagagggg

SEQ ID NO: 704753 - DNA, 20 bp, Artificial
  CRISPR gRNA sequence
atcacaggccagagagggga

SEQ ID NO: 704754 - DNA, 20 bp, Artificial
  CRISPR gRNA sequence
tcacaggccagagaggggag

SEQ ID NO: 704755 - DNA, 20 bp, Artificial
  CRISPR gRNA sequence
cagagaggggaggggactaa

SEQ ID NO: 704756 - DNA, 20 bp, Artificial
  CRISPR gRNA sequence
agaggggaggggactaaaag

SEQ ID NO: 704757 - DNA, 20 bp, Artificial
  CRISPR gRNA sequence
aggggaggggactaaaagtg

SEQ ID NO: 704758 - DNA, 20 bp, Artificial
  CRISPR gRNA sequence
ggactaaaagtggagaataa

SEQ ID NO: 704759 - DNA, 20 bp, Artificial
  CRISPR gRNA sequence
gactaaaagtggagaataac

SEQ ID NO: 704760 - DNA, 20 bp, Artificial
  CRISPR gRNA sequence
actaaaagtggagaataaca

SEQ ID NO: 704761 - DNA, 20 bp, Artificial
  CRISPR gRNA sequence
aaagtggagaataacaggga

SEQ ID NO: 704762 - DNA, 20 bp, Artificial
  CRISPR gRNA sequence
gtggagaataacagggatgg

SEQ ID NO: 704763 - DNA, 20 bp, Artificial
  CRISPR gRNA sequence
tggagaataacagggatgga

SEQ ID NO: 704764 - DNA, 20 bp, Artificial
  CRISPR gRNA sequence
ggagaataacagggatggaa

SEQ ID NO: 704765 - DNA, 20 bp, Artificial
  CRISPR gRNA sequence
taacagggatggaagggacc

SEQ ID NO: 704766 - DNA, 20 bp, Artificial
  CRISPR gRNA sequence
acagggatggaagggaccga

SEQ ID NO: 704767 - DNA, 20 bp, Artificial
  CRISPR gRNA sequence
gagagctttacatcgcatgt

SEQ ID NO: 704768 - DNA, 20 bp, Artificial
  CRISPR gRNA sequence
tgagaacgcacgtgctccgt

SEQ ID NO: 704769 - DNA, 20 bp, Artificial
  CRISPR gRNA sequence
acgcacgtgctccgtgagcg

SEQ ID NO: 704770 - DNA, 20 bp, Artificial
  CRISPR gRNA sequence
cgcacgtgctccgtgagcgt

SEQ ID NO: 704771 - DNA, 20 bp, Artificial
  CRISPR gRNA sequence
tgctccgtgagcgtgggctt

SEQ ID NO: 704772 - DNA, 20 bp, Artificial
  CRISPR gRNA sequence
ctccgtgagcgtgggcttca

SEQ ID NO: 704773 - DNA, 20 bp, Artificial
  CRISPR gRNA sequence
cgtgagcgtgggcttcagag

SEQ ID NO: 704774 - DNA, 20 bp, Artificial
  CRISPR gRNA sequence
gtgacaccgtgcacttgtgc

SEQ ID NO: 704775 - DNA, 20 bp, Artificial
  CRISPR gRNA sequence
tgacaccgtgcacttgtgca

SEQ ID NO: 704776 - DNA, 20 bp, Artificial
  CRISPR gRNA sequence
gacaccgtgcacttgtgcaa

SEQ ID NO: 704777 - DNA, 20 bp, Artificial
  CRISPR gRNA sequence
acaccgtgcacttgtgcaag

SEQ ID NO: 704778 - DNA, 20 bp, Artificial
  CRISPR gRNA sequence
caccgtgcacttgtgcaagg

SEQ ID NO: 704779 - DNA, 20 bp, Artificial
  CRISPR gRNA sequence
caagggggcctgctgctgcc

SEQ ID NO: 704780 - DNA, 20 bp, Artificial
  CRISPR gRNA sequence
gggcctgctgctgcccagca

SEQ ID NO: 704781 - DNA, 20 bp, Artificial
  CRISPR gRNA sequence
gctgctgcccagcatggtcc

SEQ ID NO: 704782 - DNA, 20 bp, Artificial
  CRISPR gRNA sequence
tggtcctggacttgtgtccc

SEQ ID NO: 704783 - DNA, 20 bp, Artificial
  CRISPR gRNA sequence
ggtcctggacttgtgtccct

SEQ ID NO: 704784 - DNA, 20 bp, Artificial
  CRISPR gRNA sequence
gtcctggacttgtgtccctg

SEQ ID NO: 704785 - DNA, 20 bp, Artificial
  CRISPR gRNA sequence
tcctggacttgtgtccctgg

SEQ ID NO: 704786 - DNA, 20 bp, Artificial
  CRISPR gRNA sequence
acttgtgtccctgggggtac

SEQ ID NO: 704787 - DNA, 20 bp, Artificial
  CRISPR gRNA sequence
gtgtccctgggggtaccaga

SEQ ID NO: 704788 - DNA, 20 bp, Artificial
  CRISPR gRNA sequence
tgtccctgggggtaccagac

SEQ ID NO: 704789 - DNA, 20 bp, Artificial
  CRISPR gRNA sequence
ggggtaccagacaggcttac

SEQ ID NO: 704790 - DNA, 20 bp, Artificial
  CRISPR gRNA sequence
gtaccagacaggcttacaag

SEQ ID NO: 704791 - DNA, 20 bp, Artificial
  CRISPR gRNA sequence
cagacaggcttacaagaaga

SEQ ID NO: 704792 - DNA, 20 bp, Artificial
  CRISPR gRNA sequence
acaggcttacaagaagacag

SEQ ID NO: 704793 - DNA, 20 bp, Artificial
  CRISPR gRNA sequence
gaagacagtggttattccaa

SEQ ID NO: 704794 - DNA, 20 bp, Artificial
  CRISPR gRNA sequence
aagacagtggttattccaaa

SEQ ID NO: 704795 - DNA, 20 bp, Artificial
  CRISPR gRNA sequence
cagtggttattccaaaaggc

SEQ ID NO: 704796 - DNA, 20 bp, Artificial
  CRISPR gRNA sequence
agtggttattccaaaaggca

SEQ ID NO: 704797 - DNA, 20 bp, Artificial
  CRISPR gRNA sequence
aggcaaggaaaccaacaaat

SEQ ID NO: 704798 - DNA, 20 bp, Artificial
  CRISPR gRNA sequence
aggaaaccaacaaataagac

SEQ ID NO: 704799 - DNA, 20 bp, Artificial
  CRISPR gRNA sequence
aaaccaacaaataagactag

SEQ ID NO: 704800 - DNA, 20 bp, Artificial
  CRISPR gRNA sequence
caacaaataagactagcaga

SEQ ID NO: 704801 - DNA, 20 bp, Artificial
  CRISPR gRNA sequence
gcagatagaatcaacatttt

SEQ ID NO: 704802 - DNA, 20 bp, Artificial
  CRISPR gRNA sequence
cagatagaatcaacattttt

SEQ ID NO: 704803 - DNA, 20 bp, Artificial
  CRISPR gRNA sequence
agatagaatcaacattttta

SEQ ID NO: 704804 - DNA, 20 bp, Artificial
  CRISPR gRNA sequence
gatagaatcaacatttttag

SEQ ID NO: 704805 - DNA, 20 bp, Artificial
  CRISPR gRNA sequence
agaatcaacatttttagggg

SEQ ID NO: 704806 - DNA, 20 bp, Artificial
  CRISPR gRNA sequence
aatcaacatttttaggggaa

SEQ ID NO: 704807 - DNA, 20 bp, Artificial
  CRISPR gRNA sequence
caacatttttaggggaagag

SEQ ID NO: 704808 - DNA, 20 bp, Artificial
  CRISPR gRNA sequence
tgaaatctgacctctgtact

SEQ ID NO: 704809 - DNA, 20 bp, Artificial
  CRISPR gRNA sequence
atctgacctctgtacttggc

SEQ ID NO: 704810 - DNA, 20 bp, Artificial
  CRISPR gRNA sequence
gtacttggcaagatttgttc

SEQ ID NO: 704811 - DNA, 20 bp, Artificial
  CRISPR gRNA sequence
tacttggcaagatttgttct

SEQ ID NO: 704812 - DNA, 20 bp, Artificial
  CRISPR gRNA sequence
ggtctttatcaaaatcctca

SEQ ID NO: 704813 - DNA, 20 bp, Artificial
  CRISPR gRNA sequence
gtctttatcaaaatcctcat

SEQ ID NO: 704814 - DNA, 20 bp, Artificial
  CRISPR gRNA sequence
aatcctcatgggttgtaaca

SEQ ID NO: 704815 - DNA, 20 bp, Artificial
  CRISPR gRNA sequence
aacacggctcttgtcaatgt

SEQ ID NO: 704816 - DNA, 20 bp, Artificial
  CRISPR gRNA sequence
cacggctcttgtcaatgtca

SEQ ID NO: 704817 - DNA, 20 bp, Artificial
  CRISPR gRNA sequence
ttgtcaatgtcagagccttc

SEQ ID NO: 704818 - DNA, 20 bp, Artificial
  CRISPR gRNA sequence
tctgtgattttacacttgtt

SEQ ID NO: 704819 - DNA, 20 bp, Artificial
  CRISPR gRNA sequence
ctgtgattttacacttgttt

SEQ ID NO: 704820 - DNA, 20 bp, Artificial
  CRISPR gRNA sequence
gtgattttacacttgtttgg

SEQ ID NO: 704821 - DNA, 20 bp, Artificial
  CRISPR gRNA sequence
gattttacacttgtttggga

SEQ ID NO: 704822 - DNA, 20 bp, Artificial
  CRISPR gRNA sequence
ttacacttgtttgggagagt

SEQ ID NO: 704823 - DNA, 20 bp, Artificial
  CRISPR gRNA sequence
ttgaactctgactttccatt

SEQ ID NO: 704824 - DNA, 20 bp, Artificial
  CRISPR gRNA sequence
tgactttccattcagtgtga

SEQ ID NO: 704825 - DNA, 20 bp, Artificial
  CRISPR gRNA sequence
actttccattcagtgtgacg

SEQ ID NO: 704826 - DNA, 20 bp, Artificial
  CRISPR gRNA sequence
ccattcagtgtgacggagtg

SEQ ID NO: 704827 - DNA, 20 bp, Artificial
  CRISPR gRNA sequence
attcagtgtgacggagtgca

SEQ ID NO: 704828 - DNA, 20 bp, Artificial
  CRISPR gRNA sequence
agccatgttacttaccatcc

SEQ ID NO: 704829 - DNA, 20 bp, Artificial
  CRISPR gRNA sequence
gccatgttacttaccatcct

SEQ ID NO: 704830 - DNA, 20 bp, Artificial
  CRISPR gRNA sequence
tgaacctgctgtgtgctcaa

SEQ ID NO: 704831 - DNA, 20 bp, Artificial
  CRISPR gRNA sequence
ctgtgtgctcaacagcatcc

SEQ ID NO: 704832 - DNA, 20 bp, Artificial
  CRISPR gRNA sequence
tggacaccttctttttaaaa

SEQ ID NO: 704833 - DNA, 20 bp, Artificial
  CRISPR gRNA sequence
gtttaatttttaaaaattct

SEQ ID NO: 704834 - DNA, 20 bp, Artificial
  CRISPR gRNA sequence
taatttttaaaaattctaag

SEQ ID NO: 704835 - DNA, 20 bp, Artificial
  CRISPR gRNA sequence
aatttttaaaaattctaagt

SEQ ID NO: 704836 - DNA, 20 bp, Artificial
  CRISPR gRNA sequence
tttaaaaattctaagtaggc

SEQ ID NO: 704837 - DNA, 20 bp, Artificial
  CRISPR gRNA sequence
ttaaaaattctaagtaggcc

SEQ ID NO: 704838 - DNA, 20 bp, Artificial
  CRISPR gRNA sequence
aattctaagtaggccaggtg

SEQ ID NO: 704839 - DNA, 20 bp, Artificial
  CRISPR gRNA sequence
tctaagtaggccaggtgtag

SEQ ID NO: 704840 - DNA, 20 bp, Artificial
  CRISPR gRNA sequence
gtggctcacacctgtaatcc

SEQ ID NO: 704841 - DNA, 20 bp, Artificial
  CRISPR gRNA sequence
cacctgtaatcccagcactt

SEQ ID NO: 704842 - DNA, 20 bp, Artificial
  CRISPR gRNA sequence
acctgtaatcccagcacttt

SEQ ID NO: 704843 - DNA, 20 bp, Artificial
  CRISPR gRNA sequence
ctgtaatcccagcactttgg

SEQ ID NO: 704844 - DNA, 20 bp, Artificial
  CRISPR gRNA sequence
tgtaatcccagcactttggg

SEQ ID NO: 704845 - DNA, 20 bp, Artificial
  CRISPR gRNA sequence
tcccagcactttgggaggcc

SEQ ID NO: 704846 - DNA, 20 bp, Artificial
  CRISPR gRNA sequence
cccagcactttgggaggcca

SEQ ID NO: 704847 - DNA, 20 bp, Artificial
  CRISPR gRNA sequence
agcactttgggaggccaagg

SEQ ID NO: 704848 - DNA, 20 bp, Artificial
  CRISPR gRNA sequence
gcactttgggaggccaaggt

SEQ ID NO: 704849 - DNA, 20 bp, Artificial
  CRISPR gRNA sequence
ctttgggaggccaaggtggg

SEQ ID NO: 704850 - DNA, 20 bp, Artificial
  CRISPR gRNA sequence
ccaaggtgggtggatcacct

SEQ ID NO: 704851 - DNA, 20 bp, Artificial
  CRISPR gRNA sequence
caaggtgggtggatcacctg

SEQ ID NO: 704852 - DNA, 20 bp, Artificial
  CRISPR gRNA sequence
tgggtggatcacctgaggtc

SEQ ID NO: 704853 - DNA, 20 bp, Artificial
  CRISPR gRNA sequence
ggtggatcacctgaggtcga

SEQ ID NO: 704854 - DNA, 20 bp, Artificial
  CRISPR gRNA sequence
tcacctgaggtcgagagttc

SEQ ID NO: 704855 - DNA, 20 bp, Artificial
  CRISPR gRNA sequence
tgaggtcgagagttcaagac

SEQ ID NO: 704856 - DNA, 20 bp, Artificial
  CRISPR gRNA sequence
tcgagagttcaagaccagcc

SEQ ID NO: 704857 - DNA, 20 bp, Artificial
  CRISPR gRNA sequence
tcaagaccagcctggccaac

SEQ ID NO: 704858 - DNA, 20 bp, Artificial
  CRISPR gRNA sequence
tctactaaaaataaaaaaat

SEQ ID NO: 704859 - DNA, 20 bp, Artificial
  CRISPR gRNA sequence
ctaaaaataaaaaaattagc

SEQ ID NO: 704860 - DNA, 20 bp, Artificial
  CRISPR gRNA sequence
taaaaataaaaaaattagcc

SEQ ID NO: 704861 - DNA, 20 bp, Artificial
  CRISPR gRNA sequence
ataaaaaaattagccaggca

SEQ ID NO: 704862 - DNA, 20 bp, Artificial
  CRISPR gRNA sequence
aaaaaattagccaggcatgg

SEQ ID NO: 704863 - DNA, 20 bp, Artificial
  CRISPR gRNA sequence
gtggcacacacctgtaatcc

SEQ ID NO: 704864 - DNA, 20 bp, Artificial
  CRISPR gRNA sequence
cacctgtaatcccagctact

SEQ ID NO: 704865 - DNA, 20 bp, Artificial
  CRISPR gRNA sequence
acctgtaatcccagctactc

SEQ ID NO: 704866 - DNA, 20 bp, Artificial
  CRISPR gRNA sequence
ctgtaatcccagctactcgg

SEQ ID NO: 704867 - DNA, 20 bp, Artificial
  CRISPR gRNA sequence
tgtaatcccagctactcggg

SEQ ID NO: 704868 - DNA, 20 bp, Artificial
  CRISPR gRNA sequence
tcccagctactcgggaggct

SEQ ID NO: 704869 - DNA, 20 bp, Artificial
  CRISPR gRNA sequence
cccagctactcgggaggctg

SEQ ID NO: 704870 - DNA, 20 bp, Artificial
  CRISPR gRNA sequence
agctactcgggaggctgagg

SEQ ID NO: 704871 - DNA, 20 bp, Artificial
  CRISPR gRNA sequence
gctactcgggaggctgaggc

SEQ ID NO: 704872 - DNA, 20 bp, Artificial
  CRISPR gRNA sequence
tactcgggaggctgaggcag

SEQ ID NO: 704873 - DNA, 20 bp, Artificial
  CRISPR gRNA sequence
gcaggagaatttcttgaacc

SEQ ID NO: 704874 - DNA, 20 bp, Artificial
  CRISPR gRNA sequence
caggagaatttcttgaacct

SEQ ID NO: 704875 - DNA, 20 bp, Artificial
  CRISPR gRNA sequence
ggagaatttcttgaacctgg

SEQ ID NO: 704876 - DNA, 20 bp, Artificial
  CRISPR gRNA sequence
gagaatttcttgaacctggg

SEQ ID NO: 704877 - DNA, 20 bp, Artificial
  CRISPR gRNA sequence
aatttcttgaacctgggagg

SEQ ID NO: 704878 - DNA, 20 bp, Artificial
  CRISPR gRNA sequence
tttcttgaacctgggaggtg

SEQ ID NO: 704879 - DNA, 20 bp, Artificial
  CRISPR gRNA sequence
ttcttgaacctgggaggtgg

SEQ ID NO: 704880 - DNA, 20 bp, Artificial
  CRISPR gRNA sequence
aacctgggaggtggaggttg

SEQ ID NO: 704881 - DNA, 20 bp, Artificial
  CRISPR gRNA sequence
tgggaggtggaggttgcagt

SEQ ID NO: 704882 - DNA, 20 bp, Artificial
  CRISPR gRNA sequence
ggtggaggttgcagtgagct

SEQ ID NO: 704883 - DNA, 20 bp, Artificial
  CRISPR gRNA sequence
gagattgcaccactgcactc

SEQ ID NO: 704884 - DNA, 20 bp, Artificial
  CRISPR gRNA sequence
agattgcaccactgcactcc

SEQ ID NO: 704885 - DNA, 20 bp, Artificial
  CRISPR gRNA sequence
gcaccactgcactccaggct

SEQ ID NO: 704886 - DNA, 20 bp, Artificial
  CRISPR gRNA sequence
ctgcactccaggctgagcaa

SEQ ID NO: 704887 - DNA, 20 bp, Artificial
  CRISPR gRNA sequence
gcactccaggctgagcaaca

SEQ ID NO: 704888 - DNA, 20 bp, Artificial
  CRISPR gRNA sequence
tccaggctgagcaacagagc

SEQ ID NO: 704889 - DNA, 20 bp, Artificial
  CRISPR gRNA sequence
aacaaacaaaaaaacattct

SEQ ID NO: 704890 - DNA, 20 bp, Artificial
  CRISPR gRNA sequence
aaacaaaaaaacattctaag

SEQ ID NO: 704891 - DNA, 20 bp, Artificial
  CRISPR gRNA sequence
tctaagtggccttcattttt

SEQ ID NO: 704892 - DNA, 20 bp, Artificial
  CRISPR gRNA sequence
ttgttttttgttttttgttt

SEQ ID NO: 704893 - DNA, 20 bp, Artificial
  CRISPR gRNA sequence
gttttttgttttttgttttg

SEQ ID NO: 704894 - DNA, 20 bp, Artificial
  CRISPR gRNA sequence
tttgttttttgttttggaga

SEQ ID NO: 704895 - DNA, 20 bp, Artificial
  CRISPR gRNA sequence
ttgttttttgttttggagac

SEQ ID NO: 704896 - DNA, 20 bp, Artificial
  CRISPR gRNA sequence
tgttttttgttttggagaca

SEQ ID NO: 704897 - DNA, 20 bp, Artificial
  CRISPR gRNA sequence
ttggagacagggtgtcactc

SEQ ID NO: 704898 - DNA, 20 bp, Artificial
  CRISPR gRNA sequence
ggagacagggtgtcactctg

SEQ ID NO: 704899 - DNA, 20 bp, Artificial
  CRISPR gRNA sequence
ggtgtcactctggagtgcca

SEQ ID NO: 704900 - DNA, 20 bp, Artificial
  CRISPR gRNA sequence
ggagtgccatggtacaatca

SEQ ID NO: 704901 - DNA, 20 bp, Artificial
  CRISPR gRNA sequence
ggtacaatcatggctcactg

SEQ ID NO: 704902 - DNA, 20 bp, Artificial
  CRISPR gRNA sequence
tcactgcagccttgacctcc

SEQ ID NO: 704903 - DNA, 20 bp, Artificial
  CRISPR gRNA sequence
cactgcagccttgacctcct

SEQ ID NO: 704904 - DNA, 20 bp, Artificial
  CRISPR gRNA sequence
agccttgacctcctgggttc

SEQ ID NO: 704905 - DNA, 20 bp, Artificial
  CRISPR gRNA sequence
cctgggttcaagtgatccct

SEQ ID NO: 704906 - DNA, 20 bp, Artificial
  CRISPR gRNA sequence
aagtgatccctcagcctccc

SEQ ID NO: 704907 - DNA, 20 bp, Artificial
  CRISPR gRNA sequence
tgatccctcagcctccccag

SEQ ID NO: 704908 - DNA, 20 bp, Artificial
  CRISPR gRNA sequence
ccctcagcctccccagtagc

SEQ ID NO: 704909 - DNA, 20 bp, Artificial
  CRISPR gRNA sequence
cctcagcctccccagtagct

SEQ ID NO: 704910 - DNA, 20 bp, Artificial
  CRISPR gRNA sequence
ctccccagtagctgggacta

SEQ ID NO: 704911 - DNA, 20 bp, Artificial
  CRISPR gRNA sequence
cagatacacaccaccacgcc

SEQ ID NO: 704912 - DNA, 20 bp, Artificial
  CRISPR gRNA sequence
gctaacttttctattttttg

SEQ ID NO: 704913 - DNA, 20 bp, Artificial
  CRISPR gRNA sequence
taacttttctattttttgta

SEQ ID NO: 704914 - DNA, 20 bp, Artificial
  CRISPR gRNA sequence
tttctattttttgtagagac

SEQ ID NO: 704915 - DNA, 20 bp, Artificial
  CRISPR gRNA sequence
ttctattttttgtagagacc

SEQ ID NO: 704916 - DNA, 20 bp, Artificial
  CRISPR gRNA sequence
ccaggtctccctttgttgtg

SEQ ID NO: 704917 - DNA, 20 bp, Artificial
  CRISPR gRNA sequence
caggtctccctttgttgtgc

SEQ ID NO: 704918 - DNA, 20 bp, Artificial
  CRISPR gRNA sequence
tctccctttgttgtgcaggc

SEQ ID NO: 704919 - DNA, 20 bp, Artificial
  CRISPR gRNA sequence
caggctggtctctaactcct

SEQ ID NO: 704920 - DNA, 20 bp, Artificial
  CRISPR gRNA sequence
ggtctctaactcctgagctc

SEQ ID NO: 704921 - DNA, 20 bp, Artificial
  CRISPR gRNA sequence
ctcaagtgatctgcccacct

SEQ ID NO: 704922 - DNA, 20 bp, Artificial
  CRISPR gRNA sequence
ctgcccacctcggcctccca

SEQ ID NO: 704923 - DNA, 20 bp, Artificial
  CRISPR gRNA sequence
cctcggcctcccaaagtgct

SEQ ID NO: 704924 - DNA, 20 bp, Artificial
  CRISPR gRNA sequence
ctcccaaagtgcttggatta

SEQ ID NO: 704925 - DNA, 20 bp, Artificial
  CRISPR gRNA sequence
tcccaaagtgcttggattat

SEQ ID NO: 704926 - DNA, 20 bp, Artificial
  CRISPR gRNA sequence
aaagtgcttggattataggc

SEQ ID NO: 704927 - DNA, 20 bp, Artificial
  CRISPR gRNA sequence
agtgcttggattataggcga

SEQ ID NO: 704928 - DNA, 20 bp, Artificial
  CRISPR gRNA sequence
taggcgagagccactgtgcc

SEQ ID NO: 704929 - DNA, 20 bp, Artificial
  CRISPR gRNA sequence
cgagagccactgtgcccagc

SEQ ID NO: 704930 - DNA, 20 bp, Artificial
  CRISPR gRNA sequence
ctagtcctcatttttttttt

SEQ ID NO: 704931 - DNA, 20 bp, Artificial
  CRISPR gRNA sequence
tagtcctcattttttttttg

SEQ ID NO: 704932 - DNA, 20 bp, Artificial
  CRISPR gRNA sequence
tcctcattttttttttgagg

SEQ ID NO: 704933 - DNA, 20 bp, Artificial
  CRISPR gRNA sequence
ctcattttttttttgaggca

SEQ ID NO: 704934 - DNA, 20 bp, Artificial
  CRISPR gRNA sequence
cagagtctcgctctgttgcc

SEQ ID NO: 704935 - DNA, 20 bp, Artificial
  CRISPR gRNA sequence
agagtctcgctctgttgccc

SEQ ID NO: 704936 - DNA, 20 bp, Artificial
  CRISPR gRNA sequence
tctcgctctgttgcccaggt

SEQ ID NO: 704937 - DNA, 20 bp, Artificial
  CRISPR gRNA sequence
tcgctctgttgcccaggttg

SEQ ID NO: 704938 - DNA, 20 bp, Artificial
  CRISPR gRNA sequence
ttgcccaggttggagtgcaa

SEQ ID NO: 704939 - DNA, 20 bp, Artificial
  CRISPR gRNA sequence
ggagtgcaatggcgcaatct

SEQ ID NO: 704940 - DNA, 20 bp, Artificial
  CRISPR gRNA sequence
tcactgcaacctctgcttcc

SEQ ID NO: 704941 - DNA, 20 bp, Artificial
  CRISPR gRNA sequence
cactgcaacctctgcttccc

SEQ ID NO: 704942 - DNA, 20 bp, Artificial
  CRISPR gRNA sequence
aacctctgcttcccgggttc

SEQ ID NO: 704943 - DNA, 20 bp, Artificial
  CRISPR gRNA sequence
ttccagcaattctcctgcct

SEQ ID NO: 704944 - DNA, 20 bp, Artificial
  CRISPR gRNA sequence
ttctcctgcctcagcctccc

SEQ ID NO: 704945 - DNA, 20 bp, Artificial
  CRISPR gRNA sequence
tcctgcctcagcctcccgag

SEQ ID NO: 704946 - DNA, 20 bp, Artificial
  CRISPR gRNA sequence
gcctcagcctcccgagtagc

SEQ ID NO: 704947 - DNA, 20 bp, Artificial
  CRISPR gRNA sequence
cctcagcctcccgagtagct

SEQ ID NO: 704948 - DNA, 20 bp, Artificial
  CRISPR gRNA sequence
ctcccgagtagctgggatta

SEQ ID NO: 704949 - DNA, 20 bp, Artificial
  CRISPR gRNA sequence
tcccgagtagctgggattat

SEQ ID NO: 704950 - DNA, 20 bp, Artificial
  CRISPR gRNA sequence
taggcgcgcgccaccatgcc

SEQ ID NO: 704951 - DNA, 20 bp, Artificial
  CRISPR gRNA sequence
ccagctaatttttgtatttt

SEQ ID NO: 704952 - DNA, 20 bp, Artificial
  CRISPR gRNA sequence
gctaatttttgtatttttag

SEQ ID NO: 704953 - DNA, 20 bp, Artificial
  CRISPR gRNA sequence
taatttttgtatttttagta

SEQ ID NO: 704954 - DNA, 20 bp, Artificial
  CRISPR gRNA sequence
ttttgtatttttagtagaga

SEQ ID NO: 704955 - DNA, 20 bp, Artificial
  CRISPR gRNA sequence
tttgtatttttagtagagat

SEQ ID NO: 704956 - DNA, 20 bp, Artificial
  CRISPR gRNA sequence
ttgtatttttagtagagatg

SEQ ID NO: 704957 - DNA, 20 bp, Artificial
  CRISPR gRNA sequence
tagtagagatggggtttcac

SEQ ID NO: 704958 - DNA, 20 bp, Artificial
  CRISPR gRNA sequence
agtagagatggggtttcacc

SEQ ID NO: 704959 - DNA, 20 bp, Artificial
  CRISPR gRNA sequence
gagatggggtttcaccaggt

SEQ ID NO: 704960 - DNA, 20 bp, Artificial
  CRISPR gRNA sequence
tggggtttcaccaggttggc

SEQ ID NO: 704961 - DNA, 20 bp, Artificial
  CRISPR gRNA sequence
ggggtttcaccaggttggcc

SEQ ID NO: 704962 - DNA, 20 bp, Artificial
  CRISPR gRNA sequence
tttcaccaggttggccaggc

SEQ ID NO: 704963 - DNA, 20 bp, Artificial
  CRISPR gRNA sequence
ccaggttggccaggctggtc

SEQ ID NO: 704964 - DNA, 20 bp, Artificial
  CRISPR gRNA sequence
ccaggctggtctggaactcc

SEQ ID NO: 704965 - DNA, 20 bp, Artificial
  CRISPR gRNA sequence
gcatcgtgatttgcccacct

SEQ ID NO: 704966 - DNA, 20 bp, Artificial
  CRISPR gRNA sequence
acctcagcctcccaaaatac

SEQ ID NO: 704967 - DNA, 20 bp, Artificial
  CRISPR gRNA sequence
cctcagcctcccaaaatact

SEQ ID NO: 704968 - DNA, 20 bp, Artificial
  CRISPR gRNA sequence
ctcccaaaatactgggatta

SEQ ID NO: 704969 - DNA, 20 bp, Artificial
  CRISPR gRNA sequence
tcccaaaatactgggattac

SEQ ID NO: 704970 - DNA, 20 bp, Artificial
  CRISPR gRNA sequence
aatactgggattacaggcat

SEQ ID NO: 704971 - DNA, 20 bp, Artificial
  CRISPR gRNA sequence
caggcatgagccaccacgcc

SEQ ID NO: 704972 - DNA, 20 bp, Artificial
  CRISPR gRNA sequence
cccagtctcatttttaaaaa

SEQ ID NO: 704973 - DNA, 20 bp, Artificial
  CRISPR gRNA sequence
ctcatttttaaaaatagttt

SEQ ID NO: 704974 - DNA, 20 bp, Artificial
  CRISPR gRNA sequence
taaaaatagttttagatgta

SEQ ID NO: 704975 - DNA, 20 bp, Artificial
  CRISPR gRNA sequence
gttttagatgtacagaaaat

SEQ ID NO: 704976 - DNA, 20 bp, Artificial
  CRISPR gRNA sequence
tttagatgtacagaaaattg

SEQ ID NO: 704977 - DNA, 20 bp, Artificial
  CRISPR gRNA sequence
agatgtacagaaaattggag

SEQ ID NO: 704978 - DNA, 20 bp, Artificial
  CRISPR gRNA sequence
gtacagaaaattggagaaga

SEQ ID NO: 704979 - DNA, 20 bp, Artificial
  CRISPR gRNA sequence
gaaaattggagaagacagca

SEQ ID NO: 704980 - DNA, 20 bp, Artificial
  CRISPR gRNA sequence
aaaattggagaagacagcac

SEQ ID NO: 704981 - DNA, 20 bp, Artificial
  CRISPR gRNA sequence
aattggagaagacagcacag

SEQ ID NO: 704982 - DNA, 20 bp, Artificial
  CRISPR gRNA sequence
gttcccacatgccccacacc

SEQ ID NO: 704983 - DNA, 20 bp, Artificial
  CRISPR gRNA sequence
cacccagtttcctctgtgat

SEQ ID NO: 704984 - DNA, 20 bp, Artificial
  CRISPR gRNA sequence
tcctctgtgattagcatctt

SEQ ID NO: 704985 - DNA, 20 bp, Artificial
  CRISPR gRNA sequence
ctgtgattagcatcttaagc

SEQ ID NO: 704986 - DNA, 20 bp, Artificial
  CRISPR gRNA sequence
tatgtgaaccattattgaca

SEQ ID NO: 704987 - DNA, 20 bp, Artificial
  CRISPR gRNA sequence
atgtgaaccattattgacac

SEQ ID NO: 704988 - DNA, 20 bp, Artificial
  CRISPR gRNA sequence
tgacacaggattacaaacga

SEQ ID NO: 704989 - DNA, 20 bp, Artificial
  CRISPR gRNA sequence
acgaaagcccacactgtgtt

SEQ ID NO: 704990 - DNA, 20 bp, Artificial
  CRISPR gRNA sequence
cgaaagcccacactgtgttc

SEQ ID NO: 704991 - DNA, 20 bp, Artificial
  CRISPR gRNA sequence
gaaagcccacactgtgttca

SEQ ID NO: 704992 - DNA, 20 bp, Artificial
  CRISPR gRNA sequence
agggttcccttgcattgcct

SEQ ID NO: 704993 - DNA, 20 bp, Artificial
  CRISPR gRNA sequence
gggttcccttgcattgccta

SEQ ID NO: 704994 - DNA, 20 bp, Artificial
  CRISPR gRNA sequence
ccttgcattgcctaaggttc

SEQ ID NO: 704995 - DNA, 20 bp, Artificial
  CRISPR gRNA sequence
cttgcattgcctaaggttcc

SEQ ID NO: 704996 - DNA, 20 bp, Artificial
  CRISPR gRNA sequence
taaggttccaggatcccatc

SEQ ID NO: 704997 - DNA, 20 bp, Artificial
  CRISPR gRNA sequence
aaggttccaggatcccatcc

SEQ ID NO: 704998 - DNA, 20 bp, Artificial
  CRISPR gRNA sequence
ggttccaggatcccatccag

SEQ ID NO: 704999 - DNA, 20 bp, Artificial
  CRISPR gRNA sequence
tccaggagccacgtcacatt

SEQ ID NO: 705000 - DNA, 20 bp, Artificial
  CRISPR gRNA sequence
attcagtcatcatgtcgcct

SEQ ID NO: 705001 - DNA, 20 bp, Artificial
  CRISPR gRNA sequence
ttcagtcatcatgtcgcctt

SEQ ID NO: 705002 - DNA, 20 bp, Artificial
  CRISPR gRNA sequence
catgtcgccttaggctactc

SEQ ID NO: 705003 - DNA, 20 bp, Artificial
  CRISPR gRNA sequence
ccttaggctactctggcctg

SEQ ID NO: 705004 - DNA, 20 bp, Artificial
  CRISPR gRNA sequence
tctggcctgtggccgtttct

SEQ ID NO: 705005 - DNA, 20 bp, Artificial
  CRISPR gRNA sequence
tttctcagatcttgtttctc

SEQ ID NO: 705006 - DNA, 20 bp, Artificial
  CRISPR gRNA sequence
cagatcttgtttctcaagac

SEQ ID NO: 705007 - DNA, 20 bp, Artificial
  CRISPR gRNA sequence
ctcaagaccagtttccctga

SEQ ID NO: 705008 - DNA, 20 bp, Artificial
  CRISPR gRNA sequence
accagtttccctgatggcct

SEQ ID NO: 705009 - DNA, 20 bp, Artificial
  CRISPR gRNA sequence
agtttccctgatggccttgg

SEQ ID NO: 705010 - DNA, 20 bp, Artificial
  CRISPR gRNA sequence
tgatggccttggcagttttt

SEQ ID NO: 705011 - DNA, 20 bp, Artificial
  CRISPR gRNA sequence
ggcagtttttgagtattgat

SEQ ID NO: 705012 - DNA, 20 bp, Artificial
  CRISPR gRNA sequence
gcagtttttgagtattgatc

SEQ ID NO: 705013 - DNA, 20 bp, Artificial
  CRISPR gRNA sequence
agtattgatcaggtgttttg

SEQ ID NO: 705014 - DNA, 20 bp, Artificial
  CRISPR gRNA sequence
gtattgatcaggtgttttgc

SEQ ID NO: 705015 - DNA, 20 bp, Artificial
  CRISPR gRNA sequence
tttgcgggacgcctgtctcc

SEQ ID NO: 705016 - DNA, 20 bp, Artificial
  CRISPR gRNA sequence
ttgcgggacgcctgtctcct

SEQ ID NO: 705017 - DNA, 20 bp, Artificial
  CRISPR gRNA sequence
tctgatgtcttccccatgat

SEQ ID NO: 705018 - DNA, 20 bp, Artificial
  CRISPR gRNA sequence
tgtcttccccatgattagac

SEQ ID NO: 705019 - DNA, 20 bp, Artificial
  CRISPR gRNA sequence
tcttccccatgattagactg

SEQ ID NO: 705020 - DNA, 20 bp, Artificial
  CRISPR gRNA sequence
attagactggagttatgcat

SEQ ID NO: 705021 - DNA, 20 bp, Artificial
  CRISPR gRNA sequence
ttagactggagttatgcatt

SEQ ID NO: 705022 - DNA, 20 bp, Artificial
  CRISPR gRNA sequence
tagactggagttatgcattg

SEQ ID NO: 705023 - DNA, 20 bp, Artificial
  CRISPR gRNA sequence
agactggagttatgcattgg

SEQ ID NO: 705024 - DNA, 20 bp, Artificial
  CRISPR gRNA sequence
ctggagttatgcattggggg

SEQ ID NO: 705025 - DNA, 20 bp, Artificial
  CRISPR gRNA sequence
gagttatgcattgggggaag

SEQ ID NO: 705026 - DNA, 20 bp, Artificial
  CRISPR gRNA sequence
gcattgggggaagaagacca

SEQ ID NO: 705027 - DNA, 20 bp, Artificial
  CRISPR gRNA sequence
attgggggaagaagaccaca

SEQ ID NO: 705028 - DNA, 20 bp, Artificial
  CRISPR gRNA sequence
ttgggggaagaagaccacag

SEQ ID NO: 705029 - DNA, 20 bp, Artificial
  CRISPR gRNA sequence
atgctcatcacatcaaatct

SEQ ID NO: 705030 - DNA, 20 bp, Artificial
  CRISPR gRNA sequence
tcatcacatcaaatcttggc

SEQ ID NO: 705031 - DNA, 20 bp, Artificial
  CRISPR gRNA sequence
catcacatcaaatcttggct

SEQ ID NO: 705032 - DNA, 20 bp, Artificial
  CRISPR gRNA sequence
catcaaatcttggctgggcg

SEQ ID NO: 705033 - DNA, 20 bp, Artificial
  CRISPR gRNA sequence
caaatcttggctgggcgcag

SEQ ID NO: 705034 - DNA, 20 bp, Artificial
  CRISPR gRNA sequence
gtagctcatgcctgtaatcc

SEQ ID NO: 705035 - DNA, 20 bp, Artificial
  CRISPR gRNA sequence
tgcctgtaatcccagcactt

SEQ ID NO: 705036 - DNA, 20 bp, Artificial
  CRISPR gRNA sequence
gcctgtaatcccagcacttt

SEQ ID NO: 705037 - DNA, 20 bp, Artificial
  CRISPR gRNA sequence
ctgtaatcccagcactttgg

SEQ ID NO: 705038 - DNA, 20 bp, Artificial
  CRISPR gRNA sequence
tgtaatcccagcactttggg

SEQ ID NO: 705039 - DNA, 20 bp, Artificial
  CRISPR gRNA sequence
tcccagcactttgggaggcc

SEQ ID NO: 705040 - DNA, 20 bp, Artificial
  CRISPR gRNA sequence
gcactttgggaggccaagcc

SEQ ID NO: 705041 - DNA, 20 bp, Artificial
  CRISPR gRNA sequence
ctttgggaggccaagcctgg

SEQ ID NO: 705042 - DNA, 20 bp, Artificial
  CRISPR gRNA sequence
ccaagcctggcagatcacct

SEQ ID NO: 705043 - DNA, 20 bp, Artificial
  CRISPR gRNA sequence
caagcctggcagatcacctg

SEQ ID NO: 705044 - DNA, 20 bp, Artificial
  CRISPR gRNA sequence
cctggcagatcacctgaggt

SEQ ID NO: 705045 - DNA, 20 bp, Artificial
  CRISPR gRNA sequence
ctggcagatcacctgaggtc

SEQ ID NO: 705046 - DNA, 20 bp, Artificial
  CRISPR gRNA sequence
ggcagatcacctgaggtcag

SEQ ID NO: 705047 - DNA, 20 bp, Artificial
  CRISPR gRNA sequence
tcacctgaggtcaggagttt

SEQ ID NO: 705048 - DNA, 20 bp, Artificial
  CRISPR gRNA sequence
tgaggtcaggagtttgagac

SEQ ID NO: 705049 - DNA, 20 bp, Artificial
  CRISPR gRNA sequence
tcaggagtttgagaccagcc

SEQ ID NO: 705050 - DNA, 20 bp, Artificial
  CRISPR gRNA sequence
tgagaccagcctggccaaca

SEQ ID NO: 705051 - DNA, 20 bp, Artificial
  CRISPR gRNA sequence
tctaccgaaaatacaaaaat

SEQ ID NO: 705052 - DNA, 20 bp, Artificial
  CRISPR gRNA sequence
ccgaaaatacaaaaattagc

SEQ ID NO: 705053 - DNA, 20 bp, Artificial
  CRISPR gRNA sequence
cgaaaatacaaaaattagcc

SEQ ID NO: 705054 - DNA, 20 bp, Artificial
  CRISPR gRNA sequence
ggtgtcatgacacgcacctg

SEQ ID NO: 705055 - DNA, 20 bp, Artificial
  CRISPR gRNA sequence
atgacacgcacctgtagtcc

SEQ ID NO: 705056 - DNA, 20 bp, Artificial
  CRISPR gRNA sequence
cacctgtagtcccagctact

SEQ ID NO: 705057 - DNA, 20 bp, Artificial
  CRISPR gRNA sequence
acctgtagtcccagctactt

SEQ ID NO: 705058 - DNA, 20 bp, Artificial
  CRISPR gRNA sequence
ctgtagtcccagctacttgg

SEQ ID NO: 705059 - DNA, 20 bp, Artificial
  CRISPR gRNA sequence
tgtagtcccagctacttggg

SEQ ID NO: 705060 - DNA, 20 bp, Artificial
  CRISPR gRNA sequence
tcccagctacttgggaggct

SEQ ID NO: 705061 - DNA, 20 bp, Artificial
  CRISPR gRNA sequence
cccagctacttgggaggctg

SEQ ID NO: 705062 - DNA, 20 bp, Artificial
  CRISPR gRNA sequence
agctacttgggaggctgagg

SEQ ID NO: 705063 - DNA, 20 bp, Artificial
  CRISPR gRNA sequence
gctacttgggaggctgaggc

SEQ ID NO: 705064 - DNA, 20 bp, Artificial
  CRISPR gRNA sequence
tacttgggaggctgaggcag

SEQ ID NO: 705065 - DNA, 20 bp, Artificial
  CRISPR gRNA sequence
acttgggaggctgaggcagg

SEQ ID NO: 705066 - DNA, 20 bp, Artificial
  CRISPR gRNA sequence
caggaggatcgcttaaaccc

SEQ ID NO: 705067 - DNA, 20 bp, Artificial
  CRISPR gRNA sequence
ggaggatcgcttaaacccca

SEQ ID NO: 705068 - DNA, 20 bp, Artificial
  CRISPR gRNA sequence
gaggatcgcttaaaccccag

SEQ ID NO: 705069 - DNA, 20 bp, Artificial
  CRISPR gRNA sequence
gatcgcttaaaccccagagg

SEQ ID NO: 705070 - DNA, 20 bp, Artificial
  CRISPR gRNA sequence
tcgcttaaaccccagaggca

SEQ ID NO: 705071 - DNA, 20 bp, Artificial
  CRISPR gRNA sequence
cgcttaaaccccagaggcag

SEQ ID NO: 705072 - DNA, 20 bp, Artificial
  CRISPR gRNA sequence
ccagaggcagaggttgcatt

SEQ ID NO: 705073 - DNA, 20 bp, Artificial
  CRISPR gRNA sequence
ggcagaggttgcattgagct

SEQ ID NO: 705074 - DNA, 20 bp, Artificial
  CRISPR gRNA sequence
gagaacgtgccactacactc

SEQ ID NO: 705075 - DNA, 20 bp, Artificial
  CRISPR gRNA sequence
gtgccactacactccagcct

SEQ ID NO: 705076 - DNA, 20 bp, Artificial
  CRISPR gRNA sequence
ctacactccagcctcggtga

SEQ ID NO: 705077 - DNA, 20 bp, Artificial
  CRISPR gRNA sequence
acactccagcctcggtgaca

SEQ ID NO: 705078 - DNA, 20 bp, Artificial
  CRISPR gRNA sequence
tccagcctcggtgacagagc

SEQ ID NO: 705079 - DNA, 20 bp, Artificial
  CRISPR gRNA sequence
aaatcaacctgatttaccac

SEQ ID NO: 705080 - DNA, 20 bp, Artificial
  CRISPR gRNA sequence
aatcaacctgatttaccact

SEQ ID NO: 705081 - DNA, 20 bp, Artificial
  CRISPR gRNA sequence
tctcttttaatcttctcaac

SEQ ID NO: 705082 - DNA, 20 bp, Artificial
  CRISPR gRNA sequence
aatcttctcaacaagcccca

SEQ ID NO: 705083 - DNA, 20 bp, Artificial
  CRISPR gRNA sequence
atgtgattcatcccattttc

SEQ ID NO: 705084 - DNA, 20 bp, Artificial
  CRISPR gRNA sequence
gattcatcccattttccagc

SEQ ID NO: 705085 - DNA, 20 bp, Artificial
  CRISPR gRNA sequence
attcatcccattttccagct

SEQ ID NO: 705086 - DNA, 20 bp, Artificial
  CRISPR gRNA sequence
tcatcccattttccagctgg

SEQ ID NO: 705087 - DNA, 20 bp, Artificial
  CRISPR gRNA sequence
catcccattttccagctggg

SEQ ID NO: 705088 - DNA, 20 bp, Artificial
  CRISPR gRNA sequence
ccattttccagctgggagga

SEQ ID NO: 705089 - DNA, 20 bp, Artificial
  CRISPR gRNA sequence
attttccagctgggaggaca

SEQ ID NO: 705090 - DNA, 20 bp, Artificial
  CRISPR gRNA sequence
ttttccagctgggaggacag

SEQ ID NO: 705091 - DNA, 20 bp, Artificial
  CRISPR gRNA sequence
cagctgggaggacagaggct

SEQ ID NO: 705092 - DNA, 20 bp, Artificial
  CRISPR gRNA sequence
gctgggaggacagaggctcg

SEQ ID NO: 705093 - DNA, 20 bp, Artificial
  CRISPR gRNA sequence
gggaggacagaggctcggag

SEQ ID NO: 705094 - DNA, 20 bp, Artificial
  CRISPR gRNA sequence
ggaggacagaggctcggaga

SEQ ID NO: 705095 - DNA, 20 bp, Artificial
  CRISPR gRNA sequence
gaggacagaggctcggagaa

SEQ ID NO: 705096 - DNA, 20 bp, Artificial
  CRISPR gRNA sequence
gacagaggctcggagaaggg

SEQ ID NO: 705097 - DNA, 20 bp, Artificial
  CRISPR gRNA sequence
aagggaagtaatattgtgct

SEQ ID NO: 705098 - DNA, 20 bp, Artificial
  CRISPR gRNA sequence
ttgtgctgagtttcaccgcc

SEQ ID NO: 705099 - DNA, 20 bp, Artificial
  CRISPR gRNA sequence
tgtgctgagtttcaccgcca

SEQ ID NO: 705100 - DNA, 20 bp, Artificial
  CRISPR gRNA sequence
tgctgagtttcaccgccaag

SEQ ID NO: 705101 - DNA, 20 bp, Artificial
  CRISPR gRNA sequence
gctgagtttcaccgccaagg

SEQ ID NO: 705102 - DNA, 20 bp, Artificial
  CRISPR gRNA sequence
cgccaaggaggcccctgctc

SEQ ID NO: 705103 - DNA, 20 bp, Artificial
  CRISPR gRNA sequence
gccaaggaggcccctgctcc

SEQ ID NO: 705104 - DNA, 20 bp, Artificial
  CRISPR gRNA sequence
ccaaggaggcccctgctcca

SEQ ID NO: 705105 - DNA, 20 bp, Artificial
  CRISPR gRNA sequence
aggaggcccctgctccaggg

SEQ ID NO: 705106 - DNA, 20 bp, Artificial
  CRISPR gRNA sequence
gcccctgctccagggtggct

SEQ ID NO: 705107 - DNA, 20 bp, Artificial
  CRISPR gRNA sequence
cctgctccagggtggctaag

SEQ ID NO: 705108 - DNA, 20 bp, Artificial
  CRISPR gRNA sequence
gcctcattgtttttgacatt

SEQ ID NO: 705109 - DNA, 20 bp, Artificial
  CRISPR gRNA sequence
cattgtttttgacatttggc

SEQ ID NO: 705110 - DNA, 20 bp, Artificial
  CRISPR gRNA sequence
atttggctggttttcaattt

SEQ ID NO: 705111 - DNA, 20 bp, Artificial
  CRISPR gRNA sequence
tttggctggttttcaatttg

SEQ ID NO: 705112 - DNA, 20 bp, Artificial
  CRISPR gRNA sequence
ttggctggttttcaatttga

SEQ ID NO: 705113 - DNA, 20 bp, Artificial
  CRISPR gRNA sequence
tataaacccgctgctgtgct

SEQ ID NO: 705114 - DNA, 20 bp, Artificial
  CRISPR gRNA sequence
tcggcctttttgttttcttt

SEQ ID NO: 705115 - DNA, 20 bp, Artificial
  CRISPR gRNA sequence
cggcctttttgttttctttc

SEQ ID NO: 705116 - DNA, 20 bp, Artificial
  CRISPR gRNA sequence
tttctttcgggttatttcct

SEQ ID NO: 705117 - DNA, 20 bp, Artificial
  CRISPR gRNA sequence
ttctttcgggttatttcctg

SEQ ID NO: 705118 - DNA, 20 bp, Artificial
  CRISPR gRNA sequence
tctttcgggttatttcctga

SEQ ID NO: 705119 - DNA, 20 bp, Artificial
  CRISPR gRNA sequence
tcctgagggtgtgttccctc

SEQ ID NO: 705120 - DNA, 20 bp, Artificial
  CRISPR gRNA sequence
ctgagggtgtgttccctcaa

SEQ ID NO: 705121 - DNA, 20 bp, Artificial
  CRISPR gRNA sequence
tgagggtgtgttccctcaag

SEQ ID NO: 705122 - DNA, 20 bp, Artificial
  CRISPR gRNA sequence
gagggtgtgttccctcaaga

SEQ ID NO: 705123 - DNA, 20 bp, Artificial
  CRISPR gRNA sequence
gttccctcaagagggatgac

SEQ ID NO: 705124 - DNA, 20 bp, Artificial
  CRISPR gRNA sequence
ttccctcaagagggatgact

SEQ ID NO: 705125 - DNA, 20 bp, Artificial
  CRISPR gRNA sequence
tcaagagggatgactgggta

SEQ ID NO: 705126 - DNA, 20 bp, Artificial
  CRISPR gRNA sequence
aagagggatgactgggtaaa

SEQ ID NO: 705127 - DNA, 20 bp, Artificial
  CRISPR gRNA sequence
gatgactgggtaaagagtgt

SEQ ID NO: 705128 - DNA, 20 bp, Artificial
  CRISPR gRNA sequence
atgactgggtaaagagtgtg

SEQ ID NO: 705129 - DNA, 20 bp, Artificial
  CRISPR gRNA sequence
gagtgtgaggtttttgttgc

SEQ ID NO: 705130 - DNA, 20 bp, Artificial
  CRISPR gRNA sequence
gtgaggtttttgttgccaga

SEQ ID NO: 705131 - DNA, 20 bp, Artificial
  CRISPR gRNA sequence
tttgttgccagatggctctt

SEQ ID NO: 705132 - DNA, 20 bp, Artificial
  CRISPR gRNA sequence
cagatggctctttagaaaaa

SEQ ID NO: 705133 - DNA, 20 bp, Artificial
  CRISPR gRNA sequence
gctctttagaaaaatggaac

SEQ ID NO: 705134 - DNA, 20 bp, Artificial
  CRISPR gRNA sequence
agaaaaatggaaccagcctg

SEQ ID NO: 705135 - DNA, 20 bp, Artificial
  CRISPR gRNA sequence
gaaaaatggaaccagcctgc

SEQ ID NO: 705136 - DNA, 20 bp, Artificial
  CRISPR gRNA sequence
aaaaatggaaccagcctgca

SEQ ID NO: 705137 - DNA, 20 bp, Artificial
  CRISPR gRNA sequence
tggaaccagcctgcagggta

SEQ ID NO: 705138 - DNA, 20 bp, Artificial
  CRISPR gRNA sequence
ggaaccagcctgcagggtat

SEQ ID NO: 705139 - DNA, 20 bp, Artificial
  CRISPR gRNA sequence
accagcctgcagggtatggg

SEQ ID NO: 705140 - DNA, 20 bp, Artificial
  CRISPR gRNA sequence
cgttcacccacttccccttc

SEQ ID NO: 705141 - DNA, 20 bp, Artificial
  CRISPR gRNA sequence
gttcacccacttccccttca

SEQ ID NO: 705142 - DNA, 20 bp, Artificial
  CRISPR gRNA sequence
cccacttccccttcaaggcc

SEQ ID NO: 705143 - DNA, 20 bp, Artificial
  CRISPR gRNA sequence
cttttttttttttattctgt

SEQ ID NO: 705144 - DNA, 20 bp, Artificial
  CRISPR gRNA sequence
tttattctgttggccacccc

SEQ ID NO: 705145 - DNA, 20 bp, Artificial
  CRISPR gRNA sequence
gttggccacccccagtgact

SEQ ID NO: 705146 - DNA, 20 bp, Artificial
  CRISPR gRNA sequence
cccccagtgacttggtacca

SEQ ID NO: 705147 - DNA, 20 bp, Artificial
  CRISPR gRNA sequence
agtgacttggtaccaaagaa

SEQ ID NO: 705148 - DNA, 20 bp, Artificial
  CRISPR gRNA sequence
acttggtaccaaagaacagt

SEQ ID NO: 705149 - DNA, 20 bp, Artificial
  CRISPR gRNA sequence
tgtaaaactcaaaatcactc

SEQ ID NO: 705150 - DNA, 20 bp, Artificial
  CRISPR gRNA sequence
taaaactcaaaatcactctg

SEQ ID NO: 705151 - DNA, 20 bp, Artificial
  CRISPR gRNA sequence
aaaactcaaaatcactctgg

SEQ ID NO: 705152 - DNA, 20 bp, Artificial
  CRISPR gRNA sequence
aaactcaaaatcactctgga

SEQ ID NO: 705153 - DNA, 20 bp, Artificial
  CRISPR gRNA sequence
actctggagggaccatgatt

SEQ ID NO: 705154 - DNA, 20 bp, Artificial
  CRISPR gRNA sequence
gtttcactgacgtcattgaa

SEQ ID NO: 705155 - DNA, 20 bp, Artificial
  CRISPR gRNA sequence
tcattgaaaagaatgtgcct

SEQ ID NO: 705156 - DNA, 20 bp, Artificial
  CRISPR gRNA sequence
tgaaaagaatgtgcctcggc

SEQ ID NO: 705157 - DNA, 20 bp, Artificial
  CRISPR gRNA sequence
gaaaagaatgtgcctcggcc

SEQ ID NO: 705158 - DNA, 20 bp, Artificial
  CRISPR gRNA sequence
tgtgcctcggccgggtgccg

SEQ ID NO: 705159 - DNA, 20 bp, Artificial
  CRISPR gRNA sequence
gtggctcacgcctgtaatcc

SEQ ID NO: 705160 - DNA, 20 bp, Artificial
  CRISPR gRNA sequence
cgcctgtaatcccagcactt

SEQ ID NO: 705161 - DNA, 20 bp, Artificial
  CRISPR gRNA sequence
gcctgtaatcccagcacttt

SEQ ID NO: 705162 - DNA, 20 bp, Artificial
  CRISPR gRNA sequence
ctgtaatcccagcactttgg

SEQ ID NO: 705163 - DNA, 20 bp, Artificial
  CRISPR gRNA sequence
tgtaatcccagcactttggg

SEQ ID NO: 705164 - DNA, 20 bp, Artificial
  CRISPR gRNA sequence
tcccagcactttgggaggcc

SEQ ID NO: 705165 - DNA, 20 bp, Artificial
  CRISPR gRNA sequence
cccagcactttgggaggccg

SEQ ID NO: 705166 - DNA, 20 bp, Artificial
  CRISPR gRNA sequence
agcactttgggaggccgagg

SEQ ID NO: 705167 - DNA, 20 bp, Artificial
  CRISPR gRNA sequence
gcactttgggaggccgaggc

SEQ ID NO: 705168 - DNA, 20 bp, Artificial
  CRISPR gRNA sequence
ctttgggaggccgaggcggg

SEQ ID NO: 705169 - DNA, 20 bp, Artificial
  CRISPR gRNA sequence
ggccgaggcgggtggatcac

SEQ ID NO: 705170 - DNA, 20 bp, Artificial
  CRISPR gRNA sequence
gccgaggcgggtggatcacg

SEQ ID NO: 705171 - DNA, 20 bp, Artificial
  CRISPR gRNA sequence
ggcgggtggatcacgaggtc

SEQ ID NO: 705172 - DNA, 20 bp, Artificial
  CRISPR gRNA sequence
cgggtggatcacgaggtcaa

SEQ ID NO: 705173 - DNA, 20 bp, Artificial
  CRISPR gRNA sequence
gatcacgaggtcaagagatc

SEQ ID NO: 705174 - DNA, 20 bp, Artificial
  CRISPR gRNA sequence
cgaggtcaagagatcgagac

SEQ ID NO: 705175 - DNA, 20 bp, Artificial
  CRISPR gRNA sequence
tcaagagatcgagaccagcc

SEQ ID NO: 705176 - DNA, 20 bp, Artificial
  CRISPR gRNA sequence
cgagaccagcctggccaaca

SEQ ID NO: 705177 - DNA, 20 bp, Artificial
  CRISPR gRNA sequence
tctactaaaaatacaaaaat

SEQ ID NO: 705178 - DNA, 20 bp, Artificial
  CRISPR gRNA sequence
taaaaatacaaaaattagct

SEQ ID NO: 705179 - DNA, 20 bp, Artificial
  CRISPR gRNA sequence
atacaaaaattagctgagca

SEQ ID NO: 705180 - DNA, 20 bp, Artificial
  CRISPR gRNA sequence
caaaaattagctgagcatgg

SEQ ID NO: 705181 - DNA, 20 bp, Artificial
  CRISPR gRNA sequence
gtggtgcgtgcctgtaatcc

SEQ ID NO: 705182 - DNA, 20 bp, Artificial
  CRISPR gRNA sequence
tgcctgtaatcccagctact

SEQ ID NO: 705183 - DNA, 20 bp, Artificial
  CRISPR gRNA sequence
gcctgtaatcccagctactc

SEQ ID NO: 705184 - DNA, 20 bp, Artificial
  CRISPR gRNA sequence
ctgtaatcccagctactcgg

SEQ ID NO: 705185 - DNA, 20 bp, Artificial
  CRISPR gRNA sequence
tgtaatcccagctactcggg

SEQ ID NO: 705186 - DNA, 20 bp, Artificial
  CRISPR gRNA sequence
tcccagctactcgggaggct

SEQ ID NO: 705187 - DNA, 20 bp, Artificial
  CRISPR gRNA sequence
cccagctactcgggaggctg

SEQ ID NO: 705188 - DNA, 20 bp, Artificial
  CRISPR gRNA sequence
agctactcgggaggctgagg

SEQ ID NO: 705189 - DNA, 20 bp, Artificial
  CRISPR gRNA sequence
gctactcgggaggctgaggc

SEQ ID NO: 705190 - DNA, 20 bp, Artificial
  CRISPR gRNA sequence
tactcgggaggctgaggcag

SEQ ID NO: 705191 - DNA, 20 bp, Artificial
  CRISPR gRNA sequence
gcaggagaatcgcttgaacc

SEQ ID NO: 705192 - DNA, 20 bp, Artificial
  CRISPR gRNA sequence
caggagaatcgcttgaaccc

SEQ ID NO: 705193 - DNA, 20 bp, Artificial
  CRISPR gRNA sequence
ggagaatcgcttgaacccag

SEQ ID NO: 705194 - DNA, 20 bp, Artificial
  CRISPR gRNA sequence
gagaatcgcttgaacccagg

SEQ ID NO: 705195 - DNA, 20 bp, Artificial
  CRISPR gRNA sequence
aatcgcttgaacccaggagg

SEQ ID NO: 705196 - DNA, 20 bp, Artificial
  CRISPR gRNA sequence
tcgcttgaacccaggaggcg

SEQ ID NO: 705197 - DNA, 20 bp, Artificial
  CRISPR gRNA sequence
cgcttgaacccaggaggcgg

SEQ ID NO: 705198 - DNA, 20 bp, Artificial
  CRISPR gRNA sequence
aacccaggaggcggaggttg

SEQ ID NO: 705199 - DNA, 20 bp, Artificial
  CRISPR gRNA sequence
caggaggcggaggttgcagt

SEQ ID NO: 705200 - DNA, 20 bp, Artificial
  CRISPR gRNA sequence
ggcggaggttgcagtgagcc

SEQ ID NO: 705201 - DNA, 20 bp, Artificial
  CRISPR gRNA sequence
cgcgctgctgcacttcaccc

SEQ ID NO: 705202 - DNA, 20 bp, Artificial
  CRISPR gRNA sequence
gctgcacttcaccctggcga

SEQ ID NO: 705203 - DNA, 20 bp, Artificial
  CRISPR gRNA sequence
tgcacttcaccctggcgaca

SEQ ID NO: 705204 - DNA, 20 bp, Artificial
  CRISPR gRNA sequence
cttcaccctggcgacagagt

SEQ ID NO: 705205 - DNA, 20 bp, Artificial
  CRISPR gRNA sequence
aaaaaaaaaaaaattacccc

SEQ ID NO: 705206 - DNA, 20 bp, Artificial
  CRISPR gRNA sequence
aaaaaaaaattacccctggc

SEQ ID NO: 705207 - DNA, 20 bp, Artificial
  CRISPR gRNA sequence
aaaaaaaattacccctggcc

SEQ ID NO: 705208 - DNA, 20 bp, Artificial
  CRISPR gRNA sequence
aaaattacccctggccgggc

SEQ ID NO: 705209 - DNA, 20 bp, Artificial
  CRISPR gRNA sequence
aaattacccctggccgggca

SEQ ID NO: 705210 - DNA, 20 bp, Artificial
  CRISPR gRNA sequence
ttacccctggccgggcaagg

SEQ ID NO: 705211 - DNA, 20 bp, Artificial
  CRISPR gRNA sequence
gtggctcatgcctgtaatcc

SEQ ID NO: 705212 - DNA, 20 bp, Artificial
  CRISPR gRNA sequence
gcctgtaatcccagcacttc

SEQ ID NO: 705213 - DNA, 20 bp, Artificial
  CRISPR gRNA sequence
ctgtaatcccagcacttcga

SEQ ID NO: 705214 - DNA, 20 bp, Artificial
  CRISPR gRNA sequence
tgtaatcccagcacttcgag

SEQ ID NO: 705215 - DNA, 20 bp, Artificial
  CRISPR gRNA sequence
tcccagcacttcgagaggcc

SEQ ID NO: 705216 - DNA, 20 bp, Artificial
  CRISPR gRNA sequence
cccagcacttcgagaggccg

SEQ ID NO: 705217 - DNA, 20 bp, Artificial
  CRISPR gRNA sequence
agcacttcgagaggccgagg

SEQ ID NO: 705218 - DNA, 20 bp, Artificial
  CRISPR gRNA sequence
gcacttcgagaggccgaggc

SEQ ID NO: 705219 - DNA, 20 bp, Artificial
  CRISPR gRNA sequence
cttcgagaggccgaggcggg

SEQ ID NO: 705220 - DNA, 20 bp, Artificial
  CRISPR gRNA sequence
ccgaggcgggcagatcacct

SEQ ID NO: 705221 - DNA, 20 bp, Artificial
  CRISPR gRNA sequence
cgaggcgggcagatcacctg

SEQ ID NO: 705222 - DNA, 20 bp, Artificial
  CRISPR gRNA sequence
gcgggcagatcacctgaggt

SEQ ID NO: 705223 - DNA, 20 bp, Artificial
  CRISPR gRNA sequence
cgggcagatcacctgaggtc

SEQ ID NO: 705224 - DNA, 20 bp, Artificial
  CRISPR gRNA sequence
ggcagatcacctgaggtcag

SEQ ID NO: 705225 - DNA, 20 bp, Artificial
  CRISPR gRNA sequence
gatcacctgaggtcaggagt

SEQ ID NO: 705226 - DNA, 20 bp, Artificial
  CRISPR gRNA sequence
tcacctgaggtcaggagttg

SEQ ID NO: 705227 - DNA, 20 bp, Artificial
  CRISPR gRNA sequence
tcaggagttggagaccaacc

SEQ ID NO: 705228 - DNA, 20 bp, Artificial
  CRISPR gRNA sequence
ggagaccaacctggccaaca

SEQ ID NO: 705229 - DNA, 20 bp, Artificial
  CRISPR gRNA sequence
tctactaaaaatacaaaaat

SEQ ID NO: 705230 - DNA, 20 bp, Artificial
  CRISPR gRNA sequence
ctaaaaatacaaaaattagc

SEQ ID NO: 705231 - DNA, 20 bp, Artificial
  CRISPR gRNA sequence
taaaaatacaaaaattagcc

SEQ ID NO: 705232 - DNA, 20 bp, Artificial
  CRISPR gRNA sequence
atacaaaaattagccgggcg

SEQ ID NO: 705233 - DNA, 20 bp, Artificial
  CRISPR gRNA sequence
caaaaattagccgggcgtgg

SEQ ID NO: 705234 - DNA, 20 bp, Artificial
  CRISPR gRNA sequence
ccgggcgtggtggcacatgt

SEQ ID NO: 705235 - DNA, 20 bp, Artificial
  CRISPR gRNA sequence
gtggcacatgtcggtaatcc

SEQ ID NO: 705236 - DNA, 20 bp, Artificial
  CRISPR gRNA sequence
cggtaatcccagctacttgt

SEQ ID NO: 705237 - DNA, 20 bp, Artificial
  CRISPR gRNA sequence
tgagaattgcttaaacctgt

SEQ ID NO: 705238 - DNA, 20 bp, Artificial
  CRISPR gRNA sequence
gagaattgcttaaacctgtg

SEQ ID NO: 705239 - DNA, 20 bp, Artificial
  CRISPR gRNA sequence
aattgcttaaacctgtgagg

SEQ ID NO: 705240 - DNA, 20 bp, Artificial
  CRISPR gRNA sequence
ttgcttaaacctgtgaggca

SEQ ID NO: 705241 - DNA, 20 bp, Artificial
  CRISPR gRNA sequence
tgcttaaacctgtgaggcag

SEQ ID NO: 705242 - DNA, 20 bp, Artificial
  CRISPR gRNA sequence
aacctgtgaggcagaggttg

SEQ ID NO: 705243 - DNA, 20 bp, Artificial
  CRISPR gRNA sequence
tgtgaggcagaggttgcagt

SEQ ID NO: 705244 - DNA, 20 bp, Artificial
  CRISPR gRNA sequence
ggcagaggttgcagtgagcc

SEQ ID NO: 705245 - DNA, 20 bp, Artificial
  CRISPR gRNA sequence
aagatcgtgccactgcactc

SEQ ID NO: 705246 - DNA, 20 bp, Artificial
  CRISPR gRNA sequence
cgtgccactgcactccagcc

SEQ ID NO: 705247 - DNA, 20 bp, Artificial
  CRISPR gRNA sequence
gtgccactgcactccagcct

SEQ ID NO: 705248 - DNA, 20 bp, Artificial
  CRISPR gRNA sequence
ctgcactccagcctgggtga

SEQ ID NO: 705249 - DNA, 20 bp, Artificial
  CRISPR gRNA sequence
gcactccagcctgggtgaca

SEQ ID NO: 705250 - DNA, 20 bp, Artificial
  CRISPR gRNA sequence
tccagcctgggtgacagagt

SEQ ID NO: 705251 - DNA, 20 bp, Artificial
  CRISPR gRNA sequence
gtgagactctgtctcaaaaa

SEQ ID NO: 705252 - DNA, 20 bp, Artificial
  CRISPR gRNA sequence
aaaaagaaaaaattacccct

SEQ ID NO: 705253 - DNA, 20 bp, Artificial
  CRISPR gRNA sequence
aaagaaaaaattacccctaa

SEQ ID NO: 705254 - DNA, 20 bp, Artificial
  CRISPR gRNA sequence
gagtgtttcccaaactcacc

SEQ ID NO: 705255 - DNA, 20 bp, Artificial
  CRISPR gRNA sequence
aaactcacctagtgtccaca

SEQ ID NO: 705256 - DNA, 20 bp, Artificial
  CRISPR gRNA sequence
gtccacacagcgtgttcaaa

SEQ ID NO: 705257 - DNA, 20 bp, Artificial
  CRISPR gRNA sequence
acacagcgtgttcaaatggt

SEQ ID NO: 705258 - DNA, 20 bp, Artificial
  CRISPR gRNA sequence
ctttatcctacttgttgact

SEQ ID NO: 705259 - DNA, 20 bp, Artificial
  CRISPR gRNA sequence
cctacttgttgactgagcac

SEQ ID NO: 705260 - DNA, 20 bp, Artificial
  CRISPR gRNA sequence
cttgttgactgagcactggt

SEQ ID NO: 705261 - DNA, 20 bp, Artificial
  CRISPR gRNA sequence
gcactggtgagcatatctgt

SEQ ID NO: 705262 - DNA, 20 bp, Artificial
  CRISPR gRNA sequence
cactggtgagcatatctgtg

SEQ ID NO: 705263 - DNA, 20 bp, Artificial
  CRISPR gRNA sequence
tgagcatatctgtgaggact

SEQ ID NO: 705264 - DNA, 20 bp, Artificial
  CRISPR gRNA sequence
gagcatatctgtgaggactc

SEQ ID NO: 705265 - DNA, 20 bp, Artificial
  CRISPR gRNA sequence
agcatatctgtgaggactca

SEQ ID NO: 705266 - DNA, 20 bp, Artificial
  CRISPR gRNA sequence
tatctgtgaggactcagggc

SEQ ID NO: 705267 - DNA, 20 bp, Artificial
  CRISPR gRNA sequence
ctgtgaggactcagggctgg

SEQ ID NO: 705268 - DNA, 20 bp, Artificial
  CRISPR gRNA sequence
actcagggctggtggctctc

SEQ ID NO: 705269 - DNA, 20 bp, Artificial
  CRISPR gRNA sequence
tcagggctggtggctctcca

SEQ ID NO: 705270 - DNA, 20 bp, Artificial
  CRISPR gRNA sequence
gtggctctccagagctgctg

SEQ ID NO: 705271 - DNA, 20 bp, Artificial
  CRISPR gRNA sequence
ctctccagagctgctgaagt

SEQ ID NO: 705272 - DNA, 20 bp, Artificial
  CRISPR gRNA sequence
ctccagagctgctgaagtca

SEQ ID NO: 705273 - DNA, 20 bp, Artificial
  CRISPR gRNA sequence
gctgaagtcagagatgtgtg

SEQ ID NO: 705274 - DNA, 20 bp, Artificial
  CRISPR gRNA sequence
ctgaagtcagagatgtgtgc

SEQ ID NO: 705275 - DNA, 20 bp, Artificial
  CRISPR gRNA sequence
gaagtcagagatgtgtgcag

SEQ ID NO: 705276 - DNA, 20 bp, Artificial
  CRISPR gRNA sequence
aagtcagagatgtgtgcagg

SEQ ID NO: 705277 - DNA, 20 bp, Artificial
  CRISPR gRNA sequence
tcagagatgtgtgcaggagg

SEQ ID NO: 705278 - DNA, 20 bp, Artificial
  CRISPR gRNA sequence
gatgtgtgcaggaggcggcg

SEQ ID NO: 705279 - DNA, 20 bp, Artificial
  CRISPR gRNA sequence
gaggcggcgtggctgacata

SEQ ID NO: 705280 - DNA, 20 bp, Artificial
  CRISPR gRNA sequence
aggcggcgtggctgacatac

SEQ ID NO: 705281 - DNA, 20 bp, Artificial
  CRISPR gRNA sequence
tggctgacatacgggcatct

SEQ ID NO: 705282 - DNA, 20 bp, Artificial
  CRISPR gRNA sequence
ctgacatacgggcatcttgg

SEQ ID NO: 705283 - DNA, 20 bp, Artificial
  CRISPR gRNA sequence
acatacgggcatcttggtgg

SEQ ID NO: 705284 - DNA, 20 bp, Artificial
  CRISPR gRNA sequence
atcttggtggcagatttgtc

SEQ ID NO: 705285 - DNA, 20 bp, Artificial
  CRISPR gRNA sequence
tggtggcagatttgtctagc

SEQ ID NO: 705286 - DNA, 20 bp, Artificial
  CRISPR gRNA sequence
ggtggcagatttgtctagcc

SEQ ID NO: 705287 - DNA, 20 bp, Artificial
  CRISPR gRNA sequence
gtggcagatttgtctagcca

SEQ ID NO: 705288 - DNA, 20 bp, Artificial
  CRISPR gRNA sequence
cagggatgtgtgcctgacaa

SEQ ID NO: 705289 - DNA, 20 bp, Artificial
  CRISPR gRNA sequence
tgcctgacaacagcatattc

SEQ ID NO: 705290 - DNA, 20 bp, Artificial
  CRISPR gRNA sequence
cagcatattccagatctccg

SEQ ID NO: 705291 - DNA, 20 bp, Artificial
  CRISPR gRNA sequence
agcatattccagatctccgt

SEQ ID NO: 705292 - DNA, 20 bp, Artificial
  CRISPR gRNA sequence
atattccagatctccgtagg

SEQ ID NO: 705293 - DNA, 20 bp, Artificial
  CRISPR gRNA sequence
atctccgtaggtagcgttct

SEQ ID NO: 705294 - DNA, 20 bp, Artificial
  CRISPR gRNA sequence
tctccgtaggtagcgttctc

SEQ ID NO: 705295 - DNA, 20 bp, Artificial
  CRISPR gRNA sequence
tccgtaggtagcgttctcag

SEQ ID NO: 705296 - DNA, 20 bp, Artificial
  CRISPR gRNA sequence
gtaggtagcgttctcaggag

SEQ ID NO: 705297 - DNA, 20 bp, Artificial
  CRISPR gRNA sequence
gcgttctcaggagtggttaa

SEQ ID NO: 705298 - DNA, 20 bp, Artificial
  CRISPR gRNA sequence
tctcaggagtggttaaaagc

SEQ ID NO: 705299 - DNA, 20 bp, Artificial
  CRISPR gRNA sequence
ctcaggagtggttaaaagct

SEQ ID NO: 705300 - DNA, 20 bp, Artificial
  CRISPR gRNA sequence
ggttaaaagctgggcatccc

SEQ ID NO: 705301 - DNA, 20 bp, Artificial
  CRISPR gRNA sequence
ttaaaagctgggcatccctg

SEQ ID NO: 705302 - DNA, 20 bp, Artificial
  CRISPR gRNA sequence
taaaagctgggcatccctgg

SEQ ID NO: 705303 - DNA, 20 bp, Artificial
  CRISPR gRNA sequence
agctgggcatccctggagga

SEQ ID NO: 705304 - DNA, 20 bp, Artificial
  CRISPR gRNA sequence
ccctggaggatggtctgctc

SEQ ID NO: 705305 - DNA, 20 bp, Artificial
  CRISPR gRNA sequence
cctggaggatggtctgctct

SEQ ID NO: 705306 - DNA, 20 bp, Artificial
  CRISPR gRNA sequence
ctctgggaactgacttgctc

SEQ ID NO: 705307 - DNA, 20 bp, Artificial
  CRISPR gRNA sequence
tctgggaactgacttgctcc

SEQ ID NO: 705308 - DNA, 20 bp, Artificial
  CRISPR gRNA sequence
gaactgacttgctccaggat

SEQ ID NO: 705309 - DNA, 20 bp, Artificial
  CRISPR gRNA sequence
tgacttgctccaggatgagt

SEQ ID NO: 705310 - DNA, 20 bp, Artificial
  CRISPR gRNA sequence
tccaggatgagttagatgcc

SEQ ID NO: 705311 - DNA, 20 bp, Artificial
  CRISPR gRNA sequence
ggatgccctctcacctttct

SEQ ID NO: 705312 - DNA, 20 bp, Artificial
  CRISPR gRNA sequence
gccctctcacctttctcaga

SEQ ID NO: 705313 - DNA, 20 bp, Artificial
  CRISPR gRNA sequence
tctcacctttctcagatggc

SEQ ID NO: 705314 - DNA, 20 bp, Artificial
  CRISPR gRNA sequence
acctttctcagatggccagt

SEQ ID NO: 705315 - DNA, 20 bp, Artificial
  CRISPR gRNA sequence
tctcagatggccagtgagcc

SEQ ID NO: 705316 - DNA, 20 bp, Artificial
  CRISPR gRNA sequence
ctcagatggccagtgagcca

SEQ ID NO: 705317 - DNA, 20 bp, Artificial
  CRISPR gRNA sequence
gttaaatgtcaatatgtgct

SEQ ID NO: 705318 - DNA, 20 bp, Artificial
  CRISPR gRNA sequence
ttaaatgtcaatatgtgctt

SEQ ID NO: 705319 - DNA, 20 bp, Artificial
  CRISPR gRNA sequence
atatgtgcttgggcgtgacc

SEQ ID NO: 705320 - DNA, 20 bp, Artificial
  CRISPR gRNA sequence
gacctggcccctgtttaata

SEQ ID NO: 705321 - DNA, 20 bp, Artificial
  CRISPR gRNA sequence
acctggcccctgtttaatat

SEQ ID NO: 705322 - DNA, 20 bp, Artificial
  CRISPR gRNA sequence
ctggcccctgtttaatatgg

SEQ ID NO: 705323 - DNA, 20 bp, Artificial
  CRISPR gRNA sequence
tgtttaatatgggagaacaa

SEQ ID NO: 705324 - DNA, 20 bp, Artificial
  CRISPR gRNA sequence
gtttaatatgggagaacaat

SEQ ID NO: 705325 - DNA, 20 bp, Artificial
  CRISPR gRNA sequence
ttaatatgggagaacaatgg

SEQ ID NO: 705326 - DNA, 20 bp, Artificial
  CRISPR gRNA sequence
atatgggagaacaatgggag

SEQ ID NO: 705327 - DNA, 20 bp, Artificial
  CRISPR gRNA sequence
atgggagaacaatgggagtg

SEQ ID NO: 705328 - DNA, 20 bp, Artificial
  CRISPR gRNA sequence
tgggagaacaatgggagtgg

SEQ ID NO: 705329 - DNA, 20 bp, Artificial
  CRISPR gRNA sequence
gggagaacaatgggagtgga

SEQ ID NO: 705330 - DNA, 20 bp, Artificial
  CRISPR gRNA sequence
agaacaatgggagtggaggg

SEQ ID NO: 705331 - DNA, 20 bp, Artificial
  CRISPR gRNA sequence
aacaatgggagtggagggta

SEQ ID NO: 705332 - DNA, 20 bp, Artificial
  CRISPR gRNA sequence
acaatgggagtggagggtag

SEQ ID NO: 705333 - DNA, 20 bp, Artificial
  CRISPR gRNA sequence
ggagtggagggtagaggttt

SEQ ID NO: 705334 - DNA, 20 bp, Artificial
  CRISPR gRNA sequence
ggagggtagaggtttgagat

SEQ ID NO: 705335 - DNA, 20 bp, Artificial
  CRISPR gRNA sequence
gggtagaggtttgagatgag

SEQ ID NO: 705336 - DNA, 20 bp, Artificial
  CRISPR gRNA sequence
agaggtttgagatgagaaga

SEQ ID NO: 705337 - DNA, 20 bp, Artificial
  CRISPR gRNA sequence
aggtttgagatgagaagata

SEQ ID NO: 705338 - DNA, 20 bp, Artificial
  CRISPR gRNA sequence
ggtttgagatgagaagatag

SEQ ID NO: 705339 - DNA, 20 bp, Artificial
  CRISPR gRNA sequence
gaagatagaggttgtgcgtt

SEQ ID NO: 705340 - DNA, 20 bp, Artificial
  CRISPR gRNA sequence
tgcgttgagaatcattgtat

SEQ ID NO: 705341 - DNA, 20 bp, Artificial
  CRISPR gRNA sequence
tcattgtatcagcacctcct

SEQ ID NO: 705342 - DNA, 20 bp, Artificial
  CRISPR gRNA sequence
agcacctcctgagcctacaa

SEQ ID NO: 705343 - DNA, 20 bp, Artificial
  CRISPR gRNA sequence
gcacctcctgagcctacaaa

SEQ ID NO: 705344 - DNA, 20 bp, Artificial
  CRISPR gRNA sequence
ctcctgagcctacaaaagga

SEQ ID NO: 705345 - DNA, 20 bp, Artificial
  CRISPR gRNA sequence
tcctgagcctacaaaaggat

SEQ ID NO: 705346 - DNA, 20 bp, Artificial
  CRISPR gRNA sequence
cctacaaaaggatgggattg

SEQ ID NO: 705347 - DNA, 20 bp, Artificial
  CRISPR gRNA sequence
ctacaaaaggatgggattga

SEQ ID NO: 705348 - DNA, 20 bp, Artificial
  CRISPR gRNA sequence
aggatgggattgaaggaaat

SEQ ID NO: 705349 - DNA, 20 bp, Artificial
  CRISPR gRNA sequence
tgggattgaaggaaatgaga

SEQ ID NO: 705350 - DNA, 20 bp, Artificial
  CRISPR gRNA sequence
tgaaggaaatgagatggccc

SEQ ID NO: 705351 - DNA, 20 bp, Artificial
  CRISPR gRNA sequence
aaggaaatgagatggcccga

SEQ ID NO: 705352 - DNA, 20 bp, Artificial
  CRISPR gRNA sequence
gaaatgagatggcccgagag

SEQ ID NO: 705353 - DNA, 20 bp, Artificial
  CRISPR gRNA sequence
gagagcagttgtcctcctcg

SEQ ID NO: 705354 - DNA, 20 bp, Artificial
  CRISPR gRNA sequence
agagcagttgtcctcctcga

SEQ ID NO: 705355 - DNA, 20 bp, Artificial
  CRISPR gRNA sequence
cctcctcgaaggctgccacc

SEQ ID NO: 705356 - DNA, 20 bp, Artificial
  CRISPR gRNA sequence
ctcctcgaaggctgccacct

SEQ ID NO: 705357 - DNA, 20 bp, Artificial
  CRISPR gRNA sequence
ggctgccacctgggtgcttt

SEQ ID NO: 705358 - DNA, 20 bp, Artificial
  CRISPR gRNA sequence
gctgccacctgggtgctttc

SEQ ID NO: 705359 - DNA, 20 bp, Artificial
  CRISPR gRNA sequence
acctgggtgctttcaggcac

SEQ ID NO: 705360 - DNA, 20 bp, Artificial
  CRISPR gRNA sequence
gggtgctttcaggcacaaga

SEQ ID NO: 705361 - DNA, 20 bp, Artificial
  CRISPR gRNA sequence
gtgctttcaggcacaagaaa

SEQ ID NO: 705362 - DNA, 20 bp, Artificial
  CRISPR gRNA sequence
gcacaagaaagagaaaatcg

SEQ ID NO: 705363 - DNA, 20 bp, Artificial
  CRISPR gRNA sequence
agaaagagaaaatcgaagtc

SEQ ID NO: 705364 - DNA, 20 bp, Artificial
  CRISPR gRNA sequence
agagaaaatcgaagtccagc

SEQ ID NO: 705365 - DNA, 20 bp, Artificial
  CRISPR gRNA sequence
agaaaatcgaagtccagctg

SEQ ID NO: 705366 - DNA, 20 bp, Artificial
  CRISPR gRNA sequence
aatcgaagtccagctggagt

SEQ ID NO: 705367 - DNA, 20 bp, Artificial
  CRISPR gRNA sequence
cgaagtccagctggagtcag

SEQ ID NO: 705368 - DNA, 20 bp, Artificial
  CRISPR gRNA sequence
gaagtccagctggagtcaga

SEQ ID NO: 705369 - DNA, 20 bp, Artificial
  CRISPR gRNA sequence
aagtccagctggagtcagaa

SEQ ID NO: 705370 - DNA, 20 bp, Artificial
  CRISPR gRNA sequence
ctggagtcagaagggctcca

SEQ ID NO: 705371 - DNA, 20 bp, Artificial
  CRISPR gRNA sequence
gagtcagaagggctccacag

SEQ ID NO: 705372 - DNA, 20 bp, Artificial
  CRISPR gRNA sequence
agaagggctccacagcagac

SEQ ID NO: 705373 - DNA, 20 bp, Artificial
  CRISPR gRNA sequence
gctccacagcagactggctt

SEQ ID NO: 705374 - DNA, 20 bp, Artificial
  CRISPR gRNA sequence
ctccacagcagactggcttc

SEQ ID NO: 705375 - DNA, 20 bp, Artificial
  CRISPR gRNA sequence
gactggcttcgggcgtgtcc

SEQ ID NO: 705376 - DNA, 20 bp, Artificial
  CRISPR gRNA sequence
actggcttcgggcgtgtccc

SEQ ID NO: 705377 - DNA, 20 bp, Artificial
  CRISPR gRNA sequence
ggcttcgggcgtgtcccagg

SEQ ID NO: 705378 - DNA, 20 bp, Artificial
  CRISPR gRNA sequence
gcttcgggcgtgtcccaggc

SEQ ID NO: 705379 - DNA, 20 bp, Artificial
  CRISPR gRNA sequence
cttcgggcgtgtcccaggca

SEQ ID NO: 705380 - DNA, 20 bp, Artificial
  CRISPR gRNA sequence
ggcgtgtcccaggcagggtc

SEQ ID NO: 705381 - DNA, 20 bp, Artificial
  CRISPR gRNA sequence
gcgtgtcccaggcagggtcc

SEQ ID NO: 705382 - DNA, 20 bp, Artificial
  CRISPR gRNA sequence
tgtcccaggcagggtccagg

SEQ ID NO: 705383 - DNA, 20 bp, Artificial
  CRISPR gRNA sequence
cagggtccaggtggcatctg

SEQ ID NO: 705384 - DNA, 20 bp, Artificial
  CRISPR gRNA sequence
agggtccaggtggcatctgc

SEQ ID NO: 705385 - DNA, 20 bp, Artificial
  CRISPR gRNA sequence
ctgtctccatgacctgcctt

SEQ ID NO: 705386 - DNA, 20 bp, Artificial
  CRISPR gRNA sequence
tgtctccatgacctgccttg

SEQ ID NO: 705387 - DNA, 20 bp, Artificial
  CRISPR gRNA sequence
ctgccttgaggtcctccatg

SEQ ID NO: 705388 - DNA, 20 bp, Artificial
  CRISPR gRNA sequence
tgccttgaggtcctccatgt

SEQ ID NO: 705389 - DNA, 20 bp, Artificial
  CRISPR gRNA sequence
tcctccatgtgggttttgcc

SEQ ID NO: 705390 - DNA, 20 bp, Artificial
  CRISPR gRNA sequence
gtgggttttgcctggtattc

SEQ ID NO: 705391 - DNA, 20 bp, Artificial
  CRISPR gRNA sequence
gggttttgcctggtattcca

SEQ ID NO: 705392 - DNA, 20 bp, Artificial
  CRISPR gRNA sequence
gcctggtattccagagaatt

SEQ ID NO: 705393 - DNA, 20 bp, Artificial
  CRISPR gRNA sequence
cctggtattccagagaattc

SEQ ID NO: 705394 - DNA, 20 bp, Artificial
  CRISPR gRNA sequence
ctggtattccagagaattcg

SEQ ID NO: 705395 - DNA, 20 bp, Artificial
  CRISPR gRNA sequence
attcggggctctccacaccc

SEQ ID NO: 705396 - DNA, 20 bp, Artificial
  CRISPR gRNA sequence
tcggggctctccacaccctg

SEQ ID NO: 705397 - DNA, 20 bp, Artificial
  CRISPR gRNA sequence
ggctctccacaccctggaga

SEQ ID NO: 705398 - DNA, 20 bp, Artificial
  CRISPR gRNA sequence
ctccacaccctggagacagt

SEQ ID NO: 705399 - DNA, 20 bp, Artificial
  CRISPR gRNA sequence
tccacaccctggagacagta

SEQ ID NO: 705400 - DNA, 20 bp, Artificial
  CRISPR gRNA sequence
acaccctggagacagtaagg

SEQ ID NO: 705401 - DNA, 20 bp, Artificial
  CRISPR gRNA sequence
caccctggagacagtaaggt

SEQ ID NO: 705402 - DNA, 20 bp, Artificial
  CRISPR gRNA sequence
tggagacagtaaggtgggcg

SEQ ID NO: 705403 - DNA, 20 bp, Artificial
  CRISPR gRNA sequence
agacagtaaggtgggcgcag

SEQ ID NO: 705404 - DNA, 20 bp, Artificial
  CRISPR gRNA sequence
taaggtgggcgcagcagcca

SEQ ID NO: 705405 - DNA, 20 bp, Artificial
  CRISPR gRNA sequence
tgggcgcagcagccacagac

SEQ ID NO: 705406 - DNA, 20 bp, Artificial
  CRISPR gRNA sequence
ccacagacgagcctctgacc

SEQ ID NO: 705407 - DNA, 20 bp, Artificial
  CRISPR gRNA sequence
cagacgagcctctgacccag

SEQ ID NO: 705408 - DNA, 20 bp, Artificial
  CRISPR gRNA sequence
acgagcctctgacccagtgg

SEQ ID NO: 705409 - DNA, 20 bp, Artificial
  CRISPR gRNA sequence
ctgacccagtggaagcctcc

SEQ ID NO: 705410 - DNA, 20 bp, Artificial
  CRISPR gRNA sequence
tgacccagtggaagcctcct

SEQ ID NO: 705411 - DNA, 20 bp, Artificial
  CRISPR gRNA sequence
agtggaagcctcctgggctc

SEQ ID NO: 705412 - DNA, 20 bp, Artificial
  CRISPR gRNA sequence
gaagcctcctgggctctggt

SEQ ID NO: 705413 - DNA, 20 bp, Artificial
  CRISPR gRNA sequence
aagcctcctgggctctggtt

SEQ ID NO: 705414 - DNA, 20 bp, Artificial
  CRISPR gRNA sequence
aaccaatccttgcatgtgcg

SEQ ID NO: 705415 - DNA, 20 bp, Artificial
  CRISPR gRNA sequence
accaatccttgcatgtgcgc

SEQ ID NO: 705416 - DNA, 20 bp, Artificial
  CRISPR gRNA sequence
ccaatccttgcatgtgcgcg

SEQ ID NO: 705417 - DNA, 20 bp, Artificial
  CRISPR gRNA sequence
caatccttgcatgtgcgcgg

SEQ ID NO: 705418 - DNA, 20 bp, Artificial
  CRISPR gRNA sequence
tccttgcatgtgcgcggggg

SEQ ID NO: 705419 - DNA, 20 bp, Artificial
  CRISPR gRNA sequence
ccttgcatgtgcgcgggggt

SEQ ID NO: 705420 - DNA, 20 bp, Artificial
  CRISPR gRNA sequence
cttgcatgtgcgcgggggtg

SEQ ID NO: 705421 - DNA, 20 bp, Artificial
  CRISPR gRNA sequence
ttgcatgtgcgcgggggtgg

SEQ ID NO: 705422 - DNA, 20 bp, Artificial
  CRISPR gRNA sequence
atgtgcgcgggggtgggggt

SEQ ID NO: 705423 - DNA, 20 bp, Artificial
  CRISPR gRNA sequence
tgtgcgcgggggtgggggtt

SEQ ID NO: 705424 - DNA, 20 bp, Artificial
  CRISPR gRNA sequence
tgcgcgggggtgggggttgg

SEQ ID NO: 705425 - DNA, 20 bp, Artificial
  CRISPR gRNA sequence
cgcgggggtgggggttggga

SEQ ID NO: 705426 - DNA, 20 bp, Artificial
  CRISPR gRNA sequence
gggggtgggggttgggagag

SEQ ID NO: 705427 - DNA, 20 bp, Artificial
  CRISPR gRNA sequence
tgggggttgggagagtggtt

SEQ ID NO: 705428 - DNA, 20 bp, Artificial
  CRISPR gRNA sequence
gagtggttcagtgtgttcat

SEQ ID NO: 705429 - DNA, 20 bp, Artificial
  CRISPR gRNA sequence
gttcagtgtgttcattggtt

SEQ ID NO: 705430 - DNA, 20 bp, Artificial
  CRISPR gRNA sequence
gtgttcattggtttagtcat

SEQ ID NO: 705431 - DNA, 20 bp, Artificial
  CRISPR gRNA sequence
tgttcattggtttagtcatt

SEQ ID NO: 705432 - DNA, 20 bp, Artificial
  CRISPR gRNA sequence
ttggtttagtcattaggaat

SEQ ID NO: 705433 - DNA, 20 bp, Artificial
  CRISPR gRNA sequence
ggtttagtcattaggaatga

SEQ ID NO: 705434 - DNA, 20 bp, Artificial
  CRISPR gRNA sequence
ttagtcattaggaatgagag

SEQ ID NO: 705435 - DNA, 20 bp, Artificial
  CRISPR gRNA sequence
gtcattaggaatgagagtgg

SEQ ID NO: 705436 - DNA, 20 bp, Artificial
  CRISPR gRNA sequence
ttaggaatgagagtggcagc

SEQ ID NO: 705437 - DNA, 20 bp, Artificial
  CRISPR gRNA sequence
taggaatgagagtggcagcc

SEQ ID NO: 705438 - DNA, 20 bp, Artificial
  CRISPR gRNA sequence
atgagagtggcagccaggtg

SEQ ID NO: 705439 - DNA, 20 bp, Artificial
  CRISPR gRNA sequence
agagtggcagccaggtgtgg

SEQ ID NO: 705440 - DNA, 20 bp, Artificial
  CRISPR gRNA sequence
gtggctcacgcctgtaatcc

SEQ ID NO: 705441 - DNA, 20 bp, Artificial
  CRISPR gRNA sequence
ctgtaatcccagcactttgc

SEQ ID NO: 705442 - DNA, 20 bp, Artificial
  CRISPR gRNA sequence
tgtaatcccagcactttgca

SEQ ID NO: 705443 - DNA, 20 bp, Artificial
  CRISPR gRNA sequence
tcccagcactttgcaaggcc

SEQ ID NO: 705444 - DNA, 20 bp, Artificial
  CRISPR gRNA sequence
cccagcactttgcaaggcca

SEQ ID NO: 705445 - DNA, 20 bp, Artificial
  CRISPR gRNA sequence
agcactttgcaaggccaagg

SEQ ID NO: 705446 - DNA, 20 bp, Artificial
  CRISPR gRNA sequence
gcactttgcaaggccaaggc

SEQ ID NO: 705447 - DNA, 20 bp, Artificial
  CRISPR gRNA sequence
ctttgcaaggccaaggcggg

SEQ ID NO: 705448 - DNA, 20 bp, Artificial
  CRISPR gRNA sequence
tttgcaaggccaaggcgggc

SEQ ID NO: 705449 - DNA, 20 bp, Artificial
  CRISPR gRNA sequence
caaggccaaggcgggcaggt

SEQ ID NO: 705450 - DNA, 20 bp, Artificial
  CRISPR gRNA sequence
aaggccaaggcgggcaggtc

SEQ ID NO: 705451 - DNA, 20 bp, Artificial
  CRISPR gRNA sequence
ggccaaggcgggcaggtcag

SEQ ID NO: 705452 - DNA, 20 bp, Artificial
  CRISPR gRNA sequence
gccaaggcgggcaggtcagg

SEQ ID NO: 705453 - DNA, 20 bp, Artificial
  CRISPR gRNA sequence
aggcgggcaggtcaggaggt

SEQ ID NO: 705454 - DNA, 20 bp, Artificial
  CRISPR gRNA sequence
ggcgggcaggtcaggaggtc

SEQ ID NO: 705455 - DNA, 20 bp, Artificial
  CRISPR gRNA sequence
cgggcaggtcaggaggtcag

SEQ ID NO: 705456 - DNA, 20 bp, Artificial
  CRISPR gRNA sequence
ggtcaggaggtcaggagttt

SEQ ID NO: 705457 - DNA, 20 bp, Artificial
  CRISPR gRNA sequence
ggaggtcaggagtttgagac

SEQ ID NO: 705458 - DNA, 20 bp, Artificial
  CRISPR gRNA sequence
tcaggagtttgagaccggcc

SEQ ID NO: 705459 - DNA, 20 bp, Artificial
  CRISPR gRNA sequence
tgagaccggcctggccaacg

SEQ ID NO: 705460 - DNA, 20 bp, Artificial
  CRISPR gRNA sequence
tactgaaaatacaaaaaaat

SEQ ID NO: 705461 - DNA, 20 bp, Artificial
  CRISPR gRNA sequence
gaaaatacaaaaaaattagc

SEQ ID NO: 705462 - DNA, 20 bp, Artificial
  CRISPR gRNA sequence
aaaatacaaaaaaattagct

SEQ ID NO: 705463 - DNA, 20 bp, Artificial
  CRISPR gRNA sequence
aaatacaaaaaaattagctg

SEQ ID NO: 705464 - DNA, 20 bp, Artificial
  CRISPR gRNA sequence
acaaaaaaattagctggggt

SEQ ID NO: 705465 - DNA, 20 bp, Artificial
  CRISPR gRNA sequence
aaaaaattagctggggttgg

SEQ ID NO: 705466 - DNA, 20 bp, Artificial
  CRISPR gRNA sequence
ttagctggggttggtggcac

SEQ ID NO: 705467 - DNA, 20 bp, Artificial
  CRISPR gRNA sequence
gtggcacgagcctataatcc

SEQ ID NO: 705468 - DNA, 20 bp, Artificial
  CRISPR gRNA sequence
agcctataatcccagctatt

SEQ ID NO: 705469 - DNA, 20 bp, Artificial
  CRISPR gRNA sequence
gcctataatcccagctattc

SEQ ID NO: 705470 - DNA, 20 bp, Artificial
  CRISPR gRNA sequence
ctataatcccagctattcgg

SEQ ID NO: 705471 - DNA, 20 bp, Artificial
  CRISPR gRNA sequence
tataatcccagctattcggg

SEQ ID NO: 705472 - DNA, 20 bp, Artificial
  CRISPR gRNA sequence
tcccagctattcgggaggct

SEQ ID NO: 705473 - DNA, 20 bp, Artificial
  CRISPR gRNA sequence
cccagctattcgggaggctg

SEQ ID NO: 705474 - DNA, 20 bp, Artificial
  CRISPR gRNA sequence
tattcgggaggctgaggcat

SEQ ID NO: 705475 - DNA, 20 bp, Artificial
  CRISPR gRNA sequence
gcatgagaatcacttgaacc

SEQ ID NO: 705476 - DNA, 20 bp, Artificial
  CRISPR gRNA sequence
catgagaatcacttgaaccc

SEQ ID NO: 705477 - DNA, 20 bp, Artificial
  CRISPR gRNA sequence
tgagaatcacttgaacccag

SEQ ID NO: 705478 - DNA, 20 bp, Artificial
  CRISPR gRNA sequence
gagaatcacttgaacccagg

SEQ ID NO: 705479 - DNA, 20 bp, Artificial
  CRISPR gRNA sequence
aatcacttgaacccaggagg

SEQ ID NO: 705480 - DNA, 20 bp, Artificial
  CRISPR gRNA sequence
tcacttgaacccaggaggcg

SEQ ID NO: 705481 - DNA, 20 bp, Artificial
  CRISPR gRNA sequence
cacttgaacccaggaggcgg

SEQ ID NO: 705482 - DNA, 20 bp, Artificial
  CRISPR gRNA sequence
caggaggcggaggttacatt

SEQ ID NO: 705483 - DNA, 20 bp, Artificial
  CRISPR gRNA sequence
ggcggaggttacattgagcc

SEQ ID NO: 705484 - DNA, 20 bp, Artificial
  CRISPR gRNA sequence
gagatcatgccactgcactc

SEQ ID NO: 705485 - DNA, 20 bp, Artificial
  CRISPR gRNA sequence
catgccactgcactctagcc

SEQ ID NO: 705486 - DNA, 20 bp, Artificial
  CRISPR gRNA sequence
atgccactgcactctagcct

SEQ ID NO: 705487 - DNA, 20 bp, Artificial
  CRISPR gRNA sequence
ctgcactctagcctgggtga

SEQ ID NO: 705488 - DNA, 20 bp, Artificial
  CRISPR gRNA sequence
gcactctagcctgggtgaca

SEQ ID NO: 705489 - DNA, 20 bp, Artificial
  CRISPR gRNA sequence
tctagcctgggtgacagagt

SEQ ID NO: 705490 - DNA, 20 bp, Artificial
  CRISPR gRNA sequence
tctcaaaaaaaaaaaaaaaa

SEQ ID NO: 705491 - DNA, 20 bp, Artificial
  CRISPR gRNA sequence
ctcaaaaaaaaaaaaaaaaa

SEQ ID NO: 705492 - DNA, 20 bp, Artificial
  CRISPR gRNA sequence
aaaaaaaaaaaaaaaggaat

SEQ ID NO: 705493 - DNA, 20 bp, Artificial
  CRISPR gRNA sequence
aaaaaaaaaaaaaggaatga

SEQ ID NO: 705494 - DNA, 20 bp, Artificial
  CRISPR gRNA sequence
aaaaaaaaaaggaatgagag

SEQ ID NO: 705495 - DNA, 20 bp, Artificial
  CRISPR gRNA sequence
aaaaaaggaatgagagtggc

SEQ ID NO: 705496 - DNA, 20 bp, Artificial
  CRISPR gRNA sequence
aaaaaggaatgagagtggcc

SEQ ID NO: 705497 - DNA, 20 bp, Artificial
  CRISPR gRNA sequence
aaaaggaatgagagtggcca

SEQ ID NO: 705498 - DNA, 20 bp, Artificial
  CRISPR gRNA sequence
aaaggaatgagagtggccag

SEQ ID NO: 705499 - DNA, 20 bp, Artificial
  CRISPR gRNA sequence
gaatgagagtggccagggga

SEQ ID NO: 705500 - DNA, 20 bp, Artificial
  CRISPR gRNA sequence
atgagagtggccaggggata

SEQ ID NO: 705501 - DNA, 20 bp, Artificial
  CRISPR gRNA sequence
tgagagtggccaggggatag

SEQ ID NO: 705502 - DNA, 20 bp, Artificial
  CRISPR gRNA sequence
gagtggccaggggatagagg

SEQ ID NO: 705503 - DNA, 20 bp, Artificial
  CRISPR gRNA sequence
ccctgtcctccatctgccac

SEQ ID NO: 705504 - DNA, 20 bp, Artificial
  CRISPR gRNA sequence
ctgtcctccatctgccactg

SEQ ID NO: 705505 - DNA, 20 bp, Artificial
  CRISPR gRNA sequence
tcctccatctgccactggag

SEQ ID NO: 705506 - DNA, 20 bp, Artificial
  CRISPR gRNA sequence
ccatctgccactggagaagt

SEQ ID NO: 705507 - DNA, 20 bp, Artificial
  CRISPR gRNA sequence
gaagtgagcctccttgcctt

SEQ ID NO: 705508 - DNA, 20 bp, Artificial
  CRISPR gRNA sequence
tgagcctccttgccttgagc

SEQ ID NO: 705509 - DNA, 20 bp, Artificial
  CRISPR gRNA sequence
gagcctccttgccttgagct

SEQ ID NO: 705510 - DNA, 20 bp, Artificial
  CRISPR gRNA sequence
agcctccttgccttgagctg

SEQ ID NO: 705511 - DNA, 20 bp, Artificial
  CRISPR gRNA sequence
ctccttgccttgagctgggg

SEQ ID NO: 705512 - DNA, 20 bp, Artificial
  CRISPR gRNA sequence
tccttgccttgagctggggt

SEQ ID NO: 705513 - DNA, 20 bp, Artificial
  CRISPR gRNA sequence
cactgactctgaaacccatc

SEQ ID NO: 705514 - DNA, 20 bp, Artificial
  CRISPR gRNA sequence
actgactctgaaacccatcg

SEQ ID NO: 705515 - DNA, 20 bp, Artificial
  CRISPR gRNA sequence
ctgactctgaaacccatcga

SEQ ID NO: 705516 - DNA, 20 bp, Artificial
  CRISPR gRNA sequence
gaaacccatcgagggctctc

SEQ ID NO: 705517 - DNA, 20 bp, Artificial
  CRISPR gRNA sequence
catcgagggctctccagact

SEQ ID NO: 705518 - DNA, 20 bp, Artificial
  CRISPR gRNA sequence
atcgagggctctccagactg

SEQ ID NO: 705519 - DNA, 20 bp, Artificial
  CRISPR gRNA sequence
cagactgaggacctgacccc

SEQ ID NO: 705520 - DNA, 20 bp, Artificial
  CRISPR gRNA sequence
agactgaggacctgacccct

SEQ ID NO: 705521 - DNA, 20 bp, Artificial
  CRISPR gRNA sequence
gaggacctgacccctgggct

SEQ ID NO: 705522 - DNA, 20 bp, Artificial
  CRISPR gRNA sequence
cctgacccctgggctgagtt

SEQ ID NO: 705523 - DNA, 20 bp, Artificial
  CRISPR gRNA sequence
gttcagcaccacctgtgatc

SEQ ID NO: 705524 - DNA, 20 bp, Artificial
  CRISPR gRNA sequence
ttcagcaccacctgtgatcc

SEQ ID NO: 705525 - DNA, 20 bp, Artificial
  CRISPR gRNA sequence
cagcaccacctgtgatccag

SEQ ID NO: 705526 - DNA, 20 bp, Artificial
  CRISPR gRNA sequence
agcaccacctgtgatccagg

SEQ ID NO: 705527 - DNA, 20 bp, Artificial
  CRISPR gRNA sequence
ccaggaggaccatttgccaa

SEQ ID NO: 705528 - DNA, 20 bp, Artificial
  CRISPR gRNA sequence
gaggaccatttgccaatagt

SEQ ID NO: 705529 - DNA, 20 bp, Artificial
  CRISPR gRNA sequence
aggaccatttgccaatagtt

SEQ ID NO: 705530 - DNA, 20 bp, Artificial
  CRISPR gRNA sequence
ggaccatttgccaatagttg

SEQ ID NO: 705531 - DNA, 20 bp, Artificial
  CRISPR gRNA sequence
ccatttgccaatagttgggg

SEQ ID NO: 705532 - DNA, 20 bp, Artificial
  CRISPR gRNA sequence
catttgccaatagttggggc

SEQ ID NO: 705533 - DNA, 20 bp, Artificial
  CRISPR gRNA sequence
ttgccaatagttggggcggg

SEQ ID NO: 705534 - DNA, 20 bp, Artificial
  CRISPR gRNA sequence
tgccaatagttggggcgggt

SEQ ID NO: 705535 - DNA, 20 bp, Artificial
  CRISPR gRNA sequence
gccaatagttggggcgggtg

SEQ ID NO: 705536 - DNA, 20 bp, Artificial
  CRISPR gRNA sequence
atagttggggcgggtggggc

SEQ ID NO: 705537 - DNA, 20 bp, Artificial
  CRISPR gRNA sequence
tagttggggcgggtggggcc

SEQ ID NO: 705538 - DNA, 20 bp, Artificial
  CRISPR gRNA sequence
agttggggcgggtggggccg

SEQ ID NO: 705539 - DNA, 20 bp, Artificial
  CRISPR gRNA sequence
gttggggcgggtggggccgg

SEQ ID NO: 705540 - DNA, 20 bp, Artificial
  CRISPR gRNA sequence
cgggtggggccgggggctgc

SEQ ID NO: 705541 - DNA, 20 bp, Artificial
  CRISPR gRNA sequence
ccgggggctgccagactcct

SEQ ID NO: 705542 - DNA, 20 bp, Artificial
  CRISPR gRNA sequence
ggctgccagactccttggtg

SEQ ID NO: 705543 - DNA, 20 bp, Artificial
  CRISPR gRNA sequence
gttgctgctcttgctttttg

SEQ ID NO: 705544 - DNA, 20 bp, Artificial
  CRISPR gRNA sequence
ctcttgctttttgcagattc

SEQ ID NO: 705545 - DNA, 20 bp, Artificial
  CRISPR gRNA sequence
ctttttgcagattccagacc

SEQ ID NO: 705546 - DNA, 20 bp, Artificial
  CRISPR gRNA sequence
tttttgcagattccagaccc

SEQ ID NO: 705547 - DNA, 20 bp, Artificial
  CRISPR gRNA sequence
tttgcagattccagacccag

SEQ ID NO: 705548 - DNA, 20 bp, Artificial
  CRISPR gRNA sequence
ttgcagattccagacccagg

SEQ ID NO: 705549 - DNA, 20 bp, Artificial
  CRISPR gRNA sequence
gcagattccagacccaggag

SEQ ID NO: 705550 - DNA, 20 bp, Artificial
  CRISPR gRNA sequence
cagacccaggaggagctcaa

SEQ ID NO: 705551 - DNA, 20 bp, Artificial
  CRISPR gRNA sequence
cccaggaggagctcaacggt

SEQ ID NO: 705552 - DNA, 20 bp, Artificial
  CRISPR gRNA sequence
cccctcccttgcccccacct

SEQ ID NO: 705553 - DNA, 20 bp, Artificial
  CRISPR gRNA sequence
aaatctgactccttccctaa

SEQ ID NO: 705554 - DNA, 20 bp, Artificial
  CRISPR gRNA sequence
ctccttccctaacagatctg

SEQ ID NO: 705555 - DNA, 20 bp, Artificial
  CRISPR gRNA sequence
cctaacagatctgaagtttt

SEQ ID NO: 705556 - DNA, 20 bp, Artificial
  CRISPR gRNA sequence
taacagatctgaagttttga

SEQ ID NO: 705557 - DNA, 20 bp, Artificial
  CRISPR gRNA sequence
tctgaagttttgagagctgc

SEQ ID NO: 705558 - DNA, 20 bp, Artificial
  CRISPR gRNA sequence
ctgaagttttgagagctgct

SEQ ID NO: 705559 - DNA, 20 bp, Artificial
  CRISPR gRNA sequence
tgaagttttgagagctgctg

SEQ ID NO: 705560 - DNA, 20 bp, Artificial
  CRISPR gRNA sequence
gaagttttgagagctgctgg

SEQ ID NO: 705561 - DNA, 20 bp, Artificial
  CRISPR gRNA sequence
gttttgagagctgctggggg

SEQ ID NO: 705562 - DNA, 20 bp, Artificial
  CRISPR gRNA sequence
ttttgagagctgctggggga

SEQ ID NO: 705563 - DNA, 20 bp, Artificial
  CRISPR gRNA sequence
tttgagagctgctgggggaa

SEQ ID NO: 705564 - DNA, 20 bp, Artificial
  CRISPR gRNA sequence
tgagagctgctgggggaagg

SEQ ID NO: 705565 - DNA, 20 bp, Artificial
  CRISPR gRNA sequence
agagctgctgggggaaggga

SEQ ID NO: 705566 - DNA, 20 bp, Artificial
  CRISPR gRNA sequence
gagctgctgggggaagggag

SEQ ID NO: 705567 - DNA, 20 bp, Artificial
  CRISPR gRNA sequence
agctgctgggggaagggaga

SEQ ID NO: 705568 - DNA, 20 bp, Artificial
  CRISPR gRNA sequence
ctgctgggggaagggagagg

SEQ ID NO: 705569 - DNA, 20 bp, Artificial
  CRISPR gRNA sequence
tgctgggggaagggagaggg

SEQ ID NO: 705570 - DNA, 20 bp, Artificial
  CRISPR gRNA sequence
gctgggggaagggagaggga

SEQ ID NO: 705571 - DNA, 20 bp, Artificial
  CRISPR gRNA sequence
ctgggggaagggagagggag

SEQ ID NO: 705572 - DNA, 20 bp, Artificial
  CRISPR gRNA sequence
gggaagggagagggagggga

SEQ ID NO: 705573 - DNA, 20 bp, Artificial
  CRISPR gRNA sequence
gggagagggaggggacggac

SEQ ID NO: 705574 - DNA, 20 bp, Artificial
  CRISPR gRNA sequence
gactggccattcccctccca

SEQ ID NO: 705575 - DNA, 20 bp, Artificial
  CRISPR gRNA sequence
cattcccctcccacagtgcc

SEQ ID NO: 705576 - DNA, 20 bp, Artificial
  CRISPR gRNA sequence
attcccctcccacagtgccc

SEQ ID NO: 705577 - DNA, 20 bp, Artificial
  CRISPR gRNA sequence
ttcccctcccacagtgccca

SEQ ID NO: 705578 - DNA, 20 bp, Artificial
  CRISPR gRNA sequence
ctcccacagtgcccagggtg

SEQ ID NO: 705579 - DNA, 20 bp, Artificial
  CRISPR gRNA sequence
tcccacagtgcccagggtgc

SEQ ID NO: 705580 - DNA, 20 bp, Artificial
  CRISPR gRNA sequence
agggtgcaggcccgtcctgc

SEQ ID NO: 705581 - DNA, 20 bp, Artificial
  CRISPR gRNA sequence
gcaggcccgtcctgcaagtt

SEQ ID NO: 705582 - DNA, 20 bp, Artificial
  CRISPR gRNA sequence
caggcccgtcctgcaagttc

SEQ ID NO: 705583 - DNA, 20 bp, Artificial
  CRISPR gRNA sequence
ccgtcctgcaagttcaggct

SEQ ID NO: 705584 - DNA, 20 bp, Artificial
  CRISPR gRNA sequence
aggctgagtctgacccacca

SEQ ID NO: 705585 - DNA, 20 bp, Artificial
  CRISPR gRNA sequence
ggctgagtctgacccaccac

SEQ ID NO: 705586 - DNA, 20 bp, Artificial
  CRISPR gRNA sequence
gctgagtctgacccaccaca

SEQ ID NO: 705587 - DNA, 20 bp, Artificial
  CRISPR gRNA sequence
accacagggacctctgtgca

SEQ ID NO: 705588 - DNA, 20 bp, Artificial
  CRISPR gRNA sequence
cacagggacctctgtgcaca

SEQ ID NO: 705589 - DNA, 20 bp, Artificial
  CRISPR gRNA sequence
acagggacctctgtgcacag

SEQ ID NO: 705590 - DNA, 20 bp, Artificial
  CRISPR gRNA sequence
ctgtgcacagaggcctcgcc

SEQ ID NO: 705591 - DNA, 20 bp, Artificial
  CRISPR gRNA sequence
tgtgcacagaggcctcgcct

SEQ ID NO: 705592 - DNA, 20 bp, Artificial
  CRISPR gRNA sequence
gtgcacagaggcctcgcctg

SEQ ID NO: 705593 - DNA, 20 bp, Artificial
  CRISPR gRNA sequence
agaggcctcgcctggggcct

SEQ ID NO: 705594 - DNA, 20 bp, Artificial
  CRISPR gRNA sequence
gcctcgcctggggcctcagc

SEQ ID NO: 705595 - DNA, 20 bp, Artificial
  CRISPR gRNA sequence
cctcgcctggggcctcagcc

SEQ ID NO: 705596 - DNA, 20 bp, Artificial
  CRISPR gRNA sequence
ctggggcctcagccaggcct

SEQ ID NO: 705597 - DNA, 20 bp, Artificial
  CRISPR gRNA sequence
gcctcagccaggccttggct

SEQ ID NO: 705598 - DNA, 20 bp, Artificial
  CRISPR gRNA sequence
cctcagccaggccttggcta

SEQ ID NO: 705599 - DNA, 20 bp, Artificial
  CRISPR gRNA sequence
agccaggccttggctaagga

SEQ ID NO: 705600 - DNA, 20 bp, Artificial
  CRISPR gRNA sequence
ccaggccttggctaaggatg

SEQ ID NO: 705601 - DNA, 20 bp, Artificial
  CRISPR gRNA sequence
aggccttggctaaggatgga

SEQ ID NO: 705602 - DNA, 20 bp, Artificial
  CRISPR gRNA sequence
gatggagagccccaccctca

SEQ ID NO: 705603 - DNA, 20 bp, Artificial
  CRISPR gRNA sequence
ggagagccccaccctcatag

SEQ ID NO: 705604 - DNA, 20 bp, Artificial
  CRISPR gRNA sequence
cccaccctcatagcagcctc

SEQ ID NO: 705605 - DNA, 20 bp, Artificial
  CRISPR gRNA sequence
tcatagcagcctccagctcc

SEQ ID NO: 705606 - DNA, 20 bp, Artificial
  CRISPR gRNA sequence
gcagcctccagctcctggct

SEQ ID NO: 705607 - DNA, 20 bp, Artificial
  CRISPR gRNA sequence
cagctcctggctcagcctgc

SEQ ID NO: 705608 - DNA, 20 bp, Artificial
  CRISPR gRNA sequence
agctcctggctcagcctgcc

SEQ ID NO: 705609 - DNA, 20 bp, Artificial
  CRISPR gRNA sequence
ctcagcctgccgggaatttc

SEQ ID NO: 705610 - DNA, 20 bp, Artificial
  CRISPR gRNA sequence
agcctgccgggaatttccag

SEQ ID NO: 705611 - DNA, 20 bp, Artificial
  CRISPR gRNA sequence
gcctgccgggaatttccaga

SEQ ID NO: 705612 - DNA, 20 bp, Artificial
  CRISPR gRNA sequence
cctgccgggaatttccagaa

SEQ ID NO: 705613 - DNA, 20 bp, Artificial
  CRISPR gRNA sequence
tttccagaagggcctgcaca

SEQ ID NO: 705614 - DNA, 20 bp, Artificial
  CRISPR gRNA sequence
ccagaagggcctgcacacag

SEQ ID NO: 705615 - DNA, 20 bp, Artificial
  CRISPR gRNA sequence
gggcctgcacacagtggatt

SEQ ID NO: 705616 - DNA, 20 bp, Artificial
  CRISPR gRNA sequence
tgcacacagtggatttggtt

SEQ ID NO: 705617 - DNA, 20 bp, Artificial
  CRISPR gRNA sequence
gcacacagtggatttggttt

SEQ ID NO: 705618 - DNA, 20 bp, Artificial
  CRISPR gRNA sequence
gatttggtttgggccacttt

SEQ ID NO: 705619 - DNA, 20 bp, Artificial
  CRISPR gRNA sequence
atttggtttgggccactttt

SEQ ID NO: 705620 - DNA, 20 bp, Artificial
  CRISPR gRNA sequence
tttgggccacttttgggtac

SEQ ID NO: 705621 - DNA, 20 bp, Artificial
  CRISPR gRNA sequence
ttgggccacttttgggtacc

SEQ ID NO: 705622 - DNA, 20 bp, Artificial
  CRISPR gRNA sequence
ccacttttgggtaccaggtc

SEQ ID NO: 705623 - DNA, 20 bp, Artificial
  CRISPR gRNA sequence
ttttgggtaccaggtctggt

SEQ ID NO: 705624 - DNA, 20 bp, Artificial
  CRISPR gRNA sequence
tttgggtaccaggtctggtc

SEQ ID NO: 705625 - DNA, 20 bp, Artificial
  CRISPR gRNA sequence
tgggtaccaggtctggtcag

SEQ ID NO: 705626 - DNA, 20 bp, Artificial
  CRISPR gRNA sequence
gggtaccaggtctggtcagg

SEQ ID NO: 705627 - DNA, 20 bp, Artificial
  CRISPR gRNA sequence
taccaggtctggtcaggagg

SEQ ID NO: 705628 - DNA, 20 bp, Artificial
  CRISPR gRNA sequence
ttccatgaatctcatcctcc

SEQ ID NO: 705629 - DNA, 20 bp, Artificial
  CRISPR gRNA sequence
atgaatctcatcctccaagc

SEQ ID NO: 705630 - DNA, 20 bp, Artificial
  CRISPR gRNA sequence
tcatcctccaagctggatga

SEQ ID NO: 705631 - DNA, 20 bp, Artificial
  CRISPR gRNA sequence
atcctccaagctggatgaca

SEQ ID NO: 705632 - DNA, 20 bp, Artificial
  CRISPR gRNA sequence
ctccaagctggatgacagag

SEQ ID NO: 705633 - DNA, 20 bp, Artificial
  CRISPR gRNA sequence
tccaagctggatgacagagc

SEQ ID NO: 705634 - DNA, 20 bp, Artificial
  CRISPR gRNA sequence
aagctggatgacagagcagg

SEQ ID NO: 705635 - DNA, 20 bp, Artificial
  CRISPR gRNA sequence
gatgacagagcaggtggcta

SEQ ID NO: 705636 - DNA, 20 bp, Artificial
  CRISPR gRNA sequence
ttttttttttccccatctgt

SEQ ID NO: 705637 - DNA, 20 bp, Artificial
  CRISPR gRNA sequence
ccattactttcttttaattc

SEQ ID NO: 705638 - DNA, 20 bp, Artificial
  CRISPR gRNA sequence
aattcaagcattcatacatt

SEQ ID NO: 705639 - DNA, 20 bp, Artificial
  CRISPR gRNA sequence
tcaagcattcatacattaag

SEQ ID NO: 705640 - DNA, 20 bp, Artificial
  CRISPR gRNA sequence
caagcattcatacattaaga

SEQ ID NO: 705641 - DNA, 20 bp, Artificial
  CRISPR gRNA sequence
aagcattcatacattaagaa

SEQ ID NO: 705642 - DNA, 20 bp, Artificial
  CRISPR gRNA sequence
aatatacacaaccataatgc

SEQ ID NO: 705643 - DNA, 20 bp, Artificial
  CRISPR gRNA sequence
acacaaccataatgctagtt

SEQ ID NO: 705644 - DNA, 20 bp, Artificial
  CRISPR gRNA sequence
gctagttcagtttcaaatta

SEQ ID NO: 705645 - DNA, 20 bp, Artificial
  CRISPR gRNA sequence
ctagttcagtttcaaattat

SEQ ID NO: 705646 - DNA, 20 bp, Artificial
  CRISPR gRNA sequence
tagttcagtttcaaattatg

SEQ ID NO: 705647 - DNA, 20 bp, Artificial
  CRISPR gRNA sequence
agttcagtttcaaattatgg

SEQ ID NO: 705648 - DNA, 20 bp, Artificial
  CRISPR gRNA sequence
ggatcacattcgaatatgct

SEQ ID NO: 705649 - DNA, 20 bp, Artificial
  CRISPR gRNA sequence
cgaatatgcttggatgtgac

SEQ ID NO: 705650 - DNA, 20 bp, Artificial
  CRISPR gRNA sequence
atatgcttggatgtgacaag

SEQ ID NO: 705651 - DNA, 20 bp, Artificial
  CRISPR gRNA sequence
caagtggctgttacaatact

SEQ ID NO: 705652 - DNA, 20 bp, Artificial
  CRISPR gRNA sequence
aatactgagaaatttcatga

SEQ ID NO: 705653 - DNA, 20 bp, Artificial
  CRISPR gRNA sequence
tactgagaaatttcatgaaa

SEQ ID NO: 705654 - DNA, 20 bp, Artificial
  CRISPR gRNA sequence
actgagaaatttcatgaaag

SEQ ID NO: 705655 - DNA, 20 bp, Artificial
  CRISPR gRNA sequence
agaggtattcaacaatttgt

SEQ ID NO: 705656 - DNA, 20 bp, Artificial
  CRISPR gRNA sequence
gaggtattcaacaatttgta

SEQ ID NO: 705657 - DNA, 20 bp, Artificial
  CRISPR gRNA sequence
tcaaatatgtttttgctgca

SEQ ID NO: 705658 - DNA, 20 bp, Artificial
  CRISPR gRNA sequence
caaatatgtttttgctgcat

SEQ ID NO: 705659 - DNA, 20 bp, Artificial
  CRISPR gRNA sequence
tgcataggccaatgcattaa

SEQ ID NO: 705660 - DNA, 20 bp, Artificial
  CRISPR gRNA sequence
tagtaacttgttttaaaatg

SEQ ID NO: 705661 - DNA, 20 bp, Artificial
  CRISPR gRNA sequence
tgttttaaaatgcagtcttt

SEQ ID NO: 705662 - DNA, 20 bp, Artificial
  CRISPR gRNA sequence
ttaaaatgcagtcttttggc

SEQ ID NO: 705663 - DNA, 20 bp, Artificial
  CRISPR gRNA sequence
agtcttttggccggatatga

SEQ ID NO: 705664 - DNA, 20 bp, Artificial
  CRISPR gRNA sequence
atggctcacacttaaaatcc

SEQ ID NO: 705665 - DNA, 20 bp, Artificial
  CRISPR gRNA sequence
cacttaaaatcccagcattt

SEQ ID NO: 705666 - DNA, 20 bp, Artificial
  CRISPR gRNA sequence
acttaaaatcccagcatttt

SEQ ID NO: 705667 - DNA, 20 bp, Artificial
  CRISPR gRNA sequence
ttaaaatcccagcattttgg

SEQ ID NO: 705668 - DNA, 20 bp, Artificial
  CRISPR gRNA sequence
taaaatcccagcattttggg

SEQ ID NO: 705669 - DNA, 20 bp, Artificial
  CRISPR gRNA sequence
tcccagcattttgggaggct

SEQ ID NO: 705670 - DNA, 20 bp, Artificial
  CRISPR gRNA sequence
cccagcattttgggaggctg

SEQ ID NO: 705671 - DNA, 20 bp, Artificial
  CRISPR gRNA sequence
agcattttgggaggctgagg

SEQ ID NO: 705672 - DNA, 20 bp, Artificial
  CRISPR gRNA sequence
gcattttgggaggctgaggc

SEQ ID NO: 705673 - DNA, 20 bp, Artificial
  CRISPR gRNA sequence
ttttgggaggctgaggcagg

SEQ ID NO: 705674 - DNA, 20 bp, Artificial
  CRISPR gRNA sequence
ctgaggcaggcggatcacct

SEQ ID NO: 705675 - DNA, 20 bp, Artificial
  CRISPR gRNA sequence
tgaggcaggcggatcacctg

SEQ ID NO: 705676 - DNA, 20 bp, Artificial
  CRISPR gRNA sequence
gcaggcggatcacctgaggt

SEQ ID NO: 705677 - DNA, 20 bp, Artificial
  CRISPR gRNA sequence
caggcggatcacctgaggtc

SEQ ID NO: 705678 - DNA, 20 bp, Artificial
  CRISPR gRNA sequence
ggcggatcacctgaggtcag

SEQ ID NO: 705679 - DNA, 20 bp, Artificial
  CRISPR gRNA sequence
tcacctgaggtcaggagttc

SEQ ID NO: 705680 - DNA, 20 bp, Artificial
  CRISPR gRNA sequence
tgaggtcaggagttcgagac

SEQ ID NO: 705681 - DNA, 20 bp, Artificial
  CRISPR gRNA sequence
cgagaccagccttgccaaca

SEQ ID NO: 705682 - DNA, 20 bp, Artificial
  CRISPR gRNA sequence
gtctctactaaaactacaaa

SEQ ID NO: 705683 - DNA, 20 bp, Artificial
  CRISPR gRNA sequence
ctaaaactacaaaaagtatc

SEQ ID NO: 705684 - DNA, 20 bp, Artificial
  CRISPR gRNA sequence
taaaactacaaaaagtatcc

SEQ ID NO: 705685 - DNA, 20 bp, Artificial
  CRISPR gRNA sequence
ctacaaaaagtatccaggtg

SEQ ID NO: 705686 - DNA, 20 bp, Artificial
  CRISPR gRNA sequence
caaaaagtatccaggtgtag

SEQ ID NO: 705687 - DNA, 20 bp, Artificial
  CRISPR gRNA sequence
ggtgtagtggcacacgcctg

SEQ ID NO: 705688 - DNA, 20 bp, Artificial
  CRISPR gRNA sequence
gtggcacacgcctgtagtcc

SEQ ID NO: 705689 - DNA, 20 bp, Artificial
  CRISPR gRNA sequence
cgcctgtagtcccagctact

SEQ ID NO: 705690 - DNA, 20 bp, Artificial
  CRISPR gRNA sequence
gcctgtagtcccagctactc

SEQ ID NO: 705691 - DNA, 20 bp, Artificial
  CRISPR gRNA sequence
ctgtagtcccagctactcag

SEQ ID NO: 705692 - DNA, 20 bp, Artificial
  CRISPR gRNA sequence
tgtagtcccagctactcagg

SEQ ID NO: 705693 - DNA, 20 bp, Artificial
  CRISPR gRNA sequence
tcccagctactcaggaggct

SEQ ID NO: 705694 - DNA, 20 bp, Artificial
  CRISPR gRNA sequence
cccagctactcaggaggctg

SEQ ID NO: 705695 - DNA, 20 bp, Artificial
  CRISPR gRNA sequence
agctactcaggaggctgagg

SEQ ID NO: 705696 - DNA, 20 bp, Artificial
  CRISPR gRNA sequence
gctactcaggaggctgaggc

SEQ ID NO: 705697 - DNA, 20 bp, Artificial
  CRISPR gRNA sequence
tactcaggaggctgaggcag

SEQ ID NO: 705698 - DNA, 20 bp, Artificial
  CRISPR gRNA sequence
ctgaggcaggagaatcgctt

SEQ ID NO: 705699 - DNA, 20 bp, Artificial
  CRISPR gRNA sequence
gcaggagaatcgcttgagcc

SEQ ID NO: 705700 - DNA, 20 bp, Artificial
  CRISPR gRNA sequence
caggagaatcgcttgagcct

SEQ ID NO: 705701 - DNA, 20 bp, Artificial
  CRISPR gRNA sequence
aggagaatcgcttgagcctg

SEQ ID NO: 705702 - DNA, 20 bp, Artificial
  CRISPR gRNA sequence
ggagaatcgcttgagcctgg

SEQ ID NO: 705703 - DNA, 20 bp, Artificial
  CRISPR gRNA sequence
aatcgcttgagcctggggga

SEQ ID NO: 705704 - DNA, 20 bp, Artificial
  CRISPR gRNA sequence
tcgcttgagcctgggggaca

SEQ ID NO: 705705 - DNA, 20 bp, Artificial
  CRISPR gRNA sequence
cgcttgagcctgggggacag

SEQ ID NO: 705706 - DNA, 20 bp, Artificial
  CRISPR gRNA sequence
agcctgggggacagaggttg

SEQ ID NO: 705707 - DNA, 20 bp, Artificial
  CRISPR gRNA sequence
gcctgggggacagaggttgc

SEQ ID NO: 705708 - DNA, 20 bp, Artificial
  CRISPR gRNA sequence
cctgggggacagaggttgca

SEQ ID NO: 705709 - DNA, 20 bp, Artificial
  CRISPR gRNA sequence
tgggggacagaggttgcagg

SEQ ID NO: 705710 - DNA, 20 bp, Artificial
  CRISPR gRNA sequence
gacagaggttgcagggagcc

SEQ ID NO: 705711 - DNA, 20 bp, Artificial
  CRISPR gRNA sequence
agattgcaccactgctctcc

SEQ ID NO: 705712 - DNA, 20 bp, Artificial
  CRISPR gRNA sequence
gcaccactgctctcccagcc

SEQ ID NO: 705713 - DNA, 20 bp, Artificial
  CRISPR gRNA sequence
caccactgctctcccagccc

SEQ ID NO: 705714 - DNA, 20 bp, Artificial
  CRISPR gRNA sequence
tgctctcccagcccgggtaa

SEQ ID NO: 705715 - DNA, 20 bp, Artificial
  CRISPR gRNA sequence
ctctcccagcccgggtaaca

SEQ ID NO: 705716 - DNA, 20 bp, Artificial
  CRISPR gRNA sequence
cccagcccgggtaacagagt

SEQ ID NO: 705717 - DNA, 20 bp, Artificial
  CRISPR gRNA sequence
tctgaaaaaaaaaaaaaaaa

SEQ ID NO: 705718 - DNA, 20 bp, Artificial
  CRISPR gRNA sequence
ctgaaaaaaaaaaaaaaaaa

SEQ ID NO: 705719 - DNA, 20 bp, Artificial
  CRISPR gRNA sequence
aaaaaaaaaaaaaaaaaagg

SEQ ID NO: 705720 - DNA, 20 bp, Artificial
  CRISPR gRNA sequence
aaaaaaaaaaggcagtcttt

SEQ ID NO: 705721 - DNA, 20 bp, Artificial
  CRISPR gRNA sequence
tagccttcatattattatga

SEQ ID NO: 705722 - DNA, 20 bp, Artificial
  CRISPR gRNA sequence
gccttcatattattatgaaa

SEQ ID NO: 705723 - DNA, 20 bp, Artificial
  CRISPR gRNA sequence
attattatgaaagagtattc

SEQ ID NO: 705724 - DNA, 20 bp, Artificial
  CRISPR gRNA sequence
tattatgaaagagtattcaa

SEQ ID NO: 705725 - DNA, 20 bp, Artificial
  CRISPR gRNA sequence
agtattcaagagtatgtatt

SEQ ID NO: 705726 - DNA, 20 bp, Artificial
  CRISPR gRNA sequence
gtattcaagagtatgtatta

SEQ ID NO: 705727 - DNA, 20 bp, Artificial
  CRISPR gRNA sequence
tcaagagtatgtattaaggt

SEQ ID NO: 705728 - DNA, 20 bp, Artificial
  CRISPR gRNA sequence
ttggtgccatttgccattaa

SEQ ID NO: 705729 - DNA, 20 bp, Artificial
  CRISPR gRNA sequence
ccatttgccattaaaagtaa

SEQ ID NO: 705730 - DNA, 20 bp, Artificial
  CRISPR gRNA sequence
attaaaagtaatggcaaacc

SEQ ID NO: 705731 - DNA, 20 bp, Artificial
  CRISPR gRNA sequence
acctggtttaacccttctga

SEQ ID NO: 705732 - DNA, 20 bp, Artificial
  CRISPR gRNA sequence
cctggtttaacccttctgat

SEQ ID NO: 705733 - DNA, 20 bp, Artificial
  CRISPR gRNA sequence
ggtttaacccttctgatagg

SEQ ID NO: 705734 - DNA, 20 bp, Artificial
  CRISPR gRNA sequence
acccttctgataggtagttg

SEQ ID NO: 705735 - DNA, 20 bp, Artificial
  CRISPR gRNA sequence
tgataggtagttgtggatgt

SEQ ID NO: 705736 - DNA, 20 bp, Artificial
  CRISPR gRNA sequence
gataggtagttgtggatgtt

SEQ ID NO: 705737 - DNA, 20 bp, Artificial
  CRISPR gRNA sequence
ataggtagttgtggatgttg

SEQ ID NO: 705738 - DNA, 20 bp, Artificial
  CRISPR gRNA sequence
tagttgtggatgttggggtt

SEQ ID NO: 705739 - DNA, 20 bp, Artificial
  CRISPR gRNA sequence
gtggatgttggggttgagaa

SEQ ID NO: 705740 - DNA, 20 bp, Artificial
  CRISPR gRNA sequence
agaacagaataatctttgtc

SEQ ID NO: 705741 - DNA, 20 bp, Artificial
  CRISPR gRNA sequence
aacagaataatctttgtctg

SEQ ID NO: 705742 - DNA, 20 bp, Artificial
  CRISPR gRNA sequence
tctggagtgacaccacactc

SEQ ID NO: 705743 - DNA, 20 bp, Artificial
  CRISPR gRNA sequence
tttccactttgaaaaatact

SEQ ID NO: 705744 - DNA, 20 bp, Artificial
  CRISPR gRNA sequence
ttttttttttttaatttttt

SEQ ID NO: 705745 - DNA, 20 bp, Artificial
  CRISPR gRNA sequence
tagtatttattgatcattct

SEQ ID NO: 705746 - DNA, 20 bp, Artificial
  CRISPR gRNA sequence
agtatttattgatcattctt

SEQ ID NO: 705747 - DNA, 20 bp, Artificial
  CRISPR gRNA sequence
gatcattcttgggtgtttct

SEQ ID NO: 705748 - DNA, 20 bp, Artificial
  CRISPR gRNA sequence
tcattcttgggtgtttctca

SEQ ID NO: 705749 - DNA, 20 bp, Artificial
  CRISPR gRNA sequence
attcttgggtgtttctcaga

SEQ ID NO: 705750 - DNA, 20 bp, Artificial
  CRISPR gRNA sequence
ttcttgggtgtttctcagag

SEQ ID NO: 705751 - DNA, 20 bp, Artificial
  CRISPR gRNA sequence
tcttgggtgtttctcagaga

SEQ ID NO: 705752 - DNA, 20 bp, Artificial
  CRISPR gRNA sequence
cttgggtgtttctcagagag

SEQ ID NO: 705753 - DNA, 20 bp, Artificial
  CRISPR gRNA sequence
ttgggtgtttctcagagagg

SEQ ID NO: 705754 - DNA, 20 bp, Artificial
  CRISPR gRNA sequence
gtttctcagagagggggatt

SEQ ID NO: 705755 - DNA, 20 bp, Artificial
  CRISPR gRNA sequence
tctcagagagggggatttgg

SEQ ID NO: 705756 - DNA, 20 bp, Artificial
  CRISPR gRNA sequence
ctcagagagggggatttggc

SEQ ID NO: 705757 - DNA, 20 bp, Artificial
  CRISPR gRNA sequence
tcagagagggggatttggca

SEQ ID NO: 705758 - DNA, 20 bp, Artificial
  CRISPR gRNA sequence
agggggatttggcagggtca

SEQ ID NO: 705759 - DNA, 20 bp, Artificial
  CRISPR gRNA sequence
gggggatttggcagggtcat

SEQ ID NO: 705760 - DNA, 20 bp, Artificial
  CRISPR gRNA sequence
ttggcagggtcataggacaa

SEQ ID NO: 705761 - DNA, 20 bp, Artificial
  CRISPR gRNA sequence
gcagggtcataggacaatag

SEQ ID NO: 705762 - DNA, 20 bp, Artificial
  CRISPR gRNA sequence
agggtcataggacaatagtg

SEQ ID NO: 705763 - DNA, 20 bp, Artificial
  CRISPR gRNA sequence
gggtcataggacaatagtgg

SEQ ID NO: 705764 - DNA, 20 bp, Artificial
  CRISPR gRNA sequence
ggtcataggacaatagtgga

SEQ ID NO: 705765 - DNA, 20 bp, Artificial
  CRISPR gRNA sequence
cataggacaatagtggaggg

SEQ ID NO: 705766 - DNA, 20 bp, Artificial
  CRISPR gRNA sequence
ataggacaatagtggaggga

SEQ ID NO: 705767 - DNA, 20 bp, Artificial
  CRISPR gRNA sequence
gacaatagtggagggaaggt

SEQ ID NO: 705768 - DNA, 20 bp, Artificial
  CRISPR gRNA sequence
aatagtggagggaaggtcag

SEQ ID NO: 705769 - DNA, 20 bp, Artificial
  CRISPR gRNA sequence
agcagataaacatgtgaaca

SEQ ID NO: 705770 - DNA, 20 bp, Artificial
  CRISPR gRNA sequence
gcagataaacatgtgaacaa

SEQ ID NO: 705771 - DNA, 20 bp, Artificial
  CRISPR gRNA sequence
aacatgtgaacaaaggtctc

SEQ ID NO: 705772 - DNA, 20 bp, Artificial
  CRISPR gRNA sequence
acaaaggtctctggttttcc

SEQ ID NO: 705773 - DNA, 20 bp, Artificial
  CRISPR gRNA sequence
caaaggtctctggttttcct

SEQ ID NO: 705774 - DNA, 20 bp, Artificial
  CRISPR gRNA sequence
aggtctctggttttcctagg

SEQ ID NO: 705775 - DNA, 20 bp, Artificial
  CRISPR gRNA sequence
gtctctggttttcctaggca

SEQ ID NO: 705776 - DNA, 20 bp, Artificial
  CRISPR gRNA sequence
tctctggttttcctaggcag

SEQ ID NO: 705777 - DNA, 20 bp, Artificial
  CRISPR gRNA sequence
ctctggttttcctaggcaga

SEQ ID NO: 705778 - DNA, 20 bp, Artificial
  CRISPR gRNA sequence
gagggccctgccgccttccg

SEQ ID NO: 705779 - DNA, 20 bp, Artificial
  CRISPR gRNA sequence
ttccgcagtgtttgtgtccc

SEQ ID NO: 705780 - DNA, 20 bp, Artificial
  CRISPR gRNA sequence
tccgcagtgtttgtgtccct

SEQ ID NO: 705781 - DNA, 20 bp, Artificial
  CRISPR gRNA sequence
gtttgtgtccctgggtactt

SEQ ID NO: 705782 - DNA, 20 bp, Artificial
  CRISPR gRNA sequence
tgtccctgggtacttgagat

SEQ ID NO: 705783 - DNA, 20 bp, Artificial
  CRISPR gRNA sequence
gtccctgggtacttgagatt

SEQ ID NO: 705784 - DNA, 20 bp, Artificial
  CRISPR gRNA sequence
tccctgggtacttgagatta

SEQ ID NO: 705785 - DNA, 20 bp, Artificial
  CRISPR gRNA sequence
cctgggtacttgagattagg

SEQ ID NO: 705786 - DNA, 20 bp, Artificial
  CRISPR gRNA sequence
gggtacttgagattagggag

SEQ ID NO: 705787 - DNA, 20 bp, Artificial
  CRISPR gRNA sequence
tagggagtggtgatgactct

SEQ ID NO: 705788 - DNA, 20 bp, Artificial
  CRISPR gRNA sequence
gagtggtgatgactcttagc

SEQ ID NO: 705789 - DNA, 20 bp, Artificial
  CRISPR gRNA sequence
gtgatgactcttagcgagtg

SEQ ID NO: 705790 - DNA, 20 bp, Artificial
  CRISPR gRNA sequence
cttagcgagtgaagaatact

SEQ ID NO: 705791 - DNA, 20 bp, Artificial
  CRISPR gRNA sequence
agtgaagaatactcagttct

SEQ ID NO: 705792 - DNA, 20 bp, Artificial
  CRISPR gRNA sequence
gaatactcagttctaagctg

SEQ ID NO: 705793 - DNA, 20 bp, Artificial
  CRISPR gRNA sequence
cagttctaagctgtggttcc

SEQ ID NO: 705794 - DNA, 20 bp, Artificial
  CRISPR gRNA sequence
ttctaagctgtggttcctgg

SEQ ID NO: 705795 - DNA, 20 bp, Artificial
  CRISPR gRNA sequence
tagaacaaactttatttttc

SEQ ID NO: 705796 - DNA, 20 bp, Artificial
  CRISPR gRNA sequence
caaactttatttttctagct

SEQ ID NO: 705797 - DNA, 20 bp, Artificial
  CRISPR gRNA sequence
actttatttttctagctcag

SEQ ID NO: 705798 - DNA, 20 bp, Artificial
  CRISPR gRNA sequence
tttctagctcagcagtgatc

SEQ ID NO: 705799 - DNA, 20 bp, Artificial
  CRISPR gRNA sequence
ctagctcagcagtgatctgg

SEQ ID NO: 705800 - DNA, 20 bp, Artificial
  CRISPR gRNA sequence
tcagcagtgatctggaagct

SEQ ID NO: 705801 - DNA, 20 bp, Artificial
  CRISPR gRNA sequence
cagcagtgatctggaagctg

SEQ ID NO: 705802 - DNA, 20 bp, Artificial
  CRISPR gRNA sequence
atctggaagctgaggaatct

SEQ ID NO: 705803 - DNA, 20 bp, Artificial
  CRISPR gRNA sequence
ggaatctcagcgccttttaa

SEQ ID NO: 705804 - DNA, 20 bp, Artificial
  CRISPR gRNA sequence
gccttttaaaagttattatg

SEQ ID NO: 705805 - DNA, 20 bp, Artificial
  CRISPR gRNA sequence
ttatgtggttttgttttaaa

SEQ ID NO: 705806 - DNA, 20 bp, Artificial
  CRISPR gRNA sequence
gttttaaaaagctcctgttt

SEQ ID NO: 705807 - DNA, 20 bp, Artificial
  CRISPR gRNA sequence
ttttaaaaagctcctgtttt

SEQ ID NO: 705808 - DNA, 20 bp, Artificial
  CRISPR gRNA sequence
aaaaagctcctgttttggga

SEQ ID NO: 705809 - DNA, 20 bp, Artificial
  CRISPR gRNA sequence
aagctcctgttttgggaaag

SEQ ID NO: 705810 - DNA, 20 bp, Artificial
  CRISPR gRNA sequence
ttttgggaaagtagaattta

SEQ ID NO: 705811 - DNA, 20 bp, Artificial
  CRISPR gRNA sequence
tttgggaaagtagaatttat

SEQ ID NO: 705812 - DNA, 20 bp, Artificial
  CRISPR gRNA sequence
ataaaataaaaccatttaaa

SEQ ID NO: 705813 - DNA, 20 bp, Artificial
  CRISPR gRNA sequence
aaaaataataataataataa

SEQ ID NO: 705814 - DNA, 20 bp, Artificial
  CRISPR gRNA sequence
taataataataataatggca

SEQ ID NO: 705815 - DNA, 20 bp, Artificial
  CRISPR gRNA sequence
ttacttttgcaccaatctaa

SEQ ID NO: 705816 - DNA, 20 bp, Artificial
  CRISPR gRNA sequence
agatacgccctctgtgcctt

SEQ ID NO: 705817 - DNA, 20 bp, Artificial
  CRISPR gRNA sequence
tgccttgagaatcattgcgt

SEQ ID NO: 705818 - DNA, 20 bp, Artificial
  CRISPR gRNA sequence
tgagaatcattgcgtcagca

SEQ ID NO: 705819 - DNA, 20 bp, Artificial
  CRISPR gRNA sequence
gagaatcattgcgtcagcac

SEQ ID NO: 705820 - DNA, 20 bp, Artificial
  CRISPR gRNA sequence
ctcacactcactccattttg

SEQ ID NO: 705821 - DNA, 20 bp, Artificial
  CRISPR gRNA sequence
tcacactcactccattttga

SEQ ID NO: 705822 - DNA, 20 bp, Artificial
  CRISPR gRNA sequence
tcactccattttgaaggcat

SEQ ID NO: 705823 - DNA, 20 bp, Artificial
  CRISPR gRNA sequence
cactccattttgaaggcatc

SEQ ID NO: 705824 - DNA, 20 bp, Artificial
  CRISPR gRNA sequence
aaggcatcaggacatttcat

SEQ ID NO: 705825 - DNA, 20 bp, Artificial
  CRISPR gRNA sequence
aggcatcaggacatttcatg

SEQ ID NO: 705826 - DNA, 20 bp, Artificial
  CRISPR gRNA sequence
ctgacactttcctcatgaca

SEQ ID NO: 705827 - DNA, 20 bp, Artificial
  CRISPR gRNA sequence
ttttttttttgttttttttt

SEQ ID NO: 705828 - DNA, 20 bp, Artificial
  CRISPR gRNA sequence
tttgttttttttttagcatt

SEQ ID NO: 705829 - DNA, 20 bp, Artificial
  CRISPR gRNA sequence
attaataatatacatgaatt

SEQ ID NO: 705830 - DNA, 20 bp, Artificial
  CRISPR gRNA sequence
atacatgaatttagattata

SEQ ID NO: 705831 - DNA, 20 bp, Artificial
  CRISPR gRNA sequence
tgaatttagattatatagta

SEQ ID NO: 705832 - DNA, 20 bp, Artificial
  CRISPR gRNA sequence
aatttagattatatagtata

SEQ ID NO: 705833 - DNA, 20 bp, Artificial
  CRISPR gRNA sequence
atttagattatatagtatag

SEQ ID NO: 705834 - DNA, 20 bp, Artificial
  CRISPR gRNA sequence
ttatatagtatagaggtcac

SEQ ID NO: 705835 - DNA, 20 bp, Artificial
  CRISPR gRNA sequence
tatatagtatagaggtcacc

SEQ ID NO: 705836 - DNA, 20 bp, Artificial
  CRISPR gRNA sequence
gggcttgtcacttgaactaa

SEQ ID NO: 705837 - DNA, 20 bp, Artificial
  CRISPR gRNA sequence
cttgtcacttgaactaacag

SEQ ID NO: 705838 - DNA, 20 bp, Artificial
  CRISPR gRNA sequence
aactaacagtagtctgtttt

SEQ ID NO: 705839 - DNA, 20 bp, Artificial
  CRISPR gRNA sequence
agtctgtttttagaatgctt

SEQ ID NO: 705840 - DNA, 20 bp, Artificial
  CRISPR gRNA sequence
atgcttgagtgtgatcataa

SEQ ID NO: 705841 - DNA, 20 bp, Artificial
  CRISPR gRNA sequence
gatcataaaagactactttc

SEQ ID NO: 705842 - DNA, 20 bp, Artificial
  CRISPR gRNA sequence
atcataaaagactactttcc

SEQ ID NO: 705843 - DNA, 20 bp, Artificial
  CRISPR gRNA sequence
aagactactttccaggatgt

SEQ ID NO: 705844 - DNA, 20 bp, Artificial
  CRISPR gRNA sequence
agactactttccaggatgtc

SEQ ID NO: 705845 - DNA, 20 bp, Artificial
  CRISPR gRNA sequence
gactactttccaggatgtcg

SEQ ID NO: 705846 - DNA, 20 bp, Artificial
  CRISPR gRNA sequence
actttccaggatgtcggggc

SEQ ID NO: 705847 - DNA, 20 bp, Artificial
  CRISPR gRNA sequence
ctttccaggatgtcggggct

SEQ ID NO: 705848 - DNA, 20 bp, Artificial
  CRISPR gRNA sequence
tttccaggatgtcggggctg

SEQ ID NO: 705849 - DNA, 20 bp, Artificial
  CRISPR gRNA sequence
tccaggatgtcggggctggg

SEQ ID NO: 705850 - DNA, 20 bp, Artificial
  CRISPR gRNA sequence
ggatgtcggggctggggagc

SEQ ID NO: 705851 - DNA, 20 bp, Artificial
  CRISPR gRNA sequence
atgtcggggctggggagctg

SEQ ID NO: 705852 - DNA, 20 bp, Artificial
  CRISPR gRNA sequence
tgtcggggctggggagctgg

SEQ ID NO: 705853 - DNA, 20 bp, Artificial
  CRISPR gRNA sequence
gtcggggctggggagctgga

SEQ ID NO: 705854 - DNA, 20 bp, Artificial
  CRISPR gRNA sequence
tcggggctggggagctggag

SEQ ID NO: 705855 - DNA, 20 bp, Artificial
  CRISPR gRNA sequence
gggagctggaggggctgctc

SEQ ID NO: 705856 - DNA, 20 bp, Artificial
  CRISPR gRNA sequence
ggagctggaggggctgctcc

SEQ ID NO: 705857 - DNA, 20 bp, Artificial
  CRISPR gRNA sequence
agctggaggggctgctccag

SEQ ID NO: 705858 - DNA, 20 bp, Artificial
  CRISPR gRNA sequence
gctggaggggctgctccagg

SEQ ID NO: 705859 - DNA, 20 bp, Artificial
  CRISPR gRNA sequence
ggaggggctgctccaggagg

SEQ ID NO: 705860 - DNA, 20 bp, Artificial
  CRISPR gRNA sequence
gaggggctgctccaggaggt

SEQ ID NO: 705861 - DNA, 20 bp, Artificial
  CRISPR gRNA sequence
aggggctgctccaggaggtg

SEQ ID NO: 705862 - DNA, 20 bp, Artificial
  CRISPR gRNA sequence
ggggctgctccaggaggtgg

SEQ ID NO: 705863 - DNA, 20 bp, Artificial
  CRISPR gRNA sequence
gctccaggaggtgggggacc

SEQ ID NO: 705864 - DNA, 20 bp, Artificial
  CRISPR gRNA sequence
tccaggaggtgggggacctg

SEQ ID NO: 705865 - DNA, 20 bp, Artificial
  CRISPR gRNA sequence
ggaggtgggggacctggagc

SEQ ID NO: 705866 - DNA, 20 bp, Artificial
  CRISPR gRNA sequence
ggacctggagctggtactta

SEQ ID NO: 705867 - DNA, 20 bp, Artificial
  CRISPR gRNA sequence
ggagctggtacttacagact

SEQ ID NO: 705868 - DNA, 20 bp, Artificial
  CRISPR gRNA sequence
gagctggtacttacagactt

SEQ ID NO: 705869 - DNA, 20 bp, Artificial
  CRISPR gRNA sequence
ttacagacttgggtgcttat

SEQ ID NO: 705870 - DNA, 20 bp, Artificial
  CRISPR gRNA sequence
gacttgggtgcttatgagtg

SEQ ID NO: 705871 - DNA, 20 bp, Artificial
  CRISPR gRNA sequence
acttgggtgcttatgagtgt

SEQ ID NO: 705872 - DNA, 20 bp, Artificial
  CRISPR gRNA sequence
gtgcttatgagtgtgggtta

SEQ ID NO: 705873 - DNA, 20 bp, Artificial
  CRISPR gRNA sequence
tatgagtgtgggttatggac

SEQ ID NO: 705874 - DNA, 20 bp, Artificial
  CRISPR gRNA sequence
gtgggttatggaccagatgc

SEQ ID NO: 705875 - DNA, 20 bp, Artificial
  CRISPR gRNA sequence
tgggttatggaccagatgcc

SEQ ID NO: 705876 - DNA, 20 bp, Artificial
  CRISPR gRNA sequence
gggttatggaccagatgcca

SEQ ID NO: 705877 - DNA, 20 bp, Artificial
  CRISPR gRNA sequence
agatgccagggttcaaatcc

SEQ ID NO: 705878 - DNA, 20 bp, Artificial
  CRISPR gRNA sequence
ccagggttcaaatcctagct

SEQ ID NO: 705879 - DNA, 20 bp, Artificial
  CRISPR gRNA sequence
ctagctcagatacttattga

SEQ ID NO: 705880 - DNA, 20 bp, Artificial
  CRISPR gRNA sequence
acttattgatggtataaccc

SEQ ID NO: 705881 - DNA, 20 bp, Artificial
  CRISPR gRNA sequence
cttattgatggtataaccct

SEQ ID NO: 705882 - DNA, 20 bp, Artificial
  CRISPR gRNA sequence
tactcgactcctctgtgcct

SEQ ID NO: 705883 - DNA, 20 bp, Artificial
  CRISPR gRNA sequence
cagtttcctcatctgtaaaa

SEQ ID NO: 705884 - DNA, 20 bp, Artificial
  CRISPR gRNA sequence
agtttcctcatctgtaaaat

SEQ ID NO: 705885 - DNA, 20 bp, Artificial
  CRISPR gRNA sequence
gtttcctcatctgtaaaatg

SEQ ID NO: 705886 - DNA, 20 bp, Artificial
  CRISPR gRNA sequence
ttcctcatctgtaaaatggg

SEQ ID NO: 705887 - DNA, 20 bp, Artificial
  CRISPR gRNA sequence
ctcatctgtaaaatggggag

SEQ ID NO: 705888 - DNA, 20 bp, Artificial
  CRISPR gRNA sequence
tcatctgtaaaatggggagt

SEQ ID NO: 705889 - DNA, 20 bp, Artificial
  CRISPR gRNA sequence
gggctgttacccacctcata

SEQ ID NO: 705890 - DNA, 20 bp, Artificial
  CRISPR gRNA sequence
ctgttacccacctcatacag

SEQ ID NO: 705891 - DNA, 20 bp, Artificial
  CRISPR gRNA sequence
ccacctcatacagtggttgt

SEQ ID NO: 705892 - DNA, 20 bp, Artificial
  CRISPR gRNA sequence
cacctcatacagtggttgtg

SEQ ID NO: 705893 - DNA, 20 bp, Artificial
  CRISPR gRNA sequence
tgtgaggattaacatatgtc

SEQ ID NO: 705894 - DNA, 20 bp, Artificial
  CRISPR gRNA sequence
gtgaggattaacatatgtca

SEQ ID NO: 705895 - DNA, 20 bp, Artificial
  CRISPR gRNA sequence
ttaacatatgtcaaggactt

SEQ ID NO: 705896 - DNA, 20 bp, Artificial
  CRISPR gRNA sequence
taacatatgtcaaggacttt

SEQ ID NO: 705897 - DNA, 20 bp, Artificial
  CRISPR gRNA sequence
atatgtcaaggactttagga

SEQ ID NO: 705898 - DNA, 20 bp, Artificial
  CRISPR gRNA sequence
tatgtcaaggactttaggac

SEQ ID NO: 705899 - DNA, 20 bp, Artificial
  CRISPR gRNA sequence
atgtcaaggactttaggaca

SEQ ID NO: 705900 - DNA, 20 bp, Artificial
  CRISPR gRNA sequence
ggactttaggacagggccaa

SEQ ID NO: 705901 - DNA, 20 bp, Artificial
  CRISPR gRNA sequence
taggacagggccaacggacg

SEQ ID NO: 705902 - DNA, 20 bp, Artificial
  CRISPR gRNA sequence
acagggccaacggacgtggc

SEQ ID NO: 705903 - DNA, 20 bp, Artificial
  CRISPR gRNA sequence
ggacgtggcgagcaccctgt

SEQ ID NO: 705904 - DNA, 20 bp, Artificial
  CRISPR gRNA sequence
tgactgttacccctactatt

SEQ ID NO: 705905 - DNA, 20 bp, Artificial
  CRISPR gRNA sequence
tactatttagtacaaattaa

SEQ ID NO: 705906 - DNA, 20 bp, Artificial
  CRISPR gRNA sequence
ttagtacaaattaaaagcaa

SEQ ID NO: 705907 - DNA, 20 bp, Artificial
  CRISPR gRNA sequence
taaaagcaacagacttcacc

SEQ ID NO: 705908 - DNA, 20 bp, Artificial
  CRISPR gRNA sequence
agcaacagacttcacccaga

SEQ ID NO: 705909 - DNA, 20 bp, Artificial
  CRISPR gRNA sequence
cagacttcacccagaaagct

SEQ ID NO: 705910 - DNA, 20 bp, Artificial
  CRISPR gRNA sequence
acttcacccagaaagctgag

SEQ ID NO: 705911 - DNA, 20 bp, Artificial
  CRISPR gRNA sequence
acccagaaagctgagaagcc

SEQ ID NO: 705912 - DNA, 20 bp, Artificial
  CRISPR gRNA sequence
cccagaaagctgagaagccc

SEQ ID NO: 705913 - DNA, 20 bp, Artificial
  CRISPR gRNA sequence
ccagaaagctgagaagcccg

SEQ ID NO: 705914 - DNA, 20 bp, Artificial
  CRISPR gRNA sequence
gaaagctgagaagcccgggg

SEQ ID NO: 705915 - DNA, 20 bp, Artificial
  CRISPR gRNA sequence
gagaagcccggggcagctca

SEQ ID NO: 705916 - DNA, 20 bp, Artificial
  CRISPR gRNA sequence
aagcccggggcagctcatgg

SEQ ID NO: 705917 - DNA, 20 bp, Artificial
  CRISPR gRNA sequence
gcagctcatggcagctttta

SEQ ID NO: 705918 - DNA, 20 bp, Artificial
  CRISPR gRNA sequence
gctcatggcagcttttaaag

SEQ ID NO: 705919 - DNA, 20 bp, Artificial
  CRISPR gRNA sequence
atggcagcttttaaagcaga

SEQ ID NO: 705920 - DNA, 20 bp, Artificial
  CRISPR gRNA sequence
tggcagcttttaaagcagaa

SEQ ID NO: 705921 - DNA, 20 bp, Artificial
  CRISPR gRNA sequence
ggcagcttttaaagcagaaa

SEQ ID NO: 705922 - DNA, 20 bp, Artificial
  CRISPR gRNA sequence
gcagcttttaaagcagaaag

SEQ ID NO: 705923 - DNA, 20 bp, Artificial
  CRISPR gRNA sequence
cagcttttaaagcagaaagg

SEQ ID NO: 705924 - DNA, 20 bp, Artificial
  CRISPR gRNA sequence
aagcagaaagggggactcac

SEQ ID NO: 705925 - DNA, 20 bp, Artificial
  CRISPR gRNA sequence
agcagaaagggggactcact

SEQ ID NO: 705926 - DNA, 20 bp, Artificial
  CRISPR gRNA sequence
gcagaaagggggactcactg

SEQ ID NO: 705927 - DNA, 20 bp, Artificial
  CRISPR gRNA sequence
gggggactcactggggtctg

SEQ ID NO: 705928 - DNA, 20 bp, Artificial
  CRISPR gRNA sequence
gggactcactggggtctgta

SEQ ID NO: 705929 - DNA, 20 bp, Artificial
  CRISPR gRNA sequence
tctgtagagatgaaaaaaaa

SEQ ID NO: 705930 - DNA, 20 bp, Artificial
  CRISPR gRNA sequence
ctgtagagatgaaaaaaaaa

SEQ ID NO: 705931 - DNA, 20 bp, Artificial
  CRISPR gRNA sequence
tgtagagatgaaaaaaaaaa

SEQ ID NO: 705932 - DNA, 20 bp, Artificial
  CRISPR gRNA sequence
gtagagatgaaaaaaaaaag

SEQ ID NO: 705933 - DNA, 20 bp, Artificial
  CRISPR gRNA sequence
gaaaaaaaaaaggggcctcc

SEQ ID NO: 705934 - DNA, 20 bp, Artificial
  CRISPR gRNA sequence
aaaaaaggggcctcccagtt

SEQ ID NO: 705935 - DNA, 20 bp, Artificial
  CRISPR gRNA sequence
aaaaggggcctcccagttca

SEQ ID NO: 705936 - DNA, 20 bp, Artificial
  CRISPR gRNA sequence
gggcctcccagttcagagac

SEQ ID NO: 705937 - DNA, 20 bp, Artificial
  CRISPR gRNA sequence
cctcccagttcagagactgg

SEQ ID NO: 705938 - DNA, 20 bp, Artificial
  CRISPR gRNA sequence
ctcccagttcagagactggt

SEQ ID NO: 705939 - DNA, 20 bp, Artificial
  CRISPR gRNA sequence
tcccagttcagagactggtg

SEQ ID NO: 705940 - DNA, 20 bp, Artificial
  CRISPR gRNA sequence
ccagttcagagactggtggg

SEQ ID NO: 705941 - DNA, 20 bp, Artificial
  CRISPR gRNA sequence
cagttcagagactggtgggg

SEQ ID NO: 705942 - DNA, 20 bp, Artificial
  CRISPR gRNA sequence
tcagagactggtggggaggt

SEQ ID NO: 705943 - DNA, 20 bp, Artificial
  CRISPR gRNA sequence
cagagactggtggggaggtt

SEQ ID NO: 705944 - DNA, 20 bp, Artificial
  CRISPR gRNA sequence
agagactggtggggaggttg

SEQ ID NO: 705945 - DNA, 20 bp, Artificial
  CRISPR gRNA sequence
gagactggtggggaggttgg

SEQ ID NO: 705946 - DNA, 20 bp, Artificial
  CRISPR gRNA sequence
gggaggttgggggtaccctg

SEQ ID NO: 705947 - DNA, 20 bp, Artificial
  CRISPR gRNA sequence
aggttgggggtaccctgcag

SEQ ID NO: 705948 - DNA, 20 bp, Artificial
  CRISPR gRNA sequence
cagcacccattcccgtccca

SEQ ID NO: 705949 - DNA, 20 bp, Artificial
  CRISPR gRNA sequence
cacccattcccgtcccacag

SEQ ID NO: 705950 - DNA, 20 bp, Artificial
  CRISPR gRNA sequence
attcccgtcccacagcagct

SEQ ID NO: 705951 - DNA, 20 bp, Artificial
  CRISPR gRNA sequence
ttcccgtcccacagcagctg

SEQ ID NO: 705952 - DNA, 20 bp, Artificial
  CRISPR gRNA sequence
cccgtcccacagcagctgag

SEQ ID NO: 705953 - DNA, 20 bp, Artificial
  CRISPR gRNA sequence
gtcccacagcagctgaggag

SEQ ID NO: 705954 - DNA, 20 bp, Artificial
  CRISPR gRNA sequence
gcagctgaggagtggtgcgt

SEQ ID NO: 705955 - DNA, 20 bp, Artificial
  CRISPR gRNA sequence
gaggagtggtgcgtcggtga

SEQ ID NO: 705956 - DNA, 20 bp, Artificial
  CRISPR gRNA sequence
gtcggtgacagaacccgtcg

SEQ ID NO: 705957 - DNA, 20 bp, Artificial
  CRISPR gRNA sequence
ggtgacagaacccgtcgcgg

SEQ ID NO: 705958 - DNA, 20 bp, Artificial
  CRISPR gRNA sequence
tgacagaacccgtcgcggaa

SEQ ID NO: 705959 - DNA, 20 bp, Artificial
  CRISPR gRNA sequence
agaacccgtcgcggaagagc

SEQ ID NO: 705960 - DNA, 20 bp, Artificial
  CRISPR gRNA sequence
gaacccgtcgcggaagagcg

SEQ ID NO: 705961 - DNA, 20 bp, Artificial
  CRISPR gRNA sequence
aacccgtcgcggaagagcga

SEQ ID NO: 705962 - DNA, 20 bp, Artificial
  CRISPR gRNA sequence
gcggaagagcgagggttaat

SEQ ID NO: 705963 - DNA, 20 bp, Artificial
  CRISPR gRNA sequence
aagagcgagggttaatgagc

SEQ ID NO: 705964 - DNA, 20 bp, Artificial
  CRISPR gRNA sequence
gttaatgagccagccactga

SEQ ID NO: 705965 - DNA, 20 bp, Artificial
  CRISPR gRNA sequence
taatgagccagccactgatg

SEQ ID NO: 705966 - DNA, 20 bp, Artificial
  CRISPR gRNA sequence
ccactgatggagacctgcca

SEQ ID NO: 705967 - DNA, 20 bp, Artificial
  CRISPR gRNA sequence
gatggagacctgccacagcg

SEQ ID NO: 705968 - DNA, 20 bp, Artificial
  CRISPR gRNA sequence
atggagacctgccacagcgt

SEQ ID NO: 705969 - DNA, 20 bp, Artificial
  CRISPR gRNA sequence
tggagacctgccacagcgtg

SEQ ID NO: 705970 - DNA, 20 bp, Artificial
  CRISPR gRNA sequence
ggagacctgccacagcgtgg

SEQ ID NO: 705971 - DNA, 20 bp, Artificial
  CRISPR gRNA sequence
gacctgccacagcgtggggg

SEQ ID NO: 705972 - DNA, 20 bp, Artificial
  CRISPR gRNA sequence
cagcgtgggggcagcctacc

SEQ ID NO: 705973 - DNA, 20 bp, Artificial
  CRISPR gRNA sequence
gcgtgggggcagcctacctg

SEQ ID NO: 705974 - DNA, 20 bp, Artificial
  CRISPR gRNA sequence
gtgggggcagcctacctgga

SEQ ID NO: 705975 - DNA, 20 bp, Artificial
  CRISPR gRNA sequence
acctggagagcctgccgctg

SEQ ID NO: 705976 - DNA, 20 bp, Artificial
  CRISPR gRNA sequence
cctggagagcctgccgctgc

SEQ ID NO: 705977 - DNA, 20 bp, Artificial
  CRISPR gRNA sequence
agcctgccgctgcaggatgc

SEQ ID NO: 705978 - DNA, 20 bp, Artificial
  CRISPR gRNA sequence
gccgctgcaggatgccagcc

SEQ ID NO: 705979 - DNA, 20 bp, Artificial
  CRISPR gRNA sequence
ctgcaggatgccagcccggc

SEQ ID NO: 705980 - DNA, 20 bp, Artificial
  CRISPR gRNA sequence
tgcaggatgccagcccggcc

SEQ ID NO: 705981 - DNA, 20 bp, Artificial
  CRISPR gRNA sequence
gcaggatgccagcccggccg

SEQ ID NO: 705982 - DNA, 20 bp, Artificial
  CRISPR gRNA sequence
caggatgccagcccggccgg

SEQ ID NO: 705983 - DNA, 20 bp, Artificial
  CRISPR gRNA sequence
gccgggggcccctcgtcccc

SEQ ID NO: 705984 - DNA, 20 bp, Artificial
  CRISPR gRNA sequence
ccgggggcccctcgtccccc

SEQ ID NO: 705985 - DNA, 20 bp, Artificial
  CRISPR gRNA sequence
cgggggcccctcgtccccca

SEQ ID NO: 705986 - DNA, 20 bp, Artificial
  CRISPR gRNA sequence
cgtcccccagggaccttcct

SEQ ID NO: 705987 - DNA, 20 bp, Artificial
  CRISPR gRNA sequence
ccagggaccttcctgagccc

SEQ ID NO: 705988 - DNA, 20 bp, Artificial
  CRISPR gRNA sequence
cagggaccttcctgagcccc

SEQ ID NO: 705989 - DNA, 20 bp, Artificial
  CRISPR gRNA sequence
tcctgagccccgggtgtcca

SEQ ID NO: 705990 - DNA, 20 bp, Artificial
  CRISPR gRNA sequence
ctgagccccgggtgtccacg

SEQ ID NO: 705991 - DNA, 20 bp, Artificial
  CRISPR gRNA sequence
ccacggagcacaccaataac

SEQ ID NO: 705992 - DNA, 20 bp, Artificial
  CRISPR gRNA sequence
gagcacaccaataacaagat

SEQ ID NO: 705993 - DNA, 20 bp, Artificial
  CRISPR gRNA sequence
acaccaataacaagattggt

SEQ ID NO: 705994 - DNA, 20 bp, Artificial
  CRISPR gRNA sequence
caataacaagattggtgagt

SEQ ID NO: 705995 - DNA, 20 bp, Artificial
  CRISPR gRNA sequence
attggtgagtcagcctgttt

SEQ ID NO: 705996 - DNA, 20 bp, Artificial
  CRISPR gRNA sequence
ttggtgagtcagcctgtttt

SEQ ID NO: 705997 - DNA, 20 bp, Artificial
  CRISPR gRNA sequence
ggtgagtcagcctgttttgg

SEQ ID NO: 705998 - DNA, 20 bp, Artificial
  CRISPR gRNA sequence
gtgagtcagcctgttttggg

SEQ ID NO: 705999 - DNA, 20 bp, Artificial
  CRISPR gRNA sequence
ctgttttgggaggtcccctg

SEQ ID NO: 706000 - DNA, 20 bp, Artificial
  CRISPR gRNA sequence
ttgggaggtcccctgcagcc

SEQ ID NO: 706001 - DNA, 20 bp, Artificial
  CRISPR gRNA sequence
tgggaggtcccctgcagccc

SEQ ID NO: 706002 - DNA, 20 bp, Artificial
  CRISPR gRNA sequence
gggaggtcccctgcagccca

SEQ ID NO: 706003 - DNA, 20 bp, Artificial
  CRISPR gRNA sequence
ggaggtcccctgcagcccag

SEQ ID NO: 706004 - DNA, 20 bp, Artificial
  CRISPR gRNA sequence
ggtcccctgcagcccagggg

SEQ ID NO: 706005 - DNA, 20 bp, Artificial
  CRISPR gRNA sequence
ccctgcagcccaggggcaga

SEQ ID NO: 706006 - DNA, 20 bp, Artificial
  CRISPR gRNA sequence
cctgcagcccaggggcagat

SEQ ID NO: 706007 - DNA, 20 bp, Artificial
  CRISPR gRNA sequence
tgcagcccaggggcagatgg

SEQ ID NO: 706008 - DNA, 20 bp, Artificial
  CRISPR gRNA sequence
gggcagatgggagatgaata

SEQ ID NO: 706009 - DNA, 20 bp, Artificial
  CRISPR gRNA sequence
ggcagatgggagatgaatac

SEQ ID NO: 706010 - DNA, 20 bp, Artificial
  CRISPR gRNA sequence
gcagatgggagatgaatacg

SEQ ID NO: 706011 - DNA, 20 bp, Artificial
  CRISPR gRNA sequence
gggagatgaatacggggccc

SEQ ID NO: 706012 - DNA, 20 bp, Artificial
  CRISPR gRNA sequence
ggagatgaatacggggccct

SEQ ID NO: 706013 - DNA, 20 bp, Artificial
  CRISPR gRNA sequence
gaatacggggccctgggccc

SEQ ID NO: 706014 - DNA, 20 bp, Artificial
  CRISPR gRNA sequence
tacggggccctgggccctgg

SEQ ID NO: 706015 - DNA, 20 bp, Artificial
  CRISPR gRNA sequence
acggggccctgggccctgga

SEQ ID NO: 706016 - DNA, 20 bp, Artificial
  CRISPR gRNA sequence
cggggccctgggccctggaa

SEQ ID NO: 706017 - DNA, 20 bp, Artificial
  CRISPR gRNA sequence
cctgggccctggaagggacc

SEQ ID NO: 706018 - DNA, 20 bp, Artificial
  CRISPR gRNA sequence
tgggccctggaagggacctg

SEQ ID NO: 706019 - DNA, 20 bp, Artificial
  CRISPR gRNA sequence
tggaagggacctggagaccc

SEQ ID NO: 706020 - DNA, 20 bp, Artificial
  CRISPR gRNA sequence
gaagggacctggagaccctg

SEQ ID NO: 706021 - DNA, 20 bp, Artificial
  CRISPR gRNA sequence
cctggagaccctggagttga

SEQ ID NO: 706022 - DNA, 20 bp, Artificial
  CRISPR gRNA sequence
ctggagaccctggagttgaa

SEQ ID NO: 706023 - DNA, 20 bp, Artificial
  CRISPR gRNA sequence
gaccctggagttgaaaggcc

SEQ ID NO: 706024 - DNA, 20 bp, Artificial
  CRISPR gRNA sequence
accctggagttgaaaggccc

SEQ ID NO: 706025 - DNA, 20 bp, Artificial
  CRISPR gRNA sequence
tggagttgaaaggcccagga

SEQ ID NO: 706026 - DNA, 20 bp, Artificial
  CRISPR gRNA sequence
ggagttgaaaggcccaggaa

SEQ ID NO: 706027 - DNA, 20 bp, Artificial
  CRISPR gRNA sequence
agttgaaaggcccaggaaag

SEQ ID NO: 706028 - DNA, 20 bp, Artificial
  CRISPR gRNA sequence
ttgaaaggcccaggaaagga

SEQ ID NO: 706029 - DNA, 20 bp, Artificial
  CRISPR gRNA sequence
tgaaaggcccaggaaaggag

SEQ ID NO: 706030 - DNA, 20 bp, Artificial
  CRISPR gRNA sequence
ggcccaggaaaggagaggca

SEQ ID NO: 706031 - DNA, 20 bp, Artificial
  CRISPR gRNA sequence
tagattcttcaccccaattg

SEQ ID NO: 706032 - DNA, 20 bp, Artificial
  CRISPR gRNA sequence
accccaattgaagtttctgt

SEQ ID NO: 706033 - DNA, 20 bp, Artificial
  CRISPR gRNA sequence
ccaattgaagtttctgtaag

SEQ ID NO: 706034 - DNA, 20 bp, Artificial
  CRISPR gRNA sequence
caattgaagtttctgtaagt

SEQ ID NO: 706035 - DNA, 20 bp, Artificial
  CRISPR gRNA sequence
aattgaagtttctgtaagta

SEQ ID NO: 706036 - DNA, 20 bp, Artificial
  CRISPR gRNA sequence
gaagtttctgtaagtaggga

SEQ ID NO: 706037 - DNA, 20 bp, Artificial
  CRISPR gRNA sequence
tttctgtaagtagggacagc

SEQ ID NO: 706038 - DNA, 20 bp, Artificial
  CRISPR gRNA sequence
ttctgtaagtagggacagcg

SEQ ID NO: 706039 - DNA, 20 bp, Artificial
  CRISPR gRNA sequence
tctgtaagtagggacagcga

SEQ ID NO: 706040 - DNA, 20 bp, Artificial
  CRISPR gRNA sequence
cagcgagggtacttacctcg

SEQ ID NO: 706041 - DNA, 20 bp, Artificial
  CRISPR gRNA sequence
agcgagggtacttacctcgt

SEQ ID NO: 706042 - DNA, 20 bp, Artificial
  CRISPR gRNA sequence
ttacctcgtaggccattgtg

SEQ ID NO: 706043 - DNA, 20 bp, Artificial
  CRISPR gRNA sequence
aggccattgtgcggattcat

SEQ ID NO: 706044 - DNA, 20 bp, Artificial
  CRISPR gRNA sequence
cattgtgcggattcatgagc

SEQ ID NO: 706045 - DNA, 20 bp, Artificial
  CRISPR gRNA sequence
attcatgagccagtgtgcat

SEQ ID NO: 706046 - DNA, 20 bp, Artificial
  CRISPR gRNA sequence
ataaaaaacgaacaccaccc

SEQ ID NO: 706047 - DNA, 20 bp, Artificial
  CRISPR gRNA sequence
ccaccccagcccccaacacc

SEQ ID NO: 706048 - DNA, 20 bp, Artificial
  CRISPR gRNA sequence
gcccccaacaccgagcaccc

SEQ ID NO: 706049 - DNA, 20 bp, Artificial
  CRISPR gRNA sequence
cccccaacaccgagcacccg

SEQ ID NO: 706050 - DNA, 20 bp, Artificial
  CRISPR gRNA sequence
ccccaacaccgagcacccga

SEQ ID NO: 706051 - DNA, 20 bp, Artificial
  CRISPR gRNA sequence
cccaacaccgagcacccgag

SEQ ID NO: 706052 - DNA, 20 bp, Artificial
  CRISPR gRNA sequence
acaccgagcacccgagggga

SEQ ID NO: 706053 - DNA, 20 bp, Artificial
  CRISPR gRNA sequence
caccgagcacccgaggggac

SEQ ID NO: 706054 - DNA, 20 bp, Artificial
  CRISPR gRNA sequence
ccgagcacccgaggggacag

SEQ ID NO: 706055 - DNA, 20 bp, Artificial
  CRISPR gRNA sequence
cgagcacccgaggggacagg

SEQ ID NO: 706056 - DNA, 20 bp, Artificial
  CRISPR gRNA sequence
gcacccgaggggacaggagg

SEQ ID NO: 706057 - DNA, 20 bp, Artificial
  CRISPR gRNA sequence
gggacaggaggaagacgtgc

SEQ ID NO: 706058 - DNA, 20 bp, Artificial
  CRISPR gRNA sequence
acaggaggaagacgtgccag

SEQ ID NO: 706059 - DNA, 20 bp, Artificial
  CRISPR gRNA sequence
ggaagacgtgccagtggtca

SEQ ID NO: 706060 - DNA, 20 bp, Artificial
  CRISPR gRNA sequence
gaagacgtgccagtggtcac

SEQ ID NO: 706061 - DNA, 20 bp, Artificial
  CRISPR gRNA sequence
cacaggacctgccacttgtc

SEQ ID NO: 706062 - DNA, 20 bp, Artificial
  CRISPR gRNA sequence
gccacttgtctggcgcattc

SEQ ID NO: 706063 - DNA, 20 bp, Artificial
  CRISPR gRNA sequence
ccacttgtctggcgcattcc

SEQ ID NO: 706064 - DNA, 20 bp, Artificial
  CRISPR gRNA sequence
ggcgcattccgggcactgtg

SEQ ID NO: 706065 - DNA, 20 bp, Artificial
  CRISPR gRNA sequence
gcgcattccgggcactgtgt

SEQ ID NO: 706066 - DNA, 20 bp, Artificial
  CRISPR gRNA sequence
tgccatctcttcatctctga

SEQ ID NO: 706067 - DNA, 20 bp, Artificial
  CRISPR gRNA sequence
gatggtctcaccaccttctt

SEQ ID NO: 706068 - DNA, 20 bp, Artificial
  CRISPR gRNA sequence
gtctcaccaccttctttgga

SEQ ID NO: 706069 - DNA, 20 bp, Artificial
  CRISPR gRNA sequence
gtgtctttctccccatttta

SEQ ID NO: 706070 - DNA, 20 bp, Artificial
  CRISPR gRNA sequence
ctttctccccattttacagt

SEQ ID NO: 706071 - DNA, 20 bp, Artificial
  CRISPR gRNA sequence
tttctccccattttacagtt

SEQ ID NO: 706072 - DNA, 20 bp, Artificial
  CRISPR gRNA sequence
ttctccccattttacagttg

SEQ ID NO: 706073 - DNA, 20 bp, Artificial
  CRISPR gRNA sequence
ctccccattttacagttggg

SEQ ID NO: 706074 - DNA, 20 bp, Artificial
  CRISPR gRNA sequence
ttttacagttggggagaccg

SEQ ID NO: 706075 - DNA, 20 bp, Artificial
  CRISPR gRNA sequence
cagttggggagaccgtggct

SEQ ID NO: 706076 - DNA, 20 bp, Artificial
  CRISPR gRNA sequence
gttggggagaccgtggctca

SEQ ID NO: 706077 - DNA, 20 bp, Artificial
  CRISPR gRNA sequence
ttggggagaccgtggctcag

SEQ ID NO: 706078 - DNA, 20 bp, Artificial
  CRISPR gRNA sequence
tggggagaccgtggctcaga

SEQ ID NO: 706079 - DNA, 20 bp, Artificial
  CRISPR gRNA sequence
agaccgtggctcagagggtg

SEQ ID NO: 706080 - DNA, 20 bp, Artificial
  CRISPR gRNA sequence
aagtgattttccccattgca

SEQ ID NO: 706081 - DNA, 20 bp, Artificial
  CRISPR gRNA sequence
ttccccattgcatggctact

SEQ ID NO: 706082 - DNA, 20 bp, Artificial
  CRISPR gRNA sequence
cccattgcatggctactaag

SEQ ID NO: 706083 - DNA, 20 bp, Artificial
  CRISPR gRNA sequence
tgcatggctactaagtggca

SEQ ID NO: 706084 - DNA, 20 bp, Artificial
  CRISPR gRNA sequence
tggctactaagtggcacagc

SEQ ID NO: 706085 - DNA, 20 bp, Artificial
  CRISPR gRNA sequence
ggaactcgtcccgcatctgc

SEQ ID NO: 706086 - DNA, 20 bp, Artificial
  CRISPR gRNA sequence
gaactcgtcccgcatctgct

SEQ ID NO: 706087 - DNA, 20 bp, Artificial
  CRISPR gRNA sequence
cccgcatctgctgggccttg

SEQ ID NO: 706088 - DNA, 20 bp, Artificial
  CRISPR gRNA sequence
ctgctgggccttgaagcccg

SEQ ID NO: 706089 - DNA, 20 bp, Artificial
  CRISPR gRNA sequence
acgttaccacccaccctctg

SEQ ID NO: 706090 - DNA, 20 bp, Artificial
  CRISPR gRNA sequence
ttaccacccaccctctgcag

SEQ ID NO: 706091 - DNA, 20 bp, Artificial
  CRISPR gRNA sequence
ccacccaccctctgcagaag

SEQ ID NO: 706092 - DNA, 20 bp, Artificial
  CRISPR gRNA sequence
cacccaccctctgcagaagc

SEQ ID NO: 706093 - DNA, 20 bp, Artificial
  CRISPR gRNA sequence
cccaccctctgcagaagcag

SEQ ID NO: 706094 - DNA, 20 bp, Artificial
  CRISPR gRNA sequence
ccaccctctgcagaagcagg

SEQ ID NO: 706095 - DNA, 20 bp, Artificial
  CRISPR gRNA sequence
cctctgcagaagcaggagga

SEQ ID NO: 706096 - DNA, 20 bp, Artificial
  CRISPR gRNA sequence
tgcagaagcaggaggacaga

SEQ ID NO: 706097 - DNA, 20 bp, Artificial
  CRISPR gRNA sequence
gcagaagcaggaggacagat

SEQ ID NO: 706098 - DNA, 20 bp, Artificial
  CRISPR gRNA sequence
cagaagcaggaggacagatg

SEQ ID NO: 706099 - DNA, 20 bp, Artificial
  CRISPR gRNA sequence
gcaggaggacagatggggcc

SEQ ID NO: 706100 - DNA, 20 bp, Artificial
  CRISPR gRNA sequence
acagatggggcccagatgtt

SEQ ID NO: 706101 - DNA, 20 bp, Artificial
  CRISPR gRNA sequence
agatggggcccagatgttca

SEQ ID NO: 706102 - DNA, 20 bp, Artificial
  CRISPR gRNA sequence
agatgttcagagcttcccaa

SEQ ID NO: 706103 - DNA, 20 bp, Artificial
  CRISPR gRNA sequence
tgttcagagcttcccaacgg

SEQ ID NO: 706104 - DNA, 20 bp, Artificial
  CRISPR gRNA sequence
ttcccaacggcagctgctgc

SEQ ID NO: 706105 - DNA, 20 bp, Artificial
  CRISPR gRNA sequence
aacggcagctgctgccagcc

SEQ ID NO: 706106 - DNA, 20 bp, Artificial
  CRISPR gRNA sequence
gcagctgctgccagcctgga

SEQ ID NO: 706107 - DNA, 20 bp, Artificial
  CRISPR gRNA sequence
ctgccagcctggacagacat

SEQ ID NO: 706108 - DNA, 20 bp, Artificial
  CRISPR gRNA sequence
gcctggacagacattggctt

SEQ ID NO: 706109 - DNA, 20 bp, Artificial
  CRISPR gRNA sequence
acattggctttggcctcctg

SEQ ID NO: 706110 - DNA, 20 bp, Artificial
  CRISPR gRNA sequence
cattggctttggcctcctgt

SEQ ID NO: 706111 - DNA, 20 bp, Artificial
  CRISPR gRNA sequence
tctcttgcttctcatcacct

SEQ ID NO: 706112 - DNA, 20 bp, Artificial
  CRISPR gRNA sequence
tgcttctcatcaccttggta

SEQ ID NO: 706113 - DNA, 20 bp, Artificial
  CRISPR gRNA sequence
gaccctattgcactcctgcc

SEQ ID NO: 706114 - DNA, 20 bp, Artificial
  CRISPR gRNA sequence
cctattgcactcctgccgag

SEQ ID NO: 706115 - DNA, 20 bp, Artificial
  CRISPR gRNA sequence
cactcctgccgagaagcctc

SEQ ID NO: 706116 - DNA, 20 bp, Artificial
  CRISPR gRNA sequence
tcctgccgagaagcctccag

SEQ ID NO: 706117 - DNA, 20 bp, Artificial
  CRISPR gRNA sequence
cagcagcttcccattcccta

SEQ ID NO: 706118 - DNA, 20 bp, Artificial
  CRISPR gRNA sequence
agcagcttcccattccctat

SEQ ID NO: 706119 - DNA, 20 bp, Artificial
  CRISPR gRNA sequence
attccctatgggatgaattc

SEQ ID NO: 706120 - DNA, 20 bp, Artificial
  CRISPR gRNA sequence
gaattccagcattcttattc

SEQ ID NO: 706121 - DNA, 20 bp, Artificial
  CRISPR gRNA sequence
gcattcttattccagcactc

SEQ ID NO: 706122 - DNA, 20 bp, Artificial
  CRISPR gRNA sequence
cattcttattccagcactca

SEQ ID NO: 706123 - DNA, 20 bp, Artificial
  CRISPR gRNA sequence
attccagcactcaaggctga

SEQ ID NO: 706124 - DNA, 20 bp, Artificial
  CRISPR gRNA sequence
cagcactcaaggctgacagc

SEQ ID NO: 706125 - DNA, 20 bp, Artificial
  CRISPR gRNA sequence
tcaaggctgacagcaagttg

SEQ ID NO: 706126 - DNA, 20 bp, Artificial
  CRISPR gRNA sequence
gcaagttgtagctccccgac

SEQ ID NO: 706127 - DNA, 20 bp, Artificial
  CRISPR gRNA sequence
tcacctaccttctgacccca

SEQ ID NO: 706128 - DNA, 20 bp, Artificial
  CRISPR gRNA sequence
cagtctgtccctccccctca

SEQ ID NO: 706129 - DNA, 20 bp, Artificial
  CRISPR gRNA sequence
tctgtccctccccctcatgg

SEQ ID NO: 706130 - DNA, 20 bp, Artificial
  CRISPR gRNA sequence
atggcagtctcccaaattta

SEQ ID NO: 706131 - DNA, 20 bp, Artificial
  CRISPR gRNA sequence
cagacccctctgtcacttct

SEQ ID NO: 706132 - DNA, 20 bp, Artificial
  CRISPR gRNA sequence
gtcacttctgagcttctcaa

SEQ ID NO: 706133 - DNA, 20 bp, Artificial
  CRISPR gRNA sequence
tcacttctgagcttctcaat

SEQ ID NO: 706134 - DNA, 20 bp, Artificial
  CRISPR gRNA sequence
acttctgagcttctcaatgg

SEQ ID NO: 706135 - DNA, 20 bp, Artificial
  CRISPR gRNA sequence
agctaccccctcgcctgaaa

SEQ ID NO: 706136 - DNA, 20 bp, Artificial
  CRISPR gRNA sequence
caactccactgccttgaatc

SEQ ID NO: 706137 - DNA, 20 bp, Artificial
  CRISPR gRNA sequence
gccttgaatccagttaattc

SEQ ID NO: 706138 - DNA, 20 bp, Artificial
  CRISPR gRNA sequence
ccagttaattctggatatcc

SEQ ID NO: 706139 - DNA, 20 bp, Artificial
  CRISPR gRNA sequence
cagttaattctggatatcct

SEQ ID NO: 706140 - DNA, 20 bp, Artificial
  CRISPR gRNA sequence
agttaattctggatatcctg

SEQ ID NO: 706141 - DNA, 20 bp, Artificial
  CRISPR gRNA sequence
tgcttatttgccccttcctc

SEQ ID NO: 706142 - DNA, 20 bp, Artificial
  CRISPR gRNA sequence
gcttatttgccccttcctcc

SEQ ID NO: 706143 - DNA, 20 bp, Artificial
  CRISPR gRNA sequence
tatttgccccttcctccagg

SEQ ID NO: 706144 - DNA, 20 bp, Artificial
  CRISPR gRNA sequence
tccaccatgctatgctccct

SEQ ID NO: 706145 - DNA, 20 bp, Artificial
  CRISPR gRNA sequence
tgctatgctccctaagaacc

SEQ ID NO: 706146 - DNA, 20 bp, Artificial
  CRISPR gRNA sequence
gctatgctccctaagaaccc

SEQ ID NO: 706147 - DNA, 20 bp, Artificial
  CRISPR gRNA sequence
gaacccaggcctcccctacc

SEQ ID NO: 706148 - DNA, 20 bp, Artificial
  CRISPR gRNA sequence
gcctcccctacccggtgtcc

SEQ ID NO: 706149 - DNA, 20 bp, Artificial
  CRISPR gRNA sequence
ctacccggtgtcctagcacc

SEQ ID NO: 706150 - DNA, 20 bp, Artificial
  CRISPR gRNA sequence
cccggtgtcctagcacccag

SEQ ID NO: 706151 - DNA, 20 bp, Artificial
  CRISPR gRNA sequence
gtggtgtgactgcgtgttta

SEQ ID NO: 706152 - DNA, 20 bp, Artificial
  CRISPR gRNA sequence
agccttcctccacctccacc

SEQ ID NO: 706153 - DNA, 20 bp, Artificial
  CRISPR gRNA sequence
acctggctttgtgctccctg

SEQ ID NO: 706154 - DNA, 20 bp, Artificial
  CRISPR gRNA sequence
cctggctttgtgctccctgt

SEQ ID NO: 706155 - DNA, 20 bp, Artificial
  CRISPR gRNA sequence
ggctttgtgctccctgtggg

SEQ ID NO: 706156 - DNA, 20 bp, Artificial
  CRISPR gRNA sequence
gctttgtgctccctgtgggc

SEQ ID NO: 706157 - DNA, 20 bp, Artificial
  CRISPR gRNA sequence
ctttgtgctccctgtgggca

SEQ ID NO: 706158 - DNA, 20 bp, Artificial
  CRISPR gRNA sequence
gctccctgtgggcagggcct

SEQ ID NO: 706159 - DNA, 20 bp, Artificial
  CRISPR gRNA sequence
ccctgtgggcagggccttgg

SEQ ID NO: 706160 - DNA, 20 bp, Artificial
  CRISPR gRNA sequence
gaccccacctctgtcgcttc

SEQ ID NO: 706161 - DNA, 20 bp, Artificial
  CRISPR gRNA sequence
cccacctctgtcgcttctgg

SEQ ID NO: 706162 - DNA, 20 bp, Artificial
  CRISPR gRNA sequence
ccacctctgtcgcttctgga

SEQ ID NO: 706163 - DNA, 20 bp, Artificial
  CRISPR gRNA sequence
cacctctgtcgcttctggaa

SEQ ID NO: 706164 - DNA, 20 bp, Artificial
  CRISPR gRNA sequence
gtcgcttctggaagggtaac

SEQ ID NO: 706165 - DNA, 20 bp, Artificial
  CRISPR gRNA sequence
tctggaagggtaactggcac

SEQ ID NO: 706166 - DNA, 20 bp, Artificial
  CRISPR gRNA sequence
ctggaagggtaactggcact

SEQ ID NO: 706167 - DNA, 20 bp, Artificial
  CRISPR gRNA sequence
ctggcactgggataatactg

SEQ ID NO: 706168 - DNA, 20 bp, Artificial
  CRISPR gRNA sequence
ggcactgggataatactgaa

SEQ ID NO: 706169 - DNA, 20 bp, Artificial
  CRISPR gRNA sequence
aattgtcctgtgcatttcta

SEQ ID NO: 706170 - DNA, 20 bp, Artificial
  CRISPR gRNA sequence
tgtcctgtgcatttctatgg

SEQ ID NO: 706171 - DNA, 20 bp, Artificial
  CRISPR gRNA sequence
ctgtgcatttctatggcaga

SEQ ID NO: 706172 - DNA, 20 bp, Artificial
  CRISPR gRNA sequence
tgcatttctatggcagacag

SEQ ID NO: 706173 - DNA, 20 bp, Artificial
  CRISPR gRNA sequence
atttctatggcagacagtgg

SEQ ID NO: 706174 - DNA, 20 bp, Artificial
  CRISPR gRNA sequence
ctatggcagacagtggtggc

SEQ ID NO: 706175 - DNA, 20 bp, Artificial
  CRISPR gRNA sequence
cagtggtggccagaactctt

SEQ ID NO: 706176 - DNA, 20 bp, Artificial
  CRISPR gRNA sequence
agtggtggccagaactcttc

SEQ ID NO: 706177 - DNA, 20 bp, Artificial
  CRISPR gRNA sequence
gtggtggccagaactcttca

SEQ ID NO: 706178 - DNA, 20 bp, Artificial
  CRISPR gRNA sequence
gtggccagaactcttcaggg

SEQ ID NO: 706179 - DNA, 20 bp, Artificial
  CRISPR gRNA sequence
atcttctctttttatttttt

SEQ ID NO: 706180 - DNA, 20 bp, Artificial
  CRISPR gRNA sequence
ttttattttttcagcctcct

SEQ ID NO: 706181 - DNA, 20 bp, Artificial
  CRISPR gRNA sequence
tattttttcagcctcctgag

SEQ ID NO: 706182 - DNA, 20 bp, Artificial
  CRISPR gRNA sequence
ttttcagcctcctgagtagc

SEQ ID NO: 706183 - DNA, 20 bp, Artificial
  CRISPR gRNA sequence
tttcagcctcctgagtagct

SEQ ID NO: 706184 - DNA, 20 bp, Artificial
  CRISPR gRNA sequence
ctcctgagtagctgggatta

SEQ ID NO: 706185 - DNA, 20 bp, Artificial
  CRISPR gRNA sequence
tcctgagtagctgggattat

SEQ ID NO: 706186 - DNA, 20 bp, Artificial
  CRISPR gRNA sequence
gagtagctgggattatgggc

SEQ ID NO: 706187 - DNA, 20 bp, Artificial
  CRISPR gRNA sequence
tgggcgagtgtcatcatgcc

SEQ ID NO: 706188 - DNA, 20 bp, Artificial
  CRISPR gRNA sequence
tggctaattttttgtatttt

SEQ ID NO: 706189 - DNA, 20 bp, Artificial
  CRISPR gRNA sequence
ctaattttttgtatttttag

SEQ ID NO: 706190 - DNA, 20 bp, Artificial
  CRISPR gRNA sequence
aattttttgtatttttagta

SEQ ID NO: 706191 - DNA, 20 bp, Artificial
  CRISPR gRNA sequence
ttttgtatttttagtagaga

SEQ ID NO: 706192 - DNA, 20 bp, Artificial
  CRISPR gRNA sequence
tttgtatttttagtagagat

SEQ ID NO: 706193 - DNA, 20 bp, Artificial
  CRISPR gRNA sequence
ttgtatttttagtagagatg

SEQ ID NO: 706194 - DNA, 20 bp, Artificial
  CRISPR gRNA sequence
gagatggggtttcactctgt

SEQ ID NO: 706195 - DNA, 20 bp, Artificial
  CRISPR gRNA sequence
tggggtttcactctgttggc

SEQ ID NO: 706196 - DNA, 20 bp, Artificial
  CRISPR gRNA sequence
ggggtttcactctgttggcc

SEQ ID NO: 706197 - DNA, 20 bp, Artificial
  CRISPR gRNA sequence
tttcactctgttggccaggc

SEQ ID NO: 706198 - DNA, 20 bp, Artificial
  CRISPR gRNA sequence
ctctgttggccaggctggtc

SEQ ID NO: 706199 - DNA, 20 bp, Artificial
  CRISPR gRNA sequence
ccaggctggtctggaactcc

SEQ ID NO: 706200 - DNA, 20 bp, Artificial
  CRISPR gRNA sequence
ggtctggaactcctggcctc

SEQ ID NO: 706201 - DNA, 20 bp, Artificial
  CRISPR gRNA sequence
gtctggaactcctggcctca

SEQ ID NO: 706202 - DNA, 20 bp, Artificial
  CRISPR gRNA sequence
tcaaggtgatctgcctgcct

SEQ ID NO: 706203 - DNA, 20 bp, Artificial
  CRISPR gRNA sequence
ctgcctgccttggcctccca

SEQ ID NO: 706204 - DNA, 20 bp, Artificial
  CRISPR gRNA sequence
gccttggcctcccaaagtac

SEQ ID NO: 706205 - DNA, 20 bp, Artificial
  CRISPR gRNA sequence
ccttggcctcccaaagtact

SEQ ID NO: 706206 - DNA, 20 bp, Artificial
  CRISPR gRNA sequence
ctcccaaagtactgggatta

SEQ ID NO: 706207 - DNA, 20 bp, Artificial
  CRISPR gRNA sequence
tcccaaagtactgggattat

SEQ ID NO: 706208 - DNA, 20 bp, Artificial
  CRISPR gRNA sequence
agtactgggattataggcat

SEQ ID NO: 706209 - DNA, 20 bp, Artificial
  CRISPR gRNA sequence
taggcatgagccaccatgcc

SEQ ID NO: 706210 - DNA, 20 bp, Artificial
  CRISPR gRNA sequence
atgagccaccatgcccagcc

SEQ ID NO: 706211 - DNA, 20 bp, Artificial
  CRISPR gRNA sequence
tgagccaccatgcccagcct

SEQ ID NO: 706212 - DNA, 20 bp, Artificial
  CRISPR gRNA sequence
gccaccatgcccagcctggg

SEQ ID NO: 706213 - DNA, 20 bp, Artificial
  CRISPR gRNA sequence
cagtcttttgtaacaaactg

SEQ ID NO: 706214 - DNA, 20 bp, Artificial
  CRISPR gRNA sequence
acaaactgaagcttttgaaa

SEQ ID NO: 706215 - DNA, 20 bp, Artificial
  CRISPR gRNA sequence
aactgaagcttttgaaatgg

SEQ ID NO: 706216 - DNA, 20 bp, Artificial
  CRISPR gRNA sequence
gcttttgaaatggtagcttt

SEQ ID NO: 706217 - DNA, 20 bp, Artificial
  CRISPR gRNA sequence
ttgaaatggtagcttttagt

SEQ ID NO: 706218 - DNA, 20 bp, Artificial
  CRISPR gRNA sequence
tttagtaagttttatttgaa

SEQ ID NO: 706219 - DNA, 20 bp, Artificial
  CRISPR gRNA sequence
tatttgaaaagtatgtattt

SEQ ID NO: 706220 - DNA, 20 bp, Artificial
  CRISPR gRNA sequence
atttgaaaagtatgtatttt

SEQ ID NO: 706221 - DNA, 20 bp, Artificial
  CRISPR gRNA sequence
tattttgggaaataccatca

SEQ ID NO: 706222 - DNA, 20 bp, Artificial
  CRISPR gRNA sequence
attttgggaaataccatcaa

SEQ ID NO: 706223 - DNA, 20 bp, Artificial
  CRISPR gRNA sequence
aataccatcaaaggcttctt

SEQ ID NO: 706224 - DNA, 20 bp, Artificial
  CRISPR gRNA sequence
aaggcttcttcagaattcct

SEQ ID NO: 706225 - DNA, 20 bp, Artificial
  CRISPR gRNA sequence
gcttcttcagaattcctaag

SEQ ID NO: 706226 - DNA, 20 bp, Artificial
  CRISPR gRNA sequence
aattcctaagaagtcctaac

SEQ ID NO: 706227 - DNA, 20 bp, Artificial
  CRISPR gRNA sequence
aagtcctaactggaacttct

SEQ ID NO: 706228 - DNA, 20 bp, Artificial
  CRISPR gRNA sequence
ggaacttctgagtccacact

SEQ ID NO: 706229 - DNA, 20 bp, Artificial
  CRISPR gRNA sequence
ttctgagtccacactgagta

SEQ ID NO: 706230 - DNA, 20 bp, Artificial
  CRISPR gRNA sequence
tccacactgagtacagtgcc

SEQ ID NO: 706231 - DNA, 20 bp, Artificial
  CRISPR gRNA sequence
gagtacagtgcctggaatcc

SEQ ID NO: 706232 - DNA, 20 bp, Artificial
  CRISPR gRNA sequence
agtacagtgcctggaatccc

SEQ ID NO: 706233 - DNA, 20 bp, Artificial
  CRISPR gRNA sequence
gtacagtgcctggaatccca

SEQ ID NO: 706234 - DNA, 20 bp, Artificial
  CRISPR gRNA sequence
tacagtgcctggaatcccag

SEQ ID NO: 706235 - DNA, 20 bp, Artificial
  CRISPR gRNA sequence
agtgcctggaatcccagggg

SEQ ID NO: 706236 - DNA, 20 bp, Artificial
  CRISPR gRNA sequence
gtgcctggaatcccaggggt

SEQ ID NO: 706237 - DNA, 20 bp, Artificial
  CRISPR gRNA sequence
tgcctggaatcccaggggtg

SEQ ID NO: 706238 - DNA, 20 bp, Artificial
  CRISPR gRNA sequence
ggaatcccaggggtggggtt

SEQ ID NO: 706239 - DNA, 20 bp, Artificial
  CRISPR gRNA sequence
aatcccaggggtggggttca

SEQ ID NO: 706240 - DNA, 20 bp, Artificial
  CRISPR gRNA sequence
atcccaggggtggggttcag

SEQ ID NO: 706241 - DNA, 20 bp, Artificial
  CRISPR gRNA sequence
tcccaggggtggggttcaga

SEQ ID NO: 706242 - DNA, 20 bp, Artificial
  CRISPR gRNA sequence
ggggttcagagggtgtttga

SEQ ID NO: 706243 - DNA, 20 bp, Artificial
  CRISPR gRNA sequence
gggttcagagggtgtttgat

SEQ ID NO: 706244 - DNA, 20 bp, Artificial
  CRISPR gRNA sequence
ggttcagagggtgtttgatg

SEQ ID NO: 706245 - DNA, 20 bp, Artificial
  CRISPR gRNA sequence
ttcagagggtgtttgatggg

SEQ ID NO: 706246 - DNA, 20 bp, Artificial
  CRISPR gRNA sequence
tcagagggtgtttgatgggg

SEQ ID NO: 706247 - DNA, 20 bp, Artificial
  CRISPR gRNA sequence
agagggtgtttgatggggag

SEQ ID NO: 706248 - DNA, 20 bp, Artificial
  CRISPR gRNA sequence
gggtgtttgatggggaggag

SEQ ID NO: 706249 - DNA, 20 bp, Artificial
  CRISPR gRNA sequence
ggtgtttgatggggaggaga

SEQ ID NO: 706250 - DNA, 20 bp, Artificial
  CRISPR gRNA sequence
gtttgatggggaggagaagg

SEQ ID NO: 706251 - DNA, 20 bp, Artificial
  CRISPR gRNA sequence
tggggaggagaaggaagtac

SEQ ID NO: 706252 - DNA, 20 bp, Artificial
  CRISPR gRNA sequence
ggggaggagaaggaagtacc

SEQ ID NO: 706253 - DNA, 20 bp, Artificial
  CRISPR gRNA sequence
agaaggaagtaccaggctcc

SEQ ID NO: 706254 - DNA, 20 bp, Artificial
  CRISPR gRNA sequence
gaaggaagtaccaggctccc

SEQ ID NO: 706255 - DNA, 20 bp, Artificial
  CRISPR gRNA sequence
ggaagtaccaggctcccagg

SEQ ID NO: 706256 - DNA, 20 bp, Artificial
  CRISPR gRNA sequence
gtaccaggctcccaggcagc

SEQ ID NO: 706257 - DNA, 20 bp, Artificial
  CRISPR gRNA sequence
aggctcccaggcagctggct

SEQ ID NO: 706258 - DNA, 20 bp, Artificial
  CRISPR gRNA sequence
ggctcccaggcagctggctc

SEQ ID NO: 706259 - DNA, 20 bp, Artificial
  CRISPR gRNA sequence
ccaggcagctggctcaggtg

SEQ ID NO: 706260 - DNA, 20 bp, Artificial
  CRISPR gRNA sequence
caggcagctggctcaggtgt

SEQ ID NO: 706261 - DNA, 20 bp, Artificial
  CRISPR gRNA sequence
aggtgtgggctgccctcccc

SEQ ID NO: 706262 - DNA, 20 bp, Artificial
  CRISPR gRNA sequence
tgggctgccctcccctggca

SEQ ID NO: 706263 - DNA, 20 bp, Artificial
  CRISPR gRNA sequence
ccctcccctggcatggcctg

SEQ ID NO: 706264 - DNA, 20 bp, Artificial
  CRISPR gRNA sequence
cctcccctggcatggcctgc

SEQ ID NO: 706265 - DNA, 20 bp, Artificial
  CRISPR gRNA sequence
gcatggcctgcaggccttgc

SEQ ID NO: 706266 - DNA, 20 bp, Artificial
  CRISPR gRNA sequence
ggcctgcaggccttgctggt

SEQ ID NO: 706267 - DNA, 20 bp, Artificial
  CRISPR gRNA sequence
ctgcaggccttgctggtgag

SEQ ID NO: 706268 - DNA, 20 bp, Artificial
  CRISPR gRNA sequence
ggccttgctggtgagtggat

SEQ ID NO: 706269 - DNA, 20 bp, Artificial
  CRISPR gRNA sequence
gccttgctggtgagtggatc

SEQ ID NO: 706270 - DNA, 20 bp, Artificial
  CRISPR gRNA sequence
ccttgctggtgagtggatcg

SEQ ID NO: 706271 - DNA, 20 bp, Artificial
  CRISPR gRNA sequence
cttgctggtgagtggatcgg

SEQ ID NO: 706272 - DNA, 20 bp, Artificial
  CRISPR gRNA sequence
atcgggggccacctccgcca

SEQ ID NO: 706273 - DNA, 20 bp, Artificial
  CRISPR gRNA sequence
gggggccacctccgccatgg

SEQ ID NO: 706274 - DNA, 20 bp, Artificial
  CRISPR gRNA sequence
gccacctccgccatggtgga

SEQ ID NO: 706275 - DNA, 20 bp, Artificial
  CRISPR gRNA sequence
ccacctccgccatggtggaa

SEQ ID NO: 706276 - DNA, 20 bp, Artificial
  CRISPR gRNA sequence
cacctccgccatggtggaaa

SEQ ID NO: 706277 - DNA, 20 bp, Artificial
  CRISPR gRNA sequence
ctccgccatggtggaaaggg

SEQ ID NO: 706278 - DNA, 20 bp, Artificial
  CRISPR gRNA sequence
tccgccatggtggaaaggga

SEQ ID NO: 706279 - DNA, 20 bp, Artificial
  CRISPR gRNA sequence
atggtggaaagggaaggcct

SEQ ID NO: 706280 - DNA, 20 bp, Artificial
  CRISPR gRNA sequence
ggtggaaagggaaggccttg

SEQ ID NO: 706281 - DNA, 20 bp, Artificial
  CRISPR gRNA sequence
gtggaaagggaaggccttgg

SEQ ID NO: 706282 - DNA, 20 bp, Artificial
  CRISPR gRNA sequence
gaaggccttggaggttctct

SEQ ID NO: 706283 - DNA, 20 bp, Artificial
  CRISPR gRNA sequence
aaggccttggaggttctctt

SEQ ID NO: 706284 - DNA, 20 bp, Artificial
  CRISPR gRNA sequence
ggaggttctcttgggcaccc

SEQ ID NO: 706285 - DNA, 20 bp, Artificial
  CRISPR gRNA sequence
tctcttgggcacccaagaca

SEQ ID NO: 706286 - DNA, 20 bp, Artificial
  CRISPR gRNA sequence
ctcttgggcacccaagacac

SEQ ID NO: 706287 - DNA, 20 bp, Artificial
  CRISPR gRNA sequence
cccccttgtcctcctaatgc

SEQ ID NO: 706288 - DNA, 20 bp, Artificial
  CRISPR gRNA sequence
ttgtcctcctaatgccagcc

SEQ ID NO: 706289 - DNA, 20 bp, Artificial
  CRISPR gRNA sequence
tgtcctcctaatgccagccc

SEQ ID NO: 706290 - DNA, 20 bp, Artificial
  CRISPR gRNA sequence
gtcctcctaatgccagccca

SEQ ID NO: 706291 - DNA, 20 bp, Artificial
  CRISPR gRNA sequence
ctcctaatgccagcccaggg

SEQ ID NO: 706292 - DNA, 20 bp, Artificial
  CRISPR gRNA sequence
tagcgttcccccttcccatc

SEQ ID NO: 706293 - DNA, 20 bp, Artificial
  CRISPR gRNA sequence
ccccttcccatccagttccc

SEQ ID NO: 706294 - DNA, 20 bp, Artificial
  CRISPR gRNA sequence
ccttcccatccagttcccaa

SEQ ID NO: 706295 - DNA, 20 bp, Artificial
  CRISPR gRNA sequence
cttcccatccagttcccaag

SEQ ID NO: 706296 - DNA, 20 bp, Artificial
  CRISPR gRNA sequence
ttcccatccagttcccaaga

SEQ ID NO: 706297 - DNA, 20 bp, Artificial
  CRISPR gRNA sequence
tcccatccagttcccaagag

SEQ ID NO: 706298 - DNA, 20 bp, Artificial
  CRISPR gRNA sequence
gttcccaagaggggtcacac

SEQ ID NO: 706299 - DNA, 20 bp, Artificial
  CRISPR gRNA sequence
ttcccaagaggggtcacact

SEQ ID NO: 706300 - DNA, 20 bp, Artificial
  CRISPR gRNA sequence
tcccaagaggggtcacactg

SEQ ID NO: 706301 - DNA, 20 bp, Artificial
  CRISPR gRNA sequence
gtacatcgtccctcttcccc

SEQ ID NO: 706302 - DNA, 20 bp, Artificial
  CRISPR gRNA sequence
tacatcgtccctcttcccct

SEQ ID NO: 706303 - DNA, 20 bp, Artificial
  CRISPR gRNA sequence
gtccctcttcccctgggaac

SEQ ID NO: 706304 - DNA, 20 bp, Artificial
  CRISPR gRNA sequence
tccctcttcccctgggaacc

SEQ ID NO: 706305 - DNA, 20 bp, Artificial
  CRISPR gRNA sequence
tcttcccctgggaaccaggc

SEQ ID NO: 706306 - DNA, 20 bp, Artificial
  CRISPR gRNA sequence
cttcccctgggaaccaggca

SEQ ID NO: 706307 - DNA, 20 bp, Artificial
  CRISPR gRNA sequence
ttcccctgggaaccaggcaa

SEQ ID NO: 706308 - DNA, 20 bp, Artificial
  CRISPR gRNA sequence
ccctgggaaccaggcaaggg

SEQ ID NO: 706309 - DNA, 20 bp, Artificial
  CRISPR gRNA sequence
cctcacctgccctccccaca

SEQ ID NO: 706310 - DNA, 20 bp, Artificial
  CRISPR gRNA sequence
cctgccctccccacatagcc

SEQ ID NO: 706311 - DNA, 20 bp, Artificial
  CRISPR gRNA sequence
catagccaagatgaattccc

SEQ ID NO: 706312 - DNA, 20 bp, Artificial
  CRISPR gRNA sequence
aagatgaattccctggactc

SEQ ID NO: 706313 - DNA, 20 bp, Artificial
  CRISPR gRNA sequence
gatgaattccctggactctg

SEQ ID NO: 706314 - DNA, 20 bp, Artificial
  CRISPR gRNA sequence
ttccctggactctggagctc

SEQ ID NO: 706315 - DNA, 20 bp, Artificial
  CRISPR gRNA sequence
tccctggactctggagctct

SEQ ID NO: 706316 - DNA, 20 bp, Artificial
  CRISPR gRNA sequence
ccctggactctggagctctg

SEQ ID NO: 706317 - DNA, 20 bp, Artificial
  CRISPR gRNA sequence
ctggactctggagctctggg

SEQ ID NO: 706318 - DNA, 20 bp, Artificial
  CRISPR gRNA sequence
tggactctggagctctgggg

SEQ ID NO: 706319 - DNA, 20 bp, Artificial
  CRISPR gRNA sequence
ggactctggagctctgggga

SEQ ID NO: 706320 - DNA, 20 bp, Artificial
  CRISPR gRNA sequence
gactctggagctctggggag

SEQ ID NO: 706321 - DNA, 20 bp, Artificial
  CRISPR gRNA sequence
actctggagctctggggagg

SEQ ID NO: 706322 - DNA, 20 bp, Artificial
  CRISPR gRNA sequence
ctggagctctggggaggggg

SEQ ID NO: 706323 - DNA, 20 bp, Artificial
  CRISPR gRNA sequence
tggagctctggggagggggc

SEQ ID NO: 706324 - DNA, 20 bp, Artificial
  CRISPR gRNA sequence
gagggggcaggaaatccatg

SEQ ID NO: 706325 - DNA, 20 bp, Artificial
  CRISPR gRNA sequence
caggaaatccatgcagccct

SEQ ID NO: 706326 - DNA, 20 bp, Artificial
  CRISPR gRNA sequence
gaaatccatgcagcccttgg

SEQ ID NO: 706327 - DNA, 20 bp, Artificial
  CRISPR gRNA sequence
gcccttggaagccaccccca

SEQ ID NO: 706328 - DNA, 20 bp, Artificial
  CRISPR gRNA sequence
tggaagccacccccacagcc

SEQ ID NO: 706329 - DNA, 20 bp, Artificial
  CRISPR gRNA sequence
ggaagccacccccacagcct

SEQ ID NO: 706330 - DNA, 20 bp, Artificial
  CRISPR gRNA sequence
gaagccacccccacagcctg

SEQ ID NO: 706331 - DNA, 20 bp, Artificial
  CRISPR gRNA sequence
agccacccccacagcctggg

SEQ ID NO: 706332 - DNA, 20 bp, Artificial
  CRISPR gRNA sequence
cacccccacagcctggggag

SEQ ID NO: 706333 - DNA, 20 bp, Artificial
  CRISPR gRNA sequence
acccccacagcctggggagt

SEQ ID NO: 706334 - DNA, 20 bp, Artificial
  CRISPR gRNA sequence
cccacagcctggggagtagg

SEQ ID NO: 706335 - DNA, 20 bp, Artificial
  CRISPR gRNA sequence
ggggagtaggcagcctgtga

SEQ ID NO: 706336 - DNA, 20 bp, Artificial
  CRISPR gRNA sequence
gggagtaggcagcctgtgat

SEQ ID NO: 706337 - DNA, 20 bp, Artificial
  CRISPR gRNA sequence
ggagtaggcagcctgtgatg

SEQ ID NO: 706338 - DNA, 20 bp, Artificial
  CRISPR gRNA sequence
gagtaggcagcctgtgatgg

SEQ ID NO: 706339 - DNA, 20 bp, Artificial
  CRISPR gRNA sequence
taggcagcctgtgatggggg

SEQ ID NO: 706340 - DNA, 20 bp, Artificial
  CRISPR gRNA sequence
ggcagcctgtgatgggggca

SEQ ID NO: 706341 - DNA, 20 bp, Artificial
  CRISPR gRNA sequence
gcctgtgatgggggcagagc

SEQ ID NO: 706342 - DNA, 20 bp, Artificial
  CRISPR gRNA sequence
ctgtgatgggggcagagcca

SEQ ID NO: 706343 - DNA, 20 bp, Artificial
  CRISPR gRNA sequence
tgatgggggcagagccagag

SEQ ID NO: 706344 - DNA, 20 bp, Artificial
  CRISPR gRNA sequence
gatgggggcagagccagagc

SEQ ID NO: 706345 - DNA, 20 bp, Artificial
  CRISPR gRNA sequence
atgggggcagagccagagcg

SEQ ID NO: 706346 - DNA, 20 bp, Artificial
  CRISPR gRNA sequence
ggggcagagccagagcgggg

SEQ ID NO: 706347 - DNA, 20 bp, Artificial
  CRISPR gRNA sequence
agagcggggcagacccctca

SEQ ID NO: 706348 - DNA, 20 bp, Artificial
  CRISPR gRNA sequence
cggggcagacccctcatggc

SEQ ID NO: 706349 - DNA, 20 bp, Artificial
  CRISPR gRNA sequence
acccctcatggccggctctg

SEQ ID NO: 706350 - DNA, 20 bp, Artificial
  CRISPR gRNA sequence
atggccggctctgaagtttc

SEQ ID NO: 706351 - DNA, 20 bp, Artificial
  CRISPR gRNA sequence
cagacccctctttcacttcc

SEQ ID NO: 706352 - DNA, 20 bp, Artificial
  CRISPR gRNA sequence
ccctctttcacttccgagct

SEQ ID NO: 706353 - DNA, 20 bp, Artificial
  CRISPR gRNA sequence
tctttcacttccgagctcag

SEQ ID NO: 706354 - DNA, 20 bp, Artificial
  CRISPR gRNA sequence
ctttcacttccgagctcagt

SEQ ID NO: 706355 - DNA, 20 bp, Artificial
  CRISPR gRNA sequence
ttcacttccgagctcagtgg

SEQ ID NO: 706356 - DNA, 20 bp, Artificial
  CRISPR gRNA sequence
gtgggagctgcttcctcacc

SEQ ID NO: 706357 - DNA, 20 bp, Artificial
  CRISPR gRNA sequence
gggagctgcttcctcaccca

SEQ ID NO: 706358 - DNA, 20 bp, Artificial
  CRISPR gRNA sequence
agctgcttcctcacccagag

SEQ ID NO: 706359 - DNA, 20 bp, Artificial
  CRISPR gRNA sequence
caattccaccgctttgaatc

SEQ ID NO: 706360 - DNA, 20 bp, Artificial
  CRISPR gRNA sequence
gctttgaatccagttaattc

SEQ ID NO: 706361 - DNA, 20 bp, Artificial
  CRISPR gRNA sequence
ccagttaattccagatttcc

SEQ ID NO: 706362 - DNA, 20 bp, Artificial
  CRISPR gRNA sequence
cagttaattccagatttcct

SEQ ID NO: 706363 - DNA, 20 bp, Artificial
  CRISPR gRNA sequence
agttaattccagatttcctg

SEQ ID NO: 706364 - DNA, 20 bp, Artificial
  CRISPR gRNA sequence
ggactcctgcccatttccct

SEQ ID NO: 706365 - DNA, 20 bp, Artificial
  CRISPR gRNA sequence
gactcctgcccatttccctg

SEQ ID NO: 706366 - DNA, 20 bp, Artificial
  CRISPR gRNA sequence
cccatttccctgaggaatgt

SEQ ID NO: 706367 - DNA, 20 bp, Artificial
  CRISPR gRNA sequence
ccatttccctgaggaatgtg

SEQ ID NO: 706368 - DNA, 20 bp, Artificial
  CRISPR gRNA sequence
catttccctgaggaatgtga

SEQ ID NO: 706369 - DNA, 20 bp, Artificial
  CRISPR gRNA sequence
atttccctgaggaatgtgag

SEQ ID NO: 706370 - DNA, 20 bp, Artificial
  CRISPR gRNA sequence
cctgaggaatgtgaggggac

SEQ ID NO: 706371 - DNA, 20 bp, Artificial
  CRISPR gRNA sequence
tgaggggaccagcctgtccc

SEQ ID NO: 706372 - DNA, 20 bp, Artificial
  CRISPR gRNA sequence
gaccagcctgtccccagctg

SEQ ID NO: 706373 - DNA, 20 bp, Artificial
  CRISPR gRNA sequence
gtggctccttctccctaatc

SEQ ID NO: 706374 - DNA, 20 bp, Artificial
  CRISPR gRNA sequence
cttctctgcccatccccctc

SEQ ID NO: 706375 - DNA, 20 bp, Artificial
  CRISPR gRNA sequence
ttctctgcccatccccctct

SEQ ID NO: 706376 - DNA, 20 bp, Artificial
  CRISPR gRNA sequence
ctgggccttctctcccctcc

SEQ ID NO: 706377 - DNA, 20 bp, Artificial
  CRISPR gRNA sequence
tgggccttctctcccctcct

SEQ ID NO: 706378 - DNA, 20 bp, Artificial
  CRISPR gRNA sequence
gggccttctctcccctcctg

SEQ ID NO: 706379 - DNA, 20 bp, Artificial
  CRISPR gRNA sequence
gtctcctctctcaccacccc

SEQ ID NO: 706380 - DNA, 20 bp, Artificial
  CRISPR gRNA sequence
cccggcccccatcttttgcc

SEQ ID NO: 706381 - DNA, 20 bp, Artificial
  CRISPR gRNA sequence
atcttttgcccagccctcta

SEQ ID NO: 706382 - DNA, 20 bp, Artificial
  CRISPR gRNA sequence
tcttttgcccagccctctat

SEQ ID NO: 706383 - DNA, 20 bp, Artificial
  CRISPR gRNA sequence
cttttgcccagccctctata

SEQ ID NO: 706384 - DNA, 20 bp, Artificial
  CRISPR gRNA sequence
ccagccctctatagggctcc

SEQ ID NO: 706385 - DNA, 20 bp, Artificial
  CRISPR gRNA sequence
cagccctctatagggctcct

SEQ ID NO: 706386 - DNA, 20 bp, Artificial
  CRISPR gRNA sequence
agccctctatagggctccta

SEQ ID NO: 706387 - DNA, 20 bp, Artificial
  CRISPR gRNA sequence
ctctatagggctcctagggc

SEQ ID NO: 706388 - DNA, 20 bp, Artificial
  CRISPR gRNA sequence
tctatagggctcctagggct

SEQ ID NO: 706389 - DNA, 20 bp, Artificial
  CRISPR gRNA sequence
tatagggctcctagggctgg

SEQ ID NO: 706390 - DNA, 20 bp, Artificial
  CRISPR gRNA sequence
tcctagggctgggagcccac

SEQ ID NO: 706391 - DNA, 20 bp, Artificial
  CRISPR gRNA sequence
ctgggagcccacaagcctga

SEQ ID NO: 706392 - DNA, 20 bp, Artificial
  CRISPR gRNA sequence
gggagcccacaagcctgatg

SEQ ID NO: 706393 - DNA, 20 bp, Artificial
  CRISPR gRNA sequence
ggagcccacaagcctgatgg

SEQ ID NO: 706394 - DNA, 20 bp, Artificial
  CRISPR gRNA sequence
ccacaagcctgatggaggtg

SEQ ID NO: 706395 - DNA, 20 bp, Artificial
  CRISPR gRNA sequence
cacaagcctgatggaggtgt

SEQ ID NO: 706396 - DNA, 20 bp, Artificial
  CRISPR gRNA sequence
acaagcctgatggaggtgtg

SEQ ID NO: 706397 - DNA, 20 bp, Artificial
  CRISPR gRNA sequence
aagcctgatggaggtgtggg

SEQ ID NO: 706398 - DNA, 20 bp, Artificial
  CRISPR gRNA sequence
atggaggtgtggggagtgct

SEQ ID NO: 706399 - DNA, 20 bp, Artificial
  CRISPR gRNA sequence
tggaggtgtggggagtgctg

SEQ ID NO: 706400 - DNA, 20 bp, Artificial
  CRISPR gRNA sequence
gctgaggccctgctctgttt

SEQ ID NO: 706401 - DNA, 20 bp, Artificial
  CRISPR gRNA sequence
ctgaggccctgctctgtttt

SEQ ID NO: 706402 - DNA, 20 bp, Artificial
  CRISPR gRNA sequence
tgaggccctgctctgttttg

SEQ ID NO: 706403 - DNA, 20 bp, Artificial
  CRISPR gRNA sequence
ctgctctgttttggggtctg

SEQ ID NO: 706404 - DNA, 20 bp, Artificial
  CRISPR gRNA sequence
tgctctgttttggggtctgt

SEQ ID NO: 706405 - DNA, 20 bp, Artificial
  CRISPR gRNA sequence
gctctgttttggggtctgtg

SEQ ID NO: 706406 - DNA, 20 bp, Artificial
  CRISPR gRNA sequence
ctctgttttggggtctgtgg

SEQ ID NO: 706407 - DNA, 20 bp, Artificial
  CRISPR gRNA sequence
ttggggtctgtgggggcgcc

SEQ ID NO: 706408 - DNA, 20 bp, Artificial
  CRISPR gRNA sequence
ctgtgggggcgcccagccca

SEQ ID NO: 706409 - DNA, 20 bp, Artificial
  CRISPR gRNA sequence
ccatagcctgtcccgcactc

SEQ ID NO: 706410 - DNA, 20 bp, Artificial
  CRISPR gRNA sequence
catagcctgtcccgcactct

SEQ ID NO: 706411 - DNA, 20 bp, Artificial
  CRISPR gRNA sequence
cttctcctcttgctgccgtt

SEQ ID NO: 706412 - DNA, 20 bp, Artificial
  CRISPR gRNA sequence
tggcgcacttctctctttcc

SEQ ID NO: 706413 - DNA, 20 bp, Artificial
  CRISPR gRNA sequence
ggcgcacttctctctttcct

SEQ ID NO: 706414 - DNA, 20 bp, Artificial
  CRISPR gRNA sequence
gcgcacttctctctttcctg

SEQ ID NO: 706415 - DNA, 20 bp, Artificial
  CRISPR gRNA sequence
cgcacttctctctttcctgg

SEQ ID NO: 706416 - DNA, 20 bp, Artificial
  CRISPR gRNA sequence
ttcctgggggtgttcaaaac

SEQ ID NO: 706417 - DNA, 20 bp, Artificial
  CRISPR gRNA sequence
gggggtgttcaaaaccagaa

SEQ ID NO: 706418 - DNA, 20 bp, Artificial
  CRISPR gRNA sequence
ggtgttcaaaaccagaatag

SEQ ID NO: 706419 - DNA, 20 bp, Artificial
  CRISPR gRNA sequence
caaaaccagaatagaagaac

SEQ ID NO: 706420 - DNA, 20 bp, Artificial
  CRISPR gRNA sequence
gaagaaccagcgtcatgcaa

SEQ ID NO: 706421 - DNA, 20 bp, Artificial
  CRISPR gRNA sequence
aagaaccagcgtcatgcaat

SEQ ID NO: 706422 - DNA, 20 bp, Artificial
  CRISPR gRNA sequence
agaaccagcgtcatgcaata

SEQ ID NO: 706423 - DNA, 20 bp, Artificial
  CRISPR gRNA sequence
cagcgtcatgcaatagggtt

SEQ ID NO: 706424 - DNA, 20 bp, Artificial
  CRISPR gRNA sequence
agcgtcatgcaatagggttg

SEQ ID NO: 706425 - DNA, 20 bp, Artificial
  CRISPR gRNA sequence
gcgtcatgcaatagggttga

SEQ ID NO: 706426 - DNA, 20 bp, Artificial
  CRISPR gRNA sequence
atgcaatagggttgagggtg

SEQ ID NO: 706427 - DNA, 20 bp, Artificial
  CRISPR gRNA sequence
tgcaatagggttgagggtgt

SEQ ID NO: 706428 - DNA, 20 bp, Artificial
  CRISPR gRNA sequence
gcaatagggttgagggtgtg

SEQ ID NO: 706429 - DNA, 20 bp, Artificial
  CRISPR gRNA sequence
caatagggttgagggtgtgg

SEQ ID NO: 706430 - DNA, 20 bp, Artificial
  CRISPR gRNA sequence
gttgagggtgtgggggactc

SEQ ID NO: 706431 - DNA, 20 bp, Artificial
  CRISPR gRNA sequence
gggggactcgagaacctttt

SEQ ID NO: 706432 - DNA, 20 bp, Artificial
  CRISPR gRNA sequence
ggggactcgagaaccttttt

SEQ ID NO: 706433 - DNA, 20 bp, Artificial
  CRISPR gRNA sequence
gggactcgagaacctttttg

SEQ ID NO: 706434 - DNA, 20 bp, Artificial
  CRISPR gRNA sequence
tttttggggttcctgaatcc

SEQ ID NO: 706435 - DNA, 20 bp, Artificial
  CRISPR gRNA sequence
ttttggggttcctgaatccg

SEQ ID NO: 706436 - DNA, 20 bp, Artificial
  CRISPR gRNA sequence
tttggggttcctgaatccga

SEQ ID NO: 706437 - DNA, 20 bp, Artificial
  CRISPR gRNA sequence
ttggggttcctgaatccgag

SEQ ID NO: 706438 - DNA, 20 bp, Artificial
  CRISPR gRNA sequence
aggggtataactgcattacc

SEQ ID NO: 706439 - DNA, 20 bp, Artificial
  CRISPR gRNA sequence
gtataactgcattacccaga

SEQ ID NO: 706440 - DNA, 20 bp, Artificial
  CRISPR gRNA sequence
tataactgcattacccagaa

SEQ ID NO: 706441 - DNA, 20 bp, Artificial
  CRISPR gRNA sequence
aactgcattacccagaaagg

SEQ ID NO: 706442 - DNA, 20 bp, Artificial
  CRISPR gRNA sequence
actgcattacccagaaaggc

SEQ ID NO: 706443 - DNA, 20 bp, Artificial
  CRISPR gRNA sequence
ctgcattacccagaaaggca

SEQ ID NO: 706444 - DNA, 20 bp, Artificial
  CRISPR gRNA sequence
tgcattacccagaaaggcag

SEQ ID NO: 706445 - DNA, 20 bp, Artificial
  CRISPR gRNA sequence
cctgcacccccaccccaccc

SEQ ID NO: 706446 - DNA, 20 bp, Artificial
  CRISPR gRNA sequence
cccaccccaccccagctctc

SEQ ID NO: 706447 - DNA, 20 bp, Artificial
  CRISPR gRNA sequence
cagctctcaagttccctctt

SEQ ID NO: 706448 - DNA, 20 bp, Artificial
  CRISPR gRNA sequence
cctcttgagcttccccattc

SEQ ID NO: 706449 - DNA, 20 bp, Artificial
  CRISPR gRNA sequence
agcttccccattctggcctc

SEQ ID NO: 706450 - DNA, 20 bp, Artificial
  CRISPR gRNA sequence
cttccccattctggcctcca

SEQ ID NO: 706451 - DNA, 20 bp, Artificial
  CRISPR gRNA sequence
ccattctggcctccagagtc

SEQ ID NO: 706452 - DNA, 20 bp, Artificial
  CRISPR gRNA sequence
ctggcctccagagtccagcg

SEQ ID NO: 706453 - DNA, 20 bp, Artificial
  CRISPR gRNA sequence
ctccagagtccagcgcagaa

SEQ ID NO: 706454 - DNA, 20 bp, Artificial
  CRISPR gRNA sequence
agagtccagcgcagaacagc

SEQ ID NO: 706455 - DNA, 20 bp, Artificial
  CRISPR gRNA sequence
gagtccagcgcagaacagct

SEQ ID NO: 706456 - DNA, 20 bp, Artificial
  CRISPR gRNA sequence
gtccagcgcagaacagctgg

SEQ ID NO: 706457 - DNA, 20 bp, Artificial
  CRISPR gRNA sequence
agcgcagaacagctgggagc

SEQ ID NO: 706458 - DNA, 20 bp, Artificial
  CRISPR gRNA sequence
gctgggagccagcccaccct

SEQ ID NO: 706459 - DNA, 20 bp, Artificial
  CRISPR gRNA sequence
ggagccagcccaccctgagc

SEQ ID NO: 706460 - DNA, 20 bp, Artificial
  CRISPR gRNA sequence
caccctgagccagacaccat

SEQ ID NO: 706461 - DNA, 20 bp, Artificial
  CRISPR gRNA sequence
ctgagccagacaccatcagc

SEQ ID NO: 706462 - DNA, 20 bp, Artificial
  CRISPR gRNA sequence
tgagccagacaccatcagct

SEQ ID NO: 706463 - DNA, 20 bp, Artificial
  CRISPR gRNA sequence
gccagacaccatcagctggg

SEQ ID NO: 706464 - DNA, 20 bp, Artificial
  CRISPR gRNA sequence
cagacaccatcagctgggcg

SEQ ID NO: 706465 - DNA, 20 bp, Artificial
  CRISPR gRNA sequence
agacaccatcagctgggcgg

SEQ ID NO: 706466 - DNA, 20 bp, Artificial
  CRISPR gRNA sequence
accatcagctgggcggaggc

SEQ ID NO: 706467 - DNA, 20 bp, Artificial
  CRISPR gRNA sequence
ccatcagctgggcggaggcc

SEQ ID NO: 706468 - DNA, 20 bp, Artificial
  CRISPR gRNA sequence
ggccaggcttccccactccc

SEQ ID NO: 706469 - DNA, 20 bp, Artificial
  CRISPR gRNA sequence
ttccccactccccagctcct

SEQ ID NO: 706470 - DNA, 20 bp, Artificial
  CRISPR gRNA sequence
tccccactccccagctcctc

SEQ ID NO: 706471 - DNA, 20 bp, Artificial
  CRISPR gRNA sequence
ctcctcgggccactgaacct

SEQ ID NO: 706472 - DNA, 20 bp, Artificial
  CRISPR gRNA sequence
agcccccatgtcccctctat

SEQ ID NO: 706473 - DNA, 20 bp, Artificial
  CRISPR gRNA sequence
ccccatgtcccctctatcag

SEQ ID NO: 706474 - DNA, 20 bp, Artificial
  CRISPR gRNA sequence
cccatgtcccctctatcaga

SEQ ID NO: 706475 - DNA, 20 bp, Artificial
  CRISPR gRNA sequence
cctctatcagaaggccacac

SEQ ID NO: 706476 - DNA, 20 bp, Artificial
  CRISPR gRNA sequence
ctatcagaaggccacaccag

SEQ ID NO: 706477 - DNA, 20 bp, Artificial
  CRISPR gRNA sequence
cacaccagaagcccccacat

SEQ ID NO: 706478 - DNA, 20 bp, Artificial
  CRISPR gRNA sequence
gaagcccccacatcagactg

SEQ ID NO: 706479 - DNA, 20 bp, Artificial
  CRISPR gRNA sequence
cccccacatcagactgtggc

SEQ ID NO: 706480 - DNA, 20 bp, Artificial
  CRISPR gRNA sequence
ccccacatcagactgtggcg

SEQ ID NO: 706481 - DNA, 20 bp, Artificial
  CRISPR gRNA sequence
catcagactgtggcgaggac

SEQ ID NO: 706482 - DNA, 20 bp, Artificial
  CRISPR gRNA sequence
cgaggaccggccctccgtcc

SEQ ID NO: 706483 - DNA, 20 bp, Artificial
  CRISPR gRNA sequence
aagctcccaccatgtgctca

SEQ ID NO: 706484 - DNA, 20 bp, Artificial
  CRISPR gRNA sequence
cccaccatgtgctcacagca

SEQ ID NO: 706485 - DNA, 20 bp, Artificial
  CRISPR gRNA sequence
cagcacagccatgcacgctg

SEQ ID NO: 706486 - DNA, 20 bp, Artificial
  CRISPR gRNA sequence
agcacagccatgcacgctgc

SEQ ID NO: 706487 - DNA, 20 bp, Artificial
  CRISPR gRNA sequence
acagccatgcacgctgcagg

SEQ ID NO: 706488 - DNA, 20 bp, Artificial
  CRISPR gRNA sequence
cagccatgcacgctgcaggc

SEQ ID NO: 706489 - DNA, 20 bp, Artificial
  CRISPR gRNA sequence
gccatgcacgctgcaggcag

SEQ ID NO: 706490 - DNA, 20 bp, Artificial
  CRISPR gRNA sequence
gcacgctgcaggcaggagac

SEQ ID NO: 706491 - DNA, 20 bp, Artificial
  CRISPR gRNA sequence
gcaggcaggagaccggctgt

SEQ ID NO: 706492 - DNA, 20 bp, Artificial
  CRISPR gRNA sequence
ggcaggagaccggctgtgag

SEQ ID NO: 706493 - DNA, 20 bp, Artificial
  CRISPR gRNA sequence
ggagaccggctgtgagcagt

SEQ ID NO: 706494 - DNA, 20 bp, Artificial
  CRISPR gRNA sequence
gcagtaagccccgaaattca

SEQ ID NO: 706495 - DNA, 20 bp, Artificial
  CRISPR gRNA sequence
agccccgaaattcacggcct

SEQ ID NO: 706496 - DNA, 20 bp, Artificial
  CRISPR gRNA sequence
ccgaaattcacggcctgagc

SEQ ID NO: 706497 - DNA, 20 bp, Artificial
  CRISPR gRNA sequence
cgaaattcacggcctgagcc

SEQ ID NO: 706498 - DNA, 20 bp, Artificial
  CRISPR gRNA sequence
gagccaggctgtctcaatca

SEQ ID NO: 706499 - DNA, 20 bp, Artificial
  CRISPR gRNA sequence
agccaggctgtctcaatcat

SEQ ID NO: 706500 - DNA, 20 bp, Artificial
  CRISPR gRNA sequence
tgtctcaatcatgggctgcc

SEQ ID NO: 706501 - DNA, 20 bp, Artificial
  CRISPR gRNA sequence
atgggctgccgagacctatt

SEQ ID NO: 706502 - DNA, 20 bp, Artificial
  CRISPR gRNA sequence
tgggctgccgagacctattg

SEQ ID NO: 706503 - DNA, 20 bp, Artificial
  CRISPR gRNA sequence
gggctgccgagacctattga

SEQ ID NO: 706504 - DNA, 20 bp, Artificial
  CRISPR gRNA sequence
ggctgccgagacctattgag

SEQ ID NO: 706505 - DNA, 20 bp, Artificial
  CRISPR gRNA sequence
gctgccgagacctattgagg

SEQ ID NO: 706506 - DNA, 20 bp, Artificial
  CRISPR gRNA sequence
ccgagacctattgagggggc

SEQ ID NO: 706507 - DNA, 20 bp, Artificial
  CRISPR gRNA sequence
cgagacctattgagggggcc

SEQ ID NO: 706508 - DNA, 20 bp, Artificial
  CRISPR gRNA sequence
tgagggggccgggttttctg

SEQ ID NO: 706509 - DNA, 20 bp, Artificial
  CRISPR gRNA sequence
gagggggccgggttttctgc

SEQ ID NO: 706510 - DNA, 20 bp, Artificial
  CRISPR gRNA sequence
gggttttctgcaggatgtga

SEQ ID NO: 706511 - DNA, 20 bp, Artificial
  CRISPR gRNA sequence
ggttttctgcaggatgtgac

SEQ ID NO: 706512 - DNA, 20 bp, Artificial
  CRISPR gRNA sequence
ttctgcaggatgtgacaggc

SEQ ID NO: 706513 - DNA, 20 bp, Artificial
  CRISPR gRNA sequence
caggatgtgacaggctggct

SEQ ID NO: 706514 - DNA, 20 bp, Artificial
  CRISPR gRNA sequence
acaggctggctgagtttgcc

SEQ ID NO: 706515 - DNA, 20 bp, Artificial
  CRISPR gRNA sequence
tggctgagtttgcccggacc

SEQ ID NO: 706516 - DNA, 20 bp, Artificial
  CRISPR gRNA sequence
ggctgagtttgcccggaccg

SEQ ID NO: 706517 - DNA, 20 bp, Artificial
  CRISPR gRNA sequence
gctgagtttgcccggaccga

SEQ ID NO: 706518 - DNA, 20 bp, Artificial
  CRISPR gRNA sequence
ctgagtttgcccggaccgag

SEQ ID NO: 706519 - DNA, 20 bp, Artificial
  CRISPR gRNA sequence
gcccggaccgaggggactcc

SEQ ID NO: 706520 - DNA, 20 bp, Artificial
  CRISPR gRNA sequence
cccggaccgaggggactccc

SEQ ID NO: 706521 - DNA, 20 bp, Artificial
  CRISPR gRNA sequence
ccgaggggactcccaggaca

SEQ ID NO: 706522 - DNA, 20 bp, Artificial
  CRISPR gRNA sequence
cgaggggactcccaggacac

SEQ ID NO: 706523 - DNA, 20 bp, Artificial
  CRISPR gRNA sequence
ctcccaggacacgggacttg

SEQ ID NO: 706524 - DNA, 20 bp, Artificial
  CRISPR gRNA sequence
ccaggacacgggacttgcag

SEQ ID NO: 706525 - DNA, 20 bp, Artificial
  CRISPR gRNA sequence
ggacacgggacttgcagtag

SEQ ID NO: 706526 - DNA, 20 bp, Artificial
  CRISPR gRNA sequence
gggacttgcagtagtagaac

SEQ ID NO: 706527 - DNA, 20 bp, Artificial
  CRISPR gRNA sequence
ggacttgcagtagtagaacc

SEQ ID NO: 706528 - DNA, 20 bp, Artificial
  CRISPR gRNA sequence
agtagaaccaggaatgttcc

SEQ ID NO: 706529 - DNA, 20 bp, Artificial
  CRISPR gRNA sequence
gtagaaccaggaatgttccc

SEQ ID NO: 706530 - DNA, 20 bp, Artificial
  CRISPR gRNA sequence
aaccaggaatgttcccgggc

SEQ ID NO: 706531 - DNA, 20 bp, Artificial
  CRISPR gRNA sequence
aggaatgttcccgggcaagc

SEQ ID NO: 706532 - DNA, 20 bp, Artificial
  CRISPR gRNA sequence
tgttcccgggcaagctggac

SEQ ID NO: 706533 - DNA, 20 bp, Artificial
  CRISPR gRNA sequence
cccgggcaagctggacaagt

SEQ ID NO: 706534 - DNA, 20 bp, Artificial
  CRISPR gRNA sequence
gctggacaagttggtcaccc

SEQ ID NO: 706535 - DNA, 20 bp, Artificial
  CRISPR gRNA sequence
ctggacaagttggtcacccc

SEQ ID NO: 706536 - DNA, 20 bp, Artificial
  CRISPR gRNA sequence
aagttggtcaccccgggttt

SEQ ID NO: 706537 - DNA, 20 bp, Artificial
  CRISPR gRNA sequence
gtcaccccgggttttggctg

SEQ ID NO: 706538 - DNA, 20 bp, Artificial
  CRISPR gRNA sequence
tcaccccgggttttggctgc

SEQ ID NO: 706539 - DNA, 20 bp, Artificial
  CRISPR gRNA sequence
gggttttggctgcaggcaca

SEQ ID NO: 706540 - DNA, 20 bp, Artificial
  CRISPR gRNA sequence
tttggctgcaggcacacaga

SEQ ID NO: 706541 - DNA, 20 bp, Artificial
  CRISPR gRNA sequence
ttggctgcaggcacacagat

SEQ ID NO: 706542 - DNA, 20 bp, Artificial
  CRISPR gRNA sequence
ggctgcaggcacacagatag

SEQ ID NO: 706543 - DNA, 20 bp, Artificial
  CRISPR gRNA sequence
tgcaggcacacagataggag

SEQ ID NO: 706544 - DNA, 20 bp, Artificial
  CRISPR gRNA sequence
ggcacacagataggagcaga

SEQ ID NO: 706545 - DNA, 20 bp, Artificial
  CRISPR gRNA sequence
gcacacagataggagcagaa

SEQ ID NO: 706546 - DNA, 20 bp, Artificial
  CRISPR gRNA sequence
cacacagataggagcagaaa

SEQ ID NO: 706547 - DNA, 20 bp, Artificial
  CRISPR gRNA sequence
ataggagcagaaagggccac

SEQ ID NO: 706548 - DNA, 20 bp, Artificial
  CRISPR gRNA sequence
taggagcagaaagggccacc

SEQ ID NO: 706549 - DNA, 20 bp, Artificial
  CRISPR gRNA sequence
gagcagaaagggccaccagg

SEQ ID NO: 706550 - DNA, 20 bp, Artificial
  CRISPR gRNA sequence
gcagaaagggccaccaggcg

SEQ ID NO: 706551 - DNA, 20 bp, Artificial
  CRISPR gRNA sequence
gaaagggccaccaggcggag

SEQ ID NO: 706552 - DNA, 20 bp, Artificial
  CRISPR gRNA sequence
aaagggccaccaggcggagt

SEQ ID NO: 706553 - DNA, 20 bp, Artificial
  CRISPR gRNA sequence
gggccaccaggcggagtggg

SEQ ID NO: 706554 - DNA, 20 bp, Artificial
  CRISPR gRNA sequence
cggagtgggtggtttttttt

SEQ ID NO: 706555 - DNA, 20 bp, Artificial
  CRISPR gRNA sequence
ggagtgggtggttttttttt

SEQ ID NO: 706556 - DNA, 20 bp, Artificial
  CRISPR gRNA sequence
gagtgggtggtttttttttg

SEQ ID NO: 706557 - DNA, 20 bp, Artificial
  CRISPR gRNA sequence
agtgggtggtttttttttgg

SEQ ID NO: 706558 - DNA, 20 bp, Artificial
  CRISPR gRNA sequence
ggggatttctcctaactacg

SEQ ID NO: 706559 - DNA, 20 bp, Artificial
  CRISPR gRNA sequence
tcctaactacgtggcgacct

SEQ ID NO: 706560 - DNA, 20 bp, Artificial
  CRISPR gRNA sequence
cctaactacgtggcgacctt

SEQ ID NO: 706561 - DNA, 20 bp, Artificial
  CRISPR gRNA sequence
aactacgtggcgaccttggg

SEQ ID NO: 706562 - DNA, 20 bp, Artificial
  CRISPR gRNA sequence
actacgtggcgaccttgggc

SEQ ID NO: 706563 - DNA, 20 bp, Artificial
  CRISPR gRNA sequence
ggcaggtcatttaacctctc

SEQ ID NO: 706564 - DNA, 20 bp, Artificial
  CRISPR gRNA sequence
gcaggtcatttaacctctcc

SEQ ID NO: 706565 - DNA, 20 bp, Artificial
  CRISPR gRNA sequence
catttaacctctccaggctt

SEQ ID NO: 706566 - DNA, 20 bp, Artificial
  CRISPR gRNA sequence
ttcagattcttacctgtaaa

SEQ ID NO: 706567 - DNA, 20 bp, Artificial
  CRISPR gRNA sequence
tcagattcttacctgtaaat

SEQ ID NO: 706568 - DNA, 20 bp, Artificial
  CRISPR gRNA sequence
cctgtaaatgggaatcttga

SEQ ID NO: 706569 - DNA, 20 bp, Artificial
  CRISPR gRNA sequence
ctgtaaatgggaatcttgat

SEQ ID NO: 706570 - DNA, 20 bp, Artificial
  CRISPR gRNA sequence
tgtaaatgggaatcttgatg

SEQ ID NO: 706571 - DNA, 20 bp, Artificial
  CRISPR gRNA sequence
tcttgatggggtccgccttg

SEQ ID NO: 706572 - DNA, 20 bp, Artificial
  CRISPR gRNA sequence
cttgatggggtccgccttgc

SEQ ID NO: 706573 - DNA, 20 bp, Artificial
  CRISPR gRNA sequence
tgatggggtccgccttgcag

SEQ ID NO: 706574 - DNA, 20 bp, Artificial
  CRISPR gRNA sequence
gatggggtccgccttgcagg

SEQ ID NO: 706575 - DNA, 20 bp, Artificial
  CRISPR gRNA sequence
atggggtccgccttgcagga

SEQ ID NO: 706576 - DNA, 20 bp, Artificial
  CRISPR gRNA sequence
ggtccgccttgcaggagggc

SEQ ID NO: 706577 - DNA, 20 bp, Artificial
  CRISPR gRNA sequence
gtccgccttgcaggagggct

SEQ ID NO: 706578 - DNA, 20 bp, Artificial
  CRISPR gRNA sequence
tccgccttgcaggagggctg

SEQ ID NO: 706579 - DNA, 20 bp, Artificial
  CRISPR gRNA sequence
ttgcaggagggctggggacc

SEQ ID NO: 706580 - DNA, 20 bp, Artificial
  CRISPR gRNA sequence
tgcaggagggctggggaccc

SEQ ID NO: 706581 - DNA, 20 bp, Artificial
  CRISPR gRNA sequence
caggagggctggggacccag

SEQ ID NO: 706582 - DNA, 20 bp, Artificial
  CRISPR gRNA sequence
gagggctggggacccaggag

SEQ ID NO: 706583 - DNA, 20 bp, Artificial
  CRISPR gRNA sequence
agggctggggacccaggagt

SEQ ID NO: 706584 - DNA, 20 bp, Artificial
  CRISPR gRNA sequence
gggctggggacccaggagtg

SEQ ID NO: 706585 - DNA, 20 bp, Artificial
  CRISPR gRNA sequence
ggctggggacccaggagtgg

SEQ ID NO: 706586 - DNA, 20 bp, Artificial
  CRISPR gRNA sequence
gggacccaggagtgggggtg

SEQ ID NO: 706587 - DNA, 20 bp, Artificial
  CRISPR gRNA sequence
gtgggggtgtggaaactgct

SEQ ID NO: 706588 - DNA, 20 bp, Artificial
  CRISPR gRNA sequence
tgctgtttctgctcgtgctc

SEQ ID NO: 706589 - DNA, 20 bp, Artificial
  CRISPR gRNA sequence
gctcgtgctctggttaccca

SEQ ID NO: 706590 - DNA, 20 bp, Artificial
  CRISPR gRNA sequence
gctttgcctgtttttgtcca

SEQ ID NO: 706591 - DNA, 20 bp, Artificial
  CRISPR gRNA sequence
tcttcttccctacccatccg

SEQ ID NO: 706592 - DNA, 20 bp, Artificial
  CRISPR gRNA sequence
ttcttccctacccatccgca

SEQ ID NO: 706593 - DNA, 20 bp, Artificial
  CRISPR gRNA sequence
cccatccgcagagatgtgct

SEQ ID NO: 706594 - DNA, 20 bp, Artificial
  CRISPR gRNA sequence
agatgtgctgagaaaatcct

SEQ ID NO: 706595 - DNA, 20 bp, Artificial
  CRISPR gRNA sequence
gctgagaaaatcctaagtac

SEQ ID NO: 706596 - DNA, 20 bp, Artificial
  CRISPR gRNA sequence
gagaaaatcctaagtacaag

SEQ ID NO: 706597 - DNA, 20 bp, Artificial
  CRISPR gRNA sequence
agaaaatcctaagtacaagt

SEQ ID NO: 706598 - DNA, 20 bp, Artificial
  CRISPR gRNA sequence
aatcctaagtacaagtgggc

SEQ ID NO: 706599 - DNA, 20 bp, Artificial
  CRISPR gRNA sequence
gggctggttcttaactcctc

SEQ ID NO: 706600 - DNA, 20 bp, Artificial
  CRISPR gRNA sequence
ggctggttcttaactcctca

SEQ ID NO: 706601 - DNA, 20 bp, Artificial
  CRISPR gRNA sequence
gttcttaactcctcaaggcc

SEQ ID NO: 706602 - DNA, 20 bp, Artificial
  CRISPR gRNA sequence
actcctcaaggcccagctcc

SEQ ID NO: 706603 - DNA, 20 bp, Artificial
  CRISPR gRNA sequence
ctagctgttctatttcctct

SEQ ID NO: 706604 - DNA, 20 bp, Artificial
  CRISPR gRNA sequence
ttctatttcctctgagcccc

SEQ ID NO: 706605 - DNA, 20 bp, Artificial
  CRISPR gRNA sequence
tctatttcctctgagccccc

SEQ ID NO: 706606 - DNA, 20 bp, Artificial
  CRISPR gRNA sequence
tgagcccccaggatgcctgt

SEQ ID NO: 706607 - DNA, 20 bp, Artificial
  CRISPR gRNA sequence
gagcccccaggatgcctgta

SEQ ID NO: 706608 - DNA, 20 bp, Artificial
  CRISPR gRNA sequence
aggatgcctgtaaggtacat

SEQ ID NO: 706609 - DNA, 20 bp, Artificial
  CRISPR gRNA sequence
gatgcctgtaaggtacatca

SEQ ID NO: 706610 - DNA, 20 bp, Artificial
  CRISPR gRNA sequence
tgcctgtaaggtacatcaga

SEQ ID NO: 706611 - DNA, 20 bp, Artificial
  CRISPR gRNA sequence
gcctgtaaggtacatcagag

SEQ ID NO: 706612 - DNA, 20 bp, Artificial
  CRISPR gRNA sequence
catcagagaggctgtgccat

SEQ ID NO: 706613 - DNA, 20 bp, Artificial
  CRISPR gRNA sequence
gaggctgtgccatcagcctg

SEQ ID NO: 706614 - DNA, 20 bp, Artificial
  CRISPR gRNA sequence
gccatcagcctgaagccacc

SEQ ID NO: 706615 - DNA, 20 bp, Artificial
  CRISPR gRNA sequence
atcagcctgaagccacccgg

SEQ ID NO: 706616 - DNA, 20 bp, Artificial
  CRISPR gRNA sequence
tcagcctgaagccacccggc

SEQ ID NO: 706617 - DNA, 20 bp, Artificial
  CRISPR gRNA sequence
aagccacccggcaggtgtac

SEQ ID NO: 706618 - DNA, 20 bp, Artificial
  CRISPR gRNA sequence
cccggcaggtgtaccagcac

SEQ ID NO: 706619 - DNA, 20 bp, Artificial
  CRISPR gRNA sequence
ccggcaggtgtaccagcact

SEQ ID NO: 706620 - DNA, 20 bp, Artificial
  CRISPR gRNA sequence
ggtgtaccagcactgggcct

SEQ ID NO: 706621 - DNA, 20 bp, Artificial
  CRISPR gRNA sequence
ctgcctctttgctcccatcc

SEQ ID NO: 706622 - DNA, 20 bp, Artificial
  CRISPR gRNA sequence
ctctttgctcccatcctggc

SEQ ID NO: 706623 - DNA, 20 bp, Artificial
  CRISPR gRNA sequence
tcccatcctggctggtgctc

SEQ ID NO: 706624 - DNA, 20 bp, Artificial
  CRISPR gRNA sequence
tcacccatccttttgccttg

SEQ ID NO: 706625 - DNA, 20 bp, Artificial
  CRISPR gRNA sequence
acccatccttttgccttgca

SEQ ID NO: 706626 - DNA, 20 bp, Artificial
  CRISPR gRNA sequence
cagagaaaatctacatcatg

SEQ ID NO: 706627 - DNA, 20 bp, Artificial
  CRISPR gRNA sequence
agagaaaatctacatcatga

SEQ ID NO: 706628 - DNA, 20 bp, Artificial
  CRISPR gRNA sequence
gaaggctgacaccgtgatcg

SEQ ID NO: 706629 - DNA, 20 bp, Artificial
  CRISPR gRNA sequence
aaggctgacaccgtgatcgt

SEQ ID NO: 706630 - DNA, 20 bp, Artificial
  CRISPR gRNA sequence
aggctgacaccgtgatcgtg

SEQ ID NO: 706631 - DNA, 20 bp, Artificial
  CRISPR gRNA sequence
ccgtgatcgtggggaccgtg

SEQ ID NO: 706632 - DNA, 20 bp, Artificial
  CRISPR gRNA sequence
cgtgatcgtggggaccgtga

SEQ ID NO: 706633 - DNA, 20 bp, Artificial
  CRISPR gRNA sequence
tcgtggggaccgtgaaggct

SEQ ID NO: 706634 - DNA, 20 bp, Artificial
  CRISPR gRNA sequence
gaccgtgaaggctgagctgc

SEQ ID NO: 706635 - DNA, 20 bp, Artificial
  CRISPR gRNA sequence
ccgtgaaggctgagctgccg

SEQ ID NO: 706636 - DNA, 20 bp, Artificial
  CRISPR gRNA sequence
cgtgaaggctgagctgccgg

SEQ ID NO: 706637 - DNA, 20 bp, Artificial
  CRISPR gRNA sequence
gtgaaggctgagctgccgga

SEQ ID NO: 706638 - DNA, 20 bp, Artificial
  CRISPR gRNA sequence
aggctgagctgccggagggc

SEQ ID NO: 706639 - DNA, 20 bp, Artificial
  CRISPR gRNA sequence
ggctgagctgccggagggcc

SEQ ID NO: 706640 - DNA, 20 bp, Artificial
  CRISPR gRNA sequence
gctgagctgccggagggccg

SEQ ID NO: 706641 - DNA, 20 bp, Artificial
  CRISPR gRNA sequence
gctgccggagggccggggcc

SEQ ID NO: 706642 - DNA, 20 bp, Artificial
  CRISPR gRNA sequence
gccggagggccggggcctgg

SEQ ID NO: 706643 - DNA, 20 bp, Artificial
  CRISPR gRNA sequence
ccggagggccggggcctggc

SEQ ID NO: 706644 - DNA, 20 bp, Artificial
  CRISPR gRNA sequence
cggagggccggggcctggcg

SEQ ID NO: 706645 - DNA, 20 bp, Artificial
  CRISPR gRNA sequence
gggccggggcctggcggggc

SEQ ID NO: 706646 - DNA, 20 bp, Artificial
  CRISPR gRNA sequence
ccggggcctggcggggccag

SEQ ID NO: 706647 - DNA, 20 bp, Artificial
  CRISPR gRNA sequence
ggggcctggcggggccagca

SEQ ID NO: 706648 - DNA, 20 bp, Artificial
  CRISPR gRNA sequence
tggcggggccagcagagccc

SEQ ID NO: 706649 - DNA, 20 bp, Artificial
  CRISPR gRNA sequence
ggggccagcagagcccgagt

SEQ ID NO: 706650 - DNA, 20 bp, Artificial
  CRISPR gRNA sequence
ggccagcagagcccgagttg

SEQ ID NO: 706651 - DNA, 20 bp, Artificial
  CRISPR gRNA sequence
gccagcagagcccgagttgg

SEQ ID NO: 706652 - DNA, 20 bp, Artificial
  CRISPR gRNA sequence
cagcagagcccgagttggag

SEQ ID NO: 706653 - DNA, 20 bp, Artificial
  CRISPR gRNA sequence
agcagagcccgagttggagg

SEQ ID NO: 706654 - DNA, 20 bp, Artificial
  CRISPR gRNA sequence
cagagcccgagttggaggag

SEQ ID NO: 706655 - DNA, 20 bp, Artificial
  CRISPR gRNA sequence
gcccgagttggaggaggagc

SEQ ID NO: 706656 - DNA, 20 bp, Artificial
  CRISPR gRNA sequence
ccgagttggaggaggagctg

SEQ ID NO: 706657 - DNA, 20 bp, Artificial
  CRISPR gRNA sequence
cgagttggaggaggagctgg

SEQ ID NO: 706658 - DNA, 20 bp, Artificial
  CRISPR gRNA sequence
gttggaggaggagctggagg

SEQ ID NO: 706659 - DNA, 20 bp, Artificial
  CRISPR gRNA sequence
accataccccccactacccc

SEQ ID NO: 706660 - DNA, 20 bp, Artificial
  CRISPR gRNA sequence
ataccccccactaccccgag

SEQ ID NO: 706661 - DNA, 20 bp, Artificial
  CRISPR gRNA sequence
taccccccactaccccgagc

SEQ ID NO: 706662 - DNA, 20 bp, Artificial
  CRISPR gRNA sequence
ccccccactaccccgagcag

SEQ ID NO: 706663 - DNA, 20 bp, Artificial
  CRISPR gRNA sequence
ccactaccccgagcaggaga

SEQ ID NO: 706664 - DNA, 20 bp, Artificial
  CRISPR gRNA sequence
gcaggagacagaaccgcctc

SEQ ID NO: 706665 - DNA, 20 bp, Artificial
  CRISPR gRNA sequence
caggagacagaaccgcctct

SEQ ID NO: 706666 - DNA, 20 bp, Artificial
  CRISPR gRNA sequence
gagacagaaccgcctctggg

SEQ ID NO: 706667 - DNA, 20 bp, Artificial
  CRISPR gRNA sequence
gaaccgcctctgggcagctg

SEQ ID NO: 706668 - DNA, 20 bp, Artificial
  CRISPR gRNA sequence
ctgcagcgatgtcatgctct

SEQ ID NO: 706669 - DNA, 20 bp, Artificial
  CRISPR gRNA sequence
cagcgatgtcatgctctcag

SEQ ID NO: 706670 - DNA, 20 bp, Artificial
  CRISPR gRNA sequence
cgatgtcatgctctcagtgg

SEQ ID NO: 706671 - DNA, 20 bp, Artificial
  CRISPR gRNA sequence
atgtcatgctctcagtggaa

SEQ ID NO: 706672 - DNA, 20 bp, Artificial
  CRISPR gRNA sequence
tgtcatgctctcagtggaag

SEQ ID NO: 706673 - DNA, 20 bp, Artificial
  CRISPR gRNA sequence
catgctctcagtggaagagg

SEQ ID NO: 706674 - DNA, 20 bp, Artificial
  CRISPR gRNA sequence
atgctctcagtggaagagga

SEQ ID NO: 706675 - DNA, 20 bp, Artificial
  CRISPR gRNA sequence
tgctctcagtggaagaggaa

SEQ ID NO: 706676 - DNA, 20 bp, Artificial
  CRISPR gRNA sequence
ctcagtggaagaggaaggga

SEQ ID NO: 706677 - DNA, 20 bp, Artificial
  CRISPR gRNA sequence
agtggaagaggaagggaaag

SEQ ID NO: 706678 - DNA, 20 bp, Artificial
  CRISPR gRNA sequence
gaaagaagaccccttgccca

SEQ ID NO: 706679 - DNA, 20 bp, Artificial
  CRISPR gRNA sequence
cccttgcccacagctgcctc

SEQ ID NO: 706680 - DNA, 20 bp, Artificial
  CRISPR gRNA sequence
tgcccacagctgcctctgga

SEQ ID NO: 706681 - DNA, 20 bp, Artificial
  CRISPR gRNA sequence
cacagctgcctctggaaagt

SEQ ID NO: 706682 - DNA, 20 bp, Artificial
  CRISPR gRNA sequence
acagctgcctctggaaagtg

SEQ ID NO: 706683 - DNA, 20 bp, Artificial
  CRISPR gRNA sequence
tgcctctggaaagtgaggcc

SEQ ID NO: 706684 - DNA, 20 bp, Artificial
  CRISPR gRNA sequence
gcctctggaaagtgaggcct

SEQ ID NO: 706685 - DNA, 20 bp, Artificial
  CRISPR gRNA sequence
ctggaaagtgaggcctgggc

SEQ ID NO: 706686 - DNA, 20 bp, Artificial
  CRISPR gRNA sequence
tggaaagtgaggcctgggct

SEQ ID NO: 706687 - DNA, 20 bp, Artificial
  CRISPR gRNA sequence
aagtgaggcctgggctgggc

SEQ ID NO: 706688 - DNA, 20 bp, Artificial
  CRISPR gRNA sequence
agtgaggcctgggctgggct

SEQ ID NO: 706689 - DNA, 20 bp, Artificial
  CRISPR gRNA sequence
gtgaggcctgggctgggctg

SEQ ID NO: 706690 - DNA, 20 bp, Artificial
  CRISPR gRNA sequence
ggcctgggctgggctggggc

SEQ ID NO: 706691 - DNA, 20 bp, Artificial
  CRISPR gRNA sequence
gcctgggctgggctggggct

SEQ ID NO: 706692 - DNA, 20 bp, Artificial
  CRISPR gRNA sequence
ctgggctgggctggggctag

SEQ ID NO: 706693 - DNA, 20 bp, Artificial
  CRISPR gRNA sequence
tgggctgggctggggctagg

SEQ ID NO: 706694 - DNA, 20 bp, Artificial
  CRISPR gRNA sequence
gggctgggctggggctagga

SEQ ID NO: 706695 - DNA, 20 bp, Artificial
  CRISPR gRNA sequence
ctgggctggggctaggaggg

SEQ ID NO: 706696 - DNA, 20 bp, Artificial
  CRISPR gRNA sequence
ggctggggctaggagggcag

SEQ ID NO: 706697 - DNA, 20 bp, Artificial
  CRISPR gRNA sequence
gctggggctaggagggcagc

SEQ ID NO: 706698 - DNA, 20 bp, Artificial
  CRISPR gRNA sequence
ctggggctaggagggcagca

SEQ ID NO: 706699 - DNA, 20 bp, Artificial
  CRISPR gRNA sequence
gggctaggagggcagcaggg

SEQ ID NO: 706700 - DNA, 20 bp, Artificial
  CRISPR gRNA sequence
gagggcagcagggtggcctc

SEQ ID NO: 706701 - DNA, 20 bp, Artificial
  CRISPR gRNA sequence
agggcagcagggtggcctct

SEQ ID NO: 706702 - DNA, 20 bp, Artificial
  CRISPR gRNA sequence
ggcagcagggtggcctctgg

SEQ ID NO: 706703 - DNA, 20 bp, Artificial
  CRISPR gRNA sequence
gcagcagggtggcctctggg

SEQ ID NO: 706704 - DNA, 20 bp, Artificial
  CRISPR gRNA sequence
cagggtggcctctgggaggc

SEQ ID NO: 706705 - DNA, 20 bp, Artificial
  CRISPR gRNA sequence
agggtggcctctgggaggcc

SEQ ID NO: 706706 - DNA, 20 bp, Artificial
  CRISPR gRNA sequence
tggcctctgggaggccagga

SEQ ID NO: 706707 - DNA, 20 bp, Artificial
  CRISPR gRNA sequence
ggaggccaggatggcactgt

SEQ ID NO: 706708 - DNA, 20 bp, Artificial
  CRISPR gRNA sequence
aggatggcactgttggcacc

SEQ ID NO: 706709 - DNA, 20 bp, Artificial
  CRISPR gRNA sequence
ggatggcactgttggcaccg

SEQ ID NO: 706710 - DNA, 20 bp, Artificial
  CRISPR gRNA sequence
ggcactgttggcaccgaggt

SEQ ID NO: 706711 - DNA, 20 bp, Artificial
  CRISPR gRNA sequence
gcactgttggcaccgaggtt

SEQ ID NO: 706712 - DNA, 20 bp, Artificial
  CRISPR gRNA sequence
cactgttggcaccgaggttg

SEQ ID NO: 706713 - DNA, 20 bp, Artificial
  CRISPR gRNA sequence
actgttggcaccgaggttgg

SEQ ID NO: 706714 - DNA, 20 bp, Artificial
  CRISPR gRNA sequence
gttggcaccgaggttggggg

SEQ ID NO: 706715 - DNA, 20 bp, Artificial
  CRISPR gRNA sequence
tggcaccgaggttgggggca

SEQ ID NO: 706716 - DNA, 20 bp, Artificial
  CRISPR gRNA sequence
ggcaccgaggttgggggcag

SEQ ID NO: 706717 - DNA, 20 bp, Artificial
  CRISPR gRNA sequence
gttgggggcagaggcccatc

SEQ ID NO: 706718 - DNA, 20 bp, Artificial
  CRISPR gRNA sequence
aggcccatctggcctgaact

SEQ ID NO: 706719 - DNA, 20 bp, Artificial
  CRISPR gRNA sequence
ggcccatctggcctgaactg

SEQ ID NO: 706720 - DNA, 20 bp, Artificial
  CRISPR gRNA sequence
tctggcctgaactgaggctc

SEQ ID NO: 706721 - DNA, 20 bp, Artificial
  CRISPR gRNA sequence
tgaactgaggctccagcatc

SEQ ID NO: 706722 - DNA, 20 bp, Artificial
  CRISPR gRNA sequence
actgaggctccagcatctag

SEQ ID NO: 706723 - DNA, 20 bp, Artificial
  CRISPR gRNA sequence
gaggctccagcatctagtgg

SEQ ID NO: 706724 - DNA, 20 bp, Artificial
  CRISPR gRNA sequence
tccagcatctagtggtggac

SEQ ID NO: 706725 - DNA, 20 bp, Artificial
  CRISPR gRNA sequence
gcatctagtggtggaccggc

SEQ ID NO: 706726 - DNA, 20 bp, Artificial
  CRISPR gRNA sequence
ggtggaccggccggtcactg

SEQ ID NO: 706727 - DNA, 20 bp, Artificial
  CRISPR gRNA sequence
gtggaccggccggtcactgc

SEQ ID NO: 706728 - DNA, 20 bp, Artificial
  CRISPR gRNA sequence
tggaccggccggtcactgca

SEQ ID NO: 706729 - DNA, 20 bp, Artificial
  CRISPR gRNA sequence
ggaccggccggtcactgcag

SEQ ID NO: 706730 - DNA, 20 bp, Artificial
  CRISPR gRNA sequence
ggccggtcactgcaggggtc

SEQ ID NO: 706731 - DNA, 20 bp, Artificial
  CRISPR gRNA sequence
cggtcactgcaggggtctgg

SEQ ID NO: 706732 - DNA, 20 bp, Artificial
  CRISPR gRNA sequence
ctctgcttgcatccccaact

SEQ ID NO: 706733 - DNA, 20 bp, Artificial
  CRISPR gRNA sequence
aacttagctgtcccctgacc

SEQ ID NO: 706734 - DNA, 20 bp, Artificial
  CRISPR gRNA sequence
cttagctgtcccctgaccca

SEQ ID NO: 706735 - DNA, 20 bp, Artificial
  CRISPR gRNA sequence
ctgtcccctgacccagagcc

SEQ ID NO: 706736 - DNA, 20 bp, Artificial
  CRISPR gRNA sequence
tgtcccctgacccagagcct

SEQ ID NO: 706737 - DNA, 20 bp, Artificial
  CRISPR gRNA sequence
gtcccctgacccagagccta

SEQ ID NO: 706738 - DNA, 20 bp, Artificial
  CRISPR gRNA sequence
tcccctgacccagagcctag

SEQ ID NO: 706739 - DNA, 20 bp, Artificial
  CRISPR gRNA sequence
gacccagagcctaggggatc

SEQ ID NO: 706740 - DNA, 20 bp, Artificial
  CRISPR gRNA sequence
acccagagcctaggggatcc

SEQ ID NO: 706741 - DNA, 20 bp, Artificial
  CRISPR gRNA sequence
cccagagcctaggggatccg

SEQ ID NO: 706742 - DNA, 20 bp, Artificial
  CRISPR gRNA sequence
taggggatccggggcttgta

SEQ ID NO: 706743 - DNA, 20 bp, Artificial
  CRISPR gRNA sequence
gggatccggggcttgtacag

SEQ ID NO: 706744 - DNA, 20 bp, Artificial
  CRISPR gRNA sequence
gatccggggcttgtacagaa

SEQ ID NO: 706745 - DNA, 20 bp, Artificial
  CRISPR gRNA sequence
cggggcttgtacagaagaga

SEQ ID NO: 706746 - DNA, 20 bp, Artificial
  CRISPR gRNA sequence
ttgtacagaagagacagtcc

SEQ ID NO: 706747 - DNA, 20 bp, Artificial
  CRISPR gRNA sequence
tgtacagaagagacagtcca

SEQ ID NO: 706748 - DNA, 20 bp, Artificial
  CRISPR gRNA sequence
gtacagaagagacagtccaa

SEQ ID NO: 706749 - DNA, 20 bp, Artificial
  CRISPR gRNA sequence
tacagaagagacagtccaag

SEQ ID NO: 706750 - DNA, 20 bp, Artificial
  CRISPR gRNA sequence
aagagacagtccaaggggac

SEQ ID NO: 706751 - DNA, 20 bp, Artificial
  CRISPR gRNA sequence
agtccaaggggactggatcc

SEQ ID NO: 706752 - DNA, 20 bp, Artificial
  CRISPR gRNA sequence
ccaaggggactggatcccag

SEQ ID NO: 706753 - DNA, 20 bp, Artificial
  CRISPR gRNA sequence
ctggatcccagcagtgatgt

SEQ ID NO: 706754 - DNA, 20 bp, Artificial
  CRISPR gRNA sequence
tcccagcagtgatgttggtt

SEQ ID NO: 706755 - DNA, 20 bp, Artificial
  CRISPR gRNA sequence
cccagcagtgatgttggttg

SEQ ID NO: 706756 - DNA, 20 bp, Artificial
  CRISPR gRNA sequence
agcagtgatgttggttgagg

SEQ ID NO: 706757 - DNA, 20 bp, Artificial
  CRISPR gRNA sequence
atgttggttgaggcagcaaa

SEQ ID NO: 706758 - DNA, 20 bp, Artificial
  CRISPR gRNA sequence
tggttgaggcagcaaacaga

SEQ ID NO: 706759 - DNA, 20 bp, Artificial
  CRISPR gRNA sequence
ttgaggcagcaaacagatgg

SEQ ID NO: 706760 - DNA, 20 bp, Artificial
  CRISPR gRNA sequence
tgaggcagcaaacagatggc

SEQ ID NO: 706761 - DNA, 20 bp, Artificial
  CRISPR gRNA sequence
gcagcaaacagatggcagga

SEQ ID NO: 706762 - DNA, 20 bp, Artificial
  CRISPR gRNA sequence
cagcaaacagatggcaggat

SEQ ID NO: 706763 - DNA, 20 bp, Artificial
  CRISPR gRNA sequence
atggcaggatgggcactgcc

SEQ ID NO: 706764 - DNA, 20 bp, Artificial
  CRISPR gRNA sequence
aggatgggcactgccgagaa

SEQ ID NO: 706765 - DNA, 20 bp, Artificial
  CRISPR gRNA sequence
ggcactgccgagaacagcat

SEQ ID NO: 706766 - DNA, 20 bp, Artificial
  CRISPR gRNA sequence
gccgagaacagcattggtcc

SEQ ID NO: 706767 - DNA, 20 bp, Artificial
  CRISPR gRNA sequence
cgagaacagcattggtccca

SEQ ID NO: 706768 - DNA, 20 bp, Artificial
  CRISPR gRNA sequence
cagcattggtcccagagccc

SEQ ID NO: 706769 - DNA, 20 bp, Artificial
  CRISPR gRNA sequence
agcattggtcccagagccct

SEQ ID NO: 706770 - DNA, 20 bp, Artificial
  CRISPR gRNA sequence
ggtcccagagccctgggcat

SEQ ID NO: 706771 - DNA, 20 bp, Artificial
  CRISPR gRNA sequence
gggcatcagaccttaaccac

SEQ ID NO: 706772 - DNA, 20 bp, Artificial
  CRISPR gRNA sequence
ggcatcagaccttaaccacc

SEQ ID NO: 706773 - DNA, 20 bp, Artificial
  CRISPR gRNA sequence
gaccttaaccaccaggccca

SEQ ID NO: 706774 - DNA, 20 bp, Artificial
  CRISPR gRNA sequence
taaccaccaggcccacagcc

SEQ ID NO: 706775 - DNA, 20 bp, Artificial
  CRISPR gRNA sequence
caccaggcccacagcccagc

SEQ ID NO: 706776 - DNA, 20 bp, Artificial
  CRISPR gRNA sequence
accaggcccacagcccagcg

SEQ ID NO: 706777 - DNA, 20 bp, Artificial
  CRISPR gRNA sequence
ccaggcccacagcccagcga

SEQ ID NO: 706778 - DNA, 20 bp, Artificial
  CRISPR gRNA sequence
aggcccacagcccagcgagg

SEQ ID NO: 706779 - DNA, 20 bp, Artificial
  CRISPR gRNA sequence
gcccacagcccagcgaggga

SEQ ID NO: 706780 - DNA, 20 bp, Artificial
  CRISPR gRNA sequence
cccacagcccagcgagggag

SEQ ID NO: 706781 - DNA, 20 bp, Artificial
  CRISPR gRNA sequence
cccagcgagggagaggtcgt

SEQ ID NO: 706782 - DNA, 20 bp, Artificial
  CRISPR gRNA sequence
ccagcgagggagaggtcgtg

SEQ ID NO: 706783 - DNA, 20 bp, Artificial
  CRISPR gRNA sequence
cgagggagaggtcgtgaggc

SEQ ID NO: 706784 - DNA, 20 bp, Artificial
  CRISPR gRNA sequence
gaggtcgtgaggccagctcc

SEQ ID NO: 706785 - DNA, 20 bp, Artificial
  CRISPR gRNA sequence
aggtcgtgaggccagctccc

SEQ ID NO: 706786 - DNA, 20 bp, Artificial
  CRISPR gRNA sequence
ggtcgtgaggccagctcccg

SEQ ID NO: 706787 - DNA, 20 bp, Artificial
  CRISPR gRNA sequence
accctactctcctctctccc

SEQ ID NO: 706788 - DNA, 20 bp, Artificial
  CRISPR gRNA sequence
tctcctctctccctggacct

SEQ ID NO: 706789 - DNA, 20 bp, Artificial
  CRISPR gRNA sequence
tcctctctccctggacctca

SEQ ID NO: 706790 - DNA, 20 bp, Artificial
  CRISPR gRNA sequence
cctctctccctggacctcag

SEQ ID NO: 706791 - DNA, 20 bp, Artificial
  CRISPR gRNA sequence
acctcagaggtgacacccat

SEQ ID NO: 706792 - DNA, 20 bp, Artificial
  CRISPR gRNA sequence
cctcagaggtgacacccatt

SEQ ID NO: 706793 - DNA, 20 bp, Artificial
  CRISPR gRNA sequence
tgacacccattgggcccttc

SEQ ID NO: 706794 - DNA, 20 bp, Artificial
  CRISPR gRNA sequence
gggcccttccggcatgcccc

SEQ ID NO: 706795 - DNA, 20 bp, Artificial
  CRISPR gRNA sequence
gcccccagttactgtaaatg

SEQ ID NO: 706796 - DNA, 20 bp, Artificial
  CRISPR gRNA sequence
gttactgtaaatgtggcccc

SEQ ID NO: 706797 - DNA, 20 bp, Artificial
  CRISPR gRNA sequence
actgtaaatgtggcccccag

SEQ ID NO: 706798 - DNA, 20 bp, Artificial
  CRISPR gRNA sequence
ctgtaaatgtggcccccagt

SEQ ID NO: 706799 - DNA, 20 bp, Artificial
  CRISPR gRNA sequence
aatgtggcccccagtgggca

SEQ ID NO: 706800 - DNA, 20 bp, Artificial
  CRISPR gRNA sequence
tgtggcccccagtgggcatg

SEQ ID NO: 706801 - DNA, 20 bp, Artificial
  CRISPR gRNA sequence
gcccccagtgggcatggagc

SEQ ID NO: 706802 - DNA, 20 bp, Artificial
  CRISPR gRNA sequence
gggcatggagccagtgcctg

SEQ ID NO: 706803 - DNA, 20 bp, Artificial
  CRISPR gRNA sequence
agtgcctgtggttgtttctc

SEQ ID NO: 706804 - DNA, 20 bp, Artificial
  CRISPR gRNA sequence
tgcctgtggttgtttctcca

SEQ ID NO: 706805 - DNA, 20 bp, Artificial
  CRISPR gRNA sequence
ggttgtttctccagagtcaa

SEQ ID NO: 706806 - DNA, 20 bp, Artificial
  CRISPR gRNA sequence
gttgtttctccagagtcaaa

SEQ ID NO: 706807 - DNA, 20 bp, Artificial
  CRISPR gRNA sequence
ttgtttctccagagtcaaaa

SEQ ID NO: 706808 - DNA, 20 bp, Artificial
  CRISPR gRNA sequence
tttctccagagtcaaaaggg

SEQ ID NO: 706809 - DNA, 20 bp, Artificial
  CRISPR gRNA sequence
ccagagtcaaaagggaagtc

SEQ ID NO: 706810 - DNA, 20 bp, Artificial
  CRISPR gRNA sequence
cagagtcaaaagggaagtcg

SEQ ID NO: 706811 - DNA, 20 bp, Artificial
  CRISPR gRNA sequence
agagtcaaaagggaagtcga

SEQ ID NO: 706812 - DNA, 20 bp, Artificial
  CRISPR gRNA sequence
tcaaaagggaagtcgaggga

SEQ ID NO: 706813 - DNA, 20 bp, Artificial
  CRISPR gRNA sequence
caaaagggaagtcgagggat

SEQ ID NO: 706814 - DNA, 20 bp, Artificial
  CRISPR gRNA sequence
aaaagggaagtcgagggatg

SEQ ID NO: 706815 - DNA, 20 bp, Artificial
  CRISPR gRNA sequence
gtcgagggatggggcgtcgt

SEQ ID NO: 706816 - DNA, 20 bp, Artificial
  CRISPR gRNA sequence
agggatggggcgtcgtcagc

SEQ ID NO: 706817 - DNA, 20 bp, Artificial
  CRISPR gRNA sequence
agctggcactgtctctgctg

SEQ ID NO: 706818 - DNA, 20 bp, Artificial
  CRISPR gRNA sequence
tggcactgtctctgctgcag

SEQ ID NO: 706819 - DNA, 20 bp, Artificial
  CRISPR gRNA sequence
ggccacactgtactctgcac

SEQ ID NO: 706820 - DNA, 20 bp, Artificial
  CRISPR gRNA sequence
actgtactctgcactggtgt

SEQ ID NO: 706821 - DNA, 20 bp, Artificial
  CRISPR gRNA sequence
ctgtactctgcactggtgtg

SEQ ID NO: 706822 - DNA, 20 bp, Artificial
  CRISPR gRNA sequence
tgtactctgcactggtgtga

SEQ ID NO: 706823 - DNA, 20 bp, Artificial
  CRISPR gRNA sequence
ctggtgtgagggcccctgcc

SEQ ID NO: 706824 - DNA, 20 bp, Artificial
  CRISPR gRNA sequence
gagggcccctgcctggactg

SEQ ID NO: 706825 - DNA, 20 bp, Artificial
  CRISPR gRNA sequence
agggcccctgcctggactgt

SEQ ID NO: 706826 - DNA, 20 bp, Artificial
  CRISPR gRNA sequence
cctggactgtgggaccctcc

SEQ ID NO: 706827 - DNA, 20 bp, Artificial
  CRISPR gRNA sequence
tgcccaccttccctgtcctg

SEQ ID NO: 706828 - DNA, 20 bp, Artificial
  CRISPR gRNA sequence
tccctgtcctgtagccccct

SEQ ID NO: 706829 - DNA, 20 bp, Artificial
  CRISPR gRNA sequence
ctgtcctgtagccccctcgg

SEQ ID NO: 706830 - DNA, 20 bp, Artificial
  CRISPR gRNA sequence
tgtcctgtagccccctcggt

SEQ ID NO: 706831 - DNA, 20 bp, Artificial
  CRISPR gRNA sequence
tgtagccccctcggtgggcc

SEQ ID NO: 706832 - DNA, 20 bp, Artificial
  CRISPR gRNA sequence
gtagccccctcggtgggccc

SEQ ID NO: 706833 - DNA, 20 bp, Artificial
  CRISPR gRNA sequence
tagccccctcggtgggccca

SEQ ID NO: 706834 - DNA, 20 bp, Artificial
  CRISPR gRNA sequence
ccctcggtgggcccagggcc

SEQ ID NO: 706835 - DNA, 20 bp, Artificial
  CRISPR gRNA sequence
cctcggtgggcccagggcct

SEQ ID NO: 706836 - DNA, 20 bp, Artificial
  CRISPR gRNA sequence
ctcggtgggcccagggccta

SEQ ID NO: 706837 - DNA, 20 bp, Artificial
  CRISPR gRNA sequence
tgggcccagggcctagggcc

SEQ ID NO: 706838 - DNA, 20 bp, Artificial
  CRISPR gRNA sequence
gggcccagggcctagggccc

SEQ ID NO: 706839 - DNA, 20 bp, Artificial
  CRISPR gRNA sequence
agggcctagggcccaggatc

SEQ ID NO: 706840 - DNA, 20 bp, Artificial
  CRISPR gRNA sequence
caggatcaagtcactcatct

SEQ ID NO: 706841 - DNA, 20 bp, Artificial
  CRISPR gRNA sequence
gtccccaccaatccccgcca

SEQ ID NO: 706842 - DNA, 20 bp, Artificial
  CRISPR gRNA sequence
cccaccaatccccgccacag

SEQ ID NO: 706843 - DNA, 20 bp, Artificial
  CRISPR gRNA sequence
ccaccaatccccgccacagc

SEQ ID NO: 706844 - DNA, 20 bp, Artificial
  CRISPR gRNA sequence
ccccgccacagcaggcgcct

SEQ ID NO: 706845 - DNA, 20 bp, Artificial
  CRISPR gRNA sequence
cccgccacagcaggcgcctc

SEQ ID NO: 706846 - DNA, 20 bp, Artificial
  CRISPR gRNA sequence
acagcaggcgcctcgggtcc

SEQ ID NO: 706847 - DNA, 20 bp, Artificial
  CRISPR gRNA sequence
cctcgggtcccagatgtctg

SEQ ID NO: 706848 - DNA, 20 bp, Artificial
  CRISPR gRNA sequence
tcccagatgtctgcagccct

SEQ ID NO: 706849 - DNA, 20 bp, Artificial
  CRISPR gRNA sequence
cagatgtctgcagccctcag

SEQ ID NO: 706850 - DNA, 20 bp, Artificial
  CRISPR gRNA sequence
tctgcagccctcagcagctg

SEQ ID NO: 706851 - DNA, 20 bp, Artificial
  CRISPR gRNA sequence
cagaccgcccctcaccaacc

SEQ ID NO: 706852 - DNA, 20 bp, Artificial
  CRISPR gRNA sequence
gaccgcccctcaccaaccca

SEQ ID NO: 706853 - DNA, 20 bp, Artificial
  CRISPR gRNA sequence
agaacctgctttactttgcc

SEQ ID NO: 706854 - DNA, 20 bp, Artificial
  CRISPR gRNA sequence
gaacctgctttactttgccc

SEQ ID NO: 706855 - DNA, 20 bp, Artificial
  CRISPR gRNA sequence
aacctgctttactttgccca

SEQ ID NO: 706856 - DNA, 20 bp, Artificial
  CRISPR gRNA sequence
acttcctccccatgtgaaca

SEQ ID NO: 706857 - DNA, 20 bp, Artificial
  CRISPR gRNA sequence
cttcctccccatgtgaacat

SEQ ID NO: 706858 - DNA, 20 bp, Artificial
  CRISPR gRNA sequence
ttcctccccatgtgaacatg

SEQ ID NO: 706859 - DNA, 20 bp, Artificial
  CRISPR gRNA sequence
catgtgaacatggggaactt

SEQ ID NO: 706860 - DNA, 20 bp, Artificial
  CRISPR gRNA sequence
atgtgaacatggggaacttc

SEQ ID NO: 706861 - DNA, 20 bp, Artificial
  CRISPR gRNA sequence
ggggaacttcgggccctgcc

SEQ ID NO: 706862 - DNA, 20 bp, Artificial
  CRISPR gRNA sequence
ggaacttcgggccctgcctg

SEQ ID NO: 706863 - DNA, 20 bp, Artificial
  CRISPR gRNA sequence
gagtccttgaccgctctctg

SEQ ID NO: 706864 - DNA, 20 bp, Artificial
  CRISPR gRNA sequence
agtccttgaccgctctctgt

SEQ ID NO: 706865 - DNA, 20 bp, Artificial
  CRISPR gRNA sequence
gggccccacccactctgtcc

SEQ ID NO: 706866 - DNA, 20 bp, Artificial
  CRISPR gRNA sequence
ggccccacccactctgtcct

SEQ ID NO: 706867 - DNA, 20 bp, Artificial
  CRISPR gRNA sequence
ccactctgtcctgggaaatg

SEQ ID NO: 706868 - DNA, 20 bp, Artificial
  CRISPR gRNA sequence
ctctgtcctgggaaatgaag

SEQ ID NO: 706869 - DNA, 20 bp, Artificial
  CRISPR gRNA sequence
aaatgaagaagcatcttcct

SEQ ID NO: 706870 - DNA, 20 bp, Artificial
  CRISPR gRNA sequence
aatgaagaagcatcttcctt

SEQ ID NO: 706871 - DNA, 20 bp, Artificial
  CRISPR gRNA sequence
tgccctgcttgcaaatccac

SEQ ID NO: 706872 - DNA, 20 bp, Artificial
  CRISPR gRNA sequence
ctagcaccgaccccaccacc

SEQ ID NO: 706873 - DNA, 20 bp, Artificial
  CRISPR gRNA sequence
ccgaccccaccacctggttc

SEQ ID NO: 706874 - DNA, 20 bp, Artificial
  CRISPR gRNA sequence
ggttccggctctgcacgctt

SEQ ID NO: 706875 - DNA, 20 bp, Artificial
  CRISPR gRNA sequence
gttccggctctgcacgcttt

SEQ ID NO: 706876 - DNA, 20 bp, Artificial
  CRISPR gRNA sequence
ttccggctctgcacgctttg

SEQ ID NO: 706877 - DNA, 20 bp, Artificial
  CRISPR gRNA sequence
gctctgcacgctttggggtg

SEQ ID NO: 706878 - DNA, 20 bp, Artificial
  CRISPR gRNA sequence
cgctttggggtgtggatgtc

SEQ ID NO: 706879 - DNA, 20 bp, Artificial
  CRISPR gRNA sequence
ctttggggtgtggatgtcga

SEQ ID NO: 706880 - DNA, 20 bp, Artificial
  CRISPR gRNA sequence
tttggggtgtggatgtcgag

SEQ ID NO: 706881 - DNA, 20 bp, Artificial
  CRISPR gRNA sequence
gtggatgtcgagaggcacca

SEQ ID NO: 706882 - DNA, 20 bp, Artificial
  CRISPR gRNA sequence
agaggcaccacggcctcacc

SEQ ID NO: 706883 - DNA, 20 bp, Artificial
  CRISPR gRNA sequence
gaggcaccacggcctcaccc

SEQ ID NO: 706884 - DNA, 20 bp, Artificial
  CRISPR gRNA sequence
cccaggcatctgctttactc

SEQ ID NO: 706885 - DNA, 20 bp, Artificial
  CRISPR gRNA sequence
atctgctttactctggacca

SEQ ID NO: 706886 - DNA, 20 bp, Artificial
  CRISPR gRNA sequence
tctgctttactctggaccat

SEQ ID NO: 706887 - DNA, 20 bp, Artificial
  CRISPR gRNA sequence
tactctggaccataggaaac

SEQ ID NO: 706888 - DNA, 20 bp, Artificial
  CRISPR gRNA sequence
ccataggaaacaagaccgtt

SEQ ID NO: 706889 - DNA, 20 bp, Artificial
  CRISPR gRNA sequence
ataggaaacaagaccgtttg

SEQ ID NO: 706890 - DNA, 20 bp, Artificial
  CRISPR gRNA sequence
taggaaacaagaccgtttgg

SEQ ID NO: 706891 - DNA, 20 bp, Artificial
  CRISPR gRNA sequence
agaccgtttggaggtttcat

SEQ ID NO: 706892 - DNA, 20 bp, Artificial
  CRISPR gRNA sequence
gaccgtttggaggtttcatc

SEQ ID NO: 706893 - DNA, 20 bp, Artificial
  CRISPR gRNA sequence
tggaggtttcatcaggattt

SEQ ID NO: 706894 - DNA, 20 bp, Artificial
  CRISPR gRNA sequence
ggaggtttcatcaggatttt

SEQ ID NO: 706895 - DNA, 20 bp, Artificial
  CRISPR gRNA sequence
ggtttttcacatttcacgct

SEQ ID NO: 706896 - DNA, 20 bp, Artificial
  CRISPR gRNA sequence
gtttttcacatttcacgcta

SEQ ID NO: 706897 - DNA, 20 bp, Artificial
  CRISPR gRNA sequence
ttttcacatttcacgctaag

SEQ ID NO: 706898 - DNA, 20 bp, Artificial
  CRISPR gRNA sequence
tcacatttcacgctaaggag

SEQ ID NO: 706899 - DNA, 20 bp, Artificial
  CRISPR gRNA sequence
catttcacgctaaggagtag

SEQ ID NO: 706900 - DNA, 20 bp, Artificial
  CRISPR gRNA sequence
ggagtagtggccctgacttc

SEQ ID NO: 706901 - DNA, 20 bp, Artificial
  CRISPR gRNA sequence
tagtggccctgacttccggt

SEQ ID NO: 706902 - DNA, 20 bp, Artificial
  CRISPR gRNA sequence
ggccctgacttccggtcggc

SEQ ID NO: 706903 - DNA, 20 bp, Artificial
  CRISPR gRNA sequence
ctgacttccggtcggctggc

SEQ ID NO: 706904 - DNA, 20 bp, Artificial
  CRISPR gRNA sequence
cggctggccagctgactccc

SEQ ID NO: 706905 - DNA, 20 bp, Artificial
  CRISPR gRNA sequence
ggctggccagctgactccct

SEQ ID NO: 706906 - DNA, 20 bp, Artificial
  CRISPR gRNA sequence
gctggccagctgactcccta

SEQ ID NO: 706907 - DNA, 20 bp, Artificial
  CRISPR gRNA sequence
agctgactccctagggcctt

SEQ ID NO: 706908 - DNA, 20 bp, Artificial
  CRISPR gRNA sequence
cttcagacgtgtatgcaaat

SEQ ID NO: 706909 - DNA, 20 bp, Artificial
  CRISPR gRNA sequence
acgtgtatgcaaatgagtga

SEQ ID NO: 706910 - DNA, 20 bp, Artificial
  CRISPR gRNA sequence
tatgcaaatgagtgatggat

SEQ ID NO: 706911 - DNA, 20 bp, Artificial
  CRISPR gRNA sequence
atgcaaatgagtgatggata

SEQ ID NO: 706912 - DNA, 20 bp, Artificial
  CRISPR gRNA sequence
aatgagtgatggataaggat

SEQ ID NO: 706913 - DNA, 20 bp, Artificial
  CRISPR gRNA sequence
tgatggataaggatgagtct

SEQ ID NO: 706914 - DNA, 20 bp, Artificial
  CRISPR gRNA sequence
atggataaggatgagtcttg

SEQ ID NO: 706915 - DNA, 20 bp, Artificial
  CRISPR gRNA sequence
aaggatgagtcttggagttg

SEQ ID NO: 706916 - DNA, 20 bp, Artificial
  CRISPR gRNA sequence
aggatgagtcttggagttgc

SEQ ID NO: 706917 - DNA, 20 bp, Artificial
  CRISPR gRNA sequence
atgagtcttggagttgcggg

SEQ ID NO: 706918 - DNA, 20 bp, Artificial
  CRISPR gRNA sequence
tcttggagttgcgggcagcc

SEQ ID NO: 706919 - DNA, 20 bp, Artificial
  CRISPR gRNA sequence
ttggagttgcgggcagcctg

SEQ ID NO: 706920 - DNA, 20 bp, Artificial
  CRISPR gRNA sequence
gcgggcagcctggagactcg

SEQ ID NO: 706921 - DNA, 20 bp, Artificial
  CRISPR gRNA sequence
agactcgtggacttaccgcc

SEQ ID NO: 706922 - DNA, 20 bp, Artificial
  CRISPR gRNA sequence
actcgtggacttaccgcctg

SEQ ID NO: 706923 - DNA, 20 bp, Artificial
  CRISPR gRNA sequence
ctcgtggacttaccgcctgg

SEQ ID NO: 706924 - DNA, 20 bp, Artificial
  CRISPR gRNA sequence
gtggacttaccgcctggagg

SEQ ID NO: 706925 - DNA, 20 bp, Artificial
  CRISPR gRNA sequence
tggacttaccgcctggaggc

SEQ ID NO: 706926 - DNA, 20 bp, Artificial
  CRISPR gRNA sequence
ttaccgcctggaggcaggcc

SEQ ID NO: 706927 - DNA, 20 bp, Artificial
  CRISPR gRNA sequence
taccgcctggaggcaggccc

SEQ ID NO: 706928 - DNA, 20 bp, Artificial
  CRISPR gRNA sequence
cgcctggaggcaggcccggg

SEQ ID NO: 706929 - DNA, 20 bp, Artificial
  CRISPR gRNA sequence
gcctggaggcaggcccggga

SEQ ID NO: 706930 - DNA, 20 bp, Artificial
  CRISPR gRNA sequence
gaaggctgctgtttactcat

SEQ ID NO: 706931 - DNA, 20 bp, Artificial
  CRISPR gRNA sequence
aaggctgctgtttactcatc

SEQ ID NO: 706932 - DNA, 20 bp, Artificial
  CRISPR gRNA sequence
gctgctgtttactcatcggg

SEQ ID NO: 706933 - DNA, 20 bp, Artificial
  CRISPR gRNA sequence
tcgggcagccacgtgctctc

SEQ ID NO: 706934 - DNA, 20 bp, Artificial
  CRISPR gRNA sequence
gggcagccacgtgctctctg

SEQ ID NO: 706935 - DNA, 20 bp, Artificial
  CRISPR gRNA sequence
ggcagccacgtgctctctgg

SEQ ID NO: 706936 - DNA, 20 bp, Artificial
  CRISPR gRNA sequence
agccacgtgctctctggagg

SEQ ID NO: 706937 - DNA, 20 bp, Artificial
  CRISPR gRNA sequence
gtgctctctggaggaagtga

SEQ ID NO: 706938 - DNA, 20 bp, Artificial
  CRISPR gRNA sequence
tgatagtttctgaaaccgct

SEQ ID NO: 706939 - DNA, 20 bp, Artificial
  CRISPR gRNA sequence
ctgaaaccgctcagatgttt

SEQ ID NO: 706940 - DNA, 20 bp, Artificial
  CRISPR gRNA sequence
tgaaaccgctcagatgtttt

SEQ ID NO: 706941 - DNA, 20 bp, Artificial
  CRISPR gRNA sequence
gaaaccgctcagatgttttg

SEQ ID NO: 706942 - DNA, 20 bp, Artificial
  CRISPR gRNA sequence
ccgctcagatgttttgggga

SEQ ID NO: 706943 - DNA, 20 bp, Artificial
  CRISPR gRNA sequence
tcagatgttttggggaaagt

SEQ ID NO: 706944 - DNA, 20 bp, Artificial
  CRISPR gRNA sequence
agatgttttggggaaagttg

SEQ ID NO: 706945 - DNA, 20 bp, Artificial
  CRISPR gRNA sequence
tgttttggggaaagttggag

SEQ ID NO: 706946 - DNA, 20 bp, Artificial
  CRISPR gRNA sequence
ggggaaagttggagaagccg

SEQ ID NO: 706947 - DNA, 20 bp, Artificial
  CRISPR gRNA sequence
tggagaagccgtggccttgc

SEQ ID NO: 706948 - DNA, 20 bp, Artificial
  CRISPR gRNA sequence
gagaagccgtggccttgcga

SEQ ID NO: 706949 - DNA, 20 bp, Artificial
  CRISPR gRNA sequence
agaagccgtggccttgcgag

SEQ ID NO: 706950 - DNA, 20 bp, Artificial
  CRISPR gRNA sequence
agccgtggccttgcgagagg

SEQ ID NO: 706951 - DNA, 20 bp, Artificial
  CRISPR gRNA sequence
cttgcgagaggtggttacac

SEQ ID NO: 706952 - DNA, 20 bp, Artificial
  CRISPR gRNA sequence
gaggtggttacaccagaacc

SEQ ID NO: 706953 - DNA, 20 bp, Artificial
  CRISPR gRNA sequence
ttacaccagaacctggacat

SEQ ID NO: 706954 - DNA, 20 bp, Artificial
  CRISPR gRNA sequence
accagaacctggacattggc

SEQ ID NO: 706955 - DNA, 20 bp, Artificial
  CRISPR gRNA sequence
agaacctggacattggccag

SEQ ID NO: 706956 - DNA, 20 bp, Artificial
  CRISPR gRNA sequence
acctggacattggccagaag

SEQ ID NO: 706957 - DNA, 20 bp, Artificial
  CRISPR gRNA sequence
acattggccagaagaagctt

SEQ ID NO: 706958 - DNA, 20 bp, Artificial
  CRISPR gRNA sequence
ttggccagaagaagcttaag

SEQ ID NO: 706959 - DNA, 20 bp, Artificial
  CRISPR gRNA sequence
tggccagaagaagcttaagt

SEQ ID NO: 706960 - DNA, 20 bp, Artificial
  CRISPR gRNA sequence
ccagaagaagcttaagtggg

SEQ ID NO: 706961 - DNA, 20 bp, Artificial
  CRISPR gRNA sequence
gtgggcagacactgtttgcc

SEQ ID NO: 706962 - DNA, 20 bp, Artificial
  CRISPR gRNA sequence
tgtttgcccagtgtttgtgc

SEQ ID NO: 706963 - DNA, 20 bp, Artificial
  CRISPR gRNA sequence
gtttgcccagtgtttgtgca

SEQ ID NO: 706964 - DNA, 20 bp, Artificial
  CRISPR gRNA sequence
gcccagtgtttgtgcaagga

SEQ ID NO: 706965 - DNA, 20 bp, Artificial
  CRISPR gRNA sequence
ccagtgtttgtgcaaggatg

SEQ ID NO: 706966 - DNA, 20 bp, Artificial
  CRISPR gRNA sequence
gtgtttgtgcaaggatggag

SEQ ID NO: 706967 - DNA, 20 bp, Artificial
  CRISPR gRNA sequence
tgtttgtgcaaggatggagt

SEQ ID NO: 706968 - DNA, 20 bp, Artificial
  CRISPR gRNA sequence
gggtgtctctgcatcaccca

SEQ ID NO: 706969 - DNA, 20 bp, Artificial
  CRISPR gRNA sequence
ctctgcatcacccacagccg

SEQ ID NO: 706970 - DNA, 20 bp, Artificial
  CRISPR gRNA sequence
tcacccacagccgcagctgt

SEQ ID NO: 706971 - DNA, 20 bp, Artificial
  CRISPR gRNA sequence
cacccacagccgcagctgta

SEQ ID NO: 706972 - DNA, 20 bp, Artificial
  CRISPR gRNA sequence
gccgcagctgtaaggcacgc

SEQ ID NO: 706973 - DNA, 20 bp, Artificial
  CRISPR gRNA sequence
gcagctgtaaggcacgctgg

SEQ ID NO: 706974 - DNA, 20 bp, Artificial
  CRISPR gRNA sequence
cagctgtaaggcacgctgga

SEQ ID NO: 706975 - DNA, 20 bp, Artificial
  CRISPR gRNA sequence
gctggaaggcacacgcctgc

SEQ ID NO: 706976 - DNA, 20 bp, Artificial
  CRISPR gRNA sequence
ctggaaggcacacgcctgcc

SEQ ID NO: 706977 - DNA, 20 bp, Artificial
  CRISPR gRNA sequence
gaaggcacacgcctgccagg

SEQ ID NO: 706978 - DNA, 20 bp, Artificial
  CRISPR gRNA sequence
aaggcacacgcctgccaggc

SEQ ID NO: 706979 - DNA, 20 bp, Artificial
  CRISPR gRNA sequence
aggcacacgcctgccaggca

SEQ ID NO: 706980 - DNA, 20 bp, Artificial
  CRISPR gRNA sequence
cacacgcctgccaggcaggg

SEQ ID NO: 706981 - DNA, 20 bp, Artificial
  CRISPR gRNA sequence
gcctgccaggcagggcagtc

SEQ ID NO: 706982 - DNA, 20 bp, Artificial
  CRISPR gRNA sequence
gggcagtctggcgcccatga
